United States Patent 10,611,818 (MHC MULTIMERS IN TUBERCULOSIS DIAGNOSTICS, VACCINE AND THERAPEUTICS) - sequence listing, part 5

SEQ ID NO: 122466 - protein, 11 aa, Mycobacterium tuberculosis
EFAPSAQLASR

SEQ ID NO: 122467 - protein, 11 aa, Mycobacterium tuberculosis
AQLASREQQIA

SEQ ID NO: 122468 - protein, 11 aa, Mycobacterium tuberculosis
QLASREQQIAV

SEQ ID NO: 122469 - protein, 11 aa, Mycobacterium tuberculosis
REQQIAVGERV

SEQ ID NO: 122470 - protein, 11 aa, Mycobacterium tuberculosis
QQIAVGERVLA

SEQ ID NO: 122471 - protein, 11 aa, Mycobacterium tuberculosis
RVLATQGRGAW

SEQ ID NO: 122472 - protein, 11 aa, Mycobacterium tuberculosis
LATQGRGAWPV

SEQ ID NO: 122473 - protein, 11 aa, Mycobacterium tuberculosis
QGRGAWPVCGR

SEQ ID NO: 122474 - protein, 11 aa, Mycobacterium tuberculosis
WPVCGRGLSNA

SEQ ID NO: 122475 - protein, 11 aa, Mycobacterium tuberculosis
GLSNATPREVL

SEQ ID NO: 122476 - protein, 11 aa, Mycobacterium tuberculosis
TPREVLPASAA

SEQ ID NO: 122477 - protein, 11 aa, Mycobacterium tuberculosis
EVLPASAAMDA

SEQ ID NO: 122478 - protein, 11 aa, Mycobacterium tuberculosis
LPASAAMDAPL

SEQ ID NO: 122479 - protein, 11 aa, Mycobacterium tuberculosis
AAMDAPLDAAA

SEQ ID NO: 122480 - protein, 11 aa, Mycobacterium tuberculosis
AMDAPLDAAAV

SEQ ID NO: 122481 - protein, 11 aa, Mycobacterium tuberculosis
AAAVNGEPAPL

SEQ ID NO: 122482 - protein, 11 aa, Mycobacterium tuberculosis
AAVNGEPAPLA

SEQ ID NO: 122483 - protein, 11 aa, Mycobacterium tuberculosis
APLAPPPADPA

SEQ ID NO: 122484 - protein, 11 aa, Mycobacterium tuberculosis
APPPADPAPPV

SEQ ID NO: 122485 - protein, 11 aa, Mycobacterium tuberculosis
PPADPAPPVEL

SEQ ID NO: 122486 - protein, 11 aa, Mycobacterium tuberculosis
APPVELAANDL

SEQ ID NO: 122487 - protein, 11 aa, Mycobacterium tuberculosis
ELAANDLPAPL

SEQ ID NO: 122488 - protein, 11 aa, Mycobacterium tuberculosis
LPAPLGEPLPA

SEQ ID NO: 122489 - protein, 11 aa, Mycobacterium tuberculosis
PLGEPLPAAPA

SEQ ID NO: 122490 - protein, 11 aa, Mycobacterium tuberculosis
EPLPAAPADPA

SEQ ID NO: 122491 - protein, 11 aa, Mycobacterium tuberculosis
LPAAPADPAPP

SEQ ID NO: 122492 - protein, 11 aa, Mycobacterium tuberculosis
APADPAPPADL

SEQ ID NO: 122493 - protein, 11 aa, Mycobacterium tuberculosis
PPADLAPPAPA

SEQ ID NO: 122494 - protein, 11 aa, Mycobacterium tuberculosis
DLAPPAPADVA

SEQ ID NO: 122495 - protein, 11 aa, Mycobacterium tuberculosis
PPAPADVAPPV

SEQ ID NO: 122496 - protein, 11 aa, Mycobacterium tuberculosis
APADVAPPVEL

SEQ ID NO: 122497 - protein, 11 aa, Mycobacterium tuberculosis
ELAVNDLPAPL

SEQ ID NO: 122498 - protein, 11 aa, Mycobacterium tuberculosis
LPAPLGEPLPA

SEQ ID NO: 122499 - protein, 11 aa, Mycobacterium tuberculosis
PLGEPLPAAPA

SEQ ID NO: 122500 - protein, 11 aa, Mycobacterium tuberculosis
EPLPAAPADPA

SEQ ID NO: 122501 - protein, 11 aa, Mycobacterium tuberculosis
LPAAPADPAPP

SEQ ID NO: 122502 - protein, 11 aa, Mycobacterium tuberculosis
APADPAPPADL

SEQ ID NO: 122503 - protein, 11 aa, Mycobacterium tuberculosis
PPADLAPPAPA

SEQ ID NO: 122504 - protein, 11 aa, Mycobacterium tuberculosis
DLAPPAPADLA

SEQ ID NO: 122505 - protein, 11 aa, Mycobacterium tuberculosis
APADLAPPAPA

SEQ ID NO: 122506 - protein, 11 aa, Mycobacterium tuberculosis
DLAPPAPADLA

SEQ ID NO: 122507 - protein, 11 aa, Mycobacterium tuberculosis
APADLAPPAPA

SEQ ID NO: 122508 - protein, 11 aa, Mycobacterium tuberculosis
DLAPPAPADLA

SEQ ID NO: 122509 - protein, 11 aa, Mycobacterium tuberculosis
APADLAPPVEL

SEQ ID NO: 122510 - protein, 11 aa, Mycobacterium tuberculosis
ELAVNDLPAPL

SEQ ID NO: 122511 - protein, 11 aa, Mycobacterium tuberculosis
LPAPLGEPLPA

SEQ ID NO: 122512 - protein, 11 aa, Mycobacterium tuberculosis
PLGEPLPAAPA

SEQ ID NO: 122513 - protein, 11 aa, Mycobacterium tuberculosis
GEPLPAAPAEL

SEQ ID NO: 122514 - protein, 11 aa, Mycobacterium tuberculosis
EPLPAAPAELA

SEQ ID NO: 122515 - protein, 11 aa, Mycobacterium tuberculosis
LPAAPAELAPP

SEQ ID NO: 122516 - protein, 11 aa, Mycobacterium tuberculosis
APAELAPPADL

SEQ ID NO: 122517 - protein, 11 aa, Mycobacterium tuberculosis
ELAPPADLAPA

SEQ ID NO: 122518 - protein, 11 aa, Mycobacterium tuberculosis
APPADLAPASA

SEQ ID NO: 122519 - protein, 11 aa, Mycobacterium tuberculosis
APASADLAPPA

SEQ ID NO: 122520 - protein, 11 aa, Mycobacterium tuberculosis
ASADLAPPAPA

SEQ ID NO: 122521 - protein, 11 aa, Mycobacterium tuberculosis
DLAPPAPADLA

SEQ ID NO: 122522 - protein, 11 aa, Mycobacterium tuberculosis
APADLAPPAPA

SEQ ID NO: 122523 - protein, 11 aa, Mycobacterium tuberculosis
DLAPPAPAELA

SEQ ID NO: 122524 - protein, 11 aa, Mycobacterium tuberculosis
PPAPAELAPPA

SEQ ID NO: 122525 - protein, 11 aa, Mycobacterium tuberculosis
APAELAPPAPA

SEQ ID NO: 122526 - protein, 11 aa, Mycobacterium tuberculosis
AELAPPAPADL

SEQ ID NO: 122527 - protein, 11 aa, Mycobacterium tuberculosis
ELAPPAPADLA

SEQ ID NO: 122528 - protein, 11 aa, Mycobacterium tuberculosis
APADLAPPAAV

SEQ ID NO: 122529 - protein, 11 aa, Mycobacterium tuberculosis
DLAPPAAVNEQ

SEQ ID NO: 122530 - protein, 11 aa, Mycobacterium tuberculosis
QTAPGDQPATA

SEQ ID NO: 122531 - protein, 11 aa, Mycobacterium tuberculosis
ATAPGGPVGLA

SEQ ID NO: 122532 - protein, 11 aa, Mycobacterium tuberculosis
GPVGLATDLEL

SEQ ID NO: 122533 - protein, 11 aa, Mycobacterium tuberculosis
QPADAPPPGDV

SEQ ID NO: 122534 - protein, 11 aa, Mycobacterium tuberculosis
VTEAPAETPQV

SEQ ID NO: 122535 - protein, 11 aa, Mycobacterium tuberculosis
APAETPQVSNI

SEQ ID NO: 122536 - protein, 11 aa, Mycobacterium tuberculosis
AETPQVSNIAY

SEQ ID NO: 122537 - protein, 11 aa, Mycobacterium tuberculosis
ETPQVSNIAYT

SEQ ID NO: 122538 - protein, 11 aa, Mycobacterium tuberculosis
TPQVSNIAYTK

SEQ ID NO: 122539 - protein, 11 aa, Mycobacterium tuberculosis
QVSNIAYTKKL

SEQ ID NO: 122540 - protein, 11 aa, Mycobacterium tuberculosis
VSNIAYTKKLW

SEQ ID NO: 122541 - protein, 11 aa, Mycobacterium tuberculosis
AYTKKLWQAIR

SEQ ID NO: 122542 - protein, 11 aa, Mycobacterium tuberculosis
KLWQAIRAQDV

SEQ ID NO: 122543 - protein, 11 aa, Mycobacterium tuberculosis
RAQDVCGNDAL

SEQ ID NO: 122544 - protein, 11 aa, Mycobacterium tuberculosis
DVCGNDALDSL

SEQ ID NO: 122545 - protein, 11 aa, Mycobacterium tuberculosis
NDALDSLAQPY

SEQ ID NO: 122546 - protein, 11 aa, Mycobacterium tuberculosis
DALDSLAQPYV

SEQ ID NO: 122547 - protein, 11 aa, Mycobacterium tuberculosis
ALDSLAQPYVI

SEQ ID NO: 122548 - protein, 13 aa, Mycobacterium tuberculosis
MSGRHRKPTTSNV

SEQ ID NO: 122549 - protein, 13 aa, Mycobacterium tuberculosis
SGRHRKPTTSNVS

SEQ ID NO: 122550 - protein, 13 aa, Mycobacterium tuberculosis
GRHRKPTTSNVSV

SEQ ID NO: 122551 - protein, 13 aa, Mycobacterium tuberculosis
RHRKPTTSNVSVA

SEQ ID NO: 122552 - protein, 13 aa, Mycobacterium tuberculosis
HRKPTTSNVSVAK

SEQ ID NO: 122553 - protein, 13 aa, Mycobacterium tuberculosis
RKPTTSNVSVAKI

SEQ ID NO: 122554 - protein, 13 aa, Mycobacterium tuberculosis
KPTTSNVSVAKIA

SEQ ID NO: 122555 - protein, 13 aa, Mycobacterium tuberculosis
PTTSNVSVAKIAF

SEQ ID NO: 122556 - protein, 13 aa, Mycobacterium tuberculosis
TTSNVSVAKIAFT

SEQ ID NO: 122557 - protein, 13 aa, Mycobacterium tuberculosis
TSNVSVAKIAFTG

SEQ ID NO: 122558 - protein, 13 aa, Mycobacterium tuberculosis
SNVSVAKIAFTGA

SEQ ID NO: 122559 - protein, 13 aa, Mycobacterium tuberculosis
NVSVAKIAFTGAV

SEQ ID NO: 122560 - protein, 13 aa, Mycobacterium tuberculosis
VSVAKIAFTGAVL

SEQ ID NO: 122561 - protein, 13 aa, Mycobacterium tuberculosis
SVAKIAFTGAVLG

SEQ ID NO: 122562 - protein, 13 aa, Mycobacterium tuberculosis
VAKIAFTGAVLGG

SEQ ID NO: 122563 - protein, 13 aa, Mycobacterium tuberculosis
AKIAFTGAVLGGG

SEQ ID NO: 122564 - protein, 13 aa, Mycobacterium tuberculosis
KIAFTGAVLGGGG

SEQ ID NO: 122565 - protein, 13 aa, Mycobacterium tuberculosis
IAFTGAVLGGGGI

SEQ ID NO: 122566 - protein, 13 aa, Mycobacterium tuberculosis
AFTGAVLGGGGIA

SEQ ID NO: 122567 - protein, 13 aa, Mycobacterium tuberculosis
FTGAVLGGGGIAM

SEQ ID NO: 122568 - protein, 13 aa, Mycobacterium tuberculosis
TGAVLGGGGIAMA

SEQ ID NO: 122569 - protein, 13 aa, Mycobacterium tuberculosis
GAVLGGGGIAMAA

SEQ ID NO: 122570 - protein, 13 aa, Mycobacterium tuberculosis
AVLGGGGIAMAAQ

SEQ ID NO: 122571 - protein, 13 aa, Mycobacterium tuberculosis
VLGGGGIAMAAQA

SEQ ID NO: 122572 - protein, 13 aa, Mycobacterium tuberculosis
LGGGGIAMAAQAT

SEQ ID NO: 122573 - protein, 13 aa, Mycobacterium tuberculosis
GGGGIAMAAQATA

SEQ ID NO: 122574 - protein, 13 aa, Mycobacterium tuberculosis
GGGIAMAAQATAA

SEQ ID NO: 122575 - protein, 13 aa, Mycobacterium tuberculosis
GGIAMAAQATAAT

SEQ ID NO: 122576 - protein, 13 aa, Mycobacterium tuberculosis
GIAMAAQATAATD

SEQ ID NO: 122577 - protein, 13 aa, Mycobacterium tuberculosis
IAMAAQATAATDG

SEQ ID NO: 122578 - protein, 13 aa, Mycobacterium tuberculosis
AMAAQATAATDGE

SEQ ID NO: 122579 - protein, 13 aa, Mycobacterium tuberculosis
MAAQATAATDGEW

SEQ ID NO: 122580 - protein, 13 aa, Mycobacterium tuberculosis
AAQATAATDGEWD

SEQ ID NO: 122581 - protein, 13 aa, Mycobacterium tuberculosis
AQATAATDGEWDQ

SEQ ID NO: 122582 - protein, 13 aa, Mycobacterium tuberculosis
QATAATDGEWDQV

SEQ ID NO: 122583 - protein, 13 aa, Mycobacterium tuberculosis
ATAATDGEWDQVA

SEQ ID NO: 122584 - protein, 13 aa, Mycobacterium tuberculosis
TAATDGEWDQVAR

SEQ ID NO: 122585 - protein, 13 aa, Mycobacterium tuberculosis
AATDGEWDQVARC

SEQ ID NO: 122586 - protein, 13 aa, Mycobacterium tuberculosis
ATDGEWDQVARCE

SEQ ID NO: 122587 - protein, 13 aa, Mycobacterium tuberculosis
TDGEWDQVARCES

SEQ ID NO: 122588 - protein, 13 aa, Mycobacterium tuberculosis
DGEWDQVARCESG

SEQ ID NO: 122589 - protein, 13 aa, Mycobacterium tuberculosis
GEWDQVARCESGG

SEQ ID NO: 122590 - protein, 13 aa, Mycobacterium tuberculosis
EWDQVARCESGGN

SEQ ID NO: 122591 - protein, 13 aa, Mycobacterium tuberculosis
WDQVARCESGGNW

SEQ ID NO: 122592 - protein, 13 aa, Mycobacterium tuberculosis
DQVARCESGGNWS

SEQ ID NO: 122593 - protein, 13 aa, Mycobacterium tuberculosis
QVARCESGGNWSI

SEQ ID NO: 122594 - protein, 13 aa, Mycobacterium tuberculosis
VARCESGGNWSIN

SEQ ID NO: 122595 - protein, 13 aa, Mycobacterium tuberculosis
ARCESGGNWSINT

SEQ ID NO: 122596 - protein, 13 aa, Mycobacterium tuberculosis
RCESGGNWSINTG

SEQ ID NO: 122597 - protein, 13 aa, Mycobacterium tuberculosis
CESGGNWSINTGN

SEQ ID NO: 122598 - protein, 13 aa, Mycobacterium tuberculosis
ESGGNWSINTGNG

SEQ ID NO: 122599 - protein, 13 aa, Mycobacterium tuberculosis
SGGNWSINTGNGY

SEQ ID NO: 122600 - protein, 13 aa, Mycobacterium tuberculosis
GGNWSINTGNGYL

SEQ ID NO: 122601 - protein, 13 aa, Mycobacterium tuberculosis
GNWSINTGNGYLG

SEQ ID NO: 122602 - protein, 13 aa, Mycobacterium tuberculosis
NWSINTGNGYLGG

SEQ ID NO: 122603 - protein, 13 aa, Mycobacterium tuberculosis
WSINTGNGYLGGL

SEQ ID NO: 122604 - protein, 13 aa, Mycobacterium tuberculosis
SINTGNGYLGGLQ

SEQ ID NO: 122605 - protein, 13 aa, Mycobacterium tuberculosis
INTGNGYLGGLQF

SEQ ID NO: 122606 - protein, 13 aa, Mycobacterium tuberculosis
NTGNGYLGGLQFT

SEQ ID NO: 122607 - protein, 13 aa, Mycobacterium tuberculosis
TGNGYLGGLQFTQ

SEQ ID NO: 122608 - protein, 13 aa, Mycobacterium tuberculosis
GNGYLGGLQFTQS

SEQ ID NO: 122609 - protein, 13 aa, Mycobacterium tuberculosis
NGYLGGLQFTQST

SEQ ID NO: 122610 - protein, 13 aa, Mycobacterium tuberculosis
GYLGGLQFTQSTW

SEQ ID NO: 122611 - protein, 13 aa, Mycobacterium tuberculosis
YLGGLQFTQSTWA

SEQ ID NO: 122612 - protein, 13 aa, Mycobacterium tuberculosis
LGGLQFTQSTWAA

SEQ ID NO: 122613 - protein, 13 aa, Mycobacterium tuberculosis
GGLQFTQSTWAAH

SEQ ID NO: 122614 - protein, 13 aa, Mycobacterium tuberculosis
GLQFTQSTWAAHG

SEQ ID NO: 122615 - protein, 13 aa, Mycobacterium tuberculosis
LQFTQSTWAAHGG

SEQ ID NO: 122616 - protein, 13 aa, Mycobacterium tuberculosis
QFTQSTWAAHGGG

SEQ ID NO: 122617 - protein, 13 aa, Mycobacterium tuberculosis
FTQSTWAAHGGGE

SEQ ID NO: 122618 - protein, 13 aa, Mycobacterium tuberculosis
TQSTWAAHGGGEF

SEQ ID NO: 122619 - protein, 13 aa, Mycobacterium tuberculosis
QSTWAAHGGGEFA

SEQ ID NO: 122620 - protein, 13 aa, Mycobacterium tuberculosis
STWAAHGGGEFAP

SEQ ID NO: 122621 - protein, 13 aa, Mycobacterium tuberculosis
TWAAHGGGEFAPS

SEQ ID NO: 122622 - protein, 13 aa, Mycobacterium tuberculosis
WAAHGGGEFAPSA

SEQ ID NO: 122623 - protein, 13 aa, Mycobacterium tuberculosis
AAHGGGEFAPSAQ

SEQ ID NO: 122624 - protein, 13 aa, Mycobacterium tuberculosis
AHGGGEFAPSAQL

SEQ ID NO: 122625 - protein, 13 aa, Mycobacterium tuberculosis
HGGGEFAPSAQLA

SEQ ID NO: 122626 - protein, 13 aa, Mycobacterium tuberculosis
GGGEFAPSAQLAS

SEQ ID NO: 122627 - protein, 13 aa, Mycobacterium tuberculosis
GGEFAPSAQLASR

SEQ ID NO: 122628 - protein, 13 aa, Mycobacterium tuberculosis
GEFAPSAQLASRE

SEQ ID NO: 122629 - protein, 13 aa, Mycobacterium tuberculosis
EFAPSAQLASREQ

SEQ ID NO: 122630 - protein, 13 aa, Mycobacterium tuberculosis
FAPSAQLASREQQ

SEQ ID NO: 122631 - protein, 13 aa, Mycobacterium tuberculosis
APSAQLASREQQI

SEQ ID NO: 122632 - protein, 13 aa, Mycobacterium tuberculosis
PSAQLASREQQIA

SEQ ID NO: 122633 - protein, 13 aa, Mycobacterium tuberculosis
SAQLASREQQIAV

SEQ ID NO: 122634 - protein, 13 aa, Mycobacterium tuberculosis
AQLASREQQIAVG

SEQ ID NO: 122635 - protein, 13 aa, Mycobacterium tuberculosis
QLASREQQIAVGE

SEQ ID NO: 122636 - protein, 13 aa, Mycobacterium tuberculosis
LASREQQIAVGER

SEQ ID NO: 122637 - protein, 13 aa, Mycobacterium tuberculosis
ASREQQIAVGERV

SEQ ID NO: 122638 - protein, 13 aa, Mycobacterium tuberculosis
SREQQIAVGERVL

SEQ ID NO: 122639 - protein, 13 aa, Mycobacterium tuberculosis
REQQIAVGERVLA

SEQ ID NO: 122640 - protein, 13 aa, Mycobacterium tuberculosis
EQQIAVGERVLAT

SEQ ID NO: 122641 - protein, 13 aa, Mycobacterium tuberculosis
QQIAVGERVLATQ

SEQ ID NO: 122642 - protein, 13 aa, Mycobacterium tuberculosis
QIAVGERVLATQG

SEQ ID NO: 122643 - protein, 13 aa, Mycobacterium tuberculosis
IAVGERVLATQGR

SEQ ID NO: 122644 - protein, 13 aa, Mycobacterium tuberculosis
AVGERVLATQGRG

SEQ ID NO: 122645 - protein, 13 aa, Mycobacterium tuberculosis
VGERVLATQGRGA

SEQ ID NO: 122646 - protein, 13 aa, Mycobacterium tuberculosis
GERVLATQGRGAW

SEQ ID NO: 122647 - protein, 13 aa, Mycobacterium tuberculosis
ERVLATQGRGAWP

SEQ ID NO: 122648 - protein, 13 aa, Mycobacterium tuberculosis
RVLATQGRGAWPV

SEQ ID NO: 122649 - protein, 13 aa, Mycobacterium tuberculosis
VLATQGRGAWPVC

SEQ ID NO: 122650 - protein, 13 aa, Mycobacterium tuberculosis
LATQGRGAWPVCG

SEQ ID NO: 122651 - protein, 13 aa, Mycobacterium tuberculosis
ATQGRGAWPVCGR

SEQ ID NO: 122652 - protein, 13 aa, Mycobacterium tuberculosis
TQGRGAWPVCGRG

SEQ ID NO: 122653 - protein, 13 aa, Mycobacterium tuberculosis
QGRGAWPVCGRGL

SEQ ID NO: 122654 - protein, 13 aa, Mycobacterium tuberculosis
GRGAWPVCGRGLS

SEQ ID NO: 122655 - protein, 13 aa, Mycobacterium tuberculosis
RGAWPVCGRGLSN

SEQ ID NO: 122656 - protein, 13 aa, Mycobacterium tuberculosis
GAWPVCGRGLSNA

SEQ ID NO: 122657 - protein, 13 aa, Mycobacterium tuberculosis
AWPVCGRGLSNAT

SEQ ID NO: 122658 - protein, 13 aa, Mycobacterium tuberculosis
WPVCGRGLSNATP

SEQ ID NO: 122659 - protein, 13 aa, Mycobacterium tuberculosis
PVCGRGLSNATPR

SEQ ID NO: 122660 - protein, 13 aa, Mycobacterium tuberculosis
VCGRGLSNATPRE

SEQ ID NO: 122661 - protein, 13 aa, Mycobacterium tuberculosis
CGRGLSNATPREV

SEQ ID NO: 122662 - protein, 13 aa, Mycobacterium tuberculosis
GRGLSNATPREVL

SEQ ID NO: 122663 - protein, 13 aa, Mycobacterium tuberculosis
RGLSNATPREVLP

SEQ ID NO: 122664 - protein, 13 aa, Mycobacterium tuberculosis
GLSNATPREVLPA

SEQ ID NO: 122665 - protein, 13 aa, Mycobacterium tuberculosis
LSNATPREVLPAS

SEQ ID NO: 122666 - protein, 13 aa, Mycobacterium tuberculosis
SNATPREVLPASA

SEQ ID NO: 122667 - protein, 13 aa, Mycobacterium tuberculosis
NATPREVLPASAA

SEQ ID NO: 122668 - protein, 13 aa, Mycobacterium tuberculosis
ATPREVLPASAAM

SEQ ID NO: 122669 - protein, 13 aa, Mycobacterium tuberculosis
TPREVLPASAAMD

SEQ ID NO: 122670 - protein, 13 aa, Mycobacterium tuberculosis
PREVLPASAAMDA

SEQ ID NO: 122671 - protein, 13 aa, Mycobacterium tuberculosis
REVLPASAAMDAP

SEQ ID NO: 122672 - protein, 13 aa, Mycobacterium tuberculosis
EVLPASAAMDAPL

SEQ ID NO: 122673 - protein, 13 aa, Mycobacterium tuberculosis
VLPASAAMDAPLD

SEQ ID NO: 122674 - protein, 13 aa, Mycobacterium tuberculosis
LPASAAMDAPLDA

SEQ ID NO: 122675 - protein, 13 aa, Mycobacterium tuberculosis
PASAAMDAPLDAA

SEQ ID NO: 122676 - protein, 13 aa, Mycobacterium tuberculosis
ASAAMDAPLDAAA

SEQ ID NO: 122677 - protein, 13 aa, Mycobacterium tuberculosis
SAAMDAPLDAAAV

SEQ ID NO: 122678 - protein, 13 aa, Mycobacterium tuberculosis
AAMDAPLDAAAVN

SEQ ID NO: 122679 - protein, 13 aa, Mycobacterium tuberculosis
AMDAPLDAAAVNG

SEQ ID NO: 122680 - protein, 13 aa, Mycobacterium tuberculosis
MDAPLDAAAVNGE

SEQ ID NO: 122681 - protein, 13 aa, Mycobacterium tuberculosis
DAPLDAAAVNGEP

SEQ ID NO: 122682 - protein, 13 aa, Mycobacterium tuberculosis
APLDAAAVNGEPA

SEQ ID NO: 122683 - protein, 13 aa, Mycobacterium tuberculosis
PLDAAAVNGEPAP

SEQ ID NO: 122684 - protein, 13 aa, Mycobacterium tuberculosis
LDAAAVNGEPAPL

SEQ ID NO: 122685 - protein, 13 aa, Mycobacterium tuberculosis
DAAAVNGEPAPLA

SEQ ID NO: 122686 - protein, 13 aa, Mycobacterium tuberculosis
AAAVNGEPAPLAP

SEQ ID NO: 122687 - protein, 13 aa, Mycobacterium tuberculosis
AAVNGEPAPLAPP

SEQ ID NO: 122688 - protein, 13 aa, Mycobacterium tuberculosis
AVNGEPAPLAPPP

SEQ ID NO: 122689 - protein, 13 aa, Mycobacterium tuberculosis
VNGEPAPLAPPPA

SEQ ID NO: 122690 - protein, 13 aa, Mycobacterium tuberculosis
NGEPAPLAPPPAD

SEQ ID NO: 122691 - protein, 13 aa, Mycobacterium tuberculosis
GEPAPLAPPPADP

SEQ ID NO: 122692 - protein, 13 aa, Mycobacterium tuberculosis
EPAPLAPPPADPA

SEQ ID NO: 122693 - protein, 13 aa, Mycobacterium tuberculosis
PAPLAPPPADPAP

SEQ ID NO: 122694 - protein, 13 aa, Mycobacterium tuberculosis
APLAPPPADPAPP

SEQ ID NO: 122695 - protein, 13 aa, Mycobacterium tuberculosis
PLAPPPADPAPPV

SEQ ID NO: 122696 - protein, 13 aa, Mycobacterium tuberculosis
LAPPPADPAPPVE

SEQ ID NO: 122697 - protein, 13 aa, Mycobacterium tuberculosis
APPPADPAPPVEL

SEQ ID NO: 122698 - protein, 13 aa, Mycobacterium tuberculosis
PPPADPAPPVELA

SEQ ID NO: 122699 - protein, 13 aa, Mycobacterium tuberculosis
PPADPAPPVELAA

SEQ ID NO: 122700 - protein, 13 aa, Mycobacterium tuberculosis
PADPAPPVELAAN

SEQ ID NO: 122701 - protein, 13 aa, Mycobacterium tuberculosis
ADPAPPVELAAND

SEQ ID NO: 122702 - protein, 13 aa, Mycobacterium tuberculosis
DPAPPVELAANDL

SEQ ID NO: 122703 - protein, 13 aa, Mycobacterium tuberculosis
PAPPVELAANDLP

SEQ ID NO: 122704 - protein, 13 aa, Mycobacterium tuberculosis
APPVELAANDLPA

SEQ ID NO: 122705 - protein, 13 aa, Mycobacterium tuberculosis
PPVELAANDLPAP

SEQ ID NO: 122706 - protein, 13 aa, Mycobacterium tuberculosis
PVELAANDLPAPL

SEQ ID NO: 122707 - protein, 13 aa, Mycobacterium tuberculosis
VELAANDLPAPLG

SEQ ID NO: 122708 - protein, 13 aa, Mycobacterium tuberculosis
ELAANDLPAPLGE

SEQ ID NO: 122709 - protein, 13 aa, Mycobacterium tuberculosis
LAANDLPAPLGEP

SEQ ID NO: 122710 - protein, 13 aa, Mycobacterium tuberculosis
AANDLPAPLGEPL

SEQ ID NO: 122711 - protein, 13 aa, Mycobacterium tuberculosis
ANDLPAPLGEPLP

SEQ ID NO: 122712 - protein, 13 aa, Mycobacterium tuberculosis
NDLPAPLGEPLPA

SEQ ID NO: 122713 - protein, 13 aa, Mycobacterium tuberculosis
DLPAPLGEPLPAA

SEQ ID NO: 122714 - protein, 13 aa, Mycobacterium tuberculosis
LPAPLGEPLPAAP

SEQ ID NO: 122715 - protein, 13 aa, Mycobacterium tuberculosis
PAPLGEPLPAAPA

SEQ ID NO: 122716 - protein, 13 aa, Mycobacterium tuberculosis
APLGEPLPAAPAD

SEQ ID NO: 122717 - protein, 13 aa, Mycobacterium tuberculosis
PLGEPLPAAPADP

SEQ ID NO: 122718 - protein, 13 aa, Mycobacterium tuberculosis
LGEPLPAAPADPA

SEQ ID NO: 122719 - protein, 13 aa, Mycobacterium tuberculosis
GEPLPAAPADPAP

SEQ ID NO: 122720 - protein, 13 aa, Mycobacterium tuberculosis
EPLPAAPADPAPP

SEQ ID NO: 122721 - protein, 13 aa, Mycobacterium tuberculosis
PLPAAPADPAPPA

SEQ ID NO: 122722 - protein, 13 aa, Mycobacterium tuberculosis
LPAAPADPAPPAD

SEQ ID NO: 122723 - protein, 13 aa, Mycobacterium tuberculosis
PAAPADPAPPADL

SEQ ID NO: 122724 - protein, 13 aa, Mycobacterium tuberculosis
AAPADPAPPADLA

SEQ ID NO: 122725 - protein, 13 aa, Mycobacterium tuberculosis
APADPAPPADLAP

SEQ ID NO: 122726 - protein, 13 aa, Mycobacterium tuberculosis
PADPAPPADLAPP

SEQ ID NO: 122727 - protein, 13 aa, Mycobacterium tuberculosis
ADPAPPADLAPPA

SEQ ID NO: 122728 - protein, 13 aa, Mycobacterium tuberculosis
DPAPPADLAPPAP

SEQ ID NO: 122729 - protein, 13 aa, Mycobacterium tuberculosis
PAPPADLAPPAPA

SEQ ID NO: 122730 - protein, 13 aa, Mycobacterium tuberculosis
APPADLAPPAPAD

SEQ ID NO: 122731 - protein, 13 aa, Mycobacterium tuberculosis
PPADLAPPAPADV

SEQ ID NO: 122732 - protein, 13 aa, Mycobacterium tuberculosis
PADLAPPAPADVA

SEQ ID NO: 122733 - protein, 13 aa, Mycobacterium tuberculosis
ADLAPPAPADVAP

SEQ ID NO: 122734 - protein, 13 aa, Mycobacterium tuberculosis
DLAPPAPADVAPP

SEQ ID NO: 122735 - protein, 13 aa, Mycobacterium tuberculosis
LAPPAPADVAPPV

SEQ ID NO: 122736 - protein, 13 aa, Mycobacterium tuberculosis
APPAPADVAPPVE

SEQ ID NO: 122737 - protein, 13 aa, Mycobacterium tuberculosis
PPAPADVAPPVEL

SEQ ID NO: 122738 - protein, 13 aa, Mycobacterium tuberculosis
PAPADVAPPVELA

SEQ ID NO: 122739 - protein, 13 aa, Mycobacterium tuberculosis
APADVAPPVELAV

SEQ ID NO: 122740 - protein, 13 aa, Mycobacterium tuberculosis
PADVAPPVELAVN

SEQ ID NO: 122741 - protein, 13 aa, Mycobacterium tuberculosis
ADVAPPVELAVND

SEQ ID NO: 122742 - protein, 13 aa, Mycobacterium tuberculosis
DVAPPVELAVNDL

SEQ ID NO: 122743 - protein, 13 aa, Mycobacterium tuberculosis
VAPPVELAVNDLP

SEQ ID NO: 122744 - protein, 13 aa, Mycobacterium tuberculosis
APPVELAVNDLPA

SEQ ID NO: 122745 - protein, 13 aa, Mycobacterium tuberculosis
PPVELAVNDLPAP

SEQ ID NO: 122746 - protein, 13 aa, Mycobacterium tuberculosis
PVELAVNDLPAPL

SEQ ID NO: 122747 - protein, 13 aa, Mycobacterium tuberculosis
VELAVNDLPAPLG

SEQ ID NO: 122748 - protein, 13 aa, Mycobacterium tuberculosis
ELAVNDLPAPLGE

SEQ ID NO: 122749 - protein, 13 aa, Mycobacterium tuberculosis
LAVNDLPAPLGEP

SEQ ID NO: 122750 - protein, 13 aa, Mycobacterium tuberculosis
AVNDLPAPLGEPL

SEQ ID NO: 122751 - protein, 13 aa, Mycobacterium tuberculosis
VNDLPAPLGEPLP

SEQ ID NO: 122752 - protein, 13 aa, Mycobacterium tuberculosis
NDLPAPLGEPLPA

SEQ ID NO: 122753 - protein, 13 aa, Mycobacterium tuberculosis
DLPAPLGEPLPAA

SEQ ID NO: 122754 - protein, 13 aa, Mycobacterium tuberculosis
LPAPLGEPLPAAP

SEQ ID NO: 122755 - protein, 13 aa, Mycobacterium tuberculosis
PAPLGEPLPAAPA

SEQ ID NO: 122756 - protein, 13 aa, Mycobacterium tuberculosis
APLGEPLPAAPAD

SEQ ID NO: 122757 - protein, 13 aa, Mycobacterium tuberculosis
PLGEPLPAAPADP

SEQ ID NO: 122758 - protein, 13 aa, Mycobacterium tuberculosis
LGEPLPAAPADPA

SEQ ID NO: 122759 - protein, 13 aa, Mycobacterium tuberculosis
GEPLPAAPADPAP

SEQ ID NO: 122760 - protein, 13 aa, Mycobacterium tuberculosis
EPLPAAPADPAPP

SEQ ID NO: 122761 - protein, 13 aa, Mycobacterium tuberculosis
PLPAAPADPAPPA

SEQ ID NO: 122762 - protein, 13 aa, Mycobacterium tuberculosis
LPAAPADPAPPAD

SEQ ID NO: 122763 - protein, 13 aa, Mycobacterium tuberculosis
PAAPADPAPPADL

SEQ ID NO: 122764 - protein, 13 aa, Mycobacterium tuberculosis
AAPADPAPPADLA

SEQ ID NO: 122765 - protein, 13 aa, Mycobacterium tuberculosis
APADPAPPADLAP

SEQ ID NO: 122766 - protein, 13 aa, Mycobacterium tuberculosis
PADPAPPADLAPP

SEQ ID NO: 122767 - protein, 13 aa, Mycobacterium tuberculosis
ADPAPPADLAPPA

SEQ ID NO: 122768 - protein, 13 aa, Mycobacterium tuberculosis
DPAPPADLAPPAP

SEQ ID NO: 122769 - protein, 13 aa, Mycobacterium tuberculosis
PAPPADLAPPAPA

SEQ ID NO: 122770 - protein, 13 aa, Mycobacterium tuberculosis
APPADLAPPAPAD

SEQ ID NO: 122771 - protein, 13 aa, Mycobacterium tuberculosis
PPADLAPPAPADL

SEQ ID NO: 122772 - protein, 13 aa, Mycobacterium tuberculosis
PADLAPPAPADLA

SEQ ID NO: 122773 - protein, 13 aa, Mycobacterium tuberculosis
ADLAPPAPADLAP

SEQ ID NO: 122774 - protein, 13 aa, Mycobacterium tuberculosis
DLAPPAPADLAPP

SEQ ID NO: 122775 - protein, 13 aa, Mycobacterium tuberculosis
LAPPAPADLAPPA

SEQ ID NO: 122776 - protein, 13 aa, Mycobacterium tuberculosis
APPAPADLAPPAP

SEQ ID NO: 122777 - protein, 13 aa, Mycobacterium tuberculosis
PPAPADLAPPAPA

SEQ ID NO: 122778 - protein, 13 aa, Mycobacterium tuberculosis
PAPADLAPPAPAD

SEQ ID NO: 122779 - protein, 13 aa, Mycobacterium tuberculosis
APADLAPPAPADL

SEQ ID NO: 122780 - protein, 13 aa, Mycobacterium tuberculosis
PADLAPPAPADLA

SEQ ID NO: 122781 - protein, 13 aa, Mycobacterium tuberculosis
ADLAPPAPADLAP

SEQ ID NO: 122782 - protein, 13 aa, Mycobacterium tuberculosis
DLAPPAPADLAPP

SEQ ID NO: 122783 - protein, 13 aa, Mycobacterium tuberculosis
LAPPAPADLAPPA

SEQ ID NO: 122784 - protein, 13 aa, Mycobacterium tuberculosis
APPAPADLAPPAP

SEQ ID NO: 122785 - protein, 13 aa, Mycobacterium tuberculosis
PPAPADLAPPAPA

SEQ ID NO: 122786 - protein, 13 aa, Mycobacterium tuberculosis
PAPADLAPPAPAD

SEQ ID NO: 122787 - protein, 13 aa, Mycobacterium tuberculosis
APADLAPPAPADL

SEQ ID NO: 122788 - protein, 13 aa, Mycobacterium tuberculosis
PADLAPPAPADLA

SEQ ID NO: 122789 - protein, 13 aa, Mycobacterium tuberculosis
ADLAPPAPADLAP

SEQ ID NO: 122790 - protein, 13 aa, Mycobacterium tuberculosis
DLAPPAPADLAPP

SEQ ID NO: 122791 - protein, 13 aa, Mycobacterium tuberculosis
LAPPAPADLAPPV

SEQ ID NO: 122792 - protein, 13 aa, Mycobacterium tuberculosis
APPAPADLAPPVE

SEQ ID NO: 122793 - protein, 13 aa, Mycobacterium tuberculosis
PPAPADLAPPVEL

SEQ ID NO: 122794 - protein, 13 aa, Mycobacterium tuberculosis
PAPADLAPPVELA

SEQ ID NO: 122795 - protein, 13 aa, Mycobacterium tuberculosis
APADLAPPVELAV

SEQ ID NO: 122796 - protein, 13 aa, Mycobacterium tuberculosis
PADLAPPVELAVN

SEQ ID NO: 122797 - protein, 13 aa, Mycobacterium tuberculosis
ADLAPPVELAVND

SEQ ID NO: 122798 - protein, 13 aa, Mycobacterium tuberculosis
DLAPPVELAVNDL

SEQ ID NO: 122799 - protein, 13 aa, Mycobacterium tuberculosis
LAPPVELAVNDLP

SEQ ID NO: 122800 - protein, 13 aa, Mycobacterium tuberculosis
APPVELAVNDLPA

SEQ ID NO: 122801 - protein, 13 aa, Mycobacterium tuberculosis
PPVELAVNDLPAP

SEQ ID NO: 122802 - protein, 13 aa, Mycobacterium tuberculosis
PVELAVNDLPAPL

SEQ ID NO: 122803 - protein, 13 aa, Mycobacterium tuberculosis
VELAVNDLPAPLG

SEQ ID NO: 122804 - protein, 13 aa, Mycobacterium tuberculosis
ELAVNDLPAPLGE

SEQ ID NO: 122805 - protein, 13 aa, Mycobacterium tuberculosis
LAVNDLPAPLGEP

SEQ ID NO: 122806 - protein, 13 aa, Mycobacterium tuberculosis
AVNDLPAPLGEPL

SEQ ID NO: 122807 - protein, 13 aa, Mycobacterium tuberculosis
VNDLPAPLGEPLP

SEQ ID NO: 122808 - protein, 13 aa, Mycobacterium tuberculosis
NDLPAPLGEPLPA

SEQ ID NO: 122809 - protein, 13 aa, Mycobacterium tuberculosis
DLPAPLGEPLPAA

SEQ ID NO: 122810 - protein, 13 aa, Mycobacterium tuberculosis
LPAPLGEPLPAAP

SEQ ID NO: 122811 - protein, 13 aa, Mycobacterium tuberculosis
PAPLGEPLPAAPA

SEQ ID NO: 122812 - protein, 13 aa, Mycobacterium tuberculosis
APLGEPLPAAPAE

SEQ ID NO: 122813 - protein, 13 aa, Mycobacterium tuberculosis
PLGEPLPAAPAEL

SEQ ID NO: 122814 - protein, 13 aa, Mycobacterium tuberculosis
LGEPLPAAPAELA

SEQ ID NO: 122815 - protein, 13 aa, Mycobacterium tuberculosis
GEPLPAAPAELAP

SEQ ID NO: 122816 - protein, 13 aa, Mycobacterium tuberculosis
EPLPAAPAELAPP

SEQ ID NO: 122817 - protein, 13 aa, Mycobacterium tuberculosis
PLPAAPAELAPPA

SEQ ID NO: 122818 - protein, 13 aa, Mycobacterium tuberculosis
LPAAPAELAPPAD

SEQ ID NO: 122819 - protein, 13 aa, Mycobacterium tuberculosis
PAAPAELAPPADL

SEQ ID NO: 122820 - protein, 13 aa, Mycobacterium tuberculosis
AAPAELAPPADLA

SEQ ID NO: 122821 - protein, 13 aa, Mycobacterium tuberculosis
APAELAPPADLAP

SEQ ID NO: 122822 - protein, 13 aa, Mycobacterium tuberculosis
PAELAPPADLAPA

SEQ ID NO: 122823 - protein, 13 aa, Mycobacterium tuberculosis
AELAPPADLAPAS

SEQ ID NO: 122824 - protein, 13 aa, Mycobacterium tuberculosis
ELAPPADLAPASA

SEQ ID NO: 122825 - protein, 13 aa, Mycobacterium tuberculosis
LAPPADLAPASAD

SEQ ID NO: 122826 - protein, 13 aa, Mycobacterium tuberculosis
APPADLAPASADL

SEQ ID NO: 122827 - protein, 13 aa, Mycobacterium tuberculosis
PPADLAPASADLA

SEQ ID NO: 122828 - protein, 13 aa, Mycobacterium tuberculosis
PADLAPASADLAP

SEQ ID NO: 122829 - protein, 13 aa, Mycobacterium tuberculosis
ADLAPASADLAPP

SEQ ID NO: 122830 - protein, 13 aa, Mycobacterium tuberculosis
DLAPASADLAPPA

SEQ ID NO: 122831 - protein, 13 aa, Mycobacterium tuberculosis
LAPASADLAPPAP

SEQ ID NO: 122832 - protein, 13 aa, Mycobacterium tuberculosis
APASADLAPPAPA

SEQ ID NO: 122833 - protein, 13 aa, Mycobacterium tuberculosis
PASADLAPPAPAD

SEQ ID NO: 122834 - protein, 13 aa, Mycobacterium tuberculosis
ASADLAPPAPADL

SEQ ID NO: 122835 - protein, 13 aa, Mycobacterium tuberculosis
SADLAPPAPADLA

SEQ ID NO: 122836 - protein, 13 aa, Mycobacterium tuberculosis
ADLAPPAPADLAP

SEQ ID NO: 122837 - protein, 13 aa, Mycobacterium tuberculosis
DLAPPAPADLAPP

SEQ ID NO: 122838 - protein, 13 aa, Mycobacterium tuberculosis
LAPPAPADLAPPA

SEQ ID NO: 122839 - protein, 13 aa, Mycobacterium tuberculosis
APPAPADLAPPAP

SEQ ID NO: 122840 - protein, 13 aa, Mycobacterium tuberculosis
PPAPADLAPPAPA

SEQ ID NO: 122841 - protein, 13 aa, Mycobacterium tuberculosis
PAPADLAPPAPAE

SEQ ID NO: 122842 - protein, 13 aa, Mycobacterium tuberculosis
APADLAPPAPAEL

SEQ ID NO: 122843 - protein, 13 aa, Mycobacterium tuberculosis
PADLAPPAPAELA

SEQ ID NO: 122844 - protein, 13 aa, Mycobacterium tuberculosis
ADLAPPAPAELAP

SEQ ID NO: 122845 - protein, 13 aa, Mycobacterium tuberculosis
DLAPPAPAELAPP

SEQ ID NO: 122846 - protein, 13 aa, Mycobacterium tuberculosis
LAPPAPAELAPPA

SEQ ID NO: 122847 - protein, 13 aa, Mycobacterium tuberculosis
APPAPAELAPPAP

SEQ ID NO: 122848 - protein, 13 aa, Mycobacterium tuberculosis
PPAPAELAPPAPA

SEQ ID NO: 122849 - protein, 13 aa, Mycobacterium tuberculosis
PAPAELAPPAPAD

SEQ ID NO: 122850 - protein, 13 aa, Mycobacterium tuberculosis
APAELAPPAPADL

SEQ ID NO: 122851 - protein, 13 aa, Mycobacterium tuberculosis
PAELAPPAPADLA

SEQ ID NO: 122852 - protein, 13 aa, Mycobacterium tuberculosis
AELAPPAPADLAP

SEQ ID NO: 122853 - protein, 13 aa, Mycobacterium tuberculosis
ELAPPAPADLAPP

SEQ ID NO: 122854 - protein, 13 aa, Mycobacterium tuberculosis
LAPPAPADLAPPA

SEQ ID NO: 122855 - protein, 13 aa, Mycobacterium tuberculosis
APPAPADLAPPAA

SEQ ID NO: 122856 - protein, 13 aa, Mycobacterium tuberculosis
PPAPADLAPPAAV

SEQ ID NO: 122857 - protein, 13 aa, Mycobacterium tuberculosis
PAPADLAPPAAVN

SEQ ID NO: 122858 - protein, 13 aa, Mycobacterium tuberculosis
APADLAPPAAVNE

SEQ ID NO: 122859 - protein, 13 aa, Mycobacterium tuberculosis
PADLAPPAAVNEQ

SEQ ID NO: 122860 - protein, 13 aa, Mycobacterium tuberculosis
ADLAPPAAVNEQT

SEQ ID NO: 122861 - protein, 13 aa, Mycobacterium tuberculosis
DLAPPAAVNEQTA

SEQ ID NO: 122862 - protein, 13 aa, Mycobacterium tuberculosis
LAPPAAVNEQTAP

SEQ ID NO: 122863 - protein, 13 aa, Mycobacterium tuberculosis
APPAAVNEQTAPG

SEQ ID NO: 122864 - protein, 13 aa, Mycobacterium tuberculosis
PPAAVNEQTAPGD

SEQ ID NO: 122865 - protein, 13 aa, Mycobacterium tuberculosis
PAAVNEQTAPGDQ

SEQ ID NO: 122866 - protein, 13 aa, Mycobacterium tuberculosis
AAVNEQTAPGDQP

SEQ ID NO: 122867 - protein, 13 aa, Mycobacterium tuberculosis
AVNEQTAPGDQPA

SEQ ID NO: 122868 - protein, 13 aa, Mycobacterium tuberculosis
VNEQTAPGDQPAT

SEQ ID NO: 122869 - protein, 13 aa, Mycobacterium tuberculosis
NEQTAPGDQPATA

SEQ ID NO: 122870 - protein, 13 aa, Mycobacterium tuberculosis
EQTAPGDQPATAP

SEQ ID NO: 122871 - protein, 13 aa, Mycobacterium tuberculosis
QTAPGDQPATAPG

SEQ ID NO: 122872 - protein, 13 aa, Mycobacterium tuberculosis
TAPGDQPATAPGG

SEQ ID NO: 122873 - protein, 13 aa, Mycobacterium tuberculosis
APGDQPATAPGGP

SEQ ID NO: 122874 - protein, 13 aa, Mycobacterium tuberculosis
PGDQPATAPGGPV

SEQ ID NO: 122875 - protein, 13 aa, Mycobacterium tuberculosis
GDQPATAPGGPVG

SEQ ID NO: 122876 - protein, 13 aa, Mycobacterium tuberculosis
DQPATAPGGPVGL

SEQ ID NO: 122877 - protein, 13 aa, Mycobacterium tuberculosis
QPATAPGGPVGLA

SEQ ID NO: 122878 - protein, 13 aa, Mycobacterium tuberculosis
PATAPGGPVGLAT

SEQ ID NO: 122879 - protein, 13 aa, Mycobacterium tuberculosis
ATAPGGPVGLATD

SEQ ID NO: 122880 - protein, 13 aa, Mycobacterium tuberculosis
TAPGGPVGLATDL

SEQ ID NO: 122881 - protein, 13 aa, Mycobacterium tuberculosis
APGGPVGLATDLE

SEQ ID NO: 122882 - protein, 13 aa, Mycobacterium tuberculosis
PGGPVGLATDLEL

SEQ ID NO: 122883 - protein, 13 aa, Mycobacterium tuberculosis
GGPVGLATDLELP

SEQ ID NO: 122884 - protein, 13 aa, Mycobacterium tuberculosis
GPVGLATDLELPE

SEQ ID NO: 122885 - protein, 13 aa, Mycobacterium tuberculosis
PVGLATDLELPEP

SEQ ID NO: 122886 - protein, 13 aa, Mycobacterium tuberculosis
VGLATDLELPEPD

SEQ ID NO: 122887 - protein, 13 aa, Mycobacterium tuberculosis
GLATDLELPEPDP

SEQ ID NO: 122888 - protein, 13 aa, Mycobacterium tuberculosis
LATDLELPEPDPQ

SEQ ID NO: 122889 - protein, 13 aa, Mycobacterium tuberculosis
ATDLELPEPDPQP

SEQ ID NO: 122890 - protein, 13 aa, Mycobacterium tuberculosis
TDLELPEPDPQPA

SEQ ID NO: 122891 - protein, 13 aa, Mycobacterium tuberculosis
DLELPEPDPQPAD

SEQ ID NO: 122892 - protein, 13 aa, Mycobacterium tuberculosis
LELPEPDPQPADA

SEQ ID NO: 122893 - protein, 13 aa, Mycobacterium tuberculosis
ELPEPDPQPADAP

SEQ ID NO: 122894 - protein, 13 aa, Mycobacterium tuberculosis
LPEPDPQPADAPP

SEQ ID NO: 122895 - protein, 13 aa, Mycobacterium tuberculosis
PEPDPQPADAPPP

SEQ ID NO: 122896 - protein, 13 aa, Mycobacterium tuberculosis
EPDPQPADAPPPG

SEQ ID NO: 122897 - protein, 13 aa, Mycobacterium tuberculosis
PDPQPADAPPPGD

SEQ ID NO: 122898 - protein, 13 aa, Mycobacterium tuberculosis
DPQPADAPPPGDV

SEQ ID NO: 122899 - protein, 13 aa, Mycobacterium tuberculosis
PQPADAPPPGDVT

SEQ ID NO: 122900 - protein, 13 aa, Mycobacterium tuberculosis
QPADAPPPGDVTE

SEQ ID NO: 122901 - protein, 13 aa, Mycobacterium tuberculosis
PADAPPPGDVTEA

SEQ ID NO: 122902 - protein, 13 aa, Mycobacterium tuberculosis
ADAPPPGDVTEAP

SEQ ID NO: 122903 - protein, 13 aa, Mycobacterium tuberculosis
DAPPPGDVTEAPA

SEQ ID NO: 122904 - protein, 13 aa, Mycobacterium tuberculosis
APPPGDVTEAPAE

SEQ ID NO: 122905 - protein, 13 aa, Mycobacterium tuberculosis
PPPGDVTEAPAET

SEQ ID NO: 122906 - protein, 13 aa, Mycobacterium tuberculosis
PPGDVTEAPAETP

SEQ ID NO: 122907 - protein, 13 aa, Mycobacterium tuberculosis
PGDVTEAPAETPQ

SEQ ID NO: 122908 - protein, 13 aa, Mycobacterium tuberculosis
GDVTEAPAETPQV

SEQ ID NO: 122909 - protein, 13 aa, Mycobacterium tuberculosis
DVTEAPAETPQVS

SEQ ID NO: 122910 - protein, 13 aa, Mycobacterium tuberculosis
VTEAPAETPQVSN

SEQ ID NO: 122911 - protein, 13 aa, Mycobacterium tuberculosis
TEAPAETPQVSNI

SEQ ID NO: 122912 - protein, 13 aa, Mycobacterium tuberculosis
EAPAETPQVSNIA

SEQ ID NO: 122913 - protein, 13 aa, Mycobacterium tuberculosis
APAETPQVSNIAY

SEQ ID NO: 122914 - protein, 13 aa, Mycobacterium tuberculosis
PAETPQVSNIAYT

SEQ ID NO: 122915 - protein, 13 aa, Mycobacterium tuberculosis
AETPQVSNIAYTK

SEQ ID NO: 122916 - protein, 13 aa, Mycobacterium tuberculosis
ETPQVSNIAYTKK

SEQ ID NO: 122917 - protein, 13 aa, Mycobacterium tuberculosis
TPQVSNIAYTKKL

SEQ ID NO: 122918 - protein, 13 aa, Mycobacterium tuberculosis
PQVSNIAYTKKLW

SEQ ID NO: 122919 - protein, 13 aa, Mycobacterium tuberculosis
QVSNIAYTKKLWQ

SEQ ID NO: 122920 - protein, 13 aa, Mycobacterium tuberculosis
VSNIAYTKKLWQA

SEQ ID NO: 122921 - protein, 13 aa, Mycobacterium tuberculosis
SNIAYTKKLWQAI

SEQ ID NO: 122922 - protein, 13 aa, Mycobacterium tuberculosis
NIAYTKKLWQAIR

SEQ ID NO: 122923 - protein, 13 aa, Mycobacterium tuberculosis
IAYTKKLWQAIRA

SEQ ID NO: 122924 - protein, 13 aa, Mycobacterium tuberculosis
AYTKKLWQAIRAQ

SEQ ID NO: 122925 - protein, 13 aa, Mycobacterium tuberculosis
YTKKLWQAIRAQD

SEQ ID NO: 122926 - protein, 13 aa, Mycobacterium tuberculosis
TKKLWQAIRAQDV

SEQ ID NO: 122927 - protein, 13 aa, Mycobacterium tuberculosis
KKLWQAIRAQDVC

SEQ ID NO: 122928 - protein, 13 aa, Mycobacterium tuberculosis
KLWQAIRAQDVCG

SEQ ID NO: 122929 - protein, 13 aa, Mycobacterium tuberculosis
LWQAIRAQDVCGN

SEQ ID NO: 122930 - protein, 13 aa, Mycobacterium tuberculosis
WQAIRAQDVCGND

SEQ ID NO: 122931 - protein, 13 aa, Mycobacterium tuberculosis
QAIRAQDVCGNDA

SEQ ID NO: 122932 - protein, 13 aa, Mycobacterium tuberculosis
AIRAQDVCGNDAL

SEQ ID NO: 122933 - protein, 13 aa, Mycobacterium tuberculosis
IRAQDVCGNDALD

SEQ ID NO: 122934 - protein, 13 aa, Mycobacterium tuberculosis
RAQDVCGNDALDS

SEQ ID NO: 122935 - protein, 13 aa, Mycobacterium tuberculosis
AQDVCGNDALDSL

SEQ ID NO: 122936 - protein, 13 aa, Mycobacterium tuberculosis
QDVCGNDALDSLA

SEQ ID NO: 122937 - protein, 13 aa, Mycobacterium tuberculosis
DVCGNDALDSLAQ

SEQ ID NO: 122938 - protein, 13 aa, Mycobacterium tuberculosis
VCGNDALDSLAQP

SEQ ID NO: 122939 - protein, 13 aa, Mycobacterium tuberculosis
CGNDALDSLAQPY

SEQ ID NO: 122940 - protein, 13 aa, Mycobacterium tuberculosis
GNDALDSLAQPYV

SEQ ID NO: 122941 - protein, 13 aa, Mycobacterium tuberculosis
NDALDSLAQPYVI

SEQ ID NO: 122942 - protein, 13 aa, Mycobacterium tuberculosis
DALDSLAQPYVIG

SEQ ID NO: 122943 - protein, 14 aa, Mycobacterium tuberculosis
MSGRHRKPTTSNVS

SEQ ID NO: 122944 - protein, 14 aa, Mycobacterium tuberculosis
SGRHRKPTTSNVSV

SEQ ID NO: 122945 - protein, 14 aa, Mycobacterium tuberculosis
GRHRKPTTSNVSVA

SEQ ID NO: 122946 - protein, 14 aa, Mycobacterium tuberculosis
RHRKPTTSNVSVAK

SEQ ID NO: 122947 - protein, 14 aa, Mycobacterium tuberculosis
HRKPTTSNVSVAKI

SEQ ID NO: 122948 - protein, 14 aa, Mycobacterium tuberculosis
RKPTTSNVSVAKIA

SEQ ID NO: 122949 - protein, 14 aa, Mycobacterium tuberculosis
KPTTSNVSVAKIAF

SEQ ID NO: 122950 - protein, 14 aa, Mycobacterium tuberculosis
PTTSNVSVAKIAFT

SEQ ID NO: 122951 - protein, 14 aa, Mycobacterium tuberculosis
TTSNVSVAKIAFTG

SEQ ID NO: 122952 - protein, 14 aa, Mycobacterium tuberculosis
TSNVSVAKIAFTGA

SEQ ID NO: 122953 - protein, 14 aa, Mycobacterium tuberculosis
SNVSVAKIAFTGAV

SEQ ID NO: 122954 - protein, 14 aa, Mycobacterium tuberculosis
NVSVAKIAFTGAVL

SEQ ID NO: 122955 - protein, 14 aa, Mycobacterium tuberculosis
VSVAKIAFTGAVLG

SEQ ID NO: 122956 - protein, 14 aa, Mycobacterium tuberculosis
SVAKIAFTGAVLGG

SEQ ID NO: 122957 - protein, 14 aa, Mycobacterium tuberculosis
VAKIAFTGAVLGGG

SEQ ID NO: 122958 - protein, 14 aa, Mycobacterium tuberculosis
AKIAFTGAVLGGGG

SEQ ID NO: 122959 - protein, 14 aa, Mycobacterium tuberculosis
KIAFTGAVLGGGGI

SEQ ID NO: 122960 - protein, 14 aa, Mycobacterium tuberculosis
IAFTGAVLGGGGIA

SEQ ID NO: 122961 - protein, 14 aa, Mycobacterium tuberculosis
AFTGAVLGGGGIAM

SEQ ID NO: 122962 - protein, 14 aa, Mycobacterium tuberculosis
FTGAVLGGGGIAMA

SEQ ID NO: 122963 - protein, 14 aa, Mycobacterium tuberculosis
TGAVLGGGGIAMAA

SEQ ID NO: 122964 - protein, 14 aa, Mycobacterium tuberculosis
GAVLGGGGIAMAAQ

SEQ ID NO: 122965 - protein, 14 aa, Mycobacterium tuberculosis
AVLGGGGIAMAAQA

SEQ ID NO: 122966 - protein, 14 aa, Mycobacterium tuberculosis
VLGGGGIAMAAQAT

SEQ ID NO: 122967 - protein, 14 aa, Mycobacterium tuberculosis
LGGGGIAMAAQATA

SEQ ID NO: 122968 - protein, 14 aa, Mycobacterium tuberculosis
GGGGIAMAAQATAA

SEQ ID NO: 122969 - protein, 14 aa, Mycobacterium tuberculosis
GGGIAMAAQATAAT

SEQ ID NO: 122970 - protein, 14 aa, Mycobacterium tuberculosis
GGIAMAAQATAATD

SEQ ID NO: 122971 - protein, 14 aa, Mycobacterium tuberculosis
GIAMAAQATAATDG

SEQ ID NO: 122972 - protein, 14 aa, Mycobacterium tuberculosis
IAMAAQATAATDGE

SEQ ID NO: 122973 - protein, 14 aa, Mycobacterium tuberculosis
AMAAQATAATDGEW

SEQ ID NO: 122974 - protein, 14 aa, Mycobacterium tuberculosis
MAAQATAATDGEWD

SEQ ID NO: 122975 - protein, 14 aa, Mycobacterium tuberculosis
AAQATAATDGEWDQ

SEQ ID NO: 122976 - protein, 14 aa, Mycobacterium tuberculosis
AQATAATDGEWDQV

SEQ ID NO: 122977 - protein, 14 aa, Mycobacterium tuberculosis
QATAATDGEWDQVA

SEQ ID NO: 122978 - protein, 14 aa, Mycobacterium tuberculosis
ATAATDGEWDQVAR

SEQ ID NO: 122979 - protein, 14 aa, Mycobacterium tuberculosis
TAATDGEWDQVARC

SEQ ID NO: 122980 - protein, 14 aa, Mycobacterium tuberculosis
AATDGEWDQVARCE

SEQ ID NO: 122981 - protein, 14 aa, Mycobacterium tuberculosis
ATDGEWDQVARCES

SEQ ID NO: 122982 - protein, 14 aa, Mycobacterium tuberculosis
TDGEWDQVARCESG

SEQ ID NO: 122983 - protein, 14 aa, Mycobacterium tuberculosis
DGEWDQVARCESGG

SEQ ID NO: 122984 - protein, 14 aa, Mycobacterium tuberculosis
GEWDQVARCESGGN

SEQ ID NO: 122985 - protein, 14 aa, Mycobacterium tuberculosis
EWDQVARCESGGNW

SEQ ID NO: 122986 - protein, 14 aa, Mycobacterium tuberculosis
WDQVARCESGGNWS

SEQ ID NO: 122987 - protein, 14 aa, Mycobacterium tuberculosis
DQVARCESGGNWSI

SEQ ID NO: 122988 - protein, 14 aa, Mycobacterium tuberculosis
QVARCESGGNWSIN

SEQ ID NO: 122989 - protein, 14 aa, Mycobacterium tuberculosis
VARCESGGNWSINT

SEQ ID NO: 122990 - protein, 14 aa, Mycobacterium tuberculosis
ARCESGGNWSINTG

SEQ ID NO: 122991 - protein, 14 aa, Mycobacterium tuberculosis
RCESGGNWSINTGN

SEQ ID NO: 122992 - protein, 14 aa, Mycobacterium tuberculosis
CESGGNWSINTGNG

SEQ ID NO: 122993 - protein, 14 aa, Mycobacterium tuberculosis
ESGGNWSINTGNGY

SEQ ID NO: 122994 - protein, 14 aa, Mycobacterium tuberculosis
SGGNWSINTGNGYL

SEQ ID NO: 122995 - protein, 14 aa, Mycobacterium tuberculosis
GGNWSINTGNGYLG

SEQ ID NO: 122996 - protein, 14 aa, Mycobacterium tuberculosis
GNWSINTGNGYLGG

SEQ ID NO: 122997 - protein, 14 aa, Mycobacterium tuberculosis
NWSINTGNGYLGGL

SEQ ID NO: 122998 - protein, 14 aa, Mycobacterium tuberculosis
WSINTGNGYLGGLQ

SEQ ID NO: 122999 - protein, 14 aa, Mycobacterium tuberculosis
SINTGNGYLGGLQF

SEQ ID NO: 123000 - protein, 14 aa, Mycobacterium tuberculosis
INTGNGYLGGLQFT

SEQ ID NO: 123001 - protein, 14 aa, Mycobacterium tuberculosis
NTGNGYLGGLQFTQ

SEQ ID NO: 123002 - protein, 14 aa, Mycobacterium tuberculosis
TGNGYLGGLQFTQS

SEQ ID NO: 123003 - protein, 14 aa, Mycobacterium tuberculosis
GNGYLGGLQFTQST

SEQ ID NO: 123004 - protein, 14 aa, Mycobacterium tuberculosis
NGYLGGLQFTQSTW

SEQ ID NO: 123005 - protein, 14 aa, Mycobacterium tuberculosis
GYLGGLQFTQSTWA

SEQ ID NO: 123006 - protein, 14 aa, Mycobacterium tuberculosis
YLGGLQFTQSTWAA

SEQ ID NO: 123007 - protein, 14 aa, Mycobacterium tuberculosis
LGGLQFTQSTWAAH

SEQ ID NO: 123008 - protein, 14 aa, Mycobacterium tuberculosis
GGLQFTQSTWAAHG

SEQ ID NO: 123009 - protein, 14 aa, Mycobacterium tuberculosis
GLQFTQSTWAAHGG

SEQ ID NO: 123010 - protein, 14 aa, Mycobacterium tuberculosis
LQFTQSTWAAHGGG

SEQ ID NO: 123011 - protein, 14 aa, Mycobacterium tuberculosis
QFTQSTWAAHGGGE

SEQ ID NO: 123012 - protein, 14 aa, Mycobacterium tuberculosis
FTQSTWAAHGGGEF

SEQ ID NO: 123013 - protein, 14 aa, Mycobacterium tuberculosis
TQSTWAAHGGGEFA

SEQ ID NO: 123014 - protein, 14 aa, Mycobacterium tuberculosis
QSTWAAHGGGEFAP

SEQ ID NO: 123015 - protein, 14 aa, Mycobacterium tuberculosis
STWAAHGGGEFAPS

SEQ ID NO: 123016 - protein, 14 aa, Mycobacterium tuberculosis
TWAAHGGGEFAPSA

SEQ ID NO: 123017 - protein, 14 aa, Mycobacterium tuberculosis
WAAHGGGEFAPSAQ

SEQ ID NO: 123018 - protein, 14 aa, Mycobacterium tuberculosis
AAHGGGEFAPSAQL

SEQ ID NO: 123019 - protein, 14 aa, Mycobacterium tuberculosis
AHGGGEFAPSAQLA

SEQ ID NO: 123020 - protein, 14 aa, Mycobacterium tuberculosis
HGGGEFAPSAQLAS

SEQ ID NO: 123021 - protein, 14 aa, Mycobacterium tuberculosis
GGGEFAPSAQLASR

SEQ ID NO: 123022 - protein, 14 aa, Mycobacterium tuberculosis
GGEFAPSAQLASRE

SEQ ID NO: 123023 - protein, 14 aa, Mycobacterium tuberculosis
GEFAPSAQLASREQ

SEQ ID NO: 123024 - protein, 14 aa, Mycobacterium tuberculosis
EFAPSAQLASREQQ

SEQ ID NO: 123025 - protein, 14 aa, Mycobacterium tuberculosis
FAPSAQLASREQQI

SEQ ID NO: 123026 - protein, 14 aa, Mycobacterium tuberculosis
APSAQLASREQQIA

SEQ ID NO: 123027 - protein, 14 aa, Mycobacterium tuberculosis
PSAQLASREQQIAV

SEQ ID NO: 123028 - protein, 14 aa, Mycobacterium tuberculosis
SAQLASREQQIAVG

SEQ ID NO: 123029 - protein, 14 aa, Mycobacterium tuberculosis
AQLASREQQIAVGE

SEQ ID NO: 123030 - protein, 14 aa, Mycobacterium tuberculosis
QLASREQQIAVGER

SEQ ID NO: 123031 - protein, 14 aa, Mycobacterium tuberculosis
LASREQQIAVGERV

SEQ ID NO: 123032 - protein, 14 aa, Mycobacterium tuberculosis
ASREQQIAVGERVL

SEQ ID NO: 123033 - protein, 14 aa, Mycobacterium tuberculosis
SREQQIAVGERVLA

SEQ ID NO: 123034 - protein, 14 aa, Mycobacterium tuberculosis
REQQIAVGERVLAT

SEQ ID NO: 123035 - protein, 14 aa, Mycobacterium tuberculosis
EQQIAVGERVLATQ

SEQ ID NO: 123036 - protein, 14 aa, Mycobacterium tuberculosis
QQIAVGERVLATQG

SEQ ID NO: 123037 - protein, 14 aa, Mycobacterium tuberculosis
QIAVGERVLATQGR

SEQ ID NO: 123038 - protein, 14 aa, Mycobacterium tuberculosis
IAVGERVLATQGRG

SEQ ID NO: 123039 - protein, 14 aa, Mycobacterium tuberculosis
AVGERVLATQGRGA

SEQ ID NO: 123040 - protein, 14 aa, Mycobacterium tuberculosis
VGERVLATQGRGAW

SEQ ID NO: 123041 - protein, 14 aa, Mycobacterium tuberculosis
GERVLATQGRGAWP

SEQ ID NO: 123042 - protein, 14 aa, Mycobacterium tuberculosis
ERVLATQGRGAWPV

SEQ ID NO: 123043 - protein, 14 aa, Mycobacterium tuberculosis
RVLATQGRGAWPVC

SEQ ID NO: 123044 - protein, 14 aa, Mycobacterium tuberculosis
VLATQGRGAWPVCG

SEQ ID NO: 123045 - protein, 14 aa, Mycobacterium tuberculosis
LATQGRGAWPVCGR

SEQ ID NO: 123046 - protein, 14 aa, Mycobacterium tuberculosis
ATQGRGAWPVCGRG

SEQ ID NO: 123047 - protein, 14 aa, Mycobacterium tuberculosis
TQGRGAWPVCGRGL

SEQ ID NO: 123048 - protein, 14 aa, Mycobacterium tuberculosis
QGRGAWPVCGRGLS

SEQ ID NO: 123049 - protein, 14 aa, Mycobacterium tuberculosis
GRGAWPVCGRGLSN

SEQ ID NO: 123050 - protein, 14 aa, Mycobacterium tuberculosis
RGAWPVCGRGLSNA

SEQ ID NO: 123051 - protein, 14 aa, Mycobacterium tuberculosis
GAWPVCGRGLSNAT

SEQ ID NO: 123052 - protein, 14 aa, Mycobacterium tuberculosis
AWPVCGRGLSNATP

SEQ ID NO: 123053 - protein, 14 aa, Mycobacterium tuberculosis
WPVCGRGLSNATPR

SEQ ID NO: 123054 - protein, 14 aa, Mycobacterium tuberculosis
PVCGRGLSNATPRE

SEQ ID NO: 123055 - protein, 14 aa, Mycobacterium tuberculosis
VCGRGLSNATPREV

SEQ ID NO: 123056 - protein, 14 aa, Mycobacterium tuberculosis
CGRGLSNATPREVL

SEQ ID NO: 123057 - protein, 14 aa, Mycobacterium tuberculosis
GRGLSNATPREVLP

SEQ ID NO: 123058 - protein, 14 aa, Mycobacterium tuberculosis
RGLSNATPREVLPA

SEQ ID NO: 123059 - protein, 14 aa, Mycobacterium tuberculosis
GLSNATPREVLPAS

SEQ ID NO: 123060 - protein, 14 aa, Mycobacterium tuberculosis
LSNATPREVLPASA

SEQ ID NO: 123061 - protein, 14 aa, Mycobacterium tuberculosis
SNATPREVLPASAA

SEQ ID NO: 123062 - protein, 14 aa, Mycobacterium tuberculosis
NATPREVLPASAAM

SEQ ID NO: 123063 - protein, 14 aa, Mycobacterium tuberculosis
ATPREVLPASAAMD

SEQ ID NO: 123064 - protein, 14 aa, Mycobacterium tuberculosis
TPREVLPASAAMDA

SEQ ID NO: 123065 - protein, 14 aa, Mycobacterium tuberculosis
PREVLPASAAMDAP

SEQ ID NO: 123066 - protein, 14 aa, Mycobacterium tuberculosis
REVLPASAAMDAPL

SEQ ID NO: 123067 - protein, 14 aa, Mycobacterium tuberculosis
EVLPASAAMDAPLD

SEQ ID NO: 123068 - protein, 14 aa, Mycobacterium tuberculosis
VLPASAAMDAPLDA

SEQ ID NO: 123069 - protein, 14 aa, Mycobacterium tuberculosis
LPASAAMDAPLDAA

SEQ ID NO: 123070 - protein, 14 aa, Mycobacterium tuberculosis
PASAAMDAPLDAAA

SEQ ID NO: 123071 - protein, 14 aa, Mycobacterium tuberculosis
ASAAMDAPLDAAAV

SEQ ID NO: 123072 - protein, 14 aa, Mycobacterium tuberculosis
SAAMDAPLDAAAVN

SEQ ID NO: 123073 - protein, 14 aa, Mycobacterium tuberculosis
AAMDAPLDAAAVNG

SEQ ID NO: 123074 - protein, 14 aa, Mycobacterium tuberculosis
AMDAPLDAAAVNGE

SEQ ID NO: 123075 - protein, 14 aa, Mycobacterium tuberculosis
MDAPLDAAAVNGEP

SEQ ID NO: 123076 - protein, 14 aa, Mycobacterium tuberculosis
DAPLDAAAVNGEPA

SEQ ID NO: 123077 - protein, 14 aa, Mycobacterium tuberculosis
APLDAAAVNGEPAP

SEQ ID NO: 123078 - protein, 14 aa, Mycobacterium tuberculosis
PLDAAAVNGEPAPL

SEQ ID NO: 123079 - protein, 14 aa, Mycobacterium tuberculosis
LDAAAVNGEPAPLA

SEQ ID NO: 123080 - protein, 14 aa, Mycobacterium tuberculosis
DAAAVNGEPAPLAP

SEQ ID NO: 123081 - protein, 14 aa, Mycobacterium tuberculosis
AAAVNGEPAPLAPP

SEQ ID NO: 123082 - protein, 14 aa, Mycobacterium tuberculosis
AAVNGEPAPLAPPP

SEQ ID NO: 123083 - protein, 14 aa, Mycobacterium tuberculosis
AVNGEPAPLAPPPA

SEQ ID NO: 123084 - protein, 14 aa, Mycobacterium tuberculosis
VNGEPAPLAPPPAD

SEQ ID NO: 123085 - protein, 14 aa, Mycobacterium tuberculosis
NGEPAPLAPPPADP

SEQ ID NO: 123086 - protein, 14 aa, Mycobacterium tuberculosis
GEPAPLAPPPADPA

SEQ ID NO: 123087 - protein, 14 aa, Mycobacterium tuberculosis
EPAPLAPPPADPAP

SEQ ID NO: 123088 - protein, 14 aa, Mycobacterium tuberculosis
PAPLAPPPADPAPP

SEQ ID NO: 123089 - protein, 14 aa, Mycobacterium tuberculosis
APLAPPPADPAPPV

SEQ ID NO: 123090 - protein, 14 aa, Mycobacterium tuberculosis
PLAPPPADPAPPVE

SEQ ID NO: 123091 - protein, 14 aa, Mycobacterium tuberculosis
LAPPPADPAPPVEL

SEQ ID NO: 123092 - protein, 14 aa, Mycobacterium tuberculosis
APPPADPAPPVELA

SEQ ID NO: 123093 - protein, 14 aa, Mycobacterium tuberculosis
PPPADPAPPVELAA

SEQ ID NO: 123094 - protein, 14 aa, Mycobacterium tuberculosis
PPADPAPPVELAAN

SEQ ID NO: 123095 - protein, 14 aa, Mycobacterium tuberculosis
PADPAPPVELAAND

SEQ ID NO: 123096 - protein, 14 aa, Mycobacterium tuberculosis
ADPAPPVELAANDL

SEQ ID NO: 123097 - protein, 14 aa, Mycobacterium tuberculosis
DPAPPVELAANDLP

SEQ ID NO: 123098 - protein, 14 aa, Mycobacterium tuberculosis
PAPPVELAANDLPA

SEQ ID NO: 123099 - protein, 14 aa, Mycobacterium tuberculosis
APPVELAANDLPAP

SEQ ID NO: 123100 - protein, 14 aa, Mycobacterium tuberculosis
PPVELAANDLPAPL

SEQ ID NO: 123101 - protein, 14 aa, Mycobacterium tuberculosis
PVELAANDLPAPLG

SEQ ID NO: 123102 - protein, 14 aa, Mycobacterium tuberculosis
VELAANDLPAPLGE

SEQ ID NO: 123103 - protein, 14 aa, Mycobacterium tuberculosis
ELAANDLPAPLGEP

SEQ ID NO: 123104 - protein, 14 aa, Mycobacterium tuberculosis
LAANDLPAPLGEPL

SEQ ID NO: 123105 - protein, 14 aa, Mycobacterium tuberculosis
AANDLPAPLGEPLP

SEQ ID NO: 123106 - protein, 14 aa, Mycobacterium tuberculosis
ANDLPAPLGEPLPA

SEQ ID NO: 123107 - protein, 14 aa, Mycobacterium tuberculosis
NDLPAPLGEPLPAA

SEQ ID NO: 123108 - protein, 14 aa, Mycobacterium tuberculosis
DLPAPLGEPLPAAP

SEQ ID NO: 123109 - protein, 14 aa, Mycobacterium tuberculosis
LPAPLGEPLPAAPA

SEQ ID NO: 123110 - protein, 14 aa, Mycobacterium tuberculosis
PAPLGEPLPAAPAD

SEQ ID NO: 123111 - protein, 14 aa, Mycobacterium tuberculosis
APLGEPLPAAPADP

SEQ ID NO: 123112 - protein, 14 aa, Mycobacterium tuberculosis
PLGEPLPAAPADPA

SEQ ID NO: 123113 - protein, 14 aa, Mycobacterium tuberculosis
LGEPLPAAPADPAP

SEQ ID NO: 123114 - protein, 14 aa, Mycobacterium tuberculosis
GEPLPAAPADPAPP

SEQ ID NO: 123115 - protein, 14 aa, Mycobacterium tuberculosis
EPLPAAPADPAPPA

SEQ ID NO: 123116 - protein, 14 aa, Mycobacterium tuberculosis
PLPAAPADPAPPAD

SEQ ID NO: 123117 - protein, 14 aa, Mycobacterium tuberculosis
LPAAPADPAPPADL

SEQ ID NO: 123118 - protein, 14 aa, Mycobacterium tuberculosis
PAAPADPAPPADLA

SEQ ID NO: 123119 - protein, 14 aa, Mycobacterium tuberculosis
AAPADPAPPADLAP

SEQ ID NO: 123120 - protein, 14 aa, Mycobacterium tuberculosis
APADPAPPADLAPP

SEQ ID NO: 123121 - protein, 14 aa, Mycobacterium tuberculosis
PADPAPPADLAPPA

SEQ ID NO: 123122 - protein, 14 aa, Mycobacterium tuberculosis
ADPAPPADLAPPAP

SEQ ID NO: 123123 - protein, 14 aa, Mycobacterium tuberculosis
DPAPPADLAPPAPA

SEQ ID NO: 123124 - protein, 14 aa, Mycobacterium tuberculosis
PAPPADLAPPAPAD

SEQ ID NO: 123125 - protein, 14 aa, Mycobacterium tuberculosis
APPADLAPPAPADV

SEQ ID NO: 123126 - protein, 14 aa, Mycobacterium tuberculosis
PPADLAPPAPADVA

SEQ ID NO: 123127 - protein, 14 aa, Mycobacterium tuberculosis
PADLAPPAPADVAP

SEQ ID NO: 123128 - protein, 14 aa, Mycobacterium tuberculosis
ADLAPPAPADVAPP

SEQ ID NO: 123129 - protein, 14 aa, Mycobacterium tuberculosis
DLAPPAPADVAPPV

SEQ ID NO: 123130 - protein, 14 aa, Mycobacterium tuberculosis
LAPPAPADVAPPVE

SEQ ID NO: 123131 - protein, 14 aa, Mycobacterium tuberculosis
APPAPADVAPPVEL

SEQ ID NO: 123132 - protein, 14 aa, Mycobacterium tuberculosis
PPAPADVAPPVELA

SEQ ID NO: 123133 - protein, 14 aa, Mycobacterium tuberculosis
PAPADVAPPVELAV

SEQ ID NO: 123134 - protein, 14 aa, Mycobacterium tuberculosis
APADVAPPVELAVN

SEQ ID NO: 123135 - protein, 14 aa, Mycobacterium tuberculosis
PADVAPPVELAVND

SEQ ID NO: 123136 - protein, 14 aa, Mycobacterium tuberculosis
ADVAPPVELAVNDL

SEQ ID NO: 123137 - protein, 14 aa, Mycobacterium tuberculosis
DVAPPVELAVNDLP

SEQ ID NO: 123138 - protein, 14 aa, Mycobacterium tuberculosis
VAPPVELAVNDLPA

SEQ ID NO: 123139 - protein, 14 aa, Mycobacterium tuberculosis
APPVELAVNDLPAP

SEQ ID NO: 123140 - protein, 14 aa, Mycobacterium tuberculosis
PPVELAVNDLPAPL

SEQ ID NO: 123141 - protein, 14 aa, Mycobacterium tuberculosis
PVELAVNDLPAPLG

SEQ ID NO: 123142 - protein, 14 aa, Mycobacterium tuberculosis
VELAVNDLPAPLGE

SEQ ID NO: 123143 - protein, 14 aa, Mycobacterium tuberculosis
ELAVNDLPAPLGEP

SEQ ID NO: 123144 - protein, 14 aa, Mycobacterium tuberculosis
LAVNDLPAPLGEPL

SEQ ID NO: 123145 - protein, 14 aa, Mycobacterium tuberculosis
AVNDLPAPLGEPLP

SEQ ID NO: 123146 - protein, 14 aa, Mycobacterium tuberculosis
VNDLPAPLGEPLPA

SEQ ID NO: 123147 - protein, 14 aa, Mycobacterium tuberculosis
NDLPAPLGEPLPAA

SEQ ID NO: 123148 - protein, 14 aa, Mycobacterium tuberculosis
DLPAPLGEPLPAAP

SEQ ID NO: 123149 - protein, 14 aa, Mycobacterium tuberculosis
LPAPLGEPLPAAPA

SEQ ID NO: 123150 - protein, 14 aa, Mycobacterium tuberculosis
PAPLGEPLPAAPAD

SEQ ID NO: 123151 - protein, 14 aa, Mycobacterium tuberculosis
APLGEPLPAAPADP

SEQ ID NO: 123152 - protein, 14 aa, Mycobacterium tuberculosis
PLGEPLPAAPADPA

SEQ ID NO: 123153 - protein, 14 aa, Mycobacterium tuberculosis
LGEPLPAAPADPAP

SEQ ID NO: 123154 - protein, 14 aa, Mycobacterium tuberculosis
GEPLPAAPADPAPP

SEQ ID NO: 123155 - protein, 14 aa, Mycobacterium tuberculosis
EPLPAAPADPAPPA

SEQ ID NO: 123156 - protein, 14 aa, Mycobacterium tuberculosis
PLPAAPADPAPPAD

SEQ ID NO: 123157 - protein, 14 aa, Mycobacterium tuberculosis
LPAAPADPAPPADL

SEQ ID NO: 123158 - protein, 14 aa, Mycobacterium tuberculosis
PAAPADPAPPADLA

SEQ ID NO: 123159 - protein, 14 aa, Mycobacterium tuberculosis
AAPADPAPPADLAP

SEQ ID NO: 123160 - protein, 14 aa, Mycobacterium tuberculosis
APADPAPPADLAPP

SEQ ID NO: 123161 - protein, 14 aa, Mycobacterium tuberculosis
PADPAPPADLAPPA

SEQ ID NO: 123162 - protein, 14 aa, Mycobacterium tuberculosis
ADPAPPADLAPPAP

SEQ ID NO: 123163 - protein, 14 aa, Mycobacterium tuberculosis
DPAPPADLAPPAPA

SEQ ID NO: 123164 - protein, 14 aa, Mycobacterium tuberculosis
PAPPADLAPPAPAD

SEQ ID NO: 123165 - protein, 14 aa, Mycobacterium tuberculosis
APPADLAPPAPADL

SEQ ID NO: 123166 - protein, 14 aa, Mycobacterium tuberculosis
PPADLAPPAPADLA

SEQ ID NO: 123167 - protein, 14 aa, Mycobacterium tuberculosis
PADLAPPAPADLAP

SEQ ID NO: 123168 - protein, 14 aa, Mycobacterium tuberculosis
ADLAPPAPADLAPP

SEQ ID NO: 123169 - protein, 14 aa, Mycobacterium tuberculosis
DLAPPAPADLAPPA

SEQ ID NO: 123170 - protein, 14 aa, Mycobacterium tuberculosis
LAPPAPADLAPPAP

SEQ ID NO: 123171 - protein, 14 aa, Mycobacterium tuberculosis
APPAPADLAPPAPA

SEQ ID NO: 123172 - protein, 14 aa, Mycobacterium tuberculosis
PPAPADLAPPAPAD

SEQ ID NO: 123173 - protein, 14 aa, Mycobacterium tuberculosis
PAPADLAPPAPADL

SEQ ID NO: 123174 - protein, 14 aa, Mycobacterium tuberculosis
APADLAPPAPADLA

SEQ ID NO: 123175 - protein, 14 aa, Mycobacterium tuberculosis
PADLAPPAPADLAP

SEQ ID NO: 123176 - protein, 14 aa, Mycobacterium tuberculosis
ADLAPPAPADLAPP

SEQ ID NO: 123177 - protein, 14 aa, Mycobacterium tuberculosis
DLAPPAPADLAPPA

SEQ ID NO: 123178 - protein, 14 aa, Mycobacterium tuberculosis
LAPPAPADLAPPAP

SEQ ID NO: 123179 - protein, 14 aa, Mycobacterium tuberculosis
APPAPADLAPPAPA

SEQ ID NO: 123180 - protein, 14 aa, Mycobacterium tuberculosis
PPAPADLAPPAPAD

SEQ ID NO: 123181 - protein, 14 aa, Mycobacterium tuberculosis
PAPADLAPPAPADL

SEQ ID NO: 123182 - protein, 14 aa, Mycobacterium tuberculosis
APADLAPPAPADLA

SEQ ID NO: 123183 - protein, 14 aa, Mycobacterium tuberculosis
PADLAPPAPADLAP

SEQ ID NO: 123184 - protein, 14 aa, Mycobacterium tuberculosis
ADLAPPAPADLAPP

SEQ ID NO: 123185 - protein, 14 aa, Mycobacterium tuberculosis
DLAPPAPADLAPPV

SEQ ID NO: 123186 - protein, 14 aa, Mycobacterium tuberculosis
LAPPAPADLAPPVE

SEQ ID NO: 123187 - protein, 14 aa, Mycobacterium tuberculosis
APPAPADLAPPVEL

SEQ ID NO: 123188 - protein, 14 aa, Mycobacterium tuberculosis
PPAPADLAPPVELA

SEQ ID NO: 123189 - protein, 14 aa, Mycobacterium tuberculosis
PAPADLAPPVELAV

SEQ ID NO: 123190 - protein, 14 aa, Mycobacterium tuberculosis
APADLAPPVELAVN

SEQ ID NO: 123191 - protein, 14 aa, Mycobacterium tuberculosis
PADLAPPVELAVND

SEQ ID NO: 123192 - protein, 14 aa, Mycobacterium tuberculosis
ADLAPPVELAVNDL

SEQ ID NO: 123193 - protein, 14 aa, Mycobacterium tuberculosis
DLAPPVELAVNDLP

SEQ ID NO: 123194 - protein, 14 aa, Mycobacterium tuberculosis
LAPPVELAVNDLPA

SEQ ID NO: 123195 - protein, 14 aa, Mycobacterium tuberculosis
APPVELAVNDLPAP

SEQ ID NO: 123196 - protein, 14 aa, Mycobacterium tuberculosis
PPVELAVNDLPAPL

SEQ ID NO: 123197 - protein, 14 aa, Mycobacterium tuberculosis
PVELAVNDLPAPLG

SEQ ID NO: 123198 - protein, 14 aa, Mycobacterium tuberculosis
VELAVNDLPAPLGE

SEQ ID NO: 123199 - protein, 14 aa, Mycobacterium tuberculosis
ELAVNDLPAPLGEP

SEQ ID NO: 123200 - protein, 14 aa, Mycobacterium tuberculosis
LAVNDLPAPLGEPL

SEQ ID NO: 123201 - protein, 14 aa, Mycobacterium tuberculosis
AVNDLPAPLGEPLP

SEQ ID NO: 123202 - protein, 14 aa, Mycobacterium tuberculosis
VNDLPAPLGEPLPA

SEQ ID NO: 123203 - protein, 14 aa, Mycobacterium tuberculosis
NDLPAPLGEPLPAA

SEQ ID NO: 123204 - protein, 14 aa, Mycobacterium tuberculosis
DLPAPLGEPLPAAP

SEQ ID NO: 123205 - protein, 14 aa, Mycobacterium tuberculosis
LPAPLGEPLPAAPA

SEQ ID NO: 123206 - protein, 14 aa, Mycobacterium tuberculosis
PAPLGEPLPAAPAE

SEQ ID NO: 123207 - protein, 14 aa, Mycobacterium tuberculosis
APLGEPLPAAPAEL

SEQ ID NO: 123208 - protein, 14 aa, Mycobacterium tuberculosis
PLGEPLPAAPAELA

SEQ ID NO: 123209 - protein, 14 aa, Mycobacterium tuberculosis
LGEPLPAAPAELAP

SEQ ID NO: 123210 - protein, 14 aa, Mycobacterium tuberculosis
GEPLPAAPAELAPP

SEQ ID NO: 123211 - protein, 14 aa, Mycobacterium tuberculosis
EPLPAAPAELAPPA

SEQ ID NO: 123212 - protein, 14 aa, Mycobacterium tuberculosis
PLPAAPAELAPPAD

SEQ ID NO: 123213 - protein, 14 aa, Mycobacterium tuberculosis
LPAAPAELAPPADL

SEQ ID NO: 123214 - protein, 14 aa, Mycobacterium tuberculosis
PAAPAELAPPADLA

SEQ ID NO: 123215 - protein, 14 aa, Mycobacterium tuberculosis
AAPAELAPPADLAP

SEQ ID NO: 123216 - protein, 14 aa, Mycobacterium tuberculosis
APAELAPPADLAPA

SEQ ID NO: 123217 - protein, 14 aa, Mycobacterium tuberculosis
PAELAPPADLAPAS

SEQ ID NO: 123218 - protein, 14 aa, Mycobacterium tuberculosis
AELAPPADLAPASA

SEQ ID NO: 123219 - protein, 14 aa, Mycobacterium tuberculosis
ELAPPADLAPASAD

SEQ ID NO: 123220 - protein, 14 aa, Mycobacterium tuberculosis
LAPPADLAPASADL

SEQ ID NO: 123221 - protein, 14 aa, Mycobacterium tuberculosis
APPADLAPASADLA

SEQ ID NO: 123222 - protein, 14 aa, Mycobacterium tuberculosis
PPADLAPASADLAP

SEQ ID NO: 123223 - protein, 14 aa, Mycobacterium tuberculosis
PADLAPASADLAPP

SEQ ID NO: 123224 - protein, 14 aa, Mycobacterium tuberculosis
ADLAPASADLAPPA

SEQ ID NO: 123225 - protein, 14 aa, Mycobacterium tuberculosis
DLAPASADLAPPAP

SEQ ID NO: 123226 - protein, 14 aa, Mycobacterium tuberculosis
LAPASADLAPPAPA

SEQ ID NO: 123227 - protein, 14 aa, Mycobacterium tuberculosis
APASADLAPPAPAD

SEQ ID NO: 123228 - protein, 14 aa, Mycobacterium tuberculosis
PASADLAPPAPADL

SEQ ID NO: 123229 - protein, 14 aa, Mycobacterium tuberculosis
ASADLAPPAPADLA

SEQ ID NO: 123230 - protein, 14 aa, Mycobacterium tuberculosis
SADLAPPAPADLAP

SEQ ID NO: 123231 - protein, 14 aa, Mycobacterium tuberculosis
ADLAPPAPADLAPP

SEQ ID NO: 123232 - protein, 14 aa, Mycobacterium tuberculosis
DLAPPAPADLAPPA

SEQ ID NO: 123233 - protein, 14 aa, Mycobacterium tuberculosis
LAPPAPADLAPPAP

SEQ ID NO: 123234 - protein, 14 aa, Mycobacterium tuberculosis
APPAPADLAPPAPA

SEQ ID NO: 123235 - protein, 14 aa, Mycobacterium tuberculosis
PPAPADLAPPAPAE

SEQ ID NO: 123236 - protein, 14 aa, Mycobacterium tuberculosis
PAPADLAPPAPAEL

SEQ ID NO: 123237 - protein, 14 aa, Mycobacterium tuberculosis
APADLAPPAPAELA

SEQ ID NO: 123238 - protein, 14 aa, Mycobacterium tuberculosis
PADLAPPAPAELAP

SEQ ID NO: 123239 - protein, 14 aa, Mycobacterium tuberculosis
ADLAPPAPAELAPP

SEQ ID NO: 123240 - protein, 14 aa, Mycobacterium tuberculosis
DLAPPAPAELAPPA

SEQ ID NO: 123241 - protein, 14 aa, Mycobacterium tuberculosis
LAPPAPAELAPPAP

SEQ ID NO: 123242 - protein, 14 aa, Mycobacterium tuberculosis
APPAPAELAPPAPA

SEQ ID NO: 123243 - protein, 14 aa, Mycobacterium tuberculosis
PPAPAELAPPAPAD

SEQ ID NO: 123244 - protein, 14 aa, Mycobacterium tuberculosis
PAPAELAPPAPADL

SEQ ID NO: 123245 - protein, 14 aa, Mycobacterium tuberculosis
APAELAPPAPADLA

SEQ ID NO: 123246 - protein, 14 aa, Mycobacterium tuberculosis
PAELAPPAPADLAP

SEQ ID NO: 123247 - protein, 14 aa, Mycobacterium tuberculosis
AELAPPAPADLAPP

SEQ ID NO: 123248 - protein, 14 aa, Mycobacterium tuberculosis
ELAPPAPADLAPPA

SEQ ID NO: 123249 - protein, 14 aa, Mycobacterium tuberculosis
LAPPAPADLAPPAA

SEQ ID NO: 123250 - protein, 14 aa, Mycobacterium tuberculosis
APPAPADLAPPAAV

SEQ ID NO: 123251 - protein, 14 aa, Mycobacterium tuberculosis
PPAPADLAPPAAVN

SEQ ID NO: 123252 - protein, 14 aa, Mycobacterium tuberculosis
PAPADLAPPAAVNE

SEQ ID NO: 123253 - protein, 14 aa, Mycobacterium tuberculosis
APADLAPPAAVNEQ

SEQ ID NO: 123254 - protein, 14 aa, Mycobacterium tuberculosis
PADLAPPAAVNEQT

SEQ ID NO: 123255 - protein, 14 aa, Mycobacterium tuberculosis
ADLAPPAAVNEQTA

SEQ ID NO: 123256 - protein, 14 aa, Mycobacterium tuberculosis
DLAPPAAVNEQTAP

SEQ ID NO: 123257 - protein, 14 aa, Mycobacterium tuberculosis
LAPPAAVNEQTAPG

SEQ ID NO: 123258 - protein, 14 aa, Mycobacterium tuberculosis
APPAAVNEQTAPGD

SEQ ID NO: 123259 - protein, 14 aa, Mycobacterium tuberculosis
PPAAVNEQTAPGDQ

SEQ ID NO: 123260 - protein, 14 aa, Mycobacterium tuberculosis
PAAVNEQTAPGDQP

SEQ ID NO: 123261 - protein, 14 aa, Mycobacterium tuberculosis
AAVNEQTAPGDQPA

SEQ ID NO: 123262 - protein, 14 aa, Mycobacterium tuberculosis
AVNEQTAPGDQPAT

SEQ ID NO: 123263 - protein, 14 aa, Mycobacterium tuberculosis
VNEQTAPGDQPATA

SEQ ID NO: 123264 - protein, 14 aa, Mycobacterium tuberculosis
NEQTAPGDQPATAP

SEQ ID NO: 123265 - protein, 14 aa, Mycobacterium tuberculosis
EQTAPGDQPATAPG

SEQ ID NO: 123266 - protein, 14 aa, Mycobacterium tuberculosis
QTAPGDQPATAPGG

SEQ ID NO: 123267 - protein, 14 aa, Mycobacterium tuberculosis
TAPGDQPATAPGGP

SEQ ID NO: 123268 - protein, 14 aa, Mycobacterium tuberculosis
APGDQPATAPGGPV

SEQ ID NO: 123269 - protein, 14 aa, Mycobacterium tuberculosis
PGDQPATAPGGPVG

SEQ ID NO: 123270 - protein, 14 aa, Mycobacterium tuberculosis
GDQPATAPGGPVGL

SEQ ID NO: 123271 - protein, 14 aa, Mycobacterium tuberculosis
DQPATAPGGPVGLA

SEQ ID NO: 123272 - protein, 14 aa, Mycobacterium tuberculosis
QPATAPGGPVGLAT

SEQ ID NO: 123273 - protein, 14 aa, Mycobacterium tuberculosis
PATAPGGPVGLATD

SEQ ID NO: 123274 - protein, 14 aa, Mycobacterium tuberculosis
ATAPGGPVGLATDL

SEQ ID NO: 123275 - protein, 14 aa, Mycobacterium tuberculosis
TAPGGPVGLATDLE

SEQ ID NO: 123276 - protein, 14 aa, Mycobacterium tuberculosis
APGGPVGLATDLEL

SEQ ID NO: 123277 - protein, 14 aa, Mycobacterium tuberculosis
PGGPVGLATDLELP

SEQ ID NO: 123278 - protein, 14 aa, Mycobacterium tuberculosis
GGPVGLATDLELPE

SEQ ID NO: 123279 - protein, 14 aa, Mycobacterium tuberculosis
GPVGLATDLELPEP

SEQ ID NO: 123280 - protein, 14 aa, Mycobacterium tuberculosis
PVGLATDLELPEPD

SEQ ID NO: 123281 - protein, 14 aa, Mycobacterium tuberculosis
VGLATDLELPEPDP

SEQ ID NO: 123282 - protein, 14 aa, Mycobacterium tuberculosis
GLATDLELPEPDPQ

SEQ ID NO: 123283 - protein, 14 aa, Mycobacterium tuberculosis
LATDLELPEPDPQP

SEQ ID NO: 123284 - protein, 14 aa, Mycobacterium tuberculosis
ATDLELPEPDPQPA

SEQ ID NO: 123285 - protein, 14 aa, Mycobacterium tuberculosis
TDLELPEPDPQPAD

SEQ ID NO: 123286 - protein, 14 aa, Mycobacterium tuberculosis
DLELPEPDPQPADA

SEQ ID NO: 123287 - protein, 14 aa, Mycobacterium tuberculosis
LELPEPDPQPADAP

SEQ ID NO: 123288 - protein, 14 aa, Mycobacterium tuberculosis
ELPEPDPQPADAPP

SEQ ID NO: 123289 - protein, 14 aa, Mycobacterium tuberculosis
LPEPDPQPADAPPP

SEQ ID NO: 123290 - protein, 14 aa, Mycobacterium tuberculosis
PEPDPQPADAPPPG

SEQ ID NO: 123291 - protein, 14 aa, Mycobacterium tuberculosis
EPDPQPADAPPPGD

SEQ ID NO: 123292 - protein, 14 aa, Mycobacterium tuberculosis
PDPQPADAPPPGDV

SEQ ID NO: 123293 - protein, 14 aa, Mycobacterium tuberculosis
DPQPADAPPPGDVT

SEQ ID NO: 123294 - protein, 14 aa, Mycobacterium tuberculosis
PQPADAPPPGDVTE

SEQ ID NO: 123295 - protein, 14 aa, Mycobacterium tuberculosis
QPADAPPPGDVTEA

SEQ ID NO: 123296 - protein, 14 aa, Mycobacterium tuberculosis
PADAPPPGDVTEAP

SEQ ID NO: 123297 - protein, 14 aa, Mycobacterium tuberculosis
ADAPPPGDVTEAPA

SEQ ID NO: 123298 - protein, 14 aa, Mycobacterium tuberculosis
DAPPPGDVTEAPAE

SEQ ID NO: 123299 - protein, 14 aa, Mycobacterium tuberculosis
APPPGDVTEAPAET

SEQ ID NO: 123300 - protein, 14 aa, Mycobacterium tuberculosis
PPPGDVTEAPAETP

SEQ ID NO: 123301 - protein, 14 aa, Mycobacterium tuberculosis
PPGDVTEAPAETPQ

SEQ ID NO: 123302 - protein, 14 aa, Mycobacterium tuberculosis
PGDVTEAPAETPQV

SEQ ID NO: 123303 - protein, 14 aa, Mycobacterium tuberculosis
GDVTEAPAETPQVS

SEQ ID NO: 123304 - protein, 14 aa, Mycobacterium tuberculosis
DVTEAPAETPQVSN

SEQ ID NO: 123305 - protein, 14 aa, Mycobacterium tuberculosis
VTEAPAETPQVSNI

SEQ ID NO: 123306 - protein, 14 aa, Mycobacterium tuberculosis
TEAPAETPQVSNIA

SEQ ID NO: 123307 - protein, 14 aa, Mycobacterium tuberculosis
EAPAETPQVSNIAY

SEQ ID NO: 123308 - protein, 14 aa, Mycobacterium tuberculosis
APAETPQVSNIAYT

SEQ ID NO: 123309 - protein, 14 aa, Mycobacterium tuberculosis
PAETPQVSNIAYTK

SEQ ID NO: 123310 - protein, 14 aa, Mycobacterium tuberculosis
AETPQVSNIAYTKK

SEQ ID NO: 123311 - protein, 14 aa, Mycobacterium tuberculosis
ETPQVSNIAYTKKL

SEQ ID NO: 123312 - protein, 14 aa, Mycobacterium tuberculosis
TPQVSNIAYTKKLW

SEQ ID NO: 123313 - protein, 14 aa, Mycobacterium tuberculosis
PQVSNIAYTKKLWQ

SEQ ID NO: 123314 - protein, 14 aa, Mycobacterium tuberculosis
QVSNIAYTKKLWQA

SEQ ID NO: 123315 - protein, 14 aa, Mycobacterium tuberculosis
VSNIAYTKKLWQAI

SEQ ID NO: 123316 - protein, 14 aa, Mycobacterium tuberculosis
SNIAYTKKLWQAIR

SEQ ID NO: 123317 - protein, 14 aa, Mycobacterium tuberculosis
NIAYTKKLWQAIRA

SEQ ID NO: 123318 - protein, 14 aa, Mycobacterium tuberculosis
IAYTKKLWQAIRAQ

SEQ ID NO: 123319 - protein, 14 aa, Mycobacterium tuberculosis
AYTKKLWQAIRAQD

SEQ ID NO: 123320 - protein, 14 aa, Mycobacterium tuberculosis
YTKKLWQAIRAQDV

SEQ ID NO: 123321 - protein, 14 aa, Mycobacterium tuberculosis
TKKLWQAIRAQDVC

SEQ ID NO: 123322 - protein, 14 aa, Mycobacterium tuberculosis
KKLWQAIRAQDVCG

SEQ ID NO: 123323 - protein, 14 aa, Mycobacterium tuberculosis
KLWQAIRAQDVCGN

SEQ ID NO: 123324 - protein, 14 aa, Mycobacterium tuberculosis
LWQAIRAQDVCGND

SEQ ID NO: 123325 - protein, 14 aa, Mycobacterium tuberculosis
WQAIRAQDVCGNDA

SEQ ID NO: 123326 - protein, 14 aa, Mycobacterium tuberculosis
QAIRAQDVCGNDAL

SEQ ID NO: 123327 - protein, 14 aa, Mycobacterium tuberculosis
AIRAQDVCGNDALD

SEQ ID NO: 123328 - protein, 14 aa, Mycobacterium tuberculosis
IRAQDVCGNDALDS

SEQ ID NO: 123329 - protein, 14 aa, Mycobacterium tuberculosis
RAQDVCGNDALDSL

SEQ ID NO: 123330 - protein, 14 aa, Mycobacterium tuberculosis
AQDVCGNDALDSLA

SEQ ID NO: 123331 - protein, 14 aa, Mycobacterium tuberculosis
QDVCGNDALDSLAQ

SEQ ID NO: 123332 - protein, 14 aa, Mycobacterium tuberculosis
DVCGNDALDSLAQP

SEQ ID NO: 123333 - protein, 14 aa, Mycobacterium tuberculosis
VCGNDALDSLAQPY

SEQ ID NO: 123334 - protein, 14 aa, Mycobacterium tuberculosis
CGNDALDSLAQPYV

SEQ ID NO: 123335 - protein, 14 aa, Mycobacterium tuberculosis
GNDALDSLAQPYVI

SEQ ID NO: 123336 - protein, 14 aa, Mycobacterium tuberculosis
NDALDSLAQPYVIG

SEQ ID NO: 123337 - protein, 15 aa, Mycobacterium tuberculosis
MSGRHRKPTTSNVSV

SEQ ID NO: 123338 - protein, 15 aa, Mycobacterium tuberculosis
SGRHRKPTTSNVSVA

SEQ ID NO: 123339 - protein, 15 aa, Mycobacterium tuberculosis
GRHRKPTTSNVSVAK

SEQ ID NO: 123340 - protein, 15 aa, Mycobacterium tuberculosis
RHRKPTTSNVSVAKI

SEQ ID NO: 123341 - protein, 15 aa, Mycobacterium tuberculosis
HRKPTTSNVSVAKIA

SEQ ID NO: 123342 - protein, 15 aa, Mycobacterium tuberculosis
RKPTTSNVSVAKIAF

SEQ ID NO: 123343 - protein, 15 aa, Mycobacterium tuberculosis
KPTTSNVSVAKIAFT

SEQ ID NO: 123344 - protein, 15 aa, Mycobacterium tuberculosis
PTTSNVSVAKIAFTG

SEQ ID NO: 123345 - protein, 15 aa, Mycobacterium tuberculosis
TTSNVSVAKIAFTGA

SEQ ID NO: 123346 - protein, 15 aa, Mycobacterium tuberculosis
TSNVSVAKIAFTGAV

SEQ ID NO: 123347 - protein, 15 aa, Mycobacterium tuberculosis
SNVSVAKIAFTGAVL

SEQ ID NO: 123348 - protein, 15 aa, Mycobacterium tuberculosis
NVSVAKIAFTGAVLG

SEQ ID NO: 123349 - protein, 15 aa, Mycobacterium tuberculosis
VSVAKIAFTGAVLGG

SEQ ID NO: 123350 - protein, 15 aa, Mycobacterium tuberculosis
SVAKIAFTGAVLGGG

SEQ ID NO: 123351 - protein, 15 aa, Mycobacterium tuberculosis
VAKIAFTGAVLGGGG

SEQ ID NO: 123352 - protein, 15 aa, Mycobacterium tuberculosis
AKIAFTGAVLGGGGI

SEQ ID NO: 123353 - protein, 15 aa, Mycobacterium tuberculosis
KIAFTGAVLGGGGIA

SEQ ID NO: 123354 - protein, 15 aa, Mycobacterium tuberculosis
IAFTGAVLGGGGIAM

SEQ ID NO: 123355 - protein, 15 aa, Mycobacterium tuberculosis
AFTGAVLGGGGIAMA

SEQ ID NO: 123356 - protein, 15 aa, Mycobacterium tuberculosis
FTGAVLGGGGIAMAA

SEQ ID NO: 123357 - protein, 15 aa, Mycobacterium tuberculosis
TGAVLGGGGIAMAAQ

SEQ ID NO: 123358 - protein, 15 aa, Mycobacterium tuberculosis
GAVLGGGGIAMAAQA

SEQ ID NO: 123359 - protein, 15 aa, Mycobacterium tuberculosis
AVLGGGGIAMAAQAT

SEQ ID NO: 123360 - protein, 15 aa, Mycobacterium tuberculosis
VLGGGGIAMAAQATA

SEQ ID NO: 123361 - protein, 15 aa, Mycobacterium tuberculosis
LGGGGIAMAAQATAA

SEQ ID NO: 123362 - protein, 15 aa, Mycobacterium tuberculosis
GGGGIAMAAQATAAT

SEQ ID NO: 123363 - protein, 15 aa, Mycobacterium tuberculosis
GGGIAMAAQATAATD

SEQ ID NO: 123364 - protein, 15 aa, Mycobacterium tuberculosis
GGIAMAAQATAATDG

SEQ ID NO: 123365 - protein, 15 aa, Mycobacterium tuberculosis
GIAMAAQATAATDGE

SEQ ID NO: 123366 - protein, 15 aa, Mycobacterium tuberculosis
IAMAAQATAATDGEW

SEQ ID NO: 123367 - protein, 15 aa, Mycobacterium tuberculosis
AMAAQATAATDGEWD

SEQ ID NO: 123368 - protein, 15 aa, Mycobacterium tuberculosis
MAAQATAATDGEWDQ

SEQ ID NO: 123369 - protein, 15 aa, Mycobacterium tuberculosis
AAQATAATDGEWDQV

SEQ ID NO: 123370 - protein, 15 aa, Mycobacterium tuberculosis
AQATAATDGEWDQVA

SEQ ID NO: 123371 - protein, 15 aa, Mycobacterium tuberculosis
QATAATDGEWDQVAR

SEQ ID NO: 123372 - protein, 15 aa, Mycobacterium tuberculosis
ATAATDGEWDQVARC

SEQ ID NO: 123373 - protein, 15 aa, Mycobacterium tuberculosis
TAATDGEWDQVARCE

SEQ ID NO: 123374 - protein, 15 aa, Mycobacterium tuberculosis
AATDGEWDQVARCES

SEQ ID NO: 123375 - protein, 15 aa, Mycobacterium tuberculosis
ATDGEWDQVARCESG

SEQ ID NO: 123376 - protein, 15 aa, Mycobacterium tuberculosis
TDGEWDQVARCESGG

SEQ ID NO: 123377 - protein, 15 aa, Mycobacterium tuberculosis
DGEWDQVARCESGGN

SEQ ID NO: 123378 - protein, 15 aa, Mycobacterium tuberculosis
GEWDQVARCESGGNW

SEQ ID NO: 123379 - protein, 15 aa, Mycobacterium tuberculosis
EWDQVARCESGGNWS

SEQ ID NO: 123380 - protein, 15 aa, Mycobacterium tuberculosis
WDQVARCESGGNWSI

SEQ ID NO: 123381 - protein, 15 aa, Mycobacterium tuberculosis
DQVARCESGGNWSIN

SEQ ID NO: 123382 - protein, 15 aa, Mycobacterium tuberculosis
QVARCESGGNWSINT

SEQ ID NO: 123383 - protein, 15 aa, Mycobacterium tuberculosis
VARCESGGNWSINTG

SEQ ID NO: 123384 - protein, 15 aa, Mycobacterium tuberculosis
ARCESGGNWSINTGN

SEQ ID NO: 123385 - protein, 15 aa, Mycobacterium tuberculosis
RCESGGNWSINTGNG

SEQ ID NO: 123386 - protein, 15 aa, Mycobacterium tuberculosis
CESGGNWSINTGNGY

SEQ ID NO: 123387 - protein, 15 aa, Mycobacterium tuberculosis
ESGGNWSINTGNGYL

SEQ ID NO: 123388 - protein, 15 aa, Mycobacterium tuberculosis
SGGNWSINTGNGYLG

SEQ ID NO: 123389 - protein, 15 aa, Mycobacterium tuberculosis
GGNWSINTGNGYLGG

SEQ ID NO: 123390 - protein, 15 aa, Mycobacterium tuberculosis
GNWSINTGNGYLGGL

SEQ ID NO: 123391 - protein, 15 aa, Mycobacterium tuberculosis
NWSINTGNGYLGGLQ

SEQ ID NO: 123392 - protein, 15 aa, Mycobacterium tuberculosis
WSINTGNGYLGGLQF

SEQ ID NO: 123393 - protein, 15 aa, Mycobacterium tuberculosis
SINTGNGYLGGLQFT

SEQ ID NO: 123394 - protein, 15 aa, Mycobacterium tuberculosis
INTGNGYLGGLQFTQ

SEQ ID NO: 123395 - protein, 15 aa, Mycobacterium tuberculosis
NTGNGYLGGLQFTQS

SEQ ID NO: 123396 - protein, 15 aa, Mycobacterium tuberculosis
TGNGYLGGLQFTQST

SEQ ID NO: 123397 - protein, 15 aa, Mycobacterium tuberculosis
GNGYLGGLQFTQSTW

SEQ ID NO: 123398 - protein, 15 aa, Mycobacterium tuberculosis
NGYLGGLQFTQSTWA

SEQ ID NO: 123399 - protein, 15 aa, Mycobacterium tuberculosis
GYLGGLQFTQSTWAA

SEQ ID NO: 123400 - protein, 15 aa, Mycobacterium tuberculosis
YLGGLQFTQSTWAAH

SEQ ID NO: 123401 - protein, 15 aa, Mycobacterium tuberculosis
LGGLQFTQSTWAAHG

SEQ ID NO: 123402 - protein, 15 aa, Mycobacterium tuberculosis
GGLQFTQSTWAAHGG

SEQ ID NO: 123403 - protein, 15 aa, Mycobacterium tuberculosis
GLQFTQSTWAAHGGG

SEQ ID NO: 123404 - protein, 15 aa, Mycobacterium tuberculosis
LQFTQSTWAAHGGGE

SEQ ID NO: 123405 - protein, 15 aa, Mycobacterium tuberculosis
QFTQSTWAAHGGGEF

SEQ ID NO: 123406 - protein, 15 aa, Mycobacterium tuberculosis
FTQSTWAAHGGGEFA

SEQ ID NO: 123407 - protein, 15 aa, Mycobacterium tuberculosis
TQSTWAAHGGGEFAP

SEQ ID NO: 123408 - protein, 15 aa, Mycobacterium tuberculosis
QSTWAAHGGGEFAPS

SEQ ID NO: 123409 - protein, 15 aa, Mycobacterium tuberculosis
STWAAHGGGEFAPSA

SEQ ID NO: 123410 - protein, 15 aa, Mycobacterium tuberculosis
TWAAHGGGEFAPSAQ

SEQ ID NO: 123411 - protein, 15 aa, Mycobacterium tuberculosis
WAAHGGGEFAPSAQL

SEQ ID NO: 123412 - protein, 15 aa, Mycobacterium tuberculosis
AAHGGGEFAPSAQLA

SEQ ID NO: 123413 - protein, 15 aa, Mycobacterium tuberculosis
AHGGGEFAPSAQLAS

SEQ ID NO: 123414 - protein, 15 aa, Mycobacterium tuberculosis
HGGGEFAPSAQLASR

SEQ ID NO: 123415 - protein, 15 aa, Mycobacterium tuberculosis
GGGEFAPSAQLASRE

SEQ ID NO: 123416 - protein, 15 aa, Mycobacterium tuberculosis
GGEFAPSAQLASREQ

SEQ ID NO: 123417 - protein, 15 aa, Mycobacterium tuberculosis
GEFAPSAQLASREQQ

SEQ ID NO: 123418 - protein, 15 aa, Mycobacterium tuberculosis
EFAPSAQLASREQQI

SEQ ID NO: 123419 - protein, 15 aa, Mycobacterium tuberculosis
FAPSAQLASREQQIA

SEQ ID NO: 123420 - protein, 15 aa, Mycobacterium tuberculosis
APSAQLASREQQIAV

SEQ ID NO: 123421 - protein, 15 aa, Mycobacterium tuberculosis
PSAQLASREQQIAVG

SEQ ID NO: 123422 - protein, 15 aa, Mycobacterium tuberculosis
SAQLASREQQIAVGE

SEQ ID NO: 123423 - protein, 15 aa, Mycobacterium tuberculosis
AQLASREQQIAVGER

SEQ ID NO: 123424 - protein, 15 aa, Mycobacterium tuberculosis
QLASREQQIAVGERV

SEQ ID NO: 123425 - protein, 15 aa, Mycobacterium tuberculosis
LASREQQIAVGERVL

SEQ ID NO: 123426 - protein, 15 aa, Mycobacterium tuberculosis
ASREQQIAVGERVLA

SEQ ID NO: 123427 - protein, 15 aa, Mycobacterium tuberculosis
SREQQIAVGERVLAT

SEQ ID NO: 123428 - protein, 15 aa, Mycobacterium tuberculosis
REQQIAVGERVLATQ

SEQ ID NO: 123429 - protein, 15 aa, Mycobacterium tuberculosis
EQQIAVGERVLATQG

SEQ ID NO: 123430 - protein, 15 aa, Mycobacterium tuberculosis
QQIAVGERVLATQGR

SEQ ID NO: 123431 - protein, 15 aa, Mycobacterium tuberculosis
QIAVGERVLATQGRG

SEQ ID NO: 123432 - protein, 15 aa, Mycobacterium tuberculosis
IAVGERVLATQGRGA

SEQ ID NO: 123433 - protein, 15 aa, Mycobacterium tuberculosis
AVGERVLATQGRGAW

SEQ ID NO: 123434 - protein, 15 aa, Mycobacterium tuberculosis
VGERVLATQGRGAWP

SEQ ID NO: 123435 - protein, 15 aa, Mycobacterium tuberculosis
GERVLATQGRGAWPV

SEQ ID NO: 123436 - protein, 15 aa, Mycobacterium tuberculosis
ERVLATQGRGAWPVC

SEQ ID NO: 123437 - protein, 15 aa, Mycobacterium tuberculosis
RVLATQGRGAWPVCG

SEQ ID NO: 123438 - protein, 15 aa, Mycobacterium tuberculosis
VLATQGRGAWPVCGR

SEQ ID NO: 123439 - protein, 15 aa, Mycobacterium tuberculosis
LATQGRGAWPVCGRG

SEQ ID NO: 123440 - protein, 15 aa, Mycobacterium tuberculosis
ATQGRGAWPVCGRGL

SEQ ID NO: 123441 - protein, 15 aa, Mycobacterium tuberculosis
TQGRGAWPVCGRGLS

SEQ ID NO: 123442 - protein, 15 aa, Mycobacterium tuberculosis
QGRGAWPVCGRGLSN

SEQ ID NO: 123443 - protein, 15 aa, Mycobacterium tuberculosis
GRGAWPVCGRGLSNA

SEQ ID NO: 123444 - protein, 15 aa, Mycobacterium tuberculosis
RGAWPVCGRGLSNAT

SEQ ID NO: 123445 - protein, 15 aa, Mycobacterium tuberculosis
GAWPVCGRGLSNATP

SEQ ID NO: 123446 - protein, 15 aa, Mycobacterium tuberculosis
AWPVCGRGLSNATPR

SEQ ID NO: 123447 - protein, 15 aa, Mycobacterium tuberculosis
WPVCGRGLSNATPRE

SEQ ID NO: 123448 - protein, 15 aa, Mycobacterium tuberculosis
PVCGRGLSNATPREV

SEQ ID NO: 123449 - protein, 15 aa, Mycobacterium tuberculosis
VCGRGLSNATPREVL

SEQ ID NO: 123450 - protein, 15 aa, Mycobacterium tuberculosis
CGRGLSNATPREVLP

SEQ ID NO: 123451 - protein, 15 aa, Mycobacterium tuberculosis
GRGLSNATPREVLPA

SEQ ID NO: 123452 - protein, 15 aa, Mycobacterium tuberculosis
RGLSNATPREVLPAS

SEQ ID NO: 123453 - protein, 15 aa, Mycobacterium tuberculosis
GLSNATPREVLPASA

SEQ ID NO: 123454 - protein, 15 aa, Mycobacterium tuberculosis
LSNATPREVLPASAA

SEQ ID NO: 123455 - protein, 15 aa, Mycobacterium tuberculosis
SNATPREVLPASAAM

SEQ ID NO: 123456 - protein, 15 aa, Mycobacterium tuberculosis
NATPREVLPASAAMD

SEQ ID NO: 123457 - protein, 15 aa, Mycobacterium tuberculosis
ATPREVLPASAAMDA

SEQ ID NO: 123458 - protein, 15 aa, Mycobacterium tuberculosis
TPREVLPASAAMDAP

SEQ ID NO: 123459 - protein, 15 aa, Mycobacterium tuberculosis
PREVLPASAAMDAPL

SEQ ID NO: 123460 - protein, 15 aa, Mycobacterium tuberculosis
REVLPASAAMDAPLD

SEQ ID NO: 123461 - protein, 15 aa, Mycobacterium tuberculosis
EVLPASAAMDAPLDA

SEQ ID NO: 123462 - protein, 15 aa, Mycobacterium tuberculosis
VLPASAAMDAPLDAA

SEQ ID NO: 123463 - protein, 15 aa, Mycobacterium tuberculosis
LPASAAMDAPLDAAA

SEQ ID NO: 123464 - protein, 15 aa, Mycobacterium tuberculosis
PASAAMDAPLDAAAV

SEQ ID NO: 123465 - protein, 15 aa, Mycobacterium tuberculosis
ASAAMDAPLDAAAVN

SEQ ID NO: 123466 - protein, 15 aa, Mycobacterium tuberculosis
SAAMDAPLDAAAVNG

SEQ ID NO: 123467 - protein, 15 aa, Mycobacterium tuberculosis
AAMDAPLDAAAVNGE

SEQ ID NO: 123468 - protein, 15 aa, Mycobacterium tuberculosis
AMDAPLDAAAVNGEP

SEQ ID NO: 123469 - protein, 15 aa, Mycobacterium tuberculosis
MDAPLDAAAVNGEPA

SEQ ID NO: 123470 - protein, 15 aa, Mycobacterium tuberculosis
DAPLDAAAVNGEPAP

SEQ ID NO: 123471 - protein, 15 aa, Mycobacterium tuberculosis
APLDAAAVNGEPAPL

SEQ ID NO: 123472 - protein, 15 aa, Mycobacterium tuberculosis
PLDAAAVNGEPAPLA

SEQ ID NO: 123473 - protein, 15 aa, Mycobacterium tuberculosis
LDAAAVNGEPAPLAP

SEQ ID NO: 123474 - protein, 15 aa, Mycobacterium tuberculosis
DAAAVNGEPAPLAPP

SEQ ID NO: 123475 - protein, 15 aa, Mycobacterium tuberculosis
AAAVNGEPAPLAPPP

SEQ ID NO: 123476 - protein, 15 aa, Mycobacterium tuberculosis
AAVNGEPAPLAPPPA

SEQ ID NO: 123477 - protein, 15 aa, Mycobacterium tuberculosis
AVNGEPAPLAPPPAD

SEQ ID NO: 123478 - protein, 15 aa, Mycobacterium tuberculosis
VNGEPAPLAPPPADP

SEQ ID NO: 123479 - protein, 15 aa, Mycobacterium tuberculosis
NGEPAPLAPPPADPA

SEQ ID NO: 123480 - protein, 15 aa, Mycobacterium tuberculosis
GEPAPLAPPPADPAP

SEQ ID NO: 123481 - protein, 15 aa, Mycobacterium tuberculosis
EPAPLAPPPADPAPP

SEQ ID NO: 123482 - protein, 15 aa, Mycobacterium tuberculosis
PAPLAPPPADPAPPV

SEQ ID NO: 123483 - protein, 15 aa, Mycobacterium tuberculosis
APLAPPPADPAPPVE

SEQ ID NO: 123484 - protein, 15 aa, Mycobacterium tuberculosis
PLAPPPADPAPPVEL

SEQ ID NO: 123485 - protein, 15 aa, Mycobacterium tuberculosis
LAPPPADPAPPVELA

SEQ ID NO: 123486 - protein, 15 aa, Mycobacterium tuberculosis
APPPADPAPPVELAA

SEQ ID NO: 123487 - protein, 15 aa, Mycobacterium tuberculosis
PPPADPAPPVELAAN

SEQ ID NO: 123488 - protein, 15 aa, Mycobacterium tuberculosis
PPADPAPPVELAAND

SEQ ID NO: 123489 - protein, 15 aa, Mycobacterium tuberculosis
PADPAPPVELAANDL

SEQ ID NO: 123490 - protein, 15 aa, Mycobacterium tuberculosis
ADPAPPVELAANDLP

SEQ ID NO: 123491 - protein, 15 aa, Mycobacterium tuberculosis
DPAPPVELAANDLPA

SEQ ID NO: 123492 - protein, 15 aa, Mycobacterium tuberculosis
PAPPVELAANDLPAP

SEQ ID NO: 123493 - protein, 15 aa, Mycobacterium tuberculosis
APPVELAANDLPAPL

SEQ ID NO: 123494 - protein, 15 aa, Mycobacterium tuberculosis
PPVELAANDLPAPLG

SEQ ID NO: 123495 - protein, 15 aa, Mycobacterium tuberculosis
PVELAANDLPAPLGE

SEQ ID NO: 123496 - protein, 15 aa, Mycobacterium tuberculosis
VELAANDLPAPLGEP

SEQ ID NO: 123497 - protein, 15 aa, Mycobacterium tuberculosis
ELAANDLPAPLGEPL

SEQ ID NO: 123498 - protein, 15 aa, Mycobacterium tuberculosis
LAANDLPAPLGEPLP

SEQ ID NO: 123499 - protein, 15 aa, Mycobacterium tuberculosis
AANDLPAPLGEPLPA

SEQ ID NO: 123500 - protein, 15 aa, Mycobacterium tuberculosis
ANDLPAPLGEPLPAA

SEQ ID NO: 123501 - protein, 15 aa, Mycobacterium tuberculosis
NDLPAPLGEPLPAAP

SEQ ID NO: 123502 - protein, 15 aa, Mycobacterium tuberculosis
DLPAPLGEPLPAAPA

SEQ ID NO: 123503 - protein, 15 aa, Mycobacterium tuberculosis
LPAPLGEPLPAAPAD

SEQ ID NO: 123504 - protein, 15 aa, Mycobacterium tuberculosis
PAPLGEPLPAAPADP

SEQ ID NO: 123505 - protein, 15 aa, Mycobacterium tuberculosis
APLGEPLPAAPADPA

SEQ ID NO: 123506 - protein, 15 aa, Mycobacterium tuberculosis
PLGEPLPAAPADPAP

SEQ ID NO: 123507 - protein, 15 aa, Mycobacterium tuberculosis
LGEPLPAAPADPAPP

SEQ ID NO: 123508 - protein, 15 aa, Mycobacterium tuberculosis
GEPLPAAPADPAPPA

SEQ ID NO: 123509 - protein, 15 aa, Mycobacterium tuberculosis
EPLPAAPADPAPPAD

SEQ ID NO: 123510 - protein, 15 aa, Mycobacterium tuberculosis
PLPAAPADPAPPADL

SEQ ID NO: 123511 - protein, 15 aa, Mycobacterium tuberculosis
LPAAPADPAPPADLA

SEQ ID NO: 123512 - protein, 15 aa, Mycobacterium tuberculosis
PAAPADPAPPADLAP

SEQ ID NO: 123513 - protein, 15 aa, Mycobacterium tuberculosis
AAPADPAPPADLAPP

SEQ ID NO: 123514 - protein, 15 aa, Mycobacterium tuberculosis
APADPAPPADLAPPA

SEQ ID NO: 123515 - protein, 15 aa, Mycobacterium tuberculosis
PADPAPPADLAPPAP

SEQ ID NO: 123516 - protein, 15 aa, Mycobacterium tuberculosis
ADPAPPADLAPPAPA

SEQ ID NO: 123517 - protein, 15 aa, Mycobacterium tuberculosis
DPAPPADLAPPAPAD

SEQ ID NO: 123518 - protein, 15 aa, Mycobacterium tuberculosis
PAPPADLAPPAPADV

SEQ ID NO: 123519 - protein, 15 aa, Mycobacterium tuberculosis
APPADLAPPAPADVA

SEQ ID NO: 123520 - protein, 15 aa, Mycobacterium tuberculosis
PPADLAPPAPADVAP

SEQ ID NO: 123521 - protein, 15 aa, Mycobacterium tuberculosis
PADLAPPAPADVAPP

SEQ ID NO: 123522 - protein, 15 aa, Mycobacterium tuberculosis
ADLAPPAPADVAPPV

SEQ ID NO: 123523 - protein, 15 aa, Mycobacterium tuberculosis
DLAPPAPADVAPPVE

SEQ ID NO: 123524 - protein, 15 aa, Mycobacterium tuberculosis
LAPPAPADVAPPVEL

SEQ ID NO: 123525 - protein, 15 aa, Mycobacterium tuberculosis
APPAPADVAPPVELA

SEQ ID NO: 123526 - protein, 15 aa, Mycobacterium tuberculosis
PPAPADVAPPVELAV

SEQ ID NO: 123527 - protein, 15 aa, Mycobacterium tuberculosis
PAPADVAPPVELAVN

SEQ ID NO: 123528 - protein, 15 aa, Mycobacterium tuberculosis
APADVAPPVELAVND

SEQ ID NO: 123529 - protein, 15 aa, Mycobacterium tuberculosis
PADVAPPVELAVNDL

SEQ ID NO: 123530 - protein, 15 aa, Mycobacterium tuberculosis
ADVAPPVELAVNDLP

SEQ ID NO: 123531 - protein, 15 aa, Mycobacterium tuberculosis
DVAPPVELAVNDLPA

SEQ ID NO: 123532 - protein, 15 aa, Mycobacterium tuberculosis
VAPPVELAVNDLPAP

SEQ ID NO: 123533 - protein, 15 aa, Mycobacterium tuberculosis
APPVELAVNDLPAPL

SEQ ID NO: 123534 - protein, 15 aa, Mycobacterium tuberculosis
PPVELAVNDLPAPLG

SEQ ID NO: 123535 - protein, 15 aa, Mycobacterium tuberculosis
PVELAVNDLPAPLGE

SEQ ID NO: 123536 - protein, 15 aa, Mycobacterium tuberculosis
VELAVNDLPAPLGEP

SEQ ID NO: 123537 - protein, 15 aa, Mycobacterium tuberculosis
ELAVNDLPAPLGEPL

SEQ ID NO: 123538 - protein, 15 aa, Mycobacterium tuberculosis
LAVNDLPAPLGEPLP

SEQ ID NO: 123539 - protein, 15 aa, Mycobacterium tuberculosis
AVNDLPAPLGEPLPA

SEQ ID NO: 123540 - protein, 15 aa, Mycobacterium tuberculosis
VNDLPAPLGEPLPAA

SEQ ID NO: 123541 - protein, 15 aa, Mycobacterium tuberculosis
NDLPAPLGEPLPAAP

SEQ ID NO: 123542 - protein, 15 aa, Mycobacterium tuberculosis
DLPAPLGEPLPAAPA

SEQ ID NO: 123543 - protein, 15 aa, Mycobacterium tuberculosis
LPAPLGEPLPAAPAD

SEQ ID NO: 123544 - protein, 15 aa, Mycobacterium tuberculosis
PAPLGEPLPAAPADP

SEQ ID NO: 123545 - protein, 15 aa, Mycobacterium tuberculosis
APLGEPLPAAPADPA

SEQ ID NO: 123546 - protein, 15 aa, Mycobacterium tuberculosis
PLGEPLPAAPADPAP

SEQ ID NO: 123547 - protein, 15 aa, Mycobacterium tuberculosis
LGEPLPAAPADPAPP

SEQ ID NO: 123548 - protein, 15 aa, Mycobacterium tuberculosis
GEPLPAAPADPAPPA

SEQ ID NO: 123549 - protein, 15 aa, Mycobacterium tuberculosis
EPLPAAPADPAPPAD

SEQ ID NO: 123550 - protein, 15 aa, Mycobacterium tuberculosis
PLPAAPADPAPPADL

SEQ ID NO: 123551 - protein, 15 aa, Mycobacterium tuberculosis
LPAAPADPAPPADLA

SEQ ID NO: 123552 - protein, 15 aa, Mycobacterium tuberculosis
PAAPADPAPPADLAP

SEQ ID NO: 123553 - protein, 15 aa, Mycobacterium tuberculosis
AAPADPAPPADLAPP

SEQ ID NO: 123554 - protein, 15 aa, Mycobacterium tuberculosis
APADPAPPADLAPPA

SEQ ID NO: 123555 - protein, 15 aa, Mycobacterium tuberculosis
PADPAPPADLAPPAP

SEQ ID NO: 123556 - protein, 15 aa, Mycobacterium tuberculosis
ADPAPPADLAPPAPA

SEQ ID NO: 123557 - protein, 15 aa, Mycobacterium tuberculosis
DPAPPADLAPPAPAD

SEQ ID NO: 123558 - protein, 15 aa, Mycobacterium tuberculosis
PAPPADLAPPAPADL

SEQ ID NO: 123559 - protein, 15 aa, Mycobacterium tuberculosis
APPADLAPPAPADLA

SEQ ID NO: 123560 - protein, 15 aa, Mycobacterium tuberculosis
PPADLAPPAPADLAP

SEQ ID NO: 123561 - protein, 15 aa, Mycobacterium tuberculosis
PADLAPPAPADLAPP

SEQ ID NO: 123562 - protein, 15 aa, Mycobacterium tuberculosis
ADLAPPAPADLAPPA

SEQ ID NO: 123563 - protein, 15 aa, Mycobacterium tuberculosis
DLAPPAPADLAPPAP

SEQ ID NO: 123564 - protein, 15 aa, Mycobacterium tuberculosis
LAPPAPADLAPPAPA

SEQ ID NO: 123565 - protein, 15 aa, Mycobacterium tuberculosis
APPAPADLAPPAPAD

SEQ ID NO: 123566 - protein, 15 aa, Mycobacterium tuberculosis
PPAPADLAPPAPADL

SEQ ID NO: 123567 - protein, 15 aa, Mycobacterium tuberculosis
PAPADLAPPAPADLA

SEQ ID NO: 123568 - protein, 15 aa, Mycobacterium tuberculosis
APADLAPPAPADLAP

SEQ ID NO: 123569 - protein, 15 aa, Mycobacterium tuberculosis
PADLAPPAPADLAPP

SEQ ID NO: 123570 - protein, 15 aa, Mycobacterium tuberculosis
ADLAPPAPADLAPPA

SEQ ID NO: 123571 - protein, 15 aa, Mycobacterium tuberculosis
DLAPPAPADLAPPAP

SEQ ID NO: 123572 - protein, 15 aa, Mycobacterium tuberculosis
LAPPAPADLAPPAPA

SEQ ID NO: 123573 - protein, 15 aa, Mycobacterium tuberculosis
APPAPADLAPPAPAD

SEQ ID NO: 123574 - protein, 15 aa, Mycobacterium tuberculosis
PPAPADLAPPAPADL

SEQ ID NO: 123575 - protein, 15 aa, Mycobacterium tuberculosis
PAPADLAPPAPADLA

SEQ ID NO: 123576 - protein, 15 aa, Mycobacterium tuberculosis
APADLAPPAPADLAP

SEQ ID NO: 123577 - protein, 15 aa, Mycobacterium tuberculosis
PADLAPPAPADLAPP

SEQ ID NO: 123578 - protein, 15 aa, Mycobacterium tuberculosis
ADLAPPAPADLAPPV

SEQ ID NO: 123579 - protein, 15 aa, Mycobacterium tuberculosis
DLAPPAPADLAPPVE

SEQ ID NO: 123580 - protein, 15 aa, Mycobacterium tuberculosis
LAPPAPADLAPPVEL

SEQ ID NO: 123581 - protein, 15 aa, Mycobacterium tuberculosis
APPAPADLAPPVELA

SEQ ID NO: 123582 - protein, 15 aa, Mycobacterium tuberculosis
PPAPADLAPPVELAV

SEQ ID NO: 123583 - protein, 15 aa, Mycobacterium tuberculosis
PAPADLAPPVELAVN

SEQ ID NO: 123584 - protein, 15 aa, Mycobacterium tuberculosis
APADLAPPVELAVND

SEQ ID NO: 123585 - protein, 15 aa, Mycobacterium tuberculosis
PADLAPPVELAVNDL

SEQ ID NO: 123586 - protein, 15 aa, Mycobacterium tuberculosis
ADLAPPVELAVNDLP

SEQ ID NO: 123587 - protein, 15 aa, Mycobacterium tuberculosis
DLAPPVELAVNDLPA

SEQ ID NO: 123588 - protein, 15 aa, Mycobacterium tuberculosis
LAPPVELAVNDLPAP

SEQ ID NO: 123589 - protein, 15 aa, Mycobacterium tuberculosis
APPVELAVNDLPAPL

SEQ ID NO: 123590 - protein, 15 aa, Mycobacterium tuberculosis
PPVELAVNDLPAPLG

SEQ ID NO: 123591 - protein, 15 aa, Mycobacterium tuberculosis
PVELAVNDLPAPLGE

SEQ ID NO: 123592 - protein, 15 aa, Mycobacterium tuberculosis
VELAVNDLPAPLGEP

SEQ ID NO: 123593 - protein, 15 aa, Mycobacterium tuberculosis
ELAVNDLPAPLGEPL

SEQ ID NO: 123594 - protein, 15 aa, Mycobacterium tuberculosis
LAVNDLPAPLGEPLP

SEQ ID NO: 123595 - protein, 15 aa, Mycobacterium tuberculosis
AVNDLPAPLGEPLPA

SEQ ID NO: 123596 - protein, 15 aa, Mycobacterium tuberculosis
VNDLPAPLGEPLPAA

SEQ ID NO: 123597 - protein, 15 aa, Mycobacterium tuberculosis
NDLPAPLGEPLPAAP

SEQ ID NO: 123598 - protein, 15 aa, Mycobacterium tuberculosis
DLPAPLGEPLPAAPA

SEQ ID NO: 123599 - protein, 15 aa, Mycobacterium tuberculosis
LPAPLGEPLPAAPAE

SEQ ID NO: 123600 - protein, 15 aa, Mycobacterium tuberculosis
PAPLGEPLPAAPAEL

SEQ ID NO: 123601 - protein, 15 aa, Mycobacterium tuberculosis
APLGEPLPAAPAELA

SEQ ID NO: 123602 - protein, 15 aa, Mycobacterium tuberculosis
PLGEPLPAAPAELAP

SEQ ID NO: 123603 - protein, 15 aa, Mycobacterium tuberculosis
LGEPLPAAPAELAPP

SEQ ID NO: 123604 - protein, 15 aa, Mycobacterium tuberculosis
GEPLPAAPAELAPPA

SEQ ID NO: 123605 - protein, 15 aa, Mycobacterium tuberculosis
EPLPAAPAELAPPAD

SEQ ID NO: 123606 - protein, 15 aa, Mycobacterium tuberculosis
PLPAAPAELAPPADL

SEQ ID NO: 123607 - protein, 15 aa, Mycobacterium tuberculosis
LPAAPAELAPPADLA

SEQ ID NO: 123608 - protein, 15 aa, Mycobacterium tuberculosis
PAAPAELAPPADLAP

SEQ ID NO: 123609 - protein, 15 aa, Mycobacterium tuberculosis
AAPAELAPPADLAPA

SEQ ID NO: 123610 - protein, 15 aa, Mycobacterium tuberculosis
APAELAPPADLAPAS

SEQ ID NO: 123611 - protein, 15 aa, Mycobacterium tuberculosis
PAELAPPADLAPASA

SEQ ID NO: 123612 - protein, 15 aa, Mycobacterium tuberculosis
AELAPPADLAPASAD

SEQ ID NO: 123613 - protein, 15 aa, Mycobacterium tuberculosis
ELAPPADLAPASADL

SEQ ID NO: 123614 - protein, 15 aa, Mycobacterium tuberculosis
LAPPADLAPASADLA

SEQ ID NO: 123615 - protein, 15 aa, Mycobacterium tuberculosis
APPADLAPASADLAP

SEQ ID NO: 123616 - protein, 15 aa, Mycobacterium tuberculosis
PPADLAPASADLAPP

SEQ ID NO: 123617 - protein, 15 aa, Mycobacterium tuberculosis
PADLAPASADLAPPA

SEQ ID NO: 123618 - protein, 15 aa, Mycobacterium tuberculosis
ADLAPASADLAPPAP

SEQ ID NO: 123619 - protein, 15 aa, Mycobacterium tuberculosis
DLAPASADLAPPAPA

SEQ ID NO: 123620 - protein, 15 aa, Mycobacterium tuberculosis
LAPASADLAPPAPAD

SEQ ID NO: 123621 - protein, 15 aa, Mycobacterium tuberculosis
APASADLAPPAPADL

SEQ ID NO: 123622 - protein, 15 aa, Mycobacterium tuberculosis
PASADLAPPAPADLA

SEQ ID NO: 123623 - protein, 15 aa, Mycobacterium tuberculosis
ASADLAPPAPADLAP

SEQ ID NO: 123624 - protein, 15 aa, Mycobacterium tuberculosis
SADLAPPAPADLAPP

SEQ ID NO: 123625 - protein, 15 aa, Mycobacterium tuberculosis
ADLAPPAPADLAPPA

SEQ ID NO: 123626 - protein, 15 aa, Mycobacterium tuberculosis
DLAPPAPADLAPPAP

SEQ ID NO: 123627 - protein, 15 aa, Mycobacterium tuberculosis
LAPPAPADLAPPAPA

SEQ ID NO: 123628 - protein, 15 aa, Mycobacterium tuberculosis
APPAPADLAPPAPAE

SEQ ID NO: 123629 - protein, 15 aa, Mycobacterium tuberculosis
PPAPADLAPPAPAEL

SEQ ID NO: 123630 - protein, 15 aa, Mycobacterium tuberculosis
PAPADLAPPAPAELA

SEQ ID NO: 123631 - protein, 15 aa, Mycobacterium tuberculosis
APADLAPPAPAELAP

SEQ ID NO: 123632 - protein, 15 aa, Mycobacterium tuberculosis
PADLAPPAPAELAPP

SEQ ID NO: 123633 - protein, 15 aa, Mycobacterium tuberculosis
ADLAPPAPAELAPPA

SEQ ID NO: 123634 - protein, 15 aa, Mycobacterium tuberculosis
DLAPPAPAELAPPAP

SEQ ID NO: 123635 - protein, 15 aa, Mycobacterium tuberculosis
LAPPAPAELAPPAPA

SEQ ID NO: 123636 - protein, 15 aa, Mycobacterium tuberculosis
APPAPAELAPPAPAD

SEQ ID NO: 123637 - protein, 15 aa, Mycobacterium tuberculosis
PPAPAELAPPAPADL

SEQ ID NO: 123638 - protein, 15 aa, Mycobacterium tuberculosis
PAPAELAPPAPADLA

SEQ ID NO: 123639 - protein, 15 aa, Mycobacterium tuberculosis
APAELAPPAPADLAP

SEQ ID NO: 123640 - protein, 15 aa, Mycobacterium tuberculosis
PAELAPPAPADLAPP

SEQ ID NO: 123641 - protein, 15 aa, Mycobacterium tuberculosis
AELAPPAPADLAPPA

SEQ ID NO: 123642 - protein, 15 aa, Mycobacterium tuberculosis
ELAPPAPADLAPPAA

SEQ ID NO: 123643 - protein, 15 aa, Mycobacterium tuberculosis
LAPPAPADLAPPAAV

SEQ ID NO: 123644 - protein, 15 aa, Mycobacterium tuberculosis
APPAPADLAPPAAVN

SEQ ID NO: 123645 - protein, 15 aa, Mycobacterium tuberculosis
PPAPADLAPPAAVNE

SEQ ID NO: 123646 - protein, 15 aa, Mycobacterium tuberculosis
PAPADLAPPAAVNEQ

SEQ ID NO: 123647 - protein, 15 aa, Mycobacterium tuberculosis
APADLAPPAAVNEQT

SEQ ID NO: 123648 - protein, 15 aa, Mycobacterium tuberculosis
PADLAPPAAVNEQTA

SEQ ID NO: 123649 - protein, 15 aa, Mycobacterium tuberculosis
ADLAPPAAVNEQTAP

SEQ ID NO: 123650 - protein, 15 aa, Mycobacterium tuberculosis
DLAPPAAVNEQTAPG

SEQ ID NO: 123651 - protein, 15 aa, Mycobacterium tuberculosis
LAPPAAVNEQTAPGD

SEQ ID NO: 123652 - protein, 15 aa, Mycobacterium tuberculosis
APPAAVNEQTAPGDQ

SEQ ID NO: 123653 - protein, 15 aa, Mycobacterium tuberculosis
PPAAVNEQTAPGDQP

SEQ ID NO: 123654 - protein, 15 aa, Mycobacterium tuberculosis
PAAVNEQTAPGDQPA

SEQ ID NO: 123655 - protein, 15 aa, Mycobacterium tuberculosis
AAVNEQTAPGDQPAT

SEQ ID NO: 123656 - protein, 15 aa, Mycobacterium tuberculosis
AVNEQTAPGDQPATA

SEQ ID NO: 123657 - protein, 15 aa, Mycobacterium tuberculosis
VNEQTAPGDQPATAP

SEQ ID NO: 123658 - protein, 15 aa, Mycobacterium tuberculosis
NEQTAPGDQPATAPG

SEQ ID NO: 123659 - protein, 15 aa, Mycobacterium tuberculosis
EQTAPGDQPATAPGG

SEQ ID NO: 123660 - protein, 15 aa, Mycobacterium tuberculosis
QTAPGDQPATAPGGP

SEQ ID NO: 123661 - protein, 15 aa, Mycobacterium tuberculosis
TAPGDQPATAPGGPV

SEQ ID NO: 123662 - protein, 15 aa, Mycobacterium tuberculosis
APGDQPATAPGGPVG

SEQ ID NO: 123663 - protein, 15 aa, Mycobacterium tuberculosis
PGDQPATAPGGPVGL

SEQ ID NO: 123664 - protein, 15 aa, Mycobacterium tuberculosis
GDQPATAPGGPVGLA

SEQ ID NO: 123665 - protein, 15 aa, Mycobacterium tuberculosis
DQPATAPGGPVGLAT

SEQ ID NO: 123666 - protein, 15 aa, Mycobacterium tuberculosis
QPATAPGGPVGLATD

SEQ ID NO: 123667 - protein, 15 aa, Mycobacterium tuberculosis
PATAPGGPVGLATDL

SEQ ID NO: 123668 - protein, 15 aa, Mycobacterium tuberculosis
ATAPGGPVGLATDLE

SEQ ID NO: 123669 - protein, 15 aa, Mycobacterium tuberculosis
TAPGGPVGLATDLEL

SEQ ID NO: 123670 - protein, 15 aa, Mycobacterium tuberculosis
APGGPVGLATDLELP

SEQ ID NO: 123671 - protein, 15 aa, Mycobacterium tuberculosis
PGGPVGLATDLELPE

SEQ ID NO: 123672 - protein, 15 aa, Mycobacterium tuberculosis
GGPVGLATDLELPEP

SEQ ID NO: 123673 - protein, 15 aa, Mycobacterium tuberculosis
GPVGLATDLELPEPD

SEQ ID NO: 123674 - protein, 15 aa, Mycobacterium tuberculosis
PVGLATDLELPEPDP

SEQ ID NO: 123675 - protein, 15 aa, Mycobacterium tuberculosis
VGLATDLELPEPDPQ

SEQ ID NO: 123676 - protein, 15 aa, Mycobacterium tuberculosis
GLATDLELPEPDPQP

SEQ ID NO: 123677 - protein, 15 aa, Mycobacterium tuberculosis
LATDLELPEPDPQPA

SEQ ID NO: 123678 - protein, 15 aa, Mycobacterium tuberculosis
ATDLELPEPDPQPAD

SEQ ID NO: 123679 - protein, 15 aa, Mycobacterium tuberculosis
TDLELPEPDPQPADA

SEQ ID NO: 123680 - protein, 15 aa, Mycobacterium tuberculosis
DLELPEPDPQPADAP

SEQ ID NO: 123681 - protein, 15 aa, Mycobacterium tuberculosis
LELPEPDPQPADAPP

SEQ ID NO: 123682 - protein, 15 aa, Mycobacterium tuberculosis
ELPEPDPQPADAPPP

SEQ ID NO: 123683 - protein, 15 aa, Mycobacterium tuberculosis
LPEPDPQPADAPPPG

SEQ ID NO: 123684 - protein, 15 aa, Mycobacterium tuberculosis
PEPDPQPADAPPPGD

SEQ ID NO: 123685 - protein, 15 aa, Mycobacterium tuberculosis
EPDPQPADAPPPGDV

SEQ ID NO: 123686 - protein, 15 aa, Mycobacterium tuberculosis
PDPQPADAPPPGDVT

SEQ ID NO: 123687 - protein, 15 aa, Mycobacterium tuberculosis
DPQPADAPPPGDVTE

SEQ ID NO: 123688 - protein, 15 aa, Mycobacterium tuberculosis
PQPADAPPPGDVTEA

SEQ ID NO: 123689 - protein, 15 aa, Mycobacterium tuberculosis
QPADAPPPGDVTEAP

SEQ ID NO: 123690 - protein, 15 aa, Mycobacterium tuberculosis
PADAPPPGDVTEAPA

SEQ ID NO: 123691 - protein, 15 aa, Mycobacterium tuberculosis
ADAPPPGDVTEAPAE

SEQ ID NO: 123692 - protein, 15 aa, Mycobacterium tuberculosis
DAPPPGDVTEAPAET

SEQ ID NO: 123693 - protein, 15 aa, Mycobacterium tuberculosis
APPPGDVTEAPAETP

SEQ ID NO: 123694 - protein, 15 aa, Mycobacterium tuberculosis
PPPGDVTEAPAETPQ

SEQ ID NO: 123695 - protein, 15 aa, Mycobacterium tuberculosis
PPGDVTEAPAETPQV

SEQ ID NO: 123696 - protein, 15 aa, Mycobacterium tuberculosis
PGDVTEAPAETPQVS

SEQ ID NO: 123697 - protein, 15 aa, Mycobacterium tuberculosis
GDVTEAPAETPQVSN

SEQ ID NO: 123698 - protein, 15 aa, Mycobacterium tuberculosis
DVTEAPAETPQVSNI

SEQ ID NO: 123699 - protein, 15 aa, Mycobacterium tuberculosis
VTEAPAETPQVSNIA

SEQ ID NO: 123700 - protein, 15 aa, Mycobacterium tuberculosis
TEAPAETPQVSNIAY

SEQ ID NO: 123701 - protein, 15 aa, Mycobacterium tuberculosis
EAPAETPQVSNIAYT

SEQ ID NO: 123702 - protein, 15 aa, Mycobacterium tuberculosis
APAETPQVSNIAYTK

SEQ ID NO: 123703 - protein, 15 aa, Mycobacterium tuberculosis
PAETPQVSNIAYTKK

SEQ ID NO: 123704 - protein, 15 aa, Mycobacterium tuberculosis
AETPQVSNIAYTKKL

SEQ ID NO: 123705 - protein, 15 aa, Mycobacterium tuberculosis
ETPQVSNIAYTKKLW

SEQ ID NO: 123706 - protein, 15 aa, Mycobacterium tuberculosis
TPQVSNIAYTKKLWQ

SEQ ID NO: 123707 - protein, 15 aa, Mycobacterium tuberculosis
PQVSNIAYTKKLWQA

SEQ ID NO: 123708 - protein, 15 aa, Mycobacterium tuberculosis
QVSNIAYTKKLWQAI

SEQ ID NO: 123709 - protein, 15 aa, Mycobacterium tuberculosis
VSNIAYTKKLWQAIR

SEQ ID NO: 123710 - protein, 15 aa, Mycobacterium tuberculosis
SNIAYTKKLWQAIRA

SEQ ID NO: 123711 - protein, 15 aa, Mycobacterium tuberculosis
NIAYTKKLWQAIRAQ

SEQ ID NO: 123712 - protein, 15 aa, Mycobacterium tuberculosis
IAYTKKLWQAIRAQD

SEQ ID NO: 123713 - protein, 15 aa, Mycobacterium tuberculosis
AYTKKLWQAIRAQDV

SEQ ID NO: 123714 - protein, 15 aa, Mycobacterium tuberculosis
YTKKLWQAIRAQDVC

SEQ ID NO: 123715 - protein, 15 aa, Mycobacterium tuberculosis
TKKLWQAIRAQDVCG

SEQ ID NO: 123716 - protein, 15 aa, Mycobacterium tuberculosis
KKLWQAIRAQDVCGN

SEQ ID NO: 123717 - protein, 15 aa, Mycobacterium tuberculosis
KLWQAIRAQDVCGND

SEQ ID NO: 123718 - protein, 15 aa, Mycobacterium tuberculosis
LWQAIRAQDVCGNDA

SEQ ID NO: 123719 - protein, 15 aa, Mycobacterium tuberculosis
WQAIRAQDVCGNDAL

SEQ ID NO: 123720 - protein, 15 aa, Mycobacterium tuberculosis
QAIRAQDVCGNDALD

SEQ ID NO: 123721 - protein, 15 aa, Mycobacterium tuberculosis
AIRAQDVCGNDALDS

SEQ ID NO: 123722 - protein, 15 aa, Mycobacterium tuberculosis
IRAQDVCGNDALDSL

SEQ ID NO: 123723 - protein, 15 aa, Mycobacterium tuberculosis
RAQDVCGNDALDSLA

SEQ ID NO: 123724 - protein, 15 aa, Mycobacterium tuberculosis
AQDVCGNDALDSLAQ

SEQ ID NO: 123725 - protein, 15 aa, Mycobacterium tuberculosis
QDVCGNDALDSLAQP

SEQ ID NO: 123726 - protein, 15 aa, Mycobacterium tuberculosis
DVCGNDALDSLAQPY

SEQ ID NO: 123727 - protein, 15 aa, Mycobacterium tuberculosis
VCGNDALDSLAQPYV

SEQ ID NO: 123728 - protein, 15 aa, Mycobacterium tuberculosis
CGNDALDSLAQPYVI

SEQ ID NO: 123729 - protein, 15 aa, Mycobacterium tuberculosis
GNDALDSLAQPYVIG

SEQ ID NO: 123730 - protein, 16 aa, Mycobacterium tuberculosis
MSGRHRKPTTSNVSVA

SEQ ID NO: 123731 - protein, 16 aa, Mycobacterium tuberculosis
SGRHRKPTTSNVSVAK

SEQ ID NO: 123732 - protein, 16 aa, Mycobacterium tuberculosis
GRHRKPTTSNVSVAKI

SEQ ID NO: 123733 - protein, 16 aa, Mycobacterium tuberculosis
RHRKPTTSNVSVAKIA

SEQ ID NO: 123734 - protein, 16 aa, Mycobacterium tuberculosis
HRKPTTSNVSVAKIAF

SEQ ID NO: 123735 - protein, 16 aa, Mycobacterium tuberculosis
RKPTTSNVSVAKIAFT

SEQ ID NO: 123736 - protein, 16 aa, Mycobacterium tuberculosis
KPTTSNVSVAKIAFTG

SEQ ID NO: 123737 - protein, 16 aa, Mycobacterium tuberculosis
PTTSNVSVAKIAFTGA

SEQ ID NO: 123738 - protein, 16 aa, Mycobacterium tuberculosis
TTSNVSVAKIAFTGAV

SEQ ID NO: 123739 - protein, 16 aa, Mycobacterium tuberculosis
TSNVSVAKIAFTGAVL

SEQ ID NO: 123740 - protein, 16 aa, Mycobacterium tuberculosis
SNVSVAKIAFTGAVLG

SEQ ID NO: 123741 - protein, 16 aa, Mycobacterium tuberculosis
NVSVAKIAFTGAVLGG

SEQ ID NO: 123742 - protein, 16 aa, Mycobacterium tuberculosis
VSVAKIAFTGAVLGGG

SEQ ID NO: 123743 - protein, 16 aa, Mycobacterium tuberculosis
SVAKIAFTGAVLGGGG

SEQ ID NO: 123744 - protein, 16 aa, Mycobacterium tuberculosis
VAKIAFTGAVLGGGGI

SEQ ID NO: 123745 - protein, 16 aa, Mycobacterium tuberculosis
AKIAFTGAVLGGGGIA

SEQ ID NO: 123746 - protein, 16 aa, Mycobacterium tuberculosis
KIAFTGAVLGGGGIAM

SEQ ID NO: 123747 - protein, 16 aa, Mycobacterium tuberculosis
IAFTGAVLGGGGIAMA

SEQ ID NO: 123748 - protein, 16 aa, Mycobacterium tuberculosis
AFTGAVLGGGGIAMAA

SEQ ID NO: 123749 - protein, 16 aa, Mycobacterium tuberculosis
FTGAVLGGGGIAMAAQ

SEQ ID NO: 123750 - protein, 16 aa, Mycobacterium tuberculosis
TGAVLGGGGIAMAAQA

SEQ ID NO: 123751 - protein, 16 aa, Mycobacterium tuberculosis
GAVLGGGGIAMAAQAT

SEQ ID NO: 123752 - protein, 16 aa, Mycobacterium tuberculosis
AVLGGGGIAMAAQATA

SEQ ID NO: 123753 - protein, 16 aa, Mycobacterium tuberculosis
VLGGGGIAMAAQATAA

SEQ ID NO: 123754 - protein, 16 aa, Mycobacterium tuberculosis
LGGGGIAMAAQATAAT

SEQ ID NO: 123755 - protein, 16 aa, Mycobacterium tuberculosis
GGGGIAMAAQATAATD

SEQ ID NO: 123756 - protein, 16 aa, Mycobacterium tuberculosis
GGGIAMAAQATAATDG

SEQ ID NO: 123757 - protein, 16 aa, Mycobacterium tuberculosis
GGIAMAAQATAATDGE

SEQ ID NO: 123758 - protein, 16 aa, Mycobacterium tuberculosis
GIAMAAQATAATDGEW

SEQ ID NO: 123759 - protein, 16 aa, Mycobacterium tuberculosis
IAMAAQATAATDGEWD

SEQ ID NO: 123760 - protein, 16 aa, Mycobacterium tuberculosis
AMAAQATAATDGEWDQ

SEQ ID NO: 123761 - protein, 16 aa, Mycobacterium tuberculosis
MAAQATAATDGEWDQV

SEQ ID NO: 123762 - protein, 16 aa, Mycobacterium tuberculosis
AAQATAATDGEWDQVA

SEQ ID NO: 123763 - protein, 16 aa, Mycobacterium tuberculosis
AQATAATDGEWDQVAR

SEQ ID NO: 123764 - protein, 16 aa, Mycobacterium tuberculosis
QATAATDGEWDQVARC

SEQ ID NO: 123765 - protein, 16 aa, Mycobacterium tuberculosis
ATAATDGEWDQVARCE

SEQ ID NO: 123766 - protein, 16 aa, Mycobacterium tuberculosis
TAATDGEWDQVARCES

SEQ ID NO: 123767 - protein, 16 aa, Mycobacterium tuberculosis
AATDGEWDQVARCESG

SEQ ID NO: 123768 - protein, 16 aa, Mycobacterium tuberculosis
ATDGEWDQVARCESGG

SEQ ID NO: 123769 - protein, 16 aa, Mycobacterium tuberculosis
TDGEWDQVARCESGGN

SEQ ID NO: 123770 - protein, 16 aa, Mycobacterium tuberculosis
DGEWDQVARCESGGNW

SEQ ID NO: 123771 - protein, 16 aa, Mycobacterium tuberculosis
GEWDQVARCESGGNWS

SEQ ID NO: 123772 - protein, 16 aa, Mycobacterium tuberculosis
EWDQVARCESGGNWSI

SEQ ID NO: 123773 - protein, 16 aa, Mycobacterium tuberculosis
WDQVARCESGGNWSIN

SEQ ID NO: 123774 - protein, 16 aa, Mycobacterium tuberculosis
DQVARCESGGNWSINT

SEQ ID NO: 123775 - protein, 16 aa, Mycobacterium tuberculosis
QVARCESGGNWSINTG

SEQ ID NO: 123776 - protein, 16 aa, Mycobacterium tuberculosis
VARCESGGNWSINTGN

SEQ ID NO: 123777 - protein, 16 aa, Mycobacterium tuberculosis
ARCESGGNWSINTGNG

SEQ ID NO: 123778 - protein, 16 aa, Mycobacterium tuberculosis
RCESGGNWSINTGNGY

SEQ ID NO: 123779 - protein, 16 aa, Mycobacterium tuberculosis
CESGGNWSINTGNGYL

SEQ ID NO: 123780 - protein, 16 aa, Mycobacterium tuberculosis
ESGGNWSINTGNGYLG

SEQ ID NO: 123781 - protein, 16 aa, Mycobacterium tuberculosis
SGGNWSINTGNGYLGG

SEQ ID NO: 123782 - protein, 16 aa, Mycobacterium tuberculosis
GGNWSINTGNGYLGGL

SEQ ID NO: 123783 - protein, 16 aa, Mycobacterium tuberculosis
GNWSINTGNGYLGGLQ

SEQ ID NO: 123784 - protein, 16 aa, Mycobacterium tuberculosis
NWSINTGNGYLGGLQF

SEQ ID NO: 123785 - protein, 16 aa, Mycobacterium tuberculosis
WSINTGNGYLGGLQFT

SEQ ID NO: 123786 - protein, 16 aa, Mycobacterium tuberculosis
SINTGNGYLGGLQFTQ

SEQ ID NO: 123787 - protein, 16 aa, Mycobacterium tuberculosis
INTGNGYLGGLQFTQS

SEQ ID NO: 123788 - protein, 16 aa, Mycobacterium tuberculosis
NTGNGYLGGLQFTQST

SEQ ID NO: 123789 - protein, 16 aa, Mycobacterium tuberculosis
TGNGYLGGLQFTQSTW

SEQ ID NO: 123790 - protein, 16 aa, Mycobacterium tuberculosis
GNGYLGGLQFTQSTWA

SEQ ID NO: 123791 - protein, 16 aa, Mycobacterium tuberculosis
NGYLGGLQFTQSTWAA

SEQ ID NO: 123792 - protein, 16 aa, Mycobacterium tuberculosis
GYLGGLQFTQSTWAAH

SEQ ID NO: 123793 - protein, 16 aa, Mycobacterium tuberculosis
YLGGLQFTQSTWAAHG

SEQ ID NO: 123794 - protein, 16 aa, Mycobacterium tuberculosis
LGGLQFTQSTWAAHGG

SEQ ID NO: 123795 - protein, 16 aa, Mycobacterium tuberculosis
GGLQFTQSTWAAHGGG

SEQ ID NO: 123796 - protein, 16 aa, Mycobacterium tuberculosis
GLQFTQSTWAAHGGGE

SEQ ID NO: 123797 - protein, 16 aa, Mycobacterium tuberculosis
LQFTQSTWAAHGGGEF

SEQ ID NO: 123798 - protein, 16 aa, Mycobacterium tuberculosis
QFTQSTWAAHGGGEFA

SEQ ID NO: 123799 - protein, 16 aa, Mycobacterium tuberculosis
FTQSTWAAHGGGEFAP

SEQ ID NO: 123800 - protein, 16 aa, Mycobacterium tuberculosis
TQSTWAAHGGGEFAPS

SEQ ID NO: 123801 - protein, 16 aa, Mycobacterium tuberculosis
QSTWAAHGGGEFAPSA

SEQ ID NO: 123802 - protein, 16 aa, Mycobacterium tuberculosis
STWAAHGGGEFAPSAQ

SEQ ID NO: 123803 - protein, 16 aa, Mycobacterium tuberculosis
TWAAHGGGEFAPSAQL

SEQ ID NO: 123804 - protein, 16 aa, Mycobacterium tuberculosis
WAAHGGGEFAPSAQLA

SEQ ID NO: 123805 - protein, 16 aa, Mycobacterium tuberculosis
AAHGGGEFAPSAQLAS

SEQ ID NO: 123806 - protein, 16 aa, Mycobacterium tuberculosis
AHGGGEFAPSAQLASR

SEQ ID NO: 123807 - protein, 16 aa, Mycobacterium tuberculosis
HGGGEFAPSAQLASRE

SEQ ID NO: 123808 - protein, 16 aa, Mycobacterium tuberculosis
GGGEFAPSAQLASREQ

SEQ ID NO: 123809 - protein, 16 aa, Mycobacterium tuberculosis
GGEFAPSAQLASREQQ

SEQ ID NO: 123810 - protein, 16 aa, Mycobacterium tuberculosis
GEFAPSAQLASREQQI

SEQ ID NO: 123811 - protein, 16 aa, Mycobacterium tuberculosis
EFAPSAQLASREQQIA

SEQ ID NO: 123812 - protein, 16 aa, Mycobacterium tuberculosis
FAPSAQLASREQQIAV

SEQ ID NO: 123813 - protein, 16 aa, Mycobacterium tuberculosis
APSAQLASREQQIAVG

SEQ ID NO: 123814 - protein, 16 aa, Mycobacterium tuberculosis
PSAQLASREQQIAVGE

SEQ ID NO: 123815 - protein, 16 aa, Mycobacterium tuberculosis
SAQLASREQQIAVGER

SEQ ID NO: 123816 - protein, 16 aa, Mycobacterium tuberculosis
AQLASREQQIAVGERV

SEQ ID NO: 123817 - protein, 16 aa, Mycobacterium tuberculosis
QLASREQQIAVGERVL

SEQ ID NO: 123818 - protein, 16 aa, Mycobacterium tuberculosis
LASREQQIAVGERVLA

SEQ ID NO: 123819 - protein, 16 aa, Mycobacterium tuberculosis
ASREQQIAVGERVLAT

SEQ ID NO: 123820 - protein, 16 aa, Mycobacterium tuberculosis
SREQQIAVGERVLATQ

SEQ ID NO: 123821 - protein, 16 aa, Mycobacterium tuberculosis
REQQIAVGERVLATQG

SEQ ID NO: 123822 - protein, 16 aa, Mycobacterium tuberculosis
EQQIAVGERVLATQGR

SEQ ID NO: 123823 - protein, 16 aa, Mycobacterium tuberculosis
QQIAVGERVLATQGRG

SEQ ID NO: 123824 - protein, 16 aa, Mycobacterium tuberculosis
QIAVGERVLATQGRGA

SEQ ID NO: 123825 - protein, 16 aa, Mycobacterium tuberculosis
IAVGERVLATQGRGAW

SEQ ID NO: 123826 - protein, 16 aa, Mycobacterium tuberculosis
AVGERVLATQGRGAWP

SEQ ID NO: 123827 - protein, 16 aa, Mycobacterium tuberculosis
VGERVLATQGRGAWPV

SEQ ID NO: 123828 - protein, 16 aa, Mycobacterium tuberculosis
GERVLATQGRGAWPVC

SEQ ID NO: 123829 - protein, 16 aa, Mycobacterium tuberculosis
ERVLATQGRGAWPVCG

SEQ ID NO: 123830 - protein, 16 aa, Mycobacterium tuberculosis
RVLATQGRGAWPVCGR

SEQ ID NO: 123831 - protein, 16 aa, Mycobacterium tuberculosis
VLATQGRGAWPVCGRG

SEQ ID NO: 123832 - protein, 16 aa, Mycobacterium tuberculosis
LATQGRGAWPVCGRGL

SEQ ID NO: 123833 - protein, 16 aa, Mycobacterium tuberculosis
ATQGRGAWPVCGRGLS

SEQ ID NO: 123834 - protein, 16 aa, Mycobacterium tuberculosis
TQGRGAWPVCGRGLSN

SEQ ID NO: 123835 - protein, 16 aa, Mycobacterium tuberculosis
QGRGAWPVCGRGLSNA

SEQ ID NO: 123836 - protein, 16 aa, Mycobacterium tuberculosis
GRGAWPVCGRGLSNAT

SEQ ID NO: 123837 - protein, 16 aa, Mycobacterium tuberculosis
RGAWPVCGRGLSNATP

SEQ ID NO: 123838 - protein, 16 aa, Mycobacterium tuberculosis
GAWPVCGRGLSNATPR

SEQ ID NO: 123839 - protein, 16 aa, Mycobacterium tuberculosis
AWPVCGRGLSNATPRE

SEQ ID NO: 123840 - protein, 16 aa, Mycobacterium tuberculosis
WPVCGRGLSNATPREV

SEQ ID NO: 123841 - protein, 16 aa, Mycobacterium tuberculosis
PVCGRGLSNATPREVL

SEQ ID NO: 123842 - protein, 16 aa, Mycobacterium tuberculosis
VCGRGLSNATPREVLP

SEQ ID NO: 123843 - protein, 16 aa, Mycobacterium tuberculosis
CGRGLSNATPREVLPA

SEQ ID NO: 123844 - protein, 16 aa, Mycobacterium tuberculosis
GRGLSNATPREVLPAS

SEQ ID NO: 123845 - protein, 16 aa, Mycobacterium tuberculosis
RGLSNATPREVLPASA

SEQ ID NO: 123846 - protein, 16 aa, Mycobacterium tuberculosis
GLSNATPREVLPASAA

SEQ ID NO: 123847 - protein, 16 aa, Mycobacterium tuberculosis
LSNATPREVLPASAAM

SEQ ID NO: 123848 - protein, 16 aa, Mycobacterium tuberculosis
SNATPREVLPASAAMD

SEQ ID NO: 123849 - protein, 16 aa, Mycobacterium tuberculosis
NATPREVLPASAAMDA

SEQ ID NO: 123850 - protein, 16 aa, Mycobacterium tuberculosis
ATPREVLPASAAMDAP

SEQ ID NO: 123851 - protein, 16 aa, Mycobacterium tuberculosis
TPREVLPASAAMDAPL

SEQ ID NO: 123852 - protein, 16 aa, Mycobacterium tuberculosis
PREVLPASAAMDAPLD

SEQ ID NO: 123853 - protein, 16 aa, Mycobacterium tuberculosis
REVLPASAAMDAPLDA

SEQ ID NO: 123854 - protein, 16 aa, Mycobacterium tuberculosis
EVLPASAAMDAPLDAA

SEQ ID NO: 123855 - protein, 16 aa, Mycobacterium tuberculosis
VLPASAAMDAPLDAAA

SEQ ID NO: 123856 - protein, 16 aa, Mycobacterium tuberculosis
LPASAAMDAPLDAAAV

SEQ ID NO: 123857 - protein, 16 aa, Mycobacterium tuberculosis
PASAAMDAPLDAAAVN

SEQ ID NO: 123858 - protein, 16 aa, Mycobacterium tuberculosis
ASAAMDAPLDAAAVNG

SEQ ID NO: 123859 - protein, 16 aa, Mycobacterium tuberculosis
SAAMDAPLDAAAVNGE

SEQ ID NO: 123860 - protein, 16 aa, Mycobacterium tuberculosis
AAMDAPLDAAAVNGEP

SEQ ID NO: 123861 - protein, 16 aa, Mycobacterium tuberculosis
AMDAPLDAAAVNGEPA

SEQ ID NO: 123862 - protein, 16 aa, Mycobacterium tuberculosis
MDAPLDAAAVNGEPAP

SEQ ID NO: 123863 - protein, 16 aa, Mycobacterium tuberculosis
DAPLDAAAVNGEPAPL

SEQ ID NO: 123864 - protein, 16 aa, Mycobacterium tuberculosis
APLDAAAVNGEPAPLA

SEQ ID NO: 123865 - protein, 16 aa, Mycobacterium tuberculosis
PLDAAAVNGEPAPLAP

SEQ ID NO: 123866 - protein, 16 aa, Mycobacterium tuberculosis
LDAAAVNGEPAPLAPP

SEQ ID NO: 123867 - protein, 16 aa, Mycobacterium tuberculosis
DAAAVNGEPAPLAPPP

SEQ ID NO: 123868 - protein, 16 aa, Mycobacterium tuberculosis
AAAVNGEPAPLAPPPA

SEQ ID NO: 123869 - protein, 16 aa, Mycobacterium tuberculosis
AAVNGEPAPLAPPPAD

SEQ ID NO: 123870 - protein, 16 aa, Mycobacterium tuberculosis
AVNGEPAPLAPPPADP

SEQ ID NO: 123871 - protein, 16 aa, Mycobacterium tuberculosis
VNGEPAPLAPPPADPA

SEQ ID NO: 123872 - protein, 16 aa, Mycobacterium tuberculosis
NGEPAPLAPPPADPAP

SEQ ID NO: 123873 - protein, 16 aa, Mycobacterium tuberculosis
GEPAPLAPPPADPAPP

SEQ ID NO: 123874 - protein, 16 aa, Mycobacterium tuberculosis
EPAPLAPPPADPAPPV

SEQ ID NO: 123875 - protein, 16 aa, Mycobacterium tuberculosis
PAPLAPPPADPAPPVE

SEQ ID NO: 123876 - protein, 16 aa, Mycobacterium tuberculosis
APLAPPPADPAPPVEL

SEQ ID NO: 123877 - protein, 16 aa, Mycobacterium tuberculosis
PLAPPPADPAPPVELA

SEQ ID NO: 123878 - protein, 16 aa, Mycobacterium tuberculosis
LAPPPADPAPPVELAA

SEQ ID NO: 123879 - protein, 16 aa, Mycobacterium tuberculosis
APPPADPAPPVELAAN

SEQ ID NO: 123880 - protein, 16 aa, Mycobacterium tuberculosis
PPPADPAPPVELAAND

SEQ ID NO: 123881 - protein, 16 aa, Mycobacterium tuberculosis
PPADPAPPVELAANDL

SEQ ID NO: 123882 - protein, 16 aa, Mycobacterium tuberculosis
PADPAPPVELAANDLP

SEQ ID NO: 123883 - protein, 16 aa, Mycobacterium tuberculosis
ADPAPPVELAANDLPA

SEQ ID NO: 123884 - protein, 16 aa, Mycobacterium tuberculosis
DPAPPVELAANDLPAP

SEQ ID NO: 123885 - protein, 16 aa, Mycobacterium tuberculosis
PAPPVELAANDLPAPL

SEQ ID NO: 123886 - protein, 16 aa, Mycobacterium tuberculosis
APPVELAANDLPAPLG

SEQ ID NO: 123887 - protein, 16 aa, Mycobacterium tuberculosis
PPVELAANDLPAPLGE

SEQ ID NO: 123888 - protein, 16 aa, Mycobacterium tuberculosis
PVELAANDLPAPLGEP

SEQ ID NO: 123889 - protein, 16 aa, Mycobacterium tuberculosis
VELAANDLPAPLGEPL

SEQ ID NO: 123890 - protein, 16 aa, Mycobacterium tuberculosis
ELAANDLPAPLGEPLP

SEQ ID NO: 123891 - protein, 16 aa, Mycobacterium tuberculosis
LAANDLPAPLGEPLPA

SEQ ID NO: 123892 - protein, 16 aa, Mycobacterium tuberculosis
AANDLPAPLGEPLPAA

SEQ ID NO: 123893 - protein, 16 aa, Mycobacterium tuberculosis
ANDLPAPLGEPLPAAP

SEQ ID NO: 123894 - protein, 16 aa, Mycobacterium tuberculosis
NDLPAPLGEPLPAAPA

SEQ ID NO: 123895 - protein, 16 aa, Mycobacterium tuberculosis
DLPAPLGEPLPAAPAD

SEQ ID NO: 123896 - protein, 16 aa, Mycobacterium tuberculosis
LPAPLGEPLPAAPADP

SEQ ID NO: 123897 - protein, 16 aa, Mycobacterium tuberculosis
PAPLGEPLPAAPADPA

SEQ ID NO: 123898 - protein, 16 aa, Mycobacterium tuberculosis
APLGEPLPAAPADPAP

SEQ ID NO: 123899 - protein, 16 aa, Mycobacterium tuberculosis
PLGEPLPAAPADPAPP

SEQ ID NO: 123900 - protein, 16 aa, Mycobacterium tuberculosis
LGEPLPAAPADPAPPA

SEQ ID NO: 123901 - protein, 16 aa, Mycobacterium tuberculosis
GEPLPAAPADPAPPAD

SEQ ID NO: 123902 - protein, 16 aa, Mycobacterium tuberculosis
EPLPAAPADPAPPADL

SEQ ID NO: 123903 - protein, 16 aa, Mycobacterium tuberculosis
PLPAAPADPAPPADLA

SEQ ID NO: 123904 - protein, 16 aa, Mycobacterium tuberculosis
LPAAPADPAPPADLAP

SEQ ID NO: 123905 - protein, 16 aa, Mycobacterium tuberculosis
PAAPADPAPPADLAPP

SEQ ID NO: 123906 - protein, 16 aa, Mycobacterium tuberculosis
AAPADPAPPADLAPPA

SEQ ID NO: 123907 - protein, 16 aa, Mycobacterium tuberculosis
APADPAPPADLAPPAP

SEQ ID NO: 123908 - protein, 16 aa, Mycobacterium tuberculosis
PADPAPPADLAPPAPA

SEQ ID NO: 123909 - protein, 16 aa, Mycobacterium tuberculosis
ADPAPPADLAPPAPAD

SEQ ID NO: 123910 - protein, 16 aa, Mycobacterium tuberculosis
DPAPPADLAPPAPADV

SEQ ID NO: 123911 - protein, 16 aa, Mycobacterium tuberculosis
PAPPADLAPPAPADVA

SEQ ID NO: 123912 - protein, 16 aa, Mycobacterium tuberculosis
APPADLAPPAPADVAP

SEQ ID NO: 123913 - protein, 16 aa, Mycobacterium tuberculosis
PPADLAPPAPADVAPP

SEQ ID NO: 123914 - protein, 16 aa, Mycobacterium tuberculosis
PADLAPPAPADVAPPV

SEQ ID NO: 123915 - protein, 16 aa, Mycobacterium tuberculosis
ADLAPPAPADVAPPVE

SEQ ID NO: 123916 - protein, 16 aa, Mycobacterium tuberculosis
DLAPPAPADVAPPVEL

SEQ ID NO: 123917 - protein, 16 aa, Mycobacterium tuberculosis
LAPPAPADVAPPVELA

SEQ ID NO: 123918 - protein, 16 aa, Mycobacterium tuberculosis
APPAPADVAPPVELAV

SEQ ID NO: 123919 - protein, 16 aa, Mycobacterium tuberculosis
PPAPADVAPPVELAVN

SEQ ID NO: 123920 - protein, 16 aa, Mycobacterium tuberculosis
PAPADVAPPVELAVND

SEQ ID NO: 123921 - protein, 16 aa, Mycobacterium tuberculosis
APADVAPPVELAVNDL

SEQ ID NO: 123922 - protein, 16 aa, Mycobacterium tuberculosis
PADVAPPVELAVNDLP

SEQ ID NO: 123923 - protein, 16 aa, Mycobacterium tuberculosis
ADVAPPVELAVNDLPA

SEQ ID NO: 123924 - protein, 16 aa, Mycobacterium tuberculosis
DVAPPVELAVNDLPAP

SEQ ID NO: 123925 - protein, 16 aa, Mycobacterium tuberculosis
VAPPVELAVNDLPAPL

SEQ ID NO: 123926 - protein, 16 aa, Mycobacterium tuberculosis
APPVELAVNDLPAPLG

SEQ ID NO: 123927 - protein, 16 aa, Mycobacterium tuberculosis
PPVELAVNDLPAPLGE

SEQ ID NO: 123928 - protein, 16 aa, Mycobacterium tuberculosis
PVELAVNDLPAPLGEP

SEQ ID NO: 123929 - protein, 16 aa, Mycobacterium tuberculosis
VELAVNDLPAPLGEPL

SEQ ID NO: 123930 - protein, 16 aa, Mycobacterium tuberculosis
ELAVNDLPAPLGEPLP

SEQ ID NO: 123931 - protein, 16 aa, Mycobacterium tuberculosis
LAVNDLPAPLGEPLPA

SEQ ID NO: 123932 - protein, 16 aa, Mycobacterium tuberculosis
AVNDLPAPLGEPLPAA

SEQ ID NO: 123933 - protein, 16 aa, Mycobacterium tuberculosis
VNDLPAPLGEPLPAAP

SEQ ID NO: 123934 - protein, 16 aa, Mycobacterium tuberculosis
NDLPAPLGEPLPAAPA

SEQ ID NO: 123935 - protein, 16 aa, Mycobacterium tuberculosis
DLPAPLGEPLPAAPAD

SEQ ID NO: 123936 - protein, 16 aa, Mycobacterium tuberculosis
LPAPLGEPLPAAPADP

SEQ ID NO: 123937 - protein, 16 aa, Mycobacterium tuberculosis
PAPLGEPLPAAPADPA

SEQ ID NO: 123938 - protein, 16 aa, Mycobacterium tuberculosis
APLGEPLPAAPADPAP

SEQ ID NO: 123939 - protein, 16 aa, Mycobacterium tuberculosis
PLGEPLPAAPADPAPP

SEQ ID NO: 123940 - protein, 16 aa, Mycobacterium tuberculosis
LGEPLPAAPADPAPPA

SEQ ID NO: 123941 - protein, 16 aa, Mycobacterium tuberculosis
GEPLPAAPADPAPPAD

SEQ ID NO: 123942 - protein, 16 aa, Mycobacterium tuberculosis
EPLPAAPADPAPPADL

SEQ ID NO: 123943 - protein, 16 aa, Mycobacterium tuberculosis
PLPAAPADPAPPADLA

SEQ ID NO: 123944 - protein, 16 aa, Mycobacterium tuberculosis
LPAAPADPAPPADLAP

SEQ ID NO: 123945 - protein, 16 aa, Mycobacterium tuberculosis
PAAPADPAPPADLAPP

SEQ ID NO: 123946 - protein, 16 aa, Mycobacterium tuberculosis
AAPADPAPPADLAPPA

SEQ ID NO: 123947 - protein, 16 aa, Mycobacterium tuberculosis
APADPAPPADLAPPAP

SEQ ID NO: 123948 - protein, 16 aa, Mycobacterium tuberculosis
PADPAPPADLAPPAPA

SEQ ID NO: 123949 - protein, 16 aa, Mycobacterium tuberculosis
ADPAPPADLAPPAPAD

SEQ ID NO: 123950 - protein, 16 aa, Mycobacterium tuberculosis
DPAPPADLAPPAPADL

SEQ ID NO: 123951 - protein, 16 aa, Mycobacterium tuberculosis
PAPPADLAPPAPADLA

SEQ ID NO: 123952 - protein, 16 aa, Mycobacterium tuberculosis
APPADLAPPAPADLAP

SEQ ID NO: 123953 - protein, 16 aa, Mycobacterium tuberculosis
PPADLAPPAPADLAPP

SEQ ID NO: 123954 - protein, 16 aa, Mycobacterium tuberculosis
PADLAPPAPADLAPPA

SEQ ID NO: 123955 - protein, 16 aa, Mycobacterium tuberculosis
ADLAPPAPADLAPPAP

SEQ ID NO: 123956 - protein, 16 aa, Mycobacterium tuberculosis
DLAPPAPADLAPPAPA

SEQ ID NO: 123957 - protein, 16 aa, Mycobacterium tuberculosis
LAPPAPADLAPPAPAD

SEQ ID NO: 123958 - protein, 16 aa, Mycobacterium tuberculosis
APPAPADLAPPAPADL

SEQ ID NO: 123959 - protein, 16 aa, Mycobacterium tuberculosis
PPAPADLAPPAPADLA

SEQ ID NO: 123960 - protein, 16 aa, Mycobacterium tuberculosis
PAPADLAPPAPADLAP

SEQ ID NO: 123961 - protein, 16 aa, Mycobacterium tuberculosis
APADLAPPAPADLAPP

SEQ ID NO: 123962 - protein, 16 aa, Mycobacterium tuberculosis
PADLAPPAPADLAPPA

SEQ ID NO: 123963 - protein, 16 aa, Mycobacterium tuberculosis
ADLAPPAPADLAPPAP

SEQ ID NO: 123964 - protein, 16 aa, Mycobacterium tuberculosis
DLAPPAPADLAPPAPA

SEQ ID NO: 123965 - protein, 16 aa, Mycobacterium tuberculosis
LAPPAPADLAPPAPAD

SEQ ID NO: 123966 - protein, 16 aa, Mycobacterium tuberculosis
APPAPADLAPPAPADL

SEQ ID NO: 123967 - protein, 16 aa, Mycobacterium tuberculosis
PPAPADLAPPAPADLA

SEQ ID NO: 123968 - protein, 16 aa, Mycobacterium tuberculosis
PAPADLAPPAPADLAP

SEQ ID NO: 123969 - protein, 16 aa, Mycobacterium tuberculosis
APADLAPPAPADLAPP

SEQ ID NO: 123970 - protein, 16 aa, Mycobacterium tuberculosis
PADLAPPAPADLAPPV

SEQ ID NO: 123971 - protein, 16 aa, Mycobacterium tuberculosis
ADLAPPAPADLAPPVE

SEQ ID NO: 123972 - protein, 16 aa, Mycobacterium tuberculosis
DLAPPAPADLAPPVEL

SEQ ID NO: 123973 - protein, 16 aa, Mycobacterium tuberculosis
LAPPAPADLAPPVELA

SEQ ID NO: 123974 - protein, 16 aa, Mycobacterium tuberculosis
APPAPADLAPPVELAV

SEQ ID NO: 123975 - protein, 16 aa, Mycobacterium tuberculosis
PPAPADLAPPVELAVN

SEQ ID NO: 123976 - protein, 16 aa, Mycobacterium tuberculosis
PAPADLAPPVELAVND

SEQ ID NO: 123977 - protein, 16 aa, Mycobacterium tuberculosis
APADLAPPVELAVNDL

SEQ ID NO: 123978 - protein, 16 aa, Mycobacterium tuberculosis
PADLAPPVELAVNDLP

SEQ ID NO: 123979 - protein, 16 aa, Mycobacterium tuberculosis
ADLAPPVELAVNDLPA

SEQ ID NO: 123980 - protein, 16 aa, Mycobacterium tuberculosis
DLAPPVELAVNDLPAP

SEQ ID NO: 123981 - protein, 16 aa, Mycobacterium tuberculosis
LAPPVELAVNDLPAPL

SEQ ID NO: 123982 - protein, 16 aa, Mycobacterium tuberculosis
APPVELAVNDLPAPLG

SEQ ID NO: 123983 - protein, 16 aa, Mycobacterium tuberculosis
PPVELAVNDLPAPLGE

SEQ ID NO: 123984 - protein, 16 aa, Mycobacterium tuberculosis
PVELAVNDLPAPLGEP

SEQ ID NO: 123985 - protein, 16 aa, Mycobacterium tuberculosis
VELAVNDLPAPLGEPL

SEQ ID NO: 123986 - protein, 16 aa, Mycobacterium tuberculosis
ELAVNDLPAPLGEPLP

SEQ ID NO: 123987 - protein, 16 aa, Mycobacterium tuberculosis
LAVNDLPAPLGEPLPA

SEQ ID NO: 123988 - protein, 16 aa, Mycobacterium tuberculosis
AVNDLPAPLGEPLPAA

SEQ ID NO: 123989 - protein, 16 aa, Mycobacterium tuberculosis
VNDLPAPLGEPLPAAP

SEQ ID NO: 123990 - protein, 16 aa, Mycobacterium tuberculosis
NDLPAPLGEPLPAAPA

SEQ ID NO: 123991 - protein, 16 aa, Mycobacterium tuberculosis
DLPAPLGEPLPAAPAE

SEQ ID NO: 123992 - protein, 16 aa, Mycobacterium tuberculosis
LPAPLGEPLPAAPAEL

SEQ ID NO: 123993 - protein, 16 aa, Mycobacterium tuberculosis
PAPLGEPLPAAPAELA

SEQ ID NO: 123994 - protein, 16 aa, Mycobacterium tuberculosis
APLGEPLPAAPAELAP

SEQ ID NO: 123995 - protein, 16 aa, Mycobacterium tuberculosis
PLGEPLPAAPAELAPP

SEQ ID NO: 123996 - protein, 16 aa, Mycobacterium tuberculosis
LGEPLPAAPAELAPPA

SEQ ID NO: 123997 - protein, 16 aa, Mycobacterium tuberculosis
GEPLPAAPAELAPPAD

SEQ ID NO: 123998 - protein, 16 aa, Mycobacterium tuberculosis
EPLPAAPAELAPPADL

SEQ ID NO: 123999 - protein, 16 aa, Mycobacterium tuberculosis
PLPAAPAELAPPADLA

SEQ ID NO: 124000 - protein, 16 aa, Mycobacterium tuberculosis
LPAAPAELAPPADLAP

SEQ ID NO: 124001 - protein, 16 aa, Mycobacterium tuberculosis
PAAPAELAPPADLAPA

SEQ ID NO: 124002 - protein, 16 aa, Mycobacterium tuberculosis
AAPAELAPPADLAPAS

SEQ ID NO: 124003 - protein, 16 aa, Mycobacterium tuberculosis
APAELAPPADLAPASA

SEQ ID NO: 124004 - protein, 16 aa, Mycobacterium tuberculosis
PAELAPPADLAPASAD

SEQ ID NO: 124005 - protein, 16 aa, Mycobacterium tuberculosis
AELAPPADLAPASADL

SEQ ID NO: 124006 - protein, 16 aa, Mycobacterium tuberculosis
ELAPPADLAPASADLA

SEQ ID NO: 124007 - protein, 16 aa, Mycobacterium tuberculosis
LAPPADLAPASADLAP

SEQ ID NO: 124008 - protein, 16 aa, Mycobacterium tuberculosis
APPADLAPASADLAPP

SEQ ID NO: 124009 - protein, 16 aa, Mycobacterium tuberculosis
PPADLAPASADLAPPA

SEQ ID NO: 124010 - protein, 16 aa, Mycobacterium tuberculosis
PADLAPASADLAPPAP

SEQ ID NO: 124011 - protein, 16 aa, Mycobacterium tuberculosis
ADLAPASADLAPPAPA

SEQ ID NO: 124012 - protein, 16 aa, Mycobacterium tuberculosis
DLAPASADLAPPAPAD

SEQ ID NO: 124013 - protein, 16 aa, Mycobacterium tuberculosis
LAPASADLAPPAPADL

SEQ ID NO: 124014 - protein, 16 aa, Mycobacterium tuberculosis
APASADLAPPAPADLA

SEQ ID NO: 124015 - protein, 16 aa, Mycobacterium tuberculosis
PASADLAPPAPADLAP

SEQ ID NO: 124016 - protein, 16 aa, Mycobacterium tuberculosis
ASADLAPPAPADLAPP

SEQ ID NO: 124017 - protein, 16 aa, Mycobacterium tuberculosis
SADLAPPAPADLAPPA

SEQ ID NO: 124018 - protein, 16 aa, Mycobacterium tuberculosis
ADLAPPAPADLAPPAP

SEQ ID NO: 124019 - protein, 16 aa, Mycobacterium tuberculosis
DLAPPAPADLAPPAPA

SEQ ID NO: 124020 - protein, 16 aa, Mycobacterium tuberculosis
LAPPAPADLAPPAPAE

SEQ ID NO: 124021 - protein, 16 aa, Mycobacterium tuberculosis
APPAPADLAPPAPAEL

SEQ ID NO: 124022 - protein, 16 aa, Mycobacterium tuberculosis
PPAPADLAPPAPAELA

SEQ ID NO: 124023 - protein, 16 aa, Mycobacterium tuberculosis
PAPADLAPPAPAELAP

SEQ ID NO: 124024 - protein, 16 aa, Mycobacterium tuberculosis
APADLAPPAPAELAPP

SEQ ID NO: 124025 - protein, 16 aa, Mycobacterium tuberculosis
PADLAPPAPAELAPPA

SEQ ID NO: 124026 - protein, 16 aa, Mycobacterium tuberculosis
ADLAPPAPAELAPPAP

SEQ ID NO: 124027 - protein, 16 aa, Mycobacterium tuberculosis
DLAPPAPAELAPPAPA

SEQ ID NO: 124028 - protein, 16 aa, Mycobacterium tuberculosis
LAPPAPAELAPPAPAD

SEQ ID NO: 124029 - protein, 16 aa, Mycobacterium tuberculosis
APPAPAELAPPAPADL

SEQ ID NO: 124030 - protein, 16 aa, Mycobacterium tuberculosis
PPAPAELAPPAPADLA

SEQ ID NO: 124031 - protein, 16 aa, Mycobacterium tuberculosis
PAPAELAPPAPADLAP

SEQ ID NO: 124032 - protein, 16 aa, Mycobacterium tuberculosis
APAELAPPAPADLAPP

SEQ ID NO: 124033 - protein, 16 aa, Mycobacterium tuberculosis
PAELAPPAPADLAPPA

SEQ ID NO: 124034 - protein, 16 aa, Mycobacterium tuberculosis
AELAPPAPADLAPPAA

SEQ ID NO: 124035 - protein, 16 aa, Mycobacterium tuberculosis
ELAPPAPADLAPPAAV

SEQ ID NO: 124036 - protein, 16 aa, Mycobacterium tuberculosis
LAPPAPADLAPPAAVN

SEQ ID NO: 124037 - protein, 16 aa, Mycobacterium tuberculosis
APPAPADLAPPAAVNE

SEQ ID NO: 124038 - protein, 16 aa, Mycobacterium tuberculosis
PPAPADLAPPAAVNEQ

SEQ ID NO: 124039 - protein, 16 aa, Mycobacterium tuberculosis
PAPADLAPPAAVNEQT

SEQ ID NO: 124040 - protein, 16 aa, Mycobacterium tuberculosis
APADLAPPAAVNEQTA

SEQ ID NO: 124041 - protein, 16 aa, Mycobacterium tuberculosis
PADLAPPAAVNEQTAP

SEQ ID NO: 124042 - protein, 16 aa, Mycobacterium tuberculosis
ADLAPPAAVNEQTAPG

SEQ ID NO: 124043 - protein, 16 aa, Mycobacterium tuberculosis
DLAPPAAVNEQTAPGD

SEQ ID NO: 124044 - protein, 16 aa, Mycobacterium tuberculosis
LAPPAAVNEQTAPGDQ

SEQ ID NO: 124045 - protein, 16 aa, Mycobacterium tuberculosis
APPAAVNEQTAPGDQP

SEQ ID NO: 124046 - protein, 16 aa, Mycobacterium tuberculosis
PPAAVNEQTAPGDQPA

SEQ ID NO: 124047 - protein, 16 aa, Mycobacterium tuberculosis
PAAVNEQTAPGDQPAT

SEQ ID NO: 124048 - protein, 16 aa, Mycobacterium tuberculosis
AAVNEQTAPGDQPATA

SEQ ID NO: 124049 - protein, 16 aa, Mycobacterium tuberculosis
AVNEQTAPGDQPATAP

SEQ ID NO: 124050 - protein, 16 aa, Mycobacterium tuberculosis
VNEQTAPGDQPATAPG

SEQ ID NO: 124051 - protein, 16 aa, Mycobacterium tuberculosis
NEQTAPGDQPATAPGG

SEQ ID NO: 124052 - protein, 16 aa, Mycobacterium tuberculosis
EQTAPGDQPATAPGGP

SEQ ID NO: 124053 - protein, 16 aa, Mycobacterium tuberculosis
QTAPGDQPATAPGGPV

SEQ ID NO: 124054 - protein, 16 aa, Mycobacterium tuberculosis
TAPGDQPATAPGGPVG

SEQ ID NO: 124055 - protein, 16 aa, Mycobacterium tuberculosis
APGDQPATAPGGPVGL

SEQ ID NO: 124056 - protein, 16 aa, Mycobacterium tuberculosis
PGDQPATAPGGPVGLA

SEQ ID NO: 124057 - protein, 16 aa, Mycobacterium tuberculosis
GDQPATAPGGPVGLAT

SEQ ID NO: 124058 - protein, 16 aa, Mycobacterium tuberculosis
DQPATAPGGPVGLATD

SEQ ID NO: 124059 - protein, 16 aa, Mycobacterium tuberculosis
QPATAPGGPVGLATDL

SEQ ID NO: 124060 - protein, 16 aa, Mycobacterium tuberculosis
PATAPGGPVGLATDLE

SEQ ID NO: 124061 - protein, 16 aa, Mycobacterium tuberculosis
ATAPGGPVGLATDLEL

SEQ ID NO: 124062 - protein, 16 aa, Mycobacterium tuberculosis
TAPGGPVGLATDLELP

SEQ ID NO: 124063 - protein, 16 aa, Mycobacterium tuberculosis
APGGPVGLATDLELPE

SEQ ID NO: 124064 - protein, 16 aa, Mycobacterium tuberculosis
PGGPVGLATDLELPEP

SEQ ID NO: 124065 - protein, 16 aa, Mycobacterium tuberculosis
GGPVGLATDLELPEPD

SEQ ID NO: 124066 - protein, 16 aa, Mycobacterium tuberculosis
GPVGLATDLELPEPDP

SEQ ID NO: 124067 - protein, 16 aa, Mycobacterium tuberculosis
PVGLATDLELPEPDPQ

SEQ ID NO: 124068 - protein, 16 aa, Mycobacterium tuberculosis
VGLATDLELPEPDPQP

SEQ ID NO: 124069 - protein, 16 aa, Mycobacterium tuberculosis
GLATDLELPEPDPQPA

SEQ ID NO: 124070 - protein, 16 aa, Mycobacterium tuberculosis
LATDLELPEPDPQPAD

SEQ ID NO: 124071 - protein, 16 aa, Mycobacterium tuberculosis
ATDLELPEPDPQPADA

SEQ ID NO: 124072 - protein, 16 aa, Mycobacterium tuberculosis
TDLELPEPDPQPADAP

SEQ ID NO: 124073 - protein, 16 aa, Mycobacterium tuberculosis
DLELPEPDPQPADAPP

SEQ ID NO: 124074 - protein, 16 aa, Mycobacterium tuberculosis
LELPEPDPQPADAPPP

SEQ ID NO: 124075 - protein, 16 aa, Mycobacterium tuberculosis
ELPEPDPQPADAPPPG

SEQ ID NO: 124076 - protein, 16 aa, Mycobacterium tuberculosis
LPEPDPQPADAPPPGD

SEQ ID NO: 124077 - protein, 16 aa, Mycobacterium tuberculosis
PEPDPQPADAPPPGDV

SEQ ID NO: 124078 - protein, 16 aa, Mycobacterium tuberculosis
EPDPQPADAPPPGDVT

SEQ ID NO: 124079 - protein, 16 aa, Mycobacterium tuberculosis
PDPQPADAPPPGDVTE

SEQ ID NO: 124080 - protein, 16 aa, Mycobacterium tuberculosis
DPQPADAPPPGDVTEA

SEQ ID NO: 124081 - protein, 16 aa, Mycobacterium tuberculosis
PQPADAPPPGDVTEAP

SEQ ID NO: 124082 - protein, 16 aa, Mycobacterium tuberculosis
QPADAPPPGDVTEAPA

SEQ ID NO: 124083 - protein, 16 aa, Mycobacterium tuberculosis
PADAPPPGDVTEAPAE

SEQ ID NO: 124084 - protein, 16 aa, Mycobacterium tuberculosis
ADAPPPGDVTEAPAET

SEQ ID NO: 124085 - protein, 16 aa, Mycobacterium tuberculosis
DAPPPGDVTEAPAETP

SEQ ID NO: 124086 - protein, 16 aa, Mycobacterium tuberculosis
APPPGDVTEAPAETPQ

SEQ ID NO: 124087 - protein, 16 aa, Mycobacterium tuberculosis
PPPGDVTEAPAETPQV

SEQ ID NO: 124088 - protein, 16 aa, Mycobacterium tuberculosis
PPGDVTEAPAETPQVS

SEQ ID NO: 124089 - protein, 16 aa, Mycobacterium tuberculosis
PGDVTEAPAETPQVSN

SEQ ID NO: 124090 - protein, 16 aa, Mycobacterium tuberculosis
GDVTEAPAETPQVSNI

SEQ ID NO: 124091 - protein, 16 aa, Mycobacterium tuberculosis
DVTEAPAETPQVSNIA

SEQ ID NO: 124092 - protein, 16 aa, Mycobacterium tuberculosis
VTEAPAETPQVSNIAY

SEQ ID NO: 124093 - protein, 16 aa, Mycobacterium tuberculosis
TEAPAETPQVSNIAYT

SEQ ID NO: 124094 - protein, 16 aa, Mycobacterium tuberculosis
EAPAETPQVSNIAYTK

SEQ ID NO: 124095 - protein, 16 aa, Mycobacterium tuberculosis
APAETPQVSNIAYTKK

SEQ ID NO: 124096 - protein, 16 aa, Mycobacterium tuberculosis
PAETPQVSNIAYTKKL

SEQ ID NO: 124097 - protein, 16 aa, Mycobacterium tuberculosis
AETPQVSNIAYTKKLW

SEQ ID NO: 124098 - protein, 16 aa, Mycobacterium tuberculosis
ETPQVSNIAYTKKLWQ

SEQ ID NO: 124099 - protein, 16 aa, Mycobacterium tuberculosis
TPQVSNIAYTKKLWQA

SEQ ID NO: 124100 - protein, 16 aa, Mycobacterium tuberculosis
PQVSNIAYTKKLWQAI

SEQ ID NO: 124101 - protein, 16 aa, Mycobacterium tuberculosis
QVSNIAYTKKLWQAIR

SEQ ID NO: 124102 - protein, 16 aa, Mycobacterium tuberculosis
VSNIAYTKKLWQAIRA

SEQ ID NO: 124103 - protein, 16 aa, Mycobacterium tuberculosis
SNIAYTKKLWQAIRAQ

SEQ ID NO: 124104 - protein, 16 aa, Mycobacterium tuberculosis
NIAYTKKLWQAIRAQD

SEQ ID NO: 124105 - protein, 16 aa, Mycobacterium tuberculosis
IAYTKKLWQAIRAQDV

SEQ ID NO: 124106 - protein, 16 aa, Mycobacterium tuberculosis
AYTKKLWQAIRAQDVC

SEQ ID NO: 124107 - protein, 16 aa, Mycobacterium tuberculosis
YTKKLWQAIRAQDVCG

SEQ ID NO: 124108 - protein, 16 aa, Mycobacterium tuberculosis
TKKLWQAIRAQDVCGN

SEQ ID NO: 124109 - protein, 16 aa, Mycobacterium tuberculosis
KKLWQAIRAQDVCGND

SEQ ID NO: 124110 - protein, 16 aa, Mycobacterium tuberculosis
KLWQAIRAQDVCGNDA

SEQ ID NO: 124111 - protein, 16 aa, Mycobacterium tuberculosis
LWQAIRAQDVCGNDAL

SEQ ID NO: 124112 - protein, 16 aa, Mycobacterium tuberculosis
WQAIRAQDVCGNDALD

SEQ ID NO: 124113 - protein, 16 aa, Mycobacterium tuberculosis
QAIRAQDVCGNDALDS

SEQ ID NO: 124114 - protein, 16 aa, Mycobacterium tuberculosis
AIRAQDVCGNDALDSL

SEQ ID NO: 124115 - protein, 16 aa, Mycobacterium tuberculosis
IRAQDVCGNDALDSLA

SEQ ID NO: 124116 - protein, 16 aa, Mycobacterium tuberculosis
RAQDVCGNDALDSLAQ

SEQ ID NO: 124117 - protein, 16 aa, Mycobacterium tuberculosis
AQDVCGNDALDSLAQP

SEQ ID NO: 124118 - protein, 16 aa, Mycobacterium tuberculosis
QDVCGNDALDSLAQPY

SEQ ID NO: 124119 - protein, 16 aa, Mycobacterium tuberculosis
DVCGNDALDSLAQPYV

SEQ ID NO: 124120 - protein, 16 aa, Mycobacterium tuberculosis
VCGNDALDSLAQPYVI

SEQ ID NO: 124121 - protein, 16 aa, Mycobacterium tuberculosis
CGNDALDSLAQPYVIG

SEQ ID NO: 124122 - protein, 144 aa, Mycobacterium tuberculosis
MATTLPVQRHPRSLFPEFSELFAAFPSFAGLRPTFDTRLMRLEDEMKEGRYEVRAELPGVDPDKDVDIMVRDGQLTIKAERTEQKDFDGRSEFAYGSFVRTVSLPVGADEDDIKATYDKGILTVSVAVSEGKPTEKHIQIRSTN

SEQ ID NO: 124123 - protein, 8 aa, Mycobacterium tuberculosis
ATTLPVQR

SEQ ID NO: 124124 - protein, 8 aa, Mycobacterium tuberculosis
LPVQRHPR

SEQ ID NO: 124125 - protein, 8 aa, Mycobacterium tuberculosis
VQRHPRSL

SEQ ID NO: 124126 - protein, 8 aa, Mycobacterium tuberculosis
HPRSLFPE

SEQ ID NO: 124127 - protein, 8 aa, Mycobacterium tuberculosis
SLFPEFSE

SEQ ID NO: 124128 - protein, 8 aa, Mycobacterium tuberculosis
LFPEFSEL

SEQ ID NO: 124129 - protein, 8 aa, Mycobacterium tuberculosis
FPEFSELF

SEQ ID NO: 124130 - protein, 8 aa, Mycobacterium tuberculosis
FSELFAAF

SEQ ID NO: 124131 - protein, 8 aa, Mycobacterium tuberculosis
ELFAAFPS

SEQ ID NO: 124132 - protein, 8 aa, Mycobacterium tuberculosis
LFAAFPSF

SEQ ID NO: 124133 - protein, 8 aa, Mycobacterium tuberculosis
FAAFPSFA

SEQ ID NO: 124134 - protein, 8 aa, Mycobacterium tuberculosis
AFPSFAGL

SEQ ID NO: 124135 - protein, 8 aa, Mycobacterium tuberculosis
FPSFAGLR

SEQ ID NO: 124136 - protein, 8 aa, Mycobacterium tuberculosis
FAGLRPTF

SEQ ID NO: 124137 - protein, 8 aa, Mycobacterium tuberculosis
RPTFDTRL

SEQ ID NO: 124138 - protein, 8 aa, Mycobacterium tuberculosis
PTFDTRLM

SEQ ID NO: 124139 - protein, 8 aa, Mycobacterium tuberculosis
TFDTRLMR

SEQ ID NO: 124140 - protein, 8 aa, Mycobacterium tuberculosis
DEMKEGRY

SEQ ID NO: 124141 - protein, 8 aa, Mycobacterium tuberculosis
RYEVRAEL

SEQ ID NO: 124142 - protein, 8 aa, Mycobacterium tuberculosis
GVDPDKDV

SEQ ID NO: 124143 - protein, 8 aa, Mycobacterium tuberculosis
IMVRDGQL

SEQ ID NO: 124144 - protein, 8 aa, Mycobacterium tuberculosis
QLTIKAER

SEQ ID NO: 124145 - protein, 8 aa, Mycobacterium tuberculosis
KAERTEQK

SEQ ID NO: 124146 - protein, 8 aa, Mycobacterium tuberculosis
EQKDFDGR

SEQ ID NO: 124147 - protein, 8 aa, Mycobacterium tuberculosis
DFDGRSEF

SEQ ID NO: 124148 - protein, 8 aa, Mycobacterium tuberculosis
SEFAYGSF

SEQ ID NO: 124149 - protein, 8 aa, Mycobacterium tuberculosis
EFAYGSFV

SEQ ID NO: 124150 - protein, 8 aa, Mycobacterium tuberculosis
FAYGSFVR

SEQ ID NO: 124151 - protein, 8 aa, Mycobacterium tuberculosis
YGSFVRTV

SEQ ID NO: 124152 - protein, 8 aa, Mycobacterium tuberculosis
SFVRTVSL

SEQ ID NO: 124153 - protein, 8 aa, Mycobacterium tuberculosis
TVSLPVGA

SEQ ID NO: 124154 - protein, 8 aa, Mycobacterium tuberculosis
DIKATYDK

SEQ ID NO: 124155 - protein, 8 aa, Mycobacterium tuberculosis
ILTVSVAV

SEQ ID NO: 124156 - protein, 8 aa, Mycobacterium tuberculosis
SVAVSEGK

SEQ ID NO: 124157 - protein, 9 aa, Mycobacterium tuberculosis
MATTLPVQR

SEQ ID NO: 124158 - protein, 9 aa, Mycobacterium tuberculosis
TLPVQRHPR

SEQ ID NO: 124159 - protein, 9 aa, Mycobacterium tuberculosis
LPVQRHPRS

SEQ ID NO: 124160 - protein, 9 aa, Mycobacterium tuberculosis
VQRHPRSLF

SEQ ID NO: 124161 - protein, 9 aa, Mycobacterium tuberculosis
HPRSLFPEF

SEQ ID NO: 124162 - protein, 9 aa, Mycobacterium tuberculosis
SLFPEFSEL

SEQ ID NO: 124163 - protein, 9 aa, Mycobacterium tuberculosis
LFPEFSELF

SEQ ID NO: 124164 - protein, 9 aa, Mycobacterium tuberculosis
FPEFSELFA

SEQ ID NO: 124165 - protein, 9 aa, Mycobacterium tuberculosis
EFSELFAAF

SEQ ID NO: 124166 - protein, 9 aa, Mycobacterium tuberculosis
SELFAAFPS

SEQ ID NO: 124167 - protein, 9 aa, Mycobacterium tuberculosis
ELFAAFPSF

SEQ ID NO: 124168 - protein, 9 aa, Mycobacterium tuberculosis
AAFPSFAGL

SEQ ID NO: 124169 - protein, 9 aa, Mycobacterium tuberculosis
AFPSFAGLR

SEQ ID NO: 124170 - protein, 9 aa, Mycobacterium tuberculosis
SFAGLRPTF

SEQ ID NO: 124171 - protein, 9 aa, Mycobacterium tuberculosis
GLRPTFDTR

SEQ ID NO: 124172 - protein, 9 aa, Mycobacterium tuberculosis
RPTFDTRLM

SEQ ID NO: 124173 - protein, 9 aa, Mycobacterium tuberculosis
PTFDTRLMR

SEQ ID NO: 124174 - protein, 9 aa, Mycobacterium tuberculosis
RLMRLEDEM

SEQ ID NO: 124175 - protein, 9 aa, Mycobacterium tuberculosis
EMKEGRYEV

SEQ ID NO: 124176 - protein, 9 aa, Mycobacterium tuberculosis
GRYEVRAEL

SEQ ID NO: 124177 - protein, 9 aa, Mycobacterium tuberculosis
EVRAELPGV

SEQ ID NO: 124178 - protein, 9 aa, Mycobacterium tuberculosis
ELPGVDPDK

SEQ ID NO: 124179 - protein, 9 aa, Mycobacterium tuberculosis
DPDKDVDIM

SEQ ID NO: 124180 - protein, 9 aa, Mycobacterium tuberculosis
MVRDGQLTI

SEQ ID NO: 124181 - protein, 9 aa, Mycobacterium tuberculosis
GQLTIKAER

SEQ ID NO: 124182 - protein, 9 aa, Mycobacterium tuberculosis
AERTEQKDF

SEQ ID NO: 124183 - protein, 9 aa, Mycobacterium tuberculosis
SEFAYGSFV

SEQ ID NO: 124184 - protein, 9 aa, Mycobacterium tuberculosis
EFAYGSFVR

SEQ ID NO: 124185 - protein, 9 aa, Mycobacterium tuberculosis
FAYGSFVRT

SEQ ID NO: 124186 - protein, 9 aa, Mycobacterium tuberculosis
AYGSFVRTV

SEQ ID NO: 124187 - protein, 9 aa, Mycobacterium tuberculosis
FVRTVSLPV

SEQ ID NO: 124188 - protein, 9 aa, Mycobacterium tuberculosis
RTVSLPVGA

SEQ ID NO: 124189 - protein, 9 aa, Mycobacterium tuberculosis
DEDDIKATY

SEQ ID NO: 124190 - protein, 9 aa, Mycobacterium tuberculosis
TYDKGILTV

SEQ ID NO: 124191 - protein, 9 aa, Mycobacterium tuberculosis
GILTVSVAV

SEQ ID NO: 124192 - protein, 9 aa, Mycobacterium tuberculosis
VSVAVSEGK

SEQ ID NO: 124193 - protein, 9 aa, Mycobacterium tuberculosis
VSEGKPTEK

SEQ ID NO: 124194 - protein, 9 aa, Mycobacterium tuberculosis
KPTEKHIQI

SEQ ID NO: 124195 - protein, 10 aa, Mycobacterium tuberculosis
TTLPVQRHPR

SEQ ID NO: 124196 - protein, 10 aa, Mycobacterium tuberculosis
LPVQRHPRSL

SEQ ID NO: 124197 - protein, 10 aa, Mycobacterium tuberculosis
PVQRHPRSLF

SEQ ID NO: 124198 - protein, 10 aa, Mycobacterium tuberculosis
RHPRSLFPEF

SEQ ID NO: 124199 - protein, 10 aa, Mycobacterium tuberculosis
SLFPEFSELF

SEQ ID NO: 124200 - protein, 10 aa, Mycobacterium tuberculosis
FPEFSELFAA

SEQ ID NO: 124201 - protein, 10 aa, Mycobacterium tuberculosis
PEFSELFAAF

SEQ ID NO: 124202 - protein, 10 aa, Mycobacterium tuberculosis
SELFAAFPSF

SEQ ID NO: 124203 - protein, 10 aa, Mycobacterium tuberculosis
ELFAAFPSFA

SEQ ID NO: 124204 - protein, 10 aa, Mycobacterium tuberculosis
FAAFPSFAGL

SEQ ID NO: 124205 - protein, 10 aa, Mycobacterium tuberculosis
AAFPSFAGLR

SEQ ID NO: 124206 - protein, 10 aa, Mycobacterium tuberculosis
FPSFAGLRPT

SEQ ID NO: 124207 - protein, 10 aa, Mycobacterium tuberculosis
GLRPTFDTRL

SEQ ID NO: 124208 - protein, 10 aa, Mycobacterium tuberculosis
RPTFDTRLMR

SEQ ID NO: 124209 - protein, 10 aa, Mycobacterium tuberculosis
PTFDTRLMRL

SEQ ID NO: 124210 - protein, 10 aa, Mycobacterium tuberculosis
RLMRLEDEMK

SEQ ID NO: 124211 - protein, 10 aa, Mycobacterium tuberculosis
DEMKEGRYEV

SEQ ID NO: 124212 - protein, 10 aa, Mycobacterium tuberculosis
EMKEGRYEVR

SEQ ID NO: 124213 - protein, 10 aa, Mycobacterium tuberculosis
YEVRAELPGV

SEQ ID NO: 124214 - protein, 10 aa, Mycobacterium tuberculosis
LPGVDPDKDV

SEQ ID NO: 124215 - protein, 10 aa, Mycobacterium tuberculosis
GVDPDKDVDI

SEQ ID NO: 124216 - protein, 10 aa, Mycobacterium tuberculosis
IMVRDGQLTI

SEQ ID NO: 124217 - protein, 10 aa, Mycobacterium tuberculosis
MVRDGQLTIK

SEQ ID NO: 124218 - protein, 10 aa, Mycobacterium tuberculosis
DGQLTIKAER

SEQ ID NO: 124219 - protein, 10 aa, Mycobacterium tuberculosis
TIKAERTEQK

SEQ ID NO: 124220 - protein, 10 aa, Mycobacterium tuberculosis
RTEQKDFDGR

SEQ ID NO: 124221 - protein, 10 aa, Mycobacterium tuberculosis
DFDGRSEFAY

SEQ ID NO: 124222 - protein, 10 aa, Mycobacterium tuberculosis
GRSEFAYGSF

SEQ ID NO: 124223 - protein, 10 aa, Mycobacterium tuberculosis
SEFAYGSFVR

SEQ ID NO: 124224 - protein, 10 aa, Mycobacterium tuberculosis
FAYGSFVRTV

SEQ ID NO: 124225 - protein, 10 aa, Mycobacterium tuberculosis
YGSFVRTVSL

SEQ ID NO: 124226 - protein, 10 aa, Mycobacterium tuberculosis
SFVRTVSLPV

SEQ ID NO: 124227 - protein, 10 aa, Mycobacterium tuberculosis
LPVGADEDDI

SEQ ID NO: 124228 - protein, 10 aa, Mycobacterium tuberculosis
ATYDKGILTV

SEQ ID NO: 124229 - protein, 10 aa, Mycobacterium tuberculosis
TVSVAVSEGK

SEQ ID NO: 124230 - protein, 10 aa, Mycobacterium tuberculosis
AVSEGKPTEK

SEQ ID NO: 124231 - protein, 11 aa, Mycobacterium tuberculosis
ATTLPVQRHPR

SEQ ID NO: 124232 - protein, 11 aa, Mycobacterium tuberculosis
TLPVQRHPRSL

SEQ ID NO: 124233 - protein, 11 aa, Mycobacterium tuberculosis
LPVQRHPRSLF

SEQ ID NO: 124234 - protein, 11 aa, Mycobacterium tuberculosis
RSLFPEFSELF

SEQ ID NO: 124235 - protein, 11 aa, Mycobacterium tuberculosis
SLFPEFSELFA

SEQ ID NO: 124236 - protein, 11 aa, Mycobacterium tuberculosis
FPEFSELFAAF

SEQ ID NO: 124237 - protein, 11 aa, Mycobacterium tuberculosis
FSELFAAFPSF

SEQ ID NO: 124238 - protein, 11 aa, Mycobacterium tuberculosis
FAAFPSFAGLR

SEQ ID NO: 124239 - protein, 11 aa, Mycobacterium tuberculosis
FPSFAGLRPTF

SEQ ID NO: 124240 - protein, 11 aa, Mycobacterium tuberculosis
FAGLRPTFDTR

SEQ ID NO: 124241 - protein, 11 aa, Mycobacterium tuberculosis
GLRPTFDTRLM

SEQ ID NO: 124242 - protein, 11 aa, Mycobacterium tuberculosis
RPTFDTRLMRL

SEQ ID NO: 124243 - protein, 11 aa, Mycobacterium tuberculosis
DTRLMRLEDEM

SEQ ID NO: 124244 - protein, 11 aa, Mycobacterium tuberculosis
EMKEGRYEVRA

SEQ ID NO: 124245 - protein, 11 aa, Mycobacterium tuberculosis
KEGRYEVRAEL

SEQ ID NO: 124246 - protein, 11 aa, Mycobacterium tuberculosis
RAELPGVDPDK

SEQ ID NO: 124247 - protein, 11 aa, Mycobacterium tuberculosis
ELPGVDPDKDV

SEQ ID NO: 124248 - protein, 11 aa, Mycobacterium tuberculosis
IMVRDGQLTIK

SEQ ID NO: 124249 - protein, 11 aa, Mycobacterium tuberculosis
MVRDGQLTIKA

SEQ ID NO: 124250 - protein, 11 aa, Mycobacterium tuberculosis
LTIKAERTEQK

SEQ ID NO: 124251 - protein, 11 aa, Mycobacterium tuberculosis
EQKDFDGRSEF

SEQ ID NO: 124252 - protein, 11 aa, Mycobacterium tuberculosis
RSEFAYGSFVR

SEQ ID NO: 124253 - protein, 11 aa, Mycobacterium tuberculosis
FAYGSFVRTVS

SEQ ID NO: 124254 - protein, 11 aa, Mycobacterium tuberculosis
AYGSFVRTVSL

SEQ ID NO: 124255 - protein, 11 aa, Mycobacterium tuberculosis
FVRTVSLPVGA

SEQ ID NO: 124256 - protein, 11 aa, Mycobacterium tuberculosis
SLPVGADEDDI

SEQ ID NO: 124257 - protein, 11 aa, Mycobacterium tuberculosis
GADEDDIKATY

SEQ ID NO: 124258 - protein, 11 aa, Mycobacterium tuberculosis
DIKATYDKGIL

SEQ ID NO: 124259 - protein, 11 aa, Mycobacterium tuberculosis
KATYDKGILTV

SEQ ID NO: 124260 - protein, 11 aa, Mycobacterium tuberculosis
TYDKGILTVSV

SEQ ID NO: 124261 - protein, 11 aa, Mycobacterium tuberculosis
LTVSVAVSEGK

SEQ ID NO: 124262 - protein, 11 aa, Mycobacterium tuberculosis
VAVSEGKPTEK

SEQ ID NO: 124263 - protein, 13 aa, Mycobacterium tuberculosis
MATTLPVQRHPRS

SEQ ID NO: 124264 - protein, 13 aa, Mycobacterium tuberculosis
ATTLPVQRHPRSL

SEQ ID NO: 124265 - protein, 13 aa, Mycobacterium tuberculosis
TTLPVQRHPRSLF

SEQ ID NO: 124266 - protein, 13 aa, Mycobacterium tuberculosis
TLPVQRHPRSLFP

SEQ ID NO: 124267 - protein, 13 aa, Mycobacterium tuberculosis
LPVQRHPRSLFPE

SEQ ID NO: 124268 - protein, 13 aa, Mycobacterium tuberculosis
PVQRHPRSLFPEF

SEQ ID NO: 124269 - protein, 13 aa, Mycobacterium tuberculosis
VQRHPRSLFPEFS

SEQ ID NO: 124270 - protein, 13 aa, Mycobacterium tuberculosis
QRHPRSLFPEFSE

SEQ ID NO: 124271 - protein, 13 aa, Mycobacterium tuberculosis
RHPRSLFPEFSEL

SEQ ID NO: 124272 - protein, 13 aa, Mycobacterium tuberculosis
HPRSLFPEFSELF

SEQ ID NO: 124273 - protein, 13 aa, Mycobacterium tuberculosis
PRSLFPEFSELFA

SEQ ID NO: 124274 - protein, 13 aa, Mycobacterium tuberculosis
RSLFPEFSELFAA

SEQ ID NO: 124275 - protein, 13 aa, Mycobacterium tuberculosis
SLFPEFSELFAAF

SEQ ID NO: 124276 - protein, 13 aa, Mycobacterium tuberculosis
LFPEFSELFAAFP

SEQ ID NO: 124277 - protein, 13 aa, Mycobacterium tuberculosis
FPEFSELFAAFPS

SEQ ID NO: 124278 - protein, 13 aa, Mycobacterium tuberculosis
PEFSELFAAFPSF

SEQ ID NO: 124279 - protein, 13 aa, Mycobacterium tuberculosis
EFSELFAAFPSFA

SEQ ID NO: 124280 - protein, 13 aa, Mycobacterium tuberculosis
FSELFAAFPSFAG

SEQ ID NO: 124281 - protein, 13 aa, Mycobacterium tuberculosis
SELFAAFPSFAGL

SEQ ID NO: 124282 - protein, 13 aa, Mycobacterium tuberculosis
ELFAAFPSFAGLR

SEQ ID NO: 124283 - protein, 13 aa, Mycobacterium tuberculosis
LFAAFPSFAGLRP

SEQ ID NO: 124284 - protein, 13 aa, Mycobacterium tuberculosis
FAAFPSFAGLRPT

SEQ ID NO: 124285 - protein, 13 aa, Mycobacterium tuberculosis
AAFPSFAGLRPTF

SEQ ID NO: 124286 - protein, 13 aa, Mycobacterium tuberculosis
AFPSFAGLRPTFD

SEQ ID NO: 124287 - protein, 13 aa, Mycobacterium tuberculosis
FPSFAGLRPTFDT

SEQ ID NO: 124288 - protein, 13 aa, Mycobacterium tuberculosis
PSFAGLRPTFDTR

SEQ ID NO: 124289 - protein, 13 aa, Mycobacterium tuberculosis
SFAGLRPTFDTRL

SEQ ID NO: 124290 - protein, 13 aa, Mycobacterium tuberculosis
FAGLRPTFDTRLM

SEQ ID NO: 124291 - protein, 13 aa, Mycobacterium tuberculosis
AGLRPTFDTRLMR

SEQ ID NO: 124292 - protein, 13 aa, Mycobacterium tuberculosis
GLRPTFDTRLMRL

SEQ ID NO: 124293 - protein, 13 aa, Mycobacterium tuberculosis
LRPTFDTRLMRLE

SEQ ID NO: 124294 - protein, 13 aa, Mycobacterium tuberculosis
RPTFDTRLMRLED

SEQ ID NO: 124295 - protein, 13 aa, Mycobacterium tuberculosis
PTFDTRLMRLEDE

SEQ ID NO: 124296 - protein, 13 aa, Mycobacterium tuberculosis
TFDTRLMRLEDEM

SEQ ID NO: 124297 - protein, 13 aa, Mycobacterium tuberculosis
FDTRLMRLEDEMK

SEQ ID NO: 124298 - protein, 13 aa, Mycobacterium tuberculosis
DTRLMRLEDEMKE

SEQ ID NO: 124299 - protein, 13 aa, Mycobacterium tuberculosis
TRLMRLEDEMKEG

SEQ ID NO: 124300 - protein, 13 aa, Mycobacterium tuberculosis
RLMRLEDEMKEGR

SEQ ID NO: 124301 - protein, 13 aa, Mycobacterium tuberculosis
LMRLEDEMKEGRY

SEQ ID NO: 124302 - protein, 13 aa, Mycobacterium tuberculosis
MRLEDEMKEGRYE

SEQ ID NO: 124303 - protein, 13 aa, Mycobacterium tuberculosis
RLEDEMKEGRYEV

SEQ ID NO: 124304 - protein, 13 aa, Mycobacterium tuberculosis
LEDEMKEGRYEVR

SEQ ID NO: 124305 - protein, 13 aa, Mycobacterium tuberculosis
EDEMKEGRYEVRA

SEQ ID NO: 124306 - protein, 13 aa, Mycobacterium tuberculosis
DEMKEGRYEVRAE

SEQ ID NO: 124307 - protein, 13 aa, Mycobacterium tuberculosis
EMKEGRYEVRAEL

SEQ ID NO: 124308 - protein, 13 aa, Mycobacterium tuberculosis
MKEGRYEVRAELP

SEQ ID NO: 124309 - protein, 13 aa, Mycobacterium tuberculosis
KEGRYEVRAELPG

SEQ ID NO: 124310 - protein, 13 aa, Mycobacterium tuberculosis
EGRYEVRAELPGV

SEQ ID NO: 124311 - protein, 13 aa, Mycobacterium tuberculosis
GRYEVRAELPGVD

SEQ ID NO: 124312 - protein, 13 aa, Mycobacterium tuberculosis
RYEVRAELPGVDP

SEQ ID NO: 124313 - protein, 13 aa, Mycobacterium tuberculosis
YEVRAELPGVDPD

SEQ ID NO: 124314 - protein, 13 aa, Mycobacterium tuberculosis
EVRAELPGVDPDK

SEQ ID NO: 124315 - protein, 13 aa, Mycobacterium tuberculosis
VRAELPGVDPDKD

SEQ ID NO: 124316 - protein, 13 aa, Mycobacterium tuberculosis
RAELPGVDPDKDV

SEQ ID NO: 124317 - protein, 13 aa, Mycobacterium tuberculosis
AELPGVDPDKDVD

SEQ ID NO: 124318 - protein, 13 aa, Mycobacterium tuberculosis
ELPGVDPDKDVDI

SEQ ID NO: 124319 - protein, 13 aa, Mycobacterium tuberculosis
LPGVDPDKDVDIM

SEQ ID NO: 124320 - protein, 13 aa, Mycobacterium tuberculosis
PGVDPDKDVDIMV

SEQ ID NO: 124321 - protein, 13 aa, Mycobacterium tuberculosis
GVDPDKDVDIMVR

SEQ ID NO: 124322 - protein, 13 aa, Mycobacterium tuberculosis
VDPDKDVDIMVRD

SEQ ID NO: 124323 - protein, 13 aa, Mycobacterium tuberculosis
DPDKDVDIMVRDG

SEQ ID NO: 124324 - protein, 13 aa, Mycobacterium tuberculosis
PDKDVDIMVRDGQ

SEQ ID NO: 124325 - protein, 13 aa, Mycobacterium tuberculosis
DKDVDIMVRDGQL

SEQ ID NO: 124326 - protein, 13 aa, Mycobacterium tuberculosis
KDVDIMVRDGQLT

SEQ ID NO: 124327 - protein, 13 aa, Mycobacterium tuberculosis
DVDIMVRDGQLTI

SEQ ID NO: 124328 - protein, 13 aa, Mycobacterium tuberculosis
VDIMVRDGQLTIK

SEQ ID NO: 124329 - protein, 13 aa, Mycobacterium tuberculosis
DIMVRDGQLTIKA

SEQ ID NO: 124330 - protein, 13 aa, Mycobacterium tuberculosis
IMVRDGQLTIKAE

SEQ ID NO: 124331 - protein, 13 aa, Mycobacterium tuberculosis
MVRDGQLTIKAER

SEQ ID NO: 124332 - protein, 13 aa, Mycobacterium tuberculosis
VRDGQLTIKAERT

SEQ ID NO: 124333 - protein, 13 aa, Mycobacterium tuberculosis
RDGQLTIKAERTE

SEQ ID NO: 124334 - protein, 13 aa, Mycobacterium tuberculosis
DGQLTIKAERTEQ

SEQ ID NO: 124335 - protein, 13 aa, Mycobacterium tuberculosis
GQLTIKAERTEQK

SEQ ID NO: 124336 - protein, 13 aa, Mycobacterium tuberculosis
QLTIKAERTEQKD

SEQ ID NO: 124337 - protein, 13 aa, Mycobacterium tuberculosis
LTIKAERTEQKDF

SEQ ID NO: 124338 - protein, 13 aa, Mycobacterium tuberculosis
TIKAERTEQKDFD

SEQ ID NO: 124339 - protein, 13 aa, Mycobacterium tuberculosis
IKAERTEQKDFDG

SEQ ID NO: 124340 - protein, 13 aa, Mycobacterium tuberculosis
KAERTEQKDFDGR

SEQ ID NO: 124341 - protein, 13 aa, Mycobacterium tuberculosis
AERTEQKDFDGRS

SEQ ID NO: 124342 - protein, 13 aa, Mycobacterium tuberculosis
ERTEQKDFDGRSE

SEQ ID NO: 124343 - protein, 13 aa, Mycobacterium tuberculosis
RTEQKDFDGRSEF

SEQ ID NO: 124344 - protein, 13 aa, Mycobacterium tuberculosis
TEQKDFDGRSEFA

SEQ ID NO: 124345 - protein, 13 aa, Mycobacterium tuberculosis
EQKDFDGRSEFAY

SEQ ID NO: 124346 - protein, 13 aa, Mycobacterium tuberculosis
QKDFDGRSEFAYG

SEQ ID NO: 124347 - protein, 13 aa, Mycobacterium tuberculosis
KDFDGRSEFAYGS

SEQ ID NO: 124348 - protein, 13 aa, Mycobacterium tuberculosis
DFDGRSEFAYGSF

SEQ ID NO: 124349 - protein, 13 aa, Mycobacterium tuberculosis
FDGRSEFAYGSFV

SEQ ID NO: 124350 - protein, 13 aa, Mycobacterium tuberculosis
DGRSEFAYGSFVR

SEQ ID NO: 124351 - protein, 13 aa, Mycobacterium tuberculosis
GRSEFAYGSFVRT

SEQ ID NO: 124352 - protein, 13 aa, Mycobacterium tuberculosis
RSEFAYGSFVRTV

SEQ ID NO: 124353 - protein, 13 aa, Mycobacterium tuberculosis
SEFAYGSFVRTVS

SEQ ID NO: 124354 - protein, 13 aa, Mycobacterium tuberculosis
EFAYGSFVRTVSL

SEQ ID NO: 124355 - protein, 13 aa, Mycobacterium tuberculosis
FAYGSFVRTVSLP

SEQ ID NO: 124356 - protein, 13 aa, Mycobacterium tuberculosis
AYGSFVRTVSLPV

SEQ ID NO: 124357 - protein, 13 aa, Mycobacterium tuberculosis
YGSFVRTVSLPVG

SEQ ID NO: 124358 - protein, 13 aa, Mycobacterium tuberculosis
GSFVRTVSLPVGA

SEQ ID NO: 124359 - protein, 13 aa, Mycobacterium tuberculosis
SFVRTVSLPVGAD

SEQ ID NO: 124360 - protein, 13 aa, Mycobacterium tuberculosis
FVRTVSLPVGADE

SEQ ID NO: 124361 - protein, 13 aa, Mycobacterium tuberculosis
VRTVSLPVGADED

SEQ ID NO: 124362 - protein, 13 aa, Mycobacterium tuberculosis
RTVSLPVGADEDD

SEQ ID NO: 124363 - protein, 13 aa, Mycobacterium tuberculosis
TVSLPVGADEDDI

SEQ ID NO: 124364 - protein, 13 aa, Mycobacterium tuberculosis
VSLPVGADEDDIK

SEQ ID NO: 124365 - protein, 13 aa, Mycobacterium tuberculosis
SLPVGADEDDIKA

SEQ ID NO: 124366 - protein, 13 aa, Mycobacterium tuberculosis
LPVGADEDDIKAT

SEQ ID NO: 124367 - protein, 13 aa, Mycobacterium tuberculosis
PVGADEDDIKATY

SEQ ID NO: 124368 - protein, 13 aa, Mycobacterium tuberculosis
VGADEDDIKATYD

SEQ ID NO: 124369 - protein, 13 aa, Mycobacterium tuberculosis
GADEDDIKATYDK

SEQ ID NO: 124370 - protein, 13 aa, Mycobacterium tuberculosis
ADEDDIKATYDKG

SEQ ID NO: 124371 - protein, 13 aa, Mycobacterium tuberculosis
DEDDIKATYDKGI

SEQ ID NO: 124372 - protein, 13 aa, Mycobacterium tuberculosis
EDDIKATYDKGIL

SEQ ID NO: 124373 - protein, 13 aa, Mycobacterium tuberculosis
DDIKATYDKGILT

SEQ ID NO: 124374 - protein, 13 aa, Mycobacterium tuberculosis
DIKATYDKGILTV

SEQ ID NO: 124375 - protein, 13 aa, Mycobacterium tuberculosis
IKATYDKGILTVS

SEQ ID NO: 124376 - protein, 13 aa, Mycobacterium tuberculosis
KATYDKGILTVSV

SEQ ID NO: 124377 - protein, 13 aa, Mycobacterium tuberculosis
ATYDKGILTVSVA

SEQ ID NO: 124378 - protein, 13 aa, Mycobacterium tuberculosis
TYDKGILTVSVAV

SEQ ID NO: 124379 - protein, 13 aa, Mycobacterium tuberculosis
YDKGILTVSVAVS

SEQ ID NO: 124380 - protein, 13 aa, Mycobacterium tuberculosis
DKGILTVSVAVSE

SEQ ID NO: 124381 - protein, 13 aa, Mycobacterium tuberculosis
KGILTVSVAVSEG

SEQ ID NO: 124382 - protein, 13 aa, Mycobacterium tuberculosis
GILTVSVAVSEGK

SEQ ID NO: 124383 - protein, 13 aa, Mycobacterium tuberculosis
ILTVSVAVSEGKP

SEQ ID NO: 124384 - protein, 13 aa, Mycobacterium tuberculosis
LTVSVAVSEGKPT

SEQ ID NO: 124385 - protein, 13 aa, Mycobacterium tuberculosis
TVSVAVSEGKPTE

SEQ ID NO: 124386 - protein, 13 aa, Mycobacterium tuberculosis
VSVAVSEGKPTEK

SEQ ID NO: 124387 - protein, 13 aa, Mycobacterium tuberculosis
SVAVSEGKPTEKH

SEQ ID NO: 124388 - protein, 13 aa, Mycobacterium tuberculosis
VAVSEGKPTEKHI

SEQ ID NO: 124389 - protein, 13 aa, Mycobacterium tuberculosis
AVSEGKPTEKHIQ

SEQ ID NO: 124390 - protein, 13 aa, Mycobacterium tuberculosis
VSEGKPTEKHIQI

SEQ ID NO: 124391 - protein, 13 aa, Mycobacterium tuberculosis
SEGKPTEKHIQIR

SEQ ID NO: 124392 - protein, 13 aa, Mycobacterium tuberculosis
EGKPTEKHIQIRS

SEQ ID NO: 124393 - protein, 13 aa, Mycobacterium tuberculosis
GKPTEKHIQIRST

SEQ ID NO: 124394 - protein, 13 aa, Mycobacterium tuberculosis
KPTEKHIQIRSTN

SEQ ID NO: 124395 - protein, 14 aa, Mycobacterium tuberculosis
MATTLPVQRHPRSL

SEQ ID NO: 124396 - protein, 14 aa, Mycobacterium tuberculosis
ATTLPVQRHPRSLF

SEQ ID NO: 124397 - protein, 14 aa, Mycobacterium tuberculosis
TTLPVQRHPRSLFP

SEQ ID NO: 124398 - protein, 14 aa, Mycobacterium tuberculosis
TLPVQRHPRSLFPE

SEQ ID NO: 124399 - protein, 14 aa, Mycobacterium tuberculosis
LPVQRHPRSLFPEF

SEQ ID NO: 124400 - protein, 14 aa, Mycobacterium tuberculosis
PVQRHPRSLFPEFS

SEQ ID NO: 124401 - protein, 14 aa, Mycobacterium tuberculosis
VQRHPRSLFPEFSE

SEQ ID NO: 124402 - protein, 14 aa, Mycobacterium tuberculosis
QRHPRSLFPEFSEL

SEQ ID NO: 124403 - protein, 14 aa, Mycobacterium tuberculosis
RHPRSLFPEFSELF

SEQ ID NO: 124404 - protein, 14 aa, Mycobacterium tuberculosis
HPRSLFPEFSELFA

SEQ ID NO: 124405 - protein, 14 aa, Mycobacterium tuberculosis
PRSLFPEFSELFAA

SEQ ID NO: 124406 - protein, 14 aa, Mycobacterium tuberculosis
RSLFPEFSELFAAF

SEQ ID NO: 124407 - protein, 14 aa, Mycobacterium tuberculosis
SLFPEFSELFAAFP

SEQ ID NO: 124408 - protein, 14 aa, Mycobacterium tuberculosis
LFPEFSELFAAFPS

SEQ ID NO: 124409 - protein, 14 aa, Mycobacterium tuberculosis
FPEFSELFAAFPSF

SEQ ID NO: 124410 - protein, 14 aa, Mycobacterium tuberculosis
PEFSELFAAFPSFA

SEQ ID NO: 124411 - protein, 14 aa, Mycobacterium tuberculosis
EFSELFAAFPSFAG

SEQ ID NO: 124412 - protein, 14 aa, Mycobacterium tuberculosis
FSELFAAFPSFAGL

SEQ ID NO: 124413 - protein, 14 aa, Mycobacterium tuberculosis
SELFAAFPSFAGLR

SEQ ID NO: 124414 - protein, 14 aa, Mycobacterium tuberculosis
ELFAAFPSFAGLRP

SEQ ID NO: 124415 - protein, 14 aa, Mycobacterium tuberculosis
LFAAFPSFAGLRPT

SEQ ID NO: 124416 - protein, 14 aa, Mycobacterium tuberculosis
FAAFPSFAGLRPTF

SEQ ID NO: 124417 - protein, 14 aa, Mycobacterium tuberculosis
AAFPSFAGLRPTFD

SEQ ID NO: 124418 - protein, 14 aa, Mycobacterium tuberculosis
AFPSFAGLRPTFDT

SEQ ID NO: 124419 - protein, 14 aa, Mycobacterium tuberculosis
FPSFAGLRPTFDTR

SEQ ID NO: 124420 - protein, 14 aa, Mycobacterium tuberculosis
PSFAGLRPTFDTRL

SEQ ID NO: 124421 - protein, 14 aa, Mycobacterium tuberculosis
SFAGLRPTFDTRLM

SEQ ID NO: 124422 - protein, 14 aa, Mycobacterium tuberculosis
FAGLRPTFDTRLMR

SEQ ID NO: 124423 - protein, 14 aa, Mycobacterium tuberculosis
AGLRPTFDTRLMRL

SEQ ID NO: 124424 - protein, 14 aa, Mycobacterium tuberculosis
GLRPTFDTRLMRLE

SEQ ID NO: 124425 - protein, 14 aa, Mycobacterium tuberculosis
LRPTFDTRLMRLED

SEQ ID NO: 124426 - protein, 14 aa, Mycobacterium tuberculosis
RPTFDTRLMRLEDE

SEQ ID NO: 124427 - protein, 14 aa, Mycobacterium tuberculosis
PTFDTRLMRLEDEM

SEQ ID NO: 124428 - protein, 14 aa, Mycobacterium tuberculosis
TFDTRLMRLEDEMK

SEQ ID NO: 124429 - protein, 14 aa, Mycobacterium tuberculosis
FDTRLMRLEDEMKE

SEQ ID NO: 124430 - protein, 14 aa, Mycobacterium tuberculosis
DTRLMRLEDEMKEG

SEQ ID NO: 124431 - protein, 14 aa, Mycobacterium tuberculosis
TRLMRLEDEMKEGR

SEQ ID NO: 124432 - protein, 14 aa, Mycobacterium tuberculosis
RLMRLEDEMKEGRY

SEQ ID NO: 124433 - protein, 14 aa, Mycobacterium tuberculosis
LMRLEDEMKEGRYE

SEQ ID NO: 124434 - protein, 14 aa, Mycobacterium tuberculosis
MRLEDEMKEGRYEV

SEQ ID NO: 124435 - protein, 14 aa, Mycobacterium tuberculosis
RLEDEMKEGRYEVR

SEQ ID NO: 124436 - protein, 14 aa, Mycobacterium tuberculosis
LEDEMKEGRYEVRA

SEQ ID NO: 124437 - protein, 14 aa, Mycobacterium tuberculosis
EDEMKEGRYEVRAE

SEQ ID NO: 124438 - protein, 14 aa, Mycobacterium tuberculosis
DEMKEGRYEVRAEL

SEQ ID NO: 124439 - protein, 14 aa, Mycobacterium tuberculosis
EMKEGRYEVRAELP

SEQ ID NO: 124440 - protein, 14 aa, Mycobacterium tuberculosis
MKEGRYEVRAELPG

SEQ ID NO: 124441 - protein, 14 aa, Mycobacterium tuberculosis
KEGRYEVRAELPGV

SEQ ID NO: 124442 - protein, 14 aa, Mycobacterium tuberculosis
EGRYEVRAELPGVD

SEQ ID NO: 124443 - protein, 14 aa, Mycobacterium tuberculosis
GRYEVRAELPGVDP

SEQ ID NO: 124444 - protein, 14 aa, Mycobacterium tuberculosis
RYEVRAELPGVDPD

SEQ ID NO: 124445 - protein, 14 aa, Mycobacterium tuberculosis
YEVRAELPGVDPDK

SEQ ID NO: 124446 - protein, 14 aa, Mycobacterium tuberculosis
EVRAELPGVDPDKD

SEQ ID NO: 124447 - protein, 14 aa, Mycobacterium tuberculosis
VRAELPGVDPDKDV

SEQ ID NO: 124448 - protein, 14 aa, Mycobacterium tuberculosis
RAELPGVDPDKDVD

SEQ ID NO: 124449 - protein, 14 aa, Mycobacterium tuberculosis
AELPGVDPDKDVDI

SEQ ID NO: 124450 - protein, 14 aa, Mycobacterium tuberculosis
ELPGVDPDKDVDIM

SEQ ID NO: 124451 - protein, 14 aa, Mycobacterium tuberculosis
LPGVDPDKDVDIMV

SEQ ID NO: 124452 - protein, 14 aa, Mycobacterium tuberculosis
PGVDPDKDVDIMVR

SEQ ID NO: 124453 - protein, 14 aa, Mycobacterium tuberculosis
GVDPDKDVDIMVRD

SEQ ID NO: 124454 - protein, 14 aa, Mycobacterium tuberculosis
VDPDKDVDIMVRDG

SEQ ID NO: 124455 - protein, 14 aa, Mycobacterium tuberculosis
DPDKDVDIMVRDGQ

SEQ ID NO: 124456 - protein, 14 aa, Mycobacterium tuberculosis
PDKDVDIMVRDGQL

SEQ ID NO: 124457 - protein, 14 aa, Mycobacterium tuberculosis
DKDVDIMVRDGQLT

SEQ ID NO: 124458 - protein, 14 aa, Mycobacterium tuberculosis
KDVDIMVRDGQLTI

SEQ ID NO: 124459 - protein, 14 aa, Mycobacterium tuberculosis
DVDIMVRDGQLTIK

SEQ ID NO: 124460 - protein, 14 aa, Mycobacterium tuberculosis
VDIMVRDGQLTIKA

SEQ ID NO: 124461 - protein, 14 aa, Mycobacterium tuberculosis
DIMVRDGQLTIKAE

SEQ ID NO: 124462 - protein, 14 aa, Mycobacterium tuberculosis
IMVRDGQLTIKAER

SEQ ID NO: 124463 - protein, 14 aa, Mycobacterium tuberculosis
MVRDGQLTIKAERT

SEQ ID NO: 124464 - protein, 14 aa, Mycobacterium tuberculosis
VRDGQLTIKAERTE

SEQ ID NO: 124465 - protein, 14 aa, Mycobacterium tuberculosis
RDGQLTIKAERTEQ

SEQ ID NO: 124466 - protein, 14 aa, Mycobacterium tuberculosis
DGQLTIKAERTEQK

SEQ ID NO: 124467 - protein, 14 aa, Mycobacterium tuberculosis
GQLTIKAERTEQKD

SEQ ID NO: 124468 - protein, 14 aa, Mycobacterium tuberculosis
QLTIKAERTEQKDF

SEQ ID NO: 124469 - protein, 14 aa, Mycobacterium tuberculosis
LTIKAERTEQKDFD

SEQ ID NO: 124470 - protein, 14 aa, Mycobacterium tuberculosis
TIKAERTEQKDFDG

SEQ ID NO: 124471 - protein, 14 aa, Mycobacterium tuberculosis
IKAERTEQKDFDGR

SEQ ID NO: 124472 - protein, 14 aa, Mycobacterium tuberculosis
KAERTEQKDFDGRS

SEQ ID NO: 124473 - protein, 14 aa, Mycobacterium tuberculosis
AERTEQKDFDGRSE

SEQ ID NO: 124474 - protein, 14 aa, Mycobacterium tuberculosis
ERTEQKDFDGRSEF

SEQ ID NO: 124475 - protein, 14 aa, Mycobacterium tuberculosis
RTEQKDFDGRSEFA

SEQ ID NO: 124476 - protein, 14 aa, Mycobacterium tuberculosis
TEQKDFDGRSEFAY

SEQ ID NO: 124477 - protein, 14 aa, Mycobacterium tuberculosis
EQKDFDGRSEFAYG

SEQ ID NO: 124478 - protein, 14 aa, Mycobacterium tuberculosis
QKDFDGRSEFAYGS

SEQ ID NO: 124479 - protein, 14 aa, Mycobacterium tuberculosis
KDFDGRSEFAYGSF

SEQ ID NO: 124480 - protein, 14 aa, Mycobacterium tuberculosis
DFDGRSEFAYGSFV

SEQ ID NO: 124481 - protein, 14 aa, Mycobacterium tuberculosis
FDGRSEFAYGSFVR

SEQ ID NO: 124482 - protein, 14 aa, Mycobacterium tuberculosis
DGRSEFAYGSFVRT

SEQ ID NO: 124483 - protein, 14 aa, Mycobacterium tuberculosis
GRSEFAYGSFVRTV

SEQ ID NO: 124484 - protein, 14 aa, Mycobacterium tuberculosis
RSEFAYGSFVRTVS

SEQ ID NO: 124485 - protein, 14 aa, Mycobacterium tuberculosis
SEFAYGSFVRTVSL

SEQ ID NO: 124486 - protein, 14 aa, Mycobacterium tuberculosis
EFAYGSFVRTVSLP

SEQ ID NO: 124487 - protein, 14 aa, Mycobacterium tuberculosis
FAYGSFVRTVSLPV

SEQ ID NO: 124488 - protein, 14 aa, Mycobacterium tuberculosis
AYGSFVRTVSLPVG

SEQ ID NO: 124489 - protein, 14 aa, Mycobacterium tuberculosis
YGSFVRTVSLPVGA

SEQ ID NO: 124490 - protein, 14 aa, Mycobacterium tuberculosis
GSFVRTVSLPVGAD

SEQ ID NO: 124491 - protein, 14 aa, Mycobacterium tuberculosis
SFVRTVSLPVGADE

SEQ ID NO: 124492 - protein, 14 aa, Mycobacterium tuberculosis
FVRTVSLPVGADED

SEQ ID NO: 124493 - protein, 14 aa, Mycobacterium tuberculosis
VRTVSLPVGADEDD

SEQ ID NO: 124494 - protein, 14 aa, Mycobacterium tuberculosis
RTVSLPVGADEDDI

SEQ ID NO: 124495 - protein, 14 aa, Mycobacterium tuberculosis
TVSLPVGADEDDIK

SEQ ID NO: 124496 - protein, 14 aa, Mycobacterium tuberculosis
VSLPVGADEDDIKA

SEQ ID NO: 124497 - protein, 14 aa, Mycobacterium tuberculosis
SLPVGADEDDIKAT

SEQ ID NO: 124498 - protein, 14 aa, Mycobacterium tuberculosis
LPVGADEDDIKATY

SEQ ID NO: 124499 - protein, 14 aa, Mycobacterium tuberculosis
PVGADEDDIKATYD

SEQ ID NO: 124500 - protein, 14 aa, Mycobacterium tuberculosis
VGADEDDIKATYDK

SEQ ID NO: 124501 - protein, 14 aa, Mycobacterium tuberculosis
GADEDDIKATYDKG

SEQ ID NO: 124502 - protein, 14 aa, Mycobacterium tuberculosis
ADEDDIKATYDKGI

SEQ ID NO: 124503 - protein, 14 aa, Mycobacterium tuberculosis
DEDDIKATYDKGIL

SEQ ID NO: 124504 - protein, 14 aa, Mycobacterium tuberculosis
EDDIKATYDKGILT

SEQ ID NO: 124505 - protein, 14 aa, Mycobacterium tuberculosis
DDIKATYDKGILTV

SEQ ID NO: 124506 - protein, 14 aa, Mycobacterium tuberculosis
DIKATYDKGILTVS

SEQ ID NO: 124507 - protein, 14 aa, Mycobacterium tuberculosis
IKATYDKGILTVSV

SEQ ID NO: 124508 - protein, 14 aa, Mycobacterium tuberculosis
KATYDKGILTVSVA

SEQ ID NO: 124509 - protein, 14 aa, Mycobacterium tuberculosis
ATYDKGILTVSVAV

SEQ ID NO: 124510 - protein, 14 aa, Mycobacterium tuberculosis
TYDKGILTVSVAVS

SEQ ID NO: 124511 - protein, 14 aa, Mycobacterium tuberculosis
YDKGILTVSVAVSE

SEQ ID NO: 124512 - protein, 14 aa, Mycobacterium tuberculosis
DKGILTVSVAVSEG

SEQ ID NO: 124513 - protein, 14 aa, Mycobacterium tuberculosis
KGILTVSVAVSEGK

SEQ ID NO: 124514 - protein, 14 aa, Mycobacterium tuberculosis
GILTVSVAVSEGKP

SEQ ID NO: 124515 - protein, 14 aa, Mycobacterium tuberculosis
ILTVSVAVSEGKPT

SEQ ID NO: 124516 - protein, 14 aa, Mycobacterium tuberculosis
LTVSVAVSEGKPTE

SEQ ID NO: 124517 - protein, 14 aa, Mycobacterium tuberculosis
TVSVAVSEGKPTEK

SEQ ID NO: 124518 - protein, 14 aa, Mycobacterium tuberculosis
VSVAVSEGKPTEKH

SEQ ID NO: 124519 - protein, 14 aa, Mycobacterium tuberculosis
SVAVSEGKPTEKHI

SEQ ID NO: 124520 - protein, 14 aa, Mycobacterium tuberculosis
VAVSEGKPTEKHIQ

SEQ ID NO: 124521 - protein, 14 aa, Mycobacterium tuberculosis
AVSEGKPTEKHIQI

SEQ ID NO: 124522 - protein, 14 aa, Mycobacterium tuberculosis
VSEGKPTEKHIQIR

SEQ ID NO: 124523 - protein, 14 aa, Mycobacterium tuberculosis
SEGKPTEKHIQIRS

SEQ ID NO: 124524 - protein, 14 aa, Mycobacterium tuberculosis
EGKPTEKHIQIRST

SEQ ID NO: 124525 - protein, 14 aa, Mycobacterium tuberculosis
GKPTEKHIQIRSTN

SEQ ID NO: 124526 - protein, 15 aa, Mycobacterium tuberculosis
MATTLPVQRHPRSLF

SEQ ID NO: 124527 - protein, 15 aa, Mycobacterium tuberculosis
ATTLPVQRHPRSLFP

SEQ ID NO: 124528 - protein, 15 aa, Mycobacterium tuberculosis
TTLPVQRHPRSLFPE

SEQ ID NO: 124529 - protein, 15 aa, Mycobacterium tuberculosis
TLPVQRHPRSLFPEF

SEQ ID NO: 124530 - protein, 15 aa, Mycobacterium tuberculosis
LPVQRHPRSLFPEFS

SEQ ID NO: 124531 - protein, 15 aa, Mycobacterium tuberculosis
PVQRHPRSLFPEFSE

SEQ ID NO: 124532 - protein, 15 aa, Mycobacterium tuberculosis
VQRHPRSLFPEFSEL

SEQ ID NO: 124533 - protein, 15 aa, Mycobacterium tuberculosis
QRHPRSLFPEFSELF

SEQ ID NO: 124534 - protein, 15 aa, Mycobacterium tuberculosis
RHPRSLFPEFSELFA

SEQ ID NO: 124535 - protein, 15 aa, Mycobacterium tuberculosis
HPRSLFPEFSELFAA

SEQ ID NO: 124536 - protein, 15 aa, Mycobacterium tuberculosis
PRSLFPEFSELFAAF

SEQ ID NO: 124537 - protein, 15 aa, Mycobacterium tuberculosis
RSLFPEFSELFAAFP

SEQ ID NO: 124538 - protein, 15 aa, Mycobacterium tuberculosis
SLFPEFSELFAAFPS

SEQ ID NO: 124539 - protein, 15 aa, Mycobacterium tuberculosis
LFPEFSELFAAFPSF

SEQ ID NO: 124540 - protein, 15 aa, Mycobacterium tuberculosis
FPEFSELFAAFPSFA

SEQ ID NO: 124541 - protein, 15 aa, Mycobacterium tuberculosis
PEFSELFAAFPSFAG

SEQ ID NO: 124542 - protein, 15 aa, Mycobacterium tuberculosis
EFSELFAAFPSFAGL

SEQ ID NO: 124543 - protein, 15 aa, Mycobacterium tuberculosis
FSELFAAFPSFAGLR

SEQ ID NO: 124544 - protein, 15 aa, Mycobacterium tuberculosis
SELFAAFPSFAGLRP

SEQ ID NO: 124545 - protein, 15 aa, Mycobacterium tuberculosis
ELFAAFPSFAGLRPT

SEQ ID NO: 124546 - protein, 15 aa, Mycobacterium tuberculosis
LFAAFPSFAGLRPTF

SEQ ID NO: 124547 - protein, 15 aa, Mycobacterium tuberculosis
FAAFPSFAGLRPTFD

SEQ ID NO: 124548 - protein, 15 aa, Mycobacterium tuberculosis
AAFPSFAGLRPTFDT

SEQ ID NO: 124549 - protein, 15 aa, Mycobacterium tuberculosis
AFPSFAGLRPTFDTR

SEQ ID NO: 124550 - protein, 15 aa, Mycobacterium tuberculosis
FPSFAGLRPTFDTRL

SEQ ID NO: 124551 - protein, 15 aa, Mycobacterium tuberculosis
PSFAGLRPTFDTRLM

SEQ ID NO: 124552 - protein, 15 aa, Mycobacterium tuberculosis
SFAGLRPTFDTRLMR

SEQ ID NO: 124553 - protein, 15 aa, Mycobacterium tuberculosis
FAGLRPTFDTRLMRL

SEQ ID NO: 124554 - protein, 15 aa, Mycobacterium tuberculosis
AGLRPTFDTRLMRLE

SEQ ID NO: 124555 - protein, 15 aa, Mycobacterium tuberculosis
GLRPTFDTRLMRLED

SEQ ID NO: 124556 - protein, 15 aa, Mycobacterium tuberculosis
LRPTFDTRLMRLEDE

SEQ ID NO: 124557 - protein, 15 aa, Mycobacterium tuberculosis
RPTFDTRLMRLEDEM

SEQ ID NO: 124558 - protein, 15 aa, Mycobacterium tuberculosis
PTFDTRLMRLEDEMK

SEQ ID NO: 124559 - protein, 15 aa, Mycobacterium tuberculosis
TFDTRLMRLEDEMKE

SEQ ID NO: 124560 - protein, 15 aa, Mycobacterium tuberculosis
FDTRLMRLEDEMKEG

SEQ ID NO: 124561 - protein, 15 aa, Mycobacterium tuberculosis
DTRLMRLEDEMKEGR

SEQ ID NO: 124562 - protein, 15 aa, Mycobacterium tuberculosis
TRLMRLEDEMKEGRY

SEQ ID NO: 124563 - protein, 15 aa, Mycobacterium tuberculosis
RLMRLEDEMKEGRYE

SEQ ID NO: 124564 - protein, 15 aa, Mycobacterium tuberculosis
LMRLEDEMKEGRYEV

SEQ ID NO: 124565 - protein, 15 aa, Mycobacterium tuberculosis
MRLEDEMKEGRYEVR

SEQ ID NO: 124566 - protein, 15 aa, Mycobacterium tuberculosis
RLEDEMKEGRYEVRA

SEQ ID NO: 124567 - protein, 15 aa, Mycobacterium tuberculosis
LEDEMKEGRYEVRAE

SEQ ID NO: 124568 - protein, 15 aa, Mycobacterium tuberculosis
EDEMKEGRYEVRAEL

SEQ ID NO: 124569 - protein, 15 aa, Mycobacterium tuberculosis
DEMKEGRYEVRAELP

SEQ ID NO: 124570 - protein, 15 aa, Mycobacterium tuberculosis
EMKEGRYEVRAELPG

SEQ ID NO: 124571 - protein, 15 aa, Mycobacterium tuberculosis
MKEGRYEVRAELPGV

SEQ ID NO: 124572 - protein, 15 aa, Mycobacterium tuberculosis
KEGRYEVRAELPGVD

SEQ ID NO: 124573 - protein, 15 aa, Mycobacterium tuberculosis
EGRYEVRAELPGVDP

SEQ ID NO: 124574 - protein, 15 aa, Mycobacterium tuberculosis
GRYEVRAELPGVDPD

SEQ ID NO: 124575 - protein, 15 aa, Mycobacterium tuberculosis
RYEVRAELPGVDPDK

SEQ ID NO: 124576 - protein, 15 aa, Mycobacterium tuberculosis
YEVRAELPGVDPDKD

SEQ ID NO: 124577 - protein, 15 aa, Mycobacterium tuberculosis
EVRAELPGVDPDKDV

SEQ ID NO: 124578 - protein, 15 aa, Mycobacterium tuberculosis
VRAELPGVDPDKDVD

SEQ ID NO: 124579 - protein, 15 aa, Mycobacterium tuberculosis
RAELPGVDPDKDVDI

SEQ ID NO: 124580 - protein, 15 aa, Mycobacterium tuberculosis
AELPGVDPDKDVDIM

SEQ ID NO: 124581 - protein, 15 aa, Mycobacterium tuberculosis
ELPGVDPDKDVDIMV

SEQ ID NO: 124582 - protein, 15 aa, Mycobacterium tuberculosis
LPGVDPDKDVDIMVR

SEQ ID NO: 124583 - protein, 15 aa, Mycobacterium tuberculosis
PGVDPDKDVDIMVRD

SEQ ID NO: 124584 - protein, 15 aa, Mycobacterium tuberculosis
GVDPDKDVDIMVRDG

SEQ ID NO: 124585 - protein, 15 aa, Mycobacterium tuberculosis
VDPDKDVDIMVRDGQ

SEQ ID NO: 124586 - protein, 15 aa, Mycobacterium tuberculosis
DPDKDVDIMVRDGQL

SEQ ID NO: 124587 - protein, 15 aa, Mycobacterium tuberculosis
PDKDVDIMVRDGQLT

SEQ ID NO: 124588 - protein, 15 aa, Mycobacterium tuberculosis
DKDVDIMVRDGQLTI

SEQ ID NO: 124589 - protein, 15 aa, Mycobacterium tuberculosis
KDVDIMVRDGQLTIK

SEQ ID NO: 124590 - protein, 15 aa, Mycobacterium tuberculosis
DVDIMVRDGQLTIKA

SEQ ID NO: 124591 - protein, 15 aa, Mycobacterium tuberculosis
VDIMVRDGQLTIKAE

SEQ ID NO: 124592 - protein, 15 aa, Mycobacterium tuberculosis
DIMVRDGQLTIKAER

SEQ ID NO: 124593 - protein, 15 aa, Mycobacterium tuberculosis
IMVRDGQLTIKAERT

SEQ ID NO: 124594 - protein, 15 aa, Mycobacterium tuberculosis
MVRDGQLTIKAERTE

SEQ ID NO: 124595 - protein, 15 aa, Mycobacterium tuberculosis
VRDGQLTIKAERTEQ

SEQ ID NO: 124596 - protein, 15 aa, Mycobacterium tuberculosis
RDGQLTIKAERTEQK

SEQ ID NO: 124597 - protein, 15 aa, Mycobacterium tuberculosis
DGQLTIKAERTEQKD

SEQ ID NO: 124598 - protein, 15 aa, Mycobacterium tuberculosis
GQLTIKAERTEQKDF

SEQ ID NO: 124599 - protein, 15 aa, Mycobacterium tuberculosis
QLTIKAERTEQKDFD

SEQ ID NO: 124600 - protein, 15 aa, Mycobacterium tuberculosis
LTIKAERTEQKDFDG

SEQ ID NO: 124601 - protein, 15 aa, Mycobacterium tuberculosis
TIKAERTEQKDFDGR

SEQ ID NO: 124602 - protein, 15 aa, Mycobacterium tuberculosis
IKAERTEQKDFDGRS

SEQ ID NO: 124603 - protein, 15 aa, Mycobacterium tuberculosis
KAERTEQKDFDGRSE

SEQ ID NO: 124604 - protein, 15 aa, Mycobacterium tuberculosis
AERTEQKDFDGRSEF

SEQ ID NO: 124605 - protein, 15 aa, Mycobacterium tuberculosis
ERTEQKDFDGRSEFA

SEQ ID NO: 124606 - protein, 15 aa, Mycobacterium tuberculosis
RTEQKDFDGRSEFAY

SEQ ID NO: 124607 - protein, 15 aa, Mycobacterium tuberculosis
TEQKDFDGRSEFAYG

SEQ ID NO: 124608 - protein, 15 aa, Mycobacterium tuberculosis
EQKDFDGRSEFAYGS

SEQ ID NO: 124609 - protein, 15 aa, Mycobacterium tuberculosis
QKDFDGRSEFAYGSF

SEQ ID NO: 124610 - protein, 15 aa, Mycobacterium tuberculosis
KDFDGRSEFAYGSFV

SEQ ID NO: 124611 - protein, 15 aa, Mycobacterium tuberculosis
DFDGRSEFAYGSFVR

SEQ ID NO: 124612 - protein, 15 aa, Mycobacterium tuberculosis
FDGRSEFAYGSFVRT

SEQ ID NO: 124613 - protein, 15 aa, Mycobacterium tuberculosis
DGRSEFAYGSFVRTV

SEQ ID NO: 124614 - protein, 15 aa, Mycobacterium tuberculosis
GRSEFAYGSFVRTVS

SEQ ID NO: 124615 - protein, 15 aa, Mycobacterium tuberculosis
RSEFAYGSFVRTVSL

SEQ ID NO: 124616 - protein, 15 aa, Mycobacterium tuberculosis
SEFAYGSFVRTVSLP

SEQ ID NO: 124617 - protein, 15 aa, Mycobacterium tuberculosis
EFAYGSFVRTVSLPV

SEQ ID NO: 124618 - protein, 15 aa, Mycobacterium tuberculosis
FAYGSFVRTVSLPVG

SEQ ID NO: 124619 - protein, 15 aa, Mycobacterium tuberculosis
AYGSFVRTVSLPVGA

SEQ ID NO: 124620 - protein, 15 aa, Mycobacterium tuberculosis
YGSFVRTVSLPVGAD

SEQ ID NO: 124621 - protein, 15 aa, Mycobacterium tuberculosis
GSFVRTVSLPVGADE

SEQ ID NO: 124622 - protein, 15 aa, Mycobacterium tuberculosis
SFVRTVSLPVGADED

SEQ ID NO: 124623 - protein, 15 aa, Mycobacterium tuberculosis
FVRTVSLPVGADEDD

SEQ ID NO: 124624 - protein, 15 aa, Mycobacterium tuberculosis
VRTVSLPVGADEDDI

SEQ ID NO: 124625 - protein, 15 aa, Mycobacterium tuberculosis
RTVSLPVGADEDDIK

SEQ ID NO: 124626 - protein, 15 aa, Mycobacterium tuberculosis
TVSLPVGADEDDIKA

SEQ ID NO: 124627 - protein, 15 aa, Mycobacterium tuberculosis
VSLPVGADEDDIKAT

SEQ ID NO: 124628 - protein, 15 aa, Mycobacterium tuberculosis
SLPVGADEDDIKATY

SEQ ID NO: 124629 - protein, 15 aa, Mycobacterium tuberculosis
LPVGADEDDIKATYD

SEQ ID NO: 124630 - protein, 15 aa, Mycobacterium tuberculosis
PVGADEDDIKATYDK

SEQ ID NO: 124631 - protein, 15 aa, Mycobacterium tuberculosis
VGADEDDIKATYDKG

SEQ ID NO: 124632 - protein, 15 aa, Mycobacterium tuberculosis
GADEDDIKATYDKGI

SEQ ID NO: 124633 - protein, 15 aa, Mycobacterium tuberculosis
ADEDDIKATYDKGIL

SEQ ID NO: 124634 - protein, 15 aa, Mycobacterium tuberculosis
DEDDIKATYDKGILT

SEQ ID NO: 124635 - protein, 15 aa, Mycobacterium tuberculosis
EDDIKATYDKGILTV

SEQ ID NO: 124636 - protein, 15 aa, Mycobacterium tuberculosis
DDIKATYDKGILTVS

SEQ ID NO: 124637 - protein, 15 aa, Mycobacterium tuberculosis
DIKATYDKGILTVSV

SEQ ID NO: 124638 - protein, 15 aa, Mycobacterium tuberculosis
IKATYDKGILTVSVA

SEQ ID NO: 124639 - protein, 15 aa, Mycobacterium tuberculosis
KATYDKGILTVSVAV

SEQ ID NO: 124640 - protein, 15 aa, Mycobacterium tuberculosis
ATYDKGILTVSVAVS

SEQ ID NO: 124641 - protein, 15 aa, Mycobacterium tuberculosis
TYDKGILTVSVAVSE

SEQ ID NO: 124642 - protein, 15 aa, Mycobacterium tuberculosis
YDKGILTVSVAVSEG

SEQ ID NO: 124643 - protein, 15 aa, Mycobacterium tuberculosis
DKGILTVSVAVSEGK

SEQ ID NO: 124644 - protein, 15 aa, Mycobacterium tuberculosis
KGILTVSVAVSEGKP

SEQ ID NO: 124645 - protein, 15 aa, Mycobacterium tuberculosis
GILTVSVAVSEGKPT

SEQ ID NO: 124646 - protein, 15 aa, Mycobacterium tuberculosis
ILTVSVAVSEGKPTE

SEQ ID NO: 124647 - protein, 15 aa, Mycobacterium tuberculosis
LTVSVAVSEGKPTEK

SEQ ID NO: 124648 - protein, 15 aa, Mycobacterium tuberculosis
TVSVAVSEGKPTEKH

SEQ ID NO: 124649 - protein, 15 aa, Mycobacterium tuberculosis
VSVAVSEGKPTEKHI

SEQ ID NO: 124650 - protein, 15 aa, Mycobacterium tuberculosis
SVAVSEGKPTEKHIQ

SEQ ID NO: 124651 - protein, 15 aa, Mycobacterium tuberculosis
VAVSEGKPTEKHIQI

SEQ ID NO: 124652 - protein, 15 aa, Mycobacterium tuberculosis
AVSEGKPTEKHIQIR

SEQ ID NO: 124653 - protein, 15 aa, Mycobacterium tuberculosis
VSEGKPTEKHIQIRS

SEQ ID NO: 124654 - protein, 15 aa, Mycobacterium tuberculosis
SEGKPTEKHIQIRST

SEQ ID NO: 124655 - protein, 15 aa, Mycobacterium tuberculosis
EGKPTEKHIQIRSTN

SEQ ID NO: 124656 - protein, 16 aa, Mycobacterium tuberculosis
MATTLPVQRHPRSLFP

SEQ ID NO: 124657 - protein, 16 aa, Mycobacterium tuberculosis
ATTLPVQRHPRSLFPE

SEQ ID NO: 124658 - protein, 16 aa, Mycobacterium tuberculosis
TTLPVQRHPRSLFPEF

SEQ ID NO: 124659 - protein, 16 aa, Mycobacterium tuberculosis
TLPVQRHPRSLFPEFS

SEQ ID NO: 124660 - protein, 16 aa, Mycobacterium tuberculosis
LPVQRHPRSLFPEFSE

SEQ ID NO: 124661 - protein, 16 aa, Mycobacterium tuberculosis
PVQRHPRSLFPEFSEL

SEQ ID NO: 124662 - protein, 16 aa, Mycobacterium tuberculosis
VQRHPRSLFPEFSELF

SEQ ID NO: 124663 - protein, 16 aa, Mycobacterium tuberculosis
QRHPRSLFPEFSELFA

SEQ ID NO: 124664 - protein, 16 aa, Mycobacterium tuberculosis
RHPRSLFPEFSELFAA

SEQ ID NO: 124665 - protein, 16 aa, Mycobacterium tuberculosis
HPRSLFPEFSELFAAF

SEQ ID NO: 124666 - protein, 16 aa, Mycobacterium tuberculosis
PRSLFPEFSELFAAFP

SEQ ID NO: 124667 - protein, 16 aa, Mycobacterium tuberculosis
RSLFPEFSELFAAFPS

SEQ ID NO: 124668 - protein, 16 aa, Mycobacterium tuberculosis
SLFPEFSELFAAFPSF

SEQ ID NO: 124669 - protein, 16 aa, Mycobacterium tuberculosis
LFPEFSELFAAFPSFA

SEQ ID NO: 124670 - protein, 16 aa, Mycobacterium tuberculosis
FPEFSELFAAFPSFAG

SEQ ID NO: 124671 - protein, 16 aa, Mycobacterium tuberculosis
PEFSELFAAFPSFAGL

SEQ ID NO: 124672 - protein, 16 aa, Mycobacterium tuberculosis
EFSELFAAFPSFAGLR

SEQ ID NO: 124673 - protein, 16 aa, Mycobacterium tuberculosis
FSELFAAFPSFAGLRP

SEQ ID NO: 124674 - protein, 16 aa, Mycobacterium tuberculosis
SELFAAFPSFAGLRPT

SEQ ID NO: 124675 - protein, 16 aa, Mycobacterium tuberculosis
ELFAAFPSFAGLRPTF

SEQ ID NO: 124676 - protein, 16 aa, Mycobacterium tuberculosis
LFAAFPSFAGLRPTFD

SEQ ID NO: 124677 - protein, 16 aa, Mycobacterium tuberculosis
FAAFPSFAGLRPTFDT

SEQ ID NO: 124678 - protein, 16 aa, Mycobacterium tuberculosis
AAFPSFAGLRPTFDTR

SEQ ID NO: 124679 - protein, 16 aa, Mycobacterium tuberculosis
AFPSFAGLRPTFDTRL

SEQ ID NO: 124680 - protein, 16 aa, Mycobacterium tuberculosis
FPSFAGLRPTFDTRLM

SEQ ID NO: 124681 - protein, 16 aa, Mycobacterium tuberculosis
PSFAGLRPTFDTRLMR

SEQ ID NO: 124682 - protein, 16 aa, Mycobacterium tuberculosis
SFAGLRPTFDTRLMRL

SEQ ID NO: 124683 - protein, 16 aa, Mycobacterium tuberculosis
FAGLRPTFDTRLMRLE

SEQ ID NO: 124684 - protein, 16 aa, Mycobacterium tuberculosis
AGLRPTFDTRLMRLED

SEQ ID NO: 124685 - protein, 16 aa, Mycobacterium tuberculosis
GLRPTFDTRLMRLEDE

SEQ ID NO: 124686 - protein, 16 aa, Mycobacterium tuberculosis
LRPTFDTRLMRLEDEM

SEQ ID NO: 124687 - protein, 16 aa, Mycobacterium tuberculosis
RPTFDTRLMRLEDEMK

SEQ ID NO: 124688 - protein, 16 aa, Mycobacterium tuberculosis
PTFDTRLMRLEDEMKE

SEQ ID NO: 124689 - protein, 16 aa, Mycobacterium tuberculosis
TFDTRLMRLEDEMKEG

SEQ ID NO: 124690 - protein, 16 aa, Mycobacterium tuberculosis
FDTRLMRLEDEMKEGR

SEQ ID NO: 124691 - protein, 16 aa, Mycobacterium tuberculosis
DTRLMRLEDEMKEGRY

SEQ ID NO: 124692 - protein, 16 aa, Mycobacterium tuberculosis
TRLMRLEDEMKEGRYE

SEQ ID NO: 124693 - protein, 16 aa, Mycobacterium tuberculosis
RLMRLEDEMKEGRYEV

SEQ ID NO: 124694 - protein, 16 aa, Mycobacterium tuberculosis
LMRLEDEMKEGRYEVR

SEQ ID NO: 124695 - protein, 16 aa, Mycobacterium tuberculosis
MRLEDEMKEGRYEVRA

SEQ ID NO: 124696 - protein, 16 aa, Mycobacterium tuberculosis
RLEDEMKEGRYEVRAE

SEQ ID NO: 124697 - protein, 16 aa, Mycobacterium tuberculosis
LEDEMKEGRYEVRAEL

SEQ ID NO: 124698 - protein, 16 aa, Mycobacterium tuberculosis
EDEMKEGRYEVRAELP

SEQ ID NO: 124699 - protein, 16 aa, Mycobacterium tuberculosis
DEMKEGRYEVRAELPG

SEQ ID NO: 124700 - protein, 16 aa, Mycobacterium tuberculosis
EMKEGRYEVRAELPGV

SEQ ID NO: 124701 - protein, 16 aa, Mycobacterium tuberculosis
MKEGRYEVRAELPGVD

SEQ ID NO: 124702 - protein, 16 aa, Mycobacterium tuberculosis
KEGRYEVRAELPGVDP

SEQ ID NO: 124703 - protein, 16 aa, Mycobacterium tuberculosis
EGRYEVRAELPGVDPD

SEQ ID NO: 124704 - protein, 16 aa, Mycobacterium tuberculosis
GRYEVRAELPGVDPDK

SEQ ID NO: 124705 - protein, 16 aa, Mycobacterium tuberculosis
RYEVRAELPGVDPDKD

SEQ ID NO: 124706 - protein, 16 aa, Mycobacterium tuberculosis
YEVRAELPGVDPDKDV

SEQ ID NO: 124707 - protein, 16 aa, Mycobacterium tuberculosis
EVRAELPGVDPDKDVD

SEQ ID NO: 124708 - protein, 16 aa, Mycobacterium tuberculosis
VRAELPGVDPDKDVDI

SEQ ID NO: 124709 - protein, 16 aa, Mycobacterium tuberculosis
RAELPGVDPDKDVDIM

SEQ ID NO: 124710 - protein, 16 aa, Mycobacterium tuberculosis
AELPGVDPDKDVDIMV

SEQ ID NO: 124711 - protein, 16 aa, Mycobacterium tuberculosis
ELPGVDPDKDVDIMVR

SEQ ID NO: 124712 - protein, 16 aa, Mycobacterium tuberculosis
LPGVDPDKDVDIMVRD

SEQ ID NO: 124713 - protein, 16 aa, Mycobacterium tuberculosis
PGVDPDKDVDIMVRDG

SEQ ID NO: 124714 - protein, 16 aa, Mycobacterium tuberculosis
GVDPDKDVDIMVRDGQ

SEQ ID NO: 124715 - protein, 16 aa, Mycobacterium tuberculosis
VDPDKDVDIMVRDGQL

SEQ ID NO: 124716 - protein, 16 aa, Mycobacterium tuberculosis
DPDKDVDIMVRDGQLT

SEQ ID NO: 124717 - protein, 16 aa, Mycobacterium tuberculosis
PDKDVDIMVRDGQLTI

SEQ ID NO: 124718 - protein, 16 aa, Mycobacterium tuberculosis
DKDVDIMVRDGQLTIK

SEQ ID NO: 124719 - protein, 16 aa, Mycobacterium tuberculosis
KDVDIMVRDGQLTIKA

SEQ ID NO: 124720 - protein, 16 aa, Mycobacterium tuberculosis
DVDIMVRDGQLTIKAE

SEQ ID NO: 124721 - protein, 16 aa, Mycobacterium tuberculosis
VDIMVRDGQLTIKAER

SEQ ID NO: 124722 - protein, 16 aa, Mycobacterium tuberculosis
DIMVRDGQLTIKAERT

SEQ ID NO: 124723 - protein, 16 aa, Mycobacterium tuberculosis
IMVRDGQLTIKAERTE

SEQ ID NO: 124724 - protein, 16 aa, Mycobacterium tuberculosis
MVRDGQLTIKAERTEQ

SEQ ID NO: 124725 - protein, 16 aa, Mycobacterium tuberculosis
VRDGQLTIKAERTEQK

SEQ ID NO: 124726 - protein, 16 aa, Mycobacterium tuberculosis
RDGQLTIKAERTEQKD

SEQ ID NO: 124727 - protein, 16 aa, Mycobacterium tuberculosis
DGQLTIKAERTEQKDF

SEQ ID NO: 124728 - protein, 16 aa, Mycobacterium tuberculosis
GQLTIKAERTEQKDFD

SEQ ID NO: 124729 - protein, 16 aa, Mycobacterium tuberculosis
QLTIKAERTEQKDFDG

SEQ ID NO: 124730 - protein, 16 aa, Mycobacterium tuberculosis
LTIKAERTEQKDFDGR

SEQ ID NO: 124731 - protein, 16 aa, Mycobacterium tuberculosis
TIKAERTEQKDFDGRS

SEQ ID NO: 124732 - protein, 16 aa, Mycobacterium tuberculosis
IKAERTEQKDFDGRSE

SEQ ID NO: 124733 - protein, 16 aa, Mycobacterium tuberculosis
KAERTEQKDFDGRSEF

SEQ ID NO: 124734 - protein, 16 aa, Mycobacterium tuberculosis
AERTEQKDFDGRSEFA

SEQ ID NO: 124735 - protein, 16 aa, Mycobacterium tuberculosis
ERTEQKDFDGRSEFAY

SEQ ID NO: 124736 - protein, 16 aa, Mycobacterium tuberculosis
RTEQKDFDGRSEFAYG

SEQ ID NO: 124737 - protein, 16 aa, Mycobacterium tuberculosis
TEQKDFDGRSEFAYGS

SEQ ID NO: 124738 - protein, 16 aa, Mycobacterium tuberculosis
EQKDFDGRSEFAYGSF

SEQ ID NO: 124739 - protein, 16 aa, Mycobacterium tuberculosis
QKDFDGRSEFAYGSFV

SEQ ID NO: 124740 - protein, 16 aa, Mycobacterium tuberculosis
KDFDGRSEFAYGSFVR

SEQ ID NO: 124741 - protein, 16 aa, Mycobacterium tuberculosis
DFDGRSEFAYGSFVRT

SEQ ID NO: 124742 - protein, 16 aa, Mycobacterium tuberculosis
FDGRSEFAYGSFVRTV

SEQ ID NO: 124743 - protein, 16 aa, Mycobacterium tuberculosis
DGRSEFAYGSFVRTVS

SEQ ID NO: 124744 - protein, 16 aa, Mycobacterium tuberculosis
GRSEFAYGSFVRTVSL

SEQ ID NO: 124745 - protein, 16 aa, Mycobacterium tuberculosis
RSEFAYGSFVRTVSLP

SEQ ID NO: 124746 - protein, 16 aa, Mycobacterium tuberculosis
SEFAYGSFVRTVSLPV

SEQ ID NO: 124747 - protein, 16 aa, Mycobacterium tuberculosis
EFAYGSFVRTVSLPVG

SEQ ID NO: 124748 - protein, 16 aa, Mycobacterium tuberculosis
FAYGSFVRTVSLPVGA

SEQ ID NO: 124749 - protein, 16 aa, Mycobacterium tuberculosis
AYGSFVRTVSLPVGAD

SEQ ID NO: 124750 - protein, 16 aa, Mycobacterium tuberculosis
YGSFVRTVSLPVGADE

SEQ ID NO: 124751 - protein, 16 aa, Mycobacterium tuberculosis
GSFVRTVSLPVGADED

SEQ ID NO: 124752 - protein, 16 aa, Mycobacterium tuberculosis
SFVRTVSLPVGADEDD

SEQ ID NO: 124753 - protein, 16 aa, Mycobacterium tuberculosis
FVRTVSLPVGADEDDI

SEQ ID NO: 124754 - protein, 16 aa, Mycobacterium tuberculosis
VRTVSLPVGADEDDIK

SEQ ID NO: 124755 - protein, 16 aa, Mycobacterium tuberculosis
RTVSLPVGADEDDIKA

SEQ ID NO: 124756 - protein, 16 aa, Mycobacterium tuberculosis
TVSLPVGADEDDIKAT

SEQ ID NO: 124757 - protein, 16 aa, Mycobacterium tuberculosis
VSLPVGADEDDIKATY

SEQ ID NO: 124758 - protein, 16 aa, Mycobacterium tuberculosis
SLPVGADEDDIKATYD

SEQ ID NO: 124759 - protein, 16 aa, Mycobacterium tuberculosis
LPVGADEDDIKATYDK

SEQ ID NO: 124760 - protein, 16 aa, Mycobacterium tuberculosis
PVGADEDDIKATYDKG

SEQ ID NO: 124761 - protein, 16 aa, Mycobacterium tuberculosis
VGADEDDIKATYDKGI

SEQ ID NO: 124762 - protein, 16 aa, Mycobacterium tuberculosis
GADEDDIKATYDKGIL

SEQ ID NO: 124763 - protein, 16 aa, Mycobacterium tuberculosis
ADEDDIKATYDKGILT

SEQ ID NO: 124764 - protein, 16 aa, Mycobacterium tuberculosis
DEDDIKATYDKGILTV

SEQ ID NO: 124765 - protein, 16 aa, Mycobacterium tuberculosis
EDDIKATYDKGILTVS

SEQ ID NO: 124766 - protein, 16 aa, Mycobacterium tuberculosis
DDIKATYDKGILTVSV

SEQ ID NO: 124767 - protein, 16 aa, Mycobacterium tuberculosis
DIKATYDKGILTVSVA

SEQ ID NO: 124768 - protein, 16 aa, Mycobacterium tuberculosis
IKATYDKGILTVSVAV

SEQ ID NO: 124769 - protein, 16 aa, Mycobacterium tuberculosis
KATYDKGILTVSVAVS

SEQ ID NO: 124770 - protein, 16 aa, Mycobacterium tuberculosis
ATYDKGILTVSVAVSE

SEQ ID NO: 124771 - protein, 16 aa, Mycobacterium tuberculosis
TYDKGILTVSVAVSEG

SEQ ID NO: 124772 - protein, 16 aa, Mycobacterium tuberculosis
YDKGILTVSVAVSEGK

SEQ ID NO: 124773 - protein, 16 aa, Mycobacterium tuberculosis
DKGILTVSVAVSEGKP

SEQ ID NO: 124774 - protein, 16 aa, Mycobacterium tuberculosis
KGILTVSVAVSEGKPT

SEQ ID NO: 124775 - protein, 16 aa, Mycobacterium tuberculosis
GILTVSVAVSEGKPTE

SEQ ID NO: 124776 - protein, 16 aa, Mycobacterium tuberculosis
ILTVSVAVSEGKPTEK

SEQ ID NO: 124777 - protein, 16 aa, Mycobacterium tuberculosis
LTVSVAVSEGKPTEKH

SEQ ID NO: 124778 - protein, 16 aa, Mycobacterium tuberculosis
TVSVAVSEGKPTEKHI

SEQ ID NO: 124779 - protein, 16 aa, Mycobacterium tuberculosis
VSVAVSEGKPTEKHIQ

SEQ ID NO: 124780 - protein, 16 aa, Mycobacterium tuberculosis
SVAVSEGKPTEKHIQI

SEQ ID NO: 124781 - protein, 16 aa, Mycobacterium tuberculosis
VAVSEGKPTEKHIQIR

SEQ ID NO: 124782 - protein, 16 aa, Mycobacterium tuberculosis
AVSEGKPTEKHIQIRS

SEQ ID NO: 124783 - protein, 16 aa, Mycobacterium tuberculosis
VSEGKPTEKHIQIRST

SEQ ID NO: 124784 - protein, 16 aa, Mycobacterium tuberculosis
SEGKPTEKHIQIRSTN

SEQ ID NO: 124785 - protein, 331 aa, Mycobacterium tuberculosis
MPDTMVTTDVIKSAVQLACRAPSLHNSQPWRWIAEDHTVALFLDKDRVLYATDHSGREALLGCGAVLDHFRVAMAAAGTTANVERFPNPNDPLHLASIDFSPADFVTEGHRLRADAILLRRTDRLPFAEPPDWDLVESQLRTTVTADTVRIDVIADDMRPELAAASKLTESLRLYDSSYHAELFWWTGAFETSEGIPHSSLVSAAESDRVTFGRDFPVVANTDRRPEFGHDRSKVLVLSTYDNERASLLRCGEMLSAVLLDATMAGLATCTLTHITELHASRDLVAALIGQPATPQALVRVGLAPEMEEPPPATPRRPIDEVFHVRAKDHR

SEQ ID NO: 124786 - protein, 8 aa, Mycobacterium tuberculosis
MPDTMVTT

SEQ ID NO: 124787 - protein, 8 aa, Mycobacterium tuberculosis
DTMVTTDV

SEQ ID NO: 124788 - protein, 8 aa, Mycobacterium tuberculosis
TMVTTDVI

SEQ ID NO: 124789 - protein, 8 aa, Mycobacterium tuberculosis
MVTTDVIK

SEQ ID NO: 124790 - protein, 8 aa, Mycobacterium tuberculosis
VIKSAVQL

SEQ ID NO: 124791 - protein, 8 aa, Mycobacterium tuberculosis
SAVQLACR

SEQ ID NO: 124792 - protein, 8 aa, Mycobacterium tuberculosis
APSLHNSQ

SEQ ID NO: 124793 - protein, 8 aa, Mycobacterium tuberculosis
HNSQPWRW

SEQ ID NO: 124794 - protein, 8 aa, Mycobacterium tuberculosis
SQPWRWIA

SEQ ID NO: 124795 - protein, 8 aa, Mycobacterium tuberculosis
QPWRWIAE

SEQ ID NO: 124796 - protein, 8 aa, Mycobacterium tuberculosis
WIAEDHTV

SEQ ID NO: 124797 - protein, 8 aa, Mycobacterium tuberculosis
AEDHTVAL

SEQ ID NO: 124798 - protein, 8 aa, Mycobacterium tuberculosis
TVALFLDK

SEQ ID NO: 124799 - protein, 8 aa, Mycobacterium tuberculosis
LFLDKDRV

SEQ ID NO: 124800 - protein, 8 aa, Mycobacterium tuberculosis
FLDKDRVL

SEQ ID NO: 124801 - protein, 8 aa, Mycobacterium tuberculosis
VLYATDHS

SEQ ID NO: 124802 - protein, 8 aa, Mycobacterium tuberculosis
YATDHSGR

SEQ ID NO: 124803 - protein, 8 aa, Mycobacterium tuberculosis
DHSGREAL

SEQ ID NO: 124804 - protein, 8 aa, Mycobacterium tuberculosis
EALLGCGA

SEQ ID NO: 124805 - protein, 8 aa, Mycobacterium tuberculosis
ALLGCGAV

SEQ ID NO: 124806 - protein, 8 aa, Mycobacterium tuberculosis
LLGCGAVL

SEQ ID NO: 124807 - protein, 8 aa, Mycobacterium tuberculosis
GAVLDHFR

SEQ ID NO: 124808 - protein, 8 aa, Mycobacterium tuberculosis
AVLDHFRV

SEQ ID NO: 124809 - protein, 8 aa, Mycobacterium tuberculosis
VLDHFRVA

SEQ ID NO: 124810 - protein, 8 aa, Mycobacterium tuberculosis
AMAAAGTT

SEQ ID NO: 124811 - protein, 8 aa, Mycobacterium tuberculosis
MAAAGTTA

SEQ ID NO: 124812 - protein, 8 aa, Mycobacterium tuberculosis
GTTANVER

SEQ ID NO: 124813 - protein, 8 aa, Mycobacterium tuberculosis
TTANVERF

SEQ ID NO: 124814 - protein, 8 aa, Mycobacterium tuberculosis
FPNPNDPL

SEQ ID NO: 124815 - protein, 8 aa, Mycobacterium tuberculosis
NPNDPLHL

SEQ ID NO: 124816 - protein, 8 aa, Mycobacterium tuberculosis
DPLHLASI

SEQ ID NO: 124817 - protein, 8 aa, Mycobacterium tuberculosis
LHLASIDF

SEQ ID NO: 124818 - protein, 8 aa, Mycobacterium tuberculosis
HLASIDFS

SEQ ID NO: 124819 - protein, 8 aa, Mycobacterium tuberculosis
ASIDFSPA

SEQ ID NO: 124820 - protein, 8 aa, Mycobacterium tuberculosis
DFVTEGHR

SEQ ID NO: 124821 - protein, 8 aa, Mycobacterium tuberculosis
FVTEGHRL

SEQ ID NO: 124822 - protein, 8 aa, Mycobacterium tuberculosis
VTEGHRLR

SEQ ID NO: 124823 - protein, 8 aa, Mycobacterium tuberculosis
RLRADAIL

SEQ ID NO: 124824 - protein, 8 aa, Mycobacterium tuberculosis
RADAILLR

SEQ ID NO: 124825 - protein, 8 aa, Mycobacterium tuberculosis
ILLRRTDR

SEQ ID NO: 124826 - protein, 8 aa, Mycobacterium tuberculosis
LLRRTDRL

SEQ ID NO: 124827 - protein, 8 aa, Mycobacterium tuberculosis
RRTDRLPF

SEQ ID NO: 124828 - protein, 8 aa, Mycobacterium tuberculosis
LPFAEPPD

SEQ ID NO: 124829 - protein, 8 aa, Mycobacterium tuberculosis
AEPPDWDL

SEQ ID NO: 124830 - protein, 8 aa, Mycobacterium tuberculosis
EPPDWDLV

SEQ ID NO: 124831 - protein, 8 aa, Mycobacterium tuberculosis
DLVESQLR

SEQ ID NO: 124832 - protein, 8 aa, Mycobacterium tuberculosis
ESQLRTTV

SEQ ID NO: 124833 - protein, 8 aa, Mycobacterium tuberculosis
SQLRTTVT

SEQ ID NO: 124834 - protein, 8 aa, Mycobacterium tuberculosis
QLRTTVTA

SEQ ID NO: 124835 - protein, 8 aa, Mycobacterium tuberculosis
TTVTADTV

SEQ ID NO: 124836 - protein, 8 aa, Mycobacterium tuberculosis
TVTADTVR

SEQ ID NO: 124837 - protein, 8 aa, Mycobacterium tuberculosis
VTADTVRI

SEQ ID NO: 124838 - protein, 8 aa, Mycobacterium tuberculosis
DTVRIDVI

SEQ ID NO: 124839 - protein, 8 aa, Mycobacterium tuberculosis
DVIADDMR

SEQ ID NO: 124840 - protein, 8 aa, Mycobacterium tuberculosis
DMRPELAA

SEQ ID NO: 124841 - protein, 8 aa, Mycobacterium tuberculosis
RPELAAAS

SEQ ID NO: 124842 - protein, 8 aa, Mycobacterium tuberculosis
ELAAASKL

SEQ ID NO: 124843 - protein, 8 aa, Mycobacterium tuberculosis
KLTESLRL

SEQ ID NO: 124844 - protein, 8 aa, Mycobacterium tuberculosis
LTESLRLY

SEQ ID NO: 124845 - protein, 8 aa, Mycobacterium tuberculosis
RLYDSSYH

SEQ ID NO: 124846 - protein, 8 aa, Mycobacterium tuberculosis
SSYHAELF

SEQ ID NO: 124847 - protein, 8 aa, Mycobacterium tuberculosis
SYHAELFW

SEQ ID NO: 124848 - protein, 8 aa, Mycobacterium tuberculosis
YHAELFWW

SEQ ID NO: 124849 - protein, 8 aa, Mycobacterium tuberculosis
ELFWWTGA

SEQ ID NO: 124850 - protein, 8 aa, Mycobacterium tuberculosis
LFWWTGAF

SEQ ID NO: 124851 - protein, 8 aa, Mycobacterium tuberculosis
ETSEGIPH

SEQ ID NO: 124852 - protein, 8 aa, Mycobacterium tuberculosis
EGIPHSSL

SEQ ID NO: 124853 - protein, 8 aa, Mycobacterium tuberculosis
GIPHSSLV

SEQ ID NO: 124854 - protein, 8 aa, Mycobacterium tuberculosis
HSSLVSAA

SEQ ID NO: 124855 - protein, 8 aa, Mycobacterium tuberculosis
VSAAESDR

SEQ ID NO: 124856 - protein, 8 aa, Mycobacterium tuberculosis
SAAESDRV

SEQ ID NO: 124857 - protein, 8 aa, Mycobacterium tuberculosis
AESDRVTF

SEQ ID NO: 124858 - protein, 8 aa, Mycobacterium tuberculosis
FGRDFPVV

SEQ ID NO: 124859 - protein, 8 aa, Mycobacterium tuberculosis
FPVVANTD

SEQ ID NO: 124860 - protein, 8 aa, Mycobacterium tuberculosis
PVVANTDR

SEQ ID NO: 124861 - protein, 8 aa, Mycobacterium tuberculosis
VVANTDRR

SEQ ID NO: 124862 - protein, 8 aa, Mycobacterium tuberculosis
NTDRRPEF

SEQ ID NO: 124863 - protein, 8 aa, Mycobacterium tuberculosis
GHDRSKVL

SEQ ID NO: 124864 - protein, 8 aa, Mycobacterium tuberculosis
KVLVLSTY

SEQ ID NO: 124865 - protein, 8 aa, Mycobacterium tuberculosis
LSTYDNER

SEQ ID NO: 124866 - protein, 8 aa, Mycobacterium tuberculosis
STYDNERA

SEQ ID NO: 124867 - protein, 8 aa, Mycobacterium tuberculosis
SLLRCGEM

SEQ ID NO: 124868 - protein, 8 aa, Mycobacterium tuberculosis
LLRCGEML

SEQ ID NO: 124869 - protein, 8 aa, Mycobacterium tuberculosis
GEMLSAVL

SEQ ID NO: 124870 - protein, 8 aa, Mycobacterium tuberculosis
EMLSAVLL

SEQ ID NO: 124871 - protein, 8 aa, Mycobacterium tuberculosis
AVLLDATM

SEQ ID NO: 124872 - protein, 8 aa, Mycobacterium tuberculosis
VLLDATMA

SEQ ID NO: 124873 - protein, 8 aa, Mycobacterium tuberculosis
LLDATMAG

SEQ ID NO: 124874 - protein, 8 aa, Mycobacterium tuberculosis
ATMAGLAT

SEQ ID NO: 124875 - protein, 8 aa, Mycobacterium tuberculosis
TMAGLATC

SEQ ID NO: 124876 - protein, 8 aa, Mycobacterium tuberculosis
GLATCTLT

SEQ ID NO: 124877 - protein, 8 aa, Mycobacterium tuberculosis
TLTHITEL

SEQ ID NO: 124878 - protein, 8 aa, Mycobacterium tuberculosis
ITELHASR

SEQ ID NO: 124879 - protein, 8 aa, Mycobacterium tuberculosis
SRDLVAAL

SEQ ID NO: 124880 - protein, 8 aa, Mycobacterium tuberculosis
ALIGQPAT

SEQ ID NO: 124881 - protein, 8 aa, Mycobacterium tuberculosis
GQPATPQA

SEQ ID NO: 124882 - protein, 8 aa, Mycobacterium tuberculosis
QPATPQAL

SEQ ID NO: 124883 - protein, 8 aa, Mycobacterium tuberculosis
PATPQALV

SEQ ID NO: 124884 - protein, 8 aa, Mycobacterium tuberculosis
ATPQALVR

SEQ ID NO: 124885 - protein, 8 aa, Mycobacterium tuberculosis
ALVRVGLA

SEQ ID NO: 124886 - protein, 8 aa, Mycobacterium tuberculosis
GLAPEMEE

SEQ ID NO: 124887 - protein, 8 aa, Mycobacterium tuberculosis
EMEEPPPA

SEQ ID NO: 124888 - protein, 8 aa, Mycobacterium tuberculosis
EPPPATPR

SEQ ID NO: 124889 - protein, 8 aa, Mycobacterium tuberculosis
PIDEVFHV

SEQ ID NO: 124890 - protein, 8 aa, Mycobacterium tuberculosis
EVFHVRAK

SEQ ID NO: 124891 - protein, 8 aa, Mycobacterium tuberculosis
HVRAKDHR

SEQ ID NO: 124892 - protein, 9 aa, Mycobacterium tuberculosis
MPDTMVTTD

SEQ ID NO: 124893 - protein, 9 aa, Mycobacterium tuberculosis
DTMVTTDVI

SEQ ID NO: 124894 - protein, 9 aa, Mycobacterium tuberculosis
TMVTTDVIK

SEQ ID NO: 124895 - protein, 9 aa, Mycobacterium tuberculosis
VTTDVIKSA

SEQ ID NO: 124896 - protein, 9 aa, Mycobacterium tuberculosis
TTDVIKSAV

SEQ ID NO: 124897 - protein, 9 aa, Mycobacterium tuberculosis
DVIKSAVQL

SEQ ID NO: 124898 - protein, 9 aa, Mycobacterium tuberculosis
VIKSAVQLA

SEQ ID NO: 124899 - protein, 9 aa, Mycobacterium tuberculosis
KSAVQLACR

SEQ ID NO: 124900 - protein, 9 aa, Mycobacterium tuberculosis
QLACRAPSL

SEQ ID NO: 124901 - protein, 9 aa, Mycobacterium tuberculosis
SLHNSQPWR

SEQ ID NO: 124902 - protein, 9 aa, Mycobacterium tuberculosis
LHNSQPWRW

SEQ ID NO: 124903 - protein, 9 aa, Mycobacterium tuberculosis
SQPWRWIAE

SEQ ID NO: 124904 - protein, 9 aa, Mycobacterium tuberculosis
WIAEDHTVA

SEQ ID NO: 124905 - protein, 9 aa, Mycobacterium tuberculosis
IAEDHTVAL

SEQ ID NO: 124906 - protein, 9 aa, Mycobacterium tuberculosis
HTVALFLDK

SEQ ID NO: 124907 - protein, 9 aa, Mycobacterium tuberculosis
ALFLDKDRV

SEQ ID NO: 124908 - protein, 9 aa, Mycobacterium tuberculosis
FLDKDRVLY

SEQ ID NO: 124909 - protein, 9 aa, Mycobacterium tuberculosis
VLYATDHSG

SEQ ID NO: 124910 - protein, 9 aa, Mycobacterium tuberculosis
LYATDHSGR

SEQ ID NO: 124911 - protein, 9 aa, Mycobacterium tuberculosis
REALLGCGA

SEQ ID NO: 124912 - protein, 9 aa, Mycobacterium tuberculosis
EALLGCGAV

SEQ ID NO: 124913 - protein, 9 aa, Mycobacterium tuberculosis
ALLGCGAVL

SEQ ID NO: 124914 - protein, 9 aa, Mycobacterium tuberculosis
CGAVLDHFR

SEQ ID NO: 124915 - protein, 9 aa, Mycobacterium tuberculosis
GAVLDHFRV

SEQ ID NO: 124916 - protein, 9 aa, Mycobacterium tuberculosis
AVLDHFRVA

SEQ ID NO: 124917 - protein, 9 aa, Mycobacterium tuberculosis
VLDHFRVAM

SEQ ID NO: 124918 - protein, 9 aa, Mycobacterium tuberculosis
AMAAAGTTA

SEQ ID NO: 124919 - protein, 9 aa, Mycobacterium tuberculosis
MAAAGTTAN

SEQ ID NO: 124920 - protein, 9 aa, Mycobacterium tuberculosis
AAAGTTANV

SEQ ID NO: 124921 - protein, 9 aa, Mycobacterium tuberculosis
RFPNPNDPL

SEQ ID NO: 124922 - protein, 9 aa, Mycobacterium tuberculosis
FPNPNDPLH

SEQ ID NO: 124923 - protein, 9 aa, Mycobacterium tuberculosis
NPNDPLHLA

SEQ ID NO: 124924 - protein, 9 aa, Mycobacterium tuberculosis
LASIDFSPA

SEQ ID NO: 124925 - protein, 9 aa, Mycobacterium tuberculosis
SIDFSPADF

SEQ ID NO: 124926 - protein, 9 aa, Mycobacterium tuberculosis
FVTEGHRLR

SEQ ID NO: 124927 - protein, 9 aa, Mycobacterium tuberculosis
HRLRADAIL

SEQ ID NO: 124928 - protein, 9 aa, Mycobacterium tuberculosis
RLRADAILL

SEQ ID NO: 124929 - protein, 9 aa, Mycobacterium tuberculosis
RADAILLRR

SEQ ID NO: 124930 - protein, 9 aa, Mycobacterium tuberculosis
AILLRRTDR

SEQ ID NO: 124931 - protein, 9 aa, Mycobacterium tuberculosis
ILLRRTDRL

SEQ ID NO: 124932 - protein, 9 aa, Mycobacterium tuberculosis
LRRTDRLPF

SEQ ID NO: 124933 - protein, 9 aa, Mycobacterium tuberculosis
LPFAEPPDW

SEQ ID NO: 124934 - protein, 9 aa, Mycobacterium tuberculosis
VESQLRTTV

SEQ ID NO: 124935 - protein, 9 aa, Mycobacterium tuberculosis
SQLRTTVTA

SEQ ID NO: 124936 - protein, 9 aa, Mycobacterium tuberculosis
RTTVTADTV

SEQ ID NO: 124937 - protein, 9 aa, Mycobacterium tuberculosis
TTVTADTVR

SEQ ID NO: 124938 - protein, 9 aa, Mycobacterium tuberculosis
TVTADTVRI

SEQ ID NO: 124939 - protein, 9 aa, Mycobacterium tuberculosis
TADTVRIDV

SEQ ID NO: 124940 - protein, 9 aa, Mycobacterium tuberculosis
DTVRIDVIA

SEQ ID NO: 124941 - protein, 9 aa, Mycobacterium tuberculosis
IADDMRPEL

SEQ ID NO: 124942 - protein, 9 aa, Mycobacterium tuberculosis
DMRPELAAA

SEQ ID NO: 124943 - protein, 9 aa, Mycobacterium tuberculosis
PELAAASKL

SEQ ID NO: 124944 - protein, 9 aa, Mycobacterium tuberculosis
AASKLTESL

SEQ ID NO: 124945 - protein, 9 aa, Mycobacterium tuberculosis
ASKLTESLR

SEQ ID NO: 124946 - protein, 9 aa, Mycobacterium tuberculosis
KLTESLRLY

SEQ ID NO: 124947 - protein, 9 aa, Mycobacterium tuberculosis
SLRLYDSSY

SEQ ID NO: 124948 - protein, 9 aa, Mycobacterium tuberculosis
RLYDSSYHA

SEQ ID NO: 124949 - protein, 9 aa, Mycobacterium tuberculosis
YDSSYHAEL

SEQ ID NO: 124950 - protein, 9 aa, Mycobacterium tuberculosis
SSYHAELFW

SEQ ID NO: 124951 - protein, 9 aa, Mycobacterium tuberculosis
SYHAELFWW

SEQ ID NO: 124952 - protein, 9 aa, Mycobacterium tuberculosis
AELFWWTGA

SEQ ID NO: 124953 - protein, 9 aa, Mycobacterium tuberculosis
ELFWWTGAF

SEQ ID NO: 124954 - protein, 9 aa, Mycobacterium tuberculosis
GAFETSEGI

SEQ ID NO: 124955 - protein, 9 aa, Mycobacterium tuberculosis
ETSEGIPHS

SEQ ID NO: 124956 - protein, 9 aa, Mycobacterium tuberculosis
SEGIPHSSL

SEQ ID NO: 124957 - protein, 9 aa, Mycobacterium tuberculosis
EGIPHSSLV

SEQ ID NO: 124958 - protein, 9 aa, Mycobacterium tuberculosis
IPHSSLVSA

SEQ ID NO: 124959 - protein, 9 aa, Mycobacterium tuberculosis
LVSAAESDR

SEQ ID NO: 124960 - protein, 9 aa, Mycobacterium tuberculosis
VSAAESDRV

SEQ ID NO: 124961 - protein, 9 aa, Mycobacterium tuberculosis
ESDRVTFGR

SEQ ID NO: 124962 - protein, 9 aa, Mycobacterium tuberculosis
VTFGRDFPV

SEQ ID NO: 124963 - protein, 9 aa, Mycobacterium tuberculosis
FPVVANTDR

SEQ ID NO: 124964 - protein, 9 aa, Mycobacterium tuberculosis
PVVANTDRR

SEQ ID NO: 124965 - protein, 9 aa, Mycobacterium tuberculosis
FGHDRSKVL

SEQ ID NO: 124966 - protein, 9 aa, Mycobacterium tuberculosis
VLSTYDNER

SEQ ID NO: 124967 - protein, 9 aa, Mycobacterium tuberculosis
TYDNERASL

SEQ ID NO: 124968 - protein, 9 aa, Mycobacterium tuberculosis
SLLRCGEML

SEQ ID NO: 124969 - protein, 9 aa, Mycobacterium tuberculosis
RCGEMLSAV

SEQ ID NO: 124970 - protein, 9 aa, Mycobacterium tuberculosis
GEMLSAVLL

SEQ ID NO: 124971 - protein, 9 aa, Mycobacterium tuberculosis
MLSAVLLDA

SEQ ID NO: 124972 - protein, 9 aa, Mycobacterium tuberculosis
SAVLLDATM

SEQ ID NO: 124973 - protein, 9 aa, Mycobacterium tuberculosis
VLLDATMAG

SEQ ID NO: 124974 - protein, 9 aa, Mycobacterium tuberculosis
LLDATMAGL

SEQ ID NO: 124975 - protein, 9 aa, Mycobacterium tuberculosis
ATMAGLATC

SEQ ID NO: 124976 - protein, 9 aa, Mycobacterium tuberculosis
TMAGLATCT

SEQ ID NO: 124977 - protein, 9 aa, Mycobacterium tuberculosis
MAGLATCTL

SEQ ID NO: 124978 - protein, 9 aa, Mycobacterium tuberculosis
GLATCTLTH

SEQ ID NO: 124979 - protein, 9 aa, Mycobacterium tuberculosis
LATCTLTHI

SEQ ID NO: 124980 - protein, 9 aa, Mycobacterium tuberculosis
CTLTHITEL

SEQ ID NO: 124981 - protein, 9 aa, Mycobacterium tuberculosis
HITELHASR

SEQ ID NO: 124982 - protein, 9 aa, Mycobacterium tuberculosis
TELHASRDL

SEQ ID NO: 124983 - protein, 9 aa, Mycobacterium tuberculosis
ELHASRDLV

SEQ ID NO: 124984 - protein, 9 aa, Mycobacterium tuberculosis
ASRDLVAAL

SEQ ID NO: 124985 - protein, 9 aa, Mycobacterium tuberculosis
VAALIGQPA

SEQ ID NO: 124986 - protein, 9 aa, Mycobacterium tuberculosis
GQPATPQAL

SEQ ID NO: 124987 - protein, 9 aa, Mycobacterium tuberculosis
QPATPQALV

SEQ ID NO: 124988 - protein, 9 aa, Mycobacterium tuberculosis
ATPQALVRV

SEQ ID NO: 124989 - protein, 9 aa, Mycobacterium tuberculosis
EMEEPPPAT

SEQ ID NO: 124990 - protein, 9 aa, Mycobacterium tuberculosis
EPPPATPRR

SEQ ID NO: 124991 - protein, 9 aa, Mycobacterium tuberculosis
PPATPRRPI

SEQ ID NO: 124992 - protein, 9 aa, Mycobacterium tuberculosis
TPRRPIDEV

SEQ ID NO: 124993 - protein, 9 aa, Mycobacterium tuberculosis
RPIDEVFHV

SEQ ID NO: 124994 - protein, 10 aa, Mycobacterium tuberculosis
MPDTMVTTDV

SEQ ID NO: 124995 - protein, 10 aa, Mycobacterium tuberculosis
DTMVTTDVIK

SEQ ID NO: 124996 - protein, 10 aa, Mycobacterium tuberculosis
MVTTDVIKSA

SEQ ID NO: 124997 - protein, 10 aa, Mycobacterium tuberculosis
VTTDVIKSAV

SEQ ID NO: 124998 - protein, 10 aa, Mycobacterium tuberculosis
IKSAVQLACR

SEQ ID NO: 124999 - protein, 10 aa, Mycobacterium tuberculosis
VQLACRAPSL

SEQ ID NO: 125000 - protein, 10 aa, Mycobacterium tuberculosis
APSLHNSQPW

SEQ ID NO: 125001 - protein, 10 aa, Mycobacterium tuberculosis
SLHNSQPWRW

SEQ ID NO: 125002 - protein, 10 aa, Mycobacterium tuberculosis
QPWRWIAEDH

SEQ ID NO: 125003 - protein, 10 aa, Mycobacterium tuberculosis
WRWIAEDHTV

SEQ ID NO: 125004 - protein, 10 aa, Mycobacterium tuberculosis
WIAEDHTVAL

SEQ ID NO: 125005 - protein, 10 aa, Mycobacterium tuberculosis
IAEDHTVALF

SEQ ID NO: 125006 - protein, 10 aa, Mycobacterium tuberculosis
AEDHTVALFL

SEQ ID NO: 125007 - protein, 10 aa, Mycobacterium tuberculosis
TVALFLDKDR

SEQ ID NO: 125008 - protein, 10 aa, Mycobacterium tuberculosis
ALFLDKDRVL

SEQ ID NO: 125009 - protein, 10 aa, Mycobacterium tuberculosis
LFLDKDRVLY

SEQ ID NO: 125010 - protein, 10 aa, Mycobacterium tuberculosis
FLDKDRVLYA

SEQ ID NO: 125011 - protein, 10 aa, Mycobacterium tuberculosis
VLYATDHSGR

SEQ ID NO: 125012 - protein, 10 aa, Mycobacterium tuberculosis
REALLGCGAV

SEQ ID NO: 125013 - protein, 10 aa, Mycobacterium tuberculosis
EALLGCGAVL

SEQ ID NO: 125014 - protein, 10 aa, Mycobacterium tuberculosis
CGAVLDHFRV

SEQ ID NO: 125015 - protein, 10 aa, Mycobacterium tuberculosis
AVLDHFRVAM

SEQ ID NO: 125016 - protein, 10 aa, Mycobacterium tuberculosis
VLDHFRVAMA

SEQ ID NO: 125017 - protein, 10 aa, Mycobacterium tuberculosis
VAMAAAGTTA

SEQ ID NO: 125018 - protein, 10 aa, Mycobacterium tuberculosis
MAAAGTTANV

SEQ ID NO: 125019 - protein, 10 aa, Mycobacterium tuberculosis
ERFPNPNDPL

SEQ ID NO: 125020 - protein, 10 aa, Mycobacterium tuberculosis
FPNPNDPLHL

SEQ ID NO: 125021 - protein, 10 aa, Mycobacterium tuberculosis
NPNDPLHLAS

SEQ ID NO: 125022 - protein, 10 aa, Mycobacterium tuberculosis
DPLHLASIDF

SEQ ID NO: 125023 - protein, 10 aa, Mycobacterium tuberculosis
HLASIDFSPA

SEQ ID NO: 125024 - protein, 10 aa, Mycobacterium tuberculosis
SIDFSPADFV

SEQ ID NO: 125025 - protein, 10 aa, Mycobacterium tuberculosis
SPADFVTEGH

SEQ ID NO: 125026 - protein, 10 aa, Mycobacterium tuberculosis
DFVTEGHRLR

SEQ ID NO: 125027 - protein, 10 aa, Mycobacterium tuberculosis
FVTEGHRLRA

SEQ ID NO: 125028 - protein, 10 aa, Mycobacterium tuberculosis
RLRADAILLR

SEQ ID NO: 125029 - protein, 10 aa, Mycobacterium tuberculosis
DAILLRRTDR

SEQ ID NO: 125030 - protein, 10 aa, Mycobacterium tuberculosis
AILLRRTDRL

SEQ ID NO: 125031 - protein, 10 aa, Mycobacterium tuberculosis
LLRRTDRLPF

SEQ ID NO: 125032 - protein, 10 aa, Mycobacterium tuberculosis
RLPFAEPPDW

SEQ ID NO: 125033 - protein, 10 aa, Mycobacterium tuberculosis
FAEPPDWDLV

SEQ ID NO: 125034 - protein, 10 aa, Mycobacterium tuberculosis
EPPDWDLVES

SEQ ID NO: 125035 - protein, 10 aa, Mycobacterium tuberculosis
LVESQLRTTV

SEQ ID NO: 125036 - protein, 10 aa, Mycobacterium tuberculosis
RTTVTADTVR

SEQ ID NO: 125037 - protein, 10 aa, Mycobacterium tuberculosis
TTVTADTVRI

SEQ ID NO: 125038 - protein, 10 aa, Mycobacterium tuberculosis
VTADTVRIDV

SEQ ID NO: 125039 - protein, 10 aa, Mycobacterium tuberculosis
DVIADDMRPE

SEQ ID NO: 125040 - protein, 10 aa, Mycobacterium tuberculosis
VIADDMRPEL

SEQ ID NO: 125041 - protein, 10 aa, Mycobacterium tuberculosis
MRPELAAASK

SEQ ID NO: 125042 - protein, 10 aa, Mycobacterium tuberculosis
RPELAAASKL

SEQ ID NO: 125043 - protein, 10 aa, Mycobacterium tuberculosis
AAASKLTESL

SEQ ID NO: 125044 - protein, 10 aa, Mycobacterium tuberculosis
AASKLTESLR

SEQ ID NO: 125045 - protein, 10 aa, Mycobacterium tuberculosis
ESLRLYDSSY

SEQ ID NO: 125046 - protein, 10 aa, Mycobacterium tuberculosis
RLYDSSYHAE

SEQ ID NO: 125047 - protein, 10 aa, Mycobacterium tuberculosis
LYDSSYHAEL

SEQ ID NO: 125048 - protein, 10 aa, Mycobacterium tuberculosis
DSSYHAELFW

SEQ ID NO: 125049 - protein, 10 aa, Mycobacterium tuberculosis
SSYHAELFWW

SEQ ID NO: 125050 - protein, 10 aa, Mycobacterium tuberculosis
AELFWWTGAF

SEQ ID NO: 125051 - protein, 10 aa, Mycobacterium tuberculosis
ELFWWTGAFE

SEQ ID NO: 125052 - protein, 10 aa, Mycobacterium tuberculosis
TGAFETSEGI

SEQ ID NO: 125053 - protein, 10 aa, Mycobacterium tuberculosis
ETSEGIPHSS

SEQ ID NO: 125054 - protein, 10 aa, Mycobacterium tuberculosis
TSEGIPHSSL

SEQ ID NO: 125055 - protein, 10 aa, Mycobacterium tuberculosis
GIPHSSLVSA

SEQ ID NO: 125056 - protein, 10 aa, Mycobacterium tuberculosis
IPHSSLVSAA

SEQ ID NO: 125057 - protein, 10 aa, Mycobacterium tuberculosis
SLVSAAESDR

SEQ ID NO: 125058 - protein, 10 aa, Mycobacterium tuberculosis
LVSAAESDRV

SEQ ID NO: 125059 - protein, 10 aa, Mycobacterium tuberculosis
SAAESDRVTF

SEQ ID NO: 125060 - protein, 10 aa, Mycobacterium tuberculosis
AESDRVTFGR

SEQ ID NO: 125061 - protein, 10 aa, Mycobacterium tuberculosis
RVTFGRDFPV

SEQ ID NO: 125062 - protein, 10 aa, Mycobacterium tuberculosis
VTFGRDFPVV

SEQ ID NO: 125063 - protein, 10 aa, Mycobacterium tuberculosis
DFPVVANTDR

SEQ ID NO: 125064 - protein, 10 aa, Mycobacterium tuberculosis
FPVVANTDRR

SEQ ID NO: 125065 - protein, 10 aa, Mycobacterium tuberculosis
VANTDRRPEF

SEQ ID NO: 125066 - protein, 10 aa, Mycobacterium tuberculosis
FGHDRSKVLV

SEQ ID NO: 125067 - protein, 10 aa, Mycobacterium tuberculosis
GHDRSKVLVL

SEQ ID NO: 125068 - protein, 10 aa, Mycobacterium tuberculosis
RSKVLVLSTY

SEQ ID NO: 125069 - protein, 10 aa, Mycobacterium tuberculosis
LVLSTYDNER

SEQ ID NO: 125070 - protein, 10 aa, Mycobacterium tuberculosis
VLSTYDNERA

SEQ ID NO: 125071 - protein, 10 aa, Mycobacterium tuberculosis
STYDNERASL

SEQ ID NO: 125072 - protein, 10 aa, Mycobacterium tuberculosis
TYDNERASLL

SEQ ID NO: 125073 - protein, 10 aa, Mycobacterium tuberculosis
RASLLRCGEM

SEQ ID NO: 125074 - protein, 10 aa, Mycobacterium tuberculosis
SLLRCGEMLS

SEQ ID NO: 125075 - protein, 10 aa, Mycobacterium tuberculosis
LLRCGEMLSA

SEQ ID NO: 125076 - protein, 10 aa, Mycobacterium tuberculosis
EMLSAVLLDA

SEQ ID NO: 125077 - protein, 10 aa, Mycobacterium tuberculosis
MLSAVLLDAT

SEQ ID NO: 125078 - protein, 10 aa, Mycobacterium tuberculosis
LSAVLLDATM

SEQ ID NO: 125079 - protein, 10 aa, Mycobacterium tuberculosis
VLLDATMAGL

SEQ ID NO: 125080 - protein, 10 aa, Mycobacterium tuberculosis
LLDATMAGLA

SEQ ID NO: 125081 - protein, 10 aa, Mycobacterium tuberculosis
ATMAGLATCT

SEQ ID NO: 125082 - protein, 10 aa, Mycobacterium tuberculosis
TMAGLATCTL

SEQ ID NO: 125083 - protein, 10 aa, Mycobacterium tuberculosis
GLATCTLTHI

SEQ ID NO: 125084 - protein, 10 aa, Mycobacterium tuberculosis
TLTHITELHA

SEQ ID NO: 125085 - protein, 10 aa, Mycobacterium tuberculosis
ELHASRDLVA

SEQ ID NO: 125086 - protein, 10 aa, Mycobacterium tuberculosis
HASRDLVAAL

SEQ ID NO: 125087 - protein, 10 aa, Mycobacterium tuberculosis
ASRDLVAALI

SEQ ID NO: 125088 - protein, 10 aa, Mycobacterium tuberculosis
LVAALIGQPA

SEQ ID NO: 125089 - protein, 10 aa, Mycobacterium tuberculosis
ALIGQPATPQ

SEQ ID NO: 125090 - protein, 10 aa, Mycobacterium tuberculosis
LIGQPATPQA

SEQ ID NO: 125091 - protein, 10 aa, Mycobacterium tuberculosis
GQPATPQALV

SEQ ID NO: 125092 - protein, 10 aa, Mycobacterium tuberculosis
PATPQALVRV

SEQ ID NO: 125093 - protein, 10 aa, Mycobacterium tuberculosis
TPQALVRVGL

SEQ ID NO: 125094 - protein, 10 aa, Mycobacterium tuberculosis
LVRVGLAPEM

SEQ ID NO: 125095 - protein, 10 aa, Mycobacterium tuberculosis
ATPRRPIDEV

SEQ ID NO: 125096 - protein, 10 aa, Mycobacterium tuberculosis
TPRRPIDEVF

SEQ ID NO: 125097 - protein, 10 aa, Mycobacterium tuberculosis
RPIDEVFHVR

SEQ ID NO: 125098 - protein, 10 aa, Mycobacterium tuberculosis
PIDEVFHVRA

SEQ ID NO: 125099 - protein, 10 aa, Mycobacterium tuberculosis
VFHVRAKDHR

SEQ ID NO: 125100 - protein, 11 aa, Mycobacterium tuberculosis
MPDTMVTTDVI

SEQ ID NO: 125101 - protein, 11 aa, Mycobacterium tuberculosis
TMVTTDVIKSA

SEQ ID NO: 125102 - protein, 11 aa, Mycobacterium tuberculosis
MVTTDVIKSAV

SEQ ID NO: 125103 - protein, 11 aa, Mycobacterium tuberculosis
VIKSAVQLACR

SEQ ID NO: 125104 - protein, 11 aa, Mycobacterium tuberculosis
RAPSLHNSQPW

SEQ ID NO: 125105 - protein, 11 aa, Mycobacterium tuberculosis
PSLHNSQPWRW

SEQ ID NO: 125106 - protein, 11 aa, Mycobacterium tuberculosis
SLHNSQPWRWI

SEQ ID NO: 125107 - protein, 11 aa, Mycobacterium tuberculosis
RWIAEDHTVAL

SEQ ID NO: 125108 - protein, 11 aa, Mycobacterium tuberculosis
WIAEDHTVALF

SEQ ID NO: 125109 - protein, 11 aa, Mycobacterium tuberculosis
IAEDHTVALFL

SEQ ID NO: 125110 - protein, 11 aa, Mycobacterium tuberculosis
HTVALFLDKDR

SEQ ID NO: 125111 - protein, 11 aa, Mycobacterium tuberculosis
TVALFLDKDRV

SEQ ID NO: 125112 - protein, 11 aa, Mycobacterium tuberculosis
ALFLDKDRVLY

SEQ ID NO: 125113 - protein, 11 aa, Mycobacterium tuberculosis
FLDKDRVLYAT

SEQ ID NO: 125114 - protein, 11 aa, Mycobacterium tuberculosis
RVLYATDHSGR

SEQ ID NO: 125115 - protein, 11 aa, Mycobacterium tuberculosis
VLYATDHSGRE

SEQ ID NO: 125116 - protein, 11 aa, Mycobacterium tuberculosis
YATDHSGREAL

SEQ ID NO: 125117 - protein, 11 aa, Mycobacterium tuberculosis
REALLGCGAVL

SEQ ID NO: 125118 - protein, 11 aa, Mycobacterium tuberculosis
LLGCGAVLDHF

SEQ ID NO: 125119 - protein, 11 aa, Mycobacterium tuberculosis
LGCGAVLDHFR

SEQ ID NO: 125120 - protein, 11 aa, Mycobacterium tuberculosis
GCGAVLDHFRV

SEQ ID NO: 125121 - protein, 11 aa, Mycobacterium tuberculosis
AVLDHFRVAMA

SEQ ID NO: 125122 - protein, 11 aa, Mycobacterium tuberculosis
VLDHFRVAMAA

SEQ ID NO: 125123 - protein, 11 aa, Mycobacterium tuberculosis
RVAMAAAGTTA

SEQ ID NO: 125124 - protein, 11 aa, Mycobacterium tuberculosis
AMAAAGTTANV

SEQ ID NO: 125125 - protein, 11 aa, Mycobacterium tuberculosis
MAAAGTTANVE

SEQ ID NO: 125126 - protein, 11 aa, Mycobacterium tuberculosis
AAAGTTANVER

SEQ ID NO: 125127 - protein, 11 aa, Mycobacterium tuberculosis
VERFPNPNDPL

SEQ ID NO: 125128 - protein, 11 aa, Mycobacterium tuberculosis
RFPNPNDPLHL

SEQ ID NO: 125129 - protein, 11 aa, Mycobacterium tuberculosis
FPNPNDPLHLA

SEQ ID NO: 125130 - protein, 11 aa, Mycobacterium tuberculosis
NPNDPLHLASI

SEQ ID NO: 125131 - protein, 11 aa, Mycobacterium tuberculosis
LASIDFSPADF

SEQ ID NO: 125132 - protein, 11 aa, Mycobacterium tuberculosis
ASIDFSPADFV

SEQ ID NO: 125133 - protein, 11 aa, Mycobacterium tuberculosis
SPADFVTEGHR

SEQ ID NO: 125134 - protein, 11 aa, Mycobacterium tuberculosis
HRLRADAILLR

SEQ ID NO: 125135 - protein, 11 aa, Mycobacterium tuberculosis
RLRADAILLRR

SEQ ID NO: 125136 - protein, 11 aa, Mycobacterium tuberculosis
ILLRRTDRLPF

SEQ ID NO: 125137 - protein, 11 aa, Mycobacterium tuberculosis
LLRRTDRLPFA

SEQ ID NO: 125138 - protein, 11 aa, Mycobacterium tuberculosis
LPFAEPPDWDL

SEQ ID NO: 125139 - protein, 11 aa, Mycobacterium tuberculosis
DLVESQLRTTV

SEQ ID NO: 125140 - protein, 11 aa, Mycobacterium tuberculosis
QLRTTVTADTV

SEQ ID NO: 125141 - protein, 11 aa, Mycobacterium tuberculosis
TVTADTVRIDV

SEQ ID NO: 125142 - protein, 11 aa, Mycobacterium tuberculosis
DVIADDMRPEL

SEQ ID NO: 125143 - protein, 11 aa, Mycobacterium tuberculosis
VIADDMRPELA

SEQ ID NO: 125144 - protein, 11 aa, Mycobacterium tuberculosis
IADDMRPELAA

SEQ ID NO: 125145 - protein, 11 aa, Mycobacterium tuberculosis
DMRPELAAASK

SEQ ID NO: 125146 - protein, 11 aa, Mycobacterium tuberculosis
RPELAAASKLT

SEQ ID NO: 125147 - protein, 11 aa, Mycobacterium tuberculosis
LAAASKLTESL

SEQ ID NO: 125148 - protein, 11 aa, Mycobacterium tuberculosis
AAASKLTESLR

SEQ ID NO: 125149 - protein, 11 aa, Mycobacterium tuberculosis
TESLRLYDSSY

SEQ ID NO: 125150 - protein, 11 aa, Mycobacterium tuberculosis
SLRLYDSSYHA

SEQ ID NO: 125151 - protein, 11 aa, Mycobacterium tuberculosis
RLYDSSYHAEL

SEQ ID NO: 125152 - protein, 11 aa, Mycobacterium tuberculosis
LYDSSYHAELF

SEQ ID NO: 125153 - protein, 11 aa, Mycobacterium tuberculosis
DSSYHAELFWW

SEQ ID NO: 125154 - protein, 11 aa, Mycobacterium tuberculosis
HAELFWWTGAF

SEQ ID NO: 125155 - protein, 11 aa, Mycobacterium tuberculosis
ELFWWTGAFET

SEQ ID NO: 125156 - protein, 11 aa, Mycobacterium tuberculosis
WTGAFETSEGI

SEQ ID NO: 125157 - protein, 11 aa, Mycobacterium tuberculosis
ETSEGIPHSSL

SEQ ID NO: 125158 - protein, 11 aa, Mycobacterium tuberculosis
TSEGIPHSSLV

SEQ ID NO: 125159 - protein, 11 aa, Mycobacterium tuberculosis
EGIPHSSLVSA

SEQ ID NO: 125160 - protein, 11 aa, Mycobacterium tuberculosis
SSLVSAAESDR

SEQ ID NO: 125161 - protein, 11 aa, Mycobacterium tuberculosis
SLVSAAESDRV

SEQ ID NO: 125162 - protein, 11 aa, Mycobacterium tuberculosis
VSAAESDRVTF

SEQ ID NO: 125163 - protein, 11 aa, Mycobacterium tuberculosis
AAESDRVTFGR

SEQ ID NO: 125164 - protein, 11 aa, Mycobacterium tuberculosis
RVTFGRDFPVV

SEQ ID NO: 125165 - protein, 11 aa, Mycobacterium tuberculosis
VTFGRDFPVVA

SEQ ID NO: 125166 - protein, 11 aa, Mycobacterium tuberculosis
DFPVVANTDRR

SEQ ID NO: 125167 - protein, 11 aa, Mycobacterium tuberculosis
FPVVANTDRRP

SEQ ID NO: 125168 - protein, 11 aa, Mycobacterium tuberculosis
VVANTDRRPEF

SEQ ID NO: 125169 - protein, 11 aa, Mycobacterium tuberculosis
RRPEFGHDRSK

SEQ ID NO: 125170 - protein, 11 aa, Mycobacterium tuberculosis
RPEFGHDRSKV

SEQ ID NO: 125171 - protein, 11 aa, Mycobacterium tuberculosis
PEFGHDRSKVL

SEQ ID NO: 125172 - protein, 11 aa, Mycobacterium tuberculosis
FGHDRSKVLVL

SEQ ID NO: 125173 - protein, 11 aa, Mycobacterium tuberculosis
VLVLSTYDNER

SEQ ID NO: 125174 - protein, 11 aa, Mycobacterium tuberculosis
STYDNERASLL

SEQ ID NO: 125175 - protein, 11 aa, Mycobacterium tuberculosis
TYDNERASLLR

SEQ ID NO: 125176 - protein, 11 aa, Mycobacterium tuberculosis
RASLLRCGEML

SEQ ID NO: 125177 - protein, 11 aa, Mycobacterium tuberculosis
SLLRCGEMLSA

SEQ ID NO: 125178 - protein, 11 aa, Mycobacterium tuberculosis
LLRCGEMLSAV

SEQ ID NO: 125179 - protein, 11 aa, Mycobacterium tuberculosis
MLSAVLLDATM

SEQ ID NO: 125180 - protein, 11 aa, Mycobacterium tuberculosis
AVLLDATMAGL

SEQ ID NO: 125181 - protein, 11 aa, Mycobacterium tuberculosis
VLLDATMAGLA

SEQ ID NO: 125182 - protein, 11 aa, Mycobacterium tuberculosis
LLDATMAGLAT

SEQ ID NO: 125183 - protein, 11 aa, Mycobacterium tuberculosis
ATMAGLATCTL

SEQ ID NO: 125184 - protein, 11 aa, Mycobacterium tuberculosis
TMAGLATCTLT

SEQ ID NO: 125185 - protein, 11 aa, Mycobacterium tuberculosis
MAGLATCTLTH

SEQ ID NO: 125186 - protein, 11 aa, Mycobacterium tuberculosis
GLATCTLTHIT

SEQ ID NO: 125187 - protein, 11 aa, Mycobacterium tuberculosis
ATCTLTHITEL

SEQ ID NO: 125188 - protein, 11 aa, Mycobacterium tuberculosis
TLTHITELHAS

SEQ ID NO: 125189 - protein, 11 aa, Mycobacterium tuberculosis
LTHITELHASR

SEQ ID NO: 125190 - protein, 11 aa, Mycobacterium tuberculosis
ELHASRDLVAA

SEQ ID NO: 125191 - protein, 11 aa, Mycobacterium tuberculosis
LHASRDLVAAL

SEQ ID NO: 125192 - protein, 11 aa, Mycobacterium tuberculosis
HASRDLVAALI

SEQ ID NO: 125193 - protein, 11 aa, Mycobacterium tuberculosis
DLVAALIGQPA

SEQ ID NO: 125194 - protein, 11 aa, Mycobacterium tuberculosis
ALIGQPATPQA

SEQ ID NO: 125195 - protein, 11 aa, Mycobacterium tuberculosis
LIGQPATPQAL

SEQ ID NO: 125196 - protein, 11 aa, Mycobacterium tuberculosis
QPATPQALVRV

SEQ ID NO: 125197 - protein, 11 aa, Mycobacterium tuberculosis
ATPQALVRVGL

SEQ ID NO: 125198 - protein, 11 aa, Mycobacterium tuberculosis
TPQALVRVGLA

SEQ ID NO: 125199 - protein, 11 aa, Mycobacterium tuberculosis
ALVRVGLAPEM

SEQ ID NO: 125200 - protein, 11 aa, Mycobacterium tuberculosis
EMEEPPPATPR

SEQ ID NO: 125201 - protein, 11 aa, Mycobacterium tuberculosis
EPPPATPRRPI

SEQ ID NO: 125202 - protein, 11 aa, Mycobacterium tuberculosis
PATPRRPIDEV

SEQ ID NO: 125203 - protein, 11 aa, Mycobacterium tuberculosis
ATPRRPIDEVF

SEQ ID NO: 125204 - protein, 11 aa, Mycobacterium tuberculosis
EVFHVRAKDHR

SEQ ID NO: 125205 - protein, 13 aa, Mycobacterium tuberculosis
MPDTMVTTDVIKS

SEQ ID NO: 125206 - protein, 13 aa, Mycobacterium tuberculosis
PDTMVTTDVIKSA

SEQ ID NO: 125207 - protein, 13 aa, Mycobacterium tuberculosis
DTMVTTDVIKSAV

SEQ ID NO: 125208 - protein, 13 aa, Mycobacterium tuberculosis
TMVTTDVIKSAVQ

SEQ ID NO: 125209 - protein, 13 aa, Mycobacterium tuberculosis
MVTTDVIKSAVQL

SEQ ID NO: 125210 - protein, 13 aa, Mycobacterium tuberculosis
VTTDVIKSAVQLA

SEQ ID NO: 125211 - protein, 13 aa, Mycobacterium tuberculosis
TTDVIKSAVQLAC

SEQ ID NO: 125212 - protein, 13 aa, Mycobacterium tuberculosis
TDVIKSAVQLACR

SEQ ID NO: 125213 - protein, 13 aa, Mycobacterium tuberculosis
DVIKSAVQLACRA

SEQ ID NO: 125214 - protein, 13 aa, Mycobacterium tuberculosis
VIKSAVQLACRAP

SEQ ID NO: 125215 - protein, 13 aa, Mycobacterium tuberculosis
IKSAVQLACRAPS

SEQ ID NO: 125216 - protein, 13 aa, Mycobacterium tuberculosis
KSAVQLACRAPSL

SEQ ID NO: 125217 - protein, 13 aa, Mycobacterium tuberculosis
SAVQLACRAPSLH

SEQ ID NO: 125218 - protein, 13 aa, Mycobacterium tuberculosis
AVQLACRAPSLHN

SEQ ID NO: 125219 - protein, 13 aa, Mycobacterium tuberculosis
VQLACRAPSLHNS

SEQ ID NO: 125220 - protein, 13 aa, Mycobacterium tuberculosis
QLACRAPSLHNSQ

SEQ ID NO: 125221 - protein, 13 aa, Mycobacterium tuberculosis
LACRAPSLHNSQP

SEQ ID NO: 125222 - protein, 13 aa, Mycobacterium tuberculosis
ACRAPSLHNSQPW

SEQ ID NO: 125223 - protein, 13 aa, Mycobacterium tuberculosis
CRAPSLHNSQPWR

SEQ ID NO: 125224 - protein, 13 aa, Mycobacterium tuberculosis
RAPSLHNSQPWRW

SEQ ID NO: 125225 - protein, 13 aa, Mycobacterium tuberculosis
APSLHNSQPWRWI

SEQ ID NO: 125226 - protein, 13 aa, Mycobacterium tuberculosis
PSLHNSQPWRWIA

SEQ ID NO: 125227 - protein, 13 aa, Mycobacterium tuberculosis
SLHNSQPWRWIAE

SEQ ID NO: 125228 - protein, 13 aa, Mycobacterium tuberculosis
LHNSQPWRWIAED

SEQ ID NO: 125229 - protein, 13 aa, Mycobacterium tuberculosis
HNSQPWRWIAEDH

SEQ ID NO: 125230 - protein, 13 aa, Mycobacterium tuberculosis
NSQPWRWIAEDHT

SEQ ID NO: 125231 - protein, 13 aa, Mycobacterium tuberculosis
SQPWRWIAEDHTV

SEQ ID NO: 125232 - protein, 13 aa, Mycobacterium tuberculosis
QPWRWIAEDHTVA

SEQ ID NO: 125233 - protein, 13 aa, Mycobacterium tuberculosis
PWRWIAEDHTVAL

SEQ ID NO: 125234 - protein, 13 aa, Mycobacterium tuberculosis
WRWIAEDHTVALF

SEQ ID NO: 125235 - protein, 13 aa, Mycobacterium tuberculosis
RWIAEDHTVALFL

SEQ ID NO: 125236 - protein, 13 aa, Mycobacterium tuberculosis
WIAEDHTVALFLD

SEQ ID NO: 125237 - protein, 13 aa, Mycobacterium tuberculosis
IAEDHTVALFLDK

SEQ ID NO: 125238 - protein, 13 aa, Mycobacterium tuberculosis
AEDHTVALFLDKD

SEQ ID NO: 125239 - protein, 13 aa, Mycobacterium tuberculosis
EDHTVALFLDKDR

SEQ ID NO: 125240 - protein, 13 aa, Mycobacterium tuberculosis
DHTVALFLDKDRV

SEQ ID NO: 125241 - protein, 13 aa, Mycobacterium tuberculosis
HTVALFLDKDRVL

SEQ ID NO: 125242 - protein, 13 aa, Mycobacterium tuberculosis
TVALFLDKDRVLY

SEQ ID NO: 125243 - protein, 13 aa, Mycobacterium tuberculosis
VALFLDKDRVLYA

SEQ ID NO: 125244 - protein, 13 aa, Mycobacterium tuberculosis
ALFLDKDRVLYAT

SEQ ID NO: 125245 - protein, 13 aa, Mycobacterium tuberculosis
LFLDKDRVLYATD

SEQ ID NO: 125246 - protein, 13 aa, Mycobacterium tuberculosis
FLDKDRVLYATDH

SEQ ID NO: 125247 - protein, 13 aa, Mycobacterium tuberculosis
LDKDRVLYATDHS

SEQ ID NO: 125248 - protein, 13 aa, Mycobacterium tuberculosis
DKDRVLYATDHSG

SEQ ID NO: 125249 - protein, 13 aa, Mycobacterium tuberculosis
KDRVLYATDHSGR

SEQ ID NO: 125250 - protein, 13 aa, Mycobacterium tuberculosis
DRVLYATDHSGRE

SEQ ID NO: 125251 - protein, 13 aa, Mycobacterium tuberculosis
RVLYATDHSGREA

SEQ ID NO: 125252 - protein, 13 aa, Mycobacterium tuberculosis
VLYATDHSGREAL

SEQ ID NO: 125253 - protein, 13 aa, Mycobacterium tuberculosis
LYATDHSGREALL

SEQ ID NO: 125254 - protein, 13 aa, Mycobacterium tuberculosis
YATDHSGREALLG

SEQ ID NO: 125255 - protein, 13 aa, Mycobacterium tuberculosis
ATDHSGREALLGC

SEQ ID NO: 125256 - protein, 13 aa, Mycobacterium tuberculosis
TDHSGREALLGCG

SEQ ID NO: 125257 - protein, 13 aa, Mycobacterium tuberculosis
DHSGREALLGCGA

SEQ ID NO: 125258 - protein, 13 aa, Mycobacterium tuberculosis
HSGREALLGCGAV

SEQ ID NO: 125259 - protein, 13 aa, Mycobacterium tuberculosis
SGREALLGCGAVL

SEQ ID NO: 125260 - protein, 13 aa, Mycobacterium tuberculosis
GREALLGCGAVLD

SEQ ID NO: 125261 - protein, 13 aa, Mycobacterium tuberculosis
REALLGCGAVLDH

SEQ ID NO: 125262 - protein, 13 aa, Mycobacterium tuberculosis
EALLGCGAVLDHF

SEQ ID NO: 125263 - protein, 13 aa, Mycobacterium tuberculosis
ALLGCGAVLDHFR

SEQ ID NO: 125264 - protein, 13 aa, Mycobacterium tuberculosis
LLGCGAVLDHFRV

SEQ ID NO: 125265 - protein, 13 aa, Mycobacterium tuberculosis
LGCGAVLDHFRVA

SEQ ID NO: 125266 - protein, 13 aa, Mycobacterium tuberculosis
GCGAVLDHFRVAM

SEQ ID NO: 125267 - protein, 13 aa, Mycobacterium tuberculosis
CGAVLDHFRVAMA

SEQ ID NO: 125268 - protein, 13 aa, Mycobacterium tuberculosis
GAVLDHFRVAMAA

SEQ ID NO: 125269 - protein, 13 aa, Mycobacterium tuberculosis
AVLDHFRVAMAAA

SEQ ID NO: 125270 - protein, 13 aa, Mycobacterium tuberculosis
VLDHFRVAMAAAG

SEQ ID NO: 125271 - protein, 13 aa, Mycobacterium tuberculosis
LDHFRVAMAAAGT

SEQ ID NO: 125272 - protein, 13 aa, Mycobacterium tuberculosis
DHFRVAMAAAGTT

SEQ ID NO: 125273 - protein, 13 aa, Mycobacterium tuberculosis
HFRVAMAAAGTTA

SEQ ID NO: 125274 - protein, 13 aa, Mycobacterium tuberculosis
FRVAMAAAGTTAN

SEQ ID NO: 125275 - protein, 13 aa, Mycobacterium tuberculosis
RVAMAAAGTTANV

SEQ ID NO: 125276 - protein, 13 aa, Mycobacterium tuberculosis
VAMAAAGTTANVE

SEQ ID NO: 125277 - protein, 13 aa, Mycobacterium tuberculosis
AMAAAGTTANVER

SEQ ID NO: 125278 - protein, 13 aa, Mycobacterium tuberculosis
MAAAGTTANVERF

SEQ ID NO: 125279 - protein, 13 aa, Mycobacterium tuberculosis
AAAGTTANVERFP

SEQ ID NO: 125280 - protein, 13 aa, Mycobacterium tuberculosis
AAGTTANVERFPN

SEQ ID NO: 125281 - protein, 13 aa, Mycobacterium tuberculosis
AGTTANVERFPNP

SEQ ID NO: 125282 - protein, 13 aa, Mycobacterium tuberculosis
GTTANVERFPNPN

SEQ ID NO: 125283 - protein, 13 aa, Mycobacterium tuberculosis
TTANVERFPNPND

SEQ ID NO: 125284 - protein, 13 aa, Mycobacterium tuberculosis
TANVERFPNPNDP

SEQ ID NO: 125285 - protein, 13 aa, Mycobacterium tuberculosis
ANVERFPNPNDPL

SEQ ID NO: 125286 - protein, 13 aa, Mycobacterium tuberculosis
NVERFPNPNDPLH

SEQ ID NO: 125287 - protein, 13 aa, Mycobacterium tuberculosis
VERFPNPNDPLHL

SEQ ID NO: 125288 - protein, 13 aa, Mycobacterium tuberculosis
ERFPNPNDPLHLA

SEQ ID NO: 125289 - protein, 13 aa, Mycobacterium tuberculosis
RFPNPNDPLHLAS

SEQ ID NO: 125290 - protein, 13 aa, Mycobacterium tuberculosis
FPNPNDPLHLASI

SEQ ID NO: 125291 - protein, 13 aa, Mycobacterium tuberculosis
PNPNDPLHLASID

SEQ ID NO: 125292 - protein, 13 aa, Mycobacterium tuberculosis
NPNDPLHLASIDF

SEQ ID NO: 125293 - protein, 13 aa, Mycobacterium tuberculosis
PNDPLHLASIDFS

SEQ ID NO: 125294 - protein, 13 aa, Mycobacterium tuberculosis
NDPLHLASIDFSP

SEQ ID NO: 125295 - protein, 13 aa, Mycobacterium tuberculosis
DPLHLASIDFSPA

SEQ ID NO: 125296 - protein, 13 aa, Mycobacterium tuberculosis
PLHLASIDFSPAD

SEQ ID NO: 125297 - protein, 13 aa, Mycobacterium tuberculosis
LHLASIDFSPADF

SEQ ID NO: 125298 - protein, 13 aa, Mycobacterium tuberculosis
HLASIDFSPADFV

SEQ ID NO: 125299 - protein, 13 aa, Mycobacterium tuberculosis
LASIDFSPADFVT

SEQ ID NO: 125300 - protein, 13 aa, Mycobacterium tuberculosis
ASIDFSPADFVTE

SEQ ID NO: 125301 - protein, 13 aa, Mycobacterium tuberculosis
SIDFSPADFVTEG

SEQ ID NO: 125302 - protein, 13 aa, Mycobacterium tuberculosis
IDFSPADFVTEGH

SEQ ID NO: 125303 - protein, 13 aa, Mycobacterium tuberculosis
DFSPADFVTEGHR

SEQ ID NO: 125304 - protein, 13 aa, Mycobacterium tuberculosis
FSPADFVTEGHRL

SEQ ID NO: 125305 - protein, 13 aa, Mycobacterium tuberculosis
SPADFVTEGHRLR

SEQ ID NO: 125306 - protein, 13 aa, Mycobacterium tuberculosis
PADFVTEGHRLRA

SEQ ID NO: 125307 - protein, 13 aa, Mycobacterium tuberculosis
ADFVTEGHRLRAD

SEQ ID NO: 125308 - protein, 13 aa, Mycobacterium tuberculosis
DFVTEGHRLRADA

SEQ ID NO: 125309 - protein, 13 aa, Mycobacterium tuberculosis
FVTEGHRLRADAI

SEQ ID NO: 125310 - protein, 13 aa, Mycobacterium tuberculosis
VTEGHRLRADAIL

SEQ ID NO: 125311 - protein, 13 aa, Mycobacterium tuberculosis
TEGHRLRADAILL

SEQ ID NO: 125312 - protein, 13 aa, Mycobacterium tuberculosis
EGHRLRADAILLR

SEQ ID NO: 125313 - protein, 13 aa, Mycobacterium tuberculosis
GHRLRADAILLRR

SEQ ID NO: 125314 - protein, 13 aa, Mycobacterium tuberculosis
HRLRADAILLRRT

SEQ ID NO: 125315 - protein, 13 aa, Mycobacterium tuberculosis
RLRADAILLRRTD

SEQ ID NO: 125316 - protein, 13 aa, Mycobacterium tuberculosis
LRADAILLRRTDR

SEQ ID NO: 125317 - protein, 13 aa, Mycobacterium tuberculosis
RADAILLRRTDRL

SEQ ID NO: 125318 - protein, 13 aa, Mycobacterium tuberculosis
ADAILLRRTDRLP

SEQ ID NO: 125319 - protein, 13 aa, Mycobacterium tuberculosis
DAILLRRTDRLPF

SEQ ID NO: 125320 - protein, 13 aa, Mycobacterium tuberculosis
AILLRRTDRLPFA

SEQ ID NO: 125321 - protein, 13 aa, Mycobacterium tuberculosis
ILLRRTDRLPFAE

SEQ ID NO: 125322 - protein, 13 aa, Mycobacterium tuberculosis
LLRRTDRLPFAEP

SEQ ID NO: 125323 - protein, 13 aa, Mycobacterium tuberculosis
LRRTDRLPFAEPP

SEQ ID NO: 125324 - protein, 13 aa, Mycobacterium tuberculosis
RRTDRLPFAEPPD

SEQ ID NO: 125325 - protein, 13 aa, Mycobacterium tuberculosis
RTDRLPFAEPPDW

SEQ ID NO: 125326 - protein, 13 aa, Mycobacterium tuberculosis
TDRLPFAEPPDWD

SEQ ID NO: 125327 - protein, 13 aa, Mycobacterium tuberculosis
DRLPFAEPPDWDL

SEQ ID NO: 125328 - protein, 13 aa, Mycobacterium tuberculosis
RLPFAEPPDWDLV

SEQ ID NO: 125329 - protein, 13 aa, Mycobacterium tuberculosis
LPFAEPPDWDLVE

SEQ ID NO: 125330 - protein, 13 aa, Mycobacterium tuberculosis
PFAEPPDWDLVES

SEQ ID NO: 125331 - protein, 13 aa, Mycobacterium tuberculosis
FAEPPDWDLVESQ

SEQ ID NO: 125332 - protein, 13 aa, Mycobacterium tuberculosis
AEPPDWDLVESQL

SEQ ID NO: 125333 - protein, 13 aa, Mycobacterium tuberculosis
EPPDWDLVESQLR

SEQ ID NO: 125334 - protein, 13 aa, Mycobacterium tuberculosis
PPDWDLVESQLRT

SEQ ID NO: 125335 - protein, 13 aa, Mycobacterium tuberculosis
PDWDLVESQLRTT

SEQ ID NO: 125336 - protein, 13 aa, Mycobacterium tuberculosis
DWDLVESQLRTTV

SEQ ID NO: 125337 - protein, 13 aa, Mycobacterium tuberculosis
WDLVESQLRTTVT

SEQ ID NO: 125338 - protein, 13 aa, Mycobacterium tuberculosis
DLVESQLRTTVTA

SEQ ID NO: 125339 - protein, 13 aa, Mycobacterium tuberculosis
LVESQLRTTVTAD

SEQ ID NO: 125340 - protein, 13 aa, Mycobacterium tuberculosis
VESQLRTTVTADT

SEQ ID NO: 125341 - protein, 13 aa, Mycobacterium tuberculosis
ESQLRTTVTADTV

SEQ ID NO: 125342 - protein, 13 aa, Mycobacterium tuberculosis
SQLRTTVTADTVR

SEQ ID NO: 125343 - protein, 13 aa, Mycobacterium tuberculosis
QLRTTVTADTVRI

SEQ ID NO: 125344 - protein, 13 aa, Mycobacterium tuberculosis
LRTTVTADTVRID

SEQ ID NO: 125345 - protein, 13 aa, Mycobacterium tuberculosis
RTTVTADTVRIDV

SEQ ID NO: 125346 - protein, 13 aa, Mycobacterium tuberculosis
TTVTADTVRIDVI

SEQ ID NO: 125347 - protein, 13 aa, Mycobacterium tuberculosis
TVTADTVRIDVIA

SEQ ID NO: 125348 - protein, 13 aa, Mycobacterium tuberculosis
VTADTVRIDVIAD

SEQ ID NO: 125349 - protein, 13 aa, Mycobacterium tuberculosis
TADTVRIDVIADD

SEQ ID NO: 125350 - protein, 13 aa, Mycobacterium tuberculosis
ADTVRIDVIADDM

SEQ ID NO: 125351 - protein, 13 aa, Mycobacterium tuberculosis
DTVRIDVIADDMR

SEQ ID NO: 125352 - protein, 13 aa, Mycobacterium tuberculosis
TVRIDVIADDMRP

SEQ ID NO: 125353 - protein, 13 aa, Mycobacterium tuberculosis
VRIDVIADDMRPE

SEQ ID NO: 125354 - protein, 13 aa, Mycobacterium tuberculosis
RIDVIADDMRPEL

SEQ ID NO: 125355 - protein, 13 aa, Mycobacterium tuberculosis
IDVIADDMRPELA

SEQ ID NO: 125356 - protein, 13 aa, Mycobacterium tuberculosis
DVIADDMRPELAA

SEQ ID NO: 125357 - protein, 13 aa, Mycobacterium tuberculosis
VIADDMRPELAAA

SEQ ID NO: 125358 - protein, 13 aa, Mycobacterium tuberculosis
IADDMRPELAAAS

SEQ ID NO: 125359 - protein, 13 aa, Mycobacterium tuberculosis
ADDMRPELAAASK

SEQ ID NO: 125360 - protein, 13 aa, Mycobacterium tuberculosis
DDMRPELAAASKL

SEQ ID NO: 125361 - protein, 13 aa, Mycobacterium tuberculosis
DMRPELAAASKLT

SEQ ID NO: 125362 - protein, 13 aa, Mycobacterium tuberculosis
MRPELAAASKLTE

SEQ ID NO: 125363 - protein, 13 aa, Mycobacterium tuberculosis
RPELAAASKLTES

SEQ ID NO: 125364 - protein, 13 aa, Mycobacterium tuberculosis
PELAAASKLTESL

SEQ ID NO: 125365 - protein, 13 aa, Mycobacterium tuberculosis
ELAAASKLTESLR

SEQ ID NO: 125366 - protein, 13 aa, Mycobacterium tuberculosis
LAAASKLTESLRL

SEQ ID NO: 125367 - protein, 13 aa, Mycobacterium tuberculosis
AAASKLTESLRLY

SEQ ID NO: 125368 - protein, 13 aa, Mycobacterium tuberculosis
AASKLTESLRLYD

SEQ ID NO: 125369 - protein, 13 aa, Mycobacterium tuberculosis
ASKLTESLRLYDS

SEQ ID NO: 125370 - protein, 13 aa, Mycobacterium tuberculosis
SKLTESLRLYDSS

SEQ ID NO: 125371 - protein, 13 aa, Mycobacterium tuberculosis
KLTESLRLYDSSY

SEQ ID NO: 125372 - protein, 13 aa, Mycobacterium tuberculosis
LTESLRLYDSSYH

SEQ ID NO: 125373 - protein, 13 aa, Mycobacterium tuberculosis
TESLRLYDSSYHA

SEQ ID NO: 125374 - protein, 13 aa, Mycobacterium tuberculosis
ESLRLYDSSYHAE

SEQ ID NO: 125375 - protein, 13 aa, Mycobacterium tuberculosis
SLRLYDSSYHAEL

SEQ ID NO: 125376 - protein, 13 aa, Mycobacterium tuberculosis
LRLYDSSYHAELF

SEQ ID NO: 125377 - protein, 13 aa, Mycobacterium tuberculosis
RLYDSSYHAELFW

SEQ ID NO: 125378 - protein, 13 aa, Mycobacterium tuberculosis
LYDSSYHAELFWW

SEQ ID NO: 125379 - protein, 13 aa, Mycobacterium tuberculosis
YDSSYHAELFWWT

SEQ ID NO: 125380 - protein, 13 aa, Mycobacterium tuberculosis
DSSYHAELFWWTG

SEQ ID NO: 125381 - protein, 13 aa, Mycobacterium tuberculosis
SSYHAELFWWTGA

SEQ ID NO: 125382 - protein, 13 aa, Mycobacterium tuberculosis
SYHAELFWWTGAF

SEQ ID NO: 125383 - protein, 13 aa, Mycobacterium tuberculosis
YHAELFWWTGAFE

SEQ ID NO: 125384 - protein, 13 aa, Mycobacterium tuberculosis
HAELFWWTGAFET

SEQ ID NO: 125385 - protein, 13 aa, Mycobacterium tuberculosis
AELFWWTGAFETS

SEQ ID NO: 125386 - protein, 13 aa, Mycobacterium tuberculosis
ELFWWTGAFETSE

SEQ ID NO: 125387 - protein, 13 aa, Mycobacterium tuberculosis
LFWWTGAFETSEG

SEQ ID NO: 125388 - protein, 13 aa, Mycobacterium tuberculosis
FWWTGAFETSEGI

SEQ ID NO: 125389 - protein, 13 aa, Mycobacterium tuberculosis
WWTGAFETSEGIP

SEQ ID NO: 125390 - protein, 13 aa, Mycobacterium tuberculosis
WTGAFETSEGIPH

SEQ ID NO: 125391 - protein, 13 aa, Mycobacterium tuberculosis
TGAFETSEGIPHS

SEQ ID NO: 125392 - protein, 13 aa, Mycobacterium tuberculosis
GAFETSEGIPHSS

SEQ ID NO: 125393 - protein, 13 aa, Mycobacterium tuberculosis
AFETSEGIPHSSL

SEQ ID NO: 125394 - protein, 13 aa, Mycobacterium tuberculosis
FETSEGIPHSSLV

SEQ ID NO: 125395 - protein, 13 aa, Mycobacterium tuberculosis
ETSEGIPHSSLVS

SEQ ID NO: 125396 - protein, 13 aa, Mycobacterium tuberculosis
TSEGIPHSSLVSA

SEQ ID NO: 125397 - protein, 13 aa, Mycobacterium tuberculosis
SEGIPHSSLVSAA

SEQ ID NO: 125398 - protein, 13 aa, Mycobacterium tuberculosis
EGIPHSSLVSAAE

SEQ ID NO: 125399 - protein, 13 aa, Mycobacterium tuberculosis
GIPHSSLVSAAES

SEQ ID NO: 125400 - protein, 13 aa, Mycobacterium tuberculosis
IPHSSLVSAAESD

SEQ ID NO: 125401 - protein, 13 aa, Mycobacterium tuberculosis
PHSSLVSAAESDR

SEQ ID NO: 125402 - protein, 13 aa, Mycobacterium tuberculosis
HSSLVSAAESDRV

SEQ ID NO: 125403 - protein, 13 aa, Mycobacterium tuberculosis
SSLVSAAESDRVT

SEQ ID NO: 125404 - protein, 13 aa, Mycobacterium tuberculosis
SLVSAAESDRVTF

SEQ ID NO: 125405 - protein, 13 aa, Mycobacterium tuberculosis
LVSAAESDRVTFG

SEQ ID NO: 125406 - protein, 13 aa, Mycobacterium tuberculosis
VSAAESDRVTFGR

SEQ ID NO: 125407 - protein, 13 aa, Mycobacterium tuberculosis
SAAESDRVTFGRD

SEQ ID NO: 125408 - protein, 13 aa, Mycobacterium tuberculosis
AAESDRVTFGRDF

SEQ ID NO: 125409 - protein, 13 aa, Mycobacterium tuberculosis
AESDRVTFGRDFP

SEQ ID NO: 125410 - protein, 13 aa, Mycobacterium tuberculosis
ESDRVTFGRDFPV

SEQ ID NO: 125411 - protein, 13 aa, Mycobacterium tuberculosis
SDRVTFGRDFPVV

SEQ ID NO: 125412 - protein, 13 aa, Mycobacterium tuberculosis
DRVTFGRDFPVVA

SEQ ID NO: 125413 - protein, 13 aa, Mycobacterium tuberculosis
RVTFGRDFPVVAN

SEQ ID NO: 125414 - protein, 13 aa, Mycobacterium tuberculosis
VTFGRDFPVVANT

SEQ ID NO: 125415 - protein, 13 aa, Mycobacterium tuberculosis
TFGRDFPVVANTD

SEQ ID NO: 125416 - protein, 13 aa, Mycobacterium tuberculosis
FGRDFPVVANTDR

SEQ ID NO: 125417 - protein, 13 aa, Mycobacterium tuberculosis
GRDFPVVANTDRR

SEQ ID NO: 125418 - protein, 13 aa, Mycobacterium tuberculosis
RDFPVVANTDRRP

SEQ ID NO: 125419 - protein, 13 aa, Mycobacterium tuberculosis
DFPVVANTDRRPE

SEQ ID NO: 125420 - protein, 13 aa, Mycobacterium tuberculosis
FPVVANTDRRPEF

SEQ ID NO: 125421 - protein, 13 aa, Mycobacterium tuberculosis
PVVANTDRRPEFG

SEQ ID NO: 125422 - protein, 13 aa, Mycobacterium tuberculosis
VVANTDRRPEFGH

SEQ ID NO: 125423 - protein, 13 aa, Mycobacterium tuberculosis
VANTDRRPEFGHD

SEQ ID NO: 125424 - protein, 13 aa, Mycobacterium tuberculosis
ANTDRRPEFGHDR

SEQ ID NO: 125425 - protein, 13 aa, Mycobacterium tuberculosis
NTDRRPEFGHDRS

SEQ ID NO: 125426 - protein, 13 aa, Mycobacterium tuberculosis
TDRRPEFGHDRSK

SEQ ID NO: 125427 - protein, 13 aa, Mycobacterium tuberculosis
DRRPEFGHDRSKV

SEQ ID NO: 125428 - protein, 13 aa, Mycobacterium tuberculosis
RRPEFGHDRSKVL

SEQ ID NO: 125429 - protein, 13 aa, Mycobacterium tuberculosis
RPEFGHDRSKVLV

SEQ ID NO: 125430 - protein, 13 aa, Mycobacterium tuberculosis
PEFGHDRSKVLVL

SEQ ID NO: 125431 - protein, 13 aa, Mycobacterium tuberculosis
EFGHDRSKVLVLS

SEQ ID NO: 125432 - protein, 13 aa, Mycobacterium tuberculosis
FGHDRSKVLVLST

SEQ ID NO: 125433 - protein, 13 aa, Mycobacterium tuberculosis
GHDRSKVLVLSTY

SEQ ID NO: 125434 - protein, 13 aa, Mycobacterium tuberculosis
HDRSKVLVLSTYD

SEQ ID NO: 125435 - protein, 13 aa, Mycobacterium tuberculosis
DRSKVLVLSTYDN

SEQ ID NO: 125436 - protein, 13 aa, Mycobacterium tuberculosis
RSKVLVLSTYDNE

SEQ ID NO: 125437 - protein, 13 aa, Mycobacterium tuberculosis
SKVLVLSTYDNER

SEQ ID NO: 125438 - protein, 13 aa, Mycobacterium tuberculosis
KVLVLSTYDNERA

SEQ ID NO: 125439 - protein, 13 aa, Mycobacterium tuberculosis
VLVLSTYDNERAS

SEQ ID NO: 125440 - protein, 13 aa, Mycobacterium tuberculosis
LVLSTYDNERASL

SEQ ID NO: 125441 - protein, 13 aa, Mycobacterium tuberculosis
VLSTYDNERASLL

SEQ ID NO: 125442 - protein, 13 aa, Mycobacterium tuberculosis
LSTYDNERASLLR

SEQ ID NO: 125443 - protein, 13 aa, Mycobacterium tuberculosis
STYDNERASLLRC

SEQ ID NO: 125444 - protein, 13 aa, Mycobacterium tuberculosis
TYDNERASLLRCG

SEQ ID NO: 125445 - protein, 13 aa, Mycobacterium tuberculosis
YDNERASLLRCGE

SEQ ID NO: 125446 - protein, 13 aa, Mycobacterium tuberculosis
DNERASLLRCGEM

SEQ ID NO: 125447 - protein, 13 aa, Mycobacterium tuberculosis
NERASLLRCGEML

SEQ ID NO: 125448 - protein, 13 aa, Mycobacterium tuberculosis
ERASLLRCGEMLS

SEQ ID NO: 125449 - protein, 13 aa, Mycobacterium tuberculosis
RASLLRCGEMLSA

SEQ ID NO: 125450 - protein, 13 aa, Mycobacterium tuberculosis
ASLLRCGEMLSAV

SEQ ID NO: 125451 - protein, 13 aa, Mycobacterium tuberculosis
SLLRCGEMLSAVL

SEQ ID NO: 125452 - protein, 13 aa, Mycobacterium tuberculosis
LLRCGEMLSAVLL

SEQ ID NO: 125453 - protein, 13 aa, Mycobacterium tuberculosis
LRCGEMLSAVLLD

SEQ ID NO: 125454 - protein, 13 aa, Mycobacterium tuberculosis
RCGEMLSAVLLDA

SEQ ID NO: 125455 - protein, 13 aa, Mycobacterium tuberculosis
CGEMLSAVLLDAT

SEQ ID NO: 125456 - protein, 13 aa, Mycobacterium tuberculosis
GEMLSAVLLDATM

SEQ ID NO: 125457 - protein, 13 aa, Mycobacterium tuberculosis
EMLSAVLLDATMA

SEQ ID NO: 125458 - protein, 13 aa, Mycobacterium tuberculosis
MLSAVLLDATMAG

SEQ ID NO: 125459 - protein, 13 aa, Mycobacterium tuberculosis
LSAVLLDATMAGL

SEQ ID NO: 125460 - protein, 13 aa, Mycobacterium tuberculosis
SAVLLDATMAGLA

SEQ ID NO: 125461 - protein, 13 aa, Mycobacterium tuberculosis
AVLLDATMAGLAT

SEQ ID NO: 125462 - protein, 13 aa, Mycobacterium tuberculosis
VLLDATMAGLATC

SEQ ID NO: 125463 - protein, 13 aa, Mycobacterium tuberculosis
LLDATMAGLATCT

SEQ ID NO: 125464 - protein, 13 aa, Mycobacterium tuberculosis
LDATMAGLATCTL

SEQ ID NO: 125465 - protein, 13 aa, Mycobacterium tuberculosis
DATMAGLATCTLT

SEQ ID NO: 125466 - protein, 13 aa, Mycobacterium tuberculosis
ATMAGLATCTLTH

SEQ ID NO: 125467 - protein, 13 aa, Mycobacterium tuberculosis
TMAGLATCTLTHI

SEQ ID NO: 125468 - protein, 13 aa, Mycobacterium tuberculosis
MAGLATCTLTHIT

SEQ ID NO: 125469 - protein, 13 aa, Mycobacterium tuberculosis
AGLATCTLTHITE

SEQ ID NO: 125470 - protein, 13 aa, Mycobacterium tuberculosis
GLATCTLTHITEL

SEQ ID NO: 125471 - protein, 13 aa, Mycobacterium tuberculosis
LATCTLTHITELH

SEQ ID NO: 125472 - protein, 13 aa, Mycobacterium tuberculosis
ATCTLTHITELHA

SEQ ID NO: 125473 - protein, 13 aa, Mycobacterium tuberculosis
TCTLTHITELHAS

SEQ ID NO: 125474 - protein, 13 aa, Mycobacterium tuberculosis
CTLTHITELHASR

SEQ ID NO: 125475 - protein, 13 aa, Mycobacterium tuberculosis
TLTHITELHASRD

SEQ ID NO: 125476 - protein, 13 aa, Mycobacterium tuberculosis
LTHITELHASRDL

SEQ ID NO: 125477 - protein, 13 aa, Mycobacterium tuberculosis
THITELHASRDLV

SEQ ID NO: 125478 - protein, 13 aa, Mycobacterium tuberculosis
HITELHASRDLVA

SEQ ID NO: 125479 - protein, 13 aa, Mycobacterium tuberculosis
ITELHASRDLVAA

SEQ ID NO: 125480 - protein, 13 aa, Mycobacterium tuberculosis
TELHASRDLVAAL

SEQ ID NO: 125481 - protein, 13 aa, Mycobacterium tuberculosis
ELHASRDLVAALI

SEQ ID NO: 125482 - protein, 13 aa, Mycobacterium tuberculosis
LHASRDLVAALIG

SEQ ID NO: 125483 - protein, 13 aa, Mycobacterium tuberculosis
HASRDLVAALIGQ

SEQ ID NO: 125484 - protein, 13 aa, Mycobacterium tuberculosis
ASRDLVAALIGQP

SEQ ID NO: 125485 - protein, 13 aa, Mycobacterium tuberculosis
SRDLVAALIGQPA

SEQ ID NO: 125486 - protein, 13 aa, Mycobacterium tuberculosis
RDLVAALIGQPAT

SEQ ID NO: 125487 - protein, 13 aa, Mycobacterium tuberculosis
DLVAALIGQPATP

SEQ ID NO: 125488 - protein, 13 aa, Mycobacterium tuberculosis
LVAALIGQPATPQ

SEQ ID NO: 125489 - protein, 13 aa, Mycobacterium tuberculosis
VAALIGQPATPQA

SEQ ID NO: 125490 - protein, 13 aa, Mycobacterium tuberculosis
AALIGQPATPQAL

SEQ ID NO: 125491 - protein, 13 aa, Mycobacterium tuberculosis
ALIGQPATPQALV

SEQ ID NO: 125492 - protein, 13 aa, Mycobacterium tuberculosis
LIGQPATPQALVR

SEQ ID NO: 125493 - protein, 13 aa, Mycobacterium tuberculosis
IGQPATPQALVRV

SEQ ID NO: 125494 - protein, 13 aa, Mycobacterium tuberculosis
GQPATPQALVRVG

SEQ ID NO: 125495 - protein, 13 aa, Mycobacterium tuberculosis
QPATPQALVRVGL

SEQ ID NO: 125496 - protein, 13 aa, Mycobacterium tuberculosis
PATPQALVRVGLA

SEQ ID NO: 125497 - protein, 13 aa, Mycobacterium tuberculosis
ATPQALVRVGLAP

SEQ ID NO: 125498 - protein, 13 aa, Mycobacterium tuberculosis
TPQALVRVGLAPE

SEQ ID NO: 125499 - protein, 13 aa, Mycobacterium tuberculosis
PQALVRVGLAPEM

SEQ ID NO: 125500 - protein, 13 aa, Mycobacterium tuberculosis
QALVRVGLAPEME

SEQ ID NO: 125501 - protein, 13 aa, Mycobacterium tuberculosis
ALVRVGLAPEMEE

SEQ ID NO: 125502 - protein, 13 aa, Mycobacterium tuberculosis
LVRVGLAPEMEEP

SEQ ID NO: 125503 - protein, 13 aa, Mycobacterium tuberculosis
VRVGLAPEMEEPP

SEQ ID NO: 125504 - protein, 13 aa, Mycobacterium tuberculosis
RVGLAPEMEEPPP

SEQ ID NO: 125505 - protein, 13 aa, Mycobacterium tuberculosis
VGLAPEMEEPPPA

SEQ ID NO: 125506 - protein, 13 aa, Mycobacterium tuberculosis
GLAPEMEEPPPAT

SEQ ID NO: 125507 - protein, 13 aa, Mycobacterium tuberculosis
LAPEMEEPPPATP

SEQ ID NO: 125508 - protein, 13 aa, Mycobacterium tuberculosis
APEMEEPPPATPR

SEQ ID NO: 125509 - protein, 13 aa, Mycobacterium tuberculosis
PEMEEPPPATPRR

SEQ ID NO: 125510 - protein, 13 aa, Mycobacterium tuberculosis
EMEEPPPATPRRP

SEQ ID NO: 125511 - protein, 13 aa, Mycobacterium tuberculosis
MEEPPPATPRRPI

SEQ ID NO: 125512 - protein, 13 aa, Mycobacterium tuberculosis
EEPPPATPRRPID

SEQ ID NO: 125513 - protein, 13 aa, Mycobacterium tuberculosis
EPPPATPRRPIDE

SEQ ID NO: 125514 - protein, 13 aa, Mycobacterium tuberculosis
PPPATPRRPIDEV

SEQ ID NO: 125515 - protein, 13 aa, Mycobacterium tuberculosis
PPATPRRPIDEVF

SEQ ID NO: 125516 - protein, 13 aa, Mycobacterium tuberculosis
PATPRRPIDEVFH

SEQ ID NO: 125517 - protein, 13 aa, Mycobacterium tuberculosis
ATPRRPIDEVFHV

SEQ ID NO: 125518 - protein, 13 aa, Mycobacterium tuberculosis
TPRRPIDEVFHVR

SEQ ID NO: 125519 - protein, 13 aa, Mycobacterium tuberculosis
PRRPIDEVFHVRA

SEQ ID NO: 125520 - protein, 13 aa, Mycobacterium tuberculosis
RRPIDEVFHVRAK

SEQ ID NO: 125521 - protein, 13 aa, Mycobacterium tuberculosis
RPIDEVFHVRAKD

SEQ ID NO: 125522 - protein, 13 aa, Mycobacterium tuberculosis
PIDEVFHVRAKDH

SEQ ID NO: 125523 - protein, 13 aa, Mycobacterium tuberculosis
IDEVFHVRAKDHR

SEQ ID NO: 125524 - protein, 14 aa, Mycobacterium tuberculosis
MPDTMVTTDVIKSA

SEQ ID NO: 125525 - protein, 14 aa, Mycobacterium tuberculosis
PDTMVTTDVIKSAV

SEQ ID NO: 125526 - protein, 14 aa, Mycobacterium tuberculosis
DTMVTTDVIKSAVQ

SEQ ID NO: 125527 - protein, 14 aa, Mycobacterium tuberculosis
TMVTTDVIKSAVQL

SEQ ID NO: 125528 - protein, 14 aa, Mycobacterium tuberculosis
MVTTDVIKSAVQLA

SEQ ID NO: 125529 - protein, 14 aa, Mycobacterium tuberculosis
VTTDVIKSAVQLAC

SEQ ID NO: 125530 - protein, 14 aa, Mycobacterium tuberculosis
TTDVIKSAVQLACR

SEQ ID NO: 125531 - protein, 14 aa, Mycobacterium tuberculosis
TDVIKSAVQLACRA

SEQ ID NO: 125532 - protein, 14 aa, Mycobacterium tuberculosis
DVIKSAVQLACRAP

SEQ ID NO: 125533 - protein, 14 aa, Mycobacterium tuberculosis
VIKSAVQLACRAPS

SEQ ID NO: 125534 - protein, 14 aa, Mycobacterium tuberculosis
IKSAVQLACRAPSL

SEQ ID NO: 125535 - protein, 14 aa, Mycobacterium tuberculosis
KSAVQLACRAPSLH

SEQ ID NO: 125536 - protein, 14 aa, Mycobacterium tuberculosis
SAVQLACRAPSLHN

SEQ ID NO: 125537 - protein, 14 aa, Mycobacterium tuberculosis
AVQLACRAPSLHNS

SEQ ID NO: 125538 - protein, 14 aa, Mycobacterium tuberculosis
VQLACRAPSLHNSQ

SEQ ID NO: 125539 - protein, 14 aa, Mycobacterium tuberculosis
QLACRAPSLHNSQP

SEQ ID NO: 125540 - protein, 14 aa, Mycobacterium tuberculosis
LACRAPSLHNSQPW

SEQ ID NO: 125541 - protein, 14 aa, Mycobacterium tuberculosis
ACRAPSLHNSQPWR

SEQ ID NO: 125542 - protein, 14 aa, Mycobacterium tuberculosis
CRAPSLHNSQPWRW

SEQ ID NO: 125543 - protein, 14 aa, Mycobacterium tuberculosis
RAPSLHNSQPWRWI

SEQ ID NO: 125544 - protein, 14 aa, Mycobacterium tuberculosis
APSLHNSQPWRWIA

SEQ ID NO: 125545 - protein, 14 aa, Mycobacterium tuberculosis
PSLHNSQPWRWIAE

SEQ ID NO: 125546 - protein, 14 aa, Mycobacterium tuberculosis
SLHNSQPWRWIAED

SEQ ID NO: 125547 - protein, 14 aa, Mycobacterium tuberculosis
LHNSQPWRWIAEDH

SEQ ID NO: 125548 - protein, 14 aa, Mycobacterium tuberculosis
HNSQPWRWIAEDHT

SEQ ID NO: 125549 - protein, 14 aa, Mycobacterium tuberculosis
NSQPWRWIAEDHTV

SEQ ID NO: 125550 - protein, 14 aa, Mycobacterium tuberculosis
SQPWRWIAEDHTVA

SEQ ID NO: 125551 - protein, 14 aa, Mycobacterium tuberculosis
QPWRWIAEDHTVAL

SEQ ID NO: 125552 - protein, 14 aa, Mycobacterium tuberculosis
PWRWIAEDHTVALF

SEQ ID NO: 125553 - protein, 14 aa, Mycobacterium tuberculosis
WRWIAEDHTVALFL

SEQ ID NO: 125554 - protein, 14 aa, Mycobacterium tuberculosis
RWIAEDHTVALFLD

SEQ ID NO: 125555 - protein, 14 aa, Mycobacterium tuberculosis
WIAEDHTVALFLDK

SEQ ID NO: 125556 - protein, 14 aa, Mycobacterium tuberculosis
IAEDHTVALFLDKD

SEQ ID NO: 125557 - protein, 14 aa, Mycobacterium tuberculosis
AEDHTVALFLDKDR

SEQ ID NO: 125558 - protein, 14 aa, Mycobacterium tuberculosis
EDHTVALFLDKDRV

SEQ ID NO: 125559 - protein, 14 aa, Mycobacterium tuberculosis
DHTVALFLDKDRVL

SEQ ID NO: 125560 - protein, 14 aa, Mycobacterium tuberculosis
HTVALFLDKDRVLY

SEQ ID NO: 125561 - protein, 14 aa, Mycobacterium tuberculosis
TVALFLDKDRVLYA

SEQ ID NO: 125562 - protein, 14 aa, Mycobacterium tuberculosis
VALFLDKDRVLYAT

SEQ ID NO: 125563 - protein, 14 aa, Mycobacterium tuberculosis
ALFLDKDRVLYATD

SEQ ID NO: 125564 - protein, 14 aa, Mycobacterium tuberculosis
LFLDKDRVLYATDH

SEQ ID NO: 125565 - protein, 14 aa, Mycobacterium tuberculosis
FLDKDRVLYATDHS

SEQ ID NO: 125566 - protein, 14 aa, Mycobacterium tuberculosis
LDKDRVLYATDHSG

SEQ ID NO: 125567 - protein, 14 aa, Mycobacterium tuberculosis
DKDRVLYATDHSGR

SEQ ID NO: 125568 - protein, 14 aa, Mycobacterium tuberculosis
KDRVLYATDHSGRE

SEQ ID NO: 125569 - protein, 14 aa, Mycobacterium tuberculosis
DRVLYATDHSGREA

SEQ ID NO: 125570 - protein, 14 aa, Mycobacterium tuberculosis
RVLYATDHSGREAL

SEQ ID NO: 125571 - protein, 14 aa, Mycobacterium tuberculosis
VLYATDHSGREALL

SEQ ID NO: 125572 - protein, 14 aa, Mycobacterium tuberculosis
LYATDHSGREALLG

SEQ ID NO: 125573 - protein, 14 aa, Mycobacterium tuberculosis
YATDHSGREALLGC

SEQ ID NO: 125574 - protein, 14 aa, Mycobacterium tuberculosis
ATDHSGREALLGCG

SEQ ID NO: 125575 - protein, 14 aa, Mycobacterium tuberculosis
TDHSGREALLGCGA

SEQ ID NO: 125576 - protein, 14 aa, Mycobacterium tuberculosis
DHSGREALLGCGAV

SEQ ID NO: 125577 - protein, 14 aa, Mycobacterium tuberculosis
HSGREALLGCGAVL

SEQ ID NO: 125578 - protein, 14 aa, Mycobacterium tuberculosis
SGREALLGCGAVLD

SEQ ID NO: 125579 - protein, 14 aa, Mycobacterium tuberculosis
GREALLGCGAVLDH

SEQ ID NO: 125580 - protein, 14 aa, Mycobacterium tuberculosis
REALLGCGAVLDHF

SEQ ID NO: 125581 - protein, 14 aa, Mycobacterium tuberculosis
EALLGCGAVLDHFR

SEQ ID NO: 125582 - protein, 14 aa, Mycobacterium tuberculosis
ALLGCGAVLDHFRV

SEQ ID NO: 125583 - protein, 14 aa, Mycobacterium tuberculosis
LLGCGAVLDHFRVA

SEQ ID NO: 125584 - protein, 14 aa, Mycobacterium tuberculosis
LGCGAVLDHFRVAM

SEQ ID NO: 125585 - protein, 14 aa, Mycobacterium tuberculosis
GCGAVLDHFRVAMA

SEQ ID NO: 125586 - protein, 14 aa, Mycobacterium tuberculosis
CGAVLDHFRVAMAA

SEQ ID NO: 125587 - protein, 14 aa, Mycobacterium tuberculosis
GAVLDHFRVAMAAA

SEQ ID NO: 125588 - protein, 14 aa, Mycobacterium tuberculosis
AVLDHFRVAMAAAG

SEQ ID NO: 125589 - protein, 14 aa, Mycobacterium tuberculosis
VLDHFRVAMAAAGT

SEQ ID NO: 125590 - protein, 14 aa, Mycobacterium tuberculosis
LDHFRVAMAAAGTT

SEQ ID NO: 125591 - protein, 14 aa, Mycobacterium tuberculosis
DHFRVAMAAAGTTA

SEQ ID NO: 125592 - protein, 14 aa, Mycobacterium tuberculosis
HFRVAMAAAGTTAN

SEQ ID NO: 125593 - protein, 14 aa, Mycobacterium tuberculosis
FRVAMAAAGTTANV

SEQ ID NO: 125594 - protein, 14 aa, Mycobacterium tuberculosis
RVAMAAAGTTANVE

SEQ ID NO: 125595 - protein, 14 aa, Mycobacterium tuberculosis
VAMAAAGTTANVER

SEQ ID NO: 125596 - protein, 14 aa, Mycobacterium tuberculosis
AMAAAGTTANVERF

SEQ ID NO: 125597 - protein, 14 aa, Mycobacterium tuberculosis
MAAAGTTANVERFP

SEQ ID NO: 125598 - protein, 14 aa, Mycobacterium tuberculosis
AAAGTTANVERFPN

SEQ ID NO: 125599 - protein, 14 aa, Mycobacterium tuberculosis
AAGTTANVERFPNP

SEQ ID NO: 125600 - protein, 14 aa, Mycobacterium tuberculosis
AGTTANVERFPNPN

SEQ ID NO: 125601 - protein, 14 aa, Mycobacterium tuberculosis
GTTANVERFPNPND

SEQ ID NO: 125602 - protein, 14 aa, Mycobacterium tuberculosis
TTANVERFPNPNDP

SEQ ID NO: 125603 - protein, 14 aa, Mycobacterium tuberculosis
TANVERFPNPNDPL

SEQ ID NO: 125604 - protein, 14 aa, Mycobacterium tuberculosis
ANVERFPNPNDPLH

SEQ ID NO: 125605 - protein, 14 aa, Mycobacterium tuberculosis
NVERFPNPNDPLHL

SEQ ID NO: 125606 - protein, 14 aa, Mycobacterium tuberculosis
VERFPNPNDPLHLA

SEQ ID NO: 125607 - protein, 14 aa, Mycobacterium tuberculosis
ERFPNPNDPLHLAS

SEQ ID NO: 125608 - protein, 14 aa, Mycobacterium tuberculosis
RFPNPNDPLHLASI

SEQ ID NO: 125609 - protein, 14 aa, Mycobacterium tuberculosis
FPNPNDPLHLASID

SEQ ID NO: 125610 - protein, 14 aa, Mycobacterium tuberculosis
PNPNDPLHLASIDF

SEQ ID NO: 125611 - protein, 14 aa, Mycobacterium tuberculosis
NPNDPLHLASIDFS

SEQ ID NO: 125612 - protein, 14 aa, Mycobacterium tuberculosis
PNDPLHLASIDFSP

SEQ ID NO: 125613 - protein, 14 aa, Mycobacterium tuberculosis
NDPLHLASIDFSPA

SEQ ID NO: 125614 - protein, 14 aa, Mycobacterium tuberculosis
DPLHLASIDFSPAD

SEQ ID NO: 125615 - protein, 14 aa, Mycobacterium tuberculosis
PLHLASIDFSPADF

SEQ ID NO: 125616 - protein, 14 aa, Mycobacterium tuberculosis
LHLASIDFSPADFV

SEQ ID NO: 125617 - protein, 14 aa, Mycobacterium tuberculosis
HLASIDFSPADFVT

SEQ ID NO: 125618 - protein, 14 aa, Mycobacterium tuberculosis
LASIDFSPADFVTE

SEQ ID NO: 125619 - protein, 14 aa, Mycobacterium tuberculosis
ASIDFSPADFVTEG

SEQ ID NO: 125620 - protein, 14 aa, Mycobacterium tuberculosis
SIDFSPADFVTEGH

SEQ ID NO: 125621 - protein, 14 aa, Mycobacterium tuberculosis
IDFSPADFVTEGHR

SEQ ID NO: 125622 - protein, 14 aa, Mycobacterium tuberculosis
DFSPADFVTEGHRL

SEQ ID NO: 125623 - protein, 14 aa, Mycobacterium tuberculosis
FSPADFVTEGHRLR

SEQ ID NO: 125624 - protein, 14 aa, Mycobacterium tuberculosis
SPADFVTEGHRLRA

SEQ ID NO: 125625 - protein, 14 aa, Mycobacterium tuberculosis
PADFVTEGHRLRAD

SEQ ID NO: 125626 - protein, 14 aa, Mycobacterium tuberculosis
ADFVTEGHRLRADA

SEQ ID NO: 125627 - protein, 14 aa, Mycobacterium tuberculosis
DFVTEGHRLRADAI

SEQ ID NO: 125628 - protein, 14 aa, Mycobacterium tuberculosis
FVTEGHRLRADAIL

SEQ ID NO: 125629 - protein, 14 aa, Mycobacterium tuberculosis
VTEGHRLRADAILL

SEQ ID NO: 125630 - protein, 14 aa, Mycobacterium tuberculosis
TEGHRLRADAILLR

SEQ ID NO: 125631 - protein, 14 aa, Mycobacterium tuberculosis
EGHRLRADAILLRR

SEQ ID NO: 125632 - protein, 14 aa, Mycobacterium tuberculosis
GHRLRADAILLRRT

SEQ ID NO: 125633 - protein, 14 aa, Mycobacterium tuberculosis
HRLRADAILLRRTD

SEQ ID NO: 125634 - protein, 14 aa, Mycobacterium tuberculosis
RLRADAILLRRTDR

SEQ ID NO: 125635 - protein, 14 aa, Mycobacterium tuberculosis
LRADAILLRRTDRL

SEQ ID NO: 125636 - protein, 14 aa, Mycobacterium tuberculosis
RADAILLRRTDRLP

SEQ ID NO: 125637 - protein, 14 aa, Mycobacterium tuberculosis
ADAILLRRTDRLPF

SEQ ID NO: 125638 - protein, 14 aa, Mycobacterium tuberculosis
DAILLRRTDRLPFA

SEQ ID NO: 125639 - protein, 14 aa, Mycobacterium tuberculosis
AILLRRTDRLPFAE

SEQ ID NO: 125640 - protein, 14 aa, Mycobacterium tuberculosis
ILLRRTDRLPFAEP

SEQ ID NO: 125641 - protein, 14 aa, Mycobacterium tuberculosis
LLRRTDRLPFAEPP

SEQ ID NO: 125642 - protein, 14 aa, Mycobacterium tuberculosis
LRRTDRLPFAEPPD

SEQ ID NO: 125643 - protein, 14 aa, Mycobacterium tuberculosis
RRTDRLPFAEPPDW

SEQ ID NO: 125644 - protein, 14 aa, Mycobacterium tuberculosis
RTDRLPFAEPPDWD

SEQ ID NO: 125645 - protein, 14 aa, Mycobacterium tuberculosis
TDRLPFAEPPDWDL

SEQ ID NO: 125646 - protein, 14 aa, Mycobacterium tuberculosis
DRLPFAEPPDWDLV

SEQ ID NO: 125647 - protein, 14 aa, Mycobacterium tuberculosis
RLPFAEPPDWDLVE

SEQ ID NO: 125648 - protein, 14 aa, Mycobacterium tuberculosis
LPFAEPPDWDLVES

SEQ ID NO: 125649 - protein, 14 aa, Mycobacterium tuberculosis
PFAEPPDWDLVESQ

SEQ ID NO: 125650 - protein, 14 aa, Mycobacterium tuberculosis
FAEPPDWDLVESQL

SEQ ID NO: 125651 - protein, 14 aa, Mycobacterium tuberculosis
AEPPDWDLVESQLR

SEQ ID NO: 125652 - protein, 14 aa, Mycobacterium tuberculosis
EPPDWDLVESQLRT

SEQ ID NO: 125653 - protein, 14 aa, Mycobacterium tuberculosis
PPDWDLVESQLRTT

SEQ ID NO: 125654 - protein, 14 aa, Mycobacterium tuberculosis
PDWDLVESQLRTTV

SEQ ID NO: 125655 - protein, 14 aa, Mycobacterium tuberculosis
DWDLVESQLRTTVT

SEQ ID NO: 125656 - protein, 14 aa, Mycobacterium tuberculosis
WDLVESQLRTTVTA

SEQ ID NO: 125657 - protein, 14 aa, Mycobacterium tuberculosis
DLVESQLRTTVTAD

SEQ ID NO: 125658 - protein, 14 aa, Mycobacterium tuberculosis
LVESQLRTTVTADT

SEQ ID NO: 125659 - protein, 14 aa, Mycobacterium tuberculosis
VESQLRTTVTADTV

SEQ ID NO: 125660 - protein, 14 aa, Mycobacterium tuberculosis
ESQLRTTVTADTVR

SEQ ID NO: 125661 - protein, 14 aa, Mycobacterium tuberculosis
SQLRTTVTADTVRI

SEQ ID NO: 125662 - protein, 14 aa, Mycobacterium tuberculosis
QLRTTVTADTVRID

SEQ ID NO: 125663 - protein, 14 aa, Mycobacterium tuberculosis
LRTTVTADTVRIDV

SEQ ID NO: 125664 - protein, 14 aa, Mycobacterium tuberculosis
RTTVTADTVRIDVI

SEQ ID NO: 125665 - protein, 14 aa, Mycobacterium tuberculosis
TTVTADTVRIDVIA

SEQ ID NO: 125666 - protein, 14 aa, Mycobacterium tuberculosis
TVTADTVRIDVIAD

SEQ ID NO: 125667 - protein, 14 aa, Mycobacterium tuberculosis
VTADTVRIDVIADD

SEQ ID NO: 125668 - protein, 14 aa, Mycobacterium tuberculosis
TADTVRIDVIADDM

SEQ ID NO: 125669 - protein, 14 aa, Mycobacterium tuberculosis
ADTVRIDVIADDMR

SEQ ID NO: 125670 - protein, 14 aa, Mycobacterium tuberculosis
DTVRIDVIADDMRP

SEQ ID NO: 125671 - protein, 14 aa, Mycobacterium tuberculosis
TVRIDVIADDMRPE

SEQ ID NO: 125672 - protein, 14 aa, Mycobacterium tuberculosis
VRIDVIADDMRPEL

SEQ ID NO: 125673 - protein, 14 aa, Mycobacterium tuberculosis
RIDVIADDMRPELA

SEQ ID NO: 125674 - protein, 14 aa, Mycobacterium tuberculosis
IDVIADDMRPELAA

SEQ ID NO: 125675 - protein, 14 aa, Mycobacterium tuberculosis
DVIADDMRPELAAA

SEQ ID NO: 125676 - protein, 14 aa, Mycobacterium tuberculosis
VIADDMRPELAAAS

SEQ ID NO: 125677 - protein, 14 aa, Mycobacterium tuberculosis
IADDMRPELAAASK

SEQ ID NO: 125678 - protein, 14 aa, Mycobacterium tuberculosis
ADDMRPELAAASKL

SEQ ID NO: 125679 - protein, 14 aa, Mycobacterium tuberculosis
DDMRPELAAASKLT

SEQ ID NO: 125680 - protein, 14 aa, Mycobacterium tuberculosis
DMRPELAAASKLTE

SEQ ID NO: 125681 - protein, 14 aa, Mycobacterium tuberculosis
MRPELAAASKLTES

SEQ ID NO: 125682 - protein, 14 aa, Mycobacterium tuberculosis
RPELAAASKLTESL

SEQ ID NO: 125683 - protein, 14 aa, Mycobacterium tuberculosis
PELAAASKLTESLR

SEQ ID NO: 125684 - protein, 14 aa, Mycobacterium tuberculosis
ELAAASKLTESLRL

SEQ ID NO: 125685 - protein, 14 aa, Mycobacterium tuberculosis
LAAASKLTESLRLY

SEQ ID NO: 125686 - protein, 14 aa, Mycobacterium tuberculosis
AAASKLTESLRLYD

SEQ ID NO: 125687 - protein, 14 aa, Mycobacterium tuberculosis
AASKLTESLRLYDS

SEQ ID NO: 125688 - protein, 14 aa, Mycobacterium tuberculosis
ASKLTESLRLYDSS

SEQ ID NO: 125689 - protein, 14 aa, Mycobacterium tuberculosis
SKLTESLRLYDSSY

SEQ ID NO: 125690 - protein, 14 aa, Mycobacterium tuberculosis
KLTESLRLYDSSYH

SEQ ID NO: 125691 - protein, 14 aa, Mycobacterium tuberculosis
LTESLRLYDSSYHA

SEQ ID NO: 125692 - protein, 14 aa, Mycobacterium tuberculosis
TESLRLYDSSYHAE

SEQ ID NO: 125693 - protein, 14 aa, Mycobacterium tuberculosis
ESLRLYDSSYHAEL

SEQ ID NO: 125694 - protein, 14 aa, Mycobacterium tuberculosis
SLRLYDSSYHAELF

SEQ ID NO: 125695 - protein, 14 aa, Mycobacterium tuberculosis
LRLYDSSYHAELFW

SEQ ID NO: 125696 - protein, 14 aa, Mycobacterium tuberculosis
RLYDSSYHAELFWW

SEQ ID NO: 125697 - protein, 14 aa, Mycobacterium tuberculosis
LYDSSYHAELFWWT

SEQ ID NO: 125698 - protein, 14 aa, Mycobacterium tuberculosis
YDSSYHAELFWWTG

SEQ ID NO: 125699 - protein, 14 aa, Mycobacterium tuberculosis
DSSYHAELFWWTGA

SEQ ID NO: 125700 - protein, 14 aa, Mycobacterium tuberculosis
SSYHAELFWWTGAF

SEQ ID NO: 125701 - protein, 14 aa, Mycobacterium tuberculosis
SYHAELFWWTGAFE

SEQ ID NO: 125702 - protein, 14 aa, Mycobacterium tuberculosis
YHAELFWWTGAFET

SEQ ID NO: 125703 - protein, 14 aa, Mycobacterium tuberculosis
HAELFWWTGAFETS

SEQ ID NO: 125704 - protein, 14 aa, Mycobacterium tuberculosis
AELFWWTGAFETSE

SEQ ID NO: 125705 - protein, 14 aa, Mycobacterium tuberculosis
ELFWWTGAFETSEG

SEQ ID NO: 125706 - protein, 14 aa, Mycobacterium tuberculosis
LFWWTGAFETSEGI

SEQ ID NO: 125707 - protein, 14 aa, Mycobacterium tuberculosis
FWWTGAFETSEGIP

SEQ ID NO: 125708 - protein, 14 aa, Mycobacterium tuberculosis
WWTGAFETSEGIPH

SEQ ID NO: 125709 - protein, 14 aa, Mycobacterium tuberculosis
WTGAFETSEGIPHS

SEQ ID NO: 125710 - protein, 14 aa, Mycobacterium tuberculosis
TGAFETSEGIPHSS

SEQ ID NO: 125711 - protein, 14 aa, Mycobacterium tuberculosis
GAFETSEGIPHSSL

SEQ ID NO: 125712 - protein, 14 aa, Mycobacterium tuberculosis
AFETSEGIPHSSLV

SEQ ID NO: 125713 - protein, 14 aa, Mycobacterium tuberculosis
FETSEGIPHSSLVS

SEQ ID NO: 125714 - protein, 14 aa, Mycobacterium tuberculosis
ETSEGIPHSSLVSA

SEQ ID NO: 125715 - protein, 14 aa, Mycobacterium tuberculosis
TSEGIPHSSLVSAA

SEQ ID NO: 125716 - protein, 14 aa, Mycobacterium tuberculosis
SEGIPHSSLVSAAE

SEQ ID NO: 125717 - protein, 14 aa, Mycobacterium tuberculosis
EGIPHSSLVSAAES

SEQ ID NO: 125718 - protein, 14 aa, Mycobacterium tuberculosis
GIPHSSLVSAAESD

SEQ ID NO: 125719 - protein, 14 aa, Mycobacterium tuberculosis
IPHSSLVSAAESDR

SEQ ID NO: 125720 - protein, 14 aa, Mycobacterium tuberculosis
PHSSLVSAAESDRV

SEQ ID NO: 125721 - protein, 14 aa, Mycobacterium tuberculosis
HSSLVSAAESDRVT

SEQ ID NO: 125722 - protein, 14 aa, Mycobacterium tuberculosis
SSLVSAAESDRVTF

SEQ ID NO: 125723 - protein, 14 aa, Mycobacterium tuberculosis
SLVSAAESDRVTFG

SEQ ID NO: 125724 - protein, 14 aa, Mycobacterium tuberculosis
LVSAAESDRVTFGR

SEQ ID NO: 125725 - protein, 14 aa, Mycobacterium tuberculosis
VSAAESDRVTFGRD

SEQ ID NO: 125726 - protein, 14 aa, Mycobacterium tuberculosis
SAAESDRVTFGRDF

SEQ ID NO: 125727 - protein, 14 aa, Mycobacterium tuberculosis
AAESDRVTFGRDFP

SEQ ID NO: 125728 - protein, 14 aa, Mycobacterium tuberculosis
AESDRVTFGRDFPV

SEQ ID NO: 125729 - protein, 14 aa, Mycobacterium tuberculosis
ESDRVTFGRDFPVV

SEQ ID NO: 125730 - protein, 14 aa, Mycobacterium tuberculosis
SDRVTFGRDFPVVA

SEQ ID NO: 125731 - protein, 14 aa, Mycobacterium tuberculosis
DRVTFGRDFPVVAN

SEQ ID NO: 125732 - protein, 14 aa, Mycobacterium tuberculosis
RVTFGRDFPVVANT

SEQ ID NO: 125733 - protein, 14 aa, Mycobacterium tuberculosis
VTFGRDFPVVANTD

SEQ ID NO: 125734 - protein, 14 aa, Mycobacterium tuberculosis
TFGRDFPVVANTDR

SEQ ID NO: 125735 - protein, 14 aa, Mycobacterium tuberculosis
FGRDFPVVANTDRR

SEQ ID NO: 125736 - protein, 14 aa, Mycobacterium tuberculosis
GRDFPVVANTDRRP

SEQ ID NO: 125737 - protein, 14 aa, Mycobacterium tuberculosis
RDFPVVANTDRRPE

SEQ ID NO: 125738 - protein, 14 aa, Mycobacterium tuberculosis
DFPVVANTDRRPEF

SEQ ID NO: 125739 - protein, 14 aa, Mycobacterium tuberculosis
FPVVANTDRRPEFG

SEQ ID NO: 125740 - protein, 14 aa, Mycobacterium tuberculosis
PVVANTDRRPEFGH

SEQ ID NO: 125741 - protein, 14 aa, Mycobacterium tuberculosis
VVANTDRRPEFGHD

SEQ ID NO: 125742 - protein, 14 aa, Mycobacterium tuberculosis
VANTDRRPEFGHDR

SEQ ID NO: 125743 - protein, 14 aa, Mycobacterium tuberculosis
ANTDRRPEFGHDRS

SEQ ID NO: 125744 - protein, 14 aa, Mycobacterium tuberculosis
NTDRRPEFGHDRSK

SEQ ID NO: 125745 - protein, 14 aa, Mycobacterium tuberculosis
TDRRPEFGHDRSKV

SEQ ID NO: 125746 - protein, 14 aa, Mycobacterium tuberculosis
DRRPEFGHDRSKVL

SEQ ID NO: 125747 - protein, 14 aa, Mycobacterium tuberculosis
RRPEFGHDRSKVLV

SEQ ID NO: 125748 - protein, 14 aa, Mycobacterium tuberculosis
RPEFGHDRSKVLVL

SEQ ID NO: 125749 - protein, 14 aa, Mycobacterium tuberculosis
PEFGHDRSKVLVLS

SEQ ID NO: 125750 - protein, 14 aa, Mycobacterium tuberculosis
EFGHDRSKVLVLST

SEQ ID NO: 125751 - protein, 14 aa, Mycobacterium tuberculosis
FGHDRSKVLVLSTY

SEQ ID NO: 125752 - protein, 14 aa, Mycobacterium tuberculosis
GHDRSKVLVLSTYD

SEQ ID NO: 125753 - protein, 14 aa, Mycobacterium tuberculosis
HDRSKVLVLSTYDN

SEQ ID NO: 125754 - protein, 14 aa, Mycobacterium tuberculosis
DRSKVLVLSTYDNE

SEQ ID NO: 125755 - protein, 14 aa, Mycobacterium tuberculosis
RSKVLVLSTYDNER

SEQ ID NO: 125756 - protein, 14 aa, Mycobacterium tuberculosis
SKVLVLSTYDNERA

SEQ ID NO: 125757 - protein, 14 aa, Mycobacterium tuberculosis
KVLVLSTYDNERAS

SEQ ID NO: 125758 - protein, 14 aa, Mycobacterium tuberculosis
VLVLSTYDNERASL

SEQ ID NO: 125759 - protein, 14 aa, Mycobacterium tuberculosis
LVLSTYDNERASLL

SEQ ID NO: 125760 - protein, 14 aa, Mycobacterium tuberculosis
VLSTYDNERASLLR

SEQ ID NO: 125761 - protein, 14 aa, Mycobacterium tuberculosis
LSTYDNERASLLRC

SEQ ID NO: 125762 - protein, 14 aa, Mycobacterium tuberculosis
STYDNERASLLRCG

SEQ ID NO: 125763 - protein, 14 aa, Mycobacterium tuberculosis
TYDNERASLLRCGE

SEQ ID NO: 125764 - protein, 14 aa, Mycobacterium tuberculosis
YDNERASLLRCGEM

SEQ ID NO: 125765 - protein, 14 aa, Mycobacterium tuberculosis
DNERASLLRCGEML

SEQ ID NO: 125766 - protein, 14 aa, Mycobacterium tuberculosis
NERASLLRCGEMLS

SEQ ID NO: 125767 - protein, 14 aa, Mycobacterium tuberculosis
ERASLLRCGEMLSA

SEQ ID NO: 125768 - protein, 14 aa, Mycobacterium tuberculosis
RASLLRCGEMLSAV

SEQ ID NO: 125769 - protein, 14 aa, Mycobacterium tuberculosis
ASLLRCGEMLSAVL

SEQ ID NO: 125770 - protein, 14 aa, Mycobacterium tuberculosis
SLLRCGEMLSAVLL

SEQ ID NO: 125771 - protein, 14 aa, Mycobacterium tuberculosis
LLRCGEMLSAVLLD

SEQ ID NO: 125772 - protein, 14 aa, Mycobacterium tuberculosis
LRCGEMLSAVLLDA

SEQ ID NO: 125773 - protein, 14 aa, Mycobacterium tuberculosis
RCGEMLSAVLLDAT

SEQ ID NO: 125774 - protein, 14 aa, Mycobacterium tuberculosis
CGEMLSAVLLDATM

SEQ ID NO: 125775 - protein, 14 aa, Mycobacterium tuberculosis
GEMLSAVLLDATMA

SEQ ID NO: 125776 - protein, 14 aa, Mycobacterium tuberculosis
EMLSAVLLDATMAG

SEQ ID NO: 125777 - protein, 14 aa, Mycobacterium tuberculosis
MLSAVLLDATMAGL

SEQ ID NO: 125778 - protein, 14 aa, Mycobacterium tuberculosis
LSAVLLDATMAGLA

SEQ ID NO: 125779 - protein, 14 aa, Mycobacterium tuberculosis
SAVLLDATMAGLAT

SEQ ID NO: 125780 - protein, 14 aa, Mycobacterium tuberculosis
AVLLDATMAGLATC

SEQ ID NO: 125781 - protein, 14 aa, Mycobacterium tuberculosis
VLLDATMAGLATCT

SEQ ID NO: 125782 - protein, 14 aa, Mycobacterium tuberculosis
LLDATMAGLATCTL

SEQ ID NO: 125783 - protein, 14 aa, Mycobacterium tuberculosis
LDATMAGLATCTLT

SEQ ID NO: 125784 - protein, 14 aa, Mycobacterium tuberculosis
DATMAGLATCTLTH

SEQ ID NO: 125785 - protein, 14 aa, Mycobacterium tuberculosis
ATMAGLATCTLTHI

SEQ ID NO: 125786 - protein, 14 aa, Mycobacterium tuberculosis
TMAGLATCTLTHIT

SEQ ID NO: 125787 - protein, 14 aa, Mycobacterium tuberculosis
MAGLATCTLTHITE

SEQ ID NO: 125788 - protein, 14 aa, Mycobacterium tuberculosis
AGLATCTLTHITEL

SEQ ID NO: 125789 - protein, 14 aa, Mycobacterium tuberculosis
GLATCTLTHITELH

SEQ ID NO: 125790 - protein, 14 aa, Mycobacterium tuberculosis
LATCTLTHITELHA

SEQ ID NO: 125791 - protein, 14 aa, Mycobacterium tuberculosis
ATCTLTHITELHAS

SEQ ID NO: 125792 - protein, 14 aa, Mycobacterium tuberculosis
TCTLTHITELHASR

SEQ ID NO: 125793 - protein, 14 aa, Mycobacterium tuberculosis
CTLTHITELHASRD

SEQ ID NO: 125794 - protein, 14 aa, Mycobacterium tuberculosis
TLTHITELHASRDL

SEQ ID NO: 125795 - protein, 14 aa, Mycobacterium tuberculosis
LTHITELHASRDLV

SEQ ID NO: 125796 - protein, 14 aa, Mycobacterium tuberculosis
THITELHASRDLVA

SEQ ID NO: 125797 - protein, 14 aa, Mycobacterium tuberculosis
HITELHASRDLVAA

SEQ ID NO: 125798 - protein, 14 aa, Mycobacterium tuberculosis
ITELHASRDLVAAL

SEQ ID NO: 125799 - protein, 14 aa, Mycobacterium tuberculosis
TELHASRDLVAALI

SEQ ID NO: 125800 - protein, 14 aa, Mycobacterium tuberculosis
ELHASRDLVAALIG

SEQ ID NO: 125801 - protein, 14 aa, Mycobacterium tuberculosis
LHASRDLVAALIGQ

SEQ ID NO: 125802 - protein, 14 aa, Mycobacterium tuberculosis
HASRDLVAALIGQP

SEQ ID NO: 125803 - protein, 14 aa, Mycobacterium tuberculosis
ASRDLVAALIGQPA

SEQ ID NO: 125804 - protein, 14 aa, Mycobacterium tuberculosis
SRDLVAALIGQPAT

SEQ ID NO: 125805 - protein, 14 aa, Mycobacterium tuberculosis
RDLVAALIGQPATP

SEQ ID NO: 125806 - protein, 14 aa, Mycobacterium tuberculosis
DLVAALIGQPATPQ

SEQ ID NO: 125807 - protein, 14 aa, Mycobacterium tuberculosis
LVAALIGQPATPQA

SEQ ID NO: 125808 - protein, 14 aa, Mycobacterium tuberculosis
VAALIGQPATPQAL

SEQ ID NO: 125809 - protein, 14 aa, Mycobacterium tuberculosis
AALIGQPATPQALV

SEQ ID NO: 125810 - protein, 14 aa, Mycobacterium tuberculosis
ALIGQPATPQALVR

SEQ ID NO: 125811 - protein, 14 aa, Mycobacterium tuberculosis
LIGQPATPQALVRV

SEQ ID NO: 125812 - protein, 14 aa, Mycobacterium tuberculosis
IGQPATPQALVRVG

SEQ ID NO: 125813 - protein, 14 aa, Mycobacterium tuberculosis
GQPATPQALVRVGL

SEQ ID NO: 125814 - protein, 14 aa, Mycobacterium tuberculosis
QPATPQALVRVGLA

SEQ ID NO: 125815 - protein, 14 aa, Mycobacterium tuberculosis
PATPQALVRVGLAP

SEQ ID NO: 125816 - protein, 14 aa, Mycobacterium tuberculosis
ATPQALVRVGLAPE

SEQ ID NO: 125817 - protein, 14 aa, Mycobacterium tuberculosis
TPQALVRVGLAPEM

SEQ ID NO: 125818 - protein, 14 aa, Mycobacterium tuberculosis
PQALVRVGLAPEME

SEQ ID NO: 125819 - protein, 14 aa, Mycobacterium tuberculosis
QALVRVGLAPEMEE

SEQ ID NO: 125820 - protein, 14 aa, Mycobacterium tuberculosis
ALVRVGLAPEMEEP

SEQ ID NO: 125821 - protein, 14 aa, Mycobacterium tuberculosis
LVRVGLAPEMEEPP

SEQ ID NO: 125822 - protein, 14 aa, Mycobacterium tuberculosis
VRVGLAPEMEEPPP

SEQ ID NO: 125823 - protein, 14 aa, Mycobacterium tuberculosis
RVGLAPEMEEPPPA

SEQ ID NO: 125824 - protein, 14 aa, Mycobacterium tuberculosis
VGLAPEMEEPPPAT

SEQ ID NO: 125825 - protein, 14 aa, Mycobacterium tuberculosis
GLAPEMEEPPPATP

SEQ ID NO: 125826 - protein, 14 aa, Mycobacterium tuberculosis
LAPEMEEPPPATPR

SEQ ID NO: 125827 - protein, 14 aa, Mycobacterium tuberculosis
APEMEEPPPATPRR

SEQ ID NO: 125828 - protein, 14 aa, Mycobacterium tuberculosis
PEMEEPPPATPRRP

SEQ ID NO: 125829 - protein, 14 aa, Mycobacterium tuberculosis
EMEEPPPATPRRPI

SEQ ID NO: 125830 - protein, 14 aa, Mycobacterium tuberculosis
MEEPPPATPRRPID

SEQ ID NO: 125831 - protein, 14 aa, Mycobacterium tuberculosis
EEPPPATPRRPIDE

SEQ ID NO: 125832 - protein, 14 aa, Mycobacterium tuberculosis
EPPPATPRRPIDEV

SEQ ID NO: 125833 - protein, 14 aa, Mycobacterium tuberculosis
PPPATPRRPIDEVF

SEQ ID NO: 125834 - protein, 14 aa, Mycobacterium tuberculosis
PPATPRRPIDEVFH

SEQ ID NO: 125835 - protein, 14 aa, Mycobacterium tuberculosis
PATPRRPIDEVFHV

SEQ ID NO: 125836 - protein, 14 aa, Mycobacterium tuberculosis
ATPRRPIDEVFHVR

SEQ ID NO: 125837 - protein, 14 aa, Mycobacterium tuberculosis
TPRRPIDEVFHVRA

SEQ ID NO: 125838 - protein, 14 aa, Mycobacterium tuberculosis
PRRPIDEVFHVRAK

SEQ ID NO: 125839 - protein, 14 aa, Mycobacterium tuberculosis
RRPIDEVFHVRAKD

SEQ ID NO: 125840 - protein, 14 aa, Mycobacterium tuberculosis
RPIDEVFHVRAKDH

SEQ ID NO: 125841 - protein, 14 aa, Mycobacterium tuberculosis
PIDEVFHVRAKDHR

SEQ ID NO: 125842 - protein, 15 aa, Mycobacterium tuberculosis
MPDTMVTTDVIKSAV

SEQ ID NO: 125843 - protein, 15 aa, Mycobacterium tuberculosis
PDTMVTTDVIKSAVQ

SEQ ID NO: 125844 - protein, 15 aa, Mycobacterium tuberculosis
DTMVTTDVIKSAVQL

SEQ ID NO: 125845 - protein, 15 aa, Mycobacterium tuberculosis
TMVTTDVIKSAVQLA

SEQ ID NO: 125846 - protein, 15 aa, Mycobacterium tuberculosis
MVTTDVIKSAVQLAC

SEQ ID NO: 125847 - protein, 15 aa, Mycobacterium tuberculosis
VTTDVIKSAVQLACR

SEQ ID NO: 125848 - protein, 15 aa, Mycobacterium tuberculosis
TTDVIKSAVQLACRA

SEQ ID NO: 125849 - protein, 15 aa, Mycobacterium tuberculosis
TDVIKSAVQLACRAP

SEQ ID NO: 125850 - protein, 15 aa, Mycobacterium tuberculosis
DVIKSAVQLACRAPS

SEQ ID NO: 125851 - protein, 15 aa, Mycobacterium tuberculosis
VIKSAVQLACRAPSL

SEQ ID NO: 125852 - protein, 15 aa, Mycobacterium tuberculosis
IKSAVQLACRAPSLH

SEQ ID NO: 125853 - protein, 15 aa, Mycobacterium tuberculosis
KSAVQLACRAPSLHN

SEQ ID NO: 125854 - protein, 15 aa, Mycobacterium tuberculosis
SAVQLACRAPSLHNS

SEQ ID NO: 125855 - protein, 15 aa, Mycobacterium tuberculosis
AVQLACRAPSLHNSQ

SEQ ID NO: 125856 - protein, 15 aa, Mycobacterium tuberculosis
VQLACRAPSLHNSQP

SEQ ID NO: 125857 - protein, 15 aa, Mycobacterium tuberculosis
QLACRAPSLHNSQPW

SEQ ID NO: 125858 - protein, 15 aa, Mycobacterium tuberculosis
LACRAPSLHNSQPWR

SEQ ID NO: 125859 - protein, 15 aa, Mycobacterium tuberculosis
ACRAPSLHNSQPWRW

SEQ ID NO: 125860 - protein, 15 aa, Mycobacterium tuberculosis
CRAPSLHNSQPWRWI

SEQ ID NO: 125861 - protein, 15 aa, Mycobacterium tuberculosis
RAPSLHNSQPWRWIA

SEQ ID NO: 125862 - protein, 15 aa, Mycobacterium tuberculosis
APSLHNSQPWRWIAE

SEQ ID NO: 125863 - protein, 15 aa, Mycobacterium tuberculosis
PSLHNSQPWRWIAED

SEQ ID NO: 125864 - protein, 15 aa, Mycobacterium tuberculosis
SLHNSQPWRWIAEDH

SEQ ID NO: 125865 - protein, 15 aa, Mycobacterium tuberculosis
LHNSQPWRWIAEDHT

SEQ ID NO: 125866 - protein, 15 aa, Mycobacterium tuberculosis
HNSQPWRWIAEDHTV

SEQ ID NO: 125867 - protein, 15 aa, Mycobacterium tuberculosis
NSQPWRWIAEDHTVA

SEQ ID NO: 125868 - protein, 15 aa, Mycobacterium tuberculosis
SQPWRWIAEDHTVAL

SEQ ID NO: 125869 - protein, 15 aa, Mycobacterium tuberculosis
QPWRWIAEDHTVALF

SEQ ID NO: 125870 - protein, 15 aa, Mycobacterium tuberculosis
PWRWIAEDHTVALFL

SEQ ID NO: 125871 - protein, 15 aa, Mycobacterium tuberculosis
WRWIAEDHTVALFLD

SEQ ID NO: 125872 - protein, 15 aa, Mycobacterium tuberculosis
RWIAEDHTVALFLDK

SEQ ID NO: 125873 - protein, 15 aa, Mycobacterium tuberculosis
WIAEDHTVALFLDKD

SEQ ID NO: 125874 - protein, 15 aa, Mycobacterium tuberculosis
IAEDHTVALFLDKDR

SEQ ID NO: 125875 - protein, 15 aa, Mycobacterium tuberculosis
AEDHTVALFLDKDRV

SEQ ID NO: 125876 - protein, 15 aa, Mycobacterium tuberculosis
EDHTVALFLDKDRVL

SEQ ID NO: 125877 - protein, 15 aa, Mycobacterium tuberculosis
DHTVALFLDKDRVLY

SEQ ID NO: 125878 - protein, 15 aa, Mycobacterium tuberculosis
HTVALFLDKDRVLYA

SEQ ID NO: 125879 - protein, 15 aa, Mycobacterium tuberculosis
TVALFLDKDRVLYAT

SEQ ID NO: 125880 - protein, 15 aa, Mycobacterium tuberculosis
VALFLDKDRVLYATD

SEQ ID NO: 125881 - protein, 15 aa, Mycobacterium tuberculosis
ALFLDKDRVLYATDH

SEQ ID NO: 125882 - protein, 15 aa, Mycobacterium tuberculosis
LFLDKDRVLYATDHS

SEQ ID NO: 125883 - protein, 15 aa, Mycobacterium tuberculosis
FLDKDRVLYATDHSG

SEQ ID NO: 125884 - protein, 15 aa, Mycobacterium tuberculosis
LDKDRVLYATDHSGR

SEQ ID NO: 125885 - protein, 15 aa, Mycobacterium tuberculosis
DKDRVLYATDHSGRE

SEQ ID NO: 125886 - protein, 15 aa, Mycobacterium tuberculosis
KDRVLYATDHSGREA

SEQ ID NO: 125887 - protein, 15 aa, Mycobacterium tuberculosis
DRVLYATDHSGREAL

SEQ ID NO: 125888 - protein, 15 aa, Mycobacterium tuberculosis
RVLYATDHSGREALL

SEQ ID NO: 125889 - protein, 15 aa, Mycobacterium tuberculosis
VLYATDHSGREALLG

SEQ ID NO: 125890 - protein, 15 aa, Mycobacterium tuberculosis
LYATDHSGREALLGC

SEQ ID NO: 125891 - protein, 15 aa, Mycobacterium tuberculosis
YATDHSGREALLGCG

SEQ ID NO: 125892 - protein, 15 aa, Mycobacterium tuberculosis
ATDHSGREALLGCGA

SEQ ID NO: 125893 - protein, 15 aa, Mycobacterium tuberculosis
TDHSGREALLGCGAV

SEQ ID NO: 125894 - protein, 15 aa, Mycobacterium tuberculosis
DHSGREALLGCGAVL

SEQ ID NO: 125895 - protein, 15 aa, Mycobacterium tuberculosis
HSGREALLGCGAVLD

SEQ ID NO: 125896 - protein, 15 aa, Mycobacterium tuberculosis
SGREALLGCGAVLDH

SEQ ID NO: 125897 - protein, 15 aa, Mycobacterium tuberculosis
GREALLGCGAVLDHF

SEQ ID NO: 125898 - protein, 15 aa, Mycobacterium tuberculosis
REALLGCGAVLDHFR

SEQ ID NO: 125899 - protein, 15 aa, Mycobacterium tuberculosis
EALLGCGAVLDHFRV

SEQ ID NO: 125900 - protein, 15 aa, Mycobacterium tuberculosis
ALLGCGAVLDHFRVA

SEQ ID NO: 125901 - protein, 15 aa, Mycobacterium tuberculosis
LLGCGAVLDHFRVAM

SEQ ID NO: 125902 - protein, 15 aa, Mycobacterium tuberculosis
LGCGAVLDHFRVAMA

SEQ ID NO: 125903 - protein, 15 aa, Mycobacterium tuberculosis
GCGAVLDHFRVAMAA

SEQ ID NO: 125904 - protein, 15 aa, Mycobacterium tuberculosis
CGAVLDHFRVAMAAA

SEQ ID NO: 125905 - protein, 15 aa, Mycobacterium tuberculosis
GAVLDHFRVAMAAAG

SEQ ID NO: 125906 - protein, 15 aa, Mycobacterium tuberculosis
AVLDHFRVAMAAAGT

SEQ ID NO: 125907 - protein, 15 aa, Mycobacterium tuberculosis
VLDHFRVAMAAAGTT

SEQ ID NO: 125908 - protein, 15 aa, Mycobacterium tuberculosis
LDHFRVAMAAAGTTA

SEQ ID NO: 125909 - protein, 15 aa, Mycobacterium tuberculosis
DHFRVAMAAAGTTAN

SEQ ID NO: 125910 - protein, 15 aa, Mycobacterium tuberculosis
HFRVAMAAAGTTANV

SEQ ID NO: 125911 - protein, 15 aa, Mycobacterium tuberculosis
FRVAMAAAGTTANVE

SEQ ID NO: 125912 - protein, 15 aa, Mycobacterium tuberculosis
RVAMAAAGTTANVER

SEQ ID NO: 125913 - protein, 15 aa, Mycobacterium tuberculosis
VAMAAAGTTANVERF

SEQ ID NO: 125914 - protein, 15 aa, Mycobacterium tuberculosis
AMAAAGTTANVERFP

SEQ ID NO: 125915 - protein, 15 aa, Mycobacterium tuberculosis
MAAAGTTANVERFPN

SEQ ID NO: 125916 - protein, 15 aa, Mycobacterium tuberculosis
AAAGTTANVERFPNP

SEQ ID NO: 125917 - protein, 15 aa, Mycobacterium tuberculosis
AAGTTANVERFPNPN

SEQ ID NO: 125918 - protein, 15 aa, Mycobacterium tuberculosis
AGTTANVERFPNPND

SEQ ID NO: 125919 - protein, 15 aa, Mycobacterium tuberculosis
GTTANVERFPNPNDP

SEQ ID NO: 125920 - protein, 15 aa, Mycobacterium tuberculosis
TTANVERFPNPNDPL

SEQ ID NO: 125921 - protein, 15 aa, Mycobacterium tuberculosis
TANVERFPNPNDPLH

SEQ ID NO: 125922 - protein, 15 aa, Mycobacterium tuberculosis
ANVERFPNPNDPLHL

SEQ ID NO: 125923 - protein, 15 aa, Mycobacterium tuberculosis
NVERFPNPNDPLHLA

SEQ ID NO: 125924 - protein, 15 aa, Mycobacterium tuberculosis
VERFPNPNDPLHLAS

SEQ ID NO: 125925 - protein, 15 aa, Mycobacterium tuberculosis
ERFPNPNDPLHLASI

SEQ ID NO: 125926 - protein, 15 aa, Mycobacterium tuberculosis
RFPNPNDPLHLASID

SEQ ID NO: 125927 - protein, 15 aa, Mycobacterium tuberculosis
FPNPNDPLHLASIDF

SEQ ID NO: 125928 - protein, 15 aa, Mycobacterium tuberculosis
PNPNDPLHLASIDFS

SEQ ID NO: 125929 - protein, 15 aa, Mycobacterium tuberculosis
NPNDPLHLASIDFSP

SEQ ID NO: 125930 - protein, 15 aa, Mycobacterium tuberculosis
PNDPLHLASIDFSPA

SEQ ID NO: 125931 - protein, 15 aa, Mycobacterium tuberculosis
NDPLHLASIDFSPAD

SEQ ID NO: 125932 - protein, 15 aa, Mycobacterium tuberculosis
DPLHLASIDFSPADF

SEQ ID NO: 125933 - protein, 15 aa, Mycobacterium tuberculosis
PLHLASIDFSPADFV

SEQ ID NO: 125934 - protein, 15 aa, Mycobacterium tuberculosis
LHLASIDFSPADFVT

SEQ ID NO: 125935 - protein, 15 aa, Mycobacterium tuberculosis
HLASIDFSPADFVTE

SEQ ID NO: 125936 - protein, 15 aa, Mycobacterium tuberculosis
LASIDFSPADFVTEG

SEQ ID NO: 125937 - protein, 15 aa, Mycobacterium tuberculosis
ASIDFSPADFVTEGH

SEQ ID NO: 125938 - protein, 15 aa, Mycobacterium tuberculosis
SIDFSPADFVTEGHR

SEQ ID NO: 125939 - protein, 15 aa, Mycobacterium tuberculosis
IDFSPADFVTEGHRL

SEQ ID NO: 125940 - protein, 15 aa, Mycobacterium tuberculosis
DFSPADFVTEGHRLR

SEQ ID NO: 125941 - protein, 15 aa, Mycobacterium tuberculosis
FSPADFVTEGHRLRA

SEQ ID NO: 125942 - protein, 15 aa, Mycobacterium tuberculosis
SPADFVTEGHRLRAD

SEQ ID NO: 125943 - protein, 15 aa, Mycobacterium tuberculosis
PADFVTEGHRLRADA

SEQ ID NO: 125944 - protein, 15 aa, Mycobacterium tuberculosis
ADFVTEGHRLRADAI

SEQ ID NO: 125945 - protein, 15 aa, Mycobacterium tuberculosis
DFVTEGHRLRADAIL

SEQ ID NO: 125946 - protein, 15 aa, Mycobacterium tuberculosis
FVTEGHRLRADAILL

SEQ ID NO: 125947 - protein, 15 aa, Mycobacterium tuberculosis
VTEGHRLRADAILLR

SEQ ID NO: 125948 - protein, 15 aa, Mycobacterium tuberculosis
TEGHRLRADAILLRR

SEQ ID NO: 125949 - protein, 15 aa, Mycobacterium tuberculosis
EGHRLRADAILLRRT

SEQ ID NO: 125950 - protein, 15 aa, Mycobacterium tuberculosis
GHRLRADAILLRRTD

SEQ ID NO: 125951 - protein, 15 aa, Mycobacterium tuberculosis
HRLRADAILLRRTDR

SEQ ID NO: 125952 - protein, 15 aa, Mycobacterium tuberculosis
RLRADAILLRRTDRL

SEQ ID NO: 125953 - protein, 15 aa, Mycobacterium tuberculosis
LRADAILLRRTDRLP

SEQ ID NO: 125954 - protein, 15 aa, Mycobacterium tuberculosis
RADAILLRRTDRLPF

SEQ ID NO: 125955 - protein, 15 aa, Mycobacterium tuberculosis
ADAILLRRTDRLPFA

SEQ ID NO: 125956 - protein, 15 aa, Mycobacterium tuberculosis
DAILLRRTDRLPFAE

SEQ ID NO: 125957 - protein, 15 aa, Mycobacterium tuberculosis
AILLRRTDRLPFAEP

SEQ ID NO: 125958 - protein, 15 aa, Mycobacterium tuberculosis
ILLRRTDRLPFAEPP

SEQ ID NO: 125959 - protein, 15 aa, Mycobacterium tuberculosis
LLRRTDRLPFAEPPD

SEQ ID NO: 125960 - protein, 15 aa, Mycobacterium tuberculosis
LRRTDRLPFAEPPDW

SEQ ID NO: 125961 - protein, 15 aa, Mycobacterium tuberculosis
RRTDRLPFAEPPDWD

SEQ ID NO: 125962 - protein, 15 aa, Mycobacterium tuberculosis
RTDRLPFAEPPDWDL

SEQ ID NO: 125963 - protein, 15 aa, Mycobacterium tuberculosis
TDRLPFAEPPDWDLV

SEQ ID NO: 125964 - protein, 15 aa, Mycobacterium tuberculosis
DRLPFAEPPDWDLVE

SEQ ID NO: 125965 - protein, 15 aa, Mycobacterium tuberculosis
RLPFAEPPDWDLVES

SEQ ID NO: 125966 - protein, 15 aa, Mycobacterium tuberculosis
LPFAEPPDWDLVESQ

SEQ ID NO: 125967 - protein, 15 aa, Mycobacterium tuberculosis
PFAEPPDWDLVESQL

SEQ ID NO: 125968 - protein, 15 aa, Mycobacterium tuberculosis
FAEPPDWDLVESQLR

SEQ ID NO: 125969 - protein, 15 aa, Mycobacterium tuberculosis
AEPPDWDLVESQLRT

SEQ ID NO: 125970 - protein, 15 aa, Mycobacterium tuberculosis
EPPDWDLVESQLRTT

SEQ ID NO: 125971 - protein, 15 aa, Mycobacterium tuberculosis
PPDWDLVESQLRTTV

SEQ ID NO: 125972 - protein, 15 aa, Mycobacterium tuberculosis
PDWDLVESQLRTTVT

SEQ ID NO: 125973 - protein, 15 aa, Mycobacterium tuberculosis
DWDLVESQLRTTVTA

SEQ ID NO: 125974 - protein, 15 aa, Mycobacterium tuberculosis
WDLVESQLRTTVTAD

SEQ ID NO: 125975 - protein, 15 aa, Mycobacterium tuberculosis
DLVESQLRTTVTADT

SEQ ID NO: 125976 - protein, 15 aa, Mycobacterium tuberculosis
LVESQLRTTVTADTV

SEQ ID NO: 125977 - protein, 15 aa, Mycobacterium tuberculosis
VESQLRTTVTADTVR

SEQ ID NO: 125978 - protein, 15 aa, Mycobacterium tuberculosis
ESQLRTTVTADTVRI

SEQ ID NO: 125979 - protein, 15 aa, Mycobacterium tuberculosis
SQLRTTVTADTVRID

SEQ ID NO: 125980 - protein, 15 aa, Mycobacterium tuberculosis
QLRTTVTADTVRIDV

SEQ ID NO: 125981 - protein, 15 aa, Mycobacterium tuberculosis
LRTTVTADTVRIDVI

SEQ ID NO: 125982 - protein, 15 aa, Mycobacterium tuberculosis
RTTVTADTVRIDVIA

SEQ ID NO: 125983 - protein, 15 aa, Mycobacterium tuberculosis
TTVTADTVRIDVIAD

SEQ ID NO: 125984 - protein, 15 aa, Mycobacterium tuberculosis
TVTADTVRIDVIADD

SEQ ID NO: 125985 - protein, 15 aa, Mycobacterium tuberculosis
VTADTVRIDVIADDM

SEQ ID NO: 125986 - protein, 15 aa, Mycobacterium tuberculosis
TADTVRIDVIADDMR

SEQ ID NO: 125987 - protein, 15 aa, Mycobacterium tuberculosis
ADTVRIDVIADDMRP

SEQ ID NO: 125988 - protein, 15 aa, Mycobacterium tuberculosis
DTVRIDVIADDMRPE

SEQ ID NO: 125989 - protein, 15 aa, Mycobacterium tuberculosis
TVRIDVIADDMRPEL

SEQ ID NO: 125990 - protein, 15 aa, Mycobacterium tuberculosis
VRIDVIADDMRPELA

SEQ ID NO: 125991 - protein, 15 aa, Mycobacterium tuberculosis
RIDVIADDMRPELAA

SEQ ID NO: 125992 - protein, 15 aa, Mycobacterium tuberculosis
IDVIADDMRPELAAA

SEQ ID NO: 125993 - protein, 15 aa, Mycobacterium tuberculosis
DVIADDMRPELAAAS

SEQ ID NO: 125994 - protein, 15 aa, Mycobacterium tuberculosis
VIADDMRPELAAASK

SEQ ID NO: 125995 - protein, 15 aa, Mycobacterium tuberculosis
IADDMRPELAAASKL

SEQ ID NO: 125996 - protein, 15 aa, Mycobacterium tuberculosis
ADDMRPELAAASKLT

SEQ ID NO: 125997 - protein, 15 aa, Mycobacterium tuberculosis
DDMRPELAAASKLTE

SEQ ID NO: 125998 - protein, 15 aa, Mycobacterium tuberculosis
DMRPELAAASKLTES

SEQ ID NO: 125999 - protein, 15 aa, Mycobacterium tuberculosis
MRPELAAASKLTESL

SEQ ID NO: 126000 - protein, 15 aa, Mycobacterium tuberculosis
RPELAAASKLTESLR

SEQ ID NO: 126001 - protein, 15 aa, Mycobacterium tuberculosis
PELAAASKLTESLRL

SEQ ID NO: 126002 - protein, 15 aa, Mycobacterium tuberculosis
ELAAASKLTESLRLY

SEQ ID NO: 126003 - protein, 15 aa, Mycobacterium tuberculosis
LAAASKLTESLRLYD

SEQ ID NO: 126004 - protein, 15 aa, Mycobacterium tuberculosis
AAASKLTESLRLYDS

SEQ ID NO: 126005 - protein, 15 aa, Mycobacterium tuberculosis
AASKLTESLRLYDSS

SEQ ID NO: 126006 - protein, 15 aa, Mycobacterium tuberculosis
ASKLTESLRLYDSSY

SEQ ID NO: 126007 - protein, 15 aa, Mycobacterium tuberculosis
SKLTESLRLYDSSYH

SEQ ID NO: 126008 - protein, 15 aa, Mycobacterium tuberculosis
KLTESLRLYDSSYHA

SEQ ID NO: 126009 - protein, 15 aa, Mycobacterium tuberculosis
LTESLRLYDSSYHAE

SEQ ID NO: 126010 - protein, 15 aa, Mycobacterium tuberculosis
TESLRLYDSSYHAEL

SEQ ID NO: 126011 - protein, 15 aa, Mycobacterium tuberculosis
ESLRLYDSSYHAELF

SEQ ID NO: 126012 - protein, 15 aa, Mycobacterium tuberculosis
SLRLYDSSYHAELFW

SEQ ID NO: 126013 - protein, 15 aa, Mycobacterium tuberculosis
LRLYDSSYHAELFWW

SEQ ID NO: 126014 - protein, 15 aa, Mycobacterium tuberculosis
RLYDSSYHAELFWWT

SEQ ID NO: 126015 - protein, 15 aa, Mycobacterium tuberculosis
LYDSSYHAELFWWTG

SEQ ID NO: 126016 - protein, 15 aa, Mycobacterium tuberculosis
YDSSYHAELFWWTGA

SEQ ID NO: 126017 - protein, 15 aa, Mycobacterium tuberculosis
DSSYHAELFWWTGAF

SEQ ID NO: 126018 - protein, 15 aa, Mycobacterium tuberculosis
SSYHAELFWWTGAFE

SEQ ID NO: 126019 - protein, 15 aa, Mycobacterium tuberculosis
SYHAELFWWTGAFET

SEQ ID NO: 126020 - protein, 15 aa, Mycobacterium tuberculosis
YHAELFWWTGAFETS

SEQ ID NO: 126021 - protein, 15 aa, Mycobacterium tuberculosis
HAELFWWTGAFETSE

SEQ ID NO: 126022 - protein, 15 aa, Mycobacterium tuberculosis
AELFWWTGAFETSEG

SEQ ID NO: 126023 - protein, 15 aa, Mycobacterium tuberculosis
ELFWWTGAFETSEGI

SEQ ID NO: 126024 - protein, 15 aa, Mycobacterium tuberculosis
LFWWTGAFETSEGIP

SEQ ID NO: 126025 - protein, 15 aa, Mycobacterium tuberculosis
FWWTGAFETSEGIPH

SEQ ID NO: 126026 - protein, 15 aa, Mycobacterium tuberculosis
WWTGAFETSEGIPHS

SEQ ID NO: 126027 - protein, 15 aa, Mycobacterium tuberculosis
WTGAFETSEGIPHSS

SEQ ID NO: 126028 - protein, 15 aa, Mycobacterium tuberculosis
TGAFETSEGIPHSSL

SEQ ID NO: 126029 - protein, 15 aa, Mycobacterium tuberculosis
GAFETSEGIPHSSLV

SEQ ID NO: 126030 - protein, 15 aa, Mycobacterium tuberculosis
AFETSEGIPHSSLVS

SEQ ID NO: 126031 - protein, 15 aa, Mycobacterium tuberculosis
FETSEGIPHSSLVSA

SEQ ID NO: 126032 - protein, 15 aa, Mycobacterium tuberculosis
ETSEGIPHSSLVSAA

SEQ ID NO: 126033 - protein, 15 aa, Mycobacterium tuberculosis
TSEGIPHSSLVSAAE

SEQ ID NO: 126034 - protein, 15 aa, Mycobacterium tuberculosis
SEGIPHSSLVSAAES

SEQ ID NO: 126035 - protein, 15 aa, Mycobacterium tuberculosis
EGIPHSSLVSAAESD

SEQ ID NO: 126036 - protein, 15 aa, Mycobacterium tuberculosis
GIPHSSLVSAAESDR

SEQ ID NO: 126037 - protein, 15 aa, Mycobacterium tuberculosis
IPHSSLVSAAESDRV

SEQ ID NO: 126038 - protein, 15 aa, Mycobacterium tuberculosis
PHSSLVSAAESDRVT

SEQ ID NO: 126039 - protein, 15 aa, Mycobacterium tuberculosis
HSSLVSAAESDRVTF

SEQ ID NO: 126040 - protein, 15 aa, Mycobacterium tuberculosis
SSLVSAAESDRVTFG

SEQ ID NO: 126041 - protein, 15 aa, Mycobacterium tuberculosis
SLVSAAESDRVTFGR

SEQ ID NO: 126042 - protein, 15 aa, Mycobacterium tuberculosis
LVSAAESDRVTFGRD

SEQ ID NO: 126043 - protein, 15 aa, Mycobacterium tuberculosis
VSAAESDRVTFGRDF

SEQ ID NO: 126044 - protein, 15 aa, Mycobacterium tuberculosis
SAAESDRVTFGRDFP

SEQ ID NO: 126045 - protein, 15 aa, Mycobacterium tuberculosis
AAESDRVTFGRDFPV

SEQ ID NO: 126046 - protein, 15 aa, Mycobacterium tuberculosis
AESDRVTFGRDFPVV

SEQ ID NO: 126047 - protein, 15 aa, Mycobacterium tuberculosis
ESDRVTFGRDFPVVA

SEQ ID NO: 126048 - protein, 15 aa, Mycobacterium tuberculosis
SDRVTFGRDFPVVAN

SEQ ID NO: 126049 - protein, 15 aa, Mycobacterium tuberculosis
DRVTFGRDFPVVANT

SEQ ID NO: 126050 - protein, 15 aa, Mycobacterium tuberculosis
RVTFGRDFPVVANTD

SEQ ID NO: 126051 - protein, 15 aa, Mycobacterium tuberculosis
VTFGRDFPVVANTDR

SEQ ID NO: 126052 - protein, 15 aa, Mycobacterium tuberculosis
TFGRDFPVVANTDRR

SEQ ID NO: 126053 - protein, 15 aa, Mycobacterium tuberculosis
FGRDFPVVANTDRRP

SEQ ID NO: 126054 - protein, 15 aa, Mycobacterium tuberculosis
GRDFPVVANTDRRPE

SEQ ID NO: 126055 - protein, 15 aa, Mycobacterium tuberculosis
RDFPVVANTDRRPEF

SEQ ID NO: 126056 - protein, 15 aa, Mycobacterium tuberculosis
DFPVVANTDRRPEFG

SEQ ID NO: 126057 - protein, 15 aa, Mycobacterium tuberculosis
FPVVANTDRRPEFGH

SEQ ID NO: 126058 - protein, 15 aa, Mycobacterium tuberculosis
PVVANTDRRPEFGHD

SEQ ID NO: 126059 - protein, 15 aa, Mycobacterium tuberculosis
VVANTDRRPEFGHDR

SEQ ID NO: 126060 - protein, 15 aa, Mycobacterium tuberculosis
VANTDRRPEFGHDRS

SEQ ID NO: 126061 - protein, 15 aa, Mycobacterium tuberculosis
ANTDRRPEFGHDRSK

SEQ ID NO: 126062 - protein, 15 aa, Mycobacterium tuberculosis
NTDRRPEFGHDRSKV

SEQ ID NO: 126063 - protein, 15 aa, Mycobacterium tuberculosis
TDRRPEFGHDRSKVL

SEQ ID NO: 126064 - protein, 15 aa, Mycobacterium tuberculosis
DRRPEFGHDRSKVLV

SEQ ID NO: 126065 - protein, 15 aa, Mycobacterium tuberculosis
RRPEFGHDRSKVLVL

SEQ ID NO: 126066 - protein, 15 aa, Mycobacterium tuberculosis
RPEFGHDRSKVLVLS

SEQ ID NO: 126067 - protein, 15 aa, Mycobacterium tuberculosis
PEFGHDRSKVLVLST

SEQ ID NO: 126068 - protein, 15 aa, Mycobacterium tuberculosis
EFGHDRSKVLVLSTY

SEQ ID NO: 126069 - protein, 15 aa, Mycobacterium tuberculosis
FGHDRSKVLVLSTYD

SEQ ID NO: 126070 - protein, 15 aa, Mycobacterium tuberculosis
GHDRSKVLVLSTYDN

SEQ ID NO: 126071 - protein, 15 aa, Mycobacterium tuberculosis
HDRSKVLVLSTYDNE

SEQ ID NO: 126072 - protein, 15 aa, Mycobacterium tuberculosis
DRSKVLVLSTYDNER

SEQ ID NO: 126073 - protein, 15 aa, Mycobacterium tuberculosis
RSKVLVLSTYDNERA

SEQ ID NO: 126074 - protein, 15 aa, Mycobacterium tuberculosis
SKVLVLSTYDNERAS

SEQ ID NO: 126075 - protein, 15 aa, Mycobacterium tuberculosis
KVLVLSTYDNERASL

SEQ ID NO: 126076 - protein, 15 aa, Mycobacterium tuberculosis
VLVLSTYDNERASLL

SEQ ID NO: 126077 - protein, 15 aa, Mycobacterium tuberculosis
LVLSTYDNERASLLR

SEQ ID NO: 126078 - protein, 15 aa, Mycobacterium tuberculosis
VLSTYDNERASLLRC

SEQ ID NO: 126079 - protein, 15 aa, Mycobacterium tuberculosis
LSTYDNERASLLRCG

SEQ ID NO: 126080 - protein, 15 aa, Mycobacterium tuberculosis
STYDNERASLLRCGE

SEQ ID NO: 126081 - protein, 15 aa, Mycobacterium tuberculosis
TYDNERASLLRCGEM

SEQ ID NO: 126082 - protein, 15 aa, Mycobacterium tuberculosis
YDNERASLLRCGEML

SEQ ID NO: 126083 - protein, 15 aa, Mycobacterium tuberculosis
DNERASLLRCGEMLS

SEQ ID NO: 126084 - protein, 15 aa, Mycobacterium tuberculosis
NERASLLRCGEMLSA

SEQ ID NO: 126085 - protein, 15 aa, Mycobacterium tuberculosis
ERASLLRCGEMLSAV

SEQ ID NO: 126086 - protein, 15 aa, Mycobacterium tuberculosis
RASLLRCGEMLSAVL

SEQ ID NO: 126087 - protein, 15 aa, Mycobacterium tuberculosis
ASLLRCGEMLSAVLL

SEQ ID NO: 126088 - protein, 15 aa, Mycobacterium tuberculosis
SLLRCGEMLSAVLLD

SEQ ID NO: 126089 - protein, 15 aa, Mycobacterium tuberculosis
LLRCGEMLSAVLLDA

SEQ ID NO: 126090 - protein, 15 aa, Mycobacterium tuberculosis
LRCGEMLSAVLLDAT

SEQ ID NO: 126091 - protein, 15 aa, Mycobacterium tuberculosis
RCGEMLSAVLLDATM

SEQ ID NO: 126092 - protein, 15 aa, Mycobacterium tuberculosis
CGEMLSAVLLDATMA

SEQ ID NO: 126093 - protein, 15 aa, Mycobacterium tuberculosis
GEMLSAVLLDATMAG

SEQ ID NO: 126094 - protein, 15 aa, Mycobacterium tuberculosis
EMLSAVLLDATMAGL

SEQ ID NO: 126095 - protein, 15 aa, Mycobacterium tuberculosis
MLSAVLLDATMAGLA

SEQ ID NO: 126096 - protein, 15 aa, Mycobacterium tuberculosis
LSAVLLDATMAGLAT

SEQ ID NO: 126097 - protein, 15 aa, Mycobacterium tuberculosis
SAVLLDATMAGLATC

SEQ ID NO: 126098 - protein, 15 aa, Mycobacterium tuberculosis
AVLLDATMAGLATCT

SEQ ID NO: 126099 - protein, 15 aa, Mycobacterium tuberculosis
VLLDATMAGLATCTL

SEQ ID NO: 126100 - protein, 15 aa, Mycobacterium tuberculosis
LLDATMAGLATCTLT

SEQ ID NO: 126101 - protein, 15 aa, Mycobacterium tuberculosis
LDATMAGLATCTLTH

SEQ ID NO: 126102 - protein, 15 aa, Mycobacterium tuberculosis
DATMAGLATCTLTHI

SEQ ID NO: 126103 - protein, 15 aa, Mycobacterium tuberculosis
ATMAGLATCTLTHIT

SEQ ID NO: 126104 - protein, 15 aa, Mycobacterium tuberculosis
TMAGLATCTLTHITE

SEQ ID NO: 126105 - protein, 15 aa, Mycobacterium tuberculosis
MAGLATCTLTHITEL

SEQ ID NO: 126106 - protein, 15 aa, Mycobacterium tuberculosis
AGLATCTLTHITELH

SEQ ID NO: 126107 - protein, 15 aa, Mycobacterium tuberculosis
GLATCTLTHITELHA

SEQ ID NO: 126108 - protein, 15 aa, Mycobacterium tuberculosis
LATCTLTHITELHAS

SEQ ID NO: 126109 - protein, 15 aa, Mycobacterium tuberculosis
ATCTLTHITELHASR

SEQ ID NO: 126110 - protein, 15 aa, Mycobacterium tuberculosis
TCTLTHITELHASRD

SEQ ID NO: 126111 - protein, 15 aa, Mycobacterium tuberculosis
CTLTHITELHASRDL

SEQ ID NO: 126112 - protein, 15 aa, Mycobacterium tuberculosis
TLTHITELHASRDLV

SEQ ID NO: 126113 - protein, 15 aa, Mycobacterium tuberculosis
LTHITELHASRDLVA

SEQ ID NO: 126114 - protein, 15 aa, Mycobacterium tuberculosis
THITELHASRDLVAA

SEQ ID NO: 126115 - protein, 15 aa, Mycobacterium tuberculosis
HITELHASRDLVAAL

SEQ ID NO: 126116 - protein, 15 aa, Mycobacterium tuberculosis
ITELHASRDLVAALI

SEQ ID NO: 126117 - protein, 15 aa, Mycobacterium tuberculosis
TELHASRDLVAALIG

SEQ ID NO: 126118 - protein, 15 aa, Mycobacterium tuberculosis
ELHASRDLVAALIGQ

SEQ ID NO: 126119 - protein, 15 aa, Mycobacterium tuberculosis
LHASRDLVAALIGQP

SEQ ID NO: 126120 - protein, 15 aa, Mycobacterium tuberculosis
HASRDLVAALIGQPA

SEQ ID NO: 126121 - protein, 15 aa, Mycobacterium tuberculosis
ASRDLVAALIGQPAT

SEQ ID NO: 126122 - protein, 15 aa, Mycobacterium tuberculosis
SRDLVAALIGQPATP

SEQ ID NO: 126123 - protein, 15 aa, Mycobacterium tuberculosis
RDLVAALIGQPATPQ

SEQ ID NO: 126124 - protein, 15 aa, Mycobacterium tuberculosis
DLVAALIGQPATPQA

SEQ ID NO: 126125 - protein, 15 aa, Mycobacterium tuberculosis
LVAALIGQPATPQAL

SEQ ID NO: 126126 - protein, 15 aa, Mycobacterium tuberculosis
VAALIGQPATPQALV

SEQ ID NO: 126127 - protein, 15 aa, Mycobacterium tuberculosis
AALIGQPATPQALVR

SEQ ID NO: 126128 - protein, 15 aa, Mycobacterium tuberculosis
ALIGQPATPQALVRV

SEQ ID NO: 126129 - protein, 15 aa, Mycobacterium tuberculosis
LIGQPATPQALVRVG

SEQ ID NO: 126130 - protein, 15 aa, Mycobacterium tuberculosis
IGQPATPQALVRVGL

SEQ ID NO: 126131 - protein, 15 aa, Mycobacterium tuberculosis
GQPATPQALVRVGLA

SEQ ID NO: 126132 - protein, 15 aa, Mycobacterium tuberculosis
QPATPQALVRVGLAP

SEQ ID NO: 126133 - protein, 15 aa, Mycobacterium tuberculosis
PATPQALVRVGLAPE

SEQ ID NO: 126134 - protein, 15 aa, Mycobacterium tuberculosis
ATPQALVRVGLAPEM

SEQ ID NO: 126135 - protein, 15 aa, Mycobacterium tuberculosis
TPQALVRVGLAPEME

SEQ ID NO: 126136 - protein, 15 aa, Mycobacterium tuberculosis
PQALVRVGLAPEMEE

SEQ ID NO: 126137 - protein, 15 aa, Mycobacterium tuberculosis
QALVRVGLAPEMEEP

SEQ ID NO: 126138 - protein, 15 aa, Mycobacterium tuberculosis
ALVRVGLAPEMEEPP

SEQ ID NO: 126139 - protein, 15 aa, Mycobacterium tuberculosis
LVRVGLAPEMEEPPP

SEQ ID NO: 126140 - protein, 15 aa, Mycobacterium tuberculosis
VRVGLAPEMEEPPPA

SEQ ID NO: 126141 - protein, 15 aa, Mycobacterium tuberculosis
RVGLAPEMEEPPPAT

SEQ ID NO: 126142 - protein, 15 aa, Mycobacterium tuberculosis
VGLAPEMEEPPPATP

SEQ ID NO: 126143 - protein, 15 aa, Mycobacterium tuberculosis
GLAPEMEEPPPATPR

SEQ ID NO: 126144 - protein, 15 aa, Mycobacterium tuberculosis
LAPEMEEPPPATPRR

SEQ ID NO: 126145 - protein, 15 aa, Mycobacterium tuberculosis
APEMEEPPPATPRRP

SEQ ID NO: 126146 - protein, 15 aa, Mycobacterium tuberculosis
PEMEEPPPATPRRPI

SEQ ID NO: 126147 - protein, 15 aa, Mycobacterium tuberculosis
EMEEPPPATPRRPID

SEQ ID NO: 126148 - protein, 15 aa, Mycobacterium tuberculosis
MEEPPPATPRRPIDE

SEQ ID NO: 126149 - protein, 15 aa, Mycobacterium tuberculosis
EEPPPATPRRPIDEV

SEQ ID NO: 126150 - protein, 15 aa, Mycobacterium tuberculosis
EPPPATPRRPIDEVF

SEQ ID NO: 126151 - protein, 15 aa, Mycobacterium tuberculosis
PPPATPRRPIDEVFH

SEQ ID NO: 126152 - protein, 15 aa, Mycobacterium tuberculosis
PPATPRRPIDEVFHV

SEQ ID NO: 126153 - protein, 15 aa, Mycobacterium tuberculosis
PATPRRPIDEVFHVR

SEQ ID NO: 126154 - protein, 15 aa, Mycobacterium tuberculosis
ATPRRPIDEVFHVRA

SEQ ID NO: 126155 - protein, 15 aa, Mycobacterium tuberculosis
TPRRPIDEVFHVRAK

SEQ ID NO: 126156 - protein, 15 aa, Mycobacterium tuberculosis
PRRPIDEVFHVRAKD

SEQ ID NO: 126157 - protein, 15 aa, Mycobacterium tuberculosis
RRPIDEVFHVRAKDH

SEQ ID NO: 126158 - protein, 15 aa, Mycobacterium tuberculosis
RPIDEVFHVRAKDHR

SEQ ID NO: 126159 - protein, 16 aa, Mycobacterium tuberculosis
MPDTMVTTDVIKSAVQ

SEQ ID NO: 126160 - protein, 16 aa, Mycobacterium tuberculosis
PDTMVTTDVIKSAVQL

SEQ ID NO: 126161 - protein, 16 aa, Mycobacterium tuberculosis
DTMVTTDVIKSAVQLA

SEQ ID NO: 126162 - protein, 16 aa, Mycobacterium tuberculosis
TMVTTDVIKSAVQLAC

SEQ ID NO: 126163 - protein, 16 aa, Mycobacterium tuberculosis
MVTTDVIKSAVQLACR

SEQ ID NO: 126164 - protein, 16 aa, Mycobacterium tuberculosis
VTTDVIKSAVQLACRA

SEQ ID NO: 126165 - protein, 16 aa, Mycobacterium tuberculosis
TTDVIKSAVQLACRAP

SEQ ID NO: 126166 - protein, 16 aa, Mycobacterium tuberculosis
TDVIKSAVQLACRAPS

SEQ ID NO: 126167 - protein, 16 aa, Mycobacterium tuberculosis
DVIKSAVQLACRAPSL

SEQ ID NO: 126168 - protein, 16 aa, Mycobacterium tuberculosis
VIKSAVQLACRAPSLH

SEQ ID NO: 126169 - protein, 16 aa, Mycobacterium tuberculosis
IKSAVQLACRAPSLHN

SEQ ID NO: 126170 - protein, 16 aa, Mycobacterium tuberculosis
KSAVQLACRAPSLHNS

SEQ ID NO: 126171 - protein, 16 aa, Mycobacterium tuberculosis
SAVQLACRAPSLHNSQ

SEQ ID NO: 126172 - protein, 16 aa, Mycobacterium tuberculosis
AVQLACRAPSLHNSQP

SEQ ID NO: 126173 - protein, 16 aa, Mycobacterium tuberculosis
VQLACRAPSLHNSQPW

SEQ ID NO: 126174 - protein, 16 aa, Mycobacterium tuberculosis
QLACRAPSLHNSQPWR

SEQ ID NO: 126175 - protein, 16 aa, Mycobacterium tuberculosis
LACRAPSLHNSQPWRW

SEQ ID NO: 126176 - protein, 16 aa, Mycobacterium tuberculosis
ACRAPSLHNSQPWRWI

SEQ ID NO: 126177 - protein, 16 aa, Mycobacterium tuberculosis
CRAPSLHNSQPWRWIA

SEQ ID NO: 126178 - protein, 16 aa, Mycobacterium tuberculosis
RAPSLHNSQPWRWIAE

SEQ ID NO: 126179 - protein, 16 aa, Mycobacterium tuberculosis
APSLHNSQPWRWIAED

SEQ ID NO: 126180 - protein, 16 aa, Mycobacterium tuberculosis
PSLHNSQPWRWIAEDH

SEQ ID NO: 126181 - protein, 16 aa, Mycobacterium tuberculosis
SLHNSQPWRWIAEDHT

SEQ ID NO: 126182 - protein, 16 aa, Mycobacterium tuberculosis
LHNSQPWRWIAEDHTV

SEQ ID NO: 126183 - protein, 16 aa, Mycobacterium tuberculosis
HNSQPWRWIAEDHTVA

SEQ ID NO: 126184 - protein, 16 aa, Mycobacterium tuberculosis
NSQPWRWIAEDHTVAL

SEQ ID NO: 126185 - protein, 16 aa, Mycobacterium tuberculosis
SQPWRWIAEDHTVALF

SEQ ID NO: 126186 - protein, 16 aa, Mycobacterium tuberculosis
QPWRWIAEDHTVALFL

SEQ ID NO: 126187 - protein, 16 aa, Mycobacterium tuberculosis
PWRWIAEDHTVALFLD

SEQ ID NO: 126188 - protein, 16 aa, Mycobacterium tuberculosis
WRWIAEDHTVALFLDK

SEQ ID NO: 126189 - protein, 16 aa, Mycobacterium tuberculosis
RWIAEDHTVALFLDKD

SEQ ID NO: 126190 - protein, 16 aa, Mycobacterium tuberculosis
WIAEDHTVALFLDKDR

SEQ ID NO: 126191 - protein, 16 aa, Mycobacterium tuberculosis
IAEDHTVALFLDKDRV

SEQ ID NO: 126192 - protein, 16 aa, Mycobacterium tuberculosis
AEDHTVALFLDKDRVL

SEQ ID NO: 126193 - protein, 16 aa, Mycobacterium tuberculosis
EDHTVALFLDKDRVLY

SEQ ID NO: 126194 - protein, 16 aa, Mycobacterium tuberculosis
DHTVALFLDKDRVLYA

SEQ ID NO: 126195 - protein, 16 aa, Mycobacterium tuberculosis
HTVALFLDKDRVLYAT

SEQ ID NO: 126196 - protein, 16 aa, Mycobacterium tuberculosis
TVALFLDKDRVLYATD

SEQ ID NO: 126197 - protein, 16 aa, Mycobacterium tuberculosis
VALFLDKDRVLYATDH

SEQ ID NO: 126198 - protein, 16 aa, Mycobacterium tuberculosis
ALFLDKDRVLYATDHS

SEQ ID NO: 126199 - protein, 16 aa, Mycobacterium tuberculosis
LFLDKDRVLYATDHSG

SEQ ID NO: 126200 - protein, 16 aa, Mycobacterium tuberculosis
FLDKDRVLYATDHSGR

SEQ ID NO: 126201 - protein, 16 aa, Mycobacterium tuberculosis
LDKDRVLYATDHSGRE

SEQ ID NO: 126202 - protein, 16 aa, Mycobacterium tuberculosis
DKDRVLYATDHSGREA

SEQ ID NO: 126203 - protein, 16 aa, Mycobacterium tuberculosis
KDRVLYATDHSGREAL

SEQ ID NO: 126204 - protein, 16 aa, Mycobacterium tuberculosis
DRVLYATDHSGREALL

SEQ ID NO: 126205 - protein, 16 aa, Mycobacterium tuberculosis
RVLYATDHSGREALLG

SEQ ID NO: 126206 - protein, 16 aa, Mycobacterium tuberculosis
VLYATDHSGREALLGC

SEQ ID NO: 126207 - protein, 16 aa, Mycobacterium tuberculosis
LYATDHSGREALLGCG

SEQ ID NO: 126208 - protein, 16 aa, Mycobacterium tuberculosis
YATDHSGREALLGCGA

SEQ ID NO: 126209 - protein, 16 aa, Mycobacterium tuberculosis
ATDHSGREALLGCGAV

SEQ ID NO: 126210 - protein, 16 aa, Mycobacterium tuberculosis
TDHSGREALLGCGAVL

SEQ ID NO: 126211 - protein, 16 aa, Mycobacterium tuberculosis
DHSGREALLGCGAVLD

SEQ ID NO: 126212 - protein, 16 aa, Mycobacterium tuberculosis
HSGREALLGCGAVLDH

SEQ ID NO: 126213 - protein, 16 aa, Mycobacterium tuberculosis
SGREALLGCGAVLDHF

SEQ ID NO: 126214 - protein, 16 aa, Mycobacterium tuberculosis
GREALLGCGAVLDHFR

SEQ ID NO: 126215 - protein, 16 aa, Mycobacterium tuberculosis
REALLGCGAVLDHFRV

SEQ ID NO: 126216 - protein, 16 aa, Mycobacterium tuberculosis
EALLGCGAVLDHFRVA

SEQ ID NO: 126217 - protein, 16 aa, Mycobacterium tuberculosis
ALLGCGAVLDHFRVAM

SEQ ID NO: 126218 - protein, 16 aa, Mycobacterium tuberculosis
LLGCGAVLDHFRVAMA

SEQ ID NO: 126219 - protein, 16 aa, Mycobacterium tuberculosis
LGCGAVLDHFRVAMAA

SEQ ID NO: 126220 - protein, 16 aa, Mycobacterium tuberculosis
GCGAVLDHFRVAMAAA

SEQ ID NO: 126221 - protein, 16 aa, Mycobacterium tuberculosis
CGAVLDHFRVAMAAAG

SEQ ID NO: 126222 - protein, 16 aa, Mycobacterium tuberculosis
GAVLDHFRVAMAAAGT

SEQ ID NO: 126223 - protein, 16 aa, Mycobacterium tuberculosis
AVLDHFRVAMAAAGTT

SEQ ID NO: 126224 - protein, 16 aa, Mycobacterium tuberculosis
VLDHFRVAMAAAGTTA

SEQ ID NO: 126225 - protein, 16 aa, Mycobacterium tuberculosis
LDHFRVAMAAAGTTAN

SEQ ID NO: 126226 - protein, 16 aa, Mycobacterium tuberculosis
DHFRVAMAAAGTTANV

SEQ ID NO: 126227 - protein, 16 aa, Mycobacterium tuberculosis
HFRVAMAAAGTTANVE

SEQ ID NO: 126228 - protein, 16 aa, Mycobacterium tuberculosis
FRVAMAAAGTTANVER

SEQ ID NO: 126229 - protein, 16 aa, Mycobacterium tuberculosis
RVAMAAAGTTANVERF

SEQ ID NO: 126230 - protein, 16 aa, Mycobacterium tuberculosis
VAMAAAGTTANVERFP

SEQ ID NO: 126231 - protein, 16 aa, Mycobacterium tuberculosis
AMAAAGTTANVERFPN

SEQ ID NO: 126232 - protein, 16 aa, Mycobacterium tuberculosis
MAAAGTTANVERFPNP

SEQ ID NO: 126233 - protein, 16 aa, Mycobacterium tuberculosis
AAAGTTANVERFPNPN

SEQ ID NO: 126234 - protein, 16 aa, Mycobacterium tuberculosis
AAGTTANVERFPNPND

SEQ ID NO: 126235 - protein, 16 aa, Mycobacterium tuberculosis
AGTTANVERFPNPNDP

SEQ ID NO: 126236 - protein, 16 aa, Mycobacterium tuberculosis
GTTANVERFPNPNDPL

SEQ ID NO: 126237 - protein, 16 aa, Mycobacterium tuberculosis
TTANVERFPNPNDPLH

SEQ ID NO: 126238 - protein, 16 aa, Mycobacterium tuberculosis
TANVERFPNPNDPLHL

SEQ ID NO: 126239 - protein, 16 aa, Mycobacterium tuberculosis
ANVERFPNPNDPLHLA

SEQ ID NO: 126240 - protein, 16 aa, Mycobacterium tuberculosis
NVERFPNPNDPLHLAS

SEQ ID NO: 126241 - protein, 16 aa, Mycobacterium tuberculosis
VERFPNPNDPLHLASI

SEQ ID NO: 126242 - protein, 16 aa, Mycobacterium tuberculosis
ERFPNPNDPLHLASID

SEQ ID NO: 126243 - protein, 16 aa, Mycobacterium tuberculosis
RFPNPNDPLHLASIDF

SEQ ID NO: 126244 - protein, 16 aa, Mycobacterium tuberculosis
FPNPNDPLHLASIDFS

SEQ ID NO: 126245 - protein, 16 aa, Mycobacterium tuberculosis
PNPNDPLHLASIDFSP

SEQ ID NO: 126246 - protein, 16 aa, Mycobacterium tuberculosis
NPNDPLHLASIDFSPA

SEQ ID NO: 126247 - protein, 16 aa, Mycobacterium tuberculosis
PNDPLHLASIDFSPAD

SEQ ID NO: 126248 - protein, 16 aa, Mycobacterium tuberculosis
NDPLHLASIDFSPADF

SEQ ID NO: 126249 - protein, 16 aa, Mycobacterium tuberculosis
DPLHLASIDFSPADFV

SEQ ID NO: 126250 - protein, 16 aa, Mycobacterium tuberculosis
PLHLASIDFSPADFVT

SEQ ID NO: 126251 - protein, 16 aa, Mycobacterium tuberculosis
LHLASIDFSPADFVTE

SEQ ID NO: 126252 - protein, 16 aa, Mycobacterium tuberculosis
HLASIDFSPADFVTEG

SEQ ID NO: 126253 - protein, 16 aa, Mycobacterium tuberculosis
LASIDFSPADFVTEGH

SEQ ID NO: 126254 - protein, 16 aa, Mycobacterium tuberculosis
ASIDFSPADFVTEGHR

SEQ ID NO: 126255 - protein, 16 aa, Mycobacterium tuberculosis
SIDFSPADFVTEGHRL

SEQ ID NO: 126256 - protein, 16 aa, Mycobacterium tuberculosis
IDFSPADFVTEGHRLR

SEQ ID NO: 126257 - protein, 16 aa, Mycobacterium tuberculosis
DFSPADFVTEGHRLRA

SEQ ID NO: 126258 - protein, 16 aa, Mycobacterium tuberculosis
FSPADFVTEGHRLRAD

SEQ ID NO: 126259 - protein, 16 aa, Mycobacterium tuberculosis
SPADFVTEGHRLRADA

SEQ ID NO: 126260 - protein, 16 aa, Mycobacterium tuberculosis
PADFVTEGHRLRADAI

SEQ ID NO: 126261 - protein, 16 aa, Mycobacterium tuberculosis
ADFVTEGHRLRADAIL

SEQ ID NO: 126262 - protein, 16 aa, Mycobacterium tuberculosis
DFVTEGHRLRADAILL

SEQ ID NO: 126263 - protein, 16 aa, Mycobacterium tuberculosis
FVTEGHRLRADAILLR

SEQ ID NO: 126264 - protein, 16 aa, Mycobacterium tuberculosis
VTEGHRLRADAILLRR

SEQ ID NO: 126265 - protein, 16 aa, Mycobacterium tuberculosis
TEGHRLRADAILLRRT

SEQ ID NO: 126266 - protein, 16 aa, Mycobacterium tuberculosis
EGHRLRADAILLRRTD

SEQ ID NO: 126267 - protein, 16 aa, Mycobacterium tuberculosis
GHRLRADAILLRRTDR

SEQ ID NO: 126268 - protein, 16 aa, Mycobacterium tuberculosis
HRLRADAILLRRTDRL

SEQ ID NO: 126269 - protein, 16 aa, Mycobacterium tuberculosis
RLRADAILLRRTDRLP

SEQ ID NO: 126270 - protein, 16 aa, Mycobacterium tuberculosis
LRADAILLRRTDRLPF

SEQ ID NO: 126271 - protein, 16 aa, Mycobacterium tuberculosis
RADAILLRRTDRLPFA

SEQ ID NO: 126272 - protein, 16 aa, Mycobacterium tuberculosis
ADAILLRRTDRLPFAE

SEQ ID NO: 126273 - protein, 16 aa, Mycobacterium tuberculosis
DAILLRRTDRLPFAEP

SEQ ID NO: 126274 - protein, 16 aa, Mycobacterium tuberculosis
AILLRRTDRLPFAEPP

SEQ ID NO: 126275 - protein, 16 aa, Mycobacterium tuberculosis
ILLRRTDRLPFAEPPD

SEQ ID NO: 126276 - protein, 16 aa, Mycobacterium tuberculosis
LLRRTDRLPFAEPPDW

SEQ ID NO: 126277 - protein, 16 aa, Mycobacterium tuberculosis
LRRTDRLPFAEPPDWD

SEQ ID NO: 126278 - protein, 16 aa, Mycobacterium tuberculosis
RRTDRLPFAEPPDWDL

SEQ ID NO: 126279 - protein, 16 aa, Mycobacterium tuberculosis
RTDRLPFAEPPDWDLV

SEQ ID NO: 126280 - protein, 16 aa, Mycobacterium tuberculosis
TDRLPFAEPPDWDLVE

SEQ ID NO: 126281 - protein, 16 aa, Mycobacterium tuberculosis
DRLPFAEPPDWDLVES

SEQ ID NO: 126282 - protein, 16 aa, Mycobacterium tuberculosis
RLPFAEPPDWDLVESQ

SEQ ID NO: 126283 - protein, 16 aa, Mycobacterium tuberculosis
LPFAEPPDWDLVESQL

SEQ ID NO: 126284 - protein, 16 aa, Mycobacterium tuberculosis
PFAEPPDWDLVESQLR

SEQ ID NO: 126285 - protein, 16 aa, Mycobacterium tuberculosis
FAEPPDWDLVESQLRT

SEQ ID NO: 126286 - protein, 16 aa, Mycobacterium tuberculosis
AEPPDWDLVESQLRTT

SEQ ID NO: 126287 - protein, 16 aa, Mycobacterium tuberculosis
EPPDWDLVESQLRTTV

SEQ ID NO: 126288 - protein, 16 aa, Mycobacterium tuberculosis
PPDWDLVESQLRTTVT

SEQ ID NO: 126289 - protein, 16 aa, Mycobacterium tuberculosis
PDWDLVESQLRTTVTA

SEQ ID NO: 126290 - protein, 16 aa, Mycobacterium tuberculosis
DWDLVESQLRTTVTAD

SEQ ID NO: 126291 - protein, 16 aa, Mycobacterium tuberculosis
WDLVESQLRTTVTADT

SEQ ID NO: 126292 - protein, 16 aa, Mycobacterium tuberculosis
DLVESQLRTTVTADTV

SEQ ID NO: 126293 - protein, 16 aa, Mycobacterium tuberculosis
LVESQLRTTVTADTVR

SEQ ID NO: 126294 - protein, 16 aa, Mycobacterium tuberculosis
VESQLRTTVTADTVRI

SEQ ID NO: 126295 - protein, 16 aa, Mycobacterium tuberculosis
ESQLRTTVTADTVRID

SEQ ID NO: 126296 - protein, 16 aa, Mycobacterium tuberculosis
SQLRTTVTADTVRIDV

SEQ ID NO: 126297 - protein, 16 aa, Mycobacterium tuberculosis
QLRTTVTADTVRIDVI

SEQ ID NO: 126298 - protein, 16 aa, Mycobacterium tuberculosis
LRTTVTADTVRIDVIA

SEQ ID NO: 126299 - protein, 16 aa, Mycobacterium tuberculosis
RTTVTADTVRIDVIAD

SEQ ID NO: 126300 - protein, 16 aa, Mycobacterium tuberculosis
TTVTADTVRIDVIADD

SEQ ID NO: 126301 - protein, 16 aa, Mycobacterium tuberculosis
TVTADTVRIDVIADDM

SEQ ID NO: 126302 - protein, 16 aa, Mycobacterium tuberculosis
VTADTVRIDVIADDMR

SEQ ID NO: 126303 - protein, 16 aa, Mycobacterium tuberculosis
TADTVRIDVIADDMRP

SEQ ID NO: 126304 - protein, 16 aa, Mycobacterium tuberculosis
ADTVRIDVIADDMRPE

SEQ ID NO: 126305 - protein, 16 aa, Mycobacterium tuberculosis
DTVRIDVIADDMRPEL

SEQ ID NO: 126306 - protein, 16 aa, Mycobacterium tuberculosis
TVRIDVIADDMRPELA

SEQ ID NO: 126307 - protein, 16 aa, Mycobacterium tuberculosis
VRIDVIADDMRPELAA

SEQ ID NO: 126308 - protein, 16 aa, Mycobacterium tuberculosis
RIDVIADDMRPELAAA

SEQ ID NO: 126309 - protein, 16 aa, Mycobacterium tuberculosis
IDVIADDMRPELAAAS

SEQ ID NO: 126310 - protein, 16 aa, Mycobacterium tuberculosis
DVIADDMRPELAAASK

SEQ ID NO: 126311 - protein, 16 aa, Mycobacterium tuberculosis
VIADDMRPELAAASKL

SEQ ID NO: 126312 - protein, 16 aa, Mycobacterium tuberculosis
IADDMRPELAAASKLT

SEQ ID NO: 126313 - protein, 16 aa, Mycobacterium tuberculosis
ADDMRPELAAASKLTE

SEQ ID NO: 126314 - protein, 16 aa, Mycobacterium tuberculosis
DDMRPELAAASKLTES

SEQ ID NO: 126315 - protein, 16 aa, Mycobacterium tuberculosis
DMRPELAAASKLTESL

SEQ ID NO: 126316 - protein, 16 aa, Mycobacterium tuberculosis
MRPELAAASKLTESLR

SEQ ID NO: 126317 - protein, 16 aa, Mycobacterium tuberculosis
RPELAAASKLTESLRL

SEQ ID NO: 126318 - protein, 16 aa, Mycobacterium tuberculosis
PELAAASKLTESLRLY

SEQ ID NO: 126319 - protein, 16 aa, Mycobacterium tuberculosis
ELAAASKLTESLRLYD

SEQ ID NO: 126320 - protein, 16 aa, Mycobacterium tuberculosis
LAAASKLTESLRLYDS

SEQ ID NO: 126321 - protein, 16 aa, Mycobacterium tuberculosis
AAASKLTESLRLYDSS

SEQ ID NO: 126322 - protein, 16 aa, Mycobacterium tuberculosis
AASKLTESLRLYDSSY

SEQ ID NO: 126323 - protein, 16 aa, Mycobacterium tuberculosis
ASKLTESLRLYDSSYH

SEQ ID NO: 126324 - protein, 16 aa, Mycobacterium tuberculosis
SKLTESLRLYDSSYHA

SEQ ID NO: 126325 - protein, 16 aa, Mycobacterium tuberculosis
KLTESLRLYDSSYHAE

SEQ ID NO: 126326 - protein, 16 aa, Mycobacterium tuberculosis
LTESLRLYDSSYHAEL

SEQ ID NO: 126327 - protein, 16 aa, Mycobacterium tuberculosis
TESLRLYDSSYHAELF

SEQ ID NO: 126328 - protein, 16 aa, Mycobacterium tuberculosis
ESLRLYDSSYHAELFW

SEQ ID NO: 126329 - protein, 16 aa, Mycobacterium tuberculosis
SLRLYDSSYHAELFWW

SEQ ID NO: 126330 - protein, 16 aa, Mycobacterium tuberculosis
LRLYDSSYHAELFWWT

SEQ ID NO: 126331 - protein, 16 aa, Mycobacterium tuberculosis
RLYDSSYHAELFWWTG

SEQ ID NO: 126332 - protein, 16 aa, Mycobacterium tuberculosis
LYDSSYHAELFWWTGA

SEQ ID NO: 126333 - protein, 16 aa, Mycobacterium tuberculosis
YDSSYHAELFWWTGAF

SEQ ID NO: 126334 - protein, 16 aa, Mycobacterium tuberculosis
DSSYHAELFWWTGAFE

SEQ ID NO: 126335 - protein, 16 aa, Mycobacterium tuberculosis
SSYHAELFWWTGAFET

SEQ ID NO: 126336 - protein, 16 aa, Mycobacterium tuberculosis
SYHAELFWWTGAFETS

SEQ ID NO: 126337 - protein, 16 aa, Mycobacterium tuberculosis
YHAELFWWTGAFETSE

SEQ ID NO: 126338 - protein, 16 aa, Mycobacterium tuberculosis
HAELFWWTGAFETSEG

SEQ ID NO: 126339 - protein, 16 aa, Mycobacterium tuberculosis
AELFWWTGAFETSEGI

SEQ ID NO: 126340 - protein, 16 aa, Mycobacterium tuberculosis
ELFWWTGAFETSEGIP

SEQ ID NO: 126341 - protein, 16 aa, Mycobacterium tuberculosis
LFWWTGAFETSEGIPH

SEQ ID NO: 126342 - protein, 16 aa, Mycobacterium tuberculosis
FWWTGAFETSEGIPHS

SEQ ID NO: 126343 - protein, 16 aa, Mycobacterium tuberculosis
WWTGAFETSEGIPHSS

SEQ ID NO: 126344 - protein, 16 aa, Mycobacterium tuberculosis
WTGAFETSEGIPHSSL

SEQ ID NO: 126345 - protein, 16 aa, Mycobacterium tuberculosis
TGAFETSEGIPHSSLV

SEQ ID NO: 126346 - protein, 16 aa, Mycobacterium tuberculosis
GAFETSEGIPHSSLVS

SEQ ID NO: 126347 - protein, 16 aa, Mycobacterium tuberculosis
AFETSEGIPHSSLVSA

SEQ ID NO: 126348 - protein, 16 aa, Mycobacterium tuberculosis
FETSEGIPHSSLVSAA

SEQ ID NO: 126349 - protein, 16 aa, Mycobacterium tuberculosis
ETSEGIPHSSLVSAAE

SEQ ID NO: 126350 - protein, 16 aa, Mycobacterium tuberculosis
TSEGIPHSSLVSAAES

SEQ ID NO: 126351 - protein, 16 aa, Mycobacterium tuberculosis
SEGIPHSSLVSAAESD

SEQ ID NO: 126352 - protein, 16 aa, Mycobacterium tuberculosis
EGIPHSSLVSAAESDR

SEQ ID NO: 126353 - protein, 16 aa, Mycobacterium tuberculosis
GIPHSSLVSAAESDRV

SEQ ID NO: 126354 - protein, 16 aa, Mycobacterium tuberculosis
IPHSSLVSAAESDRVT

SEQ ID NO: 126355 - protein, 16 aa, Mycobacterium tuberculosis
PHSSLVSAAESDRVTF

SEQ ID NO: 126356 - protein, 16 aa, Mycobacterium tuberculosis
HSSLVSAAESDRVTFG

SEQ ID NO: 126357 - protein, 16 aa, Mycobacterium tuberculosis
SSLVSAAESDRVTFGR

SEQ ID NO: 126358 - protein, 16 aa, Mycobacterium tuberculosis
SLVSAAESDRVTFGRD

SEQ ID NO: 126359 - protein, 16 aa, Mycobacterium tuberculosis
LVSAAESDRVTFGRDF

SEQ ID NO: 126360 - protein, 16 aa, Mycobacterium tuberculosis
VSAAESDRVTFGRDFP

SEQ ID NO: 126361 - protein, 16 aa, Mycobacterium tuberculosis
SAAESDRVTFGRDFPV

SEQ ID NO: 126362 - protein, 16 aa, Mycobacterium tuberculosis
AAESDRVTFGRDFPVV

SEQ ID NO: 126363 - protein, 16 aa, Mycobacterium tuberculosis
AESDRVTFGRDFPVVA

SEQ ID NO: 126364 - protein, 16 aa, Mycobacterium tuberculosis
ESDRVTFGRDFPVVAN

SEQ ID NO: 126365 - protein, 16 aa, Mycobacterium tuberculosis
SDRVTFGRDFPVVANT

SEQ ID NO: 126366 - protein, 16 aa, Mycobacterium tuberculosis
DRVTFGRDFPVVANTD

SEQ ID NO: 126367 - protein, 16 aa, Mycobacterium tuberculosis
RVTFGRDFPVVANTDR

SEQ ID NO: 126368 - protein, 16 aa, Mycobacterium tuberculosis
VTFGRDFPVVANTDRR

SEQ ID NO: 126369 - protein, 16 aa, Mycobacterium tuberculosis
TFGRDFPVVANTDRRP

SEQ ID NO: 126370 - protein, 16 aa, Mycobacterium tuberculosis
FGRDFPVVANTDRRPE

SEQ ID NO: 126371 - protein, 16 aa, Mycobacterium tuberculosis
GRDFPVVANTDRRPEF

SEQ ID NO: 126372 - protein, 16 aa, Mycobacterium tuberculosis
RDFPVVANTDRRPEFG

SEQ ID NO: 126373 - protein, 16 aa, Mycobacterium tuberculosis
DFPVVANTDRRPEFGH

SEQ ID NO: 126374 - protein, 16 aa, Mycobacterium tuberculosis
FPVVANTDRRPEFGHD

SEQ ID NO: 126375 - protein, 16 aa, Mycobacterium tuberculosis
PVVANTDRRPEFGHDR

SEQ ID NO: 126376 - protein, 16 aa, Mycobacterium tuberculosis
VVANTDRRPEFGHDRS

SEQ ID NO: 126377 - protein, 16 aa, Mycobacterium tuberculosis
VANTDRRPEFGHDRSK

SEQ ID NO: 126378 - protein, 16 aa, Mycobacterium tuberculosis
ANTDRRPEFGHDRSKV

SEQ ID NO: 126379 - protein, 16 aa, Mycobacterium tuberculosis
NTDRRPEFGHDRSKVL

SEQ ID NO: 126380 - protein, 16 aa, Mycobacterium tuberculosis
TDRRPEFGHDRSKVLV

SEQ ID NO: 126381 - protein, 16 aa, Mycobacterium tuberculosis
DRRPEFGHDRSKVLVL

SEQ ID NO: 126382 - protein, 16 aa, Mycobacterium tuberculosis
RRPEFGHDRSKVLVLS

SEQ ID NO: 126383 - protein, 16 aa, Mycobacterium tuberculosis
RPEFGHDRSKVLVLST

SEQ ID NO: 126384 - protein, 16 aa, Mycobacterium tuberculosis
PEFGHDRSKVLVLSTY

SEQ ID NO: 126385 - protein, 16 aa, Mycobacterium tuberculosis
EFGHDRSKVLVLSTYD

SEQ ID NO: 126386 - protein, 16 aa, Mycobacterium tuberculosis
FGHDRSKVLVLSTYDN

SEQ ID NO: 126387 - protein, 16 aa, Mycobacterium tuberculosis
GHDRSKVLVLSTYDNE

SEQ ID NO: 126388 - protein, 16 aa, Mycobacterium tuberculosis
HDRSKVLVLSTYDNER

SEQ ID NO: 126389 - protein, 16 aa, Mycobacterium tuberculosis
DRSKVLVLSTYDNERA

SEQ ID NO: 126390 - protein, 16 aa, Mycobacterium tuberculosis
RSKVLVLSTYDNERAS

SEQ ID NO: 126391 - protein, 16 aa, Mycobacterium tuberculosis
SKVLVLSTYDNERASL

SEQ ID NO: 126392 - protein, 16 aa, Mycobacterium tuberculosis
KVLVLSTYDNERASLL

SEQ ID NO: 126393 - protein, 16 aa, Mycobacterium tuberculosis
VLVLSTYDNERASLLR

SEQ ID NO: 126394 - protein, 16 aa, Mycobacterium tuberculosis
LVLSTYDNERASLLRC

SEQ ID NO: 126395 - protein, 16 aa, Mycobacterium tuberculosis
VLSTYDNERASLLRCG

SEQ ID NO: 126396 - protein, 16 aa, Mycobacterium tuberculosis
LSTYDNERASLLRCGE

SEQ ID NO: 126397 - protein, 16 aa, Mycobacterium tuberculosis
STYDNERASLLRCGEM

SEQ ID NO: 126398 - protein, 16 aa, Mycobacterium tuberculosis
TYDNERASLLRCGEML

SEQ ID NO: 126399 - protein, 16 aa, Mycobacterium tuberculosis
YDNERASLLRCGEMLS

SEQ ID NO: 126400 - protein, 16 aa, Mycobacterium tuberculosis
DNERASLLRCGEMLSA

SEQ ID NO: 126401 - protein, 16 aa, Mycobacterium tuberculosis
NERASLLRCGEMLSAV

SEQ ID NO: 126402 - protein, 16 aa, Mycobacterium tuberculosis
ERASLLRCGEMLSAVL

SEQ ID NO: 126403 - protein, 16 aa, Mycobacterium tuberculosis
RASLLRCGEMLSAVLL

SEQ ID NO: 126404 - protein, 16 aa, Mycobacterium tuberculosis
ASLLRCGEMLSAVLLD

SEQ ID NO: 126405 - protein, 16 aa, Mycobacterium tuberculosis
SLLRCGEMLSAVLLDA

SEQ ID NO: 126406 - protein, 16 aa, Mycobacterium tuberculosis
LLRCGEMLSAVLLDAT

SEQ ID NO: 126407 - protein, 16 aa, Mycobacterium tuberculosis
LRCGEMLSAVLLDATM

SEQ ID NO: 126408 - protein, 16 aa, Mycobacterium tuberculosis
RCGEMLSAVLLDATMA

SEQ ID NO: 126409 - protein, 16 aa, Mycobacterium tuberculosis
CGEMLSAVLLDATMAG

SEQ ID NO: 126410 - protein, 16 aa, Mycobacterium tuberculosis
GEMLSAVLLDATMAGL

SEQ ID NO: 126411 - protein, 16 aa, Mycobacterium tuberculosis
EMLSAVLLDATMAGLA

SEQ ID NO: 126412 - protein, 16 aa, Mycobacterium tuberculosis
MLSAVLLDATMAGLAT

SEQ ID NO: 126413 - protein, 16 aa, Mycobacterium tuberculosis
LSAVLLDATMAGLATC

SEQ ID NO: 126414 - protein, 16 aa, Mycobacterium tuberculosis
SAVLLDATMAGLATCT

SEQ ID NO: 126415 - protein, 16 aa, Mycobacterium tuberculosis
AVLLDATMAGLATCTL

SEQ ID NO: 126416 - protein, 16 aa, Mycobacterium tuberculosis
VLLDATMAGLATCTLT

SEQ ID NO: 126417 - protein, 16 aa, Mycobacterium tuberculosis
LLDATMAGLATCTLTH

SEQ ID NO: 126418 - protein, 16 aa, Mycobacterium tuberculosis
LDATMAGLATCTLTHI

SEQ ID NO: 126419 - protein, 16 aa, Mycobacterium tuberculosis
DATMAGLATCTLTHIT

SEQ ID NO: 126420 - protein, 16 aa, Mycobacterium tuberculosis
ATMAGLATCTLTHITE

SEQ ID NO: 126421 - protein, 16 aa, Mycobacterium tuberculosis
TMAGLATCTLTHITEL

SEQ ID NO: 126422 - protein, 16 aa, Mycobacterium tuberculosis
MAGLATCTLTHITELH

SEQ ID NO: 126423 - protein, 16 aa, Mycobacterium tuberculosis
AGLATCTLTHITELHA

SEQ ID NO: 126424 - protein, 16 aa, Mycobacterium tuberculosis
GLATCTLTHITELHAS

SEQ ID NO: 126425 - protein, 16 aa, Mycobacterium tuberculosis
LATCTLTHITELHASR

SEQ ID NO: 126426 - protein, 16 aa, Mycobacterium tuberculosis
ATCTLTHITELHASRD

SEQ ID NO: 126427 - protein, 16 aa, Mycobacterium tuberculosis
TCTLTHITELHASRDL

SEQ ID NO: 126428 - protein, 16 aa, Mycobacterium tuberculosis
CTLTHITELHASRDLV

SEQ ID NO: 126429 - protein, 16 aa, Mycobacterium tuberculosis
TLTHITELHASRDLVA

SEQ ID NO: 126430 - protein, 16 aa, Mycobacterium tuberculosis
LTHITELHASRDLVAA

SEQ ID NO: 126431 - protein, 16 aa, Mycobacterium tuberculosis
THITELHASRDLVAAL

SEQ ID NO: 126432 - protein, 16 aa, Mycobacterium tuberculosis
HITELHASRDLVAALI

SEQ ID NO: 126433 - protein, 16 aa, Mycobacterium tuberculosis
ITELHASRDLVAALIG

SEQ ID NO: 126434 - protein, 16 aa, Mycobacterium tuberculosis
TELHASRDLVAALIGQ

SEQ ID NO: 126435 - protein, 16 aa, Mycobacterium tuberculosis
ELHASRDLVAALIGQP

SEQ ID NO: 126436 - protein, 16 aa, Mycobacterium tuberculosis
LHASRDLVAALIGQPA

SEQ ID NO: 126437 - protein, 16 aa, Mycobacterium tuberculosis
HASRDLVAALIGQPAT

SEQ ID NO: 126438 - protein, 16 aa, Mycobacterium tuberculosis
ASRDLVAALIGQPATP

SEQ ID NO: 126439 - protein, 16 aa, Mycobacterium tuberculosis
SRDLVAALIGQPATPQ

SEQ ID NO: 126440 - protein, 16 aa, Mycobacterium tuberculosis
RDLVAALIGQPATPQA

SEQ ID NO: 126441 - protein, 16 aa, Mycobacterium tuberculosis
DLVAALIGQPATPQAL

SEQ ID NO: 126442 - protein, 16 aa, Mycobacterium tuberculosis
LVAALIGQPATPQALV

SEQ ID NO: 126443 - protein, 16 aa, Mycobacterium tuberculosis
VAALIGQPATPQALVR

SEQ ID NO: 126444 - protein, 16 aa, Mycobacterium tuberculosis
AALIGQPATPQALVRV

SEQ ID NO: 126445 - protein, 16 aa, Mycobacterium tuberculosis
ALIGQPATPQALVRVG

SEQ ID NO: 126446 - protein, 16 aa, Mycobacterium tuberculosis
LIGQPATPQALVRVGL

SEQ ID NO: 126447 - protein, 16 aa, Mycobacterium tuberculosis
IGQPATPQALVRVGLA

SEQ ID NO: 126448 - protein, 16 aa, Mycobacterium tuberculosis
GQPATPQALVRVGLAP

SEQ ID NO: 126449 - protein, 16 aa, Mycobacterium tuberculosis
QPATPQALVRVGLAPE

SEQ ID NO: 126450 - protein, 16 aa, Mycobacterium tuberculosis
PATPQALVRVGLAPEM

SEQ ID NO: 126451 - protein, 16 aa, Mycobacterium tuberculosis
ATPQALVRVGLAPEME

SEQ ID NO: 126452 - protein, 16 aa, Mycobacterium tuberculosis
TPQALVRVGLAPEMEE

SEQ ID NO: 126453 - protein, 16 aa, Mycobacterium tuberculosis
PQALVRVGLAPEMEEP

SEQ ID NO: 126454 - protein, 16 aa, Mycobacterium tuberculosis
QALVRVGLAPEMEEPP

SEQ ID NO: 126455 - protein, 16 aa, Mycobacterium tuberculosis
ALVRVGLAPEMEEPPP

SEQ ID NO: 126456 - protein, 16 aa, Mycobacterium tuberculosis
LVRVGLAPEMEEPPPA

SEQ ID NO: 126457 - protein, 16 aa, Mycobacterium tuberculosis
VRVGLAPEMEEPPPAT

SEQ ID NO: 126458 - protein, 16 aa, Mycobacterium tuberculosis
RVGLAPEMEEPPPATP

SEQ ID NO: 126459 - protein, 16 aa, Mycobacterium tuberculosis
VGLAPEMEEPPPATPR

SEQ ID NO: 126460 - protein, 16 aa, Mycobacterium tuberculosis
GLAPEMEEPPPATPRR

SEQ ID NO: 126461 - protein, 16 aa, Mycobacterium tuberculosis
LAPEMEEPPPATPRRP

SEQ ID NO: 126462 - protein, 16 aa, Mycobacterium tuberculosis
APEMEEPPPATPRRPI

SEQ ID NO: 126463 - protein, 16 aa, Mycobacterium tuberculosis
PEMEEPPPATPRRPID

SEQ ID NO: 126464 - protein, 16 aa, Mycobacterium tuberculosis
EMEEPPPATPRRPIDE

SEQ ID NO: 126465 - protein, 16 aa, Mycobacterium tuberculosis
MEEPPPATPRRPIDEV

SEQ ID NO: 126466 - protein, 16 aa, Mycobacterium tuberculosis
EEPPPATPRRPIDEVF

SEQ ID NO: 126467 - protein, 16 aa, Mycobacterium tuberculosis
EPPPATPRRPIDEVFH

SEQ ID NO: 126468 - protein, 16 aa, Mycobacterium tuberculosis
PPPATPRRPIDEVFHV

SEQ ID NO: 126469 - protein, 16 aa, Mycobacterium tuberculosis
PPATPRRPIDEVFHVR

SEQ ID NO: 126470 - protein, 16 aa, Mycobacterium tuberculosis
PATPRRPIDEVFHVRA

SEQ ID NO: 126471 - protein, 16 aa, Mycobacterium tuberculosis
ATPRRPIDEVFHVRAK

SEQ ID NO: 126472 - protein, 16 aa, Mycobacterium tuberculosis
TPRRPIDEVFHVRAKD

SEQ ID NO: 126473 - protein, 16 aa, Mycobacterium tuberculosis
PRRPIDEVFHVRAKDH

SEQ ID NO: 126474 - protein, 16 aa, Mycobacterium tuberculosis
RRPIDEVFHVRAKDHR

SEQ ID NO: 126475 - protein, 143 aa, Mycobacterium tuberculosis
MTTARDIMNAGVTCVGEHETLTAAAQYMREHDIGALPICGDDDRLHGMLTDRDIVIKGLAAGLDPNTATAGELARDSIYYVDANASIQEMLNVMEEHQVRRVPVISEHRLVGIVTEADIARHLPEHAIVQFVKAICSPMALAS

SEQ ID NO: 126476 - protein, 8 aa, Mycobacterium tuberculosis
IMNAGVTC

SEQ ID NO: 126477 - protein, 8 aa, Mycobacterium tuberculosis
MNAGVTCV

SEQ ID NO: 126478 - protein, 8 aa, Mycobacterium tuberculosis
CVGEHETL

SEQ ID NO: 126479 - protein, 8 aa, Mycobacterium tuberculosis
TLTAAAQY

SEQ ID NO: 126480 - protein, 8 aa, Mycobacterium tuberculosis
LTAAAQYM

SEQ ID NO: 126481 - protein, 8 aa, Mycobacterium tuberculosis
TAAAQYMR

SEQ ID NO: 126482 - protein, 8 aa, Mycobacterium tuberculosis
QYMREHDI

SEQ ID NO: 126483 - protein, 8 aa, Mycobacterium tuberculosis
REHDIGAL

SEQ ID NO: 126484 - protein, 8 aa, Mycobacterium tuberculosis
MLTDRDIV

SEQ ID NO: 126485 - protein, 8 aa, Mycobacterium tuberculosis
IVIKGLAA

SEQ ID NO: 126486 - protein, 8 aa, Mycobacterium tuberculosis
GLDPNTAT

SEQ ID NO: 126487 - protein, 8 aa, Mycobacterium tuberculosis
DPNTATAG

SEQ ID NO: 126488 - protein, 8 aa, Mycobacterium tuberculosis
NTATAGEL

SEQ ID NO: 126489 - protein, 8 aa, Mycobacterium tuberculosis
ATAGELAR

SEQ ID NO: 126490 - protein, 8 aa, Mycobacterium tuberculosis
ELARDSIY

SEQ ID NO: 126491 - protein, 8 aa, Mycobacterium tuberculosis
LARDSIYY

SEQ ID NO: 126492 - protein, 8 aa, Mycobacterium tuberculosis
ARDSIYYV

SEQ ID NO: 126493 - protein, 8 aa, Mycobacterium tuberculosis
YVDANASI

SEQ ID NO: 126494 - protein, 8 aa, Mycobacterium tuberculosis
SIQEMLNV

SEQ ID NO: 126495 - protein, 8 aa, Mycobacterium tuberculosis
NVMEEHQV

SEQ ID NO: 126496 - protein, 8 aa, Mycobacterium tuberculosis
VMEEHQVR

SEQ ID NO: 126497 - protein, 8 aa, Mycobacterium tuberculosis
EEHQVRRV

SEQ ID NO: 126498 - protein, 8 aa, Mycobacterium tuberculosis
HQVRRVPV

SEQ ID NO: 126499 - protein, 8 aa, Mycobacterium tuberculosis
VPVISEHR

SEQ ID NO: 126500 - protein, 8 aa, Mycobacterium tuberculosis
VISEHRLV

SEQ ID NO: 126501 - protein, 8 aa, Mycobacterium tuberculosis
SEHRLVGI

SEQ ID NO: 126502 - protein, 8 aa, Mycobacterium tuberculosis
RLVGIVTE

SEQ ID NO: 126503 - protein, 8 aa, Mycobacterium tuberculosis
VTEADIAR

SEQ ID NO: 126504 - protein, 8 aa, Mycobacterium tuberculosis
DIARHLPE

SEQ ID NO: 126505 - protein, 8 aa, Mycobacterium tuberculosis
HLPEHAIV

SEQ ID NO: 126506 - protein, 8 aa, Mycobacterium tuberculosis
EHAIVQFV

SEQ ID NO: 126507 - protein, 8 aa, Mycobacterium tuberculosis
HAIVQFVK

SEQ ID NO: 126508 - protein, 8 aa, Mycobacterium tuberculosis
AIVQFVKA

SEQ ID NO: 126509 - protein, 8 aa, Mycobacterium tuberculosis
KAICSPMA

SEQ ID NO: 126510 - protein, 8 aa, Mycobacterium tuberculosis
AICSPMAL

SEQ ID NO: 126511 - protein, 9 aa, Mycobacterium tuberculosis
TTARDIMNA

SEQ ID NO: 126512 - protein, 9 aa, Mycobacterium tuberculosis
IMNAGVTCV

SEQ ID NO: 126513 - protein, 9 aa, Mycobacterium tuberculosis
GEHETLTAA

SEQ ID NO: 126514 - protein, 9 aa, Mycobacterium tuberculosis
ETLTAAAQY

SEQ ID NO: 126515 - protein, 9 aa, Mycobacterium tuberculosis
TLTAAAQYM

SEQ ID NO: 126516 - protein, 9 aa, Mycobacterium tuberculosis
LTAAAQYMR

SEQ ID NO: 126517 - protein, 9 aa, Mycobacterium tuberculosis
YMREHDIGA

SEQ ID NO: 126518 - protein, 9 aa, Mycobacterium tuberculosis
RLHGMLTDR

SEQ ID NO: 126519 - protein, 9 aa, Mycobacterium tuberculosis
GMLTDRDIV

SEQ ID NO: 126520 - protein, 9 aa, Mycobacterium tuberculosis
MLTDRDIVI

SEQ ID NO: 126521 - protein, 9 aa, Mycobacterium tuberculosis
LTDRDIVIK

SEQ ID NO: 126522 - protein, 9 aa, Mycobacterium tuberculosis
VIKGLAAGL

SEQ ID NO: 126523 - protein, 9 aa, Mycobacterium tuberculosis
GLDPNTATA

SEQ ID NO: 126524 - protein, 9 aa, Mycobacterium tuberculosis
NTATAGELA

SEQ ID NO: 126525 - protein, 9 aa, Mycobacterium tuberculosis
TATAGELAR

SEQ ID NO: 126526 - protein, 9 aa, Mycobacterium tuberculosis
ELARDSIYY

SEQ ID NO: 126527 - protein, 9 aa, Mycobacterium tuberculosis
LARDSIYYV

SEQ ID NO: 126528 - protein, 9 aa, Mycobacterium tuberculosis
SIYYVDANA

SEQ ID NO: 126529 - protein, 9 aa, Mycobacterium tuberculosis
YYVDANASI

SEQ ID NO: 126530 - protein, 9 aa, Mycobacterium tuberculosis
DANASIQEM

SEQ ID NO: 126531 - protein, 9 aa, Mycobacterium tuberculosis
ANASIQEML

SEQ ID NO: 126532 - protein, 9 aa, Mycobacterium tuberculosis
SIQEMLNVM

SEQ ID NO: 126533 - protein, 9 aa, Mycobacterium tuberculosis
NVMEEHQVR

SEQ ID NO: 126534 - protein, 9 aa, Mycobacterium tuberculosis
VMEEHQVRR

SEQ ID NO: 126535 - protein, 9 aa, Mycobacterium tuberculosis
HQVRRVPVI

SEQ ID NO: 126536 - protein, 9 aa, Mycobacterium tuberculosis
RRVPVISEH

SEQ ID NO: 126537 - protein, 9 aa, Mycobacterium tuberculosis
RVPVISEHR

SEQ ID NO: 126538 - protein, 9 aa, Mycobacterium tuberculosis
VPVISEHRL

SEQ ID NO: 126539 - protein, 9 aa, Mycobacterium tuberculosis
SEHRLVGIV

SEQ ID NO: 126540 - protein, 9 aa, Mycobacterium tuberculosis
RLVGIVTEA

SEQ ID NO: 126541 - protein, 9 aa, Mycobacterium tuberculosis
IVTEADIAR

SEQ ID NO: 126542 - protein, 9 aa, Mycobacterium tuberculosis
TEADIARHL

SEQ ID NO: 126543 - protein, 9 aa, Mycobacterium tuberculosis
DIARHLPEH

SEQ ID NO: 126544 - protein, 9 aa, Mycobacterium tuberculosis
HLPEHAIVQ

SEQ ID NO: 126545 - protein, 9 aa, Mycobacterium tuberculosis
LPEHAIVQF

SEQ ID NO: 126546 - protein, 9 aa, Mycobacterium tuberculosis
EHAIVQFVK

SEQ ID NO: 126547 - protein, 9 aa, Mycobacterium tuberculosis
HAIVQFVKA

SEQ ID NO: 126548 - protein, 9 aa, Mycobacterium tuberculosis
AIVQFVKAI

SEQ ID NO: 126549 - protein, 9 aa, Mycobacterium tuberculosis
FVKAICSPM

SEQ ID NO: 126550 - protein, 9 aa, Mycobacterium tuberculosis
KAICSPMAL

SEQ ID NO: 126551 - protein, 10 aa, Mycobacterium tuberculosis
MTTARDIMNA

SEQ ID NO: 126552 - protein, 10 aa, Mycobacterium tuberculosis
TARDIMNAGV

SEQ ID NO: 126553 - protein, 10 aa, Mycobacterium tuberculosis
DIMNAGVTCV

SEQ ID NO: 126554 - protein, 10 aa, Mycobacterium tuberculosis
HETLTAAAQY

SEQ ID NO: 126555 - protein, 10 aa, Mycobacterium tuberculosis
ETLTAAAQYM

SEQ ID NO: 126556 - protein, 10 aa, Mycobacterium tuberculosis
TLTAAAQYMR

SEQ ID NO: 126557 - protein, 10 aa, Mycobacterium tuberculosis
YMREHDIGAL

SEQ ID NO: 126558 - protein, 10 aa, Mycobacterium tuberculosis
REHDIGALPI

SEQ ID NO: 126559 - protein, 10 aa, Mycobacterium tuberculosis
LPICGDDDRL

SEQ ID NO: 126560 - protein, 10 aa, Mycobacterium tuberculosis
GMLTDRDIVI

SEQ ID NO: 126561 - protein, 10 aa, Mycobacterium tuberculosis
MLTDRDIVIK

SEQ ID NO: 126562 - protein, 10 aa, Mycobacterium tuberculosis
IVIKGLAAGL

SEQ ID NO: 126563 - protein, 10 aa, Mycobacterium tuberculosis
GLAAGLDPNT

SEQ ID NO: 126564 - protein, 10 aa, Mycobacterium tuberculosis
GLDPNTATAG

SEQ ID NO: 126565 - protein, 10 aa, Mycobacterium tuberculosis
DPNTATAGEL

SEQ ID NO: 126566 - protein, 10 aa, Mycobacterium tuberculosis
NTATAGELAR

SEQ ID NO: 126567 - protein, 10 aa, Mycobacterium tuberculosis
GELARDSIYY

SEQ ID NO: 126568 - protein, 10 aa, Mycobacterium tuberculosis
ELARDSIYYV

SEQ ID NO: 126569 - protein, 10 aa, Mycobacterium tuberculosis
DSIYYVDANA

SEQ ID NO: 126570 - protein, 10 aa, Mycobacterium tuberculosis
IYYVDANASI

SEQ ID NO: 126571 - protein, 10 aa, Mycobacterium tuberculosis
DANASIQEML

SEQ ID NO: 126572 - protein, 10 aa, Mycobacterium tuberculosis
NASIQEMLNV

SEQ ID NO: 126573 - protein, 10 aa, Mycobacterium tuberculosis
ASIQEMLNVM

SEQ ID NO: 126574 - protein, 10 aa, Mycobacterium tuberculosis
MLNVMEEHQV

SEQ ID NO: 126575 - protein, 10 aa, Mycobacterium tuberculosis
NVMEEHQVRR

SEQ ID NO: 126576 - protein, 10 aa, Mycobacterium tuberculosis
VMEEHQVRRV

SEQ ID NO: 126577 - protein, 10 aa, Mycobacterium tuberculosis
EEHQVRRVPV

SEQ ID NO: 126578 - protein, 10 aa, Mycobacterium tuberculosis
RRVPVISEHR

SEQ ID NO: 126579 - protein, 10 aa, Mycobacterium tuberculosis
RVPVISEHRL

SEQ ID NO: 126580 - protein, 10 aa, Mycobacterium tuberculosis
VPVISEHRLV

SEQ ID NO: 126581 - protein, 10 aa, Mycobacterium tuberculosis
VISEHRLVGI

SEQ ID NO: 126582 - protein, 10 aa, Mycobacterium tuberculosis
IARHLPEHAI

SEQ ID NO: 126583 - protein, 10 aa, Mycobacterium tuberculosis
HLPEHAIVQF

SEQ ID NO: 126584 - protein, 10 aa, Mycobacterium tuberculosis
LPEHAIVQFV

SEQ ID NO: 126585 - protein, 10 aa, Mycobacterium tuberculosis
HAIVQFVKAI

SEQ ID NO: 126586 - protein, 10 aa, Mycobacterium tuberculosis
FVKAICSPMA

SEQ ID NO: 126587 - protein, 10 aa, Mycobacterium tuberculosis
KAICSPMALA

SEQ ID NO: 126588 - protein, 11 aa, Mycobacterium tuberculosis
TTARDIMNAGV

SEQ ID NO: 126589 - protein, 11 aa, Mycobacterium tuberculosis
CVGEHETLTAA

SEQ ID NO: 126590 - protein, 11 aa, Mycobacterium tuberculosis
ETLTAAAQYMR

SEQ ID NO: 126591 - protein, 11 aa, Mycobacterium tuberculosis
AQYMREHDIGA

SEQ ID NO: 126592 - protein, 11 aa, Mycobacterium tuberculosis
QYMREHDIGAL

SEQ ID NO: 126593 - protein, 11 aa, Mycobacterium tuberculosis
YMREHDIGALP

SEQ ID NO: 126594 - protein, 11 aa, Mycobacterium tuberculosis
ALPICGDDDRL

SEQ ID NO: 126595 - protein, 11 aa, Mycobacterium tuberculosis
LPICGDDDRLH

SEQ ID NO: 126596 - protein, 11 aa, Mycobacterium tuberculosis
RLHGMLTDRDI

SEQ ID NO: 126597 - protein, 11 aa, Mycobacterium tuberculosis
GMLTDRDIVIK

SEQ ID NO: 126598 - protein, 11 aa, Mycobacterium tuberculosis
MLTDRDIVIKG

SEQ ID NO: 126599 - protein, 11 aa, Mycobacterium tuberculosis
DIVIKGLAAGL

SEQ ID NO: 126600 - protein, 11 aa, Mycobacterium tuberculosis
GLAAGLDPNTA

SEQ ID NO: 126601 - protein, 11 aa, Mycobacterium tuberculosis
LAAGLDPNTAT

SEQ ID NO: 126602 - protein, 11 aa, Mycobacterium tuberculosis
GLDPNTATAGE

SEQ ID NO: 126603 - protein, 11 aa, Mycobacterium tuberculosis
DPNTATAGELA

SEQ ID NO: 126604 - protein, 11 aa, Mycobacterium tuberculosis
ATAGELARDSI

SEQ ID NO: 126605 - protein, 11 aa, Mycobacterium tuberculosis
TAGELARDSIY

SEQ ID NO: 126606 - protein, 11 aa, Mycobacterium tuberculosis
GELARDSIYYV

SEQ ID NO: 126607 - protein, 11 aa, Mycobacterium tuberculosis
SIYYVDANASI

SEQ ID NO: 126608 - protein, 11 aa, Mycobacterium tuberculosis
YVDANASIQEM

SEQ ID NO: 126609 - protein, 11 aa, Mycobacterium tuberculosis
NASIQEMLNVM

SEQ ID NO: 126610 - protein, 11 aa, Mycobacterium tuberculosis
EMLNVMEEHQV

SEQ ID NO: 126611 - protein, 11 aa, Mycobacterium tuberculosis
MLNVMEEHQVR

SEQ ID NO: 126612 - protein, 11 aa, Mycobacterium tuberculosis
NVMEEHQVRRV

SEQ ID NO: 126613 - protein, 11 aa, Mycobacterium tuberculosis
MEEHQVRRVPV

SEQ ID NO: 126614 - protein, 11 aa, Mycobacterium tuberculosis
EEHQVRRVPVI

SEQ ID NO: 126615 - protein, 11 aa, Mycobacterium tuberculosis
RRVPVISEHRL

SEQ ID NO: 126616 - protein, 11 aa, Mycobacterium tuberculosis
RVPVISEHRLV

SEQ ID NO: 126617 - protein, 11 aa, Mycobacterium tuberculosis
VISEHRLVGIV

SEQ ID NO: 126618 - protein, 11 aa, Mycobacterium tuberculosis
RLVGIVTEADI

SEQ ID NO: 126619 - protein, 11 aa, Mycobacterium tuberculosis
IVTEADIARHL

SEQ ID NO: 126620 - protein, 11 aa, Mycobacterium tuberculosis
DIARHLPEHAI

SEQ ID NO: 126621 - protein, 11 aa, Mycobacterium tuberculosis
RHLPEHAIVQF

SEQ ID NO: 126622 - protein, 11 aa, Mycobacterium tuberculosis
HLPEHAIVQFV

SEQ ID NO: 126623 - protein, 11 aa, Mycobacterium tuberculosis
VQFVKAICSPM

SEQ ID NO: 126624 - protein, 11 aa, Mycobacterium tuberculosis
FVKAICSPMAL

SEQ ID NO: 126625 - protein, 13 aa, Mycobacterium tuberculosis
MTTARDIMNAGVT

SEQ ID NO: 126626 - protein, 13 aa, Mycobacterium tuberculosis
TTARDIMNAGVTC

SEQ ID NO: 126627 - protein, 13 aa, Mycobacterium tuberculosis
TARDIMNAGVTCV

SEQ ID NO: 126628 - protein, 13 aa, Mycobacterium tuberculosis
ARDIMNAGVTCVG

SEQ ID NO: 126629 - protein, 13 aa, Mycobacterium tuberculosis
RDIMNAGVTCVGE

SEQ ID NO: 126630 - protein, 13 aa, Mycobacterium tuberculosis
DIMNAGVTCVGEH

SEQ ID NO: 126631 - protein, 13 aa, Mycobacterium tuberculosis
IMNAGVTCVGEHE

SEQ ID NO: 126632 - protein, 13 aa, Mycobacterium tuberculosis
MNAGVTCVGEHET

SEQ ID NO: 126633 - protein, 13 aa, Mycobacterium tuberculosis
NAGVTCVGEHETL

SEQ ID NO: 126634 - protein, 13 aa, Mycobacterium tuberculosis
AGVTCVGEHETLT

SEQ ID NO: 126635 - protein, 13 aa, Mycobacterium tuberculosis
GVTCVGEHETLTA

SEQ ID NO: 126636 - protein, 13 aa, Mycobacterium tuberculosis
VTCVGEHETLTAA

SEQ ID NO: 126637 - protein, 13 aa, Mycobacterium tuberculosis
TCVGEHETLTAAA

SEQ ID NO: 126638 - protein, 13 aa, Mycobacterium tuberculosis
CVGEHETLTAAAQ

SEQ ID NO: 126639 - protein, 13 aa, Mycobacterium tuberculosis
VGEHETLTAAAQY

SEQ ID NO: 126640 - protein, 13 aa, Mycobacterium tuberculosis
GEHETLTAAAQYM

SEQ ID NO: 126641 - protein, 13 aa, Mycobacterium tuberculosis
EHETLTAAAQYMR

SEQ ID NO: 126642 - protein, 13 aa, Mycobacterium tuberculosis
HETLTAAAQYMRE

SEQ ID NO: 126643 - protein, 13 aa, Mycobacterium tuberculosis
ETLTAAAQYMREH

SEQ ID NO: 126644 - protein, 13 aa, Mycobacterium tuberculosis
TLTAAAQYMREHD

SEQ ID NO: 126645 - protein, 13 aa, Mycobacterium tuberculosis
LTAAAQYMREHDI

SEQ ID NO: 126646 - protein, 13 aa, Mycobacterium tuberculosis
TAAAQYMREHDIG

SEQ ID NO: 126647 - protein, 13 aa, Mycobacterium tuberculosis
AAAQYMREHDIGA

SEQ ID NO: 126648 - protein, 13 aa, Mycobacterium tuberculosis
AAQYMREHDIGAL

SEQ ID NO: 126649 - protein, 13 aa, Mycobacterium tuberculosis
AQYMREHDIGALP

SEQ ID NO: 126650 - protein, 13 aa, Mycobacterium tuberculosis
QYMREHDIGALPI

SEQ ID NO: 126651 - protein, 13 aa, Mycobacterium tuberculosis
YMREHDIGALPIC

SEQ ID NO: 126652 - protein, 13 aa, Mycobacterium tuberculosis
MREHDIGALPICG

SEQ ID NO: 126653 - protein, 13 aa, Mycobacterium tuberculosis
REHDIGALPICGD

SEQ ID NO: 126654 - protein, 13 aa, Mycobacterium tuberculosis
EHDIGALPICGDD

SEQ ID NO: 126655 - protein, 13 aa, Mycobacterium tuberculosis
HDIGALPICGDDD

SEQ ID NO: 126656 - protein, 13 aa, Mycobacterium tuberculosis
DIGALPICGDDDR

SEQ ID NO: 126657 - protein, 13 aa, Mycobacterium tuberculosis
IGALPICGDDDRL

SEQ ID NO: 126658 - protein, 13 aa, Mycobacterium tuberculosis
GALPICGDDDRLH

SEQ ID NO: 126659 - protein, 13 aa, Mycobacterium tuberculosis
ALPICGDDDRLHG

SEQ ID NO: 126660 - protein, 13 aa, Mycobacterium tuberculosis
LPICGDDDRLHGM

SEQ ID NO: 126661 - protein, 13 aa, Mycobacterium tuberculosis
PICGDDDRLHGML

SEQ ID NO: 126662 - protein, 13 aa, Mycobacterium tuberculosis
ICGDDDRLHGMLT

SEQ ID NO: 126663 - protein, 13 aa, Mycobacterium tuberculosis
CGDDDRLHGMLTD

SEQ ID NO: 126664 - protein, 13 aa, Mycobacterium tuberculosis
GDDDRLHGMLTDR

SEQ ID NO: 126665 - protein, 13 aa, Mycobacterium tuberculosis
DDDRLHGMLTDRD

SEQ ID NO: 126666 - protein, 13 aa, Mycobacterium tuberculosis
DDRLHGMLTDRDI

SEQ ID NO: 126667 - protein, 13 aa, Mycobacterium tuberculosis
DRLHGMLTDRDIV

SEQ ID NO: 126668 - protein, 13 aa, Mycobacterium tuberculosis
RLHGMLTDRDIVI

SEQ ID NO: 126669 - protein, 13 aa, Mycobacterium tuberculosis
LHGMLTDRDIVIK

SEQ ID NO: 126670 - protein, 13 aa, Mycobacterium tuberculosis
HGMLTDRDIVIKG

SEQ ID NO: 126671 - protein, 13 aa, Mycobacterium tuberculosis
GMLTDRDIVIKGL

SEQ ID NO: 126672 - protein, 13 aa, Mycobacterium tuberculosis
MLTDRDIVIKGLA

SEQ ID NO: 126673 - protein, 13 aa, Mycobacterium tuberculosis
LTDRDIVIKGLAA

SEQ ID NO: 126674 - protein, 13 aa, Mycobacterium tuberculosis
TDRDIVIKGLAAG

SEQ ID NO: 126675 - protein, 13 aa, Mycobacterium tuberculosis
DRDIVIKGLAAGL

SEQ ID NO: 126676 - protein, 13 aa, Mycobacterium tuberculosis
RDIVIKGLAAGLD

SEQ ID NO: 126677 - protein, 13 aa, Mycobacterium tuberculosis
DIVIKGLAAGLDP

SEQ ID NO: 126678 - protein, 13 aa, Mycobacterium tuberculosis
IVIKGLAAGLDPN

SEQ ID NO: 126679 - protein, 13 aa, Mycobacterium tuberculosis
VIKGLAAGLDPNT

SEQ ID NO: 126680 - protein, 13 aa, Mycobacterium tuberculosis
IKGLAAGLDPNTA

SEQ ID NO: 126681 - protein, 13 aa, Mycobacterium tuberculosis
KGLAAGLDPNTAT

SEQ ID NO: 126682 - protein, 13 aa, Mycobacterium tuberculosis
GLAAGLDPNTATA

SEQ ID NO: 126683 - protein, 13 aa, Mycobacterium tuberculosis
LAAGLDPNTATAG

SEQ ID NO: 126684 - protein, 13 aa, Mycobacterium tuberculosis
AAGLDPNTATAGE

SEQ ID NO: 126685 - protein, 13 aa, Mycobacterium tuberculosis
AGLDPNTATAGEL

SEQ ID NO: 126686 - protein, 13 aa, Mycobacterium tuberculosis
GLDPNTATAGELA

SEQ ID NO: 126687 - protein, 13 aa, Mycobacterium tuberculosis
LDPNTATAGELAR

SEQ ID NO: 126688 - protein, 13 aa, Mycobacterium tuberculosis
DPNTATAGELARD

SEQ ID NO: 126689 - protein, 13 aa, Mycobacterium tuberculosis
PNTATAGELARDS

SEQ ID NO: 126690 - protein, 13 aa, Mycobacterium tuberculosis
NTATAGELARDSI

SEQ ID NO: 126691 - protein, 13 aa, Mycobacterium tuberculosis
TATAGELARDSIY

SEQ ID NO: 126692 - protein, 13 aa, Mycobacterium tuberculosis
ATAGELARDSIYY

SEQ ID NO: 126693 - protein, 13 aa, Mycobacterium tuberculosis
TAGELARDSIYYV

SEQ ID NO: 126694 - protein, 13 aa, Mycobacterium tuberculosis
AGELARDSIYYVD

SEQ ID NO: 126695 - protein, 13 aa, Mycobacterium tuberculosis
GELARDSIYYVDA

SEQ ID NO: 126696 - protein, 13 aa, Mycobacterium tuberculosis
ELARDSIYYVDAN

SEQ ID NO: 126697 - protein, 13 aa, Mycobacterium tuberculosis
LARDSIYYVDANA

SEQ ID NO: 126698 - protein, 13 aa, Mycobacterium tuberculosis
ARDSIYYVDANAS

SEQ ID NO: 126699 - protein, 13 aa, Mycobacterium tuberculosis
RDSIYYVDANASI

SEQ ID NO: 126700 - protein, 13 aa, Mycobacterium tuberculosis
DSIYYVDANASIQ

SEQ ID NO: 126701 - protein, 13 aa, Mycobacterium tuberculosis
SIYYVDANASIQE

SEQ ID NO: 126702 - protein, 13 aa, Mycobacterium tuberculosis
IYYVDANASIQEM

SEQ ID NO: 126703 - protein, 13 aa, Mycobacterium tuberculosis
YYVDANASIQEML

SEQ ID NO: 126704 - protein, 13 aa, Mycobacterium tuberculosis
YVDANASIQEMLN

SEQ ID NO: 126705 - protein, 13 aa, Mycobacterium tuberculosis
VDANASIQEMLNV

SEQ ID NO: 126706 - protein, 13 aa, Mycobacterium tuberculosis
DANASIQEMLNVM

SEQ ID NO: 126707 - protein, 13 aa, Mycobacterium tuberculosis
ANASIQEMLNVME

SEQ ID NO: 126708 - protein, 13 aa, Mycobacterium tuberculosis
NASIQEMLNVMEE

SEQ ID NO: 126709 - protein, 13 aa, Mycobacterium tuberculosis
ASIQEMLNVMEEH

SEQ ID NO: 126710 - protein, 13 aa, Mycobacterium tuberculosis
SIQEMLNVMEEHQ

SEQ ID NO: 126711 - protein, 13 aa, Mycobacterium tuberculosis
IQEMLNVMEEHQV

SEQ ID NO: 126712 - protein, 13 aa, Mycobacterium tuberculosis
QEMLNVMEEHQVR

SEQ ID NO: 126713 - protein, 13 aa, Mycobacterium tuberculosis
EMLNVMEEHQVRR

SEQ ID NO: 126714 - protein, 13 aa, Mycobacterium tuberculosis
MLNVMEEHQVRRV

SEQ ID NO: 126715 - protein, 13 aa, Mycobacterium tuberculosis
LNVMEEHQVRRVP

SEQ ID NO: 126716 - protein, 13 aa, Mycobacterium tuberculosis
NVMEEHQVRRVPV

SEQ ID NO: 126717 - protein, 13 aa, Mycobacterium tuberculosis
VMEEHQVRRVPVI

SEQ ID NO: 126718 - protein, 13 aa, Mycobacterium tuberculosis
MEEHQVRRVPVIS

SEQ ID NO: 126719 - protein, 13 aa, Mycobacterium tuberculosis
EEHQVRRVPVISE

SEQ ID NO: 126720 - protein, 13 aa, Mycobacterium tuberculosis
EHQVRRVPVISEH

SEQ ID NO: 126721 - protein, 13 aa, Mycobacterium tuberculosis
HQVRRVPVISEHR

SEQ ID NO: 126722 - protein, 13 aa, Mycobacterium tuberculosis
QVRRVPVISEHRL

SEQ ID NO: 126723 - protein, 13 aa, Mycobacterium tuberculosis
VRRVPVISEHRLV

SEQ ID NO: 126724 - protein, 13 aa, Mycobacterium tuberculosis
RRVPVISEHRLVG

SEQ ID NO: 126725 - protein, 13 aa, Mycobacterium tuberculosis
RVPVISEHRLVGI

SEQ ID NO: 126726 - protein, 13 aa, Mycobacterium tuberculosis
VPVISEHRLVGIV

SEQ ID NO: 126727 - protein, 13 aa, Mycobacterium tuberculosis
PVISEHRLVGIVT

SEQ ID NO: 126728 - protein, 13 aa, Mycobacterium tuberculosis
VISEHRLVGIVTE

SEQ ID NO: 126729 - protein, 13 aa, Mycobacterium tuberculosis
ISEHRLVGIVTEA

SEQ ID NO: 126730 - protein, 13 aa, Mycobacterium tuberculosis
SEHRLVGIVTEAD

SEQ ID NO: 126731 - protein, 13 aa, Mycobacterium tuberculosis
EHRLVGIVTEADI

SEQ ID NO: 126732 - protein, 13 aa, Mycobacterium tuberculosis
HRLVGIVTEADIA

SEQ ID NO: 126733 - protein, 13 aa, Mycobacterium tuberculosis
RLVGIVTEADIAR

SEQ ID NO: 126734 - protein, 13 aa, Mycobacterium tuberculosis
LVGIVTEADIARH

SEQ ID NO: 126735 - protein, 13 aa, Mycobacterium tuberculosis
VGIVTEADIARHL

SEQ ID NO: 126736 - protein, 13 aa, Mycobacterium tuberculosis
GIVTEADIARHLP

SEQ ID NO: 126737 - protein, 13 aa, Mycobacterium tuberculosis
IVTEADIARHLPE

SEQ ID NO: 126738 - protein, 13 aa, Mycobacterium tuberculosis
VTEADIARHLPEH

SEQ ID NO: 126739 - protein, 13 aa, Mycobacterium tuberculosis
TEADIARHLPEHA

SEQ ID NO: 126740 - protein, 13 aa, Mycobacterium tuberculosis
EADIARHLPEHAI

SEQ ID NO: 126741 - protein, 13 aa, Mycobacterium tuberculosis
ADIARHLPEHAIV

SEQ ID NO: 126742 - protein, 13 aa, Mycobacterium tuberculosis
DIARHLPEHAIVQ

SEQ ID NO: 126743 - protein, 13 aa, Mycobacterium tuberculosis
IARHLPEHAIVQF

SEQ ID NO: 126744 - protein, 13 aa, Mycobacterium tuberculosis
ARHLPEHAIVQFV

SEQ ID NO: 126745 - protein, 13 aa, Mycobacterium tuberculosis
RHLPEHAIVQFVK

SEQ ID NO: 126746 - protein, 13 aa, Mycobacterium tuberculosis
HLPEHAIVQFVKA

SEQ ID NO: 126747 - protein, 13 aa, Mycobacterium tuberculosis
LPEHAIVQFVKAI

SEQ ID NO: 126748 - protein, 13 aa, Mycobacterium tuberculosis
PEHAIVQFVKAIC

SEQ ID NO: 126749 - protein, 13 aa, Mycobacterium tuberculosis
EHAIVQFVKAICS

SEQ ID NO: 126750 - protein, 13 aa, Mycobacterium tuberculosis
HAIVQFVKAICSP

SEQ ID NO: 126751 - protein, 13 aa, Mycobacterium tuberculosis
AIVQFVKAICSPM

SEQ ID NO: 126752 - protein, 13 aa, Mycobacterium tuberculosis
IVQFVKAICSPMA

SEQ ID NO: 126753 - protein, 13 aa, Mycobacterium tuberculosis
VQFVKAICSPMAL

SEQ ID NO: 126754 - protein, 13 aa, Mycobacterium tuberculosis
QFVKAICSPMALA

SEQ ID NO: 126755 - protein, 13 aa, Mycobacterium tuberculosis
FVKAICSPMALAS

SEQ ID NO: 126756 - protein, 14 aa, Mycobacterium tuberculosis
MTTARDIMNAGVTC

SEQ ID NO: 126757 - protein, 14 aa, Mycobacterium tuberculosis
TTARDIMNAGVTCV

SEQ ID NO: 126758 - protein, 14 aa, Mycobacterium tuberculosis
TARDIMNAGVTCVG

SEQ ID NO: 126759 - protein, 14 aa, Mycobacterium tuberculosis
ARDIMNAGVTCVGE

SEQ ID NO: 126760 - protein, 14 aa, Mycobacterium tuberculosis
RDIMNAGVTCVGEH

SEQ ID NO: 126761 - protein, 14 aa, Mycobacterium tuberculosis
DIMNAGVTCVGEHE

SEQ ID NO: 126762 - protein, 14 aa, Mycobacterium tuberculosis
IMNAGVTCVGEHET

SEQ ID NO: 126763 - protein, 14 aa, Mycobacterium tuberculosis
MNAGVTCVGEHETL

SEQ ID NO: 126764 - protein, 14 aa, Mycobacterium tuberculosis
NAGVTCVGEHETLT

SEQ ID NO: 126765 - protein, 14 aa, Mycobacterium tuberculosis
AGVTCVGEHETLTA

SEQ ID NO: 126766 - protein, 14 aa, Mycobacterium tuberculosis
GVTCVGEHETLTAA

SEQ ID NO: 126767 - protein, 14 aa, Mycobacterium tuberculosis
VTCVGEHETLTAAA

SEQ ID NO: 126768 - protein, 14 aa, Mycobacterium tuberculosis
TCVGEHETLTAAAQ

SEQ ID NO: 126769 - protein, 14 aa, Mycobacterium tuberculosis
CVGEHETLTAAAQY

SEQ ID NO: 126770 - protein, 14 aa, Mycobacterium tuberculosis
VGEHETLTAAAQYM

SEQ ID NO: 126771 - protein, 14 aa, Mycobacterium tuberculosis
GEHETLTAAAQYMR

SEQ ID NO: 126772 - protein, 14 aa, Mycobacterium tuberculosis
EHETLTAAAQYMRE

SEQ ID NO: 126773 - protein, 14 aa, Mycobacterium tuberculosis
HETLTAAAQYMREH

SEQ ID NO: 126774 - protein, 14 aa, Mycobacterium tuberculosis
ETLTAAAQYMREHD

SEQ ID NO: 126775 - protein, 14 aa, Mycobacterium tuberculosis
TLTAAAQYMREHDI

SEQ ID NO: 126776 - protein, 14 aa, Mycobacterium tuberculosis
LTAAAQYMREHDIG

SEQ ID NO: 126777 - protein, 14 aa, Mycobacterium tuberculosis
TAAAQYMREHDIGA

SEQ ID NO: 126778 - protein, 14 aa, Mycobacterium tuberculosis
AAAQYMREHDIGAL

SEQ ID NO: 126779 - protein, 14 aa, Mycobacterium tuberculosis
AAQYMREHDIGALP

SEQ ID NO: 126780 - protein, 14 aa, Mycobacterium tuberculosis
AQYMREHDIGALPI

SEQ ID NO: 126781 - protein, 14 aa, Mycobacterium tuberculosis
QYMREHDIGALPIC

SEQ ID NO: 126782 - protein, 14 aa, Mycobacterium tuberculosis
YMREHDIGALPICG

SEQ ID NO: 126783 - protein, 14 aa, Mycobacterium tuberculosis
MREHDIGALPICGD

SEQ ID NO: 126784 - protein, 14 aa, Mycobacterium tuberculosis
REHDIGALPICGDD

SEQ ID NO: 126785 - protein, 14 aa, Mycobacterium tuberculosis
EHDIGALPICGDDD

SEQ ID NO: 126786 - protein, 14 aa, Mycobacterium tuberculosis
HDIGALPICGDDDR

SEQ ID NO: 126787 - protein, 14 aa, Mycobacterium tuberculosis
DIGALPICGDDDRL

SEQ ID NO: 126788 - protein, 14 aa, Mycobacterium tuberculosis
IGALPICGDDDRLH

SEQ ID NO: 126789 - protein, 14 aa, Mycobacterium tuberculosis
GALPICGDDDRLHG

SEQ ID NO: 126790 - protein, 14 aa, Mycobacterium tuberculosis
ALPICGDDDRLHGM

SEQ ID NO: 126791 - protein, 14 aa, Mycobacterium tuberculosis
LPICGDDDRLHGML

SEQ ID NO: 126792 - protein, 14 aa, Mycobacterium tuberculosis
PICGDDDRLHGMLT

SEQ ID NO: 126793 - protein, 14 aa, Mycobacterium tuberculosis
ICGDDDRLHGMLTD

SEQ ID NO: 126794 - protein, 14 aa, Mycobacterium tuberculosis
CGDDDRLHGMLTDR

SEQ ID NO: 126795 - protein, 14 aa, Mycobacterium tuberculosis
GDDDRLHGMLTDRD

SEQ ID NO: 126796 - protein, 14 aa, Mycobacterium tuberculosis
DDDRLHGMLTDRDI

SEQ ID NO: 126797 - protein, 14 aa, Mycobacterium tuberculosis
DDRLHGMLTDRDIV

SEQ ID NO: 126798 - protein, 14 aa, Mycobacterium tuberculosis
DRLHGMLTDRDIVI

SEQ ID NO: 126799 - protein, 14 aa, Mycobacterium tuberculosis
RLHGMLTDRDIVIK

SEQ ID NO: 126800 - protein, 14 aa, Mycobacterium tuberculosis
LHGMLTDRDIVIKG

SEQ ID NO: 126801 - protein, 14 aa, Mycobacterium tuberculosis
HGMLTDRDIVIKGL

SEQ ID NO: 126802 - protein, 14 aa, Mycobacterium tuberculosis
GMLTDRDIVIKGLA

SEQ ID NO: 126803 - protein, 14 aa, Mycobacterium tuberculosis
MLTDRDIVIKGLAA

SEQ ID NO: 126804 - protein, 14 aa, Mycobacterium tuberculosis
LTDRDIVIKGLAAG

SEQ ID NO: 126805 - protein, 14 aa, Mycobacterium tuberculosis
TDRDIVIKGLAAGL

SEQ ID NO: 126806 - protein, 14 aa, Mycobacterium tuberculosis
DRDIVIKGLAAGLD

SEQ ID NO: 126807 - protein, 14 aa, Mycobacterium tuberculosis
RDIVIKGLAAGLDP

SEQ ID NO: 126808 - protein, 14 aa, Mycobacterium tuberculosis
DIVIKGLAAGLDPN

SEQ ID NO: 126809 - protein, 14 aa, Mycobacterium tuberculosis
IVIKGLAAGLDPNT

SEQ ID NO: 126810 - protein, 14 aa, Mycobacterium tuberculosis
VIKGLAAGLDPNTA

SEQ ID NO: 126811 - protein, 14 aa, Mycobacterium tuberculosis
IKGLAAGLDPNTAT

SEQ ID NO: 126812 - protein, 14 aa, Mycobacterium tuberculosis
KGLAAGLDPNTATA

SEQ ID NO: 126813 - protein, 14 aa, Mycobacterium tuberculosis
GLAAGLDPNTATAG

SEQ ID NO: 126814 - protein, 14 aa, Mycobacterium tuberculosis
LAAGLDPNTATAGE

SEQ ID NO: 126815 - protein, 14 aa, Mycobacterium tuberculosis
AAGLDPNTATAGEL

SEQ ID NO: 126816 - protein, 14 aa, Mycobacterium tuberculosis
AGLDPNTATAGELA

SEQ ID NO: 126817 - protein, 14 aa, Mycobacterium tuberculosis
GLDPNTATAGELAR

SEQ ID NO: 126818 - protein, 14 aa, Mycobacterium tuberculosis
LDPNTATAGELARD

SEQ ID NO: 126819 - protein, 14 aa, Mycobacterium tuberculosis
DPNTATAGELARDS

SEQ ID NO: 126820 - protein, 14 aa, Mycobacterium tuberculosis
PNTATAGELARDSI

SEQ ID NO: 126821 - protein, 14 aa, Mycobacterium tuberculosis
NTATAGELARDSIY

SEQ ID NO: 126822 - protein, 14 aa, Mycobacterium tuberculosis
TATAGELARDSIYY

SEQ ID NO: 126823 - protein, 14 aa, Mycobacterium tuberculosis
ATAGELARDSIYYV

SEQ ID NO: 126824 - protein, 14 aa, Mycobacterium tuberculosis
TAGELARDSIYYVD

SEQ ID NO: 126825 - protein, 14 aa, Mycobacterium tuberculosis
AGELARDSIYYVDA

SEQ ID NO: 126826 - protein, 14 aa, Mycobacterium tuberculosis
GELARDSIYYVDAN

SEQ ID NO: 126827 - protein, 14 aa, Mycobacterium tuberculosis
ELARDSIYYVDANA

SEQ ID NO: 126828 - protein, 14 aa, Mycobacterium tuberculosis
LARDSIYYVDANAS

SEQ ID NO: 126829 - protein, 14 aa, Mycobacterium tuberculosis
ARDSIYYVDANASI

SEQ ID NO: 126830 - protein, 14 aa, Mycobacterium tuberculosis
RDSIYYVDANASIQ

SEQ ID NO: 126831 - protein, 14 aa, Mycobacterium tuberculosis
DSIYYVDANASIQE

SEQ ID NO: 126832 - protein, 14 aa, Mycobacterium tuberculosis
SIYYVDANASIQEM

SEQ ID NO: 126833 - protein, 14 aa, Mycobacterium tuberculosis
IYYVDANASIQEML

SEQ ID NO: 126834 - protein, 14 aa, Mycobacterium tuberculosis
YYVDANASIQEMLN

SEQ ID NO: 126835 - protein, 14 aa, Mycobacterium tuberculosis
YVDANASIQEMLNV

SEQ ID NO: 126836 - protein, 14 aa, Mycobacterium tuberculosis
VDANASIQEMLNVM

SEQ ID NO: 126837 - protein, 14 aa, Mycobacterium tuberculosis
DANASIQEMLNVME

SEQ ID NO: 126838 - protein, 14 aa, Mycobacterium tuberculosis
ANASIQEMLNVMEE

SEQ ID NO: 126839 - protein, 14 aa, Mycobacterium tuberculosis
NASIQEMLNVMEEH

SEQ ID NO: 126840 - protein, 14 aa, Mycobacterium tuberculosis
ASIQEMLNVMEEHQ

SEQ ID NO: 126841 - protein, 14 aa, Mycobacterium tuberculosis
SIQEMLNVMEEHQV

SEQ ID NO: 126842 - protein, 14 aa, Mycobacterium tuberculosis
IQEMLNVMEEHQVR

SEQ ID NO: 126843 - protein, 14 aa, Mycobacterium tuberculosis
QEMLNVMEEHQVRR

SEQ ID NO: 126844 - protein, 14 aa, Mycobacterium tuberculosis
EMLNVMEEHQVRRV

SEQ ID NO: 126845 - protein, 14 aa, Mycobacterium tuberculosis
MLNVMEEHQVRRVP

SEQ ID NO: 126846 - protein, 14 aa, Mycobacterium tuberculosis
LNVMEEHQVRRVPV

SEQ ID NO: 126847 - protein, 14 aa, Mycobacterium tuberculosis
NVMEEHQVRRVPVI

SEQ ID NO: 126848 - protein, 14 aa, Mycobacterium tuberculosis
VMEEHQVRRVPVIS

SEQ ID NO: 126849 - protein, 14 aa, Mycobacterium tuberculosis
MEEHQVRRVPVISE

SEQ ID NO: 126850 - protein, 14 aa, Mycobacterium tuberculosis
EEHQVRRVPVISEH

SEQ ID NO: 126851 - protein, 14 aa, Mycobacterium tuberculosis
EHQVRRVPVISEHR

SEQ ID NO: 126852 - protein, 14 aa, Mycobacterium tuberculosis
HQVRRVPVISEHRL

SEQ ID NO: 126853 - protein, 14 aa, Mycobacterium tuberculosis
QVRRVPVISEHRLV

SEQ ID NO: 126854 - protein, 14 aa, Mycobacterium tuberculosis
VRRVPVISEHRLVG

SEQ ID NO: 126855 - protein, 14 aa, Mycobacterium tuberculosis
RRVPVISEHRLVGI

SEQ ID NO: 126856 - protein, 14 aa, Mycobacterium tuberculosis
RVPVISEHRLVGIV

SEQ ID NO: 126857 - protein, 14 aa, Mycobacterium tuberculosis
VPVISEHRLVGIVT

SEQ ID NO: 126858 - protein, 14 aa, Mycobacterium tuberculosis
PVISEHRLVGIVTE

SEQ ID NO: 126859 - protein, 14 aa, Mycobacterium tuberculosis
VISEHRLVGIVTEA

SEQ ID NO: 126860 - protein, 14 aa, Mycobacterium tuberculosis
ISEHRLVGIVTEAD

SEQ ID NO: 126861 - protein, 14 aa, Mycobacterium tuberculosis
SEHRLVGIVTEADI

SEQ ID NO: 126862 - protein, 14 aa, Mycobacterium tuberculosis
EHRLVGIVTEADIA

SEQ ID NO: 126863 - protein, 14 aa, Mycobacterium tuberculosis
HRLVGIVTEADIAR

SEQ ID NO: 126864 - protein, 14 aa, Mycobacterium tuberculosis
RLVGIVTEADIARH

SEQ ID NO: 126865 - protein, 14 aa, Mycobacterium tuberculosis
LVGIVTEADIARHL

SEQ ID NO: 126866 - protein, 14 aa, Mycobacterium tuberculosis
VGIVTEADIARHLP

SEQ ID NO: 126867 - protein, 14 aa, Mycobacterium tuberculosis
GIVTEADIARHLPE

SEQ ID NO: 126868 - protein, 14 aa, Mycobacterium tuberculosis
IVTEADIARHLPEH

SEQ ID NO: 126869 - protein, 14 aa, Mycobacterium tuberculosis
VTEADIARHLPEHA

SEQ ID NO: 126870 - protein, 14 aa, Mycobacterium tuberculosis
TEADIARHLPEHAI

SEQ ID NO: 126871 - protein, 14 aa, Mycobacterium tuberculosis
EADIARHLPEHAIV

SEQ ID NO: 126872 - protein, 14 aa, Mycobacterium tuberculosis
ADIARHLPEHAIVQ

SEQ ID NO: 126873 - protein, 14 aa, Mycobacterium tuberculosis
DIARHLPEHAIVQF

SEQ ID NO: 126874 - protein, 14 aa, Mycobacterium tuberculosis
IARHLPEHAIVQFV

SEQ ID NO: 126875 - protein, 14 aa, Mycobacterium tuberculosis
ARHLPEHAIVQFVK

SEQ ID NO: 126876 - protein, 14 aa, Mycobacterium tuberculosis
RHLPEHAIVQFVKA

SEQ ID NO: 126877 - protein, 14 aa, Mycobacterium tuberculosis
HLPEHAIVQFVKAI

SEQ ID NO: 126878 - protein, 14 aa, Mycobacterium tuberculosis
LPEHAIVQFVKAIC

SEQ ID NO: 126879 - protein, 14 aa, Mycobacterium tuberculosis
PEHAIVQFVKAICS

SEQ ID NO: 126880 - protein, 14 aa, Mycobacterium tuberculosis
EHAIVQFVKAICSP

SEQ ID NO: 126881 - protein, 14 aa, Mycobacterium tuberculosis
HAIVQFVKAICSPM

SEQ ID NO: 126882 - protein, 14 aa, Mycobacterium tuberculosis
AIVQFVKAICSPMA

SEQ ID NO: 126883 - protein, 14 aa, Mycobacterium tuberculosis
IVQFVKAICSPMAL

SEQ ID NO: 126884 - protein, 14 aa, Mycobacterium tuberculosis
VQFVKAICSPMALA

SEQ ID NO: 126885 - protein, 14 aa, Mycobacterium tuberculosis
QFVKAICSPMALAS

SEQ ID NO: 126886 - protein, 15 aa, Mycobacterium tuberculosis
MTTARDIMNAGVTCV

SEQ ID NO: 126887 - protein, 15 aa, Mycobacterium tuberculosis
TTARDIMNAGVTCVG

SEQ ID NO: 126888 - protein, 15 aa, Mycobacterium tuberculosis
TARDIMNAGVTCVGE

SEQ ID NO: 126889 - protein, 15 aa, Mycobacterium tuberculosis
ARDIMNAGVTCVGEH

SEQ ID NO: 126890 - protein, 15 aa, Mycobacterium tuberculosis
RDIMNAGVTCVGEHE

SEQ ID NO: 126891 - protein, 15 aa, Mycobacterium tuberculosis
DIMNAGVTCVGEHET

SEQ ID NO: 126892 - protein, 15 aa, Mycobacterium tuberculosis
IMNAGVTCVGEHETL

SEQ ID NO: 126893 - protein, 15 aa, Mycobacterium tuberculosis
MNAGVTCVGEHETLT

SEQ ID NO: 126894 - protein, 15 aa, Mycobacterium tuberculosis
NAGVTCVGEHETLTA

SEQ ID NO: 126895 - protein, 15 aa, Mycobacterium tuberculosis
AGVTCVGEHETLTAA

SEQ ID NO: 126896 - protein, 15 aa, Mycobacterium tuberculosis
GVTCVGEHETLTAAA

SEQ ID NO: 126897 - protein, 15 aa, Mycobacterium tuberculosis
VTCVGEHETLTAAAQ

SEQ ID NO: 126898 - protein, 15 aa, Mycobacterium tuberculosis
TCVGEHETLTAAAQY

SEQ ID NO: 126899 - protein, 15 aa, Mycobacterium tuberculosis
CVGEHETLTAAAQYM

SEQ ID NO: 126900 - protein, 15 aa, Mycobacterium tuberculosis
VGEHETLTAAAQYMR

SEQ ID NO: 126901 - protein, 15 aa, Mycobacterium tuberculosis
GEHETLTAAAQYMRE

SEQ ID NO: 126902 - protein, 15 aa, Mycobacterium tuberculosis
EHETLTAAAQYMREH

SEQ ID NO: 126903 - protein, 15 aa, Mycobacterium tuberculosis
HETLTAAAQYMREHD

SEQ ID NO: 126904 - protein, 15 aa, Mycobacterium tuberculosis
ETLTAAAQYMREHDI

SEQ ID NO: 126905 - protein, 15 aa, Mycobacterium tuberculosis
TLTAAAQYMREHDIG

SEQ ID NO: 126906 - protein, 15 aa, Mycobacterium tuberculosis
LTAAAQYMREHDIGA

SEQ ID NO: 126907 - protein, 15 aa, Mycobacterium tuberculosis
TAAAQYMREHDIGAL

SEQ ID NO: 126908 - protein, 15 aa, Mycobacterium tuberculosis
AAAQYMREHDIGALP

SEQ ID NO: 126909 - protein, 15 aa, Mycobacterium tuberculosis
AAQYMREHDIGALPI

SEQ ID NO: 126910 - protein, 15 aa, Mycobacterium tuberculosis
AQYMREHDIGALPIC

SEQ ID NO: 126911 - protein, 15 aa, Mycobacterium tuberculosis
QYMREHDIGALPICG

SEQ ID NO: 126912 - protein, 15 aa, Mycobacterium tuberculosis
YMREHDIGALPICGD

SEQ ID NO: 126913 - protein, 15 aa, Mycobacterium tuberculosis
MREHDIGALPICGDD

SEQ ID NO: 126914 - protein, 15 aa, Mycobacterium tuberculosis
REHDIGALPICGDDD

SEQ ID NO: 126915 - protein, 15 aa, Mycobacterium tuberculosis
EHDIGALPICGDDDR

SEQ ID NO: 126916 - protein, 15 aa, Mycobacterium tuberculosis
HDIGALPICGDDDRL

SEQ ID NO: 126917 - protein, 15 aa, Mycobacterium tuberculosis
DIGALPICGDDDRLH

SEQ ID NO: 126918 - protein, 15 aa, Mycobacterium tuberculosis
IGALPICGDDDRLHG

SEQ ID NO: 126919 - protein, 15 aa, Mycobacterium tuberculosis
GALPICGDDDRLHGM

SEQ ID NO: 126920 - protein, 15 aa, Mycobacterium tuberculosis
ALPICGDDDRLHGML

SEQ ID NO: 126921 - protein, 15 aa, Mycobacterium tuberculosis
LPICGDDDRLHGMLT

SEQ ID NO: 126922 - protein, 15 aa, Mycobacterium tuberculosis
PICGDDDRLHGMLTD

SEQ ID NO: 126923 - protein, 15 aa, Mycobacterium tuberculosis
ICGDDDRLHGMLTDR

SEQ ID NO: 126924 - protein, 15 aa, Mycobacterium tuberculosis
CGDDDRLHGMLTDRD

SEQ ID NO: 126925 - protein, 15 aa, Mycobacterium tuberculosis
GDDDRLHGMLTDRDI

SEQ ID NO: 126926 - protein, 15 aa, Mycobacterium tuberculosis
DDDRLHGMLTDRDIV

SEQ ID NO: 126927 - protein, 15 aa, Mycobacterium tuberculosis
DDRLHGMLTDRDIVI

SEQ ID NO: 126928 - protein, 15 aa, Mycobacterium tuberculosis
DRLHGMLTDRDIVIK

SEQ ID NO: 126929 - protein, 15 aa, Mycobacterium tuberculosis
RLHGMLTDRDIVIKG

SEQ ID NO: 126930 - protein, 15 aa, Mycobacterium tuberculosis
LHGMLTDRDIVIKGL

SEQ ID NO: 126931 - protein, 15 aa, Mycobacterium tuberculosis
HGMLTDRDIVIKGLA

SEQ ID NO: 126932 - protein, 15 aa, Mycobacterium tuberculosis
GMLTDRDIVIKGLAA

SEQ ID NO: 126933 - protein, 15 aa, Mycobacterium tuberculosis
MLTDRDIVIKGLAAG

SEQ ID NO: 126934 - protein, 15 aa, Mycobacterium tuberculosis
LTDRDIVIKGLAAGL

SEQ ID NO: 126935 - protein, 15 aa, Mycobacterium tuberculosis
TDRDIVIKGLAAGLD

SEQ ID NO: 126936 - protein, 15 aa, Mycobacterium tuberculosis
DRDIVIKGLAAGLDP

SEQ ID NO: 126937 - protein, 15 aa, Mycobacterium tuberculosis
RDIVIKGLAAGLDPN

SEQ ID NO: 126938 - protein, 15 aa, Mycobacterium tuberculosis
DIVIKGLAAGLDPNT

SEQ ID NO: 126939 - protein, 15 aa, Mycobacterium tuberculosis
IVIKGLAAGLDPNTA

SEQ ID NO: 126940 - protein, 15 aa, Mycobacterium tuberculosis
VIKGLAAGLDPNTAT

SEQ ID NO: 126941 - protein, 15 aa, Mycobacterium tuberculosis
IKGLAAGLDPNTATA

SEQ ID NO: 126942 - protein, 15 aa, Mycobacterium tuberculosis
KGLAAGLDPNTATAG

SEQ ID NO: 126943 - protein, 15 aa, Mycobacterium tuberculosis
GLAAGLDPNTATAGE

SEQ ID NO: 126944 - protein, 15 aa, Mycobacterium tuberculosis
LAAGLDPNTATAGEL

SEQ ID NO: 126945 - protein, 15 aa, Mycobacterium tuberculosis
AAGLDPNTATAGELA

SEQ ID NO: 126946 - protein, 15 aa, Mycobacterium tuberculosis
AGLDPNTATAGELAR

SEQ ID NO: 126947 - protein, 15 aa, Mycobacterium tuberculosis
GLDPNTATAGELARD

SEQ ID NO: 126948 - protein, 15 aa, Mycobacterium tuberculosis
LDPNTATAGELARDS

SEQ ID NO: 126949 - protein, 15 aa, Mycobacterium tuberculosis
DPNTATAGELARDSI

SEQ ID NO: 126950 - protein, 15 aa, Mycobacterium tuberculosis
PNTATAGELARDSIY

SEQ ID NO: 126951 - protein, 15 aa, Mycobacterium tuberculosis
NTATAGELARDSIYY

SEQ ID NO: 126952 - protein, 15 aa, Mycobacterium tuberculosis
TATAGELARDSIYYV

SEQ ID NO: 126953 - protein, 15 aa, Mycobacterium tuberculosis
ATAGELARDSIYYVD

SEQ ID NO: 126954 - protein, 15 aa, Mycobacterium tuberculosis
TAGELARDSIYYVDA

SEQ ID NO: 126955 - protein, 15 aa, Mycobacterium tuberculosis
AGELARDSIYYVDAN

SEQ ID NO: 126956 - protein, 15 aa, Mycobacterium tuberculosis
GELARDSIYYVDANA

SEQ ID NO: 126957 - protein, 15 aa, Mycobacterium tuberculosis
ELARDSIYYVDANAS

SEQ ID NO: 126958 - protein, 15 aa, Mycobacterium tuberculosis
LARDSIYYVDANASI

SEQ ID NO: 126959 - protein, 15 aa, Mycobacterium tuberculosis
ARDSIYYVDANASIQ

SEQ ID NO: 126960 - protein, 15 aa, Mycobacterium tuberculosis
RDSIYYVDANASIQE

SEQ ID NO: 126961 - protein, 15 aa, Mycobacterium tuberculosis
DSIYYVDANASIQEM

SEQ ID NO: 126962 - protein, 15 aa, Mycobacterium tuberculosis
SIYYVDANASIQEML

SEQ ID NO: 126963 - protein, 15 aa, Mycobacterium tuberculosis
IYYVDANASIQEMLN

SEQ ID NO: 126964 - protein, 15 aa, Mycobacterium tuberculosis
YYVDANASIQEMLNV

SEQ ID NO: 126965 - protein, 15 aa, Mycobacterium tuberculosis
YVDANASIQEMLNVM

SEQ ID NO: 126966 - protein, 15 aa, Mycobacterium tuberculosis
VDANASIQEMLNVME

SEQ ID NO: 126967 - protein, 15 aa, Mycobacterium tuberculosis
DANASIQEMLNVMEE

SEQ ID NO: 126968 - protein, 15 aa, Mycobacterium tuberculosis
ANASIQEMLNVMEEH

SEQ ID NO: 126969 - protein, 15 aa, Mycobacterium tuberculosis
NASIQEMLNVMEEHQ

SEQ ID NO: 126970 - protein, 15 aa, Mycobacterium tuberculosis
ASIQEMLNVMEEHQV

SEQ ID NO: 126971 - protein, 15 aa, Mycobacterium tuberculosis
SIQEMLNVMEEHQVR

SEQ ID NO: 126972 - protein, 15 aa, Mycobacterium tuberculosis
IQEMLNVMEEHQVRR

SEQ ID NO: 126973 - protein, 15 aa, Mycobacterium tuberculosis
QEMLNVMEEHQVRRV

SEQ ID NO: 126974 - protein, 15 aa, Mycobacterium tuberculosis
EMLNVMEEHQVRRVP

SEQ ID NO: 126975 - protein, 15 aa, Mycobacterium tuberculosis
MLNVMEEHQVRRVPV

SEQ ID NO: 126976 - protein, 15 aa, Mycobacterium tuberculosis
LNVMEEHQVRRVPVI

SEQ ID NO: 126977 - protein, 15 aa, Mycobacterium tuberculosis
NVMEEHQVRRVPVIS

SEQ ID NO: 126978 - protein, 15 aa, Mycobacterium tuberculosis
VMEEHQVRRVPVISE

SEQ ID NO: 126979 - protein, 15 aa, Mycobacterium tuberculosis
MEEHQVRRVPVISEH

SEQ ID NO: 126980 - protein, 15 aa, Mycobacterium tuberculosis
EEHQVRRVPVISEHR

SEQ ID NO: 126981 - protein, 15 aa, Mycobacterium tuberculosis
EHQVRRVPVISEHRL

SEQ ID NO: 126982 - protein, 15 aa, Mycobacterium tuberculosis
HQVRRVPVISEHRLV

SEQ ID NO: 126983 - protein, 15 aa, Mycobacterium tuberculosis
QVRRVPVISEHRLVG

SEQ ID NO: 126984 - protein, 15 aa, Mycobacterium tuberculosis
VRRVPVISEHRLVGI

SEQ ID NO: 126985 - protein, 15 aa, Mycobacterium tuberculosis
RRVPVISEHRLVGIV

SEQ ID NO: 126986 - protein, 15 aa, Mycobacterium tuberculosis
RVPVISEHRLVGIVT

SEQ ID NO: 126987 - protein, 15 aa, Mycobacterium tuberculosis
VPVISEHRLVGIVTE

SEQ ID NO: 126988 - protein, 15 aa, Mycobacterium tuberculosis
PVISEHRLVGIVTEA

SEQ ID NO: 126989 - protein, 15 aa, Mycobacterium tuberculosis
VISEHRLVGIVTEAD

SEQ ID NO: 126990 - protein, 15 aa, Mycobacterium tuberculosis
ISEHRLVGIVTEADI

SEQ ID NO: 126991 - protein, 15 aa, Mycobacterium tuberculosis
SEHRLVGIVTEADIA

SEQ ID NO: 126992 - protein, 15 aa, Mycobacterium tuberculosis
EHRLVGIVTEADIAR

SEQ ID NO: 126993 - protein, 15 aa, Mycobacterium tuberculosis
HRLVGIVTEADIARH

SEQ ID NO: 126994 - protein, 15 aa, Mycobacterium tuberculosis
RLVGIVTEADIARHL

SEQ ID NO: 126995 - protein, 15 aa, Mycobacterium tuberculosis
LVGIVTEADIARHLP

SEQ ID NO: 126996 - protein, 15 aa, Mycobacterium tuberculosis
VGIVTEADIARHLPE

SEQ ID NO: 126997 - protein, 15 aa, Mycobacterium tuberculosis
GIVTEADIARHLPEH

SEQ ID NO: 126998 - protein, 15 aa, Mycobacterium tuberculosis
IVTEADIARHLPEHA

SEQ ID NO: 126999 - protein, 15 aa, Mycobacterium tuberculosis
VTEADIARHLPEHAI

SEQ ID NO: 127000 - protein, 15 aa, Mycobacterium tuberculosis
TEADIARHLPEHAIV

SEQ ID NO: 127001 - protein, 15 aa, Mycobacterium tuberculosis
EADIARHLPEHAIVQ

SEQ ID NO: 127002 - protein, 15 aa, Mycobacterium tuberculosis
ADIARHLPEHAIVQF

SEQ ID NO: 127003 - protein, 15 aa, Mycobacterium tuberculosis
DIARHLPEHAIVQFV

SEQ ID NO: 127004 - protein, 15 aa, Mycobacterium tuberculosis
IARHLPEHAIVQFVK

SEQ ID NO: 127005 - protein, 15 aa, Mycobacterium tuberculosis
ARHLPEHAIVQFVKA

SEQ ID NO: 127006 - protein, 15 aa, Mycobacterium tuberculosis
RHLPEHAIVQFVKAI

SEQ ID NO: 127007 - protein, 15 aa, Mycobacterium tuberculosis
HLPEHAIVQFVKAIC

SEQ ID NO: 127008 - protein, 15 aa, Mycobacterium tuberculosis
LPEHAIVQFVKAICS

SEQ ID NO: 127009 - protein, 15 aa, Mycobacterium tuberculosis
PEHAIVQFVKAICSP

SEQ ID NO: 127010 - protein, 15 aa, Mycobacterium tuberculosis
EHAIVQFVKAICSPM

SEQ ID NO: 127011 - protein, 15 aa, Mycobacterium tuberculosis
HAIVQFVKAICSPMA

SEQ ID NO: 127012 - protein, 15 aa, Mycobacterium tuberculosis
AIVQFVKAICSPMAL

SEQ ID NO: 127013 - protein, 15 aa, Mycobacterium tuberculosis
IVQFVKAICSPMALA

SEQ ID NO: 127014 - protein, 15 aa, Mycobacterium tuberculosis
VQFVKAICSPMALAS

SEQ ID NO: 127015 - protein, 16 aa, Mycobacterium tuberculosis
MTTARDIMNAGVTCVG

SEQ ID NO: 127016 - protein, 16 aa, Mycobacterium tuberculosis
TTARDIMNAGVTCVGE

SEQ ID NO: 127017 - protein, 16 aa, Mycobacterium tuberculosis
TARDIMNAGVTCVGEH

SEQ ID NO: 127018 - protein, 16 aa, Mycobacterium tuberculosis
ARDIMNAGVTCVGEHE

SEQ ID NO: 127019 - protein, 16 aa, Mycobacterium tuberculosis
RDIMNAGVTCVGEHET

SEQ ID NO: 127020 - protein, 16 aa, Mycobacterium tuberculosis
DIMNAGVTCVGEHETL

SEQ ID NO: 127021 - protein, 16 aa, Mycobacterium tuberculosis
IMNAGVTCVGEHETLT

SEQ ID NO: 127022 - protein, 16 aa, Mycobacterium tuberculosis
MNAGVTCVGEHETLTA

SEQ ID NO: 127023 - protein, 16 aa, Mycobacterium tuberculosis
NAGVTCVGEHETLTAA

SEQ ID NO: 127024 - protein, 16 aa, Mycobacterium tuberculosis
AGVTCVGEHETLTAAA

SEQ ID NO: 127025 - protein, 16 aa, Mycobacterium tuberculosis
GVTCVGEHETLTAAAQ

SEQ ID NO: 127026 - protein, 16 aa, Mycobacterium tuberculosis
VTCVGEHETLTAAAQY

SEQ ID NO: 127027 - protein, 16 aa, Mycobacterium tuberculosis
TCVGEHETLTAAAQYM

SEQ ID NO: 127028 - protein, 16 aa, Mycobacterium tuberculosis
CVGEHETLTAAAQYMR

SEQ ID NO: 127029 - protein, 16 aa, Mycobacterium tuberculosis
VGEHETLTAAAQYMRE

SEQ ID NO: 127030 - protein, 16 aa, Mycobacterium tuberculosis
GEHETLTAAAQYMREH

SEQ ID NO: 127031 - protein, 16 aa, Mycobacterium tuberculosis
EHETLTAAAQYMREHD

SEQ ID NO: 127032 - protein, 16 aa, Mycobacterium tuberculosis
HETLTAAAQYMREHDI

SEQ ID NO: 127033 - protein, 16 aa, Mycobacterium tuberculosis
ETLTAAAQYMREHDIG

SEQ ID NO: 127034 - protein, 16 aa, Mycobacterium tuberculosis
TLTAAAQYMREHDIGA

SEQ ID NO: 127035 - protein, 16 aa, Mycobacterium tuberculosis
LTAAAQYMREHDIGAL

SEQ ID NO: 127036 - protein, 16 aa, Mycobacterium tuberculosis
TAAAQYMREHDIGALP

SEQ ID NO: 127037 - protein, 16 aa, Mycobacterium tuberculosis
AAAQYMREHDIGALPI

SEQ ID NO: 127038 - protein, 16 aa, Mycobacterium tuberculosis
AAQYMREHDIGALPIC

SEQ ID NO: 127039 - protein, 16 aa, Mycobacterium tuberculosis
AQYMREHDIGALPICG

SEQ ID NO: 127040 - protein, 16 aa, Mycobacterium tuberculosis
QYMREHDIGALPICGD

SEQ ID NO: 127041 - protein, 16 aa, Mycobacterium tuberculosis
YMREHDIGALPICGDD

SEQ ID NO: 127042 - protein, 16 aa, Mycobacterium tuberculosis
MREHDIGALPICGDDD

SEQ ID NO: 127043 - protein, 16 aa, Mycobacterium tuberculosis
REHDIGALPICGDDDR

SEQ ID NO: 127044 - protein, 16 aa, Mycobacterium tuberculosis
EHDIGALPICGDDDRL

SEQ ID NO: 127045 - protein, 16 aa, Mycobacterium tuberculosis
HDIGALPICGDDDRLH

SEQ ID NO: 127046 - protein, 16 aa, Mycobacterium tuberculosis
DIGALPICGDDDRLHG

SEQ ID NO: 127047 - protein, 16 aa, Mycobacterium tuberculosis
IGALPICGDDDRLHGM

SEQ ID NO: 127048 - protein, 16 aa, Mycobacterium tuberculosis
GALPICGDDDRLHGML

SEQ ID NO: 127049 - protein, 16 aa, Mycobacterium tuberculosis
ALPICGDDDRLHGMLT

SEQ ID NO: 127050 - protein, 16 aa, Mycobacterium tuberculosis
LPICGDDDRLHGMLTD

SEQ ID NO: 127051 - protein, 16 aa, Mycobacterium tuberculosis
PICGDDDRLHGMLTDR

SEQ ID NO: 127052 - protein, 16 aa, Mycobacterium tuberculosis
ICGDDDRLHGMLTDRD

SEQ ID NO: 127053 - protein, 16 aa, Mycobacterium tuberculosis
CGDDDRLHGMLTDRDI

SEQ ID NO: 127054 - protein, 16 aa, Mycobacterium tuberculosis
GDDDRLHGMLTDRDIV

SEQ ID NO: 127055 - protein, 16 aa, Mycobacterium tuberculosis
DDDRLHGMLTDRDIVI

SEQ ID NO: 127056 - protein, 16 aa, Mycobacterium tuberculosis
DDRLHGMLTDRDIVIK

SEQ ID NO: 127057 - protein, 16 aa, Mycobacterium tuberculosis
DRLHGMLTDRDIVIKG

SEQ ID NO: 127058 - protein, 16 aa, Mycobacterium tuberculosis
RLHGMLTDRDIVIKGL

SEQ ID NO: 127059 - protein, 16 aa, Mycobacterium tuberculosis
LHGMLTDRDIVIKGLA

SEQ ID NO: 127060 - protein, 16 aa, Mycobacterium tuberculosis
HGMLTDRDIVIKGLAA

SEQ ID NO: 127061 - protein, 16 aa, Mycobacterium tuberculosis
GMLTDRDIVIKGLAAG

SEQ ID NO: 127062 - protein, 16 aa, Mycobacterium tuberculosis
MLTDRDIVIKGLAAGL

SEQ ID NO: 127063 - protein, 16 aa, Mycobacterium tuberculosis
LTDRDIVIKGLAAGLD

SEQ ID NO: 127064 - protein, 16 aa, Mycobacterium tuberculosis
TDRDIVIKGLAAGLDP

SEQ ID NO: 127065 - protein, 16 aa, Mycobacterium tuberculosis
DRDIVIKGLAAGLDPN

SEQ ID NO: 127066 - protein, 16 aa, Mycobacterium tuberculosis
RDIVIKGLAAGLDPNT

SEQ ID NO: 127067 - protein, 16 aa, Mycobacterium tuberculosis
DIVIKGLAAGLDPNTA

SEQ ID NO: 127068 - protein, 16 aa, Mycobacterium tuberculosis
IVIKGLAAGLDPNTAT

SEQ ID NO: 127069 - protein, 16 aa, Mycobacterium tuberculosis
VIKGLAAGLDPNTATA

SEQ ID NO: 127070 - protein, 16 aa, Mycobacterium tuberculosis
IKGLAAGLDPNTATAG

SEQ ID NO: 127071 - protein, 16 aa, Mycobacterium tuberculosis
KGLAAGLDPNTATAGE

SEQ ID NO: 127072 - protein, 16 aa, Mycobacterium tuberculosis
GLAAGLDPNTATAGEL

SEQ ID NO: 127073 - protein, 16 aa, Mycobacterium tuberculosis
LAAGLDPNTATAGELA

SEQ ID NO: 127074 - protein, 16 aa, Mycobacterium tuberculosis
AAGLDPNTATAGELAR

SEQ ID NO: 127075 - protein, 16 aa, Mycobacterium tuberculosis
AGLDPNTATAGELARD

SEQ ID NO: 127076 - protein, 16 aa, Mycobacterium tuberculosis
GLDPNTATAGELARDS

SEQ ID NO: 127077 - protein, 16 aa, Mycobacterium tuberculosis
LDPNTATAGELARDSI

SEQ ID NO: 127078 - protein, 16 aa, Mycobacterium tuberculosis
DPNTATAGELARDSIY

SEQ ID NO: 127079 - protein, 16 aa, Mycobacterium tuberculosis
PNTATAGELARDSIYY

SEQ ID NO: 127080 - protein, 16 aa, Mycobacterium tuberculosis
NTATAGELARDSIYYV

SEQ ID NO: 127081 - protein, 16 aa, Mycobacterium tuberculosis
TATAGELARDSIYYVD

SEQ ID NO: 127082 - protein, 16 aa, Mycobacterium tuberculosis
ATAGELARDSIYYVDA

SEQ ID NO: 127083 - protein, 16 aa, Mycobacterium tuberculosis
TAGELARDSIYYVDAN

SEQ ID NO: 127084 - protein, 16 aa, Mycobacterium tuberculosis
AGELARDSIYYVDANA

SEQ ID NO: 127085 - protein, 16 aa, Mycobacterium tuberculosis
GELARDSIYYVDANAS

SEQ ID NO: 127086 - protein, 16 aa, Mycobacterium tuberculosis
ELARDSIYYVDANASI

SEQ ID NO: 127087 - protein, 16 aa, Mycobacterium tuberculosis
LARDSIYYVDANASIQ

SEQ ID NO: 127088 - protein, 16 aa, Mycobacterium tuberculosis
ARDSIYYVDANASIQE

SEQ ID NO: 127089 - protein, 16 aa, Mycobacterium tuberculosis
RDSIYYVDANASIQEM

SEQ ID NO: 127090 - protein, 16 aa, Mycobacterium tuberculosis
DSIYYVDANASIQEML

SEQ ID NO: 127091 - protein, 16 aa, Mycobacterium tuberculosis
SIYYVDANASIQEMLN

SEQ ID NO: 127092 - protein, 16 aa, Mycobacterium tuberculosis
IYYVDANASIQEMLNV

SEQ ID NO: 127093 - protein, 16 aa, Mycobacterium tuberculosis
YYVDANASIQEMLNVM

SEQ ID NO: 127094 - protein, 16 aa, Mycobacterium tuberculosis
YVDANASIQEMLNVME

SEQ ID NO: 127095 - protein, 16 aa, Mycobacterium tuberculosis
VDANASIQEMLNVMEE

SEQ ID NO: 127096 - protein, 16 aa, Mycobacterium tuberculosis
DANASIQEMLNVMEEH

SEQ ID NO: 127097 - protein, 16 aa, Mycobacterium tuberculosis
ANASIQEMLNVMEEHQ

SEQ ID NO: 127098 - protein, 16 aa, Mycobacterium tuberculosis
NASIQEMLNVMEEHQV

SEQ ID NO: 127099 - protein, 16 aa, Mycobacterium tuberculosis
ASIQEMLNVMEEHQVR

SEQ ID NO: 127100 - protein, 16 aa, Mycobacterium tuberculosis
SIQEMLNVMEEHQVRR

SEQ ID NO: 127101 - protein, 16 aa, Mycobacterium tuberculosis
IQEMLNVMEEHQVRRV

SEQ ID NO: 127102 - protein, 16 aa, Mycobacterium tuberculosis
QEMLNVMEEHQVRRVP

SEQ ID NO: 127103 - protein, 16 aa, Mycobacterium tuberculosis
EMLNVMEEHQVRRVPV

SEQ ID NO: 127104 - protein, 16 aa, Mycobacterium tuberculosis
MLNVMEEHQVRRVPVI

SEQ ID NO: 127105 - protein, 16 aa, Mycobacterium tuberculosis
LNVMEEHQVRRVPVIS

SEQ ID NO: 127106 - protein, 16 aa, Mycobacterium tuberculosis
NVMEEHQVRRVPVISE

SEQ ID NO: 127107 - protein, 16 aa, Mycobacterium tuberculosis
VMEEHQVRRVPVISEH

SEQ ID NO: 127108 - protein, 16 aa, Mycobacterium tuberculosis
MEEHQVRRVPVISEHR

SEQ ID NO: 127109 - protein, 16 aa, Mycobacterium tuberculosis
EEHQVRRVPVISEHRL

SEQ ID NO: 127110 - protein, 16 aa, Mycobacterium tuberculosis
EHQVRRVPVISEHRLV

SEQ ID NO: 127111 - protein, 16 aa, Mycobacterium tuberculosis
HQVRRVPVISEHRLVG

SEQ ID NO: 127112 - protein, 16 aa, Mycobacterium tuberculosis
QVRRVPVISEHRLVGI

SEQ ID NO: 127113 - protein, 16 aa, Mycobacterium tuberculosis
VRRVPVISEHRLVGIV

SEQ ID NO: 127114 - protein, 16 aa, Mycobacterium tuberculosis
RRVPVISEHRLVGIVT

SEQ ID NO: 127115 - protein, 16 aa, Mycobacterium tuberculosis
RVPVISEHRLVGIVTE

SEQ ID NO: 127116 - protein, 16 aa, Mycobacterium tuberculosis
VPVISEHRLVGIVTEA

SEQ ID NO: 127117 - protein, 16 aa, Mycobacterium tuberculosis
PVISEHRLVGIVTEAD

SEQ ID NO: 127118 - protein, 16 aa, Mycobacterium tuberculosis
VISEHRLVGIVTEADI

SEQ ID NO: 127119 - protein, 16 aa, Mycobacterium tuberculosis
ISEHRLVGIVTEADIA

SEQ ID NO: 127120 - protein, 16 aa, Mycobacterium tuberculosis
SEHRLVGIVTEADIAR

SEQ ID NO: 127121 - protein, 16 aa, Mycobacterium tuberculosis
EHRLVGIVTEADIARH

SEQ ID NO: 127122 - protein, 16 aa, Mycobacterium tuberculosis
HRLVGIVTEADIARHL

SEQ ID NO: 127123 - protein, 16 aa, Mycobacterium tuberculosis
RLVGIVTEADIARHLP

SEQ ID NO: 127124 - protein, 16 aa, Mycobacterium tuberculosis
LVGIVTEADIARHLPE

SEQ ID NO: 127125 - protein, 16 aa, Mycobacterium tuberculosis
VGIVTEADIARHLPEH

SEQ ID NO: 127126 - protein, 16 aa, Mycobacterium tuberculosis
GIVTEADIARHLPEHA

SEQ ID NO: 127127 - protein, 16 aa, Mycobacterium tuberculosis
IVTEADIARHLPEHAI

SEQ ID NO: 127128 - protein, 16 aa, Mycobacterium tuberculosis
VTEADIARHLPEHAIV

SEQ ID NO: 127129 - protein, 16 aa, Mycobacterium tuberculosis
TEADIARHLPEHAIVQ

SEQ ID NO: 127130 - protein, 16 aa, Mycobacterium tuberculosis
EADIARHLPEHAIVQF

SEQ ID NO: 127131 - protein, 16 aa, Mycobacterium tuberculosis
ADIARHLPEHAIVQFV

SEQ ID NO: 127132 - protein, 16 aa, Mycobacterium tuberculosis
DIARHLPEHAIVQFVK

SEQ ID NO: 127133 - protein, 16 aa, Mycobacterium tuberculosis
IARHLPEHAIVQFVKA

SEQ ID NO: 127134 - protein, 16 aa, Mycobacterium tuberculosis
ARHLPEHAIVQFVKAI

SEQ ID NO: 127135 - protein, 16 aa, Mycobacterium tuberculosis
RHLPEHAIVQFVKAIC

SEQ ID NO: 127136 - protein, 16 aa, Mycobacterium tuberculosis
HLPEHAIVQFVKAICS

SEQ ID NO: 127137 - protein, 16 aa, Mycobacterium tuberculosis
LPEHAIVQFVKAICSP

SEQ ID NO: 127138 - protein, 16 aa, Mycobacterium tuberculosis
PEHAIVQFVKAICSPM

SEQ ID NO: 127139 - protein, 16 aa, Mycobacterium tuberculosis
EHAIVQFVKAICSPMA

SEQ ID NO: 127140 - protein, 16 aa, Mycobacterium tuberculosis
HAIVQFVKAICSPMAL

SEQ ID NO: 127141 - protein, 16 aa, Mycobacterium tuberculosis
AIVQFVKAICSPMALA

SEQ ID NO: 127142 - protein, 16 aa, Mycobacterium tuberculosis
IVQFVKAICSPMALAS

SEQ ID NO: 127143 - protein, 295 aa, Mycobacterium tuberculosis
MSKPRKQHGVVVGVDGSLESDAAACWGATDAAMRNIPLTVVHVVNADVATWPPMPYPETWGVWQEDEGRQIVANAVKLAKEAVGADRKLSVKSELVFSTPVPTMVEISNEAEMVVLGSSGRGALARGLLGSVSSSLVRRAGCPVAVIHSDDAVIPDPQHAPVLVGIDGSPVSELATAVAFDEASRRGVELIAVHAWSDVEVVELPGLDFSAVQQEAELSLAERLAGWQERYPDVPVSRVVVCDRPARKLVQKSASAQLVVVGSHGRGGLTGMLLGSVSNAVLHAARVPVIVARQS

SEQ ID NO: 127144 - protein, 8 aa, Mycobacterium tuberculosis
KPRKQHGV

SEQ ID NO: 127145 - protein, 8 aa, Mycobacterium tuberculosis
SLESDAAA

SEQ ID NO: 127146 - protein, 8 aa, Mycobacterium tuberculosis
ESDAAACW

SEQ ID NO: 127147 - protein, 8 aa, Mycobacterium tuberculosis
DAAACWGA

SEQ ID NO: 127148 - protein, 8 aa, Mycobacterium tuberculosis
WGATDAAM

SEQ ID NO: 127149 - protein, 8 aa, Mycobacterium tuberculosis
GATDAAMR

SEQ ID NO: 127150 - protein, 8 aa, Mycobacterium tuberculosis
AAMRNIPL

SEQ ID NO: 127151 - protein, 8 aa, Mycobacterium tuberculosis
AMRNIPLT

SEQ ID NO: 127152 - protein, 8 aa, Mycobacterium tuberculosis
IPLTVVHV

SEQ ID NO: 127153 - protein, 8 aa, Mycobacterium tuberculosis
PLTVVHVV

SEQ ID NO: 127154 - protein, 8 aa, Mycobacterium tuberculosis
TVVHVVNA

SEQ ID NO: 127155 - protein, 8 aa, Mycobacterium tuberculosis
VNADVATW

SEQ ID NO: 127156 - protein, 8 aa, Mycobacterium tuberculosis
DVATWPPM

SEQ ID NO: 127157 - protein, 8 aa, Mycobacterium tuberculosis
ATWPPMPY

SEQ ID NO: 127158 - protein, 8 aa, Mycobacterium tuberculosis
MPYPETWG

SEQ ID NO: 127159 - protein, 8 aa, Mycobacterium tuberculosis
PYPETWGV

SEQ ID NO: 127160 - protein, 8 aa, Mycobacterium tuberculosis
YPETWGVW

SEQ ID NO: 127161 - protein, 8 aa, Mycobacterium tuberculosis
RQIVANAV

SEQ ID NO: 127162 - protein, 8 aa, Mycobacterium tuberculosis
QIVANAVK

SEQ ID NO: 127163 - protein, 8 aa, Mycobacterium tuberculosis
IVANAVKL

SEQ ID NO: 127164 - protein, 8 aa, Mycobacterium tuberculosis
EAVGADRK

SEQ ID NO: 127165 - protein, 8 aa, Mycobacterium tuberculosis
GADRKLSV

SEQ ID NO: 127166 - protein, 8 aa, Mycobacterium tuberculosis
KLSVKSEL

SEQ ID NO: 127167 - protein, 8 aa, Mycobacterium tuberculosis
SVKSELVF

SEQ ID NO: 127168 - protein, 8 aa, Mycobacterium tuberculosis
ELVFSTPV

SEQ ID NO: 127169 - protein, 8 aa, Mycobacterium tuberculosis
FSTPVPTM

SEQ ID NO: 127170 - protein, 8 aa, Mycobacterium tuberculosis
STPVPTMV

SEQ ID NO: 127171 - protein, 8 aa, Mycobacterium tuberculosis
VPTMVEIS

SEQ ID NO: 127172 - protein, 8 aa, Mycobacterium tuberculosis
EISNEAEM

SEQ ID NO: 127173 - protein, 8 aa, Mycobacterium tuberculosis
NEAEMVVL

SEQ ID NO: 127174 - protein, 8 aa, Mycobacterium tuberculosis
AEMVVLGS

SEQ ID NO: 127175 - protein, 8 aa, Mycobacterium tuberculosis
VVLGSSGR

SEQ ID NO: 127176 - protein, 8 aa, Mycobacterium tuberculosis
SGRGALAR

SEQ ID NO: 127177 - protein, 8 aa, Mycobacterium tuberculosis
GLLGSVSS

SEQ ID NO: 127178 - protein, 8 aa, Mycobacterium tuberculosis
LLGSVSSS

SEQ ID NO: 127179 - protein, 8 aa, Mycobacterium tuberculosis
SVSSSLVR

SEQ ID NO: 127180 - protein, 8 aa, Mycobacterium tuberculosis
VSSSLVRR

SEQ ID NO: 127181 - protein, 8 aa, Mycobacterium tuberculosis
RAGCPVAV

SEQ ID NO: 127182 - protein, 8 aa, Mycobacterium tuberculosis
CPVAVIHS

SEQ ID NO: 127183 - protein, 8 aa, Mycobacterium tuberculosis
VIHSDDAV

SEQ ID NO: 127184 - protein, 8 aa, Mycobacterium tuberculosis
VIPDPQHA

SEQ ID NO: 127185 - protein, 8 aa, Mycobacterium tuberculosis
DPQHAPVL

SEQ ID NO: 127186 - protein, 8 aa, Mycobacterium tuberculosis
HAPVLVGI

SEQ ID NO: 127187 - protein, 8 aa, Mycobacterium tuberculosis
VGIDGSPV

SEQ ID NO: 127188 - protein, 8 aa, Mycobacterium tuberculosis
DGSPVSEL

SEQ ID NO: 127189 - protein, 8 aa, Mycobacterium tuberculosis
SPVSELAT

SEQ ID NO: 127190 - protein, 8 aa, Mycobacterium tuberculosis
ELATAVAF

SEQ ID NO: 127191 - protein, 8 aa, Mycobacterium tuberculosis
TAVAFDEA

SEQ ID NO: 127192 - protein, 8 aa, Mycobacterium tuberculosis
VAFDEASR

SEQ ID NO: 127193 - protein, 8 aa, Mycobacterium tuberculosis
RGVELIAV

SEQ ID NO: 127194 - protein, 8 aa, Mycobacterium tuberculosis
ELIAVHAW

SEQ ID NO: 127195 - protein, 8 aa, Mycobacterium tuberculosis
AVHAWSDV

SEQ ID NO: 127196 - protein, 8 aa, Mycobacterium tuberculosis
HAWSDVEV

SEQ ID NO: 127197 - protein, 8 aa, Mycobacterium tuberculosis
EVVELPGL

SEQ ID NO: 127198 - protein, 8 aa, Mycobacterium tuberculosis
VELPGLDF

SEQ ID NO: 127199 - protein, 8 aa, Mycobacterium tuberculosis
ELPGLDFS

SEQ ID NO: 127200 - protein, 8 aa, Mycobacterium tuberculosis
LPGLDFSA

SEQ ID NO: 127201 - protein, 8 aa, Mycobacterium tuberculosis
PGLDFSAV

SEQ ID NO: 127202 - protein, 8 aa, Mycobacterium tuberculosis
GLDFSAVQ

SEQ ID NO: 127203 - protein, 8 aa, Mycobacterium tuberculosis
FSAVQQEA

SEQ ID NO: 127204 - protein, 8 aa, Mycobacterium tuberculosis
AVQQEAEL

SEQ ID NO: 127205 - protein, 8 aa, Mycobacterium tuberculosis
ELSLAERL

SEQ ID NO: 127206 - protein, 8 aa, Mycobacterium tuberculosis
SLAERLAG

SEQ ID NO: 127207 - protein, 8 aa, Mycobacterium tuberculosis
RLAGWQER

SEQ ID NO: 127208 - protein, 8 aa, Mycobacterium tuberculosis
LAGWQERY

SEQ ID NO: 127209 - protein, 8 aa, Mycobacterium tuberculosis
ERYPDVPV

SEQ ID NO: 127210 - protein, 8 aa, Mycobacterium tuberculosis
DVPVSRVV

SEQ ID NO: 127211 - protein, 8 aa, Mycobacterium tuberculosis
VPVSRVVV

SEQ ID NO: 127212 - protein, 8 aa, Mycobacterium tuberculosis
VVCDRPAR

SEQ ID NO: 127213 - protein, 8 aa, Mycobacterium tuberculosis
RPARKLVQ

SEQ ID NO: 127214 - protein, 8 aa, Mycobacterium tuberculosis
PARKLVQK

SEQ ID NO: 127215 - protein, 8 aa, Mycobacterium tuberculosis
KSASAQLV

SEQ ID NO: 127216 - protein, 8 aa, Mycobacterium tuberculosis
SASAQLVV

SEQ ID NO: 127217 - protein, 8 aa, Mycobacterium tuberculosis
VVVGSHGR

SEQ ID NO: 127218 - protein, 8 aa, Mycobacterium tuberculosis
GRGGLTGM

SEQ ID NO: 127219 - protein, 8 aa, Mycobacterium tuberculosis
GLTGMLLG

SEQ ID NO: 127220 - protein, 8 aa, Mycobacterium tuberculosis
TGMLLGSV

SEQ ID NO: 127221 - protein, 8 aa, Mycobacterium tuberculosis
MLLGSVSN

SEQ ID NO: 127222 - protein, 8 aa, Mycobacterium tuberculosis
LLGSVSNA

SEQ ID NO: 127223 - protein, 8 aa, Mycobacterium tuberculosis
SVSNAVLH

SEQ ID NO: 127224 - protein, 8 aa, Mycobacterium tuberculosis
NAVLHAAR

SEQ ID NO: 127225 - protein, 8 aa, Mycobacterium tuberculosis
AVLHAARV

SEQ ID NO: 127226 - protein, 8 aa, Mycobacterium tuberculosis
HAARVPVI

SEQ ID NO: 127227 - protein, 8 aa, Mycobacterium tuberculosis
RVPVIVAR

SEQ ID NO: 127228 - protein, 9 aa, Mycobacterium tuberculosis
SKPRKQHGV

SEQ ID NO: 127229 - protein, 9 aa, Mycobacterium tuberculosis
KPRKQHGVV

SEQ ID NO: 127230 - protein, 9 aa, Mycobacterium tuberculosis
KQHGVVVGV

SEQ ID NO: 127231 - protein, 9 aa, Mycobacterium tuberculosis
VVVGVDGSL

SEQ ID NO: 127232 - protein, 9 aa, Mycobacterium tuberculosis
LESDAAACW

SEQ ID NO: 127233 - protein, 9 aa, Mycobacterium tuberculosis
DAAACWGAT

SEQ ID NO: 127234 - protein, 9 aa, Mycobacterium tuberculosis
WGATDAAMR

SEQ ID NO: 127235 - protein, 9 aa, Mycobacterium tuberculosis
DAAMRNIPL

SEQ ID NO: 127236 - protein, 9 aa, Mycobacterium tuberculosis
AMRNIPLTV

SEQ ID NO: 127237 - protein, 9 aa, Mycobacterium tuberculosis
NIPLTVVHV

SEQ ID NO: 127238 - protein, 9 aa, Mycobacterium tuberculosis
IPLTVVHVV

SEQ ID NO: 127239 - protein, 9 aa, Mycobacterium tuberculosis
VVHVVNADV

SEQ ID NO: 127240 - protein, 9 aa, Mycobacterium tuberculosis
HVVNADVAT

SEQ ID NO: 127241 - protein, 9 aa, Mycobacterium tuberculosis
VVNADVATW

SEQ ID NO: 127242 - protein, 9 aa, Mycobacterium tuberculosis
VATWPPMPY

SEQ ID NO: 127243 - protein, 9 aa, Mycobacterium tuberculosis
WPPMPYPET

SEQ ID NO: 127244 - protein, 9 aa, Mycobacterium tuberculosis
PPMPYPETW

SEQ ID NO: 127245 - protein, 9 aa, Mycobacterium tuberculosis
MPYPETWGV

SEQ ID NO: 127246 - protein, 9 aa, Mycobacterium tuberculosis
PYPETWGVW

SEQ ID NO: 127247 - protein, 9 aa, Mycobacterium tuberculosis
QEDEGRQIV

SEQ ID NO: 127248 - protein, 9 aa, Mycobacterium tuberculosis
RQIVANAVK

SEQ ID NO: 127249 - protein, 9 aa, Mycobacterium tuberculosis
QIVANAVKL

SEQ ID NO: 127250 - protein, 9 aa, Mycobacterium tuberculosis
IVANAVKLA

SEQ ID NO: 127251 - protein, 9 aa, Mycobacterium tuberculosis
VANAVKLAK

SEQ ID NO: 127252 - protein, 9 aa, Mycobacterium tuberculosis
KLAKEAVGA

SEQ ID NO: 127253 - protein, 9 aa, Mycobacterium tuberculosis
VGADRKLSV

SEQ ID NO: 127254 - protein, 9 aa, Mycobacterium tuberculosis
KLSVKSELV

SEQ ID NO: 127255 - protein, 9 aa, Mycobacterium tuberculosis
LSVKSELVF

SEQ ID NO: 127256 - protein, 9 aa, Mycobacterium tuberculosis
SELVFSTPV

SEQ ID NO: 127257 - protein, 9 aa, Mycobacterium tuberculosis
LVFSTPVPT

SEQ ID NO: 127258 - protein, 9 aa, Mycobacterium tuberculosis
FSTPVPTMV

SEQ ID NO: 127259 - protein, 9 aa, Mycobacterium tuberculosis
TPVPTMVEI

SEQ ID NO: 127260 - protein, 9 aa, Mycobacterium tuberculosis
TMVEISNEA

SEQ ID NO: 127261 - protein, 9 aa, Mycobacterium tuberculosis
EISNEAEMV

SEQ ID NO: 127262 - protein, 9 aa, Mycobacterium tuberculosis
AEMVVLGSS

SEQ ID NO: 127263 - protein, 9 aa, Mycobacterium tuberculosis
MVVLGSSGR

SEQ ID NO: 127264 - protein, 9 aa, Mycobacterium tuberculosis
VLGSSGRGA

SEQ ID NO: 127265 - protein, 9 aa, Mycobacterium tuberculosis
SSGRGALAR

SEQ ID NO: 127266 - protein, 9 aa, Mycobacterium tuberculosis
ALARGLLGS

SEQ ID NO: 127267 - protein, 9 aa, Mycobacterium tuberculosis
LARGLLGSV

SEQ ID NO: 127268 - protein, 9 aa, Mycobacterium tuberculosis
GLLGSVSSS

SEQ ID NO: 127269 - protein, 9 aa, Mycobacterium tuberculosis
LLGSVSSSL

SEQ ID NO: 127270 - protein, 9 aa, Mycobacterium tuberculosis
GSVSSSLVR

SEQ ID NO: 127271 - protein, 9 aa, Mycobacterium tuberculosis
SVSSSLVRR

SEQ ID NO: 127272 - protein, 9 aa, Mycobacterium tuberculosis
LVRRAGCPV

SEQ ID NO: 127273 - protein, 9 aa, Mycobacterium tuberculosis
RRAGCPVAV

SEQ ID NO: 127274 - protein, 9 aa, Mycobacterium tuberculosis
CPVAVIHSD

SEQ ID NO: 127275 - protein, 9 aa, Mycobacterium tuberculosis
AVIHSDDAV

SEQ ID NO: 127276 - protein, 9 aa, Mycobacterium tuberculosis
VIPDPQHAP

SEQ ID NO: 127277 - protein, 9 aa, Mycobacterium tuberculosis
IPDPQHAPV

SEQ ID NO: 127278 - protein, 9 aa, Mycobacterium tuberculosis
LVGIDGSPV

SEQ ID NO: 127279 - protein, 9 aa, Mycobacterium tuberculosis
DGSPVSELA

SEQ ID NO: 127280 - protein, 9 aa, Mycobacterium tuberculosis
SPVSELATA

SEQ ID NO: 127281 - protein, 9 aa, Mycobacterium tuberculosis
PVSELATAV

SEQ ID NO: 127282 - protein, 9 aa, Mycobacterium tuberculosis
SELATAVAF

SEQ ID NO: 127283 - protein, 9 aa, Mycobacterium tuberculosis
ATAVAFDEA

SEQ ID NO: 127284 - protein, 9 aa, Mycobacterium tuberculosis
TAVAFDEAS

SEQ ID NO: 127285 - protein, 9 aa, Mycobacterium tuberculosis
AVAFDEASR

SEQ ID NO: 127286 - protein, 9 aa, Mycobacterium tuberculosis
VAFDEASRR

SEQ ID NO: 127287 - protein, 9 aa, Mycobacterium tuberculosis
VELIAVHAW

SEQ ID NO: 127288 - protein, 9 aa, Mycobacterium tuberculosis
ELIAVHAWS

SEQ ID NO: 127289 - protein, 9 aa, Mycobacterium tuberculosis
HAWSDVEVV

SEQ ID NO: 127290 - protein, 9 aa, Mycobacterium tuberculosis
VEVVELPGL

SEQ ID NO: 127291 - protein, 9 aa, Mycobacterium tuberculosis
ELPGLDFSA

SEQ ID NO: 127292 - protein, 9 aa, Mycobacterium tuberculosis
LPGLDFSAV

SEQ ID NO: 127293 - protein, 9 aa, Mycobacterium tuberculosis
GLDFSAVQQ

SEQ ID NO: 127294 - protein, 9 aa, Mycobacterium tuberculosis
SAVQQEAEL

SEQ ID NO: 127295 - protein, 9 aa, Mycobacterium tuberculosis
VQQEAELSL

SEQ ID NO: 127296 - protein, 9 aa, Mycobacterium tuberculosis
QQEAELSLA

SEQ ID NO: 127297 - protein, 9 aa, Mycobacterium tuberculosis
EAELSLAER

SEQ ID NO: 127298 - protein, 9 aa, Mycobacterium tuberculosis
AELSLAERL

SEQ ID NO: 127299 - protein, 9 aa, Mycobacterium tuberculosis
SLAERLAGW

SEQ ID NO: 127300 - protein, 9 aa, Mycobacterium tuberculosis
RLAGWQERY

SEQ ID NO: 127301 - protein, 9 aa, Mycobacterium tuberculosis
RYPDVPVSR

SEQ ID NO: 127302 - protein, 9 aa, Mycobacterium tuberculosis
YPDVPVSRV

SEQ ID NO: 127303 - protein, 9 aa, Mycobacterium tuberculosis
DVPVSRVVV

SEQ ID NO: 127304 - protein, 9 aa, Mycobacterium tuberculosis
VPVSRVVVC

SEQ ID NO: 127305 - protein, 9 aa, Mycobacterium tuberculosis
VSRVVVCDR

SEQ ID NO: 127306 - protein, 9 aa, Mycobacterium tuberculosis
VVVCDRPAR

SEQ ID NO: 127307 - protein, 9 aa, Mycobacterium tuberculosis
VVCDRPARK

SEQ ID NO: 127308 - protein, 9 aa, Mycobacterium tuberculosis
KLVQKSASA

SEQ ID NO: 127309 - protein, 9 aa, Mycobacterium tuberculosis
VQKSASAQL

SEQ ID NO: 127310 - protein, 9 aa, Mycobacterium tuberculosis
KSASAQLVV

SEQ ID NO: 127311 - protein, 9 aa, Mycobacterium tuberculosis
SASAQLVVV

SEQ ID NO: 127312 - protein, 9 aa, Mycobacterium tuberculosis
LVVVGSHGR

SEQ ID NO: 127313 - protein, 9 aa, Mycobacterium tuberculosis
GLTGMLLGS

SEQ ID NO: 127314 - protein, 9 aa, Mycobacterium tuberculosis
LTGMLLGSV

SEQ ID NO: 127315 - protein, 9 aa, Mycobacterium tuberculosis
MLLGSVSNA

SEQ ID NO: 127316 - protein, 9 aa, Mycobacterium tuberculosis
LLGSVSNAV

SEQ ID NO: 127317 - protein, 9 aa, Mycobacterium tuberculosis
SNAVLHAAR

SEQ ID NO: 127318 - protein, 9 aa, Mycobacterium tuberculosis
NAVLHAARV

SEQ ID NO: 127319 - protein, 9 aa, Mycobacterium tuberculosis
VLHAARVPV

SEQ ID NO: 127320 - protein, 9 aa, Mycobacterium tuberculosis
HAARVPVIV

SEQ ID NO: 127321 - protein, 9 aa, Mycobacterium tuberculosis
VPVIVARQS

SEQ ID NO: 127322 - protein, 10 aa, Mycobacterium tuberculosis
KPRKQHGVVV

SEQ ID NO: 127323 - protein, 10 aa, Mycobacterium tuberculosis
ACWGATDAAM

SEQ ID NO: 127324 - protein, 10 aa, Mycobacterium tuberculosis
TDAAMRNIPL

SEQ ID NO: 127325 - protein, 10 aa, Mycobacterium tuberculosis
AAMRNIPLTV

SEQ ID NO: 127326 - protein, 10 aa, Mycobacterium tuberculosis
AMRNIPLTVV

SEQ ID NO: 127327 - protein, 10 aa, Mycobacterium tuberculosis
NIPLTVVHVV

SEQ ID NO: 127328 - protein, 10 aa, Mycobacterium tuberculosis
IPLTVVHVVN

SEQ ID NO: 127329 - protein, 10 aa, Mycobacterium tuberculosis
PLTVVHVVNA

SEQ ID NO: 127330 - protein, 10 aa, Mycobacterium tuberculosis
TVVHVVNADV

SEQ ID NO: 127331 - protein, 10 aa, Mycobacterium tuberculosis
HVVNADVATW

SEQ ID NO: 127332 - protein, 10 aa, Mycobacterium tuberculosis
NADVATWPPM

SEQ ID NO: 127333 - protein, 10 aa, Mycobacterium tuberculosis
DVATWPPMPY

SEQ ID NO: 127334 - protein, 10 aa, Mycobacterium tuberculosis
WPPMPYPETW

SEQ ID NO: 127335 - protein, 10 aa, Mycobacterium tuberculosis
PMPYPETWGV

SEQ ID NO: 127336 - protein, 10 aa, Mycobacterium tuberculosis
MPYPETWGVW

SEQ ID NO: 127337 - protein, 10 aa, Mycobacterium tuberculosis
WQEDEGRQIV

SEQ ID NO: 127338 - protein, 10 aa, Mycobacterium tuberculosis
EGRQIVANAV

SEQ ID NO: 127339 - protein, 10 aa, Mycobacterium tuberculosis
GRQIVANAVK

SEQ ID NO: 127340 - protein, 10 aa, Mycobacterium tuberculosis
RQIVANAVKL

SEQ ID NO: 127341 - protein, 10 aa, Mycobacterium tuberculosis
IVANAVKLAK

SEQ ID NO: 127342 - protein, 10 aa, Mycobacterium tuberculosis
NAVKLAKEAV

SEQ ID NO: 127343 - protein, 10 aa, Mycobacterium tuberculosis
LAKEAVGADR

SEQ ID NO: 127344 - protein, 10 aa, Mycobacterium tuberculosis
KEAVGADRKL

SEQ ID NO: 127345 - protein, 10 aa, Mycobacterium tuberculosis
AVGADRKLSV

SEQ ID NO: 127346 - protein, 10 aa, Mycobacterium tuberculosis
KLSVKSELVF

SEQ ID NO: 127347 - protein, 10 aa, Mycobacterium tuberculosis
LVFSTPVPTM

SEQ ID NO: 127348 - protein, 10 aa, Mycobacterium tuberculosis
STPVPTMVEI

SEQ ID NO: 127349 - protein, 10 aa, Mycobacterium tuberculosis
TPVPTMVEIS

SEQ ID NO: 127350 - protein, 10 aa, Mycobacterium tuberculosis
MVEISNEAEM

SEQ ID NO: 127351 - protein, 10 aa, Mycobacterium tuberculosis
VEISNEAEMV

SEQ ID NO: 127352 - protein, 10 aa, Mycobacterium tuberculosis
EISNEAEMVV

SEQ ID NO: 127353 - protein, 10 aa, Mycobacterium tuberculosis
ISNEAEMVVL

SEQ ID NO: 127354 - protein, 10 aa, Mycobacterium tuberculosis
EMVVLGSSGR

SEQ ID NO: 127355 - protein, 10 aa, Mycobacterium tuberculosis
VLGSSGRGAL

SEQ ID NO: 127356 - protein, 10 aa, Mycobacterium tuberculosis
GSSGRGALAR

SEQ ID NO: 127357 - protein, 10 aa, Mycobacterium tuberculosis
ALARGLLGSV

SEQ ID NO: 127358 - protein, 10 aa, Mycobacterium tuberculosis
GLLGSVSSSL

SEQ ID NO: 127359 - protein, 10 aa, Mycobacterium tuberculosis
LLGSVSSSLV

SEQ ID NO: 127360 - protein, 10 aa, Mycobacterium tuberculosis
GSVSSSLVRR

SEQ ID NO: 127361 - protein, 10 aa, Mycobacterium tuberculosis
SVSSSLVRRA

SEQ ID NO: 127362 - protein, 10 aa, Mycobacterium tuberculosis
SLVRRAGCPV

SEQ ID NO: 127363 - protein, 10 aa, Mycobacterium tuberculosis
RRAGCPVAVI

SEQ ID NO: 127364 - protein, 10 aa, Mycobacterium tuberculosis
AVIHSDDAVI

SEQ ID NO: 127365 - protein, 10 aa, Mycobacterium tuberculosis
VIPDPQHAPV

SEQ ID NO: 127366 - protein, 10 aa, Mycobacterium tuberculosis
IPDPQHAPVL

SEQ ID NO: 127367 - protein, 10 aa, Mycobacterium tuberculosis
APVLVGIDGS

SEQ ID NO: 127368 - protein, 10 aa, Mycobacterium tuberculosis
VLVGIDGSPV

SEQ ID NO: 127369 - protein, 10 aa, Mycobacterium tuberculosis
GIDGSPVSEL

SEQ ID NO: 127370 - protein, 10 aa, Mycobacterium tuberculosis
SPVSELATAV

SEQ ID NO: 127371 - protein, 10 aa, Mycobacterium tuberculosis
VSELATAVAF

SEQ ID NO: 127372 - protein, 10 aa, Mycobacterium tuberculosis
LATAVAFDEA

SEQ ID NO: 127373 - protein, 10 aa, Mycobacterium tuberculosis
TAVAFDEASR

SEQ ID NO: 127374 - protein, 10 aa, Mycobacterium tuberculosis
AVAFDEASRR

SEQ ID NO: 127375 - protein, 10 aa, Mycobacterium tuberculosis
AFDEASRRGV

SEQ ID NO: 127376 - protein, 10 aa, Mycobacterium tuberculosis
EASRRGVELI

SEQ ID NO: 127377 - protein, 10 aa, Mycobacterium tuberculosis
LIAVHAWSDV

SEQ ID NO: 127378 - protein, 10 aa, Mycobacterium tuberculosis
AVHAWSDVEV

SEQ ID NO: 127379 - protein, 10 aa, Mycobacterium tuberculosis
EVVELPGLDF

SEQ ID NO: 127380 - protein, 10 aa, Mycobacterium tuberculosis
VELPGLDFSA

SEQ ID NO: 127381 - protein, 10 aa, Mycobacterium tuberculosis
ELPGLDFSAV

SEQ ID NO: 127382 - protein, 10 aa, Mycobacterium tuberculosis
FSAVQQEAEL

SEQ ID NO: 127383 - protein, 10 aa, Mycobacterium tuberculosis
AVQQEAELSL

SEQ ID NO: 127384 - protein, 10 aa, Mycobacterium tuberculosis
VQQEAELSLA

SEQ ID NO: 127385 - protein, 10 aa, Mycobacterium tuberculosis
AELSLAERLA

SEQ ID NO: 127386 - protein, 10 aa, Mycobacterium tuberculosis
LSLAERLAGW

SEQ ID NO: 127387 - protein, 10 aa, Mycobacterium tuberculosis
SLAERLAGWQ

SEQ ID NO: 127388 - protein, 10 aa, Mycobacterium tuberculosis
RLAGWQERYP

SEQ ID NO: 127389 - protein, 10 aa, Mycobacterium tuberculosis
WQERYPDVPV

SEQ ID NO: 127390 - protein, 10 aa, Mycobacterium tuberculosis
ERYPDVPVSR

SEQ ID NO: 127391 - protein, 10 aa, Mycobacterium tuberculosis
RYPDVPVSRV

SEQ ID NO: 127392 - protein, 10 aa, Mycobacterium tuberculosis
YPDVPVSRVV

SEQ ID NO: 127393 - protein, 10 aa, Mycobacterium tuberculosis
PVSRVVVCDR

SEQ ID NO: 127394 - protein, 10 aa, Mycobacterium tuberculosis
RVVVCDRPAR

SEQ ID NO: 127395 - protein, 10 aa, Mycobacterium tuberculosis
VVVCDRPARK

SEQ ID NO: 127396 - protein, 10 aa, Mycobacterium tuberculosis
VVCDRPARKL

SEQ ID NO: 127397 - protein, 10 aa, Mycobacterium tuberculosis
LVQKSASAQL

SEQ ID NO: 127398 - protein, 10 aa, Mycobacterium tuberculosis
VQKSASAQLV

SEQ ID NO: 127399 - protein, 10 aa, Mycobacterium tuberculosis
KSASAQLVVV

SEQ ID NO: 127400 - protein, 10 aa, Mycobacterium tuberculosis
QLVVVGSHGR

SEQ ID NO: 127401 - protein, 10 aa, Mycobacterium tuberculosis
GLTGMLLGSV

SEQ ID NO: 127402 - protein, 10 aa, Mycobacterium tuberculosis
GMLLGSVSNA

SEQ ID NO: 127403 - protein, 10 aa, Mycobacterium tuberculosis
MLLGSVSNAV

SEQ ID NO: 127404 - protein, 10 aa, Mycobacterium tuberculosis
LLGSVSNAVL

SEQ ID NO: 127405 - protein, 10 aa, Mycobacterium tuberculosis
SVSNAVLHAA

SEQ ID NO: 127406 - protein, 10 aa, Mycobacterium tuberculosis
VSNAVLHAAR

SEQ ID NO: 127407 - protein, 10 aa, Mycobacterium tuberculosis
AVLHAARVPV

SEQ ID NO: 127408 - protein, 10 aa, Mycobacterium tuberculosis
VLHAARVPVI

SEQ ID NO: 127409 - protein, 10 aa, Mycobacterium tuberculosis
HAARVPVIVA

SEQ ID NO: 127410 - protein, 10 aa, Mycobacterium tuberculosis
AARVPVIVAR

SEQ ID NO: 127411 - protein, 11 aa, Mycobacterium tuberculosis
KPRKQHGVVVG

SEQ ID NO: 127412 - protein, 11 aa, Mycobacterium tuberculosis
GVDGSLESDAA

SEQ ID NO: 127413 - protein, 11 aa, Mycobacterium tuberculosis
GSLESDAAACW

SEQ ID NO: 127414 - protein, 11 aa, Mycobacterium tuberculosis
AAACWGATDAA

SEQ ID NO: 127415 - protein, 11 aa, Mycobacterium tuberculosis
AACWGATDAAM

SEQ ID NO: 127416 - protein, 11 aa, Mycobacterium tuberculosis
DAAMRNIPLTV

SEQ ID NO: 127417 - protein, 11 aa, Mycobacterium tuberculosis
AAMRNIPLTVV

SEQ ID NO: 127418 - protein, 11 aa, Mycobacterium tuberculosis
AMRNIPLTVVH

SEQ ID NO: 127419 - protein, 11 aa, Mycobacterium tuberculosis
IPLTVVHVVNA

SEQ ID NO: 127420 - protein, 11 aa, Mycobacterium tuberculosis
LTVVHVVNADV

SEQ ID NO: 127421 - protein, 11 aa, Mycobacterium tuberculosis
TVVHVVNADVA

SEQ ID NO: 127422 - protein, 11 aa, Mycobacterium tuberculosis
ATWPPMPYPET

SEQ ID NO: 127423 - protein, 11 aa, Mycobacterium tuberculosis
TWPPMPYPETW

SEQ ID NO: 127424 - protein, 11 aa, Mycobacterium tuberculosis
PPMPYPETWGV

SEQ ID NO: 127425 - protein, 11 aa, Mycobacterium tuberculosis
MPYPETWGVWQ

SEQ ID NO: 127426 - protein, 11 aa, Mycobacterium tuberculosis
RQIVANAVKLA

SEQ ID NO: 127427 - protein, 11 aa, Mycobacterium tuberculosis
QIVANAVKLAK

SEQ ID NO: 127428 - protein, 11 aa, Mycobacterium tuberculosis
KLAKEAVGADR

SEQ ID NO: 127429 - protein, 11 aa, Mycobacterium tuberculosis
LAKEAVGADRK

SEQ ID NO: 127430 - protein, 11 aa, Mycobacterium tuberculosis
EAVGADRKLSV

SEQ ID NO: 127431 - protein, 11 aa, Mycobacterium tuberculosis
AVGADRKLSVK

SEQ ID NO: 127432 - protein, 11 aa, Mycobacterium tuberculosis
RKLSVKSELVF

SEQ ID NO: 127433 - protein, 11 aa, Mycobacterium tuberculosis
KLSVKSELVFS

SEQ ID NO: 127434 - protein, 11 aa, Mycobacterium tuberculosis
VKSELVFSTPV

SEQ ID NO: 127435 - protein, 11 aa, Mycobacterium tuberculosis
SELVFSTPVPT

SEQ ID NO: 127436 - protein, 11 aa, Mycobacterium tuberculosis
ELVFSTPVPTM

SEQ ID NO: 127437 - protein, 11 aa, Mycobacterium tuberculosis
LVFSTPVPTMV

SEQ ID NO: 127438 - protein, 11 aa, Mycobacterium tuberculosis
FSTPVPTMVEI

SEQ ID NO: 127439 - protein, 11 aa, Mycobacterium tuberculosis
VPTMVEISNEA

SEQ ID NO: 127440 - protein, 11 aa, Mycobacterium tuberculosis
TMVEISNEAEM

SEQ ID NO: 127441 - protein, 11 aa, Mycobacterium tuberculosis
MVEISNEAEMV

SEQ ID NO: 127442 - protein, 11 aa, Mycobacterium tuberculosis
VEISNEAEMVV

SEQ ID NO: 127443 - protein, 11 aa, Mycobacterium tuberculosis
EISNEAEMVVL

SEQ ID NO: 127444 - protein, 11 aa, Mycobacterium tuberculosis
MVVLGSSGRGA

SEQ ID NO: 127445 - protein, 11 aa, Mycobacterium tuberculosis
VVLGSSGRGAL

SEQ ID NO: 127446 - protein, 11 aa, Mycobacterium tuberculosis
VLGSSGRGALA

SEQ ID NO: 127447 - protein, 11 aa, Mycobacterium tuberculosis
GALARGLLGSV

SEQ ID NO: 127448 - protein, 11 aa, Mycobacterium tuberculosis
GLLGSVSSSLV

SEQ ID NO: 127449 - protein, 11 aa, Mycobacterium tuberculosis
LLGSVSSSLVR

SEQ ID NO: 127450 - protein, 11 aa, Mycobacterium tuberculosis
SLVRRAGCPVA

SEQ ID NO: 127451 - protein, 11 aa, Mycobacterium tuberculosis
LVRRAGCPVAV

SEQ ID NO: 127452 - protein, 11 aa, Mycobacterium tuberculosis
RRAGCPVAVIH

SEQ ID NO: 127453 - protein, 11 aa, Mycobacterium tuberculosis
CPVAVIHSDDA

SEQ ID NO: 127454 - protein, 11 aa, Mycobacterium tuberculosis
PVAVIHSDDAV

SEQ ID NO: 127455 - protein, 11 aa, Mycobacterium tuberculosis
AVIPDPQHAPV

SEQ ID NO: 127456 - protein, 11 aa, Mycobacterium tuberculosis
VIPDPQHAPVL

SEQ ID NO: 127457 - protein, 11 aa, Mycobacterium tuberculosis
IPDPQHAPVLV

SEQ ID NO: 127458 - protein, 11 aa, Mycobacterium tuberculosis
PVLVGIDGSPV

SEQ ID NO: 127459 - protein, 11 aa, Mycobacterium tuberculosis
GIDGSPVSELA

SEQ ID NO: 127460 - protein, 11 aa, Mycobacterium tuberculosis
SPVSELATAVA

SEQ ID NO: 127461 - protein, 11 aa, Mycobacterium tuberculosis
PVSELATAVAF

SEQ ID NO: 127462 - protein, 11 aa, Mycobacterium tuberculosis
ELATAVAFDEA

SEQ ID NO: 127463 - protein, 11 aa, Mycobacterium tuberculosis
ATAVAFDEASR

SEQ ID NO: 127464 - protein, 11 aa, Mycobacterium tuberculosis
TAVAFDEASRR

SEQ ID NO: 127465 - protein, 11 aa, Mycobacterium tuberculosis
VAFDEASRRGV

SEQ ID NO: 127466 - protein, 11 aa, Mycobacterium tuberculosis
RGVELIAVHAW

SEQ ID NO: 127467 - protein, 11 aa, Mycobacterium tuberculosis
ELIAVHAWSDV

SEQ ID NO: 127468 - protein, 11 aa, Mycobacterium tuberculosis
IAVHAWSDVEV

SEQ ID NO: 127469 - protein, 11 aa, Mycobacterium tuberculosis
AVHAWSDVEVV

SEQ ID NO: 127470 - protein, 11 aa, Mycobacterium tuberculosis
HAWSDVEVVEL

SEQ ID NO: 127471 - protein, 11 aa, Mycobacterium tuberculosis
VEVVELPGLDF

SEQ ID NO: 127472 - protein, 11 aa, Mycobacterium tuberculosis
VELPGLDFSAV

SEQ ID NO: 127473 - protein, 11 aa, Mycobacterium tuberculosis
ELPGLDFSAVQ

SEQ ID NO: 127474 - protein, 11 aa, Mycobacterium tuberculosis
GLDFSAVQQEA

SEQ ID NO: 127475 - protein, 11 aa, Mycobacterium tuberculosis
SAVQQEAELSL

SEQ ID NO: 127476 - protein, 11 aa, Mycobacterium tuberculosis
QEAELSLAERL

SEQ ID NO: 127477 - protein, 11 aa, Mycobacterium tuberculosis
AELSLAERLAG

SEQ ID NO: 127478 - protein, 11 aa, Mycobacterium tuberculosis
SLAERLAGWQE

SEQ ID NO: 127479 - protein, 11 aa, Mycobacterium tuberculosis
LAERLAGWQER

SEQ ID NO: 127480 - protein, 11 aa, Mycobacterium tuberculosis
AERLAGWQERY

SEQ ID NO: 127481 - protein, 11 aa, Mycobacterium tuberculosis
RLAGWQERYPD

SEQ ID NO: 127482 - protein, 11 aa, Mycobacterium tuberculosis
ERYPDVPVSRV

SEQ ID NO: 127483 - protein, 11 aa, Mycobacterium tuberculosis
RYPDVPVSRVV

SEQ ID NO: 127484 - protein, 11 aa, Mycobacterium tuberculosis
YPDVPVSRVVV

SEQ ID NO: 127485 - protein, 11 aa, Mycobacterium tuberculosis
RVVVCDRPARK

SEQ ID NO: 127486 - protein, 11 aa, Mycobacterium tuberculosis
VVCDRPARKLV

SEQ ID NO: 127487 - protein, 11 aa, Mycobacterium tuberculosis
RPARKLVQKSA

SEQ ID NO: 127488 - protein, 11 aa, Mycobacterium tuberculosis
KLVQKSASAQL

SEQ ID NO: 127489 - protein, 11 aa, Mycobacterium tuberculosis
LVQKSASAQLV

SEQ ID NO: 127490 - protein, 11 aa, Mycobacterium tuberculosis
VQKSASAQLVV

SEQ ID NO: 127491 - protein, 11 aa, Mycobacterium tuberculosis
AQLVVVGSHGR

SEQ ID NO: 127492 - protein, 11 aa, Mycobacterium tuberculosis
SHGRGGLTGML

SEQ ID NO: 127493 - protein, 11 aa, Mycobacterium tuberculosis
GMLLGSVSNAV

SEQ ID NO: 127494 - protein, 11 aa, Mycobacterium tuberculosis
MLLGSVSNAVL

SEQ ID NO: 127495 - protein, 11 aa, Mycobacterium tuberculosis
SVSNAVLHAAR

SEQ ID NO: 127496 - protein, 11 aa, Mycobacterium tuberculosis
VSNAVLHAARV

SEQ ID NO: 127497 - protein, 11 aa, Mycobacterium tuberculosis
NAVLHAARVPV

SEQ ID NO: 127498 - protein, 11 aa, Mycobacterium tuberculosis
VLHAARVPVIV

SEQ ID NO: 127499 - protein, 11 aa, Mycobacterium tuberculosis
HAARVPVIVAR

SEQ ID NO: 127500 - protein, 13 aa, Mycobacterium tuberculosis
MSKPRKQHGVVVG

SEQ ID NO: 127501 - protein, 13 aa, Mycobacterium tuberculosis
SKPRKQHGVVVGV

SEQ ID NO: 127502 - protein, 13 aa, Mycobacterium tuberculosis
KPRKQHGVVVGVD

SEQ ID NO: 127503 - protein, 13 aa, Mycobacterium tuberculosis
PRKQHGVVVGVDG

SEQ ID NO: 127504 - protein, 13 aa, Mycobacterium tuberculosis
RKQHGVVVGVDGS

SEQ ID NO: 127505 - protein, 13 aa, Mycobacterium tuberculosis
KQHGVVVGVDGSL

SEQ ID NO: 127506 - protein, 13 aa, Mycobacterium tuberculosis
QHGVVVGVDGSLE

SEQ ID NO: 127507 - protein, 13 aa, Mycobacterium tuberculosis
HGVVVGVDGSLES

SEQ ID NO: 127508 - protein, 13 aa, Mycobacterium tuberculosis
GVVVGVDGSLESD

SEQ ID NO: 127509 - protein, 13 aa, Mycobacterium tuberculosis
VVVGVDGSLESDA

SEQ ID NO: 127510 - protein, 13 aa, Mycobacterium tuberculosis
VVGVDGSLESDAA

SEQ ID NO: 127511 - protein, 13 aa, Mycobacterium tuberculosis
VGVDGSLESDAAA

SEQ ID NO: 127512 - protein, 13 aa, Mycobacterium tuberculosis
GVDGSLESDAAAC

SEQ ID NO: 127513 - protein, 13 aa, Mycobacterium tuberculosis
VDGSLESDAAACW

SEQ ID NO: 127514 - protein, 13 aa, Mycobacterium tuberculosis
DGSLESDAAACWG

SEQ ID NO: 127515 - protein, 13 aa, Mycobacterium tuberculosis
GSLESDAAACWGA

SEQ ID NO: 127516 - protein, 13 aa, Mycobacterium tuberculosis
SLESDAAACWGAT

SEQ ID NO: 127517 - protein, 13 aa, Mycobacterium tuberculosis
LESDAAACWGATD

SEQ ID NO: 127518 - protein, 13 aa, Mycobacterium tuberculosis
ESDAAACWGATDA

SEQ ID NO: 127519 - protein, 13 aa, Mycobacterium tuberculosis
SDAAACWGATDAA

SEQ ID NO: 127520 - protein, 13 aa, Mycobacterium tuberculosis
DAAACWGATDAAM

SEQ ID NO: 127521 - protein, 13 aa, Mycobacterium tuberculosis
AAACWGATDAAMR

SEQ ID NO: 127522 - protein, 13 aa, Mycobacterium tuberculosis
AACWGATDAAMRN

SEQ ID NO: 127523 - protein, 13 aa, Mycobacterium tuberculosis
ACWGATDAAMRNI

SEQ ID NO: 127524 - protein, 13 aa, Mycobacterium tuberculosis
CWGATDAAMRNIP

SEQ ID NO: 127525 - protein, 13 aa, Mycobacterium tuberculosis
WGATDAAMRNIPL

SEQ ID NO: 127526 - protein, 13 aa, Mycobacterium tuberculosis
GATDAAMRNIPLT

SEQ ID NO: 127527 - protein, 13 aa, Mycobacterium tuberculosis
ATDAAMRNIPLTV

SEQ ID NO: 127528 - protein, 13 aa, Mycobacterium tuberculosis
TDAAMRNIPLTVV

SEQ ID NO: 127529 - protein, 13 aa, Mycobacterium tuberculosis
DAAMRNIPLTVVH

SEQ ID NO: 127530 - protein, 13 aa, Mycobacterium tuberculosis
AAMRNIPLTVVHV

SEQ ID NO: 127531 - protein, 13 aa, Mycobacterium tuberculosis
AMRNIPLTVVHVV

SEQ ID NO: 127532 - protein, 13 aa, Mycobacterium tuberculosis
MRNIPLTVVHVVN

SEQ ID NO: 127533 - protein, 13 aa, Mycobacterium tuberculosis
RNIPLTVVHVVNA

SEQ ID NO: 127534 - protein, 13 aa, Mycobacterium tuberculosis
NIPLTVVHVVNAD

SEQ ID NO: 127535 - protein, 13 aa, Mycobacterium tuberculosis
IPLTVVHVVNADV

SEQ ID NO: 127536 - protein, 13 aa, Mycobacterium tuberculosis
PLTVVHVVNADVA

SEQ ID NO: 127537 - protein, 13 aa, Mycobacterium tuberculosis
LTVVHVVNADVAT

SEQ ID NO: 127538 - protein, 13 aa, Mycobacterium tuberculosis
TVVHVVNADVATW

SEQ ID NO: 127539 - protein, 13 aa, Mycobacterium tuberculosis
VVHVVNADVATWP

SEQ ID NO: 127540 - protein, 13 aa, Mycobacterium tuberculosis
VHVVNADVATWPP

SEQ ID NO: 127541 - protein, 13 aa, Mycobacterium tuberculosis
HVVNADVATWPPM

SEQ ID NO: 127542 - protein, 13 aa, Mycobacterium tuberculosis
VVNADVATWPPMP

SEQ ID NO: 127543 - protein, 13 aa, Mycobacterium tuberculosis
VNADVATWPPMPY

SEQ ID NO: 127544 - protein, 13 aa, Mycobacterium tuberculosis
NADVATWPPMPYP

SEQ ID NO: 127545 - protein, 13 aa, Mycobacterium tuberculosis
ADVATWPPMPYPE

SEQ ID NO: 127546 - protein, 13 aa, Mycobacterium tuberculosis
DVATWPPMPYPET

SEQ ID NO: 127547 - protein, 13 aa, Mycobacterium tuberculosis
VATWPPMPYPETW

SEQ ID NO: 127548 - protein, 13 aa, Mycobacterium tuberculosis
ATWPPMPYPETWG

SEQ ID NO: 127549 - protein, 13 aa, Mycobacterium tuberculosis
TWPPMPYPETWGV

SEQ ID NO: 127550 - protein, 13 aa, Mycobacterium tuberculosis
WPPMPYPETWGVW

SEQ ID NO: 127551 - protein, 13 aa, Mycobacterium tuberculosis
PPMPYPETWGVWQ

SEQ ID NO: 127552 - protein, 13 aa, Mycobacterium tuberculosis
PMPYPETWGVWQE

SEQ ID NO: 127553 - protein, 13 aa, Mycobacterium tuberculosis
MPYPETWGVWQED

SEQ ID NO: 127554 - protein, 13 aa, Mycobacterium tuberculosis
PYPETWGVWQEDE

SEQ ID NO: 127555 - protein, 13 aa, Mycobacterium tuberculosis
YPETWGVWQEDEG

SEQ ID NO: 127556 - protein, 13 aa, Mycobacterium tuberculosis
PETWGVWQEDEGR

SEQ ID NO: 127557 - protein, 13 aa, Mycobacterium tuberculosis
ETWGVWQEDEGRQ

SEQ ID NO: 127558 - protein, 13 aa, Mycobacterium tuberculosis
TWGVWQEDEGRQI

SEQ ID NO: 127559 - protein, 13 aa, Mycobacterium tuberculosis
WGVWQEDEGRQIV

SEQ ID NO: 127560 - protein, 13 aa, Mycobacterium tuberculosis
GVWQEDEGRQIVA

SEQ ID NO: 127561 - protein, 13 aa, Mycobacterium tuberculosis
VWQEDEGRQIVAN

SEQ ID NO: 127562 - protein, 13 aa, Mycobacterium tuberculosis
WQEDEGRQIVANA

SEQ ID NO: 127563 - protein, 13 aa, Mycobacterium tuberculosis
QEDEGRQIVANAV

SEQ ID NO: 127564 - protein, 13 aa, Mycobacterium tuberculosis
EDEGRQIVANAVK

SEQ ID NO: 127565 - protein, 13 aa, Mycobacterium tuberculosis
DEGRQIVANAVKL

SEQ ID NO: 127566 - protein, 13 aa, Mycobacterium tuberculosis
EGRQIVANAVKLA

SEQ ID NO: 127567 - protein, 13 aa, Mycobacterium tuberculosis
GRQIVANAVKLAK

SEQ ID NO: 127568 - protein, 13 aa, Mycobacterium tuberculosis
RQIVANAVKLAKE

SEQ ID NO: 127569 - protein, 13 aa, Mycobacterium tuberculosis
QIVANAVKLAKEA

SEQ ID NO: 127570 - protein, 13 aa, Mycobacterium tuberculosis
IVANAVKLAKEAV

SEQ ID NO: 127571 - protein, 13 aa, Mycobacterium tuberculosis
VANAVKLAKEAVG

SEQ ID NO: 127572 - protein, 13 aa, Mycobacterium tuberculosis
ANAVKLAKEAVGA

SEQ ID NO: 127573 - protein, 13 aa, Mycobacterium tuberculosis
NAVKLAKEAVGAD

SEQ ID NO: 127574 - protein, 13 aa, Mycobacterium tuberculosis
AVKLAKEAVGADR

SEQ ID NO: 127575 - protein, 13 aa, Mycobacterium tuberculosis
VKLAKEAVGADRK

SEQ ID NO: 127576 - protein, 13 aa, Mycobacterium tuberculosis
KLAKEAVGADRKL

SEQ ID NO: 127577 - protein, 13 aa, Mycobacterium tuberculosis
LAKEAVGADRKLS

SEQ ID NO: 127578 - protein, 13 aa, Mycobacterium tuberculosis
AKEAVGADRKLSV

SEQ ID NO: 127579 - protein, 13 aa, Mycobacterium tuberculosis
KEAVGADRKLSVK

SEQ ID NO: 127580 - protein, 13 aa, Mycobacterium tuberculosis
EAVGADRKLSVKS

SEQ ID NO: 127581 - protein, 13 aa, Mycobacterium tuberculosis
AVGADRKLSVKSE

SEQ ID NO: 127582 - protein, 13 aa, Mycobacterium tuberculosis
VGADRKLSVKSEL

SEQ ID NO: 127583 - protein, 13 aa, Mycobacterium tuberculosis
GADRKLSVKSELV

SEQ ID NO: 127584 - protein, 13 aa, Mycobacterium tuberculosis
ADRKLSVKSELVF

SEQ ID NO: 127585 - protein, 13 aa, Mycobacterium tuberculosis
DRKLSVKSELVFS

SEQ ID NO: 127586 - protein, 13 aa, Mycobacterium tuberculosis
RKLSVKSELVFST

SEQ ID NO: 127587 - protein, 13 aa, Mycobacterium tuberculosis
KLSVKSELVFSTP

SEQ ID NO: 127588 - protein, 13 aa, Mycobacterium tuberculosis
LSVKSELVFSTPV

SEQ ID NO: 127589 - protein, 13 aa, Mycobacterium tuberculosis
SVKSELVFSTPVP

SEQ ID NO: 127590 - protein, 13 aa, Mycobacterium tuberculosis
VKSELVFSTPVPT

SEQ ID NO: 127591 - protein, 13 aa, Mycobacterium tuberculosis
KSELVFSTPVPTM

SEQ ID NO: 127592 - protein, 13 aa, Mycobacterium tuberculosis
SELVFSTPVPTMV

SEQ ID NO: 127593 - protein, 13 aa, Mycobacterium tuberculosis
ELVFSTPVPTMVE

SEQ ID NO: 127594 - protein, 13 aa, Mycobacterium tuberculosis
LVFSTPVPTMVEI

SEQ ID NO: 127595 - protein, 13 aa, Mycobacterium tuberculosis
VFSTPVPTMVEIS

SEQ ID NO: 127596 - protein, 13 aa, Mycobacterium tuberculosis
FSTPVPTMVEISN

SEQ ID NO: 127597 - protein, 13 aa, Mycobacterium tuberculosis
STPVPTMVEISNE

SEQ ID NO: 127598 - protein, 13 aa, Mycobacterium tuberculosis
TPVPTMVEISNEA

SEQ ID NO: 127599 - protein, 13 aa, Mycobacterium tuberculosis
PVPTMVEISNEAE

SEQ ID NO: 127600 - protein, 13 aa, Mycobacterium tuberculosis
VPTMVEISNEAEM

SEQ ID NO: 127601 - protein, 13 aa, Mycobacterium tuberculosis
PTMVEISNEAEMV

SEQ ID NO: 127602 - protein, 13 aa, Mycobacterium tuberculosis
TMVEISNEAEMVV

SEQ ID NO: 127603 - protein, 13 aa, Mycobacterium tuberculosis
MVEISNEAEMVVL

SEQ ID NO: 127604 - protein, 13 aa, Mycobacterium tuberculosis
VEISNEAEMVVLG

SEQ ID NO: 127605 - protein, 13 aa, Mycobacterium tuberculosis
EISNEAEMVVLGS

SEQ ID NO: 127606 - protein, 13 aa, Mycobacterium tuberculosis
ISNEAEMVVLGSS

SEQ ID NO: 127607 - protein, 13 aa, Mycobacterium tuberculosis
SNEAEMVVLGSSG

SEQ ID NO: 127608 - protein, 13 aa, Mycobacterium tuberculosis
NEAEMVVLGSSGR

SEQ ID NO: 127609 - protein, 13 aa, Mycobacterium tuberculosis
EAEMVVLGSSGRG

SEQ ID NO: 127610 - protein, 13 aa, Mycobacterium tuberculosis
AEMVVLGSSGRGA

SEQ ID NO: 127611 - protein, 13 aa, Mycobacterium tuberculosis
EMVVLGSSGRGAL

SEQ ID NO: 127612 - protein, 13 aa, Mycobacterium tuberculosis
MVVLGSSGRGALA

SEQ ID NO: 127613 - protein, 13 aa, Mycobacterium tuberculosis
VVLGSSGRGALAR

SEQ ID NO: 127614 - protein, 13 aa, Mycobacterium tuberculosis
VLGSSGRGALARG

SEQ ID NO: 127615 - protein, 13 aa, Mycobacterium tuberculosis
LGSSGRGALARGL

SEQ ID NO: 127616 - protein, 13 aa, Mycobacterium tuberculosis
GSSGRGALARGLL

SEQ ID NO: 127617 - protein, 13 aa, Mycobacterium tuberculosis
SSGRGALARGLLG

SEQ ID NO: 127618 - protein, 13 aa, Mycobacterium tuberculosis
SGRGALARGLLGS

SEQ ID NO: 127619 - protein, 13 aa, Mycobacterium tuberculosis
GRGALARGLLGSV

SEQ ID NO: 127620 - protein, 13 aa, Mycobacterium tuberculosis
RGALARGLLGSVS

SEQ ID NO: 127621 - protein, 13 aa, Mycobacterium tuberculosis
GALARGLLGSVSS

SEQ ID NO: 127622 - protein, 13 aa, Mycobacterium tuberculosis
ALARGLLGSVSSS

SEQ ID NO: 127623 - protein, 13 aa, Mycobacterium tuberculosis
LARGLLGSVSSSL

SEQ ID NO: 127624 - protein, 13 aa, Mycobacterium tuberculosis
ARGLLGSVSSSLV

SEQ ID NO: 127625 - protein, 13 aa, Mycobacterium tuberculosis
RGLLGSVSSSLVR

SEQ ID NO: 127626 - protein, 13 aa, Mycobacterium tuberculosis
GLLGSVSSSLVRR

SEQ ID NO: 127627 - protein, 13 aa, Mycobacterium tuberculosis
LLGSVSSSLVRRA

SEQ ID NO: 127628 - protein, 13 aa, Mycobacterium tuberculosis
LGSVSSSLVRRAG

SEQ ID NO: 127629 - protein, 13 aa, Mycobacterium tuberculosis
GSVSSSLVRRAGC

SEQ ID NO: 127630 - protein, 13 aa, Mycobacterium tuberculosis
SVSSSLVRRAGCP

SEQ ID NO: 127631 - protein, 13 aa, Mycobacterium tuberculosis
VSSSLVRRAGCPV

SEQ ID NO: 127632 - protein, 13 aa, Mycobacterium tuberculosis
SSSLVRRAGCPVA

SEQ ID NO: 127633 - protein, 13 aa, Mycobacterium tuberculosis
SSLVRRAGCPVAV

SEQ ID NO: 127634 - protein, 13 aa, Mycobacterium tuberculosis
SLVRRAGCPVAVI

SEQ ID NO: 127635 - protein, 13 aa, Mycobacterium tuberculosis
LVRRAGCPVAVIH

SEQ ID NO: 127636 - protein, 13 aa, Mycobacterium tuberculosis
VRRAGCPVAVIHS

SEQ ID NO: 127637 - protein, 13 aa, Mycobacterium tuberculosis
RRAGCPVAVIHSD

SEQ ID NO: 127638 - protein, 13 aa, Mycobacterium tuberculosis
RAGCPVAVIHSDD

SEQ ID NO: 127639 - protein, 13 aa, Mycobacterium tuberculosis
AGCPVAVIHSDDA

SEQ ID NO: 127640 - protein, 13 aa, Mycobacterium tuberculosis
GCPVAVIHSDDAV

SEQ ID NO: 127641 - protein, 13 aa, Mycobacterium tuberculosis
CPVAVIHSDDAVI

SEQ ID NO: 127642 - protein, 13 aa, Mycobacterium tuberculosis
PVAVIHSDDAVIP

SEQ ID NO: 127643 - protein, 13 aa, Mycobacterium tuberculosis
VAVIHSDDAVIPD

SEQ ID NO: 127644 - protein, 13 aa, Mycobacterium tuberculosis
AVIHSDDAVIPDP

SEQ ID NO: 127645 - protein, 13 aa, Mycobacterium tuberculosis
VIHSDDAVIPDPQ

SEQ ID NO: 127646 - protein, 13 aa, Mycobacterium tuberculosis
IHSDDAVIPDPQH

SEQ ID NO: 127647 - protein, 13 aa, Mycobacterium tuberculosis
HSDDAVIPDPQHA

SEQ ID NO: 127648 - protein, 13 aa, Mycobacterium tuberculosis
SDDAVIPDPQHAP

SEQ ID NO: 127649 - protein, 13 aa, Mycobacterium tuberculosis
DDAVIPDPQHAPV

SEQ ID NO: 127650 - protein, 13 aa, Mycobacterium tuberculosis
DAVIPDPQHAPVL

SEQ ID NO: 127651 - protein, 13 aa, Mycobacterium tuberculosis
AVIPDPQHAPVLV

SEQ ID NO: 127652 - protein, 13 aa, Mycobacterium tuberculosis
VIPDPQHAPVLVG

SEQ ID NO: 127653 - protein, 13 aa, Mycobacterium tuberculosis
IPDPQHAPVLVGI

SEQ ID NO: 127654 - protein, 13 aa, Mycobacterium tuberculosis
PDPQHAPVLVGID

SEQ ID NO: 127655 - protein, 13 aa, Mycobacterium tuberculosis
DPQHAPVLVGIDG

SEQ ID NO: 127656 - protein, 13 aa, Mycobacterium tuberculosis
PQHAPVLVGIDGS

SEQ ID NO: 127657 - protein, 13 aa, Mycobacterium tuberculosis
QHAPVLVGIDGSP

SEQ ID NO: 127658 - protein, 13 aa, Mycobacterium tuberculosis
HAPVLVGIDGSPV

SEQ ID NO: 127659 - protein, 13 aa, Mycobacterium tuberculosis
APVLVGIDGSPVS

SEQ ID NO: 127660 - protein, 13 aa, Mycobacterium tuberculosis
PVLVGIDGSPVSE

SEQ ID NO: 127661 - protein, 13 aa, Mycobacterium tuberculosis
VLVGIDGSPVSEL

SEQ ID NO: 127662 - protein, 13 aa, Mycobacterium tuberculosis
LVGIDGSPVSELA

SEQ ID NO: 127663 - protein, 13 aa, Mycobacterium tuberculosis
VGIDGSPVSELAT

SEQ ID NO: 127664 - protein, 13 aa, Mycobacterium tuberculosis
GIDGSPVSELATA

SEQ ID NO: 127665 - protein, 13 aa, Mycobacterium tuberculosis
IDGSPVSELATAV

SEQ ID NO: 127666 - protein, 13 aa, Mycobacterium tuberculosis
DGSPVSELATAVA

SEQ ID NO: 127667 - protein, 13 aa, Mycobacterium tuberculosis
GSPVSELATAVAF

SEQ ID NO: 127668 - protein, 13 aa, Mycobacterium tuberculosis
SPVSELATAVAFD

SEQ ID NO: 127669 - protein, 13 aa, Mycobacterium tuberculosis
PVSELATAVAFDE

SEQ ID NO: 127670 - protein, 13 aa, Mycobacterium tuberculosis
VSELATAVAFDEA

SEQ ID NO: 127671 - protein, 13 aa, Mycobacterium tuberculosis
SELATAVAFDEAS

SEQ ID NO: 127672 - protein, 13 aa, Mycobacterium tuberculosis
ELATAVAFDEASR

SEQ ID NO: 127673 - protein, 13 aa, Mycobacterium tuberculosis
LATAVAFDEASRR

SEQ ID NO: 127674 - protein, 13 aa, Mycobacterium tuberculosis
ATAVAFDEASRRG

SEQ ID NO: 127675 - protein, 13 aa, Mycobacterium tuberculosis
TAVAFDEASRRGV

SEQ ID NO: 127676 - protein, 13 aa, Mycobacterium tuberculosis
AVAFDEASRRGVE

SEQ ID NO: 127677 - protein, 13 aa, Mycobacterium tuberculosis
VAFDEASRRGVEL

SEQ ID NO: 127678 - protein, 13 aa, Mycobacterium tuberculosis
AFDEASRRGVELI

SEQ ID NO: 127679 - protein, 13 aa, Mycobacterium tuberculosis
FDEASRRGVELIA

SEQ ID NO: 127680 - protein, 13 aa, Mycobacterium tuberculosis
DEASRRGVELIAV

SEQ ID NO: 127681 - protein, 13 aa, Mycobacterium tuberculosis
EASRRGVELIAVH

SEQ ID NO: 127682 - protein, 13 aa, Mycobacterium tuberculosis
ASRRGVELIAVHA

SEQ ID NO: 127683 - protein, 13 aa, Mycobacterium tuberculosis
SRRGVELIAVHAW

SEQ ID NO: 127684 - protein, 13 aa, Mycobacterium tuberculosis
RRGVELIAVHAWS

SEQ ID NO: 127685 - protein, 13 aa, Mycobacterium tuberculosis
RGVELIAVHAWSD

SEQ ID NO: 127686 - protein, 13 aa, Mycobacterium tuberculosis
GVELIAVHAWSDV

SEQ ID NO: 127687 - protein, 13 aa, Mycobacterium tuberculosis
VELIAVHAWSDVE

SEQ ID NO: 127688 - protein, 13 aa, Mycobacterium tuberculosis
ELIAVHAWSDVEV

SEQ ID NO: 127689 - protein, 13 aa, Mycobacterium tuberculosis
LIAVHAWSDVEVV

SEQ ID NO: 127690 - protein, 13 aa, Mycobacterium tuberculosis
IAVHAWSDVEVVE

SEQ ID NO: 127691 - protein, 13 aa, Mycobacterium tuberculosis
AVHAWSDVEVVEL

SEQ ID NO: 127692 - protein, 13 aa, Mycobacterium tuberculosis
VHAWSDVEVVELP

SEQ ID NO: 127693 - protein, 13 aa, Mycobacterium tuberculosis
HAWSDVEVVELPG

SEQ ID NO: 127694 - protein, 13 aa, Mycobacterium tuberculosis
AWSDVEVVELPGL

SEQ ID NO: 127695 - protein, 13 aa, Mycobacterium tuberculosis
WSDVEVVELPGLD

SEQ ID NO: 127696 - protein, 13 aa, Mycobacterium tuberculosis
SDVEVVELPGLDF

SEQ ID NO: 127697 - protein, 13 aa, Mycobacterium tuberculosis
DVEVVELPGLDFS

SEQ ID NO: 127698 - protein, 13 aa, Mycobacterium tuberculosis
VEVVELPGLDFSA

SEQ ID NO: 127699 - protein, 13 aa, Mycobacterium tuberculosis
EVVELPGLDFSAV

SEQ ID NO: 127700 - protein, 13 aa, Mycobacterium tuberculosis
VVELPGLDFSAVQ

SEQ ID NO: 127701 - protein, 13 aa, Mycobacterium tuberculosis
VELPGLDFSAVQQ

SEQ ID NO: 127702 - protein, 13 aa, Mycobacterium tuberculosis
ELPGLDFSAVQQE

SEQ ID NO: 127703 - protein, 13 aa, Mycobacterium tuberculosis
LPGLDFSAVQQEA

SEQ ID NO: 127704 - protein, 13 aa, Mycobacterium tuberculosis
PGLDFSAVQQEAE

SEQ ID NO: 127705 - protein, 13 aa, Mycobacterium tuberculosis
GLDFSAVQQEAEL

SEQ ID NO: 127706 - protein, 13 aa, Mycobacterium tuberculosis
LDFSAVQQEAELS

SEQ ID NO: 127707 - protein, 13 aa, Mycobacterium tuberculosis
DFSAVQQEAELSL

SEQ ID NO: 127708 - protein, 13 aa, Mycobacterium tuberculosis
FSAVQQEAELSLA

SEQ ID NO: 127709 - protein, 13 aa, Mycobacterium tuberculosis
SAVQQEAELSLAE

SEQ ID NO: 127710 - protein, 13 aa, Mycobacterium tuberculosis
AVQQEAELSLAER

SEQ ID NO: 127711 - protein, 13 aa, Mycobacterium tuberculosis
VQQEAELSLAERL

SEQ ID NO: 127712 - protein, 13 aa, Mycobacterium tuberculosis
QQEAELSLAERLA

SEQ ID NO: 127713 - protein, 13 aa, Mycobacterium tuberculosis
QEAELSLAERLAG

SEQ ID NO: 127714 - protein, 13 aa, Mycobacterium tuberculosis
EAELSLAERLAGW

SEQ ID NO: 127715 - protein, 13 aa, Mycobacterium tuberculosis
AELSLAERLAGWQ

SEQ ID NO: 127716 - protein, 13 aa, Mycobacterium tuberculosis
ELSLAERLAGWQE

SEQ ID NO: 127717 - protein, 13 aa, Mycobacterium tuberculosis
LSLAERLAGWQER

SEQ ID NO: 127718 - protein, 13 aa, Mycobacterium tuberculosis
SLAERLAGWQERY

SEQ ID NO: 127719 - protein, 13 aa, Mycobacterium tuberculosis
LAERLAGWQERYP

SEQ ID NO: 127720 - protein, 13 aa, Mycobacterium tuberculosis
AERLAGWQERYPD

SEQ ID NO: 127721 - protein, 13 aa, Mycobacterium tuberculosis
ERLAGWQERYPDV

SEQ ID NO: 127722 - protein, 13 aa, Mycobacterium tuberculosis
RLAGWQERYPDVP

SEQ ID NO: 127723 - protein, 13 aa, Mycobacterium tuberculosis
LAGWQERYPDVPV

SEQ ID NO: 127724 - protein, 13 aa, Mycobacterium tuberculosis
AGWQERYPDVPVS

SEQ ID NO: 127725 - protein, 13 aa, Mycobacterium tuberculosis
GWQERYPDVPVSR

SEQ ID NO: 127726 - protein, 13 aa, Mycobacterium tuberculosis
WQERYPDVPVSRV

SEQ ID NO: 127727 - protein, 13 aa, Mycobacterium tuberculosis
QERYPDVPVSRVV

SEQ ID NO: 127728 - protein, 13 aa, Mycobacterium tuberculosis
ERYPDVPVSRVVV

SEQ ID NO: 127729 - protein, 13 aa, Mycobacterium tuberculosis
RYPDVPVSRVVVC

SEQ ID NO: 127730 - protein, 13 aa, Mycobacterium tuberculosis
YPDVPVSRVVVCD

SEQ ID NO: 127731 - protein, 13 aa, Mycobacterium tuberculosis
PDVPVSRVVVCDR

SEQ ID NO: 127732 - protein, 13 aa, Mycobacterium tuberculosis
DVPVSRVVVCDRP

SEQ ID NO: 127733 - protein, 13 aa, Mycobacterium tuberculosis
VPVSRVVVCDRPA

SEQ ID NO: 127734 - protein, 13 aa, Mycobacterium tuberculosis
PVSRVVVCDRPAR

SEQ ID NO: 127735 - protein, 13 aa, Mycobacterium tuberculosis
VSRVVVCDRPARK

SEQ ID NO: 127736 - protein, 13 aa, Mycobacterium tuberculosis
SRVVVCDRPARKL

SEQ ID NO: 127737 - protein, 13 aa, Mycobacterium tuberculosis
RVVVCDRPARKLV

SEQ ID NO: 127738 - protein, 13 aa, Mycobacterium tuberculosis
VVVCDRPARKLVQ

SEQ ID NO: 127739 - protein, 13 aa, Mycobacterium tuberculosis
VVCDRPARKLVQK

SEQ ID NO: 127740 - protein, 13 aa, Mycobacterium tuberculosis
VCDRPARKLVQKS

SEQ ID NO: 127741 - protein, 13 aa, Mycobacterium tuberculosis
CDRPARKLVQKSA

SEQ ID NO: 127742 - protein, 13 aa, Mycobacterium tuberculosis
DRPARKLVQKSAS

SEQ ID NO: 127743 - protein, 13 aa, Mycobacterium tuberculosis
RPARKLVQKSASA

SEQ ID NO: 127744 - protein, 13 aa, Mycobacterium tuberculosis
PARKLVQKSASAQ

SEQ ID NO: 127745 - protein, 13 aa, Mycobacterium tuberculosis
ARKLVQKSASAQL

SEQ ID NO: 127746 - protein, 13 aa, Mycobacterium tuberculosis
RKLVQKSASAQLV

SEQ ID NO: 127747 - protein, 13 aa, Mycobacterium tuberculosis
KLVQKSASAQLVV

SEQ ID NO: 127748 - protein, 13 aa, Mycobacterium tuberculosis
LVQKSASAQLVVV

SEQ ID NO: 127749 - protein, 13 aa, Mycobacterium tuberculosis
VQKSASAQLVVVG

SEQ ID NO: 127750 - protein, 13 aa, Mycobacterium tuberculosis
QKSASAQLVVVGS

SEQ ID NO: 127751 - protein, 13 aa, Mycobacterium tuberculosis
KSASAQLVVVGSH

SEQ ID NO: 127752 - protein, 13 aa, Mycobacterium tuberculosis
SASAQLVVVGSHG

SEQ ID NO: 127753 - protein, 13 aa, Mycobacterium tuberculosis
ASAQLVVVGSHGR

SEQ ID NO: 127754 - protein, 13 aa, Mycobacterium tuberculosis
SAQLVVVGSHGRG

SEQ ID NO: 127755 - protein, 13 aa, Mycobacterium tuberculosis
AQLVVVGSHGRGG

SEQ ID NO: 127756 - protein, 13 aa, Mycobacterium tuberculosis
QLVVVGSHGRGGL

SEQ ID NO: 127757 - protein, 13 aa, Mycobacterium tuberculosis
LVVVGSHGRGGLT

SEQ ID NO: 127758 - protein, 13 aa, Mycobacterium tuberculosis
VVVGSHGRGGLTG

SEQ ID NO: 127759 - protein, 13 aa, Mycobacterium tuberculosis
VVGSHGRGGLTGM

SEQ ID NO: 127760 - protein, 13 aa, Mycobacterium tuberculosis
VGSHGRGGLTGML

SEQ ID NO: 127761 - protein, 13 aa, Mycobacterium tuberculosis
GSHGRGGLTGMLL

SEQ ID NO: 127762 - protein, 13 aa, Mycobacterium tuberculosis
SHGRGGLTGMLLG

SEQ ID NO: 127763 - protein, 13 aa, Mycobacterium tuberculosis
HGRGGLTGMLLGS

SEQ ID NO: 127764 - protein, 13 aa, Mycobacterium tuberculosis
GRGGLTGMLLGSV

SEQ ID NO: 127765 - protein, 13 aa, Mycobacterium tuberculosis
RGGLTGMLLGSVS

SEQ ID NO: 127766 - protein, 13 aa, Mycobacterium tuberculosis
GGLTGMLLGSVSN

SEQ ID NO: 127767 - protein, 13 aa, Mycobacterium tuberculosis
GLTGMLLGSVSNA

SEQ ID NO: 127768 - protein, 13 aa, Mycobacterium tuberculosis
LTGMLLGSVSNAV

SEQ ID NO: 127769 - protein, 13 aa, Mycobacterium tuberculosis
TGMLLGSVSNAVL

SEQ ID NO: 127770 - protein, 13 aa, Mycobacterium tuberculosis
GMLLGSVSNAVLH

SEQ ID NO: 127771 - protein, 13 aa, Mycobacterium tuberculosis
MLLGSVSNAVLHA

SEQ ID NO: 127772 - protein, 13 aa, Mycobacterium tuberculosis
LLGSVSNAVLHAA

SEQ ID NO: 127773 - protein, 13 aa, Mycobacterium tuberculosis
LGSVSNAVLHAAR

SEQ ID NO: 127774 - protein, 13 aa, Mycobacterium tuberculosis
GSVSNAVLHAARV

SEQ ID NO: 127775 - protein, 13 aa, Mycobacterium tuberculosis
SVSNAVLHAARVP

SEQ ID NO: 127776 - protein, 13 aa, Mycobacterium tuberculosis
VSNAVLHAARVPV

SEQ ID NO: 127777 - protein, 13 aa, Mycobacterium tuberculosis
SNAVLHAARVPVI

SEQ ID NO: 127778 - protein, 13 aa, Mycobacterium tuberculosis
NAVLHAARVPVIV

SEQ ID NO: 127779 - protein, 13 aa, Mycobacterium tuberculosis
AVLHAARVPVIVA

SEQ ID NO: 127780 - protein, 13 aa, Mycobacterium tuberculosis
VLHAARVPVIVAR

SEQ ID NO: 127781 - protein, 13 aa, Mycobacterium tuberculosis
LHAARVPVIVARQ

SEQ ID NO: 127782 - protein, 13 aa, Mycobacterium tuberculosis
HAARVPVIVARQS

SEQ ID NO: 127783 - protein, 14 aa, Mycobacterium tuberculosis
MSKPRKQHGVVVGV

SEQ ID NO: 127784 - protein, 14 aa, Mycobacterium tuberculosis
SKPRKQHGVVVGVD

SEQ ID NO: 127785 - protein, 14 aa, Mycobacterium tuberculosis
KPRKQHGVVVGVDG

SEQ ID NO: 127786 - protein, 14 aa, Mycobacterium tuberculosis
PRKQHGVVVGVDGS

SEQ ID NO: 127787 - protein, 14 aa, Mycobacterium tuberculosis
RKQHGVVVGVDGSL

SEQ ID NO: 127788 - protein, 14 aa, Mycobacterium tuberculosis
KQHGVVVGVDGSLE

SEQ ID NO: 127789 - protein, 14 aa, Mycobacterium tuberculosis
QHGVVVGVDGSLES

SEQ ID NO: 127790 - protein, 14 aa, Mycobacterium tuberculosis
HGVVVGVDGSLESD

SEQ ID NO: 127791 - protein, 14 aa, Mycobacterium tuberculosis
GVVVGVDGSLESDA

SEQ ID NO: 127792 - protein, 14 aa, Mycobacterium tuberculosis
VVVGVDGSLESDAA

SEQ ID NO: 127793 - protein, 14 aa, Mycobacterium tuberculosis
VVGVDGSLESDAAA

SEQ ID NO: 127794 - protein, 14 aa, Mycobacterium tuberculosis
VGVDGSLESDAAAC

SEQ ID NO: 127795 - protein, 14 aa, Mycobacterium tuberculosis
GVDGSLESDAAACW

SEQ ID NO: 127796 - protein, 14 aa, Mycobacterium tuberculosis
VDGSLESDAAACWG

SEQ ID NO: 127797 - protein, 14 aa, Mycobacterium tuberculosis
DGSLESDAAACWGA

SEQ ID NO: 127798 - protein, 14 aa, Mycobacterium tuberculosis
GSLESDAAACWGAT

SEQ ID NO: 127799 - protein, 14 aa, Mycobacterium tuberculosis
SLESDAAACWGATD

SEQ ID NO: 127800 - protein, 14 aa, Mycobacterium tuberculosis
LESDAAACWGATDA

SEQ ID NO: 127801 - protein, 14 aa, Mycobacterium tuberculosis
ESDAAACWGATDAA

SEQ ID NO: 127802 - protein, 14 aa, Mycobacterium tuberculosis
SDAAACWGATDAAM

SEQ ID NO: 127803 - protein, 14 aa, Mycobacterium tuberculosis
DAAACWGATDAAMR

SEQ ID NO: 127804 - protein, 14 aa, Mycobacterium tuberculosis
AAACWGATDAAMRN

SEQ ID NO: 127805 - protein, 14 aa, Mycobacterium tuberculosis
AACWGATDAAMRNI

SEQ ID NO: 127806 - protein, 14 aa, Mycobacterium tuberculosis
ACWGATDAAMRNIP

SEQ ID NO: 127807 - protein, 14 aa, Mycobacterium tuberculosis
CWGATDAAMRNIPL

SEQ ID NO: 127808 - protein, 14 aa, Mycobacterium tuberculosis
WGATDAAMRNIPLT

SEQ ID NO: 127809 - protein, 14 aa, Mycobacterium tuberculosis
GATDAAMRNIPLTV

SEQ ID NO: 127810 - protein, 14 aa, Mycobacterium tuberculosis
ATDAAMRNIPLTVV

SEQ ID NO: 127811 - protein, 14 aa, Mycobacterium tuberculosis
TDAAMRNIPLTVVH

SEQ ID NO: 127812 - protein, 14 aa, Mycobacterium tuberculosis
DAAMRNIPLTVVHV

SEQ ID NO: 127813 - protein, 14 aa, Mycobacterium tuberculosis
AAMRNIPLTVVHVV

SEQ ID NO: 127814 - protein, 14 aa, Mycobacterium tuberculosis
AMRNIPLTVVHVVN

SEQ ID NO: 127815 - protein, 14 aa, Mycobacterium tuberculosis
MRNIPLTVVHVVNA

SEQ ID NO: 127816 - protein, 14 aa, Mycobacterium tuberculosis
RNIPLTVVHVVNAD

SEQ ID NO: 127817 - protein, 14 aa, Mycobacterium tuberculosis
NIPLTVVHVVNADV

SEQ ID NO: 127818 - protein, 14 aa, Mycobacterium tuberculosis
IPLTVVHVVNADVA

SEQ ID NO: 127819 - protein, 14 aa, Mycobacterium tuberculosis
PLTVVHVVNADVAT

SEQ ID NO: 127820 - protein, 14 aa, Mycobacterium tuberculosis
LTVVHVVNADVATW

SEQ ID NO: 127821 - protein, 14 aa, Mycobacterium tuberculosis
TVVHVVNADVATWP

SEQ ID NO: 127822 - protein, 14 aa, Mycobacterium tuberculosis
VVHVVNADVATWPP

SEQ ID NO: 127823 - protein, 14 aa, Mycobacterium tuberculosis
VHVVNADVATWPPM

SEQ ID NO: 127824 - protein, 14 aa, Mycobacterium tuberculosis
HVVNADVATWPPMP

SEQ ID NO: 127825 - protein, 14 aa, Mycobacterium tuberculosis
VVNADVATWPPMPY

SEQ ID NO: 127826 - protein, 14 aa, Mycobacterium tuberculosis
VNADVATWPPMPYP

SEQ ID NO: 127827 - protein, 14 aa, Mycobacterium tuberculosis
NADVATWPPMPYPE

SEQ ID NO: 127828 - protein, 14 aa, Mycobacterium tuberculosis
ADVATWPPMPYPET

SEQ ID NO: 127829 - protein, 14 aa, Mycobacterium tuberculosis
DVATWPPMPYPETW

SEQ ID NO: 127830 - protein, 14 aa, Mycobacterium tuberculosis
VATWPPMPYPETWG

SEQ ID NO: 127831 - protein, 14 aa, Mycobacterium tuberculosis
ATWPPMPYPETWGV

SEQ ID NO: 127832 - protein, 14 aa, Mycobacterium tuberculosis
TWPPMPYPETWGVW

SEQ ID NO: 127833 - protein, 14 aa, Mycobacterium tuberculosis
WPPMPYPETWGVWQ

SEQ ID NO: 127834 - protein, 14 aa, Mycobacterium tuberculosis
PPMPYPETWGVWQE

SEQ ID NO: 127835 - protein, 14 aa, Mycobacterium tuberculosis
PMPYPETWGVWQED

SEQ ID NO: 127836 - protein, 14 aa, Mycobacterium tuberculosis
MPYPETWGVWQEDE

SEQ ID NO: 127837 - protein, 14 aa, Mycobacterium tuberculosis
PYPETWGVWQEDEG

SEQ ID NO: 127838 - protein, 14 aa, Mycobacterium tuberculosis
YPETWGVWQEDEGR

SEQ ID NO: 127839 - protein, 14 aa, Mycobacterium tuberculosis
PETWGVWQEDEGRQ

SEQ ID NO: 127840 - protein, 14 aa, Mycobacterium tuberculosis
ETWGVWQEDEGRQI

SEQ ID NO: 127841 - protein, 14 aa, Mycobacterium tuberculosis
TWGVWQEDEGRQIV

SEQ ID NO: 127842 - protein, 14 aa, Mycobacterium tuberculosis
WGVWQEDEGRQIVA

SEQ ID NO: 127843 - protein, 14 aa, Mycobacterium tuberculosis
GVWQEDEGRQIVAN

SEQ ID NO: 127844 - protein, 14 aa, Mycobacterium tuberculosis
VWQEDEGRQIVANA

SEQ ID NO: 127845 - protein, 14 aa, Mycobacterium tuberculosis
WQEDEGRQIVANAV

SEQ ID NO: 127846 - protein, 14 aa, Mycobacterium tuberculosis
QEDEGRQIVANAVK

SEQ ID NO: 127847 - protein, 14 aa, Mycobacterium tuberculosis
EDEGRQIVANAVKL

SEQ ID NO: 127848 - protein, 14 aa, Mycobacterium tuberculosis
DEGRQIVANAVKLA

SEQ ID NO: 127849 - protein, 14 aa, Mycobacterium tuberculosis
EGRQIVANAVKLAK

SEQ ID NO: 127850 - protein, 14 aa, Mycobacterium tuberculosis
GRQIVANAVKLAKE

SEQ ID NO: 127851 - protein, 14 aa, Mycobacterium tuberculosis
RQIVANAVKLAKEA

SEQ ID NO: 127852 - protein, 14 aa, Mycobacterium tuberculosis
QIVANAVKLAKEAV

SEQ ID NO: 127853 - protein, 14 aa, Mycobacterium tuberculosis
IVANAVKLAKEAVG

SEQ ID NO: 127854 - protein, 14 aa, Mycobacterium tuberculosis
VANAVKLAKEAVGA

SEQ ID NO: 127855 - protein, 14 aa, Mycobacterium tuberculosis
ANAVKLAKEAVGAD

SEQ ID NO: 127856 - protein, 14 aa, Mycobacterium tuberculosis
NAVKLAKEAVGADR

SEQ ID NO: 127857 - protein, 14 aa, Mycobacterium tuberculosis
AVKLAKEAVGADRK

SEQ ID NO: 127858 - protein, 14 aa, Mycobacterium tuberculosis
VKLAKEAVGADRKL

SEQ ID NO: 127859 - protein, 14 aa, Mycobacterium tuberculosis
KLAKEAVGADRKLS

SEQ ID NO: 127860 - protein, 14 aa, Mycobacterium tuberculosis
LAKEAVGADRKLSV

SEQ ID NO: 127861 - protein, 14 aa, Mycobacterium tuberculosis
AKEAVGADRKLSVK

SEQ ID NO: 127862 - protein, 14 aa, Mycobacterium tuberculosis
KEAVGADRKLSVKS

SEQ ID NO: 127863 - protein, 14 aa, Mycobacterium tuberculosis
EAVGADRKLSVKSE

SEQ ID NO: 127864 - protein, 14 aa, Mycobacterium tuberculosis
AVGADRKLSVKSEL

SEQ ID NO: 127865 - protein, 14 aa, Mycobacterium tuberculosis
VGADRKLSVKSELV

SEQ ID NO: 127866 - protein, 14 aa, Mycobacterium tuberculosis
GADRKLSVKSELVF

SEQ ID NO: 127867 - protein, 14 aa, Mycobacterium tuberculosis
ADRKLSVKSELVFS

SEQ ID NO: 127868 - protein, 14 aa, Mycobacterium tuberculosis
DRKLSVKSELVFST

SEQ ID NO: 127869 - protein, 14 aa, Mycobacterium tuberculosis
RKLSVKSELVFSTP

SEQ ID NO: 127870 - protein, 14 aa, Mycobacterium tuberculosis
KLSVKSELVFSTPV

SEQ ID NO: 127871 - protein, 14 aa, Mycobacterium tuberculosis
LSVKSELVFSTPVP

SEQ ID NO: 127872 - protein, 14 aa, Mycobacterium tuberculosis
SVKSELVFSTPVPT

SEQ ID NO: 127873 - protein, 14 aa, Mycobacterium tuberculosis
VKSELVFSTPVPTM

SEQ ID NO: 127874 - protein, 14 aa, Mycobacterium tuberculosis
KSELVFSTPVPTMV

SEQ ID NO: 127875 - protein, 14 aa, Mycobacterium tuberculosis
SELVFSTPVPTMVE

SEQ ID NO: 127876 - protein, 14 aa, Mycobacterium tuberculosis
ELVFSTPVPTMVEI

SEQ ID NO: 127877 - protein, 14 aa, Mycobacterium tuberculosis
LVFSTPVPTMVEIS

SEQ ID NO: 127878 - protein, 14 aa, Mycobacterium tuberculosis
VFSTPVPTMVEISN

SEQ ID NO: 127879 - protein, 14 aa, Mycobacterium tuberculosis
FSTPVPTMVEISNE

SEQ ID NO: 127880 - protein, 14 aa, Mycobacterium tuberculosis
STPVPTMVEISNEA

SEQ ID NO: 127881 - protein, 14 aa, Mycobacterium tuberculosis
TPVPTMVEISNEAE

SEQ ID NO: 127882 - protein, 14 aa, Mycobacterium tuberculosis
PVPTMVEISNEAEM

SEQ ID NO: 127883 - protein, 14 aa, Mycobacterium tuberculosis
VPTMVEISNEAEMV

SEQ ID NO: 127884 - protein, 14 aa, Mycobacterium tuberculosis
PTMVEISNEAEMVV

SEQ ID NO: 127885 - protein, 14 aa, Mycobacterium tuberculosis
TMVEISNEAEMVVL

SEQ ID NO: 127886 - protein, 14 aa, Mycobacterium tuberculosis
MVEISNEAEMVVLG

SEQ ID NO: 127887 - protein, 14 aa, Mycobacterium tuberculosis
VEISNEAEMVVLGS

SEQ ID NO: 127888 - protein, 14 aa, Mycobacterium tuberculosis
EISNEAEMVVLGSS

SEQ ID NO: 127889 - protein, 14 aa, Mycobacterium tuberculosis
ISNEAEMVVLGSSG

SEQ ID NO: 127890 - protein, 14 aa, Mycobacterium tuberculosis
SNEAEMVVLGSSGR

SEQ ID NO: 127891 - protein, 14 aa, Mycobacterium tuberculosis
NEAEMVVLGSSGRG

SEQ ID NO: 127892 - protein, 14 aa, Mycobacterium tuberculosis
EAEMVVLGSSGRGA

SEQ ID NO: 127893 - protein, 14 aa, Mycobacterium tuberculosis
AEMVVLGSSGRGAL

SEQ ID NO: 127894 - protein, 14 aa, Mycobacterium tuberculosis
EMVVLGSSGRGALA

SEQ ID NO: 127895 - protein, 14 aa, Mycobacterium tuberculosis
MVVLGSSGRGALAR

SEQ ID NO: 127896 - protein, 14 aa, Mycobacterium tuberculosis
VVLGSSGRGALARG

SEQ ID NO: 127897 - protein, 14 aa, Mycobacterium tuberculosis
VLGSSGRGALARGL

SEQ ID NO: 127898 - protein, 14 aa, Mycobacterium tuberculosis
LGSSGRGALARGLL

SEQ ID NO: 127899 - protein, 14 aa, Mycobacterium tuberculosis
GSSGRGALARGLLG

SEQ ID NO: 127900 - protein, 14 aa, Mycobacterium tuberculosis
SSGRGALARGLLGS

SEQ ID NO: 127901 - protein, 14 aa, Mycobacterium tuberculosis
SGRGALARGLLGSV

SEQ ID NO: 127902 - protein, 14 aa, Mycobacterium tuberculosis
GRGALARGLLGSVS

SEQ ID NO: 127903 - protein, 14 aa, Mycobacterium tuberculosis
RGALARGLLGSVSS

SEQ ID NO: 127904 - protein, 14 aa, Mycobacterium tuberculosis
GALARGLLGSVSSS

SEQ ID NO: 127905 - protein, 14 aa, Mycobacterium tuberculosis
ALARGLLGSVSSSL

SEQ ID NO: 127906 - protein, 14 aa, Mycobacterium tuberculosis
LARGLLGSVSSSLV

SEQ ID NO: 127907 - protein, 14 aa, Mycobacterium tuberculosis
ARGLLGSVSSSLVR

SEQ ID NO: 127908 - protein, 14 aa, Mycobacterium tuberculosis
RGLLGSVSSSLVRR

SEQ ID NO: 127909 - protein, 14 aa, Mycobacterium tuberculosis
GLLGSVSSSLVRRA

SEQ ID NO: 127910 - protein, 14 aa, Mycobacterium tuberculosis
LLGSVSSSLVRRAG

SEQ ID NO: 127911 - protein, 14 aa, Mycobacterium tuberculosis
LGSVSSSLVRRAGC

SEQ ID NO: 127912 - protein, 14 aa, Mycobacterium tuberculosis
GSVSSSLVRRAGCP

SEQ ID NO: 127913 - protein, 14 aa, Mycobacterium tuberculosis
SVSSSLVRRAGCPV

SEQ ID NO: 127914 - protein, 14 aa, Mycobacterium tuberculosis
VSSSLVRRAGCPVA

SEQ ID NO: 127915 - protein, 14 aa, Mycobacterium tuberculosis
SSSLVRRAGCPVAV

SEQ ID NO: 127916 - protein, 14 aa, Mycobacterium tuberculosis
SSLVRRAGCPVAVI

SEQ ID NO: 127917 - protein, 14 aa, Mycobacterium tuberculosis
SLVRRAGCPVAVIH

SEQ ID NO: 127918 - protein, 14 aa, Mycobacterium tuberculosis
LVRRAGCPVAVIHS

SEQ ID NO: 127919 - protein, 14 aa, Mycobacterium tuberculosis
VRRAGCPVAVIHSD

SEQ ID NO: 127920 - protein, 14 aa, Mycobacterium tuberculosis
RRAGCPVAVIHSDD

SEQ ID NO: 127921 - protein, 14 aa, Mycobacterium tuberculosis
RAGCPVAVIHSDDA

SEQ ID NO: 127922 - protein, 14 aa, Mycobacterium tuberculosis
AGCPVAVIHSDDAV

SEQ ID NO: 127923 - protein, 14 aa, Mycobacterium tuberculosis
GCPVAVIHSDDAVI

SEQ ID NO: 127924 - protein, 14 aa, Mycobacterium tuberculosis
CPVAVIHSDDAVIP

SEQ ID NO: 127925 - protein, 14 aa, Mycobacterium tuberculosis
PVAVIHSDDAVIPD

SEQ ID NO: 127926 - protein, 14 aa, Mycobacterium tuberculosis
VAVIHSDDAVIPDP

SEQ ID NO: 127927 - protein, 14 aa, Mycobacterium tuberculosis
AVIHSDDAVIPDPQ

SEQ ID NO: 127928 - protein, 14 aa, Mycobacterium tuberculosis
VIHSDDAVIPDPQH

SEQ ID NO: 127929 - protein, 14 aa, Mycobacterium tuberculosis
IHSDDAVIPDPQHA

SEQ ID NO: 127930 - protein, 14 aa, Mycobacterium tuberculosis
HSDDAVIPDPQHAP

SEQ ID NO: 127931 - protein, 14 aa, Mycobacterium tuberculosis
SDDAVIPDPQHAPV

SEQ ID NO: 127932 - protein, 14 aa, Mycobacterium tuberculosis
DDAVIPDPQHAPVL

SEQ ID NO: 127933 - protein, 14 aa, Mycobacterium tuberculosis
DAVIPDPQHAPVLV

SEQ ID NO: 127934 - protein, 14 aa, Mycobacterium tuberculosis
AVIPDPQHAPVLVG

SEQ ID NO: 127935 - protein, 14 aa, Mycobacterium tuberculosis
VIPDPQHAPVLVGI

SEQ ID NO: 127936 - protein, 14 aa, Mycobacterium tuberculosis
IPDPQHAPVLVGID

SEQ ID NO: 127937 - protein, 14 aa, Mycobacterium tuberculosis
PDPQHAPVLVGIDG

SEQ ID NO: 127938 - protein, 14 aa, Mycobacterium tuberculosis
DPQHAPVLVGIDGS

SEQ ID NO: 127939 - protein, 14 aa, Mycobacterium tuberculosis
PQHAPVLVGIDGSP

SEQ ID NO: 127940 - protein, 14 aa, Mycobacterium tuberculosis
QHAPVLVGIDGSPV

SEQ ID NO: 127941 - protein, 14 aa, Mycobacterium tuberculosis
HAPVLVGIDGSPVS

SEQ ID NO: 127942 - protein, 14 aa, Mycobacterium tuberculosis
APVLVGIDGSPVSE

SEQ ID NO: 127943 - protein, 14 aa, Mycobacterium tuberculosis
PVLVGIDGSPVSEL

SEQ ID NO: 127944 - protein, 14 aa, Mycobacterium tuberculosis
VLVGIDGSPVSELA

SEQ ID NO: 127945 - protein, 14 aa, Mycobacterium tuberculosis
LVGIDGSPVSELAT

SEQ ID NO: 127946 - protein, 14 aa, Mycobacterium tuberculosis
VGIDGSPVSELATA

SEQ ID NO: 127947 - protein, 14 aa, Mycobacterium tuberculosis
GIDGSPVSELATAV

SEQ ID NO: 127948 - protein, 14 aa, Mycobacterium tuberculosis
IDGSPVSELATAVA

SEQ ID NO: 127949 - protein, 14 aa, Mycobacterium tuberculosis
DGSPVSELATAVAF

SEQ ID NO: 127950 - protein, 14 aa, Mycobacterium tuberculosis
GSPVSELATAVAFD

SEQ ID NO: 127951 - protein, 14 aa, Mycobacterium tuberculosis
SPVSELATAVAFDE

SEQ ID NO: 127952 - protein, 14 aa, Mycobacterium tuberculosis
PVSELATAVAFDEA

SEQ ID NO: 127953 - protein, 14 aa, Mycobacterium tuberculosis
VSELATAVAFDEAS

SEQ ID NO: 127954 - protein, 14 aa, Mycobacterium tuberculosis
SELATAVAFDEASR

SEQ ID NO: 127955 - protein, 14 aa, Mycobacterium tuberculosis
ELATAVAFDEASRR

SEQ ID NO: 127956 - protein, 14 aa, Mycobacterium tuberculosis
LATAVAFDEASRRG

SEQ ID NO: 127957 - protein, 14 aa, Mycobacterium tuberculosis
ATAVAFDEASRRGV

SEQ ID NO: 127958 - protein, 14 aa, Mycobacterium tuberculosis
TAVAFDEASRRGVE

SEQ ID NO: 127959 - protein, 14 aa, Mycobacterium tuberculosis
AVAFDEASRRGVEL

SEQ ID NO: 127960 - protein, 14 aa, Mycobacterium tuberculosis
VAFDEASRRGVELI

SEQ ID NO: 127961 - protein, 14 aa, Mycobacterium tuberculosis
AFDEASRRGVELIA

SEQ ID NO: 127962 - protein, 14 aa, Mycobacterium tuberculosis
FDEASRRGVELIAV

SEQ ID NO: 127963 - protein, 14 aa, Mycobacterium tuberculosis
DEASRRGVELIAVH

SEQ ID NO: 127964 - protein, 14 aa, Mycobacterium tuberculosis
EASRRGVELIAVHA

SEQ ID NO: 127965 - protein, 14 aa, Mycobacterium tuberculosis
ASRRGVELIAVHAW

SEQ ID NO: 127966 - protein, 14 aa, Mycobacterium tuberculosis
SRRGVELIAVHAWS

SEQ ID NO: 127967 - protein, 14 aa, Mycobacterium tuberculosis
RRGVELIAVHAWSD

SEQ ID NO: 127968 - protein, 14 aa, Mycobacterium tuberculosis
RGVELIAVHAWSDV

SEQ ID NO: 127969 - protein, 14 aa, Mycobacterium tuberculosis
GVELIAVHAWSDVE

SEQ ID NO: 127970 - protein, 14 aa, Mycobacterium tuberculosis
VELIAVHAWSDVEV

SEQ ID NO: 127971 - protein, 14 aa, Mycobacterium tuberculosis
ELIAVHAWSDVEVV

SEQ ID NO: 127972 - protein, 14 aa, Mycobacterium tuberculosis
LIAVHAWSDVEVVE

SEQ ID NO: 127973 - protein, 14 aa, Mycobacterium tuberculosis
IAVHAWSDVEVVEL

SEQ ID NO: 127974 - protein, 14 aa, Mycobacterium tuberculosis
AVHAWSDVEVVELP

SEQ ID NO: 127975 - protein, 14 aa, Mycobacterium tuberculosis
VHAWSDVEVVELPG

SEQ ID NO: 127976 - protein, 14 aa, Mycobacterium tuberculosis
HAWSDVEVVELPGL

SEQ ID NO: 127977 - protein, 14 aa, Mycobacterium tuberculosis
AWSDVEVVELPGLD

SEQ ID NO: 127978 - protein, 14 aa, Mycobacterium tuberculosis
WSDVEVVELPGLDF

SEQ ID NO: 127979 - protein, 14 aa, Mycobacterium tuberculosis
SDVEVVELPGLDFS

SEQ ID NO: 127980 - protein, 14 aa, Mycobacterium tuberculosis
DVEVVELPGLDFSA

SEQ ID NO: 127981 - protein, 14 aa, Mycobacterium tuberculosis
VEVVELPGLDFSAV

SEQ ID NO: 127982 - protein, 14 aa, Mycobacterium tuberculosis
EVVELPGLDFSAVQ

SEQ ID NO: 127983 - protein, 14 aa, Mycobacterium tuberculosis
VVELPGLDFSAVQQ

SEQ ID NO: 127984 - protein, 14 aa, Mycobacterium tuberculosis
VELPGLDFSAVQQE

SEQ ID NO: 127985 - protein, 14 aa, Mycobacterium tuberculosis
ELPGLDFSAVQQEA

SEQ ID NO: 127986 - protein, 14 aa, Mycobacterium tuberculosis
LPGLDFSAVQQEAE

SEQ ID NO: 127987 - protein, 14 aa, Mycobacterium tuberculosis
PGLDFSAVQQEAEL

SEQ ID NO: 127988 - protein, 14 aa, Mycobacterium tuberculosis
GLDFSAVQQEAELS

SEQ ID NO: 127989 - protein, 14 aa, Mycobacterium tuberculosis
LDFSAVQQEAELSL

SEQ ID NO: 127990 - protein, 14 aa, Mycobacterium tuberculosis
DFSAVQQEAELSLA

SEQ ID NO: 127991 - protein, 14 aa, Mycobacterium tuberculosis
FSAVQQEAELSLAE

SEQ ID NO: 127992 - protein, 14 aa, Mycobacterium tuberculosis
SAVQQEAELSLAER

SEQ ID NO: 127993 - protein, 14 aa, Mycobacterium tuberculosis
AVQQEAELSLAERL

SEQ ID NO: 127994 - protein, 14 aa, Mycobacterium tuberculosis
VQQEAELSLAERLA

SEQ ID NO: 127995 - protein, 14 aa, Mycobacterium tuberculosis
QQEAELSLAERLAG

SEQ ID NO: 127996 - protein, 14 aa, Mycobacterium tuberculosis
QEAELSLAERLAGW

SEQ ID NO: 127997 - protein, 14 aa, Mycobacterium tuberculosis
EAELSLAERLAGWQ

SEQ ID NO: 127998 - protein, 14 aa, Mycobacterium tuberculosis
AELSLAERLAGWQE

SEQ ID NO: 127999 - protein, 14 aa, Mycobacterium tuberculosis
ELSLAERLAGWQER

SEQ ID NO: 128000 - protein, 14 aa, Mycobacterium tuberculosis
LSLAERLAGWQERY

SEQ ID NO: 128001 - protein, 14 aa, Mycobacterium tuberculosis
SLAERLAGWQERYP

SEQ ID NO: 128002 - protein, 14 aa, Mycobacterium tuberculosis
LAERLAGWQERYPD

SEQ ID NO: 128003 - protein, 14 aa, Mycobacterium tuberculosis
AERLAGWQERYPDV

SEQ ID NO: 128004 - protein, 14 aa, Mycobacterium tuberculosis
ERLAGWQERYPDVP

SEQ ID NO: 128005 - protein, 14 aa, Mycobacterium tuberculosis
RLAGWQERYPDVPV

SEQ ID NO: 128006 - protein, 14 aa, Mycobacterium tuberculosis
LAGWQERYPDVPVS

SEQ ID NO: 128007 - protein, 14 aa, Mycobacterium tuberculosis
AGWQERYPDVPVSR

SEQ ID NO: 128008 - protein, 14 aa, Mycobacterium tuberculosis
GWQERYPDVPVSRV

SEQ ID NO: 128009 - protein, 14 aa, Mycobacterium tuberculosis
WQERYPDVPVSRVV

SEQ ID NO: 128010 - protein, 14 aa, Mycobacterium tuberculosis
QERYPDVPVSRVVV

SEQ ID NO: 128011 - protein, 14 aa, Mycobacterium tuberculosis
ERYPDVPVSRVVVC

SEQ ID NO: 128012 - protein, 14 aa, Mycobacterium tuberculosis
RYPDVPVSRVVVCD

SEQ ID NO: 128013 - protein, 14 aa, Mycobacterium tuberculosis
YPDVPVSRVVVCDR

SEQ ID NO: 128014 - protein, 14 aa, Mycobacterium tuberculosis
PDVPVSRVVVCDRP

SEQ ID NO: 128015 - protein, 14 aa, Mycobacterium tuberculosis
DVPVSRVVVCDRPA

SEQ ID NO: 128016 - protein, 14 aa, Mycobacterium tuberculosis
VPVSRVVVCDRPAR

SEQ ID NO: 128017 - protein, 14 aa, Mycobacterium tuberculosis
PVSRVVVCDRPARK

SEQ ID NO: 128018 - protein, 14 aa, Mycobacterium tuberculosis
VSRVVVCDRPARKL

SEQ ID NO: 128019 - protein, 14 aa, Mycobacterium tuberculosis
SRVVVCDRPARKLV

SEQ ID NO: 128020 - protein, 14 aa, Mycobacterium tuberculosis
RVVVCDRPARKLVQ

SEQ ID NO: 128021 - protein, 14 aa, Mycobacterium tuberculosis
VVVCDRPARKLVQK

SEQ ID NO: 128022 - protein, 14 aa, Mycobacterium tuberculosis
VVCDRPARKLVQKS

SEQ ID NO: 128023 - protein, 14 aa, Mycobacterium tuberculosis
VCDRPARKLVQKSA

SEQ ID NO: 128024 - protein, 14 aa, Mycobacterium tuberculosis
CDRPARKLVQKSAS

SEQ ID NO: 128025 - protein, 14 aa, Mycobacterium tuberculosis
DRPARKLVQKSASA

SEQ ID NO: 128026 - protein, 14 aa, Mycobacterium tuberculosis
RPARKLVQKSASAQ

SEQ ID NO: 128027 - protein, 14 aa, Mycobacterium tuberculosis
PARKLVQKSASAQL

SEQ ID NO: 128028 - protein, 14 aa, Mycobacterium tuberculosis
ARKLVQKSASAQLV

SEQ ID NO: 128029 - protein, 14 aa, Mycobacterium tuberculosis
RKLVQKSASAQLVV

SEQ ID NO: 128030 - protein, 14 aa, Mycobacterium tuberculosis
KLVQKSASAQLVVV

SEQ ID NO: 128031 - protein, 14 aa, Mycobacterium tuberculosis
LVQKSASAQLVVVG

SEQ ID NO: 128032 - protein, 14 aa, Mycobacterium tuberculosis
VQKSASAQLVVVGS

SEQ ID NO: 128033 - protein, 14 aa, Mycobacterium tuberculosis
QKSASAQLVVVGSH

SEQ ID NO: 128034 - protein, 14 aa, Mycobacterium tuberculosis
KSASAQLVVVGSHG

SEQ ID NO: 128035 - protein, 14 aa, Mycobacterium tuberculosis
SASAQLVVVGSHGR

SEQ ID NO: 128036 - protein, 14 aa, Mycobacterium tuberculosis
ASAQLVVVGSHGRG

SEQ ID NO: 128037 - protein, 14 aa, Mycobacterium tuberculosis
SAQLVVVGSHGRGG

SEQ ID NO: 128038 - protein, 14 aa, Mycobacterium tuberculosis
AQLVVVGSHGRGGL

SEQ ID NO: 128039 - protein, 14 aa, Mycobacterium tuberculosis
QLVVVGSHGRGGLT

SEQ ID NO: 128040 - protein, 14 aa, Mycobacterium tuberculosis
LVVVGSHGRGGLTG

SEQ ID NO: 128041 - protein, 14 aa, Mycobacterium tuberculosis
VVVGSHGRGGLTGM

SEQ ID NO: 128042 - protein, 14 aa, Mycobacterium tuberculosis
VVGSHGRGGLTGML

SEQ ID NO: 128043 - protein, 14 aa, Mycobacterium tuberculosis
VGSHGRGGLTGMLL

SEQ ID NO: 128044 - protein, 14 aa, Mycobacterium tuberculosis
GSHGRGGLTGMLLG

SEQ ID NO: 128045 - protein, 14 aa, Mycobacterium tuberculosis
SHGRGGLTGMLLGS

SEQ ID NO: 128046 - protein, 14 aa, Mycobacterium tuberculosis
HGRGGLTGMLLGSV

SEQ ID NO: 128047 - protein, 14 aa, Mycobacterium tuberculosis
GRGGLTGMLLGSVS

SEQ ID NO: 128048 - protein, 14 aa, Mycobacterium tuberculosis
RGGLTGMLLGSVSN

SEQ ID NO: 128049 - protein, 14 aa, Mycobacterium tuberculosis
GGLTGMLLGSVSNA

SEQ ID NO: 128050 - protein, 14 aa, Mycobacterium tuberculosis
GLTGMLLGSVSNAV

SEQ ID NO: 128051 - protein, 14 aa, Mycobacterium tuberculosis
LTGMLLGSVSNAVL

SEQ ID NO: 128052 - protein, 14 aa, Mycobacterium tuberculosis
TGMLLGSVSNAVLH

SEQ ID NO: 128053 - protein, 14 aa, Mycobacterium tuberculosis
GMLLGSVSNAVLHA

SEQ ID NO: 128054 - protein, 14 aa, Mycobacterium tuberculosis
MLLGSVSNAVLHAA

SEQ ID NO: 128055 - protein, 14 aa, Mycobacterium tuberculosis
LLGSVSNAVLHAAR

SEQ ID NO: 128056 - protein, 14 aa, Mycobacterium tuberculosis
LGSVSNAVLHAARV

SEQ ID NO: 128057 - protein, 14 aa, Mycobacterium tuberculosis
GSVSNAVLHAARVP

SEQ ID NO: 128058 - protein, 14 aa, Mycobacterium tuberculosis
SVSNAVLHAARVPV

SEQ ID NO: 128059 - protein, 14 aa, Mycobacterium tuberculosis
VSNAVLHAARVPVI

SEQ ID NO: 128060 - protein, 14 aa, Mycobacterium tuberculosis
SNAVLHAARVPVIV

SEQ ID NO: 128061 - protein, 14 aa, Mycobacterium tuberculosis
NAVLHAARVPVIVA

SEQ ID NO: 128062 - protein, 14 aa, Mycobacterium tuberculosis
AVLHAARVPVIVAR

SEQ ID NO: 128063 - protein, 14 aa, Mycobacterium tuberculosis
VLHAARVPVIVARQ

SEQ ID NO: 128064 - protein, 14 aa, Mycobacterium tuberculosis
LHAARVPVIVARQS

SEQ ID NO: 128065 - protein, 15 aa, Mycobacterium tuberculosis
MSKPRKQHGVVVGVD

SEQ ID NO: 128066 - protein, 15 aa, Mycobacterium tuberculosis
SKPRKQHGVVVGVDG

SEQ ID NO: 128067 - protein, 15 aa, Mycobacterium tuberculosis
KPRKQHGVVVGVDGS

SEQ ID NO: 128068 - protein, 15 aa, Mycobacterium tuberculosis
PRKQHGVVVGVDGSL

SEQ ID NO: 128069 - protein, 15 aa, Mycobacterium tuberculosis
RKQHGVVVGVDGSLE

SEQ ID NO: 128070 - protein, 15 aa, Mycobacterium tuberculosis
KQHGVVVGVDGSLES

SEQ ID NO: 128071 - protein, 15 aa, Mycobacterium tuberculosis
QHGVVVGVDGSLESD

SEQ ID NO: 128072 - protein, 15 aa, Mycobacterium tuberculosis
HGVVVGVDGSLESDA

SEQ ID NO: 128073 - protein, 15 aa, Mycobacterium tuberculosis
GVVVGVDGSLESDAA

SEQ ID NO: 128074 - protein, 15 aa, Mycobacterium tuberculosis
VVVGVDGSLESDAAA

SEQ ID NO: 128075 - protein, 15 aa, Mycobacterium tuberculosis
VVGVDGSLESDAAAC

SEQ ID NO: 128076 - protein, 15 aa, Mycobacterium tuberculosis
VGVDGSLESDAAACW

SEQ ID NO: 128077 - protein, 15 aa, Mycobacterium tuberculosis
GVDGSLESDAAACWG

SEQ ID NO: 128078 - protein, 15 aa, Mycobacterium tuberculosis
VDGSLESDAAACWGA

SEQ ID NO: 128079 - protein, 15 aa, Mycobacterium tuberculosis
DGSLESDAAACWGAT

SEQ ID NO: 128080 - protein, 15 aa, Mycobacterium tuberculosis
GSLESDAAACWGATD

SEQ ID NO: 128081 - protein, 15 aa, Mycobacterium tuberculosis
SLESDAAACWGATDA

SEQ ID NO: 128082 - protein, 15 aa, Mycobacterium tuberculosis
LESDAAACWGATDAA

SEQ ID NO: 128083 - protein, 15 aa, Mycobacterium tuberculosis
ESDAAACWGATDAAM

SEQ ID NO: 128084 - protein, 15 aa, Mycobacterium tuberculosis
SDAAACWGATDAAMR

SEQ ID NO: 128085 - protein, 15 aa, Mycobacterium tuberculosis
DAAACWGATDAAMRN

SEQ ID NO: 128086 - protein, 15 aa, Mycobacterium tuberculosis
AAACWGATDAAMRNI

SEQ ID NO: 128087 - protein, 15 aa, Mycobacterium tuberculosis
AACWGATDAAMRNIP

SEQ ID NO: 128088 - protein, 15 aa, Mycobacterium tuberculosis
ACWGATDAAMRNIPL

SEQ ID NO: 128089 - protein, 15 aa, Mycobacterium tuberculosis
CWGATDAAMRNIPLT

SEQ ID NO: 128090 - protein, 15 aa, Mycobacterium tuberculosis
WGATDAAMRNIPLTV

SEQ ID NO: 128091 - protein, 15 aa, Mycobacterium tuberculosis
GATDAAMRNIPLTVV

SEQ ID NO: 128092 - protein, 15 aa, Mycobacterium tuberculosis
ATDAAMRNIPLTVVH

SEQ ID NO: 128093 - protein, 15 aa, Mycobacterium tuberculosis
TDAAMRNIPLTVVHV

SEQ ID NO: 128094 - protein, 15 aa, Mycobacterium tuberculosis
DAAMRNIPLTVVHVV

SEQ ID NO: 128095 - protein, 15 aa, Mycobacterium tuberculosis
AAMRNIPLTVVHVVN

SEQ ID NO: 128096 - protein, 15 aa, Mycobacterium tuberculosis
AMRNIPLTVVHVVNA

SEQ ID NO: 128097 - protein, 15 aa, Mycobacterium tuberculosis
MRNIPLTVVHVVNAD

SEQ ID NO: 128098 - protein, 15 aa, Mycobacterium tuberculosis
RNIPLTVVHVVNADV

SEQ ID NO: 128099 - protein, 15 aa, Mycobacterium tuberculosis
NIPLTVVHVVNADVA

SEQ ID NO: 128100 - protein, 15 aa, Mycobacterium tuberculosis
IPLTVVHVVNADVAT

SEQ ID NO: 128101 - protein, 15 aa, Mycobacterium tuberculosis
PLTVVHVVNADVATW

SEQ ID NO: 128102 - protein, 15 aa, Mycobacterium tuberculosis
LTVVHVVNADVATWP

SEQ ID NO: 128103 - protein, 15 aa, Mycobacterium tuberculosis
TVVHVVNADVATWPP

SEQ ID NO: 128104 - protein, 15 aa, Mycobacterium tuberculosis
VVHVVNADVATWPPM

SEQ ID NO: 128105 - protein, 15 aa, Mycobacterium tuberculosis
VHVVNADVATWPPMP

SEQ ID NO: 128106 - protein, 15 aa, Mycobacterium tuberculosis
HVVNADVATWPPMPY

SEQ ID NO: 128107 - protein, 15 aa, Mycobacterium tuberculosis
VVNADVATWPPMPYP

SEQ ID NO: 128108 - protein, 15 aa, Mycobacterium tuberculosis
VNADVATWPPMPYPE

SEQ ID NO: 128109 - protein, 15 aa, Mycobacterium tuberculosis
NADVATWPPMPYPET

SEQ ID NO: 128110 - protein, 15 aa, Mycobacterium tuberculosis
ADVATWPPMPYPETW

SEQ ID NO: 128111 - protein, 15 aa, Mycobacterium tuberculosis
DVATWPPMPYPETWG

SEQ ID NO: 128112 - protein, 15 aa, Mycobacterium tuberculosis
VATWPPMPYPETWGV

SEQ ID NO: 128113 - protein, 15 aa, Mycobacterium tuberculosis
ATWPPMPYPETWGVW

SEQ ID NO: 128114 - protein, 15 aa, Mycobacterium tuberculosis
TWPPMPYPETWGVWQ

SEQ ID NO: 128115 - protein, 15 aa, Mycobacterium tuberculosis
WPPMPYPETWGVWQE

SEQ ID NO: 128116 - protein, 15 aa, Mycobacterium tuberculosis
PPMPYPETWGVWQED

SEQ ID NO: 128117 - protein, 15 aa, Mycobacterium tuberculosis
PMPYPETWGVWQEDE

SEQ ID NO: 128118 - protein, 15 aa, Mycobacterium tuberculosis
MPYPETWGVWQEDEG

SEQ ID NO: 128119 - protein, 15 aa, Mycobacterium tuberculosis
PYPETWGVWQEDEGR

SEQ ID NO: 128120 - protein, 15 aa, Mycobacterium tuberculosis
YPETWGVWQEDEGRQ

SEQ ID NO: 128121 - protein, 15 aa, Mycobacterium tuberculosis
PETWGVWQEDEGRQI

SEQ ID NO: 128122 - protein, 15 aa, Mycobacterium tuberculosis
ETWGVWQEDEGRQIV

SEQ ID NO: 128123 - protein, 15 aa, Mycobacterium tuberculosis
TWGVWQEDEGRQIVA

SEQ ID NO: 128124 - protein, 15 aa, Mycobacterium tuberculosis
WGVWQEDEGRQIVAN

SEQ ID NO: 128125 - protein, 15 aa, Mycobacterium tuberculosis
GVWQEDEGRQIVANA

SEQ ID NO: 128126 - protein, 15 aa, Mycobacterium tuberculosis
VWQEDEGRQIVANAV

SEQ ID NO: 128127 - protein, 15 aa, Mycobacterium tuberculosis
WQEDEGRQIVANAVK

SEQ ID NO: 128128 - protein, 15 aa, Mycobacterium tuberculosis
QEDEGRQIVANAVKL

SEQ ID NO: 128129 - protein, 15 aa, Mycobacterium tuberculosis
EDEGRQIVANAVKLA

SEQ ID NO: 128130 - protein, 15 aa, Mycobacterium tuberculosis
DEGRQIVANAVKLAK

SEQ ID NO: 128131 - protein, 15 aa, Mycobacterium tuberculosis
EGRQIVANAVKLAKE

SEQ ID NO: 128132 - protein, 15 aa, Mycobacterium tuberculosis
GRQIVANAVKLAKEA

SEQ ID NO: 128133 - protein, 15 aa, Mycobacterium tuberculosis
RQIVANAVKLAKEAV

SEQ ID NO: 128134 - protein, 15 aa, Mycobacterium tuberculosis
QIVANAVKLAKEAVG

SEQ ID NO: 128135 - protein, 15 aa, Mycobacterium tuberculosis
IVANAVKLAKEAVGA

SEQ ID NO: 128136 - protein, 15 aa, Mycobacterium tuberculosis
VANAVKLAKEAVGAD

SEQ ID NO: 128137 - protein, 15 aa, Mycobacterium tuberculosis
ANAVKLAKEAVGADR

SEQ ID NO: 128138 - protein, 15 aa, Mycobacterium tuberculosis
NAVKLAKEAVGADRK

SEQ ID NO: 128139 - protein, 15 aa, Mycobacterium tuberculosis
AVKLAKEAVGADRKL

SEQ ID NO: 128140 - protein, 15 aa, Mycobacterium tuberculosis
VKLAKEAVGADRKLS

SEQ ID NO: 128141 - protein, 15 aa, Mycobacterium tuberculosis
KLAKEAVGADRKLSV

SEQ ID NO: 128142 - protein, 15 aa, Mycobacterium tuberculosis
LAKEAVGADRKLSVK

SEQ ID NO: 128143 - protein, 15 aa, Mycobacterium tuberculosis
AKEAVGADRKLSVKS

SEQ ID NO: 128144 - protein, 15 aa, Mycobacterium tuberculosis
KEAVGADRKLSVKSE

SEQ ID NO: 128145 - protein, 15 aa, Mycobacterium tuberculosis
EAVGADRKLSVKSEL

SEQ ID NO: 128146 - protein, 15 aa, Mycobacterium tuberculosis
AVGADRKLSVKSELV

SEQ ID NO: 128147 - protein, 15 aa, Mycobacterium tuberculosis
VGADRKLSVKSELVF

SEQ ID NO: 128148 - protein, 15 aa, Mycobacterium tuberculosis
GADRKLSVKSELVFS

SEQ ID NO: 128149 - protein, 15 aa, Mycobacterium tuberculosis
ADRKLSVKSELVFST

SEQ ID NO: 128150 - protein, 15 aa, Mycobacterium tuberculosis
DRKLSVKSELVFSTP

SEQ ID NO: 128151 - protein, 15 aa, Mycobacterium tuberculosis
RKLSVKSELVFSTPV

SEQ ID NO: 128152 - protein, 15 aa, Mycobacterium tuberculosis
KLSVKSELVFSTPVP

SEQ ID NO: 128153 - protein, 15 aa, Mycobacterium tuberculosis
LSVKSELVFSTPVPT

SEQ ID NO: 128154 - protein, 15 aa, Mycobacterium tuberculosis
SVKSELVFSTPVPTM

SEQ ID NO: 128155 - protein, 15 aa, Mycobacterium tuberculosis
VKSELVFSTPVPTMV

SEQ ID NO: 128156 - protein, 15 aa, Mycobacterium tuberculosis
KSELVFSTPVPTMVE

SEQ ID NO: 128157 - protein, 15 aa, Mycobacterium tuberculosis
SELVFSTPVPTMVEI

SEQ ID NO: 128158 - protein, 15 aa, Mycobacterium tuberculosis
ELVFSTPVPTMVEIS

SEQ ID NO: 128159 - protein, 15 aa, Mycobacterium tuberculosis
LVFSTPVPTMVEISN

SEQ ID NO: 128160 - protein, 15 aa, Mycobacterium tuberculosis
VFSTPVPTMVEISNE

SEQ ID NO: 128161 - protein, 15 aa, Mycobacterium tuberculosis
FSTPVPTMVEISNEA

SEQ ID NO: 128162 - protein, 15 aa, Mycobacterium tuberculosis
STPVPTMVEISNEAE

SEQ ID NO: 128163 - protein, 15 aa, Mycobacterium tuberculosis
TPVPTMVEISNEAEM

SEQ ID NO: 128164 - protein, 15 aa, Mycobacterium tuberculosis
PVPTMVEISNEAEMV

SEQ ID NO: 128165 - protein, 15 aa, Mycobacterium tuberculosis
VPTMVEISNEAEMVV

SEQ ID NO: 128166 - protein, 15 aa, Mycobacterium tuberculosis
PTMVEISNEAEMVVL

SEQ ID NO: 128167 - protein, 15 aa, Mycobacterium tuberculosis
TMVEISNEAEMVVLG

SEQ ID NO: 128168 - protein, 15 aa, Mycobacterium tuberculosis
MVEISNEAEMVVLGS

SEQ ID NO: 128169 - protein, 15 aa, Mycobacterium tuberculosis
VEISNEAEMVVLGSS

SEQ ID NO: 128170 - protein, 15 aa, Mycobacterium tuberculosis
EISNEAEMVVLGSSG

SEQ ID NO: 128171 - protein, 15 aa, Mycobacterium tuberculosis
ISNEAEMVVLGSSGR

SEQ ID NO: 128172 - protein, 15 aa, Mycobacterium tuberculosis
SNEAEMVVLGSSGRG

SEQ ID NO: 128173 - protein, 15 aa, Mycobacterium tuberculosis
NEAEMVVLGSSGRGA

SEQ ID NO: 128174 - protein, 15 aa, Mycobacterium tuberculosis
EAEMVVLGSSGRGAL

SEQ ID NO: 128175 - protein, 15 aa, Mycobacterium tuberculosis
AEMVVLGSSGRGALA

SEQ ID NO: 128176 - protein, 15 aa, Mycobacterium tuberculosis
EMVVLGSSGRGALAR

SEQ ID NO: 128177 - protein, 15 aa, Mycobacterium tuberculosis
MVVLGSSGRGALARG

SEQ ID NO: 128178 - protein, 15 aa, Mycobacterium tuberculosis
VVLGSSGRGALARGL

SEQ ID NO: 128179 - protein, 15 aa, Mycobacterium tuberculosis
VLGSSGRGALARGLL

SEQ ID NO: 128180 - protein, 15 aa, Mycobacterium tuberculosis
LGSSGRGALARGLLG

SEQ ID NO: 128181 - protein, 15 aa, Mycobacterium tuberculosis
GSSGRGALARGLLGS

SEQ ID NO: 128182 - protein, 15 aa, Mycobacterium tuberculosis
SSGRGALARGLLGSV

SEQ ID NO: 128183 - protein, 15 aa, Mycobacterium tuberculosis
SGRGALARGLLGSVS

SEQ ID NO: 128184 - protein, 15 aa, Mycobacterium tuberculosis
GRGALARGLLGSVSS

SEQ ID NO: 128185 - protein, 15 aa, Mycobacterium tuberculosis
RGALARGLLGSVSSS

SEQ ID NO: 128186 - protein, 15 aa, Mycobacterium tuberculosis
GALARGLLGSVSSSL

SEQ ID NO: 128187 - protein, 15 aa, Mycobacterium tuberculosis
ALARGLLGSVSSSLV

SEQ ID NO: 128188 - protein, 15 aa, Mycobacterium tuberculosis
LARGLLGSVSSSLVR

SEQ ID NO: 128189 - protein, 15 aa, Mycobacterium tuberculosis
ARGLLGSVSSSLVRR

SEQ ID NO: 128190 - protein, 15 aa, Mycobacterium tuberculosis
RGLLGSVSSSLVRRA

SEQ ID NO: 128191 - protein, 15 aa, Mycobacterium tuberculosis
GLLGSVSSSLVRRAG

SEQ ID NO: 128192 - protein, 15 aa, Mycobacterium tuberculosis
LLGSVSSSLVRRAGC

SEQ ID NO: 128193 - protein, 15 aa, Mycobacterium tuberculosis
LGSVSSSLVRRAGCP

SEQ ID NO: 128194 - protein, 15 aa, Mycobacterium tuberculosis
GSVSSSLVRRAGCPV

SEQ ID NO: 128195 - protein, 15 aa, Mycobacterium tuberculosis
SVSSSLVRRAGCPVA

SEQ ID NO: 128196 - protein, 15 aa, Mycobacterium tuberculosis
VSSSLVRRAGCPVAV

SEQ ID NO: 128197 - protein, 15 aa, Mycobacterium tuberculosis
SSSLVRRAGCPVAVI

SEQ ID NO: 128198 - protein, 15 aa, Mycobacterium tuberculosis
SSLVRRAGCPVAVIH

SEQ ID NO: 128199 - protein, 15 aa, Mycobacterium tuberculosis
SLVRRAGCPVAVIHS

SEQ ID NO: 128200 - protein, 15 aa, Mycobacterium tuberculosis
LVRRAGCPVAVIHSD

SEQ ID NO: 128201 - protein, 15 aa, Mycobacterium tuberculosis
VRRAGCPVAVIHSDD

SEQ ID NO: 128202 - protein, 15 aa, Mycobacterium tuberculosis
RRAGCPVAVIHSDDA

SEQ ID NO: 128203 - protein, 15 aa, Mycobacterium tuberculosis
RAGCPVAVIHSDDAV

SEQ ID NO: 128204 - protein, 15 aa, Mycobacterium tuberculosis
AGCPVAVIHSDDAVI

SEQ ID NO: 128205 - protein, 15 aa, Mycobacterium tuberculosis
GCPVAVIHSDDAVIP

SEQ ID NO: 128206 - protein, 15 aa, Mycobacterium tuberculosis
CPVAVIHSDDAVIPD

SEQ ID NO: 128207 - protein, 15 aa, Mycobacterium tuberculosis
PVAVIHSDDAVIPDP

SEQ ID NO: 128208 - protein, 15 aa, Mycobacterium tuberculosis
VAVIHSDDAVIPDPQ

SEQ ID NO: 128209 - protein, 15 aa, Mycobacterium tuberculosis
AVIHSDDAVIPDPQH

SEQ ID NO: 128210 - protein, 15 aa, Mycobacterium tuberculosis
VIHSDDAVIPDPQHA

SEQ ID NO: 128211 - protein, 15 aa, Mycobacterium tuberculosis
IHSDDAVIPDPQHAP

SEQ ID NO: 128212 - protein, 15 aa, Mycobacterium tuberculosis
HSDDAVIPDPQHAPV

SEQ ID NO: 128213 - protein, 15 aa, Mycobacterium tuberculosis
SDDAVIPDPQHAPVL

SEQ ID NO: 128214 - protein, 15 aa, Mycobacterium tuberculosis
DDAVIPDPQHAPVLV

SEQ ID NO: 128215 - protein, 15 aa, Mycobacterium tuberculosis
DAVIPDPQHAPVLVG

SEQ ID NO: 128216 - protein, 15 aa, Mycobacterium tuberculosis
AVIPDPQHAPVLVGI

SEQ ID NO: 128217 - protein, 15 aa, Mycobacterium tuberculosis
VIPDPQHAPVLVGID

SEQ ID NO: 128218 - protein, 15 aa, Mycobacterium tuberculosis
IPDPQHAPVLVGIDG

SEQ ID NO: 128219 - protein, 15 aa, Mycobacterium tuberculosis
PDPQHAPVLVGIDGS

SEQ ID NO: 128220 - protein, 15 aa, Mycobacterium tuberculosis
DPQHAPVLVGIDGSP

SEQ ID NO: 128221 - protein, 15 aa, Mycobacterium tuberculosis
PQHAPVLVGIDGSPV

SEQ ID NO: 128222 - protein, 15 aa, Mycobacterium tuberculosis
QHAPVLVGIDGSPVS

SEQ ID NO: 128223 - protein, 15 aa, Mycobacterium tuberculosis
HAPVLVGIDGSPVSE

SEQ ID NO: 128224 - protein, 15 aa, Mycobacterium tuberculosis
APVLVGIDGSPVSEL

SEQ ID NO: 128225 - protein, 15 aa, Mycobacterium tuberculosis
PVLVGIDGSPVSELA

SEQ ID NO: 128226 - protein, 15 aa, Mycobacterium tuberculosis
VLVGIDGSPVSELAT

SEQ ID NO: 128227 - protein, 15 aa, Mycobacterium tuberculosis
LVGIDGSPVSELATA

SEQ ID NO: 128228 - protein, 15 aa, Mycobacterium tuberculosis
VGIDGSPVSELATAV

SEQ ID NO: 128229 - protein, 15 aa, Mycobacterium tuberculosis
GIDGSPVSELATAVA

SEQ ID NO: 128230 - protein, 15 aa, Mycobacterium tuberculosis
IDGSPVSELATAVAF

SEQ ID NO: 128231 - protein, 15 aa, Mycobacterium tuberculosis
DGSPVSELATAVAFD

SEQ ID NO: 128232 - protein, 15 aa, Mycobacterium tuberculosis
GSPVSELATAVAFDE

SEQ ID NO: 128233 - protein, 15 aa, Mycobacterium tuberculosis
SPVSELATAVAFDEA

SEQ ID NO: 128234 - protein, 15 aa, Mycobacterium tuberculosis
PVSELATAVAFDEAS

SEQ ID NO: 128235 - protein, 15 aa, Mycobacterium tuberculosis
VSELATAVAFDEASR

SEQ ID NO: 128236 - protein, 15 aa, Mycobacterium tuberculosis
SELATAVAFDEASRR

SEQ ID NO: 128237 - protein, 15 aa, Mycobacterium tuberculosis
ELATAVAFDEASRRG

SEQ ID NO: 128238 - protein, 15 aa, Mycobacterium tuberculosis
LATAVAFDEASRRGV

SEQ ID NO: 128239 - protein, 15 aa, Mycobacterium tuberculosis
ATAVAFDEASRRGVE

SEQ ID NO: 128240 - protein, 15 aa, Mycobacterium tuberculosis
TAVAFDEASRRGVEL

SEQ ID NO: 128241 - protein, 15 aa, Mycobacterium tuberculosis
AVAFDEASRRGVELI

SEQ ID NO: 128242 - protein, 15 aa, Mycobacterium tuberculosis
VAFDEASRRGVELIA

SEQ ID NO: 128243 - protein, 15 aa, Mycobacterium tuberculosis
AFDEASRRGVELIAV

SEQ ID NO: 128244 - protein, 15 aa, Mycobacterium tuberculosis
FDEASRRGVELIAVH

SEQ ID NO: 128245 - protein, 15 aa, Mycobacterium tuberculosis
DEASRRGVELIAVHA

SEQ ID NO: 128246 - protein, 15 aa, Mycobacterium tuberculosis
EASRRGVELIAVHAW

SEQ ID NO: 128247 - protein, 15 aa, Mycobacterium tuberculosis
ASRRGVELIAVHAWS

SEQ ID NO: 128248 - protein, 15 aa, Mycobacterium tuberculosis
SRRGVELIAVHAWSD

SEQ ID NO: 128249 - protein, 15 aa, Mycobacterium tuberculosis
RRGVELIAVHAWSDV

SEQ ID NO: 128250 - protein, 15 aa, Mycobacterium tuberculosis
RGVELIAVHAWSDVE

SEQ ID NO: 128251 - protein, 15 aa, Mycobacterium tuberculosis
GVELIAVHAWSDVEV

SEQ ID NO: 128252 - protein, 15 aa, Mycobacterium tuberculosis
VELIAVHAWSDVEVV

SEQ ID NO: 128253 - protein, 15 aa, Mycobacterium tuberculosis
ELIAVHAWSDVEVVE

SEQ ID NO: 128254 - protein, 15 aa, Mycobacterium tuberculosis
LIAVHAWSDVEVVEL

SEQ ID NO: 128255 - protein, 15 aa, Mycobacterium tuberculosis
IAVHAWSDVEVVELP

SEQ ID NO: 128256 - protein, 15 aa, Mycobacterium tuberculosis
AVHAWSDVEVVELPG

SEQ ID NO: 128257 - protein, 15 aa, Mycobacterium tuberculosis
VHAWSDVEVVELPGL

SEQ ID NO: 128258 - protein, 15 aa, Mycobacterium tuberculosis
HAWSDVEVVELPGLD

SEQ ID NO: 128259 - protein, 15 aa, Mycobacterium tuberculosis
AWSDVEVVELPGLDF

SEQ ID NO: 128260 - protein, 15 aa, Mycobacterium tuberculosis
WSDVEVVELPGLDFS

SEQ ID NO: 128261 - protein, 15 aa, Mycobacterium tuberculosis
SDVEVVELPGLDFSA

SEQ ID NO: 128262 - protein, 15 aa, Mycobacterium tuberculosis
DVEVVELPGLDFSAV

SEQ ID NO: 128263 - protein, 15 aa, Mycobacterium tuberculosis
VEVVELPGLDFSAVQ

SEQ ID NO: 128264 - protein, 15 aa, Mycobacterium tuberculosis
EVVELPGLDFSAVQQ

SEQ ID NO: 128265 - protein, 15 aa, Mycobacterium tuberculosis
VVELPGLDFSAVQQE

SEQ ID NO: 128266 - protein, 15 aa, Mycobacterium tuberculosis
VELPGLDFSAVQQEA

SEQ ID NO: 128267 - protein, 15 aa, Mycobacterium tuberculosis
ELPGLDFSAVQQEAE

SEQ ID NO: 128268 - protein, 15 aa, Mycobacterium tuberculosis
LPGLDFSAVQQEAEL

SEQ ID NO: 128269 - protein, 15 aa, Mycobacterium tuberculosis
PGLDFSAVQQEAELS

SEQ ID NO: 128270 - protein, 15 aa, Mycobacterium tuberculosis
GLDFSAVQQEAELSL

SEQ ID NO: 128271 - protein, 15 aa, Mycobacterium tuberculosis
LDFSAVQQEAELSLA

SEQ ID NO: 128272 - protein, 15 aa, Mycobacterium tuberculosis
DFSAVQQEAELSLAE

SEQ ID NO: 128273 - protein, 15 aa, Mycobacterium tuberculosis
FSAVQQEAELSLAER

SEQ ID NO: 128274 - protein, 15 aa, Mycobacterium tuberculosis
SAVQQEAELSLAERL

SEQ ID NO: 128275 - protein, 15 aa, Mycobacterium tuberculosis
AVQQEAELSLAERLA

SEQ ID NO: 128276 - protein, 15 aa, Mycobacterium tuberculosis
VQQEAELSLAERLAG

SEQ ID NO: 128277 - protein, 15 aa, Mycobacterium tuberculosis
QQEAELSLAERLAGW

SEQ ID NO: 128278 - protein, 15 aa, Mycobacterium tuberculosis
QEAELSLAERLAGWQ

SEQ ID NO: 128279 - protein, 15 aa, Mycobacterium tuberculosis
EAELSLAERLAGWQE

SEQ ID NO: 128280 - protein, 15 aa, Mycobacterium tuberculosis
AELSLAERLAGWQER

SEQ ID NO: 128281 - protein, 15 aa, Mycobacterium tuberculosis
ELSLAERLAGWQERY

SEQ ID NO: 128282 - protein, 15 aa, Mycobacterium tuberculosis
LSLAERLAGWQERYP

SEQ ID NO: 128283 - protein, 15 aa, Mycobacterium tuberculosis
SLAERLAGWQERYPD

SEQ ID NO: 128284 - protein, 15 aa, Mycobacterium tuberculosis
LAERLAGWQERYPDV

SEQ ID NO: 128285 - protein, 15 aa, Mycobacterium tuberculosis
AERLAGWQERYPDVP

SEQ ID NO: 128286 - protein, 15 aa, Mycobacterium tuberculosis
ERLAGWQERYPDVPV

SEQ ID NO: 128287 - protein, 15 aa, Mycobacterium tuberculosis
RLAGWQERYPDVPVS

SEQ ID NO: 128288 - protein, 15 aa, Mycobacterium tuberculosis
LAGWQERYPDVPVSR

SEQ ID NO: 128289 - protein, 15 aa, Mycobacterium tuberculosis
AGWQERYPDVPVSRV

SEQ ID NO: 128290 - protein, 15 aa, Mycobacterium tuberculosis
GWQERYPDVPVSRVV

SEQ ID NO: 128291 - protein, 15 aa, Mycobacterium tuberculosis
WQERYPDVPVSRVVV

SEQ ID NO: 128292 - protein, 15 aa, Mycobacterium tuberculosis
QERYPDVPVSRVVVC

SEQ ID NO: 128293 - protein, 15 aa, Mycobacterium tuberculosis
ERYPDVPVSRVVVCD

SEQ ID NO: 128294 - protein, 15 aa, Mycobacterium tuberculosis
RYPDVPVSRVVVCDR

SEQ ID NO: 128295 - protein, 15 aa, Mycobacterium tuberculosis
YPDVPVSRVVVCDRP

SEQ ID NO: 128296 - protein, 15 aa, Mycobacterium tuberculosis
PDVPVSRVVVCDRPA

SEQ ID NO: 128297 - protein, 15 aa, Mycobacterium tuberculosis
DVPVSRVVVCDRPAR

SEQ ID NO: 128298 - protein, 15 aa, Mycobacterium tuberculosis
VPVSRVVVCDRPARK

SEQ ID NO: 128299 - protein, 15 aa, Mycobacterium tuberculosis
PVSRVVVCDRPARKL

SEQ ID NO: 128300 - protein, 15 aa, Mycobacterium tuberculosis
VSRVVVCDRPARKLV

SEQ ID NO: 128301 - protein, 15 aa, Mycobacterium tuberculosis
SRVVVCDRPARKLVQ

SEQ ID NO: 128302 - protein, 15 aa, Mycobacterium tuberculosis
RVVVCDRPARKLVQK

SEQ ID NO: 128303 - protein, 15 aa, Mycobacterium tuberculosis
VVVCDRPARKLVQKS

SEQ ID NO: 128304 - protein, 15 aa, Mycobacterium tuberculosis
VVCDRPARKLVQKSA

SEQ ID NO: 128305 - protein, 15 aa, Mycobacterium tuberculosis
VCDRPARKLVQKSAS

SEQ ID NO: 128306 - protein, 15 aa, Mycobacterium tuberculosis
CDRPARKLVQKSASA

SEQ ID NO: 128307 - protein, 15 aa, Mycobacterium tuberculosis
DRPARKLVQKSASAQ

SEQ ID NO: 128308 - protein, 15 aa, Mycobacterium tuberculosis
RPARKLVQKSASAQL

SEQ ID NO: 128309 - protein, 15 aa, Mycobacterium tuberculosis
PARKLVQKSASAQLV

SEQ ID NO: 128310 - protein, 15 aa, Mycobacterium tuberculosis
ARKLVQKSASAQLVV

SEQ ID NO: 128311 - protein, 15 aa, Mycobacterium tuberculosis
RKLVQKSASAQLVVV

SEQ ID NO: 128312 - protein, 15 aa, Mycobacterium tuberculosis
KLVQKSASAQLVVVG

SEQ ID NO: 128313 - protein, 15 aa, Mycobacterium tuberculosis
LVQKSASAQLVVVGS

SEQ ID NO: 128314 - protein, 15 aa, Mycobacterium tuberculosis
VQKSASAQLVVVGSH

SEQ ID NO: 128315 - protein, 15 aa, Mycobacterium tuberculosis
QKSASAQLVVVGSHG

SEQ ID NO: 128316 - protein, 15 aa, Mycobacterium tuberculosis
KSASAQLVVVGSHGR

SEQ ID NO: 128317 - protein, 15 aa, Mycobacterium tuberculosis
SASAQLVVVGSHGRG

SEQ ID NO: 128318 - protein, 15 aa, Mycobacterium tuberculosis
ASAQLVVVGSHGRGG

SEQ ID NO: 128319 - protein, 15 aa, Mycobacterium tuberculosis
SAQLVVVGSHGRGGL

SEQ ID NO: 128320 - protein, 15 aa, Mycobacterium tuberculosis
AQLVVVGSHGRGGLT

SEQ ID NO: 128321 - protein, 15 aa, Mycobacterium tuberculosis
QLVVVGSHGRGGLTG

SEQ ID NO: 128322 - protein, 15 aa, Mycobacterium tuberculosis
LVVVGSHGRGGLTGM

SEQ ID NO: 128323 - protein, 15 aa, Mycobacterium tuberculosis
VVVGSHGRGGLTGML

SEQ ID NO: 128324 - protein, 15 aa, Mycobacterium tuberculosis
VVGSHGRGGLTGMLL

SEQ ID NO: 128325 - protein, 15 aa, Mycobacterium tuberculosis
VGSHGRGGLTGMLLG

SEQ ID NO: 128326 - protein, 15 aa, Mycobacterium tuberculosis
GSHGRGGLTGMLLGS

SEQ ID NO: 128327 - protein, 15 aa, Mycobacterium tuberculosis
SHGRGGLTGMLLGSV

SEQ ID NO: 128328 - protein, 15 aa, Mycobacterium tuberculosis
HGRGGLTGMLLGSVS

SEQ ID NO: 128329 - protein, 15 aa, Mycobacterium tuberculosis
GRGGLTGMLLGSVSN

SEQ ID NO: 128330 - protein, 15 aa, Mycobacterium tuberculosis
RGGLTGMLLGSVSNA

SEQ ID NO: 128331 - protein, 15 aa, Mycobacterium tuberculosis
GGLTGMLLGSVSNAV

SEQ ID NO: 128332 - protein, 15 aa, Mycobacterium tuberculosis
GLTGMLLGSVSNAVL

SEQ ID NO: 128333 - protein, 15 aa, Mycobacterium tuberculosis
LTGMLLGSVSNAVLH

SEQ ID NO: 128334 - protein, 15 aa, Mycobacterium tuberculosis
TGMLLGSVSNAVLHA

SEQ ID NO: 128335 - protein, 15 aa, Mycobacterium tuberculosis
GMLLGSVSNAVLHAA

SEQ ID NO: 128336 - protein, 15 aa, Mycobacterium tuberculosis
MLLGSVSNAVLHAAR

SEQ ID NO: 128337 - protein, 15 aa, Mycobacterium tuberculosis
LLGSVSNAVLHAARV

SEQ ID NO: 128338 - protein, 15 aa, Mycobacterium tuberculosis
LGSVSNAVLHAARVP

SEQ ID NO: 128339 - protein, 15 aa, Mycobacterium tuberculosis
GSVSNAVLHAARVPV

SEQ ID NO: 128340 - protein, 15 aa, Mycobacterium tuberculosis
SVSNAVLHAARVPVI

SEQ ID NO: 128341 - protein, 15 aa, Mycobacterium tuberculosis
VSNAVLHAARVPVIV

SEQ ID NO: 128342 - protein, 15 aa, Mycobacterium tuberculosis
SNAVLHAARVPVIVA

SEQ ID NO: 128343 - protein, 15 aa, Mycobacterium tuberculosis
NAVLHAARVPVIVAR

SEQ ID NO: 128344 - protein, 15 aa, Mycobacterium tuberculosis
AVLHAARVPVIVARQ

SEQ ID NO: 128345 - protein, 15 aa, Mycobacterium tuberculosis
VLHAARVPVIVARQS

SEQ ID NO: 128346 - protein, 16 aa, Mycobacterium tuberculosis
MSKPRKQHGVVVGVDG

SEQ ID NO: 128347 - protein, 16 aa, Mycobacterium tuberculosis
SKPRKQHGVVVGVDGS

SEQ ID NO: 128348 - protein, 16 aa, Mycobacterium tuberculosis
KPRKQHGVVVGVDGSL

SEQ ID NO: 128349 - protein, 16 aa, Mycobacterium tuberculosis
PRKQHGVVVGVDGSLE

SEQ ID NO: 128350 - protein, 16 aa, Mycobacterium tuberculosis
RKQHGVVVGVDGSLES

SEQ ID NO: 128351 - protein, 16 aa, Mycobacterium tuberculosis
KQHGVVVGVDGSLESD

SEQ ID NO: 128352 - protein, 16 aa, Mycobacterium tuberculosis
QHGVVVGVDGSLESDA

SEQ ID NO: 128353 - protein, 16 aa, Mycobacterium tuberculosis
HGVVVGVDGSLESDAA

SEQ ID NO: 128354 - protein, 16 aa, Mycobacterium tuberculosis
GVVVGVDGSLESDAAA

SEQ ID NO: 128355 - protein, 16 aa, Mycobacterium tuberculosis
VVVGVDGSLESDAAAC

SEQ ID NO: 128356 - protein, 16 aa, Mycobacterium tuberculosis
VVGVDGSLESDAAACW

SEQ ID NO: 128357 - protein, 16 aa, Mycobacterium tuberculosis
VGVDGSLESDAAACWG

SEQ ID NO: 128358 - protein, 16 aa, Mycobacterium tuberculosis
GVDGSLESDAAACWGA

SEQ ID NO: 128359 - protein, 16 aa, Mycobacterium tuberculosis
VDGSLESDAAACWGAT

SEQ ID NO: 128360 - protein, 16 aa, Mycobacterium tuberculosis
DGSLESDAAACWGATD

SEQ ID NO: 128361 - protein, 16 aa, Mycobacterium tuberculosis
GSLESDAAACWGATDA

SEQ ID NO: 128362 - protein, 16 aa, Mycobacterium tuberculosis
SLESDAAACWGATDAA

SEQ ID NO: 128363 - protein, 16 aa, Mycobacterium tuberculosis
LESDAAACWGATDAAM

SEQ ID NO: 128364 - protein, 16 aa, Mycobacterium tuberculosis
ESDAAACWGATDAAMR

SEQ ID NO: 128365 - protein, 16 aa, Mycobacterium tuberculosis
SDAAACWGATDAAMRN

SEQ ID NO: 128366 - protein, 16 aa, Mycobacterium tuberculosis
DAAACWGATDAAMRNI

SEQ ID NO: 128367 - protein, 16 aa, Mycobacterium tuberculosis
AAACWGATDAAMRNIP

SEQ ID NO: 128368 - protein, 16 aa, Mycobacterium tuberculosis
AACWGATDAAMRNIPL

SEQ ID NO: 128369 - protein, 16 aa, Mycobacterium tuberculosis
ACWGATDAAMRNIPLT

SEQ ID NO: 128370 - protein, 16 aa, Mycobacterium tuberculosis
CWGATDAAMRNIPLTV

SEQ ID NO: 128371 - protein, 16 aa, Mycobacterium tuberculosis
WGATDAAMRNIPLTVV

SEQ ID NO: 128372 - protein, 16 aa, Mycobacterium tuberculosis
GATDAAMRNIPLTVVH

SEQ ID NO: 128373 - protein, 16 aa, Mycobacterium tuberculosis
ATDAAMRNIPLTVVHV

SEQ ID NO: 128374 - protein, 16 aa, Mycobacterium tuberculosis
TDAAMRNIPLTVVHVV

SEQ ID NO: 128375 - protein, 16 aa, Mycobacterium tuberculosis
DAAMRNIPLTVVHVVN

SEQ ID NO: 128376 - protein, 16 aa, Mycobacterium tuberculosis
AAMRNIPLTVVHVVNA

SEQ ID NO: 128377 - protein, 16 aa, Mycobacterium tuberculosis
AMRNIPLTVVHVVNAD

SEQ ID NO: 128378 - protein, 16 aa, Mycobacterium tuberculosis
MRNIPLTVVHVVNADV

SEQ ID NO: 128379 - protein, 16 aa, Mycobacterium tuberculosis
RNIPLTVVHVVNADVA

SEQ ID NO: 128380 - protein, 16 aa, Mycobacterium tuberculosis
NIPLTVVHVVNADVAT

SEQ ID NO: 128381 - protein, 16 aa, Mycobacterium tuberculosis
IPLTVVHVVNADVATW

SEQ ID NO: 128382 - protein, 16 aa, Mycobacterium tuberculosis
PLTVVHVVNADVATWP

SEQ ID NO: 128383 - protein, 16 aa, Mycobacterium tuberculosis
LTVVHVVNADVATWPP

SEQ ID NO: 128384 - protein, 16 aa, Mycobacterium tuberculosis
TVVHVVNADVATWPPM

SEQ ID NO: 128385 - protein, 16 aa, Mycobacterium tuberculosis
VVHVVNADVATWPPMP

SEQ ID NO: 128386 - protein, 16 aa, Mycobacterium tuberculosis
VHVVNADVATWPPMPY

SEQ ID NO: 128387 - protein, 16 aa, Mycobacterium tuberculosis
HVVNADVATWPPMPYP

SEQ ID NO: 128388 - protein, 16 aa, Mycobacterium tuberculosis
VVNADVATWPPMPYPE

SEQ ID NO: 128389 - protein, 16 aa, Mycobacterium tuberculosis
VNADVATWPPMPYPET

SEQ ID NO: 128390 - protein, 16 aa, Mycobacterium tuberculosis
NADVATWPPMPYPETW

SEQ ID NO: 128391 - protein, 16 aa, Mycobacterium tuberculosis
ADVATWPPMPYPETWG

SEQ ID NO: 128392 - protein, 16 aa, Mycobacterium tuberculosis
DVATWPPMPYPETWGV

SEQ ID NO: 128393 - protein, 16 aa, Mycobacterium tuberculosis
VATWPPMPYPETWGVW

SEQ ID NO: 128394 - protein, 16 aa, Mycobacterium tuberculosis
ATWPPMPYPETWGVWQ

SEQ ID NO: 128395 - protein, 16 aa, Mycobacterium tuberculosis
TWPPMPYPETWGVWQE

SEQ ID NO: 128396 - protein, 16 aa, Mycobacterium tuberculosis
WPPMPYPETWGVWQED

SEQ ID NO: 128397 - protein, 16 aa, Mycobacterium tuberculosis
PPMPYPETWGVWQEDE

SEQ ID NO: 128398 - protein, 16 aa, Mycobacterium tuberculosis
PMPYPETWGVWQEDEG

SEQ ID NO: 128399 - protein, 16 aa, Mycobacterium tuberculosis
MPYPETWGVWQEDEGR

SEQ ID NO: 128400 - protein, 16 aa, Mycobacterium tuberculosis
PYPETWGVWQEDEGRQ

SEQ ID NO: 128401 - protein, 16 aa, Mycobacterium tuberculosis
YPETWGVWQEDEGRQI

SEQ ID NO: 128402 - protein, 16 aa, Mycobacterium tuberculosis
PETWGVWQEDEGRQIV

SEQ ID NO: 128403 - protein, 16 aa, Mycobacterium tuberculosis
ETWGVWQEDEGRQIVA

SEQ ID NO: 128404 - protein, 16 aa, Mycobacterium tuberculosis
TWGVWQEDEGRQIVAN

SEQ ID NO: 128405 - protein, 16 aa, Mycobacterium tuberculosis
WGVWQEDEGRQIVANA

SEQ ID NO: 128406 - protein, 16 aa, Mycobacterium tuberculosis
GVWQEDEGRQIVANAV

SEQ ID NO: 128407 - protein, 16 aa, Mycobacterium tuberculosis
VWQEDEGRQIVANAVK

SEQ ID NO: 128408 - protein, 16 aa, Mycobacterium tuberculosis
WQEDEGRQIVANAVKL

SEQ ID NO: 128409 - protein, 16 aa, Mycobacterium tuberculosis
QEDEGRQIVANAVKLA

SEQ ID NO: 128410 - protein, 16 aa, Mycobacterium tuberculosis
EDEGRQIVANAVKLAK

SEQ ID NO: 128411 - protein, 16 aa, Mycobacterium tuberculosis
DEGRQIVANAVKLAKE

SEQ ID NO: 128412 - protein, 16 aa, Mycobacterium tuberculosis
EGRQIVANAVKLAKEA

SEQ ID NO: 128413 - protein, 16 aa, Mycobacterium tuberculosis
GRQIVANAVKLAKEAV

SEQ ID NO: 128414 - protein, 16 aa, Mycobacterium tuberculosis
RQIVANAVKLAKEAVG

SEQ ID NO: 128415 - protein, 16 aa, Mycobacterium tuberculosis
QIVANAVKLAKEAVGA

SEQ ID NO: 128416 - protein, 16 aa, Mycobacterium tuberculosis
IVANAVKLAKEAVGAD

SEQ ID NO: 128417 - protein, 16 aa, Mycobacterium tuberculosis
VANAVKLAKEAVGADR

SEQ ID NO: 128418 - protein, 16 aa, Mycobacterium tuberculosis
ANAVKLAKEAVGADRK

SEQ ID NO: 128419 - protein, 16 aa, Mycobacterium tuberculosis
NAVKLAKEAVGADRKL

SEQ ID NO: 128420 - protein, 16 aa, Mycobacterium tuberculosis
AVKLAKEAVGADRKLS

SEQ ID NO: 128421 - protein, 16 aa, Mycobacterium tuberculosis
VKLAKEAVGADRKLSV

SEQ ID NO: 128422 - protein, 16 aa, Mycobacterium tuberculosis
KLAKEAVGADRKLSVK

SEQ ID NO: 128423 - protein, 16 aa, Mycobacterium tuberculosis
LAKEAVGADRKLSVKS

SEQ ID NO: 128424 - protein, 16 aa, Mycobacterium tuberculosis
AKEAVGADRKLSVKSE

SEQ ID NO: 128425 - protein, 16 aa, Mycobacterium tuberculosis
KEAVGADRKLSVKSEL

SEQ ID NO: 128426 - protein, 16 aa, Mycobacterium tuberculosis
EAVGADRKLSVKSELV

SEQ ID NO: 128427 - protein, 16 aa, Mycobacterium tuberculosis
AVGADRKLSVKSELVF

SEQ ID NO: 128428 - protein, 16 aa, Mycobacterium tuberculosis
VGADRKLSVKSELVFS

SEQ ID NO: 128429 - protein, 16 aa, Mycobacterium tuberculosis
GADRKLSVKSELVFST

SEQ ID NO: 128430 - protein, 16 aa, Mycobacterium tuberculosis
ADRKLSVKSELVFSTP

SEQ ID NO: 128431 - protein, 16 aa, Mycobacterium tuberculosis
DRKLSVKSELVFSTPV

SEQ ID NO: 128432 - protein, 16 aa, Mycobacterium tuberculosis
RKLSVKSELVFSTPVP

SEQ ID NO: 128433 - protein, 16 aa, Mycobacterium tuberculosis
KLSVKSELVFSTPVPT

SEQ ID NO: 128434 - protein, 16 aa, Mycobacterium tuberculosis
LSVKSELVFSTPVPTM

SEQ ID NO: 128435 - protein, 16 aa, Mycobacterium tuberculosis
SVKSELVFSTPVPTMV

SEQ ID NO: 128436 - protein, 16 aa, Mycobacterium tuberculosis
VKSELVFSTPVPTMVE

SEQ ID NO: 128437 - protein, 16 aa, Mycobacterium tuberculosis
KSELVFSTPVPTMVEI

SEQ ID NO: 128438 - protein, 16 aa, Mycobacterium tuberculosis
SELVFSTPVPTMVEIS

SEQ ID NO: 128439 - protein, 16 aa, Mycobacterium tuberculosis
ELVFSTPVPTMVEISN

SEQ ID NO: 128440 - protein, 16 aa, Mycobacterium tuberculosis
LVFSTPVPTMVEISNE

SEQ ID NO: 128441 - protein, 16 aa, Mycobacterium tuberculosis
VFSTPVPTMVEISNEA

SEQ ID NO: 128442 - protein, 16 aa, Mycobacterium tuberculosis
FSTPVPTMVEISNEAE

SEQ ID NO: 128443 - protein, 16 aa, Mycobacterium tuberculosis
STPVPTMVEISNEAEM

SEQ ID NO: 128444 - protein, 16 aa, Mycobacterium tuberculosis
TPVPTMVEISNEAEMV

SEQ ID NO: 128445 - protein, 16 aa, Mycobacterium tuberculosis
PVPTMVEISNEAEMVV

SEQ ID NO: 128446 - protein, 16 aa, Mycobacterium tuberculosis
VPTMVEISNEAEMVVL

SEQ ID NO: 128447 - protein, 16 aa, Mycobacterium tuberculosis
PTMVEISNEAEMVVLG

SEQ ID NO: 128448 - protein, 16 aa, Mycobacterium tuberculosis
TMVEISNEAEMVVLGS

SEQ ID NO: 128449 - protein, 16 aa, Mycobacterium tuberculosis
MVEISNEAEMVVLGSS

SEQ ID NO: 128450 - protein, 16 aa, Mycobacterium tuberculosis
VEISNEAEMVVLGSSG

SEQ ID NO: 128451 - protein, 16 aa, Mycobacterium tuberculosis
EISNEAEMVVLGSSGR

SEQ ID NO: 128452 - protein, 16 aa, Mycobacterium tuberculosis
ISNEAEMVVLGSSGRG

SEQ ID NO: 128453 - protein, 16 aa, Mycobacterium tuberculosis
SNEAEMVVLGSSGRGA

SEQ ID NO: 128454 - protein, 16 aa, Mycobacterium tuberculosis
NEAEMVVLGSSGRGAL

SEQ ID NO: 128455 - protein, 16 aa, Mycobacterium tuberculosis
EAEMVVLGSSGRGALA

SEQ ID NO: 128456 - protein, 16 aa, Mycobacterium tuberculosis
AEMVVLGSSGRGALAR

SEQ ID NO: 128457 - protein, 16 aa, Mycobacterium tuberculosis
EMVVLGSSGRGALARG

SEQ ID NO: 128458 - protein, 16 aa, Mycobacterium tuberculosis
MVVLGSSGRGALARGL

SEQ ID NO: 128459 - protein, 16 aa, Mycobacterium tuberculosis
VVLGSSGRGALARGLL

SEQ ID NO: 128460 - protein, 16 aa, Mycobacterium tuberculosis
VLGSSGRGALARGLLG

SEQ ID NO: 128461 - protein, 16 aa, Mycobacterium tuberculosis
LGSSGRGALARGLLGS

SEQ ID NO: 128462 - protein, 16 aa, Mycobacterium tuberculosis
GSSGRGALARGLLGSV

SEQ ID NO: 128463 - protein, 16 aa, Mycobacterium tuberculosis
SSGRGALARGLLGSVS

SEQ ID NO: 128464 - protein, 16 aa, Mycobacterium tuberculosis
SGRGALARGLLGSVSS

SEQ ID NO: 128465 - protein, 16 aa, Mycobacterium tuberculosis
GRGALARGLLGSVSSS

SEQ ID NO: 128466 - protein, 16 aa, Mycobacterium tuberculosis
RGALARGLLGSVSSSL

SEQ ID NO: 128467 - protein, 16 aa, Mycobacterium tuberculosis
GALARGLLGSVSSSLV

SEQ ID NO: 128468 - protein, 16 aa, Mycobacterium tuberculosis
ALARGLLGSVSSSLVR

SEQ ID NO: 128469 - protein, 16 aa, Mycobacterium tuberculosis
LARGLLGSVSSSLVRR

SEQ ID NO: 128470 - protein, 16 aa, Mycobacterium tuberculosis
ARGLLGSVSSSLVRRA

SEQ ID NO: 128471 - protein, 16 aa, Mycobacterium tuberculosis
RGLLGSVSSSLVRRAG

SEQ ID NO: 128472 - protein, 16 aa, Mycobacterium tuberculosis
GLLGSVSSSLVRRAGC

SEQ ID NO: 128473 - protein, 16 aa, Mycobacterium tuberculosis
LLGSVSSSLVRRAGCP

SEQ ID NO: 128474 - protein, 16 aa, Mycobacterium tuberculosis
LGSVSSSLVRRAGCPV

SEQ ID NO: 128475 - protein, 16 aa, Mycobacterium tuberculosis
GSVSSSLVRRAGCPVA

SEQ ID NO: 128476 - protein, 16 aa, Mycobacterium tuberculosis
SVSSSLVRRAGCPVAV

SEQ ID NO: 128477 - protein, 16 aa, Mycobacterium tuberculosis
VSSSLVRRAGCPVAVI

SEQ ID NO: 128478 - protein, 16 aa, Mycobacterium tuberculosis
SSSLVRRAGCPVAVIH

SEQ ID NO: 128479 - protein, 16 aa, Mycobacterium tuberculosis
SSLVRRAGCPVAVIHS

SEQ ID NO: 128480 - protein, 16 aa, Mycobacterium tuberculosis
SLVRRAGCPVAVIHSD

SEQ ID NO: 128481 - protein, 16 aa, Mycobacterium tuberculosis
LVRRAGCPVAVIHSDD

SEQ ID NO: 128482 - protein, 16 aa, Mycobacterium tuberculosis
VRRAGCPVAVIHSDDA

SEQ ID NO: 128483 - protein, 16 aa, Mycobacterium tuberculosis
RRAGCPVAVIHSDDAV

SEQ ID NO: 128484 - protein, 16 aa, Mycobacterium tuberculosis
RAGCPVAVIHSDDAVI

SEQ ID NO: 128485 - protein, 16 aa, Mycobacterium tuberculosis
AGCPVAVIHSDDAVIP

SEQ ID NO: 128486 - protein, 16 aa, Mycobacterium tuberculosis
GCPVAVIHSDDAVIPD

SEQ ID NO: 128487 - protein, 16 aa, Mycobacterium tuberculosis
CPVAVIHSDDAVIPDP

SEQ ID NO: 128488 - protein, 16 aa, Mycobacterium tuberculosis
PVAVIHSDDAVIPDPQ

SEQ ID NO: 128489 - protein, 16 aa, Mycobacterium tuberculosis
VAVIHSDDAVIPDPQH

SEQ ID NO: 128490 - protein, 16 aa, Mycobacterium tuberculosis
AVIHSDDAVIPDPQHA

SEQ ID NO: 128491 - protein, 16 aa, Mycobacterium tuberculosis
VIHSDDAVIPDPQHAP

SEQ ID NO: 128492 - protein, 16 aa, Mycobacterium tuberculosis
IHSDDAVIPDPQHAPV

SEQ ID NO: 128493 - protein, 16 aa, Mycobacterium tuberculosis
HSDDAVIPDPQHAPVL

SEQ ID NO: 128494 - protein, 16 aa, Mycobacterium tuberculosis
SDDAVIPDPQHAPVLV

SEQ ID NO: 128495 - protein, 16 aa, Mycobacterium tuberculosis
DDAVIPDPQHAPVLVG

SEQ ID NO: 128496 - protein, 16 aa, Mycobacterium tuberculosis
DAVIPDPQHAPVLVGI

SEQ ID NO: 128497 - protein, 16 aa, Mycobacterium tuberculosis
AVIPDPQHAPVLVGID

SEQ ID NO: 128498 - protein, 16 aa, Mycobacterium tuberculosis
VIPDPQHAPVLVGIDG

SEQ ID NO: 128499 - protein, 16 aa, Mycobacterium tuberculosis
IPDPQHAPVLVGIDGS

SEQ ID NO: 128500 - protein, 16 aa, Mycobacterium tuberculosis
PDPQHAPVLVGIDGSP

SEQ ID NO: 128501 - protein, 16 aa, Mycobacterium tuberculosis
DPQHAPVLVGIDGSPV

SEQ ID NO: 128502 - protein, 16 aa, Mycobacterium tuberculosis
PQHAPVLVGIDGSPVS

SEQ ID NO: 128503 - protein, 16 aa, Mycobacterium tuberculosis
QHAPVLVGIDGSPVSE

SEQ ID NO: 128504 - protein, 16 aa, Mycobacterium tuberculosis
HAPVLVGIDGSPVSEL

SEQ ID NO: 128505 - protein, 16 aa, Mycobacterium tuberculosis
APVLVGIDGSPVSELA

SEQ ID NO: 128506 - protein, 16 aa, Mycobacterium tuberculosis
PVLVGIDGSPVSELAT

SEQ ID NO: 128507 - protein, 16 aa, Mycobacterium tuberculosis
VLVGIDGSPVSELATA

SEQ ID NO: 128508 - protein, 16 aa, Mycobacterium tuberculosis
LVGIDGSPVSELATAV

SEQ ID NO: 128509 - protein, 16 aa, Mycobacterium tuberculosis
VGIDGSPVSELATAVA

SEQ ID NO: 128510 - protein, 16 aa, Mycobacterium tuberculosis
GIDGSPVSELATAVAF

SEQ ID NO: 128511 - protein, 16 aa, Mycobacterium tuberculosis
IDGSPVSELATAVAFD

SEQ ID NO: 128512 - protein, 16 aa, Mycobacterium tuberculosis
DGSPVSELATAVAFDE

SEQ ID NO: 128513 - protein, 16 aa, Mycobacterium tuberculosis
GSPVSELATAVAFDEA

SEQ ID NO: 128514 - protein, 16 aa, Mycobacterium tuberculosis
SPVSELATAVAFDEAS

SEQ ID NO: 128515 - protein, 16 aa, Mycobacterium tuberculosis
PVSELATAVAFDEASR

SEQ ID NO: 128516 - protein, 16 aa, Mycobacterium tuberculosis
VSELATAVAFDEASRR

SEQ ID NO: 128517 - protein, 16 aa, Mycobacterium tuberculosis
SELATAVAFDEASRRG

SEQ ID NO: 128518 - protein, 16 aa, Mycobacterium tuberculosis
ELATAVAFDEASRRGV

SEQ ID NO: 128519 - protein, 16 aa, Mycobacterium tuberculosis
LATAVAFDEASRRGVE

SEQ ID NO: 128520 - protein, 16 aa, Mycobacterium tuberculosis
ATAVAFDEASRRGVEL

SEQ ID NO: 128521 - protein, 16 aa, Mycobacterium tuberculosis
TAVAFDEASRRGVELI

SEQ ID NO: 128522 - protein, 16 aa, Mycobacterium tuberculosis
AVAFDEASRRGVELIA

SEQ ID NO: 128523 - protein, 16 aa, Mycobacterium tuberculosis
VAFDEASRRGVELIAV

SEQ ID NO: 128524 - protein, 16 aa, Mycobacterium tuberculosis
AFDEASRRGVELIAVH

SEQ ID NO: 128525 - protein, 16 aa, Mycobacterium tuberculosis
FDEASRRGVELIAVHA

SEQ ID NO: 128526 - protein, 16 aa, Mycobacterium tuberculosis
DEASRRGVELIAVHAW

SEQ ID NO: 128527 - protein, 16 aa, Mycobacterium tuberculosis
EASRRGVELIAVHAWS

SEQ ID NO: 128528 - protein, 16 aa, Mycobacterium tuberculosis
ASRRGVELIAVHAWSD

SEQ ID NO: 128529 - protein, 16 aa, Mycobacterium tuberculosis
SRRGVELIAVHAWSDV

SEQ ID NO: 128530 - protein, 16 aa, Mycobacterium tuberculosis
RRGVELIAVHAWSDVE

SEQ ID NO: 128531 - protein, 16 aa, Mycobacterium tuberculosis
RGVELIAVHAWSDVEV

SEQ ID NO: 128532 - protein, 16 aa, Mycobacterium tuberculosis
GVELIAVHAWSDVEVV

SEQ ID NO: 128533 - protein, 16 aa, Mycobacterium tuberculosis
VELIAVHAWSDVEVVE

SEQ ID NO: 128534 - protein, 16 aa, Mycobacterium tuberculosis
ELIAVHAWSDVEVVEL

SEQ ID NO: 128535 - protein, 16 aa, Mycobacterium tuberculosis
LIAVHAWSDVEVVELP

SEQ ID NO: 128536 - protein, 16 aa, Mycobacterium tuberculosis
IAVHAWSDVEVVELPG

SEQ ID NO: 128537 - protein, 16 aa, Mycobacterium tuberculosis
AVHAWSDVEVVELPGL

SEQ ID NO: 128538 - protein, 16 aa, Mycobacterium tuberculosis
VHAWSDVEVVELPGLD

SEQ ID NO: 128539 - protein, 16 aa, Mycobacterium tuberculosis
HAWSDVEVVELPGLDF

SEQ ID NO: 128540 - protein, 16 aa, Mycobacterium tuberculosis
AWSDVEVVELPGLDFS

SEQ ID NO: 128541 - protein, 16 aa, Mycobacterium tuberculosis
WSDVEVVELPGLDFSA

SEQ ID NO: 128542 - protein, 16 aa, Mycobacterium tuberculosis
SDVEVVELPGLDFSAV

SEQ ID NO: 128543 - protein, 16 aa, Mycobacterium tuberculosis
DVEVVELPGLDFSAVQ

SEQ ID NO: 128544 - protein, 16 aa, Mycobacterium tuberculosis
VEVVELPGLDFSAVQQ

SEQ ID NO: 128545 - protein, 16 aa, Mycobacterium tuberculosis
EVVELPGLDFSAVQQE

SEQ ID NO: 128546 - protein, 16 aa, Mycobacterium tuberculosis
VVELPGLDFSAVQQEA

SEQ ID NO: 128547 - protein, 16 aa, Mycobacterium tuberculosis
VELPGLDFSAVQQEAE

SEQ ID NO: 128548 - protein, 16 aa, Mycobacterium tuberculosis
ELPGLDFSAVQQEAEL

SEQ ID NO: 128549 - protein, 16 aa, Mycobacterium tuberculosis
LPGLDFSAVQQEAELS

SEQ ID NO: 128550 - protein, 16 aa, Mycobacterium tuberculosis
PGLDFSAVQQEAELSL

SEQ ID NO: 128551 - protein, 16 aa, Mycobacterium tuberculosis
GLDFSAVQQEAELSLA

SEQ ID NO: 128552 - protein, 16 aa, Mycobacterium tuberculosis
LDFSAVQQEAELSLAE

SEQ ID NO: 128553 - protein, 16 aa, Mycobacterium tuberculosis
DFSAVQQEAELSLAER

SEQ ID NO: 128554 - protein, 16 aa, Mycobacterium tuberculosis
FSAVQQEAELSLAERL

SEQ ID NO: 128555 - protein, 16 aa, Mycobacterium tuberculosis
SAVQQEAELSLAERLA

SEQ ID NO: 128556 - protein, 16 aa, Mycobacterium tuberculosis
AVQQEAELSLAERLAG

SEQ ID NO: 128557 - protein, 16 aa, Mycobacterium tuberculosis
VQQEAELSLAERLAGW

SEQ ID NO: 128558 - protein, 16 aa, Mycobacterium tuberculosis
QQEAELSLAERLAGWQ

SEQ ID NO: 128559 - protein, 16 aa, Mycobacterium tuberculosis
QEAELSLAERLAGWQE

SEQ ID NO: 128560 - protein, 16 aa, Mycobacterium tuberculosis
EAELSLAERLAGWQER

SEQ ID NO: 128561 - protein, 16 aa, Mycobacterium tuberculosis
AELSLAERLAGWQERY

SEQ ID NO: 128562 - protein, 16 aa, Mycobacterium tuberculosis
ELSLAERLAGWQERYP

SEQ ID NO: 128563 - protein, 16 aa, Mycobacterium tuberculosis
LSLAERLAGWQERYPD

SEQ ID NO: 128564 - protein, 16 aa, Mycobacterium tuberculosis
SLAERLAGWQERYPDV

SEQ ID NO: 128565 - protein, 16 aa, Mycobacterium tuberculosis
LAERLAGWQERYPDVP

SEQ ID NO: 128566 - protein, 16 aa, Mycobacterium tuberculosis
AERLAGWQERYPDVPV

SEQ ID NO: 128567 - protein, 16 aa, Mycobacterium tuberculosis
ERLAGWQERYPDVPVS

SEQ ID NO: 128568 - protein, 16 aa, Mycobacterium tuberculosis
RLAGWQERYPDVPVSR

SEQ ID NO: 128569 - protein, 16 aa, Mycobacterium tuberculosis
LAGWQERYPDVPVSRV

SEQ ID NO: 128570 - protein, 16 aa, Mycobacterium tuberculosis
AGWQERYPDVPVSRVV

SEQ ID NO: 128571 - protein, 16 aa, Mycobacterium tuberculosis
GWQERYPDVPVSRVVV

SEQ ID NO: 128572 - protein, 16 aa, Mycobacterium tuberculosis
WQERYPDVPVSRVVVC

SEQ ID NO: 128573 - protein, 16 aa, Mycobacterium tuberculosis
QERYPDVPVSRVVVCD

SEQ ID NO: 128574 - protein, 16 aa, Mycobacterium tuberculosis
ERYPDVPVSRVVVCDR

SEQ ID NO: 128575 - protein, 16 aa, Mycobacterium tuberculosis
RYPDVPVSRVVVCDRP

SEQ ID NO: 128576 - protein, 16 aa, Mycobacterium tuberculosis
YPDVPVSRVVVCDRPA

SEQ ID NO: 128577 - protein, 16 aa, Mycobacterium tuberculosis
PDVPVSRVVVCDRPAR

SEQ ID NO: 128578 - protein, 16 aa, Mycobacterium tuberculosis
DVPVSRVVVCDRPARK

SEQ ID NO: 128579 - protein, 16 aa, Mycobacterium tuberculosis
VPVSRVVVCDRPARKL

SEQ ID NO: 128580 - protein, 16 aa, Mycobacterium tuberculosis
PVSRVVVCDRPARKLV

SEQ ID NO: 128581 - protein, 16 aa, Mycobacterium tuberculosis
VSRVVVCDRPARKLVQ

SEQ ID NO: 128582 - protein, 16 aa, Mycobacterium tuberculosis
SRVVVCDRPARKLVQK

SEQ ID NO: 128583 - protein, 16 aa, Mycobacterium tuberculosis
RVVVCDRPARKLVQKS

SEQ ID NO: 128584 - protein, 16 aa, Mycobacterium tuberculosis
VVVCDRPARKLVQKSA

SEQ ID NO: 128585 - protein, 16 aa, Mycobacterium tuberculosis
VVCDRPARKLVQKSAS

SEQ ID NO: 128586 - protein, 16 aa, Mycobacterium tuberculosis
VCDRPARKLVQKSASA

SEQ ID NO: 128587 - protein, 16 aa, Mycobacterium tuberculosis
CDRPARKLVQKSASAQ

SEQ ID NO: 128588 - protein, 16 aa, Mycobacterium tuberculosis
DRPARKLVQKSASAQL

SEQ ID NO: 128589 - protein, 16 aa, Mycobacterium tuberculosis
RPARKLVQKSASAQLV

SEQ ID NO: 128590 - protein, 16 aa, Mycobacterium tuberculosis
PARKLVQKSASAQLVV

SEQ ID NO: 128591 - protein, 16 aa, Mycobacterium tuberculosis
ARKLVQKSASAQLVVV

SEQ ID NO: 128592 - protein, 16 aa, Mycobacterium tuberculosis
RKLVQKSASAQLVVVG

SEQ ID NO: 128593 - protein, 16 aa, Mycobacterium tuberculosis
KLVQKSASAQLVVVGS

SEQ ID NO: 128594 - protein, 16 aa, Mycobacterium tuberculosis
LVQKSASAQLVVVGSH

SEQ ID NO: 128595 - protein, 16 aa, Mycobacterium tuberculosis
VQKSASAQLVVVGSHG

SEQ ID NO: 128596 - protein, 16 aa, Mycobacterium tuberculosis
QKSASAQLVVVGSHGR

SEQ ID NO: 128597 - protein, 16 aa, Mycobacterium tuberculosis
KSASAQLVVVGSHGRG

SEQ ID NO: 128598 - protein, 16 aa, Mycobacterium tuberculosis
SASAQLVVVGSHGRGG

SEQ ID NO: 128599 - protein, 16 aa, Mycobacterium tuberculosis
ASAQLVVVGSHGRGGL

SEQ ID NO: 128600 - protein, 16 aa, Mycobacterium tuberculosis
SAQLVVVGSHGRGGLT

SEQ ID NO: 128601 - protein, 16 aa, Mycobacterium tuberculosis
AQLVVVGSHGRGGLTG

SEQ ID NO: 128602 - protein, 16 aa, Mycobacterium tuberculosis
QLVVVGSHGRGGLTGM

SEQ ID NO: 128603 - protein, 16 aa, Mycobacterium tuberculosis
LVVVGSHGRGGLTGML

SEQ ID NO: 128604 - protein, 16 aa, Mycobacterium tuberculosis
VVVGSHGRGGLTGMLL

SEQ ID NO: 128605 - protein, 16 aa, Mycobacterium tuberculosis
VVGSHGRGGLTGMLLG

SEQ ID NO: 128606 - protein, 16 aa, Mycobacterium tuberculosis
VGSHGRGGLTGMLLGS

SEQ ID NO: 128607 - protein, 16 aa, Mycobacterium tuberculosis
GSHGRGGLTGMLLGSV

SEQ ID NO: 128608 - protein, 16 aa, Mycobacterium tuberculosis
SHGRGGLTGMLLGSVS

SEQ ID NO: 128609 - protein, 16 aa, Mycobacterium tuberculosis
HGRGGLTGMLLGSVSN

SEQ ID NO: 128610 - protein, 16 aa, Mycobacterium tuberculosis
GRGGLTGMLLGSVSNA

SEQ ID NO: 128611 - protein, 16 aa, Mycobacterium tuberculosis
RGGLTGMLLGSVSNAV

SEQ ID NO: 128612 - protein, 16 aa, Mycobacterium tuberculosis
GGLTGMLLGSVSNAVL

SEQ ID NO: 128613 - protein, 16 aa, Mycobacterium tuberculosis
GLTGMLLGSVSNAVLH

SEQ ID NO: 128614 - protein, 16 aa, Mycobacterium tuberculosis
LTGMLLGSVSNAVLHA

SEQ ID NO: 128615 - protein, 16 aa, Mycobacterium tuberculosis
TGMLLGSVSNAVLHAA

SEQ ID NO: 128616 - protein, 16 aa, Mycobacterium tuberculosis
GMLLGSVSNAVLHAAR

SEQ ID NO: 128617 - protein, 16 aa, Mycobacterium tuberculosis
MLLGSVSNAVLHAARV

SEQ ID NO: 128618 - protein, 16 aa, Mycobacterium tuberculosis
LLGSVSNAVLHAARVP

SEQ ID NO: 128619 - protein, 16 aa, Mycobacterium tuberculosis
LGSVSNAVLHAARVPV

SEQ ID NO: 128620 - protein, 16 aa, Mycobacterium tuberculosis
GSVSNAVLHAARVPVI

SEQ ID NO: 128621 - protein, 16 aa, Mycobacterium tuberculosis
SVSNAVLHAARVPVIV

SEQ ID NO: 128622 - protein, 16 aa, Mycobacterium tuberculosis
VSNAVLHAARVPVIVA

SEQ ID NO: 128623 - protein, 16 aa, Mycobacterium tuberculosis
SNAVLHAARVPVIVAR

SEQ ID NO: 128624 - protein, 16 aa, Mycobacterium tuberculosis
NAVLHAARVPVIVARQ

SEQ ID NO: 128625 - protein, 16 aa, Mycobacterium tuberculosis
AVLHAARVPVIVARQS

SEQ ID NO: 128626 - protein, 344 aa, Mycobacterium tuberculosis
MLKNAVLLACRAPSVHNSQPWRWVAESGSEHTTVHLFVNRHRTVPATDHSGRQAIISCGAVLDHLRIAMTAAHWQANITRFPQPNQPDQLATVEFSPIDHVTAGQRNRAQAILQRRTDRLPFDSPMYWHLFEPALRDAVDKDVAMLDVVSDDQRTRLVVASQLSEVLRRDDPYYHAELEWWTSPFVLAHGVPPDTLASDAERLRVDLGRDFPVRSYQNRRAELADDRSKVLVLSTPSDTRADALRCGEVLSTILLECTMAGMATCTLTHLIESSDSRDIVRGLTRQRGEPQALIRVGIAPPLAAVPAPTPRRPLDSVLQIRQTPEKGRNASDRNARETGWFSPP

SEQ ID NO: 128627 - protein, 8 aa, Mycobacterium tuberculosis
MLKNAVLL

SEQ ID NO: 128628 - protein, 8 aa, Mycobacterium tuberculosis
NAVLLACR

SEQ ID NO: 128629 - protein, 8 aa, Mycobacterium tuberculosis
LLACRAPS

SEQ ID NO: 128630 - protein, 8 aa, Mycobacterium tuberculosis
APSVHNSQ

SEQ ID NO: 128631 - protein, 8 aa, Mycobacterium tuberculosis
HNSQPWRW

SEQ ID NO: 128632 - protein, 8 aa, Mycobacterium tuberculosis
SQPWRWVA

SEQ ID NO: 128633 - protein, 8 aa, Mycobacterium tuberculosis
QPWRWVAE

SEQ ID NO: 128634 - protein, 8 aa, Mycobacterium tuberculosis
AESGSEHT

SEQ ID NO: 128635 - protein, 8 aa, Mycobacterium tuberculosis
SGSEHTTV

SEQ ID NO: 128636 - protein, 8 aa, Mycobacterium tuberculosis
SEHTTVHL

SEQ ID NO: 128637 - protein, 8 aa, Mycobacterium tuberculosis
HTTVHLFV

SEQ ID NO: 128638 - protein, 8 aa, Mycobacterium tuberculosis
TVHLFVNR

SEQ ID NO: 128639 - protein, 8 aa, Mycobacterium tuberculosis
HLFVNRHR

SEQ ID NO: 128640 - protein, 8 aa, Mycobacterium tuberculosis
FVNRHRTV

SEQ ID NO: 128641 - protein, 8 aa, Mycobacterium tuberculosis
AIISCGAV

SEQ ID NO: 128642 - protein, 8 aa, Mycobacterium tuberculosis
IISCGAVL

SEQ ID NO: 128643 - protein, 8 aa, Mycobacterium tuberculosis
GAVLDHLR

SEQ ID NO: 128644 - protein, 8 aa, Mycobacterium tuberculosis
AVLDHLRI

SEQ ID NO: 128645 - protein, 8 aa, Mycobacterium tuberculosis
VLDHLRIA

SEQ ID NO: 128646 - protein, 8 aa, Mycobacterium tuberculosis
HLRIAMTA

SEQ ID NO: 128647 - protein, 8 aa, Mycobacterium tuberculosis
RIAMTAAH

SEQ ID NO: 128648 - protein, 8 aa, Mycobacterium tuberculosis
IAMTAAHW

SEQ ID NO: 128649 - protein, 8 aa, Mycobacterium tuberculosis
AMTAAHWQ

SEQ ID NO: 128650 - protein, 8 aa, Mycobacterium tuberculosis
MTAAHWQA

SEQ ID NO: 128651 - protein, 8 aa, Mycobacterium tuberculosis
HWQANITR

SEQ ID NO: 128652 - protein, 8 aa, Mycobacterium tuberculosis
WQANITRF

SEQ ID NO: 128653 - protein, 8 aa, Mycobacterium tuberculosis
ITRFPQPN

SEQ ID NO: 128654 - protein, 8 aa, Mycobacterium tuberculosis
QPNQPDQL

SEQ ID NO: 128655 - protein, 8 aa, Mycobacterium tuberculosis
NQPDQLAT

SEQ ID NO: 128656 - protein, 8 aa, Mycobacterium tuberculosis
QPDQLATV

SEQ ID NO: 128657 - protein, 8 aa, Mycobacterium tuberculosis
DQLATVEF

SEQ ID NO: 128658 - protein, 8 aa, Mycobacterium tuberculosis
QLATVEFS

SEQ ID NO: 128659 - protein, 8 aa, Mycobacterium tuberculosis
ATVEFSPI

SEQ ID NO: 128660 - protein, 8 aa, Mycobacterium tuberculosis
EFSPIDHV

SEQ ID NO: 128661 - protein, 8 aa, Mycobacterium tuberculosis
SPIDHVTA

SEQ ID NO: 128662 - protein, 8 aa, Mycobacterium tuberculosis
VTAGQRNR

SEQ ID NO: 128663 - protein, 8 aa, Mycobacterium tuberculosis
RAQAILQR

SEQ ID NO: 128664 - protein, 8 aa, Mycobacterium tuberculosis
AQAILQRR

SEQ ID NO: 128665 - protein, 8 aa, Mycobacterium tuberculosis
ILQRRTDR

SEQ ID NO: 128666 - protein, 8 aa, Mycobacterium tuberculosis
RRTDRLPF

SEQ ID NO: 128667 - protein, 8 aa, Mycobacterium tuberculosis
RLPFDSPM

SEQ ID NO: 128668 - protein, 8 aa, Mycobacterium tuberculosis
LPFDSPMY

SEQ ID NO: 128669 - protein, 8 aa, Mycobacterium tuberculosis
SPMYWHLF

SEQ ID NO: 128670 - protein, 8 aa, Mycobacterium tuberculosis
HLFEPALR

SEQ ID NO: 128671 - protein, 8 aa, Mycobacterium tuberculosis
EPALRDAV

SEQ ID NO: 128672 - protein, 8 aa, Mycobacterium tuberculosis
ALRDAVDK

SEQ ID NO: 128673 - protein, 8 aa, Mycobacterium tuberculosis
AVDKDVAM

SEQ ID NO: 128674 - protein, 8 aa, Mycobacterium tuberculosis
DVAMLDVV

SEQ ID NO: 128675 - protein, 8 aa, Mycobacterium tuberculosis
AMLDVVSD

SEQ ID NO: 128676 - protein, 8 aa, Mycobacterium tuberculosis
DVVSDDQR

SEQ ID NO: 128677 - protein, 8 aa, Mycobacterium tuberculosis
RTRLVVAS

SEQ ID NO: 128678 - protein, 8 aa, Mycobacterium tuberculosis
RLVVASQL

SEQ ID NO: 128679 - protein, 8 aa, Mycobacterium tuberculosis
VASQLSEV

SEQ ID NO: 128680 - protein, 8 aa, Mycobacterium tuberculosis
SQLSEVLR

SEQ ID NO: 128681 - protein, 8 aa, Mycobacterium tuberculosis
QLSEVLRR

SEQ ID NO: 128682 - protein, 8 aa, Mycobacterium tuberculosis
VLRRDDPY

SEQ ID NO: 128683 - protein, 8 aa, Mycobacterium tuberculosis
DPYYHAEL

SEQ ID NO: 128684 - protein, 8 aa, Mycobacterium tuberculosis
YYHAELEW

SEQ ID NO: 128685 - protein, 8 aa, Mycobacterium tuberculosis
AELEWWTS

SEQ ID NO: 128686 - protein, 8 aa, Mycobacterium tuberculosis
LEWWTSPF

SEQ ID NO: 128687 - protein, 8 aa, Mycobacterium tuberculosis
EWWTSPFV

SEQ ID NO: 128688 - protein, 8 aa, Mycobacterium tuberculosis
WWTSPFVL

SEQ ID NO: 128689 - protein, 8 aa, Mycobacterium tuberculosis
WTSPFVLA

SEQ ID NO: 128690 - protein, 8 aa, Mycobacterium tuberculosis
GVPPDTLA

SEQ ID NO: 128691 - protein, 8 aa, Mycobacterium tuberculosis
TLASDAER

SEQ ID NO: 128692 - protein, 8 aa, Mycobacterium tuberculosis
LASDAERL

SEQ ID NO: 128693 - protein, 8 aa, Mycobacterium tuberculosis
AERLRVDL

SEQ ID NO: 128694 - protein, 8 aa, Mycobacterium tuberculosis
RLRVDLGR

SEQ ID NO: 128695 - protein, 8 aa, Mycobacterium tuberculosis
DLGRDFPV

SEQ ID NO: 128696 - protein, 8 aa, Mycobacterium tuberculosis
LGRDFPVR

SEQ ID NO: 128697 - protein, 8 aa, Mycobacterium tuberculosis
FPVRSYQN

SEQ ID NO: 128698 - protein, 8 aa, Mycobacterium tuberculosis
PVRSYQNR

SEQ ID NO: 128699 - protein, 8 aa, Mycobacterium tuberculosis
YQNRRAEL

SEQ ID NO: 128700 - protein, 8 aa, Mycobacterium tuberculosis
ELADDRSK

SEQ ID NO: 128701 - protein, 8 aa, Mycobacterium tuberculosis
LADDRSKV

SEQ ID NO: 128702 - protein, 8 aa, Mycobacterium tuberculosis
LSTPSDTR

SEQ ID NO: 128703 - protein, 8 aa, Mycobacterium tuberculosis
DTRADALR

SEQ ID NO: 128704 - protein, 8 aa, Mycobacterium tuberculosis
ALRCGEVL

SEQ ID NO: 128705 - protein, 8 aa, Mycobacterium tuberculosis
GEVLSTIL

SEQ ID NO: 128706 - protein, 8 aa, Mycobacterium tuberculosis
EVLSTILL

SEQ ID NO: 128707 - protein, 8 aa, Mycobacterium tuberculosis
ILLECTMA

SEQ ID NO: 128708 - protein, 8 aa, Mycobacterium tuberculosis
CTMAGMAT

SEQ ID NO: 128709 - protein, 8 aa, Mycobacterium tuberculosis
TMAGMATC

SEQ ID NO: 128710 - protein, 8 aa, Mycobacterium tuberculosis
GMATCTLT

SEQ ID NO: 128711 - protein, 8 aa, Mycobacterium tuberculosis
MATCTLTH

SEQ ID NO: 128712 - protein, 8 aa, Mycobacterium tuberculosis
TLTHLIES

SEQ ID NO: 128713 - protein, 8 aa, Mycobacterium tuberculosis
LIESSDSR

SEQ ID NO: 128714 - protein, 8 aa, Mycobacterium tuberculosis
DIVRGLTR

SEQ ID NO: 128715 - protein, 8 aa, Mycobacterium tuberculosis
EPQALIRV

SEQ ID NO: 128716 - protein, 8 aa, Mycobacterium tuberculosis
ALIRVGIA

SEQ ID NO: 128717 - protein, 8 aa, Mycobacterium tuberculosis
GIAPPLAA

SEQ ID NO: 128718 - protein, 8 aa, Mycobacterium tuberculosis
IAPPLAAV

SEQ ID NO: 128719 - protein, 8 aa, Mycobacterium tuberculosis
PPLAAVPA

SEQ ID NO: 128720 - protein, 8 aa, Mycobacterium tuberculosis
AVPAPTPR

SEQ ID NO: 128721 - protein, 8 aa, Mycobacterium tuberculosis
APTPRRPL

SEQ ID NO: 128722 - protein, 8 aa, Mycobacterium tuberculosis
RRPLDSVL

SEQ ID NO: 128723 - protein, 8 aa, Mycobacterium tuberculosis
PLDSVLQI

SEQ ID NO: 128724 - protein, 8 aa, Mycobacterium tuberculosis
LQIRQTPE

SEQ ID NO: 128725 - protein, 8 aa, Mycobacterium tuberculosis
QIRQTPEK

SEQ ID NO: 128726 - protein, 8 aa, Mycobacterium tuberculosis
RQTPEKGR

SEQ ID NO: 128727 - protein, 8 aa, Mycobacterium tuberculosis
KGRNASDR

SEQ ID NO: 128728 - protein, 8 aa, Mycobacterium tuberculosis
NASDRNAR

SEQ ID NO: 128729 - protein, 8 aa, Mycobacterium tuberculosis
RNARETGW

SEQ ID NO: 128730 - protein, 9 aa, Mycobacterium tuberculosis
MLKNAVLLA

SEQ ID NO: 128731 - protein, 9 aa, Mycobacterium tuberculosis
KNAVLLACR

SEQ ID NO: 128732 - protein, 9 aa, Mycobacterium tuberculosis
LLACRAPSV

SEQ ID NO: 128733 - protein, 9 aa, Mycobacterium tuberculosis
SVHNSQPWR

SEQ ID NO: 128734 - protein, 9 aa, Mycobacterium tuberculosis
VHNSQPWRW

SEQ ID NO: 128735 - protein, 9 aa, Mycobacterium tuberculosis
SQPWRWVAE

SEQ ID NO: 128736 - protein, 9 aa, Mycobacterium tuberculosis
QPWRWVAES

SEQ ID NO: 128737 - protein, 9 aa, Mycobacterium tuberculosis
WVAESGSEH

SEQ ID NO: 128738 - protein, 9 aa, Mycobacterium tuberculosis
AESGSEHTT

SEQ ID NO: 128739 - protein, 9 aa, Mycobacterium tuberculosis
SEHTTVHLF

SEQ ID NO: 128740 - protein, 9 aa, Mycobacterium tuberculosis
TTVHLFVNR

SEQ ID NO: 128741 - protein, 9 aa, Mycobacterium tuberculosis
HLFVNRHRT

SEQ ID NO: 128742 - protein, 9 aa, Mycobacterium tuberculosis
RQAIISCGA

SEQ ID NO: 128743 - protein, 9 aa, Mycobacterium tuberculosis
QAIISCGAV

SEQ ID NO: 128744 - protein, 9 aa, Mycobacterium tuberculosis
AIISCGAVL

SEQ ID NO: 128745 - protein, 9 aa, Mycobacterium tuberculosis
SCGAVLDHL

SEQ ID NO: 128746 - protein, 9 aa, Mycobacterium tuberculosis
CGAVLDHLR

SEQ ID NO: 128747 - protein, 9 aa, Mycobacterium tuberculosis
AVLDHLRIA

SEQ ID NO: 128748 - protein, 9 aa, Mycobacterium tuberculosis
VLDHLRIAM

SEQ ID NO: 128749 - protein, 9 aa, Mycobacterium tuberculosis
HLRIAMTAA

SEQ ID NO: 128750 - protein, 9 aa, Mycobacterium tuberculosis
RIAMTAAHW

SEQ ID NO: 128751 - protein, 9 aa, Mycobacterium tuberculosis
AMTAAHWQA

SEQ ID NO: 128752 - protein, 9 aa, Mycobacterium tuberculosis
TAAHWQANI

SEQ ID NO: 128753 - protein, 9 aa, Mycobacterium tuberculosis
HWQANITRF

SEQ ID NO: 128754 - protein, 9 aa, Mycobacterium tuberculosis
ITRFPQPNQ

SEQ ID NO: 128755 - protein, 9 aa, Mycobacterium tuberculosis
NQPDQLATV

SEQ ID NO: 128756 - protein, 9 aa, Mycobacterium tuberculosis
LATVEFSPI

SEQ ID NO: 128757 - protein, 9 aa, Mycobacterium tuberculosis
SPIDHVTAG

SEQ ID NO: 128758 - protein, 9 aa, Mycobacterium tuberculosis
HVTAGQRNR

SEQ ID NO: 128759 - protein, 9 aa, Mycobacterium tuberculosis
VTAGQRNRA

SEQ ID NO: 128760 - protein, 9 aa, Mycobacterium tuberculosis
GQRNRAQAI

SEQ ID NO: 128761 - protein, 9 aa, Mycobacterium tuberculosis
QRNRAQAIL

SEQ ID NO: 128762 - protein, 9 aa, Mycobacterium tuberculosis
RAQAILQRR

SEQ ID NO: 128763 - protein, 9 aa, Mycobacterium tuberculosis
AILQRRTDR

SEQ ID NO: 128764 - protein, 9 aa, Mycobacterium tuberculosis
ILQRRTDRL

SEQ ID NO: 128765 - protein, 9 aa, Mycobacterium tuberculosis
QRRTDRLPF

SEQ ID NO: 128766 - protein, 9 aa, Mycobacterium tuberculosis
RLPFDSPMY

SEQ ID NO: 128767 - protein, 9 aa, Mycobacterium tuberculosis
LPFDSPMYW

SEQ ID NO: 128768 - protein, 9 aa, Mycobacterium tuberculosis
FDSPMYWHL

SEQ ID NO: 128769 - protein, 9 aa, Mycobacterium tuberculosis
DSPMYWHLF

SEQ ID NO: 128770 - protein, 9 aa, Mycobacterium tuberculosis
PMYWHLFEP

SEQ ID NO: 128771 - protein, 9 aa, Mycobacterium tuberculosis
MYWHLFEPA

SEQ ID NO: 128772 - protein, 9 aa, Mycobacterium tuberculosis
YWHLFEPAL

SEQ ID NO: 128773 - protein, 9 aa, Mycobacterium tuberculosis
FEPALRDAV

SEQ ID NO: 128774 - protein, 9 aa, Mycobacterium tuberculosis
DAVDKDVAM

SEQ ID NO: 128775 - protein, 9 aa, Mycobacterium tuberculosis
AVDKDVAML

SEQ ID NO: 128776 - protein, 9 aa, Mycobacterium tuberculosis
VVSDDQRTR

SEQ ID NO: 128777 - protein, 9 aa, Mycobacterium tuberculosis
RTRLVVASQ

SEQ ID NO: 128778 - protein, 9 aa, Mycobacterium tuberculosis
VVASQLSEV

SEQ ID NO: 128779 - protein, 9 aa, Mycobacterium tuberculosis
VASQLSEVL

SEQ ID NO: 128780 - protein, 9 aa, Mycobacterium tuberculosis
ASQLSEVLR

SEQ ID NO: 128781 - protein, 9 aa, Mycobacterium tuberculosis
SQLSEVLRR

SEQ ID NO: 128782 - protein, 9 aa, Mycobacterium tuberculosis
EVLRRDDPY

SEQ ID NO: 128783 - protein, 9 aa, Mycobacterium tuberculosis
VLRRDDPYY

SEQ ID NO: 128784 - protein, 9 aa, Mycobacterium tuberculosis
PYYHAELEW

SEQ ID NO: 128785 - protein, 9 aa, Mycobacterium tuberculosis
YYHAELEWW

SEQ ID NO: 128786 - protein, 9 aa, Mycobacterium tuberculosis
ELEWWTSPF

SEQ ID NO: 128787 - protein, 9 aa, Mycobacterium tuberculosis
LEWWTSPFV

SEQ ID NO: 128788 - protein, 9 aa, Mycobacterium tuberculosis
EWWTSPFVL

SEQ ID NO: 128789 - protein, 9 aa, Mycobacterium tuberculosis
SPFVLAHGV

SEQ ID NO: 128790 - protein, 9 aa, Mycobacterium tuberculosis
AHGVPPDTL

SEQ ID NO: 128791 - protein, 9 aa, Mycobacterium tuberculosis
DTLASDAER

SEQ ID NO: 128792 - protein, 9 aa, Mycobacterium tuberculosis
TLASDAERL

SEQ ID NO: 128793 - protein, 9 aa, Mycobacterium tuberculosis
LASDAERLR

SEQ ID NO: 128794 - protein, 9 aa, Mycobacterium tuberculosis
FPVRSYQNR

SEQ ID NO: 128795 - protein, 9 aa, Mycobacterium tuberculosis
PVRSYQNRR

SEQ ID NO: 128796 - protein, 9 aa, Mycobacterium tuberculosis
SYQNRRAEL

SEQ ID NO: 128797 - protein, 9 aa, Mycobacterium tuberculosis
YQNRRAELA

SEQ ID NO: 128798 - protein, 9 aa, Mycobacterium tuberculosis
RRAELADDR

SEQ ID NO: 128799 - protein, 9 aa, Mycobacterium tuberculosis
ELADDRSKV

SEQ ID NO: 128800 - protein, 9 aa, Mycobacterium tuberculosis
GEVLSTILL

SEQ ID NO: 128801 - protein, 9 aa, Mycobacterium tuberculosis
VLSTILLEC

SEQ ID NO: 128802 - protein, 9 aa, Mycobacterium tuberculosis
STILLECTM

SEQ ID NO: 128803 - protein, 9 aa, Mycobacterium tuberculosis
ILLECTMAG

SEQ ID NO: 128804 - protein, 9 aa, Mycobacterium tuberculosis
LLECTMAGM

SEQ ID NO: 128805 - protein, 9 aa, Mycobacterium tuberculosis
TMAGMATCT

SEQ ID NO: 128806 - protein, 9 aa, Mycobacterium tuberculosis
MAGMATCTL

SEQ ID NO: 128807 - protein, 9 aa, Mycobacterium tuberculosis
GMATCTLTH

SEQ ID NO: 128808 - protein, 9 aa, Mycobacterium tuberculosis
MATCTLTHL

SEQ ID NO: 128809 - protein, 9 aa, Mycobacterium tuberculosis
ATCTLTHLI

SEQ ID NO: 128810 - protein, 9 aa, Mycobacterium tuberculosis
HLIESSDSR

SEQ ID NO: 128811 - protein, 9 aa, Mycobacterium tuberculosis
ESSDSRDIV

SEQ ID NO: 128812 - protein, 9 aa, Mycobacterium tuberculosis
IVRGLTRQR

SEQ ID NO: 128813 - protein, 9 aa, Mycobacterium tuberculosis
RQRGEPQAL

SEQ ID NO: 128814 - protein, 9 aa, Mycobacterium tuberculosis
GEPQALIRV

SEQ ID NO: 128815 - protein, 9 aa, Mycobacterium tuberculosis
IRVGIAPPL

SEQ ID NO: 128816 - protein, 9 aa, Mycobacterium tuberculosis
GIAPPLAAV

SEQ ID NO: 128817 - protein, 9 aa, Mycobacterium tuberculosis
APPLAAVPA

SEQ ID NO: 128818 - protein, 9 aa, Mycobacterium tuberculosis
AAVPAPTPR

SEQ ID NO: 128819 - protein, 9 aa, Mycobacterium tuberculosis
AVPAPTPRR

SEQ ID NO: 128820 - protein, 9 aa, Mycobacterium tuberculosis
TPRRPLDSV

SEQ ID NO: 128821 - protein, 9 aa, Mycobacterium tuberculosis
RPLDSVLQI

SEQ ID NO: 128822 - protein, 9 aa, Mycobacterium tuberculosis
LQIRQTPEK

SEQ ID NO: 128823 - protein, 9 aa, Mycobacterium tuberculosis
TPEKGRNAS

SEQ ID NO: 128824 - protein, 9 aa, Mycobacterium tuberculosis
RNASDRNAR

SEQ ID NO: 128825 - protein, 10 aa, Mycobacterium tuberculosis
MLKNAVLLAC

SEQ ID NO: 128826 - protein, 10 aa, Mycobacterium tuberculosis
LKNAVLLACR

SEQ ID NO: 128827 - protein, 10 aa, Mycobacterium tuberculosis
VLLACRAPSV

SEQ ID NO: 128828 - protein, 10 aa, Mycobacterium tuberculosis
APSVHNSQPW

SEQ ID NO: 128829 - protein, 10 aa, Mycobacterium tuberculosis
SVHNSQPWRW

SEQ ID NO: 128830 - protein, 10 aa, Mycobacterium tuberculosis
SQPWRWVAES

SEQ ID NO: 128831 - protein, 10 aa, Mycobacterium tuberculosis
WVAESGSEHT

SEQ ID NO: 128832 - protein, 10 aa, Mycobacterium tuberculosis
AESGSEHTTV

SEQ ID NO: 128833 - protein, 10 aa, Mycobacterium tuberculosis
GSEHTTVHLF

SEQ ID NO: 128834 - protein, 10 aa, Mycobacterium tuberculosis
SEHTTVHLFV

SEQ ID NO: 128835 - protein, 10 aa, Mycobacterium tuberculosis
HTTVHLFVNR

SEQ ID NO: 128836 - protein, 10 aa, Mycobacterium tuberculosis
TVHLFVNRHR

SEQ ID NO: 128837 - protein, 10 aa, Mycobacterium tuberculosis
HLFVNRHRTV

SEQ ID NO: 128838 - protein, 10 aa, Mycobacterium tuberculosis
FVNRHRTVPA

SEQ ID NO: 128839 - protein, 10 aa, Mycobacterium tuberculosis
TVPATDHSGR

SEQ ID NO: 128840 - protein, 10 aa, Mycobacterium tuberculosis
RQAIISCGAV

SEQ ID NO: 128841 - protein, 10 aa, Mycobacterium tuberculosis
AVLDHLRIAM

SEQ ID NO: 128842 - protein, 10 aa, Mycobacterium tuberculosis
VLDHLRIAMT

SEQ ID NO: 128843 - protein, 10 aa, Mycobacterium tuberculosis
IAMTAAHWQA

SEQ ID NO: 128844 - protein, 10 aa, Mycobacterium tuberculosis
MTAAHWQANI

SEQ ID NO: 128845 - protein, 10 aa, Mycobacterium tuberculosis
AAHWQANITR

SEQ ID NO: 128846 - protein, 10 aa, Mycobacterium tuberculosis
WQANITRFPQ

SEQ ID NO: 128847 - protein, 10 aa, Mycobacterium tuberculosis
FPQPNQPDQL

SEQ ID NO: 128848 - protein, 10 aa, Mycobacterium tuberculosis
QPNQPDQLAT

SEQ ID NO: 128849 - protein, 10 aa, Mycobacterium tuberculosis
QPDQLATVEF

SEQ ID NO: 128850 - protein, 10 aa, Mycobacterium tuberculosis
QLATVEFSPI

SEQ ID NO: 128851 - protein, 10 aa, Mycobacterium tuberculosis
TVEFSPIDHV

SEQ ID NO: 128852 - protein, 10 aa, Mycobacterium tuberculosis
HVTAGQRNRA

SEQ ID NO: 128853 - protein, 10 aa, Mycobacterium tuberculosis
GQRNRAQAIL

SEQ ID NO: 128854 - protein, 10 aa, Mycobacterium tuberculosis
RNRAQAILQR

SEQ ID NO: 128855 - protein, 10 aa, Mycobacterium tuberculosis
QAILQRRTDR

SEQ ID NO: 128856 - protein, 10 aa, Mycobacterium tuberculosis
AILQRRTDRL

SEQ ID NO: 128857 - protein, 10 aa, Mycobacterium tuberculosis
LQRRTDRLPF

SEQ ID NO: 128858 - protein, 10 aa, Mycobacterium tuberculosis
RLPFDSPMYW

SEQ ID NO: 128859 - protein, 10 aa, Mycobacterium tuberculosis
PMYWHLFEPA

SEQ ID NO: 128860 - protein, 10 aa, Mycobacterium tuberculosis
MYWHLFEPAL

SEQ ID NO: 128861 - protein, 10 aa, Mycobacterium tuberculosis
YWHLFEPALR

SEQ ID NO: 128862 - protein, 10 aa, Mycobacterium tuberculosis
HLFEPALRDA

SEQ ID NO: 128863 - protein, 10 aa, Mycobacterium tuberculosis
EPALRDAVDK

SEQ ID NO: 128864 - protein, 10 aa, Mycobacterium tuberculosis
ALRDAVDKDV

SEQ ID NO: 128865 - protein, 10 aa, Mycobacterium tuberculosis
DAVDKDVAML

SEQ ID NO: 128866 - protein, 10 aa, Mycobacterium tuberculosis
AMLDVVSDDQ

SEQ ID NO: 128867 - protein, 10 aa, Mycobacterium tuberculosis
MLDVVSDDQR

SEQ ID NO: 128868 - protein, 10 aa, Mycobacterium tuberculosis
DVVSDDQRTR

SEQ ID NO: 128869 - protein, 10 aa, Mycobacterium tuberculosis
VVSDDQRTRL

SEQ ID NO: 128870 - protein, 10 aa, Mycobacterium tuberculosis
VSDDQRTRLV

SEQ ID NO: 128871 - protein, 10 aa, Mycobacterium tuberculosis
RTRLVVASQL

SEQ ID NO: 128872 - protein, 10 aa, Mycobacterium tuberculosis
LVVASQLSEV

SEQ ID NO: 128873 - protein, 10 aa, Mycobacterium tuberculosis
VVASQLSEVL

SEQ ID NO: 128874 - protein, 10 aa, Mycobacterium tuberculosis
VASQLSEVLR

SEQ ID NO: 128875 - protein, 10 aa, Mycobacterium tuberculosis
ASQLSEVLRR

SEQ ID NO: 128876 - protein, 10 aa, Mycobacterium tuberculosis
SEVLRRDDPY

SEQ ID NO: 128877 - protein, 10 aa, Mycobacterium tuberculosis
EVLRRDDPYY

SEQ ID NO: 128878 - protein, 10 aa, Mycobacterium tuberculosis
DPYYHAELEW

SEQ ID NO: 128879 - protein, 10 aa, Mycobacterium tuberculosis
PYYHAELEWW

SEQ ID NO: 128880 - protein, 10 aa, Mycobacterium tuberculosis
YYHAELEWWT

SEQ ID NO: 128881 - protein, 10 aa, Mycobacterium tuberculosis
AELEWWTSPF

SEQ ID NO: 128882 - protein, 10 aa, Mycobacterium tuberculosis
ELEWWTSPFV

SEQ ID NO: 128883 - protein, 10 aa, Mycobacterium tuberculosis
LEWWTSPFVL

SEQ ID NO: 128884 - protein, 10 aa, Mycobacterium tuberculosis
EWWTSPFVLA

SEQ ID NO: 128885 - protein, 10 aa, Mycobacterium tuberculosis
TSPFVLAHGV

SEQ ID NO: 128886 - protein, 10 aa, Mycobacterium tuberculosis
VLAHGVPPDT

SEQ ID NO: 128887 - protein, 10 aa, Mycobacterium tuberculosis
VPPDTLASDA

SEQ ID NO: 128888 - protein, 10 aa, Mycobacterium tuberculosis
DTLASDAERL

SEQ ID NO: 128889 - protein, 10 aa, Mycobacterium tuberculosis
TLASDAERLR

SEQ ID NO: 128890 - protein, 10 aa, Mycobacterium tuberculosis
LASDAERLRV

SEQ ID NO: 128891 - protein, 10 aa, Mycobacterium tuberculosis
RLRVDLGRDF

SEQ ID NO: 128892 - protein, 10 aa, Mycobacterium tuberculosis
RVDLGRDFPV

SEQ ID NO: 128893 - protein, 10 aa, Mycobacterium tuberculosis
DFPVRSYQNR

SEQ ID NO: 128894 - protein, 10 aa, Mycobacterium tuberculosis
FPVRSYQNRR

SEQ ID NO: 128895 - protein, 10 aa, Mycobacterium tuberculosis
RSYQNRRAEL

SEQ ID NO: 128896 - protein, 10 aa, Mycobacterium tuberculosis
AELADDRSKV

SEQ ID NO: 128897 - protein, 10 aa, Mycobacterium tuberculosis
ELADDRSKVL

SEQ ID NO: 128898 - protein, 10 aa, Mycobacterium tuberculosis
LADDRSKVLV

SEQ ID NO: 128899 - protein, 10 aa, Mycobacterium tuberculosis
LVLSTPSDTR

SEQ ID NO: 128900 - protein, 10 aa, Mycobacterium tuberculosis
VLSTPSDTRA

SEQ ID NO: 128901 - protein, 10 aa, Mycobacterium tuberculosis
TPSDTRADAL

SEQ ID NO: 128902 - protein, 10 aa, Mycobacterium tuberculosis
RADALRCGEV

SEQ ID NO: 128903 - protein, 10 aa, Mycobacterium tuberculosis
ALRCGEVLST

SEQ ID NO: 128904 - protein, 10 aa, Mycobacterium tuberculosis
VLSTILLECT

SEQ ID NO: 128905 - protein, 10 aa, Mycobacterium tuberculosis
ILLECTMAGM

SEQ ID NO: 128906 - protein, 10 aa, Mycobacterium tuberculosis
LLECTMAGMA

SEQ ID NO: 128907 - protein, 10 aa, Mycobacterium tuberculosis
CTMAGMATCT

SEQ ID NO: 128908 - protein, 10 aa, Mycobacterium tuberculosis
TMAGMATCTL

SEQ ID NO: 128909 - protein, 10 aa, Mycobacterium tuberculosis
GMATCTLTHL

SEQ ID NO: 128910 - protein, 10 aa, Mycobacterium tuberculosis
MATCTLTHLI

SEQ ID NO: 128911 - protein, 10 aa, Mycobacterium tuberculosis
ESSDSRDIVR

SEQ ID NO: 128912 - protein, 10 aa, Mycobacterium tuberculosis
DIVRGLTRQR

SEQ ID NO: 128913 - protein, 10 aa, Mycobacterium tuberculosis
TRQRGEPQAL

SEQ ID NO: 128914 - protein, 10 aa, Mycobacterium tuberculosis
RQRGEPQALI

SEQ ID NO: 128915 - protein, 10 aa, Mycobacterium tuberculosis
LIRVGIAPPL

SEQ ID NO: 128916 - protein, 10 aa, Mycobacterium tuberculosis
VGIAPPLAAV

SEQ ID NO: 128917 - protein, 10 aa, Mycobacterium tuberculosis
LAAVPAPTPR

SEQ ID NO: 128918 - protein, 10 aa, Mycobacterium tuberculosis
AAVPAPTPRR

SEQ ID NO: 128919 - protein, 10 aa, Mycobacterium tuberculosis
VPAPTPRRPL

SEQ ID NO: 128920 - protein, 10 aa, Mycobacterium tuberculosis
TPRRPLDSVL

SEQ ID NO: 128921 - protein, 10 aa, Mycobacterium tuberculosis
PLDSVLQIRQ

SEQ ID NO: 128922 - protein, 10 aa, Mycobacterium tuberculosis
VLQIRQTPEK

SEQ ID NO: 128923 - protein, 11 aa, Mycobacterium tuberculosis
MLKNAVLLACR

SEQ ID NO: 128924 - protein, 11 aa, Mycobacterium tuberculosis
AVLLACRAPSV

SEQ ID NO: 128925 - protein, 11 aa, Mycobacterium tuberculosis
RAPSVHNSQPW

SEQ ID NO: 128926 - protein, 11 aa, Mycobacterium tuberculosis
PSVHNSQPWRW

SEQ ID NO: 128927 - protein, 11 aa, Mycobacterium tuberculosis
SVHNSQPWRWV

SEQ ID NO: 128928 - protein, 11 aa, Mycobacterium tuberculosis
VAESGSEHTTV

SEQ ID NO: 128929 - protein, 11 aa, Mycobacterium tuberculosis
EHTTVHLFVNR

SEQ ID NO: 128930 - protein, 11 aa, Mycobacterium tuberculosis
TTVHLFVNRHR

SEQ ID NO: 128931 - protein, 11 aa, Mycobacterium tuberculosis
RTVPATDHSGR

SEQ ID NO: 128932 - protein, 11 aa, Mycobacterium tuberculosis
VPATDHSGRQA

SEQ ID NO: 128933 - protein, 11 aa, Mycobacterium tuberculosis
RQAIISCGAVL

SEQ ID NO: 128934 - protein, 11 aa, Mycobacterium tuberculosis
IISCGAVLDHL

SEQ ID NO: 128935 - protein, 11 aa, Mycobacterium tuberculosis
ISCGAVLDHLR

SEQ ID NO: 128936 - protein, 11 aa, Mycobacterium tuberculosis
VLDHLRIAMTA

SEQ ID NO: 128937 - protein, 11 aa, Mycobacterium tuberculosis
RIAMTAAHWQA

SEQ ID NO: 128938 - protein, 11 aa, Mycobacterium tuberculosis
AMTAAHWQANI

SEQ ID NO: 128939 - protein, 11 aa, Mycobacterium tuberculosis
MTAAHWQANIT

SEQ ID NO: 128940 - protein, 11 aa, Mycobacterium tuberculosis
TAAHWQANITR

SEQ ID NO: 128941 - protein, 11 aa, Mycobacterium tuberculosis
AAHWQANITRF

SEQ ID NO: 128942 - protein, 11 aa, Mycobacterium tuberculosis
WQANITRFPQP

SEQ ID NO: 128943 - protein, 11 aa, Mycobacterium tuberculosis
RFPQPNQPDQL

SEQ ID NO: 128944 - protein, 11 aa, Mycobacterium tuberculosis
FPQPNQPDQLA

SEQ ID NO: 128945 - protein, 11 aa, Mycobacterium tuberculosis
QPNQPDQLATV

SEQ ID NO: 128946 - protein, 11 aa, Mycobacterium tuberculosis
NQPDQLATVEF

SEQ ID NO: 128947 - protein, 11 aa, Mycobacterium tuberculosis
ATVEFSPIDHV

SEQ ID NO: 128948 - protein, 11 aa, Mycobacterium tuberculosis
SPIDHVTAGQR

SEQ ID NO: 128949 - protein, 11 aa, Mycobacterium tuberculosis
VTAGQRNRAQA

SEQ ID NO: 128950 - protein, 11 aa, Mycobacterium tuberculosis
QRNRAQAILQR

SEQ ID NO: 128951 - protein, 11 aa, Mycobacterium tuberculosis
RNRAQAILQRR

SEQ ID NO: 128952 - protein, 11 aa, Mycobacterium tuberculosis
AQAILQRRTDR

SEQ ID NO: 128953 - protein, 11 aa, Mycobacterium tuberculosis
QAILQRRTDRL

SEQ ID NO: 128954 - protein, 11 aa, Mycobacterium tuberculosis
ILQRRTDRLPF

SEQ ID NO: 128955 - protein, 11 aa, Mycobacterium tuberculosis
RTDRLPFDSPM

SEQ ID NO: 128956 - protein, 11 aa, Mycobacterium tuberculosis
LPFDSPMYWHL

SEQ ID NO: 128957 - protein, 11 aa, Mycobacterium tuberculosis
PFDSPMYWHLF

SEQ ID NO: 128958 - protein, 11 aa, Mycobacterium tuberculosis
SPMYWHLFEPA

SEQ ID NO: 128959 - protein, 11 aa, Mycobacterium tuberculosis
PMYWHLFEPAL

SEQ ID NO: 128960 - protein, 11 aa, Mycobacterium tuberculosis
MYWHLFEPALR

SEQ ID NO: 128961 - protein, 11 aa, Mycobacterium tuberculosis
HLFEPALRDAV

SEQ ID NO: 128962 - protein, 11 aa, Mycobacterium tuberculosis
ALRDAVDKDVA

SEQ ID NO: 128963 - protein, 11 aa, Mycobacterium tuberculosis
AVDKDVAMLDV

SEQ ID NO: 128964 - protein, 11 aa, Mycobacterium tuberculosis
AMLDVVSDDQR

SEQ ID NO: 128965 - protein, 11 aa, Mycobacterium tuberculosis
MLDVVSDDQRT

SEQ ID NO: 128966 - protein, 11 aa, Mycobacterium tuberculosis
DVVSDDQRTRL

SEQ ID NO: 128967 - protein, 11 aa, Mycobacterium tuberculosis
VVSDDQRTRLV

SEQ ID NO: 128968 - protein, 11 aa, Mycobacterium tuberculosis
VSDDQRTRLVV

SEQ ID NO: 128969 - protein, 11 aa, Mycobacterium tuberculosis
RTRLVVASQLS

SEQ ID NO: 128970 - protein, 11 aa, Mycobacterium tuberculosis
RLVVASQLSEV

SEQ ID NO: 128971 - protein, 11 aa, Mycobacterium tuberculosis
LVVASQLSEVL

SEQ ID NO: 128972 - protein, 11 aa, Mycobacterium tuberculosis
VVASQLSEVLR

SEQ ID NO: 128973 - protein, 11 aa, Mycobacterium tuberculosis
VASQLSEVLRR

SEQ ID NO: 128974 - protein, 11 aa, Mycobacterium tuberculosis
LSEVLRRDDPY

SEQ ID NO: 128975 - protein, 11 aa, Mycobacterium tuberculosis
SEVLRRDDPYY

SEQ ID NO: 128976 - protein, 11 aa, Mycobacterium tuberculosis
VLRRDDPYYHA

SEQ ID NO: 128977 - protein, 11 aa, Mycobacterium tuberculosis
RRDDPYYHAEL

SEQ ID NO: 128978 - protein, 11 aa, Mycobacterium tuberculosis
DPYYHAELEWW

SEQ ID NO: 128979 - protein, 11 aa, Mycobacterium tuberculosis
HAELEWWTSPF

SEQ ID NO: 128980 - protein, 11 aa, Mycobacterium tuberculosis
AELEWWTSPFV

SEQ ID NO: 128981 - protein, 11 aa, Mycobacterium tuberculosis
ELEWWTSPFVL

SEQ ID NO: 128982 - protein, 11 aa, Mycobacterium tuberculosis
LEWWTSPFVLA

SEQ ID NO: 128983 - protein, 11 aa, Mycobacterium tuberculosis
WTSPFVLAHGV

SEQ ID NO: 128984 - protein, 11 aa, Mycobacterium tuberculosis
SPFVLAHGVPP

SEQ ID NO: 128985 - protein, 11 aa, Mycobacterium tuberculosis
VLAHGVPPDTL

SEQ ID NO: 128986 - protein, 11 aa, Mycobacterium tuberculosis
DTLASDAERLR

SEQ ID NO: 128987 - protein, 11 aa, Mycobacterium tuberculosis
TLASDAERLRV

SEQ ID NO: 128988 - protein, 11 aa, Mycobacterium tuberculosis
DAERLRVDLGR

SEQ ID NO: 128989 - protein, 11 aa, Mycobacterium tuberculosis
RVDLGRDFPVR

SEQ ID NO: 128990 - protein, 11 aa, Mycobacterium tuberculosis
DLGRDFPVRSY

SEQ ID NO: 128991 - protein, 11 aa, Mycobacterium tuberculosis
RDFPVRSYQNR

SEQ ID NO: 128992 - protein, 11 aa, Mycobacterium tuberculosis
DFPVRSYQNRR

SEQ ID NO: 128993 - protein, 11 aa, Mycobacterium tuberculosis
FPVRSYQNRRA

SEQ ID NO: 128994 - protein, 11 aa, Mycobacterium tuberculosis
RRAELADDRSK

SEQ ID NO: 128995 - protein, 11 aa, Mycobacterium tuberculosis
AELADDRSKVL

SEQ ID NO: 128996 - protein, 11 aa, Mycobacterium tuberculosis
ELADDRSKVLV

SEQ ID NO: 128997 - protein, 11 aa, Mycobacterium tuberculosis
LADDRSKVLVL

SEQ ID NO: 128998 - protein, 11 aa, Mycobacterium tuberculosis
RSKVLVLSTPS

SEQ ID NO: 128999 - protein, 11 aa, Mycobacterium tuberculosis
VLVLSTPSDTR

SEQ ID NO: 129000 - protein, 11 aa, Mycobacterium tuberculosis
STPSDTRADAL

SEQ ID NO: 129001 - protein, 11 aa, Mycobacterium tuberculosis
TPSDTRADALR

SEQ ID NO: 129002 - protein, 11 aa, Mycobacterium tuberculosis
TRADALRCGEV

SEQ ID NO: 129003 - protein, 11 aa, Mycobacterium tuberculosis
ALRCGEVLSTI

SEQ ID NO: 129004 - protein, 11 aa, Mycobacterium tuberculosis
GEVLSTILLEC

SEQ ID NO: 129005 - protein, 11 aa, Mycobacterium tuberculosis
EVLSTILLECT

SEQ ID NO: 129006 - protein, 11 aa, Mycobacterium tuberculosis
VLSTILLECTM

SEQ ID NO: 129007 - protein, 11 aa, Mycobacterium tuberculosis
TILLECTMAGM

SEQ ID NO: 129008 - protein, 11 aa, Mycobacterium tuberculosis
ILLECTMAGMA

SEQ ID NO: 129009 - protein, 11 aa, Mycobacterium tuberculosis
CTMAGMATCTL

SEQ ID NO: 129010 - protein, 11 aa, Mycobacterium tuberculosis
TMAGMATCTLT

SEQ ID NO: 129011 - protein, 11 aa, Mycobacterium tuberculosis
MAGMATCTLTH

SEQ ID NO: 129012 - protein, 11 aa, Mycobacterium tuberculosis
GMATCTLTHLI

SEQ ID NO: 129013 - protein, 11 aa, Mycobacterium tuberculosis
LTHLIESSDSR

SEQ ID NO: 129014 - protein, 11 aa, Mycobacterium tuberculosis
HLIESSDSRDI

SEQ ID NO: 129015 - protein, 11 aa, Mycobacterium tuberculosis
LIESSDSRDIV

SEQ ID NO: 129016 - protein, 11 aa, Mycobacterium tuberculosis
DSRDIVRGLTR

SEQ ID NO: 129017 - protein, 11 aa, Mycobacterium tuberculosis
GLTRQRGEPQA

SEQ ID NO: 129018 - protein, 11 aa, Mycobacterium tuberculosis
LTRQRGEPQAL

SEQ ID NO: 129019 - protein, 11 aa, Mycobacterium tuberculosis
RQRGEPQALIR

SEQ ID NO: 129020 - protein, 11 aa, Mycobacterium tuberculosis
GEPQALIRVGI

SEQ ID NO: 129021 - protein, 11 aa, Mycobacterium tuberculosis
EPQALIRVGIA

SEQ ID NO: 129022 - protein, 11 aa, Mycobacterium tuberculosis
ALIRVGIAPPL

SEQ ID NO: 129023 - protein, 11 aa, Mycobacterium tuberculosis
LIRVGIAPPLA

SEQ ID NO: 129024 - protein, 11 aa, Mycobacterium tuberculosis
RVGIAPPLAAV

SEQ ID NO: 129025 - protein, 11 aa, Mycobacterium tuberculosis
GIAPPLAAVPA

SEQ ID NO: 129026 - protein, 11 aa, Mycobacterium tuberculosis
APPLAAVPAPT

SEQ ID NO: 129027 - protein, 11 aa, Mycobacterium tuberculosis
LAAVPAPTPRR

SEQ ID NO: 129028 - protein, 11 aa, Mycobacterium tuberculosis
AVPAPTPRRPL

SEQ ID NO: 129029 - protein, 11 aa, Mycobacterium tuberculosis
APTPRRPLDSV

SEQ ID NO: 129030 - protein, 11 aa, Mycobacterium tuberculosis
PTPRRPLDSVL

SEQ ID NO: 129031 - protein, 11 aa, Mycobacterium tuberculosis
PLDSVLQIRQT

SEQ ID NO: 129032 - protein, 11 aa, Mycobacterium tuberculosis
SVLQIRQTPEK

SEQ ID NO: 129033 - protein, 11 aa, Mycobacterium tuberculosis
KGRNASDRNAR

SEQ ID NO: 129034 - protein, 11 aa, Mycobacterium tuberculosis
ASDRNARETGW

SEQ ID NO: 129035 - protein, 13 aa, Mycobacterium tuberculosis
MLKNAVLLACRAP

SEQ ID NO: 129036 - protein, 13 aa, Mycobacterium tuberculosis
LKNAVLLACRAPS

SEQ ID NO: 129037 - protein, 13 aa, Mycobacterium tuberculosis
KNAVLLACRAPSV

SEQ ID NO: 129038 - protein, 13 aa, Mycobacterium tuberculosis
NAVLLACRAPSVH

SEQ ID NO: 129039 - protein, 13 aa, Mycobacterium tuberculosis
AVLLACRAPSVHN

SEQ ID NO: 129040 - protein, 13 aa, Mycobacterium tuberculosis
VLLACRAPSVHNS

SEQ ID NO: 129041 - protein, 13 aa, Mycobacterium tuberculosis
LLACRAPSVHNSQ

SEQ ID NO: 129042 - protein, 13 aa, Mycobacterium tuberculosis
LACRAPSVHNSQP

SEQ ID NO: 129043 - protein, 13 aa, Mycobacterium tuberculosis
ACRAPSVHNSQPW

SEQ ID NO: 129044 - protein, 13 aa, Mycobacterium tuberculosis
CRAPSVHNSQPWR

SEQ ID NO: 129045 - protein, 13 aa, Mycobacterium tuberculosis
RAPSVHNSQPWRW

SEQ ID NO: 129046 - protein, 13 aa, Mycobacterium tuberculosis
APSVHNSQPWRWV

SEQ ID NO: 129047 - protein, 13 aa, Mycobacterium tuberculosis
PSVHNSQPWRWVA

SEQ ID NO: 129048 - protein, 13 aa, Mycobacterium tuberculosis
SVHNSQPWRWVAE

SEQ ID NO: 129049 - protein, 13 aa, Mycobacterium tuberculosis
VHNSQPWRWVAES

SEQ ID NO: 129050 - protein, 13 aa, Mycobacterium tuberculosis
HNSQPWRWVAESG

SEQ ID NO: 129051 - protein, 13 aa, Mycobacterium tuberculosis
NSQPWRWVAESGS

SEQ ID NO: 129052 - protein, 13 aa, Mycobacterium tuberculosis
SQPWRWVAESGSE

SEQ ID NO: 129053 - protein, 13 aa, Mycobacterium tuberculosis
QPWRWVAESGSEH

SEQ ID NO: 129054 - protein, 13 aa, Mycobacterium tuberculosis
PWRWVAESGSEHT

SEQ ID NO: 129055 - protein, 13 aa, Mycobacterium tuberculosis
WRWVAESGSEHTT

SEQ ID NO: 129056 - protein, 13 aa, Mycobacterium tuberculosis
RWVAESGSEHTTV

SEQ ID NO: 129057 - protein, 13 aa, Mycobacterium tuberculosis
WVAESGSEHTTVH

SEQ ID NO: 129058 - protein, 13 aa, Mycobacterium tuberculosis
VAESGSEHTTVHL

SEQ ID NO: 129059 - protein, 13 aa, Mycobacterium tuberculosis
AESGSEHTTVHLF

SEQ ID NO: 129060 - protein, 13 aa, Mycobacterium tuberculosis
ESGSEHTTVHLFV

SEQ ID NO: 129061 - protein, 13 aa, Mycobacterium tuberculosis
SGSEHTTVHLFVN

SEQ ID NO: 129062 - protein, 13 aa, Mycobacterium tuberculosis
GSEHTTVHLFVNR

SEQ ID NO: 129063 - protein, 13 aa, Mycobacterium tuberculosis
SEHTTVHLFVNRH

SEQ ID NO: 129064 - protein, 13 aa, Mycobacterium tuberculosis
EHTTVHLFVNRHR

SEQ ID NO: 129065 - protein, 13 aa, Mycobacterium tuberculosis
HTTVHLFVNRHRT

SEQ ID NO: 129066 - protein, 13 aa, Mycobacterium tuberculosis
TTVHLFVNRHRTV

SEQ ID NO: 129067 - protein, 13 aa, Mycobacterium tuberculosis
TVHLFVNRHRTVP

SEQ ID NO: 129068 - protein, 13 aa, Mycobacterium tuberculosis
VHLFVNRHRTVPA

SEQ ID NO: 129069 - protein, 13 aa, Mycobacterium tuberculosis
HLFVNRHRTVPAT

SEQ ID NO: 129070 - protein, 13 aa, Mycobacterium tuberculosis
LFVNRHRTVPATD

SEQ ID NO: 129071 - protein, 13 aa, Mycobacterium tuberculosis
FVNRHRTVPATDH

SEQ ID NO: 129072 - protein, 13 aa, Mycobacterium tuberculosis
VNRHRTVPATDHS

SEQ ID NO: 129073 - protein, 13 aa, Mycobacterium tuberculosis
NRHRTVPATDHSG

SEQ ID NO: 129074 - protein, 13 aa, Mycobacterium tuberculosis
RHRTVPATDHSGR

SEQ ID NO: 129075 - protein, 13 aa, Mycobacterium tuberculosis
HRTVPATDHSGRQ

SEQ ID NO: 129076 - protein, 13 aa, Mycobacterium tuberculosis
RTVPATDHSGRQA

SEQ ID NO: 129077 - protein, 13 aa, Mycobacterium tuberculosis
TVPATDHSGRQAI

SEQ ID NO: 129078 - protein, 13 aa, Mycobacterium tuberculosis
VPATDHSGRQAII

SEQ ID NO: 129079 - protein, 13 aa, Mycobacterium tuberculosis
PATDHSGRQAIIS

SEQ ID NO: 129080 - protein, 13 aa, Mycobacterium tuberculosis
ATDHSGRQAIISC

SEQ ID NO: 129081 - protein, 13 aa, Mycobacterium tuberculosis
TDHSGRQAIISCG

SEQ ID NO: 129082 - protein, 13 aa, Mycobacterium tuberculosis
DHSGRQAIISCGA

SEQ ID NO: 129083 - protein, 13 aa, Mycobacterium tuberculosis
HSGRQAIISCGAV

SEQ ID NO: 129084 - protein, 13 aa, Mycobacterium tuberculosis
SGRQAIISCGAVL

SEQ ID NO: 129085 - protein, 13 aa, Mycobacterium tuberculosis
GRQAIISCGAVLD

SEQ ID NO: 129086 - protein, 13 aa, Mycobacterium tuberculosis
RQAIISCGAVLDH

SEQ ID NO: 129087 - protein, 13 aa, Mycobacterium tuberculosis
QAIISCGAVLDHL

SEQ ID NO: 129088 - protein, 13 aa, Mycobacterium tuberculosis
AIISCGAVLDHLR

SEQ ID NO: 129089 - protein, 13 aa, Mycobacterium tuberculosis
IISCGAVLDHLRI

SEQ ID NO: 129090 - protein, 13 aa, Mycobacterium tuberculosis
ISCGAVLDHLRIA

SEQ ID NO: 129091 - protein, 13 aa, Mycobacterium tuberculosis
SCGAVLDHLRIAM

SEQ ID NO: 129092 - protein, 13 aa, Mycobacterium tuberculosis
CGAVLDHLRIAMT

SEQ ID NO: 129093 - protein, 13 aa, Mycobacterium tuberculosis
GAVLDHLRIAMTA

SEQ ID NO: 129094 - protein, 13 aa, Mycobacterium tuberculosis
AVLDHLRIAMTAA

SEQ ID NO: 129095 - protein, 13 aa, Mycobacterium tuberculosis
VLDHLRIAMTAAH

SEQ ID NO: 129096 - protein, 13 aa, Mycobacterium tuberculosis
LDHLRIAMTAAHW

SEQ ID NO: 129097 - protein, 13 aa, Mycobacterium tuberculosis
DHLRIAMTAAHWQ

SEQ ID NO: 129098 - protein, 13 aa, Mycobacterium tuberculosis
HLRIAMTAAHWQA

SEQ ID NO: 129099 - protein, 13 aa, Mycobacterium tuberculosis
LRIAMTAAHWQAN

SEQ ID NO: 129100 - protein, 13 aa, Mycobacterium tuberculosis
RIAMTAAHWQANI

SEQ ID NO: 129101 - protein, 13 aa, Mycobacterium tuberculosis
IAMTAAHWQANIT

SEQ ID NO: 129102 - protein, 13 aa, Mycobacterium tuberculosis
AMTAAHWQANITR

SEQ ID NO: 129103 - protein, 13 aa, Mycobacterium tuberculosis
MTAAHWQANITRF

SEQ ID NO: 129104 - protein, 13 aa, Mycobacterium tuberculosis
TAAHWQANITRFP

SEQ ID NO: 129105 - protein, 13 aa, Mycobacterium tuberculosis
AAHWQANITRFPQ

SEQ ID NO: 129106 - protein, 13 aa, Mycobacterium tuberculosis
AHWQANITRFPQP

SEQ ID NO: 129107 - protein, 13 aa, Mycobacterium tuberculosis
HWQANITRFPQPN

SEQ ID NO: 129108 - protein, 13 aa, Mycobacterium tuberculosis
WQANITRFPQPNQ

SEQ ID NO: 129109 - protein, 13 aa, Mycobacterium tuberculosis
QANITRFPQPNQP

SEQ ID NO: 129110 - protein, 13 aa, Mycobacterium tuberculosis
ANITRFPQPNQPD

SEQ ID NO: 129111 - protein, 13 aa, Mycobacterium tuberculosis
NITRFPQPNQPDQ

SEQ ID NO: 129112 - protein, 13 aa, Mycobacterium tuberculosis
ITRFPQPNQPDQL

SEQ ID NO: 129113 - protein, 13 aa, Mycobacterium tuberculosis
TRFPQPNQPDQLA

SEQ ID NO: 129114 - protein, 13 aa, Mycobacterium tuberculosis
RFPQPNQPDQLAT

SEQ ID NO: 129115 - protein, 13 aa, Mycobacterium tuberculosis
FPQPNQPDQLATV

SEQ ID NO: 129116 - protein, 13 aa, Mycobacterium tuberculosis
PQPNQPDQLATVE

SEQ ID NO: 129117 - protein, 13 aa, Mycobacterium tuberculosis
QPNQPDQLATVEF

SEQ ID NO: 129118 - protein, 13 aa, Mycobacterium tuberculosis
PNQPDQLATVEFS

SEQ ID NO: 129119 - protein, 13 aa, Mycobacterium tuberculosis
NQPDQLATVEFSP

SEQ ID NO: 129120 - protein, 13 aa, Mycobacterium tuberculosis
QPDQLATVEFSPI

SEQ ID NO: 129121 - protein, 13 aa, Mycobacterium tuberculosis
PDQLATVEFSPID

SEQ ID NO: 129122 - protein, 13 aa, Mycobacterium tuberculosis
DQLATVEFSPIDH

SEQ ID NO: 129123 - protein, 13 aa, Mycobacterium tuberculosis
QLATVEFSPIDHV

SEQ ID NO: 129124 - protein, 13 aa, Mycobacterium tuberculosis
LATVEFSPIDHVT

SEQ ID NO: 129125 - protein, 13 aa, Mycobacterium tuberculosis
ATVEFSPIDHVTA

SEQ ID NO: 129126 - protein, 13 aa, Mycobacterium tuberculosis
TVEFSPIDHVTAG

SEQ ID NO: 129127 - protein, 13 aa, Mycobacterium tuberculosis
VEFSPIDHVTAGQ

SEQ ID NO: 129128 - protein, 13 aa, Mycobacterium tuberculosis
EFSPIDHVTAGQR

SEQ ID NO: 129129 - protein, 13 aa, Mycobacterium tuberculosis
FSPIDHVTAGQRN

SEQ ID NO: 129130 - protein, 13 aa, Mycobacterium tuberculosis
SPIDHVTAGQRNR

SEQ ID NO: 129131 - protein, 13 aa, Mycobacterium tuberculosis
PIDHVTAGQRNRA

SEQ ID NO: 129132 - protein, 13 aa, Mycobacterium tuberculosis
IDHVTAGQRNRAQ

SEQ ID NO: 129133 - protein, 13 aa, Mycobacterium tuberculosis
DHVTAGQRNRAQA

SEQ ID NO: 129134 - protein, 13 aa, Mycobacterium tuberculosis
HVTAGQRNRAQAI

SEQ ID NO: 129135 - protein, 13 aa, Mycobacterium tuberculosis
VTAGQRNRAQAIL

SEQ ID NO: 129136 - protein, 13 aa, Mycobacterium tuberculosis
TAGQRNRAQAILQ

SEQ ID NO: 129137 - protein, 13 aa, Mycobacterium tuberculosis
AGQRNRAQAILQR

SEQ ID NO: 129138 - protein, 13 aa, Mycobacterium tuberculosis
GQRNRAQAILQRR

SEQ ID NO: 129139 - protein, 13 aa, Mycobacterium tuberculosis
QRNRAQAILQRRT

SEQ ID NO: 129140 - protein, 13 aa, Mycobacterium tuberculosis
RNRAQAILQRRTD

SEQ ID NO: 129141 - protein, 13 aa, Mycobacterium tuberculosis
NRAQAILQRRTDR

SEQ ID NO: 129142 - protein, 13 aa, Mycobacterium tuberculosis
RAQAILQRRTDRL

SEQ ID NO: 129143 - protein, 13 aa, Mycobacterium tuberculosis
AQAILQRRTDRLP

SEQ ID NO: 129144 - protein, 13 aa, Mycobacterium tuberculosis
QAILQRRTDRLPF

SEQ ID NO: 129145 - protein, 13 aa, Mycobacterium tuberculosis
AILQRRTDRLPFD

SEQ ID NO: 129146 - protein, 13 aa, Mycobacterium tuberculosis
ILQRRTDRLPFDS

SEQ ID NO: 129147 - protein, 13 aa, Mycobacterium tuberculosis
LQRRTDRLPFDSP

SEQ ID NO: 129148 - protein, 13 aa, Mycobacterium tuberculosis
QRRTDRLPFDSPM

SEQ ID NO: 129149 - protein, 13 aa, Mycobacterium tuberculosis
RRTDRLPFDSPMY

SEQ ID NO: 129150 - protein, 13 aa, Mycobacterium tuberculosis
RTDRLPFDSPMYW

SEQ ID NO: 129151 - protein, 13 aa, Mycobacterium tuberculosis
TDRLPFDSPMYWH

SEQ ID NO: 129152 - protein, 13 aa, Mycobacterium tuberculosis
DRLPFDSPMYWHL

SEQ ID NO: 129153 - protein, 13 aa, Mycobacterium tuberculosis
RLPFDSPMYWHLF

SEQ ID NO: 129154 - protein, 13 aa, Mycobacterium tuberculosis
LPFDSPMYWHLFE

SEQ ID NO: 129155 - protein, 13 aa, Mycobacterium tuberculosis
PFDSPMYWHLFEP

SEQ ID NO: 129156 - protein, 13 aa, Mycobacterium tuberculosis
FDSPMYWHLFEPA

SEQ ID NO: 129157 - protein, 13 aa, Mycobacterium tuberculosis
DSPMYWHLFEPAL

SEQ ID NO: 129158 - protein, 13 aa, Mycobacterium tuberculosis
SPMYWHLFEPALR

SEQ ID NO: 129159 - protein, 13 aa, Mycobacterium tuberculosis
PMYWHLFEPALRD

SEQ ID NO: 129160 - protein, 13 aa, Mycobacterium tuberculosis
MYWHLFEPALRDA

SEQ ID NO: 129161 - protein, 13 aa, Mycobacterium tuberculosis
YWHLFEPALRDAV

SEQ ID NO: 129162 - protein, 13 aa, Mycobacterium tuberculosis
WHLFEPALRDAVD

SEQ ID NO: 129163 - protein, 13 aa, Mycobacterium tuberculosis
HLFEPALRDAVDK

SEQ ID NO: 129164 - protein, 13 aa, Mycobacterium tuberculosis
LFEPALRDAVDKD

SEQ ID NO: 129165 - protein, 13 aa, Mycobacterium tuberculosis
FEPALRDAVDKDV

SEQ ID NO: 129166 - protein, 13 aa, Mycobacterium tuberculosis
EPALRDAVDKDVA

SEQ ID NO: 129167 - protein, 13 aa, Mycobacterium tuberculosis
PALRDAVDKDVAM

SEQ ID NO: 129168 - protein, 13 aa, Mycobacterium tuberculosis
ALRDAVDKDVAML

SEQ ID NO: 129169 - protein, 13 aa, Mycobacterium tuberculosis
LRDAVDKDVAMLD

SEQ ID NO: 129170 - protein, 13 aa, Mycobacterium tuberculosis
RDAVDKDVAMLDV

SEQ ID NO: 129171 - protein, 13 aa, Mycobacterium tuberculosis
DAVDKDVAMLDVV

SEQ ID NO: 129172 - protein, 13 aa, Mycobacterium tuberculosis
AVDKDVAMLDVVS

SEQ ID NO: 129173 - protein, 13 aa, Mycobacterium tuberculosis
VDKDVAMLDVVSD

SEQ ID NO: 129174 - protein, 13 aa, Mycobacterium tuberculosis
DKDVAMLDVVSDD

SEQ ID NO: 129175 - protein, 13 aa, Mycobacterium tuberculosis
KDVAMLDVVSDDQ

SEQ ID NO: 129176 - protein, 13 aa, Mycobacterium tuberculosis
DVAMLDVVSDDQR

SEQ ID NO: 129177 - protein, 13 aa, Mycobacterium tuberculosis
VAMLDVVSDDQRT

SEQ ID NO: 129178 - protein, 13 aa, Mycobacterium tuberculosis
AMLDVVSDDQRTR

SEQ ID NO: 129179 - protein, 13 aa, Mycobacterium tuberculosis
MLDVVSDDQRTRL

SEQ ID NO: 129180 - protein, 13 aa, Mycobacterium tuberculosis
LDVVSDDQRTRLV

SEQ ID NO: 129181 - protein, 13 aa, Mycobacterium tuberculosis
DVVSDDQRTRLVV

SEQ ID NO: 129182 - protein, 13 aa, Mycobacterium tuberculosis
VVSDDQRTRLVVA

SEQ ID NO: 129183 - protein, 13 aa, Mycobacterium tuberculosis
VSDDQRTRLVVAS

SEQ ID NO: 129184 - protein, 13 aa, Mycobacterium tuberculosis
SDDQRTRLVVASQ

SEQ ID NO: 129185 - protein, 13 aa, Mycobacterium tuberculosis
DDQRTRLVVASQL

SEQ ID NO: 129186 - protein, 13 aa, Mycobacterium tuberculosis
DQRTRLVVASQLS

SEQ ID NO: 129187 - protein, 13 aa, Mycobacterium tuberculosis
QRTRLVVASQLSE

SEQ ID NO: 129188 - protein, 13 aa, Mycobacterium tuberculosis
RTRLVVASQLSEV

SEQ ID NO: 129189 - protein, 13 aa, Mycobacterium tuberculosis
TRLVVASQLSEVL

SEQ ID NO: 129190 - protein, 13 aa, Mycobacterium tuberculosis
RLVVASQLSEVLR

SEQ ID NO: 129191 - protein, 13 aa, Mycobacterium tuberculosis
LVVASQLSEVLRR

SEQ ID NO: 129192 - protein, 13 aa, Mycobacterium tuberculosis
VVASQLSEVLRRD

SEQ ID NO: 129193 - protein, 13 aa, Mycobacterium tuberculosis
VASQLSEVLRRDD

SEQ ID NO: 129194 - protein, 13 aa, Mycobacterium tuberculosis
ASQLSEVLRRDDP

SEQ ID NO: 129195 - protein, 13 aa, Mycobacterium tuberculosis
SQLSEVLRRDDPY

SEQ ID NO: 129196 - protein, 13 aa, Mycobacterium tuberculosis
QLSEVLRRDDPYY

SEQ ID NO: 129197 - protein, 13 aa, Mycobacterium tuberculosis
LSEVLRRDDPYYH

SEQ ID NO: 129198 - protein, 13 aa, Mycobacterium tuberculosis
SEVLRRDDPYYHA

SEQ ID NO: 129199 - protein, 13 aa, Mycobacterium tuberculosis
EVLRRDDPYYHAE

SEQ ID NO: 129200 - protein, 13 aa, Mycobacterium tuberculosis
VLRRDDPYYHAEL

SEQ ID NO: 129201 - protein, 13 aa, Mycobacterium tuberculosis
LRRDDPYYHAELE

SEQ ID NO: 129202 - protein, 13 aa, Mycobacterium tuberculosis
RRDDPYYHAELEW

SEQ ID NO: 129203 - protein, 13 aa, Mycobacterium tuberculosis
RDDPYYHAELEWW

SEQ ID NO: 129204 - protein, 13 aa, Mycobacterium tuberculosis
DDPYYHAELEWWT

SEQ ID NO: 129205 - protein, 13 aa, Mycobacterium tuberculosis
DPYYHAELEWWTS

SEQ ID NO: 129206 - protein, 13 aa, Mycobacterium tuberculosis
PYYHAELEWWTSP

SEQ ID NO: 129207 - protein, 13 aa, Mycobacterium tuberculosis
YYHAELEWWTSPF

SEQ ID NO: 129208 - protein, 13 aa, Mycobacterium tuberculosis
YHAELEWWTSPFV

SEQ ID NO: 129209 - protein, 13 aa, Mycobacterium tuberculosis
HAELEWWTSPFVL

SEQ ID NO: 129210 - protein, 13 aa, Mycobacterium tuberculosis
AELEWWTSPFVLA

SEQ ID NO: 129211 - protein, 13 aa, Mycobacterium tuberculosis
ELEWWTSPFVLAH

SEQ ID NO: 129212 - protein, 13 aa, Mycobacterium tuberculosis
LEWWTSPFVLAHG

SEQ ID NO: 129213 - protein, 13 aa, Mycobacterium tuberculosis
EWWTSPFVLAHGV

SEQ ID NO: 129214 - protein, 13 aa, Mycobacterium tuberculosis
WWTSPFVLAHGVP

SEQ ID NO: 129215 - protein, 13 aa, Mycobacterium tuberculosis
WTSPFVLAHGVPP

SEQ ID NO: 129216 - protein, 13 aa, Mycobacterium tuberculosis
TSPFVLAHGVPPD

SEQ ID NO: 129217 - protein, 13 aa, Mycobacterium tuberculosis
SPFVLAHGVPPDT

SEQ ID NO: 129218 - protein, 13 aa, Mycobacterium tuberculosis
PFVLAHGVPPDTL

SEQ ID NO: 129219 - protein, 13 aa, Mycobacterium tuberculosis
FVLAHGVPPDTLA

SEQ ID NO: 129220 - protein, 13 aa, Mycobacterium tuberculosis
VLAHGVPPDTLAS

SEQ ID NO: 129221 - protein, 13 aa, Mycobacterium tuberculosis
LAHGVPPDTLASD

SEQ ID NO: 129222 - protein, 13 aa, Mycobacterium tuberculosis
AHGVPPDTLASDA

SEQ ID NO: 129223 - protein, 13 aa, Mycobacterium tuberculosis
HGVPPDTLASDAE

SEQ ID NO: 129224 - protein, 13 aa, Mycobacterium tuberculosis
GVPPDTLASDAER

SEQ ID NO: 129225 - protein, 13 aa, Mycobacterium tuberculosis
VPPDTLASDAERL

SEQ ID NO: 129226 - protein, 13 aa, Mycobacterium tuberculosis
PPDTLASDAERLR

SEQ ID NO: 129227 - protein, 13 aa, Mycobacterium tuberculosis
PDTLASDAERLRV

SEQ ID NO: 129228 - protein, 13 aa, Mycobacterium tuberculosis
DTLASDAERLRVD

SEQ ID NO: 129229 - protein, 13 aa, Mycobacterium tuberculosis
TLASDAERLRVDL

SEQ ID NO: 129230 - protein, 13 aa, Mycobacterium tuberculosis
LASDAERLRVDLG

SEQ ID NO: 129231 - protein, 13 aa, Mycobacterium tuberculosis
ASDAERLRVDLGR

SEQ ID NO: 129232 - protein, 13 aa, Mycobacterium tuberculosis
SDAERLRVDLGRD

SEQ ID NO: 129233 - protein, 13 aa, Mycobacterium tuberculosis
DAERLRVDLGRDF

SEQ ID NO: 129234 - protein, 13 aa, Mycobacterium tuberculosis
AERLRVDLGRDFP

SEQ ID NO: 129235 - protein, 13 aa, Mycobacterium tuberculosis
ERLRVDLGRDFPV

SEQ ID NO: 129236 - protein, 13 aa, Mycobacterium tuberculosis
RLRVDLGRDFPVR

SEQ ID NO: 129237 - protein, 13 aa, Mycobacterium tuberculosis
LRVDLGRDFPVRS

SEQ ID NO: 129238 - protein, 13 aa, Mycobacterium tuberculosis
RVDLGRDFPVRSY

SEQ ID NO: 129239 - protein, 13 aa, Mycobacterium tuberculosis
VDLGRDFPVRSYQ

SEQ ID NO: 129240 - protein, 13 aa, Mycobacterium tuberculosis
DLGRDFPVRSYQN

SEQ ID NO: 129241 - protein, 13 aa, Mycobacterium tuberculosis
LGRDFPVRSYQNR

SEQ ID NO: 129242 - protein, 13 aa, Mycobacterium tuberculosis
GRDFPVRSYQNRR

SEQ ID NO: 129243 - protein, 13 aa, Mycobacterium tuberculosis
RDFPVRSYQNRRA

SEQ ID NO: 129244 - protein, 13 aa, Mycobacterium tuberculosis
DFPVRSYQNRRAE

SEQ ID NO: 129245 - protein, 13 aa, Mycobacterium tuberculosis
FPVRSYQNRRAEL

SEQ ID NO: 129246 - protein, 13 aa, Mycobacterium tuberculosis
PVRSYQNRRAELA

SEQ ID NO: 129247 - protein, 13 aa, Mycobacterium tuberculosis
VRSYQNRRAELAD

SEQ ID NO: 129248 - protein, 13 aa, Mycobacterium tuberculosis
RSYQNRRAELADD

SEQ ID NO: 129249 - protein, 13 aa, Mycobacterium tuberculosis
SYQNRRAELADDR

SEQ ID NO: 129250 - protein, 13 aa, Mycobacterium tuberculosis
YQNRRAELADDRS

SEQ ID NO: 129251 - protein, 13 aa, Mycobacterium tuberculosis
QNRRAELADDRSK

SEQ ID NO: 129252 - protein, 13 aa, Mycobacterium tuberculosis
NRRAELADDRSKV

SEQ ID NO: 129253 - protein, 13 aa, Mycobacterium tuberculosis
RRAELADDRSKVL

SEQ ID NO: 129254 - protein, 13 aa, Mycobacterium tuberculosis
RAELADDRSKVLV

SEQ ID NO: 129255 - protein, 13 aa, Mycobacterium tuberculosis
AELADDRSKVLVL

SEQ ID NO: 129256 - protein, 13 aa, Mycobacterium tuberculosis
ELADDRSKVLVLS

SEQ ID NO: 129257 - protein, 13 aa, Mycobacterium tuberculosis
LADDRSKVLVLST

SEQ ID NO: 129258 - protein, 13 aa, Mycobacterium tuberculosis
ADDRSKVLVLSTP

SEQ ID NO: 129259 - protein, 13 aa, Mycobacterium tuberculosis
DDRSKVLVLSTPS

SEQ ID NO: 129260 - protein, 13 aa, Mycobacterium tuberculosis
DRSKVLVLSTPSD

SEQ ID NO: 129261 - protein, 13 aa, Mycobacterium tuberculosis
RSKVLVLSTPSDT

SEQ ID NO: 129262 - protein, 13 aa, Mycobacterium tuberculosis
SKVLVLSTPSDTR

SEQ ID NO: 129263 - protein, 13 aa, Mycobacterium tuberculosis
KVLVLSTPSDTRA

SEQ ID NO: 129264 - protein, 13 aa, Mycobacterium tuberculosis
VLVLSTPSDTRAD

SEQ ID NO: 129265 - protein, 13 aa, Mycobacterium tuberculosis
LVLSTPSDTRADA

SEQ ID NO: 129266 - protein, 13 aa, Mycobacterium tuberculosis
VLSTPSDTRADAL

SEQ ID NO: 129267 - protein, 13 aa, Mycobacterium tuberculosis
LSTPSDTRADALR

SEQ ID NO: 129268 - protein, 13 aa, Mycobacterium tuberculosis
STPSDTRADALRC

SEQ ID NO: 129269 - protein, 13 aa, Mycobacterium tuberculosis
TPSDTRADALRCG

SEQ ID NO: 129270 - protein, 13 aa, Mycobacterium tuberculosis
PSDTRADALRCGE

SEQ ID NO: 129271 - protein, 13 aa, Mycobacterium tuberculosis
SDTRADALRCGEV

SEQ ID NO: 129272 - protein, 13 aa, Mycobacterium tuberculosis
DTRADALRCGEVL

SEQ ID NO: 129273 - protein, 13 aa, Mycobacterium tuberculosis
TRADALRCGEVLS

SEQ ID NO: 129274 - protein, 13 aa, Mycobacterium tuberculosis
RADALRCGEVLST

SEQ ID NO: 129275 - protein, 13 aa, Mycobacterium tuberculosis
ADALRCGEVLSTI

SEQ ID NO: 129276 - protein, 13 aa, Mycobacterium tuberculosis
DALRCGEVLSTIL

SEQ ID NO: 129277 - protein, 13 aa, Mycobacterium tuberculosis
ALRCGEVLSTILL

SEQ ID NO: 129278 - protein, 13 aa, Mycobacterium tuberculosis
LRCGEVLSTILLE

SEQ ID NO: 129279 - protein, 13 aa, Mycobacterium tuberculosis
RCGEVLSTILLEC

SEQ ID NO: 129280 - protein, 13 aa, Mycobacterium tuberculosis
CGEVLSTILLECT

SEQ ID NO: 129281 - protein, 13 aa, Mycobacterium tuberculosis
GEVLSTILLECTM

SEQ ID NO: 129282 - protein, 13 aa, Mycobacterium tuberculosis
EVLSTILLECTMA

SEQ ID NO: 129283 - protein, 13 aa, Mycobacterium tuberculosis
VLSTILLECTMAG

SEQ ID NO: 129284 - protein, 13 aa, Mycobacterium tuberculosis
LSTILLECTMAGM

SEQ ID NO: 129285 - protein, 13 aa, Mycobacterium tuberculosis
STILLECTMAGMA

SEQ ID NO: 129286 - protein, 13 aa, Mycobacterium tuberculosis
TILLECTMAGMAT

SEQ ID NO: 129287 - protein, 13 aa, Mycobacterium tuberculosis
ILLECTMAGMATC

SEQ ID NO: 129288 - protein, 13 aa, Mycobacterium tuberculosis
LLECTMAGMATCT

SEQ ID NO: 129289 - protein, 13 aa, Mycobacterium tuberculosis
LECTMAGMATCTL

SEQ ID NO: 129290 - protein, 13 aa, Mycobacterium tuberculosis
ECTMAGMATCTLT

SEQ ID NO: 129291 - protein, 13 aa, Mycobacterium tuberculosis
CTMAGMATCTLTH

SEQ ID NO: 129292 - protein, 13 aa, Mycobacterium tuberculosis
TMAGMATCTLTHL

SEQ ID NO: 129293 - protein, 13 aa, Mycobacterium tuberculosis
MAGMATCTLTHLI

SEQ ID NO: 129294 - protein, 13 aa, Mycobacterium tuberculosis
AGMATCTLTHLIE

SEQ ID NO: 129295 - protein, 13 aa, Mycobacterium tuberculosis
GMATCTLTHLIES

SEQ ID NO: 129296 - protein, 13 aa, Mycobacterium tuberculosis
MATCTLTHLIESS

SEQ ID NO: 129297 - protein, 13 aa, Mycobacterium tuberculosis
ATCTLTHLIESSD

SEQ ID NO: 129298 - protein, 13 aa, Mycobacterium tuberculosis
TCTLTHLIESSDS

SEQ ID NO: 129299 - protein, 13 aa, Mycobacterium tuberculosis
CTLTHLIESSDSR

SEQ ID NO: 129300 - protein, 13 aa, Mycobacterium tuberculosis
TLTHLIESSDSRD

SEQ ID NO: 129301 - protein, 13 aa, Mycobacterium tuberculosis
LTHLIESSDSRDI

SEQ ID NO: 129302 - protein, 13 aa, Mycobacterium tuberculosis
THLIESSDSRDIV

SEQ ID NO: 129303 - protein, 13 aa, Mycobacterium tuberculosis
HLIESSDSRDIVR

SEQ ID NO: 129304 - protein, 13 aa, Mycobacterium tuberculosis
LIESSDSRDIVRG

SEQ ID NO: 129305 - protein, 13 aa, Mycobacterium tuberculosis
IESSDSRDIVRGL

SEQ ID NO: 129306 - protein, 13 aa, Mycobacterium tuberculosis
ESSDSRDIVRGLT

SEQ ID NO: 129307 - protein, 13 aa, Mycobacterium tuberculosis
SSDSRDIVRGLTR

SEQ ID NO: 129308 - protein, 13 aa, Mycobacterium tuberculosis
SDSRDIVRGLTRQ

SEQ ID NO: 129309 - protein, 13 aa, Mycobacterium tuberculosis
DSRDIVRGLTRQR

SEQ ID NO: 129310 - protein, 13 aa, Mycobacterium tuberculosis
SRDIVRGLTRQRG

SEQ ID NO: 129311 - protein, 13 aa, Mycobacterium tuberculosis
RDIVRGLTRQRGE

SEQ ID NO: 129312 - protein, 13 aa, Mycobacterium tuberculosis
DIVRGLTRQRGEP

SEQ ID NO: 129313 - protein, 13 aa, Mycobacterium tuberculosis
IVRGLTRQRGEPQ

SEQ ID NO: 129314 - protein, 13 aa, Mycobacterium tuberculosis
VRGLTRQRGEPQA

SEQ ID NO: 129315 - protein, 13 aa, Mycobacterium tuberculosis
RGLTRQRGEPQAL

SEQ ID NO: 129316 - protein, 13 aa, Mycobacterium tuberculosis
GLTRQRGEPQALI

SEQ ID NO: 129317 - protein, 13 aa, Mycobacterium tuberculosis
LTRQRGEPQALIR

SEQ ID NO: 129318 - protein, 13 aa, Mycobacterium tuberculosis
TRQRGEPQALIRV

SEQ ID NO: 129319 - protein, 13 aa, Mycobacterium tuberculosis
RQRGEPQALIRVG

SEQ ID NO: 129320 - protein, 13 aa, Mycobacterium tuberculosis
QRGEPQALIRVGI

SEQ ID NO: 129321 - protein, 13 aa, Mycobacterium tuberculosis
RGEPQALIRVGIA

SEQ ID NO: 129322 - protein, 13 aa, Mycobacterium tuberculosis
GEPQALIRVGIAP

SEQ ID NO: 129323 - protein, 13 aa, Mycobacterium tuberculosis
EPQALIRVGIAPP

SEQ ID NO: 129324 - protein, 13 aa, Mycobacterium tuberculosis
PQALIRVGIAPPL

SEQ ID NO: 129325 - protein, 13 aa, Mycobacterium tuberculosis
QALIRVGIAPPLA

SEQ ID NO: 129326 - protein, 13 aa, Mycobacterium tuberculosis
ALIRVGIAPPLAA

SEQ ID NO: 129327 - protein, 13 aa, Mycobacterium tuberculosis
LIRVGIAPPLAAV

SEQ ID NO: 129328 - protein, 13 aa, Mycobacterium tuberculosis
IRVGIAPPLAAVP

SEQ ID NO: 129329 - protein, 13 aa, Mycobacterium tuberculosis
RVGIAPPLAAVPA

SEQ ID NO: 129330 - protein, 13 aa, Mycobacterium tuberculosis
VGIAPPLAAVPAP

SEQ ID NO: 129331 - protein, 13 aa, Mycobacterium tuberculosis
GIAPPLAAVPAPT

SEQ ID NO: 129332 - protein, 13 aa, Mycobacterium tuberculosis
IAPPLAAVPAPTP

SEQ ID NO: 129333 - protein, 13 aa, Mycobacterium tuberculosis
APPLAAVPAPTPR

SEQ ID NO: 129334 - protein, 13 aa, Mycobacterium tuberculosis
PPLAAVPAPTPRR

SEQ ID NO: 129335 - protein, 13 aa, Mycobacterium tuberculosis
PLAAVPAPTPRRP

SEQ ID NO: 129336 - protein, 13 aa, Mycobacterium tuberculosis
LAAVPAPTPRRPL

SEQ ID NO: 129337 - protein, 13 aa, Mycobacterium tuberculosis
AAVPAPTPRRPLD

SEQ ID NO: 129338 - protein, 13 aa, Mycobacterium tuberculosis
AVPAPTPRRPLDS

SEQ ID NO: 129339 - protein, 13 aa, Mycobacterium tuberculosis
VPAPTPRRPLDSV

SEQ ID NO: 129340 - protein, 13 aa, Mycobacterium tuberculosis
PAPTPRRPLDSVL

SEQ ID NO: 129341 - protein, 13 aa, Mycobacterium tuberculosis
APTPRRPLDSVLQ

SEQ ID NO: 129342 - protein, 13 aa, Mycobacterium tuberculosis
PTPRRPLDSVLQI

SEQ ID NO: 129343 - protein, 13 aa, Mycobacterium tuberculosis
TPRRPLDSVLQIR

SEQ ID NO: 129344 - protein, 13 aa, Mycobacterium tuberculosis
PRRPLDSVLQIRQ

SEQ ID NO: 129345 - protein, 13 aa, Mycobacterium tuberculosis
RRPLDSVLQIRQT

SEQ ID NO: 129346 - protein, 13 aa, Mycobacterium tuberculosis
RPLDSVLQIRQTP

SEQ ID NO: 129347 - protein, 13 aa, Mycobacterium tuberculosis
PLDSVLQIRQTPE

SEQ ID NO: 129348 - protein, 13 aa, Mycobacterium tuberculosis
LDSVLQIRQTPEK

SEQ ID NO: 129349 - protein, 13 aa, Mycobacterium tuberculosis
DSVLQIRQTPEKG

SEQ ID NO: 129350 - protein, 13 aa, Mycobacterium tuberculosis
SVLQIRQTPEKGR

SEQ ID NO: 129351 - protein, 13 aa, Mycobacterium tuberculosis
VLQIRQTPEKGRN

SEQ ID NO: 129352 - protein, 13 aa, Mycobacterium tuberculosis
LQIRQTPEKGRNA

SEQ ID NO: 129353 - protein, 13 aa, Mycobacterium tuberculosis
QIRQTPEKGRNAS

SEQ ID NO: 129354 - protein, 13 aa, Mycobacterium tuberculosis
IRQTPEKGRNASD

SEQ ID NO: 129355 - protein, 13 aa, Mycobacterium tuberculosis
RQTPEKGRNASDR

SEQ ID NO: 129356 - protein, 13 aa, Mycobacterium tuberculosis
QTPEKGRNASDRN

SEQ ID NO: 129357 - protein, 13 aa, Mycobacterium tuberculosis
TPEKGRNASDRNA

SEQ ID NO: 129358 - protein, 13 aa, Mycobacterium tuberculosis
PEKGRNASDRNAR

SEQ ID NO: 129359 - protein, 13 aa, Mycobacterium tuberculosis
EKGRNASDRNARE

SEQ ID NO: 129360 - protein, 13 aa, Mycobacterium tuberculosis
KGRNASDRNARET

SEQ ID NO: 129361 - protein, 13 aa, Mycobacterium tuberculosis
GRNASDRNARETG

SEQ ID NO: 129362 - protein, 13 aa, Mycobacterium tuberculosis
RNASDRNARETGW

SEQ ID NO: 129363 - protein, 13 aa, Mycobacterium tuberculosis
NASDRNARETGWF

SEQ ID NO: 129364 - protein, 13 aa, Mycobacterium tuberculosis
ASDRNARETGWFS

SEQ ID NO: 129365 - protein, 13 aa, Mycobacterium tuberculosis
SDRNARETGWFSP

SEQ ID NO: 129366 - protein, 13 aa, Mycobacterium tuberculosis
DRNARETGWFSPP

SEQ ID NO: 129367 - protein, 14 aa, Mycobacterium tuberculosis
MLKNAVLLACRAPS

SEQ ID NO: 129368 - protein, 14 aa, Mycobacterium tuberculosis
LKNAVLLACRAPSV

SEQ ID NO: 129369 - protein, 14 aa, Mycobacterium tuberculosis
KNAVLLACRAPSVH

SEQ ID NO: 129370 - protein, 14 aa, Mycobacterium tuberculosis
NAVLLACRAPSVHN

SEQ ID NO: 129371 - protein, 14 aa, Mycobacterium tuberculosis
AVLLACRAPSVHNS

SEQ ID NO: 129372 - protein, 14 aa, Mycobacterium tuberculosis
VLLACRAPSVHNSQ

SEQ ID NO: 129373 - protein, 14 aa, Mycobacterium tuberculosis
LLACRAPSVHNSQP

SEQ ID NO: 129374 - protein, 14 aa, Mycobacterium tuberculosis
LACRAPSVHNSQPW

SEQ ID NO: 129375 - protein, 14 aa, Mycobacterium tuberculosis
ACRAPSVHNSQPWR

SEQ ID NO: 129376 - protein, 14 aa, Mycobacterium tuberculosis
CRAPSVHNSQPWRW

SEQ ID NO: 129377 - protein, 14 aa, Mycobacterium tuberculosis
RAPSVHNSQPWRWV

SEQ ID NO: 129378 - protein, 14 aa, Mycobacterium tuberculosis
APSVHNSQPWRWVA

SEQ ID NO: 129379 - protein, 14 aa, Mycobacterium tuberculosis
PSVHNSQPWRWVAE

SEQ ID NO: 129380 - protein, 14 aa, Mycobacterium tuberculosis
SVHNSQPWRWVAES

SEQ ID NO: 129381 - protein, 14 aa, Mycobacterium tuberculosis
VHNSQPWRWVAESG

SEQ ID NO: 129382 - protein, 14 aa, Mycobacterium tuberculosis
HNSQPWRWVAESGS

SEQ ID NO: 129383 - protein, 14 aa, Mycobacterium tuberculosis
NSQPWRWVAESGSE

SEQ ID NO: 129384 - protein, 14 aa, Mycobacterium tuberculosis
SQPWRWVAESGSEH

SEQ ID NO: 129385 - protein, 14 aa, Mycobacterium tuberculosis
QPWRWVAESGSEHT

SEQ ID NO: 129386 - protein, 14 aa, Mycobacterium tuberculosis
PWRWVAESGSEHTT

SEQ ID NO: 129387 - protein, 14 aa, Mycobacterium tuberculosis
WRWVAESGSEHTTV

SEQ ID NO: 129388 - protein, 14 aa, Mycobacterium tuberculosis
RWVAESGSEHTTVH

SEQ ID NO: 129389 - protein, 14 aa, Mycobacterium tuberculosis
WVAESGSEHTTVHL

SEQ ID NO: 129390 - protein, 14 aa, Mycobacterium tuberculosis
VAESGSEHTTVHLF

SEQ ID NO: 129391 - protein, 14 aa, Mycobacterium tuberculosis
AESGSEHTTVHLFV

SEQ ID NO: 129392 - protein, 14 aa, Mycobacterium tuberculosis
ESGSEHTTVHLFVN

SEQ ID NO: 129393 - protein, 14 aa, Mycobacterium tuberculosis
SGSEHTTVHLFVNR

SEQ ID NO: 129394 - protein, 14 aa, Mycobacterium tuberculosis
GSEHTTVHLFVNRH

SEQ ID NO: 129395 - protein, 14 aa, Mycobacterium tuberculosis
SEHTTVHLFVNRHR

SEQ ID NO: 129396 - protein, 14 aa, Mycobacterium tuberculosis
EHTTVHLFVNRHRT

SEQ ID NO: 129397 - protein, 14 aa, Mycobacterium tuberculosis
HTTVHLFVNRHRTV

SEQ ID NO: 129398 - protein, 14 aa, Mycobacterium tuberculosis
TTVHLFVNRHRTVP

SEQ ID NO: 129399 - protein, 14 aa, Mycobacterium tuberculosis
TVHLFVNRHRTVPA

SEQ ID NO: 129400 - protein, 14 aa, Mycobacterium tuberculosis
VHLFVNRHRTVPAT

SEQ ID NO: 129401 - protein, 14 aa, Mycobacterium tuberculosis
HLFVNRHRTVPATD

SEQ ID NO: 129402 - protein, 14 aa, Mycobacterium tuberculosis
LFVNRHRTVPATDH

SEQ ID NO: 129403 - protein, 14 aa, Mycobacterium tuberculosis
FVNRHRTVPATDHS

SEQ ID NO: 129404 - protein, 14 aa, Mycobacterium tuberculosis
VNRHRTVPATDHSG

SEQ ID NO: 129405 - protein, 14 aa, Mycobacterium tuberculosis
NRHRTVPATDHSGR

SEQ ID NO: 129406 - protein, 14 aa, Mycobacterium tuberculosis
RHRTVPATDHSGRQ

SEQ ID NO: 129407 - protein, 14 aa, Mycobacterium tuberculosis
HRTVPATDHSGRQA

SEQ ID NO: 129408 - protein, 14 aa, Mycobacterium tuberculosis
RTVPATDHSGRQAI

SEQ ID NO: 129409 - protein, 14 aa, Mycobacterium tuberculosis
TVPATDHSGRQAII

SEQ ID NO: 129410 - protein, 14 aa, Mycobacterium tuberculosis
VPATDHSGRQAIIS

SEQ ID NO: 129411 - protein, 14 aa, Mycobacterium tuberculosis
PATDHSGRQAIISC

SEQ ID NO: 129412 - protein, 14 aa, Mycobacterium tuberculosis
ATDHSGRQAIISCG

SEQ ID NO: 129413 - protein, 14 aa, Mycobacterium tuberculosis
TDHSGRQAIISCGA

SEQ ID NO: 129414 - protein, 14 aa, Mycobacterium tuberculosis
DHSGRQAIISCGAV

SEQ ID NO: 129415 - protein, 14 aa, Mycobacterium tuberculosis
HSGRQAIISCGAVL

SEQ ID NO: 129416 - protein, 14 aa, Mycobacterium tuberculosis
SGRQAIISCGAVLD

SEQ ID NO: 129417 - protein, 14 aa, Mycobacterium tuberculosis
GRQAIISCGAVLDH

SEQ ID NO: 129418 - protein, 14 aa, Mycobacterium tuberculosis
RQAIISCGAVLDHL

SEQ ID NO: 129419 - protein, 14 aa, Mycobacterium tuberculosis
QAIISCGAVLDHLR

SEQ ID NO: 129420 - protein, 14 aa, Mycobacterium tuberculosis
AIISCGAVLDHLRI

SEQ ID NO: 129421 - protein, 14 aa, Mycobacterium tuberculosis
IISCGAVLDHLRIA

SEQ ID NO: 129422 - protein, 14 aa, Mycobacterium tuberculosis
ISCGAVLDHLRIAM

SEQ ID NO: 129423 - protein, 14 aa, Mycobacterium tuberculosis
SCGAVLDHLRIAMT

SEQ ID NO: 129424 - protein, 14 aa, Mycobacterium tuberculosis
CGAVLDHLRIAMTA

SEQ ID NO: 129425 - protein, 14 aa, Mycobacterium tuberculosis
GAVLDHLRIAMTAA

SEQ ID NO: 129426 - protein, 14 aa, Mycobacterium tuberculosis
AVLDHLRIAMTAAH

SEQ ID NO: 129427 - protein, 14 aa, Mycobacterium tuberculosis
VLDHLRIAMTAAHW

SEQ ID NO: 129428 - protein, 14 aa, Mycobacterium tuberculosis
LDHLRIAMTAAHWQ

SEQ ID NO: 129429 - protein, 14 aa, Mycobacterium tuberculosis
DHLRIAMTAAHWQA

SEQ ID NO: 129430 - protein, 14 aa, Mycobacterium tuberculosis
HLRIAMTAAHWQAN

SEQ ID NO: 129431 - protein, 14 aa, Mycobacterium tuberculosis
LRIAMTAAHWQANI

SEQ ID NO: 129432 - protein, 14 aa, Mycobacterium tuberculosis
RIAMTAAHWQANIT

SEQ ID NO: 129433 - protein, 14 aa, Mycobacterium tuberculosis
IAMTAAHWQANITR

SEQ ID NO: 129434 - protein, 14 aa, Mycobacterium tuberculosis
AMTAAHWQANITRF

SEQ ID NO: 129435 - protein, 14 aa, Mycobacterium tuberculosis
MTAAHWQANITRFP

SEQ ID NO: 129436 - protein, 14 aa, Mycobacterium tuberculosis
TAAHWQANITRFPQ

SEQ ID NO: 129437 - protein, 14 aa, Mycobacterium tuberculosis
AAHWQANITRFPQP

SEQ ID NO: 129438 - protein, 14 aa, Mycobacterium tuberculosis
AHWQANITRFPQPN

SEQ ID NO: 129439 - protein, 14 aa, Mycobacterium tuberculosis
HWQANITRFPQPNQ

SEQ ID NO: 129440 - protein, 14 aa, Mycobacterium tuberculosis
WQANITRFPQPNQP

SEQ ID NO: 129441 - protein, 14 aa, Mycobacterium tuberculosis
QANITRFPQPNQPD

SEQ ID NO: 129442 - protein, 14 aa, Mycobacterium tuberculosis
ANITRFPQPNQPDQ

SEQ ID NO: 129443 - protein, 14 aa, Mycobacterium tuberculosis
NITRFPQPNQPDQL

SEQ ID NO: 129444 - protein, 14 aa, Mycobacterium tuberculosis
ITRFPQPNQPDQLA

SEQ ID NO: 129445 - protein, 14 aa, Mycobacterium tuberculosis
TRFPQPNQPDQLAT

SEQ ID NO: 129446 - protein, 14 aa, Mycobacterium tuberculosis
RFPQPNQPDQLATV

SEQ ID NO: 129447 - protein, 14 aa, Mycobacterium tuberculosis
FPQPNQPDQLATVE

SEQ ID NO: 129448 - protein, 14 aa, Mycobacterium tuberculosis
PQPNQPDQLATVEF

SEQ ID NO: 129449 - protein, 14 aa, Mycobacterium tuberculosis
QPNQPDQLATVEFS

SEQ ID NO: 129450 - protein, 14 aa, Mycobacterium tuberculosis
PNQPDQLATVEFSP

SEQ ID NO: 129451 - protein, 14 aa, Mycobacterium tuberculosis
NQPDQLATVEFSPI

SEQ ID NO: 129452 - protein, 14 aa, Mycobacterium tuberculosis
QPDQLATVEFSPID

SEQ ID NO: 129453 - protein, 14 aa, Mycobacterium tuberculosis
PDQLATVEFSPIDH

SEQ ID NO: 129454 - protein, 14 aa, Mycobacterium tuberculosis
DQLATVEFSPIDHV

SEQ ID NO: 129455 - protein, 14 aa, Mycobacterium tuberculosis
QLATVEFSPIDHVT

SEQ ID NO: 129456 - protein, 14 aa, Mycobacterium tuberculosis
LATVEFSPIDHVTA

SEQ ID NO: 129457 - protein, 14 aa, Mycobacterium tuberculosis
ATVEFSPIDHVTAG

SEQ ID NO: 129458 - protein, 14 aa, Mycobacterium tuberculosis
TVEFSPIDHVTAGQ

SEQ ID NO: 129459 - protein, 14 aa, Mycobacterium tuberculosis
VEFSPIDHVTAGQR

SEQ ID NO: 129460 - protein, 14 aa, Mycobacterium tuberculosis
EFSPIDHVTAGQRN

SEQ ID NO: 129461 - protein, 14 aa, Mycobacterium tuberculosis
FSPIDHVTAGQRNR

SEQ ID NO: 129462 - protein, 14 aa, Mycobacterium tuberculosis
SPIDHVTAGQRNRA

SEQ ID NO: 129463 - protein, 14 aa, Mycobacterium tuberculosis
PIDHVTAGQRNRAQ

SEQ ID NO: 129464 - protein, 14 aa, Mycobacterium tuberculosis
IDHVTAGQRNRAQA

SEQ ID NO: 129465 - protein, 14 aa, Mycobacterium tuberculosis
DHVTAGQRNRAQAI

SEQ ID NO: 129466 - protein, 14 aa, Mycobacterium tuberculosis
HVTAGQRNRAQAIL

SEQ ID NO: 129467 - protein, 14 aa, Mycobacterium tuberculosis
VTAGQRNRAQAILQ

SEQ ID NO: 129468 - protein, 14 aa, Mycobacterium tuberculosis
TAGQRNRAQAILQR

SEQ ID NO: 129469 - protein, 14 aa, Mycobacterium tuberculosis
AGQRNRAQAILQRR

SEQ ID NO: 129470 - protein, 14 aa, Mycobacterium tuberculosis
GQRNRAQAILQRRT

SEQ ID NO: 129471 - protein, 14 aa, Mycobacterium tuberculosis
QRNRAQAILQRRTD

SEQ ID NO: 129472 - protein, 14 aa, Mycobacterium tuberculosis
RNRAQAILQRRTDR

SEQ ID NO: 129473 - protein, 14 aa, Mycobacterium tuberculosis
NRAQAILQRRTDRL

SEQ ID NO: 129474 - protein, 14 aa, Mycobacterium tuberculosis
RAQAILQRRTDRLP

SEQ ID NO: 129475 - protein, 14 aa, Mycobacterium tuberculosis
AQAILQRRTDRLPF

SEQ ID NO: 129476 - protein, 14 aa, Mycobacterium tuberculosis
QAILQRRTDRLPFD

SEQ ID NO: 129477 - protein, 14 aa, Mycobacterium tuberculosis
AILQRRTDRLPFDS

SEQ ID NO: 129478 - protein, 14 aa, Mycobacterium tuberculosis
ILQRRTDRLPFDSP

SEQ ID NO: 129479 - protein, 14 aa, Mycobacterium tuberculosis
LQRRTDRLPFDSPM

SEQ ID NO: 129480 - protein, 14 aa, Mycobacterium tuberculosis
QRRTDRLPFDSPMY

SEQ ID NO: 129481 - protein, 14 aa, Mycobacterium tuberculosis
RRTDRLPFDSPMYW

SEQ ID NO: 129482 - protein, 14 aa, Mycobacterium tuberculosis
RTDRLPFDSPMYWH

SEQ ID NO: 129483 - protein, 14 aa, Mycobacterium tuberculosis
TDRLPFDSPMYWHL

SEQ ID NO: 129484 - protein, 14 aa, Mycobacterium tuberculosis
DRLPFDSPMYWHLF

SEQ ID NO: 129485 - protein, 14 aa, Mycobacterium tuberculosis
RLPFDSPMYWHLFE

SEQ ID NO: 129486 - protein, 14 aa, Mycobacterium tuberculosis
LPFDSPMYWHLFEP

SEQ ID NO: 129487 - protein, 14 aa, Mycobacterium tuberculosis
PFDSPMYWHLFEPA

SEQ ID NO: 129488 - protein, 14 aa, Mycobacterium tuberculosis
FDSPMYWHLFEPAL

SEQ ID NO: 129489 - protein, 14 aa, Mycobacterium tuberculosis
DSPMYWHLFEPALR

SEQ ID NO: 129490 - protein, 14 aa, Mycobacterium tuberculosis
SPMYWHLFEPALRD

SEQ ID NO: 129491 - protein, 14 aa, Mycobacterium tuberculosis
PMYWHLFEPALRDA

SEQ ID NO: 129492 - protein, 14 aa, Mycobacterium tuberculosis
MYWHLFEPALRDAV

SEQ ID NO: 129493 - protein, 14 aa, Mycobacterium tuberculosis
YWHLFEPALRDAVD

SEQ ID NO: 129494 - protein, 14 aa, Mycobacterium tuberculosis
WHLFEPALRDAVDK

SEQ ID NO: 129495 - protein, 14 aa, Mycobacterium tuberculosis
HLFEPALRDAVDKD

SEQ ID NO: 129496 - protein, 14 aa, Mycobacterium tuberculosis
LFEPALRDAVDKDV

SEQ ID NO: 129497 - protein, 14 aa, Mycobacterium tuberculosis
FEPALRDAVDKDVA

SEQ ID NO: 129498 - protein, 14 aa, Mycobacterium tuberculosis
EPALRDAVDKDVAM

SEQ ID NO: 129499 - protein, 14 aa, Mycobacterium tuberculosis
PALRDAVDKDVAML

SEQ ID NO: 129500 - protein, 14 aa, Mycobacterium tuberculosis
ALRDAVDKDVAMLD

SEQ ID NO: 129501 - protein, 14 aa, Mycobacterium tuberculosis
LRDAVDKDVAMLDV

SEQ ID NO: 129502 - protein, 14 aa, Mycobacterium tuberculosis
RDAVDKDVAMLDVV

SEQ ID NO: 129503 - protein, 14 aa, Mycobacterium tuberculosis
DAVDKDVAMLDVVS

SEQ ID NO: 129504 - protein, 14 aa, Mycobacterium tuberculosis
AVDKDVAMLDVVSD

SEQ ID NO: 129505 - protein, 14 aa, Mycobacterium tuberculosis
VDKDVAMLDVVSDD

SEQ ID NO: 129506 - protein, 14 aa, Mycobacterium tuberculosis
DKDVAMLDVVSDDQ

SEQ ID NO: 129507 - protein, 14 aa, Mycobacterium tuberculosis
KDVAMLDVVSDDQR

SEQ ID NO: 129508 - protein, 14 aa, Mycobacterium tuberculosis
DVAMLDVVSDDQRT

SEQ ID NO: 129509 - protein, 14 aa, Mycobacterium tuberculosis
VAMLDVVSDDQRTR

SEQ ID NO: 129510 - protein, 14 aa, Mycobacterium tuberculosis
AMLDVVSDDQRTRL

SEQ ID NO: 129511 - protein, 14 aa, Mycobacterium tuberculosis
MLDVVSDDQRTRLV

SEQ ID NO: 129512 - protein, 14 aa, Mycobacterium tuberculosis
LDVVSDDQRTRLVV

SEQ ID NO: 129513 - protein, 14 aa, Mycobacterium tuberculosis
DVVSDDQRTRLVVA

SEQ ID NO: 129514 - protein, 14 aa, Mycobacterium tuberculosis
VVSDDQRTRLVVAS

SEQ ID NO: 129515 - protein, 14 aa, Mycobacterium tuberculosis
VSDDQRTRLVVASQ

SEQ ID NO: 129516 - protein, 14 aa, Mycobacterium tuberculosis
SDDQRTRLVVASQL

SEQ ID NO: 129517 - protein, 14 aa, Mycobacterium tuberculosis
DDQRTRLVVASQLS

SEQ ID NO: 129518 - protein, 14 aa, Mycobacterium tuberculosis
DQRTRLVVASQLSE

SEQ ID NO: 129519 - protein, 14 aa, Mycobacterium tuberculosis
QRTRLVVASQLSEV

SEQ ID NO: 129520 - protein, 14 aa, Mycobacterium tuberculosis
RTRLVVASQLSEVL

SEQ ID NO: 129521 - protein, 14 aa, Mycobacterium tuberculosis
TRLVVASQLSEVLR

SEQ ID NO: 129522 - protein, 14 aa, Mycobacterium tuberculosis
RLVVASQLSEVLRR

SEQ ID NO: 129523 - protein, 14 aa, Mycobacterium tuberculosis
LVVASQLSEVLRRD

SEQ ID NO: 129524 - protein, 14 aa, Mycobacterium tuberculosis
VVASQLSEVLRRDD

SEQ ID NO: 129525 - protein, 14 aa, Mycobacterium tuberculosis
VASQLSEVLRRDDP

SEQ ID NO: 129526 - protein, 14 aa, Mycobacterium tuberculosis
ASQLSEVLRRDDPY

SEQ ID NO: 129527 - protein, 14 aa, Mycobacterium tuberculosis
SQLSEVLRRDDPYY

SEQ ID NO: 129528 - protein, 14 aa, Mycobacterium tuberculosis
QLSEVLRRDDPYYH

SEQ ID NO: 129529 - protein, 14 aa, Mycobacterium tuberculosis
LSEVLRRDDPYYHA

SEQ ID NO: 129530 - protein, 14 aa, Mycobacterium tuberculosis
SEVLRRDDPYYHAE

SEQ ID NO: 129531 - protein, 14 aa, Mycobacterium tuberculosis
EVLRRDDPYYHAEL

SEQ ID NO: 129532 - protein, 14 aa, Mycobacterium tuberculosis
VLRRDDPYYHAELE

SEQ ID NO: 129533 - protein, 14 aa, Mycobacterium tuberculosis
LRRDDPYYHAELEW

SEQ ID NO: 129534 - protein, 14 aa, Mycobacterium tuberculosis
RRDDPYYHAELEWW

SEQ ID NO: 129535 - protein, 14 aa, Mycobacterium tuberculosis
RDDPYYHAELEWWT

SEQ ID NO: 129536 - protein, 14 aa, Mycobacterium tuberculosis
DDPYYHAELEWWTS

SEQ ID NO: 129537 - protein, 14 aa, Mycobacterium tuberculosis
DPYYHAELEWWTSP

SEQ ID NO: 129538 - protein, 14 aa, Mycobacterium tuberculosis
PYYHAELEWWTSPF

SEQ ID NO: 129539 - protein, 14 aa, Mycobacterium tuberculosis
YYHAELEWWTSPFV

SEQ ID NO: 129540 - protein, 14 aa, Mycobacterium tuberculosis
YHAELEWWTSPFVL

SEQ ID NO: 129541 - protein, 14 aa, Mycobacterium tuberculosis
HAELEWWTSPFVLA

SEQ ID NO: 129542 - protein, 14 aa, Mycobacterium tuberculosis
AELEWWTSPFVLAH

SEQ ID NO: 129543 - protein, 14 aa, Mycobacterium tuberculosis
ELEWWTSPFVLAHG

SEQ ID NO: 129544 - protein, 14 aa, Mycobacterium tuberculosis
LEWWTSPFVLAHGV

SEQ ID NO: 129545 - protein, 14 aa, Mycobacterium tuberculosis
EWWTSPFVLAHGVP

SEQ ID NO: 129546 - protein, 14 aa, Mycobacterium tuberculosis
WWTSPFVLAHGVPP

SEQ ID NO: 129547 - protein, 14 aa, Mycobacterium tuberculosis
WTSPFVLAHGVPPD

SEQ ID NO: 129548 - protein, 14 aa, Mycobacterium tuberculosis
TSPFVLAHGVPPDT

SEQ ID NO: 129549 - protein, 14 aa, Mycobacterium tuberculosis
SPFVLAHGVPPDTL

SEQ ID NO: 129550 - protein, 14 aa, Mycobacterium tuberculosis
PFVLAHGVPPDTLA

SEQ ID NO: 129551 - protein, 14 aa, Mycobacterium tuberculosis
FVLAHGVPPDTLAS

SEQ ID NO: 129552 - protein, 14 aa, Mycobacterium tuberculosis
VLAHGVPPDTLASD

SEQ ID NO: 129553 - protein, 14 aa, Mycobacterium tuberculosis
LAHGVPPDTLASDA

SEQ ID NO: 129554 - protein, 14 aa, Mycobacterium tuberculosis
AHGVPPDTLASDAE

SEQ ID NO: 129555 - protein, 14 aa, Mycobacterium tuberculosis
HGVPPDTLASDAER

SEQ ID NO: 129556 - protein, 14 aa, Mycobacterium tuberculosis
GVPPDTLASDAERL

SEQ ID NO: 129557 - protein, 14 aa, Mycobacterium tuberculosis
VPPDTLASDAERLR

SEQ ID NO: 129558 - protein, 14 aa, Mycobacterium tuberculosis
PPDTLASDAERLRV

SEQ ID NO: 129559 - protein, 14 aa, Mycobacterium tuberculosis
PDTLASDAERLRVD

SEQ ID NO: 129560 - protein, 14 aa, Mycobacterium tuberculosis
DTLASDAERLRVDL

SEQ ID NO: 129561 - protein, 14 aa, Mycobacterium tuberculosis
TLASDAERLRVDLG

SEQ ID NO: 129562 - protein, 14 aa, Mycobacterium tuberculosis
LASDAERLRVDLGR

SEQ ID NO: 129563 - protein, 14 aa, Mycobacterium tuberculosis
ASDAERLRVDLGRD

SEQ ID NO: 129564 - protein, 14 aa, Mycobacterium tuberculosis
SDAERLRVDLGRDF

SEQ ID NO: 129565 - protein, 14 aa, Mycobacterium tuberculosis
DAERLRVDLGRDFP

SEQ ID NO: 129566 - protein, 14 aa, Mycobacterium tuberculosis
AERLRVDLGRDFPV

SEQ ID NO: 129567 - protein, 14 aa, Mycobacterium tuberculosis
ERLRVDLGRDFPVR

SEQ ID NO: 129568 - protein, 14 aa, Mycobacterium tuberculosis
RLRVDLGRDFPVRS

SEQ ID NO: 129569 - protein, 14 aa, Mycobacterium tuberculosis
LRVDLGRDFPVRSY

SEQ ID NO: 129570 - protein, 14 aa, Mycobacterium tuberculosis
RVDLGRDFPVRSYQ

SEQ ID NO: 129571 - protein, 14 aa, Mycobacterium tuberculosis
VDLGRDFPVRSYQN

SEQ ID NO: 129572 - protein, 14 aa, Mycobacterium tuberculosis
DLGRDFPVRSYQNR

SEQ ID NO: 129573 - protein, 14 aa, Mycobacterium tuberculosis
LGRDFPVRSYQNRR

SEQ ID NO: 129574 - protein, 14 aa, Mycobacterium tuberculosis
GRDFPVRSYQNRRA

SEQ ID NO: 129575 - protein, 14 aa, Mycobacterium tuberculosis
RDFPVRSYQNRRAE

SEQ ID NO: 129576 - protein, 14 aa, Mycobacterium tuberculosis
DFPVRSYQNRRAEL

SEQ ID NO: 129577 - protein, 14 aa, Mycobacterium tuberculosis
FPVRSYQNRRAELA

SEQ ID NO: 129578 - protein, 14 aa, Mycobacterium tuberculosis
PVRSYQNRRAELAD

SEQ ID NO: 129579 - protein, 14 aa, Mycobacterium tuberculosis
VRSYQNRRAELADD

SEQ ID NO: 129580 - protein, 14 aa, Mycobacterium tuberculosis
RSYQNRRAELADDR

SEQ ID NO: 129581 - protein, 14 aa, Mycobacterium tuberculosis
SYQNRRAELADDRS

SEQ ID NO: 129582 - protein, 14 aa, Mycobacterium tuberculosis
YQNRRAELADDRSK

SEQ ID NO: 129583 - protein, 14 aa, Mycobacterium tuberculosis
QNRRAELADDRSKV

SEQ ID NO: 129584 - protein, 14 aa, Mycobacterium tuberculosis
NRRAELADDRSKVL

SEQ ID NO: 129585 - protein, 14 aa, Mycobacterium tuberculosis
RRAELADDRSKVLV

SEQ ID NO: 129586 - protein, 14 aa, Mycobacterium tuberculosis
RAELADDRSKVLVL

SEQ ID NO: 129587 - protein, 14 aa, Mycobacterium tuberculosis
AELADDRSKVLVLS

SEQ ID NO: 129588 - protein, 14 aa, Mycobacterium tuberculosis
ELADDRSKVLVLST

SEQ ID NO: 129589 - protein, 14 aa, Mycobacterium tuberculosis
LADDRSKVLVLSTP

SEQ ID NO: 129590 - protein, 14 aa, Mycobacterium tuberculosis
ADDRSKVLVLSTPS

SEQ ID NO: 129591 - protein, 14 aa, Mycobacterium tuberculosis
DDRSKVLVLSTPSD

SEQ ID NO: 129592 - protein, 14 aa, Mycobacterium tuberculosis
DRSKVLVLSTPSDT

SEQ ID NO: 129593 - protein, 14 aa, Mycobacterium tuberculosis
RSKVLVLSTPSDTR

SEQ ID NO: 129594 - protein, 14 aa, Mycobacterium tuberculosis
SKVLVLSTPSDTRA

SEQ ID NO: 129595 - protein, 14 aa, Mycobacterium tuberculosis
KVLVLSTPSDTRAD

SEQ ID NO: 129596 - protein, 14 aa, Mycobacterium tuberculosis
VLVLSTPSDTRADA

SEQ ID NO: 129597 - protein, 14 aa, Mycobacterium tuberculosis
LVLSTPSDTRADAL

SEQ ID NO: 129598 - protein, 14 aa, Mycobacterium tuberculosis
VLSTPSDTRADALR

SEQ ID NO: 129599 - protein, 14 aa, Mycobacterium tuberculosis
LSTPSDTRADALRC

SEQ ID NO: 129600 - protein, 14 aa, Mycobacterium tuberculosis
STPSDTRADALRCG

SEQ ID NO: 129601 - protein, 14 aa, Mycobacterium tuberculosis
TPSDTRADALRCGE

SEQ ID NO: 129602 - protein, 14 aa, Mycobacterium tuberculosis
PSDTRADALRCGEV

SEQ ID NO: 129603 - protein, 14 aa, Mycobacterium tuberculosis
SDTRADALRCGEVL

SEQ ID NO: 129604 - protein, 14 aa, Mycobacterium tuberculosis
DTRADALRCGEVLS

SEQ ID NO: 129605 - protein, 14 aa, Mycobacterium tuberculosis
TRADALRCGEVLST

SEQ ID NO: 129606 - protein, 14 aa, Mycobacterium tuberculosis
RADALRCGEVLSTI

SEQ ID NO: 129607 - protein, 14 aa, Mycobacterium tuberculosis
ADALRCGEVLSTIL

SEQ ID NO: 129608 - protein, 14 aa, Mycobacterium tuberculosis
DALRCGEVLSTILL

SEQ ID NO: 129609 - protein, 14 aa, Mycobacterium tuberculosis
ALRCGEVLSTILLE

SEQ ID NO: 129610 - protein, 14 aa, Mycobacterium tuberculosis
LRCGEVLSTILLEC

SEQ ID NO: 129611 - protein, 14 aa, Mycobacterium tuberculosis
RCGEVLSTILLECT

SEQ ID NO: 129612 - protein, 14 aa, Mycobacterium tuberculosis
CGEVLSTILLECTM

SEQ ID NO: 129613 - protein, 14 aa, Mycobacterium tuberculosis
GEVLSTILLECTMA

SEQ ID NO: 129614 - protein, 14 aa, Mycobacterium tuberculosis
EVLSTILLECTMAG

SEQ ID NO: 129615 - protein, 14 aa, Mycobacterium tuberculosis
VLSTILLECTMAGM

SEQ ID NO: 129616 - protein, 14 aa, Mycobacterium tuberculosis
LSTILLECTMAGMA

SEQ ID NO: 129617 - protein, 14 aa, Mycobacterium tuberculosis
STILLECTMAGMAT

SEQ ID NO: 129618 - protein, 14 aa, Mycobacterium tuberculosis
TILLECTMAGMATC

SEQ ID NO: 129619 - protein, 14 aa, Mycobacterium tuberculosis
ILLECTMAGMATCT

SEQ ID NO: 129620 - protein, 14 aa, Mycobacterium tuberculosis
LLECTMAGMATCTL

SEQ ID NO: 129621 - protein, 14 aa, Mycobacterium tuberculosis
LECTMAGMATCTLT

SEQ ID NO: 129622 - protein, 14 aa, Mycobacterium tuberculosis
ECTMAGMATCTLTH

SEQ ID NO: 129623 - protein, 14 aa, Mycobacterium tuberculosis
CTMAGMATCTLTHL

SEQ ID NO: 129624 - protein, 14 aa, Mycobacterium tuberculosis
TMAGMATCTLTHLI

SEQ ID NO: 129625 - protein, 14 aa, Mycobacterium tuberculosis
MAGMATCTLTHLIE

SEQ ID NO: 129626 - protein, 14 aa, Mycobacterium tuberculosis
AGMATCTLTHLIES

SEQ ID NO: 129627 - protein, 14 aa, Mycobacterium tuberculosis
GMATCTLTHLIESS

SEQ ID NO: 129628 - protein, 14 aa, Mycobacterium tuberculosis
MATCTLTHLIESSD

SEQ ID NO: 129629 - protein, 14 aa, Mycobacterium tuberculosis
ATCTLTHLIESSDS

SEQ ID NO: 129630 - protein, 14 aa, Mycobacterium tuberculosis
TCTLTHLIESSDSR

SEQ ID NO: 129631 - protein, 14 aa, Mycobacterium tuberculosis
CTLTHLIESSDSRD

SEQ ID NO: 129632 - protein, 14 aa, Mycobacterium tuberculosis
TLTHLIESSDSRDI

SEQ ID NO: 129633 - protein, 14 aa, Mycobacterium tuberculosis
LTHLIESSDSRDIV

SEQ ID NO: 129634 - protein, 14 aa, Mycobacterium tuberculosis
THLIESSDSRDIVR

SEQ ID NO: 129635 - protein, 14 aa, Mycobacterium tuberculosis
HLIESSDSRDIVRG

SEQ ID NO: 129636 - protein, 14 aa, Mycobacterium tuberculosis
LIESSDSRDIVRGL

SEQ ID NO: 129637 - protein, 14 aa, Mycobacterium tuberculosis
IESSDSRDIVRGLT

SEQ ID NO: 129638 - protein, 14 aa, Mycobacterium tuberculosis
ESSDSRDIVRGLTR

SEQ ID NO: 129639 - protein, 14 aa, Mycobacterium tuberculosis
SSDSRDIVRGLTRQ

SEQ ID NO: 129640 - protein, 14 aa, Mycobacterium tuberculosis
SDSRDIVRGLTRQR

SEQ ID NO: 129641 - protein, 14 aa, Mycobacterium tuberculosis
DSRDIVRGLTRQRG

SEQ ID NO: 129642 - protein, 14 aa, Mycobacterium tuberculosis
SRDIVRGLTRQRGE

SEQ ID NO: 129643 - protein, 14 aa, Mycobacterium tuberculosis
RDIVRGLTRQRGEP

SEQ ID NO: 129644 - protein, 14 aa, Mycobacterium tuberculosis
DIVRGLTRQRGEPQ

SEQ ID NO: 129645 - protein, 14 aa, Mycobacterium tuberculosis
IVRGLTRQRGEPQA

SEQ ID NO: 129646 - protein, 14 aa, Mycobacterium tuberculosis
VRGLTRQRGEPQAL

SEQ ID NO: 129647 - protein, 14 aa, Mycobacterium tuberculosis
RGLTRQRGEPQALI

SEQ ID NO: 129648 - protein, 14 aa, Mycobacterium tuberculosis
GLTRQRGEPQALIR

SEQ ID NO: 129649 - protein, 14 aa, Mycobacterium tuberculosis
LTRQRGEPQALIRV

SEQ ID NO: 129650 - protein, 14 aa, Mycobacterium tuberculosis
TRQRGEPQALIRVG

SEQ ID NO: 129651 - protein, 14 aa, Mycobacterium tuberculosis
RQRGEPQALIRVGI

SEQ ID NO: 129652 - protein, 14 aa, Mycobacterium tuberculosis
QRGEPQALIRVGIA

SEQ ID NO: 129653 - protein, 14 aa, Mycobacterium tuberculosis
RGEPQALIRVGIAP

SEQ ID NO: 129654 - protein, 14 aa, Mycobacterium tuberculosis
GEPQALIRVGIAPP

SEQ ID NO: 129655 - protein, 14 aa, Mycobacterium tuberculosis
EPQALIRVGIAPPL

SEQ ID NO: 129656 - protein, 14 aa, Mycobacterium tuberculosis
PQALIRVGIAPPLA

SEQ ID NO: 129657 - protein, 14 aa, Mycobacterium tuberculosis
QALIRVGIAPPLAA

SEQ ID NO: 129658 - protein, 14 aa, Mycobacterium tuberculosis
ALIRVGIAPPLAAV

SEQ ID NO: 129659 - protein, 14 aa, Mycobacterium tuberculosis
LIRVGIAPPLAAVP

SEQ ID NO: 129660 - protein, 14 aa, Mycobacterium tuberculosis
IRVGIAPPLAAVPA

SEQ ID NO: 129661 - protein, 14 aa, Mycobacterium tuberculosis
RVGIAPPLAAVPAP

SEQ ID NO: 129662 - protein, 14 aa, Mycobacterium tuberculosis
VGIAPPLAAVPAPT

SEQ ID NO: 129663 - protein, 14 aa, Mycobacterium tuberculosis
GIAPPLAAVPAPTP

SEQ ID NO: 129664 - protein, 14 aa, Mycobacterium tuberculosis
IAPPLAAVPAPTPR

SEQ ID NO: 129665 - protein, 14 aa, Mycobacterium tuberculosis
APPLAAVPAPTPRR

SEQ ID NO: 129666 - protein, 14 aa, Mycobacterium tuberculosis
PPLAAVPAPTPRRP

SEQ ID NO: 129667 - protein, 14 aa, Mycobacterium tuberculosis
PLAAVPAPTPRRPL

SEQ ID NO: 129668 - protein, 14 aa, Mycobacterium tuberculosis
LAAVPAPTPRRPLD

SEQ ID NO: 129669 - protein, 14 aa, Mycobacterium tuberculosis
AAVPAPTPRRPLDS

SEQ ID NO: 129670 - protein, 14 aa, Mycobacterium tuberculosis
AVPAPTPRRPLDSV

SEQ ID NO: 129671 - protein, 14 aa, Mycobacterium tuberculosis
VPAPTPRRPLDSVL

SEQ ID NO: 129672 - protein, 14 aa, Mycobacterium tuberculosis
PAPTPRRPLDSVLQ

SEQ ID NO: 129673 - protein, 14 aa, Mycobacterium tuberculosis
APTPRRPLDSVLQI

SEQ ID NO: 129674 - protein, 14 aa, Mycobacterium tuberculosis
PTPRRPLDSVLQIR

SEQ ID NO: 129675 - protein, 14 aa, Mycobacterium tuberculosis
TPRRPLDSVLQIRQ

SEQ ID NO: 129676 - protein, 14 aa, Mycobacterium tuberculosis
PRRPLDSVLQIRQT

SEQ ID NO: 129677 - protein, 14 aa, Mycobacterium tuberculosis
RRPLDSVLQIRQTP

SEQ ID NO: 129678 - protein, 14 aa, Mycobacterium tuberculosis
RPLDSVLQIRQTPE

SEQ ID NO: 129679 - protein, 14 aa, Mycobacterium tuberculosis
PLDSVLQIRQTPEK

SEQ ID NO: 129680 - protein, 14 aa, Mycobacterium tuberculosis
LDSVLQIRQTPEKG

SEQ ID NO: 129681 - protein, 14 aa, Mycobacterium tuberculosis
DSVLQIRQTPEKGR

SEQ ID NO: 129682 - protein, 14 aa, Mycobacterium tuberculosis
SVLQIRQTPEKGRN

SEQ ID NO: 129683 - protein, 14 aa, Mycobacterium tuberculosis
VLQIRQTPEKGRNA

SEQ ID NO: 129684 - protein, 14 aa, Mycobacterium tuberculosis
LQIRQTPEKGRNAS

SEQ ID NO: 129685 - protein, 14 aa, Mycobacterium tuberculosis
QIRQTPEKGRNASD

SEQ ID NO: 129686 - protein, 14 aa, Mycobacterium tuberculosis
IRQTPEKGRNASDR

SEQ ID NO: 129687 - protein, 14 aa, Mycobacterium tuberculosis
RQTPEKGRNASDRN

SEQ ID NO: 129688 - protein, 14 aa, Mycobacterium tuberculosis
QTPEKGRNASDRNA

SEQ ID NO: 129689 - protein, 14 aa, Mycobacterium tuberculosis
TPEKGRNASDRNAR

SEQ ID NO: 129690 - protein, 14 aa, Mycobacterium tuberculosis
PEKGRNASDRNARE

SEQ ID NO: 129691 - protein, 14 aa, Mycobacterium tuberculosis
EKGRNASDRNARET

SEQ ID NO: 129692 - protein, 14 aa, Mycobacterium tuberculosis
KGRNASDRNARETG

SEQ ID NO: 129693 - protein, 14 aa, Mycobacterium tuberculosis
GRNASDRNARETGW

SEQ ID NO: 129694 - protein, 14 aa, Mycobacterium tuberculosis
RNASDRNARETGWF

SEQ ID NO: 129695 - protein, 14 aa, Mycobacterium tuberculosis
NASDRNARETGWFS

SEQ ID NO: 129696 - protein, 14 aa, Mycobacterium tuberculosis
ASDRNARETGWFSP

SEQ ID NO: 129697 - protein, 14 aa, Mycobacterium tuberculosis
SDRNARETGWFSPP

SEQ ID NO: 129698 - protein, 15 aa, Mycobacterium tuberculosis
MLKNAVLLACRAPSV

SEQ ID NO: 129699 - protein, 15 aa, Mycobacterium tuberculosis
LKNAVLLACRAPSVH

SEQ ID NO: 129700 - protein, 15 aa, Mycobacterium tuberculosis
KNAVLLACRAPSVHN

SEQ ID NO: 129701 - protein, 15 aa, Mycobacterium tuberculosis
NAVLLACRAPSVHNS

SEQ ID NO: 129702 - protein, 15 aa, Mycobacterium tuberculosis
AVLLACRAPSVHNSQ

SEQ ID NO: 129703 - protein, 15 aa, Mycobacterium tuberculosis
VLLACRAPSVHNSQP

SEQ ID NO: 129704 - protein, 15 aa, Mycobacterium tuberculosis
LLACRAPSVHNSQPW

SEQ ID NO: 129705 - protein, 15 aa, Mycobacterium tuberculosis
LACRAPSVHNSQPWR

SEQ ID NO: 129706 - protein, 15 aa, Mycobacterium tuberculosis
ACRAPSVHNSQPWRW

SEQ ID NO: 129707 - protein, 15 aa, Mycobacterium tuberculosis
CRAPSVHNSQPWRWV

SEQ ID NO: 129708 - protein, 15 aa, Mycobacterium tuberculosis
RAPSVHNSQPWRWVA

SEQ ID NO: 129709 - protein, 15 aa, Mycobacterium tuberculosis
APSVHNSQPWRWVAE

SEQ ID NO: 129710 - protein, 15 aa, Mycobacterium tuberculosis
PSVHNSQPWRWVAES

SEQ ID NO: 129711 - protein, 15 aa, Mycobacterium tuberculosis
SVHNSQPWRWVAESG

SEQ ID NO: 129712 - protein, 15 aa, Mycobacterium tuberculosis
VHNSQPWRWVAESGS

SEQ ID NO: 129713 - protein, 15 aa, Mycobacterium tuberculosis
HNSQPWRWVAESGSE

SEQ ID NO: 129714 - protein, 15 aa, Mycobacterium tuberculosis
NSQPWRWVAESGSEH

SEQ ID NO: 129715 - protein, 15 aa, Mycobacterium tuberculosis
SQPWRWVAESGSEHT

SEQ ID NO: 129716 - protein, 15 aa, Mycobacterium tuberculosis
QPWRWVAESGSEHTT

SEQ ID NO: 129717 - protein, 15 aa, Mycobacterium tuberculosis
PWRWVAESGSEHTTV

SEQ ID NO: 129718 - protein, 15 aa, Mycobacterium tuberculosis
WRWVAESGSEHTTVH

SEQ ID NO: 129719 - protein, 15 aa, Mycobacterium tuberculosis
RWVAESGSEHTTVHL

SEQ ID NO: 129720 - protein, 15 aa, Mycobacterium tuberculosis
WVAESGSEHTTVHLF

SEQ ID NO: 129721 - protein, 15 aa, Mycobacterium tuberculosis
VAESGSEHTTVHLFV

SEQ ID NO: 129722 - protein, 15 aa, Mycobacterium tuberculosis
AESGSEHTTVHLFVN

SEQ ID NO: 129723 - protein, 15 aa, Mycobacterium tuberculosis
ESGSEHTTVHLFVNR

SEQ ID NO: 129724 - protein, 15 aa, Mycobacterium tuberculosis
SGSEHTTVHLFVNRH

SEQ ID NO: 129725 - protein, 15 aa, Mycobacterium tuberculosis
GSEHTTVHLFVNRHR

SEQ ID NO: 129726 - protein, 15 aa, Mycobacterium tuberculosis
SEHTTVHLFVNRHRT

SEQ ID NO: 129727 - protein, 15 aa, Mycobacterium tuberculosis
EHTTVHLFVNRHRTV

SEQ ID NO: 129728 - protein, 15 aa, Mycobacterium tuberculosis
HTTVHLFVNRHRTVP

SEQ ID NO: 129729 - protein, 15 aa, Mycobacterium tuberculosis
TTVHLFVNRHRTVPA

SEQ ID NO: 129730 - protein, 15 aa, Mycobacterium tuberculosis
TVHLFVNRHRTVPAT

SEQ ID NO: 129731 - protein, 15 aa, Mycobacterium tuberculosis
VHLFVNRHRTVPATD

SEQ ID NO: 129732 - protein, 15 aa, Mycobacterium tuberculosis
HLFVNRHRTVPATDH

SEQ ID NO: 129733 - protein, 15 aa, Mycobacterium tuberculosis
LFVNRHRTVPATDHS

SEQ ID NO: 129734 - protein, 15 aa, Mycobacterium tuberculosis
FVNRHRTVPATDHSG

SEQ ID NO: 129735 - protein, 15 aa, Mycobacterium tuberculosis
VNRHRTVPATDHSGR

SEQ ID NO: 129736 - protein, 15 aa, Mycobacterium tuberculosis
NRHRTVPATDHSGRQ

SEQ ID NO: 129737 - protein, 15 aa, Mycobacterium tuberculosis
RHRTVPATDHSGRQA

SEQ ID NO: 129738 - protein, 15 aa, Mycobacterium tuberculosis
HRTVPATDHSGRQAI

SEQ ID NO: 129739 - protein, 15 aa, Mycobacterium tuberculosis
RTVPATDHSGRQAII

SEQ ID NO: 129740 - protein, 15 aa, Mycobacterium tuberculosis
TVPATDHSGRQAIIS

SEQ ID NO: 129741 - protein, 15 aa, Mycobacterium tuberculosis
VPATDHSGRQAIISC

SEQ ID NO: 129742 - protein, 15 aa, Mycobacterium tuberculosis
PATDHSGRQAIISCG

SEQ ID NO: 129743 - protein, 15 aa, Mycobacterium tuberculosis
ATDHSGRQAIISCGA

SEQ ID NO: 129744 - protein, 15 aa, Mycobacterium tuberculosis
TDHSGRQAIISCGAV

SEQ ID NO: 129745 - protein, 15 aa, Mycobacterium tuberculosis
DHSGRQAIISCGAVL

SEQ ID NO: 129746 - protein, 15 aa, Mycobacterium tuberculosis
HSGRQAIISCGAVLD

SEQ ID NO: 129747 - protein, 15 aa, Mycobacterium tuberculosis
SGRQAIISCGAVLDH

SEQ ID NO: 129748 - protein, 15 aa, Mycobacterium tuberculosis
GRQAIISCGAVLDHL

SEQ ID NO: 129749 - protein, 15 aa, Mycobacterium tuberculosis
RQAIISCGAVLDHLR

SEQ ID NO: 129750 - protein, 15 aa, Mycobacterium tuberculosis
QAIISCGAVLDHLRI

SEQ ID NO: 129751 - protein, 15 aa, Mycobacterium tuberculosis
AIISCGAVLDHLRIA

SEQ ID NO: 129752 - protein, 15 aa, Mycobacterium tuberculosis
IISCGAVLDHLRIAM

SEQ ID NO: 129753 - protein, 15 aa, Mycobacterium tuberculosis
ISCGAVLDHLRIAMT

SEQ ID NO: 129754 - protein, 15 aa, Mycobacterium tuberculosis
SCGAVLDHLRIAMTA

SEQ ID NO: 129755 - protein, 15 aa, Mycobacterium tuberculosis
CGAVLDHLRIAMTAA

SEQ ID NO: 129756 - protein, 15 aa, Mycobacterium tuberculosis
GAVLDHLRIAMTAAH

SEQ ID NO: 129757 - protein, 15 aa, Mycobacterium tuberculosis
AVLDHLRIAMTAAHW

SEQ ID NO: 129758 - protein, 15 aa, Mycobacterium tuberculosis
VLDHLRIAMTAAHWQ

SEQ ID NO: 129759 - protein, 15 aa, Mycobacterium tuberculosis
LDHLRIAMTAAHWQA

SEQ ID NO: 129760 - protein, 15 aa, Mycobacterium tuberculosis
DHLRIAMTAAHWQAN

SEQ ID NO: 129761 - protein, 15 aa, Mycobacterium tuberculosis
HLRIAMTAAHWQANI

SEQ ID NO: 129762 - protein, 15 aa, Mycobacterium tuberculosis
LRIAMTAAHWQANIT

SEQ ID NO: 129763 - protein, 15 aa, Mycobacterium tuberculosis
RIAMTAAHWQANITR

SEQ ID NO: 129764 - protein, 15 aa, Mycobacterium tuberculosis
IAMTAAHWQANITRF

SEQ ID NO: 129765 - protein, 15 aa, Mycobacterium tuberculosis
AMTAAHWQANITRFP

SEQ ID NO: 129766 - protein, 15 aa, Mycobacterium tuberculosis
MTAAHWQANITRFPQ

SEQ ID NO: 129767 - protein, 15 aa, Mycobacterium tuberculosis
TAAHWQANITRFPQP

SEQ ID NO: 129768 - protein, 15 aa, Mycobacterium tuberculosis
AAHWQANITRFPQPN

SEQ ID NO: 129769 - protein, 15 aa, Mycobacterium tuberculosis
AHWQANITRFPQPNQ

SEQ ID NO: 129770 - protein, 15 aa, Mycobacterium tuberculosis
HWQANITRFPQPNQP

SEQ ID NO: 129771 - protein, 15 aa, Mycobacterium tuberculosis
WQANITRFPQPNQPD

SEQ ID NO: 129772 - protein, 15 aa, Mycobacterium tuberculosis
QANITRFPQPNQPDQ

SEQ ID NO: 129773 - protein, 15 aa, Mycobacterium tuberculosis
ANITRFPQPNQPDQL

SEQ ID NO: 129774 - protein, 15 aa, Mycobacterium tuberculosis
NITRFPQPNQPDQLA

SEQ ID NO: 129775 - protein, 15 aa, Mycobacterium tuberculosis
ITRFPQPNQPDQLAT

SEQ ID NO: 129776 - protein, 15 aa, Mycobacterium tuberculosis
TRFPQPNQPDQLATV

SEQ ID NO: 129777 - protein, 15 aa, Mycobacterium tuberculosis
RFPQPNQPDQLATVE

SEQ ID NO: 129778 - protein, 15 aa, Mycobacterium tuberculosis
FPQPNQPDQLATVEF

SEQ ID NO: 129779 - protein, 15 aa, Mycobacterium tuberculosis
PQPNQPDQLATVEFS

SEQ ID NO: 129780 - protein, 15 aa, Mycobacterium tuberculosis
QPNQPDQLATVEFSP

SEQ ID NO: 129781 - protein, 15 aa, Mycobacterium tuberculosis
PNQPDQLATVEFSPI

SEQ ID NO: 129782 - protein, 15 aa, Mycobacterium tuberculosis
NQPDQLATVEFSPID

SEQ ID NO: 129783 - protein, 15 aa, Mycobacterium tuberculosis
QPDQLATVEFSPIDH

SEQ ID NO: 129784 - protein, 15 aa, Mycobacterium tuberculosis
PDQLATVEFSPIDHV

SEQ ID NO: 129785 - protein, 15 aa, Mycobacterium tuberculosis
DQLATVEFSPIDHVT

SEQ ID NO: 129786 - protein, 15 aa, Mycobacterium tuberculosis
QLATVEFSPIDHVTA

SEQ ID NO: 129787 - protein, 15 aa, Mycobacterium tuberculosis
LATVEFSPIDHVTAG

SEQ ID NO: 129788 - protein, 15 aa, Mycobacterium tuberculosis
ATVEFSPIDHVTAGQ

SEQ ID NO: 129789 - protein, 15 aa, Mycobacterium tuberculosis
TVEFSPIDHVTAGQR

SEQ ID NO: 129790 - protein, 15 aa, Mycobacterium tuberculosis
VEFSPIDHVTAGQRN

SEQ ID NO: 129791 - protein, 15 aa, Mycobacterium tuberculosis
EFSPIDHVTAGQRNR

SEQ ID NO: 129792 - protein, 15 aa, Mycobacterium tuberculosis
FSPIDHVTAGQRNRA

SEQ ID NO: 129793 - protein, 15 aa, Mycobacterium tuberculosis
SPIDHVTAGQRNRAQ

SEQ ID NO: 129794 - protein, 15 aa, Mycobacterium tuberculosis
PIDHVTAGQRNRAQA

SEQ ID NO: 129795 - protein, 15 aa, Mycobacterium tuberculosis
IDHVTAGQRNRAQAI

SEQ ID NO: 129796 - protein, 15 aa, Mycobacterium tuberculosis
DHVTAGQRNRAQAIL

SEQ ID NO: 129797 - protein, 15 aa, Mycobacterium tuberculosis
HVTAGQRNRAQAILQ

SEQ ID NO: 129798 - protein, 15 aa, Mycobacterium tuberculosis
VTAGQRNRAQAILQR

SEQ ID NO: 129799 - protein, 15 aa, Mycobacterium tuberculosis
TAGQRNRAQAILQRR

SEQ ID NO: 129800 - protein, 15 aa, Mycobacterium tuberculosis
AGQRNRAQAILQRRT

SEQ ID NO: 129801 - protein, 15 aa, Mycobacterium tuberculosis
GQRNRAQAILQRRTD

SEQ ID NO: 129802 - protein, 15 aa, Mycobacterium tuberculosis
QRNRAQAILQRRTDR

SEQ ID NO: 129803 - protein, 15 aa, Mycobacterium tuberculosis
RNRAQAILQRRTDRL

SEQ ID NO: 129804 - protein, 15 aa, Mycobacterium tuberculosis
NRAQAILQRRTDRLP

SEQ ID NO: 129805 - protein, 15 aa, Mycobacterium tuberculosis
RAQAILQRRTDRLPF

SEQ ID NO: 129806 - protein, 15 aa, Mycobacterium tuberculosis
AQAILQRRTDRLPFD

SEQ ID NO: 129807 - protein, 15 aa, Mycobacterium tuberculosis
QAILQRRTDRLPFDS

SEQ ID NO: 129808 - protein, 15 aa, Mycobacterium tuberculosis
AILQRRTDRLPFDSP

SEQ ID NO: 129809 - protein, 15 aa, Mycobacterium tuberculosis
ILQRRTDRLPFDSPM

SEQ ID NO: 129810 - protein, 15 aa, Mycobacterium tuberculosis
LQRRTDRLPFDSPMY

SEQ ID NO: 129811 - protein, 15 aa, Mycobacterium tuberculosis
QRRTDRLPFDSPMYW

SEQ ID NO: 129812 - protein, 15 aa, Mycobacterium tuberculosis
RRTDRLPFDSPMYWH

SEQ ID NO: 129813 - protein, 15 aa, Mycobacterium tuberculosis
RTDRLPFDSPMYWHL

SEQ ID NO: 129814 - protein, 15 aa, Mycobacterium tuberculosis
TDRLPFDSPMYWHLF

SEQ ID NO: 129815 - protein, 15 aa, Mycobacterium tuberculosis
DRLPFDSPMYWHLFE

SEQ ID NO: 129816 - protein, 15 aa, Mycobacterium tuberculosis
RLPFDSPMYWHLFEP

SEQ ID NO: 129817 - protein, 15 aa, Mycobacterium tuberculosis
LPFDSPMYWHLFEPA

SEQ ID NO: 129818 - protein, 15 aa, Mycobacterium tuberculosis
PFDSPMYWHLFEPAL

SEQ ID NO: 129819 - protein, 15 aa, Mycobacterium tuberculosis
FDSPMYWHLFEPALR

SEQ ID NO: 129820 - protein, 15 aa, Mycobacterium tuberculosis
DSPMYWHLFEPALRD

SEQ ID NO: 129821 - protein, 15 aa, Mycobacterium tuberculosis
SPMYWHLFEPALRDA

SEQ ID NO: 129822 - protein, 15 aa, Mycobacterium tuberculosis
PMYWHLFEPALRDAV

SEQ ID NO: 129823 - protein, 15 aa, Mycobacterium tuberculosis
MYWHLFEPALRDAVD

SEQ ID NO: 129824 - protein, 15 aa, Mycobacterium tuberculosis
YWHLFEPALRDAVDK

SEQ ID NO: 129825 - protein, 15 aa, Mycobacterium tuberculosis
WHLFEPALRDAVDKD

SEQ ID NO: 129826 - protein, 15 aa, Mycobacterium tuberculosis
HLFEPALRDAVDKDV

SEQ ID NO: 129827 - protein, 15 aa, Mycobacterium tuberculosis
LFEPALRDAVDKDVA

SEQ ID NO: 129828 - protein, 15 aa, Mycobacterium tuberculosis
FEPALRDAVDKDVAM

SEQ ID NO: 129829 - protein, 15 aa, Mycobacterium tuberculosis
EPALRDAVDKDVAML

SEQ ID NO: 129830 - protein, 15 aa, Mycobacterium tuberculosis
PALRDAVDKDVAMLD

SEQ ID NO: 129831 - protein, 15 aa, Mycobacterium tuberculosis
ALRDAVDKDVAMLDV

SEQ ID NO: 129832 - protein, 15 aa, Mycobacterium tuberculosis
LRDAVDKDVAMLDVV

SEQ ID NO: 129833 - protein, 15 aa, Mycobacterium tuberculosis
RDAVDKDVAMLDVVS

SEQ ID NO: 129834 - protein, 15 aa, Mycobacterium tuberculosis
DAVDKDVAMLDVVSD

SEQ ID NO: 129835 - protein, 15 aa, Mycobacterium tuberculosis
AVDKDVAMLDVVSDD

SEQ ID NO: 129836 - protein, 15 aa, Mycobacterium tuberculosis
VDKDVAMLDVVSDDQ

SEQ ID NO: 129837 - protein, 15 aa, Mycobacterium tuberculosis
DKDVAMLDVVSDDQR

SEQ ID NO: 129838 - protein, 15 aa, Mycobacterium tuberculosis
KDVAMLDVVSDDQRT

SEQ ID NO: 129839 - protein, 15 aa, Mycobacterium tuberculosis
DVAMLDVVSDDQRTR

SEQ ID NO: 129840 - protein, 15 aa, Mycobacterium tuberculosis
VAMLDVVSDDQRTRL

SEQ ID NO: 129841 - protein, 15 aa, Mycobacterium tuberculosis
AMLDVVSDDQRTRLV

SEQ ID NO: 129842 - protein, 15 aa, Mycobacterium tuberculosis
MLDVVSDDQRTRLVV

SEQ ID NO: 129843 - protein, 15 aa, Mycobacterium tuberculosis
LDVVSDDQRTRLVVA

SEQ ID NO: 129844 - protein, 15 aa, Mycobacterium tuberculosis
DVVSDDQRTRLVVAS

SEQ ID NO: 129845 - protein, 15 aa, Mycobacterium tuberculosis
VVSDDQRTRLVVASQ

SEQ ID NO: 129846 - protein, 15 aa, Mycobacterium tuberculosis
VSDDQRTRLVVASQL

SEQ ID NO: 129847 - protein, 15 aa, Mycobacterium tuberculosis
SDDQRTRLVVASQLS

SEQ ID NO: 129848 - protein, 15 aa, Mycobacterium tuberculosis
DDQRTRLVVASQLSE

SEQ ID NO: 129849 - protein, 15 aa, Mycobacterium tuberculosis
DQRTRLVVASQLSEV

SEQ ID NO: 129850 - protein, 15 aa, Mycobacterium tuberculosis
QRTRLVVASQLSEVL

SEQ ID NO: 129851 - protein, 15 aa, Mycobacterium tuberculosis
RTRLVVASQLSEVLR

SEQ ID NO: 129852 - protein, 15 aa, Mycobacterium tuberculosis
TRLVVASQLSEVLRR

SEQ ID NO: 129853 - protein, 15 aa, Mycobacterium tuberculosis
RLVVASQLSEVLRRD

SEQ ID NO: 129854 - protein, 15 aa, Mycobacterium tuberculosis
LVVASQLSEVLRRDD

SEQ ID NO: 129855 - protein, 15 aa, Mycobacterium tuberculosis
VVASQLSEVLRRDDP

SEQ ID NO: 129856 - protein, 15 aa, Mycobacterium tuberculosis
VASQLSEVLRRDDPY

SEQ ID NO: 129857 - protein, 15 aa, Mycobacterium tuberculosis
ASQLSEVLRRDDPYY

SEQ ID NO: 129858 - protein, 15 aa, Mycobacterium tuberculosis
SQLSEVLRRDDPYYH

SEQ ID NO: 129859 - protein, 15 aa, Mycobacterium tuberculosis
QLSEVLRRDDPYYHA

SEQ ID NO: 129860 - protein, 15 aa, Mycobacterium tuberculosis
LSEVLRRDDPYYHAE

SEQ ID NO: 129861 - protein, 15 aa, Mycobacterium tuberculosis
SEVLRRDDPYYHAEL

SEQ ID NO: 129862 - protein, 15 aa, Mycobacterium tuberculosis
EVLRRDDPYYHAELE

SEQ ID NO: 129863 - protein, 15 aa, Mycobacterium tuberculosis
VLRRDDPYYHAELEW

SEQ ID NO: 129864 - protein, 15 aa, Mycobacterium tuberculosis
LRRDDPYYHAELEWW

SEQ ID NO: 129865 - protein, 15 aa, Mycobacterium tuberculosis
RRDDPYYHAELEWWT

SEQ ID NO: 129866 - protein, 15 aa, Mycobacterium tuberculosis
RDDPYYHAELEWWTS

SEQ ID NO: 129867 - protein, 15 aa, Mycobacterium tuberculosis
DDPYYHAELEWWTSP

SEQ ID NO: 129868 - protein, 15 aa, Mycobacterium tuberculosis
DPYYHAELEWWTSPF

SEQ ID NO: 129869 - protein, 15 aa, Mycobacterium tuberculosis
PYYHAELEWWTSPFV

SEQ ID NO: 129870 - protein, 15 aa, Mycobacterium tuberculosis
YYHAELEWWTSPFVL

SEQ ID NO: 129871 - protein, 15 aa, Mycobacterium tuberculosis
YHAELEWWTSPFVLA

SEQ ID NO: 129872 - protein, 15 aa, Mycobacterium tuberculosis
HAELEWWTSPFVLAH

SEQ ID NO: 129873 - protein, 15 aa, Mycobacterium tuberculosis
AELEWWTSPFVLAHG

SEQ ID NO: 129874 - protein, 15 aa, Mycobacterium tuberculosis
ELEWWTSPFVLAHGV

SEQ ID NO: 129875 - protein, 15 aa, Mycobacterium tuberculosis
LEWWTSPFVLAHGVP

SEQ ID NO: 129876 - protein, 15 aa, Mycobacterium tuberculosis
EWWTSPFVLAHGVPP

SEQ ID NO: 129877 - protein, 15 aa, Mycobacterium tuberculosis
WWTSPFVLAHGVPPD

SEQ ID NO: 129878 - protein, 15 aa, Mycobacterium tuberculosis
WTSPFVLAHGVPPDT

SEQ ID NO: 129879 - protein, 15 aa, Mycobacterium tuberculosis
TSPFVLAHGVPPDTL

SEQ ID NO: 129880 - protein, 15 aa, Mycobacterium tuberculosis
SPFVLAHGVPPDTLA

SEQ ID NO: 129881 - protein, 15 aa, Mycobacterium tuberculosis
PFVLAHGVPPDTLAS

SEQ ID NO: 129882 - protein, 15 aa, Mycobacterium tuberculosis
FVLAHGVPPDTLASD

SEQ ID NO: 129883 - protein, 15 aa, Mycobacterium tuberculosis
VLAHGVPPDTLASDA

SEQ ID NO: 129884 - protein, 15 aa, Mycobacterium tuberculosis
LAHGVPPDTLASDAE

SEQ ID NO: 129885 - protein, 15 aa, Mycobacterium tuberculosis
AHGVPPDTLASDAER

SEQ ID NO: 129886 - protein, 15 aa, Mycobacterium tuberculosis
HGVPPDTLASDAERL

SEQ ID NO: 129887 - protein, 15 aa, Mycobacterium tuberculosis
GVPPDTLASDAERLR

SEQ ID NO: 129888 - protein, 15 aa, Mycobacterium tuberculosis
VPPDTLASDAERLRV

SEQ ID NO: 129889 - protein, 15 aa, Mycobacterium tuberculosis
PPDTLASDAERLRVD

SEQ ID NO: 129890 - protein, 15 aa, Mycobacterium tuberculosis
PDTLASDAERLRVDL

SEQ ID NO: 129891 - protein, 15 aa, Mycobacterium tuberculosis
DTLASDAERLRVDLG

SEQ ID NO: 129892 - protein, 15 aa, Mycobacterium tuberculosis
TLASDAERLRVDLGR

SEQ ID NO: 129893 - protein, 15 aa, Mycobacterium tuberculosis
LASDAERLRVDLGRD

SEQ ID NO: 129894 - protein, 15 aa, Mycobacterium tuberculosis
ASDAERLRVDLGRDF

SEQ ID NO: 129895 - protein, 15 aa, Mycobacterium tuberculosis
SDAERLRVDLGRDFP

SEQ ID NO: 129896 - protein, 15 aa, Mycobacterium tuberculosis
DAERLRVDLGRDFPV

SEQ ID NO: 129897 - protein, 15 aa, Mycobacterium tuberculosis
AERLRVDLGRDFPVR

SEQ ID NO: 129898 - protein, 15 aa, Mycobacterium tuberculosis
ERLRVDLGRDFPVRS

SEQ ID NO: 129899 - protein, 15 aa, Mycobacterium tuberculosis
RLRVDLGRDFPVRSY

SEQ ID NO: 129900 - protein, 15 aa, Mycobacterium tuberculosis
LRVDLGRDFPVRSYQ

SEQ ID NO: 129901 - protein, 15 aa, Mycobacterium tuberculosis
RVDLGRDFPVRSYQN

SEQ ID NO: 129902 - protein, 15 aa, Mycobacterium tuberculosis
VDLGRDFPVRSYQNR

SEQ ID NO: 129903 - protein, 15 aa, Mycobacterium tuberculosis
DLGRDFPVRSYQNRR

SEQ ID NO: 129904 - protein, 15 aa, Mycobacterium tuberculosis
LGRDFPVRSYQNRRA

SEQ ID NO: 129905 - protein, 15 aa, Mycobacterium tuberculosis
GRDFPVRSYQNRRAE

SEQ ID NO: 129906 - protein, 15 aa, Mycobacterium tuberculosis
RDFPVRSYQNRRAEL

SEQ ID NO: 129907 - protein, 15 aa, Mycobacterium tuberculosis
DFPVRSYQNRRAELA

SEQ ID NO: 129908 - protein, 15 aa, Mycobacterium tuberculosis
FPVRSYQNRRAELAD

SEQ ID NO: 129909 - protein, 15 aa, Mycobacterium tuberculosis
PVRSYQNRRAELADD

SEQ ID NO: 129910 - protein, 15 aa, Mycobacterium tuberculosis
VRSYQNRRAELADDR

SEQ ID NO: 129911 - protein, 15 aa, Mycobacterium tuberculosis
RSYQNRRAELADDRS

SEQ ID NO: 129912 - protein, 15 aa, Mycobacterium tuberculosis
SYQNRRAELADDRSK

SEQ ID NO: 129913 - protein, 15 aa, Mycobacterium tuberculosis
YQNRRAELADDRSKV

SEQ ID NO: 129914 - protein, 15 aa, Mycobacterium tuberculosis
QNRRAELADDRSKVL

SEQ ID NO: 129915 - protein, 15 aa, Mycobacterium tuberculosis
NRRAELADDRSKVLV

SEQ ID NO: 129916 - protein, 15 aa, Mycobacterium tuberculosis
RRAELADDRSKVLVL

SEQ ID NO: 129917 - protein, 15 aa, Mycobacterium tuberculosis
RAELADDRSKVLVLS

SEQ ID NO: 129918 - protein, 15 aa, Mycobacterium tuberculosis
AELADDRSKVLVLST

SEQ ID NO: 129919 - protein, 15 aa, Mycobacterium tuberculosis
ELADDRSKVLVLSTP

SEQ ID NO: 129920 - protein, 15 aa, Mycobacterium tuberculosis
LADDRSKVLVLSTPS

SEQ ID NO: 129921 - protein, 15 aa, Mycobacterium tuberculosis
ADDRSKVLVLSTPSD

SEQ ID NO: 129922 - protein, 15 aa, Mycobacterium tuberculosis
DDRSKVLVLSTPSDT

SEQ ID NO: 129923 - protein, 15 aa, Mycobacterium tuberculosis
DRSKVLVLSTPSDTR

SEQ ID NO: 129924 - protein, 15 aa, Mycobacterium tuberculosis
RSKVLVLSTPSDTRA

SEQ ID NO: 129925 - protein, 15 aa, Mycobacterium tuberculosis
SKVLVLSTPSDTRAD

SEQ ID NO: 129926 - protein, 15 aa, Mycobacterium tuberculosis
KVLVLSTPSDTRADA

SEQ ID NO: 129927 - protein, 15 aa, Mycobacterium tuberculosis
VLVLSTPSDTRADAL

SEQ ID NO: 129928 - protein, 15 aa, Mycobacterium tuberculosis
LVLSTPSDTRADALR

SEQ ID NO: 129929 - protein, 15 aa, Mycobacterium tuberculosis
VLSTPSDTRADALRC

SEQ ID NO: 129930 - protein, 15 aa, Mycobacterium tuberculosis
LSTPSDTRADALRCG

SEQ ID NO: 129931 - protein, 15 aa, Mycobacterium tuberculosis
STPSDTRADALRCGE

SEQ ID NO: 129932 - protein, 15 aa, Mycobacterium tuberculosis
TPSDTRADALRCGEV

SEQ ID NO: 129933 - protein, 15 aa, Mycobacterium tuberculosis
PSDTRADALRCGEVL

SEQ ID NO: 129934 - protein, 15 aa, Mycobacterium tuberculosis
SDTRADALRCGEVLS

SEQ ID NO: 129935 - protein, 15 aa, Mycobacterium tuberculosis
DTRADALRCGEVLST

SEQ ID NO: 129936 - protein, 15 aa, Mycobacterium tuberculosis
TRADALRCGEVLSTI

SEQ ID NO: 129937 - protein, 15 aa, Mycobacterium tuberculosis
RADALRCGEVLSTIL

SEQ ID NO: 129938 - protein, 15 aa, Mycobacterium tuberculosis
ADALRCGEVLSTILL

SEQ ID NO: 129939 - protein, 15 aa, Mycobacterium tuberculosis
DALRCGEVLSTILLE

SEQ ID NO: 129940 - protein, 15 aa, Mycobacterium tuberculosis
ALRCGEVLSTILLEC

SEQ ID NO: 129941 - protein, 15 aa, Mycobacterium tuberculosis
LRCGEVLSTILLECT

SEQ ID NO: 129942 - protein, 15 aa, Mycobacterium tuberculosis
RCGEVLSTILLECTM

SEQ ID NO: 129943 - protein, 15 aa, Mycobacterium tuberculosis
CGEVLSTILLECTMA

SEQ ID NO: 129944 - protein, 15 aa, Mycobacterium tuberculosis
GEVLSTILLECTMAG

SEQ ID NO: 129945 - protein, 15 aa, Mycobacterium tuberculosis
EVLSTILLECTMAGM

SEQ ID NO: 129946 - protein, 15 aa, Mycobacterium tuberculosis
VLSTILLECTMAGMA

SEQ ID NO: 129947 - protein, 15 aa, Mycobacterium tuberculosis
LSTILLECTMAGMAT

SEQ ID NO: 129948 - protein, 15 aa, Mycobacterium tuberculosis
STILLECTMAGMATC

SEQ ID NO: 129949 - protein, 15 aa, Mycobacterium tuberculosis
TILLECTMAGMATCT

SEQ ID NO: 129950 - protein, 15 aa, Mycobacterium tuberculosis
ILLECTMAGMATCTL

SEQ ID NO: 129951 - protein, 15 aa, Mycobacterium tuberculosis
LLECTMAGMATCTLT

SEQ ID NO: 129952 - protein, 15 aa, Mycobacterium tuberculosis
LECTMAGMATCTLTH

SEQ ID NO: 129953 - protein, 15 aa, Mycobacterium tuberculosis
ECTMAGMATCTLTHL

SEQ ID NO: 129954 - protein, 15 aa, Mycobacterium tuberculosis
CTMAGMATCTLTHLI

SEQ ID NO: 129955 - protein, 15 aa, Mycobacterium tuberculosis
TMAGMATCTLTHLIE

SEQ ID NO: 129956 - protein, 15 aa, Mycobacterium tuberculosis
MAGMATCTLTHLIES

SEQ ID NO: 129957 - protein, 15 aa, Mycobacterium tuberculosis
AGMATCTLTHLIESS

SEQ ID NO: 129958 - protein, 15 aa, Mycobacterium tuberculosis
GMATCTLTHLIESSD

SEQ ID NO: 129959 - protein, 15 aa, Mycobacterium tuberculosis
MATCTLTHLIESSDS

SEQ ID NO: 129960 - protein, 15 aa, Mycobacterium tuberculosis
ATCTLTHLIESSDSR

SEQ ID NO: 129961 - protein, 15 aa, Mycobacterium tuberculosis
TCTLTHLIESSDSRD

SEQ ID NO: 129962 - protein, 15 aa, Mycobacterium tuberculosis
CTLTHLIESSDSRDI

SEQ ID NO: 129963 - protein, 15 aa, Mycobacterium tuberculosis
TLTHLIESSDSRDIV

SEQ ID NO: 129964 - protein, 15 aa, Mycobacterium tuberculosis
LTHLIESSDSRDIVR

SEQ ID NO: 129965 - protein, 15 aa, Mycobacterium tuberculosis
THLIESSDSRDIVRG

SEQ ID NO: 129966 - protein, 15 aa, Mycobacterium tuberculosis
HLIESSDSRDIVRGL

SEQ ID NO: 129967 - protein, 15 aa, Mycobacterium tuberculosis
LIESSDSRDIVRGLT

SEQ ID NO: 129968 - protein, 15 aa, Mycobacterium tuberculosis
IESSDSRDIVRGLTR

SEQ ID NO: 129969 - protein, 15 aa, Mycobacterium tuberculosis
ESSDSRDIVRGLTRQ

SEQ ID NO: 129970 - protein, 15 aa, Mycobacterium tuberculosis
SSDSRDIVRGLTRQR

SEQ ID NO: 129971 - protein, 15 aa, Mycobacterium tuberculosis
SDSRDIVRGLTRQRG

SEQ ID NO: 129972 - protein, 15 aa, Mycobacterium tuberculosis
DSRDIVRGLTRQRGE

SEQ ID NO: 129973 - protein, 15 aa, Mycobacterium tuberculosis
SRDIVRGLTRQRGEP

SEQ ID NO: 129974 - protein, 15 aa, Mycobacterium tuberculosis
RDIVRGLTRQRGEPQ

SEQ ID NO: 129975 - protein, 15 aa, Mycobacterium tuberculosis
DIVRGLTRQRGEPQA

SEQ ID NO: 129976 - protein, 15 aa, Mycobacterium tuberculosis
IVRGLTRQRGEPQAL

SEQ ID NO: 129977 - protein, 15 aa, Mycobacterium tuberculosis
VRGLTRQRGEPQALI

SEQ ID NO: 129978 - protein, 15 aa, Mycobacterium tuberculosis
RGLTRQRGEPQALIR

SEQ ID NO: 129979 - protein, 15 aa, Mycobacterium tuberculosis
GLTRQRGEPQALIRV

SEQ ID NO: 129980 - protein, 15 aa, Mycobacterium tuberculosis
LTRQRGEPQALIRVG

SEQ ID NO: 129981 - protein, 15 aa, Mycobacterium tuberculosis
TRQRGEPQALIRVGI

SEQ ID NO: 129982 - protein, 15 aa, Mycobacterium tuberculosis
RQRGEPQALIRVGIA

SEQ ID NO: 129983 - protein, 15 aa, Mycobacterium tuberculosis
QRGEPQALIRVGIAP

SEQ ID NO: 129984 - protein, 15 aa, Mycobacterium tuberculosis
RGEPQALIRVGIAPP

SEQ ID NO: 129985 - protein, 15 aa, Mycobacterium tuberculosis
GEPQALIRVGIAPPL

SEQ ID NO: 129986 - protein, 15 aa, Mycobacterium tuberculosis
EPQALIRVGIAPPLA

SEQ ID NO: 129987 - protein, 15 aa, Mycobacterium tuberculosis
PQALIRVGIAPPLAA

SEQ ID NO: 129988 - protein, 15 aa, Mycobacterium tuberculosis
QALIRVGIAPPLAAV

SEQ ID NO: 129989 - protein, 15 aa, Mycobacterium tuberculosis
ALIRVGIAPPLAAVP

SEQ ID NO: 129990 - protein, 15 aa, Mycobacterium tuberculosis
LIRVGIAPPLAAVPA

SEQ ID NO: 129991 - protein, 15 aa, Mycobacterium tuberculosis
IRVGIAPPLAAVPAP

SEQ ID NO: 129992 - protein, 15 aa, Mycobacterium tuberculosis
RVGIAPPLAAVPAPT

SEQ ID NO: 129993 - protein, 15 aa, Mycobacterium tuberculosis
VGIAPPLAAVPAPTP

SEQ ID NO: 129994 - protein, 15 aa, Mycobacterium tuberculosis
GIAPPLAAVPAPTPR

SEQ ID NO: 129995 - protein, 15 aa, Mycobacterium tuberculosis
IAPPLAAVPAPTPRR

SEQ ID NO: 129996 - protein, 15 aa, Mycobacterium tuberculosis
APPLAAVPAPTPRRP

SEQ ID NO: 129997 - protein, 15 aa, Mycobacterium tuberculosis
PPLAAVPAPTPRRPL

SEQ ID NO: 129998 - protein, 15 aa, Mycobacterium tuberculosis
PLAAVPAPTPRRPLD

SEQ ID NO: 129999 - protein, 15 aa, Mycobacterium tuberculosis
LAAVPAPTPRRPLDS

SEQ ID NO: 130000 - protein, 15 aa, Mycobacterium tuberculosis
AAVPAPTPRRPLDSV

SEQ ID NO: 130001 - protein, 15 aa, Mycobacterium tuberculosis
AVPAPTPRRPLDSVL

SEQ ID NO: 130002 - protein, 15 aa, Mycobacterium tuberculosis
VPAPTPRRPLDSVLQ

SEQ ID NO: 130003 - protein, 15 aa, Mycobacterium tuberculosis
PAPTPRRPLDSVLQI

SEQ ID NO: 130004 - protein, 15 aa, Mycobacterium tuberculosis
APTPRRPLDSVLQIR

SEQ ID NO: 130005 - protein, 15 aa, Mycobacterium tuberculosis
PTPRRPLDSVLQIRQ

SEQ ID NO: 130006 - protein, 15 aa, Mycobacterium tuberculosis
TPRRPLDSVLQIRQT

SEQ ID NO: 130007 - protein, 15 aa, Mycobacterium tuberculosis
PRRPLDSVLQIRQTP

SEQ ID NO: 130008 - protein, 15 aa, Mycobacterium tuberculosis
RRPLDSVLQIRQTPE

SEQ ID NO: 130009 - protein, 15 aa, Mycobacterium tuberculosis
RPLDSVLQIRQTPEK

SEQ ID NO: 130010 - protein, 15 aa, Mycobacterium tuberculosis
PLDSVLQIRQTPEKG

SEQ ID NO: 130011 - protein, 15 aa, Mycobacterium tuberculosis
LDSVLQIRQTPEKGR

SEQ ID NO: 130012 - protein, 15 aa, Mycobacterium tuberculosis
DSVLQIRQTPEKGRN

SEQ ID NO: 130013 - protein, 15 aa, Mycobacterium tuberculosis
SVLQIRQTPEKGRNA

SEQ ID NO: 130014 - protein, 15 aa, Mycobacterium tuberculosis
VLQIRQTPEKGRNAS

SEQ ID NO: 130015 - protein, 15 aa, Mycobacterium tuberculosis
LQIRQTPEKGRNASD

SEQ ID NO: 130016 - protein, 15 aa, Mycobacterium tuberculosis
QIRQTPEKGRNASDR

SEQ ID NO: 130017 - protein, 15 aa, Mycobacterium tuberculosis
IRQTPEKGRNASDRN

SEQ ID NO: 130018 - protein, 15 aa, Mycobacterium tuberculosis
RQTPEKGRNASDRNA

SEQ ID NO: 130019 - protein, 15 aa, Mycobacterium tuberculosis
QTPEKGRNASDRNAR

SEQ ID NO: 130020 - protein, 15 aa, Mycobacterium tuberculosis
TPEKGRNASDRNARE

SEQ ID NO: 130021 - protein, 15 aa, Mycobacterium tuberculosis
PEKGRNASDRNARET

SEQ ID NO: 130022 - protein, 15 aa, Mycobacterium tuberculosis
EKGRNASDRNARETG

SEQ ID NO: 130023 - protein, 15 aa, Mycobacterium tuberculosis
KGRNASDRNARETGW

SEQ ID NO: 130024 - protein, 15 aa, Mycobacterium tuberculosis
GRNASDRNARETGWF

SEQ ID NO: 130025 - protein, 15 aa, Mycobacterium tuberculosis
RNASDRNARETGWFS

SEQ ID NO: 130026 - protein, 15 aa, Mycobacterium tuberculosis
NASDRNARETGWFSP

SEQ ID NO: 130027 - protein, 15 aa, Mycobacterium tuberculosis
ASDRNARETGWFSPP

SEQ ID NO: 130028 - protein, 16 aa, Mycobacterium tuberculosis
MLKNAVLLACRAPSVH

SEQ ID NO: 130029 - protein, 16 aa, Mycobacterium tuberculosis
LKNAVLLACRAPSVHN

SEQ ID NO: 130030 - protein, 16 aa, Mycobacterium tuberculosis
KNAVLLACRAPSVHNS

SEQ ID NO: 130031 - protein, 16 aa, Mycobacterium tuberculosis
NAVLLACRAPSVHNSQ

SEQ ID NO: 130032 - protein, 16 aa, Mycobacterium tuberculosis
AVLLACRAPSVHNSQP

SEQ ID NO: 130033 - protein, 16 aa, Mycobacterium tuberculosis
VLLACRAPSVHNSQPW

SEQ ID NO: 130034 - protein, 16 aa, Mycobacterium tuberculosis
LLACRAPSVHNSQPWR

SEQ ID NO: 130035 - protein, 16 aa, Mycobacterium tuberculosis
LACRAPSVHNSQPWRW

SEQ ID NO: 130036 - protein, 16 aa, Mycobacterium tuberculosis
ACRAPSVHNSQPWRWV

SEQ ID NO: 130037 - protein, 16 aa, Mycobacterium tuberculosis
CRAPSVHNSQPWRWVA

SEQ ID NO: 130038 - protein, 16 aa, Mycobacterium tuberculosis
RAPSVHNSQPWRWVAE

SEQ ID NO: 130039 - protein, 16 aa, Mycobacterium tuberculosis
APSVHNSQPWRWVAES

SEQ ID NO: 130040 - protein, 16 aa, Mycobacterium tuberculosis
PSVHNSQPWRWVAESG

SEQ ID NO: 130041 - protein, 16 aa, Mycobacterium tuberculosis
SVHNSQPWRWVAESGS

SEQ ID NO: 130042 - protein, 16 aa, Mycobacterium tuberculosis
VHNSQPWRWVAESGSE

SEQ ID NO: 130043 - protein, 16 aa, Mycobacterium tuberculosis
HNSQPWRWVAESGSEH

SEQ ID NO: 130044 - protein, 16 aa, Mycobacterium tuberculosis
NSQPWRWVAESGSEHT

SEQ ID NO: 130045 - protein, 16 aa, Mycobacterium tuberculosis
SQPWRWVAESGSEHTT

SEQ ID NO: 130046 - protein, 16 aa, Mycobacterium tuberculosis
QPWRWVAESGSEHTTV

SEQ ID NO: 130047 - protein, 16 aa, Mycobacterium tuberculosis
PWRWVAESGSEHTTVH

SEQ ID NO: 130048 - protein, 16 aa, Mycobacterium tuberculosis
WRWVAESGSEHTTVHL

SEQ ID NO: 130049 - protein, 16 aa, Mycobacterium tuberculosis
RWVAESGSEHTTVHLF

SEQ ID NO: 130050 - protein, 16 aa, Mycobacterium tuberculosis
WVAESGSEHTTVHLFV

SEQ ID NO: 130051 - protein, 16 aa, Mycobacterium tuberculosis
VAESGSEHTTVHLFVN

SEQ ID NO: 130052 - protein, 16 aa, Mycobacterium tuberculosis
AESGSEHTTVHLFVNR

SEQ ID NO: 130053 - protein, 16 aa, Mycobacterium tuberculosis
ESGSEHTTVHLFVNRH

SEQ ID NO: 130054 - protein, 16 aa, Mycobacterium tuberculosis
SGSEHTTVHLFVNRHR

SEQ ID NO: 130055 - protein, 16 aa, Mycobacterium tuberculosis
GSEHTTVHLFVNRHRT

SEQ ID NO: 130056 - protein, 16 aa, Mycobacterium tuberculosis
SEHTTVHLFVNRHRTV

SEQ ID NO: 130057 - protein, 16 aa, Mycobacterium tuberculosis
EHTTVHLFVNRHRTVP

SEQ ID NO: 130058 - protein, 16 aa, Mycobacterium tuberculosis
HTTVHLFVNRHRTVPA

SEQ ID NO: 130059 - protein, 16 aa, Mycobacterium tuberculosis
TTVHLFVNRHRTVPAT

SEQ ID NO: 130060 - protein, 16 aa, Mycobacterium tuberculosis
TVHLFVNRHRTVPATD

SEQ ID NO: 130061 - protein, 16 aa, Mycobacterium tuberculosis
VHLFVNRHRTVPATDH

SEQ ID NO: 130062 - protein, 16 aa, Mycobacterium tuberculosis
HLFVNRHRTVPATDHS

SEQ ID NO: 130063 - protein, 16 aa, Mycobacterium tuberculosis
LFVNRHRTVPATDHSG

SEQ ID NO: 130064 - protein, 16 aa, Mycobacterium tuberculosis
FVNRHRTVPATDHSGR

SEQ ID NO: 130065 - protein, 16 aa, Mycobacterium tuberculosis
VNRHRTVPATDHSGRQ

SEQ ID NO: 130066 - protein, 16 aa, Mycobacterium tuberculosis
NRHRTVPATDHSGRQA

SEQ ID NO: 130067 - protein, 16 aa, Mycobacterium tuberculosis
RHRTVPATDHSGRQAI

SEQ ID NO: 130068 - protein, 16 aa, Mycobacterium tuberculosis
HRTVPATDHSGRQAII

SEQ ID NO: 130069 - protein, 16 aa, Mycobacterium tuberculosis
RTVPATDHSGRQAIIS

SEQ ID NO: 130070 - protein, 16 aa, Mycobacterium tuberculosis
TVPATDHSGRQAIISC

SEQ ID NO: 130071 - protein, 16 aa, Mycobacterium tuberculosis
VPATDHSGRQAIISCG

SEQ ID NO: 130072 - protein, 16 aa, Mycobacterium tuberculosis
PATDHSGRQAIISCGA

SEQ ID NO: 130073 - protein, 16 aa, Mycobacterium tuberculosis
ATDHSGRQAIISCGAV

SEQ ID NO: 130074 - protein, 16 aa, Mycobacterium tuberculosis
TDHSGRQAIISCGAVL

SEQ ID NO: 130075 - protein, 16 aa, Mycobacterium tuberculosis
DHSGRQAIISCGAVLD

SEQ ID NO: 130076 - protein, 16 aa, Mycobacterium tuberculosis
HSGRQAIISCGAVLDH

SEQ ID NO: 130077 - protein, 16 aa, Mycobacterium tuberculosis
SGRQAIISCGAVLDHL

SEQ ID NO: 130078 - protein, 16 aa, Mycobacterium tuberculosis
GRQAIISCGAVLDHLR

SEQ ID NO: 130079 - protein, 16 aa, Mycobacterium tuberculosis
RQAIISCGAVLDHLRI

SEQ ID NO: 130080 - protein, 16 aa, Mycobacterium tuberculosis
QAIISCGAVLDHLRIA

SEQ ID NO: 130081 - protein, 16 aa, Mycobacterium tuberculosis
AIISCGAVLDHLRIAM

SEQ ID NO: 130082 - protein, 16 aa, Mycobacterium tuberculosis
IISCGAVLDHLRIAMT

SEQ ID NO: 130083 - protein, 16 aa, Mycobacterium tuberculosis
ISCGAVLDHLRIAMTA

SEQ ID NO: 130084 - protein, 16 aa, Mycobacterium tuberculosis
SCGAVLDHLRIAMTAA

SEQ ID NO: 130085 - protein, 16 aa, Mycobacterium tuberculosis
CGAVLDHLRIAMTAAH

SEQ ID NO: 130086 - protein, 16 aa, Mycobacterium tuberculosis
GAVLDHLRIAMTAAHW

SEQ ID NO: 130087 - protein, 16 aa, Mycobacterium tuberculosis
AVLDHLRIAMTAAHWQ

SEQ ID NO: 130088 - protein, 16 aa, Mycobacterium tuberculosis
VLDHLRIAMTAAHWQA

SEQ ID NO: 130089 - protein, 16 aa, Mycobacterium tuberculosis
LDHLRIAMTAAHWQAN

SEQ ID NO: 130090 - protein, 16 aa, Mycobacterium tuberculosis
DHLRIAMTAAHWQANI

SEQ ID NO: 130091 - protein, 16 aa, Mycobacterium tuberculosis
HLRIAMTAAHWQANIT

SEQ ID NO: 130092 - protein, 16 aa, Mycobacterium tuberculosis
LRIAMTAAHWQANITR

SEQ ID NO: 130093 - protein, 16 aa, Mycobacterium tuberculosis
RIAMTAAHWQANITRF

SEQ ID NO: 130094 - protein, 16 aa, Mycobacterium tuberculosis
IAMTAAHWQANITRFP

SEQ ID NO: 130095 - protein, 16 aa, Mycobacterium tuberculosis
AMTAAHWQANITRFPQ

SEQ ID NO: 130096 - protein, 16 aa, Mycobacterium tuberculosis
MTAAHWQANITRFPQP

SEQ ID NO: 130097 - protein, 16 aa, Mycobacterium tuberculosis
TAAHWQANITRFPQPN

SEQ ID NO: 130098 - protein, 16 aa, Mycobacterium tuberculosis
AAHWQANITRFPQPNQ

SEQ ID NO: 130099 - protein, 16 aa, Mycobacterium tuberculosis
AHWQANITRFPQPNQP

SEQ ID NO: 130100 - protein, 16 aa, Mycobacterium tuberculosis
HWQANITRFPQPNQPD

SEQ ID NO: 130101 - protein, 16 aa, Mycobacterium tuberculosis
WQANITRFPQPNQPDQ

SEQ ID NO: 130102 - protein, 16 aa, Mycobacterium tuberculosis
QANITRFPQPNQPDQL

SEQ ID NO: 130103 - protein, 16 aa, Mycobacterium tuberculosis
ANITRFPQPNQPDQLA

SEQ ID NO: 130104 - protein, 16 aa, Mycobacterium tuberculosis
NITRFPQPNQPDQLAT

SEQ ID NO: 130105 - protein, 16 aa, Mycobacterium tuberculosis
ITRFPQPNQPDQLATV

SEQ ID NO: 130106 - protein, 16 aa, Mycobacterium tuberculosis
TRFPQPNQPDQLATVE

SEQ ID NO: 130107 - protein, 16 aa, Mycobacterium tuberculosis
RFPQPNQPDQLATVEF

SEQ ID NO: 130108 - protein, 16 aa, Mycobacterium tuberculosis
FPQPNQPDQLATVEFS

SEQ ID NO: 130109 - protein, 16 aa, Mycobacterium tuberculosis
PQPNQPDQLATVEFSP

SEQ ID NO: 130110 - protein, 16 aa, Mycobacterium tuberculosis
QPNQPDQLATVEFSPI

SEQ ID NO: 130111 - protein, 16 aa, Mycobacterium tuberculosis
PNQPDQLATVEFSPID

SEQ ID NO: 130112 - protein, 16 aa, Mycobacterium tuberculosis
NQPDQLATVEFSPIDH

SEQ ID NO: 130113 - protein, 16 aa, Mycobacterium tuberculosis
QPDQLATVEFSPIDHV

SEQ ID NO: 130114 - protein, 16 aa, Mycobacterium tuberculosis
PDQLATVEFSPIDHVT

SEQ ID NO: 130115 - protein, 16 aa, Mycobacterium tuberculosis
DQLATVEFSPIDHVTA

SEQ ID NO: 130116 - protein, 16 aa, Mycobacterium tuberculosis
QLATVEFSPIDHVTAG

SEQ ID NO: 130117 - protein, 16 aa, Mycobacterium tuberculosis
LATVEFSPIDHVTAGQ

SEQ ID NO: 130118 - protein, 16 aa, Mycobacterium tuberculosis
ATVEFSPIDHVTAGQR

SEQ ID NO: 130119 - protein, 16 aa, Mycobacterium tuberculosis
TVEFSPIDHVTAGQRN

SEQ ID NO: 130120 - protein, 16 aa, Mycobacterium tuberculosis
VEFSPIDHVTAGQRNR

SEQ ID NO: 130121 - protein, 16 aa, Mycobacterium tuberculosis
EFSPIDHVTAGQRNRA

SEQ ID NO: 130122 - protein, 16 aa, Mycobacterium tuberculosis
FSPIDHVTAGQRNRAQ

SEQ ID NO: 130123 - protein, 16 aa, Mycobacterium tuberculosis
SPIDHVTAGQRNRAQA

SEQ ID NO: 130124 - protein, 16 aa, Mycobacterium tuberculosis
PIDHVTAGQRNRAQAI

SEQ ID NO: 130125 - protein, 16 aa, Mycobacterium tuberculosis
IDHVTAGQRNRAQAIL

SEQ ID NO: 130126 - protein, 16 aa, Mycobacterium tuberculosis
DHVTAGQRNRAQAILQ

SEQ ID NO: 130127 - protein, 16 aa, Mycobacterium tuberculosis
HVTAGQRNRAQAILQR

SEQ ID NO: 130128 - protein, 16 aa, Mycobacterium tuberculosis
VTAGQRNRAQAILQRR

SEQ ID NO: 130129 - protein, 16 aa, Mycobacterium tuberculosis
TAGQRNRAQAILQRRT

SEQ ID NO: 130130 - protein, 16 aa, Mycobacterium tuberculosis
AGQRNRAQAILQRRTD

SEQ ID NO: 130131 - protein, 16 aa, Mycobacterium tuberculosis
GQRNRAQAILQRRTDR

SEQ ID NO: 130132 - protein, 16 aa, Mycobacterium tuberculosis
QRNRAQAILQRRTDRL

SEQ ID NO: 130133 - protein, 16 aa, Mycobacterium tuberculosis
RNRAQAILQRRTDRLP

SEQ ID NO: 130134 - protein, 16 aa, Mycobacterium tuberculosis
NRAQAILQRRTDRLPF

SEQ ID NO: 130135 - protein, 16 aa, Mycobacterium tuberculosis
RAQAILQRRTDRLPFD

SEQ ID NO: 130136 - protein, 16 aa, Mycobacterium tuberculosis
AQAILQRRTDRLPFDS

SEQ ID NO: 130137 - protein, 16 aa, Mycobacterium tuberculosis
QAILQRRTDRLPFDSP

SEQ ID NO: 130138 - protein, 16 aa, Mycobacterium tuberculosis
AILQRRTDRLPFDSPM

SEQ ID NO: 130139 - protein, 16 aa, Mycobacterium tuberculosis
ILQRRTDRLPFDSPMY

SEQ ID NO: 130140 - protein, 16 aa, Mycobacterium tuberculosis
LQRRTDRLPFDSPMYW

SEQ ID NO: 130141 - protein, 16 aa, Mycobacterium tuberculosis
QRRTDRLPFDSPMYWH

SEQ ID NO: 130142 - protein, 16 aa, Mycobacterium tuberculosis
RRTDRLPFDSPMYWHL

SEQ ID NO: 130143 - protein, 16 aa, Mycobacterium tuberculosis
RTDRLPFDSPMYWHLF

SEQ ID NO: 130144 - protein, 16 aa, Mycobacterium tuberculosis
TDRLPFDSPMYWHLFE

SEQ ID NO: 130145 - protein, 16 aa, Mycobacterium tuberculosis
DRLPFDSPMYWHLFEP

SEQ ID NO: 130146 - protein, 16 aa, Mycobacterium tuberculosis
RLPFDSPMYWHLFEPA

SEQ ID NO: 130147 - protein, 16 aa, Mycobacterium tuberculosis
LPFDSPMYWHLFEPAL

SEQ ID NO: 130148 - protein, 16 aa, Mycobacterium tuberculosis
PFDSPMYWHLFEPALR

SEQ ID NO: 130149 - protein, 16 aa, Mycobacterium tuberculosis
FDSPMYWHLFEPALRD

SEQ ID NO: 130150 - protein, 16 aa, Mycobacterium tuberculosis
DSPMYWHLFEPALRDA

SEQ ID NO: 130151 - protein, 16 aa, Mycobacterium tuberculosis
SPMYWHLFEPALRDAV

SEQ ID NO: 130152 - protein, 16 aa, Mycobacterium tuberculosis
PMYWHLFEPALRDAVD

SEQ ID NO: 130153 - protein, 16 aa, Mycobacterium tuberculosis
MYWHLFEPALRDAVDK

SEQ ID NO: 130154 - protein, 16 aa, Mycobacterium tuberculosis
YWHLFEPALRDAVDKD

SEQ ID NO: 130155 - protein, 16 aa, Mycobacterium tuberculosis
WHLFEPALRDAVDKDV

SEQ ID NO: 130156 - protein, 16 aa, Mycobacterium tuberculosis
HLFEPALRDAVDKDVA

SEQ ID NO: 130157 - protein, 16 aa, Mycobacterium tuberculosis
LFEPALRDAVDKDVAM

SEQ ID NO: 130158 - protein, 16 aa, Mycobacterium tuberculosis
FEPALRDAVDKDVAML

SEQ ID NO: 130159 - protein, 16 aa, Mycobacterium tuberculosis
EPALRDAVDKDVAMLD

SEQ ID NO: 130160 - protein, 16 aa, Mycobacterium tuberculosis
PALRDAVDKDVAMLDV

SEQ ID NO: 130161 - protein, 16 aa, Mycobacterium tuberculosis
ALRDAVDKDVAMLDVV

SEQ ID NO: 130162 - protein, 16 aa, Mycobacterium tuberculosis
LRDAVDKDVAMLDVVS

SEQ ID NO: 130163 - protein, 16 aa, Mycobacterium tuberculosis
RDAVDKDVAMLDVVSD

SEQ ID NO: 130164 - protein, 16 aa, Mycobacterium tuberculosis
DAVDKDVAMLDVVSDD

SEQ ID NO: 130165 - protein, 16 aa, Mycobacterium tuberculosis
AVDKDVAMLDVVSDDQ

SEQ ID NO: 130166 - protein, 16 aa, Mycobacterium tuberculosis
VDKDVAMLDVVSDDQR

SEQ ID NO: 130167 - protein, 16 aa, Mycobacterium tuberculosis
DKDVAMLDVVSDDQRT

SEQ ID NO: 130168 - protein, 16 aa, Mycobacterium tuberculosis
KDVAMLDVVSDDQRTR

SEQ ID NO: 130169 - protein, 16 aa, Mycobacterium tuberculosis
DVAMLDVVSDDQRTRL

SEQ ID NO: 130170 - protein, 16 aa, Mycobacterium tuberculosis
VAMLDVVSDDQRTRLV

SEQ ID NO: 130171 - protein, 16 aa, Mycobacterium tuberculosis
AMLDVVSDDQRTRLVV

SEQ ID NO: 130172 - protein, 16 aa, Mycobacterium tuberculosis
MLDVVSDDQRTRLVVA

SEQ ID NO: 130173 - protein, 16 aa, Mycobacterium tuberculosis
LDVVSDDQRTRLVVAS

SEQ ID NO: 130174 - protein, 16 aa, Mycobacterium tuberculosis
DVVSDDQRTRLVVASQ

SEQ ID NO: 130175 - protein, 16 aa, Mycobacterium tuberculosis
VVSDDQRTRLVVASQL

SEQ ID NO: 130176 - protein, 16 aa, Mycobacterium tuberculosis
VSDDQRTRLVVASQLS

SEQ ID NO: 130177 - protein, 16 aa, Mycobacterium tuberculosis
SDDQRTRLVVASQLSE

SEQ ID NO: 130178 - protein, 16 aa, Mycobacterium tuberculosis
DDQRTRLVVASQLSEV

SEQ ID NO: 130179 - protein, 16 aa, Mycobacterium tuberculosis
DQRTRLVVASQLSEVL

SEQ ID NO: 130180 - protein, 16 aa, Mycobacterium tuberculosis
QRTRLVVASQLSEVLR

SEQ ID NO: 130181 - protein, 16 aa, Mycobacterium tuberculosis
RTRLVVASQLSEVLRR

SEQ ID NO: 130182 - protein, 16 aa, Mycobacterium tuberculosis
TRLVVASQLSEVLRRD

SEQ ID NO: 130183 - protein, 16 aa, Mycobacterium tuberculosis
RLVVASQLSEVLRRDD

SEQ ID NO: 130184 - protein, 16 aa, Mycobacterium tuberculosis
LVVASQLSEVLRRDDP

SEQ ID NO: 130185 - protein, 16 aa, Mycobacterium tuberculosis
VVASQLSEVLRRDDPY

SEQ ID NO: 130186 - protein, 16 aa, Mycobacterium tuberculosis
VASQLSEVLRRDDPYY

SEQ ID NO: 130187 - protein, 16 aa, Mycobacterium tuberculosis
ASQLSEVLRRDDPYYH

SEQ ID NO: 130188 - protein, 16 aa, Mycobacterium tuberculosis
SQLSEVLRRDDPYYHA

SEQ ID NO: 130189 - protein, 16 aa, Mycobacterium tuberculosis
QLSEVLRRDDPYYHAE

SEQ ID NO: 130190 - protein, 16 aa, Mycobacterium tuberculosis
LSEVLRRDDPYYHAEL

SEQ ID NO: 130191 - protein, 16 aa, Mycobacterium tuberculosis
SEVLRRDDPYYHAELE

SEQ ID NO: 130192 - protein, 16 aa, Mycobacterium tuberculosis
EVLRRDDPYYHAELEW

SEQ ID NO: 130193 - protein, 16 aa, Mycobacterium tuberculosis
VLRRDDPYYHAELEWW

SEQ ID NO: 130194 - protein, 16 aa, Mycobacterium tuberculosis
LRRDDPYYHAELEWWT

SEQ ID NO: 130195 - protein, 16 aa, Mycobacterium tuberculosis
RRDDPYYHAELEWWTS

SEQ ID NO: 130196 - protein, 16 aa, Mycobacterium tuberculosis
RDDPYYHAELEWWTSP

SEQ ID NO: 130197 - protein, 16 aa, Mycobacterium tuberculosis
DDPYYHAELEWWTSPF

SEQ ID NO: 130198 - protein, 16 aa, Mycobacterium tuberculosis
DPYYHAELEWWTSPFV

SEQ ID NO: 130199 - protein, 16 aa, Mycobacterium tuberculosis
PYYHAELEWWTSPFVL

SEQ ID NO: 130200 - protein, 16 aa, Mycobacterium tuberculosis
YYHAELEWWTSPFVLA

SEQ ID NO: 130201 - protein, 16 aa, Mycobacterium tuberculosis
YHAELEWWTSPFVLAH

SEQ ID NO: 130202 - protein, 16 aa, Mycobacterium tuberculosis
HAELEWWTSPFVLAHG

SEQ ID NO: 130203 - protein, 16 aa, Mycobacterium tuberculosis
AELEWWTSPFVLAHGV

SEQ ID NO: 130204 - protein, 16 aa, Mycobacterium tuberculosis
ELEWWTSPFVLAHGVP

SEQ ID NO: 130205 - protein, 16 aa, Mycobacterium tuberculosis
LEWWTSPFVLAHGVPP

SEQ ID NO: 130206 - protein, 16 aa, Mycobacterium tuberculosis
EWWTSPFVLAHGVPPD

SEQ ID NO: 130207 - protein, 16 aa, Mycobacterium tuberculosis
WWTSPFVLAHGVPPDT

SEQ ID NO: 130208 - protein, 16 aa, Mycobacterium tuberculosis
WTSPFVLAHGVPPDTL

SEQ ID NO: 130209 - protein, 16 aa, Mycobacterium tuberculosis
TSPFVLAHGVPPDTLA

SEQ ID NO: 130210 - protein, 16 aa, Mycobacterium tuberculosis
SPFVLAHGVPPDTLAS

SEQ ID NO: 130211 - protein, 16 aa, Mycobacterium tuberculosis
PFVLAHGVPPDTLASD

SEQ ID NO: 130212 - protein, 16 aa, Mycobacterium tuberculosis
FVLAHGVPPDTLASDA

SEQ ID NO: 130213 - protein, 16 aa, Mycobacterium tuberculosis
VLAHGVPPDTLASDAE

SEQ ID NO: 130214 - protein, 16 aa, Mycobacterium tuberculosis
LAHGVPPDTLASDAER

SEQ ID NO: 130215 - protein, 16 aa, Mycobacterium tuberculosis
AHGVPPDTLASDAERL

SEQ ID NO: 130216 - protein, 16 aa, Mycobacterium tuberculosis
HGVPPDTLASDAERLR

SEQ ID NO: 130217 - protein, 16 aa, Mycobacterium tuberculosis
GVPPDTLASDAERLRV

SEQ ID NO: 130218 - protein, 16 aa, Mycobacterium tuberculosis
VPPDTLASDAERLRVD

SEQ ID NO: 130219 - protein, 16 aa, Mycobacterium tuberculosis
PPDTLASDAERLRVDL

SEQ ID NO: 130220 - protein, 16 aa, Mycobacterium tuberculosis
PDTLASDAERLRVDLG

SEQ ID NO: 130221 - protein, 16 aa, Mycobacterium tuberculosis
DTLASDAERLRVDLGR

SEQ ID NO: 130222 - protein, 16 aa, Mycobacterium tuberculosis
TLASDAERLRVDLGRD

SEQ ID NO: 130223 - protein, 16 aa, Mycobacterium tuberculosis
LASDAERLRVDLGRDF

SEQ ID NO: 130224 - protein, 16 aa, Mycobacterium tuberculosis
ASDAERLRVDLGRDFP

SEQ ID NO: 130225 - protein, 16 aa, Mycobacterium tuberculosis
SDAERLRVDLGRDFPV

SEQ ID NO: 130226 - protein, 16 aa, Mycobacterium tuberculosis
DAERLRVDLGRDFPVR

SEQ ID NO: 130227 - protein, 16 aa, Mycobacterium tuberculosis
AERLRVDLGRDFPVRS

SEQ ID NO: 130228 - protein, 16 aa, Mycobacterium tuberculosis
ERLRVDLGRDFPVRSY

SEQ ID NO: 130229 - protein, 16 aa, Mycobacterium tuberculosis
RLRVDLGRDFPVRSYQ

SEQ ID NO: 130230 - protein, 16 aa, Mycobacterium tuberculosis
LRVDLGRDFPVRSYQN

SEQ ID NO: 130231 - protein, 16 aa, Mycobacterium tuberculosis
RVDLGRDFPVRSYQNR

SEQ ID NO: 130232 - protein, 16 aa, Mycobacterium tuberculosis
VDLGRDFPVRSYQNRR

SEQ ID NO: 130233 - protein, 16 aa, Mycobacterium tuberculosis
DLGRDFPVRSYQNRRA

SEQ ID NO: 130234 - protein, 16 aa, Mycobacterium tuberculosis
LGRDFPVRSYQNRRAE

SEQ ID NO: 130235 - protein, 16 aa, Mycobacterium tuberculosis
GRDFPVRSYQNRRAEL

SEQ ID NO: 130236 - protein, 16 aa, Mycobacterium tuberculosis
RDFPVRSYQNRRAELA

SEQ ID NO: 130237 - protein, 16 aa, Mycobacterium tuberculosis
DFPVRSYQNRRAELAD

SEQ ID NO: 130238 - protein, 16 aa, Mycobacterium tuberculosis
FPVRSYQNRRAELADD

SEQ ID NO: 130239 - protein, 16 aa, Mycobacterium tuberculosis
PVRSYQNRRAELADDR

SEQ ID NO: 130240 - protein, 16 aa, Mycobacterium tuberculosis
VRSYQNRRAELADDRS

SEQ ID NO: 130241 - protein, 16 aa, Mycobacterium tuberculosis
RSYQNRRAELADDRSK

SEQ ID NO: 130242 - protein, 16 aa, Mycobacterium tuberculosis
SYQNRRAELADDRSKV

SEQ ID NO: 130243 - protein, 16 aa, Mycobacterium tuberculosis
YQNRRAELADDRSKVL

SEQ ID NO: 130244 - protein, 16 aa, Mycobacterium tuberculosis
QNRRAELADDRSKVLV

SEQ ID NO: 130245 - protein, 16 aa, Mycobacterium tuberculosis
NRRAELADDRSKVLVL

SEQ ID NO: 130246 - protein, 16 aa, Mycobacterium tuberculosis
RRAELADDRSKVLVLS

SEQ ID NO: 130247 - protein, 16 aa, Mycobacterium tuberculosis
RAELADDRSKVLVLST

SEQ ID NO: 130248 - protein, 16 aa, Mycobacterium tuberculosis
AELADDRSKVLVLSTP

SEQ ID NO: 130249 - protein, 16 aa, Mycobacterium tuberculosis
ELADDRSKVLVLSTPS

SEQ ID NO: 130250 - protein, 16 aa, Mycobacterium tuberculosis
LADDRSKVLVLSTPSD

SEQ ID NO: 130251 - protein, 16 aa, Mycobacterium tuberculosis
ADDRSKVLVLSTPSDT

SEQ ID NO: 130252 - protein, 16 aa, Mycobacterium tuberculosis
DDRSKVLVLSTPSDTR

SEQ ID NO: 130253 - protein, 16 aa, Mycobacterium tuberculosis
DRSKVLVLSTPSDTRA

SEQ ID NO: 130254 - protein, 16 aa, Mycobacterium tuberculosis
RSKVLVLSTPSDTRAD

SEQ ID NO: 130255 - protein, 16 aa, Mycobacterium tuberculosis
SKVLVLSTPSDTRADA

SEQ ID NO: 130256 - protein, 16 aa, Mycobacterium tuberculosis
KVLVLSTPSDTRADAL

SEQ ID NO: 130257 - protein, 16 aa, Mycobacterium tuberculosis
VLVLSTPSDTRADALR

SEQ ID NO: 130258 - protein, 16 aa, Mycobacterium tuberculosis
LVLSTPSDTRADALRC

SEQ ID NO: 130259 - protein, 16 aa, Mycobacterium tuberculosis
VLSTPSDTRADALRCG

SEQ ID NO: 130260 - protein, 16 aa, Mycobacterium tuberculosis
LSTPSDTRADALRCGE

SEQ ID NO: 130261 - protein, 16 aa, Mycobacterium tuberculosis
STPSDTRADALRCGEV

SEQ ID NO: 130262 - protein, 16 aa, Mycobacterium tuberculosis
TPSDTRADALRCGEVL

SEQ ID NO: 130263 - protein, 16 aa, Mycobacterium tuberculosis
PSDTRADALRCGEVLS

SEQ ID NO: 130264 - protein, 16 aa, Mycobacterium tuberculosis
SDTRADALRCGEVLST

SEQ ID NO: 130265 - protein, 16 aa, Mycobacterium tuberculosis
DTRADALRCGEVLSTI

SEQ ID NO: 130266 - protein, 16 aa, Mycobacterium tuberculosis
TRADALRCGEVLSTIL

SEQ ID NO: 130267 - protein, 16 aa, Mycobacterium tuberculosis
RADALRCGEVLSTILL

SEQ ID NO: 130268 - protein, 16 aa, Mycobacterium tuberculosis
ADALRCGEVLSTILLE

SEQ ID NO: 130269 - protein, 16 aa, Mycobacterium tuberculosis
DALRCGEVLSTILLEC

SEQ ID NO: 130270 - protein, 16 aa, Mycobacterium tuberculosis
ALRCGEVLSTILLECT

SEQ ID NO: 130271 - protein, 16 aa, Mycobacterium tuberculosis
LRCGEVLSTILLECTM

SEQ ID NO: 130272 - protein, 16 aa, Mycobacterium tuberculosis
RCGEVLSTILLECTMA

SEQ ID NO: 130273 - protein, 16 aa, Mycobacterium tuberculosis
CGEVLSTILLECTMAG

SEQ ID NO: 130274 - protein, 16 aa, Mycobacterium tuberculosis
GEVLSTILLECTMAGM

SEQ ID NO: 130275 - protein, 16 aa, Mycobacterium tuberculosis
EVLSTILLECTMAGMA

SEQ ID NO: 130276 - protein, 16 aa, Mycobacterium tuberculosis
VLSTILLECTMAGMAT

SEQ ID NO: 130277 - protein, 16 aa, Mycobacterium tuberculosis
LSTILLECTMAGMATC

SEQ ID NO: 130278 - protein, 16 aa, Mycobacterium tuberculosis
STILLECTMAGMATCT

SEQ ID NO: 130279 - protein, 16 aa, Mycobacterium tuberculosis
TILLECTMAGMATCTL

SEQ ID NO: 130280 - protein, 16 aa, Mycobacterium tuberculosis
ILLECTMAGMATCTLT

SEQ ID NO: 130281 - protein, 16 aa, Mycobacterium tuberculosis
LLECTMAGMATCTLTH

SEQ ID NO: 130282 - protein, 16 aa, Mycobacterium tuberculosis
LECTMAGMATCTLTHL

SEQ ID NO: 130283 - protein, 16 aa, Mycobacterium tuberculosis
ECTMAGMATCTLTHLI

SEQ ID NO: 130284 - protein, 16 aa, Mycobacterium tuberculosis
CTMAGMATCTLTHLIE

SEQ ID NO: 130285 - protein, 16 aa, Mycobacterium tuberculosis
TMAGMATCTLTHLIES

SEQ ID NO: 130286 - protein, 16 aa, Mycobacterium tuberculosis
MAGMATCTLTHLIESS

SEQ ID NO: 130287 - protein, 16 aa, Mycobacterium tuberculosis
AGMATCTLTHLIESSD

SEQ ID NO: 130288 - protein, 16 aa, Mycobacterium tuberculosis
GMATCTLTHLIESSDS

SEQ ID NO: 130289 - protein, 16 aa, Mycobacterium tuberculosis
MATCTLTHLIESSDSR

SEQ ID NO: 130290 - protein, 16 aa, Mycobacterium tuberculosis
ATCTLTHLIESSDSRD

SEQ ID NO: 130291 - protein, 16 aa, Mycobacterium tuberculosis
TCTLTHLIESSDSRDI

SEQ ID NO: 130292 - protein, 16 aa, Mycobacterium tuberculosis
CTLTHLIESSDSRDIV

SEQ ID NO: 130293 - protein, 16 aa, Mycobacterium tuberculosis
TLTHLIESSDSRDIVR

SEQ ID NO: 130294 - protein, 16 aa, Mycobacterium tuberculosis
LTHLIESSDSRDIVRG

SEQ ID NO: 130295 - protein, 16 aa, Mycobacterium tuberculosis
THLIESSDSRDIVRGL

SEQ ID NO: 130296 - protein, 16 aa, Mycobacterium tuberculosis
HLIESSDSRDIVRGLT

SEQ ID NO: 130297 - protein, 16 aa, Mycobacterium tuberculosis
LIESSDSRDIVRGLTR

SEQ ID NO: 130298 - protein, 16 aa, Mycobacterium tuberculosis
IESSDSRDIVRGLTRQ

SEQ ID NO: 130299 - protein, 16 aa, Mycobacterium tuberculosis
ESSDSRDIVRGLTRQR

SEQ ID NO: 130300 - protein, 16 aa, Mycobacterium tuberculosis
SSDSRDIVRGLTRQRG

SEQ ID NO: 130301 - protein, 16 aa, Mycobacterium tuberculosis
SDSRDIVRGLTRQRGE

SEQ ID NO: 130302 - protein, 16 aa, Mycobacterium tuberculosis
DSRDIVRGLTRQRGEP

SEQ ID NO: 130303 - protein, 16 aa, Mycobacterium tuberculosis
SRDIVRGLTRQRGEPQ

SEQ ID NO: 130304 - protein, 16 aa, Mycobacterium tuberculosis
RDIVRGLTRQRGEPQA

SEQ ID NO: 130305 - protein, 16 aa, Mycobacterium tuberculosis
DIVRGLTRQRGEPQAL

SEQ ID NO: 130306 - protein, 16 aa, Mycobacterium tuberculosis
IVRGLTRQRGEPQALI

SEQ ID NO: 130307 - protein, 16 aa, Mycobacterium tuberculosis
VRGLTRQRGEPQALIR

SEQ ID NO: 130308 - protein, 16 aa, Mycobacterium tuberculosis
RGLTRQRGEPQALIRV

SEQ ID NO: 130309 - protein, 16 aa, Mycobacterium tuberculosis
GLTRQRGEPQALIRVG

SEQ ID NO: 130310 - protein, 16 aa, Mycobacterium tuberculosis
LTRQRGEPQALIRVGI

SEQ ID NO: 130311 - protein, 16 aa, Mycobacterium tuberculosis
TRQRGEPQALIRVGIA

SEQ ID NO: 130312 - protein, 16 aa, Mycobacterium tuberculosis
RQRGEPQALIRVGIAP

SEQ ID NO: 130313 - protein, 16 aa, Mycobacterium tuberculosis
QRGEPQALIRVGIAPP

SEQ ID NO: 130314 - protein, 16 aa, Mycobacterium tuberculosis
RGEPQALIRVGIAPPL

SEQ ID NO: 130315 - protein, 16 aa, Mycobacterium tuberculosis
GEPQALIRVGIAPPLA

SEQ ID NO: 130316 - protein, 16 aa, Mycobacterium tuberculosis
EPQALIRVGIAPPLAA

SEQ ID NO: 130317 - protein, 16 aa, Mycobacterium tuberculosis
PQALIRVGIAPPLAAV

SEQ ID NO: 130318 - protein, 16 aa, Mycobacterium tuberculosis
QALIRVGIAPPLAAVP

SEQ ID NO: 130319 - protein, 16 aa, Mycobacterium tuberculosis
ALIRVGIAPPLAAVPA

SEQ ID NO: 130320 - protein, 16 aa, Mycobacterium tuberculosis
LIRVGIAPPLAAVPAP

SEQ ID NO: 130321 - protein, 16 aa, Mycobacterium tuberculosis
IRVGIAPPLAAVPAPT

SEQ ID NO: 130322 - protein, 16 aa, Mycobacterium tuberculosis
RVGIAPPLAAVPAPTP

SEQ ID NO: 130323 - protein, 16 aa, Mycobacterium tuberculosis
VGIAPPLAAVPAPTPR

SEQ ID NO: 130324 - protein, 16 aa, Mycobacterium tuberculosis
GIAPPLAAVPAPTPRR

SEQ ID NO: 130325 - protein, 16 aa, Mycobacterium tuberculosis
IAPPLAAVPAPTPRRP

SEQ ID NO: 130326 - protein, 16 aa, Mycobacterium tuberculosis
APPLAAVPAPTPRRPL

SEQ ID NO: 130327 - protein, 16 aa, Mycobacterium tuberculosis
PPLAAVPAPTPRRPLD

SEQ ID NO: 130328 - protein, 16 aa, Mycobacterium tuberculosis
PLAAVPAPTPRRPLDS

SEQ ID NO: 130329 - protein, 16 aa, Mycobacterium tuberculosis
LAAVPAPTPRRPLDSV

SEQ ID NO: 130330 - protein, 16 aa, Mycobacterium tuberculosis
AAVPAPTPRRPLDSVL

SEQ ID NO: 130331 - protein, 16 aa, Mycobacterium tuberculosis
AVPAPTPRRPLDSVLQ

SEQ ID NO: 130332 - protein, 16 aa, Mycobacterium tuberculosis
VPAPTPRRPLDSVLQI

SEQ ID NO: 130333 - protein, 16 aa, Mycobacterium tuberculosis
PAPTPRRPLDSVLQIR

SEQ ID NO: 130334 - protein, 16 aa, Mycobacterium tuberculosis
APTPRRPLDSVLQIRQ

SEQ ID NO: 130335 - protein, 16 aa, Mycobacterium tuberculosis
PTPRRPLDSVLQIRQT

SEQ ID NO: 130336 - protein, 16 aa, Mycobacterium tuberculosis
TPRRPLDSVLQIRQTP

SEQ ID NO: 130337 - protein, 16 aa, Mycobacterium tuberculosis
PRRPLDSVLQIRQTPE

SEQ ID NO: 130338 - protein, 16 aa, Mycobacterium tuberculosis
RRPLDSVLQIRQTPEK

SEQ ID NO: 130339 - protein, 16 aa, Mycobacterium tuberculosis
RPLDSVLQIRQTPEKG

SEQ ID NO: 130340 - protein, 16 aa, Mycobacterium tuberculosis
PLDSVLQIRQTPEKGR

SEQ ID NO: 130341 - protein, 16 aa, Mycobacterium tuberculosis
LDSVLQIRQTPEKGRN

SEQ ID NO: 130342 - protein, 16 aa, Mycobacterium tuberculosis
DSVLQIRQTPEKGRNA

SEQ ID NO: 130343 - protein, 16 aa, Mycobacterium tuberculosis
SVLQIRQTPEKGRNAS

SEQ ID NO: 130344 - protein, 16 aa, Mycobacterium tuberculosis
VLQIRQTPEKGRNASD

SEQ ID NO: 130345 - protein, 16 aa, Mycobacterium tuberculosis
LQIRQTPEKGRNASDR

SEQ ID NO: 130346 - protein, 16 aa, Mycobacterium tuberculosis
QIRQTPEKGRNASDRN

SEQ ID NO: 130347 - protein, 16 aa, Mycobacterium tuberculosis
IRQTPEKGRNASDRNA

SEQ ID NO: 130348 - protein, 16 aa, Mycobacterium tuberculosis
RQTPEKGRNASDRNAR

SEQ ID NO: 130349 - protein, 16 aa, Mycobacterium tuberculosis
QTPEKGRNASDRNARE

SEQ ID NO: 130350 - protein, 16 aa, Mycobacterium tuberculosis
TPEKGRNASDRNARET

SEQ ID NO: 130351 - protein, 16 aa, Mycobacterium tuberculosis
PEKGRNASDRNARETG

SEQ ID NO: 130352 - protein, 16 aa, Mycobacterium tuberculosis
EKGRNASDRNARETGW

SEQ ID NO: 130353 - protein, 16 aa, Mycobacterium tuberculosis
KGRNASDRNARETGWF

SEQ ID NO: 130354 - protein, 16 aa, Mycobacterium tuberculosis
GRNASDRNARETGWFS

SEQ ID NO: 130355 - protein, 16 aa, Mycobacterium tuberculosis
RNASDRNARETGWFSP

SEQ ID NO: 130356 - protein, 16 aa, Mycobacterium tuberculosis
NASDRNARETGWFSPP

SEQ ID NO: 130357 - protein, 210 aa, Mycobacterium tuberculosis
MIATTRDREGATMITFRLRLPCRTILRVFSRNPLVRGTDRLEAVVMLLAVTVSLLTIPFAAAAGTAVQDSRSHVYAHQAQTRHPATATVIDHEGVIDSNTTATSAPPRTKITVPARWVVNGIERSGEVNAKPGTKSGDRVGIWVDSAGQLVDEPAPPARAIADAALAALGLWLSVAAVAGALLALTRAILIRVRNASWQHDIDSLFCTQR

SEQ ID NO: 130358 - protein, 8 aa, Mycobacterium tuberculosis
MIATTRDR

SEQ ID NO: 130359 - protein, 8 aa, Mycobacterium tuberculosis
EGATMITF

SEQ ID NO: 130360 - protein, 8 aa, Mycobacterium tuberculosis
GATMITFR

SEQ ID NO: 130361 - protein, 8 aa, Mycobacterium tuberculosis
ATMITFRL

SEQ ID NO: 130362 - protein, 8 aa, Mycobacterium tuberculosis
TMITFRLR

SEQ ID NO: 130363 - protein, 8 aa, Mycobacterium tuberculosis
MITFRLRL

SEQ ID NO: 130364 - protein, 8 aa, Mycobacterium tuberculosis
RLPCRTIL

SEQ ID NO: 130365 - protein, 8 aa, Mycobacterium tuberculosis
LPCRTILR

SEQ ID NO: 130366 - protein, 8 aa, Mycobacterium tuberculosis
TILRVFSR

SEQ ID NO: 130367 - protein, 8 aa, Mycobacterium tuberculosis
RVFSRNPL

SEQ ID NO: 130368 - protein, 8 aa, Mycobacterium tuberculosis
FSRNPLVR

SEQ ID NO: 130369 - protein, 8 aa, Mycobacterium tuberculosis
GTDRLEAV

SEQ ID NO: 130370 - protein, 8 aa, Mycobacterium tuberculosis
RLEAVVML

SEQ ID NO: 130371 - protein, 8 aa, Mycobacterium tuberculosis
LEAVVMLL

SEQ ID NO: 130372 - protein, 8 aa, Mycobacterium tuberculosis
EAVVMLLA

SEQ ID NO: 130373 - protein, 8 aa, Mycobacterium tuberculosis
AVVMLLAV

SEQ ID NO: 130374 - protein, 8 aa, Mycobacterium tuberculosis
VMLLAVTV

SEQ ID NO: 130375 - protein, 8 aa, Mycobacterium tuberculosis
MLLAVTVS

SEQ ID NO: 130376 - protein, 8 aa, Mycobacterium tuberculosis
LLAVTVSL

SEQ ID NO: 130377 - protein, 8 aa, Mycobacterium tuberculosis
LAVTVSLL

SEQ ID NO: 130378 - protein, 8 aa, Mycobacterium tuberculosis
VTVSLLTI

SEQ ID NO: 130379 - protein, 8 aa, Mycobacterium tuberculosis
VSLLTIPF

SEQ ID NO: 130380 - protein, 8 aa, Mycobacterium tuberculosis
SLLTIPFA

SEQ ID NO: 130381 - protein, 8 aa, Mycobacterium tuberculosis
LLTIPFAA

SEQ ID NO: 130382 - protein, 8 aa, Mycobacterium tuberculosis
LTIPFAAA

SEQ ID NO: 130383 - protein, 8 aa, Mycobacterium tuberculosis
TIPFAAAA

SEQ ID NO: 130384 - protein, 8 aa, Mycobacterium tuberculosis
IPFAAAAG

SEQ ID NO: 130385 - protein, 8 aa, Mycobacterium tuberculosis
FAAAAGTA

SEQ ID NO: 130386 - protein, 8 aa, Mycobacterium tuberculosis
AAAAGTAV

SEQ ID NO: 130387 - protein, 8 aa, Mycobacterium tuberculosis
GTAVQDSR

SEQ ID NO: 130388 - protein, 8 aa, Mycobacterium tuberculosis
VQDSRSHV

SEQ ID NO: 130389 - protein, 8 aa, Mycobacterium tuberculosis
RSHVYAHQ

SEQ ID NO: 130390 - protein, 8 aa, Mycobacterium tuberculosis
YAHQAQTR

SEQ ID NO: 130391 - protein, 8 aa, Mycobacterium tuberculosis
HPATATVI

SEQ ID NO: 130392 - protein, 8 aa, Mycobacterium tuberculosis
TVIDHEGV

SEQ ID NO: 130393 - protein, 8 aa, Mycobacterium tuberculosis
VIDSNTTA

SEQ ID NO: 130394 - protein, 8 aa, Mycobacterium tuberculosis
TATSAPPR

SEQ ID NO: 130395 - protein, 8 aa, Mycobacterium tuberculosis
TSAPPRTK

SEQ ID NO: 130396 - protein, 8 aa, Mycobacterium tuberculosis
PPRTKITV

SEQ ID NO: 130397 - protein, 8 aa, Mycobacterium tuberculosis
RTKITVPA

SEQ ID NO: 130398 - protein, 8 aa, Mycobacterium tuberculosis
TKITVPAR

SEQ ID NO: 130399 - protein, 8 aa, Mycobacterium tuberculosis
KITVPARW

SEQ ID NO: 130400 - protein, 8 aa, Mycobacterium tuberculosis
ITVPARWV

SEQ ID NO: 130401 - protein, 8 aa, Mycobacterium tuberculosis
TVPARWVV

SEQ ID NO: 130402 - protein, 8 aa, Mycobacterium tuberculosis
WVVNGIER

SEQ ID NO: 130403 - protein, 8 aa, Mycobacterium tuberculosis
GIERSGEV

SEQ ID NO: 130404 - protein, 8 aa, Mycobacterium tuberculosis
RSGEVNAK

SEQ ID NO: 130405 - protein, 8 aa, Mycobacterium tuberculosis
WVDSAGQL

SEQ ID NO: 130406 - protein, 8 aa, Mycobacterium tuberculosis
GQLVDEPA

SEQ ID NO: 130407 - protein, 8 aa, Mycobacterium tuberculosis
EPAPPARA

SEQ ID NO: 130408 - protein, 8 aa, Mycobacterium tuberculosis
APPARAIA

SEQ ID NO: 130409 - protein, 8 aa, Mycobacterium tuberculosis
RAIADAAL

SEQ ID NO: 130410 - protein, 8 aa, Mycobacterium tuberculosis
AIADAALA

SEQ ID NO: 130411 - protein, 8 aa, Mycobacterium tuberculosis
IADAALAA

SEQ ID NO: 130412 - protein, 8 aa, Mycobacterium tuberculosis
AALAALGL

SEQ ID NO: 130413 - protein, 8 aa, Mycobacterium tuberculosis
LAALGLWL

SEQ ID NO: 130414 - protein, 8 aa, Mycobacterium tuberculosis
ALGLWLSV

SEQ ID NO: 130415 - protein, 8 aa, Mycobacterium tuberculosis
GLWLSVAA

SEQ ID NO: 130416 - protein, 8 aa, Mycobacterium tuberculosis
WLSVAAVA

SEQ ID NO: 130417 - protein, 8 aa, Mycobacterium tuberculosis
SVAAVAGA

SEQ ID NO: 130418 - protein, 8 aa, Mycobacterium tuberculosis
VAAVAGAL

SEQ ID NO: 130419 - protein, 8 aa, Mycobacterium tuberculosis
AAVAGALL

SEQ ID NO: 130420 - protein, 8 aa, Mycobacterium tuberculosis
AVAGALLA

SEQ ID NO: 130421 - protein, 8 aa, Mycobacterium tuberculosis
GALLALTR

SEQ ID NO: 130422 - protein, 8 aa, Mycobacterium tuberculosis
ALLALTRA

SEQ ID NO: 130423 - protein, 8 aa, Mycobacterium tuberculosis
LLALTRAI

SEQ ID NO: 130424 - protein, 8 aa, Mycobacterium tuberculosis
ALTRAILI

SEQ ID NO: 130425 - protein, 8 aa, Mycobacterium tuberculosis
LTRAILIR

SEQ ID NO: 130426 - protein, 8 aa, Mycobacterium tuberculosis
TRAILIRV

SEQ ID NO: 130427 - protein, 8 aa, Mycobacterium tuberculosis
RAILIRVR

SEQ ID NO: 130428 - protein, 8 aa, Mycobacterium tuberculosis
ILIRVRNA

SEQ ID NO: 130429 - protein, 8 aa, Mycobacterium tuberculosis
RVRNASWQ

SEQ ID NO: 130430 - protein, 8 aa, Mycobacterium tuberculosis
WQHDIDSL

SEQ ID NO: 130431 - protein, 8 aa, Mycobacterium tuberculosis
DSLFCTQR

SEQ ID NO: 130432 - protein, 9 aa, Mycobacterium tuberculosis
REGATMITF

SEQ ID NO: 130433 - protein, 9 aa, Mycobacterium tuberculosis
EGATMITFR

SEQ ID NO: 130434 - protein, 9 aa, Mycobacterium tuberculosis
GATMITFRL

SEQ ID NO: 130435 - protein, 9 aa, Mycobacterium tuberculosis
ATMITFRLR

SEQ ID NO: 130436 - protein, 9 aa, Mycobacterium tuberculosis
TMITFRLRL

SEQ ID NO: 130437 - protein, 9 aa, Mycobacterium tuberculosis
TFRLRLPCR

SEQ ID NO: 130438 - protein, 9 aa, Mycobacterium tuberculosis
RLPCRTILR

SEQ ID NO: 130439 - protein, 9 aa, Mycobacterium tuberculosis
LPCRTILRV

SEQ ID NO: 130440 - protein, 9 aa, Mycobacterium tuberculosis
RTILRVFSR

SEQ ID NO: 130441 - protein, 9 aa, Mycobacterium tuberculosis
RVFSRNPLV

SEQ ID NO: 130442 - protein, 9 aa, Mycobacterium tuberculosis
VFSRNPLVR

SEQ ID NO: 130443 - protein, 9 aa, Mycobacterium tuberculosis
PLVRGTDRL

SEQ ID NO: 130444 - protein, 9 aa, Mycobacterium tuberculosis
RGTDRLEAV

SEQ ID NO: 130445 - protein, 9 aa, Mycobacterium tuberculosis
GTDRLEAVV

SEQ ID NO: 130446 - protein, 9 aa, Mycobacterium tuberculosis
RLEAVVMLL

SEQ ID NO: 130447 - protein, 9 aa, Mycobacterium tuberculosis
EAVVMLLAV

SEQ ID NO: 130448 - protein, 9 aa, Mycobacterium tuberculosis
VVMLLAVTV

SEQ ID NO: 130449 - protein, 9 aa, Mycobacterium tuberculosis
MLLAVTVSL

SEQ ID NO: 130450 - protein, 9 aa, Mycobacterium tuberculosis
LLAVTVSLL

SEQ ID NO: 130451 - protein, 9 aa, Mycobacterium tuberculosis
AVTVSLLTI

SEQ ID NO: 130452 - protein, 9 aa, Mycobacterium tuberculosis
TVSLLTIPF

SEQ ID NO: 130453 - protein, 9 aa, Mycobacterium tuberculosis
SLLTIPFAA

SEQ ID NO: 130454 - protein, 9 aa, Mycobacterium tuberculosis
LLTIPFAAA

SEQ ID NO: 130455 - protein, 9 aa, Mycobacterium tuberculosis
LTIPFAAAA

SEQ ID NO: 130456 - protein, 9 aa, Mycobacterium tuberculosis
IPFAAAAGT

SEQ ID NO: 130457 - protein, 9 aa, Mycobacterium tuberculosis
FAAAAGTAV

SEQ ID NO: 130458 - protein, 9 aa, Mycobacterium tuberculosis
AVQDSRSHV

SEQ ID NO: 130459 - protein, 9 aa, Mycobacterium tuberculosis
VQDSRSHVY

SEQ ID NO: 130460 - protein, 9 aa, Mycobacterium tuberculosis
RSHVYAHQA

SEQ ID NO: 130461 - protein, 9 aa, Mycobacterium tuberculosis
YAHQAQTRH

SEQ ID NO: 130462 - protein, 9 aa, Mycobacterium tuberculosis
HQAQTRHPA

SEQ ID NO: 130463 - protein, 9 aa, Mycobacterium tuberculosis
AQTRHPATA

SEQ ID NO: 130464 - protein, 9 aa, Mycobacterium tuberculosis
TRHPATATV

SEQ ID NO: 130465 - protein, 9 aa, Mycobacterium tuberculosis
ATVIDHEGV

SEQ ID NO: 130466 - protein, 9 aa, Mycobacterium tuberculosis
TVIDHEGVI

SEQ ID NO: 130467 - protein, 9 aa, Mycobacterium tuberculosis
GVIDSNTTA

SEQ ID NO: 130468 - protein, 9 aa, Mycobacterium tuberculosis
TTATSAPPR

SEQ ID NO: 130469 - protein, 9 aa, Mycobacterium tuberculosis
ATSAPPRTK

SEQ ID NO: 130470 - protein, 9 aa, Mycobacterium tuberculosis
TSAPPRTKI

SEQ ID NO: 130471 - protein, 9 aa, Mycobacterium tuberculosis
APPRTKITV

SEQ ID NO: 130472 - protein, 9 aa, Mycobacterium tuberculosis
RTKITVPAR

SEQ ID NO: 130473 - protein, 9 aa, Mycobacterium tuberculosis
TKITVPARW

SEQ ID NO: 130474 - protein, 9 aa, Mycobacterium tuberculosis
KITVPARWV

SEQ ID NO: 130475 - protein, 9 aa, Mycobacterium tuberculosis
ITVPARWVV

SEQ ID NO: 130476 - protein, 9 aa, Mycobacterium tuberculosis
RWVVNGIER

SEQ ID NO: 130477 - protein, 9 aa, Mycobacterium tuberculosis
NGIERSGEV

SEQ ID NO: 130478 - protein, 9 aa, Mycobacterium tuberculosis
EVNAKPGTK

SEQ ID NO: 130479 - protein, 9 aa, Mycobacterium tuberculosis
KSGDRVGIW

SEQ ID NO: 130480 - protein, 9 aa, Mycobacterium tuberculosis
SGDRVGIWV

SEQ ID NO: 130481 - protein, 9 aa, Mycobacterium tuberculosis
RVGIWVDSA

SEQ ID NO: 130482 - protein, 9 aa, Mycobacterium tuberculosis
WVDSAGQLV

SEQ ID NO: 130483 - protein, 9 aa, Mycobacterium tuberculosis
LVDEPAPPA

SEQ ID NO: 130484 - protein, 9 aa, Mycobacterium tuberculosis
EPAPPARAI

SEQ ID NO: 130485 - protein, 9 aa, Mycobacterium tuberculosis
RAIADAALA

SEQ ID NO: 130486 - protein, 9 aa, Mycobacterium tuberculosis
AIADAALAA

SEQ ID NO: 130487 - protein, 9 aa, Mycobacterium tuberculosis
IADAALAAL

SEQ ID NO: 130488 - protein, 9 aa, Mycobacterium tuberculosis
AALAALGLW

SEQ ID NO: 130489 - protein, 9 aa, Mycobacterium tuberculosis
ALAALGLWL

SEQ ID NO: 130490 - protein, 9 aa, Mycobacterium tuberculosis
AALGLWLSV

SEQ ID NO: 130491 - protein, 9 aa, Mycobacterium tuberculosis
ALGLWLSVA

SEQ ID NO: 130492 - protein, 9 aa, Mycobacterium tuberculosis
GLWLSVAAV

SEQ ID NO: 130493 - protein, 9 aa, Mycobacterium tuberculosis
LSVAAVAGA

SEQ ID NO: 130494 - protein, 9 aa, Mycobacterium tuberculosis
SVAAVAGAL

SEQ ID NO: 130495 - protein, 9 aa, Mycobacterium tuberculosis
VAAVAGALL

SEQ ID NO: 130496 - protein, 9 aa, Mycobacterium tuberculosis
AAVAGALLA

SEQ ID NO: 130497 - protein, 9 aa, Mycobacterium tuberculosis
AVAGALLAL

SEQ ID NO: 130498 - protein, 9 aa, Mycobacterium tuberculosis
ALLALTRAI

SEQ ID NO: 130499 - protein, 9 aa, Mycobacterium tuberculosis
LLALTRAIL

SEQ ID NO: 130500 - protein, 9 aa, Mycobacterium tuberculosis
LALTRAILI

SEQ ID NO: 130501 - protein, 9 aa, Mycobacterium tuberculosis
ALTRAILIR

SEQ ID NO: 130502 - protein, 9 aa, Mycobacterium tuberculosis
LTRAILIRV

SEQ ID NO: 130503 - protein, 9 aa, Mycobacterium tuberculosis
RVRNASWQH

SEQ ID NO: 130504 - protein, 9 aa, Mycobacterium tuberculosis
SWQHDIDSL

SEQ ID NO: 130505 - protein, 9 aa, Mycobacterium tuberculosis
WQHDIDSLF

SEQ ID NO: 130506 - protein, 10 aa, Mycobacterium tuberculosis
TTRDREGATM

SEQ ID NO: 130507 - protein, 10 aa, Mycobacterium tuberculosis
REGATMITFR

SEQ ID NO: 130508 - protein, 10 aa, Mycobacterium tuberculosis
EGATMITFRL

SEQ ID NO: 130509 - protein, 10 aa, Mycobacterium tuberculosis
GATMITFRLR

SEQ ID NO: 130510 - protein, 10 aa, Mycobacterium tuberculosis
ATMITFRLRL

SEQ ID NO: 130511 - protein, 10 aa, Mycobacterium tuberculosis
ITFRLRLPCR

SEQ ID NO: 130512 - protein, 10 aa, Mycobacterium tuberculosis
RLRLPCRTIL

SEQ ID NO: 130513 - protein, 10 aa, Mycobacterium tuberculosis
LRLPCRTILR

SEQ ID NO: 130514 - protein, 10 aa, Mycobacterium tuberculosis
RLPCRTILRV

SEQ ID NO: 130515 - protein, 10 aa, Mycobacterium tuberculosis
LPCRTILRVF

SEQ ID NO: 130516 - protein, 10 aa, Mycobacterium tuberculosis
CRTILRVFSR

SEQ ID NO: 130517 - protein, 10 aa, Mycobacterium tuberculosis
ILRVFSRNPL

SEQ ID NO: 130518 - protein, 10 aa, Mycobacterium tuberculosis
RVFSRNPLVR

SEQ ID NO: 130519 - protein, 10 aa, Mycobacterium tuberculosis
NPLVRGTDRL

SEQ ID NO: 130520 - protein, 10 aa, Mycobacterium tuberculosis
RLEAVVMLLA

SEQ ID NO: 130521 - protein, 10 aa, Mycobacterium tuberculosis
LEAVVMLLAV

SEQ ID NO: 130522 - protein, 10 aa, Mycobacterium tuberculosis
EAVVMLLAVT

SEQ ID NO: 130523 - protein, 10 aa, Mycobacterium tuberculosis
AVVMLLAVTV

SEQ ID NO: 130524 - protein, 10 aa, Mycobacterium tuberculosis
VMLLAVTVSL

SEQ ID NO: 130525 - protein, 10 aa, Mycobacterium tuberculosis
MLLAVTVSLL

SEQ ID NO: 130526 - protein, 10 aa, Mycobacterium tuberculosis
LLAVTVSLLT

SEQ ID NO: 130527 - protein, 10 aa, Mycobacterium tuberculosis
LAVTVSLLTI

SEQ ID NO: 130528 - protein, 10 aa, Mycobacterium tuberculosis
VTVSLLTIPF

SEQ ID NO: 130529 - protein, 10 aa, Mycobacterium tuberculosis
TVSLLTIPFA

SEQ ID NO: 130530 - protein, 10 aa, Mycobacterium tuberculosis
SLLTIPFAAA

SEQ ID NO: 130531 - protein, 10 aa, Mycobacterium tuberculosis
LLTIPFAAAA

SEQ ID NO: 130532 - protein, 10 aa, Mycobacterium tuberculosis
IPFAAAAGTA

SEQ ID NO: 130533 - protein, 10 aa, Mycobacterium tuberculosis
FAAAAGTAVQ

SEQ ID NO: 130534 - protein, 10 aa, Mycobacterium tuberculosis
TAVQDSRSHV

SEQ ID NO: 130535 - protein, 10 aa, Mycobacterium tuberculosis
AVQDSRSHVY

SEQ ID NO: 130536 - protein, 10 aa, Mycobacterium tuberculosis
VQDSRSHVYA

SEQ ID NO: 130537 - protein, 10 aa, Mycobacterium tuberculosis
RSHVYAHQAQ

SEQ ID NO: 130538 - protein, 10 aa, Mycobacterium tuberculosis
HVYAHQAQTR

SEQ ID NO: 130539 - protein, 10 aa, Mycobacterium tuberculosis
HQAQTRHPAT

SEQ ID NO: 130540 - protein, 10 aa, Mycobacterium tuberculosis
QTRHPATATV

SEQ ID NO: 130541 - protein, 10 aa, Mycobacterium tuberculosis
HPATATVIDH

SEQ ID NO: 130542 - protein, 10 aa, Mycobacterium tuberculosis
TATVIDHEGV

SEQ ID NO: 130543 - protein, 10 aa, Mycobacterium tuberculosis
GVIDSNTTAT

SEQ ID NO: 130544 - protein, 10 aa, Mycobacterium tuberculosis
NTTATSAPPR

SEQ ID NO: 130545 - protein, 10 aa, Mycobacterium tuberculosis
TATSAPPRTK

SEQ ID NO: 130546 - protein, 10 aa, Mycobacterium tuberculosis
SAPPRTKITV

SEQ ID NO: 130547 - protein, 10 aa, Mycobacterium tuberculosis
PPRTKITVPA

SEQ ID NO: 130548 - protein, 10 aa, Mycobacterium tuberculosis
RTKITVPARW

SEQ ID NO: 130549 - protein, 10 aa, Mycobacterium tuberculosis
TKITVPARWV

SEQ ID NO: 130550 - protein, 10 aa, Mycobacterium tuberculosis
KITVPARWVV

SEQ ID NO: 130551 - protein, 10 aa, Mycobacterium tuberculosis
VPARWVVNGI

SEQ ID NO: 130552 - protein, 10 aa, Mycobacterium tuberculosis
KPGTKSGDRV

SEQ ID NO: 130553 - protein, 10 aa, Mycobacterium tuberculosis
KSGDRVGIWV

SEQ ID NO: 130554 - protein, 10 aa, Mycobacterium tuberculosis
GIWVDSAGQL

SEQ ID NO: 130555 - protein, 10 aa, Mycobacterium tuberculosis
QLVDEPAPPA

SEQ ID NO: 130556 - protein, 10 aa, Mycobacterium tuberculosis
EPAPPARAIA

SEQ ID NO: 130557 - protein, 10 aa, Mycobacterium tuberculosis
PPARAIADAA

SEQ ID NO: 130558 - protein, 10 aa, Mycobacterium tuberculosis
RAIADAALAA

SEQ ID NO: 130559 - protein, 10 aa, Mycobacterium tuberculosis
AIADAALAAL

SEQ ID NO: 130560 - protein, 10 aa, Mycobacterium tuberculosis
DAALAALGLW

SEQ ID NO: 130561 - protein, 10 aa, Mycobacterium tuberculosis
AALAALGLWL

SEQ ID NO: 130562 - protein, 10 aa, Mycobacterium tuberculosis
ALAALGLWLS

SEQ ID NO: 130563 - protein, 10 aa, Mycobacterium tuberculosis
LAALGLWLSV

SEQ ID NO: 130564 - protein, 10 aa, Mycobacterium tuberculosis
AALGLWLSVA

SEQ ID NO: 130565 - protein, 10 aa, Mycobacterium tuberculosis
ALGLWLSVAA

SEQ ID NO: 130566 - protein, 10 aa, Mycobacterium tuberculosis
LGLWLSVAAV

SEQ ID NO: 130567 - protein, 10 aa, Mycobacterium tuberculosis
GLWLSVAAVA

SEQ ID NO: 130568 - protein, 10 aa, Mycobacterium tuberculosis
WLSVAAVAGA

SEQ ID NO: 130569 - protein, 10 aa, Mycobacterium tuberculosis
LSVAAVAGAL

SEQ ID NO: 130570 - protein, 10 aa, Mycobacterium tuberculosis
SVAAVAGALL

SEQ ID NO: 130571 - protein, 10 aa, Mycobacterium tuberculosis
AAVAGALLAL

SEQ ID NO: 130572 - protein, 10 aa, Mycobacterium tuberculosis
AVAGALLALT

SEQ ID NO: 130573 - protein, 10 aa, Mycobacterium tuberculosis
ALLALTRAIL

SEQ ID NO: 130574 - protein, 10 aa, Mycobacterium tuberculosis
LLALTRAILI

SEQ ID NO: 130575 - protein, 10 aa, Mycobacterium tuberculosis
LALTRAILIR

SEQ ID NO: 130576 - protein, 10 aa, Mycobacterium tuberculosis
ALTRAILIRV

SEQ ID NO: 130577 - protein, 10 aa, Mycobacterium tuberculosis
LTRAILIRVR

SEQ ID NO: 130578 - protein, 10 aa, Mycobacterium tuberculosis
ILIRVRNASW

SEQ ID NO: 130579 - protein, 10 aa, Mycobacterium tuberculosis
RVRNASWQHD

SEQ ID NO: 130580 - protein, 10 aa, Mycobacterium tuberculosis
SWQHDIDSLF

SEQ ID NO: 130581 - protein, 10 aa, Mycobacterium tuberculosis
WQHDIDSLFC

SEQ ID NO: 130582 - protein, 10 aa, Mycobacterium tuberculosis
DIDSLFCTQR

SEQ ID NO: 130583 - protein, 11 aa, Mycobacterium tuberculosis
MIATTRDREGA

SEQ ID NO: 130584 - protein, 11 aa, Mycobacterium tuberculosis
ATTRDREGATM

SEQ ID NO: 130585 - protein, 11 aa, Mycobacterium tuberculosis
RDREGATMITF

SEQ ID NO: 130586 - protein, 11 aa, Mycobacterium tuberculosis
DREGATMITFR

SEQ ID NO: 130587 - protein, 11 aa, Mycobacterium tuberculosis
REGATMITFRL

SEQ ID NO: 130588 - protein, 11 aa, Mycobacterium tuberculosis
EGATMITFRLR

SEQ ID NO: 130589 - protein, 11 aa, Mycobacterium tuberculosis
TMITFRLRLPC

SEQ ID NO: 130590 - protein, 11 aa, Mycobacterium tuberculosis
MITFRLRLPCR

SEQ ID NO: 130591 - protein, 11 aa, Mycobacterium tuberculosis
FRLRLPCRTIL

SEQ ID NO: 130592 - protein, 11 aa, Mycobacterium tuberculosis
RLRLPCRTILR

SEQ ID NO: 130593 - protein, 11 aa, Mycobacterium tuberculosis
LPCRTILRVFS

SEQ ID NO: 130594 - protein, 11 aa, Mycobacterium tuberculosis
TILRVFSRNPL

SEQ ID NO: 130595 - protein, 11 aa, Mycobacterium tuberculosis
ILRVFSRNPLV

SEQ ID NO: 130596 - protein, 11 aa, Mycobacterium tuberculosis
PLVRGTDRLEA

SEQ ID NO: 130597 - protein, 11 aa, Mycobacterium tuberculosis
LVRGTDRLEAV

SEQ ID NO: 130598 - protein, 11 aa, Mycobacterium tuberculosis
GTDRLEAVVML

SEQ ID NO: 130599 - protein, 11 aa, Mycobacterium tuberculosis
RLEAVVMLLAV

SEQ ID NO: 130600 - protein, 11 aa, Mycobacterium tuberculosis
EAVVMLLAVTV

SEQ ID NO: 130601 - protein, 11 aa, Mycobacterium tuberculosis
VVMLLAVTVSL

SEQ ID NO: 130602 - protein, 11 aa, Mycobacterium tuberculosis
VMLLAVTVSLL

SEQ ID NO: 130603 - protein, 11 aa, Mycobacterium tuberculosis
MLLAVTVSLLT

SEQ ID NO: 130604 - protein, 11 aa, Mycobacterium tuberculosis
LLAVTVSLLTI

SEQ ID NO: 130605 - protein, 11 aa, Mycobacterium tuberculosis
AVTVSLLTIPF

SEQ ID NO: 130606 - protein, 11 aa, Mycobacterium tuberculosis
VTVSLLTIPFA

SEQ ID NO: 130607 - protein, 11 aa, Mycobacterium tuberculosis
TVSLLTIPFAA

SEQ ID NO: 130608 - protein, 11 aa, Mycobacterium tuberculosis
SLLTIPFAAAA

SEQ ID NO: 130609 - protein, 11 aa, Mycobacterium tuberculosis
LTIPFAAAAGT

SEQ ID NO: 130610 - protein, 11 aa, Mycobacterium tuberculosis
IPFAAAAGTAV

SEQ ID NO: 130611 - protein, 11 aa, Mycobacterium tuberculosis
AAAGTAVQDSR

SEQ ID NO: 130612 - protein, 11 aa, Mycobacterium tuberculosis
GTAVQDSRSHV

SEQ ID NO: 130613 - protein, 11 aa, Mycobacterium tuberculosis
TAVQDSRSHVY

SEQ ID NO: 130614 - protein, 11 aa, Mycobacterium tuberculosis
AVQDSRSHVYA

SEQ ID NO: 130615 - protein, 11 aa, Mycobacterium tuberculosis
HVYAHQAQTRH

SEQ ID NO: 130616 - protein, 11 aa, Mycobacterium tuberculosis
YAHQAQTRHPA

SEQ ID NO: 130617 - protein, 11 aa, Mycobacterium tuberculosis
HQAQTRHPATA

SEQ ID NO: 130618 - protein, 11 aa, Mycobacterium tuberculosis
AQTRHPATATV

SEQ ID NO: 130619 - protein, 11 aa, Mycobacterium tuberculosis
ATATVIDHEGV

SEQ ID NO: 130620 - protein, 11 aa, Mycobacterium tuberculosis
TATVIDHEGVI

SEQ ID NO: 130621 - protein, 11 aa, Mycobacterium tuberculosis
VIDSNTTATSA

SEQ ID NO: 130622 - protein, 11 aa, Mycobacterium tuberculosis
SNTTATSAPPR

SEQ ID NO: 130623 - protein, 11 aa, Mycobacterium tuberculosis
TTATSAPPRTK

SEQ ID NO: 130624 - protein, 11 aa, Mycobacterium tuberculosis
TSAPPRTKITV

SEQ ID NO: 130625 - protein, 11 aa, Mycobacterium tuberculosis
APPRTKITVPA

SEQ ID NO: 130626 - protein, 11 aa, Mycobacterium tuberculosis
RTKITVPARWV

SEQ ID NO: 130627 - protein, 11 aa, Mycobacterium tuberculosis
TKITVPARWVV

SEQ ID NO: 130628 - protein, 11 aa, Mycobacterium tuberculosis
TVPARWVVNGI

SEQ ID NO: 130629 - protein, 11 aa, Mycobacterium tuberculosis
VVNGIERSGEV

SEQ ID NO: 130630 - protein, 11 aa, Mycobacterium tuberculosis
NAKPGTKSGDR

SEQ ID NO: 130631 - protein, 11 aa, Mycobacterium tuberculosis
TKSGDRVGIWV

SEQ ID NO: 130632 - protein, 11 aa, Mycobacterium tuberculosis
GIWVDSAGQLV

SEQ ID NO: 130633 - protein, 11 aa, Mycobacterium tuberculosis
DSAGQLVDEPA

SEQ ID NO: 130634 - protein, 11 aa, Mycobacterium tuberculosis
GQLVDEPAPPA

SEQ ID NO: 130635 - protein, 11 aa, Mycobacterium tuberculosis
QLVDEPAPPAR

SEQ ID NO: 130636 - protein, 11 aa, Mycobacterium tuberculosis
LVDEPAPPARA

SEQ ID NO: 130637 - protein, 11 aa, Mycobacterium tuberculosis
APPARAIADAA

SEQ ID NO: 130638 - protein, 11 aa, Mycobacterium tuberculosis
PPARAIADAAL

SEQ ID NO: 130639 - protein, 11 aa, Mycobacterium tuberculosis
RAIADAALAAL

SEQ ID NO: 130640 - protein, 11 aa, Mycobacterium tuberculosis
IADAALAALGL

SEQ ID NO: 130641 - protein, 11 aa, Mycobacterium tuberculosis
ALAALGLWLSV

SEQ ID NO: 130642 - protein, 11 aa, Mycobacterium tuberculosis
LAALGLWLSVA

SEQ ID NO: 130643 - protein, 11 aa, Mycobacterium tuberculosis
AALGLWLSVAA

SEQ ID NO: 130644 - protein, 11 aa, Mycobacterium tuberculosis
ALGLWLSVAAV

SEQ ID NO: 130645 - protein, 11 aa, Mycobacterium tuberculosis
WLSVAAVAGAL

SEQ ID NO: 130646 - protein, 11 aa, Mycobacterium tuberculosis
SVAAVAGALLA

SEQ ID NO: 130647 - protein, 11 aa, Mycobacterium tuberculosis
VAAVAGALLAL

SEQ ID NO: 130648 - protein, 11 aa, Mycobacterium tuberculosis
AVAGALLALTR

SEQ ID NO: 130649 - protein, 11 aa, Mycobacterium tuberculosis
ALLALTRAILI

SEQ ID NO: 130650 - protein, 11 aa, Mycobacterium tuberculosis
LLALTRAILIR

SEQ ID NO: 130651 - protein, 11 aa, Mycobacterium tuberculosis
LALTRAILIRV

SEQ ID NO: 130652 - protein, 11 aa, Mycobacterium tuberculosis
ALTRAILIRVR

SEQ ID NO: 130653 - protein, 11 aa, Mycobacterium tuberculosis
ILIRVRNASWQ

SEQ ID NO: 130654 - protein, 11 aa, Mycobacterium tuberculosis
RVRNASWQHDI

SEQ ID NO: 130655 - protein, 11 aa, Mycobacterium tuberculosis
NASWQHDIDSL

SEQ ID NO: 130656 - protein, 11 aa, Mycobacterium tuberculosis
ASWQHDIDSLF

SEQ ID NO: 130657 - protein, 11 aa, Mycobacterium tuberculosis
WQHDIDSLFCT

SEQ ID NO: 130658 - protein, 11 aa, Mycobacterium tuberculosis
HDIDSLFCTQR

SEQ ID NO: 130659 - protein, 13 aa, Mycobacterium tuberculosis
MIATTRDREGATM

SEQ ID NO: 130660 - protein, 13 aa, Mycobacterium tuberculosis
IATTRDREGATMI

SEQ ID NO: 130661 - protein, 13 aa, Mycobacterium tuberculosis
ATTRDREGATMIT

SEQ ID NO: 130662 - protein, 13 aa, Mycobacterium tuberculosis
TTRDREGATMITF

SEQ ID NO: 130663 - protein, 13 aa, Mycobacterium tuberculosis
TRDREGATMITFR

SEQ ID NO: 130664 - protein, 13 aa, Mycobacterium tuberculosis
RDREGATMITFRL

SEQ ID NO: 130665 - protein, 13 aa, Mycobacterium tuberculosis
DREGATMITFRLR

SEQ ID NO: 130666 - protein, 13 aa, Mycobacterium tuberculosis
REGATMITFRLRL

SEQ ID NO: 130667 - protein, 13 aa, Mycobacterium tuberculosis
EGATMITFRLRLP

SEQ ID NO: 130668 - protein, 13 aa, Mycobacterium tuberculosis
GATMITFRLRLPC

SEQ ID NO: 130669 - protein, 13 aa, Mycobacterium tuberculosis
ATMITFRLRLPCR

SEQ ID NO: 130670 - protein, 13 aa, Mycobacterium tuberculosis
TMITFRLRLPCRT

SEQ ID NO: 130671 - protein, 13 aa, Mycobacterium tuberculosis
MITFRLRLPCRTI

SEQ ID NO: 130672 - protein, 13 aa, Mycobacterium tuberculosis
ITFRLRLPCRTIL

SEQ ID NO: 130673 - protein, 13 aa, Mycobacterium tuberculosis
TFRLRLPCRTILR

SEQ ID NO: 130674 - protein, 13 aa, Mycobacterium tuberculosis
FRLRLPCRTILRV

SEQ ID NO: 130675 - protein, 13 aa, Mycobacterium tuberculosis
RLRLPCRTILRVF

SEQ ID NO: 130676 - protein, 13 aa, Mycobacterium tuberculosis
LRLPCRTILRVFS

SEQ ID NO: 130677 - protein, 13 aa, Mycobacterium tuberculosis
RLPCRTILRVFSR

SEQ ID NO: 130678 - protein, 13 aa, Mycobacterium tuberculosis
LPCRTILRVFSRN

SEQ ID NO: 130679 - protein, 13 aa, Mycobacterium tuberculosis
PCRTILRVFSRNP

SEQ ID NO: 130680 - protein, 13 aa, Mycobacterium tuberculosis
CRTILRVFSRNPL

SEQ ID NO: 130681 - protein, 13 aa, Mycobacterium tuberculosis
RTILRVFSRNPLV

SEQ ID NO: 130682 - protein, 13 aa, Mycobacterium tuberculosis
TILRVFSRNPLVR

SEQ ID NO: 130683 - protein, 13 aa, Mycobacterium tuberculosis
ILRVFSRNPLVRG

SEQ ID NO: 130684 - protein, 13 aa, Mycobacterium tuberculosis
LRVFSRNPLVRGT

SEQ ID NO: 130685 - protein, 13 aa, Mycobacterium tuberculosis
RVFSRNPLVRGTD

SEQ ID NO: 130686 - protein, 13 aa, Mycobacterium tuberculosis
VFSRNPLVRGTDR

SEQ ID NO: 130687 - protein, 13 aa, Mycobacterium tuberculosis
FSRNPLVRGTDRL

SEQ ID NO: 130688 - protein, 13 aa, Mycobacterium tuberculosis
SRNPLVRGTDRLE

SEQ ID NO: 130689 - protein, 13 aa, Mycobacterium tuberculosis
RNPLVRGTDRLEA

SEQ ID NO: 130690 - protein, 13 aa, Mycobacterium tuberculosis
NPLVRGTDRLEAV

SEQ ID NO: 130691 - protein, 13 aa, Mycobacterium tuberculosis
PLVRGTDRLEAVV

SEQ ID NO: 130692 - protein, 13 aa, Mycobacterium tuberculosis
LVRGTDRLEAVVM

SEQ ID NO: 130693 - protein, 13 aa, Mycobacterium tuberculosis
VRGTDRLEAVVML

SEQ ID NO: 130694 - protein, 13 aa, Mycobacterium tuberculosis
RGTDRLEAVVMLL

SEQ ID NO: 130695 - protein, 13 aa, Mycobacterium tuberculosis
GTDRLEAVVMLLA

SEQ ID NO: 130696 - protein, 13 aa, Mycobacterium tuberculosis
TDRLEAVVMLLAV

SEQ ID NO: 130697 - protein, 13 aa, Mycobacterium tuberculosis
DRLEAVVMLLAVT

SEQ ID NO: 130698 - protein, 13 aa, Mycobacterium tuberculosis
RLEAVVMLLAVTV

SEQ ID NO: 130699 - protein, 13 aa, Mycobacterium tuberculosis
LEAVVMLLAVTVS

SEQ ID NO: 130700 - protein, 13 aa, Mycobacterium tuberculosis
EAVVMLLAVTVSL

SEQ ID NO: 130701 - protein, 13 aa, Mycobacterium tuberculosis
AVVMLLAVTVSLL

SEQ ID NO: 130702 - protein, 13 aa, Mycobacterium tuberculosis
VVMLLAVTVSLLT

SEQ ID NO: 130703 - protein, 13 aa, Mycobacterium tuberculosis
VMLLAVTVSLLTI

SEQ ID NO: 130704 - protein, 13 aa, Mycobacterium tuberculosis
MLLAVTVSLLTIP

SEQ ID NO: 130705 - protein, 13 aa, Mycobacterium tuberculosis
LLAVTVSLLTIPF

SEQ ID NO: 130706 - protein, 13 aa, Mycobacterium tuberculosis
LAVTVSLLTIPFA

SEQ ID NO: 130707 - protein, 13 aa, Mycobacterium tuberculosis
AVTVSLLTIPFAA

SEQ ID NO: 130708 - protein, 13 aa, Mycobacterium tuberculosis
VTVSLLTIPFAAA

SEQ ID NO: 130709 - protein, 13 aa, Mycobacterium tuberculosis
TVSLLTIPFAAAA

SEQ ID NO: 130710 - protein, 13 aa, Mycobacterium tuberculosis
VSLLTIPFAAAAG

SEQ ID NO: 130711 - protein, 13 aa, Mycobacterium tuberculosis
SLLTIPFAAAAGT

SEQ ID NO: 130712 - protein, 13 aa, Mycobacterium tuberculosis
LLTIPFAAAAGTA

SEQ ID NO: 130713 - protein, 13 aa, Mycobacterium tuberculosis
LTIPFAAAAGTAV

SEQ ID NO: 130714 - protein, 13 aa, Mycobacterium tuberculosis
TIPFAAAAGTAVQ

SEQ ID NO: 130715 - protein, 13 aa, Mycobacterium tuberculosis
IPFAAAAGTAVQD

SEQ ID NO: 130716 - protein, 13 aa, Mycobacterium tuberculosis
PFAAAAGTAVQDS

SEQ ID NO: 130717 - protein, 13 aa, Mycobacterium tuberculosis
FAAAAGTAVQDSR

SEQ ID NO: 130718 - protein, 13 aa, Mycobacterium tuberculosis
AAAAGTAVQDSRS

SEQ ID NO: 130719 - protein, 13 aa, Mycobacterium tuberculosis
AAAGTAVQDSRSH

SEQ ID NO: 130720 - protein, 13 aa, Mycobacterium tuberculosis
AAGTAVQDSRSHV

SEQ ID NO: 130721 - protein, 13 aa, Mycobacterium tuberculosis
AGTAVQDSRSHVY

SEQ ID NO: 130722 - protein, 13 aa, Mycobacterium tuberculosis
GTAVQDSRSHVYA

SEQ ID NO: 130723 - protein, 13 aa, Mycobacterium tuberculosis
TAVQDSRSHVYAH

SEQ ID NO: 130724 - protein, 13 aa, Mycobacterium tuberculosis
AVQDSRSHVYAHQ

SEQ ID NO: 130725 - protein, 13 aa, Mycobacterium tuberculosis
VQDSRSHVYAHQA

SEQ ID NO: 130726 - protein, 13 aa, Mycobacterium tuberculosis
QDSRSHVYAHQAQ

SEQ ID NO: 130727 - protein, 13 aa, Mycobacterium tuberculosis
DSRSHVYAHQAQT

SEQ ID NO: 130728 - protein, 13 aa, Mycobacterium tuberculosis
SRSHVYAHQAQTR

SEQ ID NO: 130729 - protein, 13 aa, Mycobacterium tuberculosis
RSHVYAHQAQTRH

SEQ ID NO: 130730 - protein, 13 aa, Mycobacterium tuberculosis
SHVYAHQAQTRHP

SEQ ID NO: 130731 - protein, 13 aa, Mycobacterium tuberculosis
HVYAHQAQTRHPA

SEQ ID NO: 130732 - protein, 13 aa, Mycobacterium tuberculosis
VYAHQAQTRHPAT

SEQ ID NO: 130733 - protein, 13 aa, Mycobacterium tuberculosis
YAHQAQTRHPATA

SEQ ID NO: 130734 - protein, 13 aa, Mycobacterium tuberculosis
AHQAQTRHPATAT

SEQ ID NO: 130735 - protein, 13 aa, Mycobacterium tuberculosis
HQAQTRHPATATV

SEQ ID NO: 130736 - protein, 13 aa, Mycobacterium tuberculosis
QAQTRHPATATVI

SEQ ID NO: 130737 - protein, 13 aa, Mycobacterium tuberculosis
AQTRHPATATVID

SEQ ID NO: 130738 - protein, 13 aa, Mycobacterium tuberculosis
QTRHPATATVIDH

SEQ ID NO: 130739 - protein, 13 aa, Mycobacterium tuberculosis
TRHPATATVIDHE

SEQ ID NO: 130740 - protein, 13 aa, Mycobacterium tuberculosis
RHPATATVIDHEG

SEQ ID NO: 130741 - protein, 13 aa, Mycobacterium tuberculosis
HPATATVIDHEGV

SEQ ID NO: 130742 - protein, 13 aa, Mycobacterium tuberculosis
PATATVIDHEGVI

SEQ ID NO: 130743 - protein, 13 aa, Mycobacterium tuberculosis
ATATVIDHEGVID

SEQ ID NO: 130744 - protein, 13 aa, Mycobacterium tuberculosis
TATVIDHEGVIDS

SEQ ID NO: 130745 - protein, 13 aa, Mycobacterium tuberculosis
ATVIDHEGVIDSN

SEQ ID NO: 130746 - protein, 13 aa, Mycobacterium tuberculosis
TVIDHEGVIDSNT

SEQ ID NO: 130747 - protein, 13 aa, Mycobacterium tuberculosis
VIDHEGVIDSNTT

SEQ ID NO: 130748 - protein, 13 aa, Mycobacterium tuberculosis
IDHEGVIDSNTTA

SEQ ID NO: 130749 - protein, 13 aa, Mycobacterium tuberculosis
DHEGVIDSNTTAT

SEQ ID NO: 130750 - protein, 13 aa, Mycobacterium tuberculosis
HEGVIDSNTTATS

SEQ ID NO: 130751 - protein, 13 aa, Mycobacterium tuberculosis
EGVIDSNTTATSA

SEQ ID NO: 130752 - protein, 13 aa, Mycobacterium tuberculosis
GVIDSNTTATSAP

SEQ ID NO: 130753 - protein, 13 aa, Mycobacterium tuberculosis
VIDSNTTATSAPP

SEQ ID NO: 130754 - protein, 13 aa, Mycobacterium tuberculosis
IDSNTTATSAPPR

SEQ ID NO: 130755 - protein, 13 aa, Mycobacterium tuberculosis
DSNTTATSAPPRT

SEQ ID NO: 130756 - protein, 13 aa, Mycobacterium tuberculosis
SNTTATSAPPRTK

SEQ ID NO: 130757 - protein, 13 aa, Mycobacterium tuberculosis
NTTATSAPPRTKI

SEQ ID NO: 130758 - protein, 13 aa, Mycobacterium tuberculosis
TTATSAPPRTKIT

SEQ ID NO: 130759 - protein, 13 aa, Mycobacterium tuberculosis
TATSAPPRTKITV

SEQ ID NO: 130760 - protein, 13 aa, Mycobacterium tuberculosis
ATSAPPRTKITVP

SEQ ID NO: 130761 - protein, 13 aa, Mycobacterium tuberculosis
TSAPPRTKITVPA

SEQ ID NO: 130762 - protein, 13 aa, Mycobacterium tuberculosis
SAPPRTKITVPAR

SEQ ID NO: 130763 - protein, 13 aa, Mycobacterium tuberculosis
APPRTKITVPARW

SEQ ID NO: 130764 - protein, 13 aa, Mycobacterium tuberculosis
PPRTKITVPARWV

SEQ ID NO: 130765 - protein, 13 aa, Mycobacterium tuberculosis
PRTKITVPARWVV

SEQ ID NO: 130766 - protein, 13 aa, Mycobacterium tuberculosis
RTKITVPARWVVN

SEQ ID NO: 130767 - protein, 13 aa, Mycobacterium tuberculosis
TKITVPARWVVNG

SEQ ID NO: 130768 - protein, 13 aa, Mycobacterium tuberculosis
KITVPARWVVNGI

SEQ ID NO: 130769 - protein, 13 aa, Mycobacterium tuberculosis
ITVPARWVVNGIE

SEQ ID NO: 130770 - protein, 13 aa, Mycobacterium tuberculosis
TVPARWVVNGIER

SEQ ID NO: 130771 - protein, 13 aa, Mycobacterium tuberculosis
VPARWVVNGIERS

SEQ ID NO: 130772 - protein, 13 aa, Mycobacterium tuberculosis
PARWVVNGIERSG

SEQ ID NO: 130773 - protein, 13 aa, Mycobacterium tuberculosis
ARWVVNGIERSGE

SEQ ID NO: 130774 - protein, 13 aa, Mycobacterium tuberculosis
RWVVNGIERSGEV

SEQ ID NO: 130775 - protein, 13 aa, Mycobacterium tuberculosis
WVVNGIERSGEVN

SEQ ID NO: 130776 - protein, 13 aa, Mycobacterium tuberculosis
VVNGIERSGEVNA

SEQ ID NO: 130777 - protein, 13 aa, Mycobacterium tuberculosis
VNGIERSGEVNAK

SEQ ID NO: 130778 - protein, 13 aa, Mycobacterium tuberculosis
NGIERSGEVNAKP

SEQ ID NO: 130779 - protein, 13 aa, Mycobacterium tuberculosis
GIERSGEVNAKPG

SEQ ID NO: 130780 - protein, 13 aa, Mycobacterium tuberculosis
IERSGEVNAKPGT

SEQ ID NO: 130781 - protein, 13 aa, Mycobacterium tuberculosis
ERSGEVNAKPGTK

SEQ ID NO: 130782 - protein, 13 aa, Mycobacterium tuberculosis
RSGEVNAKPGTKS

SEQ ID NO: 130783 - protein, 13 aa, Mycobacterium tuberculosis
SGEVNAKPGTKSG

SEQ ID NO: 130784 - protein, 13 aa, Mycobacterium tuberculosis
GEVNAKPGTKSGD

SEQ ID NO: 130785 - protein, 13 aa, Mycobacterium tuberculosis
EVNAKPGTKSGDR

SEQ ID NO: 130786 - protein, 13 aa, Mycobacterium tuberculosis
VNAKPGTKSGDRV

SEQ ID NO: 130787 - protein, 13 aa, Mycobacterium tuberculosis
NAKPGTKSGDRVG

SEQ ID NO: 130788 - protein, 13 aa, Mycobacterium tuberculosis
AKPGTKSGDRVGI

SEQ ID NO: 130789 - protein, 13 aa, Mycobacterium tuberculosis
KPGTKSGDRVGIW

SEQ ID NO: 130790 - protein, 13 aa, Mycobacterium tuberculosis
PGTKSGDRVGIWV

SEQ ID NO: 130791 - protein, 13 aa, Mycobacterium tuberculosis
GTKSGDRVGIWVD

SEQ ID NO: 130792 - protein, 13 aa, Mycobacterium tuberculosis
TKSGDRVGIWVDS

SEQ ID NO: 130793 - protein, 13 aa, Mycobacterium tuberculosis
KSGDRVGIWVDSA

SEQ ID NO: 130794 - protein, 13 aa, Mycobacterium tuberculosis
SGDRVGIWVDSAG

SEQ ID NO: 130795 - protein, 13 aa, Mycobacterium tuberculosis
GDRVGIWVDSAGQ

SEQ ID NO: 130796 - protein, 13 aa, Mycobacterium tuberculosis
DRVGIWVDSAGQL

SEQ ID NO: 130797 - protein, 13 aa, Mycobacterium tuberculosis
RVGIWVDSAGQLV

SEQ ID NO: 130798 - protein, 13 aa, Mycobacterium tuberculosis
VGIWVDSAGQLVD

SEQ ID NO: 130799 - protein, 13 aa, Mycobacterium tuberculosis
GIWVDSAGQLVDE

SEQ ID NO: 130800 - protein, 13 aa, Mycobacterium tuberculosis
IWVDSAGQLVDEP

SEQ ID NO: 130801 - protein, 13 aa, Mycobacterium tuberculosis
WVDSAGQLVDEPA

SEQ ID NO: 130802 - protein, 13 aa, Mycobacterium tuberculosis
VDSAGQLVDEPAP

SEQ ID NO: 130803 - protein, 13 aa, Mycobacterium tuberculosis
DSAGQLVDEPAPP

SEQ ID NO: 130804 - protein, 13 aa, Mycobacterium tuberculosis
SAGQLVDEPAPPA

SEQ ID NO: 130805 - protein, 13 aa, Mycobacterium tuberculosis
AGQLVDEPAPPAR

SEQ ID NO: 130806 - protein, 13 aa, Mycobacterium tuberculosis
GQLVDEPAPPARA

SEQ ID NO: 130807 - protein, 13 aa, Mycobacterium tuberculosis
QLVDEPAPPARAI

SEQ ID NO: 130808 - protein, 13 aa, Mycobacterium tuberculosis
LVDEPAPPARAIA

SEQ ID NO: 130809 - protein, 13 aa, Mycobacterium tuberculosis
VDEPAPPARAIAD

SEQ ID NO: 130810 - protein, 13 aa, Mycobacterium tuberculosis
DEPAPPARAIADA

SEQ ID NO: 130811 - protein, 13 aa, Mycobacterium tuberculosis
EPAPPARAIADAA

SEQ ID NO: 130812 - protein, 13 aa, Mycobacterium tuberculosis
PAPPARAIADAAL

SEQ ID NO: 130813 - protein, 13 aa, Mycobacterium tuberculosis
APPARAIADAALA

SEQ ID NO: 130814 - protein, 13 aa, Mycobacterium tuberculosis
PPARAIADAALAA

SEQ ID NO: 130815 - protein, 13 aa, Mycobacterium tuberculosis
PARAIADAALAAL

SEQ ID NO: 130816 - protein, 13 aa, Mycobacterium tuberculosis
ARAIADAALAALG

SEQ ID NO: 130817 - protein, 13 aa, Mycobacterium tuberculosis
RAIADAALAALGL

SEQ ID NO: 130818 - protein, 13 aa, Mycobacterium tuberculosis
AIADAALAALGLW

SEQ ID NO: 130819 - protein, 13 aa, Mycobacterium tuberculosis
IADAALAALGLWL

SEQ ID NO: 130820 - protein, 13 aa, Mycobacterium tuberculosis
ADAALAALGLWLS

SEQ ID NO: 130821 - protein, 13 aa, Mycobacterium tuberculosis
DAALAALGLWLSV

SEQ ID NO: 130822 - protein, 13 aa, Mycobacterium tuberculosis
AALAALGLWLSVA

SEQ ID NO: 130823 - protein, 13 aa, Mycobacterium tuberculosis
ALAALGLWLSVAA

SEQ ID NO: 130824 - protein, 13 aa, Mycobacterium tuberculosis
LAALGLWLSVAAV

SEQ ID NO: 130825 - protein, 13 aa, Mycobacterium tuberculosis
AALGLWLSVAAVA

SEQ ID NO: 130826 - protein, 13 aa, Mycobacterium tuberculosis
ALGLWLSVAAVAG

SEQ ID NO: 130827 - protein, 13 aa, Mycobacterium tuberculosis
LGLWLSVAAVAGA

SEQ ID NO: 130828 - protein, 13 aa, Mycobacterium tuberculosis
GLWLSVAAVAGAL

SEQ ID NO: 130829 - protein, 13 aa, Mycobacterium tuberculosis
LWLSVAAVAGALL

SEQ ID NO: 130830 - protein, 13 aa, Mycobacterium tuberculosis
WLSVAAVAGALLA

SEQ ID NO: 130831 - protein, 13 aa, Mycobacterium tuberculosis
LSVAAVAGALLAL

SEQ ID NO: 130832 - protein, 13 aa, Mycobacterium tuberculosis
SVAAVAGALLALT

SEQ ID NO: 130833 - protein, 13 aa, Mycobacterium tuberculosis
VAAVAGALLALTR

SEQ ID NO: 130834 - protein, 13 aa, Mycobacterium tuberculosis
AAVAGALLALTRA

SEQ ID NO: 130835 - protein, 13 aa, Mycobacterium tuberculosis
AVAGALLALTRAI

SEQ ID NO: 130836 - protein, 13 aa, Mycobacterium tuberculosis
VAGALLALTRAIL

SEQ ID NO: 130837 - protein, 13 aa, Mycobacterium tuberculosis
AGALLALTRAILI

SEQ ID NO: 130838 - protein, 13 aa, Mycobacterium tuberculosis
GALLALTRAILIR

SEQ ID NO: 130839 - protein, 13 aa, Mycobacterium tuberculosis
ALLALTRAILIRV

SEQ ID NO: 130840 - protein, 13 aa, Mycobacterium tuberculosis
LLALTRAILIRVR

SEQ ID NO: 130841 - protein, 13 aa, Mycobacterium tuberculosis
LALTRAILIRVRN

SEQ ID NO: 130842 - protein, 13 aa, Mycobacterium tuberculosis
ALTRAILIRVRNA

SEQ ID NO: 130843 - protein, 13 aa, Mycobacterium tuberculosis
LTRAILIRVRNAS

SEQ ID NO: 130844 - protein, 13 aa, Mycobacterium tuberculosis
TRAILIRVRNASW

SEQ ID NO: 130845 - protein, 13 aa, Mycobacterium tuberculosis
RAILIRVRNASWQ

SEQ ID NO: 130846 - protein, 13 aa, Mycobacterium tuberculosis
AILIRVRNASWQH

SEQ ID NO: 130847 - protein, 13 aa, Mycobacterium tuberculosis
ILIRVRNASWQHD

SEQ ID NO: 130848 - protein, 13 aa, Mycobacterium tuberculosis
LIRVRNASWQHDI

SEQ ID NO: 130849 - protein, 13 aa, Mycobacterium tuberculosis
IRVRNASWQHDID

SEQ ID NO: 130850 - protein, 13 aa, Mycobacterium tuberculosis
RVRNASWQHDIDS

SEQ ID NO: 130851 - protein, 13 aa, Mycobacterium tuberculosis
VRNASWQHDIDSL

SEQ ID NO: 130852 - protein, 13 aa, Mycobacterium tuberculosis
RNASWQHDIDSLF

SEQ ID NO: 130853 - protein, 13 aa, Mycobacterium tuberculosis
NASWQHDIDSLFC

SEQ ID NO: 130854 - protein, 13 aa, Mycobacterium tuberculosis
ASWQHDIDSLFCT

SEQ ID NO: 130855 - protein, 13 aa, Mycobacterium tuberculosis
SWQHDIDSLFCTQ

SEQ ID NO: 130856 - protein, 13 aa, Mycobacterium tuberculosis
WQHDIDSLFCTQR

SEQ ID NO: 130857 - protein, 14 aa, Mycobacterium tuberculosis
MIATTRDREGATMI

SEQ ID NO: 130858 - protein, 14 aa, Mycobacterium tuberculosis
IATTRDREGATMIT

SEQ ID NO: 130859 - protein, 14 aa, Mycobacterium tuberculosis
ATTRDREGATMITF

SEQ ID NO: 130860 - protein, 14 aa, Mycobacterium tuberculosis
TTRDREGATMITFR

SEQ ID NO: 130861 - protein, 14 aa, Mycobacterium tuberculosis
TRDREGATMITFRL

SEQ ID NO: 130862 - protein, 14 aa, Mycobacterium tuberculosis
RDREGATMITFRLR

SEQ ID NO: 130863 - protein, 14 aa, Mycobacterium tuberculosis
DREGATMITFRLRL

SEQ ID NO: 130864 - protein, 14 aa, Mycobacterium tuberculosis
REGATMITFRLRLP

SEQ ID NO: 130865 - protein, 14 aa, Mycobacterium tuberculosis
EGATMITFRLRLPC

SEQ ID NO: 130866 - protein, 14 aa, Mycobacterium tuberculosis
GATMITFRLRLPCR

SEQ ID NO: 130867 - protein, 14 aa, Mycobacterium tuberculosis
ATMITFRLRLPCRT

SEQ ID NO: 130868 - protein, 14 aa, Mycobacterium tuberculosis
TMITFRLRLPCRTI

SEQ ID NO: 130869 - protein, 14 aa, Mycobacterium tuberculosis
MITFRLRLPCRTIL

SEQ ID NO: 130870 - protein, 14 aa, Mycobacterium tuberculosis
ITFRLRLPCRTILR

SEQ ID NO: 130871 - protein, 14 aa, Mycobacterium tuberculosis
TFRLRLPCRTILRV

SEQ ID NO: 130872 - protein, 14 aa, Mycobacterium tuberculosis
FRLRLPCRTILRVF

SEQ ID NO: 130873 - protein, 14 aa, Mycobacterium tuberculosis
RLRLPCRTILRVFS

SEQ ID NO: 130874 - protein, 14 aa, Mycobacterium tuberculosis
LRLPCRTILRVFSR

SEQ ID NO: 130875 - protein, 14 aa, Mycobacterium tuberculosis
RLPCRTILRVFSRN

SEQ ID NO: 130876 - protein, 14 aa, Mycobacterium tuberculosis
LPCRTILRVFSRNP

SEQ ID NO: 130877 - protein, 14 aa, Mycobacterium tuberculosis
PCRTILRVFSRNPL

SEQ ID NO: 130878 - protein, 14 aa, Mycobacterium tuberculosis
CRTILRVFSRNPLV

SEQ ID NO: 130879 - protein, 14 aa, Mycobacterium tuberculosis
RTILRVFSRNPLVR

SEQ ID NO: 130880 - protein, 14 aa, Mycobacterium tuberculosis
TILRVFSRNPLVRG

SEQ ID NO: 130881 - protein, 14 aa, Mycobacterium tuberculosis
ILRVFSRNPLVRGT

SEQ ID NO: 130882 - protein, 14 aa, Mycobacterium tuberculosis
LRVFSRNPLVRGTD

SEQ ID NO: 130883 - protein, 14 aa, Mycobacterium tuberculosis
RVFSRNPLVRGTDR

SEQ ID NO: 130884 - protein, 14 aa, Mycobacterium tuberculosis
VFSRNPLVRGTDRL

SEQ ID NO: 130885 - protein, 14 aa, Mycobacterium tuberculosis
FSRNPLVRGTDRLE

SEQ ID NO: 130886 - protein, 14 aa, Mycobacterium tuberculosis
SRNPLVRGTDRLEA

SEQ ID NO: 130887 - protein, 14 aa, Mycobacterium tuberculosis
RNPLVRGTDRLEAV

SEQ ID NO: 130888 - protein, 14 aa, Mycobacterium tuberculosis
NPLVRGTDRLEAVV

SEQ ID NO: 130889 - protein, 14 aa, Mycobacterium tuberculosis
PLVRGTDRLEAVVM

SEQ ID NO: 130890 - protein, 14 aa, Mycobacterium tuberculosis
LVRGTDRLEAVVML

SEQ ID NO: 130891 - protein, 14 aa, Mycobacterium tuberculosis
VRGTDRLEAVVMLL

SEQ ID NO: 130892 - protein, 14 aa, Mycobacterium tuberculosis
RGTDRLEAVVMLLA

SEQ ID NO: 130893 - protein, 14 aa, Mycobacterium tuberculosis
GTDRLEAVVMLLAV

SEQ ID NO: 130894 - protein, 14 aa, Mycobacterium tuberculosis
TDRLEAVVMLLAVT

SEQ ID NO: 130895 - protein, 14 aa, Mycobacterium tuberculosis
DRLEAVVMLLAVTV

SEQ ID NO: 130896 - protein, 14 aa, Mycobacterium tuberculosis
RLEAVVMLLAVTVS

SEQ ID NO: 130897 - protein, 14 aa, Mycobacterium tuberculosis
LEAVVMLLAVTVSL

SEQ ID NO: 130898 - protein, 14 aa, Mycobacterium tuberculosis
EAVVMLLAVTVSLL

SEQ ID NO: 130899 - protein, 14 aa, Mycobacterium tuberculosis
AVVMLLAVTVSLLT

SEQ ID NO: 130900 - protein, 14 aa, Mycobacterium tuberculosis
VVMLLAVTVSLLTI

SEQ ID NO: 130901 - protein, 14 aa, Mycobacterium tuberculosis
VMLLAVTVSLLTIP

SEQ ID NO: 130902 - protein, 14 aa, Mycobacterium tuberculosis
MLLAVTVSLLTIPF

SEQ ID NO: 130903 - protein, 14 aa, Mycobacterium tuberculosis
LLAVTVSLLTIPFA

SEQ ID NO: 130904 - protein, 14 aa, Mycobacterium tuberculosis
LAVTVSLLTIPFAA

SEQ ID NO: 130905 - protein, 14 aa, Mycobacterium tuberculosis
AVTVSLLTIPFAAA

SEQ ID NO: 130906 - protein, 14 aa, Mycobacterium tuberculosis
VTVSLLTIPFAAAA

SEQ ID NO: 130907 - protein, 14 aa, Mycobacterium tuberculosis
TVSLLTIPFAAAAG

SEQ ID NO: 130908 - protein, 14 aa, Mycobacterium tuberculosis
VSLLTIPFAAAAGT

SEQ ID NO: 130909 - protein, 14 aa, Mycobacterium tuberculosis
SLLTIPFAAAAGTA

SEQ ID NO: 130910 - protein, 14 aa, Mycobacterium tuberculosis
LLTIPFAAAAGTAV

SEQ ID NO: 130911 - protein, 14 aa, Mycobacterium tuberculosis
LTIPFAAAAGTAVQ

SEQ ID NO: 130912 - protein, 14 aa, Mycobacterium tuberculosis
TIPFAAAAGTAVQD

SEQ ID NO: 130913 - protein, 14 aa, Mycobacterium tuberculosis
IPFAAAAGTAVQDS

SEQ ID NO: 130914 - protein, 14 aa, Mycobacterium tuberculosis
PFAAAAGTAVQDSR

SEQ ID NO: 130915 - protein, 14 aa, Mycobacterium tuberculosis
FAAAAGTAVQDSRS

SEQ ID NO: 130916 - protein, 14 aa, Mycobacterium tuberculosis
AAAAGTAVQDSRSH

SEQ ID NO: 130917 - protein, 14 aa, Mycobacterium tuberculosis
AAAGTAVQDSRSHV

SEQ ID NO: 130918 - protein, 14 aa, Mycobacterium tuberculosis
AAGTAVQDSRSHVY

SEQ ID NO: 130919 - protein, 14 aa, Mycobacterium tuberculosis
AGTAVQDSRSHVYA

SEQ ID NO: 130920 - protein, 14 aa, Mycobacterium tuberculosis
GTAVQDSRSHVYAH

SEQ ID NO: 130921 - protein, 14 aa, Mycobacterium tuberculosis
TAVQDSRSHVYAHQ

SEQ ID NO: 130922 - protein, 14 aa, Mycobacterium tuberculosis
AVQDSRSHVYAHQA

SEQ ID NO: 130923 - protein, 14 aa, Mycobacterium tuberculosis
VQDSRSHVYAHQAQ

SEQ ID NO: 130924 - protein, 14 aa, Mycobacterium tuberculosis
QDSRSHVYAHQAQT

SEQ ID NO: 130925 - protein, 14 aa, Mycobacterium tuberculosis
DSRSHVYAHQAQTR

SEQ ID NO: 130926 - protein, 14 aa, Mycobacterium tuberculosis
SRSHVYAHQAQTRH

SEQ ID NO: 130927 - protein, 14 aa, Mycobacterium tuberculosis
RSHVYAHQAQTRHP

SEQ ID NO: 130928 - protein, 14 aa, Mycobacterium tuberculosis
SHVYAHQAQTRHPA

SEQ ID NO: 130929 - protein, 14 aa, Mycobacterium tuberculosis
HVYAHQAQTRHPAT

SEQ ID NO: 130930 - protein, 14 aa, Mycobacterium tuberculosis
VYAHQAQTRHPATA

SEQ ID NO: 130931 - protein, 14 aa, Mycobacterium tuberculosis
YAHQAQTRHPATAT

SEQ ID NO: 130932 - protein, 14 aa, Mycobacterium tuberculosis
AHQAQTRHPATATV

SEQ ID NO: 130933 - protein, 14 aa, Mycobacterium tuberculosis
HQAQTRHPATATVI

SEQ ID NO: 130934 - protein, 14 aa, Mycobacterium tuberculosis
QAQTRHPATATVID

SEQ ID NO: 130935 - protein, 14 aa, Mycobacterium tuberculosis
AQTRHPATATVIDH

SEQ ID NO: 130936 - protein, 14 aa, Mycobacterium tuberculosis
QTRHPATATVIDHE

SEQ ID NO: 130937 - protein, 14 aa, Mycobacterium tuberculosis
TRHPATATVIDHEG

SEQ ID NO: 130938 - protein, 14 aa, Mycobacterium tuberculosis
RHPATATVIDHEGV

SEQ ID NO: 130939 - protein, 14 aa, Mycobacterium tuberculosis
HPATATVIDHEGVI

SEQ ID NO: 130940 - protein, 14 aa, Mycobacterium tuberculosis
PATATVIDHEGVID

SEQ ID NO: 130941 - protein, 14 aa, Mycobacterium tuberculosis
ATATVIDHEGVIDS

SEQ ID NO: 130942 - protein, 14 aa, Mycobacterium tuberculosis
TATVIDHEGVIDSN

SEQ ID NO: 130943 - protein, 14 aa, Mycobacterium tuberculosis
ATVIDHEGVIDSNT

SEQ ID NO: 130944 - protein, 14 aa, Mycobacterium tuberculosis
TVIDHEGVIDSNTT

SEQ ID NO: 130945 - protein, 14 aa, Mycobacterium tuberculosis
VIDHEGVIDSNTTA

SEQ ID NO: 130946 - protein, 14 aa, Mycobacterium tuberculosis
IDHEGVIDSNTTAT

SEQ ID NO: 130947 - protein, 14 aa, Mycobacterium tuberculosis
DHEGVIDSNTTATS

SEQ ID NO: 130948 - protein, 14 aa, Mycobacterium tuberculosis
HEGVIDSNTTATSA

SEQ ID NO: 130949 - protein, 14 aa, Mycobacterium tuberculosis
EGVIDSNTTATSAP

SEQ ID NO: 130950 - protein, 14 aa, Mycobacterium tuberculosis
GVIDSNTTATSAPP

SEQ ID NO: 130951 - protein, 14 aa, Mycobacterium tuberculosis
VIDSNTTATSAPPR

SEQ ID NO: 130952 - protein, 14 aa, Mycobacterium tuberculosis
IDSNTTATSAPPRT

SEQ ID NO: 130953 - protein, 14 aa, Mycobacterium tuberculosis
DSNTTATSAPPRTK

SEQ ID NO: 130954 - protein, 14 aa, Mycobacterium tuberculosis
SNTTATSAPPRTKI

SEQ ID NO: 130955 - protein, 14 aa, Mycobacterium tuberculosis
NTTATSAPPRTKIT

SEQ ID NO: 130956 - protein, 14 aa, Mycobacterium tuberculosis
TTATSAPPRTKITV

SEQ ID NO: 130957 - protein, 14 aa, Mycobacterium tuberculosis
TATSAPPRTKITVP

SEQ ID NO: 130958 - protein, 14 aa, Mycobacterium tuberculosis
ATSAPPRTKITVPA

SEQ ID NO: 130959 - protein, 14 aa, Mycobacterium tuberculosis
TSAPPRTKITVPAR

SEQ ID NO: 130960 - protein, 14 aa, Mycobacterium tuberculosis
SAPPRTKITVPARW

SEQ ID NO: 130961 - protein, 14 aa, Mycobacterium tuberculosis
APPRTKITVPARWV

SEQ ID NO: 130962 - protein, 14 aa, Mycobacterium tuberculosis
PPRTKITVPARWVV

SEQ ID NO: 130963 - protein, 14 aa, Mycobacterium tuberculosis
PRTKITVPARWVVN

SEQ ID NO: 130964 - protein, 14 aa, Mycobacterium tuberculosis
RTKITVPARWVVNG

SEQ ID NO: 130965 - protein, 14 aa, Mycobacterium tuberculosis
TKITVPARWVVNGI

SEQ ID NO: 130966 - protein, 14 aa, Mycobacterium tuberculosis
KITVPARWVVNGIE

SEQ ID NO: 130967 - protein, 14 aa, Mycobacterium tuberculosis
ITVPARWVVNGIER

SEQ ID NO: 130968 - protein, 14 aa, Mycobacterium tuberculosis
TVPARWVVNGIERS

SEQ ID NO: 130969 - protein, 14 aa, Mycobacterium tuberculosis
VPARWVVNGIERSG

SEQ ID NO: 130970 - protein, 14 aa, Mycobacterium tuberculosis
PARWVVNGIERSGE

SEQ ID NO: 130971 - protein, 14 aa, Mycobacterium tuberculosis
ARWVVNGIERSGEV

SEQ ID NO: 130972 - protein, 14 aa, Mycobacterium tuberculosis
RWVVNGIERSGEVN

SEQ ID NO: 130973 - protein, 14 aa, Mycobacterium tuberculosis
WVVNGIERSGEVNA

SEQ ID NO: 130974 - protein, 14 aa, Mycobacterium tuberculosis
VVNGIERSGEVNAK

SEQ ID NO: 130975 - protein, 14 aa, Mycobacterium tuberculosis
VNGIERSGEVNAKP

SEQ ID NO: 130976 - protein, 14 aa, Mycobacterium tuberculosis
NGIERSGEVNAKPG

SEQ ID NO: 130977 - protein, 14 aa, Mycobacterium tuberculosis
GIERSGEVNAKPGT

SEQ ID NO: 130978 - protein, 14 aa, Mycobacterium tuberculosis
IERSGEVNAKPGTK

SEQ ID NO: 130979 - protein, 14 aa, Mycobacterium tuberculosis
ERSGEVNAKPGTKS

SEQ ID NO: 130980 - protein, 14 aa, Mycobacterium tuberculosis
RSGEVNAKPGTKSG

SEQ ID NO: 130981 - protein, 14 aa, Mycobacterium tuberculosis
SGEVNAKPGTKSGD

SEQ ID NO: 130982 - protein, 14 aa, Mycobacterium tuberculosis
GEVNAKPGTKSGDR

SEQ ID NO: 130983 - protein, 14 aa, Mycobacterium tuberculosis
EVNAKPGTKSGDRV

SEQ ID NO: 130984 - protein, 14 aa, Mycobacterium tuberculosis
VNAKPGTKSGDRVG

SEQ ID NO: 130985 - protein, 14 aa, Mycobacterium tuberculosis
NAKPGTKSGDRVGI

SEQ ID NO: 130986 - protein, 14 aa, Mycobacterium tuberculosis
AKPGTKSGDRVGIW

SEQ ID NO: 130987 - protein, 14 aa, Mycobacterium tuberculosis
KPGTKSGDRVGIWV

SEQ ID NO: 130988 - protein, 14 aa, Mycobacterium tuberculosis
PGTKSGDRVGIWVD

SEQ ID NO: 130989 - protein, 14 aa, Mycobacterium tuberculosis
GTKSGDRVGIWVDS

SEQ ID NO: 130990 - protein, 14 aa, Mycobacterium tuberculosis
TKSGDRVGIWVDSA

SEQ ID NO: 130991 - protein, 14 aa, Mycobacterium tuberculosis
KSGDRVGIWVDSAG

SEQ ID NO: 130992 - protein, 14 aa, Mycobacterium tuberculosis
SGDRVGIWVDSAGQ

SEQ ID NO: 130993 - protein, 14 aa, Mycobacterium tuberculosis
GDRVGIWVDSAGQL

SEQ ID NO: 130994 - protein, 14 aa, Mycobacterium tuberculosis
DRVGIWVDSAGQLV

SEQ ID NO: 130995 - protein, 14 aa, Mycobacterium tuberculosis
RVGIWVDSAGQLVD

SEQ ID NO: 130996 - protein, 14 aa, Mycobacterium tuberculosis
VGIWVDSAGQLVDE

SEQ ID NO: 130997 - protein, 14 aa, Mycobacterium tuberculosis
GIWVDSAGQLVDEP

SEQ ID NO: 130998 - protein, 14 aa, Mycobacterium tuberculosis
IWVDSAGQLVDEPA

SEQ ID NO: 130999 - protein, 14 aa, Mycobacterium tuberculosis
WVDSAGQLVDEPAP

SEQ ID NO: 131000 - protein, 14 aa, Mycobacterium tuberculosis
VDSAGQLVDEPAPP

SEQ ID NO: 131001 - protein, 14 aa, Mycobacterium tuberculosis
DSAGQLVDEPAPPA

SEQ ID NO: 131002 - protein, 14 aa, Mycobacterium tuberculosis
SAGQLVDEPAPPAR

SEQ ID NO: 131003 - protein, 14 aa, Mycobacterium tuberculosis
AGQLVDEPAPPARA

SEQ ID NO: 131004 - protein, 14 aa, Mycobacterium tuberculosis
GQLVDEPAPPARAI

SEQ ID NO: 131005 - protein, 14 aa, Mycobacterium tuberculosis
QLVDEPAPPARAIA

SEQ ID NO: 131006 - protein, 14 aa, Mycobacterium tuberculosis
LVDEPAPPARAIAD

SEQ ID NO: 131007 - protein, 14 aa, Mycobacterium tuberculosis
VDEPAPPARAIADA

SEQ ID NO: 131008 - protein, 14 aa, Mycobacterium tuberculosis
DEPAPPARAIADAA

SEQ ID NO: 131009 - protein, 14 aa, Mycobacterium tuberculosis
EPAPPARAIADAAL

SEQ ID NO: 131010 - protein, 14 aa, Mycobacterium tuberculosis
PAPPARAIADAALA

SEQ ID NO: 131011 - protein, 14 aa, Mycobacterium tuberculosis
APPARAIADAALAA

SEQ ID NO: 131012 - protein, 14 aa, Mycobacterium tuberculosis
PPARAIADAALAAL

SEQ ID NO: 131013 - protein, 14 aa, Mycobacterium tuberculosis
PARAIADAALAALG

SEQ ID NO: 131014 - protein, 14 aa, Mycobacterium tuberculosis
ARAIADAALAALGL

SEQ ID NO: 131015 - protein, 14 aa, Mycobacterium tuberculosis
RAIADAALAALGLW

SEQ ID NO: 131016 - protein, 14 aa, Mycobacterium tuberculosis
AIADAALAALGLWL

SEQ ID NO: 131017 - protein, 14 aa, Mycobacterium tuberculosis
IADAALAALGLWLS

SEQ ID NO: 131018 - protein, 14 aa, Mycobacterium tuberculosis
ADAALAALGLWLSV

SEQ ID NO: 131019 - protein, 14 aa, Mycobacterium tuberculosis
DAALAALGLWLSVA

SEQ ID NO: 131020 - protein, 14 aa, Mycobacterium tuberculosis
AALAALGLWLSVAA

SEQ ID NO: 131021 - protein, 14 aa, Mycobacterium tuberculosis
ALAALGLWLSVAAV

SEQ ID NO: 131022 - protein, 14 aa, Mycobacterium tuberculosis
LAALGLWLSVAAVA

SEQ ID NO: 131023 - protein, 14 aa, Mycobacterium tuberculosis
AALGLWLSVAAVAG

SEQ ID NO: 131024 - protein, 14 aa, Mycobacterium tuberculosis
ALGLWLSVAAVAGA

SEQ ID NO: 131025 - protein, 14 aa, Mycobacterium tuberculosis
LGLWLSVAAVAGAL

SEQ ID NO: 131026 - protein, 14 aa, Mycobacterium tuberculosis
GLWLSVAAVAGALL

SEQ ID NO: 131027 - protein, 14 aa, Mycobacterium tuberculosis
LWLSVAAVAGALLA

SEQ ID NO: 131028 - protein, 14 aa, Mycobacterium tuberculosis
WLSVAAVAGALLAL

SEQ ID NO: 131029 - protein, 14 aa, Mycobacterium tuberculosis
LSVAAVAGALLALT

SEQ ID NO: 131030 - protein, 14 aa, Mycobacterium tuberculosis
SVAAVAGALLALTR

SEQ ID NO: 131031 - protein, 14 aa, Mycobacterium tuberculosis
VAAVAGALLALTRA

SEQ ID NO: 131032 - protein, 14 aa, Mycobacterium tuberculosis
AAVAGALLALTRAI

SEQ ID NO: 131033 - protein, 14 aa, Mycobacterium tuberculosis
AVAGALLALTRAIL

SEQ ID NO: 131034 - protein, 14 aa, Mycobacterium tuberculosis
VAGALLALTRAILI

SEQ ID NO: 131035 - protein, 14 aa, Mycobacterium tuberculosis
AGALLALTRAILIR

SEQ ID NO: 131036 - protein, 14 aa, Mycobacterium tuberculosis
GALLALTRAILIRV

SEQ ID NO: 131037 - protein, 14 aa, Mycobacterium tuberculosis
ALLALTRAILIRVR

SEQ ID NO: 131038 - protein, 14 aa, Mycobacterium tuberculosis
LLALTRAILIRVRN

SEQ ID NO: 131039 - protein, 14 aa, Mycobacterium tuberculosis
LALTRAILIRVRNA

SEQ ID NO: 131040 - protein, 14 aa, Mycobacterium tuberculosis
ALTRAILIRVRNAS

SEQ ID NO: 131041 - protein, 14 aa, Mycobacterium tuberculosis
LTRAILIRVRNASW

SEQ ID NO: 131042 - protein, 14 aa, Mycobacterium tuberculosis
TRAILIRVRNASWQ

SEQ ID NO: 131043 - protein, 14 aa, Mycobacterium tuberculosis
RAILIRVRNASWQH

SEQ ID NO: 131044 - protein, 14 aa, Mycobacterium tuberculosis
AILIRVRNASWQHD

SEQ ID NO: 131045 - protein, 14 aa, Mycobacterium tuberculosis
ILIRVRNASWQHDI

SEQ ID NO: 131046 - protein, 14 aa, Mycobacterium tuberculosis
LIRVRNASWQHDID

SEQ ID NO: 131047 - protein, 14 aa, Mycobacterium tuberculosis
IRVRNASWQHDIDS

SEQ ID NO: 131048 - protein, 14 aa, Mycobacterium tuberculosis
RVRNASWQHDIDSL

SEQ ID NO: 131049 - protein, 14 aa, Mycobacterium tuberculosis
VRNASWQHDIDSLF

SEQ ID NO: 131050 - protein, 14 aa, Mycobacterium tuberculosis
RNASWQHDIDSLFC

SEQ ID NO: 131051 - protein, 14 aa, Mycobacterium tuberculosis
NASWQHDIDSLFCT

SEQ ID NO: 131052 - protein, 14 aa, Mycobacterium tuberculosis
ASWQHDIDSLFCTQ

SEQ ID NO: 131053 - protein, 14 aa, Mycobacterium tuberculosis
SWQHDIDSLFCTQR

SEQ ID NO: 131054 - protein, 15 aa, Mycobacterium tuberculosis
MIATTRDREGATMIT

SEQ ID NO: 131055 - protein, 15 aa, Mycobacterium tuberculosis
IATTRDREGATMITF

SEQ ID NO: 131056 - protein, 15 aa, Mycobacterium tuberculosis
ATTRDREGATMITFR

SEQ ID NO: 131057 - protein, 15 aa, Mycobacterium tuberculosis
TTRDREGATMITFRL

SEQ ID NO: 131058 - protein, 15 aa, Mycobacterium tuberculosis
TRDREGATMITFRLR

SEQ ID NO: 131059 - protein, 15 aa, Mycobacterium tuberculosis
RDREGATMITFRLRL

SEQ ID NO: 131060 - protein, 15 aa, Mycobacterium tuberculosis
DREGATMITFRLRLP

SEQ ID NO: 131061 - protein, 15 aa, Mycobacterium tuberculosis
REGATMITFRLRLPC

SEQ ID NO: 131062 - protein, 15 aa, Mycobacterium tuberculosis
EGATMITFRLRLPCR

SEQ ID NO: 131063 - protein, 15 aa, Mycobacterium tuberculosis
GATMITFRLRLPCRT

SEQ ID NO: 131064 - protein, 15 aa, Mycobacterium tuberculosis
ATMITFRLRLPCRTI

SEQ ID NO: 131065 - protein, 15 aa, Mycobacterium tuberculosis
TMITFRLRLPCRTIL

SEQ ID NO: 131066 - protein, 15 aa, Mycobacterium tuberculosis
MITFRLRLPCRTILR

SEQ ID NO: 131067 - protein, 15 aa, Mycobacterium tuberculosis
ITFRLRLPCRTILRV

SEQ ID NO: 131068 - protein, 15 aa, Mycobacterium tuberculosis
TFRLRLPCRTILRVF

SEQ ID NO: 131069 - protein, 15 aa, Mycobacterium tuberculosis
FRLRLPCRTILRVFS

SEQ ID NO: 131070 - protein, 15 aa, Mycobacterium tuberculosis
RLRLPCRTILRVFSR

SEQ ID NO: 131071 - protein, 15 aa, Mycobacterium tuberculosis
LRLPCRTILRVFSRN

SEQ ID NO: 131072 - protein, 15 aa, Mycobacterium tuberculosis
RLPCRTILRVFSRNP

SEQ ID NO: 131073 - protein, 15 aa, Mycobacterium tuberculosis
LPCRTILRVFSRNPL

SEQ ID NO: 131074 - protein, 15 aa, Mycobacterium tuberculosis
PCRTILRVFSRNPLV

SEQ ID NO: 131075 - protein, 15 aa, Mycobacterium tuberculosis
CRTILRVFSRNPLVR

SEQ ID NO: 131076 - protein, 15 aa, Mycobacterium tuberculosis
RTILRVFSRNPLVRG

SEQ ID NO: 131077 - protein, 15 aa, Mycobacterium tuberculosis
TILRVFSRNPLVRGT

SEQ ID NO: 131078 - protein, 15 aa, Mycobacterium tuberculosis
ILRVFSRNPLVRGTD

SEQ ID NO: 131079 - protein, 15 aa, Mycobacterium tuberculosis
LRVFSRNPLVRGTDR

SEQ ID NO: 131080 - protein, 15 aa, Mycobacterium tuberculosis
RVFSRNPLVRGTDRL

SEQ ID NO: 131081 - protein, 15 aa, Mycobacterium tuberculosis
VFSRNPLVRGTDRLE

SEQ ID NO: 131082 - protein, 15 aa, Mycobacterium tuberculosis
FSRNPLVRGTDRLEA

SEQ ID NO: 131083 - protein, 15 aa, Mycobacterium tuberculosis
SRNPLVRGTDRLEAV

SEQ ID NO: 131084 - protein, 15 aa, Mycobacterium tuberculosis
RNPLVRGTDRLEAVV

SEQ ID NO: 131085 - protein, 15 aa, Mycobacterium tuberculosis
NPLVRGTDRLEAVVM

SEQ ID NO: 131086 - protein, 15 aa, Mycobacterium tuberculosis
PLVRGTDRLEAVVML

SEQ ID NO: 131087 - protein, 15 aa, Mycobacterium tuberculosis
LVRGTDRLEAVVMLL

SEQ ID NO: 131088 - protein, 15 aa, Mycobacterium tuberculosis
VRGTDRLEAVVMLLA

SEQ ID NO: 131089 - protein, 15 aa, Mycobacterium tuberculosis
RGTDRLEAVVMLLAV

SEQ ID NO: 131090 - protein, 15 aa, Mycobacterium tuberculosis
GTDRLEAVVMLLAVT

SEQ ID NO: 131091 - protein, 15 aa, Mycobacterium tuberculosis
TDRLEAVVMLLAVTV

SEQ ID NO: 131092 - protein, 15 aa, Mycobacterium tuberculosis
DRLEAVVMLLAVTVS

SEQ ID NO: 131093 - protein, 15 aa, Mycobacterium tuberculosis
RLEAVVMLLAVTVSL

SEQ ID NO: 131094 - protein, 15 aa, Mycobacterium tuberculosis
LEAVVMLLAVTVSLL

SEQ ID NO: 131095 - protein, 15 aa, Mycobacterium tuberculosis
EAVVMLLAVTVSLLT

SEQ ID NO: 131096 - protein, 15 aa, Mycobacterium tuberculosis
AVVMLLAVTVSLLTI

SEQ ID NO: 131097 - protein, 15 aa, Mycobacterium tuberculosis
VVMLLAVTVSLLTIP

SEQ ID NO: 131098 - protein, 15 aa, Mycobacterium tuberculosis
VMLLAVTVSLLTIPF

SEQ ID NO: 131099 - protein, 15 aa, Mycobacterium tuberculosis
MLLAVTVSLLTIPFA

SEQ ID NO: 131100 - protein, 15 aa, Mycobacterium tuberculosis
LLAVTVSLLTIPFAA

SEQ ID NO: 131101 - protein, 15 aa, Mycobacterium tuberculosis
LAVTVSLLTIPFAAA

SEQ ID NO: 131102 - protein, 15 aa, Mycobacterium tuberculosis
AVTVSLLTIPFAAAA

SEQ ID NO: 131103 - protein, 15 aa, Mycobacterium tuberculosis
VTVSLLTIPFAAAAG

SEQ ID NO: 131104 - protein, 15 aa, Mycobacterium tuberculosis
TVSLLTIPFAAAAGT

SEQ ID NO: 131105 - protein, 15 aa, Mycobacterium tuberculosis
VSLLTIPFAAAAGTA

SEQ ID NO: 131106 - protein, 15 aa, Mycobacterium tuberculosis
SLLTIPFAAAAGTAV

SEQ ID NO: 131107 - protein, 15 aa, Mycobacterium tuberculosis
LLTIPFAAAAGTAVQ

SEQ ID NO: 131108 - protein, 15 aa, Mycobacterium tuberculosis
LTIPFAAAAGTAVQD

SEQ ID NO: 131109 - protein, 15 aa, Mycobacterium tuberculosis
TIPFAAAAGTAVQDS

SEQ ID NO: 131110 - protein, 15 aa, Mycobacterium tuberculosis
IPFAAAAGTAVQDSR

SEQ ID NO: 131111 - protein, 15 aa, Mycobacterium tuberculosis
PFAAAAGTAVQDSRS

SEQ ID NO: 131112 - protein, 15 aa, Mycobacterium tuberculosis
FAAAAGTAVQDSRSH

SEQ ID NO: 131113 - protein, 15 aa, Mycobacterium tuberculosis
AAAAGTAVQDSRSHV

SEQ ID NO: 131114 - protein, 15 aa, Mycobacterium tuberculosis
AAAGTAVQDSRSHVY

SEQ ID NO: 131115 - protein, 15 aa, Mycobacterium tuberculosis
AAGTAVQDSRSHVYA

SEQ ID NO: 131116 - protein, 15 aa, Mycobacterium tuberculosis
AGTAVQDSRSHVYAH

SEQ ID NO: 131117 - protein, 15 aa, Mycobacterium tuberculosis
GTAVQDSRSHVYAHQ

SEQ ID NO: 131118 - protein, 15 aa, Mycobacterium tuberculosis
TAVQDSRSHVYAHQA

SEQ ID NO: 131119 - protein, 15 aa, Mycobacterium tuberculosis
AVQDSRSHVYAHQAQ

SEQ ID NO: 131120 - protein, 15 aa, Mycobacterium tuberculosis
VQDSRSHVYAHQAQT

SEQ ID NO: 131121 - protein, 15 aa, Mycobacterium tuberculosis
QDSRSHVYAHQAQTR

SEQ ID NO: 131122 - protein, 15 aa, Mycobacterium tuberculosis
DSRSHVYAHQAQTRH

SEQ ID NO: 131123 - protein, 15 aa, Mycobacterium tuberculosis
SRSHVYAHQAQTRHP

SEQ ID NO: 131124 - protein, 15 aa, Mycobacterium tuberculosis
RSHVYAHQAQTRHPA

SEQ ID NO: 131125 - protein, 15 aa, Mycobacterium tuberculosis
SHVYAHQAQTRHPAT

SEQ ID NO: 131126 - protein, 15 aa, Mycobacterium tuberculosis
HVYAHQAQTRHPATA

SEQ ID NO: 131127 - protein, 15 aa, Mycobacterium tuberculosis
VYAHQAQTRHPATAT

SEQ ID NO: 131128 - protein, 15 aa, Mycobacterium tuberculosis
YAHQAQTRHPATATV

SEQ ID NO: 131129 - protein, 15 aa, Mycobacterium tuberculosis
AHQAQTRHPATATVI

SEQ ID NO: 131130 - protein, 15 aa, Mycobacterium tuberculosis
HQAQTRHPATATVID

SEQ ID NO: 131131 - protein, 15 aa, Mycobacterium tuberculosis
QAQTRHPATATVIDH

SEQ ID NO: 131132 - protein, 15 aa, Mycobacterium tuberculosis
AQTRHPATATVIDHE

SEQ ID NO: 131133 - protein, 15 aa, Mycobacterium tuberculosis
QTRHPATATVIDHEG

SEQ ID NO: 131134 - protein, 15 aa, Mycobacterium tuberculosis
TRHPATATVIDHEGV

SEQ ID NO: 131135 - protein, 15 aa, Mycobacterium tuberculosis
RHPATATVIDHEGVI

SEQ ID NO: 131136 - protein, 15 aa, Mycobacterium tuberculosis
HPATATVIDHEGVID

SEQ ID NO: 131137 - protein, 15 aa, Mycobacterium tuberculosis
PATATVIDHEGVIDS

SEQ ID NO: 131138 - protein, 15 aa, Mycobacterium tuberculosis
ATATVIDHEGVIDSN

SEQ ID NO: 131139 - protein, 15 aa, Mycobacterium tuberculosis
TATVIDHEGVIDSNT

SEQ ID NO: 131140 - protein, 15 aa, Mycobacterium tuberculosis
ATVIDHEGVIDSNTT

SEQ ID NO: 131141 - protein, 15 aa, Mycobacterium tuberculosis
TVIDHEGVIDSNTTA

SEQ ID NO: 131142 - protein, 15 aa, Mycobacterium tuberculosis
VIDHEGVIDSNTTAT

SEQ ID NO: 131143 - protein, 15 aa, Mycobacterium tuberculosis
IDHEGVIDSNTTATS

SEQ ID NO: 131144 - protein, 15 aa, Mycobacterium tuberculosis
DHEGVIDSNTTATSA

SEQ ID NO: 131145 - protein, 15 aa, Mycobacterium tuberculosis
HEGVIDSNTTATSAP

SEQ ID NO: 131146 - protein, 15 aa, Mycobacterium tuberculosis
EGVIDSNTTATSAPP

SEQ ID NO: 131147 - protein, 15 aa, Mycobacterium tuberculosis
GVIDSNTTATSAPPR

SEQ ID NO: 131148 - protein, 15 aa, Mycobacterium tuberculosis
VIDSNTTATSAPPRT

SEQ ID NO: 131149 - protein, 15 aa, Mycobacterium tuberculosis
IDSNTTATSAPPRTK

SEQ ID NO: 131150 - protein, 15 aa, Mycobacterium tuberculosis
DSNTTATSAPPRTKI

SEQ ID NO: 131151 - protein, 15 aa, Mycobacterium tuberculosis
SNTTATSAPPRTKIT

SEQ ID NO: 131152 - protein, 15 aa, Mycobacterium tuberculosis
NTTATSAPPRTKITV

SEQ ID NO: 131153 - protein, 15 aa, Mycobacterium tuberculosis
TTATSAPPRTKITVP

SEQ ID NO: 131154 - protein, 15 aa, Mycobacterium tuberculosis
TATSAPPRTKITVPA

SEQ ID NO: 131155 - protein, 15 aa, Mycobacterium tuberculosis
ATSAPPRTKITVPAR

SEQ ID NO: 131156 - protein, 15 aa, Mycobacterium tuberculosis
TSAPPRTKITVPARW

SEQ ID NO: 131157 - protein, 15 aa, Mycobacterium tuberculosis
SAPPRTKITVPARWV

SEQ ID NO: 131158 - protein, 15 aa, Mycobacterium tuberculosis
APPRTKITVPARWVV

SEQ ID NO: 131159 - protein, 15 aa, Mycobacterium tuberculosis
PPRTKITVPARWVVN

SEQ ID NO: 131160 - protein, 15 aa, Mycobacterium tuberculosis
PRTKITVPARWVVNG

SEQ ID NO: 131161 - protein, 15 aa, Mycobacterium tuberculosis
RTKITVPARWVVNGI

SEQ ID NO: 131162 - protein, 15 aa, Mycobacterium tuberculosis
TKITVPARWVVNGIE

SEQ ID NO: 131163 - protein, 15 aa, Mycobacterium tuberculosis
KITVPARWVVNGIER

SEQ ID NO: 131164 - protein, 15 aa, Mycobacterium tuberculosis
ITVPARWVVNGIERS

SEQ ID NO: 131165 - protein, 15 aa, Mycobacterium tuberculosis
TVPARWVVNGIERSG

SEQ ID NO: 131166 - protein, 15 aa, Mycobacterium tuberculosis
VPARWVVNGIERSGE

SEQ ID NO: 131167 - protein, 15 aa, Mycobacterium tuberculosis
PARWVVNGIERSGEV

SEQ ID NO: 131168 - protein, 15 aa, Mycobacterium tuberculosis
ARWVVNGIERSGEVN

SEQ ID NO: 131169 - protein, 15 aa, Mycobacterium tuberculosis
RWVVNGIERSGEVNA

SEQ ID NO: 131170 - protein, 15 aa, Mycobacterium tuberculosis
WVVNGIERSGEVNAK

SEQ ID NO: 131171 - protein, 15 aa, Mycobacterium tuberculosis
VVNGIERSGEVNAKP

SEQ ID NO: 131172 - protein, 15 aa, Mycobacterium tuberculosis
VNGIERSGEVNAKPG

SEQ ID NO: 131173 - protein, 15 aa, Mycobacterium tuberculosis
NGIERSGEVNAKPGT

SEQ ID NO: 131174 - protein, 15 aa, Mycobacterium tuberculosis
GIERSGEVNAKPGTK

SEQ ID NO: 131175 - protein, 15 aa, Mycobacterium tuberculosis
IERSGEVNAKPGTKS

SEQ ID NO: 131176 - protein, 15 aa, Mycobacterium tuberculosis
ERSGEVNAKPGTKSG

SEQ ID NO: 131177 - protein, 15 aa, Mycobacterium tuberculosis
RSGEVNAKPGTKSGD

SEQ ID NO: 131178 - protein, 15 aa, Mycobacterium tuberculosis
SGEVNAKPGTKSGDR

SEQ ID NO: 131179 - protein, 15 aa, Mycobacterium tuberculosis
GEVNAKPGTKSGDRV

SEQ ID NO: 131180 - protein, 15 aa, Mycobacterium tuberculosis
EVNAKPGTKSGDRVG

SEQ ID NO: 131181 - protein, 15 aa, Mycobacterium tuberculosis
VNAKPGTKSGDRVGI

SEQ ID NO: 131182 - protein, 15 aa, Mycobacterium tuberculosis
NAKPGTKSGDRVGIW

SEQ ID NO: 131183 - protein, 15 aa, Mycobacterium tuberculosis
AKPGTKSGDRVGIWV

SEQ ID NO: 131184 - protein, 15 aa, Mycobacterium tuberculosis
KPGTKSGDRVGIWVD

SEQ ID NO: 131185 - protein, 15 aa, Mycobacterium tuberculosis
PGTKSGDRVGIWVDS

SEQ ID NO: 131186 - protein, 15 aa, Mycobacterium tuberculosis
GTKSGDRVGIWVDSA

SEQ ID NO: 131187 - protein, 15 aa, Mycobacterium tuberculosis
TKSGDRVGIWVDSAG

SEQ ID NO: 131188 - protein, 15 aa, Mycobacterium tuberculosis
KSGDRVGIWVDSAGQ

SEQ ID NO: 131189 - protein, 15 aa, Mycobacterium tuberculosis
SGDRVGIWVDSAGQL

SEQ ID NO: 131190 - protein, 15 aa, Mycobacterium tuberculosis
GDRVGIWVDSAGQLV

SEQ ID NO: 131191 - protein, 15 aa, Mycobacterium tuberculosis
DRVGIWVDSAGQLVD

SEQ ID NO: 131192 - protein, 15 aa, Mycobacterium tuberculosis
RVGIWVDSAGQLVDE

SEQ ID NO: 131193 - protein, 15 aa, Mycobacterium tuberculosis
VGIWVDSAGQLVDEP

SEQ ID NO: 131194 - protein, 15 aa, Mycobacterium tuberculosis
GIWVDSAGQLVDEPA

SEQ ID NO: 131195 - protein, 15 aa, Mycobacterium tuberculosis
IWVDSAGQLVDEPAP

SEQ ID NO: 131196 - protein, 15 aa, Mycobacterium tuberculosis
WVDSAGQLVDEPAPP

SEQ ID NO: 131197 - protein, 15 aa, Mycobacterium tuberculosis
VDSAGQLVDEPAPPA

SEQ ID NO: 131198 - protein, 15 aa, Mycobacterium tuberculosis
DSAGQLVDEPAPPAR

SEQ ID NO: 131199 - protein, 15 aa, Mycobacterium tuberculosis
SAGQLVDEPAPPARA

SEQ ID NO: 131200 - protein, 15 aa, Mycobacterium tuberculosis
AGQLVDEPAPPARAI

SEQ ID NO: 131201 - protein, 15 aa, Mycobacterium tuberculosis
GQLVDEPAPPARAIA

SEQ ID NO: 131202 - protein, 15 aa, Mycobacterium tuberculosis
QLVDEPAPPARAIAD

SEQ ID NO: 131203 - protein, 15 aa, Mycobacterium tuberculosis
LVDEPAPPARAIADA

SEQ ID NO: 131204 - protein, 15 aa, Mycobacterium tuberculosis
VDEPAPPARAIADAA

SEQ ID NO: 131205 - protein, 15 aa, Mycobacterium tuberculosis
DEPAPPARAIADAAL

SEQ ID NO: 131206 - protein, 15 aa, Mycobacterium tuberculosis
EPAPPARAIADAALA

SEQ ID NO: 131207 - protein, 15 aa, Mycobacterium tuberculosis
PAPPARAIADAALAA

SEQ ID NO: 131208 - protein, 15 aa, Mycobacterium tuberculosis
APPARAIADAALAAL

SEQ ID NO: 131209 - protein, 15 aa, Mycobacterium tuberculosis
PPARAIADAALAALG

SEQ ID NO: 131210 - protein, 15 aa, Mycobacterium tuberculosis
PARAIADAALAALGL

SEQ ID NO: 131211 - protein, 15 aa, Mycobacterium tuberculosis
ARAIADAALAALGLW

SEQ ID NO: 131212 - protein, 15 aa, Mycobacterium tuberculosis
RAIADAALAALGLWL

SEQ ID NO: 131213 - protein, 15 aa, Mycobacterium tuberculosis
AIADAALAALGLWLS

SEQ ID NO: 131214 - protein, 15 aa, Mycobacterium tuberculosis
IADAALAALGLWLSV

SEQ ID NO: 131215 - protein, 15 aa, Mycobacterium tuberculosis
ADAALAALGLWLSVA

SEQ ID NO: 131216 - protein, 15 aa, Mycobacterium tuberculosis
DAALAALGLWLSVAA

SEQ ID NO: 131217 - protein, 15 aa, Mycobacterium tuberculosis
AALAALGLWLSVAAV

SEQ ID NO: 131218 - protein, 15 aa, Mycobacterium tuberculosis
ALAALGLWLSVAAVA

SEQ ID NO: 131219 - protein, 15 aa, Mycobacterium tuberculosis
LAALGLWLSVAAVAG

SEQ ID NO: 131220 - protein, 15 aa, Mycobacterium tuberculosis
AALGLWLSVAAVAGA

SEQ ID NO: 131221 - protein, 15 aa, Mycobacterium tuberculosis
ALGLWLSVAAVAGAL

SEQ ID NO: 131222 - protein, 15 aa, Mycobacterium tuberculosis
LGLWLSVAAVAGALL

SEQ ID NO: 131223 - protein, 15 aa, Mycobacterium tuberculosis
GLWLSVAAVAGALLA

SEQ ID NO: 131224 - protein, 15 aa, Mycobacterium tuberculosis
LWLSVAAVAGALLAL

SEQ ID NO: 131225 - protein, 15 aa, Mycobacterium tuberculosis
WLSVAAVAGALLALT

SEQ ID NO: 131226 - protein, 15 aa, Mycobacterium tuberculosis
LSVAAVAGALLALTR

SEQ ID NO: 131227 - protein, 15 aa, Mycobacterium tuberculosis
SVAAVAGALLALTRA

SEQ ID NO: 131228 - protein, 15 aa, Mycobacterium tuberculosis
VAAVAGALLALTRAI

SEQ ID NO: 131229 - protein, 15 aa, Mycobacterium tuberculosis
AAVAGALLALTRAIL

SEQ ID NO: 131230 - protein, 15 aa, Mycobacterium tuberculosis
AVAGALLALTRAILI

SEQ ID NO: 131231 - protein, 15 aa, Mycobacterium tuberculosis
VAGALLALTRAILIR

SEQ ID NO: 131232 - protein, 15 aa, Mycobacterium tuberculosis
AGALLALTRAILIRV

SEQ ID NO: 131233 - protein, 15 aa, Mycobacterium tuberculosis
GALLALTRAILIRVR

SEQ ID NO: 131234 - protein, 15 aa, Mycobacterium tuberculosis
ALLALTRAILIRVRN

SEQ ID NO: 131235 - protein, 15 aa, Mycobacterium tuberculosis
LLALTRAILIRVRNA

SEQ ID NO: 131236 - protein, 15 aa, Mycobacterium tuberculosis
LALTRAILIRVRNAS

SEQ ID NO: 131237 - protein, 15 aa, Mycobacterium tuberculosis
ALTRAILIRVRNASW

SEQ ID NO: 131238 - protein, 15 aa, Mycobacterium tuberculosis
LTRAILIRVRNASWQ

SEQ ID NO: 131239 - protein, 15 aa, Mycobacterium tuberculosis
TRAILIRVRNASWQH

SEQ ID NO: 131240 - protein, 15 aa, Mycobacterium tuberculosis
RAILIRVRNASWQHD

SEQ ID NO: 131241 - protein, 15 aa, Mycobacterium tuberculosis
AILIRVRNASWQHDI

SEQ ID NO: 131242 - protein, 15 aa, Mycobacterium tuberculosis
ILIRVRNASWQHDID

SEQ ID NO: 131243 - protein, 15 aa, Mycobacterium tuberculosis
LIRVRNASWQHDIDS

SEQ ID NO: 131244 - protein, 15 aa, Mycobacterium tuberculosis
IRVRNASWQHDIDSL

SEQ ID NO: 131245 - protein, 15 aa, Mycobacterium tuberculosis
RVRNASWQHDIDSLF

SEQ ID NO: 131246 - protein, 15 aa, Mycobacterium tuberculosis
VRNASWQHDIDSLFC

SEQ ID NO: 131247 - protein, 15 aa, Mycobacterium tuberculosis
RNASWQHDIDSLFCT

SEQ ID NO: 131248 - protein, 15 aa, Mycobacterium tuberculosis
NASWQHDIDSLFCTQ

SEQ ID NO: 131249 - protein, 15 aa, Mycobacterium tuberculosis
ASWQHDIDSLFCTQR

SEQ ID NO: 131250 - protein, 16 aa, Mycobacterium tuberculosis
MIATTRDREGATMITF

SEQ ID NO: 131251 - protein, 16 aa, Mycobacterium tuberculosis
IATTRDREGATMITFR

SEQ ID NO: 131252 - protein, 16 aa, Mycobacterium tuberculosis
ATTRDREGATMITFRL

SEQ ID NO: 131253 - protein, 16 aa, Mycobacterium tuberculosis
TTRDREGATMITFRLR

SEQ ID NO: 131254 - protein, 16 aa, Mycobacterium tuberculosis
TRDREGATMITFRLRL

SEQ ID NO: 131255 - protein, 16 aa, Mycobacterium tuberculosis
RDREGATMITFRLRLP

SEQ ID NO: 131256 - protein, 16 aa, Mycobacterium tuberculosis
DREGATMITFRLRLPC

SEQ ID NO: 131257 - protein, 16 aa, Mycobacterium tuberculosis
REGATMITFRLRLPCR

SEQ ID NO: 131258 - protein, 16 aa, Mycobacterium tuberculosis
EGATMITFRLRLPCRT

SEQ ID NO: 131259 - protein, 16 aa, Mycobacterium tuberculosis
GATMITFRLRLPCRTI

SEQ ID NO: 131260 - protein, 16 aa, Mycobacterium tuberculosis
ATMITFRLRLPCRTIL

SEQ ID NO: 131261 - protein, 16 aa, Mycobacterium tuberculosis
TMITFRLRLPCRTILR

SEQ ID NO: 131262 - protein, 16 aa, Mycobacterium tuberculosis
MITFRLRLPCRTILRV

SEQ ID NO: 131263 - protein, 16 aa, Mycobacterium tuberculosis
ITFRLRLPCRTILRVF

SEQ ID NO: 131264 - protein, 16 aa, Mycobacterium tuberculosis
TFRLRLPCRTILRVFS

SEQ ID NO: 131265 - protein, 16 aa, Mycobacterium tuberculosis
FRLRLPCRTILRVFSR

SEQ ID NO: 131266 - protein, 16 aa, Mycobacterium tuberculosis
RLRLPCRTILRVFSRN

SEQ ID NO: 131267 - protein, 16 aa, Mycobacterium tuberculosis
LRLPCRTILRVFSRNP

SEQ ID NO: 131268 - protein, 16 aa, Mycobacterium tuberculosis
RLPCRTILRVFSRNPL

SEQ ID NO: 131269 - protein, 16 aa, Mycobacterium tuberculosis
LPCRTILRVFSRNPLV

SEQ ID NO: 131270 - protein, 16 aa, Mycobacterium tuberculosis
PCRTILRVFSRNPLVR

SEQ ID NO: 131271 - protein, 16 aa, Mycobacterium tuberculosis
CRTILRVFSRNPLVRG

SEQ ID NO: 131272 - protein, 16 aa, Mycobacterium tuberculosis
RTILRVFSRNPLVRGT

SEQ ID NO: 131273 - protein, 16 aa, Mycobacterium tuberculosis
TILRVFSRNPLVRGTD

SEQ ID NO: 131274 - protein, 16 aa, Mycobacterium tuberculosis
ILRVFSRNPLVRGTDR

SEQ ID NO: 131275 - protein, 16 aa, Mycobacterium tuberculosis
LRVFSRNPLVRGTDRL

SEQ ID NO: 131276 - protein, 16 aa, Mycobacterium tuberculosis
RVFSRNPLVRGTDRLE

SEQ ID NO: 131277 - protein, 16 aa, Mycobacterium tuberculosis
VFSRNPLVRGTDRLEA

SEQ ID NO: 131278 - protein, 16 aa, Mycobacterium tuberculosis
FSRNPLVRGTDRLEAV

SEQ ID NO: 131279 - protein, 16 aa, Mycobacterium tuberculosis
SRNPLVRGTDRLEAVV

SEQ ID NO: 131280 - protein, 16 aa, Mycobacterium tuberculosis
RNPLVRGTDRLEAVVM

SEQ ID NO: 131281 - protein, 16 aa, Mycobacterium tuberculosis
NPLVRGTDRLEAVVML

SEQ ID NO: 131282 - protein, 16 aa, Mycobacterium tuberculosis
PLVRGTDRLEAVVMLL

SEQ ID NO: 131283 - protein, 16 aa, Mycobacterium tuberculosis
LVRGTDRLEAVVMLLA

SEQ ID NO: 131284 - protein, 16 aa, Mycobacterium tuberculosis
VRGTDRLEAVVMLLAV

SEQ ID NO: 131285 - protein, 16 aa, Mycobacterium tuberculosis
RGTDRLEAVVMLLAVT

SEQ ID NO: 131286 - protein, 16 aa, Mycobacterium tuberculosis
GTDRLEAVVMLLAVTV

SEQ ID NO: 131287 - protein, 16 aa, Mycobacterium tuberculosis
TDRLEAVVMLLAVTVS

SEQ ID NO: 131288 - protein, 16 aa, Mycobacterium tuberculosis
DRLEAVVMLLAVTVSL

SEQ ID NO: 131289 - protein, 16 aa, Mycobacterium tuberculosis
RLEAVVMLLAVTVSLL

SEQ ID NO: 131290 - protein, 16 aa, Mycobacterium tuberculosis
LEAVVMLLAVTVSLLT

SEQ ID NO: 131291 - protein, 16 aa, Mycobacterium tuberculosis
EAVVMLLAVTVSLLTI

SEQ ID NO: 131292 - protein, 16 aa, Mycobacterium tuberculosis
AVVMLLAVTVSLLTIP

SEQ ID NO: 131293 - protein, 16 aa, Mycobacterium tuberculosis
VVMLLAVTVSLLTIPF

SEQ ID NO: 131294 - protein, 16 aa, Mycobacterium tuberculosis
VMLLAVTVSLLTIPFA

SEQ ID NO: 131295 - protein, 16 aa, Mycobacterium tuberculosis
MLLAVTVSLLTIPFAA

SEQ ID NO: 131296 - protein, 16 aa, Mycobacterium tuberculosis
LLAVTVSLLTIPFAAA

SEQ ID NO: 131297 - protein, 16 aa, Mycobacterium tuberculosis
LAVTVSLLTIPFAAAA

SEQ ID NO: 131298 - protein, 16 aa, Mycobacterium tuberculosis
AVTVSLLTIPFAAAAG

SEQ ID NO: 131299 - protein, 16 aa, Mycobacterium tuberculosis
VTVSLLTIPFAAAAGT

SEQ ID NO: 131300 - protein, 16 aa, Mycobacterium tuberculosis
TVSLLTIPFAAAAGTA

SEQ ID NO: 131301 - protein, 16 aa, Mycobacterium tuberculosis
VSLLTIPFAAAAGTAV

SEQ ID NO: 131302 - protein, 16 aa, Mycobacterium tuberculosis
SLLTIPFAAAAGTAVQ

SEQ ID NO: 131303 - protein, 16 aa, Mycobacterium tuberculosis
LLTIPFAAAAGTAVQD

SEQ ID NO: 131304 - protein, 16 aa, Mycobacterium tuberculosis
LTIPFAAAAGTAVQDS

SEQ ID NO: 131305 - protein, 16 aa, Mycobacterium tuberculosis
TIPFAAAAGTAVQDSR

SEQ ID NO: 131306 - protein, 16 aa, Mycobacterium tuberculosis
IPFAAAAGTAVQDSRS

SEQ ID NO: 131307 - protein, 16 aa, Mycobacterium tuberculosis
PFAAAAGTAVQDSRSH

SEQ ID NO: 131308 - protein, 16 aa, Mycobacterium tuberculosis
FAAAAGTAVQDSRSHV

SEQ ID NO: 131309 - protein, 16 aa, Mycobacterium tuberculosis
AAAAGTAVQDSRSHVY

SEQ ID NO: 131310 - protein, 16 aa, Mycobacterium tuberculosis
AAAGTAVQDSRSHVYA

SEQ ID NO: 131311 - protein, 16 aa, Mycobacterium tuberculosis
AAGTAVQDSRSHVYAH

SEQ ID NO: 131312 - protein, 16 aa, Mycobacterium tuberculosis
AGTAVQDSRSHVYAHQ

SEQ ID NO: 131313 - protein, 16 aa, Mycobacterium tuberculosis
GTAVQDSRSHVYAHQA

SEQ ID NO: 131314 - protein, 16 aa, Mycobacterium tuberculosis
TAVQDSRSHVYAHQAQ

SEQ ID NO: 131315 - protein, 16 aa, Mycobacterium tuberculosis
AVQDSRSHVYAHQAQT

SEQ ID NO: 131316 - protein, 16 aa, Mycobacterium tuberculosis
VQDSRSHVYAHQAQTR

SEQ ID NO: 131317 - protein, 16 aa, Mycobacterium tuberculosis
QDSRSHVYAHQAQTRH

SEQ ID NO: 131318 - protein, 16 aa, Mycobacterium tuberculosis
DSRSHVYAHQAQTRHP

SEQ ID NO: 131319 - protein, 16 aa, Mycobacterium tuberculosis
SRSHVYAHQAQTRHPA

SEQ ID NO: 131320 - protein, 16 aa, Mycobacterium tuberculosis
RSHVYAHQAQTRHPAT

SEQ ID NO: 131321 - protein, 16 aa, Mycobacterium tuberculosis
SHVYAHQAQTRHPATA

SEQ ID NO: 131322 - protein, 16 aa, Mycobacterium tuberculosis
HVYAHQAQTRHPATAT

SEQ ID NO: 131323 - protein, 16 aa, Mycobacterium tuberculosis
VYAHQAQTRHPATATV

SEQ ID NO: 131324 - protein, 16 aa, Mycobacterium tuberculosis
YAHQAQTRHPATATVI

SEQ ID NO: 131325 - protein, 16 aa, Mycobacterium tuberculosis
AHQAQTRHPATATVID

SEQ ID NO: 131326 - protein, 16 aa, Mycobacterium tuberculosis
HQAQTRHPATATVIDH

SEQ ID NO: 131327 - protein, 16 aa, Mycobacterium tuberculosis
QAQTRHPATATVIDHE

SEQ ID NO: 131328 - protein, 16 aa, Mycobacterium tuberculosis
AQTRHPATATVIDHEG

SEQ ID NO: 131329 - protein, 16 aa, Mycobacterium tuberculosis
QTRHPATATVIDHEGV

SEQ ID NO: 131330 - protein, 16 aa, Mycobacterium tuberculosis
TRHPATATVIDHEGVI

SEQ ID NO: 131331 - protein, 16 aa, Mycobacterium tuberculosis
RHPATATVIDHEGVID

SEQ ID NO: 131332 - protein, 16 aa, Mycobacterium tuberculosis
HPATATVIDHEGVIDS

SEQ ID NO: 131333 - protein, 16 aa, Mycobacterium tuberculosis
PATATVIDHEGVIDSN

SEQ ID NO: 131334 - protein, 16 aa, Mycobacterium tuberculosis
ATATVIDHEGVIDSNT

SEQ ID NO: 131335 - protein, 16 aa, Mycobacterium tuberculosis
TATVIDHEGVIDSNTT

SEQ ID NO: 131336 - protein, 16 aa, Mycobacterium tuberculosis
ATVIDHEGVIDSNTTA

SEQ ID NO: 131337 - protein, 16 aa, Mycobacterium tuberculosis
TVIDHEGVIDSNTTAT

SEQ ID NO: 131338 - protein, 16 aa, Mycobacterium tuberculosis
VIDHEGVIDSNTTATS

SEQ ID NO: 131339 - protein, 16 aa, Mycobacterium tuberculosis
IDHEGVIDSNTTATSA

SEQ ID NO: 131340 - protein, 16 aa, Mycobacterium tuberculosis
DHEGVIDSNTTATSAP

SEQ ID NO: 131341 - protein, 16 aa, Mycobacterium tuberculosis
HEGVIDSNTTATSAPP

SEQ ID NO: 131342 - protein, 16 aa, Mycobacterium tuberculosis
EGVIDSNTTATSAPPR

SEQ ID NO: 131343 - protein, 16 aa, Mycobacterium tuberculosis
GVIDSNTTATSAPPRT

SEQ ID NO: 131344 - protein, 16 aa, Mycobacterium tuberculosis
VIDSNTTATSAPPRTK

SEQ ID NO: 131345 - protein, 16 aa, Mycobacterium tuberculosis
IDSNTTATSAPPRTKI

SEQ ID NO: 131346 - protein, 16 aa, Mycobacterium tuberculosis
DSNTTATSAPPRTKIT

SEQ ID NO: 131347 - protein, 16 aa, Mycobacterium tuberculosis
SNTTATSAPPRTKITV

SEQ ID NO: 131348 - protein, 16 aa, Mycobacterium tuberculosis
NTTATSAPPRTKITVP

SEQ ID NO: 131349 - protein, 16 aa, Mycobacterium tuberculosis
TTATSAPPRTKITVPA

SEQ ID NO: 131350 - protein, 16 aa, Mycobacterium tuberculosis
TATSAPPRTKITVPAR

SEQ ID NO: 131351 - protein, 16 aa, Mycobacterium tuberculosis
ATSAPPRTKITVPARW

SEQ ID NO: 131352 - protein, 16 aa, Mycobacterium tuberculosis
TSAPPRTKITVPARWV

SEQ ID NO: 131353 - protein, 16 aa, Mycobacterium tuberculosis
SAPPRTKITVPARWVV

SEQ ID NO: 131354 - protein, 16 aa, Mycobacterium tuberculosis
APPRTKITVPARWVVN

SEQ ID NO: 131355 - protein, 16 aa, Mycobacterium tuberculosis
PPRTKITVPARWVVNG

SEQ ID NO: 131356 - protein, 16 aa, Mycobacterium tuberculosis
PRTKITVPARWVVNGI

SEQ ID NO: 131357 - protein, 16 aa, Mycobacterium tuberculosis
RTKITVPARWVVNGIE

SEQ ID NO: 131358 - protein, 16 aa, Mycobacterium tuberculosis
TKITVPARWVVNGIER

SEQ ID NO: 131359 - protein, 16 aa, Mycobacterium tuberculosis
KITVPARWVVNGIERS

SEQ ID NO: 131360 - protein, 16 aa, Mycobacterium tuberculosis
ITVPARWVVNGIERSG

SEQ ID NO: 131361 - protein, 16 aa, Mycobacterium tuberculosis
TVPARWVVNGIERSGE

SEQ ID NO: 131362 - protein, 16 aa, Mycobacterium tuberculosis
VPARWVVNGIERSGEV

SEQ ID NO: 131363 - protein, 16 aa, Mycobacterium tuberculosis
PARWVVNGIERSGEVN

SEQ ID NO: 131364 - protein, 16 aa, Mycobacterium tuberculosis
ARWVVNGIERSGEVNA

SEQ ID NO: 131365 - protein, 16 aa, Mycobacterium tuberculosis
RWVVNGIERSGEVNAK

SEQ ID NO: 131366 - protein, 16 aa, Mycobacterium tuberculosis
WVVNGIERSGEVNAKP

SEQ ID NO: 131367 - protein, 16 aa, Mycobacterium tuberculosis
VVNGIERSGEVNAKPG

SEQ ID NO: 131368 - protein, 16 aa, Mycobacterium tuberculosis
VNGIERSGEVNAKPGT

SEQ ID NO: 131369 - protein, 16 aa, Mycobacterium tuberculosis
NGIERSGEVNAKPGTK

SEQ ID NO: 131370 - protein, 16 aa, Mycobacterium tuberculosis
GIERSGEVNAKPGTKS

SEQ ID NO: 131371 - protein, 16 aa, Mycobacterium tuberculosis
IERSGEVNAKPGTKSG

SEQ ID NO: 131372 - protein, 16 aa, Mycobacterium tuberculosis
ERSGEVNAKPGTKSGD

SEQ ID NO: 131373 - protein, 16 aa, Mycobacterium tuberculosis
RSGEVNAKPGTKSGDR

SEQ ID NO: 131374 - protein, 16 aa, Mycobacterium tuberculosis
SGEVNAKPGTKSGDRV

SEQ ID NO: 131375 - protein, 16 aa, Mycobacterium tuberculosis
GEVNAKPGTKSGDRVG

SEQ ID NO: 131376 - protein, 16 aa, Mycobacterium tuberculosis
EVNAKPGTKSGDRVGI

SEQ ID NO: 131377 - protein, 16 aa, Mycobacterium tuberculosis
VNAKPGTKSGDRVGIW

SEQ ID NO: 131378 - protein, 16 aa, Mycobacterium tuberculosis
NAKPGTKSGDRVGIWV

SEQ ID NO: 131379 - protein, 16 aa, Mycobacterium tuberculosis
AKPGTKSGDRVGIWVD

SEQ ID NO: 131380 - protein, 16 aa, Mycobacterium tuberculosis
KPGTKSGDRVGIWVDS

SEQ ID NO: 131381 - protein, 16 aa, Mycobacterium tuberculosis
PGTKSGDRVGIWVDSA

SEQ ID NO: 131382 - protein, 16 aa, Mycobacterium tuberculosis
GTKSGDRVGIWVDSAG

SEQ ID NO: 131383 - protein, 16 aa, Mycobacterium tuberculosis
TKSGDRVGIWVDSAGQ

SEQ ID NO: 131384 - protein, 16 aa, Mycobacterium tuberculosis
KSGDRVGIWVDSAGQL

SEQ ID NO: 131385 - protein, 16 aa, Mycobacterium tuberculosis
SGDRVGIWVDSAGQLV

SEQ ID NO: 131386 - protein, 16 aa, Mycobacterium tuberculosis
GDRVGIWVDSAGQLVD

SEQ ID NO: 131387 - protein, 16 aa, Mycobacterium tuberculosis
DRVGIWVDSAGQLVDE

SEQ ID NO: 131388 - protein, 16 aa, Mycobacterium tuberculosis
RVGIWVDSAGQLVDEP

SEQ ID NO: 131389 - protein, 16 aa, Mycobacterium tuberculosis
VGIWVDSAGQLVDEPA

SEQ ID NO: 131390 - protein, 16 aa, Mycobacterium tuberculosis
GIWVDSAGQLVDEPAP

SEQ ID NO: 131391 - protein, 16 aa, Mycobacterium tuberculosis
IWVDSAGQLVDEPAPP

SEQ ID NO: 131392 - protein, 16 aa, Mycobacterium tuberculosis
WVDSAGQLVDEPAPPA

SEQ ID NO: 131393 - protein, 16 aa, Mycobacterium tuberculosis
VDSAGQLVDEPAPPAR

SEQ ID NO: 131394 - protein, 16 aa, Mycobacterium tuberculosis
DSAGQLVDEPAPPARA

SEQ ID NO: 131395 - protein, 16 aa, Mycobacterium tuberculosis
SAGQLVDEPAPPARAI

SEQ ID NO: 131396 - protein, 16 aa, Mycobacterium tuberculosis
AGQLVDEPAPPARAIA

SEQ ID NO: 131397 - protein, 16 aa, Mycobacterium tuberculosis
GQLVDEPAPPARAIAD

SEQ ID NO: 131398 - protein, 16 aa, Mycobacterium tuberculosis
QLVDEPAPPARAIADA

SEQ ID NO: 131399 - protein, 16 aa, Mycobacterium tuberculosis
LVDEPAPPARAIADAA

SEQ ID NO: 131400 - protein, 16 aa, Mycobacterium tuberculosis
VDEPAPPARAIADAAL

SEQ ID NO: 131401 - protein, 16 aa, Mycobacterium tuberculosis
DEPAPPARAIADAALA

SEQ ID NO: 131402 - protein, 16 aa, Mycobacterium tuberculosis
EPAPPARAIADAALAA

SEQ ID NO: 131403 - protein, 16 aa, Mycobacterium tuberculosis
PAPPARAIADAALAAL

SEQ ID NO: 131404 - protein, 16 aa, Mycobacterium tuberculosis
APPARAIADAALAALG

SEQ ID NO: 131405 - protein, 16 aa, Mycobacterium tuberculosis
PPARAIADAALAALGL

SEQ ID NO: 131406 - protein, 16 aa, Mycobacterium tuberculosis
PARAIADAALAALGLW

SEQ ID NO: 131407 - protein, 16 aa, Mycobacterium tuberculosis
ARAIADAALAALGLWL

SEQ ID NO: 131408 - protein, 16 aa, Mycobacterium tuberculosis
RAIADAALAALGLWLS

SEQ ID NO: 131409 - protein, 16 aa, Mycobacterium tuberculosis
AIADAALAALGLWLSV

SEQ ID NO: 131410 - protein, 16 aa, Mycobacterium tuberculosis
IADAALAALGLWLSVA

SEQ ID NO: 131411 - protein, 16 aa, Mycobacterium tuberculosis
ADAALAALGLWLSVAA

SEQ ID NO: 131412 - protein, 16 aa, Mycobacterium tuberculosis
DAALAALGLWLSVAAV

SEQ ID NO: 131413 - protein, 16 aa, Mycobacterium tuberculosis
AALAALGLWLSVAAVA

SEQ ID NO: 131414 - protein, 16 aa, Mycobacterium tuberculosis
ALAALGLWLSVAAVAG

SEQ ID NO: 131415 - protein, 16 aa, Mycobacterium tuberculosis
LAALGLWLSVAAVAGA

SEQ ID NO: 131416 - protein, 16 aa, Mycobacterium tuberculosis
AALGLWLSVAAVAGAL

SEQ ID NO: 131417 - protein, 16 aa, Mycobacterium tuberculosis
ALGLWLSVAAVAGALL

SEQ ID NO: 131418 - protein, 16 aa, Mycobacterium tuberculosis
LGLWLSVAAVAGALLA

SEQ ID NO: 131419 - protein, 16 aa, Mycobacterium tuberculosis
GLWLSVAAVAGALLAL

SEQ ID NO: 131420 - protein, 16 aa, Mycobacterium tuberculosis
LWLSVAAVAGALLALT

SEQ ID NO: 131421 - protein, 16 aa, Mycobacterium tuberculosis
WLSVAAVAGALLALTR

SEQ ID NO: 131422 - protein, 16 aa, Mycobacterium tuberculosis
LSVAAVAGALLALTRA

SEQ ID NO: 131423 - protein, 16 aa, Mycobacterium tuberculosis
SVAAVAGALLALTRAI

SEQ ID NO: 131424 - protein, 16 aa, Mycobacterium tuberculosis
VAAVAGALLALTRAIL

SEQ ID NO: 131425 - protein, 16 aa, Mycobacterium tuberculosis
AAVAGALLALTRAILI

SEQ ID NO: 131426 - protein, 16 aa, Mycobacterium tuberculosis
AVAGALLALTRAILIR

SEQ ID NO: 131427 - protein, 16 aa, Mycobacterium tuberculosis
VAGALLALTRAILIRV

SEQ ID NO: 131428 - protein, 16 aa, Mycobacterium tuberculosis
AGALLALTRAILIRVR

SEQ ID NO: 131429 - protein, 16 aa, Mycobacterium tuberculosis
GALLALTRAILIRVRN

SEQ ID NO: 131430 - protein, 16 aa, Mycobacterium tuberculosis
ALLALTRAILIRVRNA

SEQ ID NO: 131431 - protein, 16 aa, Mycobacterium tuberculosis
LLALTRAILIRVRNAS

SEQ ID NO: 131432 - protein, 16 aa, Mycobacterium tuberculosis
LALTRAILIRVRNASW

SEQ ID NO: 131433 - protein, 16 aa, Mycobacterium tuberculosis
ALTRAILIRVRNASWQ

SEQ ID NO: 131434 - protein, 16 aa, Mycobacterium tuberculosis
LTRAILIRVRNASWQH

SEQ ID NO: 131435 - protein, 16 aa, Mycobacterium tuberculosis
TRAILIRVRNASWQHD

SEQ ID NO: 131436 - protein, 16 aa, Mycobacterium tuberculosis
RAILIRVRNASWQHDI

SEQ ID NO: 131437 - protein, 16 aa, Mycobacterium tuberculosis
AILIRVRNASWQHDID

SEQ ID NO: 131438 - protein, 16 aa, Mycobacterium tuberculosis
ILIRVRNASWQHDIDS

SEQ ID NO: 131439 - protein, 16 aa, Mycobacterium tuberculosis
LIRVRNASWQHDIDSL

SEQ ID NO: 131440 - protein, 16 aa, Mycobacterium tuberculosis
IRVRNASWQHDIDSLF

SEQ ID NO: 131441 - protein, 16 aa, Mycobacterium tuberculosis
RVRNASWQHDIDSLFC

SEQ ID NO: 131442 - protein, 16 aa, Mycobacterium tuberculosis
VRNASWQHDIDSLFCT

SEQ ID NO: 131443 - protein, 16 aa, Mycobacterium tuberculosis
RNASWQHDIDSLFCTQ

SEQ ID NO: 131444 - protein, 16 aa, Mycobacterium tuberculosis
NASWQHDIDSLFCTQR

SEQ ID NO: 131445 - protein, 317 aa, Mycobacterium tuberculosis
MSAQQTNLGIVVGVDGSPCSHTAVEWAARDAQMRNVALRVVQVVPPVITAPEGWAFEYSRFQEAQKREIVEHSYLVAQAHQIVEQAHKVALEASSSGRAAQITGEVLHGQIVPTLANISRQVAMVVLGYRGQGAVAGALLGSVSSSLVRHAHGPVAVIPEEPRPARPPHAPVVVGIDGSPTSGLAAEIAFDEASRRGVDLVALHAWSDMGPLDFPRLNWAPIEWRNLEDEQEKMLARRLSGWQDRYPDVVVHKVVVCDRPAPRLLELAQTAQLVVVGSHGRGGFPGMHLGSVSRAVVNSGQAPVIVARIPQDPAVPA

SEQ ID NO: 131446 - protein, 8 aa, Mycobacterium tuberculosis
MSAQQTNL

SEQ ID NO: 131447 - protein, 8 aa, Mycobacterium tuberculosis
AQQTNLGI

SEQ ID NO: 131448 - protein, 8 aa, Mycobacterium tuberculosis
QQTNLGIV

SEQ ID NO: 131449 - protein, 8 aa, Mycobacterium tuberculosis
QTNLGIVV

SEQ ID NO: 131450 - protein, 8 aa, Mycobacterium tuberculosis
NLGIVVGV

SEQ ID NO: 131451 - protein, 8 aa, Mycobacterium tuberculosis
SPCSHTAV

SEQ ID NO: 131452 - protein, 8 aa, Mycobacterium tuberculosis
CSHTAVEW

SEQ ID NO: 131453 - protein, 8 aa, Mycobacterium tuberculosis
HTAVEWAA

SEQ ID NO: 131454 - protein, 8 aa, Mycobacterium tuberculosis
TAVEWAAR

SEQ ID NO: 131455 - protein, 8 aa, Mycobacterium tuberculosis
WAARDAQM

SEQ ID NO: 131456 - protein, 8 aa, Mycobacterium tuberculosis
AARDAQMR

SEQ ID NO: 131457 - protein, 8 aa, Mycobacterium tuberculosis
AQMRNVAL

SEQ ID NO: 131458 - protein, 8 aa, Mycobacterium tuberculosis
QMRNVALR

SEQ ID NO: 131459 - protein, 8 aa, Mycobacterium tuberculosis
VALRVVQV

SEQ ID NO: 131460 - protein, 8 aa, Mycobacterium tuberculosis
ALRVVQVV

SEQ ID NO: 131461 - protein, 8 aa, Mycobacterium tuberculosis
VVQVVPPV

SEQ ID NO: 131462 - protein, 8 aa, Mycobacterium tuberculosis
VQVVPPVI

SEQ ID NO: 131463 - protein, 8 aa, Mycobacterium tuberculosis
VVPPVITA

SEQ ID NO: 131464 - protein, 8 aa, Mycobacterium tuberculosis
VITAPEGW

SEQ ID NO: 131465 - protein, 8 aa, Mycobacterium tuberculosis
TAPEGWAF

SEQ ID NO: 131466 - protein, 8 aa, Mycobacterium tuberculosis
WAFEYSRF

SEQ ID NO: 131467 - protein, 8 aa, Mycobacterium tuberculosis
SRFQEAQK

SEQ ID NO: 131468 - protein, 8 aa, Mycobacterium tuberculosis
RFQEAQKR

SEQ ID NO: 131469 - protein, 8 aa, Mycobacterium tuberculosis
REIVEHSY

SEQ ID NO: 131470 - protein, 8 aa, Mycobacterium tuberculosis
EIVEHSYL

SEQ ID NO: 131471 - protein, 8 aa, Mycobacterium tuberculosis
IVEHSYLV

SEQ ID NO: 131472 - protein, 8 aa, Mycobacterium tuberculosis
YLVAQAHQ

SEQ ID NO: 131473 - protein, 8 aa, Mycobacterium tuberculosis
LVAQAHQI

SEQ ID NO: 131474 - protein, 8 aa, Mycobacterium tuberculosis
VAQAHQIV

SEQ ID NO: 131475 - protein, 8 aa, Mycobacterium tuberculosis
HQIVEQAH

SEQ ID NO: 131476 - protein, 8 aa, Mycobacterium tuberculosis
QIVEQAHK

SEQ ID NO: 131477 - protein, 8 aa, Mycobacterium tuberculosis
IVEQAHKV

SEQ ID NO: 131478 - protein, 8 aa, Mycobacterium tuberculosis
EQAHKVAL

SEQ ID NO: 131479 - protein, 8 aa, Mycobacterium tuberculosis
AQITGEVL

SEQ ID NO: 131480 - protein, 8 aa, Mycobacterium tuberculosis
GEVLHGQI

SEQ ID NO: 131481 - protein, 8 aa, Mycobacterium tuberculosis
EVLHGQIV

SEQ ID NO: 131482 - protein, 8 aa, Mycobacterium tuberculosis
GQIVPTLA

SEQ ID NO: 131483 - protein, 8 aa, Mycobacterium tuberculosis
IVPTLANI

SEQ ID NO: 131484 - protein, 8 aa, Mycobacterium tuberculosis
VPTLANIS

SEQ ID NO: 131485 - protein, 8 aa, Mycobacterium tuberculosis
TLANISRQ

SEQ ID NO: 131486 - protein, 8 aa, Mycobacterium tuberculosis
NISRQVAM

SEQ ID NO: 131487 - protein, 8 aa, Mycobacterium tuberculosis
RQVAMVVL

SEQ ID NO: 131488 - protein, 8 aa, Mycobacterium tuberculosis
VAMVVLGY

SEQ ID NO: 131489 - protein, 8 aa, Mycobacterium tuberculosis
AMVVLGYR

SEQ ID NO: 131490 - protein, 8 aa, Mycobacterium tuberculosis
GQGAVAGA

SEQ ID NO: 131491 - protein, 8 aa, Mycobacterium tuberculosis
GAVAGALL

SEQ ID NO: 131492 - protein, 8 aa, Mycobacterium tuberculosis
ALLGSVSS

SEQ ID NO: 131493 - protein, 8 aa, Mycobacterium tuberculosis
LLGSVSSS

SEQ ID NO: 131494 - protein, 8 aa, Mycobacterium tuberculosis
SVSSSLVR

SEQ ID NO: 131495 - protein, 8 aa, Mycobacterium tuberculosis
HAHGPVAV

SEQ ID NO: 131496 - protein, 8 aa, Mycobacterium tuberculosis
AVIPEEPR

SEQ ID NO: 131497 - protein, 8 aa, Mycobacterium tuberculosis
IPEEPRPA

SEQ ID NO: 131498 - protein, 8 aa, Mycobacterium tuberculosis
RPARPPHA

SEQ ID NO: 131499 - protein, 8 aa, Mycobacterium tuberculosis
RPPHAPVV

SEQ ID NO: 131500 - protein, 8 aa, Mycobacterium tuberculosis
HAPVVVGI

SEQ ID NO: 131501 - protein, 8 aa, Mycobacterium tuberculosis
SPTSGLAA

SEQ ID NO: 131502 - protein, 8 aa, Mycobacterium tuberculosis
GLAAEIAF

SEQ ID NO: 131503 - protein, 8 aa, Mycobacterium tuberculosis
AEIAFDEA

SEQ ID NO: 131504 - protein, 8 aa, Mycobacterium tuberculosis
EIAFDEAS

SEQ ID NO: 131505 - protein, 8 aa, Mycobacterium tuberculosis
IAFDEASR

SEQ ID NO: 131506 - protein, 8 aa, Mycobacterium tuberculosis
ALHAWSDM

SEQ ID NO: 131507 - protein, 8 aa, Mycobacterium tuberculosis
FPRLNWAP

SEQ ID NO: 131508 - protein, 8 aa, Mycobacterium tuberculosis
LNWAPIEW

SEQ ID NO: 131509 - protein, 8 aa, Mycobacterium tuberculosis
NWAPIEWR

SEQ ID NO: 131510 - protein, 8 aa, Mycobacterium tuberculosis
APIEWRNL

SEQ ID NO: 131511 - protein, 8 aa, Mycobacterium tuberculosis
LARRLSGW

SEQ ID NO: 131512 - protein, 8 aa, Mycobacterium tuberculosis
RLSGWQDR

SEQ ID NO: 131513 - protein, 8 aa, Mycobacterium tuberculosis
WQDRYPDV

SEQ ID NO: 131514 - protein, 8 aa, Mycobacterium tuberculosis
VVVHKVVV

SEQ ID NO: 131515 - protein, 8 aa, Mycobacterium tuberculosis
RPAPRLLE

SEQ ID NO: 131516 - protein, 8 aa, Mycobacterium tuberculosis
APRLLELA

SEQ ID NO: 131517 - protein, 8 aa, Mycobacterium tuberculosis
RLLELAQT

SEQ ID NO: 131518 - protein, 8 aa, Mycobacterium tuberculosis
LLELAQTA

SEQ ID NO: 131519 - protein, 8 aa, Mycobacterium tuberculosis
ELAQTAQL

SEQ ID NO: 131520 - protein, 8 aa, Mycobacterium tuberculosis
LAQTAQLV

SEQ ID NO: 131521 - protein, 8 aa, Mycobacterium tuberculosis
AQTAQLVV

SEQ ID NO: 131522 - protein, 8 aa, Mycobacterium tuberculosis
QTAQLVVV

SEQ ID NO: 131523 - protein, 8 aa, Mycobacterium tuberculosis
VVVGSHGR

SEQ ID NO: 131524 - protein, 8 aa, Mycobacterium tuberculosis
FPGMHLGS

SEQ ID NO: 131525 - protein, 8 aa, Mycobacterium tuberculosis
HLGSVSRA

SEQ ID NO: 131526 - protein, 8 aa, Mycobacterium tuberculosis
GQAPVIVA

SEQ ID NO: 131527 - protein, 8 aa, Mycobacterium tuberculosis
QAPVIVAR

SEQ ID NO: 131528 - protein, 8 aa, Mycobacterium tuberculosis
APVIVARI

SEQ ID NO: 131529 - protein, 8 aa, Mycobacterium tuberculosis
RIPQDPAV

SEQ ID NO: 131530 - protein, 9 aa, Mycobacterium tuberculosis
AQQTNLGIV

SEQ ID NO: 131531 - protein, 9 aa, Mycobacterium tuberculosis
QQTNLGIVV

SEQ ID NO: 131532 - protein, 9 aa, Mycobacterium tuberculosis
TNLGIVVGV

SEQ ID NO: 131533 - protein, 9 aa, Mycobacterium tuberculosis
HTAVEWAAR

SEQ ID NO: 131534 - protein, 9 aa, Mycobacterium tuberculosis
WAARDAQMR

SEQ ID NO: 131535 - protein, 9 aa, Mycobacterium tuberculosis
DAQMRNVAL

SEQ ID NO: 131536 - protein, 9 aa, Mycobacterium tuberculosis
AQMRNVALR

SEQ ID NO: 131537 - protein, 9 aa, Mycobacterium tuberculosis
QMRNVALRV

SEQ ID NO: 131538 - protein, 9 aa, Mycobacterium tuberculosis
NVALRVVQV

SEQ ID NO: 131539 - protein, 9 aa, Mycobacterium tuberculosis
VALRVVQVV

SEQ ID NO: 131540 - protein, 9 aa, Mycobacterium tuberculosis
RVVQVVPPV

SEQ ID NO: 131541 - protein, 9 aa, Mycobacterium tuberculosis
QVVPPVITA

SEQ ID NO: 131542 - protein, 9 aa, Mycobacterium tuberculosis
ITAPEGWAF

SEQ ID NO: 131543 - protein, 9 aa, Mycobacterium tuberculosis
APEGWAFEY

SEQ ID NO: 131544 - protein, 9 aa, Mycobacterium tuberculosis
EGWAFEYSR

SEQ ID NO: 131545 - protein, 9 aa, Mycobacterium tuberculosis
GWAFEYSRF

SEQ ID NO: 131546 - protein, 9 aa, Mycobacterium tuberculosis
FEYSRFQEA

SEQ ID NO: 131547 - protein, 9 aa, Mycobacterium tuberculosis
YSRFQEAQK

SEQ ID NO: 131548 - protein, 9 aa, Mycobacterium tuberculosis
AQKREIVEH

SEQ ID NO: 131549 - protein, 9 aa, Mycobacterium tuberculosis
REIVEHSYL

SEQ ID NO: 131550 - protein, 9 aa, Mycobacterium tuberculosis
EIVEHSYLV

SEQ ID NO: 131551 - protein, 9 aa, Mycobacterium tuberculosis
YLVAQAHQI

SEQ ID NO: 131552 - protein, 9 aa, Mycobacterium tuberculosis
LVAQAHQIV

SEQ ID NO: 131553 - protein, 9 aa, Mycobacterium tuberculosis
QIVEQAHKV

SEQ ID NO: 131554 - protein, 9 aa, Mycobacterium tuberculosis
VEQAHKVAL

SEQ ID NO: 131555 - protein, 9 aa, Mycobacterium tuberculosis
RAAQITGEV

SEQ ID NO: 131556 - protein, 9 aa, Mycobacterium tuberculosis
AAQITGEVL

SEQ ID NO: 131557 - protein, 9 aa, Mycobacterium tuberculosis
GEVLHGQIV

SEQ ID NO: 131558 - protein, 9 aa, Mycobacterium tuberculosis
VLHGQIVPT

SEQ ID NO: 131559 - protein, 9 aa, Mycobacterium tuberculosis
LHGQIVPTL

SEQ ID NO: 131560 - protein, 9 aa, Mycobacterium tuberculosis
QIVPTLANI

SEQ ID NO: 131561 - protein, 9 aa, Mycobacterium tuberculosis
TLANISRQV

SEQ ID NO: 131562 - protein, 9 aa, Mycobacterium tuberculosis
NISRQVAMV

SEQ ID NO: 131563 - protein, 9 aa, Mycobacterium tuberculosis
SRQVAMVVL

SEQ ID NO: 131564 - protein, 9 aa, Mycobacterium tuberculosis
QVAMVVLGY

SEQ ID NO: 131565 - protein, 9 aa, Mycobacterium tuberculosis
VAMVVLGYR

SEQ ID NO: 131566 - protein, 9 aa, Mycobacterium tuberculosis
VLGYRGQGA

SEQ ID NO: 131567 - protein, 9 aa, Mycobacterium tuberculosis
GQGAVAGAL

SEQ ID NO: 131568 - protein, 9 aa, Mycobacterium tuberculosis
VAGALLGSV

SEQ ID NO: 131569 - protein, 9 aa, Mycobacterium tuberculosis
ALLGSVSSS

SEQ ID NO: 131570 - protein, 9 aa, Mycobacterium tuberculosis
LLGSVSSSL

SEQ ID NO: 131571 - protein, 9 aa, Mycobacterium tuberculosis
GSVSSSLVR

SEQ ID NO: 131572 - protein, 9 aa, Mycobacterium tuberculosis
SVSSSLVRH

SEQ ID NO: 131573 - protein, 9 aa, Mycobacterium tuberculosis
LVRHAHGPV

SEQ ID NO: 131574 - protein, 9 aa, Mycobacterium tuberculosis
HAHGPVAVI

SEQ ID NO: 131575 - protein, 9 aa, Mycobacterium tuberculosis
VAVIPEEPR

SEQ ID NO: 131576 - protein, 9 aa, Mycobacterium tuberculosis
EPRPARPPH

SEQ ID NO: 131577 - protein, 9 aa, Mycobacterium tuberculosis
RPARPPHAP

SEQ ID NO: 131578 - protein, 9 aa, Mycobacterium tuberculosis
RPPHAPVVV

SEQ ID NO: 131579 - protein, 9 aa, Mycobacterium tuberculosis
SPTSGLAAE

SEQ ID NO: 131580 - protein, 9 aa, Mycobacterium tuberculosis
AEIAFDEAS

SEQ ID NO: 131581 - protein, 9 aa, Mycobacterium tuberculosis
EIAFDEASR

SEQ ID NO: 131582 - protein, 9 aa, Mycobacterium tuberculosis
IAFDEASRR

SEQ ID NO: 131583 - protein, 9 aa, Mycobacterium tuberculosis
RRGVDLVAL

SEQ ID NO: 131584 - protein, 9 aa, Mycobacterium tuberculosis
HAWSDMGPL

SEQ ID NO: 131585 - protein, 9 aa, Mycobacterium tuberculosis
WSDMGPLDF

SEQ ID NO: 131586 - protein, 9 aa, Mycobacterium tuberculosis
DMGPLDFPR

SEQ ID NO: 131587 - protein, 9 aa, Mycobacterium tuberculosis
FPRLNWAPI

SEQ ID NO: 131588 - protein, 9 aa, Mycobacterium tuberculosis
RLNWAPIEW

SEQ ID NO: 131589 - protein, 9 aa, Mycobacterium tuberculosis
LNWAPIEWR

SEQ ID NO: 131590 - protein, 9 aa, Mycobacterium tuberculosis
NLEDEQEKM

SEQ ID NO: 131591 - protein, 9 aa, Mycobacterium tuberculosis
LEDEQEKML

SEQ ID NO: 131592 - protein, 9 aa, Mycobacterium tuberculosis
DEQEKMLAR

SEQ ID NO: 131593 - protein, 9 aa, Mycobacterium tuberculosis
MLARRLSGW

SEQ ID NO: 131594 - protein, 9 aa, Mycobacterium tuberculosis
RRLSGWQDR

SEQ ID NO: 131595 - protein, 9 aa, Mycobacterium tuberculosis
RLSGWQDRY

SEQ ID NO: 131596 - protein, 9 aa, Mycobacterium tuberculosis
WQDRYPDVV

SEQ ID NO: 131597 - protein, 9 aa, Mycobacterium tuberculosis
RYPDVVVHK

SEQ ID NO: 131598 - protein, 9 aa, Mycobacterium tuberculosis
YPDVVVHKV

SEQ ID NO: 131599 - protein, 9 aa, Mycobacterium tuberculosis
DVVVHKVVV

SEQ ID NO: 131600 - protein, 9 aa, Mycobacterium tuberculosis
VVCDRPAPR

SEQ ID NO: 131601 - protein, 9 aa, Mycobacterium tuberculosis
RPAPRLLEL

SEQ ID NO: 131602 - protein, 9 aa, Mycobacterium tuberculosis
APRLLELAQ

SEQ ID NO: 131603 - protein, 9 aa, Mycobacterium tuberculosis
RLLELAQTA

SEQ ID NO: 131604 - protein, 9 aa, Mycobacterium tuberculosis
LELAQTAQL

SEQ ID NO: 131605 - protein, 9 aa, Mycobacterium tuberculosis
ELAQTAQLV

SEQ ID NO: 131606 - protein, 9 aa, Mycobacterium tuberculosis
LAQTAQLVV

SEQ ID NO: 131607 - protein, 9 aa, Mycobacterium tuberculosis
AQTAQLVVV

SEQ ID NO: 131608 - protein, 9 aa, Mycobacterium tuberculosis
LVVVGSHGR

SEQ ID NO: 131609 - protein, 9 aa, Mycobacterium tuberculosis
FPGMHLGSV

SEQ ID NO: 131610 - protein, 9 aa, Mycobacterium tuberculosis
GMHLGSVSR

SEQ ID NO: 131611 - protein, 9 aa, Mycobacterium tuberculosis
HLGSVSRAV

SEQ ID NO: 131612 - protein, 9 aa, Mycobacterium tuberculosis
VVNSGQAPV

SEQ ID NO: 131613 - protein, 9 aa, Mycobacterium tuberculosis
GQAPVIVAR

SEQ ID NO: 131614 - protein, 9 aa, Mycobacterium tuberculosis
QAPVIVARI

SEQ ID NO: 131615 - protein, 9 aa, Mycobacterium tuberculosis
IPQDPAVPA

SEQ ID NO: 131616 - protein, 10 aa, Mycobacterium tuberculosis
MSAQQTNLGI

SEQ ID NO: 131617 - protein, 10 aa, Mycobacterium tuberculosis
AQQTNLGIVV

SEQ ID NO: 131618 - protein, 10 aa, Mycobacterium tuberculosis
QTNLGIVVGV

SEQ ID NO: 131619 - protein, 10 aa, Mycobacterium tuberculosis
DGSPCSHTAV

SEQ ID NO: 131620 - protein, 10 aa, Mycobacterium tuberculosis
SPCSHTAVEW

SEQ ID NO: 131621 - protein, 10 aa, Mycobacterium tuberculosis
EWAARDAQMR

SEQ ID NO: 131622 - protein, 10 aa, Mycobacterium tuberculosis
AARDAQMRNV

SEQ ID NO: 131623 - protein, 10 aa, Mycobacterium tuberculosis
RDAQMRNVAL

SEQ ID NO: 131624 - protein, 10 aa, Mycobacterium tuberculosis
DAQMRNVALR

SEQ ID NO: 131625 - protein, 10 aa, Mycobacterium tuberculosis
AQMRNVALRV

SEQ ID NO: 131626 - protein, 10 aa, Mycobacterium tuberculosis
QMRNVALRVV

SEQ ID NO: 131627 - protein, 10 aa, Mycobacterium tuberculosis
NVALRVVQVV

SEQ ID NO: 131628 - protein, 10 aa, Mycobacterium tuberculosis
RVVQVVPPVI

SEQ ID NO: 131629 - protein, 10 aa, Mycobacterium tuberculosis
VQVVPPVITA

SEQ ID NO: 131630 - protein, 10 aa, Mycobacterium tuberculosis
PPVITAPEGW

SEQ ID NO: 131631 - protein, 10 aa, Mycobacterium tuberculosis
TAPEGWAFEY

SEQ ID NO: 131632 - protein, 10 aa, Mycobacterium tuberculosis
EYSRFQEAQK

SEQ ID NO: 131633 - protein, 10 aa, Mycobacterium tuberculosis
YSRFQEAQKR

SEQ ID NO: 131634 - protein, 10 aa, Mycobacterium tuberculosis
RFQEAQKREI

SEQ ID NO: 131635 - protein, 10 aa, Mycobacterium tuberculosis
FQEAQKREIV

SEQ ID NO: 131636 - protein, 10 aa, Mycobacterium tuberculosis
REIVEHSYLV

SEQ ID NO: 131637 - protein, 10 aa, Mycobacterium tuberculosis
EIVEHSYLVA

SEQ ID NO: 131638 - protein, 10 aa, Mycobacterium tuberculosis
SYLVAQAHQI

SEQ ID NO: 131639 - protein, 10 aa, Mycobacterium tuberculosis
YLVAQAHQIV

SEQ ID NO: 131640 - protein, 10 aa, Mycobacterium tuberculosis
AQAHQIVEQA

SEQ ID NO: 131641 - protein, 10 aa, Mycobacterium tuberculosis
HQIVEQAHKV

SEQ ID NO: 131642 - protein, 10 aa, Mycobacterium tuberculosis
IVEQAHKVAL

SEQ ID NO: 131643 - protein, 10 aa, Mycobacterium tuberculosis
VALEASSSGR

SEQ ID NO: 131644 - protein, 10 aa, Mycobacterium tuberculosis
RAAQITGEVL

SEQ ID NO: 131645 - protein, 10 aa, Mycobacterium tuberculosis
ITGEVLHGQI

SEQ ID NO: 131646 - protein, 10 aa, Mycobacterium tuberculosis
EVLHGQIVPT

SEQ ID NO: 131647 - protein, 10 aa, Mycobacterium tuberculosis
VLHGQIVPTL

SEQ ID NO: 131648 - protein, 10 aa, Mycobacterium tuberculosis
GQIVPTLANI

SEQ ID NO: 131649 - protein, 10 aa, Mycobacterium tuberculosis
IVPTLANISR

SEQ ID NO: 131650 - protein, 10 aa, Mycobacterium tuberculosis
PTLANISRQV

SEQ ID NO: 131651 - protein, 10 aa, Mycobacterium tuberculosis
TLANISRQVA

SEQ ID NO: 131652 - protein, 10 aa, Mycobacterium tuberculosis
LANISRQVAM

SEQ ID NO: 131653 - protein, 10 aa, Mycobacterium tuberculosis
NISRQVAMVV

SEQ ID NO: 131654 - protein, 10 aa, Mycobacterium tuberculosis
RQVAMVVLGY

SEQ ID NO: 131655 - protein, 10 aa, Mycobacterium tuberculosis
QVAMVVLGYR

SEQ ID NO: 131656 - protein, 10 aa, Mycobacterium tuberculosis
VVLGYRGQGA

SEQ ID NO: 131657 - protein, 10 aa, Mycobacterium tuberculosis
VLGYRGQGAV

SEQ ID NO: 131658 - protein, 10 aa, Mycobacterium tuberculosis
GQGAVAGALL

SEQ ID NO: 131659 - protein, 10 aa, Mycobacterium tuberculosis
AVAGALLGSV

SEQ ID NO: 131660 - protein, 10 aa, Mycobacterium tuberculosis
ALLGSVSSSL

SEQ ID NO: 131661 - protein, 10 aa, Mycobacterium tuberculosis
LLGSVSSSLV

SEQ ID NO: 131662 - protein, 10 aa, Mycobacterium tuberculosis
SVSSSLVRHA

SEQ ID NO: 131663 - protein, 10 aa, Mycobacterium tuberculosis
SLVRHAHGPV

SEQ ID NO: 131664 - protein, 10 aa, Mycobacterium tuberculosis
LVRHAHGPVA

SEQ ID NO: 131665 - protein, 10 aa, Mycobacterium tuberculosis
EPRPARPPHA

SEQ ID NO: 131666 - protein, 10 aa, Mycobacterium tuberculosis
RPARPPHAPV

SEQ ID NO: 131667 - protein, 10 aa, Mycobacterium tuberculosis
PPHAPVVVGI

SEQ ID NO: 131668 - protein, 10 aa, Mycobacterium tuberculosis
GIDGSPTSGL

SEQ ID NO: 131669 - protein, 10 aa, Mycobacterium tuberculosis
SPTSGLAAEI

SEQ ID NO: 131670 - protein, 10 aa, Mycobacterium tuberculosis
TSGLAAEIAF

SEQ ID NO: 131671 - protein, 10 aa, Mycobacterium tuberculosis
LAAEIAFDEA

SEQ ID NO: 131672 - protein, 10 aa, Mycobacterium tuberculosis
AEIAFDEASR

SEQ ID NO: 131673 - protein, 10 aa, Mycobacterium tuberculosis
EIAFDEASRR

SEQ ID NO: 131674 - protein, 10 aa, Mycobacterium tuberculosis
AFDEASRRGV

SEQ ID NO: 131675 - protein, 10 aa, Mycobacterium tuberculosis
EASRRGVDLV

SEQ ID NO: 131676 - protein, 10 aa, Mycobacterium tuberculosis
LVALHAWSDM

SEQ ID NO: 131677 - protein, 10 aa, Mycobacterium tuberculosis
AWSDMGPLDF

SEQ ID NO: 131678 - protein, 10 aa, Mycobacterium tuberculosis
DMGPLDFPRL

SEQ ID NO: 131679 - protein, 10 aa, Mycobacterium tuberculosis
GPLDFPRLNW

SEQ ID NO: 131680 - protein, 10 aa, Mycobacterium tuberculosis
PLDFPRLNWA

SEQ ID NO: 131681 - protein, 10 aa, Mycobacterium tuberculosis
DFPRLNWAPI

SEQ ID NO: 131682 - protein, 10 aa, Mycobacterium tuberculosis
RLNWAPIEWR

SEQ ID NO: 131683 - protein, 10 aa, Mycobacterium tuberculosis
NLEDEQEKML

SEQ ID NO: 131684 - protein, 10 aa, Mycobacterium tuberculosis
KMLARRLSGW

SEQ ID NO: 131685 - protein, 10 aa, Mycobacterium tuberculosis
MLARRLSGWQ

SEQ ID NO: 131686 - protein, 10 aa, Mycobacterium tuberculosis
RRLSGWQDRY

SEQ ID NO: 131687 - protein, 10 aa, Mycobacterium tuberculosis
SGWQDRYPDV

SEQ ID NO: 131688 - protein, 10 aa, Mycobacterium tuberculosis
WQDRYPDVVV

SEQ ID NO: 131689 - protein, 10 aa, Mycobacterium tuberculosis
RYPDVVVHKV

SEQ ID NO: 131690 - protein, 10 aa, Mycobacterium tuberculosis
YPDVVVHKVV

SEQ ID NO: 131691 - protein, 10 aa, Mycobacterium tuberculosis
VVHKVVVCDR

SEQ ID NO: 131692 - protein, 10 aa, Mycobacterium tuberculosis
VVVCDRPAPR

SEQ ID NO: 131693 - protein, 10 aa, Mycobacterium tuberculosis
VVCDRPAPRL

SEQ ID NO: 131694 - protein, 10 aa, Mycobacterium tuberculosis
RPAPRLLELA

SEQ ID NO: 131695 - protein, 10 aa, Mycobacterium tuberculosis
APRLLELAQT

SEQ ID NO: 131696 - protein, 10 aa, Mycobacterium tuberculosis
RLLELAQTAQ

SEQ ID NO: 131697 - protein, 10 aa, Mycobacterium tuberculosis
LLELAQTAQL

SEQ ID NO: 131698 - protein, 10 aa, Mycobacterium tuberculosis
ELAQTAQLVV

SEQ ID NO: 131699 - protein, 10 aa, Mycobacterium tuberculosis
QTAQLVVVGS

SEQ ID NO: 131700 - protein, 10 aa, Mycobacterium tuberculosis
QLVVVGSHGR

SEQ ID NO: 131701 - protein, 10 aa, Mycobacterium tuberculosis
GFPGMHLGSV

SEQ ID NO: 131702 - protein, 10 aa, Mycobacterium tuberculosis
FPGMHLGSVS

SEQ ID NO: 131703 - protein, 10 aa, Mycobacterium tuberculosis
GMHLGSVSRA

SEQ ID NO: 131704 - protein, 10 aa, Mycobacterium tuberculosis
HLGSVSRAVV

SEQ ID NO: 131705 - protein, 10 aa, Mycobacterium tuberculosis
AVVNSGQAPV

SEQ ID NO: 131706 - protein, 10 aa, Mycobacterium tuberculosis
GQAPVIVARI

SEQ ID NO: 131707 - protein, 10 aa, Mycobacterium tuberculosis
APVIVARIPQ

SEQ ID NO: 131708 - protein, 10 aa, Mycobacterium tuberculosis
IVARIPQDPA

SEQ ID NO: 131709 - protein, 10 aa, Mycobacterium tuberculosis
RIPQDPAVPA

SEQ ID NO: 131710 - protein, 11 aa, Mycobacterium tuberculosis
MSAQQTNLGIV

SEQ ID NO: 131711 - protein, 11 aa, Mycobacterium tuberculosis
SAQQTNLGIVV

SEQ ID NO: 131712 - protein, 11 aa, Mycobacterium tuberculosis
QQTNLGIVVGV

SEQ ID NO: 131713 - protein, 11 aa, Mycobacterium tuberculosis
GVDGSPCSHTA

SEQ ID NO: 131714 - protein, 11 aa, Mycobacterium tuberculosis
CSHTAVEWAAR

SEQ ID NO: 131715 - protein, 11 aa, Mycobacterium tuberculosis
WAARDAQMRNV

SEQ ID NO: 131716 - protein, 11 aa, Mycobacterium tuberculosis
AARDAQMRNVA

SEQ ID NO: 131717 - protein, 11 aa, Mycobacterium tuberculosis
ARDAQMRNVAL

SEQ ID NO: 131718 - protein, 11 aa, Mycobacterium tuberculosis
AQMRNVALRVV

SEQ ID NO: 131719 - protein, 11 aa, Mycobacterium tuberculosis
ALRVVQVVPPV

SEQ ID NO: 131720 - protein, 11 aa, Mycobacterium tuberculosis
VPPVITAPEGW

SEQ ID NO: 131721 - protein, 11 aa, Mycobacterium tuberculosis
PPVITAPEGWA

SEQ ID NO: 131722 - protein, 11 aa, Mycobacterium tuberculosis
PVITAPEGWAF

SEQ ID NO: 131723 - protein, 11 aa, Mycobacterium tuberculosis
ITAPEGWAFEY

SEQ ID NO: 131724 - protein, 11 aa, Mycobacterium tuberculosis
WAFEYSRFQEA

SEQ ID NO: 131725 - protein, 11 aa, Mycobacterium tuberculosis
EYSRFQEAQKR

SEQ ID NO: 131726 - protein, 11 aa, Mycobacterium tuberculosis
AQKREIVEHSY

SEQ ID NO: 131727 - protein, 11 aa, Mycobacterium tuberculosis
REIVEHSYLVA

SEQ ID NO: 131728 - protein, 11 aa, Mycobacterium tuberculosis
EIVEHSYLVAQ

SEQ ID NO: 131729 - protein, 11 aa, Mycobacterium tuberculosis
HSYLVAQAHQI

SEQ ID NO: 131730 - protein, 11 aa, Mycobacterium tuberculosis
SYLVAQAHQIV

SEQ ID NO: 131731 - protein, 11 aa, Mycobacterium tuberculosis
YLVAQAHQIVE

SEQ ID NO: 131732 - protein, 11 aa, Mycobacterium tuberculosis
AQAHQIVEQAH

SEQ ID NO: 131733 - protein, 11 aa, Mycobacterium tuberculosis
QAHQIVEQAHK

SEQ ID NO: 131734 - protein, 11 aa, Mycobacterium tuberculosis
QIVEQAHKVAL

SEQ ID NO: 131735 - protein, 11 aa, Mycobacterium tuberculosis
KVALEASSSGR

SEQ ID NO: 131736 - protein, 11 aa, Mycobacterium tuberculosis
AQITGEVLHGQ

SEQ ID NO: 131737 - protein, 11 aa, Mycobacterium tuberculosis
ITGEVLHGQIV

SEQ ID NO: 131738 - protein, 11 aa, Mycobacterium tuberculosis
EVLHGQIVPTL

SEQ ID NO: 131739 - protein, 11 aa, Mycobacterium tuberculosis
VLHGQIVPTLA

SEQ ID NO: 131740 - protein, 11 aa, Mycobacterium tuberculosis
QIVPTLANISR

SEQ ID NO: 131741 - protein, 11 aa, Mycobacterium tuberculosis
VPTLANISRQV

SEQ ID NO: 131742 - protein, 11 aa, Mycobacterium tuberculosis
TLANISRQVAM

SEQ ID NO: 131743 - protein, 11 aa, Mycobacterium tuberculosis
LANISRQVAMV

SEQ ID NO: 131744 - protein, 11 aa, Mycobacterium tuberculosis
NISRQVAMVVL

SEQ ID NO: 131745 - protein, 11 aa, Mycobacterium tuberculosis
SRQVAMVVLGY

SEQ ID NO: 131746 - protein, 11 aa, Mycobacterium tuberculosis
RQVAMVVLGYR

SEQ ID NO: 131747 - protein, 11 aa, Mycobacterium tuberculosis
MVVLGYRGQGA

SEQ ID NO: 131748 - protein, 11 aa, Mycobacterium tuberculosis
VVLGYRGQGAV

SEQ ID NO: 131749 - protein, 11 aa, Mycobacterium tuberculosis
VLGYRGQGAVA

SEQ ID NO: 131750 - protein, 11 aa, Mycobacterium tuberculosis
YRGQGAVAGAL

SEQ ID NO: 131751 - protein, 11 aa, Mycobacterium tuberculosis
GAVAGALLGSV

SEQ ID NO: 131752 - protein, 11 aa, Mycobacterium tuberculosis
GALLGSVSSSL

SEQ ID NO: 131753 - protein, 11 aa, Mycobacterium tuberculosis
ALLGSVSSSLV

SEQ ID NO: 131754 - protein, 11 aa, Mycobacterium tuberculosis
LLGSVSSSLVR

SEQ ID NO: 131755 - protein, 11 aa, Mycobacterium tuberculosis
SVSSSLVRHAH

SEQ ID NO: 131756 - protein, 11 aa, Mycobacterium tuberculosis
SLVRHAHGPVA

SEQ ID NO: 131757 - protein, 11 aa, Mycobacterium tuberculosis
LVRHAHGPVAV

SEQ ID NO: 131758 - protein, 11 aa, Mycobacterium tuberculosis
AVIPEEPRPAR

SEQ ID NO: 131759 - protein, 11 aa, Mycobacterium tuberculosis
RPARPPHAPVV

SEQ ID NO: 131760 - protein, 11 aa, Mycobacterium tuberculosis
RPPHAPVVVGI

SEQ ID NO: 131761 - protein, 11 aa, Mycobacterium tuberculosis
GIDGSPTSGLA

SEQ ID NO: 131762 - protein, 11 aa, Mycobacterium tuberculosis
SPTSGLAAEIA

SEQ ID NO: 131763 - protein, 11 aa, Mycobacterium tuberculosis
GLAAEIAFDEA

SEQ ID NO: 131764 - protein, 11 aa, Mycobacterium tuberculosis
AEIAFDEASRR

SEQ ID NO: 131765 - protein, 11 aa, Mycobacterium tuberculosis
IAFDEASRRGV

SEQ ID NO: 131766 - protein, 11 aa, Mycobacterium tuberculosis
RGVDLVALHAW

SEQ ID NO: 131767 - protein, 11 aa, Mycobacterium tuberculosis
DLVALHAWSDM

SEQ ID NO: 131768 - protein, 11 aa, Mycobacterium tuberculosis
ALHAWSDMGPL

SEQ ID NO: 131769 - protein, 11 aa, Mycobacterium tuberculosis
HAWSDMGPLDF

SEQ ID NO: 131770 - protein, 11 aa, Mycobacterium tuberculosis
GPLDFPRLNWA

SEQ ID NO: 131771 - protein, 11 aa, Mycobacterium tuberculosis
FPRLNWAPIEW

SEQ ID NO: 131772 - protein, 11 aa, Mycobacterium tuberculosis
NLEDEQEKMLA

SEQ ID NO: 131773 - protein, 11 aa, Mycobacterium tuberculosis
DEQEKMLARRL

SEQ ID NO: 131774 - protein, 11 aa, Mycobacterium tuberculosis
KMLARRLSGWQ

SEQ ID NO: 131775 - protein, 11 aa, Mycobacterium tuberculosis
LARRLSGWQDR

SEQ ID NO: 131776 - protein, 11 aa, Mycobacterium tuberculosis
SGWQDRYPDVV

SEQ ID NO: 131777 - protein, 11 aa, Mycobacterium tuberculosis
RYPDVVVHKVV

SEQ ID NO: 131778 - protein, 11 aa, Mycobacterium tuberculosis
YPDVVVHKVVV

SEQ ID NO: 131779 - protein, 11 aa, Mycobacterium tuberculosis
VVVHKVVVCDR

SEQ ID NO: 131780 - protein, 11 aa, Mycobacterium tuberculosis
KVVVCDRPAPR

SEQ ID NO: 131781 - protein, 11 aa, Mycobacterium tuberculosis
VVVCDRPAPRL

SEQ ID NO: 131782 - protein, 11 aa, Mycobacterium tuberculosis
VVCDRPAPRLL

SEQ ID NO: 131783 - protein, 11 aa, Mycobacterium tuberculosis
RPAPRLLELAQ

SEQ ID NO: 131784 - protein, 11 aa, Mycobacterium tuberculosis
APRLLELAQTA

SEQ ID NO: 131785 - protein, 11 aa, Mycobacterium tuberculosis
RLLELAQTAQL

SEQ ID NO: 131786 - protein, 11 aa, Mycobacterium tuberculosis
LLELAQTAQLV

SEQ ID NO: 131787 - protein, 11 aa, Mycobacterium tuberculosis
LELAQTAQLVV

SEQ ID NO: 131788 - protein, 11 aa, Mycobacterium tuberculosis
ELAQTAQLVVV

SEQ ID NO: 131789 - protein, 11 aa, Mycobacterium tuberculosis
AQLVVVGSHGR

SEQ ID NO: 131790 - protein, 11 aa, Mycobacterium tuberculosis
VVVGSHGRGGF

SEQ ID NO: 131791 - protein, 11 aa, Mycobacterium tuberculosis
GGFPGMHLGSV

SEQ ID NO: 131792 - protein, 11 aa, Mycobacterium tuberculosis
FPGMHLGSVSR

SEQ ID NO: 131793 - protein, 11 aa, Mycobacterium tuberculosis
GMHLGSVSRAV

SEQ ID NO: 131794 - protein, 11 aa, Mycobacterium tuberculosis
RAVVNSGQAPV

SEQ ID NO: 131795 - protein, 11 aa, Mycobacterium tuberculosis
AVVNSGQAPVI

SEQ ID NO: 131796 - protein, 11 aa, Mycobacterium tuberculosis
VVNSGQAPVIV

SEQ ID NO: 131797 - protein, 11 aa, Mycobacterium tuberculosis
NSGQAPVIVAR

SEQ ID NO: 131798 - protein, 11 aa, Mycobacterium tuberculosis
VIVARIPQDPA

SEQ ID NO: 131799 - protein, 11 aa, Mycobacterium tuberculosis
IVARIPQDPAV

SEQ ID NO: 131800 - protein, 13 aa, Mycobacterium tuberculosis
MSAQQTNLGIVVG

SEQ ID NO: 131801 - protein, 13 aa, Mycobacterium tuberculosis
SAQQTNLGIVVGV

SEQ ID NO: 131802 - protein, 13 aa, Mycobacterium tuberculosis
AQQTNLGIVVGVD

SEQ ID NO: 131803 - protein, 13 aa, Mycobacterium tuberculosis
QQTNLGIVVGVDG

SEQ ID NO: 131804 - protein, 13 aa, Mycobacterium tuberculosis
QTNLGIVVGVDGS

SEQ ID NO: 131805 - protein, 13 aa, Mycobacterium tuberculosis
TNLGIVVGVDGSP

SEQ ID NO: 131806 - protein, 13 aa, Mycobacterium tuberculosis
NLGIVVGVDGSPC

SEQ ID NO: 131807 - protein, 13 aa, Mycobacterium tuberculosis
LGIVVGVDGSPCS

SEQ ID NO: 131808 - protein, 13 aa, Mycobacterium tuberculosis
GIVVGVDGSPCSH

SEQ ID NO: 131809 - protein, 13 aa, Mycobacterium tuberculosis
IVVGVDGSPCSHT

SEQ ID NO: 131810 - protein, 13 aa, Mycobacterium tuberculosis
VVGVDGSPCSHTA

SEQ ID NO: 131811 - protein, 13 aa, Mycobacterium tuberculosis
VGVDGSPCSHTAV

SEQ ID NO: 131812 - protein, 13 aa, Mycobacterium tuberculosis
GVDGSPCSHTAVE

SEQ ID NO: 131813 - protein, 13 aa, Mycobacterium tuberculosis
VDGSPCSHTAVEW

SEQ ID NO: 131814 - protein, 13 aa, Mycobacterium tuberculosis
DGSPCSHTAVEWA

SEQ ID NO: 131815 - protein, 13 aa, Mycobacterium tuberculosis
GSPCSHTAVEWAA

SEQ ID NO: 131816 - protein, 13 aa, Mycobacterium tuberculosis
SPCSHTAVEWAAR

SEQ ID NO: 131817 - protein, 13 aa, Mycobacterium tuberculosis
PCSHTAVEWAARD

SEQ ID NO: 131818 - protein, 13 aa, Mycobacterium tuberculosis
CSHTAVEWAARDA

SEQ ID NO: 131819 - protein, 13 aa, Mycobacterium tuberculosis
SHTAVEWAARDAQ

SEQ ID NO: 131820 - protein, 13 aa, Mycobacterium tuberculosis
HTAVEWAARDAQM

SEQ ID NO: 131821 - protein, 13 aa, Mycobacterium tuberculosis
TAVEWAARDAQMR

SEQ ID NO: 131822 - protein, 13 aa, Mycobacterium tuberculosis
AVEWAARDAQMRN

SEQ ID NO: 131823 - protein, 13 aa, Mycobacterium tuberculosis
VEWAARDAQMRNV

SEQ ID NO: 131824 - protein, 13 aa, Mycobacterium tuberculosis
EWAARDAQMRNVA

SEQ ID NO: 131825 - protein, 13 aa, Mycobacterium tuberculosis
WAARDAQMRNVAL

SEQ ID NO: 131826 - protein, 13 aa, Mycobacterium tuberculosis
AARDAQMRNVALR

SEQ ID NO: 131827 - protein, 13 aa, Mycobacterium tuberculosis
ARDAQMRNVALRV

SEQ ID NO: 131828 - protein, 13 aa, Mycobacterium tuberculosis
RDAQMRNVALRVV

SEQ ID NO: 131829 - protein, 13 aa, Mycobacterium tuberculosis
DAQMRNVALRVVQ

SEQ ID NO: 131830 - protein, 13 aa, Mycobacterium tuberculosis
AQMRNVALRVVQV

SEQ ID NO: 131831 - protein, 13 aa, Mycobacterium tuberculosis
QMRNVALRVVQVV

SEQ ID NO: 131832 - protein, 13 aa, Mycobacterium tuberculosis
MRNVALRVVQVVP

SEQ ID NO: 131833 - protein, 13 aa, Mycobacterium tuberculosis
RNVALRVVQVVPP

SEQ ID NO: 131834 - protein, 13 aa, Mycobacterium tuberculosis
NVALRVVQVVPPV

SEQ ID NO: 131835 - protein, 13 aa, Mycobacterium tuberculosis
VALRVVQVVPPVI

SEQ ID NO: 131836 - protein, 13 aa, Mycobacterium tuberculosis
ALRVVQVVPPVIT

SEQ ID NO: 131837 - protein, 13 aa, Mycobacterium tuberculosis
LRVVQVVPPVITA

SEQ ID NO: 131838 - protein, 13 aa, Mycobacterium tuberculosis
RVVQVVPPVITAP

SEQ ID NO: 131839 - protein, 13 aa, Mycobacterium tuberculosis
VVQVVPPVITAPE

SEQ ID NO: 131840 - protein, 13 aa, Mycobacterium tuberculosis
VQVVPPVITAPEG

SEQ ID NO: 131841 - protein, 13 aa, Mycobacterium tuberculosis
QVVPPVITAPEGW

SEQ ID NO: 131842 - protein, 13 aa, Mycobacterium tuberculosis
VVPPVITAPEGWA

SEQ ID NO: 131843 - protein, 13 aa, Mycobacterium tuberculosis
VPPVITAPEGWAF

SEQ ID NO: 131844 - protein, 13 aa, Mycobacterium tuberculosis
PPVITAPEGWAFE

SEQ ID NO: 131845 - protein, 13 aa, Mycobacterium tuberculosis
PVITAPEGWAFEY

SEQ ID NO: 131846 - protein, 13 aa, Mycobacterium tuberculosis
VITAPEGWAFEYS

SEQ ID NO: 131847 - protein, 13 aa, Mycobacterium tuberculosis
ITAPEGWAFEYSR

SEQ ID NO: 131848 - protein, 13 aa, Mycobacterium tuberculosis
TAPEGWAFEYSRF

SEQ ID NO: 131849 - protein, 13 aa, Mycobacterium tuberculosis
APEGWAFEYSRFQ

SEQ ID NO: 131850 - protein, 13 aa, Mycobacterium tuberculosis
PEGWAFEYSRFQE

SEQ ID NO: 131851 - protein, 13 aa, Mycobacterium tuberculosis
EGWAFEYSRFQEA

SEQ ID NO: 131852 - protein, 13 aa, Mycobacterium tuberculosis
GWAFEYSRFQEAQ

SEQ ID NO: 131853 - protein, 13 aa, Mycobacterium tuberculosis
WAFEYSRFQEAQK

SEQ ID NO: 131854 - protein, 13 aa, Mycobacterium tuberculosis
AFEYSRFQEAQKR

SEQ ID NO: 131855 - protein, 13 aa, Mycobacterium tuberculosis
FEYSRFQEAQKRE

SEQ ID NO: 131856 - protein, 13 aa, Mycobacterium tuberculosis
EYSRFQEAQKREI

SEQ ID NO: 131857 - protein, 13 aa, Mycobacterium tuberculosis
YSRFQEAQKREIV

SEQ ID NO: 131858 - protein, 13 aa, Mycobacterium tuberculosis
SRFQEAQKREIVE

SEQ ID NO: 131859 - protein, 13 aa, Mycobacterium tuberculosis
RFQEAQKREIVEH

SEQ ID NO: 131860 - protein, 13 aa, Mycobacterium tuberculosis
FQEAQKREIVEHS

SEQ ID NO: 131861 - protein, 13 aa, Mycobacterium tuberculosis
QEAQKREIVEHSY

SEQ ID NO: 131862 - protein, 13 aa, Mycobacterium tuberculosis
EAQKREIVEHSYL

SEQ ID NO: 131863 - protein, 13 aa, Mycobacterium tuberculosis
AQKREIVEHSYLV

SEQ ID NO: 131864 - protein, 13 aa, Mycobacterium tuberculosis
QKREIVEHSYLVA

SEQ ID NO: 131865 - protein, 13 aa, Mycobacterium tuberculosis
KREIVEHSYLVAQ

SEQ ID NO: 131866 - protein, 13 aa, Mycobacterium tuberculosis
REIVEHSYLVAQA

SEQ ID NO: 131867 - protein, 13 aa, Mycobacterium tuberculosis
EIVEHSYLVAQAH

SEQ ID NO: 131868 - protein, 13 aa, Mycobacterium tuberculosis
IVEHSYLVAQAHQ

SEQ ID NO: 131869 - protein, 13 aa, Mycobacterium tuberculosis
VEHSYLVAQAHQI

SEQ ID NO: 131870 - protein, 13 aa, Mycobacterium tuberculosis
EHSYLVAQAHQIV

SEQ ID NO: 131871 - protein, 13 aa, Mycobacterium tuberculosis
HSYLVAQAHQIVE

SEQ ID NO: 131872 - protein, 13 aa, Mycobacterium tuberculosis
SYLVAQAHQIVEQ

SEQ ID NO: 131873 - protein, 13 aa, Mycobacterium tuberculosis
YLVAQAHQIVEQA

SEQ ID NO: 131874 - protein, 13 aa, Mycobacterium tuberculosis
LVAQAHQIVEQAH

SEQ ID NO: 131875 - protein, 13 aa, Mycobacterium tuberculosis
VAQAHQIVEQAHK

SEQ ID NO: 131876 - protein, 13 aa, Mycobacterium tuberculosis
AQAHQIVEQAHKV

SEQ ID NO: 131877 - protein, 13 aa, Mycobacterium tuberculosis
QAHQIVEQAHKVA

SEQ ID NO: 131878 - protein, 13 aa, Mycobacterium tuberculosis
AHQIVEQAHKVAL

SEQ ID NO: 131879 - protein, 13 aa, Mycobacterium tuberculosis
HQIVEQAHKVALE

SEQ ID NO: 131880 - protein, 13 aa, Mycobacterium tuberculosis
QIVEQAHKVALEA

SEQ ID NO: 131881 - protein, 13 aa, Mycobacterium tuberculosis
IVEQAHKVALEAS

SEQ ID NO: 131882 - protein, 13 aa, Mycobacterium tuberculosis
VEQAHKVALEASS

SEQ ID NO: 131883 - protein, 13 aa, Mycobacterium tuberculosis
EQAHKVALEASSS

SEQ ID NO: 131884 - protein, 13 aa, Mycobacterium tuberculosis
QAHKVALEASSSG

SEQ ID NO: 131885 - protein, 13 aa, Mycobacterium tuberculosis
AHKVALEASSSGR

SEQ ID NO: 131886 - protein, 13 aa, Mycobacterium tuberculosis
HKVALEASSSGRA

SEQ ID NO: 131887 - protein, 13 aa, Mycobacterium tuberculosis
KVALEASSSGRAA

SEQ ID NO: 131888 - protein, 13 aa, Mycobacterium tuberculosis
VALEASSSGRAAQ

SEQ ID NO: 131889 - protein, 13 aa, Mycobacterium tuberculosis
ALEASSSGRAAQI

SEQ ID NO: 131890 - protein, 13 aa, Mycobacterium tuberculosis
LEASSSGRAAQIT

SEQ ID NO: 131891 - protein, 13 aa, Mycobacterium tuberculosis
EASSSGRAAQITG

SEQ ID NO: 131892 - protein, 13 aa, Mycobacterium tuberculosis
ASSSGRAAQITGE

SEQ ID NO: 131893 - protein, 13 aa, Mycobacterium tuberculosis
SSSGRAAQITGEV

SEQ ID NO: 131894 - protein, 13 aa, Mycobacterium tuberculosis
SSGRAAQITGEVL

SEQ ID NO: 131895 - protein, 13 aa, Mycobacterium tuberculosis
SGRAAQITGEVLH

SEQ ID NO: 131896 - protein, 13 aa, Mycobacterium tuberculosis
GRAAQITGEVLHG

SEQ ID NO: 131897 - protein, 13 aa, Mycobacterium tuberculosis
RAAQITGEVLHGQ

SEQ ID NO: 131898 - protein, 13 aa, Mycobacterium tuberculosis
AAQITGEVLHGQI

SEQ ID NO: 131899 - protein, 13 aa, Mycobacterium tuberculosis
AQITGEVLHGQIV

SEQ ID NO: 131900 - protein, 13 aa, Mycobacterium tuberculosis
QITGEVLHGQIVP

SEQ ID NO: 131901 - protein, 13 aa, Mycobacterium tuberculosis
ITGEVLHGQIVPT

SEQ ID NO: 131902 - protein, 13 aa, Mycobacterium tuberculosis
TGEVLHGQIVPTL

SEQ ID NO: 131903 - protein, 13 aa, Mycobacterium tuberculosis
GEVLHGQIVPTLA

SEQ ID NO: 131904 - protein, 13 aa, Mycobacterium tuberculosis
EVLHGQIVPTLAN

SEQ ID NO: 131905 - protein, 13 aa, Mycobacterium tuberculosis
VLHGQIVPTLANI

SEQ ID NO: 131906 - protein, 13 aa, Mycobacterium tuberculosis
LHGQIVPTLANIS

SEQ ID NO: 131907 - protein, 13 aa, Mycobacterium tuberculosis
HGQIVPTLANISR

SEQ ID NO: 131908 - protein, 13 aa, Mycobacterium tuberculosis
GQIVPTLANISRQ

SEQ ID NO: 131909 - protein, 13 aa, Mycobacterium tuberculosis
QIVPTLANISRQV

SEQ ID NO: 131910 - protein, 13 aa, Mycobacterium tuberculosis
IVPTLANISRQVA

SEQ ID NO: 131911 - protein, 13 aa, Mycobacterium tuberculosis
VPTLANISRQVAM

SEQ ID NO: 131912 - protein, 13 aa, Mycobacterium tuberculosis
PTLANISRQVAMV

SEQ ID NO: 131913 - protein, 13 aa, Mycobacterium tuberculosis
TLANISRQVAMVV

SEQ ID NO: 131914 - protein, 13 aa, Mycobacterium tuberculosis
LANISRQVAMVVL

SEQ ID NO: 131915 - protein, 13 aa, Mycobacterium tuberculosis
ANISRQVAMVVLG

SEQ ID NO: 131916 - protein, 13 aa, Mycobacterium tuberculosis
NISRQVAMVVLGY

SEQ ID NO: 131917 - protein, 13 aa, Mycobacterium tuberculosis
ISRQVAMVVLGYR

SEQ ID NO: 131918 - protein, 13 aa, Mycobacterium tuberculosis
SRQVAMVVLGYRG

SEQ ID NO: 131919 - protein, 13 aa, Mycobacterium tuberculosis
RQVAMVVLGYRGQ

SEQ ID NO: 131920 - protein, 13 aa, Mycobacterium tuberculosis
QVAMVVLGYRGQG

SEQ ID NO: 131921 - protein, 13 aa, Mycobacterium tuberculosis
VAMVVLGYRGQGA

SEQ ID NO: 131922 - protein, 13 aa, Mycobacterium tuberculosis
AMVVLGYRGQGAV

SEQ ID NO: 131923 - protein, 13 aa, Mycobacterium tuberculosis
MVVLGYRGQGAVA

SEQ ID NO: 131924 - protein, 13 aa, Mycobacterium tuberculosis
VVLGYRGQGAVAG

SEQ ID NO: 131925 - protein, 13 aa, Mycobacterium tuberculosis
VLGYRGQGAVAGA

SEQ ID NO: 131926 - protein, 13 aa, Mycobacterium tuberculosis
LGYRGQGAVAGAL

SEQ ID NO: 131927 - protein, 13 aa, Mycobacterium tuberculosis
GYRGQGAVAGALL

SEQ ID NO: 131928 - protein, 13 aa, Mycobacterium tuberculosis
YRGQGAVAGALLG

SEQ ID NO: 131929 - protein, 13 aa, Mycobacterium tuberculosis
RGQGAVAGALLGS

SEQ ID NO: 131930 - protein, 13 aa, Mycobacterium tuberculosis
GQGAVAGALLGSV

SEQ ID NO: 131931 - protein, 13 aa, Mycobacterium tuberculosis
QGAVAGALLGSVS

SEQ ID NO: 131932 - protein, 13 aa, Mycobacterium tuberculosis
GAVAGALLGSVSS

SEQ ID NO: 131933 - protein, 13 aa, Mycobacterium tuberculosis
AVAGALLGSVSSS

SEQ ID NO: 131934 - protein, 13 aa, Mycobacterium tuberculosis
VAGALLGSVSSSL

SEQ ID NO: 131935 - protein, 13 aa, Mycobacterium tuberculosis
AGALLGSVSSSLV

SEQ ID NO: 131936 - protein, 13 aa, Mycobacterium tuberculosis
GALLGSVSSSLVR

SEQ ID NO: 131937 - protein, 13 aa, Mycobacterium tuberculosis
ALLGSVSSSLVRH

SEQ ID NO: 131938 - protein, 13 aa, Mycobacterium tuberculosis
LLGSVSSSLVRHA

SEQ ID NO: 131939 - protein, 13 aa, Mycobacterium tuberculosis
LGSVSSSLVRHAH

SEQ ID NO: 131940 - protein, 13 aa, Mycobacterium tuberculosis
GSVSSSLVRHAHG

SEQ ID NO: 131941 - protein, 13 aa, Mycobacterium tuberculosis
SVSSSLVRHAHGP

SEQ ID NO: 131942 - protein, 13 aa, Mycobacterium tuberculosis
VSSSLVRHAHGPV

SEQ ID NO: 131943 - protein, 13 aa, Mycobacterium tuberculosis
SSSLVRHAHGPVA

SEQ ID NO: 131944 - protein, 13 aa, Mycobacterium tuberculosis
SSLVRHAHGPVAV

SEQ ID NO: 131945 - protein, 13 aa, Mycobacterium tuberculosis
SLVRHAHGPVAVI

SEQ ID NO: 131946 - protein, 13 aa, Mycobacterium tuberculosis
LVRHAHGPVAVIP

SEQ ID NO: 131947 - protein, 13 aa, Mycobacterium tuberculosis
VRHAHGPVAVIPE

SEQ ID NO: 131948 - protein, 13 aa, Mycobacterium tuberculosis
RHAHGPVAVIPEE

SEQ ID NO: 131949 - protein, 13 aa, Mycobacterium tuberculosis
HAHGPVAVIPEEP

SEQ ID NO: 131950 - protein, 13 aa, Mycobacterium tuberculosis
AHGPVAVIPEEPR

SEQ ID NO: 131951 - protein, 13 aa, Mycobacterium tuberculosis
HGPVAVIPEEPRP

SEQ ID NO: 131952 - protein, 13 aa, Mycobacterium tuberculosis
GPVAVIPEEPRPA

SEQ ID NO: 131953 - protein, 13 aa, Mycobacterium tuberculosis
PVAVIPEEPRPAR

SEQ ID NO: 131954 - protein, 13 aa, Mycobacterium tuberculosis
VAVIPEEPRPARP

SEQ ID NO: 131955 - protein, 13 aa, Mycobacterium tuberculosis
AVIPEEPRPARPP

SEQ ID NO: 131956 - protein, 13 aa, Mycobacterium tuberculosis
VIPEEPRPARPPH

SEQ ID NO: 131957 - protein, 13 aa, Mycobacterium tuberculosis
IPEEPRPARPPHA

SEQ ID NO: 131958 - protein, 13 aa, Mycobacterium tuberculosis
PEEPRPARPPHAP

SEQ ID NO: 131959 - protein, 13 aa, Mycobacterium tuberculosis
EEPRPARPPHAPV

SEQ ID NO: 131960 - protein, 13 aa, Mycobacterium tuberculosis
EPRPARPPHAPVV

SEQ ID NO: 131961 - protein, 13 aa, Mycobacterium tuberculosis
PRPARPPHAPVVV

SEQ ID NO: 131962 - protein, 13 aa, Mycobacterium tuberculosis
RPARPPHAPVVVG

SEQ ID NO: 131963 - protein, 13 aa, Mycobacterium tuberculosis
PARPPHAPVVVGI

SEQ ID NO: 131964 - protein, 13 aa, Mycobacterium tuberculosis
ARPPHAPVVVGID

SEQ ID NO: 131965 - protein, 13 aa, Mycobacterium tuberculosis
RPPHAPVVVGIDG

SEQ ID NO: 131966 - protein, 13 aa, Mycobacterium tuberculosis
PPHAPVVVGIDGS

SEQ ID NO: 131967 - protein, 13 aa, Mycobacterium tuberculosis
PHAPVVVGIDGSP

SEQ ID NO: 131968 - protein, 13 aa, Mycobacterium tuberculosis
HAPVVVGIDGSPT

SEQ ID NO: 131969 - protein, 13 aa, Mycobacterium tuberculosis
APVVVGIDGSPTS

SEQ ID NO: 131970 - protein, 13 aa, Mycobacterium tuberculosis
PVVVGIDGSPTSG

SEQ ID NO: 131971 - protein, 13 aa, Mycobacterium tuberculosis
VVVGIDGSPTSGL

SEQ ID NO: 131972 - protein, 13 aa, Mycobacterium tuberculosis
VVGIDGSPTSGLA

SEQ ID NO: 131973 - protein, 13 aa, Mycobacterium tuberculosis
VGIDGSPTSGLAA

SEQ ID NO: 131974 - protein, 13 aa, Mycobacterium tuberculosis
GIDGSPTSGLAAE

SEQ ID NO: 131975 - protein, 13 aa, Mycobacterium tuberculosis
IDGSPTSGLAAEI

SEQ ID NO: 131976 - protein, 13 aa, Mycobacterium tuberculosis
DGSPTSGLAAEIA

SEQ ID NO: 131977 - protein, 13 aa, Mycobacterium tuberculosis
GSPTSGLAAEIAF

SEQ ID NO: 131978 - protein, 13 aa, Mycobacterium tuberculosis
SPTSGLAAEIAFD

SEQ ID NO: 131979 - protein, 13 aa, Mycobacterium tuberculosis
PTSGLAAEIAFDE

SEQ ID NO: 131980 - protein, 13 aa, Mycobacterium tuberculosis
TSGLAAEIAFDEA

SEQ ID NO: 131981 - protein, 13 aa, Mycobacterium tuberculosis
SGLAAEIAFDEAS

SEQ ID NO: 131982 - protein, 13 aa, Mycobacterium tuberculosis
GLAAEIAFDEASR

SEQ ID NO: 131983 - protein, 13 aa, Mycobacterium tuberculosis
LAAEIAFDEASRR

SEQ ID NO: 131984 - protein, 13 aa, Mycobacterium tuberculosis
AAEIAFDEASRRG

SEQ ID NO: 131985 - protein, 13 aa, Mycobacterium tuberculosis
AEIAFDEASRRGV

SEQ ID NO: 131986 - protein, 13 aa, Mycobacterium tuberculosis
EIAFDEASRRGVD

SEQ ID NO: 131987 - protein, 13 aa, Mycobacterium tuberculosis
IAFDEASRRGVDL

SEQ ID NO: 131988 - protein, 13 aa, Mycobacterium tuberculosis
AFDEASRRGVDLV

SEQ ID NO: 131989 - protein, 13 aa, Mycobacterium tuberculosis
FDEASRRGVDLVA

SEQ ID NO: 131990 - protein, 13 aa, Mycobacterium tuberculosis
DEASRRGVDLVAL

SEQ ID NO: 131991 - protein, 13 aa, Mycobacterium tuberculosis
EASRRGVDLVALH

SEQ ID NO: 131992 - protein, 13 aa, Mycobacterium tuberculosis
ASRRGVDLVALHA

SEQ ID NO: 131993 - protein, 13 aa, Mycobacterium tuberculosis
SRRGVDLVALHAW

SEQ ID NO: 131994 - protein, 13 aa, Mycobacterium tuberculosis
RRGVDLVALHAWS

SEQ ID NO: 131995 - protein, 13 aa, Mycobacterium tuberculosis
RGVDLVALHAWSD

SEQ ID NO: 131996 - protein, 13 aa, Mycobacterium tuberculosis
GVDLVALHAWSDM

SEQ ID NO: 131997 - protein, 13 aa, Mycobacterium tuberculosis
VDLVALHAWSDMG

SEQ ID NO: 131998 - protein, 13 aa, Mycobacterium tuberculosis
DLVALHAWSDMGP

SEQ ID NO: 131999 - protein, 13 aa, Mycobacterium tuberculosis
LVALHAWSDMGPL

SEQ ID NO: 132000 - protein, 13 aa, Mycobacterium tuberculosis
VALHAWSDMGPLD

SEQ ID NO: 132001 - protein, 13 aa, Mycobacterium tuberculosis
ALHAWSDMGPLDF

SEQ ID NO: 132002 - protein, 13 aa, Mycobacterium tuberculosis
LHAWSDMGPLDFP

SEQ ID NO: 132003 - protein, 13 aa, Mycobacterium tuberculosis
HAWSDMGPLDFPR

SEQ ID NO: 132004 - protein, 13 aa, Mycobacterium tuberculosis
AWSDMGPLDFPRL

SEQ ID NO: 132005 - protein, 13 aa, Mycobacterium tuberculosis
WSDMGPLDFPRLN

SEQ ID NO: 132006 - protein, 13 aa, Mycobacterium tuberculosis
SDMGPLDFPRLNW

SEQ ID NO: 132007 - protein, 13 aa, Mycobacterium tuberculosis
DMGPLDFPRLNWA

SEQ ID NO: 132008 - protein, 13 aa, Mycobacterium tuberculosis
MGPLDFPRLNWAP

SEQ ID NO: 132009 - protein, 13 aa, Mycobacterium tuberculosis
GPLDFPRLNWAPI

SEQ ID NO: 132010 - protein, 13 aa, Mycobacterium tuberculosis
PLDFPRLNWAPIE

SEQ ID NO: 132011 - protein, 13 aa, Mycobacterium tuberculosis
LDFPRLNWAPIEW

SEQ ID NO: 132012 - protein, 13 aa, Mycobacterium tuberculosis
DFPRLNWAPIEWR

SEQ ID NO: 132013 - protein, 13 aa, Mycobacterium tuberculosis
FPRLNWAPIEWRN

SEQ ID NO: 132014 - protein, 13 aa, Mycobacterium tuberculosis
PRLNWAPIEWRNL

SEQ ID NO: 132015 - protein, 13 aa, Mycobacterium tuberculosis
RLNWAPIEWRNLE

SEQ ID NO: 132016 - protein, 13 aa, Mycobacterium tuberculosis
LNWAPIEWRNLED

SEQ ID NO: 132017 - protein, 13 aa, Mycobacterium tuberculosis
NWAPIEWRNLEDE

SEQ ID NO: 132018 - protein, 13 aa, Mycobacterium tuberculosis
WAPIEWRNLEDEQ

SEQ ID NO: 132019 - protein, 13 aa, Mycobacterium tuberculosis
APIEWRNLEDEQE

SEQ ID NO: 132020 - protein, 13 aa, Mycobacterium tuberculosis
PIEWRNLEDEQEK

SEQ ID NO: 132021 - protein, 13 aa, Mycobacterium tuberculosis
IEWRNLEDEQEKM

SEQ ID NO: 132022 - protein, 13 aa, Mycobacterium tuberculosis
EWRNLEDEQEKML

SEQ ID NO: 132023 - protein, 13 aa, Mycobacterium tuberculosis
WRNLEDEQEKMLA

SEQ ID NO: 132024 - protein, 13 aa, Mycobacterium tuberculosis
RNLEDEQEKMLAR

SEQ ID NO: 132025 - protein, 13 aa, Mycobacterium tuberculosis
NLEDEQEKMLARR

SEQ ID NO: 132026 - protein, 13 aa, Mycobacterium tuberculosis
LEDEQEKMLARRL

SEQ ID NO: 132027 - protein, 13 aa, Mycobacterium tuberculosis
EDEQEKMLARRLS

SEQ ID NO: 132028 - protein, 13 aa, Mycobacterium tuberculosis
DEQEKMLARRLSG

SEQ ID NO: 132029 - protein, 13 aa, Mycobacterium tuberculosis
EQEKMLARRLSGW

SEQ ID NO: 132030 - protein, 13 aa, Mycobacterium tuberculosis
QEKMLARRLSGWQ

SEQ ID NO: 132031 - protein, 13 aa, Mycobacterium tuberculosis
EKMLARRLSGWQD

SEQ ID NO: 132032 - protein, 13 aa, Mycobacterium tuberculosis
KMLARRLSGWQDR

SEQ ID NO: 132033 - protein, 13 aa, Mycobacterium tuberculosis
MLARRLSGWQDRY

SEQ ID NO: 132034 - protein, 13 aa, Mycobacterium tuberculosis
LARRLSGWQDRYP

SEQ ID NO: 132035 - protein, 13 aa, Mycobacterium tuberculosis
ARRLSGWQDRYPD

SEQ ID NO: 132036 - protein, 13 aa, Mycobacterium tuberculosis
RRLSGWQDRYPDV

SEQ ID NO: 132037 - protein, 13 aa, Mycobacterium tuberculosis
RLSGWQDRYPDVV

SEQ ID NO: 132038 - protein, 13 aa, Mycobacterium tuberculosis
LSGWQDRYPDVVV

SEQ ID NO: 132039 - protein, 13 aa, Mycobacterium tuberculosis
SGWQDRYPDVVVH

SEQ ID NO: 132040 - protein, 13 aa, Mycobacterium tuberculosis
GWQDRYPDVVVHK

SEQ ID NO: 132041 - protein, 13 aa, Mycobacterium tuberculosis
WQDRYPDVVVHKV

SEQ ID NO: 132042 - protein, 13 aa, Mycobacterium tuberculosis
QDRYPDVVVHKVV

SEQ ID NO: 132043 - protein, 13 aa, Mycobacterium tuberculosis
DRYPDVVVHKVVV

SEQ ID NO: 132044 - protein, 13 aa, Mycobacterium tuberculosis
RYPDVVVHKVVVC

SEQ ID NO: 132045 - protein, 13 aa, Mycobacterium tuberculosis
YPDVVVHKVVVCD

SEQ ID NO: 132046 - protein, 13 aa, Mycobacterium tuberculosis
PDVVVHKVVVCDR

SEQ ID NO: 132047 - protein, 13 aa, Mycobacterium tuberculosis
DVVVHKVVVCDRP

SEQ ID NO: 132048 - protein, 13 aa, Mycobacterium tuberculosis
VVVHKVVVCDRPA

SEQ ID NO: 132049 - protein, 13 aa, Mycobacterium tuberculosis
VVHKVVVCDRPAP

SEQ ID NO: 132050 - protein, 13 aa, Mycobacterium tuberculosis
VHKVVVCDRPAPR

SEQ ID NO: 132051 - protein, 13 aa, Mycobacterium tuberculosis
HKVVVCDRPAPRL

SEQ ID NO: 132052 - protein, 13 aa, Mycobacterium tuberculosis
KVVVCDRPAPRLL

SEQ ID NO: 132053 - protein, 13 aa, Mycobacterium tuberculosis
VVVCDRPAPRLLE

SEQ ID NO: 132054 - protein, 13 aa, Mycobacterium tuberculosis
VVCDRPAPRLLEL

SEQ ID NO: 132055 - protein, 13 aa, Mycobacterium tuberculosis
VCDRPAPRLLELA

SEQ ID NO: 132056 - protein, 13 aa, Mycobacterium tuberculosis
CDRPAPRLLELAQ

SEQ ID NO: 132057 - protein, 13 aa, Mycobacterium tuberculosis
DRPAPRLLELAQT

SEQ ID NO: 132058 - protein, 13 aa, Mycobacterium tuberculosis
RPAPRLLELAQTA

SEQ ID NO: 132059 - protein, 13 aa, Mycobacterium tuberculosis
PAPRLLELAQTAQ

SEQ ID NO: 132060 - protein, 13 aa, Mycobacterium tuberculosis
APRLLELAQTAQL

SEQ ID NO: 132061 - protein, 13 aa, Mycobacterium tuberculosis
PRLLELAQTAQLV

SEQ ID NO: 132062 - protein, 13 aa, Mycobacterium tuberculosis
RLLELAQTAQLVV

SEQ ID NO: 132063 - protein, 13 aa, Mycobacterium tuberculosis
LLELAQTAQLVVV

SEQ ID NO: 132064 - protein, 13 aa, Mycobacterium tuberculosis
LELAQTAQLVVVG

SEQ ID NO: 132065 - protein, 13 aa, Mycobacterium tuberculosis
ELAQTAQLVVVGS

SEQ ID NO: 132066 - protein, 13 aa, Mycobacterium tuberculosis
LAQTAQLVVVGSH

SEQ ID NO: 132067 - protein, 13 aa, Mycobacterium tuberculosis
AQTAQLVVVGSHG

SEQ ID NO: 132068 - protein, 13 aa, Mycobacterium tuberculosis
QTAQLVVVGSHGR

SEQ ID NO: 132069 - protein, 13 aa, Mycobacterium tuberculosis
TAQLVVVGSHGRG

SEQ ID NO: 132070 - protein, 13 aa, Mycobacterium tuberculosis
AQLVVVGSHGRGG

SEQ ID NO: 132071 - protein, 13 aa, Mycobacterium tuberculosis
QLVVVGSHGRGGF

SEQ ID NO: 132072 - protein, 13 aa, Mycobacterium tuberculosis
LVVVGSHGRGGFP

SEQ ID NO: 132073 - protein, 13 aa, Mycobacterium tuberculosis
VVVGSHGRGGFPG

SEQ ID NO: 132074 - protein, 13 aa, Mycobacterium tuberculosis
VVGSHGRGGFPGM

SEQ ID NO: 132075 - protein, 13 aa, Mycobacterium tuberculosis
VGSHGRGGFPGMH

SEQ ID NO: 132076 - protein, 13 aa, Mycobacterium tuberculosis
GSHGRGGFPGMHL

SEQ ID NO: 132077 - protein, 13 aa, Mycobacterium tuberculosis
SHGRGGFPGMHLG

SEQ ID NO: 132078 - protein, 13 aa, Mycobacterium tuberculosis
HGRGGFPGMHLGS

SEQ ID NO: 132079 - protein, 13 aa, Mycobacterium tuberculosis
GRGGFPGMHLGSV

SEQ ID NO: 132080 - protein, 13 aa, Mycobacterium tuberculosis
RGGFPGMHLGSVS

SEQ ID NO: 132081 - protein, 13 aa, Mycobacterium tuberculosis
GGFPGMHLGSVSR

SEQ ID NO: 132082 - protein, 13 aa, Mycobacterium tuberculosis
GFPGMHLGSVSRA

SEQ ID NO: 132083 - protein, 13 aa, Mycobacterium tuberculosis
FPGMHLGSVSRAV

SEQ ID NO: 132084 - protein, 13 aa, Mycobacterium tuberculosis
PGMHLGSVSRAVV

SEQ ID NO: 132085 - protein, 13 aa, Mycobacterium tuberculosis
GMHLGSVSRAVVN

SEQ ID NO: 132086 - protein, 13 aa, Mycobacterium tuberculosis
MHLGSVSRAVVNS

SEQ ID NO: 132087 - protein, 13 aa, Mycobacterium tuberculosis
HLGSVSRAVVNSG

SEQ ID NO: 132088 - protein, 13 aa, Mycobacterium tuberculosis
LGSVSRAVVNSGQ

SEQ ID NO: 132089 - protein, 13 aa, Mycobacterium tuberculosis
GSVSRAVVNSGQA

SEQ ID NO: 132090 - protein, 13 aa, Mycobacterium tuberculosis
SVSRAVVNSGQAP

SEQ ID NO: 132091 - protein, 13 aa, Mycobacterium tuberculosis
VSRAVVNSGQAPV

SEQ ID NO: 132092 - protein, 13 aa, Mycobacterium tuberculosis
SRAVVNSGQAPVI

SEQ ID NO: 132093 - protein, 13 aa, Mycobacterium tuberculosis
RAVVNSGQAPVIV

SEQ ID NO: 132094 - protein, 13 aa, Mycobacterium tuberculosis
AVVNSGQAPVIVA

SEQ ID NO: 132095 - protein, 13 aa, Mycobacterium tuberculosis
VVNSGQAPVIVAR

SEQ ID NO: 132096 - protein, 13 aa, Mycobacterium tuberculosis
VNSGQAPVIVARI

SEQ ID NO: 132097 - protein, 13 aa, Mycobacterium tuberculosis
NSGQAPVIVARIP

SEQ ID NO: 132098 - protein, 13 aa, Mycobacterium tuberculosis
SGQAPVIVARIPQ

SEQ ID NO: 132099 - protein, 13 aa, Mycobacterium tuberculosis
GQAPVIVARIPQD

SEQ ID NO: 132100 - protein, 13 aa, Mycobacterium tuberculosis
QAPVIVARIPQDP

SEQ ID NO: 132101 - protein, 13 aa, Mycobacterium tuberculosis
APVIVARIPQDPA

SEQ ID NO: 132102 - protein, 13 aa, Mycobacterium tuberculosis
PVIVARIPQDPAV

SEQ ID NO: 132103 - protein, 13 aa, Mycobacterium tuberculosis
VIVARIPQDPAVP

SEQ ID NO: 132104 - protein, 13 aa, Mycobacterium tuberculosis
IVARIPQDPAVPA

SEQ ID NO: 132105 - protein, 14 aa, Mycobacterium tuberculosis
MSAQQTNLGIVVGV

SEQ ID NO: 132106 - protein, 14 aa, Mycobacterium tuberculosis
SAQQTNLGIVVGVD

SEQ ID NO: 132107 - protein, 14 aa, Mycobacterium tuberculosis
AQQTNLGIVVGVDG

SEQ ID NO: 132108 - protein, 14 aa, Mycobacterium tuberculosis
QQTNLGIVVGVDGS

SEQ ID NO: 132109 - protein, 14 aa, Mycobacterium tuberculosis
QTNLGIVVGVDGSP

SEQ ID NO: 132110 - protein, 14 aa, Mycobacterium tuberculosis
TNLGIVVGVDGSPC

SEQ ID NO: 132111 - protein, 14 aa, Mycobacterium tuberculosis
NLGIVVGVDGSPCS

SEQ ID NO: 132112 - protein, 14 aa, Mycobacterium tuberculosis
LGIVVGVDGSPCSH

SEQ ID NO: 132113 - protein, 14 aa, Mycobacterium tuberculosis
GIVVGVDGSPCSHT

SEQ ID NO: 132114 - protein, 14 aa, Mycobacterium tuberculosis
IVVGVDGSPCSHTA

SEQ ID NO: 132115 - protein, 14 aa, Mycobacterium tuberculosis
VVGVDGSPCSHTAV

SEQ ID NO: 132116 - protein, 14 aa, Mycobacterium tuberculosis
VGVDGSPCSHTAVE

SEQ ID NO: 132117 - protein, 14 aa, Mycobacterium tuberculosis
GVDGSPCSHTAVEW

SEQ ID NO: 132118 - protein, 14 aa, Mycobacterium tuberculosis
VDGSPCSHTAVEWA

SEQ ID NO: 132119 - protein, 14 aa, Mycobacterium tuberculosis
DGSPCSHTAVEWAA

SEQ ID NO: 132120 - protein, 14 aa, Mycobacterium tuberculosis
GSPCSHTAVEWAAR

SEQ ID NO: 132121 - protein, 14 aa, Mycobacterium tuberculosis
SPCSHTAVEWAARD

SEQ ID NO: 132122 - protein, 14 aa, Mycobacterium tuberculosis
PCSHTAVEWAARDA

SEQ ID NO: 132123 - protein, 14 aa, Mycobacterium tuberculosis
CSHTAVEWAARDAQ

SEQ ID NO: 132124 - protein, 14 aa, Mycobacterium tuberculosis
SHTAVEWAARDAQM

SEQ ID NO: 132125 - protein, 14 aa, Mycobacterium tuberculosis
HTAVEWAARDAQMR

SEQ ID NO: 132126 - protein, 14 aa, Mycobacterium tuberculosis
TAVEWAARDAQMRN

SEQ ID NO: 132127 - protein, 14 aa, Mycobacterium tuberculosis
AVEWAARDAQMRNV

SEQ ID NO: 132128 - protein, 14 aa, Mycobacterium tuberculosis
VEWAARDAQMRNVA

SEQ ID NO: 132129 - protein, 14 aa, Mycobacterium tuberculosis
EWAARDAQMRNVAL

SEQ ID NO: 132130 - protein, 14 aa, Mycobacterium tuberculosis
WAARDAQMRNVALR

SEQ ID NO: 132131 - protein, 14 aa, Mycobacterium tuberculosis
AARDAQMRNVALRV

SEQ ID NO: 132132 - protein, 14 aa, Mycobacterium tuberculosis
ARDAQMRNVALRVV

SEQ ID NO: 132133 - protein, 14 aa, Mycobacterium tuberculosis
RDAQMRNVALRVVQ

SEQ ID NO: 132134 - protein, 14 aa, Mycobacterium tuberculosis
DAQMRNVALRVVQV

SEQ ID NO: 132135 - protein, 14 aa, Mycobacterium tuberculosis
AQMRNVALRVVQVV

SEQ ID NO: 132136 - protein, 14 aa, Mycobacterium tuberculosis
QMRNVALRVVQVVP

SEQ ID NO: 132137 - protein, 14 aa, Mycobacterium tuberculosis
MRNVALRVVQVVPP

SEQ ID NO: 132138 - protein, 14 aa, Mycobacterium tuberculosis
RNVALRVVQVVPPV

SEQ ID NO: 132139 - protein, 14 aa, Mycobacterium tuberculosis
NVALRVVQVVPPVI

SEQ ID NO: 132140 - protein, 14 aa, Mycobacterium tuberculosis
VALRVVQVVPPVIT

SEQ ID NO: 132141 - protein, 14 aa, Mycobacterium tuberculosis
ALRVVQVVPPVITA

SEQ ID NO: 132142 - protein, 14 aa, Mycobacterium tuberculosis
LRVVQVVPPVITAP

SEQ ID NO: 132143 - protein, 14 aa, Mycobacterium tuberculosis
RVVQVVPPVITAPE

SEQ ID NO: 132144 - protein, 14 aa, Mycobacterium tuberculosis
VVQVVPPVITAPEG

SEQ ID NO: 132145 - protein, 14 aa, Mycobacterium tuberculosis
VQVVPPVITAPEGW

SEQ ID NO: 132146 - protein, 14 aa, Mycobacterium tuberculosis
QVVPPVITAPEGWA

SEQ ID NO: 132147 - protein, 14 aa, Mycobacterium tuberculosis
VVPPVITAPEGWAF

SEQ ID NO: 132148 - protein, 14 aa, Mycobacterium tuberculosis
VPPVITAPEGWAFE

SEQ ID NO: 132149 - protein, 14 aa, Mycobacterium tuberculosis
PPVITAPEGWAFEY

SEQ ID NO: 132150 - protein, 14 aa, Mycobacterium tuberculosis
PVITAPEGWAFEYS

SEQ ID NO: 132151 - protein, 14 aa, Mycobacterium tuberculosis
VITAPEGWAFEYSR

SEQ ID NO: 132152 - protein, 14 aa, Mycobacterium tuberculosis
ITAPEGWAFEYSRF

SEQ ID NO: 132153 - protein, 14 aa, Mycobacterium tuberculosis
TAPEGWAFEYSRFQ

SEQ ID NO: 132154 - protein, 14 aa, Mycobacterium tuberculosis
APEGWAFEYSRFQE

SEQ ID NO: 132155 - protein, 14 aa, Mycobacterium tuberculosis
PEGWAFEYSRFQEA

SEQ ID NO: 132156 - protein, 14 aa, Mycobacterium tuberculosis
EGWAFEYSRFQEAQ

SEQ ID NO: 132157 - protein, 14 aa, Mycobacterium tuberculosis
GWAFEYSRFQEAQK

SEQ ID NO: 132158 - protein, 14 aa, Mycobacterium tuberculosis
WAFEYSRFQEAQKR

SEQ ID NO: 132159 - protein, 14 aa, Mycobacterium tuberculosis
AFEYSRFQEAQKRE

SEQ ID NO: 132160 - protein, 14 aa, Mycobacterium tuberculosis
FEYSRFQEAQKREI

SEQ ID NO: 132161 - protein, 14 aa, Mycobacterium tuberculosis
EYSRFQEAQKREIV

SEQ ID NO: 132162 - protein, 14 aa, Mycobacterium tuberculosis
YSRFQEAQKREIVE

SEQ ID NO: 132163 - protein, 14 aa, Mycobacterium tuberculosis
SRFQEAQKREIVEH

SEQ ID NO: 132164 - protein, 14 aa, Mycobacterium tuberculosis
RFQEAQKREIVEHS

SEQ ID NO: 132165 - protein, 14 aa, Mycobacterium tuberculosis
FQEAQKREIVEHSY

SEQ ID NO: 132166 - protein, 14 aa, Mycobacterium tuberculosis
QEAQKREIVEHSYL

SEQ ID NO: 132167 - protein, 14 aa, Mycobacterium tuberculosis
EAQKREIVEHSYLV

SEQ ID NO: 132168 - protein, 14 aa, Mycobacterium tuberculosis
AQKREIVEHSYLVA

SEQ ID NO: 132169 - protein, 14 aa, Mycobacterium tuberculosis
QKREIVEHSYLVAQ

SEQ ID NO: 132170 - protein, 14 aa, Mycobacterium tuberculosis
KREIVEHSYLVAQA

SEQ ID NO: 132171 - protein, 14 aa, Mycobacterium tuberculosis
REIVEHSYLVAQAH

SEQ ID NO: 132172 - protein, 14 aa, Mycobacterium tuberculosis
EIVEHSYLVAQAHQ

SEQ ID NO: 132173 - protein, 14 aa, Mycobacterium tuberculosis
IVEHSYLVAQAHQI

SEQ ID NO: 132174 - protein, 14 aa, Mycobacterium tuberculosis
VEHSYLVAQAHQIV

SEQ ID NO: 132175 - protein, 14 aa, Mycobacterium tuberculosis
EHSYLVAQAHQIVE

SEQ ID NO: 132176 - protein, 14 aa, Mycobacterium tuberculosis
HSYLVAQAHQIVEQ

SEQ ID NO: 132177 - protein, 14 aa, Mycobacterium tuberculosis
SYLVAQAHQIVEQA

SEQ ID NO: 132178 - protein, 14 aa, Mycobacterium tuberculosis
YLVAQAHQIVEQAH

SEQ ID NO: 132179 - protein, 14 aa, Mycobacterium tuberculosis
LVAQAHQIVEQAHK

SEQ ID NO: 132180 - protein, 14 aa, Mycobacterium tuberculosis
VAQAHQIVEQAHKV

SEQ ID NO: 132181 - protein, 14 aa, Mycobacterium tuberculosis
AQAHQIVEQAHKVA

SEQ ID NO: 132182 - protein, 14 aa, Mycobacterium tuberculosis
QAHQIVEQAHKVAL

SEQ ID NO: 132183 - protein, 14 aa, Mycobacterium tuberculosis
AHQIVEQAHKVALE

SEQ ID NO: 132184 - protein, 14 aa, Mycobacterium tuberculosis
HQIVEQAHKVALEA

SEQ ID NO: 132185 - protein, 14 aa, Mycobacterium tuberculosis
QIVEQAHKVALEAS

SEQ ID NO: 132186 - protein, 14 aa, Mycobacterium tuberculosis
IVEQAHKVALEASS

SEQ ID NO: 132187 - protein, 14 aa, Mycobacterium tuberculosis
VEQAHKVALEASSS

SEQ ID NO: 132188 - protein, 14 aa, Mycobacterium tuberculosis
EQAHKVALEASSSG

SEQ ID NO: 132189 - protein, 14 aa, Mycobacterium tuberculosis
QAHKVALEASSSGR

SEQ ID NO: 132190 - protein, 14 aa, Mycobacterium tuberculosis
AHKVALEASSSGRA

SEQ ID NO: 132191 - protein, 14 aa, Mycobacterium tuberculosis
HKVALEASSSGRAA

SEQ ID NO: 132192 - protein, 14 aa, Mycobacterium tuberculosis
KVALEASSSGRAAQ

SEQ ID NO: 132193 - protein, 14 aa, Mycobacterium tuberculosis
VALEASSSGRAAQI

SEQ ID NO: 132194 - protein, 14 aa, Mycobacterium tuberculosis
ALEASSSGRAAQIT

SEQ ID NO: 132195 - protein, 14 aa, Mycobacterium tuberculosis
LEASSSGRAAQITG

SEQ ID NO: 132196 - protein, 14 aa, Mycobacterium tuberculosis
EASSSGRAAQITGE

SEQ ID NO: 132197 - protein, 14 aa, Mycobacterium tuberculosis
ASSSGRAAQITGEV

SEQ ID NO: 132198 - protein, 14 aa, Mycobacterium tuberculosis
SSSGRAAQITGEVL

SEQ ID NO: 132199 - protein, 14 aa, Mycobacterium tuberculosis
SSGRAAQITGEVLH

SEQ ID NO: 132200 - protein, 14 aa, Mycobacterium tuberculosis
SGRAAQITGEVLHG

SEQ ID NO: 132201 - protein, 14 aa, Mycobacterium tuberculosis
GRAAQITGEVLHGQ

SEQ ID NO: 132202 - protein, 14 aa, Mycobacterium tuberculosis
RAAQITGEVLHGQI

SEQ ID NO: 132203 - protein, 14 aa, Mycobacterium tuberculosis
AAQITGEVLHGQIV

SEQ ID NO: 132204 - protein, 14 aa, Mycobacterium tuberculosis
AQITGEVLHGQIVP

SEQ ID NO: 132205 - protein, 14 aa, Mycobacterium tuberculosis
QITGEVLHGQIVPT

SEQ ID NO: 132206 - protein, 14 aa, Mycobacterium tuberculosis
ITGEVLHGQIVPTL

SEQ ID NO: 132207 - protein, 14 aa, Mycobacterium tuberculosis
TGEVLHGQIVPTLA

SEQ ID NO: 132208 - protein, 14 aa, Mycobacterium tuberculosis
GEVLHGQIVPTLAN

SEQ ID NO: 132209 - protein, 14 aa, Mycobacterium tuberculosis
EVLHGQIVPTLANI

SEQ ID NO: 132210 - protein, 14 aa, Mycobacterium tuberculosis
VLHGQIVPTLANIS

SEQ ID NO: 132211 - protein, 14 aa, Mycobacterium tuberculosis
LHGQIVPTLANISR

SEQ ID NO: 132212 - protein, 14 aa, Mycobacterium tuberculosis
HGQIVPTLANISRQ

SEQ ID NO: 132213 - protein, 14 aa, Mycobacterium tuberculosis
GQIVPTLANISRQV

SEQ ID NO: 132214 - protein, 14 aa, Mycobacterium tuberculosis
QIVPTLANISRQVA

SEQ ID NO: 132215 - protein, 14 aa, Mycobacterium tuberculosis
IVPTLANISRQVAM

SEQ ID NO: 132216 - protein, 14 aa, Mycobacterium tuberculosis
VPTLANISRQVAMV

SEQ ID NO: 132217 - protein, 14 aa, Mycobacterium tuberculosis
PTLANISRQVAMVV

SEQ ID NO: 132218 - protein, 14 aa, Mycobacterium tuberculosis
TLANISRQVAMVVL

SEQ ID NO: 132219 - protein, 14 aa, Mycobacterium tuberculosis
LANISRQVAMVVLG

SEQ ID NO: 132220 - protein, 14 aa, Mycobacterium tuberculosis
ANISRQVAMVVLGY

SEQ ID NO: 132221 - protein, 14 aa, Mycobacterium tuberculosis
NISRQVAMVVLGYR

SEQ ID NO: 132222 - protein, 14 aa, Mycobacterium tuberculosis
ISRQVAMVVLGYRG

SEQ ID NO: 132223 - protein, 14 aa, Mycobacterium tuberculosis
SRQVAMVVLGYRGQ

SEQ ID NO: 132224 - protein, 14 aa, Mycobacterium tuberculosis
RQVAMVVLGYRGQG

SEQ ID NO: 132225 - protein, 14 aa, Mycobacterium tuberculosis
QVAMVVLGYRGQGA

SEQ ID NO: 132226 - protein, 14 aa, Mycobacterium tuberculosis
VAMVVLGYRGQGAV

SEQ ID NO: 132227 - protein, 14 aa, Mycobacterium tuberculosis
AMVVLGYRGQGAVA

SEQ ID NO: 132228 - protein, 14 aa, Mycobacterium tuberculosis
MVVLGYRGQGAVAG

SEQ ID NO: 132229 - protein, 14 aa, Mycobacterium tuberculosis
VVLGYRGQGAVAGA

SEQ ID NO: 132230 - protein, 14 aa, Mycobacterium tuberculosis
VLGYRGQGAVAGAL

SEQ ID NO: 132231 - protein, 14 aa, Mycobacterium tuberculosis
LGYRGQGAVAGALL

SEQ ID NO: 132232 - protein, 14 aa, Mycobacterium tuberculosis
GYRGQGAVAGALLG

SEQ ID NO: 132233 - protein, 14 aa, Mycobacterium tuberculosis
YRGQGAVAGALLGS

SEQ ID NO: 132234 - protein, 14 aa, Mycobacterium tuberculosis
RGQGAVAGALLGSV

SEQ ID NO: 132235 - protein, 14 aa, Mycobacterium tuberculosis
GQGAVAGALLGSVS

SEQ ID NO: 132236 - protein, 14 aa, Mycobacterium tuberculosis
QGAVAGALLGSVSS

SEQ ID NO: 132237 - protein, 14 aa, Mycobacterium tuberculosis
GAVAGALLGSVSSS

SEQ ID NO: 132238 - protein, 14 aa, Mycobacterium tuberculosis
AVAGALLGSVSSSL

SEQ ID NO: 132239 - protein, 14 aa, Mycobacterium tuberculosis
VAGALLGSVSSSLV

SEQ ID NO: 132240 - protein, 14 aa, Mycobacterium tuberculosis
AGALLGSVSSSLVR

SEQ ID NO: 132241 - protein, 14 aa, Mycobacterium tuberculosis
GALLGSVSSSLVRH

SEQ ID NO: 132242 - protein, 14 aa, Mycobacterium tuberculosis
ALLGSVSSSLVRHA

SEQ ID NO: 132243 - protein, 14 aa, Mycobacterium tuberculosis
LLGSVSSSLVRHAH

SEQ ID NO: 132244 - protein, 14 aa, Mycobacterium tuberculosis
LGSVSSSLVRHAHG

SEQ ID NO: 132245 - protein, 14 aa, Mycobacterium tuberculosis
GSVSSSLVRHAHGP

SEQ ID NO: 132246 - protein, 14 aa, Mycobacterium tuberculosis
SVSSSLVRHAHGPV

SEQ ID NO: 132247 - protein, 14 aa, Mycobacterium tuberculosis
VSSSLVRHAHGPVA

SEQ ID NO: 132248 - protein, 14 aa, Mycobacterium tuberculosis
SSSLVRHAHGPVAV

SEQ ID NO: 132249 - protein, 14 aa, Mycobacterium tuberculosis
SSLVRHAHGPVAVI

SEQ ID NO: 132250 - protein, 14 aa, Mycobacterium tuberculosis
SLVRHAHGPVAVIP

SEQ ID NO: 132251 - protein, 14 aa, Mycobacterium tuberculosis
LVRHAHGPVAVIPE

SEQ ID NO: 132252 - protein, 14 aa, Mycobacterium tuberculosis
VRHAHGPVAVIPEE

SEQ ID NO: 132253 - protein, 14 aa, Mycobacterium tuberculosis
RHAHGPVAVIPEEP

SEQ ID NO: 132254 - protein, 14 aa, Mycobacterium tuberculosis
HAHGPVAVIPEEPR

SEQ ID NO: 132255 - protein, 14 aa, Mycobacterium tuberculosis
AHGPVAVIPEEPRP

SEQ ID NO: 132256 - protein, 14 aa, Mycobacterium tuberculosis
HGPVAVIPEEPRPA

SEQ ID NO: 132257 - protein, 14 aa, Mycobacterium tuberculosis
GPVAVIPEEPRPAR

SEQ ID NO: 132258 - protein, 14 aa, Mycobacterium tuberculosis
PVAVIPEEPRPARP

SEQ ID NO: 132259 - protein, 14 aa, Mycobacterium tuberculosis
VAVIPEEPRPARPP

SEQ ID NO: 132260 - protein, 14 aa, Mycobacterium tuberculosis
AVIPEEPRPARPPH

SEQ ID NO: 132261 - protein, 14 aa, Mycobacterium tuberculosis
VIPEEPRPARPPHA

SEQ ID NO: 132262 - protein, 14 aa, Mycobacterium tuberculosis
IPEEPRPARPPHAP

SEQ ID NO: 132263 - protein, 14 aa, Mycobacterium tuberculosis
PEEPRPARPPHAPV

SEQ ID NO: 132264 - protein, 14 aa, Mycobacterium tuberculosis
EEPRPARPPHAPVV

SEQ ID NO: 132265 - protein, 14 aa, Mycobacterium tuberculosis
EPRPARPPHAPVVV

SEQ ID NO: 132266 - protein, 14 aa, Mycobacterium tuberculosis
PRPARPPHAPVVVG

SEQ ID NO: 132267 - protein, 14 aa, Mycobacterium tuberculosis
RPARPPHAPVVVGI

SEQ ID NO: 132268 - protein, 14 aa, Mycobacterium tuberculosis
PARPPHAPVVVGID

SEQ ID NO: 132269 - protein, 14 aa, Mycobacterium tuberculosis
ARPPHAPVVVGIDG

SEQ ID NO: 132270 - protein, 14 aa, Mycobacterium tuberculosis
RPPHAPVVVGIDGS

SEQ ID NO: 132271 - protein, 14 aa, Mycobacterium tuberculosis
PPHAPVVVGIDGSP

SEQ ID NO: 132272 - protein, 14 aa, Mycobacterium tuberculosis
PHAPVVVGIDGSPT

SEQ ID NO: 132273 - protein, 14 aa, Mycobacterium tuberculosis
HAPVVVGIDGSPTS

SEQ ID NO: 132274 - protein, 14 aa, Mycobacterium tuberculosis
APVVVGIDGSPTSG

SEQ ID NO: 132275 - protein, 14 aa, Mycobacterium tuberculosis
PVVVGIDGSPTSGL

SEQ ID NO: 132276 - protein, 14 aa, Mycobacterium tuberculosis
VVVGIDGSPTSGLA

SEQ ID NO: 132277 - protein, 14 aa, Mycobacterium tuberculosis
VVGIDGSPTSGLAA

SEQ ID NO: 132278 - protein, 14 aa, Mycobacterium tuberculosis
VGIDGSPTSGLAAE

SEQ ID NO: 132279 - protein, 14 aa, Mycobacterium tuberculosis
GIDGSPTSGLAAEI

SEQ ID NO: 132280 - protein, 14 aa, Mycobacterium tuberculosis
IDGSPTSGLAAEIA

SEQ ID NO: 132281 - protein, 14 aa, Mycobacterium tuberculosis
DGSPTSGLAAEIAF

SEQ ID NO: 132282 - protein, 14 aa, Mycobacterium tuberculosis
GSPTSGLAAEIAFD

SEQ ID NO: 132283 - protein, 14 aa, Mycobacterium tuberculosis
SPTSGLAAEIAFDE

SEQ ID NO: 132284 - protein, 14 aa, Mycobacterium tuberculosis
PTSGLAAEIAFDEA

SEQ ID NO: 132285 - protein, 14 aa, Mycobacterium tuberculosis
TSGLAAEIAFDEAS

SEQ ID NO: 132286 - protein, 14 aa, Mycobacterium tuberculosis
SGLAAEIAFDEASR

SEQ ID NO: 132287 - protein, 14 aa, Mycobacterium tuberculosis
GLAAEIAFDEASRR

SEQ ID NO: 132288 - protein, 14 aa, Mycobacterium tuberculosis
LAAEIAFDEASRRG

SEQ ID NO: 132289 - protein, 14 aa, Mycobacterium tuberculosis
AAEIAFDEASRRGV

SEQ ID NO: 132290 - protein, 14 aa, Mycobacterium tuberculosis
AEIAFDEASRRGVD

SEQ ID NO: 132291 - protein, 14 aa, Mycobacterium tuberculosis
EIAFDEASRRGVDL

SEQ ID NO: 132292 - protein, 14 aa, Mycobacterium tuberculosis
IAFDEASRRGVDLV

SEQ ID NO: 132293 - protein, 14 aa, Mycobacterium tuberculosis
AFDEASRRGVDLVA

SEQ ID NO: 132294 - protein, 14 aa, Mycobacterium tuberculosis
FDEASRRGVDLVAL

SEQ ID NO: 132295 - protein, 14 aa, Mycobacterium tuberculosis
DEASRRGVDLVALH

SEQ ID NO: 132296 - protein, 14 aa, Mycobacterium tuberculosis
EASRRGVDLVALHA

SEQ ID NO: 132297 - protein, 14 aa, Mycobacterium tuberculosis
ASRRGVDLVALHAW

SEQ ID NO: 132298 - protein, 14 aa, Mycobacterium tuberculosis
SRRGVDLVALHAWS

SEQ ID NO: 132299 - protein, 14 aa, Mycobacterium tuberculosis
RRGVDLVALHAWSD

SEQ ID NO: 132300 - protein, 14 aa, Mycobacterium tuberculosis
RGVDLVALHAWSDM

SEQ ID NO: 132301 - protein, 14 aa, Mycobacterium tuberculosis
GVDLVALHAWSDMG

SEQ ID NO: 132302 - protein, 14 aa, Mycobacterium tuberculosis
VDLVALHAWSDMGP

SEQ ID NO: 132303 - protein, 14 aa, Mycobacterium tuberculosis
DLVALHAWSDMGPL

SEQ ID NO: 132304 - protein, 14 aa, Mycobacterium tuberculosis
LVALHAWSDMGPLD

SEQ ID NO: 132305 - protein, 14 aa, Mycobacterium tuberculosis
VALHAWSDMGPLDF

SEQ ID NO: 132306 - protein, 14 aa, Mycobacterium tuberculosis
ALHAWSDMGPLDFP

SEQ ID NO: 132307 - protein, 14 aa, Mycobacterium tuberculosis
LHAWSDMGPLDFPR

SEQ ID NO: 132308 - protein, 14 aa, Mycobacterium tuberculosis
HAWSDMGPLDFPRL

SEQ ID NO: 132309 - protein, 14 aa, Mycobacterium tuberculosis
AWSDMGPLDFPRLN

SEQ ID NO: 132310 - protein, 14 aa, Mycobacterium tuberculosis
WSDMGPLDFPRLNW

SEQ ID NO: 132311 - protein, 14 aa, Mycobacterium tuberculosis
SDMGPLDFPRLNWA

SEQ ID NO: 132312 - protein, 14 aa, Mycobacterium tuberculosis
DMGPLDFPRLNWAP

SEQ ID NO: 132313 - protein, 14 aa, Mycobacterium tuberculosis
MGPLDFPRLNWAPI

SEQ ID NO: 132314 - protein, 14 aa, Mycobacterium tuberculosis
GPLDFPRLNWAPIE

SEQ ID NO: 132315 - protein, 14 aa, Mycobacterium tuberculosis
PLDFPRLNWAPIEW

SEQ ID NO: 132316 - protein, 14 aa, Mycobacterium tuberculosis
LDFPRLNWAPIEWR

SEQ ID NO: 132317 - protein, 14 aa, Mycobacterium tuberculosis
DFPRLNWAPIEWRN

SEQ ID NO: 132318 - protein, 14 aa, Mycobacterium tuberculosis
FPRLNWAPIEWRNL

SEQ ID NO: 132319 - protein, 14 aa, Mycobacterium tuberculosis
PRLNWAPIEWRNLE

SEQ ID NO: 132320 - protein, 14 aa, Mycobacterium tuberculosis
RLNWAPIEWRNLED

SEQ ID NO: 132321 - protein, 14 aa, Mycobacterium tuberculosis
LNWAPIEWRNLEDE

SEQ ID NO: 132322 - protein, 14 aa, Mycobacterium tuberculosis
NWAPIEWRNLEDEQ

SEQ ID NO: 132323 - protein, 14 aa, Mycobacterium tuberculosis
WAPIEWRNLEDEQE

SEQ ID NO: 132324 - protein, 14 aa, Mycobacterium tuberculosis
APIEWRNLEDEQEK

SEQ ID NO: 132325 - protein, 14 aa, Mycobacterium tuberculosis
PIEWRNLEDEQEKM

SEQ ID NO: 132326 - protein, 14 aa, Mycobacterium tuberculosis
IEWRNLEDEQEKML

SEQ ID NO: 132327 - protein, 14 aa, Mycobacterium tuberculosis
EWRNLEDEQEKMLA

SEQ ID NO: 132328 - protein, 14 aa, Mycobacterium tuberculosis
WRNLEDEQEKMLAR

SEQ ID NO: 132329 - protein, 14 aa, Mycobacterium tuberculosis
RNLEDEQEKMLARR

SEQ ID NO: 132330 - protein, 14 aa, Mycobacterium tuberculosis
NLEDEQEKMLARRL

SEQ ID NO: 132331 - protein, 14 aa, Mycobacterium tuberculosis
LEDEQEKMLARRLS

SEQ ID NO: 132332 - protein, 14 aa, Mycobacterium tuberculosis
EDEQEKMLARRLSG

SEQ ID NO: 132333 - protein, 14 aa, Mycobacterium tuberculosis
DEQEKMLARRLSGW

SEQ ID NO: 132334 - protein, 14 aa, Mycobacterium tuberculosis
EQEKMLARRLSGWQ

SEQ ID NO: 132335 - protein, 14 aa, Mycobacterium tuberculosis
QEKMLARRLSGWQD

SEQ ID NO: 132336 - protein, 14 aa, Mycobacterium tuberculosis
EKMLARRLSGWQDR

SEQ ID NO: 132337 - protein, 14 aa, Mycobacterium tuberculosis
KMLARRLSGWQDRY

SEQ ID NO: 132338 - protein, 14 aa, Mycobacterium tuberculosis
MLARRLSGWQDRYP

SEQ ID NO: 132339 - protein, 14 aa, Mycobacterium tuberculosis
LARRLSGWQDRYPD

SEQ ID NO: 132340 - protein, 14 aa, Mycobacterium tuberculosis
ARRLSGWQDRYPDV

SEQ ID NO: 132341 - protein, 14 aa, Mycobacterium tuberculosis
RRLSGWQDRYPDVV

SEQ ID NO: 132342 - protein, 14 aa, Mycobacterium tuberculosis
RLSGWQDRYPDVVV

SEQ ID NO: 132343 - protein, 14 aa, Mycobacterium tuberculosis
LSGWQDRYPDVVVH

SEQ ID NO: 132344 - protein, 14 aa, Mycobacterium tuberculosis
SGWQDRYPDVVVHK

SEQ ID NO: 132345 - protein, 14 aa, Mycobacterium tuberculosis
GWQDRYPDVVVHKV

SEQ ID NO: 132346 - protein, 14 aa, Mycobacterium tuberculosis
WQDRYPDVVVHKVV

SEQ ID NO: 132347 - protein, 14 aa, Mycobacterium tuberculosis
QDRYPDVVVHKVVV

SEQ ID NO: 132348 - protein, 14 aa, Mycobacterium tuberculosis
DRYPDVVVHKVVVC

SEQ ID NO: 132349 - protein, 14 aa, Mycobacterium tuberculosis
RYPDVVVHKVVVCD

SEQ ID NO: 132350 - protein, 14 aa, Mycobacterium tuberculosis
YPDVVVHKVVVCDR

SEQ ID NO: 132351 - protein, 14 aa, Mycobacterium tuberculosis
PDVVVHKVVVCDRP

SEQ ID NO: 132352 - protein, 14 aa, Mycobacterium tuberculosis
DVVVHKVVVCDRPA

SEQ ID NO: 132353 - protein, 14 aa, Mycobacterium tuberculosis
VVVHKVVVCDRPAP

SEQ ID NO: 132354 - protein, 14 aa, Mycobacterium tuberculosis
VVHKVVVCDRPAPR

SEQ ID NO: 132355 - protein, 14 aa, Mycobacterium tuberculosis
VHKVVVCDRPAPRL

SEQ ID NO: 132356 - protein, 14 aa, Mycobacterium tuberculosis
HKVVVCDRPAPRLL

SEQ ID NO: 132357 - protein, 14 aa, Mycobacterium tuberculosis
KVVVCDRPAPRLLE

SEQ ID NO: 132358 - protein, 14 aa, Mycobacterium tuberculosis
VVVCDRPAPRLLEL

SEQ ID NO: 132359 - protein, 14 aa, Mycobacterium tuberculosis
VVCDRPAPRLLELA

SEQ ID NO: 132360 - protein, 14 aa, Mycobacterium tuberculosis
VCDRPAPRLLELAQ

SEQ ID NO: 132361 - protein, 14 aa, Mycobacterium tuberculosis
CDRPAPRLLELAQT

SEQ ID NO: 132362 - protein, 14 aa, Mycobacterium tuberculosis
DRPAPRLLELAQTA

SEQ ID NO: 132363 - protein, 14 aa, Mycobacterium tuberculosis
RPAPRLLELAQTAQ

SEQ ID NO: 132364 - protein, 14 aa, Mycobacterium tuberculosis
PAPRLLELAQTAQL

SEQ ID NO: 132365 - protein, 14 aa, Mycobacterium tuberculosis
APRLLELAQTAQLV

SEQ ID NO: 132366 - protein, 14 aa, Mycobacterium tuberculosis
PRLLELAQTAQLVV

SEQ ID NO: 132367 - protein, 14 aa, Mycobacterium tuberculosis
RLLELAQTAQLVVV

SEQ ID NO: 132368 - protein, 14 aa, Mycobacterium tuberculosis
LLELAQTAQLVVVG

SEQ ID NO: 132369 - protein, 14 aa, Mycobacterium tuberculosis
LELAQTAQLVVVGS

SEQ ID NO: 132370 - protein, 14 aa, Mycobacterium tuberculosis
ELAQTAQLVVVGSH

SEQ ID NO: 132371 - protein, 14 aa, Mycobacterium tuberculosis
LAQTAQLVVVGSHG

SEQ ID NO: 132372 - protein, 14 aa, Mycobacterium tuberculosis
AQTAQLVVVGSHGR

SEQ ID NO: 132373 - protein, 14 aa, Mycobacterium tuberculosis
QTAQLVVVGSHGRG

SEQ ID NO: 132374 - protein, 14 aa, Mycobacterium tuberculosis
TAQLVVVGSHGRGG

SEQ ID NO: 132375 - protein, 14 aa, Mycobacterium tuberculosis
AQLVVVGSHGRGGF

SEQ ID NO: 132376 - protein, 14 aa, Mycobacterium tuberculosis
QLVVVGSHGRGGFP

SEQ ID NO: 132377 - protein, 14 aa, Mycobacterium tuberculosis
LVVVGSHGRGGFPG

SEQ ID NO: 132378 - protein, 14 aa, Mycobacterium tuberculosis
VVVGSHGRGGFPGM

SEQ ID NO: 132379 - protein, 14 aa, Mycobacterium tuberculosis
VVGSHGRGGFPGMH

SEQ ID NO: 132380 - protein, 14 aa, Mycobacterium tuberculosis
VGSHGRGGFPGMHL

SEQ ID NO: 132381 - protein, 14 aa, Mycobacterium tuberculosis
GSHGRGGFPGMHLG

SEQ ID NO: 132382 - protein, 14 aa, Mycobacterium tuberculosis
SHGRGGFPGMHLGS

SEQ ID NO: 132383 - protein, 14 aa, Mycobacterium tuberculosis
HGRGGFPGMHLGSV

SEQ ID NO: 132384 - protein, 14 aa, Mycobacterium tuberculosis
GRGGFPGMHLGSVS

SEQ ID NO: 132385 - protein, 14 aa, Mycobacterium tuberculosis
RGGFPGMHLGSVSR

SEQ ID NO: 132386 - protein, 14 aa, Mycobacterium tuberculosis
GGFPGMHLGSVSRA

SEQ ID NO: 132387 - protein, 14 aa, Mycobacterium tuberculosis
GFPGMHLGSVSRAV

SEQ ID NO: 132388 - protein, 14 aa, Mycobacterium tuberculosis
FPGMHLGSVSRAVV

SEQ ID NO: 132389 - protein, 14 aa, Mycobacterium tuberculosis
PGMHLGSVSRAVVN

SEQ ID NO: 132390 - protein, 14 aa, Mycobacterium tuberculosis
GMHLGSVSRAVVNS

SEQ ID NO: 132391 - protein, 14 aa, Mycobacterium tuberculosis
MHLGSVSRAVVNSG

SEQ ID NO: 132392 - protein, 14 aa, Mycobacterium tuberculosis
HLGSVSRAVVNSGQ

SEQ ID NO: 132393 - protein, 14 aa, Mycobacterium tuberculosis
LGSVSRAVVNSGQA

SEQ ID NO: 132394 - protein, 14 aa, Mycobacterium tuberculosis
GSVSRAVVNSGQAP

SEQ ID NO: 132395 - protein, 14 aa, Mycobacterium tuberculosis
SVSRAVVNSGQAPV

SEQ ID NO: 132396 - protein, 14 aa, Mycobacterium tuberculosis
VSRAVVNSGQAPVI

SEQ ID NO: 132397 - protein, 14 aa, Mycobacterium tuberculosis
SRAVVNSGQAPVIV

SEQ ID NO: 132398 - protein, 14 aa, Mycobacterium tuberculosis
RAVVNSGQAPVIVA

SEQ ID NO: 132399 - protein, 14 aa, Mycobacterium tuberculosis
AVVNSGQAPVIVAR

SEQ ID NO: 132400 - protein, 14 aa, Mycobacterium tuberculosis
VVNSGQAPVIVARI

SEQ ID NO: 132401 - protein, 14 aa, Mycobacterium tuberculosis
VNSGQAPVIVARIP

SEQ ID NO: 132402 - protein, 14 aa, Mycobacterium tuberculosis
NSGQAPVIVARIPQ

SEQ ID NO: 132403 - protein, 14 aa, Mycobacterium tuberculosis
SGQAPVIVARIPQD

SEQ ID NO: 132404 - protein, 14 aa, Mycobacterium tuberculosis
GQAPVIVARIPQDP

SEQ ID NO: 132405 - protein, 14 aa, Mycobacterium tuberculosis
QAPVIVARIPQDPA

SEQ ID NO: 132406 - protein, 14 aa, Mycobacterium tuberculosis
APVIVARIPQDPAV

SEQ ID NO: 132407 - protein, 14 aa, Mycobacterium tuberculosis
PVIVARIPQDPAVP

SEQ ID NO: 132408 - protein, 14 aa, Mycobacterium tuberculosis
VIVARIPQDPAVPA

SEQ ID NO: 132409 - protein, 15 aa, Mycobacterium tuberculosis
MSAQQTNLGIVVGVD

SEQ ID NO: 132410 - protein, 15 aa, Mycobacterium tuberculosis
SAQQTNLGIVVGVDG

SEQ ID NO: 132411 - protein, 15 aa, Mycobacterium tuberculosis
AQQTNLGIVVGVDGS

SEQ ID NO: 132412 - protein, 15 aa, Mycobacterium tuberculosis
QQTNLGIVVGVDGSP

SEQ ID NO: 132413 - protein, 15 aa, Mycobacterium tuberculosis
QTNLGIVVGVDGSPC

SEQ ID NO: 132414 - protein, 15 aa, Mycobacterium tuberculosis
TNLGIVVGVDGSPCS

SEQ ID NO: 132415 - protein, 15 aa, Mycobacterium tuberculosis
NLGIVVGVDGSPCSH

SEQ ID NO: 132416 - protein, 15 aa, Mycobacterium tuberculosis
LGIVVGVDGSPCSHT

SEQ ID NO: 132417 - protein, 15 aa, Mycobacterium tuberculosis
GIVVGVDGSPCSHTA

SEQ ID NO: 132418 - protein, 15 aa, Mycobacterium tuberculosis
IVVGVDGSPCSHTAV

SEQ ID NO: 132419 - protein, 15 aa, Mycobacterium tuberculosis
VVGVDGSPCSHTAVE

SEQ ID NO: 132420 - protein, 15 aa, Mycobacterium tuberculosis
VGVDGSPCSHTAVEW

SEQ ID NO: 132421 - protein, 15 aa, Mycobacterium tuberculosis
GVDGSPCSHTAVEWA

SEQ ID NO: 132422 - protein, 15 aa, Mycobacterium tuberculosis
VDGSPCSHTAVEWAA

SEQ ID NO: 132423 - protein, 15 aa, Mycobacterium tuberculosis
DGSPCSHTAVEWAAR

SEQ ID NO: 132424 - protein, 15 aa, Mycobacterium tuberculosis
GSPCSHTAVEWAARD

SEQ ID NO: 132425 - protein, 15 aa, Mycobacterium tuberculosis
SPCSHTAVEWAARDA

SEQ ID NO: 132426 - protein, 15 aa, Mycobacterium tuberculosis
PCSHTAVEWAARDAQ

SEQ ID NO: 132427 - protein, 15 aa, Mycobacterium tuberculosis
CSHTAVEWAARDAQM

SEQ ID NO: 132428 - protein, 15 aa, Mycobacterium tuberculosis
SHTAVEWAARDAQMR

SEQ ID NO: 132429 - protein, 15 aa, Mycobacterium tuberculosis
HTAVEWAARDAQMRN

SEQ ID NO: 132430 - protein, 15 aa, Mycobacterium tuberculosis
TAVEWAARDAQMRNV

SEQ ID NO: 132431 - protein, 15 aa, Mycobacterium tuberculosis
AVEWAARDAQMRNVA

SEQ ID NO: 132432 - protein, 15 aa, Mycobacterium tuberculosis
VEWAARDAQMRNVAL

SEQ ID NO: 132433 - protein, 15 aa, Mycobacterium tuberculosis
EWAARDAQMRNVALR

SEQ ID NO: 132434 - protein, 15 aa, Mycobacterium tuberculosis
WAARDAQMRNVALRV

SEQ ID NO: 132435 - protein, 15 aa, Mycobacterium tuberculosis
AARDAQMRNVALRVV

SEQ ID NO: 132436 - protein, 15 aa, Mycobacterium tuberculosis
ARDAQMRNVALRVVQ

SEQ ID NO: 132437 - protein, 15 aa, Mycobacterium tuberculosis
RDAQMRNVALRVVQV

SEQ ID NO: 132438 - protein, 15 aa, Mycobacterium tuberculosis
DAQMRNVALRVVQVV

SEQ ID NO: 132439 - protein, 15 aa, Mycobacterium tuberculosis
AQMRNVALRVVQVVP

SEQ ID NO: 132440 - protein, 15 aa, Mycobacterium tuberculosis
QMRNVALRVVQVVPP

SEQ ID NO: 132441 - protein, 15 aa, Mycobacterium tuberculosis
MRNVALRVVQVVPPV

SEQ ID NO: 132442 - protein, 15 aa, Mycobacterium tuberculosis
RNVALRVVQVVPPVI

SEQ ID NO: 132443 - protein, 15 aa, Mycobacterium tuberculosis
NVALRVVQVVPPVIT

SEQ ID NO: 132444 - protein, 15 aa, Mycobacterium tuberculosis
VALRVVQVVPPVITA

SEQ ID NO: 132445 - protein, 15 aa, Mycobacterium tuberculosis
ALRVVQVVPPVITAP

SEQ ID NO: 132446 - protein, 15 aa, Mycobacterium tuberculosis
LRVVQVVPPVITAPE

SEQ ID NO: 132447 - protein, 15 aa, Mycobacterium tuberculosis
RVVQVVPPVITAPEG

SEQ ID NO: 132448 - protein, 15 aa, Mycobacterium tuberculosis
VVQVVPPVITAPEGW

SEQ ID NO: 132449 - protein, 15 aa, Mycobacterium tuberculosis
VQVVPPVITAPEGWA

SEQ ID NO: 132450 - protein, 15 aa, Mycobacterium tuberculosis
QVVPPVITAPEGWAF

SEQ ID NO: 132451 - protein, 15 aa, Mycobacterium tuberculosis
VVPPVITAPEGWAFE

SEQ ID NO: 132452 - protein, 15 aa, Mycobacterium tuberculosis
VPPVITAPEGWAFEY

SEQ ID NO: 132453 - protein, 15 aa, Mycobacterium tuberculosis
PPVITAPEGWAFEYS

SEQ ID NO: 132454 - protein, 15 aa, Mycobacterium tuberculosis
PVITAPEGWAFEYSR

SEQ ID NO: 132455 - protein, 15 aa, Mycobacterium tuberculosis
VITAPEGWAFEYSRF

SEQ ID NO: 132456 - protein, 15 aa, Mycobacterium tuberculosis
ITAPEGWAFEYSRFQ

SEQ ID NO: 132457 - protein, 15 aa, Mycobacterium tuberculosis
TAPEGWAFEYSRFQE

SEQ ID NO: 132458 - protein, 15 aa, Mycobacterium tuberculosis
APEGWAFEYSRFQEA

SEQ ID NO: 132459 - protein, 15 aa, Mycobacterium tuberculosis
PEGWAFEYSRFQEAQ

SEQ ID NO: 132460 - protein, 15 aa, Mycobacterium tuberculosis
EGWAFEYSRFQEAQK

SEQ ID NO: 132461 - protein, 15 aa, Mycobacterium tuberculosis
GWAFEYSRFQEAQKR

SEQ ID NO: 132462 - protein, 15 aa, Mycobacterium tuberculosis
WAFEYSRFQEAQKRE

SEQ ID NO: 132463 - protein, 15 aa, Mycobacterium tuberculosis
AFEYSRFQEAQKREI

SEQ ID NO: 132464 - protein, 15 aa, Mycobacterium tuberculosis
FEYSRFQEAQKREIV

SEQ ID NO: 132465 - protein, 15 aa, Mycobacterium tuberculosis
EYSRFQEAQKREIVE

SEQ ID NO: 132466 - protein, 15 aa, Mycobacterium tuberculosis
YSRFQEAQKREIVEH

SEQ ID NO: 132467 - protein, 15 aa, Mycobacterium tuberculosis
SRFQEAQKREIVEHS

SEQ ID NO: 132468 - protein, 15 aa, Mycobacterium tuberculosis
RFQEAQKREIVEHSY

SEQ ID NO: 132469 - protein, 15 aa, Mycobacterium tuberculosis
FQEAQKREIVEHSYL

SEQ ID NO: 132470 - protein, 15 aa, Mycobacterium tuberculosis
QEAQKREIVEHSYLV

SEQ ID NO: 132471 - protein, 15 aa, Mycobacterium tuberculosis
EAQKREIVEHSYLVA

SEQ ID NO: 132472 - protein, 15 aa, Mycobacterium tuberculosis
AQKREIVEHSYLVAQ

SEQ ID NO: 132473 - protein, 15 aa, Mycobacterium tuberculosis
QKREIVEHSYLVAQA

SEQ ID NO: 132474 - protein, 15 aa, Mycobacterium tuberculosis
KREIVEHSYLVAQAH

SEQ ID NO: 132475 - protein, 15 aa, Mycobacterium tuberculosis
REIVEHSYLVAQAHQ

SEQ ID NO: 132476 - protein, 15 aa, Mycobacterium tuberculosis
EIVEHSYLVAQAHQI

SEQ ID NO: 132477 - protein, 15 aa, Mycobacterium tuberculosis
IVEHSYLVAQAHQIV

SEQ ID NO: 132478 - protein, 15 aa, Mycobacterium tuberculosis
VEHSYLVAQAHQIVE

SEQ ID NO: 132479 - protein, 15 aa, Mycobacterium tuberculosis
EHSYLVAQAHQIVEQ

SEQ ID NO: 132480 - protein, 15 aa, Mycobacterium tuberculosis
HSYLVAQAHQIVEQA

SEQ ID NO: 132481 - protein, 15 aa, Mycobacterium tuberculosis
SYLVAQAHQIVEQAH

SEQ ID NO: 132482 - protein, 15 aa, Mycobacterium tuberculosis
YLVAQAHQIVEQAHK

SEQ ID NO: 132483 - protein, 15 aa, Mycobacterium tuberculosis
LVAQAHQIVEQAHKV

SEQ ID NO: 132484 - protein, 15 aa, Mycobacterium tuberculosis
VAQAHQIVEQAHKVA

SEQ ID NO: 132485 - protein, 15 aa, Mycobacterium tuberculosis
AQAHQIVEQAHKVAL

SEQ ID NO: 132486 - protein, 15 aa, Mycobacterium tuberculosis
QAHQIVEQAHKVALE

SEQ ID NO: 132487 - protein, 15 aa, Mycobacterium tuberculosis
AHQIVEQAHKVALEA

SEQ ID NO: 132488 - protein, 15 aa, Mycobacterium tuberculosis
HQIVEQAHKVALEAS

SEQ ID NO: 132489 - protein, 15 aa, Mycobacterium tuberculosis
QIVEQAHKVALEASS

SEQ ID NO: 132490 - protein, 15 aa, Mycobacterium tuberculosis
IVEQAHKVALEASSS

SEQ ID NO: 132491 - protein, 15 aa, Mycobacterium tuberculosis
VEQAHKVALEASSSG

SEQ ID NO: 132492 - protein, 15 aa, Mycobacterium tuberculosis
EQAHKVALEASSSGR

SEQ ID NO: 132493 - protein, 15 aa, Mycobacterium tuberculosis
QAHKVALEASSSGRA

SEQ ID NO: 132494 - protein, 15 aa, Mycobacterium tuberculosis
AHKVALEASSSGRAA

SEQ ID NO: 132495 - protein, 15 aa, Mycobacterium tuberculosis
HKVALEASSSGRAAQ

SEQ ID NO: 132496 - protein, 15 aa, Mycobacterium tuberculosis
KVALEASSSGRAAQI

SEQ ID NO: 132497 - protein, 15 aa, Mycobacterium tuberculosis
VALEASSSGRAAQIT

SEQ ID NO: 132498 - protein, 15 aa, Mycobacterium tuberculosis
ALEASSSGRAAQITG

SEQ ID NO: 132499 - protein, 15 aa, Mycobacterium tuberculosis
LEASSSGRAAQITGE

SEQ ID NO: 132500 - protein, 15 aa, Mycobacterium tuberculosis
EASSSGRAAQITGEV

SEQ ID NO: 132501 - protein, 15 aa, Mycobacterium tuberculosis
ASSSGRAAQITGEVL

SEQ ID NO: 132502 - protein, 15 aa, Mycobacterium tuberculosis
SSSGRAAQITGEVLH

SEQ ID NO: 132503 - protein, 15 aa, Mycobacterium tuberculosis
SSGRAAQITGEVLHG

SEQ ID NO: 132504 - protein, 15 aa, Mycobacterium tuberculosis
SGRAAQITGEVLHGQ

SEQ ID NO: 132505 - protein, 15 aa, Mycobacterium tuberculosis
GRAAQITGEVLHGQI

SEQ ID NO: 132506 - protein, 15 aa, Mycobacterium tuberculosis
RAAQITGEVLHGQIV

SEQ ID NO: 132507 - protein, 15 aa, Mycobacterium tuberculosis
AAQITGEVLHGQIVP

SEQ ID NO: 132508 - protein, 15 aa, Mycobacterium tuberculosis
AQITGEVLHGQIVPT

SEQ ID NO: 132509 - protein, 15 aa, Mycobacterium tuberculosis
QITGEVLHGQIVPTL

SEQ ID NO: 132510 - protein, 15 aa, Mycobacterium tuberculosis
ITGEVLHGQIVPTLA

SEQ ID NO: 132511 - protein, 15 aa, Mycobacterium tuberculosis
TGEVLHGQIVPTLAN

SEQ ID NO: 132512 - protein, 15 aa, Mycobacterium tuberculosis
GEVLHGQIVPTLANI

SEQ ID NO: 132513 - protein, 15 aa, Mycobacterium tuberculosis
EVLHGQIVPTLANIS

SEQ ID NO: 132514 - protein, 15 aa, Mycobacterium tuberculosis
VLHGQIVPTLANISR

SEQ ID NO: 132515 - protein, 15 aa, Mycobacterium tuberculosis
LHGQIVPTLANISRQ

SEQ ID NO: 132516 - protein, 15 aa, Mycobacterium tuberculosis
HGQIVPTLANISRQV

SEQ ID NO: 132517 - protein, 15 aa, Mycobacterium tuberculosis
GQIVPTLANISRQVA

SEQ ID NO: 132518 - protein, 15 aa, Mycobacterium tuberculosis
QIVPTLANISRQVAM

SEQ ID NO: 132519 - protein, 15 aa, Mycobacterium tuberculosis
IVPTLANISRQVAMV

SEQ ID NO: 132520 - protein, 15 aa, Mycobacterium tuberculosis
VPTLANISRQVAMVV

SEQ ID NO: 132521 - protein, 15 aa, Mycobacterium tuberculosis
PTLANISRQVAMVVL

SEQ ID NO: 132522 - protein, 15 aa, Mycobacterium tuberculosis
TLANISRQVAMVVLG

SEQ ID NO: 132523 - protein, 15 aa, Mycobacterium tuberculosis
LANISRQVAMVVLGY

SEQ ID NO: 132524 - protein, 15 aa, Mycobacterium tuberculosis
ANISRQVAMVVLGYR

SEQ ID NO: 132525 - protein, 15 aa, Mycobacterium tuberculosis
NISRQVAMVVLGYRG

SEQ ID NO: 132526 - protein, 15 aa, Mycobacterium tuberculosis
ISRQVAMVVLGYRGQ

SEQ ID NO: 132527 - protein, 15 aa, Mycobacterium tuberculosis
SRQVAMVVLGYRGQG

SEQ ID NO: 132528 - protein, 15 aa, Mycobacterium tuberculosis
RQVAMVVLGYRGQGA

SEQ ID NO: 132529 - protein, 15 aa, Mycobacterium tuberculosis
QVAMVVLGYRGQGAV

SEQ ID NO: 132530 - protein, 15 aa, Mycobacterium tuberculosis
VAMVVLGYRGQGAVA

SEQ ID NO: 132531 - protein, 15 aa, Mycobacterium tuberculosis
AMVVLGYRGQGAVAG

SEQ ID NO: 132532 - protein, 15 aa, Mycobacterium tuberculosis
MVVLGYRGQGAVAGA

SEQ ID NO: 132533 - protein, 15 aa, Mycobacterium tuberculosis
VVLGYRGQGAVAGAL

SEQ ID NO: 132534 - protein, 15 aa, Mycobacterium tuberculosis
VLGYRGQGAVAGALL

SEQ ID NO: 132535 - protein, 15 aa, Mycobacterium tuberculosis
LGYRGQGAVAGALLG

SEQ ID NO: 132536 - protein, 15 aa, Mycobacterium tuberculosis
GYRGQGAVAGALLGS

SEQ ID NO: 132537 - protein, 15 aa, Mycobacterium tuberculosis
YRGQGAVAGALLGSV

SEQ ID NO: 132538 - protein, 15 aa, Mycobacterium tuberculosis
RGQGAVAGALLGSVS

SEQ ID NO: 132539 - protein, 15 aa, Mycobacterium tuberculosis
GQGAVAGALLGSVSS

SEQ ID NO: 132540 - protein, 15 aa, Mycobacterium tuberculosis
QGAVAGALLGSVSSS

SEQ ID NO: 132541 - protein, 15 aa, Mycobacterium tuberculosis
GAVAGALLGSVSSSL

SEQ ID NO: 132542 - protein, 15 aa, Mycobacterium tuberculosis
AVAGALLGSVSSSLV

SEQ ID NO: 132543 - protein, 15 aa, Mycobacterium tuberculosis
VAGALLGSVSSSLVR

SEQ ID NO: 132544 - protein, 15 aa, Mycobacterium tuberculosis
AGALLGSVSSSLVRH

SEQ ID NO: 132545 - protein, 15 aa, Mycobacterium tuberculosis
GALLGSVSSSLVRHA

SEQ ID NO: 132546 - protein, 15 aa, Mycobacterium tuberculosis
ALLGSVSSSLVRHAH

SEQ ID NO: 132547 - protein, 15 aa, Mycobacterium tuberculosis
LLGSVSSSLVRHAHG

SEQ ID NO: 132548 - protein, 15 aa, Mycobacterium tuberculosis
LGSVSSSLVRHAHGP

SEQ ID NO: 132549 - protein, 15 aa, Mycobacterium tuberculosis
GSVSSSLVRHAHGPV

SEQ ID NO: 132550 - protein, 15 aa, Mycobacterium tuberculosis
SVSSSLVRHAHGPVA

SEQ ID NO: 132551 - protein, 15 aa, Mycobacterium tuberculosis
VSSSLVRHAHGPVAV

SEQ ID NO: 132552 - protein, 15 aa, Mycobacterium tuberculosis
SSSLVRHAHGPVAVI

SEQ ID NO: 132553 - protein, 15 aa, Mycobacterium tuberculosis
SSLVRHAHGPVAVIP

SEQ ID NO: 132554 - protein, 15 aa, Mycobacterium tuberculosis
SLVRHAHGPVAVIPE

SEQ ID NO: 132555 - protein, 15 aa, Mycobacterium tuberculosis
LVRHAHGPVAVIPEE

SEQ ID NO: 132556 - protein, 15 aa, Mycobacterium tuberculosis
VRHAHGPVAVIPEEP

SEQ ID NO: 132557 - protein, 15 aa, Mycobacterium tuberculosis
RHAHGPVAVIPEEPR

SEQ ID NO: 132558 - protein, 15 aa, Mycobacterium tuberculosis
HAHGPVAVIPEEPRP

SEQ ID NO: 132559 - protein, 15 aa, Mycobacterium tuberculosis
AHGPVAVIPEEPRPA

SEQ ID NO: 132560 - protein, 15 aa, Mycobacterium tuberculosis
HGPVAVIPEEPRPAR

SEQ ID NO: 132561 - protein, 15 aa, Mycobacterium tuberculosis
GPVAVIPEEPRPARP

SEQ ID NO: 132562 - protein, 15 aa, Mycobacterium tuberculosis
PVAVIPEEPRPARPP

SEQ ID NO: 132563 - protein, 15 aa, Mycobacterium tuberculosis
VAVIPEEPRPARPPH

SEQ ID NO: 132564 - protein, 15 aa, Mycobacterium tuberculosis
AVIPEEPRPARPPHA

SEQ ID NO: 132565 - protein, 15 aa, Mycobacterium tuberculosis
VIPEEPRPARPPHAP

SEQ ID NO: 132566 - protein, 15 aa, Mycobacterium tuberculosis
IPEEPRPARPPHAPV

SEQ ID NO: 132567 - protein, 15 aa, Mycobacterium tuberculosis
PEEPRPARPPHAPVV

SEQ ID NO: 132568 - protein, 15 aa, Mycobacterium tuberculosis
EEPRPARPPHAPVVV

SEQ ID NO: 132569 - protein, 15 aa, Mycobacterium tuberculosis
EPRPARPPHAPVVVG

SEQ ID NO: 132570 - protein, 15 aa, Mycobacterium tuberculosis
PRPARPPHAPVVVGI

SEQ ID NO: 132571 - protein, 15 aa, Mycobacterium tuberculosis
RPARPPHAPVVVGID

SEQ ID NO: 132572 - protein, 15 aa, Mycobacterium tuberculosis
PARPPHAPVVVGIDG

SEQ ID NO: 132573 - protein, 15 aa, Mycobacterium tuberculosis
ARPPHAPVVVGIDGS

SEQ ID NO: 132574 - protein, 15 aa, Mycobacterium tuberculosis
RPPHAPVVVGIDGSP

SEQ ID NO: 132575 - protein, 15 aa, Mycobacterium tuberculosis
PPHAPVVVGIDGSPT

SEQ ID NO: 132576 - protein, 15 aa, Mycobacterium tuberculosis
PHAPVVVGIDGSPTS

SEQ ID NO: 132577 - protein, 15 aa, Mycobacterium tuberculosis
HAPVVVGIDGSPTSG

SEQ ID NO: 132578 - protein, 15 aa, Mycobacterium tuberculosis
APVVVGIDGSPTSGL

SEQ ID NO: 132579 - protein, 15 aa, Mycobacterium tuberculosis
PVVVGIDGSPTSGLA

SEQ ID NO: 132580 - protein, 15 aa, Mycobacterium tuberculosis
VVVGIDGSPTSGLAA

SEQ ID NO: 132581 - protein, 15 aa, Mycobacterium tuberculosis
VVGIDGSPTSGLAAE

SEQ ID NO: 132582 - protein, 15 aa, Mycobacterium tuberculosis
VGIDGSPTSGLAAEI

SEQ ID NO: 132583 - protein, 15 aa, Mycobacterium tuberculosis
GIDGSPTSGLAAEIA

SEQ ID NO: 132584 - protein, 15 aa, Mycobacterium tuberculosis
IDGSPTSGLAAEIAF

SEQ ID NO: 132585 - protein, 15 aa, Mycobacterium tuberculosis
DGSPTSGLAAEIAFD

SEQ ID NO: 132586 - protein, 15 aa, Mycobacterium tuberculosis
GSPTSGLAAEIAFDE

SEQ ID NO: 132587 - protein, 15 aa, Mycobacterium tuberculosis
SPTSGLAAEIAFDEA

SEQ ID NO: 132588 - protein, 15 aa, Mycobacterium tuberculosis
PTSGLAAEIAFDEAS

SEQ ID NO: 132589 - protein, 15 aa, Mycobacterium tuberculosis
TSGLAAEIAFDEASR

SEQ ID NO: 132590 - protein, 15 aa, Mycobacterium tuberculosis
SGLAAEIAFDEASRR

SEQ ID NO: 132591 - protein, 15 aa, Mycobacterium tuberculosis
GLAAEIAFDEASRRG

SEQ ID NO: 132592 - protein, 15 aa, Mycobacterium tuberculosis
LAAEIAFDEASRRGV

SEQ ID NO: 132593 - protein, 15 aa, Mycobacterium tuberculosis
AAEIAFDEASRRGVD

SEQ ID NO: 132594 - protein, 15 aa, Mycobacterium tuberculosis
AEIAFDEASRRGVDL

SEQ ID NO: 132595 - protein, 15 aa, Mycobacterium tuberculosis
EIAFDEASRRGVDLV

SEQ ID NO: 132596 - protein, 15 aa, Mycobacterium tuberculosis
IAFDEASRRGVDLVA

SEQ ID NO: 132597 - protein, 15 aa, Mycobacterium tuberculosis
AFDEASRRGVDLVAL

SEQ ID NO: 132598 - protein, 15 aa, Mycobacterium tuberculosis
FDEASRRGVDLVALH

SEQ ID NO: 132599 - protein, 15 aa, Mycobacterium tuberculosis
DEASRRGVDLVALHA

SEQ ID NO: 132600 - protein, 15 aa, Mycobacterium tuberculosis
EASRRGVDLVALHAW

SEQ ID NO: 132601 - protein, 15 aa, Mycobacterium tuberculosis
ASRRGVDLVALHAWS

SEQ ID NO: 132602 - protein, 15 aa, Mycobacterium tuberculosis
SRRGVDLVALHAWSD

SEQ ID NO: 132603 - protein, 15 aa, Mycobacterium tuberculosis
RRGVDLVALHAWSDM

SEQ ID NO: 132604 - protein, 15 aa, Mycobacterium tuberculosis
RGVDLVALHAWSDMG

SEQ ID NO: 132605 - protein, 15 aa, Mycobacterium tuberculosis
GVDLVALHAWSDMGP

SEQ ID NO: 132606 - protein, 15 aa, Mycobacterium tuberculosis
VDLVALHAWSDMGPL

SEQ ID NO: 132607 - protein, 15 aa, Mycobacterium tuberculosis
DLVALHAWSDMGPLD

SEQ ID NO: 132608 - protein, 15 aa, Mycobacterium tuberculosis
LVALHAWSDMGPLDF

SEQ ID NO: 132609 - protein, 15 aa, Mycobacterium tuberculosis
VALHAWSDMGPLDFP

SEQ ID NO: 132610 - protein, 15 aa, Mycobacterium tuberculosis
ALHAWSDMGPLDFPR

SEQ ID NO: 132611 - protein, 15 aa, Mycobacterium tuberculosis
LHAWSDMGPLDFPRL

SEQ ID NO: 132612 - protein, 15 aa, Mycobacterium tuberculosis
HAWSDMGPLDFPRLN

SEQ ID NO: 132613 - protein, 15 aa, Mycobacterium tuberculosis
AWSDMGPLDFPRLNW

SEQ ID NO: 132614 - protein, 15 aa, Mycobacterium tuberculosis
WSDMGPLDFPRLNWA

SEQ ID NO: 132615 - protein, 15 aa, Mycobacterium tuberculosis
SDMGPLDFPRLNWAP

SEQ ID NO: 132616 - protein, 15 aa, Mycobacterium tuberculosis
DMGPLDFPRLNWAPI

SEQ ID NO: 132617 - protein, 15 aa, Mycobacterium tuberculosis
MGPLDFPRLNWAPIE

SEQ ID NO: 132618 - protein, 15 aa, Mycobacterium tuberculosis
GPLDFPRLNWAPIEW

SEQ ID NO: 132619 - protein, 15 aa, Mycobacterium tuberculosis
PLDFPRLNWAPIEWR

SEQ ID NO: 132620 - protein, 15 aa, Mycobacterium tuberculosis
LDFPRLNWAPIEWRN

SEQ ID NO: 132621 - protein, 15 aa, Mycobacterium tuberculosis
DFPRLNWAPIEWRNL

SEQ ID NO: 132622 - protein, 15 aa, Mycobacterium tuberculosis
FPRLNWAPIEWRNLE

SEQ ID NO: 132623 - protein, 15 aa, Mycobacterium tuberculosis
PRLNWAPIEWRNLED

SEQ ID NO: 132624 - protein, 15 aa, Mycobacterium tuberculosis
RLNWAPIEWRNLEDE

SEQ ID NO: 132625 - protein, 15 aa, Mycobacterium tuberculosis
LNWAPIEWRNLEDEQ

SEQ ID NO: 132626 - protein, 15 aa, Mycobacterium tuberculosis
NWAPIEWRNLEDEQE

SEQ ID NO: 132627 - protein, 15 aa, Mycobacterium tuberculosis
WAPIEWRNLEDEQEK

SEQ ID NO: 132628 - protein, 15 aa, Mycobacterium tuberculosis
APIEWRNLEDEQEKM

SEQ ID NO: 132629 - protein, 15 aa, Mycobacterium tuberculosis
PIEWRNLEDEQEKML

SEQ ID NO: 132630 - protein, 15 aa, Mycobacterium tuberculosis
IEWRNLEDEQEKMLA

SEQ ID NO: 132631 - protein, 15 aa, Mycobacterium tuberculosis
EWRNLEDEQEKMLAR

SEQ ID NO: 132632 - protein, 15 aa, Mycobacterium tuberculosis
WRNLEDEQEKMLARR

SEQ ID NO: 132633 - protein, 15 aa, Mycobacterium tuberculosis
RNLEDEQEKMLARRL

SEQ ID NO: 132634 - protein, 15 aa, Mycobacterium tuberculosis
NLEDEQEKMLARRLS

SEQ ID NO: 132635 - protein, 15 aa, Mycobacterium tuberculosis
LEDEQEKMLARRLSG

SEQ ID NO: 132636 - protein, 15 aa, Mycobacterium tuberculosis
EDEQEKMLARRLSGW

SEQ ID NO: 132637 - protein, 15 aa, Mycobacterium tuberculosis
DEQEKMLARRLSGWQ

SEQ ID NO: 132638 - protein, 15 aa, Mycobacterium tuberculosis
EQEKMLARRLSGWQD

SEQ ID NO: 132639 - protein, 15 aa, Mycobacterium tuberculosis
QEKMLARRLSGWQDR

SEQ ID NO: 132640 - protein, 15 aa, Mycobacterium tuberculosis
EKMLARRLSGWQDRY

SEQ ID NO: 132641 - protein, 15 aa, Mycobacterium tuberculosis
KMLARRLSGWQDRYP

SEQ ID NO: 132642 - protein, 15 aa, Mycobacterium tuberculosis
MLARRLSGWQDRYPD

SEQ ID NO: 132643 - protein, 15 aa, Mycobacterium tuberculosis
LARRLSGWQDRYPDV

SEQ ID NO: 132644 - protein, 15 aa, Mycobacterium tuberculosis
ARRLSGWQDRYPDVV

SEQ ID NO: 132645 - protein, 15 aa, Mycobacterium tuberculosis
RRLSGWQDRYPDVVV

SEQ ID NO: 132646 - protein, 15 aa, Mycobacterium tuberculosis
RLSGWQDRYPDVVVH

SEQ ID NO: 132647 - protein, 15 aa, Mycobacterium tuberculosis
LSGWQDRYPDVVVHK

SEQ ID NO: 132648 - protein, 15 aa, Mycobacterium tuberculosis
SGWQDRYPDVVVHKV

SEQ ID NO: 132649 - protein, 15 aa, Mycobacterium tuberculosis
GWQDRYPDVVVHKVV

SEQ ID NO: 132650 - protein, 15 aa, Mycobacterium tuberculosis
WQDRYPDVVVHKVVV

SEQ ID NO: 132651 - protein, 15 aa, Mycobacterium tuberculosis
QDRYPDVVVHKVVVC

SEQ ID NO: 132652 - protein, 15 aa, Mycobacterium tuberculosis
DRYPDVVVHKVVVCD

SEQ ID NO: 132653 - protein, 15 aa, Mycobacterium tuberculosis
RYPDVVVHKVVVCDR

SEQ ID NO: 132654 - protein, 15 aa, Mycobacterium tuberculosis
YPDVVVHKVVVCDRP

SEQ ID NO: 132655 - protein, 15 aa, Mycobacterium tuberculosis
PDVVVHKVVVCDRPA

SEQ ID NO: 132656 - protein, 15 aa, Mycobacterium tuberculosis
DVVVHKVVVCDRPAP

SEQ ID NO: 132657 - protein, 15 aa, Mycobacterium tuberculosis
VVVHKVVVCDRPAPR

SEQ ID NO: 132658 - protein, 15 aa, Mycobacterium tuberculosis
VVHKVVVCDRPAPRL

SEQ ID NO: 132659 - protein, 15 aa, Mycobacterium tuberculosis
VHKVVVCDRPAPRLL

SEQ ID NO: 132660 - protein, 15 aa, Mycobacterium tuberculosis
HKVVVCDRPAPRLLE

SEQ ID NO: 132661 - protein, 15 aa, Mycobacterium tuberculosis
KVVVCDRPAPRLLEL

SEQ ID NO: 132662 - protein, 15 aa, Mycobacterium tuberculosis
VVVCDRPAPRLLELA

SEQ ID NO: 132663 - protein, 15 aa, Mycobacterium tuberculosis
VVCDRPAPRLLELAQ

SEQ ID NO: 132664 - protein, 15 aa, Mycobacterium tuberculosis
VCDRPAPRLLELAQT

SEQ ID NO: 132665 - protein, 15 aa, Mycobacterium tuberculosis
CDRPAPRLLELAQTA

SEQ ID NO: 132666 - protein, 15 aa, Mycobacterium tuberculosis
DRPAPRLLELAQTAQ

SEQ ID NO: 132667 - protein, 15 aa, Mycobacterium tuberculosis
RPAPRLLELAQTAQL

SEQ ID NO: 132668 - protein, 15 aa, Mycobacterium tuberculosis
PAPRLLELAQTAQLV

SEQ ID NO: 132669 - protein, 15 aa, Mycobacterium tuberculosis
APRLLELAQTAQLVV

SEQ ID NO: 132670 - protein, 15 aa, Mycobacterium tuberculosis
PRLLELAQTAQLVVV

SEQ ID NO: 132671 - protein, 15 aa, Mycobacterium tuberculosis
RLLELAQTAQLVVVG

SEQ ID NO: 132672 - protein, 15 aa, Mycobacterium tuberculosis
LLELAQTAQLVVVGS

SEQ ID NO: 132673 - protein, 15 aa, Mycobacterium tuberculosis
LELAQTAQLVVVGSH

SEQ ID NO: 132674 - protein, 15 aa, Mycobacterium tuberculosis
ELAQTAQLVVVGSHG

SEQ ID NO: 132675 - protein, 15 aa, Mycobacterium tuberculosis
LAQTAQLVVVGSHGR

SEQ ID NO: 132676 - protein, 15 aa, Mycobacterium tuberculosis
AQTAQLVVVGSHGRG

SEQ ID NO: 132677 - protein, 15 aa, Mycobacterium tuberculosis
QTAQLVVVGSHGRGG

SEQ ID NO: 132678 - protein, 15 aa, Mycobacterium tuberculosis
TAQLVVVGSHGRGGF

SEQ ID NO: 132679 - protein, 15 aa, Mycobacterium tuberculosis
AQLVVVGSHGRGGFP

SEQ ID NO: 132680 - protein, 15 aa, Mycobacterium tuberculosis
QLVVVGSHGRGGFPG

SEQ ID NO: 132681 - protein, 15 aa, Mycobacterium tuberculosis
LVVVGSHGRGGFPGM

SEQ ID NO: 132682 - protein, 15 aa, Mycobacterium tuberculosis
VVVGSHGRGGFPGMH

SEQ ID NO: 132683 - protein, 15 aa, Mycobacterium tuberculosis
VVGSHGRGGFPGMHL

SEQ ID NO: 132684 - protein, 15 aa, Mycobacterium tuberculosis
VGSHGRGGFPGMHLG

SEQ ID NO: 132685 - protein, 15 aa, Mycobacterium tuberculosis
GSHGRGGFPGMHLGS

SEQ ID NO: 132686 - protein, 15 aa, Mycobacterium tuberculosis
SHGRGGFPGMHLGSV

SEQ ID NO: 132687 - protein, 15 aa, Mycobacterium tuberculosis
HGRGGFPGMHLGSVS

SEQ ID NO: 132688 - protein, 15 aa, Mycobacterium tuberculosis
GRGGFPGMHLGSVSR

SEQ ID NO: 132689 - protein, 15 aa, Mycobacterium tuberculosis
RGGFPGMHLGSVSRA

SEQ ID NO: 132690 - protein, 15 aa, Mycobacterium tuberculosis
GGFPGMHLGSVSRAV

SEQ ID NO: 132691 - protein, 15 aa, Mycobacterium tuberculosis
GFPGMHLGSVSRAVV

SEQ ID NO: 132692 - protein, 15 aa, Mycobacterium tuberculosis
FPGMHLGSVSRAVVN

SEQ ID NO: 132693 - protein, 15 aa, Mycobacterium tuberculosis
PGMHLGSVSRAVVNS

SEQ ID NO: 132694 - protein, 15 aa, Mycobacterium tuberculosis
GMHLGSVSRAVVNSG

SEQ ID NO: 132695 - protein, 15 aa, Mycobacterium tuberculosis
MHLGSVSRAVVNSGQ

SEQ ID NO: 132696 - protein, 15 aa, Mycobacterium tuberculosis
HLGSVSRAVVNSGQA

SEQ ID NO: 132697 - protein, 15 aa, Mycobacterium tuberculosis
LGSVSRAVVNSGQAP

SEQ ID NO: 132698 - protein, 15 aa, Mycobacterium tuberculosis
GSVSRAVVNSGQAPV

SEQ ID NO: 132699 - protein, 15 aa, Mycobacterium tuberculosis
SVSRAVVNSGQAPVI

SEQ ID NO: 132700 - protein, 15 aa, Mycobacterium tuberculosis
VSRAVVNSGQAPVIV

SEQ ID NO: 132701 - protein, 15 aa, Mycobacterium tuberculosis
SRAVVNSGQAPVIVA

SEQ ID NO: 132702 - protein, 15 aa, Mycobacterium tuberculosis
RAVVNSGQAPVIVAR

SEQ ID NO: 132703 - protein, 15 aa, Mycobacterium tuberculosis
AVVNSGQAPVIVARI

SEQ ID NO: 132704 - protein, 15 aa, Mycobacterium tuberculosis
VVNSGQAPVIVARIP

SEQ ID NO: 132705 - protein, 15 aa, Mycobacterium tuberculosis
VNSGQAPVIVARIPQ

SEQ ID NO: 132706 - protein, 15 aa, Mycobacterium tuberculosis
NSGQAPVIVARIPQD

SEQ ID NO: 132707 - protein, 15 aa, Mycobacterium tuberculosis
SGQAPVIVARIPQDP

SEQ ID NO: 132708 - protein, 15 aa, Mycobacterium tuberculosis
GQAPVIVARIPQDPA

SEQ ID NO: 132709 - protein, 15 aa, Mycobacterium tuberculosis
QAPVIVARIPQDPAV

SEQ ID NO: 132710 - protein, 15 aa, Mycobacterium tuberculosis
APVIVARIPQDPAVP

SEQ ID NO: 132711 - protein, 15 aa, Mycobacterium tuberculosis
PVIVARIPQDPAVPA

SEQ ID NO: 132712 - protein, 16 aa, Mycobacterium tuberculosis
MSAQQTNLGIVVGVDG

SEQ ID NO: 132713 - protein, 16 aa, Mycobacterium tuberculosis
SAQQTNLGIVVGVDGS

SEQ ID NO: 132714 - protein, 16 aa, Mycobacterium tuberculosis
AQQTNLGIVVGVDGSP

SEQ ID NO: 132715 - protein, 16 aa, Mycobacterium tuberculosis
QQTNLGIVVGVDGSPC

SEQ ID NO: 132716 - protein, 16 aa, Mycobacterium tuberculosis
QTNLGIVVGVDGSPCS

SEQ ID NO: 132717 - protein, 16 aa, Mycobacterium tuberculosis
TNLGIVVGVDGSPCSH

SEQ ID NO: 132718 - protein, 16 aa, Mycobacterium tuberculosis
NLGIVVGVDGSPCSHT

SEQ ID NO: 132719 - protein, 16 aa, Mycobacterium tuberculosis
LGIVVGVDGSPCSHTA

SEQ ID NO: 132720 - protein, 16 aa, Mycobacterium tuberculosis
GIVVGVDGSPCSHTAV

SEQ ID NO: 132721 - protein, 16 aa, Mycobacterium tuberculosis
IVVGVDGSPCSHTAVE

SEQ ID NO: 132722 - protein, 16 aa, Mycobacterium tuberculosis
VVGVDGSPCSHTAVEW

SEQ ID NO: 132723 - protein, 16 aa, Mycobacterium tuberculosis
VGVDGSPCSHTAVEWA

SEQ ID NO: 132724 - protein, 16 aa, Mycobacterium tuberculosis
GVDGSPCSHTAVEWAA

SEQ ID NO: 132725 - protein, 16 aa, Mycobacterium tuberculosis
VDGSPCSHTAVEWAAR

SEQ ID NO: 132726 - protein, 16 aa, Mycobacterium tuberculosis
DGSPCSHTAVEWAARD

SEQ ID NO: 132727 - protein, 16 aa, Mycobacterium tuberculosis
GSPCSHTAVEWAARDA

SEQ ID NO: 132728 - protein, 16 aa, Mycobacterium tuberculosis
SPCSHTAVEWAARDAQ

SEQ ID NO: 132729 - protein, 16 aa, Mycobacterium tuberculosis
PCSHTAVEWAARDAQM

SEQ ID NO: 132730 - protein, 16 aa, Mycobacterium tuberculosis
CSHTAVEWAARDAQMR

SEQ ID NO: 132731 - protein, 16 aa, Mycobacterium tuberculosis
SHTAVEWAARDAQMRN

SEQ ID NO: 132732 - protein, 16 aa, Mycobacterium tuberculosis
HTAVEWAARDAQMRNV

SEQ ID NO: 132733 - protein, 16 aa, Mycobacterium tuberculosis
TAVEWAARDAQMRNVA

SEQ ID NO: 132734 - protein, 16 aa, Mycobacterium tuberculosis
AVEWAARDAQMRNVAL

SEQ ID NO: 132735 - protein, 16 aa, Mycobacterium tuberculosis
VEWAARDAQMRNVALR

SEQ ID NO: 132736 - protein, 16 aa, Mycobacterium tuberculosis
EWAARDAQMRNVALRV

SEQ ID NO: 132737 - protein, 16 aa, Mycobacterium tuberculosis
WAARDAQMRNVALRVV

SEQ ID NO: 132738 - protein, 16 aa, Mycobacterium tuberculosis
AARDAQMRNVALRVVQ

SEQ ID NO: 132739 - protein, 16 aa, Mycobacterium tuberculosis
ARDAQMRNVALRVVQV

SEQ ID NO: 132740 - protein, 16 aa, Mycobacterium tuberculosis
RDAQMRNVALRVVQVV

SEQ ID NO: 132741 - protein, 16 aa, Mycobacterium tuberculosis
DAQMRNVALRVVQVVP

SEQ ID NO: 132742 - protein, 16 aa, Mycobacterium tuberculosis
AQMRNVALRVVQVVPP

SEQ ID NO: 132743 - protein, 16 aa, Mycobacterium tuberculosis
QMRNVALRVVQVVPPV

SEQ ID NO: 132744 - protein, 16 aa, Mycobacterium tuberculosis
MRNVALRVVQVVPPVI

SEQ ID NO: 132745 - protein, 16 aa, Mycobacterium tuberculosis
RNVALRVVQVVPPVIT

SEQ ID NO: 132746 - protein, 16 aa, Mycobacterium tuberculosis
NVALRVVQVVPPVITA

SEQ ID NO: 132747 - protein, 16 aa, Mycobacterium tuberculosis
VALRVVQVVPPVITAP

SEQ ID NO: 132748 - protein, 16 aa, Mycobacterium tuberculosis
ALRVVQVVPPVITAPE

SEQ ID NO: 132749 - protein, 16 aa, Mycobacterium tuberculosis
LRVVQVVPPVITAPEG

SEQ ID NO: 132750 - protein, 16 aa, Mycobacterium tuberculosis
RVVQVVPPVITAPEGW

SEQ ID NO: 132751 - protein, 16 aa, Mycobacterium tuberculosis
VVQVVPPVITAPEGWA

SEQ ID NO: 132752 - protein, 16 aa, Mycobacterium tuberculosis
VQVVPPVITAPEGWAF

SEQ ID NO: 132753 - protein, 16 aa, Mycobacterium tuberculosis
QVVPPVITAPEGWAFE

SEQ ID NO: 132754 - protein, 16 aa, Mycobacterium tuberculosis
VVPPVITAPEGWAFEY

SEQ ID NO: 132755 - protein, 16 aa, Mycobacterium tuberculosis
VPPVITAPEGWAFEYS

SEQ ID NO: 132756 - protein, 16 aa, Mycobacterium tuberculosis
PPVITAPEGWAFEYSR

SEQ ID NO: 132757 - protein, 16 aa, Mycobacterium tuberculosis
PVITAPEGWAFEYSRF

SEQ ID NO: 132758 - protein, 16 aa, Mycobacterium tuberculosis
VITAPEGWAFEYSRFQ

SEQ ID NO: 132759 - protein, 16 aa, Mycobacterium tuberculosis
ITAPEGWAFEYSRFQE

SEQ ID NO: 132760 - protein, 16 aa, Mycobacterium tuberculosis
TAPEGWAFEYSRFQEA

SEQ ID NO: 132761 - protein, 16 aa, Mycobacterium tuberculosis
APEGWAFEYSRFQEAQ

SEQ ID NO: 132762 - protein, 16 aa, Mycobacterium tuberculosis
PEGWAFEYSRFQEAQK

SEQ ID NO: 132763 - protein, 16 aa, Mycobacterium tuberculosis
EGWAFEYSRFQEAQKR

SEQ ID NO: 132764 - protein, 16 aa, Mycobacterium tuberculosis
GWAFEYSRFQEAQKRE

SEQ ID NO: 132765 - protein, 16 aa, Mycobacterium tuberculosis
WAFEYSRFQEAQKREI

SEQ ID NO: 132766 - protein, 16 aa, Mycobacterium tuberculosis
AFEYSRFQEAQKREIV

SEQ ID NO: 132767 - protein, 16 aa, Mycobacterium tuberculosis
FEYSRFQEAQKREIVE

SEQ ID NO: 132768 - protein, 16 aa, Mycobacterium tuberculosis
EYSRFQEAQKREIVEH

SEQ ID NO: 132769 - protein, 16 aa, Mycobacterium tuberculosis
YSRFQEAQKREIVEHS

SEQ ID NO: 132770 - protein, 16 aa, Mycobacterium tuberculosis
SRFQEAQKREIVEHSY

SEQ ID NO: 132771 - protein, 16 aa, Mycobacterium tuberculosis
RFQEAQKREIVEHSYL

SEQ ID NO: 132772 - protein, 16 aa, Mycobacterium tuberculosis
FQEAQKREIVEHSYLV

SEQ ID NO: 132773 - protein, 16 aa, Mycobacterium tuberculosis
QEAQKREIVEHSYLVA

SEQ ID NO: 132774 - protein, 16 aa, Mycobacterium tuberculosis
EAQKREIVEHSYLVAQ

SEQ ID NO: 132775 - protein, 16 aa, Mycobacterium tuberculosis
AQKREIVEHSYLVAQA

SEQ ID NO: 132776 - protein, 16 aa, Mycobacterium tuberculosis
QKREIVEHSYLVAQAH

SEQ ID NO: 132777 - protein, 16 aa, Mycobacterium tuberculosis
KREIVEHSYLVAQAHQ

SEQ ID NO: 132778 - protein, 16 aa, Mycobacterium tuberculosis
REIVEHSYLVAQAHQI

SEQ ID NO: 132779 - protein, 16 aa, Mycobacterium tuberculosis
EIVEHSYLVAQAHQIV

SEQ ID NO: 132780 - protein, 16 aa, Mycobacterium tuberculosis
IVEHSYLVAQAHQIVE

SEQ ID NO: 132781 - protein, 16 aa, Mycobacterium tuberculosis
VEHSYLVAQAHQIVEQ

SEQ ID NO: 132782 - protein, 16 aa, Mycobacterium tuberculosis
EHSYLVAQAHQIVEQA

SEQ ID NO: 132783 - protein, 16 aa, Mycobacterium tuberculosis
HSYLVAQAHQIVEQAH

SEQ ID NO: 132784 - protein, 16 aa, Mycobacterium tuberculosis
SYLVAQAHQIVEQAHK

SEQ ID NO: 132785 - protein, 16 aa, Mycobacterium tuberculosis
YLVAQAHQIVEQAHKV

SEQ ID NO: 132786 - protein, 16 aa, Mycobacterium tuberculosis
LVAQAHQIVEQAHKVA

SEQ ID NO: 132787 - protein, 16 aa, Mycobacterium tuberculosis
VAQAHQIVEQAHKVAL

SEQ ID NO: 132788 - protein, 16 aa, Mycobacterium tuberculosis
AQAHQIVEQAHKVALE

SEQ ID NO: 132789 - protein, 16 aa, Mycobacterium tuberculosis
QAHQIVEQAHKVALEA

SEQ ID NO: 132790 - protein, 16 aa, Mycobacterium tuberculosis
AHQIVEQAHKVALEAS

SEQ ID NO: 132791 - protein, 16 aa, Mycobacterium tuberculosis
HQIVEQAHKVALEASS

SEQ ID NO: 132792 - protein, 16 aa, Mycobacterium tuberculosis
QIVEQAHKVALEASSS

SEQ ID NO: 132793 - protein, 16 aa, Mycobacterium tuberculosis
IVEQAHKVALEASSSG

SEQ ID NO: 132794 - protein, 16 aa, Mycobacterium tuberculosis
VEQAHKVALEASSSGR

SEQ ID NO: 132795 - protein, 16 aa, Mycobacterium tuberculosis
EQAHKVALEASSSGRA

SEQ ID NO: 132796 - protein, 16 aa, Mycobacterium tuberculosis
QAHKVALEASSSGRAA

SEQ ID NO: 132797 - protein, 16 aa, Mycobacterium tuberculosis
AHKVALEASSSGRAAQ

SEQ ID NO: 132798 - protein, 16 aa, Mycobacterium tuberculosis
HKVALEASSSGRAAQI

SEQ ID NO: 132799 - protein, 16 aa, Mycobacterium tuberculosis
KVALEASSSGRAAQIT

SEQ ID NO: 132800 - protein, 16 aa, Mycobacterium tuberculosis
VALEASSSGRAAQITG

SEQ ID NO: 132801 - protein, 16 aa, Mycobacterium tuberculosis
ALEASSSGRAAQITGE

SEQ ID NO: 132802 - protein, 16 aa, Mycobacterium tuberculosis
LEASSSGRAAQITGEV

SEQ ID NO: 132803 - protein, 16 aa, Mycobacterium tuberculosis
EASSSGRAAQITGEVL

SEQ ID NO: 132804 - protein, 16 aa, Mycobacterium tuberculosis
ASSSGRAAQITGEVLH

SEQ ID NO: 132805 - protein, 16 aa, Mycobacterium tuberculosis
SSSGRAAQITGEVLHG

SEQ ID NO: 132806 - protein, 16 aa, Mycobacterium tuberculosis
SSGRAAQITGEVLHGQ

SEQ ID NO: 132807 - protein, 16 aa, Mycobacterium tuberculosis
SGRAAQITGEVLHGQI

SEQ ID NO: 132808 - protein, 16 aa, Mycobacterium tuberculosis
GRAAQITGEVLHGQIV

SEQ ID NO: 132809 - protein, 16 aa, Mycobacterium tuberculosis
RAAQITGEVLHGQIVP

SEQ ID NO: 132810 - protein, 16 aa, Mycobacterium tuberculosis
AAQITGEVLHGQIVPT

SEQ ID NO: 132811 - protein, 16 aa, Mycobacterium tuberculosis
AQITGEVLHGQIVPTL

SEQ ID NO: 132812 - protein, 16 aa, Mycobacterium tuberculosis
QITGEVLHGQIVPTLA

SEQ ID NO: 132813 - protein, 16 aa, Mycobacterium tuberculosis
ITGEVLHGQIVPTLAN

SEQ ID NO: 132814 - protein, 16 aa, Mycobacterium tuberculosis
TGEVLHGQIVPTLANI

SEQ ID NO: 132815 - protein, 16 aa, Mycobacterium tuberculosis
GEVLHGQIVPTLANIS

SEQ ID NO: 132816 - protein, 16 aa, Mycobacterium tuberculosis
EVLHGQIVPTLANISR

SEQ ID NO: 132817 - protein, 16 aa, Mycobacterium tuberculosis
VLHGQIVPTLANISRQ

SEQ ID NO: 132818 - protein, 16 aa, Mycobacterium tuberculosis
LHGQIVPTLANISRQV

SEQ ID NO: 132819 - protein, 16 aa, Mycobacterium tuberculosis
HGQIVPTLANISRQVA

SEQ ID NO: 132820 - protein, 16 aa, Mycobacterium tuberculosis
GQIVPTLANISRQVAM

SEQ ID NO: 132821 - protein, 16 aa, Mycobacterium tuberculosis
QIVPTLANISRQVAMV

SEQ ID NO: 132822 - protein, 16 aa, Mycobacterium tuberculosis
IVPTLANISRQVAMVV

SEQ ID NO: 132823 - protein, 16 aa, Mycobacterium tuberculosis
VPTLANISRQVAMVVL

SEQ ID NO: 132824 - protein, 16 aa, Mycobacterium tuberculosis
PTLANISRQVAMVVLG

SEQ ID NO: 132825 - protein, 16 aa, Mycobacterium tuberculosis
TLANISRQVAMVVLGY

SEQ ID NO: 132826 - protein, 16 aa, Mycobacterium tuberculosis
LANISRQVAMVVLGYR

SEQ ID NO: 132827 - protein, 16 aa, Mycobacterium tuberculosis
ANISRQVAMVVLGYRG

SEQ ID NO: 132828 - protein, 16 aa, Mycobacterium tuberculosis
NISRQVAMVVLGYRGQ

SEQ ID NO: 132829 - protein, 16 aa, Mycobacterium tuberculosis
ISRQVAMVVLGYRGQG

SEQ ID NO: 132830 - protein, 16 aa, Mycobacterium tuberculosis
SRQVAMVVLGYRGQGA

SEQ ID NO: 132831 - protein, 16 aa, Mycobacterium tuberculosis
RQVAMVVLGYRGQGAV

SEQ ID NO: 132832 - protein, 16 aa, Mycobacterium tuberculosis
QVAMVVLGYRGQGAVA

SEQ ID NO: 132833 - protein, 16 aa, Mycobacterium tuberculosis
VAMVVLGYRGQGAVAG

SEQ ID NO: 132834 - protein, 16 aa, Mycobacterium tuberculosis
AMVVLGYRGQGAVAGA

SEQ ID NO: 132835 - protein, 16 aa, Mycobacterium tuberculosis
MVVLGYRGQGAVAGAL

SEQ ID NO: 132836 - protein, 16 aa, Mycobacterium tuberculosis
VVLGYRGQGAVAGALL

SEQ ID NO: 132837 - protein, 16 aa, Mycobacterium tuberculosis
VLGYRGQGAVAGALLG

SEQ ID NO: 132838 - protein, 16 aa, Mycobacterium tuberculosis
LGYRGQGAVAGALLGS

SEQ ID NO: 132839 - protein, 16 aa, Mycobacterium tuberculosis
GYRGQGAVAGALLGSV

SEQ ID NO: 132840 - protein, 16 aa, Mycobacterium tuberculosis
YRGQGAVAGALLGSVS

SEQ ID NO: 132841 - protein, 16 aa, Mycobacterium tuberculosis
RGQGAVAGALLGSVSS

SEQ ID NO: 132842 - protein, 16 aa, Mycobacterium tuberculosis
GQGAVAGALLGSVSSS

SEQ ID NO: 132843 - protein, 16 aa, Mycobacterium tuberculosis
QGAVAGALLGSVSSSL

SEQ ID NO: 132844 - protein, 16 aa, Mycobacterium tuberculosis
GAVAGALLGSVSSSLV

SEQ ID NO: 132845 - protein, 16 aa, Mycobacterium tuberculosis
AVAGALLGSVSSSLVR

SEQ ID NO: 132846 - protein, 16 aa, Mycobacterium tuberculosis
VAGALLGSVSSSLVRH

SEQ ID NO: 132847 - protein, 16 aa, Mycobacterium tuberculosis
AGALLGSVSSSLVRHA

SEQ ID NO: 132848 - protein, 16 aa, Mycobacterium tuberculosis
GALLGSVSSSLVRHAH

SEQ ID NO: 132849 - protein, 16 aa, Mycobacterium tuberculosis
ALLGSVSSSLVRHAHG

SEQ ID NO: 132850 - protein, 16 aa, Mycobacterium tuberculosis
LLGSVSSSLVRHAHGP

SEQ ID NO: 132851 - protein, 16 aa, Mycobacterium tuberculosis
LGSVSSSLVRHAHGPV

SEQ ID NO: 132852 - protein, 16 aa, Mycobacterium tuberculosis
GSVSSSLVRHAHGPVA

SEQ ID NO: 132853 - protein, 16 aa, Mycobacterium tuberculosis
SVSSSLVRHAHGPVAV

SEQ ID NO: 132854 - protein, 16 aa, Mycobacterium tuberculosis
VSSSLVRHAHGPVAVI

SEQ ID NO: 132855 - protein, 16 aa, Mycobacterium tuberculosis
SSSLVRHAHGPVAVIP

SEQ ID NO: 132856 - protein, 16 aa, Mycobacterium tuberculosis
SSLVRHAHGPVAVIPE

SEQ ID NO: 132857 - protein, 16 aa, Mycobacterium tuberculosis
SLVRHAHGPVAVIPEE

SEQ ID NO: 132858 - protein, 16 aa, Mycobacterium tuberculosis
LVRHAHGPVAVIPEEP

SEQ ID NO: 132859 - protein, 16 aa, Mycobacterium tuberculosis
VRHAHGPVAVIPEEPR

SEQ ID NO: 132860 - protein, 16 aa, Mycobacterium tuberculosis
RHAHGPVAVIPEEPRP

SEQ ID NO: 132861 - protein, 16 aa, Mycobacterium tuberculosis
HAHGPVAVIPEEPRPA

SEQ ID NO: 132862 - protein, 16 aa, Mycobacterium tuberculosis
AHGPVAVIPEEPRPAR

SEQ ID NO: 132863 - protein, 16 aa, Mycobacterium tuberculosis
HGPVAVIPEEPRPARP

SEQ ID NO: 132864 - protein, 16 aa, Mycobacterium tuberculosis
GPVAVIPEEPRPARPP

SEQ ID NO: 132865 - protein, 16 aa, Mycobacterium tuberculosis
PVAVIPEEPRPARPPH

SEQ ID NO: 132866 - protein, 16 aa, Mycobacterium tuberculosis
VAVIPEEPRPARPPHA

SEQ ID NO: 132867 - protein, 16 aa, Mycobacterium tuberculosis
AVIPEEPRPARPPHAP

SEQ ID NO: 132868 - protein, 16 aa, Mycobacterium tuberculosis
VIPEEPRPARPPHAPV

SEQ ID NO: 132869 - protein, 16 aa, Mycobacterium tuberculosis
IPEEPRPARPPHAPVV

SEQ ID NO: 132870 - protein, 16 aa, Mycobacterium tuberculosis
PEEPRPARPPHAPVVV

SEQ ID NO: 132871 - protein, 16 aa, Mycobacterium tuberculosis
EEPRPARPPHAPVVVG

SEQ ID NO: 132872 - protein, 16 aa, Mycobacterium tuberculosis
EPRPARPPHAPVVVGI

SEQ ID NO: 132873 - protein, 16 aa, Mycobacterium tuberculosis
PRPARPPHAPVVVGID

SEQ ID NO: 132874 - protein, 16 aa, Mycobacterium tuberculosis
RPARPPHAPVVVGIDG

SEQ ID NO: 132875 - protein, 16 aa, Mycobacterium tuberculosis
PARPPHAPVVVGIDGS

SEQ ID NO: 132876 - protein, 16 aa, Mycobacterium tuberculosis
ARPPHAPVVVGIDGSP

SEQ ID NO: 132877 - protein, 16 aa, Mycobacterium tuberculosis
RPPHAPVVVGIDGSPT

SEQ ID NO: 132878 - protein, 16 aa, Mycobacterium tuberculosis
PPHAPVVVGIDGSPTS

SEQ ID NO: 132879 - protein, 16 aa, Mycobacterium tuberculosis
PHAPVVVGIDGSPTSG

SEQ ID NO: 132880 - protein, 16 aa, Mycobacterium tuberculosis
HAPVVVGIDGSPTSGL

SEQ ID NO: 132881 - protein, 16 aa, Mycobacterium tuberculosis
APVVVGIDGSPTSGLA

SEQ ID NO: 132882 - protein, 16 aa, Mycobacterium tuberculosis
PVVVGIDGSPTSGLAA

SEQ ID NO: 132883 - protein, 16 aa, Mycobacterium tuberculosis
VVVGIDGSPTSGLAAE

SEQ ID NO: 132884 - protein, 16 aa, Mycobacterium tuberculosis
VVGIDGSPTSGLAAEI

SEQ ID NO: 132885 - protein, 16 aa, Mycobacterium tuberculosis
VGIDGSPTSGLAAEIA

SEQ ID NO: 132886 - protein, 16 aa, Mycobacterium tuberculosis
GIDGSPTSGLAAEIAF

SEQ ID NO: 132887 - protein, 16 aa, Mycobacterium tuberculosis
IDGSPTSGLAAEIAFD

SEQ ID NO: 132888 - protein, 16 aa, Mycobacterium tuberculosis
DGSPTSGLAAEIAFDE

SEQ ID NO: 132889 - protein, 16 aa, Mycobacterium tuberculosis
GSPTSGLAAEIAFDEA

SEQ ID NO: 132890 - protein, 16 aa, Mycobacterium tuberculosis
SPTSGLAAEIAFDEAS

SEQ ID NO: 132891 - protein, 16 aa, Mycobacterium tuberculosis
PTSGLAAEIAFDEASR

SEQ ID NO: 132892 - protein, 16 aa, Mycobacterium tuberculosis
TSGLAAEIAFDEASRR

SEQ ID NO: 132893 - protein, 16 aa, Mycobacterium tuberculosis
SGLAAEIAFDEASRRG

SEQ ID NO: 132894 - protein, 16 aa, Mycobacterium tuberculosis
GLAAEIAFDEASRRGV

SEQ ID NO: 132895 - protein, 16 aa, Mycobacterium tuberculosis
LAAEIAFDEASRRGVD

SEQ ID NO: 132896 - protein, 16 aa, Mycobacterium tuberculosis
AAEIAFDEASRRGVDL

SEQ ID NO: 132897 - protein, 16 aa, Mycobacterium tuberculosis
AEIAFDEASRRGVDLV

SEQ ID NO: 132898 - protein, 16 aa, Mycobacterium tuberculosis
EIAFDEASRRGVDLVA

SEQ ID NO: 132899 - protein, 16 aa, Mycobacterium tuberculosis
IAFDEASRRGVDLVAL

SEQ ID NO: 132900 - protein, 16 aa, Mycobacterium tuberculosis
AFDEASRRGVDLVALH

SEQ ID NO: 132901 - protein, 16 aa, Mycobacterium tuberculosis
FDEASRRGVDLVALHA

SEQ ID NO: 132902 - protein, 16 aa, Mycobacterium tuberculosis
DEASRRGVDLVALHAW

SEQ ID NO: 132903 - protein, 16 aa, Mycobacterium tuberculosis
EASRRGVDLVALHAWS

SEQ ID NO: 132904 - protein, 16 aa, Mycobacterium tuberculosis
ASRRGVDLVALHAWSD

SEQ ID NO: 132905 - protein, 16 aa, Mycobacterium tuberculosis
SRRGVDLVALHAWSDM

SEQ ID NO: 132906 - protein, 16 aa, Mycobacterium tuberculosis
RRGVDLVALHAWSDMG

SEQ ID NO: 132907 - protein, 16 aa, Mycobacterium tuberculosis
RGVDLVALHAWSDMGP

SEQ ID NO: 132908 - protein, 16 aa, Mycobacterium tuberculosis
GVDLVALHAWSDMGPL

SEQ ID NO: 132909 - protein, 16 aa, Mycobacterium tuberculosis
VDLVALHAWSDMGPLD

SEQ ID NO: 132910 - protein, 16 aa, Mycobacterium tuberculosis
DLVALHAWSDMGPLDF

SEQ ID NO: 132911 - protein, 16 aa, Mycobacterium tuberculosis
LVALHAWSDMGPLDFP

SEQ ID NO: 132912 - protein, 16 aa, Mycobacterium tuberculosis
VALHAWSDMGPLDFPR

SEQ ID NO: 132913 - protein, 16 aa, Mycobacterium tuberculosis
ALHAWSDMGPLDFPRL

SEQ ID NO: 132914 - protein, 16 aa, Mycobacterium tuberculosis
LHAWSDMGPLDFPRLN

SEQ ID NO: 132915 - protein, 16 aa, Mycobacterium tuberculosis
HAWSDMGPLDFPRLNW

SEQ ID NO: 132916 - protein, 16 aa, Mycobacterium tuberculosis
AWSDMGPLDFPRLNWA

SEQ ID NO: 132917 - protein, 16 aa, Mycobacterium tuberculosis
WSDMGPLDFPRLNWAP

SEQ ID NO: 132918 - protein, 16 aa, Mycobacterium tuberculosis
SDMGPLDFPRLNWAPI

SEQ ID NO: 132919 - protein, 16 aa, Mycobacterium tuberculosis
DMGPLDFPRLNWAPIE

SEQ ID NO: 132920 - protein, 16 aa, Mycobacterium tuberculosis
MGPLDFPRLNWAPIEW

SEQ ID NO: 132921 - protein, 16 aa, Mycobacterium tuberculosis
GPLDFPRLNWAPIEWR

SEQ ID NO: 132922 - protein, 16 aa, Mycobacterium tuberculosis
PLDFPRLNWAPIEWRN

SEQ ID NO: 132923 - protein, 16 aa, Mycobacterium tuberculosis
LDFPRLNWAPIEWRNL

SEQ ID NO: 132924 - protein, 16 aa, Mycobacterium tuberculosis
DFPRLNWAPIEWRNLE

SEQ ID NO: 132925 - protein, 16 aa, Mycobacterium tuberculosis
FPRLNWAPIEWRNLED

SEQ ID NO: 132926 - protein, 16 aa, Mycobacterium tuberculosis
PRLNWAPIEWRNLEDE

SEQ ID NO: 132927 - protein, 16 aa, Mycobacterium tuberculosis
RLNWAPIEWRNLEDEQ

SEQ ID NO: 132928 - protein, 16 aa, Mycobacterium tuberculosis
LNWAPIEWRNLEDEQE

SEQ ID NO: 132929 - protein, 16 aa, Mycobacterium tuberculosis
NWAPIEWRNLEDEQEK

SEQ ID NO: 132930 - protein, 16 aa, Mycobacterium tuberculosis
WAPIEWRNLEDEQEKM

SEQ ID NO: 132931 - protein, 16 aa, Mycobacterium tuberculosis
APIEWRNLEDEQEKML

SEQ ID NO: 132932 - protein, 16 aa, Mycobacterium tuberculosis
PIEWRNLEDEQEKMLA

SEQ ID NO: 132933 - protein, 16 aa, Mycobacterium tuberculosis
IEWRNLEDEQEKMLAR

SEQ ID NO: 132934 - protein, 16 aa, Mycobacterium tuberculosis
EWRNLEDEQEKMLARR

SEQ ID NO: 132935 - protein, 16 aa, Mycobacterium tuberculosis
WRNLEDEQEKMLARRL

SEQ ID NO: 132936 - protein, 16 aa, Mycobacterium tuberculosis
RNLEDEQEKMLARRLS

SEQ ID NO: 132937 - protein, 16 aa, Mycobacterium tuberculosis
NLEDEQEKMLARRLSG

SEQ ID NO: 132938 - protein, 16 aa, Mycobacterium tuberculosis
LEDEQEKMLARRLSGW

SEQ ID NO: 132939 - protein, 16 aa, Mycobacterium tuberculosis
EDEQEKMLARRLSGWQ

SEQ ID NO: 132940 - protein, 16 aa, Mycobacterium tuberculosis
DEQEKMLARRLSGWQD

SEQ ID NO: 132941 - protein, 16 aa, Mycobacterium tuberculosis
EQEKMLARRLSGWQDR

SEQ ID NO: 132942 - protein, 16 aa, Mycobacterium tuberculosis
QEKMLARRLSGWQDRY

SEQ ID NO: 132943 - protein, 16 aa, Mycobacterium tuberculosis
EKMLARRLSGWQDRYP

SEQ ID NO: 132944 - protein, 16 aa, Mycobacterium tuberculosis
KMLARRLSGWQDRYPD

SEQ ID NO: 132945 - protein, 16 aa, Mycobacterium tuberculosis
MLARRLSGWQDRYPDV

SEQ ID NO: 132946 - protein, 16 aa, Mycobacterium tuberculosis
LARRLSGWQDRYPDVV

SEQ ID NO: 132947 - protein, 16 aa, Mycobacterium tuberculosis
ARRLSGWQDRYPDVVV

SEQ ID NO: 132948 - protein, 16 aa, Mycobacterium tuberculosis
RRLSGWQDRYPDVVVH

SEQ ID NO: 132949 - protein, 16 aa, Mycobacterium tuberculosis
RLSGWQDRYPDVVVHK

SEQ ID NO: 132950 - protein, 16 aa, Mycobacterium tuberculosis
LSGWQDRYPDVVVHKV

SEQ ID NO: 132951 - protein, 16 aa, Mycobacterium tuberculosis
SGWQDRYPDVVVHKVV

SEQ ID NO: 132952 - protein, 16 aa, Mycobacterium tuberculosis
GWQDRYPDVVVHKVVV

SEQ ID NO: 132953 - protein, 16 aa, Mycobacterium tuberculosis
WQDRYPDVVVHKVVVC

SEQ ID NO: 132954 - protein, 16 aa, Mycobacterium tuberculosis
QDRYPDVVVHKVVVCD

SEQ ID NO: 132955 - protein, 16 aa, Mycobacterium tuberculosis
DRYPDVVVHKVVVCDR

SEQ ID NO: 132956 - protein, 16 aa, Mycobacterium tuberculosis
RYPDVVVHKVVVCDRP

SEQ ID NO: 132957 - protein, 16 aa, Mycobacterium tuberculosis
YPDVVVHKVVVCDRPA

SEQ ID NO: 132958 - protein, 16 aa, Mycobacterium tuberculosis
PDVVVHKVVVCDRPAP

SEQ ID NO: 132959 - protein, 16 aa, Mycobacterium tuberculosis
DVVVHKVVVCDRPAPR

SEQ ID NO: 132960 - protein, 16 aa, Mycobacterium tuberculosis
VVVHKVVVCDRPAPRL

SEQ ID NO: 132961 - protein, 16 aa, Mycobacterium tuberculosis
VVHKVVVCDRPAPRLL

SEQ ID NO: 132962 - protein, 16 aa, Mycobacterium tuberculosis
VHKVVVCDRPAPRLLE

SEQ ID NO: 132963 - protein, 16 aa, Mycobacterium tuberculosis
HKVVVCDRPAPRLLEL

SEQ ID NO: 132964 - protein, 16 aa, Mycobacterium tuberculosis
KVVVCDRPAPRLLELA

SEQ ID NO: 132965 - protein, 16 aa, Mycobacterium tuberculosis
VVVCDRPAPRLLELAQ

SEQ ID NO: 132966 - protein, 16 aa, Mycobacterium tuberculosis
VVCDRPAPRLLELAQT

SEQ ID NO: 132967 - protein, 16 aa, Mycobacterium tuberculosis
VCDRPAPRLLELAQTA

SEQ ID NO: 132968 - protein, 16 aa, Mycobacterium tuberculosis
CDRPAPRLLELAQTAQ

SEQ ID NO: 132969 - protein, 16 aa, Mycobacterium tuberculosis
DRPAPRLLELAQTAQL

SEQ ID NO: 132970 - protein, 16 aa, Mycobacterium tuberculosis
RPAPRLLELAQTAQLV

SEQ ID NO: 132971 - protein, 16 aa, Mycobacterium tuberculosis
PAPRLLELAQTAQLVV

SEQ ID NO: 132972 - protein, 16 aa, Mycobacterium tuberculosis
APRLLELAQTAQLVVV

SEQ ID NO: 132973 - protein, 16 aa, Mycobacterium tuberculosis
PRLLELAQTAQLVVVG

SEQ ID NO: 132974 - protein, 16 aa, Mycobacterium tuberculosis
RLLELAQTAQLVVVGS

SEQ ID NO: 132975 - protein, 16 aa, Mycobacterium tuberculosis
LLELAQTAQLVVVGSH

SEQ ID NO: 132976 - protein, 16 aa, Mycobacterium tuberculosis
LELAQTAQLVVVGSHG

SEQ ID NO: 132977 - protein, 16 aa, Mycobacterium tuberculosis
ELAQTAQLVVVGSHGR

SEQ ID NO: 132978 - protein, 16 aa, Mycobacterium tuberculosis
LAQTAQLVVVGSHGRG

SEQ ID NO: 132979 - protein, 16 aa, Mycobacterium tuberculosis
AQTAQLVVVGSHGRGG

SEQ ID NO: 132980 - protein, 16 aa, Mycobacterium tuberculosis
QTAQLVVVGSHGRGGF

SEQ ID NO: 132981 - protein, 16 aa, Mycobacterium tuberculosis
TAQLVVVGSHGRGGFP

SEQ ID NO: 132982 - protein, 16 aa, Mycobacterium tuberculosis
AQLVVVGSHGRGGFPG

SEQ ID NO: 132983 - protein, 16 aa, Mycobacterium tuberculosis
QLVVVGSHGRGGFPGM

SEQ ID NO: 132984 - protein, 16 aa, Mycobacterium tuberculosis
LVVVGSHGRGGFPGMH

SEQ ID NO: 132985 - protein, 16 aa, Mycobacterium tuberculosis
VVVGSHGRGGFPGMHL

SEQ ID NO: 132986 - protein, 16 aa, Mycobacterium tuberculosis
VVGSHGRGGFPGMHLG

SEQ ID NO: 132987 - protein, 16 aa, Mycobacterium tuberculosis
VGSHGRGGFPGMHLGS

SEQ ID NO: 132988 - protein, 16 aa, Mycobacterium tuberculosis
GSHGRGGFPGMHLGSV

SEQ ID NO: 132989 - protein, 16 aa, Mycobacterium tuberculosis
SHGRGGFPGMHLGSVS

SEQ ID NO: 132990 - protein, 16 aa, Mycobacterium tuberculosis
HGRGGFPGMHLGSVSR

SEQ ID NO: 132991 - protein, 16 aa, Mycobacterium tuberculosis
GRGGFPGMHLGSVSRA

SEQ ID NO: 132992 - protein, 16 aa, Mycobacterium tuberculosis
RGGFPGMHLGSVSRAV

SEQ ID NO: 132993 - protein, 16 aa, Mycobacterium tuberculosis
GGFPGMHLGSVSRAVV

SEQ ID NO: 132994 - protein, 16 aa, Mycobacterium tuberculosis
GFPGMHLGSVSRAVVN

SEQ ID NO: 132995 - protein, 16 aa, Mycobacterium tuberculosis
FPGMHLGSVSRAVVNS

SEQ ID NO: 132996 - protein, 16 aa, Mycobacterium tuberculosis
PGMHLGSVSRAVVNSG

SEQ ID NO: 132997 - protein, 16 aa, Mycobacterium tuberculosis
GMHLGSVSRAVVNSGQ

SEQ ID NO: 132998 - protein, 16 aa, Mycobacterium tuberculosis
MHLGSVSRAVVNSGQA

SEQ ID NO: 132999 - protein, 16 aa, Mycobacterium tuberculosis
HLGSVSRAVVNSGQAP

SEQ ID NO: 133000 - protein, 16 aa, Mycobacterium tuberculosis
LGSVSRAVVNSGQAPV

SEQ ID NO: 133001 - protein, 16 aa, Mycobacterium tuberculosis
GSVSRAVVNSGQAPVI

SEQ ID NO: 133002 - protein, 16 aa, Mycobacterium tuberculosis
SVSRAVVNSGQAPVIV

SEQ ID NO: 133003 - protein, 16 aa, Mycobacterium tuberculosis
VSRAVVNSGQAPVIVA

SEQ ID NO: 133004 - protein, 16 aa, Mycobacterium tuberculosis
SRAVVNSGQAPVIVAR

SEQ ID NO: 133005 - protein, 16 aa, Mycobacterium tuberculosis
RAVVNSGQAPVIVARI

SEQ ID NO: 133006 - protein, 16 aa, Mycobacterium tuberculosis
AVVNSGQAPVIVARIP

SEQ ID NO: 133007 - protein, 16 aa, Mycobacterium tuberculosis
VVNSGQAPVIVARIPQ

SEQ ID NO: 133008 - protein, 16 aa, Mycobacterium tuberculosis
VNSGQAPVIVARIPQD

SEQ ID NO: 133009 - protein, 16 aa, Mycobacterium tuberculosis
NSGQAPVIVARIPQDP

SEQ ID NO: 133010 - protein, 16 aa, Mycobacterium tuberculosis
SGQAPVIVARIPQDPA

SEQ ID NO: 133011 - protein, 16 aa, Mycobacterium tuberculosis
GQAPVIVARIPQDPAV

SEQ ID NO: 133012 - protein, 16 aa, Mycobacterium tuberculosis
QAPVIVARIPQDPAVP

SEQ ID NO: 133013 - protein, 16 aa, Mycobacterium tuberculosis
APVIVARIPQDPAVPA

SEQ ID NO: 133014 - protein, 154 aa, Mycobacterium tuberculosis
MTPGLLTTAGAGRPRDRCARIVCTVFIETAVVATMFVALLGLSTISSKADDIDWDAIAQCESGGNWAANTGNGLYGGLQISQATWDSNGGVGSPAAASPQQQIEVADNIMKTQGPGAWPKCSSCSQGDAPLGSLTHILTFLAAETGGCSGSRDD

SEQ ID NO: 133015 - protein, 8 aa, Mycobacterium tuberculosis
TPGLLTTA

SEQ ID NO: 133016 - protein, 8 aa, Mycobacterium tuberculosis
GLLTTAGA

SEQ ID NO: 133017 - protein, 8 aa, Mycobacterium tuberculosis
LTTAGAGR

SEQ ID NO: 133018 - protein, 8 aa, Mycobacterium tuberculosis
TAGAGRPR

SEQ ID NO: 133019 - protein, 8 aa, Mycobacterium tuberculosis
RPRDRCAR

SEQ ID NO: 133020 - protein, 8 aa, Mycobacterium tuberculosis
RIVCTVFI

SEQ ID NO: 133021 - protein, 8 aa, Mycobacterium tuberculosis
CTVFIETA

SEQ ID NO: 133022 - protein, 8 aa, Mycobacterium tuberculosis
TVFIETAV

SEQ ID NO: 133023 - protein, 8 aa, Mycobacterium tuberculosis
VFIETAVV

SEQ ID NO: 133024 - protein, 8 aa, Mycobacterium tuberculosis
ETAVVATM

SEQ ID NO: 133025 - protein, 8 aa, Mycobacterium tuberculosis
TAVVATMF

SEQ ID NO: 133026 - protein, 8 aa, Mycobacterium tuberculosis
AVVATMFV

SEQ ID NO: 133027 - protein, 8 aa, Mycobacterium tuberculosis
VVATMFVA

SEQ ID NO: 133028 - protein, 8 aa, Mycobacterium tuberculosis
ATMFVALL

SEQ ID NO: 133029 - protein, 8 aa, Mycobacterium tuberculosis
ALLGLSTI

SEQ ID NO: 133030 - protein, 8 aa, Mycobacterium tuberculosis
GLSTISSK

SEQ ID NO: 133031 - protein, 8 aa, Mycobacterium tuberculosis
GLYGGLQI

SEQ ID NO: 133032 - protein, 8 aa, Mycobacterium tuberculosis
LQISQATW

SEQ ID NO: 133033 - protein, 8 aa, Mycobacterium tuberculosis
SPAAASPQ

SEQ ID NO: 133034 - protein, 8 aa, Mycobacterium tuberculosis
IEVADNIM

SEQ ID NO: 133035 - protein, 8 aa, Mycobacterium tuberculosis
EVADNIMK

SEQ ID NO: 133036 - protein, 8 aa, Mycobacterium tuberculosis
KTQGPGAW

SEQ ID NO: 133037 - protein, 8 aa, Mycobacterium tuberculosis
QGPGAWPK

SEQ ID NO: 133038 - protein, 8 aa, Mycobacterium tuberculosis
PLGSLTHI

SEQ ID NO: 133039 - protein, 8 aa, Mycobacterium tuberculosis
SLTHILTF

SEQ ID NO: 133040 - protein, 8 aa, Mycobacterium tuberculosis
LTHILTFL

SEQ ID NO: 133041 - protein, 8 aa, Mycobacterium tuberculosis
HILTFLAA

SEQ ID NO: 133042 - protein, 8 aa, Mycobacterium tuberculosis
FLAAETGG

SEQ ID NO: 133043 - protein, 9 aa, Mycobacterium tuberculosis
MTPGLLTTA

SEQ ID NO: 133044 - protein, 9 aa, Mycobacterium tuberculosis
LLTTAGAGR

SEQ ID NO: 133045 - protein, 9 aa, Mycobacterium tuberculosis
TTAGAGRPR

SEQ ID NO: 133046 - protein, 9 aa, Mycobacterium tuberculosis
RPRDRCARI

SEQ ID NO: 133047 - protein, 9 aa, Mycobacterium tuberculosis
RCARIVCTV

SEQ ID NO: 133048 - protein, 9 aa, Mycobacterium tuberculosis
CTVFIETAV

SEQ ID NO: 133049 - protein, 9 aa, Mycobacterium tuberculosis
TVFIETAVV

SEQ ID NO: 133050 - protein, 9 aa, Mycobacterium tuberculosis
ETAVVATMF

SEQ ID NO: 133051 - protein, 9 aa, Mycobacterium tuberculosis
TAVVATMFV

SEQ ID NO: 133052 - protein, 9 aa, Mycobacterium tuberculosis
AVVATMFVA

SEQ ID NO: 133053 - protein, 9 aa, Mycobacterium tuberculosis
VVATMFVAL

SEQ ID NO: 133054 - protein, 9 aa, Mycobacterium tuberculosis
TMFVALLGL

SEQ ID NO: 133055 - protein, 9 aa, Mycobacterium tuberculosis
VALLGLSTI

SEQ ID NO: 133056 - protein, 9 aa, Mycobacterium tuberculosis
ALLGLSTIS

SEQ ID NO: 133057 - protein, 9 aa, Mycobacterium tuberculosis
GLSTISSKA

SEQ ID NO: 133058 - protein, 9 aa, Mycobacterium tuberculosis
SSKADDIDW

SEQ ID NO: 133059 - protein, 9 aa, Mycobacterium tuberculosis
KADDIDWDA

SEQ ID NO: 133060 - protein, 9 aa, Mycobacterium tuberculosis
WAANTGNGL

SEQ ID NO: 133061 - protein, 9 aa, Mycobacterium tuberculosis
AANTGNGLY

SEQ ID NO: 133062 - protein, 9 aa, Mycobacterium tuberculosis
TGNGLYGGL

SEQ ID NO: 133063 - protein, 9 aa, Mycobacterium tuberculosis
GLYGGLQIS

SEQ ID NO: 133064 - protein, 9 aa, Mycobacterium tuberculosis
ATWDSNGGV

SEQ ID NO: 133065 - protein, 9 aa, Mycobacterium tuberculosis
QQIEVADNI

SEQ ID NO: 133066 - protein, 9 aa, Mycobacterium tuberculosis
QIEVADNIM

SEQ ID NO: 133067 - protein, 9 aa, Mycobacterium tuberculosis
EVADNIMKT

SEQ ID NO: 133068 - protein, 9 aa, Mycobacterium tuberculosis
IMKTQGPGA

SEQ ID NO: 133069 - protein, 9 aa, Mycobacterium tuberculosis
TQGPGAWPK

SEQ ID NO: 133070 - protein, 9 aa, Mycobacterium tuberculosis
APLGSLTHI

SEQ ID NO: 133071 - protein, 9 aa, Mycobacterium tuberculosis
PLGSLTHIL

SEQ ID NO: 133072 - protein, 9 aa, Mycobacterium tuberculosis
GSLTHILTF

SEQ ID NO: 133073 - protein, 9 aa, Mycobacterium tuberculosis
SLTHILTFL

SEQ ID NO: 133074 - protein, 9 aa, Mycobacterium tuberculosis
LTHILTFLA

SEQ ID NO: 133075 - protein, 9 aa, Mycobacterium tuberculosis
ILTFLAAET

SEQ ID NO: 133076 - protein, 9 aa, Mycobacterium tuberculosis
FLAAETGGC

SEQ ID NO: 133077 - protein, 9 aa, Mycobacterium tuberculosis
ETGGCSGSR

SEQ ID NO: 133078 - protein, 10 aa, Mycobacterium tuberculosis
TPGLLTTAGA

SEQ ID NO: 133079 - protein, 10 aa, Mycobacterium tuberculosis
GLLTTAGAGR

SEQ ID NO: 133080 - protein, 10 aa, Mycobacterium tuberculosis
LTTAGAGRPR

SEQ ID NO: 133081 - protein, 10 aa, Mycobacterium tuberculosis
AGRPRDRCAR

SEQ ID NO: 133082 - protein, 10 aa, Mycobacterium tuberculosis
RPRDRCARIV

SEQ ID NO: 133083 - protein, 10 aa, Mycobacterium tuberculosis
RIVCTVFIET

SEQ ID NO: 133084 - protein, 10 aa, Mycobacterium tuberculosis
CTVFIETAVV

SEQ ID NO: 133085 - protein, 10 aa, Mycobacterium tuberculosis
TVFIETAVVA

SEQ ID NO: 133086 - protein, 10 aa, Mycobacterium tuberculosis
FIETAVVATM

SEQ ID NO: 133087 - protein, 10 aa, Mycobacterium tuberculosis
IETAVVATMF

SEQ ID NO: 133088 - protein, 10 aa, Mycobacterium tuberculosis
ETAVVATMFV

SEQ ID NO: 133089 - protein, 10 aa, Mycobacterium tuberculosis
TAVVATMFVA

SEQ ID NO: 133090 - protein, 10 aa, Mycobacterium tuberculosis
AVVATMFVAL

SEQ ID NO: 133091 - protein, 10 aa, Mycobacterium tuberculosis
VVATMFVALL

SEQ ID NO: 133092 - protein, 10 aa, Mycobacterium tuberculosis
ATMFVALLGL

SEQ ID NO: 133093 - protein, 10 aa, Mycobacterium tuberculosis
FVALLGLSTI

SEQ ID NO: 133094 - protein, 10 aa, Mycobacterium tuberculosis
ALLGLSTISS

SEQ ID NO: 133095 - protein, 10 aa, Mycobacterium tuberculosis
LLGLSTISSK

SEQ ID NO: 133096 - protein, 10 aa, Mycobacterium tuberculosis
ISSKADDIDW

SEQ ID NO: 133097 - protein, 10 aa, Mycobacterium tuberculosis
KADDIDWDAI

SEQ ID NO: 133098 - protein, 10 aa, Mycobacterium tuberculosis
IAQCESGGNW

SEQ ID NO: 133099 - protein, 10 aa, Mycobacterium tuberculosis
AQCESGGNWA

SEQ ID NO: 133100 - protein, 10 aa, Mycobacterium tuberculosis
NWAANTGNGL

SEQ ID NO: 133101 - protein, 10 aa, Mycobacterium tuberculosis
WAANTGNGLY

SEQ ID NO: 133102 - protein, 10 aa, Mycobacterium tuberculosis
NTGNGLYGGL

SEQ ID NO: 133103 - protein, 10 aa, Mycobacterium tuberculosis
GLYGGLQISQ

SEQ ID NO: 133104 - protein, 10 aa, Mycobacterium tuberculosis
GGLQISQATW

SEQ ID NO: 133105 - protein, 10 aa, Mycobacterium tuberculosis
LQISQATWDS

SEQ ID NO: 133106 - protein, 10 aa, Mycobacterium tuberculosis
QATWDSNGGV

SEQ ID NO: 133107 - protein, 10 aa, Mycobacterium tuberculosis
AASPQQQIEV

SEQ ID NO: 133108 - protein, 10 aa, Mycobacterium tuberculosis
QQIEVADNIM

SEQ ID NO: 133109 - protein, 10 aa, Mycobacterium tuberculosis
EVADNIMKTQ

SEQ ID NO: 133110 - protein, 10 aa, Mycobacterium tuberculosis
NIMKTQGPGA

SEQ ID NO: 133111 - protein, 10 aa, Mycobacterium tuberculosis
IMKTQGPGAW

SEQ ID NO: 133112 - protein, 10 aa, Mycobacterium tuberculosis
KTQGPGAWPK

SEQ ID NO: 133113 - protein, 10 aa, Mycobacterium tuberculosis
SQGDAPLGSL

SEQ ID NO: 133114 - protein, 10 aa, Mycobacterium tuberculosis
APLGSLTHIL

SEQ ID NO: 133115 - protein, 10 aa, Mycobacterium tuberculosis
PLGSLTHILT

SEQ ID NO: 133116 - protein, 10 aa, Mycobacterium tuberculosis
GSLTHILTFL

SEQ ID NO: 133117 - protein, 10 aa, Mycobacterium tuberculosis
SLTHILTFLA

SEQ ID NO: 133118 - protein, 10 aa, Mycobacterium tuberculosis
FLAAETGGCS

SEQ ID NO: 133119 - protein, 11 aa, Mycobacterium tuberculosis
MTPGLLTTAGA

SEQ ID NO: 133120 - protein, 11 aa, Mycobacterium tuberculosis
LLTTAGAGRPR

SEQ ID NO: 133121 - protein, 11 aa, Mycobacterium tuberculosis
TTAGAGRPRDR

SEQ ID NO: 133122 - protein, 11 aa, Mycobacterium tuberculosis
GAGRPRDRCAR

SEQ ID NO: 133123 - protein, 11 aa, Mycobacterium tuberculosis
RPRDRCARIVC

SEQ ID NO: 133124 - protein, 11 aa, Mycobacterium tuberculosis
RCARIVCTVFI

SEQ ID NO: 133125 - protein, 11 aa, Mycobacterium tuberculosis
RIVCTVFIETA

SEQ ID NO: 133126 - protein, 11 aa, Mycobacterium tuberculosis
IVCTVFIETAV

SEQ ID NO: 133127 - protein, 11 aa, Mycobacterium tuberculosis
CTVFIETAVVA

SEQ ID NO: 133128 - protein, 11 aa, Mycobacterium tuberculosis
TVFIETAVVAT

SEQ ID NO: 133129 - protein, 11 aa, Mycobacterium tuberculosis
VFIETAVVATM

SEQ ID NO: 133130 - protein, 11 aa, Mycobacterium tuberculosis
FIETAVVATMF

SEQ ID NO: 133131 - protein, 11 aa, Mycobacterium tuberculosis
IETAVVATMFV

SEQ ID NO: 133132 - protein, 11 aa, Mycobacterium tuberculosis
ETAVVATMFVA

SEQ ID NO: 133133 - protein, 11 aa, Mycobacterium tuberculosis
TAVVATMFVAL

SEQ ID NO: 133134 - protein, 11 aa, Mycobacterium tuberculosis
AVVATMFVALL

SEQ ID NO: 133135 - protein, 11 aa, Mycobacterium tuberculosis
TMFVALLGLST

SEQ ID NO: 133136 - protein, 11 aa, Mycobacterium tuberculosis
MFVALLGLSTI

SEQ ID NO: 133137 - protein, 11 aa, Mycobacterium tuberculosis
ALLGLSTISSK

SEQ ID NO: 133138 - protein, 11 aa, Mycobacterium tuberculosis
LLGLSTISSKA

SEQ ID NO: 133139 - protein, 11 aa, Mycobacterium tuberculosis
KADDIDWDAIA

SEQ ID NO: 133140 - protein, 11 aa, Mycobacterium tuberculosis
AQCESGGNWAA

SEQ ID NO: 133141 - protein, 11 aa, Mycobacterium tuberculosis
NWAANTGNGLY

SEQ ID NO: 133142 - protein, 11 aa, Mycobacterium tuberculosis
GLYGGLQISQA

SEQ ID NO: 133143 - protein, 11 aa, Mycobacterium tuberculosis
SQATWDSNGGV

SEQ ID NO: 133144 - protein, 11 aa, Mycobacterium tuberculosis
SPAAASPQQQI

SEQ ID NO: 133145 - protein, 11 aa, Mycobacterium tuberculosis
AAASPQQQIEV

SEQ ID NO: 133146 - protein, 11 aa, Mycobacterium tuberculosis
QQQIEVADNIM

SEQ ID NO: 133147 - protein, 11 aa, Mycobacterium tuberculosis
QQIEVADNIMK

SEQ ID NO: 133148 - protein, 11 aa, Mycobacterium tuberculosis
CSSCSQGDAPL

SEQ ID NO: 133149 - protein, 11 aa, Mycobacterium tuberculosis
LGSLTHILTFL

SEQ ID NO: 133150 - protein, 11 aa, Mycobacterium tuberculosis
SLTHILTFLAA

SEQ ID NO: 133151 - protein, 11 aa, Mycobacterium tuberculosis
FLAAETGGCSG

SEQ ID NO: 133152 - protein, 13 aa, Mycobacterium tuberculosis
MTPGLLTTAGAGR

SEQ ID NO: 133153 - protein, 13 aa, Mycobacterium tuberculosis
TPGLLTTAGAGRP

SEQ ID NO: 133154 - protein, 13 aa, Mycobacterium tuberculosis
PGLLTTAGAGRPR

SEQ ID NO: 133155 - protein, 13 aa, Mycobacterium tuberculosis
GLLTTAGAGRPRD

SEQ ID NO: 133156 - protein, 13 aa, Mycobacterium tuberculosis
LLTTAGAGRPRDR

SEQ ID NO: 133157 - protein, 13 aa, Mycobacterium tuberculosis
LTTAGAGRPRDRC

SEQ ID NO: 133158 - protein, 13 aa, Mycobacterium tuberculosis
TTAGAGRPRDRCA

SEQ ID NO: 133159 - protein, 13 aa, Mycobacterium tuberculosis
TAGAGRPRDRCAR

SEQ ID NO: 133160 - protein, 13 aa, Mycobacterium tuberculosis
AGAGRPRDRCARI

SEQ ID NO: 133161 - protein, 13 aa, Mycobacterium tuberculosis
GAGRPRDRCARIV

SEQ ID NO: 133162 - protein, 13 aa, Mycobacterium tuberculosis
AGRPRDRCARIVC

SEQ ID NO: 133163 - protein, 13 aa, Mycobacterium tuberculosis
GRPRDRCARIVCT

SEQ ID NO: 133164 - protein, 13 aa, Mycobacterium tuberculosis
RPRDRCARIVCTV

SEQ ID NO: 133165 - protein, 13 aa, Mycobacterium tuberculosis
PRDRCARIVCTVF

SEQ ID NO: 133166 - protein, 13 aa, Mycobacterium tuberculosis
RDRCARIVCTVFI

SEQ ID NO: 133167 - protein, 13 aa, Mycobacterium tuberculosis
DRCARIVCTVFIE

SEQ ID NO: 133168 - protein, 13 aa, Mycobacterium tuberculosis
RCARIVCTVFIET

SEQ ID NO: 133169 - protein, 13 aa, Mycobacterium tuberculosis
CARIVCTVFIETA

SEQ ID NO: 133170 - protein, 13 aa, Mycobacterium tuberculosis
ARIVCTVFIETAV

SEQ ID NO: 133171 - protein, 13 aa, Mycobacterium tuberculosis
RIVCTVFIETAVV

SEQ ID NO: 133172 - protein, 13 aa, Mycobacterium tuberculosis
IVCTVFIETAVVA

SEQ ID NO: 133173 - protein, 13 aa, Mycobacterium tuberculosis
VCTVFIETAVVAT

SEQ ID NO: 133174 - protein, 13 aa, Mycobacterium tuberculosis
CTVFIETAVVATM

SEQ ID NO: 133175 - protein, 13 aa, Mycobacterium tuberculosis
TVFIETAVVATMF

SEQ ID NO: 133176 - protein, 13 aa, Mycobacterium tuberculosis
VFIETAVVATMFV

SEQ ID NO: 133177 - protein, 13 aa, Mycobacterium tuberculosis
FIETAVVATMFVA

SEQ ID NO: 133178 - protein, 13 aa, Mycobacterium tuberculosis
IETAVVATMFVAL

SEQ ID NO: 133179 - protein, 13 aa, Mycobacterium tuberculosis
ETAVVATMFVALL

SEQ ID NO: 133180 - protein, 13 aa, Mycobacterium tuberculosis
TAVVATMFVALLG

SEQ ID NO: 133181 - protein, 13 aa, Mycobacterium tuberculosis
AVVATMFVALLGL

SEQ ID NO: 133182 - protein, 13 aa, Mycobacterium tuberculosis
VVATMFVALLGLS

SEQ ID NO: 133183 - protein, 13 aa, Mycobacterium tuberculosis
VATMFVALLGLST

SEQ ID NO: 133184 - protein, 13 aa, Mycobacterium tuberculosis
ATMFVALLGLSTI

SEQ ID NO: 133185 - protein, 13 aa, Mycobacterium tuberculosis
TMFVALLGLSTIS

SEQ ID NO: 133186 - protein, 13 aa, Mycobacterium tuberculosis
MFVALLGLSTISS

SEQ ID NO: 133187 - protein, 13 aa, Mycobacterium tuberculosis
FVALLGLSTISSK

SEQ ID NO: 133188 - protein, 13 aa, Mycobacterium tuberculosis
VALLGLSTISSKA

SEQ ID NO: 133189 - protein, 13 aa, Mycobacterium tuberculosis
ALLGLSTISSKAD

SEQ ID NO: 133190 - protein, 13 aa, Mycobacterium tuberculosis
LLGLSTISSKADD

SEQ ID NO: 133191 - protein, 13 aa, Mycobacterium tuberculosis
LGLSTISSKADDI

SEQ ID NO: 133192 - protein, 13 aa, Mycobacterium tuberculosis
GLSTISSKADDID

SEQ ID NO: 133193 - protein, 13 aa, Mycobacterium tuberculosis
LSTISSKADDIDW

SEQ ID NO: 133194 - protein, 13 aa, Mycobacterium tuberculosis
STISSKADDIDWD

SEQ ID NO: 133195 - protein, 13 aa, Mycobacterium tuberculosis
TISSKADDIDWDA

SEQ ID NO: 133196 - protein, 13 aa, Mycobacterium tuberculosis
ISSKADDIDWDAI

SEQ ID NO: 133197 - protein, 13 aa, Mycobacterium tuberculosis
SSKADDIDWDAIA

SEQ ID NO: 133198 - protein, 13 aa, Mycobacterium tuberculosis
SKADDIDWDAIAQ

SEQ ID NO: 133199 - protein, 13 aa, Mycobacterium tuberculosis
KADDIDWDAIAQC

SEQ ID NO: 133200 - protein, 13 aa, Mycobacterium tuberculosis
ADDIDWDAIAQCE

SEQ ID NO: 133201 - protein, 13 aa, Mycobacterium tuberculosis
DDIDWDAIAQCES

SEQ ID NO: 133202 - protein, 13 aa, Mycobacterium tuberculosis
DIDWDAIAQCESG

SEQ ID NO: 133203 - protein, 13 aa, Mycobacterium tuberculosis
IDWDAIAQCESGG

SEQ ID NO: 133204 - protein, 13 aa, Mycobacterium tuberculosis
DWDAIAQCESGGN

SEQ ID NO: 133205 - protein, 13 aa, Mycobacterium tuberculosis
WDAIAQCESGGNW

SEQ ID NO: 133206 - protein, 13 aa, Mycobacterium tuberculosis
DAIAQCESGGNWA

SEQ ID NO: 133207 - protein, 13 aa, Mycobacterium tuberculosis
AIAQCESGGNWAA

SEQ ID NO: 133208 - protein, 13 aa, Mycobacterium tuberculosis
IAQCESGGNWAAN

SEQ ID NO: 133209 - protein, 13 aa, Mycobacterium tuberculosis
AQCESGGNWAANT

SEQ ID NO: 133210 - protein, 13 aa, Mycobacterium tuberculosis
QCESGGNWAANTG

SEQ ID NO: 133211 - protein, 13 aa, Mycobacterium tuberculosis
CESGGNWAANTGN

SEQ ID NO: 133212 - protein, 13 aa, Mycobacterium tuberculosis
ESGGNWAANTGNG

SEQ ID NO: 133213 - protein, 13 aa, Mycobacterium tuberculosis
SGGNWAANTGNGL

SEQ ID NO: 133214 - protein, 13 aa, Mycobacterium tuberculosis
GGNWAANTGNGLY

SEQ ID NO: 133215 - protein, 13 aa, Mycobacterium tuberculosis
GNWAANTGNGLYG

SEQ ID NO: 133216 - protein, 13 aa, Mycobacterium tuberculosis
NWAANTGNGLYGG

SEQ ID NO: 133217 - protein, 13 aa, Mycobacterium tuberculosis
WAANTGNGLYGGL

SEQ ID NO: 133218 - protein, 13 aa, Mycobacterium tuberculosis
AANTGNGLYGGLQ

SEQ ID NO: 133219 - protein, 13 aa, Mycobacterium tuberculosis
ANTGNGLYGGLQI

SEQ ID NO: 133220 - protein, 13 aa, Mycobacterium tuberculosis
NTGNGLYGGLQIS

SEQ ID NO: 133221 - protein, 13 aa, Mycobacterium tuberculosis
TGNGLYGGLQISQ

SEQ ID NO: 133222 - protein, 13 aa, Mycobacterium tuberculosis
GNGLYGGLQISQA

SEQ ID NO: 133223 - protein, 13 aa, Mycobacterium tuberculosis
NGLYGGLQISQAT

SEQ ID NO: 133224 - protein, 13 aa, Mycobacterium tuberculosis
GLYGGLQISQATW

SEQ ID NO: 133225 - protein, 13 aa, Mycobacterium tuberculosis
LYGGLQISQATWD

SEQ ID NO: 133226 - protein, 13 aa, Mycobacterium tuberculosis
YGGLQISQATWDS

SEQ ID NO: 133227 - protein, 13 aa, Mycobacterium tuberculosis
GGLQISQATWDSN

SEQ ID NO: 133228 - protein, 13 aa, Mycobacterium tuberculosis
GLQISQATWDSNG

SEQ ID NO: 133229 - protein, 13 aa, Mycobacterium tuberculosis
LQISQATWDSNGG

SEQ ID NO: 133230 - protein, 13 aa, Mycobacterium tuberculosis
QISQATWDSNGGV

SEQ ID NO: 133231 - protein, 13 aa, Mycobacterium tuberculosis
ISQATWDSNGGVG

SEQ ID NO: 133232 - protein, 13 aa, Mycobacterium tuberculosis
SQATWDSNGGVGS

SEQ ID NO: 133233 - protein, 13 aa, Mycobacterium tuberculosis
QATWDSNGGVGSP

SEQ ID NO: 133234 - protein, 13 aa, Mycobacterium tuberculosis
ATWDSNGGVGSPA

SEQ ID NO: 133235 - protein, 13 aa, Mycobacterium tuberculosis
TWDSNGGVGSPAA

SEQ ID NO: 133236 - protein, 13 aa, Mycobacterium tuberculosis
WDSNGGVGSPAAA

SEQ ID NO: 133237 - protein, 13 aa, Mycobacterium tuberculosis
DSNGGVGSPAAAS

SEQ ID NO: 133238 - protein, 13 aa, Mycobacterium tuberculosis
SNGGVGSPAAASP

SEQ ID NO: 133239 - protein, 13 aa, Mycobacterium tuberculosis
NGGVGSPAAASPQ

SEQ ID NO: 133240 - protein, 13 aa, Mycobacterium tuberculosis
GGVGSPAAASPQQ

SEQ ID NO: 133241 - protein, 13 aa, Mycobacterium tuberculosis
GVGSPAAASPQQQ

SEQ ID NO: 133242 - protein, 13 aa, Mycobacterium tuberculosis
VGSPAAASPQQQI

SEQ ID NO: 133243 - protein, 13 aa, Mycobacterium tuberculosis
GSPAAASPQQQIE

SEQ ID NO: 133244 - protein, 13 aa, Mycobacterium tuberculosis
SPAAASPQQQIEV

SEQ ID NO: 133245 - protein, 13 aa, Mycobacterium tuberculosis
PAAASPQQQIEVA

SEQ ID NO: 133246 - protein, 13 aa, Mycobacterium tuberculosis
AAASPQQQIEVAD

SEQ ID NO: 133247 - protein, 13 aa, Mycobacterium tuberculosis
AASPQQQIEVADN

SEQ ID NO: 133248 - protein, 13 aa, Mycobacterium tuberculosis
ASPQQQIEVADNI

SEQ ID NO: 133249 - protein, 13 aa, Mycobacterium tuberculosis
SPQQQIEVADNIM

SEQ ID NO: 133250 - protein, 13 aa, Mycobacterium tuberculosis
PQQQIEVADNIMK

SEQ ID NO: 133251 - protein, 13 aa, Mycobacterium tuberculosis
QQQIEVADNIMKT

SEQ ID NO: 133252 - protein, 13 aa, Mycobacterium tuberculosis
QQIEVADNIMKTQ

SEQ ID NO: 133253 - protein, 13 aa, Mycobacterium tuberculosis
QIEVADNIMKTQG

SEQ ID NO: 133254 - protein, 13 aa, Mycobacterium tuberculosis
IEVADNIMKTQGP

SEQ ID NO: 133255 - protein, 13 aa, Mycobacterium tuberculosis
EVADNIMKTQGPG

SEQ ID NO: 133256 - protein, 13 aa, Mycobacterium tuberculosis
VADNIMKTQGPGA

SEQ ID NO: 133257 - protein, 13 aa, Mycobacterium tuberculosis
ADNIMKTQGPGAW

SEQ ID NO: 133258 - protein, 13 aa, Mycobacterium tuberculosis
DNIMKTQGPGAWP

SEQ ID NO: 133259 - protein, 13 aa, Mycobacterium tuberculosis
NIMKTQGPGAWPK

SEQ ID NO: 133260 - protein, 13 aa, Mycobacterium tuberculosis
IMKTQGPGAWPKC

SEQ ID NO: 133261 - protein, 13 aa, Mycobacterium tuberculosis
MKTQGPGAWPKCS

SEQ ID NO: 133262 - protein, 13 aa, Mycobacterium tuberculosis
KTQGPGAWPKCSS

SEQ ID NO: 133263 - protein, 13 aa, Mycobacterium tuberculosis
TQGPGAWPKCSSC

SEQ ID NO: 133264 - protein, 13 aa, Mycobacterium tuberculosis
QGPGAWPKCSSCS

SEQ ID NO: 133265 - protein, 13 aa, Mycobacterium tuberculosis
GPGAWPKCSSCSQ

SEQ ID NO: 133266 - protein, 13 aa, Mycobacterium tuberculosis
PGAWPKCSSCSQG

SEQ ID NO: 133267 - protein, 13 aa, Mycobacterium tuberculosis
GAWPKCSSCSQGD

SEQ ID NO: 133268 - protein, 13 aa, Mycobacterium tuberculosis
AWPKCSSCSQGDA

SEQ ID NO: 133269 - protein, 13 aa, Mycobacterium tuberculosis
WPKCSSCSQGDAP

SEQ ID NO: 133270 - protein, 13 aa, Mycobacterium tuberculosis
PKCSSCSQGDAPL

SEQ ID NO: 133271 - protein, 13 aa, Mycobacterium tuberculosis
KCSSCSQGDAPLG

SEQ ID NO: 133272 - protein, 13 aa, Mycobacterium tuberculosis
CSSCSQGDAPLGS

SEQ ID NO: 133273 - protein, 13 aa, Mycobacterium tuberculosis
SSCSQGDAPLGSL

SEQ ID NO: 133274 - protein, 13 aa, Mycobacterium tuberculosis
SCSQGDAPLGSLT

SEQ ID NO: 133275 - protein, 13 aa, Mycobacterium tuberculosis
CSQGDAPLGSLTH

SEQ ID NO: 133276 - protein, 13 aa, Mycobacterium tuberculosis
SQGDAPLGSLTHI

SEQ ID NO: 133277 - protein, 13 aa, Mycobacterium tuberculosis
QGDAPLGSLTHIL

SEQ ID NO: 133278 - protein, 13 aa, Mycobacterium tuberculosis
GDAPLGSLTHILT

SEQ ID NO: 133279 - protein, 13 aa, Mycobacterium tuberculosis
DAPLGSLTHILTF

SEQ ID NO: 133280 - protein, 13 aa, Mycobacterium tuberculosis
APLGSLTHILTFL

SEQ ID NO: 133281 - protein, 13 aa, Mycobacterium tuberculosis
PLGSLTHILTFLA

SEQ ID NO: 133282 - protein, 13 aa, Mycobacterium tuberculosis
LGSLTHILTFLAA

SEQ ID NO: 133283 - protein, 13 aa, Mycobacterium tuberculosis
GSLTHILTFLAAE

SEQ ID NO: 133284 - protein, 13 aa, Mycobacterium tuberculosis
SLTHILTFLAAET

SEQ ID NO: 133285 - protein, 13 aa, Mycobacterium tuberculosis
LTHILTFLAAETG

SEQ ID NO: 133286 - protein, 13 aa, Mycobacterium tuberculosis
THILTFLAAETGG

SEQ ID NO: 133287 - protein, 13 aa, Mycobacterium tuberculosis
HILTFLAAETGGC

SEQ ID NO: 133288 - protein, 13 aa, Mycobacterium tuberculosis
ILTFLAAETGGCS

SEQ ID NO: 133289 - protein, 13 aa, Mycobacterium tuberculosis
LTFLAAETGGCSG

SEQ ID NO: 133290 - protein, 13 aa, Mycobacterium tuberculosis
TFLAAETGGCSGS

SEQ ID NO: 133291 - protein, 13 aa, Mycobacterium tuberculosis
FLAAETGGCSGSR

SEQ ID NO: 133292 - protein, 13 aa, Mycobacterium tuberculosis
LAAETGGCSGSRD

SEQ ID NO: 133293 - protein, 13 aa, Mycobacterium tuberculosis
AAETGGCSGSRDD

SEQ ID NO: 133294 - protein, 14 aa, Mycobacterium tuberculosis
MTPGLLTTAGAGRP

SEQ ID NO: 133295 - protein, 14 aa, Mycobacterium tuberculosis
TPGLLTTAGAGRPR

SEQ ID NO: 133296 - protein, 14 aa, Mycobacterium tuberculosis
PGLLTTAGAGRPRD

SEQ ID NO: 133297 - protein, 14 aa, Mycobacterium tuberculosis
GLLTTAGAGRPRDR

SEQ ID NO: 133298 - protein, 14 aa, Mycobacterium tuberculosis
LLTTAGAGRPRDRC

SEQ ID NO: 133299 - protein, 14 aa, Mycobacterium tuberculosis
LTTAGAGRPRDRCA

SEQ ID NO: 133300 - protein, 14 aa, Mycobacterium tuberculosis
TTAGAGRPRDRCAR

SEQ ID NO: 133301 - protein, 14 aa, Mycobacterium tuberculosis
TAGAGRPRDRCARI

SEQ ID NO: 133302 - protein, 14 aa, Mycobacterium tuberculosis
AGAGRPRDRCARIV

SEQ ID NO: 133303 - protein, 14 aa, Mycobacterium tuberculosis
GAGRPRDRCARIVC

SEQ ID NO: 133304 - protein, 14 aa, Mycobacterium tuberculosis
AGRPRDRCARIVCT

SEQ ID NO: 133305 - protein, 14 aa, Mycobacterium tuberculosis
GRPRDRCARIVCTV

SEQ ID NO: 133306 - protein, 14 aa, Mycobacterium tuberculosis
RPRDRCARIVCTVF

SEQ ID NO: 133307 - protein, 14 aa, Mycobacterium tuberculosis
PRDRCARIVCTVFI

SEQ ID NO: 133308 - protein, 14 aa, Mycobacterium tuberculosis
RDRCARIVCTVFIE

SEQ ID NO: 133309 - protein, 14 aa, Mycobacterium tuberculosis
DRCARIVCTVFIET

SEQ ID NO: 133310 - protein, 14 aa, Mycobacterium tuberculosis
RCARIVCTVFIETA

SEQ ID NO: 133311 - protein, 14 aa, Mycobacterium tuberculosis
CARIVCTVFIETAV

SEQ ID NO: 133312 - protein, 14 aa, Mycobacterium tuberculosis
ARIVCTVFIETAVV

SEQ ID NO: 133313 - protein, 14 aa, Mycobacterium tuberculosis
RIVCTVFIETAVVA

SEQ ID NO: 133314 - protein, 14 aa, Mycobacterium tuberculosis
IVCTVFIETAVVAT

SEQ ID NO: 133315 - protein, 14 aa, Mycobacterium tuberculosis
VCTVFIETAVVATM

SEQ ID NO: 133316 - protein, 14 aa, Mycobacterium tuberculosis
CTVFIETAVVATMF

SEQ ID NO: 133317 - protein, 14 aa, Mycobacterium tuberculosis
TVFIETAVVATMFV

SEQ ID NO: 133318 - protein, 14 aa, Mycobacterium tuberculosis
VFIETAVVATMFVA

SEQ ID NO: 133319 - protein, 14 aa, Mycobacterium tuberculosis
FIETAVVATMFVAL

SEQ ID NO: 133320 - protein, 14 aa, Mycobacterium tuberculosis
IETAVVATMFVALL

SEQ ID NO: 133321 - protein, 14 aa, Mycobacterium tuberculosis
ETAVVATMFVALLG

SEQ ID NO: 133322 - protein, 14 aa, Mycobacterium tuberculosis
TAVVATMFVALLGL

SEQ ID NO: 133323 - protein, 14 aa, Mycobacterium tuberculosis
AVVATMFVALLGLS

SEQ ID NO: 133324 - protein, 14 aa, Mycobacterium tuberculosis
VVATMFVALLGLST

SEQ ID NO: 133325 - protein, 14 aa, Mycobacterium tuberculosis
VATMFVALLGLSTI

SEQ ID NO: 133326 - protein, 14 aa, Mycobacterium tuberculosis
ATMFVALLGLSTIS

SEQ ID NO: 133327 - protein, 14 aa, Mycobacterium tuberculosis
TMFVALLGLSTISS

SEQ ID NO: 133328 - protein, 14 aa, Mycobacterium tuberculosis
MFVALLGLSTISSK

SEQ ID NO: 133329 - protein, 14 aa, Mycobacterium tuberculosis
FVALLGLSTISSKA

SEQ ID NO: 133330 - protein, 14 aa, Mycobacterium tuberculosis
VALLGLSTISSKAD

SEQ ID NO: 133331 - protein, 14 aa, Mycobacterium tuberculosis
ALLGLSTISSKADD

SEQ ID NO: 133332 - protein, 14 aa, Mycobacterium tuberculosis
LLGLSTISSKADDI

SEQ ID NO: 133333 - protein, 14 aa, Mycobacterium tuberculosis
LGLSTISSKADDID

SEQ ID NO: 133334 - protein, 14 aa, Mycobacterium tuberculosis
GLSTISSKADDIDW

SEQ ID NO: 133335 - protein, 14 aa, Mycobacterium tuberculosis
LSTISSKADDIDWD

SEQ ID NO: 133336 - protein, 14 aa, Mycobacterium tuberculosis
STISSKADDIDWDA

SEQ ID NO: 133337 - protein, 14 aa, Mycobacterium tuberculosis
TISSKADDIDWDAI

SEQ ID NO: 133338 - protein, 14 aa, Mycobacterium tuberculosis
ISSKADDIDWDAIA

SEQ ID NO: 133339 - protein, 14 aa, Mycobacterium tuberculosis
SSKADDIDWDAIAQ

SEQ ID NO: 133340 - protein, 14 aa, Mycobacterium tuberculosis
SKADDIDWDAIAQC

SEQ ID NO: 133341 - protein, 14 aa, Mycobacterium tuberculosis
KADDIDWDAIAQCE

SEQ ID NO: 133342 - protein, 14 aa, Mycobacterium tuberculosis
ADDIDWDAIAQCES

SEQ ID NO: 133343 - protein, 14 aa, Mycobacterium tuberculosis
DDIDWDAIAQCESG

SEQ ID NO: 133344 - protein, 14 aa, Mycobacterium tuberculosis
DIDWDAIAQCESGG

SEQ ID NO: 133345 - protein, 14 aa, Mycobacterium tuberculosis
IDWDAIAQCESGGN

SEQ ID NO: 133346 - protein, 14 aa, Mycobacterium tuberculosis
DWDAIAQCESGGNW

SEQ ID NO: 133347 - protein, 14 aa, Mycobacterium tuberculosis
WDAIAQCESGGNWA

SEQ ID NO: 133348 - protein, 14 aa, Mycobacterium tuberculosis
DAIAQCESGGNWAA

SEQ ID NO: 133349 - protein, 14 aa, Mycobacterium tuberculosis
AIAQCESGGNWAAN

SEQ ID NO: 133350 - protein, 14 aa, Mycobacterium tuberculosis
IAQCESGGNWAANT

SEQ ID NO: 133351 - protein, 14 aa, Mycobacterium tuberculosis
AQCESGGNWAANTG

SEQ ID NO: 133352 - protein, 14 aa, Mycobacterium tuberculosis
QCESGGNWAANTGN

SEQ ID NO: 133353 - protein, 14 aa, Mycobacterium tuberculosis
CESGGNWAANTGNG

SEQ ID NO: 133354 - protein, 14 aa, Mycobacterium tuberculosis
ESGGNWAANTGNGL

SEQ ID NO: 133355 - protein, 14 aa, Mycobacterium tuberculosis
SGGNWAANTGNGLY

SEQ ID NO: 133356 - protein, 14 aa, Mycobacterium tuberculosis
GGNWAANTGNGLYG

SEQ ID NO: 133357 - protein, 14 aa, Mycobacterium tuberculosis
GNWAANTGNGLYGG

SEQ ID NO: 133358 - protein, 14 aa, Mycobacterium tuberculosis
NWAANTGNGLYGGL

SEQ ID NO: 133359 - protein, 14 aa, Mycobacterium tuberculosis
WAANTGNGLYGGLQ

SEQ ID NO: 133360 - protein, 14 aa, Mycobacterium tuberculosis
AANTGNGLYGGLQI

SEQ ID NO: 133361 - protein, 14 aa, Mycobacterium tuberculosis
ANTGNGLYGGLQIS

SEQ ID NO: 133362 - protein, 14 aa, Mycobacterium tuberculosis
NTGNGLYGGLQISQ

SEQ ID NO: 133363 - protein, 14 aa, Mycobacterium tuberculosis
TGNGLYGGLQISQA

SEQ ID NO: 133364 - protein, 14 aa, Mycobacterium tuberculosis
GNGLYGGLQISQAT

SEQ ID NO: 133365 - protein, 14 aa, Mycobacterium tuberculosis
NGLYGGLQISQATW

SEQ ID NO: 133366 - protein, 14 aa, Mycobacterium tuberculosis
GLYGGLQISQATWD

SEQ ID NO: 133367 - protein, 14 aa, Mycobacterium tuberculosis
LYGGLQISQATWDS

SEQ ID NO: 133368 - protein, 14 aa, Mycobacterium tuberculosis
YGGLQISQATWDSN

SEQ ID NO: 133369 - protein, 14 aa, Mycobacterium tuberculosis
GGLQISQATWDSNG

SEQ ID NO: 133370 - protein, 14 aa, Mycobacterium tuberculosis
GLQISQATWDSNGG

SEQ ID NO: 133371 - protein, 14 aa, Mycobacterium tuberculosis
LQISQATWDSNGGV

SEQ ID NO: 133372 - protein, 14 aa, Mycobacterium tuberculosis
QISQATWDSNGGVG

SEQ ID NO: 133373 - protein, 14 aa, Mycobacterium tuberculosis
ISQATWDSNGGVGS

SEQ ID NO: 133374 - protein, 14 aa, Mycobacterium tuberculosis
SQATWDSNGGVGSP

SEQ ID NO: 133375 - protein, 14 aa, Mycobacterium tuberculosis
QATWDSNGGVGSPA

SEQ ID NO: 133376 - protein, 14 aa, Mycobacterium tuberculosis
ATWDSNGGVGSPAA

SEQ ID NO: 133377 - protein, 14 aa, Mycobacterium tuberculosis
TWDSNGGVGSPAAA

SEQ ID NO: 133378 - protein, 14 aa, Mycobacterium tuberculosis
WDSNGGVGSPAAAS

SEQ ID NO: 133379 - protein, 14 aa, Mycobacterium tuberculosis
DSNGGVGSPAAASP

SEQ ID NO: 133380 - protein, 14 aa, Mycobacterium tuberculosis
SNGGVGSPAAASPQ

SEQ ID NO: 133381 - protein, 14 aa, Mycobacterium tuberculosis
NGGVGSPAAASPQQ

SEQ ID NO: 133382 - protein, 14 aa, Mycobacterium tuberculosis
GGVGSPAAASPQQQ

SEQ ID NO: 133383 - protein, 14 aa, Mycobacterium tuberculosis
GVGSPAAASPQQQI

SEQ ID NO: 133384 - protein, 14 aa, Mycobacterium tuberculosis
VGSPAAASPQQQIE

SEQ ID NO: 133385 - protein, 14 aa, Mycobacterium tuberculosis
GSPAAASPQQQIEV

SEQ ID NO: 133386 - protein, 14 aa, Mycobacterium tuberculosis
SPAAASPQQQIEVA

SEQ ID NO: 133387 - protein, 14 aa, Mycobacterium tuberculosis
PAAASPQQQIEVAD

SEQ ID NO: 133388 - protein, 14 aa, Mycobacterium tuberculosis
AAASPQQQIEVADN

SEQ ID NO: 133389 - protein, 14 aa, Mycobacterium tuberculosis
AASPQQQIEVADNI

SEQ ID NO: 133390 - protein, 14 aa, Mycobacterium tuberculosis
ASPQQQIEVADNIM

SEQ ID NO: 133391 - protein, 14 aa, Mycobacterium tuberculosis
SPQQQIEVADNIMK

SEQ ID NO: 133392 - protein, 14 aa, Mycobacterium tuberculosis
PQQQIEVADNIMKT

SEQ ID NO: 133393 - protein, 14 aa, Mycobacterium tuberculosis
QQQIEVADNIMKTQ

SEQ ID NO: 133394 - protein, 14 aa, Mycobacterium tuberculosis
QQIEVADNIMKTQG

SEQ ID NO: 133395 - protein, 14 aa, Mycobacterium tuberculosis
QIEVADNIMKTQGP

SEQ ID NO: 133396 - protein, 14 aa, Mycobacterium tuberculosis
IEVADNIMKTQGPG

SEQ ID NO: 133397 - protein, 14 aa, Mycobacterium tuberculosis
EVADNIMKTQGPGA

SEQ ID NO: 133398 - protein, 14 aa, Mycobacterium tuberculosis
VADNIMKTQGPGAW

SEQ ID NO: 133399 - protein, 14 aa, Mycobacterium tuberculosis
ADNIMKTQGPGAWP

SEQ ID NO: 133400 - protein, 14 aa, Mycobacterium tuberculosis
DNIMKTQGPGAWPK

SEQ ID NO: 133401 - protein, 14 aa, Mycobacterium tuberculosis
NIMKTQGPGAWPKC

SEQ ID NO: 133402 - protein, 14 aa, Mycobacterium tuberculosis
IMKTQGPGAWPKCS

SEQ ID NO: 133403 - protein, 14 aa, Mycobacterium tuberculosis
MKTQGPGAWPKCSS

SEQ ID NO: 133404 - protein, 14 aa, Mycobacterium tuberculosis
KTQGPGAWPKCSSC

SEQ ID NO: 133405 - protein, 14 aa, Mycobacterium tuberculosis
TQGPGAWPKCSSCS

SEQ ID NO: 133406 - protein, 14 aa, Mycobacterium tuberculosis
QGPGAWPKCSSCSQ

SEQ ID NO: 133407 - protein, 14 aa, Mycobacterium tuberculosis
GPGAWPKCSSCSQG

SEQ ID NO: 133408 - protein, 14 aa, Mycobacterium tuberculosis
PGAWPKCSSCSQGD

SEQ ID NO: 133409 - protein, 14 aa, Mycobacterium tuberculosis
GAWPKCSSCSQGDA

SEQ ID NO: 133410 - protein, 14 aa, Mycobacterium tuberculosis
AWPKCSSCSQGDAP

SEQ ID NO: 133411 - protein, 14 aa, Mycobacterium tuberculosis
WPKCSSCSQGDAPL

SEQ ID NO: 133412 - protein, 14 aa, Mycobacterium tuberculosis
PKCSSCSQGDAPLG

SEQ ID NO: 133413 - protein, 14 aa, Mycobacterium tuberculosis
KCSSCSQGDAPLGS

SEQ ID NO: 133414 - protein, 14 aa, Mycobacterium tuberculosis
CSSCSQGDAPLGSL

SEQ ID NO: 133415 - protein, 14 aa, Mycobacterium tuberculosis
SSCSQGDAPLGSLT

SEQ ID NO: 133416 - protein, 14 aa, Mycobacterium tuberculosis
SCSQGDAPLGSLTH

SEQ ID NO: 133417 - protein, 14 aa, Mycobacterium tuberculosis
CSQGDAPLGSLTHI

SEQ ID NO: 133418 - protein, 14 aa, Mycobacterium tuberculosis
SQGDAPLGSLTHIL

SEQ ID NO: 133419 - protein, 14 aa, Mycobacterium tuberculosis
QGDAPLGSLTHILT

SEQ ID NO: 133420 - protein, 14 aa, Mycobacterium tuberculosis
GDAPLGSLTHILTF

SEQ ID NO: 133421 - protein, 14 aa, Mycobacterium tuberculosis
DAPLGSLTHILTFL

SEQ ID NO: 133422 - protein, 14 aa, Mycobacterium tuberculosis
APLGSLTHILTFLA

SEQ ID NO: 133423 - protein, 14 aa, Mycobacterium tuberculosis
PLGSLTHILTFLAA

SEQ ID NO: 133424 - protein, 14 aa, Mycobacterium tuberculosis
LGSLTHILTFLAAE

SEQ ID NO: 133425 - protein, 14 aa, Mycobacterium tuberculosis
GSLTHILTFLAAET

SEQ ID NO: 133426 - protein, 14 aa, Mycobacterium tuberculosis
SLTHILTFLAAETG

SEQ ID NO: 133427 - protein, 14 aa, Mycobacterium tuberculosis
LTHILTFLAAETGG

SEQ ID NO: 133428 - protein, 14 aa, Mycobacterium tuberculosis
THILTFLAAETGGC

SEQ ID NO: 133429 - protein, 14 aa, Mycobacterium tuberculosis
HILTFLAAETGGCS

SEQ ID NO: 133430 - protein, 14 aa, Mycobacterium tuberculosis
ILTFLAAETGGCSG

SEQ ID NO: 133431 - protein, 14 aa, Mycobacterium tuberculosis
LTFLAAETGGCSGS

SEQ ID NO: 133432 - protein, 14 aa, Mycobacterium tuberculosis
TFLAAETGGCSGSR

SEQ ID NO: 133433 - protein, 14 aa, Mycobacterium tuberculosis
FLAAETGGCSGSRD

SEQ ID NO: 133434 - protein, 14 aa, Mycobacterium tuberculosis
LAAETGGCSGSRDD

SEQ ID NO: 133435 - protein, 15 aa, Mycobacterium tuberculosis
MTPGLLTTAGAGRPR

SEQ ID NO: 133436 - protein, 15 aa, Mycobacterium tuberculosis
TPGLLTTAGAGRPRD

SEQ ID NO: 133437 - protein, 15 aa, Mycobacterium tuberculosis
PGLLTTAGAGRPRDR

SEQ ID NO: 133438 - protein, 15 aa, Mycobacterium tuberculosis
GLLTTAGAGRPRDRC

SEQ ID NO: 133439 - protein, 15 aa, Mycobacterium tuberculosis
LLTTAGAGRPRDRCA

SEQ ID NO: 133440 - protein, 15 aa, Mycobacterium tuberculosis
LTTAGAGRPRDRCAR

SEQ ID NO: 133441 - protein, 15 aa, Mycobacterium tuberculosis
TTAGAGRPRDRCARI

SEQ ID NO: 133442 - protein, 15 aa, Mycobacterium tuberculosis
TAGAGRPRDRCARIV

SEQ ID NO: 133443 - protein, 15 aa, Mycobacterium tuberculosis
AGAGRPRDRCARIVC

SEQ ID NO: 133444 - protein, 15 aa, Mycobacterium tuberculosis
GAGRPRDRCARIVCT

SEQ ID NO: 133445 - protein, 15 aa, Mycobacterium tuberculosis
AGRPRDRCARIVCTV

SEQ ID NO: 133446 - protein, 15 aa, Mycobacterium tuberculosis
GRPRDRCARIVCTVF

SEQ ID NO: 133447 - protein, 15 aa, Mycobacterium tuberculosis
RPRDRCARIVCTVFI

SEQ ID NO: 133448 - protein, 15 aa, Mycobacterium tuberculosis
PRDRCARIVCTVFIE

SEQ ID NO: 133449 - protein, 15 aa, Mycobacterium tuberculosis
RDRCARIVCTVFIET

SEQ ID NO: 133450 - protein, 15 aa, Mycobacterium tuberculosis
DRCARIVCTVFIETA

SEQ ID NO: 133451 - protein, 15 aa, Mycobacterium tuberculosis
RCARIVCTVFIETAV

SEQ ID NO: 133452 - protein, 15 aa, Mycobacterium tuberculosis
CARIVCTVFIETAVV

SEQ ID NO: 133453 - protein, 15 aa, Mycobacterium tuberculosis
ARIVCTVFIETAVVA

SEQ ID NO: 133454 - protein, 15 aa, Mycobacterium tuberculosis
RIVCTVFIETAVVAT

SEQ ID NO: 133455 - protein, 15 aa, Mycobacterium tuberculosis
IVCTVFIETAVVATM

SEQ ID NO: 133456 - protein, 15 aa, Mycobacterium tuberculosis
VCTVFIETAVVATMF

SEQ ID NO: 133457 - protein, 15 aa, Mycobacterium tuberculosis
CTVFIETAVVATMFV

SEQ ID NO: 133458 - protein, 15 aa, Mycobacterium tuberculosis
TVFIETAVVATMFVA

SEQ ID NO: 133459 - protein, 15 aa, Mycobacterium tuberculosis
VFIETAVVATMFVAL

SEQ ID NO: 133460 - protein, 15 aa, Mycobacterium tuberculosis
FIETAVVATMFVALL

SEQ ID NO: 133461 - protein, 15 aa, Mycobacterium tuberculosis
IETAVVATMFVALLG

SEQ ID NO: 133462 - protein, 15 aa, Mycobacterium tuberculosis
ETAVVATMFVALLGL

SEQ ID NO: 133463 - protein, 15 aa, Mycobacterium tuberculosis
TAVVATMFVALLGLS

SEQ ID NO: 133464 - protein, 15 aa, Mycobacterium tuberculosis
AVVATMFVALLGLST

SEQ ID NO: 133465 - protein, 15 aa, Mycobacterium tuberculosis
VVATMFVALLGLSTI

SEQ ID NO: 133466 - protein, 15 aa, Mycobacterium tuberculosis
VATMFVALLGLSTIS

SEQ ID NO: 133467 - protein, 15 aa, Mycobacterium tuberculosis
ATMFVALLGLSTISS

SEQ ID NO: 133468 - protein, 15 aa, Mycobacterium tuberculosis
TMFVALLGLSTISSK

SEQ ID NO: 133469 - protein, 15 aa, Mycobacterium tuberculosis
MFVALLGLSTISSKA

SEQ ID NO: 133470 - protein, 15 aa, Mycobacterium tuberculosis
FVALLGLSTISSKAD

SEQ ID NO: 133471 - protein, 15 aa, Mycobacterium tuberculosis
VALLGLSTISSKADD

SEQ ID NO: 133472 - protein, 15 aa, Mycobacterium tuberculosis
ALLGLSTISSKADDI

SEQ ID NO: 133473 - protein, 15 aa, Mycobacterium tuberculosis
LLGLSTISSKADDID

SEQ ID NO: 133474 - protein, 15 aa, Mycobacterium tuberculosis
LGLSTISSKADDIDW

SEQ ID NO: 133475 - protein, 15 aa, Mycobacterium tuberculosis
GLSTISSKADDIDWD

SEQ ID NO: 133476 - protein, 15 aa, Mycobacterium tuberculosis
LSTISSKADDIDWDA

SEQ ID NO: 133477 - protein, 15 aa, Mycobacterium tuberculosis
STISSKADDIDWDAI

SEQ ID NO: 133478 - protein, 15 aa, Mycobacterium tuberculosis
TISSKADDIDWDAIA

SEQ ID NO: 133479 - protein, 15 aa, Mycobacterium tuberculosis
ISSKADDIDWDAIAQ

SEQ ID NO: 133480 - protein, 15 aa, Mycobacterium tuberculosis
SSKADDIDWDAIAQC

SEQ ID NO: 133481 - protein, 15 aa, Mycobacterium tuberculosis
SKADDIDWDAIAQCE

SEQ ID NO: 133482 - protein, 15 aa, Mycobacterium tuberculosis
KADDIDWDAIAQCES

SEQ ID NO: 133483 - protein, 15 aa, Mycobacterium tuberculosis
ADDIDWDAIAQCESG

SEQ ID NO: 133484 - protein, 15 aa, Mycobacterium tuberculosis
DDIDWDAIAQCESGG

SEQ ID NO: 133485 - protein, 15 aa, Mycobacterium tuberculosis
DIDWDAIAQCESGGN

SEQ ID NO: 133486 - protein, 15 aa, Mycobacterium tuberculosis
IDWDAIAQCESGGNW

SEQ ID NO: 133487 - protein, 15 aa, Mycobacterium tuberculosis
DWDAIAQCESGGNWA

SEQ ID NO: 133488 - protein, 15 aa, Mycobacterium tuberculosis
WDAIAQCESGGNWAA

SEQ ID NO: 133489 - protein, 15 aa, Mycobacterium tuberculosis
DAIAQCESGGNWAAN

SEQ ID NO: 133490 - protein, 15 aa, Mycobacterium tuberculosis
AIAQCESGGNWAANT

SEQ ID NO: 133491 - protein, 15 aa, Mycobacterium tuberculosis
IAQCESGGNWAANTG

SEQ ID NO: 133492 - protein, 15 aa, Mycobacterium tuberculosis
AQCESGGNWAANTGN

SEQ ID NO: 133493 - protein, 15 aa, Mycobacterium tuberculosis
QCESGGNWAANTGNG

SEQ ID NO: 133494 - protein, 15 aa, Mycobacterium tuberculosis
CESGGNWAANTGNGL

SEQ ID NO: 133495 - protein, 15 aa, Mycobacterium tuberculosis
ESGGNWAANTGNGLY

SEQ ID NO: 133496 - protein, 15 aa, Mycobacterium tuberculosis
SGGNWAANTGNGLYG

SEQ ID NO: 133497 - protein, 15 aa, Mycobacterium tuberculosis
GGNWAANTGNGLYGG

SEQ ID NO: 133498 - protein, 15 aa, Mycobacterium tuberculosis
GNWAANTGNGLYGGL

SEQ ID NO: 133499 - protein, 15 aa, Mycobacterium tuberculosis
NWAANTGNGLYGGLQ

SEQ ID NO: 133500 - protein, 15 aa, Mycobacterium tuberculosis
WAANTGNGLYGGLQI

SEQ ID NO: 133501 - protein, 15 aa, Mycobacterium tuberculosis
AANTGNGLYGGLQIS

SEQ ID NO: 133502 - protein, 15 aa, Mycobacterium tuberculosis
ANTGNGLYGGLQISQ

SEQ ID NO: 133503 - protein, 15 aa, Mycobacterium tuberculosis
NTGNGLYGGLQISQA

SEQ ID NO: 133504 - protein, 15 aa, Mycobacterium tuberculosis
TGNGLYGGLQISQAT

SEQ ID NO: 133505 - protein, 15 aa, Mycobacterium tuberculosis
GNGLYGGLQISQATW

SEQ ID NO: 133506 - protein, 15 aa, Mycobacterium tuberculosis
NGLYGGLQISQATWD

SEQ ID NO: 133507 - protein, 15 aa, Mycobacterium tuberculosis
GLYGGLQISQATWDS

SEQ ID NO: 133508 - protein, 15 aa, Mycobacterium tuberculosis
LYGGLQISQATWDSN

SEQ ID NO: 133509 - protein, 15 aa, Mycobacterium tuberculosis
YGGLQISQATWDSNG

SEQ ID NO: 133510 - protein, 15 aa, Mycobacterium tuberculosis
GGLQISQATWDSNGG

SEQ ID NO: 133511 - protein, 15 aa, Mycobacterium tuberculosis
GLQISQATWDSNGGV

SEQ ID NO: 133512 - protein, 15 aa, Mycobacterium tuberculosis
LQISQATWDSNGGVG

SEQ ID NO: 133513 - protein, 15 aa, Mycobacterium tuberculosis
QISQATWDSNGGVGS

SEQ ID NO: 133514 - protein, 15 aa, Mycobacterium tuberculosis
ISQATWDSNGGVGSP

SEQ ID NO: 133515 - protein, 15 aa, Mycobacterium tuberculosis
SQATWDSNGGVGSPA

SEQ ID NO: 133516 - protein, 15 aa, Mycobacterium tuberculosis
QATWDSNGGVGSPAA

SEQ ID NO: 133517 - protein, 15 aa, Mycobacterium tuberculosis
ATWDSNGGVGSPAAA

SEQ ID NO: 133518 - protein, 15 aa, Mycobacterium tuberculosis
TWDSNGGVGSPAAAS

SEQ ID NO: 133519 - protein, 15 aa, Mycobacterium tuberculosis
WDSNGGVGSPAAASP

SEQ ID NO: 133520 - protein, 15 aa, Mycobacterium tuberculosis
DSNGGVGSPAAASPQ

SEQ ID NO: 133521 - protein, 15 aa, Mycobacterium tuberculosis
SNGGVGSPAAASPQQ

SEQ ID NO: 133522 - protein, 15 aa, Mycobacterium tuberculosis
NGGVGSPAAASPQQQ

SEQ ID NO: 133523 - protein, 15 aa, Mycobacterium tuberculosis
GGVGSPAAASPQQQI

SEQ ID NO: 133524 - protein, 15 aa, Mycobacterium tuberculosis
GVGSPAAASPQQQIE

SEQ ID NO: 133525 - protein, 15 aa, Mycobacterium tuberculosis
VGSPAAASPQQQIEV

SEQ ID NO: 133526 - protein, 15 aa, Mycobacterium tuberculosis
GSPAAASPQQQIEVA

SEQ ID NO: 133527 - protein, 15 aa, Mycobacterium tuberculosis
SPAAASPQQQIEVAD

SEQ ID NO: 133528 - protein, 15 aa, Mycobacterium tuberculosis
PAAASPQQQIEVADN

SEQ ID NO: 133529 - protein, 15 aa, Mycobacterium tuberculosis
AAASPQQQIEVADNI

SEQ ID NO: 133530 - protein, 15 aa, Mycobacterium tuberculosis
AASPQQQIEVADNIM

SEQ ID NO: 133531 - protein, 15 aa, Mycobacterium tuberculosis
ASPQQQIEVADNIMK

SEQ ID NO: 133532 - protein, 15 aa, Mycobacterium tuberculosis
SPQQQIEVADNIMKT

SEQ ID NO: 133533 - protein, 15 aa, Mycobacterium tuberculosis
PQQQIEVADNIMKTQ

SEQ ID NO: 133534 - protein, 15 aa, Mycobacterium tuberculosis
QQQIEVADNIMKTQG

SEQ ID NO: 133535 - protein, 15 aa, Mycobacterium tuberculosis
QQIEVADNIMKTQGP

SEQ ID NO: 133536 - protein, 15 aa, Mycobacterium tuberculosis
QIEVADNIMKTQGPG

SEQ ID NO: 133537 - protein, 15 aa, Mycobacterium tuberculosis
IEVADNIMKTQGPGA

SEQ ID NO: 133538 - protein, 15 aa, Mycobacterium tuberculosis
EVADNIMKTQGPGAW

SEQ ID NO: 133539 - protein, 15 aa, Mycobacterium tuberculosis
VADNIMKTQGPGAWP

SEQ ID NO: 133540 - protein, 15 aa, Mycobacterium tuberculosis
ADNIMKTQGPGAWPK

SEQ ID NO: 133541 - protein, 15 aa, Mycobacterium tuberculosis
DNIMKTQGPGAWPKC

SEQ ID NO: 133542 - protein, 15 aa, Mycobacterium tuberculosis
NIMKTQGPGAWPKCS

SEQ ID NO: 133543 - protein, 15 aa, Mycobacterium tuberculosis
IMKTQGPGAWPKCSS

SEQ ID NO: 133544 - protein, 15 aa, Mycobacterium tuberculosis
MKTQGPGAWPKCSSC

SEQ ID NO: 133545 - protein, 15 aa, Mycobacterium tuberculosis
KTQGPGAWPKCSSCS

SEQ ID NO: 133546 - protein, 15 aa, Mycobacterium tuberculosis
TQGPGAWPKCSSCSQ

SEQ ID NO: 133547 - protein, 15 aa, Mycobacterium tuberculosis
QGPGAWPKCSSCSQG

SEQ ID NO: 133548 - protein, 15 aa, Mycobacterium tuberculosis
GPGAWPKCSSCSQGD

SEQ ID NO: 133549 - protein, 15 aa, Mycobacterium tuberculosis
PGAWPKCSSCSQGDA

SEQ ID NO: 133550 - protein, 15 aa, Mycobacterium tuberculosis
GAWPKCSSCSQGDAP

SEQ ID NO: 133551 - protein, 15 aa, Mycobacterium tuberculosis
AWPKCSSCSQGDAPL

SEQ ID NO: 133552 - protein, 15 aa, Mycobacterium tuberculosis
WPKCSSCSQGDAPLG

SEQ ID NO: 133553 - protein, 15 aa, Mycobacterium tuberculosis
PKCSSCSQGDAPLGS

SEQ ID NO: 133554 - protein, 15 aa, Mycobacterium tuberculosis
KCSSCSQGDAPLGSL

SEQ ID NO: 133555 - protein, 15 aa, Mycobacterium tuberculosis
CSSCSQGDAPLGSLT

SEQ ID NO: 133556 - protein, 15 aa, Mycobacterium tuberculosis
SSCSQGDAPLGSLTH

SEQ ID NO: 133557 - protein, 15 aa, Mycobacterium tuberculosis
SCSQGDAPLGSLTHI

SEQ ID NO: 133558 - protein, 15 aa, Mycobacterium tuberculosis
CSQGDAPLGSLTHIL

SEQ ID NO: 133559 - protein, 15 aa, Mycobacterium tuberculosis
SQGDAPLGSLTHILT

SEQ ID NO: 133560 - protein, 15 aa, Mycobacterium tuberculosis
QGDAPLGSLTHILTF

SEQ ID NO: 133561 - protein, 15 aa, Mycobacterium tuberculosis
GDAPLGSLTHILTFL

SEQ ID NO: 133562 - protein, 15 aa, Mycobacterium tuberculosis
DAPLGSLTHILTFLA

SEQ ID NO: 133563 - protein, 15 aa, Mycobacterium tuberculosis
APLGSLTHILTFLAA

SEQ ID NO: 133564 - protein, 15 aa, Mycobacterium tuberculosis
PLGSLTHILTFLAAE

SEQ ID NO: 133565 - protein, 15 aa, Mycobacterium tuberculosis
LGSLTHILTFLAAET

SEQ ID NO: 133566 - protein, 15 aa, Mycobacterium tuberculosis
GSLTHILTFLAAETG

SEQ ID NO: 133567 - protein, 15 aa, Mycobacterium tuberculosis
SLTHILTFLAAETGG

SEQ ID NO: 133568 - protein, 15 aa, Mycobacterium tuberculosis
LTHILTFLAAETGGC

SEQ ID NO: 133569 - protein, 15 aa, Mycobacterium tuberculosis
THILTFLAAETGGCS

SEQ ID NO: 133570 - protein, 15 aa, Mycobacterium tuberculosis
HILTFLAAETGGCSG

SEQ ID NO: 133571 - protein, 15 aa, Mycobacterium tuberculosis
ILTFLAAETGGCSGS

SEQ ID NO: 133572 - protein, 15 aa, Mycobacterium tuberculosis
LTFLAAETGGCSGSR

SEQ ID NO: 133573 - protein, 15 aa, Mycobacterium tuberculosis
TFLAAETGGCSGSRD

SEQ ID NO: 133574 - protein, 15 aa, Mycobacterium tuberculosis
FLAAETGGCSGSRDD

SEQ ID NO: 133575 - protein, 16 aa, Mycobacterium tuberculosis
MTPGLLTTAGAGRPRD

SEQ ID NO: 133576 - protein, 16 aa, Mycobacterium tuberculosis
TPGLLTTAGAGRPRDR

SEQ ID NO: 133577 - protein, 16 aa, Mycobacterium tuberculosis
PGLLTTAGAGRPRDRC

SEQ ID NO: 133578 - protein, 16 aa, Mycobacterium tuberculosis
GLLTTAGAGRPRDRCA

SEQ ID NO: 133579 - protein, 16 aa, Mycobacterium tuberculosis
LLTTAGAGRPRDRCAR

SEQ ID NO: 133580 - protein, 16 aa, Mycobacterium tuberculosis
LTTAGAGRPRDRCARI

SEQ ID NO: 133581 - protein, 16 aa, Mycobacterium tuberculosis
TTAGAGRPRDRCARIV

SEQ ID NO: 133582 - protein, 16 aa, Mycobacterium tuberculosis
TAGAGRPRDRCARIVC

SEQ ID NO: 133583 - protein, 16 aa, Mycobacterium tuberculosis
AGAGRPRDRCARIVCT

SEQ ID NO: 133584 - protein, 16 aa, Mycobacterium tuberculosis
GAGRPRDRCARIVCTV

SEQ ID NO: 133585 - protein, 16 aa, Mycobacterium tuberculosis
AGRPRDRCARIVCTVF

SEQ ID NO: 133586 - protein, 16 aa, Mycobacterium tuberculosis
GRPRDRCARIVCTVFI

SEQ ID NO: 133587 - protein, 16 aa, Mycobacterium tuberculosis
RPRDRCARIVCTVFIE

SEQ ID NO: 133588 - protein, 16 aa, Mycobacterium tuberculosis
PRDRCARIVCTVFIET

SEQ ID NO: 133589 - protein, 16 aa, Mycobacterium tuberculosis
RDRCARIVCTVFIETA

SEQ ID NO: 133590 - protein, 16 aa, Mycobacterium tuberculosis
DRCARIVCTVFIETAV

SEQ ID NO: 133591 - protein, 16 aa, Mycobacterium tuberculosis
RCARIVCTVFIETAVV

SEQ ID NO: 133592 - protein, 16 aa, Mycobacterium tuberculosis
CARIVCTVFIETAVVA

SEQ ID NO: 133593 - protein, 16 aa, Mycobacterium tuberculosis
ARIVCTVFIETAVVAT

SEQ ID NO: 133594 - protein, 16 aa, Mycobacterium tuberculosis
RIVCTVFIETAVVATM

SEQ ID NO: 133595 - protein, 16 aa, Mycobacterium tuberculosis
IVCTVFIETAVVATMF

SEQ ID NO: 133596 - protein, 16 aa, Mycobacterium tuberculosis
VCTVFIETAVVATMFV

SEQ ID NO: 133597 - protein, 16 aa, Mycobacterium tuberculosis
CTVFIETAVVATMFVA

SEQ ID NO: 133598 - protein, 16 aa, Mycobacterium tuberculosis
TVFIETAVVATMFVAL

SEQ ID NO: 133599 - protein, 16 aa, Mycobacterium tuberculosis
VFIETAVVATMFVALL

SEQ ID NO: 133600 - protein, 16 aa, Mycobacterium tuberculosis
FIETAVVATMFVALLG

SEQ ID NO: 133601 - protein, 16 aa, Mycobacterium tuberculosis
IETAVVATMFVALLGL

SEQ ID NO: 133602 - protein, 16 aa, Mycobacterium tuberculosis
ETAVVATMFVALLGLS

SEQ ID NO: 133603 - protein, 16 aa, Mycobacterium tuberculosis
TAVVATMFVALLGLST

SEQ ID NO: 133604 - protein, 16 aa, Mycobacterium tuberculosis
AVVATMFVALLGLSTI

SEQ ID NO: 133605 - protein, 16 aa, Mycobacterium tuberculosis
VVATMFVALLGLSTIS

SEQ ID NO: 133606 - protein, 16 aa, Mycobacterium tuberculosis
VATMFVALLGLSTISS

SEQ ID NO: 133607 - protein, 16 aa, Mycobacterium tuberculosis
ATMFVALLGLSTISSK

SEQ ID NO: 133608 - protein, 16 aa, Mycobacterium tuberculosis
TMFVALLGLSTISSKA

SEQ ID NO: 133609 - protein, 16 aa, Mycobacterium tuberculosis
MFVALLGLSTISSKAD

SEQ ID NO: 133610 - protein, 16 aa, Mycobacterium tuberculosis
FVALLGLSTISSKADD

SEQ ID NO: 133611 - protein, 16 aa, Mycobacterium tuberculosis
VALLGLSTISSKADDI

SEQ ID NO: 133612 - protein, 16 aa, Mycobacterium tuberculosis
ALLGLSTISSKADDID

SEQ ID NO: 133613 - protein, 16 aa, Mycobacterium tuberculosis
LLGLSTISSKADDIDW

SEQ ID NO: 133614 - protein, 16 aa, Mycobacterium tuberculosis
LGLSTISSKADDIDWD

SEQ ID NO: 133615 - protein, 16 aa, Mycobacterium tuberculosis
GLSTISSKADDIDWDA

SEQ ID NO: 133616 - protein, 16 aa, Mycobacterium tuberculosis
LSTISSKADDIDWDAI

SEQ ID NO: 133617 - protein, 16 aa, Mycobacterium tuberculosis
STISSKADDIDWDAIA

SEQ ID NO: 133618 - protein, 16 aa, Mycobacterium tuberculosis
TISSKADDIDWDAIAQ

SEQ ID NO: 133619 - protein, 16 aa, Mycobacterium tuberculosis
ISSKADDIDWDAIAQC

SEQ ID NO: 133620 - protein, 16 aa, Mycobacterium tuberculosis
SSKADDIDWDAIAQCE

SEQ ID NO: 133621 - protein, 16 aa, Mycobacterium tuberculosis
SKADDIDWDAIAQCES

SEQ ID NO: 133622 - protein, 16 aa, Mycobacterium tuberculosis
KADDIDWDAIAQCESG

SEQ ID NO: 133623 - protein, 16 aa, Mycobacterium tuberculosis
ADDIDWDAIAQCESGG

SEQ ID NO: 133624 - protein, 16 aa, Mycobacterium tuberculosis
DDIDWDAIAQCESGGN

SEQ ID NO: 133625 - protein, 16 aa, Mycobacterium tuberculosis
DIDWDAIAQCESGGNW

SEQ ID NO: 133626 - protein, 16 aa, Mycobacterium tuberculosis
IDWDAIAQCESGGNWA

SEQ ID NO: 133627 - protein, 16 aa, Mycobacterium tuberculosis
DWDAIAQCESGGNWAA

SEQ ID NO: 133628 - protein, 16 aa, Mycobacterium tuberculosis
WDAIAQCESGGNWAAN

SEQ ID NO: 133629 - protein, 16 aa, Mycobacterium tuberculosis
DAIAQCESGGNWAANT

SEQ ID NO: 133630 - protein, 16 aa, Mycobacterium tuberculosis
AIAQCESGGNWAANTG

SEQ ID NO: 133631 - protein, 16 aa, Mycobacterium tuberculosis
IAQCESGGNWAANTGN

SEQ ID NO: 133632 - protein, 16 aa, Mycobacterium tuberculosis
AQCESGGNWAANTGNG

SEQ ID NO: 133633 - protein, 16 aa, Mycobacterium tuberculosis
QCESGGNWAANTGNGL

SEQ ID NO: 133634 - protein, 16 aa, Mycobacterium tuberculosis
CESGGNWAANTGNGLY

SEQ ID NO: 133635 - protein, 16 aa, Mycobacterium tuberculosis
ESGGNWAANTGNGLYG

SEQ ID NO: 133636 - protein, 16 aa, Mycobacterium tuberculosis
SGGNWAANTGNGLYGG

SEQ ID NO: 133637 - protein, 16 aa, Mycobacterium tuberculosis
GGNWAANTGNGLYGGL

SEQ ID NO: 133638 - protein, 16 aa, Mycobacterium tuberculosis
GNWAANTGNGLYGGLQ

SEQ ID NO: 133639 - protein, 16 aa, Mycobacterium tuberculosis
NWAANTGNGLYGGLQI

SEQ ID NO: 133640 - protein, 16 aa, Mycobacterium tuberculosis
WAANTGNGLYGGLQIS

SEQ ID NO: 133641 - protein, 16 aa, Mycobacterium tuberculosis
AANTGNGLYGGLQISQ

SEQ ID NO: 133642 - protein, 16 aa, Mycobacterium tuberculosis
ANTGNGLYGGLQISQA

SEQ ID NO: 133643 - protein, 16 aa, Mycobacterium tuberculosis
NTGNGLYGGLQISQAT

SEQ ID NO: 133644 - protein, 16 aa, Mycobacterium tuberculosis
TGNGLYGGLQISQATW

SEQ ID NO: 133645 - protein, 16 aa, Mycobacterium tuberculosis
GNGLYGGLQISQATWD

SEQ ID NO: 133646 - protein, 16 aa, Mycobacterium tuberculosis
NGLYGGLQISQATWDS

SEQ ID NO: 133647 - protein, 16 aa, Mycobacterium tuberculosis
GLYGGLQISQATWDSN

SEQ ID NO: 133648 - protein, 16 aa, Mycobacterium tuberculosis
LYGGLQISQATWDSNG

SEQ ID NO: 133649 - protein, 16 aa, Mycobacterium tuberculosis
YGGLQISQATWDSNGG

SEQ ID NO: 133650 - protein, 16 aa, Mycobacterium tuberculosis
GGLQISQATWDSNGGV

SEQ ID NO: 133651 - protein, 16 aa, Mycobacterium tuberculosis
GLQISQATWDSNGGVG

SEQ ID NO: 133652 - protein, 16 aa, Mycobacterium tuberculosis
LQISQATWDSNGGVGS

SEQ ID NO: 133653 - protein, 16 aa, Mycobacterium tuberculosis
QISQATWDSNGGVGSP

SEQ ID NO: 133654 - protein, 16 aa, Mycobacterium tuberculosis
ISQATWDSNGGVGSPA

SEQ ID NO: 133655 - protein, 16 aa, Mycobacterium tuberculosis
SQATWDSNGGVGSPAA

SEQ ID NO: 133656 - protein, 16 aa, Mycobacterium tuberculosis
QATWDSNGGVGSPAAA

SEQ ID NO: 133657 - protein, 16 aa, Mycobacterium tuberculosis
ATWDSNGGVGSPAAAS

SEQ ID NO: 133658 - protein, 16 aa, Mycobacterium tuberculosis
TWDSNGGVGSPAAASP

SEQ ID NO: 133659 - protein, 16 aa, Mycobacterium tuberculosis
WDSNGGVGSPAAASPQ

SEQ ID NO: 133660 - protein, 16 aa, Mycobacterium tuberculosis
DSNGGVGSPAAASPQQ

SEQ ID NO: 133661 - protein, 16 aa, Mycobacterium tuberculosis
SNGGVGSPAAASPQQQ

SEQ ID NO: 133662 - protein, 16 aa, Mycobacterium tuberculosis
NGGVGSPAAASPQQQI

SEQ ID NO: 133663 - protein, 16 aa, Mycobacterium tuberculosis
GGVGSPAAASPQQQIE

SEQ ID NO: 133664 - protein, 16 aa, Mycobacterium tuberculosis
GVGSPAAASPQQQIEV

SEQ ID NO: 133665 - protein, 16 aa, Mycobacterium tuberculosis
VGSPAAASPQQQIEVA

SEQ ID NO: 133666 - protein, 16 aa, Mycobacterium tuberculosis
GSPAAASPQQQIEVAD

SEQ ID NO: 133667 - protein, 16 aa, Mycobacterium tuberculosis
SPAAASPQQQIEVADN

SEQ ID NO: 133668 - protein, 16 aa, Mycobacterium tuberculosis
PAAASPQQQIEVADNI

SEQ ID NO: 133669 - protein, 16 aa, Mycobacterium tuberculosis
AAASPQQQIEVADNIM

SEQ ID NO: 133670 - protein, 16 aa, Mycobacterium tuberculosis
AASPQQQIEVADNIMK

SEQ ID NO: 133671 - protein, 16 aa, Mycobacterium tuberculosis
ASPQQQIEVADNIMKT

SEQ ID NO: 133672 - protein, 16 aa, Mycobacterium tuberculosis
SPQQQIEVADNIMKTQ

SEQ ID NO: 133673 - protein, 16 aa, Mycobacterium tuberculosis
PQQQIEVADNIMKTQG

SEQ ID NO: 133674 - protein, 16 aa, Mycobacterium tuberculosis
QQQIEVADNIMKTQGP

SEQ ID NO: 133675 - protein, 16 aa, Mycobacterium tuberculosis
QQIEVADNIMKTQGPG

SEQ ID NO: 133676 - protein, 16 aa, Mycobacterium tuberculosis
QIEVADNIMKTQGPGA

SEQ ID NO: 133677 - protein, 16 aa, Mycobacterium tuberculosis
IEVADNIMKTQGPGAW

SEQ ID NO: 133678 - protein, 16 aa, Mycobacterium tuberculosis
EVADNIMKTQGPGAWP

SEQ ID NO: 133679 - protein, 16 aa, Mycobacterium tuberculosis
VADNIMKTQGPGAWPK

SEQ ID NO: 133680 - protein, 16 aa, Mycobacterium tuberculosis
ADNIMKTQGPGAWPKC

SEQ ID NO: 133681 - protein, 16 aa, Mycobacterium tuberculosis
DNIMKTQGPGAWPKCS

SEQ ID NO: 133682 - protein, 16 aa, Mycobacterium tuberculosis
NIMKTQGPGAWPKCSS

SEQ ID NO: 133683 - protein, 16 aa, Mycobacterium tuberculosis
IMKTQGPGAWPKCSSC

SEQ ID NO: 133684 - protein, 16 aa, Mycobacterium tuberculosis
MKTQGPGAWPKCSSCS

SEQ ID NO: 133685 - protein, 16 aa, Mycobacterium tuberculosis
KTQGPGAWPKCSSCSQ

SEQ ID NO: 133686 - protein, 16 aa, Mycobacterium tuberculosis
TQGPGAWPKCSSCSQG

SEQ ID NO: 133687 - protein, 16 aa, Mycobacterium tuberculosis
QGPGAWPKCSSCSQGD

SEQ ID NO: 133688 - protein, 16 aa, Mycobacterium tuberculosis
GPGAWPKCSSCSQGDA

SEQ ID NO: 133689 - protein, 16 aa, Mycobacterium tuberculosis
PGAWPKCSSCSQGDAP

SEQ ID NO: 133690 - protein, 16 aa, Mycobacterium tuberculosis
GAWPKCSSCSQGDAPL

SEQ ID NO: 133691 - protein, 16 aa, Mycobacterium tuberculosis
AWPKCSSCSQGDAPLG

SEQ ID NO: 133692 - protein, 16 aa, Mycobacterium tuberculosis
WPKCSSCSQGDAPLGS

SEQ ID NO: 133693 - protein, 16 aa, Mycobacterium tuberculosis
PKCSSCSQGDAPLGSL

SEQ ID NO: 133694 - protein, 16 aa, Mycobacterium tuberculosis
KCSSCSQGDAPLGSLT

SEQ ID NO: 133695 - protein, 16 aa, Mycobacterium tuberculosis
CSSCSQGDAPLGSLTH

SEQ ID NO: 133696 - protein, 16 aa, Mycobacterium tuberculosis
SSCSQGDAPLGSLTHI

SEQ ID NO: 133697 - protein, 16 aa, Mycobacterium tuberculosis
SCSQGDAPLGSLTHIL

SEQ ID NO: 133698 - protein, 16 aa, Mycobacterium tuberculosis
CSQGDAPLGSLTHILT

SEQ ID NO: 133699 - protein, 16 aa, Mycobacterium tuberculosis
SQGDAPLGSLTHILTF

SEQ ID NO: 133700 - protein, 16 aa, Mycobacterium tuberculosis
QGDAPLGSLTHILTFL

SEQ ID NO: 133701 - protein, 16 aa, Mycobacterium tuberculosis
GDAPLGSLTHILTFLA

SEQ ID NO: 133702 - protein, 16 aa, Mycobacterium tuberculosis
DAPLGSLTHILTFLAA

SEQ ID NO: 133703 - protein, 16 aa, Mycobacterium tuberculosis
APLGSLTHILTFLAAE

SEQ ID NO: 133704 - protein, 16 aa, Mycobacterium tuberculosis
PLGSLTHILTFLAAET

SEQ ID NO: 133705 - protein, 16 aa, Mycobacterium tuberculosis
LGSLTHILTFLAAETG

SEQ ID NO: 133706 - protein, 16 aa, Mycobacterium tuberculosis
GSLTHILTFLAAETGG

SEQ ID NO: 133707 - protein, 16 aa, Mycobacterium tuberculosis
SLTHILTFLAAETGGC

SEQ ID NO: 133708 - protein, 16 aa, Mycobacterium tuberculosis
LTHILTFLAAETGGCS

SEQ ID NO: 133709 - protein, 16 aa, Mycobacterium tuberculosis
THILTFLAAETGGCSG

SEQ ID NO: 133710 - protein, 16 aa, Mycobacterium tuberculosis
HILTFLAAETGGCSGS

SEQ ID NO: 133711 - protein, 16 aa, Mycobacterium tuberculosis
ILTFLAAETGGCSGSR

SEQ ID NO: 133712 - protein, 16 aa, Mycobacterium tuberculosis
LTFLAAETGGCSGSRD

SEQ ID NO: 133713 - protein, 16 aa, Mycobacterium tuberculosis
TFLAAETGGCSGSRDD

SEQ ID NO: 133714 - protein, 396 aa, Mycobacterium tuberculosis
MAKAKFQRTKPHVNIGTIGHVDHGKTTLTAAITKVLHDKFPDLNETKAFDQIDNAPEERQRGITINIAHVEYQTDKRHYAHVDAPGHADYIKNMITGAAQMDGAILVVAATDGPMPQTREHVLLARQVGVPYILVALNKADAVDDEELLELVEMEVRELLAAQEFDEDAPVVRVSALKALEGDAKWVASVEELMNAVDESIPDPVRETDKPFLMPVEDVFTITGRGTVVTGRVERGVINVNEEVEIVGIRPSTTKTTVTGVEMFRKLLDQGQAGDNVGLLLRGVKREDVERGQVVTKPGTTTPHTEFEGQVYILSKDEGGRHTPFFNNYRPQFYFRTTDVTGVVTLPEGTEMVMPGDNTNISVKLIQPVAMDEGLRFAIREGGRTVGAGRVTKIIK

SEQ ID NO: 133715 - protein, 8 aa, Mycobacterium tuberculosis
MAKAKFQR

SEQ ID NO: 133716 - protein, 8 aa, Mycobacterium tuberculosis
KAKFQRTK

SEQ ID NO: 133717 - protein, 8 aa, Mycobacterium tuberculosis
FQRTKPHV

SEQ ID NO: 133718 - protein, 8 aa, Mycobacterium tuberculosis
RTKPHVNI

SEQ ID NO: 133719 - protein, 8 aa, Mycobacterium tuberculosis
NIGTIGHV

SEQ ID NO: 133720 - protein, 8 aa, Mycobacterium tuberculosis
IGHVDHGK

SEQ ID NO: 133721 - protein, 8 aa, Mycobacterium tuberculosis
TLTAAITK

SEQ ID NO: 133722 - protein, 8 aa, Mycobacterium tuberculosis
LTAAITKV

SEQ ID NO: 133723 - protein, 8 aa, Mycobacterium tuberculosis
ITKVLHDK

SEQ ID NO: 133724 - protein, 8 aa, Mycobacterium tuberculosis
LHDKFPDL

SEQ ID NO: 133725 - protein, 8 aa, Mycobacterium tuberculosis
ETKAFDQI

SEQ ID NO: 133726 - protein, 8 aa, Mycobacterium tuberculosis
NAPEERQR

SEQ ID NO: 133727 - protein, 8 aa, Mycobacterium tuberculosis
ITINIAHV

SEQ ID NO: 133728 - protein, 8 aa, Mycobacterium tuberculosis
INIAHVEY

SEQ ID NO: 133729 - protein, 8 aa, Mycobacterium tuberculosis
HVEYQTDK

SEQ ID NO: 133730 - protein, 8 aa, Mycobacterium tuberculosis
YQTDKRHY

SEQ ID NO: 133731 - protein, 8 aa, Mycobacterium tuberculosis
HVDAPGHA

SEQ ID NO: 133732 - protein, 8 aa, Mycobacterium tuberculosis
DAPGHADY

SEQ ID NO: 133733 - protein, 8 aa, Mycobacterium tuberculosis
MITGAAQM

SEQ ID NO: 133734 - protein, 8 aa, Mycobacterium tuberculosis
AQMDGAIL

SEQ ID NO: 133735 - protein, 8 aa, Mycobacterium tuberculosis
QMDGAILV

SEQ ID NO: 133736 - protein, 8 aa, Mycobacterium tuberculosis
VAATDGPM

SEQ ID NO: 133737 - protein, 8 aa, Mycobacterium tuberculosis
MPQTREHV

SEQ ID NO: 133738 - protein, 8 aa, Mycobacterium tuberculosis
QTREHVLL

SEQ ID NO: 133739 - protein, 8 aa, Mycobacterium tuberculosis
REHVLLAR

SEQ ID NO: 133740 - protein, 8 aa, Mycobacterium tuberculosis
HVLLARQV

SEQ ID NO: 133741 - protein, 8 aa, Mycobacterium tuberculosis
LLARQVGV

SEQ ID NO: 133742 - protein, 8 aa, Mycobacterium tuberculosis
RQVGVPYI

SEQ ID NO: 133743 - protein, 8 aa, Mycobacterium tuberculosis
VGVPYILV

SEQ ID NO: 133744 - protein, 8 aa, Mycobacterium tuberculosis
VPYILVAL

SEQ ID NO: 133745 - protein, 8 aa, Mycobacterium tuberculosis
YILVALNK

SEQ ID NO: 133746 - protein, 8 aa, Mycobacterium tuberculosis
ILVALNKA

SEQ ID NO: 133747 - protein, 8 aa, Mycobacterium tuberculosis
ALNKADAV

SEQ ID NO: 133748 - protein, 8 aa, Mycobacterium tuberculosis
DAVDDEEL

SEQ ID NO: 133749 - protein, 8 aa, Mycobacterium tuberculosis
AVDDEELL

SEQ ID NO: 133750 - protein, 8 aa, Mycobacterium tuberculosis
ELLELVEM

SEQ ID NO: 133751 - protein, 8 aa, Mycobacterium tuberculosis
LELVEMEV

SEQ ID NO: 133752 - protein, 8 aa, Mycobacterium tuberculosis
ELVEMEVR

SEQ ID NO: 133753 - protein, 8 aa, Mycobacterium tuberculosis
VEMEVREL

SEQ ID NO: 133754 - protein, 8 aa, Mycobacterium tuberculosis
ELLAAQEF

SEQ ID NO: 133755 - protein, 8 aa, Mycobacterium tuberculosis
EFDEDAPV

SEQ ID NO: 133756 - protein, 8 aa, Mycobacterium tuberculosis
EDAPVVRV

SEQ ID NO: 133757 - protein, 8 aa, Mycobacterium tuberculosis
APVVRVSA

SEQ ID NO: 133758 - protein, 8 aa, Mycobacterium tuberculosis
PVVRVSAL

SEQ ID NO: 133759 - protein, 8 aa, Mycobacterium tuberculosis
VVRVSALK

SEQ ID NO: 133760 - protein, 8 aa, Mycobacterium tuberculosis
RVSALKAL

SEQ ID NO: 133761 - protein, 8 aa, Mycobacterium tuberculosis
KALEGDAK

SEQ ID NO: 133762 - protein, 8 aa, Mycobacterium tuberculosis
DAKWVASV

SEQ ID NO: 133763 - protein, 8 aa, Mycobacterium tuberculosis
WVASVEEL

SEQ ID NO: 133764 - protein, 8 aa, Mycobacterium tuberculosis
VASVEELM

SEQ ID NO: 133765 - protein, 8 aa, Mycobacterium tuberculosis
LMNAVDES

SEQ ID NO: 133766 - protein, 8 aa, Mycobacterium tuberculosis
ESIPDPVR

SEQ ID NO: 133767 - protein, 8 aa, Mycobacterium tuberculosis
RETDKPFL

SEQ ID NO: 133768 - protein, 8 aa, Mycobacterium tuberculosis
ETDKPFLM

SEQ ID NO: 133769 - protein, 8 aa, Mycobacterium tuberculosis
DKPFLMPV

SEQ ID NO: 133770 - protein, 8 aa, Mycobacterium tuberculosis
FLMPVEDV

SEQ ID NO: 133771 - protein, 8 aa, Mycobacterium tuberculosis
MPVEDVFT

SEQ ID NO: 133772 - protein, 8 aa, Mycobacterium tuberculosis
PVEDVFTI

SEQ ID NO: 133773 - protein, 8 aa, Mycobacterium tuberculosis
DVFTITGR

SEQ ID NO: 133774 - protein, 8 aa, Mycobacterium tuberculosis
TITGRGTV

SEQ ID NO: 133775 - protein, 8 aa, Mycobacterium tuberculosis
ITGRGTVV

SEQ ID NO: 133776 - protein, 8 aa, Mycobacterium tuberculosis
RGTVVTGR

SEQ ID NO: 133777 - protein, 8 aa, Mycobacterium tuberculosis
VVTGRVER

SEQ ID NO: 133778 - protein, 8 aa, Mycobacterium tuberculosis
VERGVINV

SEQ ID NO: 133779 - protein, 8 aa, Mycobacterium tuberculosis
VINVNEEV

SEQ ID NO: 133780 - protein, 8 aa, Mycobacterium tuberculosis
EEVEIVGI

SEQ ID NO: 133781 - protein, 8 aa, Mycobacterium tuberculosis
EVEIVGIR

SEQ ID NO: 133782 - protein, 8 aa, Mycobacterium tuberculosis
GIRPSTTK

SEQ ID NO: 133783 - protein, 8 aa, Mycobacterium tuberculosis
RPSTTKTT

SEQ ID NO: 133784 - protein, 8 aa, Mycobacterium tuberculosis
TKTTVTGV

SEQ ID NO: 133785 - protein, 8 aa, Mycobacterium tuberculosis
TTVTGVEM

SEQ ID NO: 133786 - protein, 8 aa, Mycobacterium tuberculosis
VTGVEMFR

SEQ ID NO: 133787 - protein, 8 aa, Mycobacterium tuberculosis
TGVEMFRK

SEQ ID NO: 133788 - protein, 8 aa, Mycobacterium tuberculosis
VEMFRKLL

SEQ ID NO: 133789 - protein, 8 aa, Mycobacterium tuberculosis
KLLDQGQA

SEQ ID NO: 133790 - protein, 8 aa, Mycobacterium tuberculosis
LLDQGQAG

SEQ ID NO: 133791 - protein, 8 aa, Mycobacterium tuberculosis
DNVGLLLR

SEQ ID NO: 133792 - protein, 8 aa, Mycobacterium tuberculosis
GLLLRGVK

SEQ ID NO: 133793 - protein, 8 aa, Mycobacterium tuberculosis
LLLRGVKR

SEQ ID NO: 133794 - protein, 8 aa, Mycobacterium tuberculosis
DVERGQVV

SEQ ID NO: 133795 - protein, 8 aa, Mycobacterium tuberculosis
VERGQVVT

SEQ ID NO: 133796 - protein, 8 aa, Mycobacterium tuberculosis
TTTPHTEF

SEQ ID NO: 133797 - protein, 8 aa, Mycobacterium tuberculosis
TEFEGQVY

SEQ ID NO: 133798 - protein, 8 aa, Mycobacterium tuberculosis
FEGQVYIL

SEQ ID NO: 133799 - protein, 8 aa, Mycobacterium tuberculosis
GQVYILSK

SEQ ID NO: 133800 - protein, 8 aa, Mycobacterium tuberculosis
EGGRHTPF

SEQ ID NO: 133801 - protein, 8 aa, Mycobacterium tuberculosis
HTPFFNNY

SEQ ID NO: 133802 - protein, 8 aa, Mycobacterium tuberculosis
TPFFNNYR

SEQ ID NO: 133803 - protein, 8 aa, Mycobacterium tuberculosis
NYRPQFYF

SEQ ID NO: 133804 - protein, 8 aa, Mycobacterium tuberculosis
YRPQFYFR

SEQ ID NO: 133805 - protein, 8 aa, Mycobacterium tuberculosis
FYFRTTDV

SEQ ID NO: 133806 - protein, 8 aa, Mycobacterium tuberculosis
RTTDVTGV

SEQ ID NO: 133807 - protein, 8 aa, Mycobacterium tuberculosis
TTDVTGVV

SEQ ID NO: 133808 - protein, 8 aa, Mycobacterium tuberculosis
DVTGVVTL

SEQ ID NO: 133809 - protein, 8 aa, Mycobacterium tuberculosis
TLPEGTEM

SEQ ID NO: 133810 - protein, 8 aa, Mycobacterium tuberculosis
LPEGTEMV

SEQ ID NO: 133811 - protein, 8 aa, Mycobacterium tuberculosis
MVMPGDNT

SEQ ID NO: 133812 - protein, 8 aa, Mycobacterium tuberculosis
MPGDNTNI

SEQ ID NO: 133813 - protein, 8 aa, Mycobacterium tuberculosis
DNTNISVK

SEQ ID NO: 133814 - protein, 8 aa, Mycobacterium tuberculosis
NTNISVKL

SEQ ID NO: 133815 - protein, 8 aa, Mycobacterium tuberculosis
SVKLIQPV

SEQ ID NO: 133816 - protein, 8 aa, Mycobacterium tuberculosis
KLIQPVAM

SEQ ID NO: 133817 - protein, 8 aa, Mycobacterium tuberculosis
VAMDEGLR

SEQ ID NO: 133818 - protein, 8 aa, Mycobacterium tuberculosis
AMDEGLRF

SEQ ID NO: 133819 - protein, 8 aa, Mycobacterium tuberculosis
FAIREGGR

SEQ ID NO: 133820 - protein, 8 aa, Mycobacterium tuberculosis
RTVGAGRV

SEQ ID NO: 133821 - protein, 8 aa, Mycobacterium tuberculosis
GRVTKIIK

SEQ ID NO: 133822 - protein, 9 aa, Mycobacterium tuberculosis
KFQRTKPHV

SEQ ID NO: 133823 - protein, 9 aa, Mycobacterium tuberculosis
KPHVNIGTI

SEQ ID NO: 133824 - protein, 9 aa, Mycobacterium tuberculosis
TIGHVDHGK

SEQ ID NO: 133825 - protein, 9 aa, Mycobacterium tuberculosis
HVDHGKTTL

SEQ ID NO: 133826 - protein, 9 aa, Mycobacterium tuberculosis
TTLTAAITK

SEQ ID NO: 133827 - protein, 9 aa, Mycobacterium tuberculosis
TLTAAITKV

SEQ ID NO: 133828 - protein, 9 aa, Mycobacterium tuberculosis
LTAAITKVL

SEQ ID NO: 133829 - protein, 9 aa, Mycobacterium tuberculosis
AITKVLHDK

SEQ ID NO: 133830 - protein, 9 aa, Mycobacterium tuberculosis
VLHDKFPDL

SEQ ID NO: 133831 - protein, 9 aa, Mycobacterium tuberculosis
KFPDLNETK

SEQ ID NO: 133832 - protein, 9 aa, Mycobacterium tuberculosis
FPDLNETKA

SEQ ID NO: 133833 - protein, 9 aa, Mycobacterium tuberculosis
KAFDQIDNA

SEQ ID NO: 133834 - protein, 9 aa, Mycobacterium tuberculosis
QIDNAPEER

SEQ ID NO: 133835 - protein, 9 aa, Mycobacterium tuberculosis
APEERQRGI

SEQ ID NO: 133836 - protein, 9 aa, Mycobacterium tuberculosis
EERQRGITI

SEQ ID NO: 133837 - protein, 9 aa, Mycobacterium tuberculosis
RQRGITINI

SEQ ID NO: 133838 - protein, 9 aa, Mycobacterium tuberculosis
GITINIAHV

SEQ ID NO: 133839 - protein, 9 aa, Mycobacterium tuberculosis
ITINIAHVE

SEQ ID NO: 133840 - protein, 9 aa, Mycobacterium tuberculosis
TINIAHVEY

SEQ ID NO: 133841 - protein, 9 aa, Mycobacterium tuberculosis
HVEYQTDKR

SEQ ID NO: 133842 - protein, 9 aa, Mycobacterium tuberculosis
EYQTDKRHY

SEQ ID NO: 133843 - protein, 9 aa, Mycobacterium tuberculosis
YQTDKRHYA

SEQ ID NO: 133844 - protein, 9 aa, Mycobacterium tuberculosis
YIKNMITGA

SEQ ID NO: 133845 - protein, 9 aa, Mycobacterium tuberculosis
NMITGAAQM

SEQ ID NO: 133846 - protein, 9 aa, Mycobacterium tuberculosis
TGAAQMDGA

SEQ ID NO: 133847 - protein, 9 aa, Mycobacterium tuberculosis
AQMDGAILV

SEQ ID NO: 133848 - protein, 9 aa, Mycobacterium tuberculosis
QMDGAILVV

SEQ ID NO: 133849 - protein, 9 aa, Mycobacterium tuberculosis
VVAATDGPM

SEQ ID NO: 133850 - protein, 9 aa, Mycobacterium tuberculosis
PMPQTREHV

SEQ ID NO: 133851 - protein, 9 aa, Mycobacterium tuberculosis
MPQTREHVL

SEQ ID NO: 133852 - protein, 9 aa, Mycobacterium tuberculosis
QTREHVLLA

SEQ ID NO: 133853 - protein, 9 aa, Mycobacterium tuberculosis
VLLARQVGV

SEQ ID NO: 133854 - protein, 9 aa, Mycobacterium tuberculosis
LARQVGVPY

SEQ ID NO: 133855 - protein, 9 aa, Mycobacterium tuberculosis
RQVGVPYIL

SEQ ID NO: 133856 - protein, 9 aa, Mycobacterium tuberculosis
QVGVPYILV

SEQ ID NO: 133857 - protein, 9 aa, Mycobacterium tuberculosis
GVPYILVAL

SEQ ID NO: 133858 - protein, 9 aa, Mycobacterium tuberculosis
VPYILVALN

SEQ ID NO: 133859 - protein, 9 aa, Mycobacterium tuberculosis
PYILVALNK

SEQ ID NO: 133860 - protein, 9 aa, Mycobacterium tuberculosis
YILVALNKA

SEQ ID NO: 133861 - protein, 9 aa, Mycobacterium tuberculosis
VALNKADAV

SEQ ID NO: 133862 - protein, 9 aa, Mycobacterium tuberculosis
EELLELVEM

SEQ ID NO: 133863 - protein, 9 aa, Mycobacterium tuberculosis
LLELVEMEV

SEQ ID NO: 133864 - protein, 9 aa, Mycobacterium tuberculosis
VEMEVRELL

SEQ ID NO: 133865 - protein, 9 aa, Mycobacterium tuberculosis
MEVRELLAA

SEQ ID NO: 133866 - protein, 9 aa, Mycobacterium tuberculosis
EVRELLAAQ

SEQ ID NO: 133867 - protein, 9 aa, Mycobacterium tuberculosis
RELLAAQEF

SEQ ID NO: 133868 - protein, 9 aa, Mycobacterium tuberculosis
QEFDEDAPV

SEQ ID NO: 133869 - protein, 9 aa, Mycobacterium tuberculosis
EFDEDAPVV

SEQ ID NO: 133870 - protein, 9 aa, Mycobacterium tuberculosis
DAPVVRVSA

SEQ ID NO: 133871 - protein, 9 aa, Mycobacterium tuberculosis
APVVRVSAL

SEQ ID NO: 133872 - protein, 9 aa, Mycobacterium tuberculosis
PVVRVSALK

SEQ ID NO: 133873 - protein, 9 aa, Mycobacterium tuberculosis
KALEGDAKW

SEQ ID NO: 133874 - protein, 9 aa, Mycobacterium tuberculosis
ALEGDAKWV

SEQ ID NO: 133875 - protein, 9 aa, Mycobacterium tuberculosis
GDAKWVASV

SEQ ID NO: 133876 - protein, 9 aa, Mycobacterium tuberculosis
KWVASVEEL

SEQ ID NO: 133877 - protein, 9 aa, Mycobacterium tuberculosis
WVASVEELM

SEQ ID NO: 133878 - protein, 9 aa, Mycobacterium tuberculosis
SVEELMNAV

SEQ ID NO: 133879 - protein, 9 aa, Mycobacterium tuberculosis
LMNAVDESI

SEQ ID NO: 133880 - protein, 9 aa, Mycobacterium tuberculosis
SIPDPVRET

SEQ ID NO: 133881 - protein, 9 aa, Mycobacterium tuberculosis
PVRETDKPF

SEQ ID NO: 133882 - protein, 9 aa, Mycobacterium tuberculosis
RETDKPFLM

SEQ ID NO: 133883 - protein, 9 aa, Mycobacterium tuberculosis
TDKPFLMPV

SEQ ID NO: 133884 - protein, 9 aa, Mycobacterium tuberculosis
FLMPVEDVF

SEQ ID NO: 133885 - protein, 9 aa, Mycobacterium tuberculosis
MPVEDVFTI

SEQ ID NO: 133886 - protein, 9 aa, Mycobacterium tuberculosis
EDVFTITGR

SEQ ID NO: 133887 - protein, 9 aa, Mycobacterium tuberculosis
FTITGRGTV

SEQ ID NO: 133888 - protein, 9 aa, Mycobacterium tuberculosis
TITGRGTVV

SEQ ID NO: 133889 - protein, 9 aa, Mycobacterium tuberculosis
GRGTVVTGR

SEQ ID NO: 133890 - protein, 9 aa, Mycobacterium tuberculosis
RGTVVTGRV

SEQ ID NO: 133891 - protein, 9 aa, Mycobacterium tuberculosis
TVVTGRVER

SEQ ID NO: 133892 - protein, 9 aa, Mycobacterium tuberculosis
VTGRVERGV

SEQ ID NO: 133893 - protein, 9 aa, Mycobacterium tuberculosis
RVERGVINV

SEQ ID NO: 133894 - protein, 9 aa, Mycobacterium tuberculosis
GVINVNEEV

SEQ ID NO: 133895 - protein, 9 aa, Mycobacterium tuberculosis
NVNEEVEIV

SEQ ID NO: 133896 - protein, 9 aa, Mycobacterium tuberculosis
EEVEIVGIR

SEQ ID NO: 133897 - protein, 9 aa, Mycobacterium tuberculosis
EIVGIRPST

SEQ ID NO: 133898 - protein, 9 aa, Mycobacterium tuberculosis
RPSTTKTTV

SEQ ID NO: 133899 - protein, 9 aa, Mycobacterium tuberculosis
TTKTTVTGV

SEQ ID NO: 133900 - protein, 9 aa, Mycobacterium tuberculosis
KTTVTGVEM

SEQ ID NO: 133901 - protein, 9 aa, Mycobacterium tuberculosis
TTVTGVEMF

SEQ ID NO: 133902 - protein, 9 aa, Mycobacterium tuberculosis
TVTGVEMFR

SEQ ID NO: 133903 - protein, 9 aa, Mycobacterium tuberculosis
VTGVEMFRK

SEQ ID NO: 133904 - protein, 9 aa, Mycobacterium tuberculosis
KLLDQGQAG

SEQ ID NO: 133905 - protein, 9 aa, Mycobacterium tuberculosis
LLDQGQAGD

SEQ ID NO: 133906 - protein, 9 aa, Mycobacterium tuberculosis
GQAGDNVGL

SEQ ID NO: 133907 - protein, 9 aa, Mycobacterium tuberculosis
NVGLLLRGV

SEQ ID NO: 133908 - protein, 9 aa, Mycobacterium tuberculosis
GLLLRGVKR

SEQ ID NO: 133909 - protein, 9 aa, Mycobacterium tuberculosis
GVKREDVER

SEQ ID NO: 133910 - protein, 9 aa, Mycobacterium tuberculosis
TTTPHTEFE

SEQ ID NO: 133911 - protein, 9 aa, Mycobacterium tuberculosis
HTEFEGQVY

SEQ ID NO: 133912 - protein, 9 aa, Mycobacterium tuberculosis
TEFEGQVYI

SEQ ID NO: 133913 - protein, 9 aa, Mycobacterium tuberculosis
EGGRHTPFF

SEQ ID NO: 133914 - protein, 9 aa, Mycobacterium tuberculosis
RHTPFFNNY

SEQ ID NO: 133915 - protein, 9 aa, Mycobacterium tuberculosis
HTPFFNNYR

SEQ ID NO: 133916 - protein, 9 aa, Mycobacterium tuberculosis
FFNNYRPQF

SEQ ID NO: 133917 - protein, 9 aa, Mycobacterium tuberculosis
NYRPQFYFR

SEQ ID NO: 133918 - protein, 9 aa, Mycobacterium tuberculosis
RPQFYFRTT

SEQ ID NO: 133919 - protein, 9 aa, Mycobacterium tuberculosis
RTTDVTGVV

SEQ ID NO: 133920 - protein, 9 aa, Mycobacterium tuberculosis
TLPEGTEMV

SEQ ID NO: 133921 - protein, 9 aa, Mycobacterium tuberculosis
LPEGTEMVM

SEQ ID NO: 133922 - protein, 9 aa, Mycobacterium tuberculosis
VMPGDNTNI

SEQ ID NO: 133923 - protein, 9 aa, Mycobacterium tuberculosis
MPGDNTNIS

SEQ ID NO: 133924 - protein, 9 aa, Mycobacterium tuberculosis
ISVKLIQPV

SEQ ID NO: 133925 - protein, 9 aa, Mycobacterium tuberculosis
QPVAMDEGL

SEQ ID NO: 133926 - protein, 9 aa, Mycobacterium tuberculosis
PVAMDEGLR

SEQ ID NO: 133927 - protein, 9 aa, Mycobacterium tuberculosis
VAMDEGLRF

SEQ ID NO: 133928 - protein, 9 aa, Mycobacterium tuberculosis
AMDEGLRFA

SEQ ID NO: 133929 - protein, 9 aa, Mycobacterium tuberculosis
DEGLRFAIR

SEQ ID NO: 133930 - protein, 9 aa, Mycobacterium tuberculosis
RFAIREGGR

SEQ ID NO: 133931 - protein, 9 aa, Mycobacterium tuberculosis
AIREGGRTV

SEQ ID NO: 133932 - protein, 9 aa, Mycobacterium tuberculosis
TVGAGRVTK

SEQ ID NO: 133933 - protein, 9 aa, Mycobacterium tuberculosis
AGRVTKIIK

SEQ ID NO: 133934 - protein, 10 aa, Mycobacterium tuberculosis
MAKAKFQRTK

SEQ ID NO: 133935 - protein, 10 aa, Mycobacterium tuberculosis
FQRTKPHVNI

SEQ ID NO: 133936 - protein, 10 aa, Mycobacterium tuberculosis
HVNIGTIGHV

SEQ ID NO: 133937 - protein, 10 aa, Mycobacterium tuberculosis
GTIGHVDHGK

SEQ ID NO: 133938 - protein, 10 aa, Mycobacterium tuberculosis
KTTLTAAITK

SEQ ID NO: 133939 - protein, 10 aa, Mycobacterium tuberculosis
TTLTAAITKV

SEQ ID NO: 133940 - protein, 10 aa, Mycobacterium tuberculosis
TLTAAITKVL

SEQ ID NO: 133941 - protein, 10 aa, Mycobacterium tuberculosis
AAITKVLHDK

SEQ ID NO: 133942 - protein, 10 aa, Mycobacterium tuberculosis
KVLHDKFPDL

SEQ ID NO: 133943 - protein, 10 aa, Mycobacterium tuberculosis
FPDLNETKAF

SEQ ID NO: 133944 - protein, 10 aa, Mycobacterium tuberculosis
DQIDNAPEER

SEQ ID NO: 133945 - protein, 10 aa, Mycobacterium tuberculosis
APEERQRGIT

SEQ ID NO: 133946 - protein, 10 aa, Mycobacterium tuberculosis
RQRGITINIA

SEQ ID NO: 133947 - protein, 10 aa, Mycobacterium tuberculosis
RGITINIAHV

SEQ ID NO: 133948 - protein, 10 aa, Mycobacterium tuberculosis
ITINIAHVEY

SEQ ID NO: 133949 - protein, 10 aa, Mycobacterium tuberculosis
IAHVEYQTDK

SEQ ID NO: 133950 - protein, 10 aa, Mycobacterium tuberculosis
VEYQTDKRHY

SEQ ID NO: 133951 - protein, 10 aa, Mycobacterium tuberculosis
YQTDKRHYAH

SEQ ID NO: 133952 - protein, 10 aa, Mycobacterium tuberculosis
QTDKRHYAHV

SEQ ID NO: 133953 - protein, 10 aa, Mycobacterium tuberculosis
HVDAPGHADY

SEQ ID NO: 133954 - protein, 10 aa, Mycobacterium tuberculosis
DAPGHADYIK

SEQ ID NO: 133955 - protein, 10 aa, Mycobacterium tuberculosis
YIKNMITGAA

SEQ ID NO: 133956 - protein, 10 aa, Mycobacterium tuberculosis
TGAAQMDGAI

SEQ ID NO: 133957 - protein, 10 aa, Mycobacterium tuberculosis
AAQMDGAILV

SEQ ID NO: 133958 - protein, 10 aa, Mycobacterium tuberculosis
AQMDGAILVV

SEQ ID NO: 133959 - protein, 10 aa, Mycobacterium tuberculosis
QMDGAILVVA

SEQ ID NO: 133960 - protein, 10 aa, Mycobacterium tuberculosis
LVVAATDGPM

SEQ ID NO: 133961 - protein, 10 aa, Mycobacterium tuberculosis
ATDGPMPQTR

SEQ ID NO: 133962 - protein, 10 aa, Mycobacterium tuberculosis
GPMPQTREHV

SEQ ID NO: 133963 - protein, 10 aa, Mycobacterium tuberculosis
PMPQTREHVL

SEQ ID NO: 133964 - protein, 10 aa, Mycobacterium tuberculosis
MPQTREHVLL

SEQ ID NO: 133965 - protein, 10 aa, Mycobacterium tuberculosis
QTREHVLLAR

SEQ ID NO: 133966 - protein, 10 aa, Mycobacterium tuberculosis
REHVLLARQV

SEQ ID NO: 133967 - protein, 10 aa, Mycobacterium tuberculosis
HVLLARQVGV

SEQ ID NO: 133968 - protein, 10 aa, Mycobacterium tuberculosis
LLARQVGVPY

SEQ ID NO: 133969 - protein, 10 aa, Mycobacterium tuberculosis
RQVGVPYILV

SEQ ID NO: 133970 - protein, 10 aa, Mycobacterium tuberculosis
VPYILVALNK

SEQ ID NO: 133971 - protein, 10 aa, Mycobacterium tuberculosis
LVALNKADAV

SEQ ID NO: 133972 - protein, 10 aa, Mycobacterium tuberculosis
AVDDEELLEL

SEQ ID NO: 133973 - protein, 10 aa, Mycobacterium tuberculosis
VDDEELLELV

SEQ ID NO: 133974 - protein, 10 aa, Mycobacterium tuberculosis
ELLELVEMEV

SEQ ID NO: 133975 - protein, 10 aa, Mycobacterium tuberculosis
LLELVEMEVR

SEQ ID NO: 133976 - protein, 10 aa, Mycobacterium tuberculosis
ELVEMEVREL

SEQ ID NO: 133977 - protein, 10 aa, Mycobacterium tuberculosis
AQEFDEDAPV

SEQ ID NO: 133978 - protein, 10 aa, Mycobacterium tuberculosis
QEFDEDAPVV

SEQ ID NO: 133979 - protein, 10 aa, Mycobacterium tuberculosis
EDAPVVRVSA

SEQ ID NO: 133980 - protein, 10 aa, Mycobacterium tuberculosis
DAPVVRVSAL

SEQ ID NO: 133981 - protein, 10 aa, Mycobacterium tuberculosis
APVVRVSALK

SEQ ID NO: 133982 - protein, 10 aa, Mycobacterium tuberculosis
VVRVSALKAL

SEQ ID NO: 133983 - protein, 10 aa, Mycobacterium tuberculosis
ALKALEGDAK

SEQ ID NO: 133984 - protein, 10 aa, Mycobacterium tuberculosis
KALEGDAKWV

SEQ ID NO: 133985 - protein, 10 aa, Mycobacterium tuberculosis
ALEGDAKWVA

SEQ ID NO: 133986 - protein, 10 aa, Mycobacterium tuberculosis
ASVEELMNAV

SEQ ID NO: 133987 - protein, 10 aa, Mycobacterium tuberculosis
ELMNAVDESI

SEQ ID NO: 133988 - protein, 10 aa, Mycobacterium tuberculosis
AVDESIPDPV

SEQ ID NO: 133989 - protein, 10 aa, Mycobacterium tuberculosis
DPVRETDKPF

SEQ ID NO: 133990 - protein, 10 aa, Mycobacterium tuberculosis
ETDKPFLMPV

SEQ ID NO: 133991 - protein, 10 aa, Mycobacterium tuberculosis
KPFLMPVEDV

SEQ ID NO: 133992 - protein, 10 aa, Mycobacterium tuberculosis
PFLMPVEDVF

SEQ ID NO: 133993 - protein, 10 aa, Mycobacterium tuberculosis
FLMPVEDVFT

SEQ ID NO: 133994 - protein, 10 aa, Mycobacterium tuberculosis
LMPVEDVFTI

SEQ ID NO: 133995 - protein, 10 aa, Mycobacterium tuberculosis
MPVEDVFTIT

SEQ ID NO: 133996 - protein, 10 aa, Mycobacterium tuberculosis
FTITGRGTVV

SEQ ID NO: 133997 - protein, 10 aa, Mycobacterium tuberculosis
GTVVTGRVER

SEQ ID NO: 133998 - protein, 10 aa, Mycobacterium tuberculosis
VVTGRVERGV

SEQ ID NO: 133999 - protein, 10 aa, Mycobacterium tuberculosis
IVGIRPSTTK

SEQ ID NO: 134000 - protein, 10 aa, Mycobacterium tuberculosis
RPSTTKTTVT

SEQ ID NO: 134001 - protein, 10 aa, Mycobacterium tuberculosis
STTKTTVTGV

SEQ ID NO: 134002 - protein, 10 aa, Mycobacterium tuberculosis
KTTVTGVEMF

SEQ ID NO: 134003 - protein, 10 aa, Mycobacterium tuberculosis
TTVTGVEMFR

SEQ ID NO: 134004 - protein, 10 aa, Mycobacterium tuberculosis
TVTGVEMFRK

SEQ ID NO: 134005 - protein, 10 aa, Mycobacterium tuberculosis
KLLDQGQAGD

SEQ ID NO: 134006 - protein, 10 aa, Mycobacterium tuberculosis
GQAGDNVGLL

SEQ ID NO: 134007 - protein, 10 aa, Mycobacterium tuberculosis
NVGLLLRGVK

SEQ ID NO: 134008 - protein, 10 aa, Mycobacterium tuberculosis
VGLLLRGVKR

SEQ ID NO: 134009 - protein, 10 aa, Mycobacterium tuberculosis
LLRGVKREDV

SEQ ID NO: 134010 - protein, 10 aa, Mycobacterium tuberculosis
DVERGQVVTK

SEQ ID NO: 134011 - protein, 10 aa, Mycobacterium tuberculosis
TEFEGQVYIL

SEQ ID NO: 134012 - protein, 10 aa, Mycobacterium tuberculosis
YILSKDEGGR

SEQ ID NO: 134013 - protein, 10 aa, Mycobacterium tuberculosis
RHTPFFNNYR

SEQ ID NO: 134014 - protein, 10 aa, Mycobacterium tuberculosis
PFFNNYRPQF

SEQ ID NO: 134015 - protein, 10 aa, Mycobacterium tuberculosis
FFNNYRPQFY

SEQ ID NO: 134016 - protein, 10 aa, Mycobacterium tuberculosis
NNYRPQFYFR

SEQ ID NO: 134017 - protein, 10 aa, Mycobacterium tuberculosis
RPQFYFRTTD

SEQ ID NO: 134018 - protein, 10 aa, Mycobacterium tuberculosis
YFRTTDVTGV

SEQ ID NO: 134019 - protein, 10 aa, Mycobacterium tuberculosis
TTDVTGVVTL

SEQ ID NO: 134020 - protein, 10 aa, Mycobacterium tuberculosis
VTLPEGTEMV

SEQ ID NO: 134021 - protein, 10 aa, Mycobacterium tuberculosis
TLPEGTEMVM

SEQ ID NO: 134022 - protein, 10 aa, Mycobacterium tuberculosis
MVMPGDNTNI

SEQ ID NO: 134023 - protein, 10 aa, Mycobacterium tuberculosis
MPGDNTNISV

SEQ ID NO: 134024 - protein, 10 aa, Mycobacterium tuberculosis
NISVKLIQPV

SEQ ID NO: 134025 - protein, 10 aa, Mycobacterium tuberculosis
SVKLIQPVAM

SEQ ID NO: 134026 - protein, 10 aa, Mycobacterium tuberculosis
IQPVAMDEGL

SEQ ID NO: 134027 - protein, 10 aa, Mycobacterium tuberculosis
QPVAMDEGLR

SEQ ID NO: 134028 - protein, 10 aa, Mycobacterium tuberculosis
VAMDEGLRFA

SEQ ID NO: 134029 - protein, 10 aa, Mycobacterium tuberculosis
AMDEGLRFAI

SEQ ID NO: 134030 - protein, 10 aa, Mycobacterium tuberculosis
LRFAIREGGR

SEQ ID NO: 134031 - protein, 10 aa, Mycobacterium tuberculosis
FAIREGGRTV

SEQ ID NO: 134032 - protein, 10 aa, Mycobacterium tuberculosis
RTVGAGRVTK

SEQ ID NO: 134033 - protein, 10 aa, Mycobacterium tuberculosis
GAGRVTKIIK

SEQ ID NO: 134034 - protein, 11 aa, Mycobacterium tuberculosis
KAKFQRTKPHV

SEQ ID NO: 134035 - protein, 11 aa, Mycobacterium tuberculosis
KFQRTKPHVNI

SEQ ID NO: 134036 - protein, 11 aa, Mycobacterium tuberculosis
RTKPHVNIGTI

SEQ ID NO: 134037 - protein, 11 aa, Mycobacterium tuberculosis
HVDHGKTTLTA

SEQ ID NO: 134038 - protein, 11 aa, Mycobacterium tuberculosis
KTTLTAAITKV

SEQ ID NO: 134039 - protein, 11 aa, Mycobacterium tuberculosis
TAAITKVLHDK

SEQ ID NO: 134040 - protein, 11 aa, Mycobacterium tuberculosis
KFPDLNETKAF

SEQ ID NO: 134041 - protein, 11 aa, Mycobacterium tuberculosis
DLNETKAFDQI

SEQ ID NO: 134042 - protein, 11 aa, Mycobacterium tuberculosis
ETKAFDQIDNA

SEQ ID NO: 134043 - protein, 11 aa, Mycobacterium tuberculosis
APEERQRGITI

SEQ ID NO: 134044 - protein, 11 aa, Mycobacterium tuberculosis
EERQRGITINI

SEQ ID NO: 134045 - protein, 11 aa, Mycobacterium tuberculosis
RQRGITINIAH

SEQ ID NO: 134046 - protein, 11 aa, Mycobacterium tuberculosis
ITINIAHVEYQ

SEQ ID NO: 134047 - protein, 11 aa, Mycobacterium tuberculosis
NIAHVEYQTDK

SEQ ID NO: 134048 - protein, 11 aa, Mycobacterium tuberculosis
IAHVEYQTDKR

SEQ ID NO: 134049 - protein, 11 aa, Mycobacterium tuberculosis
HVEYQTDKRHY

SEQ ID NO: 134050 - protein, 11 aa, Mycobacterium tuberculosis
YQTDKRHYAHV

SEQ ID NO: 134051 - protein, 11 aa, Mycobacterium tuberculosis
HVDAPGHADYI

SEQ ID NO: 134052 - protein, 11 aa, Mycobacterium tuberculosis
MITGAAQMDGA

SEQ ID NO: 134053 - protein, 11 aa, Mycobacterium tuberculosis
TGAAQMDGAIL

SEQ ID NO: 134054 - protein, 11 aa, Mycobacterium tuberculosis
GAAQMDGAILV

SEQ ID NO: 134055 - protein, 11 aa, Mycobacterium tuberculosis
AQMDGAILVVA

SEQ ID NO: 134056 - protein, 11 aa, Mycobacterium tuberculosis
QMDGAILVVAA

SEQ ID NO: 134057 - protein, 11 aa, Mycobacterium tuberculosis
ILVVAATDGPM

SEQ ID NO: 134058 - protein, 11 aa, Mycobacterium tuberculosis
AATDGPMPQTR

SEQ ID NO: 134059 - protein, 11 aa, Mycobacterium tuberculosis
GPMPQTREHVL

SEQ ID NO: 134060 - protein, 11 aa, Mycobacterium tuberculosis
PMPQTREHVLL

SEQ ID NO: 134061 - protein, 11 aa, Mycobacterium tuberculosis
MPQTREHVLLA

SEQ ID NO: 134062 - protein, 11 aa, Mycobacterium tuberculosis
VLLARQVGVPY

SEQ ID NO: 134063 - protein, 11 aa, Mycobacterium tuberculosis
LLARQVGVPYI

SEQ ID NO: 134064 - protein, 11 aa, Mycobacterium tuberculosis
LARQVGVPYIL

SEQ ID NO: 134065 - protein, 11 aa, Mycobacterium tuberculosis
RQVGVPYILVA

SEQ ID NO: 134066 - protein, 11 aa, Mycobacterium tuberculosis
QVGVPYILVAL

SEQ ID NO: 134067 - protein, 11 aa, Mycobacterium tuberculosis
GVPYILVALNK

SEQ ID NO: 134068 - protein, 11 aa, Mycobacterium tuberculosis
VPYILVALNKA

SEQ ID NO: 134069 - protein, 11 aa, Mycobacterium tuberculosis
ILVALNKADAV

SEQ ID NO: 134070 - protein, 11 aa, Mycobacterium tuberculosis
KADAVDDEELL

SEQ ID NO: 134071 - protein, 11 aa, Mycobacterium tuberculosis
DAVDDEELLEL

SEQ ID NO: 134072 - protein, 11 aa, Mycobacterium tuberculosis
AVDDEELLELV

SEQ ID NO: 134073 - protein, 11 aa, Mycobacterium tuberculosis
EELLELVEMEV

SEQ ID NO: 134074 - protein, 11 aa, Mycobacterium tuberculosis
ELLELVEMEVR

SEQ ID NO: 134075 - protein, 11 aa, Mycobacterium tuberculosis
LELVEMEVREL

SEQ ID NO: 134076 - protein, 11 aa, Mycobacterium tuberculosis
ELVEMEVRELL

SEQ ID NO: 134077 - protein, 11 aa, Mycobacterium tuberculosis
VEMEVRELLAA

SEQ ID NO: 134078 - protein, 11 aa, Mycobacterium tuberculosis
EVRELLAAQEF

SEQ ID NO: 134079 - protein, 11 aa, Mycobacterium tuberculosis
LLAAQEFDEDA

SEQ ID NO: 134080 - protein, 11 aa, Mycobacterium tuberculosis
AAQEFDEDAPV

SEQ ID NO: 134081 - protein, 11 aa, Mycobacterium tuberculosis
AQEFDEDAPVV

SEQ ID NO: 134082 - protein, 11 aa, Mycobacterium tuberculosis
EFDEDAPVVRV

SEQ ID NO: 134083 - protein, 11 aa, Mycobacterium tuberculosis
EDAPVVRVSAL

SEQ ID NO: 134084 - protein, 11 aa, Mycobacterium tuberculosis
DAPVVRVSALK

SEQ ID NO: 134085 - protein, 11 aa, Mycobacterium tuberculosis
APVVRVSALKA

SEQ ID NO: 134086 - protein, 11 aa, Mycobacterium tuberculosis
PVVRVSALKAL

SEQ ID NO: 134087 - protein, 11 aa, Mycobacterium tuberculosis
SALKALEGDAK

SEQ ID NO: 134088 - protein, 11 aa, Mycobacterium tuberculosis
KALEGDAKWVA

SEQ ID NO: 134089 - protein, 11 aa, Mycobacterium tuberculosis
LEGDAKWVASV

SEQ ID NO: 134090 - protein, 11 aa, Mycobacterium tuberculosis
WVASVEELMNA

SEQ ID NO: 134091 - protein, 11 aa, Mycobacterium tuberculosis
EELMNAVDESI

SEQ ID NO: 134092 - protein, 11 aa, Mycobacterium tuberculosis
NAVDESIPDPV

SEQ ID NO: 134093 - protein, 11 aa, Mycobacterium tuberculosis
SIPDPVRETDK

SEQ ID NO: 134094 - protein, 11 aa, Mycobacterium tuberculosis
DPVRETDKPFL

SEQ ID NO: 134095 - protein, 11 aa, Mycobacterium tuberculosis
RETDKPFLMPV

SEQ ID NO: 134096 - protein, 11 aa, Mycobacterium tuberculosis
ETDKPFLMPVE

SEQ ID NO: 134097 - protein, 11 aa, Mycobacterium tuberculosis
KPFLMPVEDVF

SEQ ID NO: 134098 - protein, 11 aa, Mycobacterium tuberculosis
FLMPVEDVFTI

SEQ ID NO: 134099 - protein, 11 aa, Mycobacterium tuberculosis
MPVEDVFTITG

SEQ ID NO: 134100 - protein, 11 aa, Mycobacterium tuberculosis
DVFTITGRGTV

SEQ ID NO: 134101 - protein, 11 aa, Mycobacterium tuberculosis
FTITGRGTVVT

SEQ ID NO: 134102 - protein, 11 aa, Mycobacterium tuberculosis
ITGRGTVVTGR

SEQ ID NO: 134103 - protein, 11 aa, Mycobacterium tuberculosis
RGTVVTGRVER

SEQ ID NO: 134104 - protein, 11 aa, Mycobacterium tuberculosis
TVVTGRVERGV

SEQ ID NO: 134105 - protein, 11 aa, Mycobacterium tuberculosis
ERGVINVNEEV

SEQ ID NO: 134106 - protein, 11 aa, Mycobacterium tuberculosis
GVINVNEEVEI

SEQ ID NO: 134107 - protein, 11 aa, Mycobacterium tuberculosis
VINVNEEVEIV

SEQ ID NO: 134108 - protein, 11 aa, Mycobacterium tuberculosis
NVNEEVEIVGI

SEQ ID NO: 134109 - protein, 11 aa, Mycobacterium tuberculosis
EEVEIVGIRPS

SEQ ID NO: 134110 - protein, 11 aa, Mycobacterium tuberculosis
EIVGIRPSTTK

SEQ ID NO: 134111 - protein, 11 aa, Mycobacterium tuberculosis
GIRPSTTKTTV

SEQ ID NO: 134112 - protein, 11 aa, Mycobacterium tuberculosis
RPSTTKTTVTG

SEQ ID NO: 134113 - protein, 11 aa, Mycobacterium tuberculosis
TTKTTVTGVEM

SEQ ID NO: 134114 - protein, 11 aa, Mycobacterium tuberculosis
KTTVTGVEMFR

SEQ ID NO: 134115 - protein, 11 aa, Mycobacterium tuberculosis
TTVTGVEMFRK

SEQ ID NO: 134116 - protein, 11 aa, Mycobacterium tuberculosis
TVTGVEMFRKL

SEQ ID NO: 134117 - protein, 11 aa, Mycobacterium tuberculosis
EMFRKLLDQGQ

SEQ ID NO: 134118 - protein, 11 aa, Mycobacterium tuberculosis
LLDQGQAGDNV

SEQ ID NO: 134119 - protein, 11 aa, Mycobacterium tuberculosis
GQAGDNVGLLL

SEQ ID NO: 134120 - protein, 11 aa, Mycobacterium tuberculosis
QAGDNVGLLLR

SEQ ID NO: 134121 - protein, 11 aa, Mycobacterium tuberculosis
NVGLLLRGVKR

SEQ ID NO: 134122 - protein, 11 aa, Mycobacterium tuberculosis
LLLRGVKREDV

SEQ ID NO: 134123 - protein, 11 aa, Mycobacterium tuberculosis
KPGTTTPHTEF

SEQ ID NO: 134124 - protein, 11 aa, Mycobacterium tuberculosis
TTPHTEFEGQV

SEQ ID NO: 134125 - protein, 11 aa, Mycobacterium tuberculosis
TPHTEFEGQVY

SEQ ID NO: 134126 - protein, 11 aa, Mycobacterium tuberculosis
TEFEGQVYILS

SEQ ID NO: 134127 - protein, 11 aa, Mycobacterium tuberculosis
EFEGQVYILSK

SEQ ID NO: 134128 - protein, 11 aa, Mycobacterium tuberculosis
TPFFNNYRPQF

SEQ ID NO: 134129 - protein, 11 aa, Mycobacterium tuberculosis
PFFNNYRPQFY

SEQ ID NO: 134130 - protein, 11 aa, Mycobacterium tuberculosis
FFNNYRPQFYF

SEQ ID NO: 134131 - protein, 11 aa, Mycobacterium tuberculosis
FNNYRPQFYFR

SEQ ID NO: 134132 - protein, 11 aa, Mycobacterium tuberculosis
RPQFYFRTTDV

SEQ ID NO: 134133 - protein, 11 aa, Mycobacterium tuberculosis
FYFRTTDVTGV

SEQ ID NO: 134134 - protein, 11 aa, Mycobacterium tuberculosis
RTTDVTGVVTL

SEQ ID NO: 134135 - protein, 11 aa, Mycobacterium tuberculosis
VVTLPEGTEMV

SEQ ID NO: 134136 - protein, 11 aa, Mycobacterium tuberculosis
TLPEGTEMVMP

SEQ ID NO: 134137 - protein, 11 aa, Mycobacterium tuberculosis
EMVMPGDNTNI

SEQ ID NO: 134138 - protein, 11 aa, Mycobacterium tuberculosis
MVMPGDNTNIS

SEQ ID NO: 134139 - protein, 11 aa, Mycobacterium tuberculosis
VMPGDNTNISV

SEQ ID NO: 134140 - protein, 11 aa, Mycobacterium tuberculosis
TNISVKLIQPV

SEQ ID NO: 134141 - protein, 11 aa, Mycobacterium tuberculosis
ISVKLIQPVAM

SEQ ID NO: 134142 - protein, 11 aa, Mycobacterium tuberculosis
LIQPVAMDEGL

SEQ ID NO: 134143 - protein, 11 aa, Mycobacterium tuberculosis
QPVAMDEGLRF

SEQ ID NO: 134144 - protein, 11 aa, Mycobacterium tuberculosis
VAMDEGLRFAI

SEQ ID NO: 134145 - protein, 11 aa, Mycobacterium tuberculosis
AMDEGLRFAIR

SEQ ID NO: 134146 - protein, 11 aa, Mycobacterium tuberculosis
GLRFAIREGGR

SEQ ID NO: 134147 - protein, 11 aa, Mycobacterium tuberculosis
AIREGGRTVGA

SEQ ID NO: 134148 - protein, 11 aa, Mycobacterium tuberculosis
GRTVGAGRVTK

SEQ ID NO: 134149 - protein, 11 aa, Mycobacterium tuberculosis
RTVGAGRVTKI

SEQ ID NO: 134150 - protein, 13 aa, Mycobacterium tuberculosis
MAKAKFQRTKPHV

SEQ ID NO: 134151 - protein, 13 aa, Mycobacterium tuberculosis
AKAKFQRTKPHVN

SEQ ID NO: 134152 - protein, 13 aa, Mycobacterium tuberculosis
KAKFQRTKPHVNI

SEQ ID NO: 134153 - protein, 13 aa, Mycobacterium tuberculosis
AKFQRTKPHVNIG

SEQ ID NO: 134154 - protein, 13 aa, Mycobacterium tuberculosis
KFQRTKPHVNIGT

SEQ ID NO: 134155 - protein, 13 aa, Mycobacterium tuberculosis
FQRTKPHVNIGTI

SEQ ID NO: 134156 - protein, 13 aa, Mycobacterium tuberculosis
QRTKPHVNIGTIG

SEQ ID NO: 134157 - protein, 13 aa, Mycobacterium tuberculosis
RTKPHVNIGTIGH

SEQ ID NO: 134158 - protein, 13 aa, Mycobacterium tuberculosis
TKPHVNIGTIGHV

SEQ ID NO: 134159 - protein, 13 aa, Mycobacterium tuberculosis
KPHVNIGTIGHVD

SEQ ID NO: 134160 - protein, 13 aa, Mycobacterium tuberculosis
PHVNIGTIGHVDH

SEQ ID NO: 134161 - protein, 13 aa, Mycobacterium tuberculosis
HVNIGTIGHVDHG

SEQ ID NO: 134162 - protein, 13 aa, Mycobacterium tuberculosis
VNIGTIGHVDHGK

SEQ ID NO: 134163 - protein, 13 aa, Mycobacterium tuberculosis
NIGTIGHVDHGKT

SEQ ID NO: 134164 - protein, 13 aa, Mycobacterium tuberculosis
IGTIGHVDHGKTT

SEQ ID NO: 134165 - protein, 13 aa, Mycobacterium tuberculosis
GTIGHVDHGKTTL

SEQ ID NO: 134166 - protein, 13 aa, Mycobacterium tuberculosis
TIGHVDHGKTTLT

SEQ ID NO: 134167 - protein, 13 aa, Mycobacterium tuberculosis
IGHVDHGKTTLTA

SEQ ID NO: 134168 - protein, 13 aa, Mycobacterium tuberculosis
GHVDHGKTTLTAA

SEQ ID NO: 134169 - protein, 13 aa, Mycobacterium tuberculosis
HVDHGKTTLTAAI

SEQ ID NO: 134170 - protein, 13 aa, Mycobacterium tuberculosis
VDHGKTTLTAAIT

SEQ ID NO: 134171 - protein, 13 aa, Mycobacterium tuberculosis
DHGKTTLTAAITK

SEQ ID NO: 134172 - protein, 13 aa, Mycobacterium tuberculosis
HGKTTLTAAITKV

SEQ ID NO: 134173 - protein, 13 aa, Mycobacterium tuberculosis
GKTTLTAAITKVL

SEQ ID NO: 134174 - protein, 13 aa, Mycobacterium tuberculosis
KTTLTAAITKVLH

SEQ ID NO: 134175 - protein, 13 aa, Mycobacterium tuberculosis
TTLTAAITKVLHD

SEQ ID NO: 134176 - protein, 13 aa, Mycobacterium tuberculosis
TLTAAITKVLHDK

SEQ ID NO: 134177 - protein, 13 aa, Mycobacterium tuberculosis
LTAAITKVLHDKF

SEQ ID NO: 134178 - protein, 13 aa, Mycobacterium tuberculosis
TAAITKVLHDKFP

SEQ ID NO: 134179 - protein, 13 aa, Mycobacterium tuberculosis
AAITKVLHDKFPD

SEQ ID NO: 134180 - protein, 13 aa, Mycobacterium tuberculosis
AITKVLHDKFPDL

SEQ ID NO: 134181 - protein, 13 aa, Mycobacterium tuberculosis
ITKVLHDKFPDLN

SEQ ID NO: 134182 - protein, 13 aa, Mycobacterium tuberculosis
TKVLHDKFPDLNE

SEQ ID NO: 134183 - protein, 13 aa, Mycobacterium tuberculosis
KVLHDKFPDLNET

SEQ ID NO: 134184 - protein, 13 aa, Mycobacterium tuberculosis
VLHDKFPDLNETK

SEQ ID NO: 134185 - protein, 13 aa, Mycobacterium tuberculosis
LHDKFPDLNETKA

SEQ ID NO: 134186 - protein, 13 aa, Mycobacterium tuberculosis
HDKFPDLNETKAF

SEQ ID NO: 134187 - protein, 13 aa, Mycobacterium tuberculosis
DKFPDLNETKAFD

SEQ ID NO: 134188 - protein, 13 aa, Mycobacterium tuberculosis
KFPDLNETKAFDQ

SEQ ID NO: 134189 - protein, 13 aa, Mycobacterium tuberculosis
FPDLNETKAFDQI

SEQ ID NO: 134190 - protein, 13 aa, Mycobacterium tuberculosis
PDLNETKAFDQID

SEQ ID NO: 134191 - protein, 13 aa, Mycobacterium tuberculosis
DLNETKAFDQIDN

SEQ ID NO: 134192 - protein, 13 aa, Mycobacterium tuberculosis
LNETKAFDQIDNA

SEQ ID NO: 134193 - protein, 13 aa, Mycobacterium tuberculosis
NETKAFDQIDNAP

SEQ ID NO: 134194 - protein, 13 aa, Mycobacterium tuberculosis
ETKAFDQIDNAPE

SEQ ID NO: 134195 - protein, 13 aa, Mycobacterium tuberculosis
TKAFDQIDNAPEE

SEQ ID NO: 134196 - protein, 13 aa, Mycobacterium tuberculosis
KAFDQIDNAPEER

SEQ ID NO: 134197 - protein, 13 aa, Mycobacterium tuberculosis
AFDQIDNAPEERQ

SEQ ID NO: 134198 - protein, 13 aa, Mycobacterium tuberculosis
FDQIDNAPEERQR

SEQ ID NO: 134199 - protein, 13 aa, Mycobacterium tuberculosis
DQIDNAPEERQRG

SEQ ID NO: 134200 - protein, 13 aa, Mycobacterium tuberculosis
QIDNAPEERQRGI

SEQ ID NO: 134201 - protein, 13 aa, Mycobacterium tuberculosis
IDNAPEERQRGIT

SEQ ID NO: 134202 - protein, 13 aa, Mycobacterium tuberculosis
DNAPEERQRGITI

SEQ ID NO: 134203 - protein, 13 aa, Mycobacterium tuberculosis
NAPEERQRGITIN

SEQ ID NO: 134204 - protein, 13 aa, Mycobacterium tuberculosis
APEERQRGITINI

SEQ ID NO: 134205 - protein, 13 aa, Mycobacterium tuberculosis
PEERQRGITINIA

SEQ ID NO: 134206 - protein, 13 aa, Mycobacterium tuberculosis
EERQRGITINIAH

SEQ ID NO: 134207 - protein, 13 aa, Mycobacterium tuberculosis
ERQRGITINIAHV

SEQ ID NO: 134208 - protein, 13 aa, Mycobacterium tuberculosis
RQRGITINIAHVE

SEQ ID NO: 134209 - protein, 13 aa, Mycobacterium tuberculosis
QRGITINIAHVEY

SEQ ID NO: 134210 - protein, 13 aa, Mycobacterium tuberculosis
RGITINIAHVEYQ

SEQ ID NO: 134211 - protein, 13 aa, Mycobacterium tuberculosis
GITINIAHVEYQT

SEQ ID NO: 134212 - protein, 13 aa, Mycobacterium tuberculosis
ITINIAHVEYQTD

SEQ ID NO: 134213 - protein, 13 aa, Mycobacterium tuberculosis
TINIAHVEYQTDK

SEQ ID NO: 134214 - protein, 13 aa, Mycobacterium tuberculosis
INIAHVEYQTDKR

SEQ ID NO: 134215 - protein, 13 aa, Mycobacterium tuberculosis
NIAHVEYQTDKRH

SEQ ID NO: 134216 - protein, 13 aa, Mycobacterium tuberculosis
IAHVEYQTDKRHY

SEQ ID NO: 134217 - protein, 13 aa, Mycobacterium tuberculosis
AHVEYQTDKRHYA

SEQ ID NO: 134218 - protein, 13 aa, Mycobacterium tuberculosis
HVEYQTDKRHYAH

SEQ ID NO: 134219 - protein, 13 aa, Mycobacterium tuberculosis
VEYQTDKRHYAHV

SEQ ID NO: 134220 - protein, 13 aa, Mycobacterium tuberculosis
EYQTDKRHYAHVD

SEQ ID NO: 134221 - protein, 13 aa, Mycobacterium tuberculosis
YQTDKRHYAHVDA

SEQ ID NO: 134222 - protein, 13 aa, Mycobacterium tuberculosis
QTDKRHYAHVDAP

SEQ ID NO: 134223 - protein, 13 aa, Mycobacterium tuberculosis
TDKRHYAHVDAPG

SEQ ID NO: 134224 - protein, 13 aa, Mycobacterium tuberculosis
DKRHYAHVDAPGH

SEQ ID NO: 134225 - protein, 13 aa, Mycobacterium tuberculosis
KRHYAHVDAPGHA

SEQ ID NO: 134226 - protein, 13 aa, Mycobacterium tuberculosis
RHYAHVDAPGHAD

SEQ ID NO: 134227 - protein, 13 aa, Mycobacterium tuberculosis
HYAHVDAPGHADY

SEQ ID NO: 134228 - protein, 13 aa, Mycobacterium tuberculosis
YAHVDAPGHADYI

SEQ ID NO: 134229 - protein, 13 aa, Mycobacterium tuberculosis
AHVDAPGHADYIK

SEQ ID NO: 134230 - protein, 13 aa, Mycobacterium tuberculosis
HVDAPGHADYIKN

SEQ ID NO: 134231 - protein, 13 aa, Mycobacterium tuberculosis
VDAPGHADYIKNM

SEQ ID NO: 134232 - protein, 13 aa, Mycobacterium tuberculosis
DAPGHADYIKNMI

SEQ ID NO: 134233 - protein, 13 aa, Mycobacterium tuberculosis
APGHADYIKNMIT

SEQ ID NO: 134234 - protein, 13 aa, Mycobacterium tuberculosis
PGHADYIKNMITG

SEQ ID NO: 134235 - protein, 13 aa, Mycobacterium tuberculosis
GHADYIKNMITGA

SEQ ID NO: 134236 - protein, 13 aa, Mycobacterium tuberculosis
HADYIKNMITGAA

SEQ ID NO: 134237 - protein, 13 aa, Mycobacterium tuberculosis
ADYIKNMITGAAQ

SEQ ID NO: 134238 - protein, 13 aa, Mycobacterium tuberculosis
DYIKNMITGAAQM

SEQ ID NO: 134239 - protein, 13 aa, Mycobacterium tuberculosis
YIKNMITGAAQMD

SEQ ID NO: 134240 - protein, 13 aa, Mycobacterium tuberculosis
IKNMITGAAQMDG

SEQ ID NO: 134241 - protein, 13 aa, Mycobacterium tuberculosis
KNMITGAAQMDGA

SEQ ID NO: 134242 - protein, 13 aa, Mycobacterium tuberculosis
NMITGAAQMDGAI

SEQ ID NO: 134243 - protein, 13 aa, Mycobacterium tuberculosis
MITGAAQMDGAIL

SEQ ID NO: 134244 - protein, 13 aa, Mycobacterium tuberculosis
ITGAAQMDGAILV

SEQ ID NO: 134245 - protein, 13 aa, Mycobacterium tuberculosis
TGAAQMDGAILVV

SEQ ID NO: 134246 - protein, 13 aa, Mycobacterium tuberculosis
GAAQMDGAILVVA

SEQ ID NO: 134247 - protein, 13 aa, Mycobacterium tuberculosis
AAQMDGAILVVAA

SEQ ID NO: 134248 - protein, 13 aa, Mycobacterium tuberculosis
AQMDGAILVVAAT

SEQ ID NO: 134249 - protein, 13 aa, Mycobacterium tuberculosis
QMDGAILVVAATD

SEQ ID NO: 134250 - protein, 13 aa, Mycobacterium tuberculosis
MDGAILVVAATDG

SEQ ID NO: 134251 - protein, 13 aa, Mycobacterium tuberculosis
DGAILVVAATDGP

SEQ ID NO: 134252 - protein, 13 aa, Mycobacterium tuberculosis
GAILVVAATDGPM

SEQ ID NO: 134253 - protein, 13 aa, Mycobacterium tuberculosis
AILVVAATDGPMP

SEQ ID NO: 134254 - protein, 13 aa, Mycobacterium tuberculosis
ILVVAATDGPMPQ

SEQ ID NO: 134255 - protein, 13 aa, Mycobacterium tuberculosis
LVVAATDGPMPQT

SEQ ID NO: 134256 - protein, 13 aa, Mycobacterium tuberculosis
VVAATDGPMPQTR

SEQ ID NO: 134257 - protein, 13 aa, Mycobacterium tuberculosis
VAATDGPMPQTRE

SEQ ID NO: 134258 - protein, 13 aa, Mycobacterium tuberculosis
AATDGPMPQTREH

SEQ ID NO: 134259 - protein, 13 aa, Mycobacterium tuberculosis
ATDGPMPQTREHV

SEQ ID NO: 134260 - protein, 13 aa, Mycobacterium tuberculosis
TDGPMPQTREHVL

SEQ ID NO: 134261 - protein, 13 aa, Mycobacterium tuberculosis
DGPMPQTREHVLL

SEQ ID NO: 134262 - protein, 13 aa, Mycobacterium tuberculosis
GPMPQTREHVLLA

SEQ ID NO: 134263 - protein, 13 aa, Mycobacterium tuberculosis
PMPQTREHVLLAR

SEQ ID NO: 134264 - protein, 13 aa, Mycobacterium tuberculosis
MPQTREHVLLARQ

SEQ ID NO: 134265 - protein, 13 aa, Mycobacterium tuberculosis
PQTREHVLLARQV

SEQ ID NO: 134266 - protein, 13 aa, Mycobacterium tuberculosis
QTREHVLLARQVG

SEQ ID NO: 134267 - protein, 13 aa, Mycobacterium tuberculosis
TREHVLLARQVGV

SEQ ID NO: 134268 - protein, 13 aa, Mycobacterium tuberculosis
REHVLLARQVGVP

SEQ ID NO: 134269 - protein, 13 aa, Mycobacterium tuberculosis
EHVLLARQVGVPY

SEQ ID NO: 134270 - protein, 13 aa, Mycobacterium tuberculosis
HVLLARQVGVPYI

SEQ ID NO: 134271 - protein, 13 aa, Mycobacterium tuberculosis
VLLARQVGVPYIL

SEQ ID NO: 134272 - protein, 13 aa, Mycobacterium tuberculosis
LLARQVGVPYILV

SEQ ID NO: 134273 - protein, 13 aa, Mycobacterium tuberculosis
LARQVGVPYILVA

SEQ ID NO: 134274 - protein, 13 aa, Mycobacterium tuberculosis
ARQVGVPYILVAL

SEQ ID NO: 134275 - protein, 13 aa, Mycobacterium tuberculosis
RQVGVPYILVALN

SEQ ID NO: 134276 - protein, 13 aa, Mycobacterium tuberculosis
QVGVPYILVALNK

SEQ ID NO: 134277 - protein, 13 aa, Mycobacterium tuberculosis
VGVPYILVALNKA

SEQ ID NO: 134278 - protein, 13 aa, Mycobacterium tuberculosis
GVPYILVALNKAD

SEQ ID NO: 134279 - protein, 13 aa, Mycobacterium tuberculosis
VPYILVALNKADA

SEQ ID NO: 134280 - protein, 13 aa, Mycobacterium tuberculosis
PYILVALNKADAV

SEQ ID NO: 134281 - protein, 13 aa, Mycobacterium tuberculosis
YILVALNKADAVD

SEQ ID NO: 134282 - protein, 13 aa, Mycobacterium tuberculosis
ILVALNKADAVDD

SEQ ID NO: 134283 - protein, 13 aa, Mycobacterium tuberculosis
LVALNKADAVDDE

SEQ ID NO: 134284 - protein, 13 aa, Mycobacterium tuberculosis
VALNKADAVDDEE

SEQ ID NO: 134285 - protein, 13 aa, Mycobacterium tuberculosis
ALNKADAVDDEEL

SEQ ID NO: 134286 - protein, 13 aa, Mycobacterium tuberculosis
LNKADAVDDEELL

SEQ ID NO: 134287 - protein, 13 aa, Mycobacterium tuberculosis
NKADAVDDEELLE

SEQ ID NO: 134288 - protein, 13 aa, Mycobacterium tuberculosis
KADAVDDEELLEL

SEQ ID NO: 134289 - protein, 13 aa, Mycobacterium tuberculosis
ADAVDDEELLELV

SEQ ID NO: 134290 - protein, 13 aa, Mycobacterium tuberculosis
DAVDDEELLELVE

SEQ ID NO: 134291 - protein, 13 aa, Mycobacterium tuberculosis
AVDDEELLELVEM

SEQ ID NO: 134292 - protein, 13 aa, Mycobacterium tuberculosis
VDDEELLELVEME

SEQ ID NO: 134293 - protein, 13 aa, Mycobacterium tuberculosis
DDEELLELVEMEV

SEQ ID NO: 134294 - protein, 13 aa, Mycobacterium tuberculosis
DEELLELVEMEVR

SEQ ID NO: 134295 - protein, 13 aa, Mycobacterium tuberculosis
EELLELVEMEVRE

SEQ ID NO: 134296 - protein, 13 aa, Mycobacterium tuberculosis
ELLELVEMEVREL

SEQ ID NO: 134297 - protein, 13 aa, Mycobacterium tuberculosis
LLELVEMEVRELL

SEQ ID NO: 134298 - protein, 13 aa, Mycobacterium tuberculosis
LELVEMEVRELLA

SEQ ID NO: 134299 - protein, 13 aa, Mycobacterium tuberculosis
ELVEMEVRELLAA

SEQ ID NO: 134300 - protein, 13 aa, Mycobacterium tuberculosis
LVEMEVRELLAAQ

SEQ ID NO: 134301 - protein, 13 aa, Mycobacterium tuberculosis
VEMEVRELLAAQE

SEQ ID NO: 134302 - protein, 13 aa, Mycobacterium tuberculosis
EMEVRELLAAQEF

SEQ ID NO: 134303 - protein, 13 aa, Mycobacterium tuberculosis
MEVRELLAAQEFD

SEQ ID NO: 134304 - protein, 13 aa, Mycobacterium tuberculosis
EVRELLAAQEFDE

SEQ ID NO: 134305 - protein, 13 aa, Mycobacterium tuberculosis
VRELLAAQEFDED

SEQ ID NO: 134306 - protein, 13 aa, Mycobacterium tuberculosis
RELLAAQEFDEDA

SEQ ID NO: 134307 - protein, 13 aa, Mycobacterium tuberculosis
ELLAAQEFDEDAP

SEQ ID NO: 134308 - protein, 13 aa, Mycobacterium tuberculosis
LLAAQEFDEDAPV

SEQ ID NO: 134309 - protein, 13 aa, Mycobacterium tuberculosis
LAAQEFDEDAPVV

SEQ ID NO: 134310 - protein, 13 aa, Mycobacterium tuberculosis
AAQEFDEDAPVVR

SEQ ID NO: 134311 - protein, 13 aa, Mycobacterium tuberculosis
AQEFDEDAPVVRV

SEQ ID NO: 134312 - protein, 13 aa, Mycobacterium tuberculosis
QEFDEDAPVVRVS

SEQ ID NO: 134313 - protein, 13 aa, Mycobacterium tuberculosis
EFDEDAPVVRVSA

SEQ ID NO: 134314 - protein, 13 aa, Mycobacterium tuberculosis
FDEDAPVVRVSAL

SEQ ID NO: 134315 - protein, 13 aa, Mycobacterium tuberculosis
DEDAPVVRVSALK

SEQ ID NO: 134316 - protein, 13 aa, Mycobacterium tuberculosis
EDAPVVRVSALKA

SEQ ID NO: 134317 - protein, 13 aa, Mycobacterium tuberculosis
DAPVVRVSALKAL

SEQ ID NO: 134318 - protein, 13 aa, Mycobacterium tuberculosis
APVVRVSALKALE

SEQ ID NO: 134319 - protein, 13 aa, Mycobacterium tuberculosis
PVVRVSALKALEG

SEQ ID NO: 134320 - protein, 13 aa, Mycobacterium tuberculosis
VVRVSALKALEGD

SEQ ID NO: 134321 - protein, 13 aa, Mycobacterium tuberculosis
VRVSALKALEGDA

SEQ ID NO: 134322 - protein, 13 aa, Mycobacterium tuberculosis
RVSALKALEGDAK

SEQ ID NO: 134323 - protein, 13 aa, Mycobacterium tuberculosis
VSALKALEGDAKW

SEQ ID NO: 134324 - protein, 13 aa, Mycobacterium tuberculosis
SALKALEGDAKWV

SEQ ID NO: 134325 - protein, 13 aa, Mycobacterium tuberculosis
ALKALEGDAKWVA

SEQ ID NO: 134326 - protein, 13 aa, Mycobacterium tuberculosis
LKALEGDAKWVAS

SEQ ID NO: 134327 - protein, 13 aa, Mycobacterium tuberculosis
KALEGDAKWVASV

SEQ ID NO: 134328 - protein, 13 aa, Mycobacterium tuberculosis
ALEGDAKWVASVE

SEQ ID NO: 134329 - protein, 13 aa, Mycobacterium tuberculosis
LEGDAKWVASVEE

SEQ ID NO: 134330 - protein, 13 aa, Mycobacterium tuberculosis
EGDAKWVASVEEL

SEQ ID NO: 134331 - protein, 13 aa, Mycobacterium tuberculosis
GDAKWVASVEELM

SEQ ID NO: 134332 - protein, 13 aa, Mycobacterium tuberculosis
DAKWVASVEELMN

SEQ ID NO: 134333 - protein, 13 aa, Mycobacterium tuberculosis
AKWVASVEELMNA

SEQ ID NO: 134334 - protein, 13 aa, Mycobacterium tuberculosis
KWVASVEELMNAV

SEQ ID NO: 134335 - protein, 13 aa, Mycobacterium tuberculosis
WVASVEELMNAVD

SEQ ID NO: 134336 - protein, 13 aa, Mycobacterium tuberculosis
VASVEELMNAVDE

SEQ ID NO: 134337 - protein, 13 aa, Mycobacterium tuberculosis
ASVEELMNAVDES

SEQ ID NO: 134338 - protein, 13 aa, Mycobacterium tuberculosis
SVEELMNAVDESI

SEQ ID NO: 134339 - protein, 13 aa, Mycobacterium tuberculosis
VEELMNAVDESIP

SEQ ID NO: 134340 - protein, 13 aa, Mycobacterium tuberculosis
EELMNAVDESIPD

SEQ ID NO: 134341 - protein, 13 aa, Mycobacterium tuberculosis
ELMNAVDESIPDP

SEQ ID NO: 134342 - protein, 13 aa, Mycobacterium tuberculosis
LMNAVDESIPDPV

SEQ ID NO: 134343 - protein, 13 aa, Mycobacterium tuberculosis
MNAVDESIPDPVR

SEQ ID NO: 134344 - protein, 13 aa, Mycobacterium tuberculosis
NAVDESIPDPVRE

SEQ ID NO: 134345 - protein, 13 aa, Mycobacterium tuberculosis
AVDESIPDPVRET

SEQ ID NO: 134346 - protein, 13 aa, Mycobacterium tuberculosis
VDESIPDPVRETD

SEQ ID NO: 134347 - protein, 13 aa, Mycobacterium tuberculosis
DESIPDPVRETDK

SEQ ID NO: 134348 - protein, 13 aa, Mycobacterium tuberculosis
ESIPDPVRETDKP

SEQ ID NO: 134349 - protein, 13 aa, Mycobacterium tuberculosis
SIPDPVRETDKPF

SEQ ID NO: 134350 - protein, 13 aa, Mycobacterium tuberculosis
IPDPVRETDKPFL

SEQ ID NO: 134351 - protein, 13 aa, Mycobacterium tuberculosis
PDPVRETDKPFLM

SEQ ID NO: 134352 - protein, 13 aa, Mycobacterium tuberculosis
DPVRETDKPFLMP

SEQ ID NO: 134353 - protein, 13 aa, Mycobacterium tuberculosis
PVRETDKPFLMPV

SEQ ID NO: 134354 - protein, 13 aa, Mycobacterium tuberculosis
VRETDKPFLMPVE

SEQ ID NO: 134355 - protein, 13 aa, Mycobacterium tuberculosis
RETDKPFLMPVED

SEQ ID NO: 134356 - protein, 13 aa, Mycobacterium tuberculosis
ETDKPFLMPVEDV

SEQ ID NO: 134357 - protein, 13 aa, Mycobacterium tuberculosis
TDKPFLMPVEDVF

SEQ ID NO: 134358 - protein, 13 aa, Mycobacterium tuberculosis
DKPFLMPVEDVFT

SEQ ID NO: 134359 - protein, 13 aa, Mycobacterium tuberculosis
KPFLMPVEDVFTI

SEQ ID NO: 134360 - protein, 13 aa, Mycobacterium tuberculosis
PFLMPVEDVFTIT

SEQ ID NO: 134361 - protein, 13 aa, Mycobacterium tuberculosis
FLMPVEDVFTITG

SEQ ID NO: 134362 - protein, 13 aa, Mycobacterium tuberculosis
LMPVEDVFTITGR

SEQ ID NO: 134363 - protein, 13 aa, Mycobacterium tuberculosis
MPVEDVFTITGRG

SEQ ID NO: 134364 - protein, 13 aa, Mycobacterium tuberculosis
PVEDVFTITGRGT

SEQ ID NO: 134365 - protein, 13 aa, Mycobacterium tuberculosis
VEDVFTITGRGTV

SEQ ID NO: 134366 - protein, 13 aa, Mycobacterium tuberculosis
EDVFTITGRGTVV

SEQ ID NO: 134367 - protein, 13 aa, Mycobacterium tuberculosis
DVFTITGRGTVVT

SEQ ID NO: 134368 - protein, 13 aa, Mycobacterium tuberculosis
VFTITGRGTVVTG

SEQ ID NO: 134369 - protein, 13 aa, Mycobacterium tuberculosis
FTITGRGTVVTGR

SEQ ID NO: 134370 - protein, 13 aa, Mycobacterium tuberculosis
TITGRGTVVTGRV

SEQ ID NO: 134371 - protein, 13 aa, Mycobacterium tuberculosis
ITGRGTVVTGRVE

SEQ ID NO: 134372 - protein, 13 aa, Mycobacterium tuberculosis
TGRGTVVTGRVER

SEQ ID NO: 134373 - protein, 13 aa, Mycobacterium tuberculosis
GRGTVVTGRVERG

SEQ ID NO: 134374 - protein, 13 aa, Mycobacterium tuberculosis
RGTVVTGRVERGV

SEQ ID NO: 134375 - protein, 13 aa, Mycobacterium tuberculosis
GTVVTGRVERGVI

SEQ ID NO: 134376 - protein, 13 aa, Mycobacterium tuberculosis
TVVTGRVERGVIN

SEQ ID NO: 134377 - protein, 13 aa, Mycobacterium tuberculosis
VVTGRVERGVINV

SEQ ID NO: 134378 - protein, 13 aa, Mycobacterium tuberculosis
VTGRVERGVINVN

SEQ ID NO: 134379 - protein, 13 aa, Mycobacterium tuberculosis
TGRVERGVINVNE

SEQ ID NO: 134380 - protein, 13 aa, Mycobacterium tuberculosis
GRVERGVINVNEE

SEQ ID NO: 134381 - protein, 13 aa, Mycobacterium tuberculosis
RVERGVINVNEEV

SEQ ID NO: 134382 - protein, 13 aa, Mycobacterium tuberculosis
VERGVINVNEEVE

SEQ ID NO: 134383 - protein, 13 aa, Mycobacterium tuberculosis
ERGVINVNEEVEI

SEQ ID NO: 134384 - protein, 13 aa, Mycobacterium tuberculosis
RGVINVNEEVEIV

SEQ ID NO: 134385 - protein, 13 aa, Mycobacterium tuberculosis
GVINVNEEVEIVG

SEQ ID NO: 134386 - protein, 13 aa, Mycobacterium tuberculosis
VINVNEEVEIVGI

SEQ ID NO: 134387 - protein, 13 aa, Mycobacterium tuberculosis
INVNEEVEIVGIR

SEQ ID NO: 134388 - protein, 13 aa, Mycobacterium tuberculosis
NVNEEVEIVGIRP

SEQ ID NO: 134389 - protein, 13 aa, Mycobacterium tuberculosis
VNEEVEIVGIRPS

SEQ ID NO: 134390 - protein, 13 aa, Mycobacterium tuberculosis
NEEVEIVGIRPST

SEQ ID NO: 134391 - protein, 13 aa, Mycobacterium tuberculosis
EEVEIVGIRPSTT

SEQ ID NO: 134392 - protein, 13 aa, Mycobacterium tuberculosis
EVEIVGIRPSTTK

SEQ ID NO: 134393 - protein, 13 aa, Mycobacterium tuberculosis
VEIVGIRPSTTKT

SEQ ID NO: 134394 - protein, 13 aa, Mycobacterium tuberculosis
EIVGIRPSTTKTT

SEQ ID NO: 134395 - protein, 13 aa, Mycobacterium tuberculosis
IVGIRPSTTKTTV

SEQ ID NO: 134396 - protein, 13 aa, Mycobacterium tuberculosis
VGIRPSTTKTTVT

SEQ ID NO: 134397 - protein, 13 aa, Mycobacterium tuberculosis
GIRPSTTKTTVTG

SEQ ID NO: 134398 - protein, 13 aa, Mycobacterium tuberculosis
IRPSTTKTTVTGV

SEQ ID NO: 134399 - protein, 13 aa, Mycobacterium tuberculosis
RPSTTKTTVTGVE

SEQ ID NO: 134400 - protein, 13 aa, Mycobacterium tuberculosis
PSTTKTTVTGVEM

SEQ ID NO: 134401 - protein, 13 aa, Mycobacterium tuberculosis
STTKTTVTGVEMF

SEQ ID NO: 134402 - protein, 13 aa, Mycobacterium tuberculosis
TTKTTVTGVEMFR

SEQ ID NO: 134403 - protein, 13 aa, Mycobacterium tuberculosis
TKTTVTGVEMFRK

SEQ ID NO: 134404 - protein, 13 aa, Mycobacterium tuberculosis
KTTVTGVEMFRKL

SEQ ID NO: 134405 - protein, 13 aa, Mycobacterium tuberculosis
TTVTGVEMFRKLL

SEQ ID NO: 134406 - protein, 13 aa, Mycobacterium tuberculosis
TVTGVEMFRKLLD

SEQ ID NO: 134407 - protein, 13 aa, Mycobacterium tuberculosis
VTGVEMFRKLLDQ

SEQ ID NO: 134408 - protein, 13 aa, Mycobacterium tuberculosis
TGVEMFRKLLDQG

SEQ ID NO: 134409 - protein, 13 aa, Mycobacterium tuberculosis
GVEMFRKLLDQGQ

SEQ ID NO: 134410 - protein, 13 aa, Mycobacterium tuberculosis
VEMFRKLLDQGQA

SEQ ID NO: 134411 - protein, 13 aa, Mycobacterium tuberculosis
EMFRKLLDQGQAG

SEQ ID NO: 134412 - protein, 13 aa, Mycobacterium tuberculosis
MFRKLLDQGQAGD

SEQ ID NO: 134413 - protein, 13 aa, Mycobacterium tuberculosis
FRKLLDQGQAGDN

SEQ ID NO: 134414 - protein, 13 aa, Mycobacterium tuberculosis
RKLLDQGQAGDNV

SEQ ID NO: 134415 - protein, 13 aa, Mycobacterium tuberculosis
KLLDQGQAGDNVG

SEQ ID NO: 134416 - protein, 13 aa, Mycobacterium tuberculosis
LLDQGQAGDNVGL

SEQ ID NO: 134417 - protein, 13 aa, Mycobacterium tuberculosis
LDQGQAGDNVGLL

SEQ ID NO: 134418 - protein, 13 aa, Mycobacterium tuberculosis
DQGQAGDNVGLLL

SEQ ID NO: 134419 - protein, 13 aa, Mycobacterium tuberculosis
QGQAGDNVGLLLR

SEQ ID NO: 134420 - protein, 13 aa, Mycobacterium tuberculosis
GQAGDNVGLLLRG

SEQ ID NO: 134421 - protein, 13 aa, Mycobacterium tuberculosis
QAGDNVGLLLRGV

SEQ ID NO: 134422 - protein, 13 aa, Mycobacterium tuberculosis
AGDNVGLLLRGVK

SEQ ID NO: 134423 - protein, 13 aa, Mycobacterium tuberculosis
GDNVGLLLRGVKR

SEQ ID NO: 134424 - protein, 13 aa, Mycobacterium tuberculosis
DNVGLLLRGVKRE

SEQ ID NO: 134425 - protein, 13 aa, Mycobacterium tuberculosis
NVGLLLRGVKRED

SEQ ID NO: 134426 - protein, 13 aa, Mycobacterium tuberculosis
VGLLLRGVKREDV

SEQ ID NO: 134427 - protein, 13 aa, Mycobacterium tuberculosis
GLLLRGVKREDVE

SEQ ID NO: 134428 - protein, 13 aa, Mycobacterium tuberculosis
LLLRGVKREDVER

SEQ ID NO: 134429 - protein, 13 aa, Mycobacterium tuberculosis
LLRGVKREDVERG

SEQ ID NO: 134430 - protein, 13 aa, Mycobacterium tuberculosis
LRGVKREDVERGQ

SEQ ID NO: 134431 - protein, 13 aa, Mycobacterium tuberculosis
RGVKREDVERGQV

SEQ ID NO: 134432 - protein, 13 aa, Mycobacterium tuberculosis
GVKREDVERGQVV

SEQ ID NO: 134433 - protein, 13 aa, Mycobacterium tuberculosis
VKREDVERGQVVT

SEQ ID NO: 134434 - protein, 13 aa, Mycobacterium tuberculosis
KREDVERGQVVTK

SEQ ID NO: 134435 - protein, 13 aa, Mycobacterium tuberculosis
REDVERGQVVTKP

SEQ ID NO: 134436 - protein, 13 aa, Mycobacterium tuberculosis
EDVERGQVVTKPG

SEQ ID NO: 134437 - protein, 13 aa, Mycobacterium tuberculosis
DVERGQVVTKPGT

SEQ ID NO: 134438 - protein, 13 aa, Mycobacterium tuberculosis
VERGQVVTKPGTT

SEQ ID NO: 134439 - protein, 13 aa, Mycobacterium tuberculosis
ERGQVVTKPGTTT

SEQ ID NO: 134440 - protein, 13 aa, Mycobacterium tuberculosis
RGQVVTKPGTTTP

SEQ ID NO: 134441 - protein, 13 aa, Mycobacterium tuberculosis
GQVVTKPGTTTPH

SEQ ID NO: 134442 - protein, 13 aa, Mycobacterium tuberculosis
QVVTKPGTTTPHT

SEQ ID NO: 134443 - protein, 13 aa, Mycobacterium tuberculosis
VVTKPGTTTPHTE

SEQ ID NO: 134444 - protein, 13 aa, Mycobacterium tuberculosis
VTKPGTTTPHTEF

SEQ ID NO: 134445 - protein, 13 aa, Mycobacterium tuberculosis
TKPGTTTPHTEFE

SEQ ID NO: 134446 - protein, 13 aa, Mycobacterium tuberculosis
KPGTTTPHTEFEG

SEQ ID NO: 134447 - protein, 13 aa, Mycobacterium tuberculosis
PGTTTPHTEFEGQ

SEQ ID NO: 134448 - protein, 13 aa, Mycobacterium tuberculosis
GTTTPHTEFEGQV

SEQ ID NO: 134449 - protein, 13 aa, Mycobacterium tuberculosis
TTTPHTEFEGQVY

SEQ ID NO: 134450 - protein, 13 aa, Mycobacterium tuberculosis
TTPHTEFEGQVYI

SEQ ID NO: 134451 - protein, 13 aa, Mycobacterium tuberculosis
TPHTEFEGQVYIL

SEQ ID NO: 134452 - protein, 13 aa, Mycobacterium tuberculosis
PHTEFEGQVYILS

SEQ ID NO: 134453 - protein, 13 aa, Mycobacterium tuberculosis
HTEFEGQVYILSK

SEQ ID NO: 134454 - protein, 13 aa, Mycobacterium tuberculosis
TEFEGQVYILSKD

SEQ ID NO: 134455 - protein, 13 aa, Mycobacterium tuberculosis
EFEGQVYILSKDE

SEQ ID NO: 134456 - protein, 13 aa, Mycobacterium tuberculosis
FEGQVYILSKDEG

SEQ ID NO: 134457 - protein, 13 aa, Mycobacterium tuberculosis
EGQVYILSKDEGG

SEQ ID NO: 134458 - protein, 13 aa, Mycobacterium tuberculosis
GQVYILSKDEGGR

SEQ ID NO: 134459 - protein, 13 aa, Mycobacterium tuberculosis
QVYILSKDEGGRH

SEQ ID NO: 134460 - protein, 13 aa, Mycobacterium tuberculosis
VYILSKDEGGRHT

SEQ ID NO: 134461 - protein, 13 aa, Mycobacterium tuberculosis
YILSKDEGGRHTP

SEQ ID NO: 134462 - protein, 13 aa, Mycobacterium tuberculosis
ILSKDEGGRHTPF

SEQ ID NO: 134463 - protein, 13 aa, Mycobacterium tuberculosis
LSKDEGGRHTPFF

SEQ ID NO: 134464 - protein, 13 aa, Mycobacterium tuberculosis
SKDEGGRHTPFFN

SEQ ID NO: 134465 - protein, 13 aa, Mycobacterium tuberculosis
KDEGGRHTPFFNN

SEQ ID NO: 134466 - protein, 13 aa, Mycobacterium tuberculosis
DEGGRHTPFFNNY

SEQ ID NO: 134467 - protein, 13 aa, Mycobacterium tuberculosis
EGGRHTPFFNNYR

SEQ ID NO: 134468 - protein, 13 aa, Mycobacterium tuberculosis
GGRHTPFFNNYRP

SEQ ID NO: 134469 - protein, 13 aa, Mycobacterium tuberculosis
GRHTPFFNNYRPQ

SEQ ID NO: 134470 - protein, 13 aa, Mycobacterium tuberculosis
RHTPFFNNYRPQF

SEQ ID NO: 134471 - protein, 13 aa, Mycobacterium tuberculosis
HTPFFNNYRPQFY

SEQ ID NO: 134472 - protein, 13 aa, Mycobacterium tuberculosis
TPFFNNYRPQFYF

SEQ ID NO: 134473 - protein, 13 aa, Mycobacterium tuberculosis
PFFNNYRPQFYFR

SEQ ID NO: 134474 - protein, 13 aa, Mycobacterium tuberculosis
FFNNYRPQFYFRT

SEQ ID NO: 134475 - protein, 13 aa, Mycobacterium tuberculosis
FNNYRPQFYFRTT

SEQ ID NO: 134476 - protein, 13 aa, Mycobacterium tuberculosis
NNYRPQFYFRTTD

SEQ ID NO: 134477 - protein, 13 aa, Mycobacterium tuberculosis
NYRPQFYFRTTDV

SEQ ID NO: 134478 - protein, 13 aa, Mycobacterium tuberculosis
YRPQFYFRTTDVT

SEQ ID NO: 134479 - protein, 13 aa, Mycobacterium tuberculosis
RPQFYFRTTDVTG

SEQ ID NO: 134480 - protein, 13 aa, Mycobacterium tuberculosis
PQFYFRTTDVTGV

SEQ ID NO: 134481 - protein, 13 aa, Mycobacterium tuberculosis
QFYFRTTDVTGVV

SEQ ID NO: 134482 - protein, 13 aa, Mycobacterium tuberculosis
FYFRTTDVTGVVT

SEQ ID NO: 134483 - protein, 13 aa, Mycobacterium tuberculosis
YFRTTDVTGVVTL

SEQ ID NO: 134484 - protein, 13 aa, Mycobacterium tuberculosis
FRTTDVTGVVTLP

SEQ ID NO: 134485 - protein, 13 aa, Mycobacterium tuberculosis
RTTDVTGVVTLPE

SEQ ID NO: 134486 - protein, 13 aa, Mycobacterium tuberculosis
TTDVTGVVTLPEG

SEQ ID NO: 134487 - protein, 13 aa, Mycobacterium tuberculosis
TDVTGVVTLPEGT

SEQ ID NO: 134488 - protein, 13 aa, Mycobacterium tuberculosis
DVTGVVTLPEGTE

SEQ ID NO: 134489 - protein, 13 aa, Mycobacterium tuberculosis
VTGVVTLPEGTEM

SEQ ID NO: 134490 - protein, 13 aa, Mycobacterium tuberculosis
TGVVTLPEGTEMV

SEQ ID NO: 134491 - protein, 13 aa, Mycobacterium tuberculosis
GVVTLPEGTEMVM

SEQ ID NO: 134492 - protein, 13 aa, Mycobacterium tuberculosis
VVTLPEGTEMVMP

SEQ ID NO: 134493 - protein, 13 aa, Mycobacterium tuberculosis
VTLPEGTEMVMPG

SEQ ID NO: 134494 - protein, 13 aa, Mycobacterium tuberculosis
TLPEGTEMVMPGD

SEQ ID NO: 134495 - protein, 13 aa, Mycobacterium tuberculosis
LPEGTEMVMPGDN

SEQ ID NO: 134496 - protein, 13 aa, Mycobacterium tuberculosis
PEGTEMVMPGDNT

SEQ ID NO: 134497 - protein, 13 aa, Mycobacterium tuberculosis
EGTEMVMPGDNTN

SEQ ID NO: 134498 - protein, 13 aa, Mycobacterium tuberculosis
GTEMVMPGDNTNI

SEQ ID NO: 134499 - protein, 13 aa, Mycobacterium tuberculosis
TEMVMPGDNTNIS

SEQ ID NO: 134500 - protein, 13 aa, Mycobacterium tuberculosis
EMVMPGDNTNISV

SEQ ID NO: 134501 - protein, 13 aa, Mycobacterium tuberculosis
MVMPGDNTNISVK

SEQ ID NO: 134502 - protein, 13 aa, Mycobacterium tuberculosis
VMPGDNTNISVKL

SEQ ID NO: 134503 - protein, 13 aa, Mycobacterium tuberculosis
MPGDNTNISVKLI

SEQ ID NO: 134504 - protein, 13 aa, Mycobacterium tuberculosis
PGDNTNISVKLIQ

SEQ ID NO: 134505 - protein, 13 aa, Mycobacterium tuberculosis
GDNTNISVKLIQP

SEQ ID NO: 134506 - protein, 13 aa, Mycobacterium tuberculosis
DNTNISVKLIQPV

SEQ ID NO: 134507 - protein, 13 aa, Mycobacterium tuberculosis
NTNISVKLIQPVA

SEQ ID NO: 134508 - protein, 13 aa, Mycobacterium tuberculosis
TNISVKLIQPVAM

SEQ ID NO: 134509 - protein, 13 aa, Mycobacterium tuberculosis
NISVKLIQPVAMD

SEQ ID NO: 134510 - protein, 13 aa, Mycobacterium tuberculosis
ISVKLIQPVAMDE

SEQ ID NO: 134511 - protein, 13 aa, Mycobacterium tuberculosis
SVKLIQPVAMDEG

SEQ ID NO: 134512 - protein, 13 aa, Mycobacterium tuberculosis
VKLIQPVAMDEGL

SEQ ID NO: 134513 - protein, 13 aa, Mycobacterium tuberculosis
KLIQPVAMDEGLR

SEQ ID NO: 134514 - protein, 13 aa, Mycobacterium tuberculosis
LIQPVAMDEGLRF

SEQ ID NO: 134515 - protein, 13 aa, Mycobacterium tuberculosis
IQPVAMDEGLRFA

SEQ ID NO: 134516 - protein, 13 aa, Mycobacterium tuberculosis
QPVAMDEGLRFAI

SEQ ID NO: 134517 - protein, 13 aa, Mycobacterium tuberculosis
PVAMDEGLRFAIR

SEQ ID NO: 134518 - protein, 13 aa, Mycobacterium tuberculosis
VAMDEGLRFAIRE

SEQ ID NO: 134519 - protein, 13 aa, Mycobacterium tuberculosis
AMDEGLRFAIREG

SEQ ID NO: 134520 - protein, 13 aa, Mycobacterium tuberculosis
MDEGLRFAIREGG

SEQ ID NO: 134521 - protein, 13 aa, Mycobacterium tuberculosis
DEGLRFAIREGGR

SEQ ID NO: 134522 - protein, 13 aa, Mycobacterium tuberculosis
EGLRFAIREGGRT

SEQ ID NO: 134523 - protein, 13 aa, Mycobacterium tuberculosis
GLRFAIREGGRTV

SEQ ID NO: 134524 - protein, 13 aa, Mycobacterium tuberculosis
LRFAIREGGRTVG

SEQ ID NO: 134525 - protein, 13 aa, Mycobacterium tuberculosis
RFAIREGGRTVGA

SEQ ID NO: 134526 - protein, 13 aa, Mycobacterium tuberculosis
FAIREGGRTVGAG

SEQ ID NO: 134527 - protein, 13 aa, Mycobacterium tuberculosis
AIREGGRTVGAGR

SEQ ID NO: 134528 - protein, 13 aa, Mycobacterium tuberculosis
IREGGRTVGAGRV

SEQ ID NO: 134529 - protein, 13 aa, Mycobacterium tuberculosis
REGGRTVGAGRVT

SEQ ID NO: 134530 - protein, 13 aa, Mycobacterium tuberculosis
EGGRTVGAGRVTK

SEQ ID NO: 134531 - protein, 13 aa, Mycobacterium tuberculosis
GGRTVGAGRVTKI

SEQ ID NO: 134532 - protein, 13 aa, Mycobacterium tuberculosis
GRTVGAGRVTKII

SEQ ID NO: 134533 - protein, 13 aa, Mycobacterium tuberculosis
RTVGAGRVTKIIK

SEQ ID NO: 134534 - protein, 14 aa, Mycobacterium tuberculosis
MAKAKFQRTKPHVN

SEQ ID NO: 134535 - protein, 14 aa, Mycobacterium tuberculosis
AKAKFQRTKPHVNI

SEQ ID NO: 134536 - protein, 14 aa, Mycobacterium tuberculosis
KAKFQRTKPHVNIG

SEQ ID NO: 134537 - protein, 14 aa, Mycobacterium tuberculosis
AKFQRTKPHVNIGT

SEQ ID NO: 134538 - protein, 14 aa, Mycobacterium tuberculosis
KFQRTKPHVNIGTI

SEQ ID NO: 134539 - protein, 14 aa, Mycobacterium tuberculosis
FQRTKPHVNIGTIG

SEQ ID NO: 134540 - protein, 14 aa, Mycobacterium tuberculosis
QRTKPHVNIGTIGH

SEQ ID NO: 134541 - protein, 14 aa, Mycobacterium tuberculosis
RTKPHVNIGTIGHV

SEQ ID NO: 134542 - protein, 14 aa, Mycobacterium tuberculosis
TKPHVNIGTIGHVD

SEQ ID NO: 134543 - protein, 14 aa, Mycobacterium tuberculosis
KPHVNIGTIGHVDH

SEQ ID NO: 134544 - protein, 14 aa, Mycobacterium tuberculosis
PHVNIGTIGHVDHG

SEQ ID NO: 134545 - protein, 14 aa, Mycobacterium tuberculosis
HVNIGTIGHVDHGK

SEQ ID NO: 134546 - protein, 14 aa, Mycobacterium tuberculosis
VNIGTIGHVDHGKT

SEQ ID NO: 134547 - protein, 14 aa, Mycobacterium tuberculosis
NIGTIGHVDHGKTT

SEQ ID NO: 134548 - protein, 14 aa, Mycobacterium tuberculosis
IGTIGHVDHGKTTL

SEQ ID NO: 134549 - protein, 14 aa, Mycobacterium tuberculosis
GTIGHVDHGKTTLT

SEQ ID NO: 134550 - protein, 14 aa, Mycobacterium tuberculosis
TIGHVDHGKTTLTA

SEQ ID NO: 134551 - protein, 14 aa, Mycobacterium tuberculosis
IGHVDHGKTTLTAA

SEQ ID NO: 134552 - protein, 14 aa, Mycobacterium tuberculosis
GHVDHGKTTLTAAI

SEQ ID NO: 134553 - protein, 14 aa, Mycobacterium tuberculosis
HVDHGKTTLTAAIT

SEQ ID NO: 134554 - protein, 14 aa, Mycobacterium tuberculosis
VDHGKTTLTAAITK

SEQ ID NO: 134555 - protein, 14 aa, Mycobacterium tuberculosis
DHGKTTLTAAITKV

SEQ ID NO: 134556 - protein, 14 aa, Mycobacterium tuberculosis
HGKTTLTAAITKVL

SEQ ID NO: 134557 - protein, 14 aa, Mycobacterium tuberculosis
GKTTLTAAITKVLH

SEQ ID NO: 134558 - protein, 14 aa, Mycobacterium tuberculosis
KTTLTAAITKVLHD

SEQ ID NO: 134559 - protein, 14 aa, Mycobacterium tuberculosis
TTLTAAITKVLHDK

SEQ ID NO: 134560 - protein, 14 aa, Mycobacterium tuberculosis
TLTAAITKVLHDKF

SEQ ID NO: 134561 - protein, 14 aa, Mycobacterium tuberculosis
LTAAITKVLHDKFP

SEQ ID NO: 134562 - protein, 14 aa, Mycobacterium tuberculosis
TAAITKVLHDKFPD

SEQ ID NO: 134563 - protein, 14 aa, Mycobacterium tuberculosis
AAITKVLHDKFPDL

SEQ ID NO: 134564 - protein, 14 aa, Mycobacterium tuberculosis
AITKVLHDKFPDLN

SEQ ID NO: 134565 - protein, 14 aa, Mycobacterium tuberculosis
ITKVLHDKFPDLNE

SEQ ID NO: 134566 - protein, 14 aa, Mycobacterium tuberculosis
TKVLHDKFPDLNET

SEQ ID NO: 134567 - protein, 14 aa, Mycobacterium tuberculosis
KVLHDKFPDLNETK

SEQ ID NO: 134568 - protein, 14 aa, Mycobacterium tuberculosis
VLHDKFPDLNETKA

SEQ ID NO: 134569 - protein, 14 aa, Mycobacterium tuberculosis
LHDKFPDLNETKAF

SEQ ID NO: 134570 - protein, 14 aa, Mycobacterium tuberculosis
HDKFPDLNETKAFD

SEQ ID NO: 134571 - protein, 14 aa, Mycobacterium tuberculosis
DKFPDLNETKAFDQ

SEQ ID NO: 134572 - protein, 14 aa, Mycobacterium tuberculosis
KFPDLNETKAFDQI

SEQ ID NO: 134573 - protein, 14 aa, Mycobacterium tuberculosis
FPDLNETKAFDQID

SEQ ID NO: 134574 - protein, 14 aa, Mycobacterium tuberculosis
PDLNETKAFDQIDN

SEQ ID NO: 134575 - protein, 14 aa, Mycobacterium tuberculosis
DLNETKAFDQIDNA

SEQ ID NO: 134576 - protein, 14 aa, Mycobacterium tuberculosis
LNETKAFDQIDNAP

SEQ ID NO: 134577 - protein, 14 aa, Mycobacterium tuberculosis
NETKAFDQIDNAPE

SEQ ID NO: 134578 - protein, 14 aa, Mycobacterium tuberculosis
ETKAFDQIDNAPEE

SEQ ID NO: 134579 - protein, 14 aa, Mycobacterium tuberculosis
TKAFDQIDNAPEER

SEQ ID NO: 134580 - protein, 14 aa, Mycobacterium tuberculosis
KAFDQIDNAPEERQ

SEQ ID NO: 134581 - protein, 14 aa, Mycobacterium tuberculosis
AFDQIDNAPEERQR

SEQ ID NO: 134582 - protein, 14 aa, Mycobacterium tuberculosis
FDQIDNAPEERQRG

SEQ ID NO: 134583 - protein, 14 aa, Mycobacterium tuberculosis
DQIDNAPEERQRGI

SEQ ID NO: 134584 - protein, 14 aa, Mycobacterium tuberculosis
QIDNAPEERQRGIT

SEQ ID NO: 134585 - protein, 14 aa, Mycobacterium tuberculosis
IDNAPEERQRGITI

SEQ ID NO: 134586 - protein, 14 aa, Mycobacterium tuberculosis
DNAPEERQRGITIN

SEQ ID NO: 134587 - protein, 14 aa, Mycobacterium tuberculosis
NAPEERQRGITINI

SEQ ID NO: 134588 - protein, 14 aa, Mycobacterium tuberculosis
APEERQRGITINIA

SEQ ID NO: 134589 - protein, 14 aa, Mycobacterium tuberculosis
PEERQRGITINIAH

SEQ ID NO: 134590 - protein, 14 aa, Mycobacterium tuberculosis
EERQRGITINIAHV

SEQ ID NO: 134591 - protein, 14 aa, Mycobacterium tuberculosis
ERQRGITINIAHVE

SEQ ID NO: 134592 - protein, 14 aa, Mycobacterium tuberculosis
RQRGITINIAHVEY

SEQ ID NO: 134593 - protein, 14 aa, Mycobacterium tuberculosis
QRGITINIAHVEYQ

SEQ ID NO: 134594 - protein, 14 aa, Mycobacterium tuberculosis
RGITINIAHVEYQT

SEQ ID NO: 134595 - protein, 14 aa, Mycobacterium tuberculosis
GITINIAHVEYQTD

SEQ ID NO: 134596 - protein, 14 aa, Mycobacterium tuberculosis
ITINIAHVEYQTDK

SEQ ID NO: 134597 - protein, 14 aa, Mycobacterium tuberculosis
TINIAHVEYQTDKR

SEQ ID NO: 134598 - protein, 14 aa, Mycobacterium tuberculosis
INIAHVEYQTDKRH

SEQ ID NO: 134599 - protein, 14 aa, Mycobacterium tuberculosis
NIAHVEYQTDKRHY

SEQ ID NO: 134600 - protein, 14 aa, Mycobacterium tuberculosis
IAHVEYQTDKRHYA

SEQ ID NO: 134601 - protein, 14 aa, Mycobacterium tuberculosis
AHVEYQTDKRHYAH

SEQ ID NO: 134602 - protein, 14 aa, Mycobacterium tuberculosis
HVEYQTDKRHYAHV

SEQ ID NO: 134603 - protein, 14 aa, Mycobacterium tuberculosis
VEYQTDKRHYAHVD

SEQ ID NO: 134604 - protein, 14 aa, Mycobacterium tuberculosis
EYQTDKRHYAHVDA

SEQ ID NO: 134605 - protein, 14 aa, Mycobacterium tuberculosis
YQTDKRHYAHVDAP

SEQ ID NO: 134606 - protein, 14 aa, Mycobacterium tuberculosis
QTDKRHYAHVDAPG

SEQ ID NO: 134607 - protein, 14 aa, Mycobacterium tuberculosis
TDKRHYAHVDAPGH

SEQ ID NO: 134608 - protein, 14 aa, Mycobacterium tuberculosis
DKRHYAHVDAPGHA

SEQ ID NO: 134609 - protein, 14 aa, Mycobacterium tuberculosis
KRHYAHVDAPGHAD

SEQ ID NO: 134610 - protein, 14 aa, Mycobacterium tuberculosis
RHYAHVDAPGHADY

SEQ ID NO: 134611 - protein, 14 aa, Mycobacterium tuberculosis
HYAHVDAPGHADYI

SEQ ID NO: 134612 - protein, 14 aa, Mycobacterium tuberculosis
YAHVDAPGHADYIK

SEQ ID NO: 134613 - protein, 14 aa, Mycobacterium tuberculosis
AHVDAPGHADYIKN

SEQ ID NO: 134614 - protein, 14 aa, Mycobacterium tuberculosis
HVDAPGHADYIKNM

SEQ ID NO: 134615 - protein, 14 aa, Mycobacterium tuberculosis
VDAPGHADYIKNMI

SEQ ID NO: 134616 - protein, 14 aa, Mycobacterium tuberculosis
DAPGHADYIKNMIT

SEQ ID NO: 134617 - protein, 14 aa, Mycobacterium tuberculosis
APGHADYIKNMITG

SEQ ID NO: 134618 - protein, 14 aa, Mycobacterium tuberculosis
PGHADYIKNMITGA

SEQ ID NO: 134619 - protein, 14 aa, Mycobacterium tuberculosis
GHADYIKNMITGAA

SEQ ID NO: 134620 - protein, 14 aa, Mycobacterium tuberculosis
HADYIKNMITGAAQ

SEQ ID NO: 134621 - protein, 14 aa, Mycobacterium tuberculosis
ADYIKNMITGAAQM

SEQ ID NO: 134622 - protein, 14 aa, Mycobacterium tuberculosis
DYIKNMITGAAQMD

SEQ ID NO: 134623 - protein, 14 aa, Mycobacterium tuberculosis
YIKNMITGAAQMDG

SEQ ID NO: 134624 - protein, 14 aa, Mycobacterium tuberculosis
IKNMITGAAQMDGA

SEQ ID NO: 134625 - protein, 14 aa, Mycobacterium tuberculosis
KNMITGAAQMDGAI

SEQ ID NO: 134626 - protein, 14 aa, Mycobacterium tuberculosis
NMITGAAQMDGAIL

SEQ ID NO: 134627 - protein, 14 aa, Mycobacterium tuberculosis
MITGAAQMDGAILV

SEQ ID NO: 134628 - protein, 14 aa, Mycobacterium tuberculosis
ITGAAQMDGAILVV

SEQ ID NO: 134629 - protein, 14 aa, Mycobacterium tuberculosis
TGAAQMDGAILVVA

SEQ ID NO: 134630 - protein, 14 aa, Mycobacterium tuberculosis
GAAQMDGAILVVAA

SEQ ID NO: 134631 - protein, 14 aa, Mycobacterium tuberculosis
AAQMDGAILVVAAT

SEQ ID NO: 134632 - protein, 14 aa, Mycobacterium tuberculosis
AQMDGAILVVAATD

SEQ ID NO: 134633 - protein, 14 aa, Mycobacterium tuberculosis
QMDGAILVVAATDG

SEQ ID NO: 134634 - protein, 14 aa, Mycobacterium tuberculosis
MDGAILVVAATDGP

SEQ ID NO: 134635 - protein, 14 aa, Mycobacterium tuberculosis
DGAILVVAATDGPM

SEQ ID NO: 134636 - protein, 14 aa, Mycobacterium tuberculosis
GAILVVAATDGPMP

SEQ ID NO: 134637 - protein, 14 aa, Mycobacterium tuberculosis
AILVVAATDGPMPQ

SEQ ID NO: 134638 - protein, 14 aa, Mycobacterium tuberculosis
ILVVAATDGPMPQT

SEQ ID NO: 134639 - protein, 14 aa, Mycobacterium tuberculosis
LVVAATDGPMPQTR

SEQ ID NO: 134640 - protein, 14 aa, Mycobacterium tuberculosis
VVAATDGPMPQTRE

SEQ ID NO: 134641 - protein, 14 aa, Mycobacterium tuberculosis
VAATDGPMPQTREH

SEQ ID NO: 134642 - protein, 14 aa, Mycobacterium tuberculosis
AATDGPMPQTREHV

SEQ ID NO: 134643 - protein, 14 aa, Mycobacterium tuberculosis
ATDGPMPQTREHVL

SEQ ID NO: 134644 - protein, 14 aa, Mycobacterium tuberculosis
TDGPMPQTREHVLL

SEQ ID NO: 134645 - protein, 14 aa, Mycobacterium tuberculosis
DGPMPQTREHVLLA

SEQ ID NO: 134646 - protein, 14 aa, Mycobacterium tuberculosis
GPMPQTREHVLLAR

SEQ ID NO: 134647 - protein, 14 aa, Mycobacterium tuberculosis
PMPQTREHVLLARQ

SEQ ID NO: 134648 - protein, 14 aa, Mycobacterium tuberculosis
MPQTREHVLLARQV

SEQ ID NO: 134649 - protein, 14 aa, Mycobacterium tuberculosis
PQTREHVLLARQVG

SEQ ID NO: 134650 - protein, 14 aa, Mycobacterium tuberculosis
QTREHVLLARQVGV

SEQ ID NO: 134651 - protein, 14 aa, Mycobacterium tuberculosis
TREHVLLARQVGVP

SEQ ID NO: 134652 - protein, 14 aa, Mycobacterium tuberculosis
REHVLLARQVGVPY

SEQ ID NO: 134653 - protein, 14 aa, Mycobacterium tuberculosis
EHVLLARQVGVPYI

SEQ ID NO: 134654 - protein, 14 aa, Mycobacterium tuberculosis
HVLLARQVGVPYIL

SEQ ID NO: 134655 - protein, 14 aa, Mycobacterium tuberculosis
VLLARQVGVPYILV

SEQ ID NO: 134656 - protein, 14 aa, Mycobacterium tuberculosis
LLARQVGVPYILVA

SEQ ID NO: 134657 - protein, 14 aa, Mycobacterium tuberculosis
LARQVGVPYILVAL

SEQ ID NO: 134658 - protein, 14 aa, Mycobacterium tuberculosis
ARQVGVPYILVALN

SEQ ID NO: 134659 - protein, 14 aa, Mycobacterium tuberculosis
RQVGVPYILVALNK

SEQ ID NO: 134660 - protein, 14 aa, Mycobacterium tuberculosis
QVGVPYILVALNKA

SEQ ID NO: 134661 - protein, 14 aa, Mycobacterium tuberculosis
VGVPYILVALNKAD

SEQ ID NO: 134662 - protein, 14 aa, Mycobacterium tuberculosis
GVPYILVALNKADA

SEQ ID NO: 134663 - protein, 14 aa, Mycobacterium tuberculosis
VPYILVALNKADAV

SEQ ID NO: 134664 - protein, 14 aa, Mycobacterium tuberculosis
PYILVALNKADAVD

SEQ ID NO: 134665 - protein, 14 aa, Mycobacterium tuberculosis
YILVALNKADAVDD

SEQ ID NO: 134666 - protein, 14 aa, Mycobacterium tuberculosis
ILVALNKADAVDDE

SEQ ID NO: 134667 - protein, 14 aa, Mycobacterium tuberculosis
LVALNKADAVDDEE

SEQ ID NO: 134668 - protein, 14 aa, Mycobacterium tuberculosis
VALNKADAVDDEEL

SEQ ID NO: 134669 - protein, 14 aa, Mycobacterium tuberculosis
ALNKADAVDDEELL

SEQ ID NO: 134670 - protein, 14 aa, Mycobacterium tuberculosis
LNKADAVDDEELLE

SEQ ID NO: 134671 - protein, 14 aa, Mycobacterium tuberculosis
NKADAVDDEELLEL

SEQ ID NO: 134672 - protein, 14 aa, Mycobacterium tuberculosis
KADAVDDEELLELV

SEQ ID NO: 134673 - protein, 14 aa, Mycobacterium tuberculosis
ADAVDDEELLELVE

SEQ ID NO: 134674 - protein, 14 aa, Mycobacterium tuberculosis
DAVDDEELLELVEM

SEQ ID NO: 134675 - protein, 14 aa, Mycobacterium tuberculosis
AVDDEELLELVEME

SEQ ID NO: 134676 - protein, 14 aa, Mycobacterium tuberculosis
VDDEELLELVEMEV

SEQ ID NO: 134677 - protein, 14 aa, Mycobacterium tuberculosis
DDEELLELVEMEVR

SEQ ID NO: 134678 - protein, 14 aa, Mycobacterium tuberculosis
DEELLELVEMEVRE

SEQ ID NO: 134679 - protein, 14 aa, Mycobacterium tuberculosis
EELLELVEMEVREL

SEQ ID NO: 134680 - protein, 14 aa, Mycobacterium tuberculosis
ELLELVEMEVRELL

SEQ ID NO: 134681 - protein, 14 aa, Mycobacterium tuberculosis
LLELVEMEVRELLA

SEQ ID NO: 134682 - protein, 14 aa, Mycobacterium tuberculosis
LELVEMEVRELLAA

SEQ ID NO: 134683 - protein, 14 aa, Mycobacterium tuberculosis
ELVEMEVRELLAAQ

SEQ ID NO: 134684 - protein, 14 aa, Mycobacterium tuberculosis
LVEMEVRELLAAQE

SEQ ID NO: 134685 - protein, 14 aa, Mycobacterium tuberculosis
VEMEVRELLAAQEF

SEQ ID NO: 134686 - protein, 14 aa, Mycobacterium tuberculosis
EMEVRELLAAQEFD

SEQ ID NO: 134687 - protein, 14 aa, Mycobacterium tuberculosis
MEVRELLAAQEFDE

SEQ ID NO: 134688 - protein, 14 aa, Mycobacterium tuberculosis
EVRELLAAQEFDED

SEQ ID NO: 134689 - protein, 14 aa, Mycobacterium tuberculosis
VRELLAAQEFDEDA

SEQ ID NO: 134690 - protein, 14 aa, Mycobacterium tuberculosis
RELLAAQEFDEDAP

SEQ ID NO: 134691 - protein, 14 aa, Mycobacterium tuberculosis
ELLAAQEFDEDAPV

SEQ ID NO: 134692 - protein, 14 aa, Mycobacterium tuberculosis
LLAAQEFDEDAPVV

SEQ ID NO: 134693 - protein, 14 aa, Mycobacterium tuberculosis
LAAQEFDEDAPVVR

SEQ ID NO: 134694 - protein, 14 aa, Mycobacterium tuberculosis
AAQEFDEDAPVVRV

SEQ ID NO: 134695 - protein, 14 aa, Mycobacterium tuberculosis
AQEFDEDAPVVRVS

SEQ ID NO: 134696 - protein, 14 aa, Mycobacterium tuberculosis
QEFDEDAPVVRVSA

SEQ ID NO: 134697 - protein, 14 aa, Mycobacterium tuberculosis
EFDEDAPVVRVSAL

SEQ ID NO: 134698 - protein, 14 aa, Mycobacterium tuberculosis
FDEDAPVVRVSALK

SEQ ID NO: 134699 - protein, 14 aa, Mycobacterium tuberculosis
DEDAPVVRVSALKA

SEQ ID NO: 134700 - protein, 14 aa, Mycobacterium tuberculosis
EDAPVVRVSALKAL

SEQ ID NO: 134701 - protein, 14 aa, Mycobacterium tuberculosis
DAPVVRVSALKALE

SEQ ID NO: 134702 - protein, 14 aa, Mycobacterium tuberculosis
APVVRVSALKALEG

SEQ ID NO: 134703 - protein, 14 aa, Mycobacterium tuberculosis
PVVRVSALKALEGD

SEQ ID NO: 134704 - protein, 14 aa, Mycobacterium tuberculosis
VVRVSALKALEGDA

SEQ ID NO: 134705 - protein, 14 aa, Mycobacterium tuberculosis
VRVSALKALEGDAK

SEQ ID NO: 134706 - protein, 14 aa, Mycobacterium tuberculosis
RVSALKALEGDAKW

SEQ ID NO: 134707 - protein, 14 aa, Mycobacterium tuberculosis
VSALKALEGDAKWV

SEQ ID NO: 134708 - protein, 14 aa, Mycobacterium tuberculosis
SALKALEGDAKWVA

SEQ ID NO: 134709 - protein, 14 aa, Mycobacterium tuberculosis
ALKALEGDAKWVAS

SEQ ID NO: 134710 - protein, 14 aa, Mycobacterium tuberculosis
LKALEGDAKWVASV

SEQ ID NO: 134711 - protein, 14 aa, Mycobacterium tuberculosis
KALEGDAKWVASVE

SEQ ID NO: 134712 - protein, 14 aa, Mycobacterium tuberculosis
ALEGDAKWVASVEE

SEQ ID NO: 134713 - protein, 14 aa, Mycobacterium tuberculosis
LEGDAKWVASVEEL

SEQ ID NO: 134714 - protein, 14 aa, Mycobacterium tuberculosis
EGDAKWVASVEELM

SEQ ID NO: 134715 - protein, 14 aa, Mycobacterium tuberculosis
GDAKWVASVEELMN

SEQ ID NO: 134716 - protein, 14 aa, Mycobacterium tuberculosis
DAKWVASVEELMNA

SEQ ID NO: 134717 - protein, 14 aa, Mycobacterium tuberculosis
AKWVASVEELMNAV

SEQ ID NO: 134718 - protein, 14 aa, Mycobacterium tuberculosis
KWVASVEELMNAVD

SEQ ID NO: 134719 - protein, 14 aa, Mycobacterium tuberculosis
WVASVEELMNAVDE

SEQ ID NO: 134720 - protein, 14 aa, Mycobacterium tuberculosis
VASVEELMNAVDES

SEQ ID NO: 134721 - protein, 14 aa, Mycobacterium tuberculosis
ASVEELMNAVDESI

SEQ ID NO: 134722 - protein, 14 aa, Mycobacterium tuberculosis
SVEELMNAVDESIP

SEQ ID NO: 134723 - protein, 14 aa, Mycobacterium tuberculosis
VEELMNAVDESIPD

SEQ ID NO: 134724 - protein, 14 aa, Mycobacterium tuberculosis
EELMNAVDESIPDP

SEQ ID NO: 134725 - protein, 14 aa, Mycobacterium tuberculosis
ELMNAVDESIPDPV

SEQ ID NO: 134726 - protein, 14 aa, Mycobacterium tuberculosis
LMNAVDESIPDPVR

SEQ ID NO: 134727 - protein, 14 aa, Mycobacterium tuberculosis
MNAVDESIPDPVRE

SEQ ID NO: 134728 - protein, 14 aa, Mycobacterium tuberculosis
NAVDESIPDPVRET

SEQ ID NO: 134729 - protein, 14 aa, Mycobacterium tuberculosis
AVDESIPDPVRETD

SEQ ID NO: 134730 - protein, 14 aa, Mycobacterium tuberculosis
VDESIPDPVRETDK

SEQ ID NO: 134731 - protein, 14 aa, Mycobacterium tuberculosis
DESIPDPVRETDKP

SEQ ID NO: 134732 - protein, 14 aa, Mycobacterium tuberculosis
ESIPDPVRETDKPF

SEQ ID NO: 134733 - protein, 14 aa, Mycobacterium tuberculosis
SIPDPVRETDKPFL

SEQ ID NO: 134734 - protein, 14 aa, Mycobacterium tuberculosis
IPDPVRETDKPFLM

SEQ ID NO: 134735 - protein, 14 aa, Mycobacterium tuberculosis
PDPVRETDKPFLMP

SEQ ID NO: 134736 - protein, 14 aa, Mycobacterium tuberculosis
DPVRETDKPFLMPV

SEQ ID NO: 134737 - protein, 14 aa, Mycobacterium tuberculosis
PVRETDKPFLMPVE

SEQ ID NO: 134738 - protein, 14 aa, Mycobacterium tuberculosis
VRETDKPFLMPVED

SEQ ID NO: 134739 - protein, 14 aa, Mycobacterium tuberculosis
RETDKPFLMPVEDV

SEQ ID NO: 134740 - protein, 14 aa, Mycobacterium tuberculosis
ETDKPFLMPVEDVF

SEQ ID NO: 134741 - protein, 14 aa, Mycobacterium tuberculosis
TDKPFLMPVEDVFT

SEQ ID NO: 134742 - protein, 14 aa, Mycobacterium tuberculosis
DKPFLMPVEDVFTI

SEQ ID NO: 134743 - protein, 14 aa, Mycobacterium tuberculosis
KPFLMPVEDVFTIT

SEQ ID NO: 134744 - protein, 14 aa, Mycobacterium tuberculosis
PFLMPVEDVFTITG

SEQ ID NO: 134745 - protein, 14 aa, Mycobacterium tuberculosis
FLMPVEDVFTITGR

SEQ ID NO: 134746 - protein, 14 aa, Mycobacterium tuberculosis
LMPVEDVFTITGRG

SEQ ID NO: 134747 - protein, 14 aa, Mycobacterium tuberculosis
MPVEDVFTITGRGT

SEQ ID NO: 134748 - protein, 14 aa, Mycobacterium tuberculosis
PVEDVFTITGRGTV

SEQ ID NO: 134749 - protein, 14 aa, Mycobacterium tuberculosis
VEDVFTITGRGTVV

SEQ ID NO: 134750 - protein, 14 aa, Mycobacterium tuberculosis
EDVFTITGRGTVVT

SEQ ID NO: 134751 - protein, 14 aa, Mycobacterium tuberculosis
DVFTITGRGTVVTG

SEQ ID NO: 134752 - protein, 14 aa, Mycobacterium tuberculosis
VFTITGRGTVVTGR

SEQ ID NO: 134753 - protein, 14 aa, Mycobacterium tuberculosis
FTITGRGTVVTGRV

SEQ ID NO: 134754 - protein, 14 aa, Mycobacterium tuberculosis
TITGRGTVVTGRVE

SEQ ID NO: 134755 - protein, 14 aa, Mycobacterium tuberculosis
ITGRGTVVTGRVER

SEQ ID NO: 134756 - protein, 14 aa, Mycobacterium tuberculosis
TGRGTVVTGRVERG

SEQ ID NO: 134757 - protein, 14 aa, Mycobacterium tuberculosis
GRGTVVTGRVERGV

SEQ ID NO: 134758 - protein, 14 aa, Mycobacterium tuberculosis
RGTVVTGRVERGVI

SEQ ID NO: 134759 - protein, 14 aa, Mycobacterium tuberculosis
GTVVTGRVERGVIN

SEQ ID NO: 134760 - protein, 14 aa, Mycobacterium tuberculosis
TVVTGRVERGVINV

SEQ ID NO: 134761 - protein, 14 aa, Mycobacterium tuberculosis
VVTGRVERGVINVN

SEQ ID NO: 134762 - protein, 14 aa, Mycobacterium tuberculosis
VTGRVERGVINVNE

SEQ ID NO: 134763 - protein, 14 aa, Mycobacterium tuberculosis
TGRVERGVINVNEE

SEQ ID NO: 134764 - protein, 14 aa, Mycobacterium tuberculosis
GRVERGVINVNEEV

SEQ ID NO: 134765 - protein, 14 aa, Mycobacterium tuberculosis
RVERGVINVNEEVE

SEQ ID NO: 134766 - protein, 14 aa, Mycobacterium tuberculosis
VERGVINVNEEVEI

SEQ ID NO: 134767 - protein, 14 aa, Mycobacterium tuberculosis
ERGVINVNEEVEIV

SEQ ID NO: 134768 - protein, 14 aa, Mycobacterium tuberculosis
RGVINVNEEVEIVG

SEQ ID NO: 134769 - protein, 14 aa, Mycobacterium tuberculosis
GVINVNEEVEIVGI

SEQ ID NO: 134770 - protein, 14 aa, Mycobacterium tuberculosis
VINVNEEVEIVGIR

SEQ ID NO: 134771 - protein, 14 aa, Mycobacterium tuberculosis
INVNEEVEIVGIRP

SEQ ID NO: 134772 - protein, 14 aa, Mycobacterium tuberculosis
NVNEEVEIVGIRPS

SEQ ID NO: 134773 - protein, 14 aa, Mycobacterium tuberculosis
VNEEVEIVGIRPST

SEQ ID NO: 134774 - protein, 14 aa, Mycobacterium tuberculosis
NEEVEIVGIRPSTT

SEQ ID NO: 134775 - protein, 14 aa, Mycobacterium tuberculosis
EEVEIVGIRPSTTK

SEQ ID NO: 134776 - protein, 14 aa, Mycobacterium tuberculosis
EVEIVGIRPSTTKT

SEQ ID NO: 134777 - protein, 14 aa, Mycobacterium tuberculosis
VEIVGIRPSTTKTT

SEQ ID NO: 134778 - protein, 14 aa, Mycobacterium tuberculosis
EIVGIRPSTTKTTV

SEQ ID NO: 134779 - protein, 14 aa, Mycobacterium tuberculosis
IVGIRPSTTKTTVT

SEQ ID NO: 134780 - protein, 14 aa, Mycobacterium tuberculosis
VGIRPSTTKTTVTG

SEQ ID NO: 134781 - protein, 14 aa, Mycobacterium tuberculosis
GIRPSTTKTTVTGV

SEQ ID NO: 134782 - protein, 14 aa, Mycobacterium tuberculosis
IRPSTTKTTVTGVE

SEQ ID NO: 134783 - protein, 14 aa, Mycobacterium tuberculosis
RPSTTKTTVTGVEM

SEQ ID NO: 134784 - protein, 14 aa, Mycobacterium tuberculosis
PSTTKTTVTGVEMF

SEQ ID NO: 134785 - protein, 14 aa, Mycobacterium tuberculosis
STTKTTVTGVEMFR

SEQ ID NO: 134786 - protein, 14 aa, Mycobacterium tuberculosis
TTKTTVTGVEMFRK

SEQ ID NO: 134787 - protein, 14 aa, Mycobacterium tuberculosis
TKTTVTGVEMFRKL

SEQ ID NO: 134788 - protein, 14 aa, Mycobacterium tuberculosis
KTTVTGVEMFRKLL

SEQ ID NO: 134789 - protein, 14 aa, Mycobacterium tuberculosis
TTVTGVEMFRKLLD

SEQ ID NO: 134790 - protein, 14 aa, Mycobacterium tuberculosis
TVTGVEMFRKLLDQ

SEQ ID NO: 134791 - protein, 14 aa, Mycobacterium tuberculosis
VTGVEMFRKLLDQG

SEQ ID NO: 134792 - protein, 14 aa, Mycobacterium tuberculosis
TGVEMFRKLLDQGQ

SEQ ID NO: 134793 - protein, 14 aa, Mycobacterium tuberculosis
GVEMFRKLLDQGQA

SEQ ID NO: 134794 - protein, 14 aa, Mycobacterium tuberculosis
VEMFRKLLDQGQAG

SEQ ID NO: 134795 - protein, 14 aa, Mycobacterium tuberculosis
EMFRKLLDQGQAGD

SEQ ID NO: 134796 - protein, 14 aa, Mycobacterium tuberculosis
MFRKLLDQGQAGDN

SEQ ID NO: 134797 - protein, 14 aa, Mycobacterium tuberculosis
FRKLLDQGQAGDNV

SEQ ID NO: 134798 - protein, 14 aa, Mycobacterium tuberculosis
RKLLDQGQAGDNVG

SEQ ID NO: 134799 - protein, 14 aa, Mycobacterium tuberculosis
KLLDQGQAGDNVGL

SEQ ID NO: 134800 - protein, 14 aa, Mycobacterium tuberculosis
LLDQGQAGDNVGLL

SEQ ID NO: 134801 - protein, 14 aa, Mycobacterium tuberculosis
LDQGQAGDNVGLLL

SEQ ID NO: 134802 - protein, 14 aa, Mycobacterium tuberculosis
DQGQAGDNVGLLLR

SEQ ID NO: 134803 - protein, 14 aa, Mycobacterium tuberculosis
QGQAGDNVGLLLRG

SEQ ID NO: 134804 - protein, 14 aa, Mycobacterium tuberculosis
GQAGDNVGLLLRGV

SEQ ID NO: 134805 - protein, 14 aa, Mycobacterium tuberculosis
QAGDNVGLLLRGVK

SEQ ID NO: 134806 - protein, 14 aa, Mycobacterium tuberculosis
AGDNVGLLLRGVKR

SEQ ID NO: 134807 - protein, 14 aa, Mycobacterium tuberculosis
GDNVGLLLRGVKRE

SEQ ID NO: 134808 - protein, 14 aa, Mycobacterium tuberculosis
DNVGLLLRGVKRED

SEQ ID NO: 134809 - protein, 14 aa, Mycobacterium tuberculosis
NVGLLLRGVKREDV

SEQ ID NO: 134810 - protein, 14 aa, Mycobacterium tuberculosis
VGLLLRGVKREDVE

SEQ ID NO: 134811 - protein, 14 aa, Mycobacterium tuberculosis
GLLLRGVKREDVER

SEQ ID NO: 134812 - protein, 14 aa, Mycobacterium tuberculosis
LLLRGVKREDVERG

SEQ ID NO: 134813 - protein, 14 aa, Mycobacterium tuberculosis
LLRGVKREDVERGQ

SEQ ID NO: 134814 - protein, 14 aa, Mycobacterium tuberculosis
LRGVKREDVERGQV

SEQ ID NO: 134815 - protein, 14 aa, Mycobacterium tuberculosis
RGVKREDVERGQVV

SEQ ID NO: 134816 - protein, 14 aa, Mycobacterium tuberculosis
GVKREDVERGQVVT

SEQ ID NO: 134817 - protein, 14 aa, Mycobacterium tuberculosis
VKREDVERGQVVTK

SEQ ID NO: 134818 - protein, 14 aa, Mycobacterium tuberculosis
KREDVERGQVVTKP

SEQ ID NO: 134819 - protein, 14 aa, Mycobacterium tuberculosis
REDVERGQVVTKPG

SEQ ID NO: 134820 - protein, 14 aa, Mycobacterium tuberculosis
EDVERGQVVTKPGT

SEQ ID NO: 134821 - protein, 14 aa, Mycobacterium tuberculosis
DVERGQVVTKPGTT

SEQ ID NO: 134822 - protein, 14 aa, Mycobacterium tuberculosis
VERGQVVTKPGTTT

SEQ ID NO: 134823 - protein, 14 aa, Mycobacterium tuberculosis
ERGQVVTKPGTTTP

SEQ ID NO: 134824 - protein, 14 aa, Mycobacterium tuberculosis
RGQVVTKPGTTTPH

SEQ ID NO: 134825 - protein, 14 aa, Mycobacterium tuberculosis
GQVVTKPGTTTPHT

SEQ ID NO: 134826 - protein, 14 aa, Mycobacterium tuberculosis
QVVTKPGTTTPHTE

SEQ ID NO: 134827 - protein, 14 aa, Mycobacterium tuberculosis
VVTKPGTTTPHTEF

SEQ ID NO: 134828 - protein, 14 aa, Mycobacterium tuberculosis
VTKPGTTTPHTEFE

SEQ ID NO: 134829 - protein, 14 aa, Mycobacterium tuberculosis
TKPGTTTPHTEFEG

SEQ ID NO: 134830 - protein, 14 aa, Mycobacterium tuberculosis
KPGTTTPHTEFEGQ

SEQ ID NO: 134831 - protein, 14 aa, Mycobacterium tuberculosis
PGTTTPHTEFEGQV

SEQ ID NO: 134832 - protein, 14 aa, Mycobacterium tuberculosis
GTTTPHTEFEGQVY

SEQ ID NO: 134833 - protein, 14 aa, Mycobacterium tuberculosis
TTTPHTEFEGQVYI

SEQ ID NO: 134834 - protein, 14 aa, Mycobacterium tuberculosis
TTPHTEFEGQVYIL

SEQ ID NO: 134835 - protein, 14 aa, Mycobacterium tuberculosis
TPHTEFEGQVYILS

SEQ ID NO: 134836 - protein, 14 aa, Mycobacterium tuberculosis
PHTEFEGQVYILSK

SEQ ID NO: 134837 - protein, 14 aa, Mycobacterium tuberculosis
HTEFEGQVYILSKD

SEQ ID NO: 134838 - protein, 14 aa, Mycobacterium tuberculosis
TEFEGQVYILSKDE

SEQ ID NO: 134839 - protein, 14 aa, Mycobacterium tuberculosis
EFEGQVYILSKDEG

SEQ ID NO: 134840 - protein, 14 aa, Mycobacterium tuberculosis
FEGQVYILSKDEGG

SEQ ID NO: 134841 - protein, 14 aa, Mycobacterium tuberculosis
EGQVYILSKDEGGR

SEQ ID NO: 134842 - protein, 14 aa, Mycobacterium tuberculosis
GQVYILSKDEGGRH

SEQ ID NO: 134843 - protein, 14 aa, Mycobacterium tuberculosis
QVYILSKDEGGRHT

SEQ ID NO: 134844 - protein, 14 aa, Mycobacterium tuberculosis
VYILSKDEGGRHTP

SEQ ID NO: 134845 - protein, 14 aa, Mycobacterium tuberculosis
YILSKDEGGRHTPF

SEQ ID NO: 134846 - protein, 14 aa, Mycobacterium tuberculosis
ILSKDEGGRHTPFF

SEQ ID NO: 134847 - protein, 14 aa, Mycobacterium tuberculosis
LSKDEGGRHTPFFN

SEQ ID NO: 134848 - protein, 14 aa, Mycobacterium tuberculosis
SKDEGGRHTPFFNN

SEQ ID NO: 134849 - protein, 14 aa, Mycobacterium tuberculosis
KDEGGRHTPFFNNY

SEQ ID NO: 134850 - protein, 14 aa, Mycobacterium tuberculosis
DEGGRHTPFFNNYR

SEQ ID NO: 134851 - protein, 14 aa, Mycobacterium tuberculosis
EGGRHTPFFNNYRP

SEQ ID NO: 134852 - protein, 14 aa, Mycobacterium tuberculosis
GGRHTPFFNNYRPQ

SEQ ID NO: 134853 - protein, 14 aa, Mycobacterium tuberculosis
GRHTPFFNNYRPQF

SEQ ID NO: 134854 - protein, 14 aa, Mycobacterium tuberculosis
RHTPFFNNYRPQFY

SEQ ID NO: 134855 - protein, 14 aa, Mycobacterium tuberculosis
HTPFFNNYRPQFYF

SEQ ID NO: 134856 - protein, 14 aa, Mycobacterium tuberculosis
TPFFNNYRPQFYFR

SEQ ID NO: 134857 - protein, 14 aa, Mycobacterium tuberculosis
PFFNNYRPQFYFRT

SEQ ID NO: 134858 - protein, 14 aa, Mycobacterium tuberculosis
FFNNYRPQFYFRTT

SEQ ID NO: 134859 - protein, 14 aa, Mycobacterium tuberculosis
FNNYRPQFYFRTTD

SEQ ID NO: 134860 - protein, 14 aa, Mycobacterium tuberculosis
NNYRPQFYFRTTDV

SEQ ID NO: 134861 - protein, 14 aa, Mycobacterium tuberculosis
NYRPQFYFRTTDVT

SEQ ID NO: 134862 - protein, 14 aa, Mycobacterium tuberculosis
YRPQFYFRTTDVTG

SEQ ID NO: 134863 - protein, 14 aa, Mycobacterium tuberculosis
RPQFYFRTTDVTGV

SEQ ID NO: 134864 - protein, 14 aa, Mycobacterium tuberculosis
PQFYFRTTDVTGVV

SEQ ID NO: 134865 - protein, 14 aa, Mycobacterium tuberculosis
QFYFRTTDVTGVVT

SEQ ID NO: 134866 - protein, 14 aa, Mycobacterium tuberculosis
FYFRTTDVTGVVTL

SEQ ID NO: 134867 - protein, 14 aa, Mycobacterium tuberculosis
YFRTTDVTGVVTLP

SEQ ID NO: 134868 - protein, 14 aa, Mycobacterium tuberculosis
FRTTDVTGVVTLPE

SEQ ID NO: 134869 - protein, 14 aa, Mycobacterium tuberculosis
RTTDVTGVVTLPEG

SEQ ID NO: 134870 - protein, 14 aa, Mycobacterium tuberculosis
TTDVTGVVTLPEGT

SEQ ID NO: 134871 - protein, 14 aa, Mycobacterium tuberculosis
TDVTGVVTLPEGTE

SEQ ID NO: 134872 - protein, 14 aa, Mycobacterium tuberculosis
DVTGVVTLPEGTEM

SEQ ID NO: 134873 - protein, 14 aa, Mycobacterium tuberculosis
VTGVVTLPEGTEMV

SEQ ID NO: 134874 - protein, 14 aa, Mycobacterium tuberculosis
TGVVTLPEGTEMVM

SEQ ID NO: 134875 - protein, 14 aa, Mycobacterium tuberculosis
GVVTLPEGTEMVMP

SEQ ID NO: 134876 - protein, 14 aa, Mycobacterium tuberculosis
VVTLPEGTEMVMPG

SEQ ID NO: 134877 - protein, 14 aa, Mycobacterium tuberculosis
VTLPEGTEMVMPGD

SEQ ID NO: 134878 - protein, 14 aa, Mycobacterium tuberculosis
TLPEGTEMVMPGDN

SEQ ID NO: 134879 - protein, 14 aa, Mycobacterium tuberculosis
LPEGTEMVMPGDNT

SEQ ID NO: 134880 - protein, 14 aa, Mycobacterium tuberculosis
PEGTEMVMPGDNTN

SEQ ID NO: 134881 - protein, 14 aa, Mycobacterium tuberculosis
EGTEMVMPGDNTNI

SEQ ID NO: 134882 - protein, 14 aa, Mycobacterium tuberculosis
GTEMVMPGDNTNIS

SEQ ID NO: 134883 - protein, 14 aa, Mycobacterium tuberculosis
TEMVMPGDNTNISV

SEQ ID NO: 134884 - protein, 14 aa, Mycobacterium tuberculosis
EMVMPGDNTNISVK

SEQ ID NO: 134885 - protein, 14 aa, Mycobacterium tuberculosis
MVMPGDNTNISVKL

SEQ ID NO: 134886 - protein, 14 aa, Mycobacterium tuberculosis
VMPGDNTNISVKLI

SEQ ID NO: 134887 - protein, 14 aa, Mycobacterium tuberculosis
MPGDNTNISVKLIQ

SEQ ID NO: 134888 - protein, 14 aa, Mycobacterium tuberculosis
PGDNTNISVKLIQP

SEQ ID NO: 134889 - protein, 14 aa, Mycobacterium tuberculosis
GDNTNISVKLIQPV

SEQ ID NO: 134890 - protein, 14 aa, Mycobacterium tuberculosis
DNTNISVKLIQPVA

SEQ ID NO: 134891 - protein, 14 aa, Mycobacterium tuberculosis
NTNISVKLIQPVAM

SEQ ID NO: 134892 - protein, 14 aa, Mycobacterium tuberculosis
TNISVKLIQPVAMD

SEQ ID NO: 134893 - protein, 14 aa, Mycobacterium tuberculosis
NISVKLIQPVAMDE

SEQ ID NO: 134894 - protein, 14 aa, Mycobacterium tuberculosis
ISVKLIQPVAMDEG

SEQ ID NO: 134895 - protein, 14 aa, Mycobacterium tuberculosis
SVKLIQPVAMDEGL

SEQ ID NO: 134896 - protein, 14 aa, Mycobacterium tuberculosis
VKLIQPVAMDEGLR

SEQ ID NO: 134897 - protein, 14 aa, Mycobacterium tuberculosis
KLIQPVAMDEGLRF

SEQ ID NO: 134898 - protein, 14 aa, Mycobacterium tuberculosis
LIQPVAMDEGLRFA

SEQ ID NO: 134899 - protein, 14 aa, Mycobacterium tuberculosis
IQPVAMDEGLRFAI

SEQ ID NO: 134900 - protein, 14 aa, Mycobacterium tuberculosis
QPVAMDEGLRFAIR

SEQ ID NO: 134901 - protein, 14 aa, Mycobacterium tuberculosis
PVAMDEGLRFAIRE

SEQ ID NO: 134902 - protein, 14 aa, Mycobacterium tuberculosis
VAMDEGLRFAIREG

SEQ ID NO: 134903 - protein, 14 aa, Mycobacterium tuberculosis
AMDEGLRFAIREGG

SEQ ID NO: 134904 - protein, 14 aa, Mycobacterium tuberculosis
MDEGLRFAIREGGR

SEQ ID NO: 134905 - protein, 14 aa, Mycobacterium tuberculosis
DEGLRFAIREGGRT

SEQ ID NO: 134906 - protein, 14 aa, Mycobacterium tuberculosis
EGLRFAIREGGRTV

SEQ ID NO: 134907 - protein, 14 aa, Mycobacterium tuberculosis
GLRFAIREGGRTVG

SEQ ID NO: 134908 - protein, 14 aa, Mycobacterium tuberculosis
LRFAIREGGRTVGA

SEQ ID NO: 134909 - protein, 14 aa, Mycobacterium tuberculosis
RFAIREGGRTVGAG

SEQ ID NO: 134910 - protein, 14 aa, Mycobacterium tuberculosis
FAIREGGRTVGAGR

SEQ ID NO: 134911 - protein, 14 aa, Mycobacterium tuberculosis
AIREGGRTVGAGRV

SEQ ID NO: 134912 - protein, 14 aa, Mycobacterium tuberculosis
IREGGRTVGAGRVT

SEQ ID NO: 134913 - protein, 14 aa, Mycobacterium tuberculosis
REGGRTVGAGRVTK

SEQ ID NO: 134914 - protein, 14 aa, Mycobacterium tuberculosis
EGGRTVGAGRVTKI

SEQ ID NO: 134915 - protein, 14 aa, Mycobacterium tuberculosis
GGRTVGAGRVTKII

SEQ ID NO: 134916 - protein, 14 aa, Mycobacterium tuberculosis
GRTVGAGRVTKIIK

SEQ ID NO: 134917 - protein, 15 aa, Mycobacterium tuberculosis
MAKAKFQRTKPHVNI

SEQ ID NO: 134918 - protein, 15 aa, Mycobacterium tuberculosis
AKAKFQRTKPHVNIG

SEQ ID NO: 134919 - protein, 15 aa, Mycobacterium tuberculosis
KAKFQRTKPHVNIGT

SEQ ID NO: 134920 - protein, 15 aa, Mycobacterium tuberculosis
AKFQRTKPHVNIGTI

SEQ ID NO: 134921 - protein, 15 aa, Mycobacterium tuberculosis
KFQRTKPHVNIGTIG

SEQ ID NO: 134922 - protein, 15 aa, Mycobacterium tuberculosis
FQRTKPHVNIGTIGH

SEQ ID NO: 134923 - protein, 15 aa, Mycobacterium tuberculosis
QRTKPHVNIGTIGHV

SEQ ID NO: 134924 - protein, 15 aa, Mycobacterium tuberculosis
RTKPHVNIGTIGHVD

SEQ ID NO: 134925 - protein, 15 aa, Mycobacterium tuberculosis
TKPHVNIGTIGHVDH

SEQ ID NO: 134926 - protein, 15 aa, Mycobacterium tuberculosis
KPHVNIGTIGHVDHG

SEQ ID NO: 134927 - protein, 15 aa, Mycobacterium tuberculosis
PHVNIGTIGHVDHGK

SEQ ID NO: 134928 - protein, 15 aa, Mycobacterium tuberculosis
HVNIGTIGHVDHGKT

SEQ ID NO: 134929 - protein, 15 aa, Mycobacterium tuberculosis
VNIGTIGHVDHGKTT

SEQ ID NO: 134930 - protein, 15 aa, Mycobacterium tuberculosis
NIGTIGHVDHGKTTL

SEQ ID NO: 134931 - protein, 15 aa, Mycobacterium tuberculosis
IGTIGHVDHGKTTLT

SEQ ID NO: 134932 - protein, 15 aa, Mycobacterium tuberculosis
GTIGHVDHGKTTLTA

SEQ ID NO: 134933 - protein, 15 aa, Mycobacterium tuberculosis
TIGHVDHGKTTLTAA

SEQ ID NO: 134934 - protein, 15 aa, Mycobacterium tuberculosis
IGHVDHGKTTLTAAI

SEQ ID NO: 134935 - protein, 15 aa, Mycobacterium tuberculosis
GHVDHGKTTLTAAIT

SEQ ID NO: 134936 - protein, 15 aa, Mycobacterium tuberculosis
HVDHGKTTLTAAITK

SEQ ID NO: 134937 - protein, 15 aa, Mycobacterium tuberculosis
VDHGKTTLTAAITKV

SEQ ID NO: 134938 - protein, 15 aa, Mycobacterium tuberculosis
DHGKTTLTAAITKVL

SEQ ID NO: 134939 - protein, 15 aa, Mycobacterium tuberculosis
HGKTTLTAAITKVLH

SEQ ID NO: 134940 - protein, 15 aa, Mycobacterium tuberculosis
GKTTLTAAITKVLHD

SEQ ID NO: 134941 - protein, 15 aa, Mycobacterium tuberculosis
KTTLTAAITKVLHDK

SEQ ID NO: 134942 - protein, 15 aa, Mycobacterium tuberculosis
TTLTAAITKVLHDKF

SEQ ID NO: 134943 - protein, 15 aa, Mycobacterium tuberculosis
TLTAAITKVLHDKFP

SEQ ID NO: 134944 - protein, 15 aa, Mycobacterium tuberculosis
LTAAITKVLHDKFPD

SEQ ID NO: 134945 - protein, 15 aa, Mycobacterium tuberculosis
TAAITKVLHDKFPDL

SEQ ID NO: 134946 - protein, 15 aa, Mycobacterium tuberculosis
AAITKVLHDKFPDLN

SEQ ID NO: 134947 - protein, 15 aa, Mycobacterium tuberculosis
AITKVLHDKFPDLNE

SEQ ID NO: 134948 - protein, 15 aa, Mycobacterium tuberculosis
ITKVLHDKFPDLNET

SEQ ID NO: 134949 - protein, 15 aa, Mycobacterium tuberculosis
TKVLHDKFPDLNETK

SEQ ID NO: 134950 - protein, 15 aa, Mycobacterium tuberculosis
KVLHDKFPDLNETKA

SEQ ID NO: 134951 - protein, 15 aa, Mycobacterium tuberculosis
VLHDKFPDLNETKAF

SEQ ID NO: 134952 - protein, 15 aa, Mycobacterium tuberculosis
LHDKFPDLNETKAFD

SEQ ID NO: 134953 - protein, 15 aa, Mycobacterium tuberculosis
HDKFPDLNETKAFDQ

SEQ ID NO: 134954 - protein, 15 aa, Mycobacterium tuberculosis
DKFPDLNETKAFDQI

SEQ ID NO: 134955 - protein, 15 aa, Mycobacterium tuberculosis
KFPDLNETKAFDQID

SEQ ID NO: 134956 - protein, 15 aa, Mycobacterium tuberculosis
FPDLNETKAFDQIDN

SEQ ID NO: 134957 - protein, 15 aa, Mycobacterium tuberculosis
PDLNETKAFDQIDNA

SEQ ID NO: 134958 - protein, 15 aa, Mycobacterium tuberculosis
DLNETKAFDQIDNAP

SEQ ID NO: 134959 - protein, 15 aa, Mycobacterium tuberculosis
LNETKAFDQIDNAPE

SEQ ID NO: 134960 - protein, 15 aa, Mycobacterium tuberculosis
NETKAFDQIDNAPEE

SEQ ID NO: 134961 - protein, 15 aa, Mycobacterium tuberculosis
ETKAFDQIDNAPEER

SEQ ID NO: 134962 - protein, 15 aa, Mycobacterium tuberculosis
TKAFDQIDNAPEERQ

SEQ ID NO: 134963 - protein, 15 aa, Mycobacterium tuberculosis
KAFDQIDNAPEERQR

SEQ ID NO: 134964 - protein, 15 aa, Mycobacterium tuberculosis
AFDQIDNAPEERQRG

SEQ ID NO: 134965 - protein, 15 aa, Mycobacterium tuberculosis
FDQIDNAPEERQRGI

SEQ ID NO: 134966 - protein, 15 aa, Mycobacterium tuberculosis
DQIDNAPEERQRGIT

SEQ ID NO: 134967 - protein, 15 aa, Mycobacterium tuberculosis
QIDNAPEERQRGITI

SEQ ID NO: 134968 - protein, 15 aa, Mycobacterium tuberculosis
IDNAPEERQRGITIN

SEQ ID NO: 134969 - protein, 15 aa, Mycobacterium tuberculosis
DNAPEERQRGITINI

SEQ ID NO: 134970 - protein, 15 aa, Mycobacterium tuberculosis
NAPEERQRGITINIA

SEQ ID NO: 134971 - protein, 15 aa, Mycobacterium tuberculosis
APEERQRGITINIAH

SEQ ID NO: 134972 - protein, 15 aa, Mycobacterium tuberculosis
PEERQRGITINIAHV

SEQ ID NO: 134973 - protein, 15 aa, Mycobacterium tuberculosis
EERQRGITINIAHVE

SEQ ID NO: 134974 - protein, 15 aa, Mycobacterium tuberculosis
ERQRGITINIAHVEY

SEQ ID NO: 134975 - protein, 15 aa, Mycobacterium tuberculosis
RQRGITINIAHVEYQ

SEQ ID NO: 134976 - protein, 15 aa, Mycobacterium tuberculosis
QRGITINIAHVEYQT

SEQ ID NO: 134977 - protein, 15 aa, Mycobacterium tuberculosis
RGITINIAHVEYQTD

SEQ ID NO: 134978 - protein, 15 aa, Mycobacterium tuberculosis
GITINIAHVEYQTDK

SEQ ID NO: 134979 - protein, 15 aa, Mycobacterium tuberculosis
ITINIAHVEYQTDKR

SEQ ID NO: 134980 - protein, 15 aa, Mycobacterium tuberculosis
TINIAHVEYQTDKRH

SEQ ID NO: 134981 - protein, 15 aa, Mycobacterium tuberculosis
INIAHVEYQTDKRHY

SEQ ID NO: 134982 - protein, 15 aa, Mycobacterium tuberculosis
NIAHVEYQTDKRHYA

SEQ ID NO: 134983 - protein, 15 aa, Mycobacterium tuberculosis
IAHVEYQTDKRHYAH

SEQ ID NO: 134984 - protein, 15 aa, Mycobacterium tuberculosis
AHVEYQTDKRHYAHV

SEQ ID NO: 134985 - protein, 15 aa, Mycobacterium tuberculosis
HVEYQTDKRHYAHVD

SEQ ID NO: 134986 - protein, 15 aa, Mycobacterium tuberculosis
VEYQTDKRHYAHVDA

SEQ ID NO: 134987 - protein, 15 aa, Mycobacterium tuberculosis
EYQTDKRHYAHVDAP

SEQ ID NO: 134988 - protein, 15 aa, Mycobacterium tuberculosis
YQTDKRHYAHVDAPG

SEQ ID NO: 134989 - protein, 15 aa, Mycobacterium tuberculosis
QTDKRHYAHVDAPGH

SEQ ID NO: 134990 - protein, 15 aa, Mycobacterium tuberculosis
TDKRHYAHVDAPGHA

SEQ ID NO: 134991 - protein, 15 aa, Mycobacterium tuberculosis
DKRHYAHVDAPGHAD

SEQ ID NO: 134992 - protein, 15 aa, Mycobacterium tuberculosis
KRHYAHVDAPGHADY

SEQ ID NO: 134993 - protein, 15 aa, Mycobacterium tuberculosis
RHYAHVDAPGHADYI

SEQ ID NO: 134994 - protein, 15 aa, Mycobacterium tuberculosis
HYAHVDAPGHADYIK

SEQ ID NO: 134995 - protein, 15 aa, Mycobacterium tuberculosis
YAHVDAPGHADYIKN

SEQ ID NO: 134996 - protein, 15 aa, Mycobacterium tuberculosis
AHVDAPGHADYIKNM

SEQ ID NO: 134997 - protein, 15 aa, Mycobacterium tuberculosis
HVDAPGHADYIKNMI

SEQ ID NO: 134998 - protein, 15 aa, Mycobacterium tuberculosis
VDAPGHADYIKNMIT

SEQ ID NO: 134999 - protein, 15 aa, Mycobacterium tuberculosis
DAPGHADYIKNMITG

SEQ ID NO: 135000 - protein, 15 aa, Mycobacterium tuberculosis
APGHADYIKNMITGA

SEQ ID NO: 135001 - protein, 15 aa, Mycobacterium tuberculosis
PGHADYIKNMITGAA

SEQ ID NO: 135002 - protein, 15 aa, Mycobacterium tuberculosis
GHADYIKNMITGAAQ

SEQ ID NO: 135003 - protein, 15 aa, Mycobacterium tuberculosis
HADYIKNMITGAAQM

SEQ ID NO: 135004 - protein, 15 aa, Mycobacterium tuberculosis
ADYIKNMITGAAQMD

SEQ ID NO: 135005 - protein, 15 aa, Mycobacterium tuberculosis
DYIKNMITGAAQMDG

SEQ ID NO: 135006 - protein, 15 aa, Mycobacterium tuberculosis
YIKNMITGAAQMDGA

SEQ ID NO: 135007 - protein, 15 aa, Mycobacterium tuberculosis
IKNMITGAAQMDGAI

SEQ ID NO: 135008 - protein, 15 aa, Mycobacterium tuberculosis
KNMITGAAQMDGAIL

SEQ ID NO: 135009 - protein, 15 aa, Mycobacterium tuberculosis
NMITGAAQMDGAILV

SEQ ID NO: 135010 - protein, 15 aa, Mycobacterium tuberculosis
MITGAAQMDGAILVV

SEQ ID NO: 135011 - protein, 15 aa, Mycobacterium tuberculosis
ITGAAQMDGAILVVA

SEQ ID NO: 135012 - protein, 15 aa, Mycobacterium tuberculosis
TGAAQMDGAILVVAA

SEQ ID NO: 135013 - protein, 15 aa, Mycobacterium tuberculosis
GAAQMDGAILVVAAT

SEQ ID NO: 135014 - protein, 15 aa, Mycobacterium tuberculosis
AAQMDGAILVVAATD

SEQ ID NO: 135015 - protein, 15 aa, Mycobacterium tuberculosis
AQMDGAILVVAATDG

SEQ ID NO: 135016 - protein, 15 aa, Mycobacterium tuberculosis
QMDGAILVVAATDGP

SEQ ID NO: 135017 - protein, 15 aa, Mycobacterium tuberculosis
MDGAILVVAATDGPM

SEQ ID NO: 135018 - protein, 15 aa, Mycobacterium tuberculosis
DGAILVVAATDGPMP

SEQ ID NO: 135019 - protein, 15 aa, Mycobacterium tuberculosis
GAILVVAATDGPMPQ

SEQ ID NO: 135020 - protein, 15 aa, Mycobacterium tuberculosis
AILVVAATDGPMPQT

SEQ ID NO: 135021 - protein, 15 aa, Mycobacterium tuberculosis
ILVVAATDGPMPQTR

SEQ ID NO: 135022 - protein, 15 aa, Mycobacterium tuberculosis
LVVAATDGPMPQTRE

SEQ ID NO: 135023 - protein, 15 aa, Mycobacterium tuberculosis
VVAATDGPMPQTREH

SEQ ID NO: 135024 - protein, 15 aa, Mycobacterium tuberculosis
VAATDGPMPQTREHV

SEQ ID NO: 135025 - protein, 15 aa, Mycobacterium tuberculosis
AATDGPMPQTREHVL

SEQ ID NO: 135026 - protein, 15 aa, Mycobacterium tuberculosis
ATDGPMPQTREHVLL

SEQ ID NO: 135027 - protein, 15 aa, Mycobacterium tuberculosis
TDGPMPQTREHVLLA

SEQ ID NO: 135028 - protein, 15 aa, Mycobacterium tuberculosis
DGPMPQTREHVLLAR

SEQ ID NO: 135029 - protein, 15 aa, Mycobacterium tuberculosis
GPMPQTREHVLLARQ

SEQ ID NO: 135030 - protein, 15 aa, Mycobacterium tuberculosis
PMPQTREHVLLARQV

SEQ ID NO: 135031 - protein, 15 aa, Mycobacterium tuberculosis
MPQTREHVLLARQVG

SEQ ID NO: 135032 - protein, 15 aa, Mycobacterium tuberculosis
PQTREHVLLARQVGV

SEQ ID NO: 135033 - protein, 15 aa, Mycobacterium tuberculosis
QTREHVLLARQVGVP

SEQ ID NO: 135034 - protein, 15 aa, Mycobacterium tuberculosis
TREHVLLARQVGVPY

SEQ ID NO: 135035 - protein, 15 aa, Mycobacterium tuberculosis
REHVLLARQVGVPYI

SEQ ID NO: 135036 - protein, 15 aa, Mycobacterium tuberculosis
EHVLLARQVGVPYIL

SEQ ID NO: 135037 - protein, 15 aa, Mycobacterium tuberculosis
HVLLARQVGVPYILV

SEQ ID NO: 135038 - protein, 15 aa, Mycobacterium tuberculosis
VLLARQVGVPYILVA

SEQ ID NO: 135039 - protein, 15 aa, Mycobacterium tuberculosis
LLARQVGVPYILVAL

SEQ ID NO: 135040 - protein, 15 aa, Mycobacterium tuberculosis
LARQVGVPYILVALN

SEQ ID NO: 135041 - protein, 15 aa, Mycobacterium tuberculosis
ARQVGVPYILVALNK

SEQ ID NO: 135042 - protein, 15 aa, Mycobacterium tuberculosis
RQVGVPYILVALNKA

SEQ ID NO: 135043 - protein, 15 aa, Mycobacterium tuberculosis
QVGVPYILVALNKAD

SEQ ID NO: 135044 - protein, 15 aa, Mycobacterium tuberculosis
VGVPYILVALNKADA

SEQ ID NO: 135045 - protein, 15 aa, Mycobacterium tuberculosis
GVPYILVALNKADAV

SEQ ID NO: 135046 - protein, 15 aa, Mycobacterium tuberculosis
VPYILVALNKADAVD

SEQ ID NO: 135047 - protein, 15 aa, Mycobacterium tuberculosis
PYILVALNKADAVDD

SEQ ID NO: 135048 - protein, 15 aa, Mycobacterium tuberculosis
YILVALNKADAVDDE

SEQ ID NO: 135049 - protein, 15 aa, Mycobacterium tuberculosis
ILVALNKADAVDDEE

SEQ ID NO: 135050 - protein, 15 aa, Mycobacterium tuberculosis
LVALNKADAVDDEEL

SEQ ID NO: 135051 - protein, 15 aa, Mycobacterium tuberculosis
VALNKADAVDDEELL

SEQ ID NO: 135052 - protein, 15 aa, Mycobacterium tuberculosis
ALNKADAVDDEELLE

SEQ ID NO: 135053 - protein, 15 aa, Mycobacterium tuberculosis
LNKADAVDDEELLEL

SEQ ID NO: 135054 - protein, 15 aa, Mycobacterium tuberculosis
NKADAVDDEELLELV

SEQ ID NO: 135055 - protein, 15 aa, Mycobacterium tuberculosis
KADAVDDEELLELVE

SEQ ID NO: 135056 - protein, 15 aa, Mycobacterium tuberculosis
ADAVDDEELLELVEM

SEQ ID NO: 135057 - protein, 15 aa, Mycobacterium tuberculosis
DAVDDEELLELVEME

SEQ ID NO: 135058 - protein, 15 aa, Mycobacterium tuberculosis
AVDDEELLELVEMEV

SEQ ID NO: 135059 - protein, 15 aa, Mycobacterium tuberculosis
VDDEELLELVEMEVR

SEQ ID NO: 135060 - protein, 15 aa, Mycobacterium tuberculosis
DDEELLELVEMEVRE

SEQ ID NO: 135061 - protein, 15 aa, Mycobacterium tuberculosis
DEELLELVEMEVREL

SEQ ID NO: 135062 - protein, 15 aa, Mycobacterium tuberculosis
EELLELVEMEVRELL

SEQ ID NO: 135063 - protein, 15 aa, Mycobacterium tuberculosis
ELLELVEMEVRELLA

SEQ ID NO: 135064 - protein, 15 aa, Mycobacterium tuberculosis
LLELVEMEVRELLAA

SEQ ID NO: 135065 - protein, 15 aa, Mycobacterium tuberculosis
LELVEMEVRELLAAQ

SEQ ID NO: 135066 - protein, 15 aa, Mycobacterium tuberculosis
ELVEMEVRELLAAQE

SEQ ID NO: 135067 - protein, 15 aa, Mycobacterium tuberculosis
LVEMEVRELLAAQEF

SEQ ID NO: 135068 - protein, 15 aa, Mycobacterium tuberculosis
VEMEVRELLAAQEFD

SEQ ID NO: 135069 - protein, 15 aa, Mycobacterium tuberculosis
EMEVRELLAAQEFDE

SEQ ID NO: 135070 - protein, 15 aa, Mycobacterium tuberculosis
MEVRELLAAQEFDED

SEQ ID NO: 135071 - protein, 15 aa, Mycobacterium tuberculosis
EVRELLAAQEFDEDA

SEQ ID NO: 135072 - protein, 15 aa, Mycobacterium tuberculosis
VRELLAAQEFDEDAP

SEQ ID NO: 135073 - protein, 15 aa, Mycobacterium tuberculosis
RELLAAQEFDEDAPV

SEQ ID NO: 135074 - protein, 15 aa, Mycobacterium tuberculosis
ELLAAQEFDEDAPVV

SEQ ID NO: 135075 - protein, 15 aa, Mycobacterium tuberculosis
LLAAQEFDEDAPVVR

SEQ ID NO: 135076 - protein, 15 aa, Mycobacterium tuberculosis
LAAQEFDEDAPVVRV

SEQ ID NO: 135077 - protein, 15 aa, Mycobacterium tuberculosis
AAQEFDEDAPVVRVS

SEQ ID NO: 135078 - protein, 15 aa, Mycobacterium tuberculosis
AQEFDEDAPVVRVSA

SEQ ID NO: 135079 - protein, 15 aa, Mycobacterium tuberculosis
QEFDEDAPVVRVSAL

SEQ ID NO: 135080 - protein, 15 aa, Mycobacterium tuberculosis
EFDEDAPVVRVSALK

SEQ ID NO: 135081 - protein, 15 aa, Mycobacterium tuberculosis
FDEDAPVVRVSALKA

SEQ ID NO: 135082 - protein, 15 aa, Mycobacterium tuberculosis
DEDAPVVRVSALKAL

SEQ ID NO: 135083 - protein, 15 aa, Mycobacterium tuberculosis
EDAPVVRVSALKALE

SEQ ID NO: 135084 - protein, 15 aa, Mycobacterium tuberculosis
DAPVVRVSALKALEG

SEQ ID NO: 135085 - protein, 15 aa, Mycobacterium tuberculosis
APVVRVSALKALEGD

SEQ ID NO: 135086 - protein, 15 aa, Mycobacterium tuberculosis
PVVRVSALKALEGDA

SEQ ID NO: 135087 - protein, 15 aa, Mycobacterium tuberculosis
VVRVSALKALEGDAK

SEQ ID NO: 135088 - protein, 15 aa, Mycobacterium tuberculosis
VRVSALKALEGDAKW

SEQ ID NO: 135089 - protein, 15 aa, Mycobacterium tuberculosis
RVSALKALEGDAKWV

SEQ ID NO: 135090 - protein, 15 aa, Mycobacterium tuberculosis
VSALKALEGDAKWVA

SEQ ID NO: 135091 - protein, 15 aa, Mycobacterium tuberculosis
SALKALEGDAKWVAS

SEQ ID NO: 135092 - protein, 15 aa, Mycobacterium tuberculosis
ALKALEGDAKWVASV

SEQ ID NO: 135093 - protein, 15 aa, Mycobacterium tuberculosis
LKALEGDAKWVASVE

SEQ ID NO: 135094 - protein, 15 aa, Mycobacterium tuberculosis
KALEGDAKWVASVEE

SEQ ID NO: 135095 - protein, 15 aa, Mycobacterium tuberculosis
ALEGDAKWVASVEEL

SEQ ID NO: 135096 - protein, 15 aa, Mycobacterium tuberculosis
LEGDAKWVASVEELM

SEQ ID NO: 135097 - protein, 15 aa, Mycobacterium tuberculosis
EGDAKWVASVEELMN

SEQ ID NO: 135098 - protein, 15 aa, Mycobacterium tuberculosis
GDAKWVASVEELMNA

SEQ ID NO: 135099 - protein, 15 aa, Mycobacterium tuberculosis
DAKWVASVEELMNAV

SEQ ID NO: 135100 - protein, 15 aa, Mycobacterium tuberculosis
AKWVASVEELMNAVD

SEQ ID NO: 135101 - protein, 15 aa, Mycobacterium tuberculosis
KWVASVEELMNAVDE

SEQ ID NO: 135102 - protein, 15 aa, Mycobacterium tuberculosis
WVASVEELMNAVDES

SEQ ID NO: 135103 - protein, 15 aa, Mycobacterium tuberculosis
VASVEELMNAVDESI

SEQ ID NO: 135104 - protein, 15 aa, Mycobacterium tuberculosis
ASVEELMNAVDESIP

SEQ ID NO: 135105 - protein, 15 aa, Mycobacterium tuberculosis
SVEELMNAVDESIPD

SEQ ID NO: 135106 - protein, 15 aa, Mycobacterium tuberculosis
VEELMNAVDESIPDP

SEQ ID NO: 135107 - protein, 15 aa, Mycobacterium tuberculosis
EELMNAVDESIPDPV

SEQ ID NO: 135108 - protein, 15 aa, Mycobacterium tuberculosis
ELMNAVDESIPDPVR

SEQ ID NO: 135109 - protein, 15 aa, Mycobacterium tuberculosis
LMNAVDESIPDPVRE

SEQ ID NO: 135110 - protein, 15 aa, Mycobacterium tuberculosis
MNAVDESIPDPVRET

SEQ ID NO: 135111 - protein, 15 aa, Mycobacterium tuberculosis
NAVDESIPDPVRETD

SEQ ID NO: 135112 - protein, 15 aa, Mycobacterium tuberculosis
AVDESIPDPVRETDK

SEQ ID NO: 135113 - protein, 15 aa, Mycobacterium tuberculosis
VDESIPDPVRETDKP

SEQ ID NO: 135114 - protein, 15 aa, Mycobacterium tuberculosis
DESIPDPVRETDKPF

SEQ ID NO: 135115 - protein, 15 aa, Mycobacterium tuberculosis
ESIPDPVRETDKPFL

SEQ ID NO: 135116 - protein, 15 aa, Mycobacterium tuberculosis
SIPDPVRETDKPFLM

SEQ ID NO: 135117 - protein, 15 aa, Mycobacterium tuberculosis
IPDPVRETDKPFLMP

SEQ ID NO: 135118 - protein, 15 aa, Mycobacterium tuberculosis
PDPVRETDKPFLMPV

SEQ ID NO: 135119 - protein, 15 aa, Mycobacterium tuberculosis
DPVRETDKPFLMPVE

SEQ ID NO: 135120 - protein, 15 aa, Mycobacterium tuberculosis
PVRETDKPFLMPVED

SEQ ID NO: 135121 - protein, 15 aa, Mycobacterium tuberculosis
VRETDKPFLMPVEDV

SEQ ID NO: 135122 - protein, 15 aa, Mycobacterium tuberculosis
RETDKPFLMPVEDVF

SEQ ID NO: 135123 - protein, 15 aa, Mycobacterium tuberculosis
ETDKPFLMPVEDVFT

SEQ ID NO: 135124 - protein, 15 aa, Mycobacterium tuberculosis
TDKPFLMPVEDVFTI

SEQ ID NO: 135125 - protein, 15 aa, Mycobacterium tuberculosis
DKPFLMPVEDVFTIT

SEQ ID NO: 135126 - protein, 15 aa, Mycobacterium tuberculosis
KPFLMPVEDVFTITG

SEQ ID NO: 135127 - protein, 15 aa, Mycobacterium tuberculosis
PFLMPVEDVFTITGR

SEQ ID NO: 135128 - protein, 15 aa, Mycobacterium tuberculosis
FLMPVEDVFTITGRG

SEQ ID NO: 135129 - protein, 15 aa, Mycobacterium tuberculosis
LMPVEDVFTITGRGT

SEQ ID NO: 135130 - protein, 15 aa, Mycobacterium tuberculosis
MPVEDVFTITGRGTV

SEQ ID NO: 135131 - protein, 15 aa, Mycobacterium tuberculosis
PVEDVFTITGRGTVV

SEQ ID NO: 135132 - protein, 15 aa, Mycobacterium tuberculosis
VEDVFTITGRGTVVT

SEQ ID NO: 135133 - protein, 15 aa, Mycobacterium tuberculosis
EDVFTITGRGTVVTG

SEQ ID NO: 135134 - protein, 15 aa, Mycobacterium tuberculosis
DVFTITGRGTVVTGR

SEQ ID NO: 135135 - protein, 15 aa, Mycobacterium tuberculosis
VFTITGRGTVVTGRV

SEQ ID NO: 135136 - protein, 15 aa, Mycobacterium tuberculosis
FTITGRGTVVTGRVE

SEQ ID NO: 135137 - protein, 15 aa, Mycobacterium tuberculosis
TITGRGTVVTGRVER

SEQ ID NO: 135138 - protein, 15 aa, Mycobacterium tuberculosis
ITGRGTVVTGRVERG

SEQ ID NO: 135139 - protein, 15 aa, Mycobacterium tuberculosis
TGRGTVVTGRVERGV

SEQ ID NO: 135140 - protein, 15 aa, Mycobacterium tuberculosis
GRGTVVTGRVERGVI

SEQ ID NO: 135141 - protein, 15 aa, Mycobacterium tuberculosis
RGTVVTGRVERGVIN

SEQ ID NO: 135142 - protein, 15 aa, Mycobacterium tuberculosis
GTVVTGRVERGVINV

SEQ ID NO: 135143 - protein, 15 aa, Mycobacterium tuberculosis
TVVTGRVERGVINVN

SEQ ID NO: 135144 - protein, 15 aa, Mycobacterium tuberculosis
VVTGRVERGVINVNE

SEQ ID NO: 135145 - protein, 15 aa, Mycobacterium tuberculosis
VTGRVERGVINVNEE

SEQ ID NO: 135146 - protein, 15 aa, Mycobacterium tuberculosis
TGRVERGVINVNEEV

SEQ ID NO: 135147 - protein, 15 aa, Mycobacterium tuberculosis
GRVERGVINVNEEVE

SEQ ID NO: 135148 - protein, 15 aa, Mycobacterium tuberculosis
RVERGVINVNEEVEI

SEQ ID NO: 135149 - protein, 15 aa, Mycobacterium tuberculosis
VERGVINVNEEVEIV

SEQ ID NO: 135150 - protein, 15 aa, Mycobacterium tuberculosis
ERGVINVNEEVEIVG

SEQ ID NO: 135151 - protein, 15 aa, Mycobacterium tuberculosis
RGVINVNEEVEIVGI

SEQ ID NO: 135152 - protein, 15 aa, Mycobacterium tuberculosis
GVINVNEEVEIVGIR

SEQ ID NO: 135153 - protein, 15 aa, Mycobacterium tuberculosis
VINVNEEVEIVGIRP

SEQ ID NO: 135154 - protein, 15 aa, Mycobacterium tuberculosis
INVNEEVEIVGIRPS

SEQ ID NO: 135155 - protein, 15 aa, Mycobacterium tuberculosis
NVNEEVEIVGIRPST

SEQ ID NO: 135156 - protein, 15 aa, Mycobacterium tuberculosis
VNEEVEIVGIRPSTT

SEQ ID NO: 135157 - protein, 15 aa, Mycobacterium tuberculosis
NEEVEIVGIRPSTTK

SEQ ID NO: 135158 - protein, 15 aa, Mycobacterium tuberculosis
EEVEIVGIRPSTTKT

SEQ ID NO: 135159 - protein, 15 aa, Mycobacterium tuberculosis
EVEIVGIRPSTTKTT

SEQ ID NO: 135160 - protein, 15 aa, Mycobacterium tuberculosis
VEIVGIRPSTTKTTV

SEQ ID NO: 135161 - protein, 15 aa, Mycobacterium tuberculosis
EIVGIRPSTTKTTVT

SEQ ID NO: 135162 - protein, 15 aa, Mycobacterium tuberculosis
IVGIRPSTTKTTVTG

SEQ ID NO: 135163 - protein, 15 aa, Mycobacterium tuberculosis
VGIRPSTTKTTVTGV

SEQ ID NO: 135164 - protein, 15 aa, Mycobacterium tuberculosis
GIRPSTTKTTVTGVE

SEQ ID NO: 135165 - protein, 15 aa, Mycobacterium tuberculosis
IRPSTTKTTVTGVEM

SEQ ID NO: 135166 - protein, 15 aa, Mycobacterium tuberculosis
RPSTTKTTVTGVEMF

SEQ ID NO: 135167 - protein, 15 aa, Mycobacterium tuberculosis
PSTTKTTVTGVEMFR

SEQ ID NO: 135168 - protein, 15 aa, Mycobacterium tuberculosis
STTKTTVTGVEMFRK

SEQ ID NO: 135169 - protein, 15 aa, Mycobacterium tuberculosis
TTKTTVTGVEMFRKL

SEQ ID NO: 135170 - protein, 15 aa, Mycobacterium tuberculosis
TKTTVTGVEMFRKLL

SEQ ID NO: 135171 - protein, 15 aa, Mycobacterium tuberculosis
KTTVTGVEMFRKLLD

SEQ ID NO: 135172 - protein, 15 aa, Mycobacterium tuberculosis
TTVTGVEMFRKLLDQ

SEQ ID NO: 135173 - protein, 15 aa, Mycobacterium tuberculosis
TVTGVEMFRKLLDQG

SEQ ID NO: 135174 - protein, 15 aa, Mycobacterium tuberculosis
VTGVEMFRKLLDQGQ

SEQ ID NO: 135175 - protein, 15 aa, Mycobacterium tuberculosis
TGVEMFRKLLDQGQA

SEQ ID NO: 135176 - protein, 15 aa, Mycobacterium tuberculosis
GVEMFRKLLDQGQAG

SEQ ID NO: 135177 - protein, 15 aa, Mycobacterium tuberculosis
VEMFRKLLDQGQAGD

SEQ ID NO: 135178 - protein, 15 aa, Mycobacterium tuberculosis
EMFRKLLDQGQAGDN

SEQ ID NO: 135179 - protein, 15 aa, Mycobacterium tuberculosis
MFRKLLDQGQAGDNV

SEQ ID NO: 135180 - protein, 15 aa, Mycobacterium tuberculosis
FRKLLDQGQAGDNVG

SEQ ID NO: 135181 - protein, 15 aa, Mycobacterium tuberculosis
RKLLDQGQAGDNVGL

SEQ ID NO: 135182 - protein, 15 aa, Mycobacterium tuberculosis
KLLDQGQAGDNVGLL

SEQ ID NO: 135183 - protein, 15 aa, Mycobacterium tuberculosis
LLDQGQAGDNVGLLL

SEQ ID NO: 135184 - protein, 15 aa, Mycobacterium tuberculosis
LDQGQAGDNVGLLLR

SEQ ID NO: 135185 - protein, 15 aa, Mycobacterium tuberculosis
DQGQAGDNVGLLLRG

SEQ ID NO: 135186 - protein, 15 aa, Mycobacterium tuberculosis
QGQAGDNVGLLLRGV

SEQ ID NO: 135187 - protein, 15 aa, Mycobacterium tuberculosis
GQAGDNVGLLLRGVK

SEQ ID NO: 135188 - protein, 15 aa, Mycobacterium tuberculosis
QAGDNVGLLLRGVKR

SEQ ID NO: 135189 - protein, 15 aa, Mycobacterium tuberculosis
AGDNVGLLLRGVKRE

SEQ ID NO: 135190 - protein, 15 aa, Mycobacterium tuberculosis
GDNVGLLLRGVKRED

SEQ ID NO: 135191 - protein, 15 aa, Mycobacterium tuberculosis
DNVGLLLRGVKREDV

SEQ ID NO: 135192 - protein, 15 aa, Mycobacterium tuberculosis
NVGLLLRGVKREDVE

SEQ ID NO: 135193 - protein, 15 aa, Mycobacterium tuberculosis
VGLLLRGVKREDVER

SEQ ID NO: 135194 - protein, 15 aa, Mycobacterium tuberculosis
GLLLRGVKREDVERG

SEQ ID NO: 135195 - protein, 15 aa, Mycobacterium tuberculosis
LLLRGVKREDVERGQ

SEQ ID NO: 135196 - protein, 15 aa, Mycobacterium tuberculosis
LLRGVKREDVERGQV

SEQ ID NO: 135197 - protein, 15 aa, Mycobacterium tuberculosis
LRGVKREDVERGQVV

SEQ ID NO: 135198 - protein, 15 aa, Mycobacterium tuberculosis
RGVKREDVERGQVVT

SEQ ID NO: 135199 - protein, 15 aa, Mycobacterium tuberculosis
GVKREDVERGQVVTK

SEQ ID NO: 135200 - protein, 15 aa, Mycobacterium tuberculosis
VKREDVERGQVVTKP

SEQ ID NO: 135201 - protein, 15 aa, Mycobacterium tuberculosis
KREDVERGQVVTKPG

SEQ ID NO: 135202 - protein, 15 aa, Mycobacterium tuberculosis
REDVERGQVVTKPGT

SEQ ID NO: 135203 - protein, 15 aa, Mycobacterium tuberculosis
EDVERGQVVTKPGTT

SEQ ID NO: 135204 - protein, 15 aa, Mycobacterium tuberculosis
DVERGQVVTKPGTTT

SEQ ID NO: 135205 - protein, 15 aa, Mycobacterium tuberculosis
VERGQVVTKPGTTTP

SEQ ID NO: 135206 - protein, 15 aa, Mycobacterium tuberculosis
ERGQVVTKPGTTTPH

SEQ ID NO: 135207 - protein, 15 aa, Mycobacterium tuberculosis
RGQVVTKPGTTTPHT

SEQ ID NO: 135208 - protein, 15 aa, Mycobacterium tuberculosis
GQVVTKPGTTTPHTE

SEQ ID NO: 135209 - protein, 15 aa, Mycobacterium tuberculosis
QVVTKPGTTTPHTEF

SEQ ID NO: 135210 - protein, 15 aa, Mycobacterium tuberculosis
VVTKPGTTTPHTEFE

SEQ ID NO: 135211 - protein, 15 aa, Mycobacterium tuberculosis
VTKPGTTTPHTEFEG

SEQ ID NO: 135212 - protein, 15 aa, Mycobacterium tuberculosis
TKPGTTTPHTEFEGQ

SEQ ID NO: 135213 - protein, 15 aa, Mycobacterium tuberculosis
KPGTTTPHTEFEGQV

SEQ ID NO: 135214 - protein, 15 aa, Mycobacterium tuberculosis
PGTTTPHTEFEGQVY

SEQ ID NO: 135215 - protein, 15 aa, Mycobacterium tuberculosis
GTTTPHTEFEGQVYI

SEQ ID NO: 135216 - protein, 15 aa, Mycobacterium tuberculosis
TTTPHTEFEGQVYIL

SEQ ID NO: 135217 - protein, 15 aa, Mycobacterium tuberculosis
TTPHTEFEGQVYILS

SEQ ID NO: 135218 - protein, 15 aa, Mycobacterium tuberculosis
TPHTEFEGQVYILSK

SEQ ID NO: 135219 - protein, 15 aa, Mycobacterium tuberculosis
PHTEFEGQVYILSKD

SEQ ID NO: 135220 - protein, 15 aa, Mycobacterium tuberculosis
HTEFEGQVYILSKDE

SEQ ID NO: 135221 - protein, 15 aa, Mycobacterium tuberculosis
TEFEGQVYILSKDEG

SEQ ID NO: 135222 - protein, 15 aa, Mycobacterium tuberculosis
EFEGQVYILSKDEGG

SEQ ID NO: 135223 - protein, 15 aa, Mycobacterium tuberculosis
FEGQVYILSKDEGGR

SEQ ID NO: 135224 - protein, 15 aa, Mycobacterium tuberculosis
EGQVYILSKDEGGRH

SEQ ID NO: 135225 - protein, 15 aa, Mycobacterium tuberculosis
GQVYILSKDEGGRHT

SEQ ID NO: 135226 - protein, 15 aa, Mycobacterium tuberculosis
QVYILSKDEGGRHTP

SEQ ID NO: 135227 - protein, 15 aa, Mycobacterium tuberculosis
VYILSKDEGGRHTPF

SEQ ID NO: 135228 - protein, 15 aa, Mycobacterium tuberculosis
YILSKDEGGRHTPFF

SEQ ID NO: 135229 - protein, 15 aa, Mycobacterium tuberculosis
ILSKDEGGRHTPFFN

SEQ ID NO: 135230 - protein, 15 aa, Mycobacterium tuberculosis
LSKDEGGRHTPFFNN

SEQ ID NO: 135231 - protein, 15 aa, Mycobacterium tuberculosis
SKDEGGRHTPFFNNY

SEQ ID NO: 135232 - protein, 15 aa, Mycobacterium tuberculosis
KDEGGRHTPFFNNYR

SEQ ID NO: 135233 - protein, 15 aa, Mycobacterium tuberculosis
DEGGRHTPFFNNYRP

SEQ ID NO: 135234 - protein, 15 aa, Mycobacterium tuberculosis
EGGRHTPFFNNYRPQ

SEQ ID NO: 135235 - protein, 15 aa, Mycobacterium tuberculosis
GGRHTPFFNNYRPQF

SEQ ID NO: 135236 - protein, 15 aa, Mycobacterium tuberculosis
GRHTPFFNNYRPQFY

SEQ ID NO: 135237 - protein, 15 aa, Mycobacterium tuberculosis
RHTPFFNNYRPQFYF

SEQ ID NO: 135238 - protein, 15 aa, Mycobacterium tuberculosis
HTPFFNNYRPQFYFR

SEQ ID NO: 135239 - protein, 15 aa, Mycobacterium tuberculosis
TPFFNNYRPQFYFRT

SEQ ID NO: 135240 - protein, 15 aa, Mycobacterium tuberculosis
PFFNNYRPQFYFRTT

SEQ ID NO: 135241 - protein, 15 aa, Mycobacterium tuberculosis
FFNNYRPQFYFRTTD

SEQ ID NO: 135242 - protein, 15 aa, Mycobacterium tuberculosis
FNNYRPQFYFRTTDV

SEQ ID NO: 135243 - protein, 15 aa, Mycobacterium tuberculosis
NNYRPQFYFRTTDVT

SEQ ID NO: 135244 - protein, 15 aa, Mycobacterium tuberculosis
NYRPQFYFRTTDVTG

SEQ ID NO: 135245 - protein, 15 aa, Mycobacterium tuberculosis
YRPQFYFRTTDVTGV

SEQ ID NO: 135246 - protein, 15 aa, Mycobacterium tuberculosis
RPQFYFRTTDVTGVV

SEQ ID NO: 135247 - protein, 15 aa, Mycobacterium tuberculosis
PQFYFRTTDVTGVVT

SEQ ID NO: 135248 - protein, 15 aa, Mycobacterium tuberculosis
QFYFRTTDVTGVVTL

SEQ ID NO: 135249 - protein, 15 aa, Mycobacterium tuberculosis
FYFRTTDVTGVVTLP

SEQ ID NO: 135250 - protein, 15 aa, Mycobacterium tuberculosis
YFRTTDVTGVVTLPE

SEQ ID NO: 135251 - protein, 15 aa, Mycobacterium tuberculosis
FRTTDVTGVVTLPEG

SEQ ID NO: 135252 - protein, 15 aa, Mycobacterium tuberculosis
RTTDVTGVVTLPEGT

SEQ ID NO: 135253 - protein, 15 aa, Mycobacterium tuberculosis
TTDVTGVVTLPEGTE

SEQ ID NO: 135254 - protein, 15 aa, Mycobacterium tuberculosis
TDVTGVVTLPEGTEM

SEQ ID NO: 135255 - protein, 15 aa, Mycobacterium tuberculosis
DVTGVVTLPEGTEMV

SEQ ID NO: 135256 - protein, 15 aa, Mycobacterium tuberculosis
VTGVVTLPEGTEMVM

SEQ ID NO: 135257 - protein, 15 aa, Mycobacterium tuberculosis
TGVVTLPEGTEMVMP

SEQ ID NO: 135258 - protein, 15 aa, Mycobacterium tuberculosis
GVVTLPEGTEMVMPG

SEQ ID NO: 135259 - protein, 15 aa, Mycobacterium tuberculosis
VVTLPEGTEMVMPGD

SEQ ID NO: 135260 - protein, 15 aa, Mycobacterium tuberculosis
VTLPEGTEMVMPGDN

SEQ ID NO: 135261 - protein, 15 aa, Mycobacterium tuberculosis
TLPEGTEMVMPGDNT

SEQ ID NO: 135262 - protein, 15 aa, Mycobacterium tuberculosis
LPEGTEMVMPGDNTN

SEQ ID NO: 135263 - protein, 15 aa, Mycobacterium tuberculosis
PEGTEMVMPGDNTNI

SEQ ID NO: 135264 - protein, 15 aa, Mycobacterium tuberculosis
EGTEMVMPGDNTNIS

SEQ ID NO: 135265 - protein, 15 aa, Mycobacterium tuberculosis
GTEMVMPGDNTNISV

SEQ ID NO: 135266 - protein, 15 aa, Mycobacterium tuberculosis
TEMVMPGDNTNISVK

SEQ ID NO: 135267 - protein, 15 aa, Mycobacterium tuberculosis
EMVMPGDNTNISVKL

SEQ ID NO: 135268 - protein, 15 aa, Mycobacterium tuberculosis
MVMPGDNTNISVKLI

SEQ ID NO: 135269 - protein, 15 aa, Mycobacterium tuberculosis
VMPGDNTNISVKLIQ

SEQ ID NO: 135270 - protein, 15 aa, Mycobacterium tuberculosis
MPGDNTNISVKLIQP

SEQ ID NO: 135271 - protein, 15 aa, Mycobacterium tuberculosis
PGDNTNISVKLIQPV

SEQ ID NO: 135272 - protein, 15 aa, Mycobacterium tuberculosis
GDNTNISVKLIQPVA

SEQ ID NO: 135273 - protein, 15 aa, Mycobacterium tuberculosis
DNTNISVKLIQPVAM

SEQ ID NO: 135274 - protein, 15 aa, Mycobacterium tuberculosis
NTNISVKLIQPVAMD

SEQ ID NO: 135275 - protein, 15 aa, Mycobacterium tuberculosis
TNISVKLIQPVAMDE

SEQ ID NO: 135276 - protein, 15 aa, Mycobacterium tuberculosis
NISVKLIQPVAMDEG

SEQ ID NO: 135277 - protein, 15 aa, Mycobacterium tuberculosis
ISVKLIQPVAMDEGL

SEQ ID NO: 135278 - protein, 15 aa, Mycobacterium tuberculosis
SVKLIQPVAMDEGLR

SEQ ID NO: 135279 - protein, 15 aa, Mycobacterium tuberculosis
VKLIQPVAMDEGLRF

SEQ ID NO: 135280 - protein, 15 aa, Mycobacterium tuberculosis
KLIQPVAMDEGLRFA

SEQ ID NO: 135281 - protein, 15 aa, Mycobacterium tuberculosis
LIQPVAMDEGLRFAI

SEQ ID NO: 135282 - protein, 15 aa, Mycobacterium tuberculosis
IQPVAMDEGLRFAIR

SEQ ID NO: 135283 - protein, 15 aa, Mycobacterium tuberculosis
QPVAMDEGLRFAIRE

SEQ ID NO: 135284 - protein, 15 aa, Mycobacterium tuberculosis
PVAMDEGLRFAIREG

SEQ ID NO: 135285 - protein, 15 aa, Mycobacterium tuberculosis
VAMDEGLRFAIREGG

SEQ ID NO: 135286 - protein, 15 aa, Mycobacterium tuberculosis
AMDEGLRFAIREGGR

SEQ ID NO: 135287 - protein, 15 aa, Mycobacterium tuberculosis
MDEGLRFAIREGGRT

SEQ ID NO: 135288 - protein, 15 aa, Mycobacterium tuberculosis
DEGLRFAIREGGRTV

SEQ ID NO: 135289 - protein, 15 aa, Mycobacterium tuberculosis
EGLRFAIREGGRTVG

SEQ ID NO: 135290 - protein, 15 aa, Mycobacterium tuberculosis
GLRFAIREGGRTVGA

SEQ ID NO: 135291 - protein, 15 aa, Mycobacterium tuberculosis
LRFAIREGGRTVGAG

SEQ ID NO: 135292 - protein, 15 aa, Mycobacterium tuberculosis
RFAIREGGRTVGAGR

SEQ ID NO: 135293 - protein, 15 aa, Mycobacterium tuberculosis
FAIREGGRTVGAGRV

SEQ ID NO: 135294 - protein, 15 aa, Mycobacterium tuberculosis
AIREGGRTVGAGRVT

SEQ ID NO: 135295 - protein, 15 aa, Mycobacterium tuberculosis
IREGGRTVGAGRVTK

SEQ ID NO: 135296 - protein, 15 aa, Mycobacterium tuberculosis
REGGRTVGAGRVTKI

SEQ ID NO: 135297 - protein, 15 aa, Mycobacterium tuberculosis
EGGRTVGAGRVTKII

SEQ ID NO: 135298 - protein, 15 aa, Mycobacterium tuberculosis
GGRTVGAGRVTKIIK

SEQ ID NO: 135299 - protein, 16 aa, Mycobacterium tuberculosis
MAKAKFQRTKPHVNIG

SEQ ID NO: 135300 - protein, 16 aa, Mycobacterium tuberculosis
AKAKFQRTKPHVNIGT

SEQ ID NO: 135301 - protein, 16 aa, Mycobacterium tuberculosis
KAKFQRTKPHVNIGTI

SEQ ID NO: 135302 - protein, 16 aa, Mycobacterium tuberculosis
AKFQRTKPHVNIGTIG

SEQ ID NO: 135303 - protein, 16 aa, Mycobacterium tuberculosis
KFQRTKPHVNIGTIGH

SEQ ID NO: 135304 - protein, 16 aa, Mycobacterium tuberculosis
FQRTKPHVNIGTIGHV

SEQ ID NO: 135305 - protein, 16 aa, Mycobacterium tuberculosis
QRTKPHVNIGTIGHVD

SEQ ID NO: 135306 - protein, 16 aa, Mycobacterium tuberculosis
RTKPHVNIGTIGHVDH

SEQ ID NO: 135307 - protein, 16 aa, Mycobacterium tuberculosis
TKPHVNIGTIGHVDHG

SEQ ID NO: 135308 - protein, 16 aa, Mycobacterium tuberculosis
KPHVNIGTIGHVDHGK

SEQ ID NO: 135309 - protein, 16 aa, Mycobacterium tuberculosis
PHVNIGTIGHVDHGKT

SEQ ID NO: 135310 - protein, 16 aa, Mycobacterium tuberculosis
HVNIGTIGHVDHGKTT

SEQ ID NO: 135311 - protein, 16 aa, Mycobacterium tuberculosis
VNIGTIGHVDHGKTTL

SEQ ID NO: 135312 - protein, 16 aa, Mycobacterium tuberculosis
NIGTIGHVDHGKTTLT

SEQ ID NO: 135313 - protein, 16 aa, Mycobacterium tuberculosis
IGTIGHVDHGKTTLTA

SEQ ID NO: 135314 - protein, 16 aa, Mycobacterium tuberculosis
GTIGHVDHGKTTLTAA

SEQ ID NO: 135315 - protein, 16 aa, Mycobacterium tuberculosis
TIGHVDHGKTTLTAAI

SEQ ID NO: 135316 - protein, 16 aa, Mycobacterium tuberculosis
IGHVDHGKTTLTAAIT

SEQ ID NO: 135317 - protein, 16 aa, Mycobacterium tuberculosis
GHVDHGKTTLTAAITK

SEQ ID NO: 135318 - protein, 16 aa, Mycobacterium tuberculosis
HVDHGKTTLTAAITKV

SEQ ID NO: 135319 - protein, 16 aa, Mycobacterium tuberculosis
VDHGKTTLTAAITKVL

SEQ ID NO: 135320 - protein, 16 aa, Mycobacterium tuberculosis
DHGKTTLTAAITKVLH

SEQ ID NO: 135321 - protein, 16 aa, Mycobacterium tuberculosis
HGKTTLTAAITKVLHD

SEQ ID NO: 135322 - protein, 16 aa, Mycobacterium tuberculosis
GKTTLTAAITKVLHDK

SEQ ID NO: 135323 - protein, 16 aa, Mycobacterium tuberculosis
KTTLTAAITKVLHDKF

SEQ ID NO: 135324 - protein, 16 aa, Mycobacterium tuberculosis
TTLTAAITKVLHDKFP

SEQ ID NO: 135325 - protein, 16 aa, Mycobacterium tuberculosis
TLTAAITKVLHDKFPD

SEQ ID NO: 135326 - protein, 16 aa, Mycobacterium tuberculosis
LTAAITKVLHDKFPDL

SEQ ID NO: 135327 - protein, 16 aa, Mycobacterium tuberculosis
TAAITKVLHDKFPDLN

SEQ ID NO: 135328 - protein, 16 aa, Mycobacterium tuberculosis
AAITKVLHDKFPDLNE

SEQ ID NO: 135329 - protein, 16 aa, Mycobacterium tuberculosis
AITKVLHDKFPDLNET

SEQ ID NO: 135330 - protein, 16 aa, Mycobacterium tuberculosis
ITKVLHDKFPDLNETK

SEQ ID NO: 135331 - protein, 16 aa, Mycobacterium tuberculosis
TKVLHDKFPDLNETKA

SEQ ID NO: 135332 - protein, 16 aa, Mycobacterium tuberculosis
KVLHDKFPDLNETKAF

SEQ ID NO: 135333 - protein, 16 aa, Mycobacterium tuberculosis
VLHDKFPDLNETKAFD

SEQ ID NO: 135334 - protein, 16 aa, Mycobacterium tuberculosis
LHDKFPDLNETKAFDQ

SEQ ID NO: 135335 - protein, 16 aa, Mycobacterium tuberculosis
HDKFPDLNETKAFDQI

SEQ ID NO: 135336 - protein, 16 aa, Mycobacterium tuberculosis
DKFPDLNETKAFDQID

SEQ ID NO: 135337 - protein, 16 aa, Mycobacterium tuberculosis
KFPDLNETKAFDQIDN

SEQ ID NO: 135338 - protein, 16 aa, Mycobacterium tuberculosis
FPDLNETKAFDQIDNA

SEQ ID NO: 135339 - protein, 16 aa, Mycobacterium tuberculosis
PDLNETKAFDQIDNAP

SEQ ID NO: 135340 - protein, 16 aa, Mycobacterium tuberculosis
DLNETKAFDQIDNAPE

SEQ ID NO: 135341 - protein, 16 aa, Mycobacterium tuberculosis
LNETKAFDQIDNAPEE

SEQ ID NO: 135342 - protein, 16 aa, Mycobacterium tuberculosis
NETKAFDQIDNAPEER

SEQ ID NO: 135343 - protein, 16 aa, Mycobacterium tuberculosis
ETKAFDQIDNAPEERQ

SEQ ID NO: 135344 - protein, 16 aa, Mycobacterium tuberculosis
TKAFDQIDNAPEERQR

SEQ ID NO: 135345 - protein, 16 aa, Mycobacterium tuberculosis
KAFDQIDNAPEERQRG

SEQ ID NO: 135346 - protein, 16 aa, Mycobacterium tuberculosis
AFDQIDNAPEERQRGI

SEQ ID NO: 135347 - protein, 16 aa, Mycobacterium tuberculosis
FDQIDNAPEERQRGIT

SEQ ID NO: 135348 - protein, 16 aa, Mycobacterium tuberculosis
DQIDNAPEERQRGITI

SEQ ID NO: 135349 - protein, 16 aa, Mycobacterium tuberculosis
QIDNAPEERQRGITIN

SEQ ID NO: 135350 - protein, 16 aa, Mycobacterium tuberculosis
IDNAPEERQRGITINI

SEQ ID NO: 135351 - protein, 16 aa, Mycobacterium tuberculosis
DNAPEERQRGITINIA

SEQ ID NO: 135352 - protein, 16 aa, Mycobacterium tuberculosis
NAPEERQRGITINIAH

SEQ ID NO: 135353 - protein, 16 aa, Mycobacterium tuberculosis
APEERQRGITINIAHV

SEQ ID NO: 135354 - protein, 16 aa, Mycobacterium tuberculosis
PEERQRGITINIAHVE

SEQ ID NO: 135355 - protein, 16 aa, Mycobacterium tuberculosis
EERQRGITINIAHVEY

SEQ ID NO: 135356 - protein, 16 aa, Mycobacterium tuberculosis
ERQRGITINIAHVEYQ

SEQ ID NO: 135357 - protein, 16 aa, Mycobacterium tuberculosis
RQRGITINIAHVEYQT

SEQ ID NO: 135358 - protein, 16 aa, Mycobacterium tuberculosis
QRGITINIAHVEYQTD

SEQ ID NO: 135359 - protein, 16 aa, Mycobacterium tuberculosis
RGITINIAHVEYQTDK

SEQ ID NO: 135360 - protein, 16 aa, Mycobacterium tuberculosis
GITINIAHVEYQTDKR

SEQ ID NO: 135361 - protein, 16 aa, Mycobacterium tuberculosis
ITINIAHVEYQTDKRH

SEQ ID NO: 135362 - protein, 16 aa, Mycobacterium tuberculosis
TINIAHVEYQTDKRHY

SEQ ID NO: 135363 - protein, 16 aa, Mycobacterium tuberculosis
INIAHVEYQTDKRHYA

SEQ ID NO: 135364 - protein, 16 aa, Mycobacterium tuberculosis
NIAHVEYQTDKRHYAH

SEQ ID NO: 135365 - protein, 16 aa, Mycobacterium tuberculosis
IAHVEYQTDKRHYAHV

SEQ ID NO: 135366 - protein, 16 aa, Mycobacterium tuberculosis
AHVEYQTDKRHYAHVD

SEQ ID NO: 135367 - protein, 16 aa, Mycobacterium tuberculosis
HVEYQTDKRHYAHVDA

SEQ ID NO: 135368 - protein, 16 aa, Mycobacterium tuberculosis
VEYQTDKRHYAHVDAP

SEQ ID NO: 135369 - protein, 16 aa, Mycobacterium tuberculosis
EYQTDKRHYAHVDAPG

SEQ ID NO: 135370 - protein, 16 aa, Mycobacterium tuberculosis
YQTDKRHYAHVDAPGH

SEQ ID NO: 135371 - protein, 16 aa, Mycobacterium tuberculosis
QTDKRHYAHVDAPGHA

SEQ ID NO: 135372 - protein, 16 aa, Mycobacterium tuberculosis
TDKRHYAHVDAPGHAD

SEQ ID NO: 135373 - protein, 16 aa, Mycobacterium tuberculosis
DKRHYAHVDAPGHADY

SEQ ID NO: 135374 - protein, 16 aa, Mycobacterium tuberculosis
KRHYAHVDAPGHADYI

SEQ ID NO: 135375 - protein, 16 aa, Mycobacterium tuberculosis
RHYAHVDAPGHADYIK

SEQ ID NO: 135376 - protein, 16 aa, Mycobacterium tuberculosis
HYAHVDAPGHADYIKN

SEQ ID NO: 135377 - protein, 16 aa, Mycobacterium tuberculosis
YAHVDAPGHADYIKNM

SEQ ID NO: 135378 - protein, 16 aa, Mycobacterium tuberculosis
AHVDAPGHADYIKNMI

SEQ ID NO: 135379 - protein, 16 aa, Mycobacterium tuberculosis
HVDAPGHADYIKNMIT

SEQ ID NO: 135380 - protein, 16 aa, Mycobacterium tuberculosis
VDAPGHADYIKNMITG

SEQ ID NO: 135381 - protein, 16 aa, Mycobacterium tuberculosis
DAPGHADYIKNMITGA

SEQ ID NO: 135382 - protein, 16 aa, Mycobacterium tuberculosis
APGHADYIKNMITGAA

SEQ ID NO: 135383 - protein, 16 aa, Mycobacterium tuberculosis
PGHADYIKNMITGAAQ

SEQ ID NO: 135384 - protein, 16 aa, Mycobacterium tuberculosis
GHADYIKNMITGAAQM

SEQ ID NO: 135385 - protein, 16 aa, Mycobacterium tuberculosis
HADYIKNMITGAAQMD

SEQ ID NO: 135386 - protein, 16 aa, Mycobacterium tuberculosis
ADYIKNMITGAAQMDG

SEQ ID NO: 135387 - protein, 16 aa, Mycobacterium tuberculosis
DYIKNMITGAAQMDGA

SEQ ID NO: 135388 - protein, 16 aa, Mycobacterium tuberculosis
YIKNMITGAAQMDGAI

SEQ ID NO: 135389 - protein, 16 aa, Mycobacterium tuberculosis
IKNMITGAAQMDGAIL

SEQ ID NO: 135390 - protein, 16 aa, Mycobacterium tuberculosis
KNMITGAAQMDGAILV

SEQ ID NO: 135391 - protein, 16 aa, Mycobacterium tuberculosis
NMITGAAQMDGAILVV

SEQ ID NO: 135392 - protein, 16 aa, Mycobacterium tuberculosis
MITGAAQMDGAILVVA

SEQ ID NO: 135393 - protein, 16 aa, Mycobacterium tuberculosis
ITGAAQMDGAILVVAA

SEQ ID NO: 135394 - protein, 16 aa, Mycobacterium tuberculosis
TGAAQMDGAILVVAAT

SEQ ID NO: 135395 - protein, 16 aa, Mycobacterium tuberculosis
GAAQMDGAILVVAATD

SEQ ID NO: 135396 - protein, 16 aa, Mycobacterium tuberculosis
AAQMDGAILVVAATDG

SEQ ID NO: 135397 - protein, 16 aa, Mycobacterium tuberculosis
AQMDGAILVVAATDGP

SEQ ID NO: 135398 - protein, 16 aa, Mycobacterium tuberculosis
QMDGAILVVAATDGPM

SEQ ID NO: 135399 - protein, 16 aa, Mycobacterium tuberculosis
MDGAILVVAATDGPMP

SEQ ID NO: 135400 - protein, 16 aa, Mycobacterium tuberculosis
DGAILVVAATDGPMPQ

SEQ ID NO: 135401 - protein, 16 aa, Mycobacterium tuberculosis
GAILVVAATDGPMPQT

SEQ ID NO: 135402 - protein, 16 aa, Mycobacterium tuberculosis
AILVVAATDGPMPQTR

SEQ ID NO: 135403 - protein, 16 aa, Mycobacterium tuberculosis
ILVVAATDGPMPQTRE

SEQ ID NO: 135404 - protein, 16 aa, Mycobacterium tuberculosis
LVVAATDGPMPQTREH

SEQ ID NO: 135405 - protein, 16 aa, Mycobacterium tuberculosis
VVAATDGPMPQTREHV

SEQ ID NO: 135406 - protein, 16 aa, Mycobacterium tuberculosis
VAATDGPMPQTREHVL

SEQ ID NO: 135407 - protein, 16 aa, Mycobacterium tuberculosis
AATDGPMPQTREHVLL

SEQ ID NO: 135408 - protein, 16 aa, Mycobacterium tuberculosis
ATDGPMPQTREHVLLA

SEQ ID NO: 135409 - protein, 16 aa, Mycobacterium tuberculosis
TDGPMPQTREHVLLAR

SEQ ID NO: 135410 - protein, 16 aa, Mycobacterium tuberculosis
DGPMPQTREHVLLARQ

SEQ ID NO: 135411 - protein, 16 aa, Mycobacterium tuberculosis
GPMPQTREHVLLARQV

SEQ ID NO: 135412 - protein, 16 aa, Mycobacterium tuberculosis
PMPQTREHVLLARQVG

SEQ ID NO: 135413 - protein, 16 aa, Mycobacterium tuberculosis
MPQTREHVLLARQVGV

SEQ ID NO: 135414 - protein, 16 aa, Mycobacterium tuberculosis
PQTREHVLLARQVGVP

SEQ ID NO: 135415 - protein, 16 aa, Mycobacterium tuberculosis
QTREHVLLARQVGVPY

SEQ ID NO: 135416 - protein, 16 aa, Mycobacterium tuberculosis
TREHVLLARQVGVPYI

SEQ ID NO: 135417 - protein, 16 aa, Mycobacterium tuberculosis
REHVLLARQVGVPYIL

SEQ ID NO: 135418 - protein, 16 aa, Mycobacterium tuberculosis
EHVLLARQVGVPYILV

SEQ ID NO: 135419 - protein, 16 aa, Mycobacterium tuberculosis
HVLLARQVGVPYILVA

SEQ ID NO: 135420 - protein, 16 aa, Mycobacterium tuberculosis
VLLARQVGVPYILVAL

SEQ ID NO: 135421 - protein, 16 aa, Mycobacterium tuberculosis
LLARQVGVPYILVALN

SEQ ID NO: 135422 - protein, 16 aa, Mycobacterium tuberculosis
LARQVGVPYILVALNK

SEQ ID NO: 135423 - protein, 16 aa, Mycobacterium tuberculosis
ARQVGVPYILVALNKA

SEQ ID NO: 135424 - protein, 16 aa, Mycobacterium tuberculosis
RQVGVPYILVALNKAD

SEQ ID NO: 135425 - protein, 16 aa, Mycobacterium tuberculosis
QVGVPYILVALNKADA

SEQ ID NO: 135426 - protein, 16 aa, Mycobacterium tuberculosis
VGVPYILVALNKADAV

SEQ ID NO: 135427 - protein, 16 aa, Mycobacterium tuberculosis
GVPYILVALNKADAVD

SEQ ID NO: 135428 - protein, 16 aa, Mycobacterium tuberculosis
VPYILVALNKADAVDD

SEQ ID NO: 135429 - protein, 16 aa, Mycobacterium tuberculosis
PYILVALNKADAVDDE

SEQ ID NO: 135430 - protein, 16 aa, Mycobacterium tuberculosis
YILVALNKADAVDDEE

SEQ ID NO: 135431 - protein, 16 aa, Mycobacterium tuberculosis
ILVALNKADAVDDEEL

SEQ ID NO: 135432 - protein, 16 aa, Mycobacterium tuberculosis
LVALNKADAVDDEELL

SEQ ID NO: 135433 - protein, 16 aa, Mycobacterium tuberculosis
VALNKADAVDDEELLE

SEQ ID NO: 135434 - protein, 16 aa, Mycobacterium tuberculosis
ALNKADAVDDEELLEL

SEQ ID NO: 135435 - protein, 16 aa, Mycobacterium tuberculosis
LNKADAVDDEELLELV

SEQ ID NO: 135436 - protein, 16 aa, Mycobacterium tuberculosis
NKADAVDDEELLELVE

SEQ ID NO: 135437 - protein, 16 aa, Mycobacterium tuberculosis
KADAVDDEELLELVEM

SEQ ID NO: 135438 - protein, 16 aa, Mycobacterium tuberculosis
ADAVDDEELLELVEME

SEQ ID NO: 135439 - protein, 16 aa, Mycobacterium tuberculosis
DAVDDEELLELVEMEV

SEQ ID NO: 135440 - protein, 16 aa, Mycobacterium tuberculosis
AVDDEELLELVEMEVR

SEQ ID NO: 135441 - protein, 16 aa, Mycobacterium tuberculosis
VDDEELLELVEMEVRE

SEQ ID NO: 135442 - protein, 16 aa, Mycobacterium tuberculosis
DDEELLELVEMEVREL

SEQ ID NO: 135443 - protein, 16 aa, Mycobacterium tuberculosis
DEELLELVEMEVRELL

SEQ ID NO: 135444 - protein, 16 aa, Mycobacterium tuberculosis
EELLELVEMEVRELLA

SEQ ID NO: 135445 - protein, 16 aa, Mycobacterium tuberculosis
ELLELVEMEVRELLAA

SEQ ID NO: 135446 - protein, 16 aa, Mycobacterium tuberculosis
LLELVEMEVRELLAAQ

SEQ ID NO: 135447 - protein, 16 aa, Mycobacterium tuberculosis
LELVEMEVRELLAAQE

SEQ ID NO: 135448 - protein, 16 aa, Mycobacterium tuberculosis
ELVEMEVRELLAAQEF

SEQ ID NO: 135449 - protein, 16 aa, Mycobacterium tuberculosis
LVEMEVRELLAAQEFD

SEQ ID NO: 135450 - protein, 16 aa, Mycobacterium tuberculosis
VEMEVRELLAAQEFDE

SEQ ID NO: 135451 - protein, 16 aa, Mycobacterium tuberculosis
EMEVRELLAAQEFDED

SEQ ID NO: 135452 - protein, 16 aa, Mycobacterium tuberculosis
MEVRELLAAQEFDEDA

SEQ ID NO: 135453 - protein, 16 aa, Mycobacterium tuberculosis
EVRELLAAQEFDEDAP

SEQ ID NO: 135454 - protein, 16 aa, Mycobacterium tuberculosis
VRELLAAQEFDEDAPV

SEQ ID NO: 135455 - protein, 16 aa, Mycobacterium tuberculosis
RELLAAQEFDEDAPVV

SEQ ID NO: 135456 - protein, 16 aa, Mycobacterium tuberculosis
ELLAAQEFDEDAPVVR

SEQ ID NO: 135457 - protein, 16 aa, Mycobacterium tuberculosis
LLAAQEFDEDAPVVRV

SEQ ID NO: 135458 - protein, 16 aa, Mycobacterium tuberculosis
LAAQEFDEDAPVVRVS

SEQ ID NO: 135459 - protein, 16 aa, Mycobacterium tuberculosis
AAQEFDEDAPVVRVSA

SEQ ID NO: 135460 - protein, 16 aa, Mycobacterium tuberculosis
AQEFDEDAPVVRVSAL

SEQ ID NO: 135461 - protein, 16 aa, Mycobacterium tuberculosis
QEFDEDAPVVRVSALK

SEQ ID NO: 135462 - protein, 16 aa, Mycobacterium tuberculosis
EFDEDAPVVRVSALKA

SEQ ID NO: 135463 - protein, 16 aa, Mycobacterium tuberculosis
FDEDAPVVRVSALKAL

SEQ ID NO: 135464 - protein, 16 aa, Mycobacterium tuberculosis
DEDAPVVRVSALKALE

SEQ ID NO: 135465 - protein, 16 aa, Mycobacterium tuberculosis
EDAPVVRVSALKALEG

SEQ ID NO: 135466 - protein, 16 aa, Mycobacterium tuberculosis
DAPVVRVSALKALEGD

SEQ ID NO: 135467 - protein, 16 aa, Mycobacterium tuberculosis
APVVRVSALKALEGDA

SEQ ID NO: 135468 - protein, 16 aa, Mycobacterium tuberculosis
PVVRVSALKALEGDAK

SEQ ID NO: 135469 - protein, 16 aa, Mycobacterium tuberculosis
VVRVSALKALEGDAKW

SEQ ID NO: 135470 - protein, 16 aa, Mycobacterium tuberculosis
VRVSALKALEGDAKWV

SEQ ID NO: 135471 - protein, 16 aa, Mycobacterium tuberculosis
RVSALKALEGDAKWVA

SEQ ID NO: 135472 - protein, 16 aa, Mycobacterium tuberculosis
VSALKALEGDAKWVAS

SEQ ID NO: 135473 - protein, 16 aa, Mycobacterium tuberculosis
SALKALEGDAKWVASV

SEQ ID NO: 135474 - protein, 16 aa, Mycobacterium tuberculosis
ALKALEGDAKWVASVE

SEQ ID NO: 135475 - protein, 16 aa, Mycobacterium tuberculosis
LKALEGDAKWVASVEE

SEQ ID NO: 135476 - protein, 16 aa, Mycobacterium tuberculosis
KALEGDAKWVASVEEL

SEQ ID NO: 135477 - protein, 16 aa, Mycobacterium tuberculosis
ALEGDAKWVASVEELM

SEQ ID NO: 135478 - protein, 16 aa, Mycobacterium tuberculosis
LEGDAKWVASVEELMN

SEQ ID NO: 135479 - protein, 16 aa, Mycobacterium tuberculosis
EGDAKWVASVEELMNA

SEQ ID NO: 135480 - protein, 16 aa, Mycobacterium tuberculosis
GDAKWVASVEELMNAV

SEQ ID NO: 135481 - protein, 16 aa, Mycobacterium tuberculosis
DAKWVASVEELMNAVD

SEQ ID NO: 135482 - protein, 16 aa, Mycobacterium tuberculosis
AKWVASVEELMNAVDE

SEQ ID NO: 135483 - protein, 16 aa, Mycobacterium tuberculosis
KWVASVEELMNAVDES

SEQ ID NO: 135484 - protein, 16 aa, Mycobacterium tuberculosis
WVASVEELMNAVDESI

SEQ ID NO: 135485 - protein, 16 aa, Mycobacterium tuberculosis
VASVEELMNAVDESIP

SEQ ID NO: 135486 - protein, 16 aa, Mycobacterium tuberculosis
ASVEELMNAVDESIPD

SEQ ID NO: 135487 - protein, 16 aa, Mycobacterium tuberculosis
SVEELMNAVDESIPDP

SEQ ID NO: 135488 - protein, 16 aa, Mycobacterium tuberculosis
VEELMNAVDESIPDPV

SEQ ID NO: 135489 - protein, 16 aa, Mycobacterium tuberculosis
EELMNAVDESIPDPVR

SEQ ID NO: 135490 - protein, 16 aa, Mycobacterium tuberculosis
ELMNAVDESIPDPVRE

SEQ ID NO: 135491 - protein, 16 aa, Mycobacterium tuberculosis
LMNAVDESIPDPVRET

SEQ ID NO: 135492 - protein, 16 aa, Mycobacterium tuberculosis
MNAVDESIPDPVRETD

SEQ ID NO: 135493 - protein, 16 aa, Mycobacterium tuberculosis
NAVDESIPDPVRETDK

SEQ ID NO: 135494 - protein, 16 aa, Mycobacterium tuberculosis
AVDESIPDPVRETDKP

SEQ ID NO: 135495 - protein, 16 aa, Mycobacterium tuberculosis
VDESIPDPVRETDKPF

SEQ ID NO: 135496 - protein, 16 aa, Mycobacterium tuberculosis
DESIPDPVRETDKPFL

SEQ ID NO: 135497 - protein, 16 aa, Mycobacterium tuberculosis
ESIPDPVRETDKPFLM

SEQ ID NO: 135498 - protein, 16 aa, Mycobacterium tuberculosis
SIPDPVRETDKPFLMP

SEQ ID NO: 135499 - protein, 16 aa, Mycobacterium tuberculosis
IPDPVRETDKPFLMPV

SEQ ID NO: 135500 - protein, 16 aa, Mycobacterium tuberculosis
PDPVRETDKPFLMPVE

SEQ ID NO: 135501 - protein, 16 aa, Mycobacterium tuberculosis
DPVRETDKPFLMPVED

SEQ ID NO: 135502 - protein, 16 aa, Mycobacterium tuberculosis
PVRETDKPFLMPVEDV

SEQ ID NO: 135503 - protein, 16 aa, Mycobacterium tuberculosis
VRETDKPFLMPVEDVF

SEQ ID NO: 135504 - protein, 16 aa, Mycobacterium tuberculosis
RETDKPFLMPVEDVFT

SEQ ID NO: 135505 - protein, 16 aa, Mycobacterium tuberculosis
ETDKPFLMPVEDVFTI

SEQ ID NO: 135506 - protein, 16 aa, Mycobacterium tuberculosis
TDKPFLMPVEDVFTIT

SEQ ID NO: 135507 - protein, 16 aa, Mycobacterium tuberculosis
DKPFLMPVEDVFTITG

SEQ ID NO: 135508 - protein, 16 aa, Mycobacterium tuberculosis
KPFLMPVEDVFTITGR

SEQ ID NO: 135509 - protein, 16 aa, Mycobacterium tuberculosis
PFLMPVEDVFTITGRG

SEQ ID NO: 135510 - protein, 16 aa, Mycobacterium tuberculosis
FLMPVEDVFTITGRGT

SEQ ID NO: 135511 - protein, 16 aa, Mycobacterium tuberculosis
LMPVEDVFTITGRGTV

SEQ ID NO: 135512 - protein, 16 aa, Mycobacterium tuberculosis
MPVEDVFTITGRGTVV

SEQ ID NO: 135513 - protein, 16 aa, Mycobacterium tuberculosis
PVEDVFTITGRGTVVT

SEQ ID NO: 135514 - protein, 16 aa, Mycobacterium tuberculosis
VEDVFTITGRGTVVTG

SEQ ID NO: 135515 - protein, 16 aa, Mycobacterium tuberculosis
EDVFTITGRGTVVTGR

SEQ ID NO: 135516 - protein, 16 aa, Mycobacterium tuberculosis
DVFTITGRGTVVTGRV

SEQ ID NO: 135517 - protein, 16 aa, Mycobacterium tuberculosis
VFTITGRGTVVTGRVE

SEQ ID NO: 135518 - protein, 16 aa, Mycobacterium tuberculosis
FTITGRGTVVTGRVER

SEQ ID NO: 135519 - protein, 16 aa, Mycobacterium tuberculosis
TITGRGTVVTGRVERG

SEQ ID NO: 135520 - protein, 16 aa, Mycobacterium tuberculosis
ITGRGTVVTGRVERGV

SEQ ID NO: 135521 - protein, 16 aa, Mycobacterium tuberculosis
TGRGTVVTGRVERGVI

SEQ ID NO: 135522 - protein, 16 aa, Mycobacterium tuberculosis
GRGTVVTGRVERGVIN

SEQ ID NO: 135523 - protein, 16 aa, Mycobacterium tuberculosis
RGTVVTGRVERGVINV

SEQ ID NO: 135524 - protein, 16 aa, Mycobacterium tuberculosis
GTVVTGRVERGVINVN

SEQ ID NO: 135525 - protein, 16 aa, Mycobacterium tuberculosis
TVVTGRVERGVINVNE

SEQ ID NO: 135526 - protein, 16 aa, Mycobacterium tuberculosis
VVTGRVERGVINVNEE

SEQ ID NO: 135527 - protein, 16 aa, Mycobacterium tuberculosis
VTGRVERGVINVNEEV

SEQ ID NO: 135528 - protein, 16 aa, Mycobacterium tuberculosis
TGRVERGVINVNEEVE

SEQ ID NO: 135529 - protein, 16 aa, Mycobacterium tuberculosis
GRVERGVINVNEEVEI

SEQ ID NO: 135530 - protein, 16 aa, Mycobacterium tuberculosis
RVERGVINVNEEVEIV

SEQ ID NO: 135531 - protein, 16 aa, Mycobacterium tuberculosis
VERGVINVNEEVEIVG

SEQ ID NO: 135532 - protein, 16 aa, Mycobacterium tuberculosis
ERGVINVNEEVEIVGI

SEQ ID NO: 135533 - protein, 16 aa, Mycobacterium tuberculosis
RGVINVNEEVEIVGIR

SEQ ID NO: 135534 - protein, 16 aa, Mycobacterium tuberculosis
GVINVNEEVEIVGIRP

SEQ ID NO: 135535 - protein, 16 aa, Mycobacterium tuberculosis
VINVNEEVEIVGIRPS

SEQ ID NO: 135536 - protein, 16 aa, Mycobacterium tuberculosis
INVNEEVEIVGIRPST

SEQ ID NO: 135537 - protein, 16 aa, Mycobacterium tuberculosis
NVNEEVEIVGIRPSTT

SEQ ID NO: 135538 - protein, 16 aa, Mycobacterium tuberculosis
VNEEVEIVGIRPSTTK

SEQ ID NO: 135539 - protein, 16 aa, Mycobacterium tuberculosis
NEEVEIVGIRPSTTKT

SEQ ID NO: 135540 - protein, 16 aa, Mycobacterium tuberculosis
EEVEIVGIRPSTTKTT

SEQ ID NO: 135541 - protein, 16 aa, Mycobacterium tuberculosis
EVEIVGIRPSTTKTTV

SEQ ID NO: 135542 - protein, 16 aa, Mycobacterium tuberculosis
VEIVGIRPSTTKTTVT

SEQ ID NO: 135543 - protein, 16 aa, Mycobacterium tuberculosis
EIVGIRPSTTKTTVTG

SEQ ID NO: 135544 - protein, 16 aa, Mycobacterium tuberculosis
IVGIRPSTTKTTVTGV

SEQ ID NO: 135545 - protein, 16 aa, Mycobacterium tuberculosis
VGIRPSTTKTTVTGVE

SEQ ID NO: 135546 - protein, 16 aa, Mycobacterium tuberculosis
GIRPSTTKTTVTGVEM

SEQ ID NO: 135547 - protein, 16 aa, Mycobacterium tuberculosis
IRPSTTKTTVTGVEMF

SEQ ID NO: 135548 - protein, 16 aa, Mycobacterium tuberculosis
RPSTTKTTVTGVEMFR

SEQ ID NO: 135549 - protein, 16 aa, Mycobacterium tuberculosis
PSTTKTTVTGVEMFRK

SEQ ID NO: 135550 - protein, 16 aa, Mycobacterium tuberculosis
STTKTTVTGVEMFRKL

SEQ ID NO: 135551 - protein, 16 aa, Mycobacterium tuberculosis
TTKTTVTGVEMFRKLL

SEQ ID NO: 135552 - protein, 16 aa, Mycobacterium tuberculosis
TKTTVTGVEMFRKLLD

SEQ ID NO: 135553 - protein, 16 aa, Mycobacterium tuberculosis
KTTVTGVEMFRKLLDQ

SEQ ID NO: 135554 - protein, 16 aa, Mycobacterium tuberculosis
TTVTGVEMFRKLLDQG

SEQ ID NO: 135555 - protein, 16 aa, Mycobacterium tuberculosis
TVTGVEMFRKLLDQGQ

SEQ ID NO: 135556 - protein, 16 aa, Mycobacterium tuberculosis
VTGVEMFRKLLDQGQA

SEQ ID NO: 135557 - protein, 16 aa, Mycobacterium tuberculosis
TGVEMFRKLLDQGQAG

SEQ ID NO: 135558 - protein, 16 aa, Mycobacterium tuberculosis
GVEMFRKLLDQGQAGD

SEQ ID NO: 135559 - protein, 16 aa, Mycobacterium tuberculosis
VEMFRKLLDQGQAGDN

SEQ ID NO: 135560 - protein, 16 aa, Mycobacterium tuberculosis
EMFRKLLDQGQAGDNV

SEQ ID NO: 135561 - protein, 16 aa, Mycobacterium tuberculosis
MFRKLLDQGQAGDNVG

SEQ ID NO: 135562 - protein, 16 aa, Mycobacterium tuberculosis
FRKLLDQGQAGDNVGL

SEQ ID NO: 135563 - protein, 16 aa, Mycobacterium tuberculosis
RKLLDQGQAGDNVGLL

SEQ ID NO: 135564 - protein, 16 aa, Mycobacterium tuberculosis
KLLDQGQAGDNVGLLL

SEQ ID NO: 135565 - protein, 16 aa, Mycobacterium tuberculosis
LLDQGQAGDNVGLLLR

SEQ ID NO: 135566 - protein, 16 aa, Mycobacterium tuberculosis
LDQGQAGDNVGLLLRG

SEQ ID NO: 135567 - protein, 16 aa, Mycobacterium tuberculosis
DQGQAGDNVGLLLRGV

SEQ ID NO: 135568 - protein, 16 aa, Mycobacterium tuberculosis
QGQAGDNVGLLLRGVK

SEQ ID NO: 135569 - protein, 16 aa, Mycobacterium tuberculosis
GQAGDNVGLLLRGVKR

SEQ ID NO: 135570 - protein, 16 aa, Mycobacterium tuberculosis
QAGDNVGLLLRGVKRE

SEQ ID NO: 135571 - protein, 16 aa, Mycobacterium tuberculosis
AGDNVGLLLRGVKRED

SEQ ID NO: 135572 - protein, 16 aa, Mycobacterium tuberculosis
GDNVGLLLRGVKREDV

SEQ ID NO: 135573 - protein, 16 aa, Mycobacterium tuberculosis
DNVGLLLRGVKREDVE

SEQ ID NO: 135574 - protein, 16 aa, Mycobacterium tuberculosis
NVGLLLRGVKREDVER

SEQ ID NO: 135575 - protein, 16 aa, Mycobacterium tuberculosis
VGLLLRGVKREDVERG

SEQ ID NO: 135576 - protein, 16 aa, Mycobacterium tuberculosis
GLLLRGVKREDVERGQ

SEQ ID NO: 135577 - protein, 16 aa, Mycobacterium tuberculosis
LLLRGVKREDVERGQV

SEQ ID NO: 135578 - protein, 16 aa, Mycobacterium tuberculosis
LLRGVKREDVERGQVV

SEQ ID NO: 135579 - protein, 16 aa, Mycobacterium tuberculosis
LRGVKREDVERGQVVT

SEQ ID NO: 135580 - protein, 16 aa, Mycobacterium tuberculosis
RGVKREDVERGQVVTK

SEQ ID NO: 135581 - protein, 16 aa, Mycobacterium tuberculosis
GVKREDVERGQVVTKP

SEQ ID NO: 135582 - protein, 16 aa, Mycobacterium tuberculosis
VKREDVERGQVVTKPG

SEQ ID NO: 135583 - protein, 16 aa, Mycobacterium tuberculosis
KREDVERGQVVTKPGT

SEQ ID NO: 135584 - protein, 16 aa, Mycobacterium tuberculosis
REDVERGQVVTKPGTT

SEQ ID NO: 135585 - protein, 16 aa, Mycobacterium tuberculosis
EDVERGQVVTKPGTTT

SEQ ID NO: 135586 - protein, 16 aa, Mycobacterium tuberculosis
DVERGQVVTKPGTTTP

SEQ ID NO: 135587 - protein, 16 aa, Mycobacterium tuberculosis
VERGQVVTKPGTTTPH

SEQ ID NO: 135588 - protein, 16 aa, Mycobacterium tuberculosis
ERGQVVTKPGTTTPHT

SEQ ID NO: 135589 - protein, 16 aa, Mycobacterium tuberculosis
RGQVVTKPGTTTPHTE

SEQ ID NO: 135590 - protein, 16 aa, Mycobacterium tuberculosis
GQVVTKPGTTTPHTEF

SEQ ID NO: 135591 - protein, 16 aa, Mycobacterium tuberculosis
QVVTKPGTTTPHTEFE

SEQ ID NO: 135592 - protein, 16 aa, Mycobacterium tuberculosis
VVTKPGTTTPHTEFEG

SEQ ID NO: 135593 - protein, 16 aa, Mycobacterium tuberculosis
VTKPGTTTPHTEFEGQ

SEQ ID NO: 135594 - protein, 16 aa, Mycobacterium tuberculosis
TKPGTTTPHTEFEGQV

SEQ ID NO: 135595 - protein, 16 aa, Mycobacterium tuberculosis
KPGTTTPHTEFEGQVY

SEQ ID NO: 135596 - protein, 16 aa, Mycobacterium tuberculosis
PGTTTPHTEFEGQVYI

SEQ ID NO: 135597 - protein, 16 aa, Mycobacterium tuberculosis
GTTTPHTEFEGQVYIL

SEQ ID NO: 135598 - protein, 16 aa, Mycobacterium tuberculosis
TTTPHTEFEGQVYILS

SEQ ID NO: 135599 - protein, 16 aa, Mycobacterium tuberculosis
TTPHTEFEGQVYILSK

SEQ ID NO: 135600 - protein, 16 aa, Mycobacterium tuberculosis
TPHTEFEGQVYILSKD

SEQ ID NO: 135601 - protein, 16 aa, Mycobacterium tuberculosis
PHTEFEGQVYILSKDE

SEQ ID NO: 135602 - protein, 16 aa, Mycobacterium tuberculosis
HTEFEGQVYILSKDEG

SEQ ID NO: 135603 - protein, 16 aa, Mycobacterium tuberculosis
TEFEGQVYILSKDEGG

SEQ ID NO: 135604 - protein, 16 aa, Mycobacterium tuberculosis
EFEGQVYILSKDEGGR

SEQ ID NO: 135605 - protein, 16 aa, Mycobacterium tuberculosis
FEGQVYILSKDEGGRH

SEQ ID NO: 135606 - protein, 16 aa, Mycobacterium tuberculosis
EGQVYILSKDEGGRHT

SEQ ID NO: 135607 - protein, 16 aa, Mycobacterium tuberculosis
GQVYILSKDEGGRHTP

SEQ ID NO: 135608 - protein, 16 aa, Mycobacterium tuberculosis
QVYILSKDEGGRHTPF

SEQ ID NO: 135609 - protein, 16 aa, Mycobacterium tuberculosis
VYILSKDEGGRHTPFF

SEQ ID NO: 135610 - protein, 16 aa, Mycobacterium tuberculosis
YILSKDEGGRHTPFFN

SEQ ID NO: 135611 - protein, 16 aa, Mycobacterium tuberculosis
ILSKDEGGRHTPFFNN

SEQ ID NO: 135612 - protein, 16 aa, Mycobacterium tuberculosis
LSKDEGGRHTPFFNNY

SEQ ID NO: 135613 - protein, 16 aa, Mycobacterium tuberculosis
SKDEGGRHTPFFNNYR

SEQ ID NO: 135614 - protein, 16 aa, Mycobacterium tuberculosis
KDEGGRHTPFFNNYRP

SEQ ID NO: 135615 - protein, 16 aa, Mycobacterium tuberculosis
DEGGRHTPFFNNYRPQ

SEQ ID NO: 135616 - protein, 16 aa, Mycobacterium tuberculosis
EGGRHTPFFNNYRPQF

SEQ ID NO: 135617 - protein, 16 aa, Mycobacterium tuberculosis
GGRHTPFFNNYRPQFY

SEQ ID NO: 135618 - protein, 16 aa, Mycobacterium tuberculosis
GRHTPFFNNYRPQFYF

SEQ ID NO: 135619 - protein, 16 aa, Mycobacterium tuberculosis
RHTPFFNNYRPQFYFR

SEQ ID NO: 135620 - protein, 16 aa, Mycobacterium tuberculosis
HTPFFNNYRPQFYFRT

SEQ ID NO: 135621 - protein, 16 aa, Mycobacterium tuberculosis
TPFFNNYRPQFYFRTT

SEQ ID NO: 135622 - protein, 16 aa, Mycobacterium tuberculosis
PFFNNYRPQFYFRTTD

SEQ ID NO: 135623 - protein, 16 aa, Mycobacterium tuberculosis
FFNNYRPQFYFRTTDV

SEQ ID NO: 135624 - protein, 16 aa, Mycobacterium tuberculosis
FNNYRPQFYFRTTDVT

SEQ ID NO: 135625 - protein, 16 aa, Mycobacterium tuberculosis
NNYRPQFYFRTTDVTG

SEQ ID NO: 135626 - protein, 16 aa, Mycobacterium tuberculosis
NYRPQFYFRTTDVTGV

SEQ ID NO: 135627 - protein, 16 aa, Mycobacterium tuberculosis
YRPQFYFRTTDVTGVV

SEQ ID NO: 135628 - protein, 16 aa, Mycobacterium tuberculosis
RPQFYFRTTDVTGVVT

SEQ ID NO: 135629 - protein, 16 aa, Mycobacterium tuberculosis
PQFYFRTTDVTGVVTL

SEQ ID NO: 135630 - protein, 16 aa, Mycobacterium tuberculosis
QFYFRTTDVTGVVTLP

SEQ ID NO: 135631 - protein, 16 aa, Mycobacterium tuberculosis
FYFRTTDVTGVVTLPE

SEQ ID NO: 135632 - protein, 16 aa, Mycobacterium tuberculosis
YFRTTDVTGVVTLPEG

SEQ ID NO: 135633 - protein, 16 aa, Mycobacterium tuberculosis
FRTTDVTGVVTLPEGT

SEQ ID NO: 135634 - protein, 16 aa, Mycobacterium tuberculosis
RTTDVTGVVTLPEGTE

SEQ ID NO: 135635 - protein, 16 aa, Mycobacterium tuberculosis
TTDVTGVVTLPEGTEM

SEQ ID NO: 135636 - protein, 16 aa, Mycobacterium tuberculosis
TDVTGVVTLPEGTEMV

SEQ ID NO: 135637 - protein, 16 aa, Mycobacterium tuberculosis
DVTGVVTLPEGTEMVM

SEQ ID NO: 135638 - protein, 16 aa, Mycobacterium tuberculosis
VTGVVTLPEGTEMVMP

SEQ ID NO: 135639 - protein, 16 aa, Mycobacterium tuberculosis
TGVVTLPEGTEMVMPG

SEQ ID NO: 135640 - protein, 16 aa, Mycobacterium tuberculosis
GVVTLPEGTEMVMPGD

SEQ ID NO: 135641 - protein, 16 aa, Mycobacterium tuberculosis
VVTLPEGTEMVMPGDN

SEQ ID NO: 135642 - protein, 16 aa, Mycobacterium tuberculosis
VTLPEGTEMVMPGDNT

SEQ ID NO: 135643 - protein, 16 aa, Mycobacterium tuberculosis
TLPEGTEMVMPGDNTN

SEQ ID NO: 135644 - protein, 16 aa, Mycobacterium tuberculosis
LPEGTEMVMPGDNTNI

SEQ ID NO: 135645 - protein, 16 aa, Mycobacterium tuberculosis
PEGTEMVMPGDNTNIS

SEQ ID NO: 135646 - protein, 16 aa, Mycobacterium tuberculosis
EGTEMVMPGDNTNISV

SEQ ID NO: 135647 - protein, 16 aa, Mycobacterium tuberculosis
GTEMVMPGDNTNISVK

SEQ ID NO: 135648 - protein, 16 aa, Mycobacterium tuberculosis
TEMVMPGDNTNISVKL

SEQ ID NO: 135649 - protein, 16 aa, Mycobacterium tuberculosis
EMVMPGDNTNISVKLI

SEQ ID NO: 135650 - protein, 16 aa, Mycobacterium tuberculosis
MVMPGDNTNISVKLIQ

SEQ ID NO: 135651 - protein, 16 aa, Mycobacterium tuberculosis
VMPGDNTNISVKLIQP

SEQ ID NO: 135652 - protein, 16 aa, Mycobacterium tuberculosis
MPGDNTNISVKLIQPV

SEQ ID NO: 135653 - protein, 16 aa, Mycobacterium tuberculosis
PGDNTNISVKLIQPVA

SEQ ID NO: 135654 - protein, 16 aa, Mycobacterium tuberculosis
GDNTNISVKLIQPVAM

SEQ ID NO: 135655 - protein, 16 aa, Mycobacterium tuberculosis
DNTNISVKLIQPVAMD

SEQ ID NO: 135656 - protein, 16 aa, Mycobacterium tuberculosis
NTNISVKLIQPVAMDE

SEQ ID NO: 135657 - protein, 16 aa, Mycobacterium tuberculosis
TNISVKLIQPVAMDEG

SEQ ID NO: 135658 - protein, 16 aa, Mycobacterium tuberculosis
NISVKLIQPVAMDEGL

SEQ ID NO: 135659 - protein, 16 aa, Mycobacterium tuberculosis
ISVKLIQPVAMDEGLR

SEQ ID NO: 135660 - protein, 16 aa, Mycobacterium tuberculosis
SVKLIQPVAMDEGLRF

SEQ ID NO: 135661 - protein, 16 aa, Mycobacterium tuberculosis
VKLIQPVAMDEGLRFA

SEQ ID NO: 135662 - protein, 16 aa, Mycobacterium tuberculosis
KLIQPVAMDEGLRFAI

SEQ ID NO: 135663 - protein, 16 aa, Mycobacterium tuberculosis
LIQPVAMDEGLRFAIR

SEQ ID NO: 135664 - protein, 16 aa, Mycobacterium tuberculosis
IQPVAMDEGLRFAIRE

SEQ ID NO: 135665 - protein, 16 aa, Mycobacterium tuberculosis
QPVAMDEGLRFAIREG

SEQ ID NO: 135666 - protein, 16 aa, Mycobacterium tuberculosis
PVAMDEGLRFAIREGG

SEQ ID NO: 135667 - protein, 16 aa, Mycobacterium tuberculosis
VAMDEGLRFAIREGGR

SEQ ID NO: 135668 - protein, 16 aa, Mycobacterium tuberculosis
AMDEGLRFAIREGGRT

SEQ ID NO: 135669 - protein, 16 aa, Mycobacterium tuberculosis
MDEGLRFAIREGGRTV

SEQ ID NO: 135670 - protein, 16 aa, Mycobacterium tuberculosis
DEGLRFAIREGGRTVG

SEQ ID NO: 135671 - protein, 16 aa, Mycobacterium tuberculosis
EGLRFAIREGGRTVGA

SEQ ID NO: 135672 - protein, 16 aa, Mycobacterium tuberculosis
GLRFAIREGGRTVGAG

SEQ ID NO: 135673 - protein, 16 aa, Mycobacterium tuberculosis
LRFAIREGGRTVGAGR

SEQ ID NO: 135674 - protein, 16 aa, Mycobacterium tuberculosis
RFAIREGGRTVGAGRV

SEQ ID NO: 135675 - protein, 16 aa, Mycobacterium tuberculosis
FAIREGGRTVGAGRVT

SEQ ID NO: 135676 - protein, 16 aa, Mycobacterium tuberculosis
AIREGGRTVGAGRVTK

SEQ ID NO: 135677 - protein, 16 aa, Mycobacterium tuberculosis
IREGGRTVGAGRVTKI

SEQ ID NO: 135678 - protein, 16 aa, Mycobacterium tuberculosis
REGGRTVGAGRVTKII

SEQ ID NO: 135679 - protein, 16 aa, Mycobacterium tuberculosis
EGGRTVGAGRVTKIIK

SEQ ID NO: 135680 - protein, 120 aa, Mycobacterium tuberculosis
MSTQRPRHSGIRAVGPYAWAGRCGRIGRWGVHQEAMMNLAIWHPRKVQSATIYQVTDRSHDGRTARVPGDEITSTVSGWLSELGTQSPLADELARAVRIGDWPAAYAIGEHLSVEIAVAV

SEQ ID NO: 135681 - protein, 8 aa, Mycobacterium tuberculosis
RPRHSGIR

SEQ ID NO: 135682 - protein, 8 aa, Mycobacterium tuberculosis
GIRAVGPY

SEQ ID NO: 135683 - protein, 8 aa, Mycobacterium tuberculosis
RAVGPYAW

SEQ ID NO: 135684 - protein, 8 aa, Mycobacterium tuberculosis
AVGPYAWA

SEQ ID NO: 135685 - protein, 8 aa, Mycobacterium tuberculosis
GRCGRIGR

SEQ ID NO: 135686 - protein, 8 aa, Mycobacterium tuberculosis
WGVHQEAM

SEQ ID NO: 135687 - protein, 8 aa, Mycobacterium tuberculosis
HQEAMMNL

SEQ ID NO: 135688 - protein, 8 aa, Mycobacterium tuberculosis
EAMMNLAI

SEQ ID NO: 135689 - protein, 8 aa, Mycobacterium tuberculosis
AMMNLAIW

SEQ ID NO: 135690 - protein, 8 aa, Mycobacterium tuberculosis
MMNLAIWH

SEQ ID NO: 135691 - protein, 8 aa, Mycobacterium tuberculosis
NLAIWHPR

SEQ ID NO: 135692 - protein, 8 aa, Mycobacterium tuberculosis
LAIWHPRK

SEQ ID NO: 135693 - protein, 8 aa, Mycobacterium tuberculosis
AIWHPRKV

SEQ ID NO: 135694 - protein, 8 aa, Mycobacterium tuberculosis
HPRKVQSA

SEQ ID NO: 135695 - protein, 8 aa, Mycobacterium tuberculosis
KVQSATIY

SEQ ID NO: 135696 - protein, 8 aa, Mycobacterium tuberculosis
QSATIYQV

SEQ ID NO: 135697 - protein, 8 aa, Mycobacterium tuberculosis
TIYQVTDR

SEQ ID NO: 135698 - protein, 8 aa, Mycobacterium tuberculosis
YQVTDRSH

SEQ ID NO: 135699 - protein, 8 aa, Mycobacterium tuberculosis
RSHDGRTA

SEQ ID NO: 135700 - protein, 8 aa, Mycobacterium tuberculosis
ITSTVSGW

SEQ ID NO: 135701 - protein, 8 aa, Mycobacterium tuberculosis
WLSELGTQ

SEQ ID NO: 135702 - protein, 8 aa, Mycobacterium tuberculosis
ELGTQSPL

SEQ ID NO: 135703 - protein, 8 aa, Mycobacterium tuberculosis
DELARAVR

SEQ ID NO: 135704 - protein, 8 aa, Mycobacterium tuberculosis
ELARAVRI

SEQ ID NO: 135705 - protein, 8 aa, Mycobacterium tuberculosis
RAVRIGDW

SEQ ID NO: 135706 - protein, 8 aa, Mycobacterium tuberculosis
RIGDWPAA

SEQ ID NO: 135707 - protein, 8 aa, Mycobacterium tuberculosis
IGDWPAAY

SEQ ID NO: 135708 - protein, 8 aa, Mycobacterium tuberculosis
DWPAAYAI

SEQ ID NO: 135709 - protein, 8 aa, Mycobacterium tuberculosis
WPAAYAIG

SEQ ID NO: 135710 - protein, 8 aa, Mycobacterium tuberculosis
AYAIGEHL

SEQ ID NO: 135711 - protein, 8 aa, Mycobacterium tuberculosis
AIGEHLSV

SEQ ID NO: 135712 - protein, 8 aa, Mycobacterium tuberculosis
GEHLSVEI

SEQ ID NO: 135713 - protein, 8 aa, Mycobacterium tuberculosis
HLSVEIAV

SEQ ID NO: 135714 - protein, 8 aa, Mycobacterium tuberculosis
SVEIAVAV

SEQ ID NO: 135715 - protein, 9 aa, Mycobacterium tuberculosis
TQRPRHSGI

SEQ ID NO: 135716 - protein, 9 aa, Mycobacterium tuberculosis
RPRHSGIRA

SEQ ID NO: 135717 - protein, 9 aa, Mycobacterium tuberculosis
SGIRAVGPY

SEQ ID NO: 135718 - protein, 9 aa, Mycobacterium tuberculosis
YAWAGRCGR

SEQ ID NO: 135719 - protein, 9 aa, Mycobacterium tuberculosis
AGRCGRIGR

SEQ ID NO: 135720 - protein, 9 aa, Mycobacterium tuberculosis
GRWGVHQEA

SEQ ID NO: 135721 - protein, 9 aa, Mycobacterium tuberculosis
WGVHQEAMM

SEQ ID NO: 135722 - protein, 9 aa, Mycobacterium tuberculosis
VHQEAMMNL

SEQ ID NO: 135723 - protein, 9 aa, Mycobacterium tuberculosis
HQEAMMNLA

SEQ ID NO: 135724 - protein, 9 aa, Mycobacterium tuberculosis
QEAMMNLAI

SEQ ID NO: 135725 - protein, 9 aa, Mycobacterium tuberculosis
EAMMNLAIW

SEQ ID NO: 135726 - protein, 9 aa, Mycobacterium tuberculosis
AMMNLAIWH

SEQ ID NO: 135727 - protein, 9 aa, Mycobacterium tuberculosis
MNLAIWHPR

SEQ ID NO: 135728 - protein, 9 aa, Mycobacterium tuberculosis
NLAIWHPRK

SEQ ID NO: 135729 - protein, 9 aa, Mycobacterium tuberculosis
LAIWHPRKV

SEQ ID NO: 135730 - protein, 9 aa, Mycobacterium tuberculosis
HPRKVQSAT

SEQ ID NO: 135731 - protein, 9 aa, Mycobacterium tuberculosis
KVQSATIYQ

SEQ ID NO: 135732 - protein, 9 aa, Mycobacterium tuberculosis
VQSATIYQV

SEQ ID NO: 135733 - protein, 9 aa, Mycobacterium tuberculosis
QSATIYQVT

SEQ ID NO: 135734 - protein, 9 aa, Mycobacterium tuberculosis
ATIYQVTDR

SEQ ID NO: 135735 - protein, 9 aa, Mycobacterium tuberculosis
RSHDGRTAR

SEQ ID NO: 135736 - protein, 9 aa, Mycobacterium tuberculosis
SHDGRTARV

SEQ ID NO: 135737 - protein, 9 aa, Mycobacterium tuberculosis
PGDEITSTV

SEQ ID NO: 135738 - protein, 9 aa, Mycobacterium tuberculosis
EITSTVSGW

SEQ ID NO: 135739 - protein, 9 aa, Mycobacterium tuberculosis
ITSTVSGWL

SEQ ID NO: 135740 - protein, 9 aa, Mycobacterium tuberculosis
TVSGWLSEL

SEQ ID NO: 135741 - protein, 9 aa, Mycobacterium tuberculosis
WLSELGTQS

SEQ ID NO: 135742 - protein, 9 aa, Mycobacterium tuberculosis
SELGTQSPL

SEQ ID NO: 135743 - protein, 9 aa, Mycobacterium tuberculosis
ELGTQSPLA

SEQ ID NO: 135744 - protein, 9 aa, Mycobacterium tuberculosis
TQSPLADEL

SEQ ID NO: 135745 - protein, 9 aa, Mycobacterium tuberculosis
PLADELARA

SEQ ID NO: 135746 - protein, 9 aa, Mycobacterium tuberculosis
LADELARAV

SEQ ID NO: 135747 - protein, 9 aa, Mycobacterium tuberculosis
AVRIGDWPA

SEQ ID NO: 135748 - protein, 9 aa, Mycobacterium tuberculosis
RIGDWPAAY

SEQ ID NO: 135749 - protein, 9 aa, Mycobacterium tuberculosis
AAYAIGEHL

SEQ ID NO: 135750 - protein, 9 aa, Mycobacterium tuberculosis
YAIGEHLSV

SEQ ID NO: 135751 - protein, 9 aa, Mycobacterium tuberculosis
HLSVEIAVA

SEQ ID NO: 135752 - protein, 9 aa, Mycobacterium tuberculosis
LSVEIAVAV

SEQ ID NO: 135753 - protein, 10 aa, Mycobacterium tuberculosis
STQRPRHSGI

SEQ ID NO: 135754 - protein, 10 aa, Mycobacterium tuberculosis
TQRPRHSGIR

SEQ ID NO: 135755 - protein, 10 aa, Mycobacterium tuberculosis
RPRHSGIRAV

SEQ ID NO: 135756 - protein, 10 aa, Mycobacterium tuberculosis
AVGPYAWAGR

SEQ ID NO: 135757 - protein, 10 aa, Mycobacterium tuberculosis
PYAWAGRCGR

SEQ ID NO: 135758 - protein, 10 aa, Mycobacterium tuberculosis
YAWAGRCGRI

SEQ ID NO: 135759 - protein, 10 aa, Mycobacterium tuberculosis
RCGRIGRWGV

SEQ ID NO: 135760 - protein, 10 aa, Mycobacterium tuberculosis
GRWGVHQEAM

SEQ ID NO: 135761 - protein, 10 aa, Mycobacterium tuberculosis
GVHQEAMMNL

SEQ ID NO: 135762 - protein, 10 aa, Mycobacterium tuberculosis
HQEAMMNLAI

SEQ ID NO: 135763 - protein, 10 aa, Mycobacterium tuberculosis
MMNLAIWHPR

SEQ ID NO: 135764 - protein, 10 aa, Mycobacterium tuberculosis
MNLAIWHPRK

SEQ ID NO: 135765 - protein, 10 aa, Mycobacterium tuberculosis
NLAIWHPRKV

SEQ ID NO: 135766 - protein, 10 aa, Mycobacterium tuberculosis
HPRKVQSATI

SEQ ID NO: 135767 - protein, 10 aa, Mycobacterium tuberculosis
KVQSATIYQV

SEQ ID NO: 135768 - protein, 10 aa, Mycobacterium tuberculosis
SATIYQVTDR

SEQ ID NO: 135769 - protein, 10 aa, Mycobacterium tuberculosis
QVTDRSHDGR

SEQ ID NO: 135770 - protein, 10 aa, Mycobacterium tuberculosis
RSHDGRTARV

SEQ ID NO: 135771 - protein, 10 aa, Mycobacterium tuberculosis
RTARVPGDEI

SEQ ID NO: 135772 - protein, 10 aa, Mycobacterium tuberculosis
VPGDEITSTV

SEQ ID NO: 135773 - protein, 10 aa, Mycobacterium tuberculosis
DEITSTVSGW

SEQ ID NO: 135774 - protein, 10 aa, Mycobacterium tuberculosis
EITSTVSGWL

SEQ ID NO: 135775 - protein, 10 aa, Mycobacterium tuberculosis
STVSGWLSEL

SEQ ID NO: 135776 - protein, 10 aa, Mycobacterium tuberculosis
WLSELGTQSP

SEQ ID NO: 135777 - protein, 10 aa, Mycobacterium tuberculosis
TQSPLADELA

SEQ ID NO: 135778 - protein, 10 aa, Mycobacterium tuberculosis
QSPLADELAR

SEQ ID NO: 135779 - protein, 10 aa, Mycobacterium tuberculosis
PLADELARAV

SEQ ID NO: 135780 - protein, 10 aa, Mycobacterium tuberculosis
LARAVRIGDW

SEQ ID NO: 135781 - protein, 10 aa, Mycobacterium tuberculosis
RAVRIGDWPA

SEQ ID NO: 135782 - protein, 10 aa, Mycobacterium tuberculosis
AVRIGDWPAA

SEQ ID NO: 135783 - protein, 10 aa, Mycobacterium tuberculosis
VRIGDWPAAY

SEQ ID NO: 135784 - protein, 10 aa, Mycobacterium tuberculosis
RIGDWPAAYA

SEQ ID NO: 135785 - protein, 10 aa, Mycobacterium tuberculosis
WPAAYAIGEH

SEQ ID NO: 135786 - protein, 10 aa, Mycobacterium tuberculosis
AYAIGEHLSV

SEQ ID NO: 135787 - protein, 10 aa, Mycobacterium tuberculosis
AIGEHLSVEI

SEQ ID NO: 135788 - protein, 10 aa, Mycobacterium tuberculosis
GEHLSVEIAV

SEQ ID NO: 135789 - protein, 10 aa, Mycobacterium tuberculosis
HLSVEIAVAV

SEQ ID NO: 135790 - protein, 11 aa, Mycobacterium tuberculosis
MSTQRPRHSGI

SEQ ID NO: 135791 - protein, 11 aa, Mycobacterium tuberculosis
STQRPRHSGIR

SEQ ID NO: 135792 - protein, 11 aa, Mycobacterium tuberculosis
RPRHSGIRAVG

SEQ ID NO: 135793 - protein, 11 aa, Mycobacterium tuberculosis
SGIRAVGPYAW

SEQ ID NO: 135794 - protein, 11 aa, Mycobacterium tuberculosis
GIRAVGPYAWA

SEQ ID NO: 135795 - protein, 11 aa, Mycobacterium tuberculosis
RAVGPYAWAGR

SEQ ID NO: 135796 - protein, 11 aa, Mycobacterium tuberculosis
PYAWAGRCGRI

SEQ ID NO: 135797 - protein, 11 aa, Mycobacterium tuberculosis
RIGRWGVHQEA

SEQ ID NO: 135798 - protein, 11 aa, Mycobacterium tuberculosis
GRWGVHQEAMM

SEQ ID NO: 135799 - protein, 11 aa, Mycobacterium tuberculosis
AMMNLAIWHPR

SEQ ID NO: 135800 - protein, 11 aa, Mycobacterium tuberculosis
MMNLAIWHPRK

SEQ ID NO: 135801 - protein, 11 aa, Mycobacterium tuberculosis
AIWHPRKVQSA

SEQ ID NO: 135802 - protein, 11 aa, Mycobacterium tuberculosis
HPRKVQSATIY

SEQ ID NO: 135803 - protein, 11 aa, Mycobacterium tuberculosis
RKVQSATIYQV

SEQ ID NO: 135804 - protein, 11 aa, Mycobacterium tuberculosis
QSATIYQVTDR

SEQ ID NO: 135805 - protein, 11 aa, Mycobacterium tuberculosis
YQVTDRSHDGR

SEQ ID NO: 135806 - protein, 11 aa, Mycobacterium tuberculosis
RVPGDEITSTV

SEQ ID NO: 135807 - protein, 11 aa, Mycobacterium tuberculosis
DEITSTVSGWL

SEQ ID NO: 135808 - protein, 11 aa, Mycobacterium tuberculosis
WLSELGTQSPL

SEQ ID NO: 135809 - protein, 11 aa, Mycobacterium tuberculosis
SPLADELARAV

SEQ ID NO: 135810 - protein, 11 aa, Mycobacterium tuberculosis
RAVRIGDWPAA

SEQ ID NO: 135811 - protein, 11 aa, Mycobacterium tuberculosis
AVRIGDWPAAY

SEQ ID NO: 135812 - protein, 11 aa, Mycobacterium tuberculosis
RIGDWPAAYAI

SEQ ID NO: 135813 - protein, 11 aa, Mycobacterium tuberculosis
WPAAYAIGEHL

SEQ ID NO: 135814 - protein, 11 aa, Mycobacterium tuberculosis
AAYAIGEHLSV

SEQ ID NO: 135815 - protein, 11 aa, Mycobacterium tuberculosis
YAIGEHLSVEI

SEQ ID NO: 135816 - protein, 11 aa, Mycobacterium tuberculosis
AIGEHLSVEIA

SEQ ID NO: 135817 - protein, 13 aa, Mycobacterium tuberculosis
MSTQRPRHSGIRA

SEQ ID NO: 135818 - protein, 13 aa, Mycobacterium tuberculosis
STQRPRHSGIRAV

SEQ ID NO: 135819 - protein, 13 aa, Mycobacterium tuberculosis
TQRPRHSGIRAVG

SEQ ID NO: 135820 - protein, 13 aa, Mycobacterium tuberculosis
QRPRHSGIRAVGP

SEQ ID NO: 135821 - protein, 13 aa, Mycobacterium tuberculosis
RPRHSGIRAVGPY

SEQ ID NO: 135822 - protein, 13 aa, Mycobacterium tuberculosis
PRHSGIRAVGPYA

SEQ ID NO: 135823 - protein, 13 aa, Mycobacterium tuberculosis
RHSGIRAVGPYAW

SEQ ID NO: 135824 - protein, 13 aa, Mycobacterium tuberculosis
HSGIRAVGPYAWA

SEQ ID NO: 135825 - protein, 13 aa, Mycobacterium tuberculosis
SGIRAVGPYAWAG

SEQ ID NO: 135826 - protein, 13 aa, Mycobacterium tuberculosis
GIRAVGPYAWAGR

SEQ ID NO: 135827 - protein, 13 aa, Mycobacterium tuberculosis
IRAVGPYAWAGRC

SEQ ID NO: 135828 - protein, 13 aa, Mycobacterium tuberculosis
RAVGPYAWAGRCG

SEQ ID NO: 135829 - protein, 13 aa, Mycobacterium tuberculosis
AVGPYAWAGRCGR

SEQ ID NO: 135830 - protein, 13 aa, Mycobacterium tuberculosis
VGPYAWAGRCGRI

SEQ ID NO: 135831 - protein, 13 aa, Mycobacterium tuberculosis
GPYAWAGRCGRIG

SEQ ID NO: 135832 - protein, 13 aa, Mycobacterium tuberculosis
PYAWAGRCGRIGR

SEQ ID NO: 135833 - protein, 13 aa, Mycobacterium tuberculosis
YAWAGRCGRIGRW

SEQ ID NO: 135834 - protein, 13 aa, Mycobacterium tuberculosis
AWAGRCGRIGRWG

SEQ ID NO: 135835 - protein, 13 aa, Mycobacterium tuberculosis
WAGRCGRIGRWGV

SEQ ID NO: 135836 - protein, 13 aa, Mycobacterium tuberculosis
AGRCGRIGRWGVH

SEQ ID NO: 135837 - protein, 13 aa, Mycobacterium tuberculosis
GRCGRIGRWGVHQ

SEQ ID NO: 135838 - protein, 13 aa, Mycobacterium tuberculosis
RCGRIGRWGVHQE

SEQ ID NO: 135839 - protein, 13 aa, Mycobacterium tuberculosis
CGRIGRWGVHQEA

SEQ ID NO: 135840 - protein, 13 aa, Mycobacterium tuberculosis
GRIGRWGVHQEAM

SEQ ID NO: 135841 - protein, 13 aa, Mycobacterium tuberculosis
RIGRWGVHQEAMM

SEQ ID NO: 135842 - protein, 13 aa, Mycobacterium tuberculosis
IGRWGVHQEAMMN

SEQ ID NO: 135843 - protein, 13 aa, Mycobacterium tuberculosis
GRWGVHQEAMMNL

SEQ ID NO: 135844 - protein, 13 aa, Mycobacterium tuberculosis
RWGVHQEAMMNLA

SEQ ID NO: 135845 - protein, 13 aa, Mycobacterium tuberculosis
WGVHQEAMMNLAI

SEQ ID NO: 135846 - protein, 13 aa, Mycobacterium tuberculosis
GVHQEAMMNLAIW

SEQ ID NO: 135847 - protein, 13 aa, Mycobacterium tuberculosis
VHQEAMMNLAIWH

SEQ ID NO: 135848 - protein, 13 aa, Mycobacterium tuberculosis
HQEAMMNLAIWHP

SEQ ID NO: 135849 - protein, 13 aa, Mycobacterium tuberculosis
QEAMMNLAIWHPR

SEQ ID NO: 135850 - protein, 13 aa, Mycobacterium tuberculosis
EAMMNLAIWHPRK

SEQ ID NO: 135851 - protein, 13 aa, Mycobacterium tuberculosis
AMMNLAIWHPRKV

SEQ ID NO: 135852 - protein, 13 aa, Mycobacterium tuberculosis
MMNLAIWHPRKVQ

SEQ ID NO: 135853 - protein, 13 aa, Mycobacterium tuberculosis
MNLAIWHPRKVQS

SEQ ID NO: 135854 - protein, 13 aa, Mycobacterium tuberculosis
NLAIWHPRKVQSA

SEQ ID NO: 135855 - protein, 13 aa, Mycobacterium tuberculosis
LAIWHPRKVQSAT

SEQ ID NO: 135856 - protein, 13 aa, Mycobacterium tuberculosis
AIWHPRKVQSATI

SEQ ID NO: 135857 - protein, 13 aa, Mycobacterium tuberculosis
IWHPRKVQSATIY

SEQ ID NO: 135858 - protein, 13 aa, Mycobacterium tuberculosis
WHPRKVQSATIYQ

SEQ ID NO: 135859 - protein, 13 aa, Mycobacterium tuberculosis
HPRKVQSATIYQV

SEQ ID NO: 135860 - protein, 13 aa, Mycobacterium tuberculosis
PRKVQSATIYQVT

SEQ ID NO: 135861 - protein, 13 aa, Mycobacterium tuberculosis
RKVQSATIYQVTD

SEQ ID NO: 135862 - protein, 13 aa, Mycobacterium tuberculosis
KVQSATIYQVTDR

SEQ ID NO: 135863 - protein, 13 aa, Mycobacterium tuberculosis
VQSATIYQVTDRS

SEQ ID NO: 135864 - protein, 13 aa, Mycobacterium tuberculosis
QSATIYQVTDRSH

SEQ ID NO: 135865 - protein, 13 aa, Mycobacterium tuberculosis
SATIYQVTDRSHD

SEQ ID NO: 135866 - protein, 13 aa, Mycobacterium tuberculosis
ATIYQVTDRSHDG

SEQ ID NO: 135867 - protein, 13 aa, Mycobacterium tuberculosis
TIYQVTDRSHDGR

SEQ ID NO: 135868 - protein, 13 aa, Mycobacterium tuberculosis
IYQVTDRSHDGRT

SEQ ID NO: 135869 - protein, 13 aa, Mycobacterium tuberculosis
YQVTDRSHDGRTA

SEQ ID NO: 135870 - protein, 13 aa, Mycobacterium tuberculosis
QVTDRSHDGRTAR

SEQ ID NO: 135871 - protein, 13 aa, Mycobacterium tuberculosis
VTDRSHDGRTARV

SEQ ID NO: 135872 - protein, 13 aa, Mycobacterium tuberculosis
TDRSHDGRTARVP

SEQ ID NO: 135873 - protein, 13 aa, Mycobacterium tuberculosis
DRSHDGRTARVPG

SEQ ID NO: 135874 - protein, 13 aa, Mycobacterium tuberculosis
RSHDGRTARVPGD

SEQ ID NO: 135875 - protein, 13 aa, Mycobacterium tuberculosis
SHDGRTARVPGDE

SEQ ID NO: 135876 - protein, 13 aa, Mycobacterium tuberculosis
HDGRTARVPGDEI

SEQ ID NO: 135877 - protein, 13 aa, Mycobacterium tuberculosis
DGRTARVPGDEIT

SEQ ID NO: 135878 - protein, 13 aa, Mycobacterium tuberculosis
GRTARVPGDEITS

SEQ ID NO: 135879 - protein, 13 aa, Mycobacterium tuberculosis
RTARVPGDEITST

SEQ ID NO: 135880 - protein, 13 aa, Mycobacterium tuberculosis
TARVPGDEITSTV

SEQ ID NO: 135881 - protein, 13 aa, Mycobacterium tuberculosis
ARVPGDEITSTVS

SEQ ID NO: 135882 - protein, 13 aa, Mycobacterium tuberculosis
RVPGDEITSTVSG

SEQ ID NO: 135883 - protein, 13 aa, Mycobacterium tuberculosis
VPGDEITSTVSGW

SEQ ID NO: 135884 - protein, 13 aa, Mycobacterium tuberculosis
PGDEITSTVSGWL

SEQ ID NO: 135885 - protein, 13 aa, Mycobacterium tuberculosis
GDEITSTVSGWLS

SEQ ID NO: 135886 - protein, 13 aa, Mycobacterium tuberculosis
DEITSTVSGWLSE

SEQ ID NO: 135887 - protein, 13 aa, Mycobacterium tuberculosis
EITSTVSGWLSEL

SEQ ID NO: 135888 - protein, 13 aa, Mycobacterium tuberculosis
ITSTVSGWLSELG

SEQ ID NO: 135889 - protein, 13 aa, Mycobacterium tuberculosis
TSTVSGWLSELGT

SEQ ID NO: 135890 - protein, 13 aa, Mycobacterium tuberculosis
STVSGWLSELGTQ

SEQ ID NO: 135891 - protein, 13 aa, Mycobacterium tuberculosis
TVSGWLSELGTQS

SEQ ID NO: 135892 - protein, 13 aa, Mycobacterium tuberculosis
VSGWLSELGTQSP

SEQ ID NO: 135893 - protein, 13 aa, Mycobacterium tuberculosis
SGWLSELGTQSPL

SEQ ID NO: 135894 - protein, 13 aa, Mycobacterium tuberculosis
GWLSELGTQSPLA

SEQ ID NO: 135895 - protein, 13 aa, Mycobacterium tuberculosis
WLSELGTQSPLAD

SEQ ID NO: 135896 - protein, 13 aa, Mycobacterium tuberculosis
LSELGTQSPLADE

SEQ ID NO: 135897 - protein, 13 aa, Mycobacterium tuberculosis
SELGTQSPLADEL

SEQ ID NO: 135898 - protein, 13 aa, Mycobacterium tuberculosis
ELGTQSPLADELA

SEQ ID NO: 135899 - protein, 13 aa, Mycobacterium tuberculosis
LGTQSPLADELAR

SEQ ID NO: 135900 - protein, 13 aa, Mycobacterium tuberculosis
GTQSPLADELARA

SEQ ID NO: 135901 - protein, 13 aa, Mycobacterium tuberculosis
TQSPLADELARAV

SEQ ID NO: 135902 - protein, 13 aa, Mycobacterium tuberculosis
QSPLADELARAVR

SEQ ID NO: 135903 - protein, 13 aa, Mycobacterium tuberculosis
SPLADELARAVRI

SEQ ID NO: 135904 - protein, 13 aa, Mycobacterium tuberculosis
PLADELARAVRIG

SEQ ID NO: 135905 - protein, 13 aa, Mycobacterium tuberculosis
LADELARAVRIGD

SEQ ID NO: 135906 - protein, 13 aa, Mycobacterium tuberculosis
ADELARAVRIGDW

SEQ ID NO: 135907 - protein, 13 aa, Mycobacterium tuberculosis
DELARAVRIGDWP

SEQ ID NO: 135908 - protein, 13 aa, Mycobacterium tuberculosis
ELARAVRIGDWPA

SEQ ID NO: 135909 - protein, 13 aa, Mycobacterium tuberculosis
LARAVRIGDWPAA

SEQ ID NO: 135910 - protein, 13 aa, Mycobacterium tuberculosis
ARAVRIGDWPAAY

SEQ ID NO: 135911 - protein, 13 aa, Mycobacterium tuberculosis
RAVRIGDWPAAYA

SEQ ID NO: 135912 - protein, 13 aa, Mycobacterium tuberculosis
AVRIGDWPAAYAI

SEQ ID NO: 135913 - protein, 13 aa, Mycobacterium tuberculosis
VRIGDWPAAYAIG

SEQ ID NO: 135914 - protein, 13 aa, Mycobacterium tuberculosis
RIGDWPAAYAIGE

SEQ ID NO: 135915 - protein, 13 aa, Mycobacterium tuberculosis
IGDWPAAYAIGEH

SEQ ID NO: 135916 - protein, 13 aa, Mycobacterium tuberculosis
GDWPAAYAIGEHL

SEQ ID NO: 135917 - protein, 13 aa, Mycobacterium tuberculosis
DWPAAYAIGEHLS

SEQ ID NO: 135918 - protein, 13 aa, Mycobacterium tuberculosis
WPAAYAIGEHLSV

SEQ ID NO: 135919 - protein, 13 aa, Mycobacterium tuberculosis
PAAYAIGEHLSVE

SEQ ID NO: 135920 - protein, 13 aa, Mycobacterium tuberculosis
AAYAIGEHLSVEI

SEQ ID NO: 135921 - protein, 13 aa, Mycobacterium tuberculosis
AYAIGEHLSVEIA

SEQ ID NO: 135922 - protein, 13 aa, Mycobacterium tuberculosis
YAIGEHLSVEIAV

SEQ ID NO: 135923 - protein, 13 aa, Mycobacterium tuberculosis
AIGEHLSVEIAVA

SEQ ID NO: 135924 - protein, 13 aa, Mycobacterium tuberculosis
IGEHLSVEIAVAV

SEQ ID NO: 135925 - protein, 14 aa, Mycobacterium tuberculosis
MSTQRPRHSGIRAV

SEQ ID NO: 135926 - protein, 14 aa, Mycobacterium tuberculosis
STQRPRHSGIRAVG

SEQ ID NO: 135927 - protein, 14 aa, Mycobacterium tuberculosis
TQRPRHSGIRAVGP

SEQ ID NO: 135928 - protein, 14 aa, Mycobacterium tuberculosis
QRPRHSGIRAVGPY

SEQ ID NO: 135929 - protein, 14 aa, Mycobacterium tuberculosis
RPRHSGIRAVGPYA

SEQ ID NO: 135930 - protein, 14 aa, Mycobacterium tuberculosis
PRHSGIRAVGPYAW

SEQ ID NO: 135931 - protein, 14 aa, Mycobacterium tuberculosis
RHSGIRAVGPYAWA

SEQ ID NO: 135932 - protein, 14 aa, Mycobacterium tuberculosis
HSGIRAVGPYAWAG

SEQ ID NO: 135933 - protein, 14 aa, Mycobacterium tuberculosis
SGIRAVGPYAWAGR

SEQ ID NO: 135934 - protein, 14 aa, Mycobacterium tuberculosis
GIRAVGPYAWAGRC

SEQ ID NO: 135935 - protein, 14 aa, Mycobacterium tuberculosis
IRAVGPYAWAGRCG

SEQ ID NO: 135936 - protein, 14 aa, Mycobacterium tuberculosis
RAVGPYAWAGRCGR

SEQ ID NO: 135937 - protein, 14 aa, Mycobacterium tuberculosis
AVGPYAWAGRCGRI

SEQ ID NO: 135938 - protein, 14 aa, Mycobacterium tuberculosis
VGPYAWAGRCGRIG

SEQ ID NO: 135939 - protein, 14 aa, Mycobacterium tuberculosis
GPYAWAGRCGRIGR

SEQ ID NO: 135940 - protein, 14 aa, Mycobacterium tuberculosis
PYAWAGRCGRIGRW

SEQ ID NO: 135941 - protein, 14 aa, Mycobacterium tuberculosis
YAWAGRCGRIGRWG

SEQ ID NO: 135942 - protein, 14 aa, Mycobacterium tuberculosis
AWAGRCGRIGRWGV

SEQ ID NO: 135943 - protein, 14 aa, Mycobacterium tuberculosis
WAGRCGRIGRWGVH

SEQ ID NO: 135944 - protein, 14 aa, Mycobacterium tuberculosis
AGRCGRIGRWGVHQ

SEQ ID NO: 135945 - protein, 14 aa, Mycobacterium tuberculosis
GRCGRIGRWGVHQE

SEQ ID NO: 135946 - protein, 14 aa, Mycobacterium tuberculosis
RCGRIGRWGVHQEA

SEQ ID NO: 135947 - protein, 14 aa, Mycobacterium tuberculosis
CGRIGRWGVHQEAM

SEQ ID NO: 135948 - protein, 14 aa, Mycobacterium tuberculosis
GRIGRWGVHQEAMM

SEQ ID NO: 135949 - protein, 14 aa, Mycobacterium tuberculosis
RIGRWGVHQEAMMN

SEQ ID NO: 135950 - protein, 14 aa, Mycobacterium tuberculosis
IGRWGVHQEAMMNL

SEQ ID NO: 135951 - protein, 14 aa, Mycobacterium tuberculosis
GRWGVHQEAMMNLA

SEQ ID NO: 135952 - protein, 14 aa, Mycobacterium tuberculosis
RWGVHQEAMMNLAI

SEQ ID NO: 135953 - protein, 14 aa, Mycobacterium tuberculosis
WGVHQEAMMNLAIW

SEQ ID NO: 135954 - protein, 14 aa, Mycobacterium tuberculosis
GVHQEAMMNLAIWH

SEQ ID NO: 135955 - protein, 14 aa, Mycobacterium tuberculosis
VHQEAMMNLAIWHP

SEQ ID NO: 135956 - protein, 14 aa, Mycobacterium tuberculosis
HQEAMMNLAIWHPR

SEQ ID NO: 135957 - protein, 14 aa, Mycobacterium tuberculosis
QEAMMNLAIWHPRK

SEQ ID NO: 135958 - protein, 14 aa, Mycobacterium tuberculosis
EAMMNLAIWHPRKV

SEQ ID NO: 135959 - protein, 14 aa, Mycobacterium tuberculosis
AMMNLAIWHPRKVQ

SEQ ID NO: 135960 - protein, 14 aa, Mycobacterium tuberculosis
MMNLAIWHPRKVQS

SEQ ID NO: 135961 - protein, 14 aa, Mycobacterium tuberculosis
MNLAIWHPRKVQSA

SEQ ID NO: 135962 - protein, 14 aa, Mycobacterium tuberculosis
NLAIWHPRKVQSAT

SEQ ID NO: 135963 - protein, 14 aa, Mycobacterium tuberculosis
LAIWHPRKVQSATI

SEQ ID NO: 135964 - protein, 14 aa, Mycobacterium tuberculosis
AIWHPRKVQSATIY

SEQ ID NO: 135965 - protein, 14 aa, Mycobacterium tuberculosis
IWHPRKVQSATIYQ

SEQ ID NO: 135966 - protein, 14 aa, Mycobacterium tuberculosis
WHPRKVQSATIYQV

SEQ ID NO: 135967 - protein, 14 aa, Mycobacterium tuberculosis
HPRKVQSATIYQVT

SEQ ID NO: 135968 - protein, 14 aa, Mycobacterium tuberculosis
PRKVQSATIYQVTD

SEQ ID NO: 135969 - protein, 14 aa, Mycobacterium tuberculosis
RKVQSATIYQVTDR

SEQ ID NO: 135970 - protein, 14 aa, Mycobacterium tuberculosis
KVQSATIYQVTDRS

SEQ ID NO: 135971 - protein, 14 aa, Mycobacterium tuberculosis
VQSATIYQVTDRSH

SEQ ID NO: 135972 - protein, 14 aa, Mycobacterium tuberculosis
QSATIYQVTDRSHD

SEQ ID NO: 135973 - protein, 14 aa, Mycobacterium tuberculosis
SATIYQVTDRSHDG

SEQ ID NO: 135974 - protein, 14 aa, Mycobacterium tuberculosis
ATIYQVTDRSHDGR

SEQ ID NO: 135975 - protein, 14 aa, Mycobacterium tuberculosis
TIYQVTDRSHDGRT

SEQ ID NO: 135976 - protein, 14 aa, Mycobacterium tuberculosis
IYQVTDRSHDGRTA

SEQ ID NO: 135977 - protein, 14 aa, Mycobacterium tuberculosis
YQVTDRSHDGRTAR

SEQ ID NO: 135978 - protein, 14 aa, Mycobacterium tuberculosis
QVTDRSHDGRTARV

SEQ ID NO: 135979 - protein, 14 aa, Mycobacterium tuberculosis
VTDRSHDGRTARVP

SEQ ID NO: 135980 - protein, 14 aa, Mycobacterium tuberculosis
TDRSHDGRTARVPG

SEQ ID NO: 135981 - protein, 14 aa, Mycobacterium tuberculosis
DRSHDGRTARVPGD

SEQ ID NO: 135982 - protein, 14 aa, Mycobacterium tuberculosis
RSHDGRTARVPGDE

SEQ ID NO: 135983 - protein, 14 aa, Mycobacterium tuberculosis
SHDGRTARVPGDEI

SEQ ID NO: 135984 - protein, 14 aa, Mycobacterium tuberculosis
HDGRTARVPGDEIT

SEQ ID NO: 135985 - protein, 14 aa, Mycobacterium tuberculosis
DGRTARVPGDEITS

SEQ ID NO: 135986 - protein, 14 aa, Mycobacterium tuberculosis
GRTARVPGDEITST

SEQ ID NO: 135987 - protein, 14 aa, Mycobacterium tuberculosis
RTARVPGDEITSTV

SEQ ID NO: 135988 - protein, 14 aa, Mycobacterium tuberculosis
TARVPGDEITSTVS

SEQ ID NO: 135989 - protein, 14 aa, Mycobacterium tuberculosis
ARVPGDEITSTVSG

SEQ ID NO: 135990 - protein, 14 aa, Mycobacterium tuberculosis
RVPGDEITSTVSGW

SEQ ID NO: 135991 - protein, 14 aa, Mycobacterium tuberculosis
VPGDEITSTVSGWL

SEQ ID NO: 135992 - protein, 14 aa, Mycobacterium tuberculosis
PGDEITSTVSGWLS

SEQ ID NO: 135993 - protein, 14 aa, Mycobacterium tuberculosis
GDEITSTVSGWLSE

SEQ ID NO: 135994 - protein, 14 aa, Mycobacterium tuberculosis
DEITSTVSGWLSEL

SEQ ID NO: 135995 - protein, 14 aa, Mycobacterium tuberculosis
EITSTVSGWLSELG

SEQ ID NO: 135996 - protein, 14 aa, Mycobacterium tuberculosis
ITSTVSGWLSELGT

SEQ ID NO: 135997 - protein, 14 aa, Mycobacterium tuberculosis
TSTVSGWLSELGTQ

SEQ ID NO: 135998 - protein, 14 aa, Mycobacterium tuberculosis
STVSGWLSELGTQS

SEQ ID NO: 135999 - protein, 14 aa, Mycobacterium tuberculosis
TVSGWLSELGTQSP

SEQ ID NO: 136000 - protein, 14 aa, Mycobacterium tuberculosis
VSGWLSELGTQSPL

SEQ ID NO: 136001 - protein, 14 aa, Mycobacterium tuberculosis
SGWLSELGTQSPLA

SEQ ID NO: 136002 - protein, 14 aa, Mycobacterium tuberculosis
GWLSELGTQSPLAD

SEQ ID NO: 136003 - protein, 14 aa, Mycobacterium tuberculosis
WLSELGTQSPLADE

SEQ ID NO: 136004 - protein, 14 aa, Mycobacterium tuberculosis
LSELGTQSPLADEL

SEQ ID NO: 136005 - protein, 14 aa, Mycobacterium tuberculosis
SELGTQSPLADELA

SEQ ID NO: 136006 - protein, 14 aa, Mycobacterium tuberculosis
ELGTQSPLADELAR

SEQ ID NO: 136007 - protein, 14 aa, Mycobacterium tuberculosis
LGTQSPLADELARA

SEQ ID NO: 136008 - protein, 14 aa, Mycobacterium tuberculosis
GTQSPLADELARAV

SEQ ID NO: 136009 - protein, 14 aa, Mycobacterium tuberculosis
TQSPLADELARAVR

SEQ ID NO: 136010 - protein, 14 aa, Mycobacterium tuberculosis
QSPLADELARAVRI

SEQ ID NO: 136011 - protein, 14 aa, Mycobacterium tuberculosis
SPLADELARAVRIG

SEQ ID NO: 136012 - protein, 14 aa, Mycobacterium tuberculosis
PLADELARAVRIGD

SEQ ID NO: 136013 - protein, 14 aa, Mycobacterium tuberculosis
LADELARAVRIGDW

SEQ ID NO: 136014 - protein, 14 aa, Mycobacterium tuberculosis
ADELARAVRIGDWP

SEQ ID NO: 136015 - protein, 14 aa, Mycobacterium tuberculosis
DELARAVRIGDWPA

SEQ ID NO: 136016 - protein, 14 aa, Mycobacterium tuberculosis
ELARAVRIGDWPAA

SEQ ID NO: 136017 - protein, 14 aa, Mycobacterium tuberculosis
LARAVRIGDWPAAY

SEQ ID NO: 136018 - protein, 14 aa, Mycobacterium tuberculosis
ARAVRIGDWPAAYA

SEQ ID NO: 136019 - protein, 14 aa, Mycobacterium tuberculosis
RAVRIGDWPAAYAI

SEQ ID NO: 136020 - protein, 14 aa, Mycobacterium tuberculosis
AVRIGDWPAAYAIG

SEQ ID NO: 136021 - protein, 14 aa, Mycobacterium tuberculosis
VRIGDWPAAYAIGE

SEQ ID NO: 136022 - protein, 14 aa, Mycobacterium tuberculosis
RIGDWPAAYAIGEH

SEQ ID NO: 136023 - protein, 14 aa, Mycobacterium tuberculosis
IGDWPAAYAIGEHL

SEQ ID NO: 136024 - protein, 14 aa, Mycobacterium tuberculosis
GDWPAAYAIGEHLS

SEQ ID NO: 136025 - protein, 14 aa, Mycobacterium tuberculosis
DWPAAYAIGEHLSV

SEQ ID NO: 136026 - protein, 14 aa, Mycobacterium tuberculosis
WPAAYAIGEHLSVE

SEQ ID NO: 136027 - protein, 14 aa, Mycobacterium tuberculosis
PAAYAIGEHLSVEI

SEQ ID NO: 136028 - protein, 14 aa, Mycobacterium tuberculosis
AAYAIGEHLSVEIA

SEQ ID NO: 136029 - protein, 14 aa, Mycobacterium tuberculosis
AYAIGEHLSVEIAV

SEQ ID NO: 136030 - protein, 14 aa, Mycobacterium tuberculosis
YAIGEHLSVEIAVA

SEQ ID NO: 136031 - protein, 14 aa, Mycobacterium tuberculosis
AIGEHLSVEIAVAV

SEQ ID NO: 136032 - protein, 15 aa, Mycobacterium tuberculosis
MSTQRPRHSGIRAVG

SEQ ID NO: 136033 - protein, 15 aa, Mycobacterium tuberculosis
STQRPRHSGIRAVGP

SEQ ID NO: 136034 - protein, 15 aa, Mycobacterium tuberculosis
TQRPRHSGIRAVGPY

SEQ ID NO: 136035 - protein, 15 aa, Mycobacterium tuberculosis
QRPRHSGIRAVGPYA

SEQ ID NO: 136036 - protein, 15 aa, Mycobacterium tuberculosis
RPRHSGIRAVGPYAW

SEQ ID NO: 136037 - protein, 15 aa, Mycobacterium tuberculosis
PRHSGIRAVGPYAWA

SEQ ID NO: 136038 - protein, 15 aa, Mycobacterium tuberculosis
RHSGIRAVGPYAWAG

SEQ ID NO: 136039 - protein, 15 aa, Mycobacterium tuberculosis
HSGIRAVGPYAWAGR

SEQ ID NO: 136040 - protein, 15 aa, Mycobacterium tuberculosis
SGIRAVGPYAWAGRC

SEQ ID NO: 136041 - protein, 15 aa, Mycobacterium tuberculosis
GIRAVGPYAWAGRCG

SEQ ID NO: 136042 - protein, 15 aa, Mycobacterium tuberculosis
IRAVGPYAWAGRCGR

SEQ ID NO: 136043 - protein, 15 aa, Mycobacterium tuberculosis
RAVGPYAWAGRCGRI

SEQ ID NO: 136044 - protein, 15 aa, Mycobacterium tuberculosis
AVGPYAWAGRCGRIG

SEQ ID NO: 136045 - protein, 15 aa, Mycobacterium tuberculosis
VGPYAWAGRCGRIGR

SEQ ID NO: 136046 - protein, 15 aa, Mycobacterium tuberculosis
GPYAWAGRCGRIGRW

SEQ ID NO: 136047 - protein, 15 aa, Mycobacterium tuberculosis
PYAWAGRCGRIGRWG

SEQ ID NO: 136048 - protein, 15 aa, Mycobacterium tuberculosis
YAWAGRCGRIGRWGV

SEQ ID NO: 136049 - protein, 15 aa, Mycobacterium tuberculosis
AWAGRCGRIGRWGVH

SEQ ID NO: 136050 - protein, 15 aa, Mycobacterium tuberculosis
WAGRCGRIGRWGVHQ

SEQ ID NO: 136051 - protein, 15 aa, Mycobacterium tuberculosis
AGRCGRIGRWGVHQE

SEQ ID NO: 136052 - protein, 15 aa, Mycobacterium tuberculosis
GRCGRIGRWGVHQEA

SEQ ID NO: 136053 - protein, 15 aa, Mycobacterium tuberculosis
RCGRIGRWGVHQEAM

SEQ ID NO: 136054 - protein, 15 aa, Mycobacterium tuberculosis
CGRIGRWGVHQEAMM

SEQ ID NO: 136055 - protein, 15 aa, Mycobacterium tuberculosis
GRIGRWGVHQEAMMN

SEQ ID NO: 136056 - protein, 15 aa, Mycobacterium tuberculosis
RIGRWGVHQEAMMNL

SEQ ID NO: 136057 - protein, 15 aa, Mycobacterium tuberculosis
IGRWGVHQEAMMNLA

SEQ ID NO: 136058 - protein, 15 aa, Mycobacterium tuberculosis
GRWGVHQEAMMNLAI

SEQ ID NO: 136059 - protein, 15 aa, Mycobacterium tuberculosis
RWGVHQEAMMNLAIW

SEQ ID NO: 136060 - protein, 15 aa, Mycobacterium tuberculosis
WGVHQEAMMNLAIWH

SEQ ID NO: 136061 - protein, 15 aa, Mycobacterium tuberculosis
GVHQEAMMNLAIWHP

SEQ ID NO: 136062 - protein, 15 aa, Mycobacterium tuberculosis
VHQEAMMNLAIWHPR

SEQ ID NO: 136063 - protein, 15 aa, Mycobacterium tuberculosis
HQEAMMNLAIWHPRK

SEQ ID NO: 136064 - protein, 15 aa, Mycobacterium tuberculosis
QEAMMNLAIWHPRKV

SEQ ID NO: 136065 - protein, 15 aa, Mycobacterium tuberculosis
EAMMNLAIWHPRKVQ

SEQ ID NO: 136066 - protein, 15 aa, Mycobacterium tuberculosis
AMMNLAIWHPRKVQS

SEQ ID NO: 136067 - protein, 15 aa, Mycobacterium tuberculosis
MMNLAIWHPRKVQSA

SEQ ID NO: 136068 - protein, 15 aa, Mycobacterium tuberculosis
MNLAIWHPRKVQSAT

SEQ ID NO: 136069 - protein, 15 aa, Mycobacterium tuberculosis
NLAIWHPRKVQSATI

SEQ ID NO: 136070 - protein, 15 aa, Mycobacterium tuberculosis
LAIWHPRKVQSATIY

SEQ ID NO: 136071 - protein, 15 aa, Mycobacterium tuberculosis
AIWHPRKVQSATIYQ

SEQ ID NO: 136072 - protein, 15 aa, Mycobacterium tuberculosis
IWHPRKVQSATIYQV

SEQ ID NO: 136073 - protein, 15 aa, Mycobacterium tuberculosis
WHPRKVQSATIYQVT

SEQ ID NO: 136074 - protein, 15 aa, Mycobacterium tuberculosis
HPRKVQSATIYQVTD

SEQ ID NO: 136075 - protein, 15 aa, Mycobacterium tuberculosis
PRKVQSATIYQVTDR

SEQ ID NO: 136076 - protein, 15 aa, Mycobacterium tuberculosis
RKVQSATIYQVTDRS

SEQ ID NO: 136077 - protein, 15 aa, Mycobacterium tuberculosis
KVQSATIYQVTDRSH

SEQ ID NO: 136078 - protein, 15 aa, Mycobacterium tuberculosis
VQSATIYQVTDRSHD

SEQ ID NO: 136079 - protein, 15 aa, Mycobacterium tuberculosis
QSATIYQVTDRSHDG

SEQ ID NO: 136080 - protein, 15 aa, Mycobacterium tuberculosis
SATIYQVTDRSHDGR

SEQ ID NO: 136081 - protein, 15 aa, Mycobacterium tuberculosis
ATIYQVTDRSHDGRT

SEQ ID NO: 136082 - protein, 15 aa, Mycobacterium tuberculosis
TIYQVTDRSHDGRTA

SEQ ID NO: 136083 - protein, 15 aa, Mycobacterium tuberculosis
IYQVTDRSHDGRTAR

SEQ ID NO: 136084 - protein, 15 aa, Mycobacterium tuberculosis
YQVTDRSHDGRTARV

SEQ ID NO: 136085 - protein, 15 aa, Mycobacterium tuberculosis
QVTDRSHDGRTARVP

SEQ ID NO: 136086 - protein, 15 aa, Mycobacterium tuberculosis
VTDRSHDGRTARVPG

SEQ ID NO: 136087 - protein, 15 aa, Mycobacterium tuberculosis
TDRSHDGRTARVPGD

SEQ ID NO: 136088 - protein, 15 aa, Mycobacterium tuberculosis
DRSHDGRTARVPGDE

SEQ ID NO: 136089 - protein, 15 aa, Mycobacterium tuberculosis
RSHDGRTARVPGDEI

SEQ ID NO: 136090 - protein, 15 aa, Mycobacterium tuberculosis
SHDGRTARVPGDEIT

SEQ ID NO: 136091 - protein, 15 aa, Mycobacterium tuberculosis
HDGRTARVPGDEITS

SEQ ID NO: 136092 - protein, 15 aa, Mycobacterium tuberculosis
DGRTARVPGDEITST

SEQ ID NO: 136093 - protein, 15 aa, Mycobacterium tuberculosis
GRTARVPGDEITSTV

SEQ ID NO: 136094 - protein, 15 aa, Mycobacterium tuberculosis
RTARVPGDEITSTVS

SEQ ID NO: 136095 - protein, 15 aa, Mycobacterium tuberculosis
TARVPGDEITSTVSG

SEQ ID NO: 136096 - protein, 15 aa, Mycobacterium tuberculosis
ARVPGDEITSTVSGW

SEQ ID NO: 136097 - protein, 15 aa, Mycobacterium tuberculosis
RVPGDEITSTVSGWL

SEQ ID NO: 136098 - protein, 15 aa, Mycobacterium tuberculosis
VPGDEITSTVSGWLS

SEQ ID NO: 136099 - protein, 15 aa, Mycobacterium tuberculosis
PGDEITSTVSGWLSE

SEQ ID NO: 136100 - protein, 15 aa, Mycobacterium tuberculosis
GDEITSTVSGWLSEL

SEQ ID NO: 136101 - protein, 15 aa, Mycobacterium tuberculosis
DEITSTVSGWLSELG

SEQ ID NO: 136102 - protein, 15 aa, Mycobacterium tuberculosis
EITSTVSGWLSELGT

SEQ ID NO: 136103 - protein, 15 aa, Mycobacterium tuberculosis
ITSTVSGWLSELGTQ

SEQ ID NO: 136104 - protein, 15 aa, Mycobacterium tuberculosis
TSTVSGWLSELGTQS

SEQ ID NO: 136105 - protein, 15 aa, Mycobacterium tuberculosis
STVSGWLSELGTQSP

SEQ ID NO: 136106 - protein, 15 aa, Mycobacterium tuberculosis
TVSGWLSELGTQSPL

SEQ ID NO: 136107 - protein, 15 aa, Mycobacterium tuberculosis
VSGWLSELGTQSPLA

SEQ ID NO: 136108 - protein, 15 aa, Mycobacterium tuberculosis
SGWLSELGTQSPLAD

SEQ ID NO: 136109 - protein, 15 aa, Mycobacterium tuberculosis
GWLSELGTQSPLADE

SEQ ID NO: 136110 - protein, 15 aa, Mycobacterium tuberculosis
WLSELGTQSPLADEL

SEQ ID NO: 136111 - protein, 15 aa, Mycobacterium tuberculosis
LSELGTQSPLADELA

SEQ ID NO: 136112 - protein, 15 aa, Mycobacterium tuberculosis
SELGTQSPLADELAR

SEQ ID NO: 136113 - protein, 15 aa, Mycobacterium tuberculosis
ELGTQSPLADELARA

SEQ ID NO: 136114 - protein, 15 aa, Mycobacterium tuberculosis
LGTQSPLADELARAV

SEQ ID NO: 136115 - protein, 15 aa, Mycobacterium tuberculosis
GTQSPLADELARAVR

SEQ ID NO: 136116 - protein, 15 aa, Mycobacterium tuberculosis
TQSPLADELARAVRI

SEQ ID NO: 136117 - protein, 15 aa, Mycobacterium tuberculosis
QSPLADELARAVRIG

SEQ ID NO: 136118 - protein, 15 aa, Mycobacterium tuberculosis
SPLADELARAVRIGD

SEQ ID NO: 136119 - protein, 15 aa, Mycobacterium tuberculosis
PLADELARAVRIGDW

SEQ ID NO: 136120 - protein, 15 aa, Mycobacterium tuberculosis
LADELARAVRIGDWP

SEQ ID NO: 136121 - protein, 15 aa, Mycobacterium tuberculosis
ADELARAVRIGDWPA

SEQ ID NO: 136122 - protein, 15 aa, Mycobacterium tuberculosis
DELARAVRIGDWPAA

SEQ ID NO: 136123 - protein, 15 aa, Mycobacterium tuberculosis
ELARAVRIGDWPAAY

SEQ ID NO: 136124 - protein, 15 aa, Mycobacterium tuberculosis
LARAVRIGDWPAAYA

SEQ ID NO: 136125 - protein, 15 aa, Mycobacterium tuberculosis
ARAVRIGDWPAAYAI

SEQ ID NO: 136126 - protein, 15 aa, Mycobacterium tuberculosis
RAVRIGDWPAAYAIG

SEQ ID NO: 136127 - protein, 15 aa, Mycobacterium tuberculosis
AVRIGDWPAAYAIGE

SEQ ID NO: 136128 - protein, 15 aa, Mycobacterium tuberculosis
VRIGDWPAAYAIGEH

SEQ ID NO: 136129 - protein, 15 aa, Mycobacterium tuberculosis
RIGDWPAAYAIGEHL

SEQ ID NO: 136130 - protein, 15 aa, Mycobacterium tuberculosis
IGDWPAAYAIGEHLS

SEQ ID NO: 136131 - protein, 15 aa, Mycobacterium tuberculosis
GDWPAAYAIGEHLSV

SEQ ID NO: 136132 - protein, 15 aa, Mycobacterium tuberculosis
DWPAAYAIGEHLSVE

SEQ ID NO: 136133 - protein, 15 aa, Mycobacterium tuberculosis
WPAAYAIGEHLSVEI

SEQ ID NO: 136134 - protein, 15 aa, Mycobacterium tuberculosis
PAAYAIGEHLSVEIA

SEQ ID NO: 136135 - protein, 15 aa, Mycobacterium tuberculosis
AAYAIGEHLSVEIAV

SEQ ID NO: 136136 - protein, 15 aa, Mycobacterium tuberculosis
AYAIGEHLSVEIAVA

SEQ ID NO: 136137 - protein, 15 aa, Mycobacterium tuberculosis
YAIGEHLSVEIAVAV

SEQ ID NO: 136138 - protein, 16 aa, Mycobacterium tuberculosis
MSTQRPRHSGIRAVGP

SEQ ID NO: 136139 - protein, 16 aa, Mycobacterium tuberculosis
STQRPRHSGIRAVGPY

SEQ ID NO: 136140 - protein, 16 aa, Mycobacterium tuberculosis
TQRPRHSGIRAVGPYA

SEQ ID NO: 136141 - protein, 16 aa, Mycobacterium tuberculosis
QRPRHSGIRAVGPYAW

SEQ ID NO: 136142 - protein, 16 aa, Mycobacterium tuberculosis
RPRHSGIRAVGPYAWA

SEQ ID NO: 136143 - protein, 16 aa, Mycobacterium tuberculosis
PRHSGIRAVGPYAWAG

SEQ ID NO: 136144 - protein, 16 aa, Mycobacterium tuberculosis
RHSGIRAVGPYAWAGR

SEQ ID NO: 136145 - protein, 16 aa, Mycobacterium tuberculosis
HSGIRAVGPYAWAGRC

SEQ ID NO: 136146 - protein, 16 aa, Mycobacterium tuberculosis
SGIRAVGPYAWAGRCG

SEQ ID NO: 136147 - protein, 16 aa, Mycobacterium tuberculosis
GIRAVGPYAWAGRCGR

SEQ ID NO: 136148 - protein, 16 aa, Mycobacterium tuberculosis
IRAVGPYAWAGRCGRI

SEQ ID NO: 136149 - protein, 16 aa, Mycobacterium tuberculosis
RAVGPYAWAGRCGRIG

SEQ ID NO: 136150 - protein, 16 aa, Mycobacterium tuberculosis
AVGPYAWAGRCGRIGR

SEQ ID NO: 136151 - protein, 16 aa, Mycobacterium tuberculosis
VGPYAWAGRCGRIGRW

SEQ ID NO: 136152 - protein, 16 aa, Mycobacterium tuberculosis
GPYAWAGRCGRIGRWG

SEQ ID NO: 136153 - protein, 16 aa, Mycobacterium tuberculosis
PYAWAGRCGRIGRWGV

SEQ ID NO: 136154 - protein, 16 aa, Mycobacterium tuberculosis
YAWAGRCGRIGRWGVH

SEQ ID NO: 136155 - protein, 16 aa, Mycobacterium tuberculosis
AWAGRCGRIGRWGVHQ

SEQ ID NO: 136156 - protein, 16 aa, Mycobacterium tuberculosis
WAGRCGRIGRWGVHQE

SEQ ID NO: 136157 - protein, 16 aa, Mycobacterium tuberculosis
AGRCGRIGRWGVHQEA

SEQ ID NO: 136158 - protein, 16 aa, Mycobacterium tuberculosis
GRCGRIGRWGVHQEAM

SEQ ID NO: 136159 - protein, 16 aa, Mycobacterium tuberculosis
RCGRIGRWGVHQEAMM

SEQ ID NO: 136160 - protein, 16 aa, Mycobacterium tuberculosis
CGRIGRWGVHQEAMMN

SEQ ID NO: 136161 - protein, 16 aa, Mycobacterium tuberculosis
GRIGRWGVHQEAMMNL

SEQ ID NO: 136162 - protein, 16 aa, Mycobacterium tuberculosis
RIGRWGVHQEAMMNLA

SEQ ID NO: 136163 - protein, 16 aa, Mycobacterium tuberculosis
IGRWGVHQEAMMNLAI

SEQ ID NO: 136164 - protein, 16 aa, Mycobacterium tuberculosis
GRWGVHQEAMMNLAIW

SEQ ID NO: 136165 - protein, 16 aa, Mycobacterium tuberculosis
RWGVHQEAMMNLAIWH

SEQ ID NO: 136166 - protein, 16 aa, Mycobacterium tuberculosis
WGVHQEAMMNLAIWHP

SEQ ID NO: 136167 - protein, 16 aa, Mycobacterium tuberculosis
GVHQEAMMNLAIWHPR

SEQ ID NO: 136168 - protein, 16 aa, Mycobacterium tuberculosis
VHQEAMMNLAIWHPRK

SEQ ID NO: 136169 - protein, 16 aa, Mycobacterium tuberculosis
HQEAMMNLAIWHPRKV

SEQ ID NO: 136170 - protein, 16 aa, Mycobacterium tuberculosis
QEAMMNLAIWHPRKVQ

SEQ ID NO: 136171 - protein, 16 aa, Mycobacterium tuberculosis
EAMMNLAIWHPRKVQS

SEQ ID NO: 136172 - protein, 16 aa, Mycobacterium tuberculosis
AMMNLAIWHPRKVQSA

SEQ ID NO: 136173 - protein, 16 aa, Mycobacterium tuberculosis
MMNLAIWHPRKVQSAT

SEQ ID NO: 136174 - protein, 16 aa, Mycobacterium tuberculosis
MNLAIWHPRKVQSATI

SEQ ID NO: 136175 - protein, 16 aa, Mycobacterium tuberculosis
NLAIWHPRKVQSATIY

SEQ ID NO: 136176 - protein, 16 aa, Mycobacterium tuberculosis
LAIWHPRKVQSATIYQ

SEQ ID NO: 136177 - protein, 16 aa, Mycobacterium tuberculosis
AIWHPRKVQSATIYQV

SEQ ID NO: 136178 - protein, 16 aa, Mycobacterium tuberculosis
IWHPRKVQSATIYQVT

SEQ ID NO: 136179 - protein, 16 aa, Mycobacterium tuberculosis
WHPRKVQSATIYQVTD

SEQ ID NO: 136180 - protein, 16 aa, Mycobacterium tuberculosis
HPRKVQSATIYQVTDR

SEQ ID NO: 136181 - protein, 16 aa, Mycobacterium tuberculosis
PRKVQSATIYQVTDRS

SEQ ID NO: 136182 - protein, 16 aa, Mycobacterium tuberculosis
RKVQSATIYQVTDRSH

SEQ ID NO: 136183 - protein, 16 aa, Mycobacterium tuberculosis
KVQSATIYQVTDRSHD

SEQ ID NO: 136184 - protein, 16 aa, Mycobacterium tuberculosis
VQSATIYQVTDRSHDG

SEQ ID NO: 136185 - protein, 16 aa, Mycobacterium tuberculosis
QSATIYQVTDRSHDGR

SEQ ID NO: 136186 - protein, 16 aa, Mycobacterium tuberculosis
SATIYQVTDRSHDGRT

SEQ ID NO: 136187 - protein, 16 aa, Mycobacterium tuberculosis
ATIYQVTDRSHDGRTA

SEQ ID NO: 136188 - protein, 16 aa, Mycobacterium tuberculosis
TIYQVTDRSHDGRTAR

SEQ ID NO: 136189 - protein, 16 aa, Mycobacterium tuberculosis
IYQVTDRSHDGRTARV

SEQ ID NO: 136190 - protein, 16 aa, Mycobacterium tuberculosis
YQVTDRSHDGRTARVP

SEQ ID NO: 136191 - protein, 16 aa, Mycobacterium tuberculosis
QVTDRSHDGRTARVPG

SEQ ID NO: 136192 - protein, 16 aa, Mycobacterium tuberculosis
VTDRSHDGRTARVPGD

SEQ ID NO: 136193 - protein, 16 aa, Mycobacterium tuberculosis
TDRSHDGRTARVPGDE

SEQ ID NO: 136194 - protein, 16 aa, Mycobacterium tuberculosis
DRSHDGRTARVPGDEI

SEQ ID NO: 136195 - protein, 16 aa, Mycobacterium tuberculosis
RSHDGRTARVPGDEIT

SEQ ID NO: 136196 - protein, 16 aa, Mycobacterium tuberculosis
SHDGRTARVPGDEITS

SEQ ID NO: 136197 - protein, 16 aa, Mycobacterium tuberculosis
HDGRTARVPGDEITST

SEQ ID NO: 136198 - protein, 16 aa, Mycobacterium tuberculosis
DGRTARVPGDEITSTV

SEQ ID NO: 136199 - protein, 16 aa, Mycobacterium tuberculosis
GRTARVPGDEITSTVS

SEQ ID NO: 136200 - protein, 16 aa, Mycobacterium tuberculosis
RTARVPGDEITSTVSG

SEQ ID NO: 136201 - protein, 16 aa, Mycobacterium tuberculosis
TARVPGDEITSTVSGW

SEQ ID NO: 136202 - protein, 16 aa, Mycobacterium tuberculosis
ARVPGDEITSTVSGWL

SEQ ID NO: 136203 - protein, 16 aa, Mycobacterium tuberculosis
RVPGDEITSTVSGWLS

SEQ ID NO: 136204 - protein, 16 aa, Mycobacterium tuberculosis
VPGDEITSTVSGWLSE

SEQ ID NO: 136205 - protein, 16 aa, Mycobacterium tuberculosis
PGDEITSTVSGWLSEL

SEQ ID NO: 136206 - protein, 16 aa, Mycobacterium tuberculosis
GDEITSTVSGWLSELG

SEQ ID NO: 136207 - protein, 16 aa, Mycobacterium tuberculosis
DEITSTVSGWLSELGT

SEQ ID NO: 136208 - protein, 16 aa, Mycobacterium tuberculosis
EITSTVSGWLSELGTQ

SEQ ID NO: 136209 - protein, 16 aa, Mycobacterium tuberculosis
ITSTVSGWLSELGTQS

SEQ ID NO: 136210 - protein, 16 aa, Mycobacterium tuberculosis
TSTVSGWLSELGTQSP

SEQ ID NO: 136211 - protein, 16 aa, Mycobacterium tuberculosis
STVSGWLSELGTQSPL

SEQ ID NO: 136212 - protein, 16 aa, Mycobacterium tuberculosis
TVSGWLSELGTQSPLA

SEQ ID NO: 136213 - protein, 16 aa, Mycobacterium tuberculosis
VSGWLSELGTQSPLAD

SEQ ID NO: 136214 - protein, 16 aa, Mycobacterium tuberculosis
SGWLSELGTQSPLADE

SEQ ID NO: 136215 - protein, 16 aa, Mycobacterium tuberculosis
GWLSELGTQSPLADEL

SEQ ID NO: 136216 - protein, 16 aa, Mycobacterium tuberculosis
WLSELGTQSPLADELA

SEQ ID NO: 136217 - protein, 16 aa, Mycobacterium tuberculosis
LSELGTQSPLADELAR

SEQ ID NO: 136218 - protein, 16 aa, Mycobacterium tuberculosis
SELGTQSPLADELARA

SEQ ID NO: 136219 - protein, 16 aa, Mycobacterium tuberculosis
ELGTQSPLADELARAV

SEQ ID NO: 136220 - protein, 16 aa, Mycobacterium tuberculosis
LGTQSPLADELARAVR

SEQ ID NO: 136221 - protein, 16 aa, Mycobacterium tuberculosis
GTQSPLADELARAVRI

SEQ ID NO: 136222 - protein, 16 aa, Mycobacterium tuberculosis
TQSPLADELARAVRIG

SEQ ID NO: 136223 - protein, 16 aa, Mycobacterium tuberculosis
QSPLADELARAVRIGD

SEQ ID NO: 136224 - protein, 16 aa, Mycobacterium tuberculosis
SPLADELARAVRIGDW

SEQ ID NO: 136225 - protein, 16 aa, Mycobacterium tuberculosis
PLADELARAVRIGDWP

SEQ ID NO: 136226 - protein, 16 aa, Mycobacterium tuberculosis
LADELARAVRIGDWPA

SEQ ID NO: 136227 - protein, 16 aa, Mycobacterium tuberculosis
ADELARAVRIGDWPAA

SEQ ID NO: 136228 - protein, 16 aa, Mycobacterium tuberculosis
DELARAVRIGDWPAAY

SEQ ID NO: 136229 - protein, 16 aa, Mycobacterium tuberculosis
ELARAVRIGDWPAAYA

SEQ ID NO: 136230 - protein, 16 aa, Mycobacterium tuberculosis
LARAVRIGDWPAAYAI

SEQ ID NO: 136231 - protein, 16 aa, Mycobacterium tuberculosis
ARAVRIGDWPAAYAIG

SEQ ID NO: 136232 - protein, 16 aa, Mycobacterium tuberculosis
RAVRIGDWPAAYAIGE

SEQ ID NO: 136233 - protein, 16 aa, Mycobacterium tuberculosis
AVRIGDWPAAYAIGEH

SEQ ID NO: 136234 - protein, 16 aa, Mycobacterium tuberculosis
VRIGDWPAAYAIGEHL

SEQ ID NO: 136235 - protein, 16 aa, Mycobacterium tuberculosis
RIGDWPAAYAIGEHLS

SEQ ID NO: 136236 - protein, 16 aa, Mycobacterium tuberculosis
IGDWPAAYAIGEHLSV

SEQ ID NO: 136237 - protein, 16 aa, Mycobacterium tuberculosis
GDWPAAYAIGEHLSVE

SEQ ID NO: 136238 - protein, 16 aa, Mycobacterium tuberculosis
DWPAAYAIGEHLSVEI

SEQ ID NO: 136239 - protein, 16 aa, Mycobacterium tuberculosis
WPAAYAIGEHLSVEIA

SEQ ID NO: 136240 - protein, 16 aa, Mycobacterium tuberculosis
PAAYAIGEHLSVEIAV

SEQ ID NO: 136241 - protein, 16 aa, Mycobacterium tuberculosis
AAYAIGEHLSVEIAVA

SEQ ID NO: 136242 - protein, 16 aa, Mycobacterium tuberculosis
AYAIGEHLSVEIAVAV

SEQ ID NO: 136243 - protein, 228 aa, Mycobacterium tuberculosis
MRIKIFMLVTAVVLLCCSGVATAAPKTYCEELKGTDTGQACQIQMSDPAYNINISLPSYYPDQKSLENYIAQTRDKFLSAATSSTPREAPYELNITSATYQSAIPPRGTQAVVLKVYQNAGGTHPTTTYKAFDWDQAYRKPITYDTLWQADTDPLPVVFPIVQGELSKQTGQQVSIAPNAGLDPVNYQNFAVTNDGVIFFFNPGELLPEAAGPTQVLVPRSAIDSMLA

SEQ ID NO: 136244 - protein, 8 aa, Mycobacterium tuberculosis
MRIKIFML

SEQ ID NO: 136245 - protein, 8 aa, Mycobacterium tuberculosis
RIKIFMLV

SEQ ID NO: 136246 - protein, 8 aa, Mycobacterium tuberculosis
KIFMLVTA

SEQ ID NO: 136247 - protein, 8 aa, Mycobacterium tuberculosis
FMLVTAVV

SEQ ID NO: 136248 - protein, 8 aa, Mycobacterium tuberculosis
MLVTAVVL

SEQ ID NO: 136249 - protein, 8 aa, Mycobacterium tuberculosis
LVTAVVLL

SEQ ID NO: 136250 - protein, 8 aa, Mycobacterium tuberculosis
VLLCCSGV

SEQ ID NO: 136251 - protein, 8 aa, Mycobacterium tuberculosis
LLCCSGVA

SEQ ID NO: 136252 - protein, 8 aa, Mycobacterium tuberculosis
GVATAAPK

SEQ ID NO: 136253 - protein, 8 aa, Mycobacterium tuberculosis
ATAAPKTY

SEQ ID NO: 136254 - protein, 8 aa, Mycobacterium tuberculosis
KTYCEELK

SEQ ID NO: 136255 - protein, 8 aa, Mycobacterium tuberculosis
GQACQIQM

SEQ ID NO: 136256 - protein, 8 aa, Mycobacterium tuberculosis
IQMSDPAY

SEQ ID NO: 136257 - protein, 8 aa, Mycobacterium tuberculosis
MSDPAYNI

SEQ ID NO: 136258 - protein, 8 aa, Mycobacterium tuberculosis
DPAYNINI

SEQ ID NO: 136259 - protein, 8 aa, Mycobacterium tuberculosis
AYNINISL

SEQ ID NO: 136260 - protein, 8 aa, Mycobacterium tuberculosis
NISLPSYY

SEQ ID NO: 136261 - protein, 8 aa, Mycobacterium tuberculosis
PSYYPDQK

SEQ ID NO: 136262 - protein, 8 aa, Mycobacterium tuberculosis
YYPDQKSL

SEQ ID NO: 136263 - protein, 8 aa, Mycobacterium tuberculosis
SLENYIAQ

SEQ ID NO: 136264 - protein, 8 aa, Mycobacterium tuberculosis
ENYIAQTR

SEQ ID NO: 136265 - protein, 8 aa, Mycobacterium tuberculosis
YIAQTRDK

SEQ ID NO: 136266 - protein, 8 aa, Mycobacterium tuberculosis
IAQTRDKF

SEQ ID NO: 136267 - protein, 8 aa, Mycobacterium tuberculosis
FLSAATSS

SEQ ID NO: 136268 - protein, 8 aa, Mycobacterium tuberculosis
AATSSTPR

SEQ ID NO: 136269 - protein, 8 aa, Mycobacterium tuberculosis
STPREAPY

SEQ ID NO: 136270 - protein, 8 aa, Mycobacterium tuberculosis
APYELNIT

SEQ ID NO: 136271 - protein, 8 aa, Mycobacterium tuberculosis
YELNITSA

SEQ ID NO: 136272 - protein, 8 aa, Mycobacterium tuberculosis
TSATYQSA

SEQ ID NO: 136273 - protein, 8 aa, Mycobacterium tuberculosis
SATYQSAI

SEQ ID NO: 136274 - protein, 8 aa, Mycobacterium tuberculosis
YQSAIPPR

SEQ ID NO: 136275 - protein, 8 aa, Mycobacterium tuberculosis
IPPRGTQA

SEQ ID NO: 136276 - protein, 8 aa, Mycobacterium tuberculosis
PPRGTQAV

SEQ ID NO: 136277 - protein, 8 aa, Mycobacterium tuberculosis
GTQAVVLK

SEQ ID NO: 136278 - protein, 8 aa, Mycobacterium tuberculosis
TQAVVLKV

SEQ ID NO: 136279 - protein, 8 aa, Mycobacterium tuberculosis
QAVVLKVY

SEQ ID NO: 136280 - protein, 8 aa, Mycobacterium tuberculosis
VLKVYQNA

SEQ ID NO: 136281 - protein, 8 aa, Mycobacterium tuberculosis
YQNAGGTH

SEQ ID NO: 136282 - protein, 8 aa, Mycobacterium tuberculosis
GTHPTTTY

SEQ ID NO: 136283 - protein, 8 aa, Mycobacterium tuberculosis
HPTTTYKA

SEQ ID NO: 136284 - protein, 8 aa, Mycobacterium tuberculosis
PTTTYKAF

SEQ ID NO: 136285 - protein, 8 aa, Mycobacterium tuberculosis
TTYKAFDW

SEQ ID NO: 136286 - protein, 8 aa, Mycobacterium tuberculosis
KAFDWDQA

SEQ ID NO: 136287 - protein, 8 aa, Mycobacterium tuberculosis
AFDWDQAY

SEQ ID NO: 136288 - protein, 8 aa, Mycobacterium tuberculosis
AYRKPITY

SEQ ID NO: 136289 - protein, 8 aa, Mycobacterium tuberculosis
KPITYDTL

SEQ ID NO: 136290 - protein, 8 aa, Mycobacterium tuberculosis
ITYDTLWQ

SEQ ID NO: 136291 - protein, 8 aa, Mycobacterium tuberculosis
WQADTDPL

SEQ ID NO: 136292 - protein, 8 aa, Mycobacterium tuberculosis
DTDPLPVV

SEQ ID NO: 136293 - protein, 8 aa, Mycobacterium tuberculosis
PLPVVFPI

SEQ ID NO: 136294 - protein, 8 aa, Mycobacterium tuberculosis
LPVVFPIV

SEQ ID NO: 136295 - protein, 8 aa, Mycobacterium tuberculosis
FPIVQGEL

SEQ ID NO: 136296 - protein, 8 aa, Mycobacterium tuberculosis
IVQGELSK

SEQ ID NO: 136297 - protein, 8 aa, Mycobacterium tuberculosis
SIAPNAGL

SEQ ID NO: 136298 - protein, 8 aa, Mycobacterium tuberculosis
GLDPVNYQ

SEQ ID NO: 136299 - protein, 8 aa, Mycobacterium tuberculosis
DPVNYQNF

SEQ ID NO: 136300 - protein, 8 aa, Mycobacterium tuberculosis
VNYQNFAV

SEQ ID NO: 136301 - protein, 8 aa, Mycobacterium tuberculosis
FAVTNDGV

SEQ ID NO: 136302 - protein, 8 aa, Mycobacterium tuberculosis
VTNDGVIF

SEQ ID NO: 136303 - protein, 8 aa, Mycobacterium tuberculosis
FFFNPGEL

SEQ ID NO: 136304 - protein, 8 aa, Mycobacterium tuberculosis
FFNPGELL

SEQ ID NO: 136305 - protein, 8 aa, Mycobacterium tuberculosis
LPEAAGPT

SEQ ID NO: 136306 - protein, 8 aa, Mycobacterium tuberculosis
EAAGPTQV

SEQ ID NO: 136307 - protein, 8 aa, Mycobacterium tuberculosis
PTQVLVPR

SEQ ID NO: 136308 - protein, 8 aa, Mycobacterium tuberculosis
VLVPRSAI

SEQ ID NO: 136309 - protein, 8 aa, Mycobacterium tuberculosis
SAIDSMLA

SEQ ID NO: 136310 - protein, 9 aa, Mycobacterium tuberculosis
MRIKIFMLV

SEQ ID NO: 136311 - protein, 9 aa, Mycobacterium tuberculosis
KIFMLVTAV

SEQ ID NO: 136312 - protein, 9 aa, Mycobacterium tuberculosis
IFMLVTAVV

SEQ ID NO: 136313 - protein, 9 aa, Mycobacterium tuberculosis
FMLVTAVVL

SEQ ID NO: 136314 - protein, 9 aa, Mycobacterium tuberculosis
MLVTAVVLL

SEQ ID NO: 136315 - protein, 9 aa, Mycobacterium tuberculosis
VVLLCCSGV

SEQ ID NO: 136316 - protein, 9 aa, Mycobacterium tuberculosis
VLLCCSGVA

SEQ ID NO: 136317 - protein, 9 aa, Mycobacterium tuberculosis
SGVATAAPK

SEQ ID NO: 136318 - protein, 9 aa, Mycobacterium tuberculosis
VATAAPKTY

SEQ ID NO: 136319 - protein, 9 aa, Mycobacterium tuberculosis
APKTYCEEL

SEQ ID NO: 136320 - protein, 9 aa, Mycobacterium tuberculosis
CQIQMSDPA

SEQ ID NO: 136321 - protein, 9 aa, Mycobacterium tuberculosis
QIQMSDPAY

SEQ ID NO: 136322 - protein, 9 aa, Mycobacterium tuberculosis
QMSDPAYNI

SEQ ID NO: 136323 - protein, 9 aa, Mycobacterium tuberculosis
DPAYNINIS

SEQ ID NO: 136324 - protein, 9 aa, Mycobacterium tuberculosis
NINISLPSY

SEQ ID NO: 136325 - protein, 9 aa, Mycobacterium tuberculosis
INISLPSYY

SEQ ID NO: 136326 - protein, 9 aa, Mycobacterium tuberculosis
SLPSYYPDQ

SEQ ID NO: 136327 - protein, 9 aa, Mycobacterium tuberculosis
LPSYYPDQK

SEQ ID NO: 136328 - protein, 9 aa, Mycobacterium tuberculosis
SYYPDQKSL

SEQ ID NO: 136329 - protein, 9 aa, Mycobacterium tuberculosis
SLENYIAQT

SEQ ID NO: 136330 - protein, 9 aa, Mycobacterium tuberculosis
NYIAQTRDK

SEQ ID NO: 136331 - protein, 9 aa, Mycobacterium tuberculosis
YIAQTRDKF

SEQ ID NO: 136332 - protein, 9 aa, Mycobacterium tuberculosis
QTRDKFLSA

SEQ ID NO: 136333 - protein, 9 aa, Mycobacterium tuberculosis
FLSAATSST

SEQ ID NO: 136334 - protein, 9 aa, Mycobacterium tuberculosis
SAATSSTPR

SEQ ID NO: 136335 - protein, 9 aa, Mycobacterium tuberculosis
SSTPREAPY

SEQ ID NO: 136336 - protein, 9 aa, Mycobacterium tuberculosis
TPREAPYEL

SEQ ID NO: 136337 - protein, 9 aa, Mycobacterium tuberculosis
REAPYELNI

SEQ ID NO: 136338 - protein, 9 aa, Mycobacterium tuberculosis
YELNITSAT

SEQ ID NO: 136339 - protein, 9 aa, Mycobacterium tuberculosis
ELNITSATY

SEQ ID NO: 136340 - protein, 9 aa, Mycobacterium tuberculosis
ITSATYQSA

SEQ ID NO: 136341 - protein, 9 aa, Mycobacterium tuberculosis
TSATYQSAI

SEQ ID NO: 136342 - protein, 9 aa, Mycobacterium tuberculosis
TYQSAIPPR

SEQ ID NO: 136343 - protein, 9 aa, Mycobacterium tuberculosis
AIPPRGTQA

SEQ ID NO: 136344 - protein, 9 aa, Mycobacterium tuberculosis
IPPRGTQAV

SEQ ID NO: 136345 - protein, 9 aa, Mycobacterium tuberculosis
PPRGTQAVV

SEQ ID NO: 136346 - protein, 9 aa, Mycobacterium tuberculosis
RGTQAVVLK

SEQ ID NO: 136347 - protein, 9 aa, Mycobacterium tuberculosis
GTQAVVLKV

SEQ ID NO: 136348 - protein, 9 aa, Mycobacterium tuberculosis
TQAVVLKVY

SEQ ID NO: 136349 - protein, 9 aa, Mycobacterium tuberculosis
VVLKVYQNA

SEQ ID NO: 136350 - protein, 9 aa, Mycobacterium tuberculosis
YQNAGGTHP

SEQ ID NO: 136351 - protein, 9 aa, Mycobacterium tuberculosis
GTHPTTTYK

SEQ ID NO: 136352 - protein, 9 aa, Mycobacterium tuberculosis
HPTTTYKAF

SEQ ID NO: 136353 - protein, 9 aa, Mycobacterium tuberculosis
TTTYKAFDW

SEQ ID NO: 136354 - protein, 9 aa, Mycobacterium tuberculosis
KAFDWDQAY

SEQ ID NO: 136355 - protein, 9 aa, Mycobacterium tuberculosis
AFDWDQAYR

SEQ ID NO: 136356 - protein, 9 aa, Mycobacterium tuberculosis
QAYRKPITY

SEQ ID NO: 136357 - protein, 9 aa, Mycobacterium tuberculosis
KPITYDTLW

SEQ ID NO: 136358 - protein, 9 aa, Mycobacterium tuberculosis
ITYDTLWQA

SEQ ID NO: 136359 - protein, 9 aa, Mycobacterium tuberculosis
WQADTDPLP

SEQ ID NO: 136360 - protein, 9 aa, Mycobacterium tuberculosis
QADTDPLPV

SEQ ID NO: 136361 - protein, 9 aa, Mycobacterium tuberculosis
DTDPLPVVF

SEQ ID NO: 136362 - protein, 9 aa, Mycobacterium tuberculosis
DPLPVVFPI

SEQ ID NO: 136363 - protein, 9 aa, Mycobacterium tuberculosis
PLPVVFPIV

SEQ ID NO: 136364 - protein, 9 aa, Mycobacterium tuberculosis
LPVVFPIVQ

SEQ ID NO: 136365 - protein, 9 aa, Mycobacterium tuberculosis
VFPIVQGEL

SEQ ID NO: 136366 - protein, 9 aa, Mycobacterium tuberculosis
FPIVQGELS

SEQ ID NO: 136367 - protein, 9 aa, Mycobacterium tuberculosis
KQTGQQVSI

SEQ ID NO: 136368 - protein, 9 aa, Mycobacterium tuberculosis
QQVSIAPNA

SEQ ID NO: 136369 - protein, 9 aa, Mycobacterium tuberculosis
VSIAPNAGL

SEQ ID NO: 136370 - protein, 9 aa, Mycobacterium tuberculosis
APNAGLDPV

SEQ ID NO: 136371 - protein, 9 aa, Mycobacterium tuberculosis
GLDPVNYQN

SEQ ID NO: 136372 - protein, 9 aa, Mycobacterium tuberculosis
DPVNYQNFA

SEQ ID NO: 136373 - protein, 9 aa, Mycobacterium tuberculosis
PVNYQNFAV

SEQ ID NO: 136374 - protein, 9 aa, Mycobacterium tuberculosis
FAVTNDGVI

SEQ ID NO: 136375 - protein, 9 aa, Mycobacterium tuberculosis
VTNDGVIFF

SEQ ID NO: 136376 - protein, 9 aa, Mycobacterium tuberculosis
IFFFNPGEL

SEQ ID NO: 136377 - protein, 9 aa, Mycobacterium tuberculosis
FFFNPGELL

SEQ ID NO: 136378 - protein, 9 aa, Mycobacterium tuberculosis
NPGELLPEA

SEQ ID NO: 136379 - protein, 9 aa, Mycobacterium tuberculosis
LLPEAAGPT

SEQ ID NO: 136380 - protein, 9 aa, Mycobacterium tuberculosis
LPEAAGPTQ

SEQ ID NO: 136381 - protein, 9 aa, Mycobacterium tuberculosis
EAAGPTQVL

SEQ ID NO: 136382 - protein, 9 aa, Mycobacterium tuberculosis
AAGPTQVLV

SEQ ID NO: 136383 - protein, 9 aa, Mycobacterium tuberculosis
QVLVPRSAI

SEQ ID NO: 136384 - protein, 9 aa, Mycobacterium tuberculosis
VPRSAIDSM

SEQ ID NO: 136385 - protein, 10 aa, Mycobacterium tuberculosis
RIKIFMLVTA

SEQ ID NO: 136386 - protein, 10 aa, Mycobacterium tuberculosis
IKIFMLVTAV

SEQ ID NO: 136387 - protein, 10 aa, Mycobacterium tuberculosis
KIFMLVTAVV

SEQ ID NO: 136388 - protein, 10 aa, Mycobacterium tuberculosis
IFMLVTAVVL

SEQ ID NO: 136389 - protein, 10 aa, Mycobacterium tuberculosis
FMLVTAVVLL

SEQ ID NO: 136390 - protein, 10 aa, Mycobacterium tuberculosis
MLVTAVVLLC

SEQ ID NO: 136391 - protein, 10 aa, Mycobacterium tuberculosis
AVVLLCCSGV

SEQ ID NO: 136392 - protein, 10 aa, Mycobacterium tuberculosis
LLCCSGVATA

SEQ ID NO: 136393 - protein, 10 aa, Mycobacterium tuberculosis
CSGVATAAPK

SEQ ID NO: 136394 - protein, 10 aa, Mycobacterium tuberculosis
GVATAAPKTY

SEQ ID NO: 136395 - protein, 10 aa, Mycobacterium tuberculosis
GTDTGQACQI

SEQ ID NO: 136396 - protein, 10 aa, Mycobacterium tuberculosis
CQIQMSDPAY

SEQ ID NO: 136397 - protein, 10 aa, Mycobacterium tuberculosis
IQMSDPAYNI

SEQ ID NO: 136398 - protein, 10 aa, Mycobacterium tuberculosis
MSDPAYNINI

SEQ ID NO: 136399 - protein, 10 aa, Mycobacterium tuberculosis
DPAYNINISL

SEQ ID NO: 136400 - protein, 10 aa, Mycobacterium tuberculosis
YNINISLPSY

SEQ ID NO: 136401 - protein, 10 aa, Mycobacterium tuberculosis
NINISLPSYY

SEQ ID NO: 136402 - protein, 10 aa, Mycobacterium tuberculosis
SLPSYYPDQK

SEQ ID NO: 136403 - protein, 10 aa, Mycobacterium tuberculosis
YPDQKSLENY

SEQ ID NO: 136404 - protein, 10 aa, Mycobacterium tuberculosis
SLENYIAQTR

SEQ ID NO: 136405 - protein, 10 aa, Mycobacterium tuberculosis
ENYIAQTRDK

SEQ ID NO: 136406 - protein, 10 aa, Mycobacterium tuberculosis
NYIAQTRDKF

SEQ ID NO: 136407 - protein, 10 aa, Mycobacterium tuberculosis
YIAQTRDKFL

SEQ ID NO: 136408 - protein, 10 aa, Mycobacterium tuberculosis
AQTRDKFLSA

SEQ ID NO: 136409 - protein, 10 aa, Mycobacterium tuberculosis
QTRDKFLSAA

SEQ ID NO: 136410 - protein, 10 aa, Mycobacterium tuberculosis
FLSAATSSTP

SEQ ID NO: 136411 - protein, 10 aa, Mycobacterium tuberculosis
LSAATSSTPR

SEQ ID NO: 136412 - protein, 10 aa, Mycobacterium tuberculosis
TSSTPREAPY

SEQ ID NO: 136413 - protein, 10 aa, Mycobacterium tuberculosis
STPREAPYEL

SEQ ID NO: 136414 - protein, 10 aa, Mycobacterium tuberculosis
APYELNITSA

SEQ ID NO: 136415 - protein, 10 aa, Mycobacterium tuberculosis
YELNITSATY

SEQ ID NO: 136416 - protein, 10 aa, Mycobacterium tuberculosis
NITSATYQSA

SEQ ID NO: 136417 - protein, 10 aa, Mycobacterium tuberculosis
ITSATYQSAI

SEQ ID NO: 136418 - protein, 10 aa, Mycobacterium tuberculosis
ATYQSAIPPR

SEQ ID NO: 136419 - protein, 10 aa, Mycobacterium tuberculosis
AIPPRGTQAV

SEQ ID NO: 136420 - protein, 10 aa, Mycobacterium tuberculosis
IPPRGTQAVV

SEQ ID NO: 136421 - protein, 10 aa, Mycobacterium tuberculosis
PPRGTQAVVL

SEQ ID NO: 136422 - protein, 10 aa, Mycobacterium tuberculosis
GTQAVVLKVY

SEQ ID NO: 136423 - protein, 10 aa, Mycobacterium tuberculosis
YQNAGGTHPT

SEQ ID NO: 136424 - protein, 10 aa, Mycobacterium tuberculosis
GGTHPTTTYK

SEQ ID NO: 136425 - protein, 10 aa, Mycobacterium tuberculosis
GTHPTTTYKA

SEQ ID NO: 136426 - protein, 10 aa, Mycobacterium tuberculosis
THPTTTYKAF

SEQ ID NO: 136427 - protein, 10 aa, Mycobacterium tuberculosis
TTYKAFDWDQ

SEQ ID NO: 136428 - protein, 10 aa, Mycobacterium tuberculosis
YKAFDWDQAY

SEQ ID NO: 136429 - protein, 10 aa, Mycobacterium tuberculosis
KAFDWDQAYR

SEQ ID NO: 136430 - protein, 10 aa, Mycobacterium tuberculosis
AFDWDQAYRK

SEQ ID NO: 136431 - protein, 10 aa, Mycobacterium tuberculosis
YRKPITYDTL

SEQ ID NO: 136432 - protein, 10 aa, Mycobacterium tuberculosis
TLWQADTDPL

SEQ ID NO: 136433 - protein, 10 aa, Mycobacterium tuberculosis
WQADTDPLPV

SEQ ID NO: 136434 - protein, 10 aa, Mycobacterium tuberculosis
QADTDPLPVV

SEQ ID NO: 136435 - protein, 10 aa, Mycobacterium tuberculosis
TDPLPVVFPI

SEQ ID NO: 136436 - protein, 10 aa, Mycobacterium tuberculosis
DPLPVVFPIV

SEQ ID NO: 136437 - protein, 10 aa, Mycobacterium tuberculosis
LPVVFPIVQG

SEQ ID NO: 136438 - protein, 10 aa, Mycobacterium tuberculosis
VVFPIVQGEL

SEQ ID NO: 136439 - protein, 10 aa, Mycobacterium tuberculosis
FPIVQGELSK

SEQ ID NO: 136440 - protein, 10 aa, Mycobacterium tuberculosis
ELSKQTGQQV

SEQ ID NO: 136441 - protein, 10 aa, Mycobacterium tuberculosis
KQTGQQVSIA

SEQ ID NO: 136442 - protein, 10 aa, Mycobacterium tuberculosis
QVSIAPNAGL

SEQ ID NO: 136443 - protein, 10 aa, Mycobacterium tuberculosis
IAPNAGLDPV

SEQ ID NO: 136444 - protein, 10 aa, Mycobacterium tuberculosis
GLDPVNYQNF

SEQ ID NO: 136445 - protein, 10 aa, Mycobacterium tuberculosis
DPVNYQNFAV

SEQ ID NO: 136446 - protein, 10 aa, Mycobacterium tuberculosis
QNFAVTNDGV

SEQ ID NO: 136447 - protein, 10 aa, Mycobacterium tuberculosis
FAVTNDGVIF

SEQ ID NO: 136448 - protein, 10 aa, Mycobacterium tuberculosis
AVTNDGVIFF

SEQ ID NO: 136449 - protein, 10 aa, Mycobacterium tuberculosis
VTNDGVIFFF

SEQ ID NO: 136450 - protein, 10 aa, Mycobacterium tuberculosis
VIFFFNPGEL

SEQ ID NO: 136451 - protein, 10 aa, Mycobacterium tuberculosis
IFFFNPGELL

SEQ ID NO: 136452 - protein, 10 aa, Mycobacterium tuberculosis
NPGELLPEAA

SEQ ID NO: 136453 - protein, 10 aa, Mycobacterium tuberculosis
ELLPEAAGPT

SEQ ID NO: 136454 - protein, 10 aa, Mycobacterium tuberculosis
LLPEAAGPTQ

SEQ ID NO: 136455 - protein, 10 aa, Mycobacterium tuberculosis
LPEAAGPTQV

SEQ ID NO: 136456 - protein, 10 aa, Mycobacterium tuberculosis
PEAAGPTQVL

SEQ ID NO: 136457 - protein, 10 aa, Mycobacterium tuberculosis
EAAGPTQVLV

SEQ ID NO: 136458 - protein, 10 aa, Mycobacterium tuberculosis
TQVLVPRSAI

SEQ ID NO: 136459 - protein, 10 aa, Mycobacterium tuberculosis
LVPRSAIDSM

SEQ ID NO: 136460 - protein, 10 aa, Mycobacterium tuberculosis
VPRSAIDSML

SEQ ID NO: 136461 - protein, 11 aa, Mycobacterium tuberculosis
MRIKIFMLVTA

SEQ ID NO: 136462 - protein, 11 aa, Mycobacterium tuberculosis
RIKIFMLVTAV

SEQ ID NO: 136463 - protein, 11 aa, Mycobacterium tuberculosis
KIFMLVTAVVL

SEQ ID NO: 136464 - protein, 11 aa, Mycobacterium tuberculosis
IFMLVTAVVLL

SEQ ID NO: 136465 - protein, 11 aa, Mycobacterium tuberculosis
FMLVTAVVLLC

SEQ ID NO: 136466 - protein, 11 aa, Mycobacterium tuberculosis
MLVTAVVLLCC

SEQ ID NO: 136467 - protein, 11 aa, Mycobacterium tuberculosis
TAVVLLCCSGV

SEQ ID NO: 136468 - protein, 11 aa, Mycobacterium tuberculosis
VLLCCSGVATA

SEQ ID NO: 136469 - protein, 11 aa, Mycobacterium tuberculosis
LLCCSGVATAA

SEQ ID NO: 136470 - protein, 11 aa, Mycobacterium tuberculosis
TAAPKTYCEEL

SEQ ID NO: 136471 - protein, 11 aa, Mycobacterium tuberculosis
AAPKTYCEELK

SEQ ID NO: 136472 - protein, 11 aa, Mycobacterium tuberculosis
QACQIQMSDPA

SEQ ID NO: 136473 - protein, 11 aa, Mycobacterium tuberculosis
QMSDPAYNINI

SEQ ID NO: 136474 - protein, 11 aa, Mycobacterium tuberculosis
AYNINISLPSY

SEQ ID NO: 136475 - protein, 11 aa, Mycobacterium tuberculosis
YNINISLPSYY

SEQ ID NO: 136476 - protein, 11 aa, Mycobacterium tuberculosis
ISLPSYYPDQK

SEQ ID NO: 136477 - protein, 11 aa, Mycobacterium tuberculosis
LPSYYPDQKSL

SEQ ID NO: 136478 - protein, 11 aa, Mycobacterium tuberculosis
YYPDQKSLENY

SEQ ID NO: 136479 - protein, 11 aa, Mycobacterium tuberculosis
YPDQKSLENYI

SEQ ID NO: 136480 - protein, 11 aa, Mycobacterium tuberculosis
KSLENYIAQTR

SEQ ID NO: 136481 - protein, 11 aa, Mycobacterium tuberculosis
NYIAQTRDKFL

SEQ ID NO: 136482 - protein, 11 aa, Mycobacterium tuberculosis
AQTRDKFLSAA

SEQ ID NO: 136483 - protein, 11 aa, Mycobacterium tuberculosis
FLSAATSSTPR

SEQ ID NO: 136484 - protein, 11 aa, Mycobacterium tuberculosis
ATSSTPREAPY

SEQ ID NO: 136485 - protein, 11 aa, Mycobacterium tuberculosis
TPREAPYELNI

SEQ ID NO: 136486 - protein, 11 aa, Mycobacterium tuberculosis
REAPYELNITS

SEQ ID NO: 136487 - protein, 11 aa, Mycobacterium tuberculosis
EAPYELNITSA

SEQ ID NO: 136488 - protein, 11 aa, Mycobacterium tuberculosis
APYELNITSAT

SEQ ID NO: 136489 - protein, 11 aa, Mycobacterium tuberculosis
NITSATYQSAI

SEQ ID NO: 136490 - protein, 11 aa, Mycobacterium tuberculosis
SATYQSAIPPR

SEQ ID NO: 136491 - protein, 11 aa, Mycobacterium tuberculosis
SAIPPRGTQAV

SEQ ID NO: 136492 - protein, 11 aa, Mycobacterium tuberculosis
AIPPRGTQAVV

SEQ ID NO: 136493 - protein, 11 aa, Mycobacterium tuberculosis
IPPRGTQAVVL

SEQ ID NO: 136494 - protein, 11 aa, Mycobacterium tuberculosis
YQNAGGTHPTT

SEQ ID NO: 136495 - protein, 11 aa, Mycobacterium tuberculosis
NAGGTHPTTTY

SEQ ID NO: 136496 - protein, 11 aa, Mycobacterium tuberculosis
AGGTHPTTTYK

SEQ ID NO: 136497 - protein, 11 aa, Mycobacterium tuberculosis
GTHPTTTYKAF

SEQ ID NO: 136498 - protein, 11 aa, Mycobacterium tuberculosis
HPTTTYKAFDW

SEQ ID NO: 136499 - protein, 11 aa, Mycobacterium tuberculosis
TTTYKAFDWDQ

SEQ ID NO: 136500 - protein, 11 aa, Mycobacterium tuberculosis
TTYKAFDWDQA

SEQ ID NO: 136501 - protein, 11 aa, Mycobacterium tuberculosis
TYKAFDWDQAY

SEQ ID NO: 136502 - protein, 11 aa, Mycobacterium tuberculosis
YKAFDWDQAYR

SEQ ID NO: 136503 - protein, 11 aa, Mycobacterium tuberculosis
KAFDWDQAYRK

SEQ ID NO: 136504 - protein, 11 aa, Mycobacterium tuberculosis
WDQAYRKPITY

SEQ ID NO: 136505 - protein, 11 aa, Mycobacterium tuberculosis
AYRKPITYDTL

SEQ ID NO: 136506 - protein, 11 aa, Mycobacterium tuberculosis
KPITYDTLWQA

SEQ ID NO: 136507 - protein, 11 aa, Mycobacterium tuberculosis
DTLWQADTDPL

SEQ ID NO: 136508 - protein, 11 aa, Mycobacterium tuberculosis
WQADTDPLPVV

SEQ ID NO: 136509 - protein, 11 aa, Mycobacterium tuberculosis
QADTDPLPVVF

SEQ ID NO: 136510 - protein, 11 aa, Mycobacterium tuberculosis
DTDPLPVVFPI

SEQ ID NO: 136511 - protein, 11 aa, Mycobacterium tuberculosis
LPVVFPIVQGE

SEQ ID NO: 136512 - protein, 11 aa, Mycobacterium tuberculosis
QQVSIAPNAGL

SEQ ID NO: 136513 - protein, 11 aa, Mycobacterium tuberculosis
SIAPNAGLDPV

SEQ ID NO: 136514 - protein, 11 aa, Mycobacterium tuberculosis
APNAGLDPVNY

SEQ ID NO: 136515 - protein, 11 aa, Mycobacterium tuberculosis
GLDPVNYQNFA

SEQ ID NO: 136516 - protein, 11 aa, Mycobacterium tuberculosis
DPVNYQNFAVT

SEQ ID NO: 136517 - protein, 11 aa, Mycobacterium tuberculosis
YQNFAVTNDGV

SEQ ID NO: 136518 - protein, 11 aa, Mycobacterium tuberculosis
NFAVTNDGVIF

SEQ ID NO: 136519 - protein, 11 aa, Mycobacterium tuberculosis
FAVTNDGVIFF

SEQ ID NO: 136520 - protein, 11 aa, Mycobacterium tuberculosis
AVTNDGVIFFF

SEQ ID NO: 136521 - protein, 11 aa, Mycobacterium tuberculosis
GVIFFFNPGEL

SEQ ID NO: 136522 - protein, 11 aa, Mycobacterium tuberculosis
VIFFFNPGELL

SEQ ID NO: 136523 - protein, 11 aa, Mycobacterium tuberculosis
FFNPGELLPEA

SEQ ID NO: 136524 - protein, 11 aa, Mycobacterium tuberculosis
ELLPEAAGPTQ

SEQ ID NO: 136525 - protein, 11 aa, Mycobacterium tuberculosis
LLPEAAGPTQV

SEQ ID NO: 136526 - protein, 11 aa, Mycobacterium tuberculosis
LPEAAGPTQVL

SEQ ID NO: 136527 - protein, 11 aa, Mycobacterium tuberculosis
AAGPTQVLVPR

SEQ ID NO: 136528 - protein, 11 aa, Mycobacterium tuberculosis
GPTQVLVPRSA

SEQ ID NO: 136529 - protein, 11 aa, Mycobacterium tuberculosis
VLVPRSAIDSM

SEQ ID NO: 136530 - protein, 11 aa, Mycobacterium tuberculosis
LVPRSAIDSML

SEQ ID NO: 136531 - protein, 11 aa, Mycobacterium tuberculosis
VPRSAIDSMLA

SEQ ID NO: 136532 - protein, 13 aa, Mycobacterium tuberculosis
MRIKIFMLVTAVV

SEQ ID NO: 136533 - protein, 13 aa, Mycobacterium tuberculosis
RIKIFMLVTAVVL

SEQ ID NO: 136534 - protein, 13 aa, Mycobacterium tuberculosis
IKIFMLVTAVVLL

SEQ ID NO: 136535 - protein, 13 aa, Mycobacterium tuberculosis
KIFMLVTAVVLLC

SEQ ID NO: 136536 - protein, 13 aa, Mycobacterium tuberculosis
IFMLVTAVVLLCC

SEQ ID NO: 136537 - protein, 13 aa, Mycobacterium tuberculosis
FMLVTAVVLLCCS

SEQ ID NO: 136538 - protein, 13 aa, Mycobacterium tuberculosis
MLVTAVVLLCCSG

SEQ ID NO: 136539 - protein, 13 aa, Mycobacterium tuberculosis
LVTAVVLLCCSGV

SEQ ID NO: 136540 - protein, 13 aa, Mycobacterium tuberculosis
VTAVVLLCCSGVA

SEQ ID NO: 136541 - protein, 13 aa, Mycobacterium tuberculosis
TAVVLLCCSGVAT

SEQ ID NO: 136542 - protein, 13 aa, Mycobacterium tuberculosis
AVVLLCCSGVATA

SEQ ID NO: 136543 - protein, 13 aa, Mycobacterium tuberculosis
VVLLCCSGVATAA

SEQ ID NO: 136544 - protein, 13 aa, Mycobacterium tuberculosis
VLLCCSGVATAAP

SEQ ID NO: 136545 - protein, 13 aa, Mycobacterium tuberculosis
LLCCSGVATAAPK

SEQ ID NO: 136546 - protein, 13 aa, Mycobacterium tuberculosis
LCCSGVATAAPKT

SEQ ID NO: 136547 - protein, 13 aa, Mycobacterium tuberculosis
CCSGVATAAPKTY

SEQ ID NO: 136548 - protein, 13 aa, Mycobacterium tuberculosis
CSGVATAAPKTYC

SEQ ID NO: 136549 - protein, 13 aa, Mycobacterium tuberculosis
SGVATAAPKTYCE

SEQ ID NO: 136550 - protein, 13 aa, Mycobacterium tuberculosis
GVATAAPKTYCEE

SEQ ID NO: 136551 - protein, 13 aa, Mycobacterium tuberculosis
VATAAPKTYCEEL

SEQ ID NO: 136552 - protein, 13 aa, Mycobacterium tuberculosis
ATAAPKTYCEELK

SEQ ID NO: 136553 - protein, 13 aa, Mycobacterium tuberculosis
TAAPKTYCEELKG

SEQ ID NO: 136554 - protein, 13 aa, Mycobacterium tuberculosis
AAPKTYCEELKGT

SEQ ID NO: 136555 - protein, 13 aa, Mycobacterium tuberculosis
APKTYCEELKGTD

SEQ ID NO: 136556 - protein, 13 aa, Mycobacterium tuberculosis
PKTYCEELKGTDT

SEQ ID NO: 136557 - protein, 13 aa, Mycobacterium tuberculosis
KTYCEELKGTDTG

SEQ ID NO: 136558 - protein, 13 aa, Mycobacterium tuberculosis
TYCEELKGTDTGQ

SEQ ID NO: 136559 - protein, 13 aa, Mycobacterium tuberculosis
YCEELKGTDTGQA

SEQ ID NO: 136560 - protein, 13 aa, Mycobacterium tuberculosis
CEELKGTDTGQAC

SEQ ID NO: 136561 - protein, 13 aa, Mycobacterium tuberculosis
EELKGTDTGQACQ

SEQ ID NO: 136562 - protein, 13 aa, Mycobacterium tuberculosis
ELKGTDTGQACQI

SEQ ID NO: 136563 - protein, 13 aa, Mycobacterium tuberculosis
LKGTDTGQACQIQ

SEQ ID NO: 136564 - protein, 13 aa, Mycobacterium tuberculosis
KGTDTGQACQIQM

SEQ ID NO: 136565 - protein, 13 aa, Mycobacterium tuberculosis
GTDTGQACQIQMS

SEQ ID NO: 136566 - protein, 13 aa, Mycobacterium tuberculosis
TDTGQACQIQMSD

SEQ ID NO: 136567 - protein, 13 aa, Mycobacterium tuberculosis
DTGQACQIQMSDP

SEQ ID NO: 136568 - protein, 13 aa, Mycobacterium tuberculosis
TGQACQIQMSDPA

SEQ ID NO: 136569 - protein, 13 aa, Mycobacterium tuberculosis
GQACQIQMSDPAY

SEQ ID NO: 136570 - protein, 13 aa, Mycobacterium tuberculosis
QACQIQMSDPAYN

SEQ ID NO: 136571 - protein, 13 aa, Mycobacterium tuberculosis
ACQIQMSDPAYNI

SEQ ID NO: 136572 - protein, 13 aa, Mycobacterium tuberculosis
CQIQMSDPAYNIN

SEQ ID NO: 136573 - protein, 13 aa, Mycobacterium tuberculosis
QIQMSDPAYNINI

SEQ ID NO: 136574 - protein, 13 aa, Mycobacterium tuberculosis
IQMSDPAYNINIS

SEQ ID NO: 136575 - protein, 13 aa, Mycobacterium tuberculosis
QMSDPAYNINISL

SEQ ID NO: 136576 - protein, 13 aa, Mycobacterium tuberculosis
MSDPAYNINISLP

SEQ ID NO: 136577 - protein, 13 aa, Mycobacterium tuberculosis
SDPAYNINISLPS

SEQ ID NO: 136578 - protein, 13 aa, Mycobacterium tuberculosis
DPAYNINISLPSY

SEQ ID NO: 136579 - protein, 13 aa, Mycobacterium tuberculosis
PAYNINISLPSYY

SEQ ID NO: 136580 - protein, 13 aa, Mycobacterium tuberculosis
AYNINISLPSYYP

SEQ ID NO: 136581 - protein, 13 aa, Mycobacterium tuberculosis
YNINISLPSYYPD

SEQ ID NO: 136582 - protein, 13 aa, Mycobacterium tuberculosis
NINISLPSYYPDQ

SEQ ID NO: 136583 - protein, 13 aa, Mycobacterium tuberculosis
INISLPSYYPDQK

SEQ ID NO: 136584 - protein, 13 aa, Mycobacterium tuberculosis
NISLPSYYPDQKS

SEQ ID NO: 136585 - protein, 13 aa, Mycobacterium tuberculosis
ISLPSYYPDQKSL

SEQ ID NO: 136586 - protein, 13 aa, Mycobacterium tuberculosis
SLPSYYPDQKSLE

SEQ ID NO: 136587 - protein, 13 aa, Mycobacterium tuberculosis
LPSYYPDQKSLEN

SEQ ID NO: 136588 - protein, 13 aa, Mycobacterium tuberculosis
PSYYPDQKSLENY

SEQ ID NO: 136589 - protein, 13 aa, Mycobacterium tuberculosis
SYYPDQKSLENYI

SEQ ID NO: 136590 - protein, 13 aa, Mycobacterium tuberculosis
YYPDQKSLENYIA

SEQ ID NO: 136591 - protein, 13 aa, Mycobacterium tuberculosis
YPDQKSLENYIAQ

SEQ ID NO: 136592 - protein, 13 aa, Mycobacterium tuberculosis
PDQKSLENYIAQT

SEQ ID NO: 136593 - protein, 13 aa, Mycobacterium tuberculosis
DQKSLENYIAQTR

SEQ ID NO: 136594 - protein, 13 aa, Mycobacterium tuberculosis
QKSLENYIAQTRD

SEQ ID NO: 136595 - protein, 13 aa, Mycobacterium tuberculosis
KSLENYIAQTRDK

SEQ ID NO: 136596 - protein, 13 aa, Mycobacterium tuberculosis
SLENYIAQTRDKF

SEQ ID NO: 136597 - protein, 13 aa, Mycobacterium tuberculosis
LENYIAQTRDKFL

SEQ ID NO: 136598 - protein, 13 aa, Mycobacterium tuberculosis
ENYIAQTRDKFLS

SEQ ID NO: 136599 - protein, 13 aa, Mycobacterium tuberculosis
NYIAQTRDKFLSA

SEQ ID NO: 136600 - protein, 13 aa, Mycobacterium tuberculosis
YIAQTRDKFLSAA

SEQ ID NO: 136601 - protein, 13 aa, Mycobacterium tuberculosis
IAQTRDKFLSAAT

SEQ ID NO: 136602 - protein, 13 aa, Mycobacterium tuberculosis
AQTRDKFLSAATS

SEQ ID NO: 136603 - protein, 13 aa, Mycobacterium tuberculosis
QTRDKFLSAATSS

SEQ ID NO: 136604 - protein, 13 aa, Mycobacterium tuberculosis
TRDKFLSAATSST

SEQ ID NO: 136605 - protein, 13 aa, Mycobacterium tuberculosis
RDKFLSAATSSTP

SEQ ID NO: 136606 - protein, 13 aa, Mycobacterium tuberculosis
DKFLSAATSSTPR

SEQ ID NO: 136607 - protein, 13 aa, Mycobacterium tuberculosis
KFLSAATSSTPRE

SEQ ID NO: 136608 - protein, 13 aa, Mycobacterium tuberculosis
FLSAATSSTPREA

SEQ ID NO: 136609 - protein, 13 aa, Mycobacterium tuberculosis
LSAATSSTPREAP

SEQ ID NO: 136610 - protein, 13 aa, Mycobacterium tuberculosis
SAATSSTPREAPY

SEQ ID NO: 136611 - protein, 13 aa, Mycobacterium tuberculosis
AATSSTPREAPYE

SEQ ID NO: 136612 - protein, 13 aa, Mycobacterium tuberculosis
ATSSTPREAPYEL

SEQ ID NO: 136613 - protein, 13 aa, Mycobacterium tuberculosis
TSSTPREAPYELN

SEQ ID NO: 136614 - protein, 13 aa, Mycobacterium tuberculosis
SSTPREAPYELNI

SEQ ID NO: 136615 - protein, 13 aa, Mycobacterium tuberculosis
STPREAPYELNIT

SEQ ID NO: 136616 - protein, 13 aa, Mycobacterium tuberculosis
TPREAPYELNITS

SEQ ID NO: 136617 - protein, 13 aa, Mycobacterium tuberculosis
PREAPYELNITSA

SEQ ID NO: 136618 - protein, 13 aa, Mycobacterium tuberculosis
REAPYELNITSAT

SEQ ID NO: 136619 - protein, 13 aa, Mycobacterium tuberculosis
EAPYELNITSATY

SEQ ID NO: 136620 - protein, 13 aa, Mycobacterium tuberculosis
APYELNITSATYQ

SEQ ID NO: 136621 - protein, 13 aa, Mycobacterium tuberculosis
PYELNITSATYQS

SEQ ID NO: 136622 - protein, 13 aa, Mycobacterium tuberculosis
YELNITSATYQSA

SEQ ID NO: 136623 - protein, 13 aa, Mycobacterium tuberculosis
ELNITSATYQSAI

SEQ ID NO: 136624 - protein, 13 aa, Mycobacterium tuberculosis
LNITSATYQSAIP

SEQ ID NO: 136625 - protein, 13 aa, Mycobacterium tuberculosis
NITSATYQSAIPP

SEQ ID NO: 136626 - protein, 13 aa, Mycobacterium tuberculosis
ITSATYQSAIPPR

SEQ ID NO: 136627 - protein, 13 aa, Mycobacterium tuberculosis
TSATYQSAIPPRG

SEQ ID NO: 136628 - protein, 13 aa, Mycobacterium tuberculosis
SATYQSAIPPRGT

SEQ ID NO: 136629 - protein, 13 aa, Mycobacterium tuberculosis
ATYQSAIPPRGTQ

SEQ ID NO: 136630 - protein, 13 aa, Mycobacterium tuberculosis
TYQSAIPPRGTQA

SEQ ID NO: 136631 - protein, 13 aa, Mycobacterium tuberculosis
YQSAIPPRGTQAV

SEQ ID NO: 136632 - protein, 13 aa, Mycobacterium tuberculosis
QSAIPPRGTQAVV

SEQ ID NO: 136633 - protein, 13 aa, Mycobacterium tuberculosis
SAIPPRGTQAVVL

SEQ ID NO: 136634 - protein, 13 aa, Mycobacterium tuberculosis
AIPPRGTQAVVLK

SEQ ID NO: 136635 - protein, 13 aa, Mycobacterium tuberculosis
IPPRGTQAVVLKV

SEQ ID NO: 136636 - protein, 13 aa, Mycobacterium tuberculosis
PPRGTQAVVLKVY

SEQ ID NO: 136637 - protein, 13 aa, Mycobacterium tuberculosis
PRGTQAVVLKVYQ

SEQ ID NO: 136638 - protein, 13 aa, Mycobacterium tuberculosis
RGTQAVVLKVYQN

SEQ ID NO: 136639 - protein, 13 aa, Mycobacterium tuberculosis
GTQAVVLKVYQNA

SEQ ID NO: 136640 - protein, 13 aa, Mycobacterium tuberculosis
TQAVVLKVYQNAG

SEQ ID NO: 136641 - protein, 13 aa, Mycobacterium tuberculosis
QAVVLKVYQNAGG

SEQ ID NO: 136642 - protein, 13 aa, Mycobacterium tuberculosis
AVVLKVYQNAGGT

SEQ ID NO: 136643 - protein, 13 aa, Mycobacterium tuberculosis
VVLKVYQNAGGTH

SEQ ID NO: 136644 - protein, 13 aa, Mycobacterium tuberculosis
VLKVYQNAGGTHP

SEQ ID NO: 136645 - protein, 13 aa, Mycobacterium tuberculosis
LKVYQNAGGTHPT

SEQ ID NO: 136646 - protein, 13 aa, Mycobacterium tuberculosis
KVYQNAGGTHPTT

SEQ ID NO: 136647 - protein, 13 aa, Mycobacterium tuberculosis
VYQNAGGTHPTTT

SEQ ID NO: 136648 - protein, 13 aa, Mycobacterium tuberculosis
YQNAGGTHPTTTY

SEQ ID NO: 136649 - protein, 13 aa, Mycobacterium tuberculosis
QNAGGTHPTTTYK

SEQ ID NO: 136650 - protein, 13 aa, Mycobacterium tuberculosis
NAGGTHPTTTYKA

SEQ ID NO: 136651 - protein, 13 aa, Mycobacterium tuberculosis
AGGTHPTTTYKAF

SEQ ID NO: 136652 - protein, 13 aa, Mycobacterium tuberculosis
GGTHPTTTYKAFD

SEQ ID NO: 136653 - protein, 13 aa, Mycobacterium tuberculosis
GTHPTTTYKAFDW

SEQ ID NO: 136654 - protein, 13 aa, Mycobacterium tuberculosis
THPTTTYKAFDWD

SEQ ID NO: 136655 - protein, 13 aa, Mycobacterium tuberculosis
HPTTTYKAFDWDQ

SEQ ID NO: 136656 - protein, 13 aa, Mycobacterium tuberculosis
PTTTYKAFDWDQA

SEQ ID NO: 136657 - protein, 13 aa, Mycobacterium tuberculosis
TTTYKAFDWDQAY

SEQ ID NO: 136658 - protein, 13 aa, Mycobacterium tuberculosis
TTYKAFDWDQAYR

SEQ ID NO: 136659 - protein, 13 aa, Mycobacterium tuberculosis
TYKAFDWDQAYRK

SEQ ID NO: 136660 - protein, 13 aa, Mycobacterium tuberculosis
YKAFDWDQAYRKP

SEQ ID NO: 136661 - protein, 13 aa, Mycobacterium tuberculosis
KAFDWDQAYRKPI

SEQ ID NO: 136662 - protein, 13 aa, Mycobacterium tuberculosis
AFDWDQAYRKPIT

SEQ ID NO: 136663 - protein, 13 aa, Mycobacterium tuberculosis
FDWDQAYRKPITY

SEQ ID NO: 136664 - protein, 13 aa, Mycobacterium tuberculosis
DWDQAYRKPITYD

SEQ ID NO: 136665 - protein, 13 aa, Mycobacterium tuberculosis
WDQAYRKPITYDT

SEQ ID NO: 136666 - protein, 13 aa, Mycobacterium tuberculosis
DQAYRKPITYDTL

SEQ ID NO: 136667 - protein, 13 aa, Mycobacterium tuberculosis
QAYRKPITYDTLW

SEQ ID NO: 136668 - protein, 13 aa, Mycobacterium tuberculosis
AYRKPITYDTLWQ

SEQ ID NO: 136669 - protein, 13 aa, Mycobacterium tuberculosis
YRKPITYDTLWQA

SEQ ID NO: 136670 - protein, 13 aa, Mycobacterium tuberculosis
RKPITYDTLWQAD

SEQ ID NO: 136671 - protein, 13 aa, Mycobacterium tuberculosis
KPITYDTLWQADT

SEQ ID NO: 136672 - protein, 13 aa, Mycobacterium tuberculosis
PITYDTLWQADTD

SEQ ID NO: 136673 - protein, 13 aa, Mycobacterium tuberculosis
ITYDTLWQADTDP

SEQ ID NO: 136674 - protein, 13 aa, Mycobacterium tuberculosis
TYDTLWQADTDPL

SEQ ID NO: 136675 - protein, 13 aa, Mycobacterium tuberculosis
YDTLWQADTDPLP

SEQ ID NO: 136676 - protein, 13 aa, Mycobacterium tuberculosis
DTLWQADTDPLPV

SEQ ID NO: 136677 - protein, 13 aa, Mycobacterium tuberculosis
TLWQADTDPLPVV

SEQ ID NO: 136678 - protein, 13 aa, Mycobacterium tuberculosis
LWQADTDPLPVVF

SEQ ID NO: 136679 - protein, 13 aa, Mycobacterium tuberculosis
WQADTDPLPVVFP

SEQ ID NO: 136680 - protein, 13 aa, Mycobacterium tuberculosis
QADTDPLPVVFPI

SEQ ID NO: 136681 - protein, 13 aa, Mycobacterium tuberculosis
ADTDPLPVVFPIV

SEQ ID NO: 136682 - protein, 13 aa, Mycobacterium tuberculosis
DTDPLPVVFPIVQ

SEQ ID NO: 136683 - protein, 13 aa, Mycobacterium tuberculosis
TDPLPVVFPIVQG

SEQ ID NO: 136684 - protein, 13 aa, Mycobacterium tuberculosis
DPLPVVFPIVQGE

SEQ ID NO: 136685 - protein, 13 aa, Mycobacterium tuberculosis
PLPVVFPIVQGEL

SEQ ID NO: 136686 - protein, 13 aa, Mycobacterium tuberculosis
LPVVFPIVQGELS

SEQ ID NO: 136687 - protein, 13 aa, Mycobacterium tuberculosis
PVVFPIVQGELSK

SEQ ID NO: 136688 - protein, 13 aa, Mycobacterium tuberculosis
VVFPIVQGELSKQ

SEQ ID NO: 136689 - protein, 13 aa, Mycobacterium tuberculosis
VFPIVQGELSKQT

SEQ ID NO: 136690 - protein, 13 aa, Mycobacterium tuberculosis
FPIVQGELSKQTG

SEQ ID NO: 136691 - protein, 13 aa, Mycobacterium tuberculosis
PIVQGELSKQTGQ

SEQ ID NO: 136692 - protein, 13 aa, Mycobacterium tuberculosis
IVQGELSKQTGQQ

SEQ ID NO: 136693 - protein, 13 aa, Mycobacterium tuberculosis
VQGELSKQTGQQV

SEQ ID NO: 136694 - protein, 13 aa, Mycobacterium tuberculosis
QGELSKQTGQQVS

SEQ ID NO: 136695 - protein, 13 aa, Mycobacterium tuberculosis
GELSKQTGQQVSI

SEQ ID NO: 136696 - protein, 13 aa, Mycobacterium tuberculosis
ELSKQTGQQVSIA

SEQ ID NO: 136697 - protein, 13 aa, Mycobacterium tuberculosis
LSKQTGQQVSIAP

SEQ ID NO: 136698 - protein, 13 aa, Mycobacterium tuberculosis
SKQTGQQVSIAPN

SEQ ID NO: 136699 - protein, 13 aa, Mycobacterium tuberculosis
KQTGQQVSIAPNA

SEQ ID NO: 136700 - protein, 13 aa, Mycobacterium tuberculosis
QTGQQVSIAPNAG

SEQ ID NO: 136701 - protein, 13 aa, Mycobacterium tuberculosis
TGQQVSIAPNAGL

SEQ ID NO: 136702 - protein, 13 aa, Mycobacterium tuberculosis
GQQVSIAPNAGLD

SEQ ID NO: 136703 - protein, 13 aa, Mycobacterium tuberculosis
QQVSIAPNAGLDP

SEQ ID NO: 136704 - protein, 13 aa, Mycobacterium tuberculosis
QVSIAPNAGLDPV

SEQ ID NO: 136705 - protein, 13 aa, Mycobacterium tuberculosis
VSIAPNAGLDPVN

SEQ ID NO: 136706 - protein, 13 aa, Mycobacterium tuberculosis
SIAPNAGLDPVNY

SEQ ID NO: 136707 - protein, 13 aa, Mycobacterium tuberculosis
IAPNAGLDPVNYQ

SEQ ID NO: 136708 - protein, 13 aa, Mycobacterium tuberculosis
APNAGLDPVNYQN

SEQ ID NO: 136709 - protein, 13 aa, Mycobacterium tuberculosis
PNAGLDPVNYQNF

SEQ ID NO: 136710 - protein, 13 aa, Mycobacterium tuberculosis
NAGLDPVNYQNFA

SEQ ID NO: 136711 - protein, 13 aa, Mycobacterium tuberculosis
AGLDPVNYQNFAV

SEQ ID NO: 136712 - protein, 13 aa, Mycobacterium tuberculosis
GLDPVNYQNFAVT

SEQ ID NO: 136713 - protein, 13 aa, Mycobacterium tuberculosis
LDPVNYQNFAVTN

SEQ ID NO: 136714 - protein, 13 aa, Mycobacterium tuberculosis
DPVNYQNFAVTND

SEQ ID NO: 136715 - protein, 13 aa, Mycobacterium tuberculosis
PVNYQNFAVTNDG

SEQ ID NO: 136716 - protein, 13 aa, Mycobacterium tuberculosis
VNYQNFAVTNDGV

SEQ ID NO: 136717 - protein, 13 aa, Mycobacterium tuberculosis
NYQNFAVTNDGVI

SEQ ID NO: 136718 - protein, 13 aa, Mycobacterium tuberculosis
YQNFAVTNDGVIF

SEQ ID NO: 136719 - protein, 13 aa, Mycobacterium tuberculosis
QNFAVTNDGVIFF

SEQ ID NO: 136720 - protein, 13 aa, Mycobacterium tuberculosis
NFAVTNDGVIFFF

SEQ ID NO: 136721 - protein, 13 aa, Mycobacterium tuberculosis
FAVTNDGVIFFFN

SEQ ID NO: 136722 - protein, 13 aa, Mycobacterium tuberculosis
AVTNDGVIFFFNP

SEQ ID NO: 136723 - protein, 13 aa, Mycobacterium tuberculosis
VTNDGVIFFFNPG

SEQ ID NO: 136724 - protein, 13 aa, Mycobacterium tuberculosis
TNDGVIFFFNPGE

SEQ ID NO: 136725 - protein, 13 aa, Mycobacterium tuberculosis
NDGVIFFFNPGEL

SEQ ID NO: 136726 - protein, 13 aa, Mycobacterium tuberculosis
DGVIFFFNPGELL

SEQ ID NO: 136727 - protein, 13 aa, Mycobacterium tuberculosis
GVIFFFNPGELLP

SEQ ID NO: 136728 - protein, 13 aa, Mycobacterium tuberculosis
VIFFFNPGELLPE

SEQ ID NO: 136729 - protein, 13 aa, Mycobacterium tuberculosis
IFFFNPGELLPEA

SEQ ID NO: 136730 - protein, 13 aa, Mycobacterium tuberculosis
FFFNPGELLPEAA

SEQ ID NO: 136731 - protein, 13 aa, Mycobacterium tuberculosis
FFNPGELLPEAAG

SEQ ID NO: 136732 - protein, 13 aa, Mycobacterium tuberculosis
FNPGELLPEAAGP

SEQ ID NO: 136733 - protein, 13 aa, Mycobacterium tuberculosis
NPGELLPEAAGPT

SEQ ID NO: 136734 - protein, 13 aa, Mycobacterium tuberculosis
PGELLPEAAGPTQ

SEQ ID NO: 136735 - protein, 13 aa, Mycobacterium tuberculosis
GELLPEAAGPTQV

SEQ ID NO: 136736 - protein, 13 aa, Mycobacterium tuberculosis
ELLPEAAGPTQVL

SEQ ID NO: 136737 - protein, 13 aa, Mycobacterium tuberculosis
LLPEAAGPTQVLV

SEQ ID NO: 136738 - protein, 13 aa, Mycobacterium tuberculosis
LPEAAGPTQVLVP

SEQ ID NO: 136739 - protein, 13 aa, Mycobacterium tuberculosis
PEAAGPTQVLVPR

SEQ ID NO: 136740 - protein, 13 aa, Mycobacterium tuberculosis
EAAGPTQVLVPRS

SEQ ID NO: 136741 - protein, 13 aa, Mycobacterium tuberculosis
AAGPTQVLVPRSA

SEQ ID NO: 136742 - protein, 13 aa, Mycobacterium tuberculosis
AGPTQVLVPRSAI

SEQ ID NO: 136743 - protein, 13 aa, Mycobacterium tuberculosis
GPTQVLVPRSAID

SEQ ID NO: 136744 - protein, 13 aa, Mycobacterium tuberculosis
PTQVLVPRSAIDS

SEQ ID NO: 136745 - protein, 13 aa, Mycobacterium tuberculosis
TQVLVPRSAIDSM

SEQ ID NO: 136746 - protein, 13 aa, Mycobacterium tuberculosis
QVLVPRSAIDSML

SEQ ID NO: 136747 - protein, 13 aa, Mycobacterium tuberculosis
VLVPRSAIDSMLA

SEQ ID NO: 136748 - protein, 14 aa, Mycobacterium tuberculosis
MRIKIFMLVTAVVL

SEQ ID NO: 136749 - protein, 14 aa, Mycobacterium tuberculosis
RIKIFMLVTAVVLL

SEQ ID NO: 136750 - protein, 14 aa, Mycobacterium tuberculosis
IKIFMLVTAVVLLC

SEQ ID NO: 136751 - protein, 14 aa, Mycobacterium tuberculosis
KIFMLVTAVVLLCC

SEQ ID NO: 136752 - protein, 14 aa, Mycobacterium tuberculosis
IFMLVTAVVLLCCS

SEQ ID NO: 136753 - protein, 14 aa, Mycobacterium tuberculosis
FMLVTAVVLLCCSG

SEQ ID NO: 136754 - protein, 14 aa, Mycobacterium tuberculosis
MLVTAVVLLCCSGV

SEQ ID NO: 136755 - protein, 14 aa, Mycobacterium tuberculosis
LVTAVVLLCCSGVA

SEQ ID NO: 136756 - protein, 14 aa, Mycobacterium tuberculosis
VTAVVLLCCSGVAT

SEQ ID NO: 136757 - protein, 14 aa, Mycobacterium tuberculosis
TAVVLLCCSGVATA

SEQ ID NO: 136758 - protein, 14 aa, Mycobacterium tuberculosis
AVVLLCCSGVATAA

SEQ ID NO: 136759 - protein, 14 aa, Mycobacterium tuberculosis
VVLLCCSGVATAAP

SEQ ID NO: 136760 - protein, 14 aa, Mycobacterium tuberculosis
VLLCCSGVATAAPK

SEQ ID NO: 136761 - protein, 14 aa, Mycobacterium tuberculosis
LLCCSGVATAAPKT

SEQ ID NO: 136762 - protein, 14 aa, Mycobacterium tuberculosis
LCCSGVATAAPKTY

SEQ ID NO: 136763 - protein, 14 aa, Mycobacterium tuberculosis
CCSGVATAAPKTYC

SEQ ID NO: 136764 - protein, 14 aa, Mycobacterium tuberculosis
CSGVATAAPKTYCE

SEQ ID NO: 136765 - protein, 14 aa, Mycobacterium tuberculosis
SGVATAAPKTYCEE

SEQ ID NO: 136766 - protein, 14 aa, Mycobacterium tuberculosis
GVATAAPKTYCEEL

SEQ ID NO: 136767 - protein, 14 aa, Mycobacterium tuberculosis
VATAAPKTYCEELK

SEQ ID NO: 136768 - protein, 14 aa, Mycobacterium tuberculosis
ATAAPKTYCEELKG

SEQ ID NO: 136769 - protein, 14 aa, Mycobacterium tuberculosis
TAAPKTYCEELKGT

SEQ ID NO: 136770 - protein, 14 aa, Mycobacterium tuberculosis
AAPKTYCEELKGTD

SEQ ID NO: 136771 - protein, 14 aa, Mycobacterium tuberculosis
APKTYCEELKGTDT

SEQ ID NO: 136772 - protein, 14 aa, Mycobacterium tuberculosis
PKTYCEELKGTDTG

SEQ ID NO: 136773 - protein, 14 aa, Mycobacterium tuberculosis
KTYCEELKGTDTGQ

SEQ ID NO: 136774 - protein, 14 aa, Mycobacterium tuberculosis
TYCEELKGTDTGQA

SEQ ID NO: 136775 - protein, 14 aa, Mycobacterium tuberculosis
YCEELKGTDTGQAC

SEQ ID NO: 136776 - protein, 14 aa, Mycobacterium tuberculosis
CEELKGTDTGQACQ

SEQ ID NO: 136777 - protein, 14 aa, Mycobacterium tuberculosis
EELKGTDTGQACQI

SEQ ID NO: 136778 - protein, 14 aa, Mycobacterium tuberculosis
ELKGTDTGQACQIQ

SEQ ID NO: 136779 - protein, 14 aa, Mycobacterium tuberculosis
LKGTDTGQACQIQM

SEQ ID NO: 136780 - protein, 14 aa, Mycobacterium tuberculosis
KGTDTGQACQIQMS

SEQ ID NO: 136781 - protein, 14 aa, Mycobacterium tuberculosis
GTDTGQACQIQMSD

SEQ ID NO: 136782 - protein, 14 aa, Mycobacterium tuberculosis
TDTGQACQIQMSDP

SEQ ID NO: 136783 - protein, 14 aa, Mycobacterium tuberculosis
DTGQACQIQMSDPA

SEQ ID NO: 136784 - protein, 14 aa, Mycobacterium tuberculosis
TGQACQIQMSDPAY

SEQ ID NO: 136785 - protein, 14 aa, Mycobacterium tuberculosis
GQACQIQMSDPAYN

SEQ ID NO: 136786 - protein, 14 aa, Mycobacterium tuberculosis
QACQIQMSDPAYNI

SEQ ID NO: 136787 - protein, 14 aa, Mycobacterium tuberculosis
ACQIQMSDPAYNIN

SEQ ID NO: 136788 - protein, 14 aa, Mycobacterium tuberculosis
CQIQMSDPAYNINI

SEQ ID NO: 136789 - protein, 14 aa, Mycobacterium tuberculosis
QIQMSDPAYNINIS

SEQ ID NO: 136790 - protein, 14 aa, Mycobacterium tuberculosis
IQMSDPAYNINISL

SEQ ID NO: 136791 - protein, 14 aa, Mycobacterium tuberculosis
QMSDPAYNINISLP

SEQ ID NO: 136792 - protein, 14 aa, Mycobacterium tuberculosis
MSDPAYNINISLPS

SEQ ID NO: 136793 - protein, 14 aa, Mycobacterium tuberculosis
SDPAYNINISLPSY

SEQ ID NO: 136794 - protein, 14 aa, Mycobacterium tuberculosis
DPAYNINISLPSYY

SEQ ID NO: 136795 - protein, 14 aa, Mycobacterium tuberculosis
PAYNINISLPSYYP

SEQ ID NO: 136796 - protein, 14 aa, Mycobacterium tuberculosis
AYNINISLPSYYPD

SEQ ID NO: 136797 - protein, 14 aa, Mycobacterium tuberculosis
YNINISLPSYYPDQ

SEQ ID NO: 136798 - protein, 14 aa, Mycobacterium tuberculosis
NINISLPSYYPDQK

SEQ ID NO: 136799 - protein, 14 aa, Mycobacterium tuberculosis
INISLPSYYPDQKS

SEQ ID NO: 136800 - protein, 14 aa, Mycobacterium tuberculosis
NISLPSYYPDQKSL

SEQ ID NO: 136801 - protein, 14 aa, Mycobacterium tuberculosis
ISLPSYYPDQKSLE

SEQ ID NO: 136802 - protein, 14 aa, Mycobacterium tuberculosis
SLPSYYPDQKSLEN

SEQ ID NO: 136803 - protein, 14 aa, Mycobacterium tuberculosis
LPSYYPDQKSLENY

SEQ ID NO: 136804 - protein, 14 aa, Mycobacterium tuberculosis
PSYYPDQKSLENYI

SEQ ID NO: 136805 - protein, 14 aa, Mycobacterium tuberculosis
SYYPDQKSLENYIA

SEQ ID NO: 136806 - protein, 14 aa, Mycobacterium tuberculosis
YYPDQKSLENYIAQ

SEQ ID NO: 136807 - protein, 14 aa, Mycobacterium tuberculosis
YPDQKSLENYIAQT

SEQ ID NO: 136808 - protein, 14 aa, Mycobacterium tuberculosis
PDQKSLENYIAQTR

SEQ ID NO: 136809 - protein, 14 aa, Mycobacterium tuberculosis
DQKSLENYIAQTRD

SEQ ID NO: 136810 - protein, 14 aa, Mycobacterium tuberculosis
QKSLENYIAQTRDK

SEQ ID NO: 136811 - protein, 14 aa, Mycobacterium tuberculosis
KSLENYIAQTRDKF

SEQ ID NO: 136812 - protein, 14 aa, Mycobacterium tuberculosis
SLENYIAQTRDKFL

SEQ ID NO: 136813 - protein, 14 aa, Mycobacterium tuberculosis
LENYIAQTRDKFLS

SEQ ID NO: 136814 - protein, 14 aa, Mycobacterium tuberculosis
ENYIAQTRDKFLSA

SEQ ID NO: 136815 - protein, 14 aa, Mycobacterium tuberculosis
NYIAQTRDKFLSAA

SEQ ID NO: 136816 - protein, 14 aa, Mycobacterium tuberculosis
YIAQTRDKFLSAAT

SEQ ID NO: 136817 - protein, 14 aa, Mycobacterium tuberculosis
IAQTRDKFLSAATS

SEQ ID NO: 136818 - protein, 14 aa, Mycobacterium tuberculosis
AQTRDKFLSAATSS

SEQ ID NO: 136819 - protein, 14 aa, Mycobacterium tuberculosis
QTRDKFLSAATSST

SEQ ID NO: 136820 - protein, 14 aa, Mycobacterium tuberculosis
TRDKFLSAATSSTP

SEQ ID NO: 136821 - protein, 14 aa, Mycobacterium tuberculosis
RDKFLSAATSSTPR

SEQ ID NO: 136822 - protein, 14 aa, Mycobacterium tuberculosis
DKFLSAATSSTPRE

SEQ ID NO: 136823 - protein, 14 aa, Mycobacterium tuberculosis
KFLSAATSSTPREA

SEQ ID NO: 136824 - protein, 14 aa, Mycobacterium tuberculosis
FLSAATSSTPREAP

SEQ ID NO: 136825 - protein, 14 aa, Mycobacterium tuberculosis
LSAATSSTPREAPY

SEQ ID NO: 136826 - protein, 14 aa, Mycobacterium tuberculosis
SAATSSTPREAPYE

SEQ ID NO: 136827 - protein, 14 aa, Mycobacterium tuberculosis
AATSSTPREAPYEL

SEQ ID NO: 136828 - protein, 14 aa, Mycobacterium tuberculosis
ATSSTPREAPYELN

SEQ ID NO: 136829 - protein, 14 aa, Mycobacterium tuberculosis
TSSTPREAPYELNI

SEQ ID NO: 136830 - protein, 14 aa, Mycobacterium tuberculosis
SSTPREAPYELNIT

SEQ ID NO: 136831 - protein, 14 aa, Mycobacterium tuberculosis
STPREAPYELNITS

SEQ ID NO: 136832 - protein, 14 aa, Mycobacterium tuberculosis
TPREAPYELNITSA

SEQ ID NO: 136833 - protein, 14 aa, Mycobacterium tuberculosis
PREAPYELNITSAT

SEQ ID NO: 136834 - protein, 14 aa, Mycobacterium tuberculosis
REAPYELNITSATY

SEQ ID NO: 136835 - protein, 14 aa, Mycobacterium tuberculosis
EAPYELNITSATYQ

SEQ ID NO: 136836 - protein, 14 aa, Mycobacterium tuberculosis
APYELNITSATYQS

SEQ ID NO: 136837 - protein, 14 aa, Mycobacterium tuberculosis
PYELNITSATYQSA

SEQ ID NO: 136838 - protein, 14 aa, Mycobacterium tuberculosis
YELNITSATYQSAI

SEQ ID NO: 136839 - protein, 14 aa, Mycobacterium tuberculosis
ELNITSATYQSAIP

SEQ ID NO: 136840 - protein, 14 aa, Mycobacterium tuberculosis
LNITSATYQSAIPP

SEQ ID NO: 136841 - protein, 14 aa, Mycobacterium tuberculosis
NITSATYQSAIPPR

SEQ ID NO: 136842 - protein, 14 aa, Mycobacterium tuberculosis
ITSATYQSAIPPRG

SEQ ID NO: 136843 - protein, 14 aa, Mycobacterium tuberculosis
TSATYQSAIPPRGT

SEQ ID NO: 136844 - protein, 14 aa, Mycobacterium tuberculosis
SATYQSAIPPRGTQ

SEQ ID NO: 136845 - protein, 14 aa, Mycobacterium tuberculosis
ATYQSAIPPRGTQA

SEQ ID NO: 136846 - protein, 14 aa, Mycobacterium tuberculosis
TYQSAIPPRGTQAV

SEQ ID NO: 136847 - protein, 14 aa, Mycobacterium tuberculosis
YQSAIPPRGTQAVV

SEQ ID NO: 136848 - protein, 14 aa, Mycobacterium tuberculosis
QSAIPPRGTQAVVL

SEQ ID NO: 136849 - protein, 14 aa, Mycobacterium tuberculosis
SAIPPRGTQAVVLK

SEQ ID NO: 136850 - protein, 14 aa, Mycobacterium tuberculosis
AIPPRGTQAVVLKV

SEQ ID NO: 136851 - protein, 14 aa, Mycobacterium tuberculosis
IPPRGTQAVVLKVY

SEQ ID NO: 136852 - protein, 14 aa, Mycobacterium tuberculosis
PPRGTQAVVLKVYQ

SEQ ID NO: 136853 - protein, 14 aa, Mycobacterium tuberculosis
PRGTQAVVLKVYQN

SEQ ID NO: 136854 - protein, 14 aa, Mycobacterium tuberculosis
RGTQAVVLKVYQNA

SEQ ID NO: 136855 - protein, 14 aa, Mycobacterium tuberculosis
GTQAVVLKVYQNAG

SEQ ID NO: 136856 - protein, 14 aa, Mycobacterium tuberculosis
TQAVVLKVYQNAGG

SEQ ID NO: 136857 - protein, 14 aa, Mycobacterium tuberculosis
QAVVLKVYQNAGGT

SEQ ID NO: 136858 - protein, 14 aa, Mycobacterium tuberculosis
AVVLKVYQNAGGTH

SEQ ID NO: 136859 - protein, 14 aa, Mycobacterium tuberculosis
VVLKVYQNAGGTHP

SEQ ID NO: 136860 - protein, 14 aa, Mycobacterium tuberculosis
VLKVYQNAGGTHPT

SEQ ID NO: 136861 - protein, 14 aa, Mycobacterium tuberculosis
LKVYQNAGGTHPTT

SEQ ID NO: 136862 - protein, 14 aa, Mycobacterium tuberculosis
KVYQNAGGTHPTTT

SEQ ID NO: 136863 - protein, 14 aa, Mycobacterium tuberculosis
VYQNAGGTHPTTTY

SEQ ID NO: 136864 - protein, 14 aa, Mycobacterium tuberculosis
YQNAGGTHPTTTYK

SEQ ID NO: 136865 - protein, 14 aa, Mycobacterium tuberculosis
QNAGGTHPTTTYKA

SEQ ID NO: 136866 - protein, 14 aa, Mycobacterium tuberculosis
NAGGTHPTTTYKAF

SEQ ID NO: 136867 - protein, 14 aa, Mycobacterium tuberculosis
AGGTHPTTTYKAFD

SEQ ID NO: 136868 - protein, 14 aa, Mycobacterium tuberculosis
GGTHPTTTYKAFDW

SEQ ID NO: 136869 - protein, 14 aa, Mycobacterium tuberculosis
GTHPTTTYKAFDWD

SEQ ID NO: 136870 - protein, 14 aa, Mycobacterium tuberculosis
THPTTTYKAFDWDQ

SEQ ID NO: 136871 - protein, 14 aa, Mycobacterium tuberculosis
HPTTTYKAFDWDQA

SEQ ID NO: 136872 - protein, 14 aa, Mycobacterium tuberculosis
PTTTYKAFDWDQAY

SEQ ID NO: 136873 - protein, 14 aa, Mycobacterium tuberculosis
TTTYKAFDWDQAYR

SEQ ID NO: 136874 - protein, 14 aa, Mycobacterium tuberculosis
TTYKAFDWDQAYRK

SEQ ID NO: 136875 - protein, 14 aa, Mycobacterium tuberculosis
TYKAFDWDQAYRKP

SEQ ID NO: 136876 - protein, 14 aa, Mycobacterium tuberculosis
YKAFDWDQAYRKPI

SEQ ID NO: 136877 - protein, 14 aa, Mycobacterium tuberculosis
KAFDWDQAYRKPIT

SEQ ID NO: 136878 - protein, 14 aa, Mycobacterium tuberculosis
AFDWDQAYRKPITY

SEQ ID NO: 136879 - protein, 14 aa, Mycobacterium tuberculosis
FDWDQAYRKPITYD

SEQ ID NO: 136880 - protein, 14 aa, Mycobacterium tuberculosis
DWDQAYRKPITYDT

SEQ ID NO: 136881 - protein, 14 aa, Mycobacterium tuberculosis
WDQAYRKPITYDTL

SEQ ID NO: 136882 - protein, 14 aa, Mycobacterium tuberculosis
DQAYRKPITYDTLW

SEQ ID NO: 136883 - protein, 14 aa, Mycobacterium tuberculosis
QAYRKPITYDTLWQ

SEQ ID NO: 136884 - protein, 14 aa, Mycobacterium tuberculosis
AYRKPITYDTLWQA

SEQ ID NO: 136885 - protein, 14 aa, Mycobacterium tuberculosis
YRKPITYDTLWQAD

SEQ ID NO: 136886 - protein, 14 aa, Mycobacterium tuberculosis
RKPITYDTLWQADT

SEQ ID NO: 136887 - protein, 14 aa, Mycobacterium tuberculosis
KPITYDTLWQADTD

SEQ ID NO: 136888 - protein, 14 aa, Mycobacterium tuberculosis
PITYDTLWQADTDP

SEQ ID NO: 136889 - protein, 14 aa, Mycobacterium tuberculosis
ITYDTLWQADTDPL

SEQ ID NO: 136890 - protein, 14 aa, Mycobacterium tuberculosis
TYDTLWQADTDPLP

SEQ ID NO: 136891 - protein, 14 aa, Mycobacterium tuberculosis
YDTLWQADTDPLPV

SEQ ID NO: 136892 - protein, 14 aa, Mycobacterium tuberculosis
DTLWQADTDPLPVV

SEQ ID NO: 136893 - protein, 14 aa, Mycobacterium tuberculosis
TLWQADTDPLPVVF

SEQ ID NO: 136894 - protein, 14 aa, Mycobacterium tuberculosis
LWQADTDPLPVVFP

SEQ ID NO: 136895 - protein, 14 aa, Mycobacterium tuberculosis
WQADTDPLPVVFPI

SEQ ID NO: 136896 - protein, 14 aa, Mycobacterium tuberculosis
QADTDPLPVVFPIV

SEQ ID NO: 136897 - protein, 14 aa, Mycobacterium tuberculosis
ADTDPLPVVFPIVQ

SEQ ID NO: 136898 - protein, 14 aa, Mycobacterium tuberculosis
DTDPLPVVFPIVQG

SEQ ID NO: 136899 - protein, 14 aa, Mycobacterium tuberculosis
TDPLPVVFPIVQGE

SEQ ID NO: 136900 - protein, 14 aa, Mycobacterium tuberculosis
DPLPVVFPIVQGEL

SEQ ID NO: 136901 - protein, 14 aa, Mycobacterium tuberculosis
PLPVVFPIVQGELS

SEQ ID NO: 136902 - protein, 14 aa, Mycobacterium tuberculosis
LPVVFPIVQGELSK

SEQ ID NO: 136903 - protein, 14 aa, Mycobacterium tuberculosis
PVVFPIVQGELSKQ

SEQ ID NO: 136904 - protein, 14 aa, Mycobacterium tuberculosis
VVFPIVQGELSKQT

SEQ ID NO: 136905 - protein, 14 aa, Mycobacterium tuberculosis
VFPIVQGELSKQTG

SEQ ID NO: 136906 - protein, 14 aa, Mycobacterium tuberculosis
FPIVQGELSKQTGQ

SEQ ID NO: 136907 - protein, 14 aa, Mycobacterium tuberculosis
PIVQGELSKQTGQQ

SEQ ID NO: 136908 - protein, 14 aa, Mycobacterium tuberculosis
IVQGELSKQTGQQV

SEQ ID NO: 136909 - protein, 14 aa, Mycobacterium tuberculosis
VQGELSKQTGQQVS

SEQ ID NO: 136910 - protein, 14 aa, Mycobacterium tuberculosis
QGELSKQTGQQVSI

SEQ ID NO: 136911 - protein, 14 aa, Mycobacterium tuberculosis
GELSKQTGQQVSIA

SEQ ID NO: 136912 - protein, 14 aa, Mycobacterium tuberculosis
ELSKQTGQQVSIAP

SEQ ID NO: 136913 - protein, 14 aa, Mycobacterium tuberculosis
LSKQTGQQVSIAPN

SEQ ID NO: 136914 - protein, 14 aa, Mycobacterium tuberculosis
SKQTGQQVSIAPNA

SEQ ID NO: 136915 - protein, 14 aa, Mycobacterium tuberculosis
KQTGQQVSIAPNAG

SEQ ID NO: 136916 - protein, 14 aa, Mycobacterium tuberculosis
QTGQQVSIAPNAGL

SEQ ID NO: 136917 - protein, 14 aa, Mycobacterium tuberculosis
TGQQVSIAPNAGLD

SEQ ID NO: 136918 - protein, 14 aa, Mycobacterium tuberculosis
GQQVSIAPNAGLDP

SEQ ID NO: 136919 - protein, 14 aa, Mycobacterium tuberculosis
QQVSIAPNAGLDPV

SEQ ID NO: 136920 - protein, 14 aa, Mycobacterium tuberculosis
QVSIAPNAGLDPVN

SEQ ID NO: 136921 - protein, 14 aa, Mycobacterium tuberculosis
VSIAPNAGLDPVNY

SEQ ID NO: 136922 - protein, 14 aa, Mycobacterium tuberculosis
SIAPNAGLDPVNYQ

SEQ ID NO: 136923 - protein, 14 aa, Mycobacterium tuberculosis
IAPNAGLDPVNYQN

SEQ ID NO: 136924 - protein, 14 aa, Mycobacterium tuberculosis
APNAGLDPVNYQNF

SEQ ID NO: 136925 - protein, 14 aa, Mycobacterium tuberculosis
PNAGLDPVNYQNFA

SEQ ID NO: 136926 - protein, 14 aa, Mycobacterium tuberculosis
NAGLDPVNYQNFAV

SEQ ID NO: 136927 - protein, 14 aa, Mycobacterium tuberculosis
AGLDPVNYQNFAVT

SEQ ID NO: 136928 - protein, 14 aa, Mycobacterium tuberculosis
GLDPVNYQNFAVTN

SEQ ID NO: 136929 - protein, 14 aa, Mycobacterium tuberculosis
LDPVNYQNFAVTND

SEQ ID NO: 136930 - protein, 14 aa, Mycobacterium tuberculosis
DPVNYQNFAVTNDG

SEQ ID NO: 136931 - protein, 14 aa, Mycobacterium tuberculosis
PVNYQNFAVTNDGV

SEQ ID NO: 136932 - protein, 14 aa, Mycobacterium tuberculosis
VNYQNFAVTNDGVI

SEQ ID NO: 136933 - protein, 14 aa, Mycobacterium tuberculosis
NYQNFAVTNDGVIF

SEQ ID NO: 136934 - protein, 14 aa, Mycobacterium tuberculosis
YQNFAVTNDGVIFF

SEQ ID NO: 136935 - protein, 14 aa, Mycobacterium tuberculosis
QNFAVTNDGVIFFF

SEQ ID NO: 136936 - protein, 14 aa, Mycobacterium tuberculosis
NFAVTNDGVIFFFN

SEQ ID NO: 136937 - protein, 14 aa, Mycobacterium tuberculosis
FAVTNDGVIFFFNP

SEQ ID NO: 136938 - protein, 14 aa, Mycobacterium tuberculosis
AVTNDGVIFFFNPG

SEQ ID NO: 136939 - protein, 14 aa, Mycobacterium tuberculosis
VTNDGVIFFFNPGE

SEQ ID NO: 136940 - protein, 14 aa, Mycobacterium tuberculosis
TNDGVIFFFNPGEL

SEQ ID NO: 136941 - protein, 14 aa, Mycobacterium tuberculosis
NDGVIFFFNPGELL

SEQ ID NO: 136942 - protein, 14 aa, Mycobacterium tuberculosis
DGVIFFFNPGELLP

SEQ ID NO: 136943 - protein, 14 aa, Mycobacterium tuberculosis
GVIFFFNPGELLPE

SEQ ID NO: 136944 - protein, 14 aa, Mycobacterium tuberculosis
VIFFFNPGELLPEA

SEQ ID NO: 136945 - protein, 14 aa, Mycobacterium tuberculosis
IFFFNPGELLPEAA

SEQ ID NO: 136946 - protein, 14 aa, Mycobacterium tuberculosis
FFFNPGELLPEAAG

SEQ ID NO: 136947 - protein, 14 aa, Mycobacterium tuberculosis
FFNPGELLPEAAGP

SEQ ID NO: 136948 - protein, 14 aa, Mycobacterium tuberculosis
FNPGELLPEAAGPT

SEQ ID NO: 136949 - protein, 14 aa, Mycobacterium tuberculosis
NPGELLPEAAGPTQ

SEQ ID NO: 136950 - protein, 14 aa, Mycobacterium tuberculosis
PGELLPEAAGPTQV

SEQ ID NO: 136951 - protein, 14 aa, Mycobacterium tuberculosis
GELLPEAAGPTQVL

SEQ ID NO: 136952 - protein, 14 aa, Mycobacterium tuberculosis
ELLPEAAGPTQVLV

SEQ ID NO: 136953 - protein, 14 aa, Mycobacterium tuberculosis
LLPEAAGPTQVLVP

SEQ ID NO: 136954 - protein, 14 aa, Mycobacterium tuberculosis
LPEAAGPTQVLVPR

SEQ ID NO: 136955 - protein, 14 aa, Mycobacterium tuberculosis
PEAAGPTQVLVPRS

SEQ ID NO: 136956 - protein, 14 aa, Mycobacterium tuberculosis
EAAGPTQVLVPRSA

SEQ ID NO: 136957 - protein, 14 aa, Mycobacterium tuberculosis
AAGPTQVLVPRSAI

SEQ ID NO: 136958 - protein, 14 aa, Mycobacterium tuberculosis
AGPTQVLVPRSAID

SEQ ID NO: 136959 - protein, 14 aa, Mycobacterium tuberculosis
GPTQVLVPRSAIDS

SEQ ID NO: 136960 - protein, 14 aa, Mycobacterium tuberculosis
PTQVLVPRSAIDSM

SEQ ID NO: 136961 - protein, 14 aa, Mycobacterium tuberculosis
TQVLVPRSAIDSML

SEQ ID NO: 136962 - protein, 14 aa, Mycobacterium tuberculosis
QVLVPRSAIDSMLA

SEQ ID NO: 136963 - protein, 15 aa, Mycobacterium tuberculosis
MRIKIFMLVTAVVLL

SEQ ID NO: 136964 - protein, 15 aa, Mycobacterium tuberculosis
RIKIFMLVTAVVLLC

SEQ ID NO: 136965 - protein, 15 aa, Mycobacterium tuberculosis
IKIFMLVTAVVLLCC

SEQ ID NO: 136966 - protein, 15 aa, Mycobacterium tuberculosis
KIFMLVTAVVLLCCS

SEQ ID NO: 136967 - protein, 15 aa, Mycobacterium tuberculosis
IFMLVTAVVLLCCSG

SEQ ID NO: 136968 - protein, 15 aa, Mycobacterium tuberculosis
FMLVTAVVLLCCSGV

SEQ ID NO: 136969 - protein, 15 aa, Mycobacterium tuberculosis
MLVTAVVLLCCSGVA

SEQ ID NO: 136970 - protein, 15 aa, Mycobacterium tuberculosis
LVTAVVLLCCSGVAT

SEQ ID NO: 136971 - protein, 15 aa, Mycobacterium tuberculosis
VTAVVLLCCSGVATA

SEQ ID NO: 136972 - protein, 15 aa, Mycobacterium tuberculosis
TAVVLLCCSGVATAA

SEQ ID NO: 136973 - protein, 15 aa, Mycobacterium tuberculosis
AVVLLCCSGVATAAP

SEQ ID NO: 136974 - protein, 15 aa, Mycobacterium tuberculosis
VVLLCCSGVATAAPK

SEQ ID NO: 136975 - protein, 15 aa, Mycobacterium tuberculosis
VLLCCSGVATAAPKT

SEQ ID NO: 136976 - protein, 15 aa, Mycobacterium tuberculosis
LLCCSGVATAAPKTY

SEQ ID NO: 136977 - protein, 15 aa, Mycobacterium tuberculosis
LCCSGVATAAPKTYC

SEQ ID NO: 136978 - protein, 15 aa, Mycobacterium tuberculosis
CCSGVATAAPKTYCE

SEQ ID NO: 136979 - protein, 15 aa, Mycobacterium tuberculosis
CSGVATAAPKTYCEE

SEQ ID NO: 136980 - protein, 15 aa, Mycobacterium tuberculosis
SGVATAAPKTYCEEL

SEQ ID NO: 136981 - protein, 15 aa, Mycobacterium tuberculosis
GVATAAPKTYCEELK

SEQ ID NO: 136982 - protein, 15 aa, Mycobacterium tuberculosis
VATAAPKTYCEELKG

SEQ ID NO: 136983 - protein, 15 aa, Mycobacterium tuberculosis
ATAAPKTYCEELKGT

SEQ ID NO: 136984 - protein, 15 aa, Mycobacterium tuberculosis
TAAPKTYCEELKGTD

SEQ ID NO: 136985 - protein, 15 aa, Mycobacterium tuberculosis
AAPKTYCEELKGTDT

SEQ ID NO: 136986 - protein, 15 aa, Mycobacterium tuberculosis
APKTYCEELKGTDTG

SEQ ID NO: 136987 - protein, 15 aa, Mycobacterium tuberculosis
PKTYCEELKGTDTGQ

SEQ ID NO: 136988 - protein, 15 aa, Mycobacterium tuberculosis
KTYCEELKGTDTGQA

SEQ ID NO: 136989 - protein, 15 aa, Mycobacterium tuberculosis
TYCEELKGTDTGQAC

SEQ ID NO: 136990 - protein, 15 aa, Mycobacterium tuberculosis
YCEELKGTDTGQACQ

SEQ ID NO: 136991 - protein, 15 aa, Mycobacterium tuberculosis
CEELKGTDTGQACQI

SEQ ID NO: 136992 - protein, 15 aa, Mycobacterium tuberculosis
EELKGTDTGQACQIQ

SEQ ID NO: 136993 - protein, 15 aa, Mycobacterium tuberculosis
ELKGTDTGQACQIQM

SEQ ID NO: 136994 - protein, 15 aa, Mycobacterium tuberculosis
LKGTDTGQACQIQMS

SEQ ID NO: 136995 - protein, 15 aa, Mycobacterium tuberculosis
KGTDTGQACQIQMSD

SEQ ID NO: 136996 - protein, 15 aa, Mycobacterium tuberculosis
GTDTGQACQIQMSDP

SEQ ID NO: 136997 - protein, 15 aa, Mycobacterium tuberculosis
TDTGQACQIQMSDPA

SEQ ID NO: 136998 - protein, 15 aa, Mycobacterium tuberculosis
DTGQACQIQMSDPAY

SEQ ID NO: 136999 - protein, 15 aa, Mycobacterium tuberculosis
TGQACQIQMSDPAYN

SEQ ID NO: 137000 - protein, 15 aa, Mycobacterium tuberculosis
GQACQIQMSDPAYNI

SEQ ID NO: 137001 - protein, 15 aa, Mycobacterium tuberculosis
QACQIQMSDPAYNIN

SEQ ID NO: 137002 - protein, 15 aa, Mycobacterium tuberculosis
ACQIQMSDPAYNINI

SEQ ID NO: 137003 - protein, 15 aa, Mycobacterium tuberculosis
CQIQMSDPAYNINIS

SEQ ID NO: 137004 - protein, 15 aa, Mycobacterium tuberculosis
QIQMSDPAYNINISL

SEQ ID NO: 137005 - protein, 15 aa, Mycobacterium tuberculosis
IQMSDPAYNINISLP

SEQ ID NO: 137006 - protein, 15 aa, Mycobacterium tuberculosis
QMSDPAYNINISLPS

SEQ ID NO: 137007 - protein, 15 aa, Mycobacterium tuberculosis
MSDPAYNINISLPSY

SEQ ID NO: 137008 - protein, 15 aa, Mycobacterium tuberculosis
SDPAYNINISLPSYY

SEQ ID NO: 137009 - protein, 15 aa, Mycobacterium tuberculosis
DPAYNINISLPSYYP

SEQ ID NO: 137010 - protein, 15 aa, Mycobacterium tuberculosis
PAYNINISLPSYYPD

SEQ ID NO: 137011 - protein, 15 aa, Mycobacterium tuberculosis
AYNINISLPSYYPDQ

SEQ ID NO: 137012 - protein, 15 aa, Mycobacterium tuberculosis
YNINISLPSYYPDQK

SEQ ID NO: 137013 - protein, 15 aa, Mycobacterium tuberculosis
NINISLPSYYPDQKS

SEQ ID NO: 137014 - protein, 15 aa, Mycobacterium tuberculosis
INISLPSYYPDQKSL

SEQ ID NO: 137015 - protein, 15 aa, Mycobacterium tuberculosis
NISLPSYYPDQKSLE

SEQ ID NO: 137016 - protein, 15 aa, Mycobacterium tuberculosis
ISLPSYYPDQKSLEN

SEQ ID NO: 137017 - protein, 15 aa, Mycobacterium tuberculosis
SLPSYYPDQKSLENY

SEQ ID NO: 137018 - protein, 15 aa, Mycobacterium tuberculosis
LPSYYPDQKSLENYI

SEQ ID NO: 137019 - protein, 15 aa, Mycobacterium tuberculosis
PSYYPDQKSLENYIA

SEQ ID NO: 137020 - protein, 15 aa, Mycobacterium tuberculosis
SYYPDQKSLENYIAQ

SEQ ID NO: 137021 - protein, 15 aa, Mycobacterium tuberculosis
YYPDQKSLENYIAQT

SEQ ID NO: 137022 - protein, 15 aa, Mycobacterium tuberculosis
YPDQKSLENYIAQTR

SEQ ID NO: 137023 - protein, 15 aa, Mycobacterium tuberculosis
PDQKSLENYIAQTRD

SEQ ID NO: 137024 - protein, 15 aa, Mycobacterium tuberculosis
DQKSLENYIAQTRDK

SEQ ID NO: 137025 - protein, 15 aa, Mycobacterium tuberculosis
QKSLENYIAQTRDKF

SEQ ID NO: 137026 - protein, 15 aa, Mycobacterium tuberculosis
KSLENYIAQTRDKFL

SEQ ID NO: 137027 - protein, 15 aa, Mycobacterium tuberculosis
SLENYIAQTRDKFLS

SEQ ID NO: 137028 - protein, 15 aa, Mycobacterium tuberculosis
LENYIAQTRDKFLSA

SEQ ID NO: 137029 - protein, 15 aa, Mycobacterium tuberculosis
ENYIAQTRDKFLSAA

SEQ ID NO: 137030 - protein, 15 aa, Mycobacterium tuberculosis
NYIAQTRDKFLSAAT

SEQ ID NO: 137031 - protein, 15 aa, Mycobacterium tuberculosis
YIAQTRDKFLSAATS

SEQ ID NO: 137032 - protein, 15 aa, Mycobacterium tuberculosis
IAQTRDKFLSAATSS

SEQ ID NO: 137033 - protein, 15 aa, Mycobacterium tuberculosis
AQTRDKFLSAATSST

SEQ ID NO: 137034 - protein, 15 aa, Mycobacterium tuberculosis
QTRDKFLSAATSSTP

SEQ ID NO: 137035 - protein, 15 aa, Mycobacterium tuberculosis
TRDKFLSAATSSTPR

SEQ ID NO: 137036 - protein, 15 aa, Mycobacterium tuberculosis
RDKFLSAATSSTPRE

SEQ ID NO: 137037 - protein, 15 aa, Mycobacterium tuberculosis
DKFLSAATSSTPREA

SEQ ID NO: 137038 - protein, 15 aa, Mycobacterium tuberculosis
KFLSAATSSTPREAP

SEQ ID NO: 137039 - protein, 15 aa, Mycobacterium tuberculosis
FLSAATSSTPREAPY

SEQ ID NO: 137040 - protein, 15 aa, Mycobacterium tuberculosis
LSAATSSTPREAPYE

SEQ ID NO: 137041 - protein, 15 aa, Mycobacterium tuberculosis
SAATSSTPREAPYEL

SEQ ID NO: 137042 - protein, 15 aa, Mycobacterium tuberculosis
AATSSTPREAPYELN

SEQ ID NO: 137043 - protein, 15 aa, Mycobacterium tuberculosis
ATSSTPREAPYELNI

SEQ ID NO: 137044 - protein, 15 aa, Mycobacterium tuberculosis
TSSTPREAPYELNIT

SEQ ID NO: 137045 - protein, 15 aa, Mycobacterium tuberculosis
SSTPREAPYELNITS

SEQ ID NO: 137046 - protein, 15 aa, Mycobacterium tuberculosis
STPREAPYELNITSA

SEQ ID NO: 137047 - protein, 15 aa, Mycobacterium tuberculosis
TPREAPYELNITSAT

SEQ ID NO: 137048 - protein, 15 aa, Mycobacterium tuberculosis
PREAPYELNITSATY

SEQ ID NO: 137049 - protein, 15 aa, Mycobacterium tuberculosis
REAPYELNITSATYQ

SEQ ID NO: 137050 - protein, 15 aa, Mycobacterium tuberculosis
EAPYELNITSATYQS

SEQ ID NO: 137051 - protein, 15 aa, Mycobacterium tuberculosis
APYELNITSATYQSA

SEQ ID NO: 137052 - protein, 15 aa, Mycobacterium tuberculosis
PYELNITSATYQSAI

SEQ ID NO: 137053 - protein, 15 aa, Mycobacterium tuberculosis
YELNITSATYQSAIP

SEQ ID NO: 137054 - protein, 15 aa, Mycobacterium tuberculosis
ELNITSATYQSAIPP

SEQ ID NO: 137055 - protein, 15 aa, Mycobacterium tuberculosis
LNITSATYQSAIPPR

SEQ ID NO: 137056 - protein, 15 aa, Mycobacterium tuberculosis
NITSATYQSAIPPRG

SEQ ID NO: 137057 - protein, 15 aa, Mycobacterium tuberculosis
ITSATYQSAIPPRGT

SEQ ID NO: 137058 - protein, 15 aa, Mycobacterium tuberculosis
TSATYQSAIPPRGTQ

SEQ ID NO: 137059 - protein, 15 aa, Mycobacterium tuberculosis
SATYQSAIPPRGTQA

SEQ ID NO: 137060 - protein, 15 aa, Mycobacterium tuberculosis
ATYQSAIPPRGTQAV

SEQ ID NO: 137061 - protein, 15 aa, Mycobacterium tuberculosis
TYQSAIPPRGTQAVV

SEQ ID NO: 137062 - protein, 15 aa, Mycobacterium tuberculosis
YQSAIPPRGTQAVVL

SEQ ID NO: 137063 - protein, 15 aa, Mycobacterium tuberculosis
QSAIPPRGTQAVVLK

SEQ ID NO: 137064 - protein, 15 aa, Mycobacterium tuberculosis
SAIPPRGTQAVVLKV

SEQ ID NO: 137065 - protein, 15 aa, Mycobacterium tuberculosis
AIPPRGTQAVVLKVY

SEQ ID NO: 137066 - protein, 15 aa, Mycobacterium tuberculosis
IPPRGTQAVVLKVYQ

SEQ ID NO: 137067 - protein, 15 aa, Mycobacterium tuberculosis
PPRGTQAVVLKVYQN

SEQ ID NO: 137068 - protein, 15 aa, Mycobacterium tuberculosis
PRGTQAVVLKVYQNA

SEQ ID NO: 137069 - protein, 15 aa, Mycobacterium tuberculosis
RGTQAVVLKVYQNAG

SEQ ID NO: 137070 - protein, 15 aa, Mycobacterium tuberculosis
GTQAVVLKVYQNAGG

SEQ ID NO: 137071 - protein, 15 aa, Mycobacterium tuberculosis
TQAVVLKVYQNAGGT

SEQ ID NO: 137072 - protein, 15 aa, Mycobacterium tuberculosis
QAVVLKVYQNAGGTH

SEQ ID NO: 137073 - protein, 15 aa, Mycobacterium tuberculosis
AVVLKVYQNAGGTHP

SEQ ID NO: 137074 - protein, 15 aa, Mycobacterium tuberculosis
VVLKVYQNAGGTHPT

SEQ ID NO: 137075 - protein, 15 aa, Mycobacterium tuberculosis
VLKVYQNAGGTHPTT

SEQ ID NO: 137076 - protein, 15 aa, Mycobacterium tuberculosis
LKVYQNAGGTHPTTT

SEQ ID NO: 137077 - protein, 15 aa, Mycobacterium tuberculosis
KVYQNAGGTHPTTTY

SEQ ID NO: 137078 - protein, 15 aa, Mycobacterium tuberculosis
VYQNAGGTHPTTTYK

SEQ ID NO: 137079 - protein, 15 aa, Mycobacterium tuberculosis
YQNAGGTHPTTTYKA

SEQ ID NO: 137080 - protein, 15 aa, Mycobacterium tuberculosis
QNAGGTHPTTTYKAF

SEQ ID NO: 137081 - protein, 15 aa, Mycobacterium tuberculosis
NAGGTHPTTTYKAFD

SEQ ID NO: 137082 - protein, 15 aa, Mycobacterium tuberculosis
AGGTHPTTTYKAFDW

SEQ ID NO: 137083 - protein, 15 aa, Mycobacterium tuberculosis
GGTHPTTTYKAFDWD

SEQ ID NO: 137084 - protein, 15 aa, Mycobacterium tuberculosis
GTHPTTTYKAFDWDQ

SEQ ID NO: 137085 - protein, 15 aa, Mycobacterium tuberculosis
THPTTTYKAFDWDQA

SEQ ID NO: 137086 - protein, 15 aa, Mycobacterium tuberculosis
HPTTTYKAFDWDQAY

SEQ ID NO: 137087 - protein, 15 aa, Mycobacterium tuberculosis
PTTTYKAFDWDQAYR

SEQ ID NO: 137088 - protein, 15 aa, Mycobacterium tuberculosis
TTTYKAFDWDQAYRK

SEQ ID NO: 137089 - protein, 15 aa, Mycobacterium tuberculosis
TTYKAFDWDQAYRKP

SEQ ID NO: 137090 - protein, 15 aa, Mycobacterium tuberculosis
TYKAFDWDQAYRKPI

SEQ ID NO: 137091 - protein, 15 aa, Mycobacterium tuberculosis
YKAFDWDQAYRKPIT

SEQ ID NO: 137092 - protein, 15 aa, Mycobacterium tuberculosis
KAFDWDQAYRKPITY

SEQ ID NO: 137093 - protein, 15 aa, Mycobacterium tuberculosis
AFDWDQAYRKPITYD

SEQ ID NO: 137094 - protein, 15 aa, Mycobacterium tuberculosis
FDWDQAYRKPITYDT

SEQ ID NO: 137095 - protein, 15 aa, Mycobacterium tuberculosis
DWDQAYRKPITYDTL

SEQ ID NO: 137096 - protein, 15 aa, Mycobacterium tuberculosis
WDQAYRKPITYDTLW

SEQ ID NO: 137097 - protein, 15 aa, Mycobacterium tuberculosis
DQAYRKPITYDTLWQ

SEQ ID NO: 137098 - protein, 15 aa, Mycobacterium tuberculosis
QAYRKPITYDTLWQA

SEQ ID NO: 137099 - protein, 15 aa, Mycobacterium tuberculosis
AYRKPITYDTLWQAD

SEQ ID NO: 137100 - protein, 15 aa, Mycobacterium tuberculosis
YRKPITYDTLWQADT

SEQ ID NO: 137101 - protein, 15 aa, Mycobacterium tuberculosis
RKPITYDTLWQADTD

SEQ ID NO: 137102 - protein, 15 aa, Mycobacterium tuberculosis
KPITYDTLWQADTDP

SEQ ID NO: 137103 - protein, 15 aa, Mycobacterium tuberculosis
PITYDTLWQADTDPL

SEQ ID NO: 137104 - protein, 15 aa, Mycobacterium tuberculosis
ITYDTLWQADTDPLP

SEQ ID NO: 137105 - protein, 15 aa, Mycobacterium tuberculosis
TYDTLWQADTDPLPV

SEQ ID NO: 137106 - protein, 15 aa, Mycobacterium tuberculosis
YDTLWQADTDPLPVV

SEQ ID NO: 137107 - protein, 15 aa, Mycobacterium tuberculosis
DTLWQADTDPLPVVF

SEQ ID NO: 137108 - protein, 15 aa, Mycobacterium tuberculosis
TLWQADTDPLPVVFP

SEQ ID NO: 137109 - protein, 15 aa, Mycobacterium tuberculosis
LWQADTDPLPVVFPI

SEQ ID NO: 137110 - protein, 15 aa, Mycobacterium tuberculosis
WQADTDPLPVVFPIV

SEQ ID NO: 137111 - protein, 15 aa, Mycobacterium tuberculosis
QADTDPLPVVFPIVQ

SEQ ID NO: 137112 - protein, 15 aa, Mycobacterium tuberculosis
ADTDPLPVVFPIVQG

SEQ ID NO: 137113 - protein, 15 aa, Mycobacterium tuberculosis
DTDPLPVVFPIVQGE

SEQ ID NO: 137114 - protein, 15 aa, Mycobacterium tuberculosis
TDPLPVVFPIVQGEL

SEQ ID NO: 137115 - protein, 15 aa, Mycobacterium tuberculosis
DPLPVVFPIVQGELS

SEQ ID NO: 137116 - protein, 15 aa, Mycobacterium tuberculosis
PLPVVFPIVQGELSK

SEQ ID NO: 137117 - protein, 15 aa, Mycobacterium tuberculosis
LPVVFPIVQGELSKQ

SEQ ID NO: 137118 - protein, 15 aa, Mycobacterium tuberculosis
PVVFPIVQGELSKQT

SEQ ID NO: 137119 - protein, 15 aa, Mycobacterium tuberculosis
VVFPIVQGELSKQTG

SEQ ID NO: 137120 - protein, 15 aa, Mycobacterium tuberculosis
VFPIVQGELSKQTGQ

SEQ ID NO: 137121 - protein, 15 aa, Mycobacterium tuberculosis
FPIVQGELSKQTGQQ

SEQ ID NO: 137122 - protein, 15 aa, Mycobacterium tuberculosis
PIVQGELSKQTGQQV

SEQ ID NO: 137123 - protein, 15 aa, Mycobacterium tuberculosis
IVQGELSKQTGQQVS

SEQ ID NO: 137124 - protein, 15 aa, Mycobacterium tuberculosis
VQGELSKQTGQQVSI

SEQ ID NO: 137125 - protein, 15 aa, Mycobacterium tuberculosis
QGELSKQTGQQVSIA

SEQ ID NO: 137126 - protein, 15 aa, Mycobacterium tuberculosis
GELSKQTGQQVSIAP

SEQ ID NO: 137127 - protein, 15 aa, Mycobacterium tuberculosis
ELSKQTGQQVSIAPN

SEQ ID NO: 137128 - protein, 15 aa, Mycobacterium tuberculosis
LSKQTGQQVSIAPNA

SEQ ID NO: 137129 - protein, 15 aa, Mycobacterium tuberculosis
SKQTGQQVSIAPNAG

SEQ ID NO: 137130 - protein, 15 aa, Mycobacterium tuberculosis
KQTGQQVSIAPNAGL

SEQ ID NO: 137131 - protein, 15 aa, Mycobacterium tuberculosis
QTGQQVSIAPNAGLD

SEQ ID NO: 137132 - protein, 15 aa, Mycobacterium tuberculosis
TGQQVSIAPNAGLDP

SEQ ID NO: 137133 - protein, 15 aa, Mycobacterium tuberculosis
GQQVSIAPNAGLDPV

SEQ ID NO: 137134 - protein, 15 aa, Mycobacterium tuberculosis
QQVSIAPNAGLDPVN

SEQ ID NO: 137135 - protein, 15 aa, Mycobacterium tuberculosis
QVSIAPNAGLDPVNY

SEQ ID NO: 137136 - protein, 15 aa, Mycobacterium tuberculosis
VSIAPNAGLDPVNYQ

SEQ ID NO: 137137 - protein, 15 aa, Mycobacterium tuberculosis
SIAPNAGLDPVNYQN

SEQ ID NO: 137138 - protein, 15 aa, Mycobacterium tuberculosis
IAPNAGLDPVNYQNF

SEQ ID NO: 137139 - protein, 15 aa, Mycobacterium tuberculosis
APNAGLDPVNYQNFA

SEQ ID NO: 137140 - protein, 15 aa, Mycobacterium tuberculosis
PNAGLDPVNYQNFAV

SEQ ID NO: 137141 - protein, 15 aa, Mycobacterium tuberculosis
NAGLDPVNYQNFAVT

SEQ ID NO: 137142 - protein, 15 aa, Mycobacterium tuberculosis
AGLDPVNYQNFAVTN

SEQ ID NO: 137143 - protein, 15 aa, Mycobacterium tuberculosis
GLDPVNYQNFAVTND

SEQ ID NO: 137144 - protein, 15 aa, Mycobacterium tuberculosis
LDPVNYQNFAVTNDG

SEQ ID NO: 137145 - protein, 15 aa, Mycobacterium tuberculosis
DPVNYQNFAVTNDGV

SEQ ID NO: 137146 - protein, 15 aa, Mycobacterium tuberculosis
PVNYQNFAVTNDGVI

SEQ ID NO: 137147 - protein, 15 aa, Mycobacterium tuberculosis
VNYQNFAVTNDGVIF

SEQ ID NO: 137148 - protein, 15 aa, Mycobacterium tuberculosis
NYQNFAVTNDGVIFF

SEQ ID NO: 137149 - protein, 15 aa, Mycobacterium tuberculosis
YQNFAVTNDGVIFFF

SEQ ID NO: 137150 - protein, 15 aa, Mycobacterium tuberculosis
QNFAVTNDGVIFFFN

SEQ ID NO: 137151 - protein, 15 aa, Mycobacterium tuberculosis
NFAVTNDGVIFFFNP

SEQ ID NO: 137152 - protein, 15 aa, Mycobacterium tuberculosis
FAVTNDGVIFFFNPG

SEQ ID NO: 137153 - protein, 15 aa, Mycobacterium tuberculosis
AVTNDGVIFFFNPGE

SEQ ID NO: 137154 - protein, 15 aa, Mycobacterium tuberculosis
VTNDGVIFFFNPGEL

SEQ ID NO: 137155 - protein, 15 aa, Mycobacterium tuberculosis
TNDGVIFFFNPGELL

SEQ ID NO: 137156 - protein, 15 aa, Mycobacterium tuberculosis
NDGVIFFFNPGELLP

SEQ ID NO: 137157 - protein, 15 aa, Mycobacterium tuberculosis
DGVIFFFNPGELLPE

SEQ ID NO: 137158 - protein, 15 aa, Mycobacterium tuberculosis
GVIFFFNPGELLPEA

SEQ ID NO: 137159 - protein, 15 aa, Mycobacterium tuberculosis
VIFFFNPGELLPEAA

SEQ ID NO: 137160 - protein, 15 aa, Mycobacterium tuberculosis
IFFFNPGELLPEAAG

SEQ ID NO: 137161 - protein, 15 aa, Mycobacterium tuberculosis
FFFNPGELLPEAAGP

SEQ ID NO: 137162 - protein, 15 aa, Mycobacterium tuberculosis
FFNPGELLPEAAGPT

SEQ ID NO: 137163 - protein, 15 aa, Mycobacterium tuberculosis
FNPGELLPEAAGPTQ

SEQ ID NO: 137164 - protein, 15 aa, Mycobacterium tuberculosis
NPGELLPEAAGPTQV

SEQ ID NO: 137165 - protein, 15 aa, Mycobacterium tuberculosis
PGELLPEAAGPTQVL

SEQ ID NO: 137166 - protein, 15 aa, Mycobacterium tuberculosis
GELLPEAAGPTQVLV

SEQ ID NO: 137167 - protein, 15 aa, Mycobacterium tuberculosis
ELLPEAAGPTQVLVP

SEQ ID NO: 137168 - protein, 15 aa, Mycobacterium tuberculosis
LLPEAAGPTQVLVPR

SEQ ID NO: 137169 - protein, 15 aa, Mycobacterium tuberculosis
LPEAAGPTQVLVPRS

SEQ ID NO: 137170 - protein, 15 aa, Mycobacterium tuberculosis
PEAAGPTQVLVPRSA

SEQ ID NO: 137171 - protein, 15 aa, Mycobacterium tuberculosis
EAAGPTQVLVPRSAI

SEQ ID NO: 137172 - protein, 15 aa, Mycobacterium tuberculosis
AAGPTQVLVPRSAID

SEQ ID NO: 137173 - protein, 15 aa, Mycobacterium tuberculosis
AGPTQVLVPRSAIDS

SEQ ID NO: 137174 - protein, 15 aa, Mycobacterium tuberculosis
GPTQVLVPRSAIDSM

SEQ ID NO: 137175 - protein, 15 aa, Mycobacterium tuberculosis
PTQVLVPRSAIDSML

SEQ ID NO: 137176 - protein, 15 aa, Mycobacterium tuberculosis
TQVLVPRSAIDSMLA

SEQ ID NO: 137177 - protein, 16 aa, Mycobacterium tuberculosis
MRIKIFMLVTAVVLLC

SEQ ID NO: 137178 - protein, 16 aa, Mycobacterium tuberculosis
RIKIFMLVTAVVLLCC

SEQ ID NO: 137179 - protein, 16 aa, Mycobacterium tuberculosis
IKIFMLVTAVVLLCCS

SEQ ID NO: 137180 - protein, 16 aa, Mycobacterium tuberculosis
KIFMLVTAVVLLCCSG

SEQ ID NO: 137181 - protein, 16 aa, Mycobacterium tuberculosis
IFMLVTAVVLLCCSGV

SEQ ID NO: 137182 - protein, 16 aa, Mycobacterium tuberculosis
FMLVTAVVLLCCSGVA

SEQ ID NO: 137183 - protein, 16 aa, Mycobacterium tuberculosis
MLVTAVVLLCCSGVAT

SEQ ID NO: 137184 - protein, 16 aa, Mycobacterium tuberculosis
LVTAVVLLCCSGVATA

SEQ ID NO: 137185 - protein, 16 aa, Mycobacterium tuberculosis
VTAVVLLCCSGVATAA

SEQ ID NO: 137186 - protein, 16 aa, Mycobacterium tuberculosis
TAVVLLCCSGVATAAP

SEQ ID NO: 137187 - protein, 16 aa, Mycobacterium tuberculosis
AVVLLCCSGVATAAPK

SEQ ID NO: 137188 - protein, 16 aa, Mycobacterium tuberculosis
VVLLCCSGVATAAPKT

SEQ ID NO: 137189 - protein, 16 aa, Mycobacterium tuberculosis
VLLCCSGVATAAPKTY

SEQ ID NO: 137190 - protein, 16 aa, Mycobacterium tuberculosis
LLCCSGVATAAPKTYC

SEQ ID NO: 137191 - protein, 16 aa, Mycobacterium tuberculosis
LCCSGVATAAPKTYCE

SEQ ID NO: 137192 - protein, 16 aa, Mycobacterium tuberculosis
CCSGVATAAPKTYCEE

SEQ ID NO: 137193 - protein, 16 aa, Mycobacterium tuberculosis
CSGVATAAPKTYCEEL

SEQ ID NO: 137194 - protein, 16 aa, Mycobacterium tuberculosis
SGVATAAPKTYCEELK

SEQ ID NO: 137195 - protein, 16 aa, Mycobacterium tuberculosis
GVATAAPKTYCEELKG

SEQ ID NO: 137196 - protein, 16 aa, Mycobacterium tuberculosis
VATAAPKTYCEELKGT

SEQ ID NO: 137197 - protein, 16 aa, Mycobacterium tuberculosis
ATAAPKTYCEELKGTD

SEQ ID NO: 137198 - protein, 16 aa, Mycobacterium tuberculosis
TAAPKTYCEELKGTDT

SEQ ID NO: 137199 - protein, 16 aa, Mycobacterium tuberculosis
AAPKTYCEELKGTDTG

SEQ ID NO: 137200 - protein, 16 aa, Mycobacterium tuberculosis
APKTYCEELKGTDTGQ

SEQ ID NO: 137201 - protein, 16 aa, Mycobacterium tuberculosis
PKTYCEELKGTDTGQA

SEQ ID NO: 137202 - protein, 16 aa, Mycobacterium tuberculosis
KTYCEELKGTDTGQAC

SEQ ID NO: 137203 - protein, 16 aa, Mycobacterium tuberculosis
TYCEELKGTDTGQACQ

SEQ ID NO: 137204 - protein, 16 aa, Mycobacterium tuberculosis
YCEELKGTDTGQACQI

SEQ ID NO: 137205 - protein, 16 aa, Mycobacterium tuberculosis
CEELKGTDTGQACQIQ

SEQ ID NO: 137206 - protein, 16 aa, Mycobacterium tuberculosis
EELKGTDTGQACQIQM

SEQ ID NO: 137207 - protein, 16 aa, Mycobacterium tuberculosis
ELKGTDTGQACQIQMS

SEQ ID NO: 137208 - protein, 16 aa, Mycobacterium tuberculosis
LKGTDTGQACQIQMSD

SEQ ID NO: 137209 - protein, 16 aa, Mycobacterium tuberculosis
KGTDTGQACQIQMSDP

SEQ ID NO: 137210 - protein, 16 aa, Mycobacterium tuberculosis
GTDTGQACQIQMSDPA

SEQ ID NO: 137211 - protein, 16 aa, Mycobacterium tuberculosis
TDTGQACQIQMSDPAY

SEQ ID NO: 137212 - protein, 16 aa, Mycobacterium tuberculosis
DTGQACQIQMSDPAYN

SEQ ID NO: 137213 - protein, 16 aa, Mycobacterium tuberculosis
TGQACQIQMSDPAYNI

SEQ ID NO: 137214 - protein, 16 aa, Mycobacterium tuberculosis
GQACQIQMSDPAYNIN

SEQ ID NO: 137215 - protein, 16 aa, Mycobacterium tuberculosis
QACQIQMSDPAYNINI

SEQ ID NO: 137216 - protein, 16 aa, Mycobacterium tuberculosis
ACQIQMSDPAYNINIS

SEQ ID NO: 137217 - protein, 16 aa, Mycobacterium tuberculosis
CQIQMSDPAYNINISL

SEQ ID NO: 137218 - protein, 16 aa, Mycobacterium tuberculosis
QIQMSDPAYNINISLP

SEQ ID NO: 137219 - protein, 16 aa, Mycobacterium tuberculosis
IQMSDPAYNINISLPS

SEQ ID NO: 137220 - protein, 16 aa, Mycobacterium tuberculosis
QMSDPAYNINISLPSY

SEQ ID NO: 137221 - protein, 16 aa, Mycobacterium tuberculosis
MSDPAYNINISLPSYY

SEQ ID NO: 137222 - protein, 16 aa, Mycobacterium tuberculosis
SDPAYNINISLPSYYP

SEQ ID NO: 137223 - protein, 16 aa, Mycobacterium tuberculosis
DPAYNINISLPSYYPD

SEQ ID NO: 137224 - protein, 16 aa, Mycobacterium tuberculosis
PAYNINISLPSYYPDQ

SEQ ID NO: 137225 - protein, 16 aa, Mycobacterium tuberculosis
AYNINISLPSYYPDQK

SEQ ID NO: 137226 - protein, 16 aa, Mycobacterium tuberculosis
YNINISLPSYYPDQKS

SEQ ID NO: 137227 - protein, 16 aa, Mycobacterium tuberculosis
NINISLPSYYPDQKSL

SEQ ID NO: 137228 - protein, 16 aa, Mycobacterium tuberculosis
INISLPSYYPDQKSLE

SEQ ID NO: 137229 - protein, 16 aa, Mycobacterium tuberculosis
NISLPSYYPDQKSLEN

SEQ ID NO: 137230 - protein, 16 aa, Mycobacterium tuberculosis
ISLPSYYPDQKSLENY

SEQ ID NO: 137231 - protein, 16 aa, Mycobacterium tuberculosis
SLPSYYPDQKSLENYI

SEQ ID NO: 137232 - protein, 16 aa, Mycobacterium tuberculosis
LPSYYPDQKSLENYIA

SEQ ID NO: 137233 - protein, 16 aa, Mycobacterium tuberculosis
PSYYPDQKSLENYIAQ

SEQ ID NO: 137234 - protein, 16 aa, Mycobacterium tuberculosis
SYYPDQKSLENYIAQT

SEQ ID NO: 137235 - protein, 16 aa, Mycobacterium tuberculosis
YYPDQKSLENYIAQTR

SEQ ID NO: 137236 - protein, 16 aa, Mycobacterium tuberculosis
YPDQKSLENYIAQTRD

SEQ ID NO: 137237 - protein, 16 aa, Mycobacterium tuberculosis
PDQKSLENYIAQTRDK

SEQ ID NO: 137238 - protein, 16 aa, Mycobacterium tuberculosis
DQKSLENYIAQTRDKF

SEQ ID NO: 137239 - protein, 16 aa, Mycobacterium tuberculosis
QKSLENYIAQTRDKFL

SEQ ID NO: 137240 - protein, 16 aa, Mycobacterium tuberculosis
KSLENYIAQTRDKFLS

SEQ ID NO: 137241 - protein, 16 aa, Mycobacterium tuberculosis
SLENYIAQTRDKFLSA

SEQ ID NO: 137242 - protein, 16 aa, Mycobacterium tuberculosis
LENYIAQTRDKFLSAA

SEQ ID NO: 137243 - protein, 16 aa, Mycobacterium tuberculosis
ENYIAQTRDKFLSAAT

SEQ ID NO: 137244 - protein, 16 aa, Mycobacterium tuberculosis
NYIAQTRDKFLSAATS

SEQ ID NO: 137245 - protein, 16 aa, Mycobacterium tuberculosis
YIAQTRDKFLSAATSS

SEQ ID NO: 137246 - protein, 16 aa, Mycobacterium tuberculosis
IAQTRDKFLSAATSST

SEQ ID NO: 137247 - protein, 16 aa, Mycobacterium tuberculosis
AQTRDKFLSAATSSTP

SEQ ID NO: 137248 - protein, 16 aa, Mycobacterium tuberculosis
QTRDKFLSAATSSTPR

SEQ ID NO: 137249 - protein, 16 aa, Mycobacterium tuberculosis
TRDKFLSAATSSTPRE

SEQ ID NO: 137250 - protein, 16 aa, Mycobacterium tuberculosis
RDKFLSAATSSTPREA

SEQ ID NO: 137251 - protein, 16 aa, Mycobacterium tuberculosis
DKFLSAATSSTPREAP

SEQ ID NO: 137252 - protein, 16 aa, Mycobacterium tuberculosis
KFLSAATSSTPREAPY

SEQ ID NO: 137253 - protein, 16 aa, Mycobacterium tuberculosis
FLSAATSSTPREAPYE

SEQ ID NO: 137254 - protein, 16 aa, Mycobacterium tuberculosis
LSAATSSTPREAPYEL

SEQ ID NO: 137255 - protein, 16 aa, Mycobacterium tuberculosis
SAATSSTPREAPYELN

SEQ ID NO: 137256 - protein, 16 aa, Mycobacterium tuberculosis
AATSSTPREAPYELNI

SEQ ID NO: 137257 - protein, 16 aa, Mycobacterium tuberculosis
ATSSTPREAPYELNIT

SEQ ID NO: 137258 - protein, 16 aa, Mycobacterium tuberculosis
TSSTPREAPYELNITS

SEQ ID NO: 137259 - protein, 16 aa, Mycobacterium tuberculosis
SSTPREAPYELNITSA

SEQ ID NO: 137260 - protein, 16 aa, Mycobacterium tuberculosis
STPREAPYELNITSAT

SEQ ID NO: 137261 - protein, 16 aa, Mycobacterium tuberculosis
TPREAPYELNITSATY

SEQ ID NO: 137262 - protein, 16 aa, Mycobacterium tuberculosis
PREAPYELNITSATYQ

SEQ ID NO: 137263 - protein, 16 aa, Mycobacterium tuberculosis
REAPYELNITSATYQS

SEQ ID NO: 137264 - protein, 16 aa, Mycobacterium tuberculosis
EAPYELNITSATYQSA

SEQ ID NO: 137265 - protein, 16 aa, Mycobacterium tuberculosis
APYELNITSATYQSAI

SEQ ID NO: 137266 - protein, 16 aa, Mycobacterium tuberculosis
PYELNITSATYQSAIP

SEQ ID NO: 137267 - protein, 16 aa, Mycobacterium tuberculosis
YELNITSATYQSAIPP

SEQ ID NO: 137268 - protein, 16 aa, Mycobacterium tuberculosis
ELNITSATYQSAIPPR

SEQ ID NO: 137269 - protein, 16 aa, Mycobacterium tuberculosis
LNITSATYQSAIPPRG

SEQ ID NO: 137270 - protein, 16 aa, Mycobacterium tuberculosis
NITSATYQSAIPPRGT

SEQ ID NO: 137271 - protein, 16 aa, Mycobacterium tuberculosis
ITSATYQSAIPPRGTQ

SEQ ID NO: 137272 - protein, 16 aa, Mycobacterium tuberculosis
TSATYQSAIPPRGTQA

SEQ ID NO: 137273 - protein, 16 aa, Mycobacterium tuberculosis
SATYQSAIPPRGTQAV

SEQ ID NO: 137274 - protein, 16 aa, Mycobacterium tuberculosis
ATYQSAIPPRGTQAVV

SEQ ID NO: 137275 - protein, 16 aa, Mycobacterium tuberculosis
TYQSAIPPRGTQAVVL

SEQ ID NO: 137276 - protein, 16 aa, Mycobacterium tuberculosis
YQSAIPPRGTQAVVLK

SEQ ID NO: 137277 - protein, 16 aa, Mycobacterium tuberculosis
QSAIPPRGTQAVVLKV

SEQ ID NO: 137278 - protein, 16 aa, Mycobacterium tuberculosis
SAIPPRGTQAVVLKVY

SEQ ID NO: 137279 - protein, 16 aa, Mycobacterium tuberculosis
AIPPRGTQAVVLKVYQ

SEQ ID NO: 137280 - protein, 16 aa, Mycobacterium tuberculosis
IPPRGTQAVVLKVYQN

SEQ ID NO: 137281 - protein, 16 aa, Mycobacterium tuberculosis
PPRGTQAVVLKVYQNA

SEQ ID NO: 137282 - protein, 16 aa, Mycobacterium tuberculosis
PRGTQAVVLKVYQNAG

SEQ ID NO: 137283 - protein, 16 aa, Mycobacterium tuberculosis
RGTQAVVLKVYQNAGG

SEQ ID NO: 137284 - protein, 16 aa, Mycobacterium tuberculosis
GTQAVVLKVYQNAGGT

SEQ ID NO: 137285 - protein, 16 aa, Mycobacterium tuberculosis
TQAVVLKVYQNAGGTH

SEQ ID NO: 137286 - protein, 16 aa, Mycobacterium tuberculosis
QAVVLKVYQNAGGTHP

SEQ ID NO: 137287 - protein, 16 aa, Mycobacterium tuberculosis
AVVLKVYQNAGGTHPT

SEQ ID NO: 137288 - protein, 16 aa, Mycobacterium tuberculosis
VVLKVYQNAGGTHPTT

SEQ ID NO: 137289 - protein, 16 aa, Mycobacterium tuberculosis
VLKVYQNAGGTHPTTT

SEQ ID NO: 137290 - protein, 16 aa, Mycobacterium tuberculosis
LKVYQNAGGTHPTTTY

SEQ ID NO: 137291 - protein, 16 aa, Mycobacterium tuberculosis
KVYQNAGGTHPTTTYK

SEQ ID NO: 137292 - protein, 16 aa, Mycobacterium tuberculosis
VYQNAGGTHPTTTYKA

SEQ ID NO: 137293 - protein, 16 aa, Mycobacterium tuberculosis
YQNAGGTHPTTTYKAF

SEQ ID NO: 137294 - protein, 16 aa, Mycobacterium tuberculosis
QNAGGTHPTTTYKAFD

SEQ ID NO: 137295 - protein, 16 aa, Mycobacterium tuberculosis
NAGGTHPTTTYKAFDW

SEQ ID NO: 137296 - protein, 16 aa, Mycobacterium tuberculosis
AGGTHPTTTYKAFDWD

SEQ ID NO: 137297 - protein, 16 aa, Mycobacterium tuberculosis
GGTHPTTTYKAFDWDQ

SEQ ID NO: 137298 - protein, 16 aa, Mycobacterium tuberculosis
GTHPTTTYKAFDWDQA

SEQ ID NO: 137299 - protein, 16 aa, Mycobacterium tuberculosis
THPTTTYKAFDWDQAY

SEQ ID NO: 137300 - protein, 16 aa, Mycobacterium tuberculosis
HPTTTYKAFDWDQAYR

SEQ ID NO: 137301 - protein, 16 aa, Mycobacterium tuberculosis
PTTTYKAFDWDQAYRK

SEQ ID NO: 137302 - protein, 16 aa, Mycobacterium tuberculosis
TTTYKAFDWDQAYRKP

SEQ ID NO: 137303 - protein, 16 aa, Mycobacterium tuberculosis
TTYKAFDWDQAYRKPI

SEQ ID NO: 137304 - protein, 16 aa, Mycobacterium tuberculosis
TYKAFDWDQAYRKPIT

SEQ ID NO: 137305 - protein, 16 aa, Mycobacterium tuberculosis
YKAFDWDQAYRKPITY

SEQ ID NO: 137306 - protein, 16 aa, Mycobacterium tuberculosis
KAFDWDQAYRKPITYD

SEQ ID NO: 137307 - protein, 16 aa, Mycobacterium tuberculosis
AFDWDQAYRKPITYDT

SEQ ID NO: 137308 - protein, 16 aa, Mycobacterium tuberculosis
FDWDQAYRKPITYDTL

SEQ ID NO: 137309 - protein, 16 aa, Mycobacterium tuberculosis
DWDQAYRKPITYDTLW

SEQ ID NO: 137310 - protein, 16 aa, Mycobacterium tuberculosis
WDQAYRKPITYDTLWQ

SEQ ID NO: 137311 - protein, 16 aa, Mycobacterium tuberculosis
DQAYRKPITYDTLWQA

SEQ ID NO: 137312 - protein, 16 aa, Mycobacterium tuberculosis
QAYRKPITYDTLWQAD

SEQ ID NO: 137313 - protein, 16 aa, Mycobacterium tuberculosis
AYRKPITYDTLWQADT

SEQ ID NO: 137314 - protein, 16 aa, Mycobacterium tuberculosis
YRKPITYDTLWQADTD

SEQ ID NO: 137315 - protein, 16 aa, Mycobacterium tuberculosis
RKPITYDTLWQADTDP

SEQ ID NO: 137316 - protein, 16 aa, Mycobacterium tuberculosis
KPITYDTLWQADTDPL

SEQ ID NO: 137317 - protein, 16 aa, Mycobacterium tuberculosis
PITYDTLWQADTDPLP

SEQ ID NO: 137318 - protein, 16 aa, Mycobacterium tuberculosis
ITYDTLWQADTDPLPV

SEQ ID NO: 137319 - protein, 16 aa, Mycobacterium tuberculosis
TYDTLWQADTDPLPVV

SEQ ID NO: 137320 - protein, 16 aa, Mycobacterium tuberculosis
YDTLWQADTDPLPVVF

SEQ ID NO: 137321 - protein, 16 aa, Mycobacterium tuberculosis
DTLWQADTDPLPVVFP

SEQ ID NO: 137322 - protein, 16 aa, Mycobacterium tuberculosis
TLWQADTDPLPVVFPI

SEQ ID NO: 137323 - protein, 16 aa, Mycobacterium tuberculosis
LWQADTDPLPVVFPIV

SEQ ID NO: 137324 - protein, 16 aa, Mycobacterium tuberculosis
WQADTDPLPVVFPIVQ

SEQ ID NO: 137325 - protein, 16 aa, Mycobacterium tuberculosis
QADTDPLPVVFPIVQG

SEQ ID NO: 137326 - protein, 16 aa, Mycobacterium tuberculosis
ADTDPLPVVFPIVQGE

SEQ ID NO: 137327 - protein, 16 aa, Mycobacterium tuberculosis
DTDPLPVVFPIVQGEL

SEQ ID NO: 137328 - protein, 16 aa, Mycobacterium tuberculosis
TDPLPVVFPIVQGELS

SEQ ID NO: 137329 - protein, 16 aa, Mycobacterium tuberculosis
DPLPVVFPIVQGELSK

SEQ ID NO: 137330 - protein, 16 aa, Mycobacterium tuberculosis
PLPVVFPIVQGELSKQ

SEQ ID NO: 137331 - protein, 16 aa, Mycobacterium tuberculosis
LPVVFPIVQGELSKQT

SEQ ID NO: 137332 - protein, 16 aa, Mycobacterium tuberculosis
PVVFPIVQGELSKQTG

SEQ ID NO: 137333 - protein, 16 aa, Mycobacterium tuberculosis
VVFPIVQGELSKQTGQ

SEQ ID NO: 137334 - protein, 16 aa, Mycobacterium tuberculosis
VFPIVQGELSKQTGQQ

SEQ ID NO: 137335 - protein, 16 aa, Mycobacterium tuberculosis
FPIVQGELSKQTGQQV

SEQ ID NO: 137336 - protein, 16 aa, Mycobacterium tuberculosis
PIVQGELSKQTGQQVS

SEQ ID NO: 137337 - protein, 16 aa, Mycobacterium tuberculosis
IVQGELSKQTGQQVSI

SEQ ID NO: 137338 - protein, 16 aa, Mycobacterium tuberculosis
VQGELSKQTGQQVSIA

SEQ ID NO: 137339 - protein, 16 aa, Mycobacterium tuberculosis
QGELSKQTGQQVSIAP

SEQ ID NO: 137340 - protein, 16 aa, Mycobacterium tuberculosis
GELSKQTGQQVSIAPN

SEQ ID NO: 137341 - protein, 16 aa, Mycobacterium tuberculosis
ELSKQTGQQVSIAPNA

SEQ ID NO: 137342 - protein, 16 aa, Mycobacterium tuberculosis
LSKQTGQQVSIAPNAG

SEQ ID NO: 137343 - protein, 16 aa, Mycobacterium tuberculosis
SKQTGQQVSIAPNAGL

SEQ ID NO: 137344 - protein, 16 aa, Mycobacterium tuberculosis
KQTGQQVSIAPNAGLD

SEQ ID NO: 137345 - protein, 16 aa, Mycobacterium tuberculosis
QTGQQVSIAPNAGLDP

SEQ ID NO: 137346 - protein, 16 aa, Mycobacterium tuberculosis
TGQQVSIAPNAGLDPV

SEQ ID NO: 137347 - protein, 16 aa, Mycobacterium tuberculosis
GQQVSIAPNAGLDPVN

SEQ ID NO: 137348 - protein, 16 aa, Mycobacterium tuberculosis
QQVSIAPNAGLDPVNY

SEQ ID NO: 137349 - protein, 16 aa, Mycobacterium tuberculosis
QVSIAPNAGLDPVNYQ

SEQ ID NO: 137350 - protein, 16 aa, Mycobacterium tuberculosis
VSIAPNAGLDPVNYQN

SEQ ID NO: 137351 - protein, 16 aa, Mycobacterium tuberculosis
SIAPNAGLDPVNYQNF

SEQ ID NO: 137352 - protein, 16 aa, Mycobacterium tuberculosis
IAPNAGLDPVNYQNFA

SEQ ID NO: 137353 - protein, 16 aa, Mycobacterium tuberculosis
APNAGLDPVNYQNFAV

SEQ ID NO: 137354 - protein, 16 aa, Mycobacterium tuberculosis
PNAGLDPVNYQNFAVT

SEQ ID NO: 137355 - protein, 16 aa, Mycobacterium tuberculosis
NAGLDPVNYQNFAVTN

SEQ ID NO: 137356 - protein, 16 aa, Mycobacterium tuberculosis
AGLDPVNYQNFAVTND

SEQ ID NO: 137357 - protein, 16 aa, Mycobacterium tuberculosis
GLDPVNYQNFAVTNDG

SEQ ID NO: 137358 - protein, 16 aa, Mycobacterium tuberculosis
LDPVNYQNFAVTNDGV

SEQ ID NO: 137359 - protein, 16 aa, Mycobacterium tuberculosis
DPVNYQNFAVTNDGVI

SEQ ID NO: 137360 - protein, 16 aa, Mycobacterium tuberculosis
PVNYQNFAVTNDGVIF

SEQ ID NO: 137361 - protein, 16 aa, Mycobacterium tuberculosis
VNYQNFAVTNDGVIFF

SEQ ID NO: 137362 - protein, 16 aa, Mycobacterium tuberculosis
NYQNFAVTNDGVIFFF

SEQ ID NO: 137363 - protein, 16 aa, Mycobacterium tuberculosis
YQNFAVTNDGVIFFFN

SEQ ID NO: 137364 - protein, 16 aa, Mycobacterium tuberculosis
QNFAVTNDGVIFFFNP

SEQ ID NO: 137365 - protein, 16 aa, Mycobacterium tuberculosis
NFAVTNDGVIFFFNPG

SEQ ID NO: 137366 - protein, 16 aa, Mycobacterium tuberculosis
FAVTNDGVIFFFNPGE

SEQ ID NO: 137367 - protein, 16 aa, Mycobacterium tuberculosis
AVTNDGVIFFFNPGEL

SEQ ID NO: 137368 - protein, 16 aa, Mycobacterium tuberculosis
VTNDGVIFFFNPGELL

SEQ ID NO: 137369 - protein, 16 aa, Mycobacterium tuberculosis
TNDGVIFFFNPGELLP

SEQ ID NO: 137370 - protein, 16 aa, Mycobacterium tuberculosis
NDGVIFFFNPGELLPE

SEQ ID NO: 137371 - protein, 16 aa, Mycobacterium tuberculosis
DGVIFFFNPGELLPEA

SEQ ID NO: 137372 - protein, 16 aa, Mycobacterium tuberculosis
GVIFFFNPGELLPEAA

SEQ ID NO: 137373 - protein, 16 aa, Mycobacterium tuberculosis
VIFFFNPGELLPEAAG

SEQ ID NO: 137374 - protein, 16 aa, Mycobacterium tuberculosis
IFFFNPGELLPEAAGP

SEQ ID NO: 137375 - protein, 16 aa, Mycobacterium tuberculosis
FFFNPGELLPEAAGPT

SEQ ID NO: 137376 - protein, 16 aa, Mycobacterium tuberculosis
FFNPGELLPEAAGPTQ

SEQ ID NO: 137377 - protein, 16 aa, Mycobacterium tuberculosis
FNPGELLPEAAGPTQV

SEQ ID NO: 137378 - protein, 16 aa, Mycobacterium tuberculosis
NPGELLPEAAGPTQVL

SEQ ID NO: 137379 - protein, 16 aa, Mycobacterium tuberculosis
PGELLPEAAGPTQVLV

SEQ ID NO: 137380 - protein, 16 aa, Mycobacterium tuberculosis
GELLPEAAGPTQVLVP

SEQ ID NO: 137381 - protein, 16 aa, Mycobacterium tuberculosis
ELLPEAAGPTQVLVPR

SEQ ID NO: 137382 - protein, 16 aa, Mycobacterium tuberculosis
LLPEAAGPTQVLVPRS

SEQ ID NO: 137383 - protein, 16 aa, Mycobacterium tuberculosis
LPEAAGPTQVLVPRSA

SEQ ID NO: 137384 - protein, 16 aa, Mycobacterium tuberculosis
PEAAGPTQVLVPRSAI

SEQ ID NO: 137385 - protein, 16 aa, Mycobacterium tuberculosis
EAAGPTQVLVPRSAID

SEQ ID NO: 137386 - protein, 16 aa, Mycobacterium tuberculosis
AAGPTQVLVPRSAIDS

SEQ ID NO: 137387 - protein, 16 aa, Mycobacterium tuberculosis
AGPTQVLVPRSAIDSM

SEQ ID NO: 137388 - protein, 16 aa, Mycobacterium tuberculosis
GPTQVLVPRSAIDSML

SEQ ID NO: 137389 - protein, 16 aa, Mycobacterium tuberculosis
PTQVLVPRSAIDSMLA

SEQ ID NO: 137390 - protein, 273 aa, Mycobacterium tuberculosis
MEPKRSRLVVCAPEPSHAREFPDVAVFSGGRANASQAERLARAVGRVLADRGVTGGARVRLTMANCADGPTLVQINLQVGDTPLRAQAATAGIDDLRPALIRLDRQIVRASAQWCPRPWPDRPRRRLTTPAEALVTRRKPVVLRRATPLQAIAAMDAMDYDVHLFTDAETGEDAVVYRAGPSGLRLARQHHVFPPGWSRCRAPAGPPVPLIVNSRPTPVLTEAAAVDRAREHGLPFLFFTDQATGRGQLLYSRYDGNLGLITPTGDGVADGLA

SEQ ID NO: 137391 - protein, 8 aa, Mycobacterium tuberculosis
RSRLVVCA

SEQ ID NO: 137392 - protein, 8 aa, Mycobacterium tuberculosis
EPSHAREF

SEQ ID NO: 137393 - protein, 8 aa, Mycobacterium tuberculosis
REFPDVAV

SEQ ID NO: 137394 - protein, 8 aa, Mycobacterium tuberculosis
EFPDVAVF

SEQ ID NO: 137395 - protein, 8 aa, Mycobacterium tuberculosis
FPDVAVFS

SEQ ID NO: 137396 - protein, 8 aa, Mycobacterium tuberculosis
VAVFSGGR

SEQ ID NO: 137397 - protein, 8 aa, Mycobacterium tuberculosis
SQAERLAR

SEQ ID NO: 137398 - protein, 8 aa, Mycobacterium tuberculosis
AERLARAV

SEQ ID NO: 137399 - protein, 8 aa, Mycobacterium tuberculosis
RLARAVGR

SEQ ID NO: 137400 - protein, 8 aa, Mycobacterium tuberculosis
LARAVGRV

SEQ ID NO: 137401 - protein, 8 aa, Mycobacterium tuberculosis
ARAVGRVL

SEQ ID NO: 137402 - protein, 8 aa, Mycobacterium tuberculosis
RAVGRVLA

SEQ ID NO: 137403 - protein, 8 aa, Mycobacterium tuberculosis
RVLADRGV

SEQ ID NO: 137404 - protein, 8 aa, Mycobacterium tuberculosis
VLADRGVT

SEQ ID NO: 137405 - protein, 8 aa, Mycobacterium tuberculosis
GVTGGARV

SEQ ID NO: 137406 - protein, 8 aa, Mycobacterium tuberculosis
VTGGARVR

SEQ ID NO: 137407 - protein, 8 aa, Mycobacterium tuberculosis
GARVRLTM

SEQ ID NO: 137408 - protein, 8 aa, Mycobacterium tuberculosis
RVRLTMAN

SEQ ID NO: 137409 - protein, 8 aa, Mycobacterium tuberculosis
RLTMANCA

SEQ ID NO: 137410 - protein, 8 aa, Mycobacterium tuberculosis
NCADGPTL

SEQ ID NO: 137411 - protein, 8 aa, Mycobacterium tuberculosis
CADGPTLV

SEQ ID NO: 137412 - protein, 8 aa, Mycobacterium tuberculosis
TLVQINLQ

SEQ ID NO: 137413 - protein, 8 aa, Mycobacterium tuberculosis
LVQINLQV

SEQ ID NO: 137414 - protein, 8 aa, Mycobacterium tuberculosis
LQVGDTPL

SEQ ID NO: 137415 - protein, 8 aa, Mycobacterium tuberculosis
QVGDTPLR

SEQ ID NO: 137416 - protein, 8 aa, Mycobacterium tuberculosis
TPLRAQAA

SEQ ID NO: 137417 - protein, 8 aa, Mycobacterium tuberculosis
AQAATAGI

SEQ ID NO: 137418 - protein, 8 aa, Mycobacterium tuberculosis
ATAGIDDL

SEQ ID NO: 137419 - protein, 8 aa, Mycobacterium tuberculosis
TAGIDDLR

SEQ ID NO: 137420 - protein, 8 aa, Mycobacterium tuberculosis
GIDDLRPA

SEQ ID NO: 137421 - protein, 8 aa, Mycobacterium tuberculosis
DLRPALIR

SEQ ID NO: 137422 - protein, 8 aa, Mycobacterium tuberculosis
RLDRQIVR

SEQ ID NO: 137423 - protein, 8 aa, Mycobacterium tuberculosis
RQIVRASA

SEQ ID NO: 137424 - protein, 8 aa, Mycobacterium tuberculosis
IVRASAQW

SEQ ID NO: 137425 - protein, 8 aa, Mycobacterium tuberculosis
ASAQWCPR

SEQ ID NO: 137426 - protein, 8 aa, Mycobacterium tuberculosis
RPWPDRPR

SEQ ID NO: 137427 - protein, 8 aa, Mycobacterium tuberculosis
RPRRRLTT

SEQ ID NO: 137428 - protein, 8 aa, Mycobacterium tuberculosis
RRRLTTPA

SEQ ID NO: 137429 - protein, 8 aa, Mycobacterium tuberculosis
RRLTTPAE

SEQ ID NO: 137430 - protein, 8 aa, Mycobacterium tuberculosis
RLTTPAEA

SEQ ID NO: 137431 - protein, 8 aa, Mycobacterium tuberculosis
LTTPAEAL

SEQ ID NO: 137432 - protein, 8 aa, Mycobacterium tuberculosis
TTPAEALV

SEQ ID NO: 137433 - protein, 8 aa, Mycobacterium tuberculosis
TPAEALVT

SEQ ID NO: 137434 - protein, 8 aa, Mycobacterium tuberculosis
EALVTRRK

SEQ ID NO: 137435 - protein, 8 aa, Mycobacterium tuberculosis
LVTRRKPV

SEQ ID NO: 137436 - protein, 8 aa, Mycobacterium tuberculosis
RRKPVVLR

SEQ ID NO: 137437 - protein, 8 aa, Mycobacterium tuberculosis
KPVVLRRA

SEQ ID NO: 137438 - protein, 8 aa, Mycobacterium tuberculosis
VLRRATPL

SEQ ID NO: 137439 - protein, 8 aa, Mycobacterium tuberculosis
RATPLQAI

SEQ ID NO: 137440 - protein, 8 aa, Mycobacterium tuberculosis
TPLQAIAA

SEQ ID NO: 137441 - protein, 8 aa, Mycobacterium tuberculosis
PLQAIAAM

SEQ ID NO: 137442 - protein, 8 aa, Mycobacterium tuberculosis
AIAAMDAM

SEQ ID NO: 137443 - protein, 8 aa, Mycobacterium tuberculosis
AAMDAMDY

SEQ ID NO: 137444 - protein, 8 aa, Mycobacterium tuberculosis
DAMDYDVH

SEQ ID NO: 137445 - protein, 8 aa, Mycobacterium tuberculosis
AMDYDVHL

SEQ ID NO: 137446 - protein, 8 aa, Mycobacterium tuberculosis
HLFTDAET

SEQ ID NO: 137447 - protein, 8 aa, Mycobacterium tuberculosis
AETGEDAV

SEQ ID NO: 137448 - protein, 8 aa, Mycobacterium tuberculosis
ETGEDAVV

SEQ ID NO: 137449 - protein, 8 aa, Mycobacterium tuberculosis
TGEDAVVY

SEQ ID NO: 137450 - protein, 8 aa, Mycobacterium tuberculosis
EDAVVYRA

SEQ ID NO: 137451 - protein, 8 aa, Mycobacterium tuberculosis
YRAGPSGL

SEQ ID NO: 137452 - protein, 8 aa, Mycobacterium tuberculosis
RAGPSGLR

SEQ ID NO: 137453 - protein, 8 aa, Mycobacterium tuberculosis
RLARQHHV

SEQ ID NO: 137454 - protein, 8 aa, Mycobacterium tuberculosis
LARQHHVF

SEQ ID NO: 137455 - protein, 8 aa, Mycobacterium tuberculosis
VFPPGWSR

SEQ ID NO: 137456 - protein, 8 aa, Mycobacterium tuberculosis
FPPGWSRC

SEQ ID NO: 137457 - protein, 8 aa, Mycobacterium tuberculosis
RAPAGPPV

SEQ ID NO: 137458 - protein, 8 aa, Mycobacterium tuberculosis
GPPVPLIV

SEQ ID NO: 137459 - protein, 8 aa, Mycobacterium tuberculosis
TPVLTEAA

SEQ ID NO: 137460 - protein, 8 aa, Mycobacterium tuberculosis
VLTEAAAV

SEQ ID NO: 137461 - protein, 8 aa, Mycobacterium tuberculosis
TEAAAVDR

SEQ ID NO: 137462 - protein, 8 aa, Mycobacterium tuberculosis
EAAAVDRA

SEQ ID NO: 137463 - protein, 8 aa, Mycobacterium tuberculosis
REHGLPFL

SEQ ID NO: 137464 - protein, 8 aa, Mycobacterium tuberculosis
GLPFLFFT

SEQ ID NO: 137465 - protein, 8 aa, Mycobacterium tuberculosis
LPFLFFTD

SEQ ID NO: 137466 - protein, 8 aa, Mycobacterium tuberculosis
FLFFTDQA

SEQ ID NO: 137467 - protein, 8 aa, Mycobacterium tuberculosis
FTDQATGR

SEQ ID NO: 137468 - protein, 8 aa, Mycobacterium tuberculosis
RGQLLYSR

SEQ ID NO: 137469 - protein, 8 aa, Mycobacterium tuberculosis
GQLLYSRY

SEQ ID NO: 137470 - protein, 8 aa, Mycobacterium tuberculosis
RYDGNLGL

SEQ ID NO: 137471 - protein, 8 aa, Mycobacterium tuberculosis
NLGLITPT

SEQ ID NO: 137472 - protein, 8 aa, Mycobacterium tuberculosis
ITPTGDGV

SEQ ID NO: 137473 - protein, 8 aa, Mycobacterium tuberculosis
TPTGDGVA

SEQ ID NO: 137474 - protein, 9 aa, Mycobacterium tuberculosis
EPKRSRLVV

SEQ ID NO: 137475 - protein, 9 aa, Mycobacterium tuberculosis
CAPEPSHAR

SEQ ID NO: 137476 - protein, 9 aa, Mycobacterium tuberculosis
REFPDVAVF

SEQ ID NO: 137477 - protein, 9 aa, Mycobacterium tuberculosis
FPDVAVFSG

SEQ ID NO: 137478 - protein, 9 aa, Mycobacterium tuberculosis
DVAVFSGGR

SEQ ID NO: 137479 - protein, 9 aa, Mycobacterium tuberculosis
RANASQAER

SEQ ID NO: 137480 - protein, 9 aa, Mycobacterium tuberculosis
ASQAERLAR

SEQ ID NO: 137481 - protein, 9 aa, Mycobacterium tuberculosis
SQAERLARA

SEQ ID NO: 137482 - protein, 9 aa, Mycobacterium tuberculosis
RLARAVGRV

SEQ ID NO: 137483 - protein, 9 aa, Mycobacterium tuberculosis
LARAVGRVL

SEQ ID NO: 137484 - protein, 9 aa, Mycobacterium tuberculosis
AVGRVLADR

SEQ ID NO: 137485 - protein, 9 aa, Mycobacterium tuberculosis
VLADRGVTG

SEQ ID NO: 137486 - protein, 9 aa, Mycobacterium tuberculosis
GVTGGARVR

SEQ ID NO: 137487 - protein, 9 aa, Mycobacterium tuberculosis
VTGGARVRL

SEQ ID NO: 137488 - protein, 9 aa, Mycobacterium tuberculosis
GARVRLTMA

SEQ ID NO: 137489 - protein, 9 aa, Mycobacterium tuberculosis
MANCADGPT

SEQ ID NO: 137490 - protein, 9 aa, Mycobacterium tuberculosis
NCADGPTLV

SEQ ID NO: 137491 - protein, 9 aa, Mycobacterium tuberculosis
TLVQINLQV

SEQ ID NO: 137492 - protein, 9 aa, Mycobacterium tuberculosis
NLQVGDTPL

SEQ ID NO: 137493 - protein, 9 aa, Mycobacterium tuberculosis
LQVGDTPLR

SEQ ID NO: 137494 - protein, 9 aa, Mycobacterium tuberculosis
QVGDTPLRA

SEQ ID NO: 137495 - protein, 9 aa, Mycobacterium tuberculosis
TPLRAQAAT

SEQ ID NO: 137496 - protein, 9 aa, Mycobacterium tuberculosis
RAQAATAGI

SEQ ID NO: 137497 - protein, 9 aa, Mycobacterium tuberculosis
ATAGIDDLR

SEQ ID NO: 137498 - protein, 9 aa, Mycobacterium tuberculosis
GIDDLRPAL

SEQ ID NO: 137499 - protein, 9 aa, Mycobacterium tuberculosis
DLRPALIRL

SEQ ID NO: 137500 - protein, 9 aa, Mycobacterium tuberculosis
ALIRLDRQI

SEQ ID NO: 137501 - protein, 9 aa, Mycobacterium tuberculosis
LIRLDRQIV

SEQ ID NO: 137502 - protein, 9 aa, Mycobacterium tuberculosis
RLDRQIVRA

SEQ ID NO: 137503 - protein, 9 aa, Mycobacterium tuberculosis
RQIVRASAQ

SEQ ID NO: 137504 - protein, 9 aa, Mycobacterium tuberculosis
QIVRASAQW

SEQ ID NO: 137505 - protein, 9 aa, Mycobacterium tuberculosis
RASAQWCPR

SEQ ID NO: 137506 - protein, 9 aa, Mycobacterium tuberculosis
SAQWCPRPW

SEQ ID NO: 137507 - protein, 9 aa, Mycobacterium tuberculosis
RPWPDRPRR

SEQ ID NO: 137508 - protein, 9 aa, Mycobacterium tuberculosis
WPDRPRRRL

SEQ ID NO: 137509 - protein, 9 aa, Mycobacterium tuberculosis
RPRRRLTTP

SEQ ID NO: 137510 - protein, 9 aa, Mycobacterium tuberculosis
RRRLTTPAE

SEQ ID NO: 137511 - protein, 9 aa, Mycobacterium tuberculosis
RRLTTPAEA

SEQ ID NO: 137512 - protein, 9 aa, Mycobacterium tuberculosis
RLTTPAEAL

SEQ ID NO: 137513 - protein, 9 aa, Mycobacterium tuberculosis
LTTPAEALV

SEQ ID NO: 137514 - protein, 9 aa, Mycobacterium tuberculosis
TPAEALVTR

SEQ ID NO: 137515 - protein, 9 aa, Mycobacterium tuberculosis
ALVTRRKPV

SEQ ID NO: 137516 - protein, 9 aa, Mycobacterium tuberculosis
LVTRRKPVV

SEQ ID NO: 137517 - protein, 9 aa, Mycobacterium tuberculosis
VTRRKPVVL

SEQ ID NO: 137518 - protein, 9 aa, Mycobacterium tuberculosis
RRKPVVLRR

SEQ ID NO: 137519 - protein, 9 aa, Mycobacterium tuberculosis
KPVVLRRAT

SEQ ID NO: 137520 - protein, 9 aa, Mycobacterium tuberculosis
VVLRRATPL

SEQ ID NO: 137521 - protein, 9 aa, Mycobacterium tuberculosis
VLRRATPLQ

SEQ ID NO: 137522 - protein, 9 aa, Mycobacterium tuberculosis
TPLQAIAAM

SEQ ID NO: 137523 - protein, 9 aa, Mycobacterium tuberculosis
QAIAAMDAM

SEQ ID NO: 137524 - protein, 9 aa, Mycobacterium tuberculosis
IAAMDAMDY

SEQ ID NO: 137525 - protein, 9 aa, Mycobacterium tuberculosis
AMDAMDYDV

SEQ ID NO: 137526 - protein, 9 aa, Mycobacterium tuberculosis
DAMDYDVHL

SEQ ID NO: 137527 - protein, 9 aa, Mycobacterium tuberculosis
AMDYDVHLF

SEQ ID NO: 137528 - protein, 9 aa, Mycobacterium tuberculosis
AETGEDAVV

SEQ ID NO: 137529 - protein, 9 aa, Mycobacterium tuberculosis
ETGEDAVVY

SEQ ID NO: 137530 - protein, 9 aa, Mycobacterium tuberculosis
TGEDAVVYR

SEQ ID NO: 137531 - protein, 9 aa, Mycobacterium tuberculosis
VYRAGPSGL

SEQ ID NO: 137532 - protein, 9 aa, Mycobacterium tuberculosis
YRAGPSGLR

SEQ ID NO: 137533 - protein, 9 aa, Mycobacterium tuberculosis
RAGPSGLRL

SEQ ID NO: 137534 - protein, 9 aa, Mycobacterium tuberculosis
RLARQHHVF

SEQ ID NO: 137535 - protein, 9 aa, Mycobacterium tuberculosis
HVFPPGWSR

SEQ ID NO: 137536 - protein, 9 aa, Mycobacterium tuberculosis
APAGPPVPL

SEQ ID NO: 137537 - protein, 9 aa, Mycobacterium tuberculosis
IVNSRPTPV

SEQ ID NO: 137538 - protein, 9 aa, Mycobacterium tuberculosis
RPTPVLTEA

SEQ ID NO: 137539 - protein, 9 aa, Mycobacterium tuberculosis
TPVLTEAAA

SEQ ID NO: 137540 - protein, 9 aa, Mycobacterium tuberculosis
PVLTEAAAV

SEQ ID NO: 137541 - protein, 9 aa, Mycobacterium tuberculosis
LTEAAAVDR

SEQ ID NO: 137542 - protein, 9 aa, Mycobacterium tuberculosis
EAAAVDRAR

SEQ ID NO: 137543 - protein, 9 aa, Mycobacterium tuberculosis
RAREHGLPF

SEQ ID NO: 137544 - protein, 9 aa, Mycobacterium tuberculosis
REHGLPFLF

SEQ ID NO: 137545 - protein, 9 aa, Mycobacterium tuberculosis
LPFLFFTDQ

SEQ ID NO: 137546 - protein, 9 aa, Mycobacterium tuberculosis
FLFFTDQAT

SEQ ID NO: 137547 - protein, 9 aa, Mycobacterium tuberculosis
FFTDQATGR

SEQ ID NO: 137548 - protein, 9 aa, Mycobacterium tuberculosis
ATGRGQLLY

SEQ ID NO: 137549 - protein, 9 aa, Mycobacterium tuberculosis
GRGQLLYSR

SEQ ID NO: 137550 - protein, 9 aa, Mycobacterium tuberculosis
LYSRYDGNL

SEQ ID NO: 137551 - protein, 9 aa, Mycobacterium tuberculosis
SRYDGNLGL

SEQ ID NO: 137552 - protein, 9 aa, Mycobacterium tuberculosis
RYDGNLGLI

SEQ ID NO: 137553 - protein, 9 aa, Mycobacterium tuberculosis
LITPTGDGV

SEQ ID NO: 137554 - protein, 10 aa, Mycobacterium tuberculosis
RSRLVVCAPE

SEQ ID NO: 137555 - protein, 10 aa, Mycobacterium tuberculosis
APEPSHAREF

SEQ ID NO: 137556 - protein, 10 aa, Mycobacterium tuberculosis
HAREFPDVAV

SEQ ID NO: 137557 - protein, 10 aa, Mycobacterium tuberculosis
REFPDVAVFS

SEQ ID NO: 137558 - protein, 10 aa, Mycobacterium tuberculosis
FPDVAVFSGG

SEQ ID NO: 137559 - protein, 10 aa, Mycobacterium tuberculosis
DVAVFSGGRA

SEQ ID NO: 137560 - protein, 10 aa, Mycobacterium tuberculosis
GRANASQAER

SEQ ID NO: 137561 - protein, 10 aa, Mycobacterium tuberculosis
RANASQAERL

SEQ ID NO: 137562 - protein, 10 aa, Mycobacterium tuberculosis
NASQAERLAR

SEQ ID NO: 137563 - protein, 10 aa, Mycobacterium tuberculosis
SQAERLARAV

SEQ ID NO: 137564 - protein, 10 aa, Mycobacterium tuberculosis
AERLARAVGR

SEQ ID NO: 137565 - protein, 10 aa, Mycobacterium tuberculosis
RLARAVGRVL

SEQ ID NO: 137566 - protein, 10 aa, Mycobacterium tuberculosis
RAVGRVLADR

SEQ ID NO: 137567 - protein, 10 aa, Mycobacterium tuberculosis
VLADRGVTGG

SEQ ID NO: 137568 - protein, 10 aa, Mycobacterium tuberculosis
GVTGGARVRL

SEQ ID NO: 137569 - protein, 10 aa, Mycobacterium tuberculosis
RVRLTMANCA

SEQ ID NO: 137570 - protein, 10 aa, Mycobacterium tuberculosis
TMANCADGPT

SEQ ID NO: 137571 - protein, 10 aa, Mycobacterium tuberculosis
MANCADGPTL

SEQ ID NO: 137572 - protein, 10 aa, Mycobacterium tuberculosis
CADGPTLVQI

SEQ ID NO: 137573 - protein, 10 aa, Mycobacterium tuberculosis
PTLVQINLQV

SEQ ID NO: 137574 - protein, 10 aa, Mycobacterium tuberculosis
NLQVGDTPLR

SEQ ID NO: 137575 - protein, 10 aa, Mycobacterium tuberculosis
LQVGDTPLRA

SEQ ID NO: 137576 - protein, 10 aa, Mycobacterium tuberculosis
TPLRAQAATA

SEQ ID NO: 137577 - protein, 10 aa, Mycobacterium tuberculosis
AATAGIDDLR

SEQ ID NO: 137578 - protein, 10 aa, Mycobacterium tuberculosis
GIDDLRPALI

SEQ ID NO: 137579 - protein, 10 aa, Mycobacterium tuberculosis
ALIRLDRQIV

SEQ ID NO: 137580 - protein, 10 aa, Mycobacterium tuberculosis
LIRLDRQIVR

SEQ ID NO: 137581 - protein, 10 aa, Mycobacterium tuberculosis
RLDRQIVRAS

SEQ ID NO: 137582 - protein, 10 aa, Mycobacterium tuberculosis
RQIVRASAQW

SEQ ID NO: 137583 - protein, 10 aa, Mycobacterium tuberculosis
ASAQWCPRPW

SEQ ID NO: 137584 - protein, 10 aa, Mycobacterium tuberculosis
WPDRPRRRLT

SEQ ID NO: 137585 - protein, 10 aa, Mycobacterium tuberculosis
RPRRRLTTPA

SEQ ID NO: 137586 - protein, 10 aa, Mycobacterium tuberculosis
RRLTTPAEAL

SEQ ID NO: 137587 - protein, 10 aa, Mycobacterium tuberculosis
RLTTPAEALV

SEQ ID NO: 137588 - protein, 10 aa, Mycobacterium tuberculosis
TTPAEALVTR

SEQ ID NO: 137589 - protein, 10 aa, Mycobacterium tuberculosis
TPAEALVTRR

SEQ ID NO: 137590 - protein, 10 aa, Mycobacterium tuberculosis
EALVTRRKPV

SEQ ID NO: 137591 - protein, 10 aa, Mycobacterium tuberculosis
ALVTRRKPVV

SEQ ID NO: 137592 - protein, 10 aa, Mycobacterium tuberculosis
VTRRKPVVLR

SEQ ID NO: 137593 - protein, 10 aa, Mycobacterium tuberculosis
TRRKPVVLRR

SEQ ID NO: 137594 - protein, 10 aa, Mycobacterium tuberculosis
KPVVLRRATP

SEQ ID NO: 137595 - protein, 10 aa, Mycobacterium tuberculosis
VLRRATPLQA

SEQ ID NO: 137596 - protein, 10 aa, Mycobacterium tuberculosis
ATPLQAIAAM

SEQ ID NO: 137597 - protein, 10 aa, Mycobacterium tuberculosis
LQAIAAMDAM

SEQ ID NO: 137598 - protein, 10 aa, Mycobacterium tuberculosis
AIAAMDAMDY

SEQ ID NO: 137599 - protein, 10 aa, Mycobacterium tuberculosis
AAMDAMDYDV

SEQ ID NO: 137600 - protein, 10 aa, Mycobacterium tuberculosis
DAMDYDVHLF

SEQ ID NO: 137601 - protein, 10 aa, Mycobacterium tuberculosis
AMDYDVHLFT

SEQ ID NO: 137602 - protein, 10 aa, Mycobacterium tuberculosis
AETGEDAVVY

SEQ ID NO: 137603 - protein, 10 aa, Mycobacterium tuberculosis
ETGEDAVVYR

SEQ ID NO: 137604 - protein, 10 aa, Mycobacterium tuberculosis
VVYRAGPSGL

SEQ ID NO: 137605 - protein, 10 aa, Mycobacterium tuberculosis
YRAGPSGLRL

SEQ ID NO: 137606 - protein, 10 aa, Mycobacterium tuberculosis
GLRLARQHHV

SEQ ID NO: 137607 - protein, 10 aa, Mycobacterium tuberculosis
RQHHVFPPGW

SEQ ID NO: 137608 - protein, 10 aa, Mycobacterium tuberculosis
FPPGWSRCRA

SEQ ID NO: 137609 - protein, 10 aa, Mycobacterium tuberculosis
RCRAPAGPPV

SEQ ID NO: 137610 - protein, 10 aa, Mycobacterium tuberculosis
RAPAGPPVPL

SEQ ID NO: 137611 - protein, 10 aa, Mycobacterium tuberculosis
APAGPPVPLI

SEQ ID NO: 137612 - protein, 10 aa, Mycobacterium tuberculosis
PAGPPVPLIV

SEQ ID NO: 137613 - protein, 10 aa, Mycobacterium tuberculosis
VPLIVNSRPT

SEQ ID NO: 137614 - protein, 10 aa, Mycobacterium tuberculosis
LIVNSRPTPV

SEQ ID NO: 137615 - protein, 10 aa, Mycobacterium tuberculosis
IVNSRPTPVL

SEQ ID NO: 137616 - protein, 10 aa, Mycobacterium tuberculosis
RPTPVLTEAA

SEQ ID NO: 137617 - protein, 10 aa, Mycobacterium tuberculosis
TPVLTEAAAV

SEQ ID NO: 137618 - protein, 10 aa, Mycobacterium tuberculosis
VLTEAAAVDR

SEQ ID NO: 137619 - protein, 10 aa, Mycobacterium tuberculosis
AVDRAREHGL

SEQ ID NO: 137620 - protein, 10 aa, Mycobacterium tuberculosis
RAREHGLPFL

SEQ ID NO: 137621 - protein, 10 aa, Mycobacterium tuberculosis
REHGLPFLFF

SEQ ID NO: 137622 - protein, 10 aa, Mycobacterium tuberculosis
LPFLFFTDQA

SEQ ID NO: 137623 - protein, 10 aa, Mycobacterium tuberculosis
FLFFTDQATG

SEQ ID NO: 137624 - protein, 10 aa, Mycobacterium tuberculosis
LFFTDQATGR

SEQ ID NO: 137625 - protein, 10 aa, Mycobacterium tuberculosis
GRGQLLYSRY

SEQ ID NO: 137626 - protein, 10 aa, Mycobacterium tuberculosis
LLYSRYDGNL

SEQ ID NO: 137627 - protein, 10 aa, Mycobacterium tuberculosis
GLITPTGDGV

SEQ ID NO: 137628 - protein, 11 aa, Mycobacterium tuberculosis
RSRLVVCAPEP

SEQ ID NO: 137629 - protein, 11 aa, Mycobacterium tuberculosis
LVVCAPEPSHA

SEQ ID NO: 137630 - protein, 11 aa, Mycobacterium tuberculosis
VVCAPEPSHAR

SEQ ID NO: 137631 - protein, 11 aa, Mycobacterium tuberculosis
HAREFPDVAVF

SEQ ID NO: 137632 - protein, 11 aa, Mycobacterium tuberculosis
QAERLARAVGR

SEQ ID NO: 137633 - protein, 11 aa, Mycobacterium tuberculosis
AERLARAVGRV

SEQ ID NO: 137634 - protein, 11 aa, Mycobacterium tuberculosis
RLARAVGRVLA

SEQ ID NO: 137635 - protein, 11 aa, Mycobacterium tuberculosis
AVGRVLADRGV

SEQ ID NO: 137636 - protein, 11 aa, Mycobacterium tuberculosis
VLADRGVTGGA

SEQ ID NO: 137637 - protein, 11 aa, Mycobacterium tuberculosis
LTMANCADGPT

SEQ ID NO: 137638 - protein, 11 aa, Mycobacterium tuberculosis
TMANCADGPTL

SEQ ID NO: 137639 - protein, 11 aa, Mycobacterium tuberculosis
MANCADGPTLV

SEQ ID NO: 137640 - protein, 11 aa, Mycobacterium tuberculosis
NCADGPTLVQI

SEQ ID NO: 137641 - protein, 11 aa, Mycobacterium tuberculosis
QINLQVGDTPL

SEQ ID NO: 137642 - protein, 11 aa, Mycobacterium tuberculosis
NLQVGDTPLRA

SEQ ID NO: 137643 - protein, 11 aa, Mycobacterium tuberculosis
QVGDTPLRAQA

SEQ ID NO: 137644 - protein, 11 aa, Mycobacterium tuberculosis
TPLRAQAATAG

SEQ ID NO: 137645 - protein, 11 aa, Mycobacterium tuberculosis
PLRAQAATAGI

SEQ ID NO: 137646 - protein, 11 aa, Mycobacterium tuberculosis
AQAATAGIDDL

SEQ ID NO: 137647 - protein, 11 aa, Mycobacterium tuberculosis
QAATAGIDDLR

SEQ ID NO: 137648 - protein, 11 aa, Mycobacterium tuberculosis
ATAGIDDLRPA

SEQ ID NO: 137649 - protein, 11 aa, Mycobacterium tuberculosis
TAGIDDLRPAL

SEQ ID NO: 137650 - protein, 11 aa, Mycobacterium tuberculosis
DLRPALIRLDR

SEQ ID NO: 137651 - protein, 11 aa, Mycobacterium tuberculosis
RPALIRLDRQI

SEQ ID NO: 137652 - protein, 11 aa, Mycobacterium tuberculosis
ALIRLDRQIVR

SEQ ID NO: 137653 - protein, 11 aa, Mycobacterium tuberculosis
RLDRQIVRASA

SEQ ID NO: 137654 - protein, 11 aa, Mycobacterium tuberculosis
RQIVRASAQWC

SEQ ID NO: 137655 - protein, 11 aa, Mycobacterium tuberculosis
IVRASAQWCPR

SEQ ID NO: 137656 - protein, 11 aa, Mycobacterium tuberculosis
RASAQWCPRPW

SEQ ID NO: 137657 - protein, 11 aa, Mycobacterium tuberculosis
AQWCPRPWPDR

SEQ ID NO: 137658 - protein, 11 aa, Mycobacterium tuberculosis
RPWPDRPRRRL

SEQ ID NO: 137659 - protein, 11 aa, Mycobacterium tuberculosis
WPDRPRRRLTT

SEQ ID NO: 137660 - protein, 11 aa, Mycobacterium tuberculosis
RPRRRLTTPAE

SEQ ID NO: 137661 - protein, 11 aa, Mycobacterium tuberculosis
RRRLTTPAEAL

SEQ ID NO: 137662 - protein, 11 aa, Mycobacterium tuberculosis
RRLTTPAEALV

SEQ ID NO: 137663 - protein, 11 aa, Mycobacterium tuberculosis
LTTPAEALVTR

SEQ ID NO: 137664 - protein, 11 aa, Mycobacterium tuberculosis
TTPAEALVTRR

SEQ ID NO: 137665 - protein, 11 aa, Mycobacterium tuberculosis
TPAEALVTRRK

SEQ ID NO: 137666 - protein, 11 aa, Mycobacterium tuberculosis
AEALVTRRKPV

SEQ ID NO: 137667 - protein, 11 aa, Mycobacterium tuberculosis
EALVTRRKPVV

SEQ ID NO: 137668 - protein, 11 aa, Mycobacterium tuberculosis
ALVTRRKPVVL

SEQ ID NO: 137669 - protein, 11 aa, Mycobacterium tuberculosis
LVTRRKPVVLR

SEQ ID NO: 137670 - protein, 11 aa, Mycobacterium tuberculosis
VTRRKPVVLRR

SEQ ID NO: 137671 - protein, 11 aa, Mycobacterium tuberculosis
KPVVLRRATPL

SEQ ID NO: 137672 - protein, 11 aa, Mycobacterium tuberculosis
VLRRATPLQAI

SEQ ID NO: 137673 - protein, 11 aa, Mycobacterium tuberculosis
RATPLQAIAAM

SEQ ID NO: 137674 - protein, 11 aa, Mycobacterium tuberculosis
TPLQAIAAMDA

SEQ ID NO: 137675 - protein, 11 aa, Mycobacterium tuberculosis
QAIAAMDAMDY

SEQ ID NO: 137676 - protein, 11 aa, Mycobacterium tuberculosis
AMDAMDYDVHL

SEQ ID NO: 137677 - protein, 11 aa, Mycobacterium tuberculosis
FTDAETGEDAV

SEQ ID NO: 137678 - protein, 11 aa, Mycobacterium tuberculosis
DAETGEDAVVY

SEQ ID NO: 137679 - protein, 11 aa, Mycobacterium tuberculosis
ETGEDAVVYRA

SEQ ID NO: 137680 - protein, 11 aa, Mycobacterium tuberculosis
AVVYRAGPSGL

SEQ ID NO: 137681 - protein, 11 aa, Mycobacterium tuberculosis
VVYRAGPSGLR

SEQ ID NO: 137682 - protein, 11 aa, Mycobacterium tuberculosis
VYRAGPSGLRL

SEQ ID NO: 137683 - protein, 11 aa, Mycobacterium tuberculosis
RAGPSGLRLAR

SEQ ID NO: 137684 - protein, 11 aa, Mycobacterium tuberculosis
GLRLARQHHVF

SEQ ID NO: 137685 - protein, 11 aa, Mycobacterium tuberculosis
HVFPPGWSRCR

SEQ ID NO: 137686 - protein, 11 aa, Mycobacterium tuberculosis
FPPGWSRCRAP

SEQ ID NO: 137687 - protein, 11 aa, Mycobacterium tuberculosis
PPGWSRCRAPA

SEQ ID NO: 137688 - protein, 11 aa, Mycobacterium tuberculosis
APAGPPVPLIV

SEQ ID NO: 137689 - protein, 11 aa, Mycobacterium tuberculosis
PLIVNSRPTPV

SEQ ID NO: 137690 - protein, 11 aa, Mycobacterium tuberculosis
LIVNSRPTPVL

SEQ ID NO: 137691 - protein, 11 aa, Mycobacterium tuberculosis
RPTPVLTEAAA

SEQ ID NO: 137692 - protein, 11 aa, Mycobacterium tuberculosis
VLTEAAAVDRA

SEQ ID NO: 137693 - protein, 11 aa, Mycobacterium tuberculosis
LTEAAAVDRAR

SEQ ID NO: 137694 - protein, 11 aa, Mycobacterium tuberculosis
AAVDRAREHGL

SEQ ID NO: 137695 - protein, 11 aa, Mycobacterium tuberculosis
RAREHGLPFLF

SEQ ID NO: 137696 - protein, 11 aa, Mycobacterium tuberculosis
REHGLPFLFFT

SEQ ID NO: 137697 - protein, 11 aa, Mycobacterium tuberculosis
GLPFLFFTDQA

SEQ ID NO: 137698 - protein, 11 aa, Mycobacterium tuberculosis
LPFLFFTDQAT

SEQ ID NO: 137699 - protein, 11 aa, Mycobacterium tuberculosis
FLFFTDQATGR

SEQ ID NO: 137700 - protein, 11 aa, Mycobacterium tuberculosis
FTDQATGRGQL

SEQ ID NO: 137701 - protein, 11 aa, Mycobacterium tuberculosis
ATGRGQLLYSR

SEQ ID NO: 137702 - protein, 11 aa, Mycobacterium tuberculosis
QLLYSRYDGNL

SEQ ID NO: 137703 - protein, 11 aa, Mycobacterium tuberculosis
LYSRYDGNLGL

SEQ ID NO: 137704 - protein, 11 aa, Mycobacterium tuberculosis
GLITPTGDGVA

SEQ ID NO: 137705 - protein, 11 aa, Mycobacterium tuberculosis
TPTGDGVADGL

SEQ ID NO: 137706 - protein, 13 aa, Mycobacterium tuberculosis
MEPKRSRLVVCAP

SEQ ID NO: 137707 - protein, 13 aa, Mycobacterium tuberculosis
EPKRSRLVVCAPE

SEQ ID NO: 137708 - protein, 13 aa, Mycobacterium tuberculosis
PKRSRLVVCAPEP

SEQ ID NO: 137709 - protein, 13 aa, Mycobacterium tuberculosis
KRSRLVVCAPEPS

SEQ ID NO: 137710 - protein, 13 aa, Mycobacterium tuberculosis
RSRLVVCAPEPSH

SEQ ID NO: 137711 - protein, 13 aa, Mycobacterium tuberculosis
SRLVVCAPEPSHA

SEQ ID NO: 137712 - protein, 13 aa, Mycobacterium tuberculosis
RLVVCAPEPSHAR

SEQ ID NO: 137713 - protein, 13 aa, Mycobacterium tuberculosis
LVVCAPEPSHARE

SEQ ID NO: 137714 - protein, 13 aa, Mycobacterium tuberculosis
VVCAPEPSHAREF

SEQ ID NO: 137715 - protein, 13 aa, Mycobacterium tuberculosis
VCAPEPSHAREFP

SEQ ID NO: 137716 - protein, 13 aa, Mycobacterium tuberculosis
CAPEPSHAREFPD

SEQ ID NO: 137717 - protein, 13 aa, Mycobacterium tuberculosis
APEPSHAREFPDV

SEQ ID NO: 137718 - protein, 13 aa, Mycobacterium tuberculosis
PEPSHAREFPDVA

SEQ ID NO: 137719 - protein, 13 aa, Mycobacterium tuberculosis
EPSHAREFPDVAV

SEQ ID NO: 137720 - protein, 13 aa, Mycobacterium tuberculosis
PSHAREFPDVAVF

SEQ ID NO: 137721 - protein, 13 aa, Mycobacterium tuberculosis
SHAREFPDVAVFS

SEQ ID NO: 137722 - protein, 13 aa, Mycobacterium tuberculosis
HAREFPDVAVFSG

SEQ ID NO: 137723 - protein, 13 aa, Mycobacterium tuberculosis
AREFPDVAVFSGG

SEQ ID NO: 137724 - protein, 13 aa, Mycobacterium tuberculosis
REFPDVAVFSGGR

SEQ ID NO: 137725 - protein, 13 aa, Mycobacterium tuberculosis
EFPDVAVFSGGRA

SEQ ID NO: 137726 - protein, 13 aa, Mycobacterium tuberculosis
FPDVAVFSGGRAN

SEQ ID NO: 137727 - protein, 13 aa, Mycobacterium tuberculosis
PDVAVFSGGRANA

SEQ ID NO: 137728 - protein, 13 aa, Mycobacterium tuberculosis
DVAVFSGGRANAS

SEQ ID NO: 137729 - protein, 13 aa, Mycobacterium tuberculosis
VAVFSGGRANASQ

SEQ ID NO: 137730 - protein, 13 aa, Mycobacterium tuberculosis
AVFSGGRANASQA

SEQ ID NO: 137731 - protein, 13 aa, Mycobacterium tuberculosis
VFSGGRANASQAE

SEQ ID NO: 137732 - protein, 13 aa, Mycobacterium tuberculosis
FSGGRANASQAER

SEQ ID NO: 137733 - protein, 13 aa, Mycobacterium tuberculosis
SGGRANASQAERL

SEQ ID NO: 137734 - protein, 13 aa, Mycobacterium tuberculosis
GGRANASQAERLA

SEQ ID NO: 137735 - protein, 13 aa, Mycobacterium tuberculosis
GRANASQAERLAR

SEQ ID NO: 137736 - protein, 13 aa, Mycobacterium tuberculosis
RANASQAERLARA

SEQ ID NO: 137737 - protein, 13 aa, Mycobacterium tuberculosis
ANASQAERLARAV

SEQ ID NO: 137738 - protein, 13 aa, Mycobacterium tuberculosis
NASQAERLARAVG

SEQ ID NO: 137739 - protein, 13 aa, Mycobacterium tuberculosis
ASQAERLARAVGR

SEQ ID NO: 137740 - protein, 13 aa, Mycobacterium tuberculosis
SQAERLARAVGRV

SEQ ID NO: 137741 - protein, 13 aa, Mycobacterium tuberculosis
QAERLARAVGRVL

SEQ ID NO: 137742 - protein, 13 aa, Mycobacterium tuberculosis
AERLARAVGRVLA

SEQ ID NO: 137743 - protein, 13 aa, Mycobacterium tuberculosis
ERLARAVGRVLAD

SEQ ID NO: 137744 - protein, 13 aa, Mycobacterium tuberculosis
RLARAVGRVLADR

SEQ ID NO: 137745 - protein, 13 aa, Mycobacterium tuberculosis
LARAVGRVLADRG

SEQ ID NO: 137746 - protein, 13 aa, Mycobacterium tuberculosis
ARAVGRVLADRGV

SEQ ID NO: 137747 - protein, 13 aa, Mycobacterium tuberculosis
RAVGRVLADRGVT

SEQ ID NO: 137748 - protein, 13 aa, Mycobacterium tuberculosis
AVGRVLADRGVTG

SEQ ID NO: 137749 - protein, 13 aa, Mycobacterium tuberculosis
VGRVLADRGVTGG

SEQ ID NO: 137750 - protein, 13 aa, Mycobacterium tuberculosis
GRVLADRGVTGGA

SEQ ID NO: 137751 - protein, 13 aa, Mycobacterium tuberculosis
RVLADRGVTGGAR

SEQ ID NO: 137752 - protein, 13 aa, Mycobacterium tuberculosis
VLADRGVTGGARV

SEQ ID NO: 137753 - protein, 13 aa, Mycobacterium tuberculosis
LADRGVTGGARVR

SEQ ID NO: 137754 - protein, 13 aa, Mycobacterium tuberculosis
ADRGVTGGARVRL

SEQ ID NO: 137755 - protein, 13 aa, Mycobacterium tuberculosis
DRGVTGGARVRLT

SEQ ID NO: 137756 - protein, 13 aa, Mycobacterium tuberculosis
RGVTGGARVRLTM

SEQ ID NO: 137757 - protein, 13 aa, Mycobacterium tuberculosis
GVTGGARVRLTMA

SEQ ID NO: 137758 - protein, 13 aa, Mycobacterium tuberculosis
VTGGARVRLTMAN

SEQ ID NO: 137759 - protein, 13 aa, Mycobacterium tuberculosis
TGGARVRLTMANC

SEQ ID NO: 137760 - protein, 13 aa, Mycobacterium tuberculosis
GGARVRLTMANCA

SEQ ID NO: 137761 - protein, 13 aa, Mycobacterium tuberculosis
GARVRLTMANCAD

SEQ ID NO: 137762 - protein, 13 aa, Mycobacterium tuberculosis
ARVRLTMANCADG

SEQ ID NO: 137763 - protein, 13 aa, Mycobacterium tuberculosis
RVRLTMANCADGP

SEQ ID NO: 137764 - protein, 13 aa, Mycobacterium tuberculosis
VRLTMANCADGPT

SEQ ID NO: 137765 - protein, 13 aa, Mycobacterium tuberculosis
RLTMANCADGPTL

SEQ ID NO: 137766 - protein, 13 aa, Mycobacterium tuberculosis
LTMANCADGPTLV

SEQ ID NO: 137767 - protein, 13 aa, Mycobacterium tuberculosis
TMANCADGPTLVQ

SEQ ID NO: 137768 - protein, 13 aa, Mycobacterium tuberculosis
MANCADGPTLVQI

SEQ ID NO: 137769 - protein, 13 aa, Mycobacterium tuberculosis
ANCADGPTLVQIN

SEQ ID NO: 137770 - protein, 13 aa, Mycobacterium tuberculosis
NCADGPTLVQINL

SEQ ID NO: 137771 - protein, 13 aa, Mycobacterium tuberculosis
CADGPTLVQINLQ

SEQ ID NO: 137772 - protein, 13 aa, Mycobacterium tuberculosis
ADGPTLVQINLQV

SEQ ID NO: 137773 - protein, 13 aa, Mycobacterium tuberculosis
DGPTLVQINLQVG

SEQ ID NO: 137774 - protein, 13 aa, Mycobacterium tuberculosis
GPTLVQINLQVGD

SEQ ID NO: 137775 - protein, 13 aa, Mycobacterium tuberculosis
PTLVQINLQVGDT

SEQ ID NO: 137776 - protein, 13 aa, Mycobacterium tuberculosis
TLVQINLQVGDTP

SEQ ID NO: 137777 - protein, 13 aa, Mycobacterium tuberculosis
LVQINLQVGDTPL

SEQ ID NO: 137778 - protein, 13 aa, Mycobacterium tuberculosis
VQINLQVGDTPLR

SEQ ID NO: 137779 - protein, 13 aa, Mycobacterium tuberculosis
QINLQVGDTPLRA

SEQ ID NO: 137780 - protein, 13 aa, Mycobacterium tuberculosis
INLQVGDTPLRAQ

SEQ ID NO: 137781 - protein, 13 aa, Mycobacterium tuberculosis
NLQVGDTPLRAQA

SEQ ID NO: 137782 - protein, 13 aa, Mycobacterium tuberculosis
LQVGDTPLRAQAA

SEQ ID NO: 137783 - protein, 13 aa, Mycobacterium tuberculosis
QVGDTPLRAQAAT

SEQ ID NO: 137784 - protein, 13 aa, Mycobacterium tuberculosis
VGDTPLRAQAATA

SEQ ID NO: 137785 - protein, 13 aa, Mycobacterium tuberculosis
GDTPLRAQAATAG

SEQ ID NO: 137786 - protein, 13 aa, Mycobacterium tuberculosis
DTPLRAQAATAGI

SEQ ID NO: 137787 - protein, 13 aa, Mycobacterium tuberculosis
TPLRAQAATAGID

SEQ ID NO: 137788 - protein, 13 aa, Mycobacterium tuberculosis
PLRAQAATAGIDD

SEQ ID NO: 137789 - protein, 13 aa, Mycobacterium tuberculosis
LRAQAATAGIDDL

SEQ ID NO: 137790 - protein, 13 aa, Mycobacterium tuberculosis
RAQAATAGIDDLR

SEQ ID NO: 137791 - protein, 13 aa, Mycobacterium tuberculosis
AQAATAGIDDLRP

SEQ ID NO: 137792 - protein, 13 aa, Mycobacterium tuberculosis
QAATAGIDDLRPA

SEQ ID NO: 137793 - protein, 13 aa, Mycobacterium tuberculosis
AATAGIDDLRPAL

SEQ ID NO: 137794 - protein, 13 aa, Mycobacterium tuberculosis
ATAGIDDLRPALI

SEQ ID NO: 137795 - protein, 13 aa, Mycobacterium tuberculosis
TAGIDDLRPALIR

SEQ ID NO: 137796 - protein, 13 aa, Mycobacterium tuberculosis
AGIDDLRPALIRL

SEQ ID NO: 137797 - protein, 13 aa, Mycobacterium tuberculosis
GIDDLRPALIRLD

SEQ ID NO: 137798 - protein, 13 aa, Mycobacterium tuberculosis
IDDLRPALIRLDR

SEQ ID NO: 137799 - protein, 13 aa, Mycobacterium tuberculosis
DDLRPALIRLDRQ

SEQ ID NO: 137800 - protein, 13 aa, Mycobacterium tuberculosis
DLRPALIRLDRQI

SEQ ID NO: 137801 - protein, 13 aa, Mycobacterium tuberculosis
LRPALIRLDRQIV

SEQ ID NO: 137802 - protein, 13 aa, Mycobacterium tuberculosis
RPALIRLDRQIVR

SEQ ID NO: 137803 - protein, 13 aa, Mycobacterium tuberculosis
PALIRLDRQIVRA

SEQ ID NO: 137804 - protein, 13 aa, Mycobacterium tuberculosis
ALIRLDRQIVRAS

SEQ ID NO: 137805 - protein, 13 aa, Mycobacterium tuberculosis
LIRLDRQIVRASA

SEQ ID NO: 137806 - protein, 13 aa, Mycobacterium tuberculosis
IRLDRQIVRASAQ

SEQ ID NO: 137807 - protein, 13 aa, Mycobacterium tuberculosis
RLDRQIVRASAQW

SEQ ID NO: 137808 - protein, 13 aa, Mycobacterium tuberculosis
LDRQIVRASAQWC

SEQ ID NO: 137809 - protein, 13 aa, Mycobacterium tuberculosis
DRQIVRASAQWCP

SEQ ID NO: 137810 - protein, 13 aa, Mycobacterium tuberculosis
RQIVRASAQWCPR

SEQ ID NO: 137811 - protein, 13 aa, Mycobacterium tuberculosis
QIVRASAQWCPRP

SEQ ID NO: 137812 - protein, 13 aa, Mycobacterium tuberculosis
IVRASAQWCPRPW

SEQ ID NO: 137813 - protein, 13 aa, Mycobacterium tuberculosis
VRASAQWCPRPWP

SEQ ID NO: 137814 - protein, 13 aa, Mycobacterium tuberculosis
RASAQWCPRPWPD

SEQ ID NO: 137815 - protein, 13 aa, Mycobacterium tuberculosis
ASAQWCPRPWPDR

SEQ ID NO: 137816 - protein, 13 aa, Mycobacterium tuberculosis
SAQWCPRPWPDRP

SEQ ID NO: 137817 - protein, 13 aa, Mycobacterium tuberculosis
AQWCPRPWPDRPR

SEQ ID NO: 137818 - protein, 13 aa, Mycobacterium tuberculosis
QWCPRPWPDRPRR

SEQ ID NO: 137819 - protein, 13 aa, Mycobacterium tuberculosis
WCPRPWPDRPRRR

SEQ ID NO: 137820 - protein, 13 aa, Mycobacterium tuberculosis
CPRPWPDRPRRRL

SEQ ID NO: 137821 - protein, 13 aa, Mycobacterium tuberculosis
PRPWPDRPRRRLT

SEQ ID NO: 137822 - protein, 13 aa, Mycobacterium tuberculosis
RPWPDRPRRRLTT

SEQ ID NO: 137823 - protein, 13 aa, Mycobacterium tuberculosis
PWPDRPRRRLTTP

SEQ ID NO: 137824 - protein, 13 aa, Mycobacterium tuberculosis
WPDRPRRRLTTPA

SEQ ID NO: 137825 - protein, 13 aa, Mycobacterium tuberculosis
PDRPRRRLTTPAE

SEQ ID NO: 137826 - protein, 13 aa, Mycobacterium tuberculosis
DRPRRRLTTPAEA

SEQ ID NO: 137827 - protein, 13 aa, Mycobacterium tuberculosis
RPRRRLTTPAEAL

SEQ ID NO: 137828 - protein, 13 aa, Mycobacterium tuberculosis
PRRRLTTPAEALV

SEQ ID NO: 137829 - protein, 13 aa, Mycobacterium tuberculosis
RRRLTTPAEALVT

SEQ ID NO: 137830 - protein, 13 aa, Mycobacterium tuberculosis
RRLTTPAEALVTR

SEQ ID NO: 137831 - protein, 13 aa, Mycobacterium tuberculosis
RLTTPAEALVTRR

SEQ ID NO: 137832 - protein, 13 aa, Mycobacterium tuberculosis
LTTPAEALVTRRK

SEQ ID NO: 137833 - protein, 13 aa, Mycobacterium tuberculosis
TTPAEALVTRRKP

SEQ ID NO: 137834 - protein, 13 aa, Mycobacterium tuberculosis
TPAEALVTRRKPV

SEQ ID NO: 137835 - protein, 13 aa, Mycobacterium tuberculosis
PAEALVTRRKPVV

SEQ ID NO: 137836 - protein, 13 aa, Mycobacterium tuberculosis
AEALVTRRKPVVL

SEQ ID NO: 137837 - protein, 13 aa, Mycobacterium tuberculosis
EALVTRRKPVVLR

SEQ ID NO: 137838 - protein, 13 aa, Mycobacterium tuberculosis
ALVTRRKPVVLRR

SEQ ID NO: 137839 - protein, 13 aa, Mycobacterium tuberculosis
LVTRRKPVVLRRA

SEQ ID NO: 137840 - protein, 13 aa, Mycobacterium tuberculosis
VTRRKPVVLRRAT

SEQ ID NO: 137841 - protein, 13 aa, Mycobacterium tuberculosis
TRRKPVVLRRATP

SEQ ID NO: 137842 - protein, 13 aa, Mycobacterium tuberculosis
RRKPVVLRRATPL

SEQ ID NO: 137843 - protein, 13 aa, Mycobacterium tuberculosis
RKPVVLRRATPLQ

SEQ ID NO: 137844 - protein, 13 aa, Mycobacterium tuberculosis
KPVVLRRATPLQA

SEQ ID NO: 137845 - protein, 13 aa, Mycobacterium tuberculosis
PVVLRRATPLQAI

SEQ ID NO: 137846 - protein, 13 aa, Mycobacterium tuberculosis
VVLRRATPLQAIA

SEQ ID NO: 137847 - protein, 13 aa, Mycobacterium tuberculosis
VLRRATPLQAIAA

SEQ ID NO: 137848 - protein, 13 aa, Mycobacterium tuberculosis
LRRATPLQAIAAM

SEQ ID NO: 137849 - protein, 13 aa, Mycobacterium tuberculosis
RRATPLQAIAAMD

SEQ ID NO: 137850 - protein, 13 aa, Mycobacterium tuberculosis
RATPLQAIAAMDA

SEQ ID NO: 137851 - protein, 13 aa, Mycobacterium tuberculosis
ATPLQAIAAMDAM

SEQ ID NO: 137852 - protein, 13 aa, Mycobacterium tuberculosis
TPLQAIAAMDAMD

SEQ ID NO: 137853 - protein, 13 aa, Mycobacterium tuberculosis
PLQAIAAMDAMDY

SEQ ID NO: 137854 - protein, 13 aa, Mycobacterium tuberculosis
LQAIAAMDAMDYD

SEQ ID NO: 137855 - protein, 13 aa, Mycobacterium tuberculosis
QAIAAMDAMDYDV

SEQ ID NO: 137856 - protein, 13 aa, Mycobacterium tuberculosis
AIAAMDAMDYDVH

SEQ ID NO: 137857 - protein, 13 aa, Mycobacterium tuberculosis
IAAMDAMDYDVHL

SEQ ID NO: 137858 - protein, 13 aa, Mycobacterium tuberculosis
AAMDAMDYDVHLF

SEQ ID NO: 137859 - protein, 13 aa, Mycobacterium tuberculosis
AMDAMDYDVHLFT

SEQ ID NO: 137860 - protein, 13 aa, Mycobacterium tuberculosis
MDAMDYDVHLFTD

SEQ ID NO: 137861 - protein, 13 aa, Mycobacterium tuberculosis
DAMDYDVHLFTDA

SEQ ID NO: 137862 - protein, 13 aa, Mycobacterium tuberculosis
AMDYDVHLFTDAE

SEQ ID NO: 137863 - protein, 13 aa, Mycobacterium tuberculosis
MDYDVHLFTDAET

SEQ ID NO: 137864 - protein, 13 aa, Mycobacterium tuberculosis
DYDVHLFTDAETG

SEQ ID NO: 137865 - protein, 13 aa, Mycobacterium tuberculosis
YDVHLFTDAETGE

SEQ ID NO: 137866 - protein, 13 aa, Mycobacterium tuberculosis
DVHLFTDAETGED

SEQ ID NO: 137867 - protein, 13 aa, Mycobacterium tuberculosis
VHLFTDAETGEDA

SEQ ID NO: 137868 - protein, 13 aa, Mycobacterium tuberculosis
HLFTDAETGEDAV

SEQ ID NO: 137869 - protein, 13 aa, Mycobacterium tuberculosis
LFTDAETGEDAVV

SEQ ID NO: 137870 - protein, 13 aa, Mycobacterium tuberculosis
FTDAETGEDAVVY

SEQ ID NO: 137871 - protein, 13 aa, Mycobacterium tuberculosis
TDAETGEDAVVYR

SEQ ID NO: 137872 - protein, 13 aa, Mycobacterium tuberculosis
DAETGEDAVVYRA

SEQ ID NO: 137873 - protein, 13 aa, Mycobacterium tuberculosis
AETGEDAVVYRAG

SEQ ID NO: 137874 - protein, 13 aa, Mycobacterium tuberculosis
ETGEDAVVYRAGP

SEQ ID NO: 137875 - protein, 13 aa, Mycobacterium tuberculosis
TGEDAVVYRAGPS

SEQ ID NO: 137876 - protein, 13 aa, Mycobacterium tuberculosis
GEDAVVYRAGPSG

SEQ ID NO: 137877 - protein, 13 aa, Mycobacterium tuberculosis
EDAVVYRAGPSGL

SEQ ID NO: 137878 - protein, 13 aa, Mycobacterium tuberculosis
DAVVYRAGPSGLR

SEQ ID NO: 137879 - protein, 13 aa, Mycobacterium tuberculosis
AVVYRAGPSGLRL

SEQ ID NO: 137880 - protein, 13 aa, Mycobacterium tuberculosis
VVYRAGPSGLRLA

SEQ ID NO: 137881 - protein, 13 aa, Mycobacterium tuberculosis
VYRAGPSGLRLAR

SEQ ID NO: 137882 - protein, 13 aa, Mycobacterium tuberculosis
YRAGPSGLRLARQ

SEQ ID NO: 137883 - protein, 13 aa, Mycobacterium tuberculosis
RAGPSGLRLARQH

SEQ ID NO: 137884 - protein, 13 aa, Mycobacterium tuberculosis
AGPSGLRLARQHH

SEQ ID NO: 137885 - protein, 13 aa, Mycobacterium tuberculosis
GPSGLRLARQHHV

SEQ ID NO: 137886 - protein, 13 aa, Mycobacterium tuberculosis
PSGLRLARQHHVF

SEQ ID NO: 137887 - protein, 13 aa, Mycobacterium tuberculosis
SGLRLARQHHVFP

SEQ ID NO: 137888 - protein, 13 aa, Mycobacterium tuberculosis
GLRLARQHHVFPP

SEQ ID NO: 137889 - protein, 13 aa, Mycobacterium tuberculosis
LRLARQHHVFPPG

SEQ ID NO: 137890 - protein, 13 aa, Mycobacterium tuberculosis
RLARQHHVFPPGW

SEQ ID NO: 137891 - protein, 13 aa, Mycobacterium tuberculosis
LARQHHVFPPGWS

SEQ ID NO: 137892 - protein, 13 aa, Mycobacterium tuberculosis
ARQHHVFPPGWSR

SEQ ID NO: 137893 - protein, 13 aa, Mycobacterium tuberculosis
RQHHVFPPGWSRC

SEQ ID NO: 137894 - protein, 13 aa, Mycobacterium tuberculosis
QHHVFPPGWSRCR

SEQ ID NO: 137895 - protein, 13 aa, Mycobacterium tuberculosis
HHVFPPGWSRCRA

SEQ ID NO: 137896 - protein, 13 aa, Mycobacterium tuberculosis
HVFPPGWSRCRAP

SEQ ID NO: 137897 - protein, 13 aa, Mycobacterium tuberculosis
VFPPGWSRCRAPA

SEQ ID NO: 137898 - protein, 13 aa, Mycobacterium tuberculosis
FPPGWSRCRAPAG

SEQ ID NO: 137899 - protein, 13 aa, Mycobacterium tuberculosis
PPGWSRCRAPAGP

SEQ ID NO: 137900 - protein, 13 aa, Mycobacterium tuberculosis
PGWSRCRAPAGPP

SEQ ID NO: 137901 - protein, 13 aa, Mycobacterium tuberculosis
GWSRCRAPAGPPV

SEQ ID NO: 137902 - protein, 13 aa, Mycobacterium tuberculosis
WSRCRAPAGPPVP

SEQ ID NO: 137903 - protein, 13 aa, Mycobacterium tuberculosis
SRCRAPAGPPVPL

SEQ ID NO: 137904 - protein, 13 aa, Mycobacterium tuberculosis
RCRAPAGPPVPLI

SEQ ID NO: 137905 - protein, 13 aa, Mycobacterium tuberculosis
CRAPAGPPVPLIV

SEQ ID NO: 137906 - protein, 13 aa, Mycobacterium tuberculosis
RAPAGPPVPLIVN

SEQ ID NO: 137907 - protein, 13 aa, Mycobacterium tuberculosis
APAGPPVPLIVNS

SEQ ID NO: 137908 - protein, 13 aa, Mycobacterium tuberculosis
PAGPPVPLIVNSR

SEQ ID NO: 137909 - protein, 13 aa, Mycobacterium tuberculosis
AGPPVPLIVNSRP

SEQ ID NO: 137910 - protein, 13 aa, Mycobacterium tuberculosis
GPPVPLIVNSRPT

SEQ ID NO: 137911 - protein, 13 aa, Mycobacterium tuberculosis
PPVPLIVNSRPTP

SEQ ID NO: 137912 - protein, 13 aa, Mycobacterium tuberculosis
PVPLIVNSRPTPV

SEQ ID NO: 137913 - protein, 13 aa, Mycobacterium tuberculosis
VPLIVNSRPTPVL

SEQ ID NO: 137914 - protein, 13 aa, Mycobacterium tuberculosis
PLIVNSRPTPVLT

SEQ ID NO: 137915 - protein, 13 aa, Mycobacterium tuberculosis
LIVNSRPTPVLTE

SEQ ID NO: 137916 - protein, 13 aa, Mycobacterium tuberculosis
IVNSRPTPVLTEA

SEQ ID NO: 137917 - protein, 13 aa, Mycobacterium tuberculosis
VNSRPTPVLTEAA

SEQ ID NO: 137918 - protein, 13 aa, Mycobacterium tuberculosis
NSRPTPVLTEAAA

SEQ ID NO: 137919 - protein, 13 aa, Mycobacterium tuberculosis
SRPTPVLTEAAAV

SEQ ID NO: 137920 - protein, 13 aa, Mycobacterium tuberculosis
RPTPVLTEAAAVD

SEQ ID NO: 137921 - protein, 13 aa, Mycobacterium tuberculosis
PTPVLTEAAAVDR

SEQ ID NO: 137922 - protein, 13 aa, Mycobacterium tuberculosis
TPVLTEAAAVDRA

SEQ ID NO: 137923 - protein, 13 aa, Mycobacterium tuberculosis
PVLTEAAAVDRAR

SEQ ID NO: 137924 - protein, 13 aa, Mycobacterium tuberculosis
VLTEAAAVDRARE

SEQ ID NO: 137925 - protein, 13 aa, Mycobacterium tuberculosis
LTEAAAVDRAREH

SEQ ID NO: 137926 - protein, 13 aa, Mycobacterium tuberculosis
TEAAAVDRAREHG

SEQ ID NO: 137927 - protein, 13 aa, Mycobacterium tuberculosis
EAAAVDRAREHGL

SEQ ID NO: 137928 - protein, 13 aa, Mycobacterium tuberculosis
AAAVDRAREHGLP

SEQ ID NO: 137929 - protein, 13 aa, Mycobacterium tuberculosis
AAVDRAREHGLPF

SEQ ID NO: 137930 - protein, 13 aa, Mycobacterium tuberculosis
AVDRAREHGLPFL

SEQ ID NO: 137931 - protein, 13 aa, Mycobacterium tuberculosis
VDRAREHGLPFLF

SEQ ID NO: 137932 - protein, 13 aa, Mycobacterium tuberculosis
DRAREHGLPFLFF

SEQ ID NO: 137933 - protein, 13 aa, Mycobacterium tuberculosis
RAREHGLPFLFFT

SEQ ID NO: 137934 - protein, 13 aa, Mycobacterium tuberculosis
AREHGLPFLFFTD

SEQ ID NO: 137935 - protein, 13 aa, Mycobacterium tuberculosis
REHGLPFLFFTDQ

SEQ ID NO: 137936 - protein, 13 aa, Mycobacterium tuberculosis
EHGLPFLFFTDQA

SEQ ID NO: 137937 - protein, 13 aa, Mycobacterium tuberculosis
HGLPFLFFTDQAT

SEQ ID NO: 137938 - protein, 13 aa, Mycobacterium tuberculosis
GLPFLFFTDQATG

SEQ ID NO: 137939 - protein, 13 aa, Mycobacterium tuberculosis
LPFLFFTDQATGR

SEQ ID NO: 137940 - protein, 13 aa, Mycobacterium tuberculosis
PFLFFTDQATGRG

SEQ ID NO: 137941 - protein, 13 aa, Mycobacterium tuberculosis
FLFFTDQATGRGQ

SEQ ID NO: 137942 - protein, 13 aa, Mycobacterium tuberculosis
LFFTDQATGRGQL

SEQ ID NO: 137943 - protein, 13 aa, Mycobacterium tuberculosis
FFTDQATGRGQLL

SEQ ID NO: 137944 - protein, 13 aa, Mycobacterium tuberculosis
FTDQATGRGQLLY

SEQ ID NO: 137945 - protein, 13 aa, Mycobacterium tuberculosis
TDQATGRGQLLYS

SEQ ID NO: 137946 - protein, 13 aa, Mycobacterium tuberculosis
DQATGRGQLLYSR

SEQ ID NO: 137947 - protein, 13 aa, Mycobacterium tuberculosis
QATGRGQLLYSRY

SEQ ID NO: 137948 - protein, 13 aa, Mycobacterium tuberculosis
ATGRGQLLYSRYD

SEQ ID NO: 137949 - protein, 13 aa, Mycobacterium tuberculosis
TGRGQLLYSRYDG

SEQ ID NO: 137950 - protein, 13 aa, Mycobacterium tuberculosis
GRGQLLYSRYDGN

SEQ ID NO: 137951 - protein, 13 aa, Mycobacterium tuberculosis
RGQLLYSRYDGNL

SEQ ID NO: 137952 - protein, 13 aa, Mycobacterium tuberculosis
GQLLYSRYDGNLG

SEQ ID NO: 137953 - protein, 13 aa, Mycobacterium tuberculosis
QLLYSRYDGNLGL

SEQ ID NO: 137954 - protein, 13 aa, Mycobacterium tuberculosis
LLYSRYDGNLGLI

SEQ ID NO: 137955 - protein, 13 aa, Mycobacterium tuberculosis
LYSRYDGNLGLIT

SEQ ID NO: 137956 - protein, 13 aa, Mycobacterium tuberculosis
YSRYDGNLGLITP

SEQ ID NO: 137957 - protein, 13 aa, Mycobacterium tuberculosis
SRYDGNLGLITPT

SEQ ID NO: 137958 - protein, 13 aa, Mycobacterium tuberculosis
RYDGNLGLITPTG

SEQ ID NO: 137959 - protein, 13 aa, Mycobacterium tuberculosis
YDGNLGLITPTGD

SEQ ID NO: 137960 - protein, 13 aa, Mycobacterium tuberculosis
DGNLGLITPTGDG

SEQ ID NO: 137961 - protein, 13 aa, Mycobacterium tuberculosis
GNLGLITPTGDGV

SEQ ID NO: 137962 - protein, 13 aa, Mycobacterium tuberculosis
NLGLITPTGDGVA

SEQ ID NO: 137963 - protein, 13 aa, Mycobacterium tuberculosis
LGLITPTGDGVAD

SEQ ID NO: 137964 - protein, 13 aa, Mycobacterium tuberculosis
GLITPTGDGVADG

SEQ ID NO: 137965 - protein, 13 aa, Mycobacterium tuberculosis
LITPTGDGVADGL

SEQ ID NO: 137966 - protein, 13 aa, Mycobacterium tuberculosis
ITPTGDGVADGLA

SEQ ID NO: 137967 - protein, 14 aa, Mycobacterium tuberculosis
MEPKRSRLVVCAPE

SEQ ID NO: 137968 - protein, 14 aa, Mycobacterium tuberculosis
EPKRSRLVVCAPEP

SEQ ID NO: 137969 - protein, 14 aa, Mycobacterium tuberculosis
PKRSRLVVCAPEPS

SEQ ID NO: 137970 - protein, 14 aa, Mycobacterium tuberculosis
KRSRLVVCAPEPSH

SEQ ID NO: 137971 - protein, 14 aa, Mycobacterium tuberculosis
RSRLVVCAPEPSHA

SEQ ID NO: 137972 - protein, 14 aa, Mycobacterium tuberculosis
SRLVVCAPEPSHAR

SEQ ID NO: 137973 - protein, 14 aa, Mycobacterium tuberculosis
RLVVCAPEPSHARE

SEQ ID NO: 137974 - protein, 14 aa, Mycobacterium tuberculosis
LVVCAPEPSHAREF

SEQ ID NO: 137975 - protein, 14 aa, Mycobacterium tuberculosis
VVCAPEPSHAREFP

SEQ ID NO: 137976 - protein, 14 aa, Mycobacterium tuberculosis
VCAPEPSHAREFPD

SEQ ID NO: 137977 - protein, 14 aa, Mycobacterium tuberculosis
CAPEPSHAREFPDV

SEQ ID NO: 137978 - protein, 14 aa, Mycobacterium tuberculosis
APEPSHAREFPDVA

SEQ ID NO: 137979 - protein, 14 aa, Mycobacterium tuberculosis
PEPSHAREFPDVAV

SEQ ID NO: 137980 - protein, 14 aa, Mycobacterium tuberculosis
EPSHAREFPDVAVF

SEQ ID NO: 137981 - protein, 14 aa, Mycobacterium tuberculosis
PSHAREFPDVAVFS

SEQ ID NO: 137982 - protein, 14 aa, Mycobacterium tuberculosis
SHAREFPDVAVFSG

SEQ ID NO: 137983 - protein, 14 aa, Mycobacterium tuberculosis
HAREFPDVAVFSGG

SEQ ID NO: 137984 - protein, 14 aa, Mycobacterium tuberculosis
AREFPDVAVFSGGR

SEQ ID NO: 137985 - protein, 14 aa, Mycobacterium tuberculosis
REFPDVAVFSGGRA

SEQ ID NO: 137986 - protein, 14 aa, Mycobacterium tuberculosis
EFPDVAVFSGGRAN

SEQ ID NO: 137987 - protein, 14 aa, Mycobacterium tuberculosis
FPDVAVFSGGRANA

SEQ ID NO: 137988 - protein, 14 aa, Mycobacterium tuberculosis
PDVAVFSGGRANAS

SEQ ID NO: 137989 - protein, 14 aa, Mycobacterium tuberculosis
DVAVFSGGRANASQ

SEQ ID NO: 137990 - protein, 14 aa, Mycobacterium tuberculosis
VAVFSGGRANASQA

SEQ ID NO: 137991 - protein, 14 aa, Mycobacterium tuberculosis
AVFSGGRANASQAE

SEQ ID NO: 137992 - protein, 14 aa, Mycobacterium tuberculosis
VFSGGRANASQAER

SEQ ID NO: 137993 - protein, 14 aa, Mycobacterium tuberculosis
FSGGRANASQAERL

SEQ ID NO: 137994 - protein, 14 aa, Mycobacterium tuberculosis
SGGRANASQAERLA

SEQ ID NO: 137995 - protein, 14 aa, Mycobacterium tuberculosis
GGRANASQAERLAR

SEQ ID NO: 137996 - protein, 14 aa, Mycobacterium tuberculosis
GRANASQAERLARA

SEQ ID NO: 137997 - protein, 14 aa, Mycobacterium tuberculosis
RANASQAERLARAV

SEQ ID NO: 137998 - protein, 14 aa, Mycobacterium tuberculosis
ANASQAERLARAVG

SEQ ID NO: 137999 - protein, 14 aa, Mycobacterium tuberculosis
NASQAERLARAVGR

SEQ ID NO: 138000 - protein, 14 aa, Mycobacterium tuberculosis
ASQAERLARAVGRV

SEQ ID NO: 138001 - protein, 14 aa, Mycobacterium tuberculosis
SQAERLARAVGRVL

SEQ ID NO: 138002 - protein, 14 aa, Mycobacterium tuberculosis
QAERLARAVGRVLA

SEQ ID NO: 138003 - protein, 14 aa, Mycobacterium tuberculosis
AERLARAVGRVLAD

SEQ ID NO: 138004 - protein, 14 aa, Mycobacterium tuberculosis
ERLARAVGRVLADR

SEQ ID NO: 138005 - protein, 14 aa, Mycobacterium tuberculosis
RLARAVGRVLADRG

SEQ ID NO: 138006 - protein, 14 aa, Mycobacterium tuberculosis
LARAVGRVLADRGV

SEQ ID NO: 138007 - protein, 14 aa, Mycobacterium tuberculosis
ARAVGRVLADRGVT

SEQ ID NO: 138008 - protein, 14 aa, Mycobacterium tuberculosis
RAVGRVLADRGVTG

SEQ ID NO: 138009 - protein, 14 aa, Mycobacterium tuberculosis
AVGRVLADRGVTGG

SEQ ID NO: 138010 - protein, 14 aa, Mycobacterium tuberculosis
VGRVLADRGVTGGA

SEQ ID NO: 138011 - protein, 14 aa, Mycobacterium tuberculosis
GRVLADRGVTGGAR

SEQ ID NO: 138012 - protein, 14 aa, Mycobacterium tuberculosis
RVLADRGVTGGARV

SEQ ID NO: 138013 - protein, 14 aa, Mycobacterium tuberculosis
VLADRGVTGGARVR

SEQ ID NO: 138014 - protein, 14 aa, Mycobacterium tuberculosis
LADRGVTGGARVRL

SEQ ID NO: 138015 - protein, 14 aa, Mycobacterium tuberculosis
ADRGVTGGARVRLT

SEQ ID NO: 138016 - protein, 14 aa, Mycobacterium tuberculosis
DRGVTGGARVRLTM

SEQ ID NO: 138017 - protein, 14 aa, Mycobacterium tuberculosis
RGVTGGARVRLTMA

SEQ ID NO: 138018 - protein, 14 aa, Mycobacterium tuberculosis
GVTGGARVRLTMAN

SEQ ID NO: 138019 - protein, 14 aa, Mycobacterium tuberculosis
VTGGARVRLTMANC

SEQ ID NO: 138020 - protein, 14 aa, Mycobacterium tuberculosis
TGGARVRLTMANCA

SEQ ID NO: 138021 - protein, 14 aa, Mycobacterium tuberculosis
GGARVRLTMANCAD

SEQ ID NO: 138022 - protein, 14 aa, Mycobacterium tuberculosis
GARVRLTMANCADG

SEQ ID NO: 138023 - protein, 14 aa, Mycobacterium tuberculosis
ARVRLTMANCADGP

SEQ ID NO: 138024 - protein, 14 aa, Mycobacterium tuberculosis
RVRLTMANCADGPT

SEQ ID NO: 138025 - protein, 14 aa, Mycobacterium tuberculosis
VRLTMANCADGPTL

SEQ ID NO: 138026 - protein, 14 aa, Mycobacterium tuberculosis
RLTMANCADGPTLV

SEQ ID NO: 138027 - protein, 14 aa, Mycobacterium tuberculosis
LTMANCADGPTLVQ

SEQ ID NO: 138028 - protein, 14 aa, Mycobacterium tuberculosis
TMANCADGPTLVQI

SEQ ID NO: 138029 - protein, 14 aa, Mycobacterium tuberculosis
MANCADGPTLVQIN

SEQ ID NO: 138030 - protein, 14 aa, Mycobacterium tuberculosis
ANCADGPTLVQINL

SEQ ID NO: 138031 - protein, 14 aa, Mycobacterium tuberculosis
NCADGPTLVQINLQ

SEQ ID NO: 138032 - protein, 14 aa, Mycobacterium tuberculosis
CADGPTLVQINLQV

SEQ ID NO: 138033 - protein, 14 aa, Mycobacterium tuberculosis
ADGPTLVQINLQVG

SEQ ID NO: 138034 - protein, 14 aa, Mycobacterium tuberculosis
DGPTLVQINLQVGD

SEQ ID NO: 138035 - protein, 14 aa, Mycobacterium tuberculosis
GPTLVQINLQVGDT

SEQ ID NO: 138036 - protein, 14 aa, Mycobacterium tuberculosis
PTLVQINLQVGDTP

SEQ ID NO: 138037 - protein, 14 aa, Mycobacterium tuberculosis
TLVQINLQVGDTPL

SEQ ID NO: 138038 - protein, 14 aa, Mycobacterium tuberculosis
LVQINLQVGDTPLR

SEQ ID NO: 138039 - protein, 14 aa, Mycobacterium tuberculosis
VQINLQVGDTPLRA

SEQ ID NO: 138040 - protein, 14 aa, Mycobacterium tuberculosis
QINLQVGDTPLRAQ

SEQ ID NO: 138041 - protein, 14 aa, Mycobacterium tuberculosis
INLQVGDTPLRAQA

SEQ ID NO: 138042 - protein, 14 aa, Mycobacterium tuberculosis
NLQVGDTPLRAQAA

SEQ ID NO: 138043 - protein, 14 aa, Mycobacterium tuberculosis
LQVGDTPLRAQAAT

SEQ ID NO: 138044 - protein, 14 aa, Mycobacterium tuberculosis
QVGDTPLRAQAATA

SEQ ID NO: 138045 - protein, 14 aa, Mycobacterium tuberculosis
VGDTPLRAQAATAG

SEQ ID NO: 138046 - protein, 14 aa, Mycobacterium tuberculosis
GDTPLRAQAATAGI

SEQ ID NO: 138047 - protein, 14 aa, Mycobacterium tuberculosis
DTPLRAQAATAGID

SEQ ID NO: 138048 - protein, 14 aa, Mycobacterium tuberculosis
TPLRAQAATAGIDD

SEQ ID NO: 138049 - protein, 14 aa, Mycobacterium tuberculosis
PLRAQAATAGIDDL

SEQ ID NO: 138050 - protein, 14 aa, Mycobacterium tuberculosis
LRAQAATAGIDDLR

SEQ ID NO: 138051 - protein, 14 aa, Mycobacterium tuberculosis
RAQAATAGIDDLRP

SEQ ID NO: 138052 - protein, 14 aa, Mycobacterium tuberculosis
AQAATAGIDDLRPA

SEQ ID NO: 138053 - protein, 14 aa, Mycobacterium tuberculosis
QAATAGIDDLRPAL

SEQ ID NO: 138054 - protein, 14 aa, Mycobacterium tuberculosis
AATAGIDDLRPALI

SEQ ID NO: 138055 - protein, 14 aa, Mycobacterium tuberculosis
ATAGIDDLRPALIR

SEQ ID NO: 138056 - protein, 14 aa, Mycobacterium tuberculosis
TAGIDDLRPALIRL

SEQ ID NO: 138057 - protein, 14 aa, Mycobacterium tuberculosis
AGIDDLRPALIRLD

SEQ ID NO: 138058 - protein, 14 aa, Mycobacterium tuberculosis
GIDDLRPALIRLDR

SEQ ID NO: 138059 - protein, 14 aa, Mycobacterium tuberculosis
IDDLRPALIRLDRQ

SEQ ID NO: 138060 - protein, 14 aa, Mycobacterium tuberculosis
DDLRPALIRLDRQI

SEQ ID NO: 138061 - protein, 14 aa, Mycobacterium tuberculosis
DLRPALIRLDRQIV

SEQ ID NO: 138062 - protein, 14 aa, Mycobacterium tuberculosis
LRPALIRLDRQIVR

SEQ ID NO: 138063 - protein, 14 aa, Mycobacterium tuberculosis
RPALIRLDRQIVRA

SEQ ID NO: 138064 - protein, 14 aa, Mycobacterium tuberculosis
PALIRLDRQIVRAS

SEQ ID NO: 138065 - protein, 14 aa, Mycobacterium tuberculosis
ALIRLDRQIVRASA

SEQ ID NO: 138066 - protein, 14 aa, Mycobacterium tuberculosis
LIRLDRQIVRASAQ

SEQ ID NO: 138067 - protein, 14 aa, Mycobacterium tuberculosis
IRLDRQIVRASAQW

SEQ ID NO: 138068 - protein, 14 aa, Mycobacterium tuberculosis
RLDRQIVRASAQWC

SEQ ID NO: 138069 - protein, 14 aa, Mycobacterium tuberculosis
LDRQIVRASAQWCP

SEQ ID NO: 138070 - protein, 14 aa, Mycobacterium tuberculosis
DRQIVRASAQWCPR

SEQ ID NO: 138071 - protein, 14 aa, Mycobacterium tuberculosis
RQIVRASAQWCPRP

SEQ ID NO: 138072 - protein, 14 aa, Mycobacterium tuberculosis
QIVRASAQWCPRPW

SEQ ID NO: 138073 - protein, 14 aa, Mycobacterium tuberculosis
IVRASAQWCPRPWP

SEQ ID NO: 138074 - protein, 14 aa, Mycobacterium tuberculosis
VRASAQWCPRPWPD

SEQ ID NO: 138075 - protein, 14 aa, Mycobacterium tuberculosis
RASAQWCPRPWPDR

SEQ ID NO: 138076 - protein, 14 aa, Mycobacterium tuberculosis
ASAQWCPRPWPDRP

SEQ ID NO: 138077 - protein, 14 aa, Mycobacterium tuberculosis
SAQWCPRPWPDRPR

SEQ ID NO: 138078 - protein, 14 aa, Mycobacterium tuberculosis
AQWCPRPWPDRPRR

SEQ ID NO: 138079 - protein, 14 aa, Mycobacterium tuberculosis
QWCPRPWPDRPRRR

SEQ ID NO: 138080 - protein, 14 aa, Mycobacterium tuberculosis
WCPRPWPDRPRRRL

SEQ ID NO: 138081 - protein, 14 aa, Mycobacterium tuberculosis
CPRPWPDRPRRRLT

SEQ ID NO: 138082 - protein, 14 aa, Mycobacterium tuberculosis
PRPWPDRPRRRLTT

SEQ ID NO: 138083 - protein, 14 aa, Mycobacterium tuberculosis
RPWPDRPRRRLTTP

SEQ ID NO: 138084 - protein, 14 aa, Mycobacterium tuberculosis
PWPDRPRRRLTTPA

SEQ ID NO: 138085 - protein, 14 aa, Mycobacterium tuberculosis
WPDRPRRRLTTPAE

SEQ ID NO: 138086 - protein, 14 aa, Mycobacterium tuberculosis
PDRPRRRLTTPAEA

SEQ ID NO: 138087 - protein, 14 aa, Mycobacterium tuberculosis
DRPRRRLTTPAEAL

SEQ ID NO: 138088 - protein, 14 aa, Mycobacterium tuberculosis
RPRRRLTTPAEALV

SEQ ID NO: 138089 - protein, 14 aa, Mycobacterium tuberculosis
PRRRLTTPAEALVT

SEQ ID NO: 138090 - protein, 14 aa, Mycobacterium tuberculosis
RRRLTTPAEALVTR

SEQ ID NO: 138091 - protein, 14 aa, Mycobacterium tuberculosis
RRLTTPAEALVTRR

SEQ ID NO: 138092 - protein, 14 aa, Mycobacterium tuberculosis
RLTTPAEALVTRRK

SEQ ID NO: 138093 - protein, 14 aa, Mycobacterium tuberculosis
LTTPAEALVTRRKP

SEQ ID NO: 138094 - protein, 14 aa, Mycobacterium tuberculosis
TTPAEALVTRRKPV

SEQ ID NO: 138095 - protein, 14 aa, Mycobacterium tuberculosis
TPAEALVTRRKPVV

SEQ ID NO: 138096 - protein, 14 aa, Mycobacterium tuberculosis
PAEALVTRRKPVVL

SEQ ID NO: 138097 - protein, 14 aa, Mycobacterium tuberculosis
AEALVTRRKPVVLR

SEQ ID NO: 138098 - protein, 14 aa, Mycobacterium tuberculosis
EALVTRRKPVVLRR

SEQ ID NO: 138099 - protein, 14 aa, Mycobacterium tuberculosis
ALVTRRKPVVLRRA

SEQ ID NO: 138100 - protein, 14 aa, Mycobacterium tuberculosis
LVTRRKPVVLRRAT

SEQ ID NO: 138101 - protein, 14 aa, Mycobacterium tuberculosis
VTRRKPVVLRRATP

SEQ ID NO: 138102 - protein, 14 aa, Mycobacterium tuberculosis
TRRKPVVLRRATPL

SEQ ID NO: 138103 - protein, 14 aa, Mycobacterium tuberculosis
RRKPVVLRRATPLQ

SEQ ID NO: 138104 - protein, 14 aa, Mycobacterium tuberculosis
RKPVVLRRATPLQA

SEQ ID NO: 138105 - protein, 14 aa, Mycobacterium tuberculosis
KPVVLRRATPLQAI

SEQ ID NO: 138106 - protein, 14 aa, Mycobacterium tuberculosis
PVVLRRATPLQAIA

SEQ ID NO: 138107 - protein, 14 aa, Mycobacterium tuberculosis
VVLRRATPLQAIAA

SEQ ID NO: 138108 - protein, 14 aa, Mycobacterium tuberculosis
VLRRATPLQAIAAM

SEQ ID NO: 138109 - protein, 14 aa, Mycobacterium tuberculosis
LRRATPLQAIAAMD

SEQ ID NO: 138110 - protein, 14 aa, Mycobacterium tuberculosis
RRATPLQAIAAMDA

SEQ ID NO: 138111 - protein, 14 aa, Mycobacterium tuberculosis
RATPLQAIAAMDAM

SEQ ID NO: 138112 - protein, 14 aa, Mycobacterium tuberculosis
ATPLQAIAAMDAMD

SEQ ID NO: 138113 - protein, 14 aa, Mycobacterium tuberculosis
TPLQAIAAMDAMDY

SEQ ID NO: 138114 - protein, 14 aa, Mycobacterium tuberculosis
PLQAIAAMDAMDYD

SEQ ID NO: 138115 - protein, 14 aa, Mycobacterium tuberculosis
LQAIAAMDAMDYDV

SEQ ID NO: 138116 - protein, 14 aa, Mycobacterium tuberculosis
QAIAAMDAMDYDVH

SEQ ID NO: 138117 - protein, 14 aa, Mycobacterium tuberculosis
AIAAMDAMDYDVHL

SEQ ID NO: 138118 - protein, 14 aa, Mycobacterium tuberculosis
IAAMDAMDYDVHLF

SEQ ID NO: 138119 - protein, 14 aa, Mycobacterium tuberculosis
AAMDAMDYDVHLFT

SEQ ID NO: 138120 - protein, 14 aa, Mycobacterium tuberculosis
AMDAMDYDVHLFTD

SEQ ID NO: 138121 - protein, 14 aa, Mycobacterium tuberculosis
MDAMDYDVHLFTDA

SEQ ID NO: 138122 - protein, 14 aa, Mycobacterium tuberculosis
DAMDYDVHLFTDAE

SEQ ID NO: 138123 - protein, 14 aa, Mycobacterium tuberculosis
AMDYDVHLFTDAET

SEQ ID NO: 138124 - protein, 14 aa, Mycobacterium tuberculosis
MDYDVHLFTDAETG

SEQ ID NO: 138125 - protein, 14 aa, Mycobacterium tuberculosis
DYDVHLFTDAETGE

SEQ ID NO: 138126 - protein, 14 aa, Mycobacterium tuberculosis
YDVHLFTDAETGED

SEQ ID NO: 138127 - protein, 14 aa, Mycobacterium tuberculosis
DVHLFTDAETGEDA

SEQ ID NO: 138128 - protein, 14 aa, Mycobacterium tuberculosis
VHLFTDAETGEDAV

SEQ ID NO: 138129 - protein, 14 aa, Mycobacterium tuberculosis
HLFTDAETGEDAVV

SEQ ID NO: 138130 - protein, 14 aa, Mycobacterium tuberculosis
LFTDAETGEDAVVY

SEQ ID NO: 138131 - protein, 14 aa, Mycobacterium tuberculosis
FTDAETGEDAVVYR

SEQ ID NO: 138132 - protein, 14 aa, Mycobacterium tuberculosis
TDAETGEDAVVYRA

SEQ ID NO: 138133 - protein, 14 aa, Mycobacterium tuberculosis
DAETGEDAVVYRAG

SEQ ID NO: 138134 - protein, 14 aa, Mycobacterium tuberculosis
AETGEDAVVYRAGP

SEQ ID NO: 138135 - protein, 14 aa, Mycobacterium tuberculosis
ETGEDAVVYRAGPS

SEQ ID NO: 138136 - protein, 14 aa, Mycobacterium tuberculosis
TGEDAVVYRAGPSG

SEQ ID NO: 138137 - protein, 14 aa, Mycobacterium tuberculosis
GEDAVVYRAGPSGL

SEQ ID NO: 138138 - protein, 14 aa, Mycobacterium tuberculosis
EDAVVYRAGPSGLR

SEQ ID NO: 138139 - protein, 14 aa, Mycobacterium tuberculosis
DAVVYRAGPSGLRL

SEQ ID NO: 138140 - protein, 14 aa, Mycobacterium tuberculosis
AVVYRAGPSGLRLA

SEQ ID NO: 138141 - protein, 14 aa, Mycobacterium tuberculosis
VVYRAGPSGLRLAR

SEQ ID NO: 138142 - protein, 14 aa, Mycobacterium tuberculosis
VYRAGPSGLRLARQ

SEQ ID NO: 138143 - protein, 14 aa, Mycobacterium tuberculosis
YRAGPSGLRLARQH

SEQ ID NO: 138144 - protein, 14 aa, Mycobacterium tuberculosis
RAGPSGLRLARQHH

SEQ ID NO: 138145 - protein, 14 aa, Mycobacterium tuberculosis
AGPSGLRLARQHHV

SEQ ID NO: 138146 - protein, 14 aa, Mycobacterium tuberculosis
GPSGLRLARQHHVF

SEQ ID NO: 138147 - protein, 14 aa, Mycobacterium tuberculosis
PSGLRLARQHHVFP

SEQ ID NO: 138148 - protein, 14 aa, Mycobacterium tuberculosis
SGLRLARQHHVFPP

SEQ ID NO: 138149 - protein, 14 aa, Mycobacterium tuberculosis
GLRLARQHHVFPPG

SEQ ID NO: 138150 - protein, 14 aa, Mycobacterium tuberculosis
LRLARQHHVFPPGW

SEQ ID NO: 138151 - protein, 14 aa, Mycobacterium tuberculosis
RLARQHHVFPPGWS

SEQ ID NO: 138152 - protein, 14 aa, Mycobacterium tuberculosis
LARQHHVFPPGWSR

SEQ ID NO: 138153 - protein, 14 aa, Mycobacterium tuberculosis
ARQHHVFPPGWSRC

SEQ ID NO: 138154 - protein, 14 aa, Mycobacterium tuberculosis
RQHHVFPPGWSRCR

SEQ ID NO: 138155 - protein, 14 aa, Mycobacterium tuberculosis
QHHVFPPGWSRCRA

SEQ ID NO: 138156 - protein, 14 aa, Mycobacterium tuberculosis
HHVFPPGWSRCRAP

SEQ ID NO: 138157 - protein, 14 aa, Mycobacterium tuberculosis
HVFPPGWSRCRAPA

SEQ ID NO: 138158 - protein, 14 aa, Mycobacterium tuberculosis
VFPPGWSRCRAPAG

SEQ ID NO: 138159 - protein, 14 aa, Mycobacterium tuberculosis
FPPGWSRCRAPAGP

SEQ ID NO: 138160 - protein, 14 aa, Mycobacterium tuberculosis
PPGWSRCRAPAGPP

SEQ ID NO: 138161 - protein, 14 aa, Mycobacterium tuberculosis
PGWSRCRAPAGPPV

SEQ ID NO: 138162 - protein, 14 aa, Mycobacterium tuberculosis
GWSRCRAPAGPPVP

SEQ ID NO: 138163 - protein, 14 aa, Mycobacterium tuberculosis
WSRCRAPAGPPVPL

SEQ ID NO: 138164 - protein, 14 aa, Mycobacterium tuberculosis
SRCRAPAGPPVPLI

SEQ ID NO: 138165 - protein, 14 aa, Mycobacterium tuberculosis
RCRAPAGPPVPLIV

SEQ ID NO: 138166 - protein, 14 aa, Mycobacterium tuberculosis
CRAPAGPPVPLIVN

SEQ ID NO: 138167 - protein, 14 aa, Mycobacterium tuberculosis
RAPAGPPVPLIVNS

SEQ ID NO: 138168 - protein, 14 aa, Mycobacterium tuberculosis
APAGPPVPLIVNSR

SEQ ID NO: 138169 - protein, 14 aa, Mycobacterium tuberculosis
PAGPPVPLIVNSRP

SEQ ID NO: 138170 - protein, 14 aa, Mycobacterium tuberculosis
AGPPVPLIVNSRPT

SEQ ID NO: 138171 - protein, 14 aa, Mycobacterium tuberculosis
GPPVPLIVNSRPTP

SEQ ID NO: 138172 - protein, 14 aa, Mycobacterium tuberculosis
PPVPLIVNSRPTPV

SEQ ID NO: 138173 - protein, 14 aa, Mycobacterium tuberculosis
PVPLIVNSRPTPVL

SEQ ID NO: 138174 - protein, 14 aa, Mycobacterium tuberculosis
VPLIVNSRPTPVLT

SEQ ID NO: 138175 - protein, 14 aa, Mycobacterium tuberculosis
PLIVNSRPTPVLTE

SEQ ID NO: 138176 - protein, 14 aa, Mycobacterium tuberculosis
LIVNSRPTPVLTEA

SEQ ID NO: 138177 - protein, 14 aa, Mycobacterium tuberculosis
IVNSRPTPVLTEAA

SEQ ID NO: 138178 - protein, 14 aa, Mycobacterium tuberculosis
VNSRPTPVLTEAAA

SEQ ID NO: 138179 - protein, 14 aa, Mycobacterium tuberculosis
NSRPTPVLTEAAAV

SEQ ID NO: 138180 - protein, 14 aa, Mycobacterium tuberculosis
SRPTPVLTEAAAVD

SEQ ID NO: 138181 - protein, 14 aa, Mycobacterium tuberculosis
RPTPVLTEAAAVDR

SEQ ID NO: 138182 - protein, 14 aa, Mycobacterium tuberculosis
PTPVLTEAAAVDRA

SEQ ID NO: 138183 - protein, 14 aa, Mycobacterium tuberculosis
TPVLTEAAAVDRAR

SEQ ID NO: 138184 - protein, 14 aa, Mycobacterium tuberculosis
PVLTEAAAVDRARE

SEQ ID NO: 138185 - protein, 14 aa, Mycobacterium tuberculosis
VLTEAAAVDRAREH

SEQ ID NO: 138186 - protein, 14 aa, Mycobacterium tuberculosis
LTEAAAVDRAREHG

SEQ ID NO: 138187 - protein, 14 aa, Mycobacterium tuberculosis
TEAAAVDRAREHGL

SEQ ID NO: 138188 - protein, 14 aa, Mycobacterium tuberculosis
EAAAVDRAREHGLP

SEQ ID NO: 138189 - protein, 14 aa, Mycobacterium tuberculosis
AAAVDRAREHGLPF

SEQ ID NO: 138190 - protein, 14 aa, Mycobacterium tuberculosis
AAVDRAREHGLPFL

SEQ ID NO: 138191 - protein, 14 aa, Mycobacterium tuberculosis
AVDRAREHGLPFLF

SEQ ID NO: 138192 - protein, 14 aa, Mycobacterium tuberculosis
VDRAREHGLPFLFF

SEQ ID NO: 138193 - protein, 14 aa, Mycobacterium tuberculosis
DRAREHGLPFLFFT

SEQ ID NO: 138194 - protein, 14 aa, Mycobacterium tuberculosis
RAREHGLPFLFFTD

SEQ ID NO: 138195 - protein, 14 aa, Mycobacterium tuberculosis
AREHGLPFLFFTDQ

SEQ ID NO: 138196 - protein, 14 aa, Mycobacterium tuberculosis
REHGLPFLFFTDQA

SEQ ID NO: 138197 - protein, 14 aa, Mycobacterium tuberculosis
EHGLPFLFFTDQAT

SEQ ID NO: 138198 - protein, 14 aa, Mycobacterium tuberculosis
HGLPFLFFTDQATG

SEQ ID NO: 138199 - protein, 14 aa, Mycobacterium tuberculosis
GLPFLFFTDQATGR

SEQ ID NO: 138200 - protein, 14 aa, Mycobacterium tuberculosis
LPFLFFTDQATGRG

SEQ ID NO: 138201 - protein, 14 aa, Mycobacterium tuberculosis
PFLFFTDQATGRGQ

SEQ ID NO: 138202 - protein, 14 aa, Mycobacterium tuberculosis
FLFFTDQATGRGQL

SEQ ID NO: 138203 - protein, 14 aa, Mycobacterium tuberculosis
LFFTDQATGRGQLL

SEQ ID NO: 138204 - protein, 14 aa, Mycobacterium tuberculosis
FFTDQATGRGQLLY

SEQ ID NO: 138205 - protein, 14 aa, Mycobacterium tuberculosis
FTDQATGRGQLLYS

SEQ ID NO: 138206 - protein, 14 aa, Mycobacterium tuberculosis
TDQATGRGQLLYSR

SEQ ID NO: 138207 - protein, 14 aa, Mycobacterium tuberculosis
DQATGRGQLLYSRY

SEQ ID NO: 138208 - protein, 14 aa, Mycobacterium tuberculosis
QATGRGQLLYSRYD

SEQ ID NO: 138209 - protein, 14 aa, Mycobacterium tuberculosis
ATGRGQLLYSRYDG

SEQ ID NO: 138210 - protein, 14 aa, Mycobacterium tuberculosis
TGRGQLLYSRYDGN

SEQ ID NO: 138211 - protein, 14 aa, Mycobacterium tuberculosis
GRGQLLYSRYDGNL

SEQ ID NO: 138212 - protein, 14 aa, Mycobacterium tuberculosis
RGQLLYSRYDGNLG

SEQ ID NO: 138213 - protein, 14 aa, Mycobacterium tuberculosis
GQLLYSRYDGNLGL

SEQ ID NO: 138214 - protein, 14 aa, Mycobacterium tuberculosis
QLLYSRYDGNLGLI

SEQ ID NO: 138215 - protein, 14 aa, Mycobacterium tuberculosis
LLYSRYDGNLGLIT

SEQ ID NO: 138216 - protein, 14 aa, Mycobacterium tuberculosis
LYSRYDGNLGLITP

SEQ ID NO: 138217 - protein, 14 aa, Mycobacterium tuberculosis
YSRYDGNLGLITPT

SEQ ID NO: 138218 - protein, 14 aa, Mycobacterium tuberculosis
SRYDGNLGLITPTG

SEQ ID NO: 138219 - protein, 14 aa, Mycobacterium tuberculosis
RYDGNLGLITPTGD

SEQ ID NO: 138220 - protein, 14 aa, Mycobacterium tuberculosis
YDGNLGLITPTGDG

SEQ ID NO: 138221 - protein, 14 aa, Mycobacterium tuberculosis
DGNLGLITPTGDGV

SEQ ID NO: 138222 - protein, 14 aa, Mycobacterium tuberculosis
GNLGLITPTGDGVA

SEQ ID NO: 138223 - protein, 14 aa, Mycobacterium tuberculosis
NLGLITPTGDGVAD

SEQ ID NO: 138224 - protein, 14 aa, Mycobacterium tuberculosis
LGLITPTGDGVADG

SEQ ID NO: 138225 - protein, 14 aa, Mycobacterium tuberculosis
GLITPTGDGVADGL

SEQ ID NO: 138226 - protein, 14 aa, Mycobacterium tuberculosis
LITPTGDGVADGLA

SEQ ID NO: 138227 - protein, 15 aa, Mycobacterium tuberculosis
MEPKRSRLVVCAPEP

SEQ ID NO: 138228 - protein, 15 aa, Mycobacterium tuberculosis
EPKRSRLVVCAPEPS

SEQ ID NO: 138229 - protein, 15 aa, Mycobacterium tuberculosis
PKRSRLVVCAPEPSH

SEQ ID NO: 138230 - protein, 15 aa, Mycobacterium tuberculosis
KRSRLVVCAPEPSHA

SEQ ID NO: 138231 - protein, 15 aa, Mycobacterium tuberculosis
RSRLVVCAPEPSHAR

SEQ ID NO: 138232 - protein, 15 aa, Mycobacterium tuberculosis
SRLVVCAPEPSHARE

SEQ ID NO: 138233 - protein, 15 aa, Mycobacterium tuberculosis
RLVVCAPEPSHAREF

SEQ ID NO: 138234 - protein, 15 aa, Mycobacterium tuberculosis
LVVCAPEPSHAREFP

SEQ ID NO: 138235 - protein, 15 aa, Mycobacterium tuberculosis
VVCAPEPSHAREFPD

SEQ ID NO: 138236 - protein, 15 aa, Mycobacterium tuberculosis
VCAPEPSHAREFPDV

SEQ ID NO: 138237 - protein, 15 aa, Mycobacterium tuberculosis
CAPEPSHAREFPDVA

SEQ ID NO: 138238 - protein, 15 aa, Mycobacterium tuberculosis
APEPSHAREFPDVAV

SEQ ID NO: 138239 - protein, 15 aa, Mycobacterium tuberculosis
PEPSHAREFPDVAVF

SEQ ID NO: 138240 - protein, 15 aa, Mycobacterium tuberculosis
EPSHAREFPDVAVFS

SEQ ID NO: 138241 - protein, 15 aa, Mycobacterium tuberculosis
PSHAREFPDVAVFSG

SEQ ID NO: 138242 - protein, 15 aa, Mycobacterium tuberculosis
SHAREFPDVAVFSGG

SEQ ID NO: 138243 - protein, 15 aa, Mycobacterium tuberculosis
HAREFPDVAVFSGGR

SEQ ID NO: 138244 - protein, 15 aa, Mycobacterium tuberculosis
AREFPDVAVFSGGRA

SEQ ID NO: 138245 - protein, 15 aa, Mycobacterium tuberculosis
REFPDVAVFSGGRAN

SEQ ID NO: 138246 - protein, 15 aa, Mycobacterium tuberculosis
EFPDVAVFSGGRANA

SEQ ID NO: 138247 - protein, 15 aa, Mycobacterium tuberculosis
FPDVAVFSGGRANAS

SEQ ID NO: 138248 - protein, 15 aa, Mycobacterium tuberculosis
PDVAVFSGGRANASQ

SEQ ID NO: 138249 - protein, 15 aa, Mycobacterium tuberculosis
DVAVFSGGRANASQA

SEQ ID NO: 138250 - protein, 15 aa, Mycobacterium tuberculosis
VAVFSGGRANASQAE

SEQ ID NO: 138251 - protein, 15 aa, Mycobacterium tuberculosis
AVFSGGRANASQAER

SEQ ID NO: 138252 - protein, 15 aa, Mycobacterium tuberculosis
VFSGGRANASQAERL

SEQ ID NO: 138253 - protein, 15 aa, Mycobacterium tuberculosis
FSGGRANASQAERLA

SEQ ID NO: 138254 - protein, 15 aa, Mycobacterium tuberculosis
SGGRANASQAERLAR

SEQ ID NO: 138255 - protein, 15 aa, Mycobacterium tuberculosis
GGRANASQAERLARA

SEQ ID NO: 138256 - protein, 15 aa, Mycobacterium tuberculosis
GRANASQAERLARAV

SEQ ID NO: 138257 - protein, 15 aa, Mycobacterium tuberculosis
RANASQAERLARAVG

SEQ ID NO: 138258 - protein, 15 aa, Mycobacterium tuberculosis
ANASQAERLARAVGR

SEQ ID NO: 138259 - protein, 15 aa, Mycobacterium tuberculosis
NASQAERLARAVGRV

SEQ ID NO: 138260 - protein, 15 aa, Mycobacterium tuberculosis
ASQAERLARAVGRVL

SEQ ID NO: 138261 - protein, 15 aa, Mycobacterium tuberculosis
SQAERLARAVGRVLA

SEQ ID NO: 138262 - protein, 15 aa, Mycobacterium tuberculosis
QAERLARAVGRVLAD

SEQ ID NO: 138263 - protein, 15 aa, Mycobacterium tuberculosis
AERLARAVGRVLADR

SEQ ID NO: 138264 - protein, 15 aa, Mycobacterium tuberculosis
ERLARAVGRVLADRG

SEQ ID NO: 138265 - protein, 15 aa, Mycobacterium tuberculosis
RLARAVGRVLADRGV

SEQ ID NO: 138266 - protein, 15 aa, Mycobacterium tuberculosis
LARAVGRVLADRGVT

SEQ ID NO: 138267 - protein, 15 aa, Mycobacterium tuberculosis
ARAVGRVLADRGVTG

SEQ ID NO: 138268 - protein, 15 aa, Mycobacterium tuberculosis
RAVGRVLADRGVTGG

SEQ ID NO: 138269 - protein, 15 aa, Mycobacterium tuberculosis
AVGRVLADRGVTGGA

SEQ ID NO: 138270 - protein, 15 aa, Mycobacterium tuberculosis
VGRVLADRGVTGGAR

SEQ ID NO: 138271 - protein, 15 aa, Mycobacterium tuberculosis
GRVLADRGVTGGARV

SEQ ID NO: 138272 - protein, 15 aa, Mycobacterium tuberculosis
RVLADRGVTGGARVR

SEQ ID NO: 138273 - protein, 15 aa, Mycobacterium tuberculosis
VLADRGVTGGARVRL

SEQ ID NO: 138274 - protein, 15 aa, Mycobacterium tuberculosis
LADRGVTGGARVRLT

SEQ ID NO: 138275 - protein, 15 aa, Mycobacterium tuberculosis
ADRGVTGGARVRLTM

SEQ ID NO: 138276 - protein, 15 aa, Mycobacterium tuberculosis
DRGVTGGARVRLTMA

SEQ ID NO: 138277 - protein, 15 aa, Mycobacterium tuberculosis
RGVTGGARVRLTMAN

SEQ ID NO: 138278 - protein, 15 aa, Mycobacterium tuberculosis
GVTGGARVRLTMANC

SEQ ID NO: 138279 - protein, 15 aa, Mycobacterium tuberculosis
VTGGARVRLTMANCA

SEQ ID NO: 138280 - protein, 15 aa, Mycobacterium tuberculosis
TGGARVRLTMANCAD

SEQ ID NO: 138281 - protein, 15 aa, Mycobacterium tuberculosis
GGARVRLTMANCADG

SEQ ID NO: 138282 - protein, 15 aa, Mycobacterium tuberculosis
GARVRLTMANCADGP

SEQ ID NO: 138283 - protein, 15 aa, Mycobacterium tuberculosis
ARVRLTMANCADGPT

SEQ ID NO: 138284 - protein, 15 aa, Mycobacterium tuberculosis
RVRLTMANCADGPTL

SEQ ID NO: 138285 - protein, 15 aa, Mycobacterium tuberculosis
VRLTMANCADGPTLV

SEQ ID NO: 138286 - protein, 15 aa, Mycobacterium tuberculosis
RLTMANCADGPTLVQ

SEQ ID NO: 138287 - protein, 15 aa, Mycobacterium tuberculosis
LTMANCADGPTLVQI

SEQ ID NO: 138288 - protein, 15 aa, Mycobacterium tuberculosis
TMANCADGPTLVQIN

SEQ ID NO: 138289 - protein, 15 aa, Mycobacterium tuberculosis
MANCADGPTLVQINL

SEQ ID NO: 138290 - protein, 15 aa, Mycobacterium tuberculosis
ANCADGPTLVQINLQ

SEQ ID NO: 138291 - protein, 15 aa, Mycobacterium tuberculosis
NCADGPTLVQINLQV

SEQ ID NO: 138292 - protein, 15 aa, Mycobacterium tuberculosis
CADGPTLVQINLQVG

SEQ ID NO: 138293 - protein, 15 aa, Mycobacterium tuberculosis
ADGPTLVQINLQVGD

SEQ ID NO: 138294 - protein, 15 aa, Mycobacterium tuberculosis
DGPTLVQINLQVGDT

SEQ ID NO: 138295 - protein, 15 aa, Mycobacterium tuberculosis
GPTLVQINLQVGDTP

SEQ ID NO: 138296 - protein, 15 aa, Mycobacterium tuberculosis
PTLVQINLQVGDTPL

SEQ ID NO: 138297 - protein, 15 aa, Mycobacterium tuberculosis
TLVQINLQVGDTPLR

SEQ ID NO: 138298 - protein, 15 aa, Mycobacterium tuberculosis
LVQINLQVGDTPLRA

SEQ ID NO: 138299 - protein, 15 aa, Mycobacterium tuberculosis
VQINLQVGDTPLRAQ

SEQ ID NO: 138300 - protein, 15 aa, Mycobacterium tuberculosis
QINLQVGDTPLRAQA

SEQ ID NO: 138301 - protein, 15 aa, Mycobacterium tuberculosis
INLQVGDTPLRAQAA

SEQ ID NO: 138302 - protein, 15 aa, Mycobacterium tuberculosis
NLQVGDTPLRAQAAT

SEQ ID NO: 138303 - protein, 15 aa, Mycobacterium tuberculosis
LQVGDTPLRAQAATA

SEQ ID NO: 138304 - protein, 15 aa, Mycobacterium tuberculosis
QVGDTPLRAQAATAG

SEQ ID NO: 138305 - protein, 15 aa, Mycobacterium tuberculosis
VGDTPLRAQAATAGI

SEQ ID NO: 138306 - protein, 15 aa, Mycobacterium tuberculosis
GDTPLRAQAATAGID

SEQ ID NO: 138307 - protein, 15 aa, Mycobacterium tuberculosis
DTPLRAQAATAGIDD

SEQ ID NO: 138308 - protein, 15 aa, Mycobacterium tuberculosis
TPLRAQAATAGIDDL

SEQ ID NO: 138309 - protein, 15 aa, Mycobacterium tuberculosis
PLRAQAATAGIDDLR

SEQ ID NO: 138310 - protein, 15 aa, Mycobacterium tuberculosis
LRAQAATAGIDDLRP

SEQ ID NO: 138311 - protein, 15 aa, Mycobacterium tuberculosis
RAQAATAGIDDLRPA

SEQ ID NO: 138312 - protein, 15 aa, Mycobacterium tuberculosis
AQAATAGIDDLRPAL

SEQ ID NO: 138313 - protein, 15 aa, Mycobacterium tuberculosis
QAATAGIDDLRPALI

SEQ ID NO: 138314 - protein, 15 aa, Mycobacterium tuberculosis
AATAGIDDLRPALIR

SEQ ID NO: 138315 - protein, 15 aa, Mycobacterium tuberculosis
ATAGIDDLRPALIRL

SEQ ID NO: 138316 - protein, 15 aa, Mycobacterium tuberculosis
TAGIDDLRPALIRLD

SEQ ID NO: 138317 - protein, 15 aa, Mycobacterium tuberculosis
AGIDDLRPALIRLDR

SEQ ID NO: 138318 - protein, 15 aa, Mycobacterium tuberculosis
GIDDLRPALIRLDRQ

SEQ ID NO: 138319 - protein, 15 aa, Mycobacterium tuberculosis
IDDLRPALIRLDRQI

SEQ ID NO: 138320 - protein, 15 aa, Mycobacterium tuberculosis
DDLRPALIRLDRQIV

SEQ ID NO: 138321 - protein, 15 aa, Mycobacterium tuberculosis
DLRPALIRLDRQIVR

SEQ ID NO: 138322 - protein, 15 aa, Mycobacterium tuberculosis
LRPALIRLDRQIVRA

SEQ ID NO: 138323 - protein, 15 aa, Mycobacterium tuberculosis
RPALIRLDRQIVRAS

SEQ ID NO: 138324 - protein, 15 aa, Mycobacterium tuberculosis
PALIRLDRQIVRASA

SEQ ID NO: 138325 - protein, 15 aa, Mycobacterium tuberculosis
ALIRLDRQIVRASAQ

SEQ ID NO: 138326 - protein, 15 aa, Mycobacterium tuberculosis
LIRLDRQIVRASAQW

SEQ ID NO: 138327 - protein, 15 aa, Mycobacterium tuberculosis
IRLDRQIVRASAQWC

SEQ ID NO: 138328 - protein, 15 aa, Mycobacterium tuberculosis
RLDRQIVRASAQWCP

SEQ ID NO: 138329 - protein, 15 aa, Mycobacterium tuberculosis
LDRQIVRASAQWCPR

SEQ ID NO: 138330 - protein, 15 aa, Mycobacterium tuberculosis
DRQIVRASAQWCPRP

SEQ ID NO: 138331 - protein, 15 aa, Mycobacterium tuberculosis
RQIVRASAQWCPRPW

SEQ ID NO: 138332 - protein, 15 aa, Mycobacterium tuberculosis
QIVRASAQWCPRPWP

SEQ ID NO: 138333 - protein, 15 aa, Mycobacterium tuberculosis
IVRASAQWCPRPWPD

SEQ ID NO: 138334 - protein, 15 aa, Mycobacterium tuberculosis
VRASAQWCPRPWPDR

SEQ ID NO: 138335 - protein, 15 aa, Mycobacterium tuberculosis
RASAQWCPRPWPDRP

SEQ ID NO: 138336 - protein, 15 aa, Mycobacterium tuberculosis
ASAQWCPRPWPDRPR

SEQ ID NO: 138337 - protein, 15 aa, Mycobacterium tuberculosis
SAQWCPRPWPDRPRR

SEQ ID NO: 138338 - protein, 15 aa, Mycobacterium tuberculosis
AQWCPRPWPDRPRRR

SEQ ID NO: 138339 - protein, 15 aa, Mycobacterium tuberculosis
QWCPRPWPDRPRRRL

SEQ ID NO: 138340 - protein, 15 aa, Mycobacterium tuberculosis
WCPRPWPDRPRRRLT

SEQ ID NO: 138341 - protein, 15 aa, Mycobacterium tuberculosis
CPRPWPDRPRRRLTT

SEQ ID NO: 138342 - protein, 15 aa, Mycobacterium tuberculosis
PRPWPDRPRRRLTTP

SEQ ID NO: 138343 - protein, 15 aa, Mycobacterium tuberculosis
RPWPDRPRRRLTTPA

SEQ ID NO: 138344 - protein, 15 aa, Mycobacterium tuberculosis
PWPDRPRRRLTTPAE

SEQ ID NO: 138345 - protein, 15 aa, Mycobacterium tuberculosis
WPDRPRRRLTTPAEA

SEQ ID NO: 138346 - protein, 15 aa, Mycobacterium tuberculosis
PDRPRRRLTTPAEAL

SEQ ID NO: 138347 - protein, 15 aa, Mycobacterium tuberculosis
DRPRRRLTTPAEALV

SEQ ID NO: 138348 - protein, 15 aa, Mycobacterium tuberculosis
RPRRRLTTPAEALVT

SEQ ID NO: 138349 - protein, 15 aa, Mycobacterium tuberculosis
PRRRLTTPAEALVTR

SEQ ID NO: 138350 - protein, 15 aa, Mycobacterium tuberculosis
RRRLTTPAEALVTRR

SEQ ID NO: 138351 - protein, 15 aa, Mycobacterium tuberculosis
RRLTTPAEALVTRRK

SEQ ID NO: 138352 - protein, 15 aa, Mycobacterium tuberculosis
RLTTPAEALVTRRKP

SEQ ID NO: 138353 - protein, 15 aa, Mycobacterium tuberculosis
LTTPAEALVTRRKPV

SEQ ID NO: 138354 - protein, 15 aa, Mycobacterium tuberculosis
TTPAEALVTRRKPVV

SEQ ID NO: 138355 - protein, 15 aa, Mycobacterium tuberculosis
TPAEALVTRRKPVVL

SEQ ID NO: 138356 - protein, 15 aa, Mycobacterium tuberculosis
PAEALVTRRKPVVLR

SEQ ID NO: 138357 - protein, 15 aa, Mycobacterium tuberculosis
AEALVTRRKPVVLRR

SEQ ID NO: 138358 - protein, 15 aa, Mycobacterium tuberculosis
EALVTRRKPVVLRRA

SEQ ID NO: 138359 - protein, 15 aa, Mycobacterium tuberculosis
ALVTRRKPVVLRRAT

SEQ ID NO: 138360 - protein, 15 aa, Mycobacterium tuberculosis
LVTRRKPVVLRRATP

SEQ ID NO: 138361 - protein, 15 aa, Mycobacterium tuberculosis
VTRRKPVVLRRATPL

SEQ ID NO: 138362 - protein, 15 aa, Mycobacterium tuberculosis
TRRKPVVLRRATPLQ

SEQ ID NO: 138363 - protein, 15 aa, Mycobacterium tuberculosis
RRKPVVLRRATPLQA

SEQ ID NO: 138364 - protein, 15 aa, Mycobacterium tuberculosis
RKPVVLRRATPLQAI

SEQ ID NO: 138365 - protein, 15 aa, Mycobacterium tuberculosis
KPVVLRRATPLQAIA

SEQ ID NO: 138366 - protein, 15 aa, Mycobacterium tuberculosis
PVVLRRATPLQAIAA

SEQ ID NO: 138367 - protein, 15 aa, Mycobacterium tuberculosis
VVLRRATPLQAIAAM

SEQ ID NO: 138368 - protein, 15 aa, Mycobacterium tuberculosis
VLRRATPLQAIAAMD

SEQ ID NO: 138369 - protein, 15 aa, Mycobacterium tuberculosis
LRRATPLQAIAAMDA

SEQ ID NO: 138370 - protein, 15 aa, Mycobacterium tuberculosis
RRATPLQAIAAMDAM

SEQ ID NO: 138371 - protein, 15 aa, Mycobacterium tuberculosis
RATPLQAIAAMDAMD

SEQ ID NO: 138372 - protein, 15 aa, Mycobacterium tuberculosis
ATPLQAIAAMDAMDY

SEQ ID NO: 138373 - protein, 15 aa, Mycobacterium tuberculosis
TPLQAIAAMDAMDYD

SEQ ID NO: 138374 - protein, 15 aa, Mycobacterium tuberculosis
PLQAIAAMDAMDYDV

SEQ ID NO: 138375 - protein, 15 aa, Mycobacterium tuberculosis
LQAIAAMDAMDYDVH

SEQ ID NO: 138376 - protein, 15 aa, Mycobacterium tuberculosis
QAIAAMDAMDYDVHL

SEQ ID NO: 138377 - protein, 15 aa, Mycobacterium tuberculosis
AIAAMDAMDYDVHLF

SEQ ID NO: 138378 - protein, 15 aa, Mycobacterium tuberculosis
IAAMDAMDYDVHLFT

SEQ ID NO: 138379 - protein, 15 aa, Mycobacterium tuberculosis
AAMDAMDYDVHLFTD

SEQ ID NO: 138380 - protein, 15 aa, Mycobacterium tuberculosis
AMDAMDYDVHLFTDA

SEQ ID NO: 138381 - protein, 15 aa, Mycobacterium tuberculosis
MDAMDYDVHLFTDAE

SEQ ID NO: 138382 - protein, 15 aa, Mycobacterium tuberculosis
DAMDYDVHLFTDAET

SEQ ID NO: 138383 - protein, 15 aa, Mycobacterium tuberculosis
AMDYDVHLFTDAETG

SEQ ID NO: 138384 - protein, 15 aa, Mycobacterium tuberculosis
MDYDVHLFTDAETGE

SEQ ID NO: 138385 - protein, 15 aa, Mycobacterium tuberculosis
DYDVHLFTDAETGED

SEQ ID NO: 138386 - protein, 15 aa, Mycobacterium tuberculosis
YDVHLFTDAETGEDA

SEQ ID NO: 138387 - protein, 15 aa, Mycobacterium tuberculosis
DVHLFTDAETGEDAV

SEQ ID NO: 138388 - protein, 15 aa, Mycobacterium tuberculosis
VHLFTDAETGEDAVV

SEQ ID NO: 138389 - protein, 15 aa, Mycobacterium tuberculosis
HLFTDAETGEDAVVY

SEQ ID NO: 138390 - protein, 15 aa, Mycobacterium tuberculosis
LFTDAETGEDAVVYR

SEQ ID NO: 138391 - protein, 15 aa, Mycobacterium tuberculosis
FTDAETGEDAVVYRA

SEQ ID NO: 138392 - protein, 15 aa, Mycobacterium tuberculosis
TDAETGEDAVVYRAG

SEQ ID NO: 138393 - protein, 15 aa, Mycobacterium tuberculosis
DAETGEDAVVYRAGP

SEQ ID NO: 138394 - protein, 15 aa, Mycobacterium tuberculosis
AETGEDAVVYRAGPS

SEQ ID NO: 138395 - protein, 15 aa, Mycobacterium tuberculosis
ETGEDAVVYRAGPSG

SEQ ID NO: 138396 - protein, 15 aa, Mycobacterium tuberculosis
TGEDAVVYRAGPSGL

SEQ ID NO: 138397 - protein, 15 aa, Mycobacterium tuberculosis
GEDAVVYRAGPSGLR

SEQ ID NO: 138398 - protein, 15 aa, Mycobacterium tuberculosis
EDAVVYRAGPSGLRL

SEQ ID NO: 138399 - protein, 15 aa, Mycobacterium tuberculosis
DAVVYRAGPSGLRLA

SEQ ID NO: 138400 - protein, 15 aa, Mycobacterium tuberculosis
AVVYRAGPSGLRLAR

SEQ ID NO: 138401 - protein, 15 aa, Mycobacterium tuberculosis
VVYRAGPSGLRLARQ

SEQ ID NO: 138402 - protein, 15 aa, Mycobacterium tuberculosis
VYRAGPSGLRLARQH

SEQ ID NO: 138403 - protein, 15 aa, Mycobacterium tuberculosis
YRAGPSGLRLARQHH

SEQ ID NO: 138404 - protein, 15 aa, Mycobacterium tuberculosis
RAGPSGLRLARQHHV

SEQ ID NO: 138405 - protein, 15 aa, Mycobacterium tuberculosis
AGPSGLRLARQHHVF

SEQ ID NO: 138406 - protein, 15 aa, Mycobacterium tuberculosis
GPSGLRLARQHHVFP

SEQ ID NO: 138407 - protein, 15 aa, Mycobacterium tuberculosis
PSGLRLARQHHVFPP

SEQ ID NO: 138408 - protein, 15 aa, Mycobacterium tuberculosis
SGLRLARQHHVFPPG

SEQ ID NO: 138409 - protein, 15 aa, Mycobacterium tuberculosis
GLRLARQHHVFPPGW

SEQ ID NO: 138410 - protein, 15 aa, Mycobacterium tuberculosis
LRLARQHHVFPPGWS

SEQ ID NO: 138411 - protein, 15 aa, Mycobacterium tuberculosis
RLARQHHVFPPGWSR

SEQ ID NO: 138412 - protein, 15 aa, Mycobacterium tuberculosis
LARQHHVFPPGWSRC

SEQ ID NO: 138413 - protein, 15 aa, Mycobacterium tuberculosis
ARQHHVFPPGWSRCR

SEQ ID NO: 138414 - protein, 15 aa, Mycobacterium tuberculosis
RQHHVFPPGWSRCRA

SEQ ID NO: 138415 - protein, 15 aa, Mycobacterium tuberculosis
QHHVFPPGWSRCRAP

SEQ ID NO: 138416 - protein, 15 aa, Mycobacterium tuberculosis
HHVFPPGWSRCRAPA

SEQ ID NO: 138417 - protein, 15 aa, Mycobacterium tuberculosis
HVFPPGWSRCRAPAG

SEQ ID NO: 138418 - protein, 15 aa, Mycobacterium tuberculosis
VFPPGWSRCRAPAGP

SEQ ID NO: 138419 - protein, 15 aa, Mycobacterium tuberculosis
FPPGWSRCRAPAGPP

SEQ ID NO: 138420 - protein, 15 aa, Mycobacterium tuberculosis
PPGWSRCRAPAGPPV

SEQ ID NO: 138421 - protein, 15 aa, Mycobacterium tuberculosis
PGWSRCRAPAGPPVP

SEQ ID NO: 138422 - protein, 15 aa, Mycobacterium tuberculosis
GWSRCRAPAGPPVPL

SEQ ID NO: 138423 - protein, 15 aa, Mycobacterium tuberculosis
WSRCRAPAGPPVPLI

SEQ ID NO: 138424 - protein, 15 aa, Mycobacterium tuberculosis
SRCRAPAGPPVPLIV

SEQ ID NO: 138425 - protein, 15 aa, Mycobacterium tuberculosis
RCRAPAGPPVPLIVN

SEQ ID NO: 138426 - protein, 15 aa, Mycobacterium tuberculosis
CRAPAGPPVPLIVNS

SEQ ID NO: 138427 - protein, 15 aa, Mycobacterium tuberculosis
RAPAGPPVPLIVNSR

SEQ ID NO: 138428 - protein, 15 aa, Mycobacterium tuberculosis
APAGPPVPLIVNSRP

SEQ ID NO: 138429 - protein, 15 aa, Mycobacterium tuberculosis
PAGPPVPLIVNSRPT

SEQ ID NO: 138430 - protein, 15 aa, Mycobacterium tuberculosis
AGPPVPLIVNSRPTP

SEQ ID NO: 138431 - protein, 15 aa, Mycobacterium tuberculosis
GPPVPLIVNSRPTPV

SEQ ID NO: 138432 - protein, 15 aa, Mycobacterium tuberculosis
PPVPLIVNSRPTPVL

SEQ ID NO: 138433 - protein, 15 aa, Mycobacterium tuberculosis
PVPLIVNSRPTPVLT

SEQ ID NO: 138434 - protein, 15 aa, Mycobacterium tuberculosis
VPLIVNSRPTPVLTE

SEQ ID NO: 138435 - protein, 15 aa, Mycobacterium tuberculosis
PLIVNSRPTPVLTEA

SEQ ID NO: 138436 - protein, 15 aa, Mycobacterium tuberculosis
LIVNSRPTPVLTEAA

SEQ ID NO: 138437 - protein, 15 aa, Mycobacterium tuberculosis
IVNSRPTPVLTEAAA

SEQ ID NO: 138438 - protein, 15 aa, Mycobacterium tuberculosis
VNSRPTPVLTEAAAV

SEQ ID NO: 138439 - protein, 15 aa, Mycobacterium tuberculosis
NSRPTPVLTEAAAVD

SEQ ID NO: 138440 - protein, 15 aa, Mycobacterium tuberculosis
SRPTPVLTEAAAVDR

SEQ ID NO: 138441 - protein, 15 aa, Mycobacterium tuberculosis
RPTPVLTEAAAVDRA

SEQ ID NO: 138442 - protein, 15 aa, Mycobacterium tuberculosis
PTPVLTEAAAVDRAR

SEQ ID NO: 138443 - protein, 15 aa, Mycobacterium tuberculosis
TPVLTEAAAVDRARE

SEQ ID NO: 138444 - protein, 15 aa, Mycobacterium tuberculosis
PVLTEAAAVDRAREH

SEQ ID NO: 138445 - protein, 15 aa, Mycobacterium tuberculosis
VLTEAAAVDRAREHG

SEQ ID NO: 138446 - protein, 15 aa, Mycobacterium tuberculosis
LTEAAAVDRAREHGL

SEQ ID NO: 138447 - protein, 15 aa, Mycobacterium tuberculosis
TEAAAVDRAREHGLP

SEQ ID NO: 138448 - protein, 15 aa, Mycobacterium tuberculosis
EAAAVDRAREHGLPF

SEQ ID NO: 138449 - protein, 15 aa, Mycobacterium tuberculosis
AAAVDRAREHGLPFL

SEQ ID NO: 138450 - protein, 15 aa, Mycobacterium tuberculosis
AAVDRAREHGLPFLF

SEQ ID NO: 138451 - protein, 15 aa, Mycobacterium tuberculosis
AVDRAREHGLPFLFF

SEQ ID NO: 138452 - protein, 15 aa, Mycobacterium tuberculosis
VDRAREHGLPFLFFT

SEQ ID NO: 138453 - protein, 15 aa, Mycobacterium tuberculosis
DRAREHGLPFLFFTD

SEQ ID NO: 138454 - protein, 15 aa, Mycobacterium tuberculosis
RAREHGLPFLFFTDQ

SEQ ID NO: 138455 - protein, 15 aa, Mycobacterium tuberculosis
AREHGLPFLFFTDQA

SEQ ID NO: 138456 - protein, 15 aa, Mycobacterium tuberculosis
REHGLPFLFFTDQAT

SEQ ID NO: 138457 - protein, 15 aa, Mycobacterium tuberculosis
EHGLPFLFFTDQATG

SEQ ID NO: 138458 - protein, 15 aa, Mycobacterium tuberculosis
HGLPFLFFTDQATGR

SEQ ID NO: 138459 - protein, 15 aa, Mycobacterium tuberculosis
GLPFLFFTDQATGRG

SEQ ID NO: 138460 - protein, 15 aa, Mycobacterium tuberculosis
LPFLFFTDQATGRGQ

SEQ ID NO: 138461 - protein, 15 aa, Mycobacterium tuberculosis
PFLFFTDQATGRGQL

SEQ ID NO: 138462 - protein, 15 aa, Mycobacterium tuberculosis
FLFFTDQATGRGQLL

SEQ ID NO: 138463 - protein, 15 aa, Mycobacterium tuberculosis
LFFTDQATGRGQLLY

SEQ ID NO: 138464 - protein, 15 aa, Mycobacterium tuberculosis
FFTDQATGRGQLLYS

SEQ ID NO: 138465 - protein, 15 aa, Mycobacterium tuberculosis
FTDQATGRGQLLYSR

SEQ ID NO: 138466 - protein, 15 aa, Mycobacterium tuberculosis
TDQATGRGQLLYSRY

SEQ ID NO: 138467 - protein, 15 aa, Mycobacterium tuberculosis
DQATGRGQLLYSRYD

SEQ ID NO: 138468 - protein, 15 aa, Mycobacterium tuberculosis
QATGRGQLLYSRYDG

SEQ ID NO: 138469 - protein, 15 aa, Mycobacterium tuberculosis
ATGRGQLLYSRYDGN

SEQ ID NO: 138470 - protein, 15 aa, Mycobacterium tuberculosis
TGRGQLLYSRYDGNL

SEQ ID NO: 138471 - protein, 15 aa, Mycobacterium tuberculosis
GRGQLLYSRYDGNLG

SEQ ID NO: 138472 - protein, 15 aa, Mycobacterium tuberculosis
RGQLLYSRYDGNLGL

SEQ ID NO: 138473 - protein, 15 aa, Mycobacterium tuberculosis
GQLLYSRYDGNLGLI

SEQ ID NO: 138474 - protein, 15 aa, Mycobacterium tuberculosis
QLLYSRYDGNLGLIT

SEQ ID NO: 138475 - protein, 15 aa, Mycobacterium tuberculosis
LLYSRYDGNLGLITP

SEQ ID NO: 138476 - protein, 15 aa, Mycobacterium tuberculosis
LYSRYDGNLGLITPT

SEQ ID NO: 138477 - protein, 15 aa, Mycobacterium tuberculosis
YSRYDGNLGLITPTG

SEQ ID NO: 138478 - protein, 15 aa, Mycobacterium tuberculosis
SRYDGNLGLITPTGD

SEQ ID NO: 138479 - protein, 15 aa, Mycobacterium tuberculosis
RYDGNLGLITPTGDG

SEQ ID NO: 138480 - protein, 15 aa, Mycobacterium tuberculosis
YDGNLGLITPTGDGV

SEQ ID NO: 138481 - protein, 15 aa, Mycobacterium tuberculosis
DGNLGLITPTGDGVA

SEQ ID NO: 138482 - protein, 15 aa, Mycobacterium tuberculosis
GNLGLITPTGDGVAD

SEQ ID NO: 138483 - protein, 15 aa, Mycobacterium tuberculosis
NLGLITPTGDGVADG

SEQ ID NO: 138484 - protein, 15 aa, Mycobacterium tuberculosis
LGLITPTGDGVADGL

SEQ ID NO: 138485 - protein, 15 aa, Mycobacterium tuberculosis
GLITPTGDGVADGLA

SEQ ID NO: 138486 - protein, 16 aa, Mycobacterium tuberculosis
MEPKRSRLVVCAPEPS

SEQ ID NO: 138487 - protein, 16 aa, Mycobacterium tuberculosis
EPKRSRLVVCAPEPSH

SEQ ID NO: 138488 - protein, 16 aa, Mycobacterium tuberculosis
PKRSRLVVCAPEPSHA

SEQ ID NO: 138489 - protein, 16 aa, Mycobacterium tuberculosis
KRSRLVVCAPEPSHAR

SEQ ID NO: 138490 - protein, 16 aa, Mycobacterium tuberculosis
RSRLVVCAPEPSHARE

SEQ ID NO: 138491 - protein, 16 aa, Mycobacterium tuberculosis
SRLVVCAPEPSHAREF

SEQ ID NO: 138492 - protein, 16 aa, Mycobacterium tuberculosis
RLVVCAPEPSHAREFP

SEQ ID NO: 138493 - protein, 16 aa, Mycobacterium tuberculosis
LVVCAPEPSHAREFPD

SEQ ID NO: 138494 - protein, 16 aa, Mycobacterium tuberculosis
VVCAPEPSHAREFPDV

SEQ ID NO: 138495 - protein, 16 aa, Mycobacterium tuberculosis
VCAPEPSHAREFPDVA

SEQ ID NO: 138496 - protein, 16 aa, Mycobacterium tuberculosis
CAPEPSHAREFPDVAV

SEQ ID NO: 138497 - protein, 16 aa, Mycobacterium tuberculosis
APEPSHAREFPDVAVF

SEQ ID NO: 138498 - protein, 16 aa, Mycobacterium tuberculosis
PEPSHAREFPDVAVFS

SEQ ID NO: 138499 - protein, 16 aa, Mycobacterium tuberculosis
EPSHAREFPDVAVFSG

SEQ ID NO: 138500 - protein, 16 aa, Mycobacterium tuberculosis
PSHAREFPDVAVFSGG

SEQ ID NO: 138501 - protein, 16 aa, Mycobacterium tuberculosis
SHAREFPDVAVFSGGR

SEQ ID NO: 138502 - protein, 16 aa, Mycobacterium tuberculosis
HAREFPDVAVFSGGRA

SEQ ID NO: 138503 - protein, 16 aa, Mycobacterium tuberculosis
AREFPDVAVFSGGRAN

SEQ ID NO: 138504 - protein, 16 aa, Mycobacterium tuberculosis
REFPDVAVFSGGRANA

SEQ ID NO: 138505 - protein, 16 aa, Mycobacterium tuberculosis
EFPDVAVFSGGRANAS

SEQ ID NO: 138506 - protein, 16 aa, Mycobacterium tuberculosis
FPDVAVFSGGRANASQ

SEQ ID NO: 138507 - protein, 16 aa, Mycobacterium tuberculosis
PDVAVFSGGRANASQA

SEQ ID NO: 138508 - protein, 16 aa, Mycobacterium tuberculosis
DVAVFSGGRANASQAE

SEQ ID NO: 138509 - protein, 16 aa, Mycobacterium tuberculosis
VAVFSGGRANASQAER

SEQ ID NO: 138510 - protein, 16 aa, Mycobacterium tuberculosis
AVFSGGRANASQAERL

SEQ ID NO: 138511 - protein, 16 aa, Mycobacterium tuberculosis
VFSGGRANASQAERLA

SEQ ID NO: 138512 - protein, 16 aa, Mycobacterium tuberculosis
FSGGRANASQAERLAR

SEQ ID NO: 138513 - protein, 16 aa, Mycobacterium tuberculosis
SGGRANASQAERLARA

SEQ ID NO: 138514 - protein, 16 aa, Mycobacterium tuberculosis
GGRANASQAERLARAV

SEQ ID NO: 138515 - protein, 16 aa, Mycobacterium tuberculosis
GRANASQAERLARAVG

SEQ ID NO: 138516 - protein, 16 aa, Mycobacterium tuberculosis
RANASQAERLARAVGR

SEQ ID NO: 138517 - protein, 16 aa, Mycobacterium tuberculosis
ANASQAERLARAVGRV

SEQ ID NO: 138518 - protein, 16 aa, Mycobacterium tuberculosis
NASQAERLARAVGRVL

SEQ ID NO: 138519 - protein, 16 aa, Mycobacterium tuberculosis
ASQAERLARAVGRVLA

SEQ ID NO: 138520 - protein, 16 aa, Mycobacterium tuberculosis
SQAERLARAVGRVLAD

SEQ ID NO: 138521 - protein, 16 aa, Mycobacterium tuberculosis
QAERLARAVGRVLADR

SEQ ID NO: 138522 - protein, 16 aa, Mycobacterium tuberculosis
AERLARAVGRVLADRG

SEQ ID NO: 138523 - protein, 16 aa, Mycobacterium tuberculosis
ERLARAVGRVLADRGV

SEQ ID NO: 138524 - protein, 16 aa, Mycobacterium tuberculosis
RLARAVGRVLADRGVT

SEQ ID NO: 138525 - protein, 16 aa, Mycobacterium tuberculosis
LARAVGRVLADRGVTG

SEQ ID NO: 138526 - protein, 16 aa, Mycobacterium tuberculosis
ARAVGRVLADRGVTGG

SEQ ID NO: 138527 - protein, 16 aa, Mycobacterium tuberculosis
RAVGRVLADRGVTGGA

SEQ ID NO: 138528 - protein, 16 aa, Mycobacterium tuberculosis
AVGRVLADRGVTGGAR

SEQ ID NO: 138529 - protein, 16 aa, Mycobacterium tuberculosis
VGRVLADRGVTGGARV

SEQ ID NO: 138530 - protein, 16 aa, Mycobacterium tuberculosis
GRVLADRGVTGGARVR

SEQ ID NO: 138531 - protein, 16 aa, Mycobacterium tuberculosis
RVLADRGVTGGARVRL

SEQ ID NO: 138532 - protein, 16 aa, Mycobacterium tuberculosis
VLADRGVTGGARVRLT

SEQ ID NO: 138533 - protein, 16 aa, Mycobacterium tuberculosis
LADRGVTGGARVRLTM

SEQ ID NO: 138534 - protein, 16 aa, Mycobacterium tuberculosis
ADRGVTGGARVRLTMA

SEQ ID NO: 138535 - protein, 16 aa, Mycobacterium tuberculosis
DRGVTGGARVRLTMAN

SEQ ID NO: 138536 - protein, 16 aa, Mycobacterium tuberculosis
RGVTGGARVRLTMANC

SEQ ID NO: 138537 - protein, 16 aa, Mycobacterium tuberculosis
GVTGGARVRLTMANCA

SEQ ID NO: 138538 - protein, 16 aa, Mycobacterium tuberculosis
VTGGARVRLTMANCAD

SEQ ID NO: 138539 - protein, 16 aa, Mycobacterium tuberculosis
TGGARVRLTMANCADG

SEQ ID NO: 138540 - protein, 16 aa, Mycobacterium tuberculosis
GGARVRLTMANCADGP

SEQ ID NO: 138541 - protein, 16 aa, Mycobacterium tuberculosis
GARVRLTMANCADGPT

SEQ ID NO: 138542 - protein, 16 aa, Mycobacterium tuberculosis
ARVRLTMANCADGPTL

SEQ ID NO: 138543 - protein, 16 aa, Mycobacterium tuberculosis
RVRLTMANCADGPTLV

SEQ ID NO: 138544 - protein, 16 aa, Mycobacterium tuberculosis
VRLTMANCADGPTLVQ

SEQ ID NO: 138545 - protein, 16 aa, Mycobacterium tuberculosis
RLTMANCADGPTLVQI

SEQ ID NO: 138546 - protein, 16 aa, Mycobacterium tuberculosis
LTMANCADGPTLVQIN

SEQ ID NO: 138547 - protein, 16 aa, Mycobacterium tuberculosis
TMANCADGPTLVQINL

SEQ ID NO: 138548 - protein, 16 aa, Mycobacterium tuberculosis
MANCADGPTLVQINLQ

SEQ ID NO: 138549 - protein, 16 aa, Mycobacterium tuberculosis
ANCADGPTLVQINLQV

SEQ ID NO: 138550 - protein, 16 aa, Mycobacterium tuberculosis
NCADGPTLVQINLQVG

SEQ ID NO: 138551 - protein, 16 aa, Mycobacterium tuberculosis
CADGPTLVQINLQVGD

SEQ ID NO: 138552 - protein, 16 aa, Mycobacterium tuberculosis
ADGPTLVQINLQVGDT

SEQ ID NO: 138553 - protein, 16 aa, Mycobacterium tuberculosis
DGPTLVQINLQVGDTP

SEQ ID NO: 138554 - protein, 16 aa, Mycobacterium tuberculosis
GPTLVQINLQVGDTPL

SEQ ID NO: 138555 - protein, 16 aa, Mycobacterium tuberculosis
PTLVQINLQVGDTPLR

SEQ ID NO: 138556 - protein, 16 aa, Mycobacterium tuberculosis
TLVQINLQVGDTPLRA

SEQ ID NO: 138557 - protein, 16 aa, Mycobacterium tuberculosis
LVQINLQVGDTPLRAQ

SEQ ID NO: 138558 - protein, 16 aa, Mycobacterium tuberculosis
VQINLQVGDTPLRAQA

SEQ ID NO: 138559 - protein, 16 aa, Mycobacterium tuberculosis
QINLQVGDTPLRAQAA

SEQ ID NO: 138560 - protein, 16 aa, Mycobacterium tuberculosis
INLQVGDTPLRAQAAT

SEQ ID NO: 138561 - protein, 16 aa, Mycobacterium tuberculosis
NLQVGDTPLRAQAATA

SEQ ID NO: 138562 - protein, 16 aa, Mycobacterium tuberculosis
LQVGDTPLRAQAATAG

SEQ ID NO: 138563 - protein, 16 aa, Mycobacterium tuberculosis
QVGDTPLRAQAATAGI

SEQ ID NO: 138564 - protein, 16 aa, Mycobacterium tuberculosis
VGDTPLRAQAATAGID

SEQ ID NO: 138565 - protein, 16 aa, Mycobacterium tuberculosis
GDTPLRAQAATAGIDD

SEQ ID NO: 138566 - protein, 16 aa, Mycobacterium tuberculosis
DTPLRAQAATAGIDDL

SEQ ID NO: 138567 - protein, 16 aa, Mycobacterium tuberculosis
TPLRAQAATAGIDDLR

SEQ ID NO: 138568 - protein, 16 aa, Mycobacterium tuberculosis
PLRAQAATAGIDDLRP

SEQ ID NO: 138569 - protein, 16 aa, Mycobacterium tuberculosis
LRAQAATAGIDDLRPA

SEQ ID NO: 138570 - protein, 16 aa, Mycobacterium tuberculosis
RAQAATAGIDDLRPAL

SEQ ID NO: 138571 - protein, 16 aa, Mycobacterium tuberculosis
AQAATAGIDDLRPALI

SEQ ID NO: 138572 - protein, 16 aa, Mycobacterium tuberculosis
QAATAGIDDLRPALIR

SEQ ID NO: 138573 - protein, 16 aa, Mycobacterium tuberculosis
AATAGIDDLRPALIRL

SEQ ID NO: 138574 - protein, 16 aa, Mycobacterium tuberculosis
ATAGIDDLRPALIRLD

SEQ ID NO: 138575 - protein, 16 aa, Mycobacterium tuberculosis
TAGIDDLRPALIRLDR

SEQ ID NO: 138576 - protein, 16 aa, Mycobacterium tuberculosis
AGIDDLRPALIRLDRQ

SEQ ID NO: 138577 - protein, 16 aa, Mycobacterium tuberculosis
GIDDLRPALIRLDRQI

SEQ ID NO: 138578 - protein, 16 aa, Mycobacterium tuberculosis
IDDLRPALIRLDRQIV

SEQ ID NO: 138579 - protein, 16 aa, Mycobacterium tuberculosis
DDLRPALIRLDRQIVR

SEQ ID NO: 138580 - protein, 16 aa, Mycobacterium tuberculosis
DLRPALIRLDRQIVRA

SEQ ID NO: 138581 - protein, 16 aa, Mycobacterium tuberculosis
LRPALIRLDRQIVRAS

SEQ ID NO: 138582 - protein, 16 aa, Mycobacterium tuberculosis
RPALIRLDRQIVRASA

SEQ ID NO: 138583 - protein, 16 aa, Mycobacterium tuberculosis
PALIRLDRQIVRASAQ

SEQ ID NO: 138584 - protein, 16 aa, Mycobacterium tuberculosis
ALIRLDRQIVRASAQW

SEQ ID NO: 138585 - protein, 16 aa, Mycobacterium tuberculosis
LIRLDRQIVRASAQWC

SEQ ID NO: 138586 - protein, 16 aa, Mycobacterium tuberculosis
IRLDRQIVRASAQWCP

SEQ ID NO: 138587 - protein, 16 aa, Mycobacterium tuberculosis
RLDRQIVRASAQWCPR

SEQ ID NO: 138588 - protein, 16 aa, Mycobacterium tuberculosis
LDRQIVRASAQWCPRP

SEQ ID NO: 138589 - protein, 16 aa, Mycobacterium tuberculosis
DRQIVRASAQWCPRPW

SEQ ID NO: 138590 - protein, 16 aa, Mycobacterium tuberculosis
RQIVRASAQWCPRPWP

SEQ ID NO: 138591 - protein, 16 aa, Mycobacterium tuberculosis
QIVRASAQWCPRPWPD

SEQ ID NO: 138592 - protein, 16 aa, Mycobacterium tuberculosis
IVRASAQWCPRPWPDR

SEQ ID NO: 138593 - protein, 16 aa, Mycobacterium tuberculosis
VRASAQWCPRPWPDRP

SEQ ID NO: 138594 - protein, 16 aa, Mycobacterium tuberculosis
RASAQWCPRPWPDRPR

SEQ ID NO: 138595 - protein, 16 aa, Mycobacterium tuberculosis
ASAQWCPRPWPDRPRR

SEQ ID NO: 138596 - protein, 16 aa, Mycobacterium tuberculosis
SAQWCPRPWPDRPRRR

SEQ ID NO: 138597 - protein, 16 aa, Mycobacterium tuberculosis
AQWCPRPWPDRPRRRL

SEQ ID NO: 138598 - protein, 16 aa, Mycobacterium tuberculosis
QWCPRPWPDRPRRRLT

SEQ ID NO: 138599 - protein, 16 aa, Mycobacterium tuberculosis
WCPRPWPDRPRRRLTT

SEQ ID NO: 138600 - protein, 16 aa, Mycobacterium tuberculosis
CPRPWPDRPRRRLTTP

SEQ ID NO: 138601 - protein, 16 aa, Mycobacterium tuberculosis
PRPWPDRPRRRLTTPA

SEQ ID NO: 138602 - protein, 16 aa, Mycobacterium tuberculosis
RPWPDRPRRRLTTPAE

SEQ ID NO: 138603 - protein, 16 aa, Mycobacterium tuberculosis
PWPDRPRRRLTTPAEA

SEQ ID NO: 138604 - protein, 16 aa, Mycobacterium tuberculosis
WPDRPRRRLTTPAEAL

SEQ ID NO: 138605 - protein, 16 aa, Mycobacterium tuberculosis
PDRPRRRLTTPAEALV

SEQ ID NO: 138606 - protein, 16 aa, Mycobacterium tuberculosis
DRPRRRLTTPAEALVT

SEQ ID NO: 138607 - protein, 16 aa, Mycobacterium tuberculosis
RPRRRLTTPAEALVTR

SEQ ID NO: 138608 - protein, 16 aa, Mycobacterium tuberculosis
PRRRLTTPAEALVTRR

SEQ ID NO: 138609 - protein, 16 aa, Mycobacterium tuberculosis
RRRLTTPAEALVTRRK

SEQ ID NO: 138610 - protein, 16 aa, Mycobacterium tuberculosis
RRLTTPAEALVTRRKP

SEQ ID NO: 138611 - protein, 16 aa, Mycobacterium tuberculosis
RLTTPAEALVTRRKPV

SEQ ID NO: 138612 - protein, 16 aa, Mycobacterium tuberculosis
LTTPAEALVTRRKPVV

SEQ ID NO: 138613 - protein, 16 aa, Mycobacterium tuberculosis
TTPAEALVTRRKPVVL

SEQ ID NO: 138614 - protein, 16 aa, Mycobacterium tuberculosis
TPAEALVTRRKPVVLR

SEQ ID NO: 138615 - protein, 16 aa, Mycobacterium tuberculosis
PAEALVTRRKPVVLRR

SEQ ID NO: 138616 - protein, 16 aa, Mycobacterium tuberculosis
AEALVTRRKPVVLRRA

SEQ ID NO: 138617 - protein, 16 aa, Mycobacterium tuberculosis
EALVTRRKPVVLRRAT

SEQ ID NO: 138618 - protein, 16 aa, Mycobacterium tuberculosis
ALVTRRKPVVLRRATP

SEQ ID NO: 138619 - protein, 16 aa, Mycobacterium tuberculosis
LVTRRKPVVLRRATPL

SEQ ID NO: 138620 - protein, 16 aa, Mycobacterium tuberculosis
VTRRKPVVLRRATPLQ

SEQ ID NO: 138621 - protein, 16 aa, Mycobacterium tuberculosis
TRRKPVVLRRATPLQA

SEQ ID NO: 138622 - protein, 16 aa, Mycobacterium tuberculosis
RRKPVVLRRATPLQAI

SEQ ID NO: 138623 - protein, 16 aa, Mycobacterium tuberculosis
RKPVVLRRATPLQAIA

SEQ ID NO: 138624 - protein, 16 aa, Mycobacterium tuberculosis
KPVVLRRATPLQAIAA

SEQ ID NO: 138625 - protein, 16 aa, Mycobacterium tuberculosis
PVVLRRATPLQAIAAM

SEQ ID NO: 138626 - protein, 16 aa, Mycobacterium tuberculosis
VVLRRATPLQAIAAMD

SEQ ID NO: 138627 - protein, 16 aa, Mycobacterium tuberculosis
VLRRATPLQAIAAMDA

SEQ ID NO: 138628 - protein, 16 aa, Mycobacterium tuberculosis
LRRATPLQAIAAMDAM

SEQ ID NO: 138629 - protein, 16 aa, Mycobacterium tuberculosis
RRATPLQAIAAMDAMD

SEQ ID NO: 138630 - protein, 16 aa, Mycobacterium tuberculosis
RATPLQAIAAMDAMDY

SEQ ID NO: 138631 - protein, 16 aa, Mycobacterium tuberculosis
ATPLQAIAAMDAMDYD

SEQ ID NO: 138632 - protein, 16 aa, Mycobacterium tuberculosis
TPLQAIAAMDAMDYDV

SEQ ID NO: 138633 - protein, 16 aa, Mycobacterium tuberculosis
PLQAIAAMDAMDYDVH

SEQ ID NO: 138634 - protein, 16 aa, Mycobacterium tuberculosis
LQAIAAMDAMDYDVHL

SEQ ID NO: 138635 - protein, 16 aa, Mycobacterium tuberculosis
QAIAAMDAMDYDVHLF

SEQ ID NO: 138636 - protein, 16 aa, Mycobacterium tuberculosis
AIAAMDAMDYDVHLFT

SEQ ID NO: 138637 - protein, 16 aa, Mycobacterium tuberculosis
IAAMDAMDYDVHLFTD

SEQ ID NO: 138638 - protein, 16 aa, Mycobacterium tuberculosis
AAMDAMDYDVHLFTDA

SEQ ID NO: 138639 - protein, 16 aa, Mycobacterium tuberculosis
AMDAMDYDVHLFTDAE

SEQ ID NO: 138640 - protein, 16 aa, Mycobacterium tuberculosis
MDAMDYDVHLFTDAET

SEQ ID NO: 138641 - protein, 16 aa, Mycobacterium tuberculosis
DAMDYDVHLFTDAETG

SEQ ID NO: 138642 - protein, 16 aa, Mycobacterium tuberculosis
AMDYDVHLFTDAETGE

SEQ ID NO: 138643 - protein, 16 aa, Mycobacterium tuberculosis
MDYDVHLFTDAETGED

SEQ ID NO: 138644 - protein, 16 aa, Mycobacterium tuberculosis
DYDVHLFTDAETGEDA

SEQ ID NO: 138645 - protein, 16 aa, Mycobacterium tuberculosis
YDVHLFTDAETGEDAV

SEQ ID NO: 138646 - protein, 16 aa, Mycobacterium tuberculosis
DVHLFTDAETGEDAVV

SEQ ID NO: 138647 - protein, 16 aa, Mycobacterium tuberculosis
VHLFTDAETGEDAVVY

SEQ ID NO: 138648 - protein, 16 aa, Mycobacterium tuberculosis
HLFTDAETGEDAVVYR

SEQ ID NO: 138649 - protein, 16 aa, Mycobacterium tuberculosis
LFTDAETGEDAVVYRA

SEQ ID NO: 138650 - protein, 16 aa, Mycobacterium tuberculosis
FTDAETGEDAVVYRAG

SEQ ID NO: 138651 - protein, 16 aa, Mycobacterium tuberculosis
TDAETGEDAVVYRAGP

SEQ ID NO: 138652 - protein, 16 aa, Mycobacterium tuberculosis
DAETGEDAVVYRAGPS

SEQ ID NO: 138653 - protein, 16 aa, Mycobacterium tuberculosis
AETGEDAVVYRAGPSG

SEQ ID NO: 138654 - protein, 16 aa, Mycobacterium tuberculosis
ETGEDAVVYRAGPSGL

SEQ ID NO: 138655 - protein, 16 aa, Mycobacterium tuberculosis
TGEDAVVYRAGPSGLR

SEQ ID NO: 138656 - protein, 16 aa, Mycobacterium tuberculosis
GEDAVVYRAGPSGLRL

SEQ ID NO: 138657 - protein, 16 aa, Mycobacterium tuberculosis
EDAVVYRAGPSGLRLA

SEQ ID NO: 138658 - protein, 16 aa, Mycobacterium tuberculosis
DAVVYRAGPSGLRLAR

SEQ ID NO: 138659 - protein, 16 aa, Mycobacterium tuberculosis
AVVYRAGPSGLRLARQ

SEQ ID NO: 138660 - protein, 16 aa, Mycobacterium tuberculosis
VVYRAGPSGLRLARQH

SEQ ID NO: 138661 - protein, 16 aa, Mycobacterium tuberculosis
VYRAGPSGLRLARQHH

SEQ ID NO: 138662 - protein, 16 aa, Mycobacterium tuberculosis
YRAGPSGLRLARQHHV

SEQ ID NO: 138663 - protein, 16 aa, Mycobacterium tuberculosis
RAGPSGLRLARQHHVF

SEQ ID NO: 138664 - protein, 16 aa, Mycobacterium tuberculosis
AGPSGLRLARQHHVFP

SEQ ID NO: 138665 - protein, 16 aa, Mycobacterium tuberculosis
GPSGLRLARQHHVFPP

SEQ ID NO: 138666 - protein, 16 aa, Mycobacterium tuberculosis
PSGLRLARQHHVFPPG

SEQ ID NO: 138667 - protein, 16 aa, Mycobacterium tuberculosis
SGLRLARQHHVFPPGW

SEQ ID NO: 138668 - protein, 16 aa, Mycobacterium tuberculosis
GLRLARQHHVFPPGWS

SEQ ID NO: 138669 - protein, 16 aa, Mycobacterium tuberculosis
LRLARQHHVFPPGWSR

SEQ ID NO: 138670 - protein, 16 aa, Mycobacterium tuberculosis
RLARQHHVFPPGWSRC

SEQ ID NO: 138671 - protein, 16 aa, Mycobacterium tuberculosis
LARQHHVFPPGWSRCR

SEQ ID NO: 138672 - protein, 16 aa, Mycobacterium tuberculosis
ARQHHVFPPGWSRCRA

SEQ ID NO: 138673 - protein, 16 aa, Mycobacterium tuberculosis
RQHHVFPPGWSRCRAP

SEQ ID NO: 138674 - protein, 16 aa, Mycobacterium tuberculosis
QHHVFPPGWSRCRAPA

SEQ ID NO: 138675 - protein, 16 aa, Mycobacterium tuberculosis
HHVFPPGWSRCRAPAG

SEQ ID NO: 138676 - protein, 16 aa, Mycobacterium tuberculosis
HVFPPGWSRCRAPAGP

SEQ ID NO: 138677 - protein, 16 aa, Mycobacterium tuberculosis
VFPPGWSRCRAPAGPP

SEQ ID NO: 138678 - protein, 16 aa, Mycobacterium tuberculosis
FPPGWSRCRAPAGPPV

SEQ ID NO: 138679 - protein, 16 aa, Mycobacterium tuberculosis
PPGWSRCRAPAGPPVP

SEQ ID NO: 138680 - protein, 16 aa, Mycobacterium tuberculosis
PGWSRCRAPAGPPVPL

SEQ ID NO: 138681 - protein, 16 aa, Mycobacterium tuberculosis
GWSRCRAPAGPPVPLI

SEQ ID NO: 138682 - protein, 16 aa, Mycobacterium tuberculosis
WSRCRAPAGPPVPLIV

SEQ ID NO: 138683 - protein, 16 aa, Mycobacterium tuberculosis
SRCRAPAGPPVPLIVN

SEQ ID NO: 138684 - protein, 16 aa, Mycobacterium tuberculosis
RCRAPAGPPVPLIVNS

SEQ ID NO: 138685 - protein, 16 aa, Mycobacterium tuberculosis
CRAPAGPPVPLIVNSR

SEQ ID NO: 138686 - protein, 16 aa, Mycobacterium tuberculosis
RAPAGPPVPLIVNSRP

SEQ ID NO: 138687 - protein, 16 aa, Mycobacterium tuberculosis
APAGPPVPLIVNSRPT

SEQ ID NO: 138688 - protein, 16 aa, Mycobacterium tuberculosis
PAGPPVPLIVNSRPTP

SEQ ID NO: 138689 - protein, 16 aa, Mycobacterium tuberculosis
AGPPVPLIVNSRPTPV

SEQ ID NO: 138690 - protein, 16 aa, Mycobacterium tuberculosis
GPPVPLIVNSRPTPVL

SEQ ID NO: 138691 - protein, 16 aa, Mycobacterium tuberculosis
PPVPLIVNSRPTPVLT

SEQ ID NO: 138692 - protein, 16 aa, Mycobacterium tuberculosis
PVPLIVNSRPTPVLTE

SEQ ID NO: 138693 - protein, 16 aa, Mycobacterium tuberculosis
VPLIVNSRPTPVLTEA

SEQ ID NO: 138694 - protein, 16 aa, Mycobacterium tuberculosis
PLIVNSRPTPVLTEAA

SEQ ID NO: 138695 - protein, 16 aa, Mycobacterium tuberculosis
LIVNSRPTPVLTEAAA

SEQ ID NO: 138696 - protein, 16 aa, Mycobacterium tuberculosis
IVNSRPTPVLTEAAAV

SEQ ID NO: 138697 - protein, 16 aa, Mycobacterium tuberculosis
VNSRPTPVLTEAAAVD

SEQ ID NO: 138698 - protein, 16 aa, Mycobacterium tuberculosis
NSRPTPVLTEAAAVDR

SEQ ID NO: 138699 - protein, 16 aa, Mycobacterium tuberculosis
SRPTPVLTEAAAVDRA

SEQ ID NO: 138700 - protein, 16 aa, Mycobacterium tuberculosis
RPTPVLTEAAAVDRAR

SEQ ID NO: 138701 - protein, 16 aa, Mycobacterium tuberculosis
PTPVLTEAAAVDRARE

SEQ ID NO: 138702 - protein, 16 aa, Mycobacterium tuberculosis
TPVLTEAAAVDRAREH

SEQ ID NO: 138703 - protein, 16 aa, Mycobacterium tuberculosis
PVLTEAAAVDRAREHG

SEQ ID NO: 138704 - protein, 16 aa, Mycobacterium tuberculosis
VLTEAAAVDRAREHGL

SEQ ID NO: 138705 - protein, 16 aa, Mycobacterium tuberculosis
LTEAAAVDRAREHGLP

SEQ ID NO: 138706 - protein, 16 aa, Mycobacterium tuberculosis
TEAAAVDRAREHGLPF

SEQ ID NO: 138707 - protein, 16 aa, Mycobacterium tuberculosis
EAAAVDRAREHGLPFL

SEQ ID NO: 138708 - protein, 16 aa, Mycobacterium tuberculosis
AAAVDRAREHGLPFLF

SEQ ID NO: 138709 - protein, 16 aa, Mycobacterium tuberculosis
AAVDRAREHGLPFLFF

SEQ ID NO: 138710 - protein, 16 aa, Mycobacterium tuberculosis
AVDRAREHGLPFLFFT

SEQ ID NO: 138711 - protein, 16 aa, Mycobacterium tuberculosis
VDRAREHGLPFLFFTD

SEQ ID NO: 138712 - protein, 16 aa, Mycobacterium tuberculosis
DRAREHGLPFLFFTDQ

SEQ ID NO: 138713 - protein, 16 aa, Mycobacterium tuberculosis
RAREHGLPFLFFTDQA

SEQ ID NO: 138714 - protein, 16 aa, Mycobacterium tuberculosis
AREHGLPFLFFTDQAT

SEQ ID NO: 138715 - protein, 16 aa, Mycobacterium tuberculosis
REHGLPFLFFTDQATG

SEQ ID NO: 138716 - protein, 16 aa, Mycobacterium tuberculosis
EHGLPFLFFTDQATGR

SEQ ID NO: 138717 - protein, 16 aa, Mycobacterium tuberculosis
HGLPFLFFTDQATGRG

SEQ ID NO: 138718 - protein, 16 aa, Mycobacterium tuberculosis
GLPFLFFTDQATGRGQ

SEQ ID NO: 138719 - protein, 16 aa, Mycobacterium tuberculosis
LPFLFFTDQATGRGQL

SEQ ID NO: 138720 - protein, 16 aa, Mycobacterium tuberculosis
PFLFFTDQATGRGQLL

SEQ ID NO: 138721 - protein, 16 aa, Mycobacterium tuberculosis
FLFFTDQATGRGQLLY

SEQ ID NO: 138722 - protein, 16 aa, Mycobacterium tuberculosis
LFFTDQATGRGQLLYS

SEQ ID NO: 138723 - protein, 16 aa, Mycobacterium tuberculosis
FFTDQATGRGQLLYSR

SEQ ID NO: 138724 - protein, 16 aa, Mycobacterium tuberculosis
FTDQATGRGQLLYSRY

SEQ ID NO: 138725 - protein, 16 aa, Mycobacterium tuberculosis
TDQATGRGQLLYSRYD

SEQ ID NO: 138726 - protein, 16 aa, Mycobacterium tuberculosis
DQATGRGQLLYSRYDG

SEQ ID NO: 138727 - protein, 16 aa, Mycobacterium tuberculosis
QATGRGQLLYSRYDGN

SEQ ID NO: 138728 - protein, 16 aa, Mycobacterium tuberculosis
ATGRGQLLYSRYDGNL

SEQ ID NO: 138729 - protein, 16 aa, Mycobacterium tuberculosis
TGRGQLLYSRYDGNLG

SEQ ID NO: 138730 - protein, 16 aa, Mycobacterium tuberculosis
GRGQLLYSRYDGNLGL

SEQ ID NO: 138731 - protein, 16 aa, Mycobacterium tuberculosis
RGQLLYSRYDGNLGLI

SEQ ID NO: 138732 - protein, 16 aa, Mycobacterium tuberculosis
GQLLYSRYDGNLGLIT

SEQ ID NO: 138733 - protein, 16 aa, Mycobacterium tuberculosis
QLLYSRYDGNLGLITP

SEQ ID NO: 138734 - protein, 16 aa, Mycobacterium tuberculosis
LLYSRYDGNLGLITPT

SEQ ID NO: 138735 - protein, 16 aa, Mycobacterium tuberculosis
LYSRYDGNLGLITPTG

SEQ ID NO: 138736 - protein, 16 aa, Mycobacterium tuberculosis
YSRYDGNLGLITPTGD

SEQ ID NO: 138737 - protein, 16 aa, Mycobacterium tuberculosis
SRYDGNLGLITPTGDG

SEQ ID NO: 138738 - protein, 16 aa, Mycobacterium tuberculosis
RYDGNLGLITPTGDGV

SEQ ID NO: 138739 - protein, 16 aa, Mycobacterium tuberculosis
YDGNLGLITPTGDGVA

SEQ ID NO: 138740 - protein, 16 aa, Mycobacterium tuberculosis
DGNLGLITPTGDGVAD

SEQ ID NO: 138741 - protein, 16 aa, Mycobacterium tuberculosis
GNLGLITPTGDGVADG

SEQ ID NO: 138742 - protein, 16 aa, Mycobacterium tuberculosis
NLGLITPTGDGVADGL

SEQ ID NO: 138743 - protein, 16 aa, Mycobacterium tuberculosis
LGLITPTGDGVADGLA

SEQ ID NO: 138744 - protein, 463 aa, Mycobacterium tuberculosis
MNHLTTLDAGFLKAEDVDRHVSLAIGALAVIEGPAPDQEAFLSSLAQRLRPCTRFGQRLRLRPFDLGAPKWVDDPDFDLGRHVWRIALPRPGNEDQLFELIADLMARRLDRGRPLWEVWVIEGLADSKWAILTKLHHCMADGIAATHLLAGLSDESMSDSFASNIHTTMQSQSASVRRGGFRVNPSEALTASTAVMAGIVRAAKGASEIAAGVLSPAASSLNGPISDLRRYSAAKVPLADVEQVCRKFDVTINDVALAAITESYRNVLIQRGERPRFDSLRTLVPVSTRSNSALSKTDNRVSLMLPNLPVDQENPLQRLRIVHSRLTRAKAGGQRQFGNTLMAIANRLPFPMTAWAVGLLMRLPQRGVVTVATNVPGPRRPLQIMGRRVLDLYPVSPIAMQLRTSVAMLSYADDLYFGILADYDVVADAGQLARGIEDAVARLVAISKRRKVTRRRGALSLVV

SEQ ID NO: 138745 - protein, 8 aa, Mycobacterium tuberculosis
TTLDAGFL

SEQ ID NO: 138746 - protein, 8 aa, Mycobacterium tuberculosis
TLDAGFLK

SEQ ID NO: 138747 - protein, 8 aa, Mycobacterium tuberculosis
AEDVDRHV

SEQ ID NO: 138748 - protein, 8 aa, Mycobacterium tuberculosis
DVDRHVSL

SEQ ID NO: 138749 - protein, 8 aa, Mycobacterium tuberculosis
HVSLAIGA

SEQ ID NO: 138750 - protein, 8 aa, Mycobacterium tuberculosis
SLAIGALA

SEQ ID NO: 138751 - protein, 8 aa, Mycobacterium tuberculosis
LAIGALAV

SEQ ID NO: 138752 - protein, 8 aa, Mycobacterium tuberculosis
AIGALAVI

SEQ ID NO: 138753 - protein, 8 aa, Mycobacterium tuberculosis
LAVIEGPA

SEQ ID NO: 138754 - protein, 8 aa, Mycobacterium tuberculosis
APDQEAFL

SEQ ID NO: 138755 - protein, 8 aa, Mycobacterium tuberculosis
QEAFLSSL

SEQ ID NO: 138756 - protein, 8 aa, Mycobacterium tuberculosis
EAFLSSLA

SEQ ID NO: 138757 - protein, 8 aa, Mycobacterium tuberculosis
FLSSLAQR

SEQ ID NO: 138758 - protein, 8 aa, Mycobacterium tuberculosis
SSLAQRLR

SEQ ID NO: 138759 - protein, 8 aa, Mycobacterium tuberculosis
RLRPCTRF

SEQ ID NO: 138760 - protein, 8 aa, Mycobacterium tuberculosis
TRFGQRLR

SEQ ID NO: 138761 - protein, 8 aa, Mycobacterium tuberculosis
QRLRLRPF

SEQ ID NO: 138762 - protein, 8 aa, Mycobacterium tuberculosis
RLRLRPFD

SEQ ID NO: 138763 - protein, 8 aa, Mycobacterium tuberculosis
DLGAPKWV

SEQ ID NO: 138764 - protein, 8 aa, Mycobacterium tuberculosis
KWVDDPDF

SEQ ID NO: 138765 - protein, 8 aa, Mycobacterium tuberculosis
DLGRHVWR

SEQ ID NO: 138766 - protein, 8 aa, Mycobacterium tuberculosis
RHVWRIAL

SEQ ID NO: 138767 - protein, 8 aa, Mycobacterium tuberculosis
VWRIALPR

SEQ ID NO: 138768 - protein, 8 aa, Mycobacterium tuberculosis
RPGNEDQL

SEQ ID NO: 138769 - protein, 8 aa, Mycobacterium tuberculosis
NEDQLFEL

SEQ ID NO: 138770 - protein, 8 aa, Mycobacterium tuberculosis
FELIADLM

SEQ ID NO: 138771 - protein, 8 aa, Mycobacterium tuberculosis
ELIADLMA

SEQ ID NO: 138772 - protein, 8 aa, Mycobacterium tuberculosis
LIADLMAR

SEQ ID NO: 138773 - protein, 8 aa, Mycobacterium tuberculosis
IADLMARR

SEQ ID NO: 138774 - protein, 8 aa, Mycobacterium tuberculosis
LMARRLDR

SEQ ID NO: 138775 - protein, 8 aa, Mycobacterium tuberculosis
RLDRGRPL

SEQ ID NO: 138776 - protein, 8 aa, Mycobacterium tuberculosis
RGRPLWEV

SEQ ID NO: 138777 - protein, 8 aa, Mycobacterium tuberculosis
RPLWEVWV

SEQ ID NO: 138778 - protein, 8 aa, Mycobacterium tuberculosis
PLWEVWVI

SEQ ID NO: 138779 - protein, 8 aa, Mycobacterium tuberculosis
WEVWVIEG

SEQ ID NO: 138780 - protein, 8 aa, Mycobacterium tuberculosis
EVWVIEGL

SEQ ID NO: 138781 - protein, 8 aa, Mycobacterium tuberculosis
GLADSKWA

SEQ ID NO: 138782 - protein, 8 aa, Mycobacterium tuberculosis
KWAILTKL

SEQ ID NO: 138783 - protein, 8 aa, Mycobacterium tuberculosis
ILTKLHHC

SEQ ID NO: 138784 - protein, 8 aa, Mycobacterium tuberculosis
LTKLHHCM

SEQ ID NO: 138785 - protein, 8 aa, Mycobacterium tuberculosis
CMADGIAA

SEQ ID NO: 138786 - protein, 8 aa, Mycobacterium tuberculosis
MADGIAAT

SEQ ID NO: 138787 - protein, 8 aa, Mycobacterium tuberculosis
GIAATHLL

SEQ ID NO: 138788 - protein, 8 aa, Mycobacterium tuberculosis
ATHLLAGL

SEQ ID NO: 138789 - protein, 8 aa, Mycobacterium tuberculosis
GLSDESMS

SEQ ID NO: 138790 - protein, 8 aa, Mycobacterium tuberculosis
DESMSDSF

SEQ ID NO: 138791 - protein, 8 aa, Mycobacterium tuberculosis
ESMSDSFA

SEQ ID NO: 138792 - protein, 8 aa, Mycobacterium tuberculosis
SMSDSFAS

SEQ ID NO: 138793 - protein, 8 aa, Mycobacterium tuberculosis
FASNIHTT

SEQ ID NO: 138794 - protein, 8 aa, Mycobacterium tuberculosis
TTMQSQSA

SEQ ID NO: 138795 - protein, 8 aa, Mycobacterium tuberculosis
MQSQSASV

SEQ ID NO: 138796 - protein, 8 aa, Mycobacterium tuberculosis
QSQSASVR

SEQ ID NO: 138797 - protein, 8 aa, Mycobacterium tuberculosis
SQSASVRR

SEQ ID NO: 138798 - protein, 8 aa, Mycobacterium tuberculosis
SVRRGGFR

SEQ ID NO: 138799 - protein, 8 aa, Mycobacterium tuberculosis
RVNPSEAL

SEQ ID NO: 138800 - protein, 8 aa, Mycobacterium tuberculosis
NPSEALTA

SEQ ID NO: 138801 - protein, 8 aa, Mycobacterium tuberculosis
EALTASTA

SEQ ID NO: 138802 - protein, 8 aa, Mycobacterium tuberculosis
ALTASTAV

SEQ ID NO: 138803 - protein, 8 aa, Mycobacterium tuberculosis
LTASTAVM

SEQ ID NO: 138804 - protein, 8 aa, Mycobacterium tuberculosis
STAVMAGI

SEQ ID NO: 138805 - protein, 8 aa, Mycobacterium tuberculosis
TAVMAGIV

SEQ ID NO: 138806 - protein, 8 aa, Mycobacterium tuberculosis
AVMAGIVR

SEQ ID NO: 138807 - protein, 8 aa, Mycobacterium tuberculosis
VMAGIVRA

SEQ ID NO: 138808 - protein, 8 aa, Mycobacterium tuberculosis
MAGIVRAA

SEQ ID NO: 138809 - protein, 8 aa, Mycobacterium tuberculosis
AGIVRAAK

SEQ ID NO: 138810 - protein, 8 aa, Mycobacterium tuberculosis
SEIAAGVL

SEQ ID NO: 138811 - protein, 8 aa, Mycobacterium tuberculosis
VLSPAASS

SEQ ID NO: 138812 - protein, 8 aa, Mycobacterium tuberculosis
PISDLRRY

SEQ ID NO: 138813 - protein, 8 aa, Mycobacterium tuberculosis
LRRYSAAK

SEQ ID NO: 138814 - protein, 8 aa, Mycobacterium tuberculosis
RRYSAAKV

SEQ ID NO: 138815 - protein, 8 aa, Mycobacterium tuberculosis
YSAAKVPL

SEQ ID NO: 138816 - protein, 8 aa, Mycobacterium tuberculosis
PLADVEQV

SEQ ID NO: 138817 - protein, 8 aa, Mycobacterium tuberculosis
DVEQVCRK

SEQ ID NO: 138818 - protein, 8 aa, Mycobacterium tuberculosis
VEQVCRKF

SEQ ID NO: 138819 - protein, 8 aa, Mycobacterium tuberculosis
QVCRKFDV

SEQ ID NO: 138820 - protein, 8 aa, Mycobacterium tuberculosis
VTINDVAL

SEQ ID NO: 138821 - protein, 8 aa, Mycobacterium tuberculosis
TINDVALA

SEQ ID NO: 138822 - protein, 8 aa, Mycobacterium tuberculosis
ALAAITES

SEQ ID NO: 138823 - protein, 8 aa, Mycobacterium tuberculosis
LAAITESY

SEQ ID NO: 138824 - protein, 8 aa, Mycobacterium tuberculosis
AAITESYR

SEQ ID NO: 138825 - protein, 8 aa, Mycobacterium tuberculosis
TESYRNVL

SEQ ID NO: 138826 - protein, 8 aa, Mycobacterium tuberculosis
ESYRNVLI

SEQ ID NO: 138827 - protein, 8 aa, Mycobacterium tuberculosis
YRNVLIQR

SEQ ID NO: 138828 - protein, 8 aa, Mycobacterium tuberculosis
VLIQRGER

SEQ ID NO: 138829 - protein, 8 aa, Mycobacterium tuberculosis
IQRGERPR

SEQ ID NO: 138830 - protein, 8 aa, Mycobacterium tuberculosis
RPRFDSLR

SEQ ID NO: 138831 - protein, 8 aa, Mycobacterium tuberculosis
FDSLRTLV

SEQ ID NO: 138832 - protein, 8 aa, Mycobacterium tuberculosis
SLRTLVPV

SEQ ID NO: 138833 - protein, 8 aa, Mycobacterium tuberculosis
TLVPVSTR

SEQ ID NO: 138834 - protein, 8 aa, Mycobacterium tuberculosis
VPVSTRSN

SEQ ID NO: 138835 - protein, 8 aa, Mycobacterium tuberculosis
STRSNSAL

SEQ ID NO: 138836 - protein, 8 aa, Mycobacterium tuberculosis
RSNSALSK

SEQ ID NO: 138837 - protein, 8 aa, Mycobacterium tuberculosis
KTDNRVSL

SEQ ID NO: 138838 - protein, 8 aa, Mycobacterium tuberculosis
LMLPNLPV

SEQ ID NO: 138839 - protein, 8 aa, Mycobacterium tuberculosis
QENPLQRL

SEQ ID NO: 138840 - protein, 8 aa, Mycobacterium tuberculosis
NPLQRLRI

SEQ ID NO: 138841 - protein, 8 aa, Mycobacterium tuberculosis
PLQRLRIV

SEQ ID NO: 138842 - protein, 8 aa, Mycobacterium tuberculosis
LQRLRIVH

SEQ ID NO: 138843 - protein, 8 aa, Mycobacterium tuberculosis
RLRIVHSR

SEQ ID NO: 138844 - protein, 8 aa, Mycobacterium tuberculosis
IVHSRLTR

SEQ ID NO: 138845 - protein, 8 aa, Mycobacterium tuberculosis
HSRLTRAK

SEQ ID NO: 138846 - protein, 8 aa, Mycobacterium tuberculosis
RAKAGGQR

SEQ ID NO: 138847 - protein, 8 aa, Mycobacterium tuberculosis
RQFGNTLM

SEQ ID NO: 138848 - protein, 8 aa, Mycobacterium tuberculosis
FGNTLMAI

SEQ ID NO: 138849 - protein, 8 aa, Mycobacterium tuberculosis
TLMAIANR

SEQ ID NO: 138850 - protein, 8 aa, Mycobacterium tuberculosis
LMAIANRL

SEQ ID NO: 138851 - protein, 8 aa, Mycobacterium tuberculosis
AIANRLPF

SEQ ID NO: 138852 - protein, 8 aa, Mycobacterium tuberculosis
RLPFPMTA

SEQ ID NO: 138853 - protein, 8 aa, Mycobacterium tuberculosis
LPFPMTAW

SEQ ID NO: 138854 - protein, 8 aa, Mycobacterium tuberculosis
FPMTAWAV

SEQ ID NO: 138855 - protein, 8 aa, Mycobacterium tuberculosis
MTAWAVGL

SEQ ID NO: 138856 - protein, 8 aa, Mycobacterium tuberculosis
TAWAVGLL

SEQ ID NO: 138857 - protein, 8 aa, Mycobacterium tuberculosis
WAVGLLMR

SEQ ID NO: 138858 - protein, 8 aa, Mycobacterium tuberculosis
AVGLLMRL

SEQ ID NO: 138859 - protein, 8 aa, Mycobacterium tuberculosis
GLLMRLPQ

SEQ ID NO: 138860 - protein, 8 aa, Mycobacterium tuberculosis
LLMRLPQR

SEQ ID NO: 138861 - protein, 8 aa, Mycobacterium tuberculosis
RLPQRGVV

SEQ ID NO: 138862 - protein, 8 aa, Mycobacterium tuberculosis
LPQRGVVT

SEQ ID NO: 138863 - protein, 8 aa, Mycobacterium tuberculosis
VVTVATNV

SEQ ID NO: 138864 - protein, 8 aa, Mycobacterium tuberculosis
ATNVPGPR

SEQ ID NO: 138865 - protein, 8 aa, Mycobacterium tuberculosis
VPGPRRPL

SEQ ID NO: 138866 - protein, 8 aa, Mycobacterium tuberculosis
GPRRPLQI

SEQ ID NO: 138867 - protein, 8 aa, Mycobacterium tuberculosis
LQIMGRRV

SEQ ID NO: 138868 - protein, 8 aa, Mycobacterium tuberculosis
QIMGRRVL

SEQ ID NO: 138869 - protein, 8 aa, Mycobacterium tuberculosis
RVLDLYPV

SEQ ID NO: 138870 - protein, 8 aa, Mycobacterium tuberculosis
DLYPVSPI

SEQ ID NO: 138871 - protein, 8 aa, Mycobacterium tuberculosis
YPVSPIAM

SEQ ID NO: 138872 - protein, 8 aa, Mycobacterium tuberculosis
SPIAMQLR

SEQ ID NO: 138873 - protein, 8 aa, Mycobacterium tuberculosis
AMQLRTSV

SEQ ID NO: 138874 - protein, 8 aa, Mycobacterium tuberculosis
MQLRTSVA

SEQ ID NO: 138875 - protein, 8 aa, Mycobacterium tuberculosis
QLRTSVAM

SEQ ID NO: 138876 - protein, 8 aa, Mycobacterium tuberculosis
TSVAMLSY

SEQ ID NO: 138877 - protein, 8 aa, Mycobacterium tuberculosis
SVAMLSYA

SEQ ID NO: 138878 - protein, 8 aa, Mycobacterium tuberculosis
MLSYADDL

SEQ ID NO: 138879 - protein, 8 aa, Mycobacterium tuberculosis
LSYADDLY

SEQ ID NO: 138880 - protein, 8 aa, Mycobacterium tuberculosis
SYADDLYF

SEQ ID NO: 138881 - protein, 8 aa, Mycobacterium tuberculosis
DLYFGILA

SEQ ID NO: 138882 - protein, 8 aa, Mycobacterium tuberculosis
YFGILADY

SEQ ID NO: 138883 - protein, 8 aa, Mycobacterium tuberculosis
GILADYDV

SEQ ID NO: 138884 - protein, 8 aa, Mycobacterium tuberculosis
ILADYDVV

SEQ ID NO: 138885 - protein, 8 aa, Mycobacterium tuberculosis
VVADAGQL

SEQ ID NO: 138886 - protein, 8 aa, Mycobacterium tuberculosis
IEDAVARL

SEQ ID NO: 138887 - protein, 8 aa, Mycobacterium tuberculosis
AVARLVAI

SEQ ID NO: 138888 - protein, 8 aa, Mycobacterium tuberculosis
ARLVAISK

SEQ ID NO: 138889 - protein, 8 aa, Mycobacterium tuberculosis
RLVAISKR

SEQ ID NO: 138890 - protein, 8 aa, Mycobacterium tuberculosis
LVAISKRR

SEQ ID NO: 138891 - protein, 8 aa, Mycobacterium tuberculosis
VAISKRRK

SEQ ID NO: 138892 - protein, 8 aa, Mycobacterium tuberculosis
AISKRRKV

SEQ ID NO: 138893 - protein, 8 aa, Mycobacterium tuberculosis
KRRKVTRR

SEQ ID NO: 138894 - protein, 8 aa, Mycobacterium tuberculosis
RRKVTRRR

SEQ ID NO: 138895 - protein, 8 aa, Mycobacterium tuberculosis
VTRRRGAL

SEQ ID NO: 138896 - protein, 8 aa, Mycobacterium tuberculosis
RRRGALSL

SEQ ID NO: 138897 - protein, 9 aa, Mycobacterium tuberculosis
TTLDAGFLK

SEQ ID NO: 138898 - protein, 9 aa, Mycobacterium tuberculosis
TLDAGFLKA

SEQ ID NO: 138899 - protein, 9 aa, Mycobacterium tuberculosis
HVSLAIGAL

SEQ ID NO: 138900 - protein, 9 aa, Mycobacterium tuberculosis
SLAIGALAV

SEQ ID NO: 138901 - protein, 9 aa, Mycobacterium tuberculosis
LAIGALAVI

SEQ ID NO: 138902 - protein, 9 aa, Mycobacterium tuberculosis
ALAVIEGPA

SEQ ID NO: 138903 - protein, 9 aa, Mycobacterium tuberculosis
EGPAPDQEA

SEQ ID NO: 138904 - protein, 9 aa, Mycobacterium tuberculosis
GPAPDQEAF

SEQ ID NO: 138905 - protein, 9 aa, Mycobacterium tuberculosis
AFLSSLAQR

SEQ ID NO: 138906 - protein, 9 aa, Mycobacterium tuberculosis
FLSSLAQRL

SEQ ID NO: 138907 - protein, 9 aa, Mycobacterium tuberculosis
LSSLAQRLR

SEQ ID NO: 138908 - protein, 9 aa, Mycobacterium tuberculosis
SLAQRLRPC

SEQ ID NO: 138909 - protein, 9 aa, Mycobacterium tuberculosis
AQRLRPCTR

SEQ ID NO: 138910 - protein, 9 aa, Mycobacterium tuberculosis
RLRPCTRFG

SEQ ID NO: 138911 - protein, 9 aa, Mycobacterium tuberculosis
RPCTRFGQR

SEQ ID NO: 138912 - protein, 9 aa, Mycobacterium tuberculosis
CTRFGQRLR

SEQ ID NO: 138913 - protein, 9 aa, Mycobacterium tuberculosis
TRFGQRLRL

SEQ ID NO: 138914 - protein, 9 aa, Mycobacterium tuberculosis
RFGQRLRLR

SEQ ID NO: 138915 - protein, 9 aa, Mycobacterium tuberculosis
GQRLRLRPF

SEQ ID NO: 138916 - protein, 9 aa, Mycobacterium tuberculosis
RLRLRPFDL

SEQ ID NO: 138917 - protein, 9 aa, Mycobacterium tuberculosis
RLRPFDLGA

SEQ ID NO: 138918 - protein, 9 aa, Mycobacterium tuberculosis
RPFDLGAPK

SEQ ID NO: 138919 - protein, 9 aa, Mycobacterium tuberculosis
WVDDPDFDL

SEQ ID NO: 138920 - protein, 9 aa, Mycobacterium tuberculosis
DLGRHVWRI

SEQ ID NO: 138921 - protein, 9 aa, Mycobacterium tuberculosis
GRHVWRIAL

SEQ ID NO: 138922 - protein, 9 aa, Mycobacterium tuberculosis
HVWRIALPR

SEQ ID NO: 138923 - protein, 9 aa, Mycobacterium tuberculosis
RPGNEDQLF

SEQ ID NO: 138924 - protein, 9 aa, Mycobacterium tuberculosis
NEDQLFELI

SEQ ID NO: 138925 - protein, 9 aa, Mycobacterium tuberculosis
QLFELIADL

SEQ ID NO: 138926 - protein, 9 aa, Mycobacterium tuberculosis
ELIADLMAR

SEQ ID NO: 138927 - protein, 9 aa, Mycobacterium tuberculosis
LIADLMARR

SEQ ID NO: 138928 - protein, 9 aa, Mycobacterium tuberculosis
DLMARRLDR

SEQ ID NO: 138929 - protein, 9 aa, Mycobacterium tuberculosis
MARRLDRGR

SEQ ID NO: 138930 - protein, 9 aa, Mycobacterium tuberculosis
RRLDRGRPL

SEQ ID NO: 138931 - protein, 9 aa, Mycobacterium tuberculosis
RLDRGRPLW

SEQ ID NO: 138932 - protein, 9 aa, Mycobacterium tuberculosis
RGRPLWEVW

SEQ ID NO: 138933 - protein, 9 aa, Mycobacterium tuberculosis
RPLWEVWVI

SEQ ID NO: 138934 - protein, 9 aa, Mycobacterium tuberculosis
PLWEVWVIE

SEQ ID NO: 138935 - protein, 9 aa, Mycobacterium tuberculosis
WEVWVIEGL

SEQ ID NO: 138936 - protein, 9 aa, Mycobacterium tuberculosis
EVWVIEGLA

SEQ ID NO: 138937 - protein, 9 aa, Mycobacterium tuberculosis
WVIEGLADS

SEQ ID NO: 138938 - protein, 9 aa, Mycobacterium tuberculosis
VIEGLADSK

SEQ ID NO: 138939 - protein, 9 aa, Mycobacterium tuberculosis
GLADSKWAI

SEQ ID NO: 138940 - protein, 9 aa, Mycobacterium tuberculosis
DSKWAILTK

SEQ ID NO: 138941 - protein, 9 aa, Mycobacterium tuberculosis
SKWAILTKL

SEQ ID NO: 138942 - protein, 9 aa, Mycobacterium tuberculosis
ILTKLHHCM

SEQ ID NO: 138943 - protein, 9 aa, Mycobacterium tuberculosis
CMADGIAAT

SEQ ID NO: 138944 - protein, 9 aa, Mycobacterium tuberculosis
MADGIAATH

SEQ ID NO: 138945 - protein, 9 aa, Mycobacterium tuberculosis
DGIAATHLL

SEQ ID NO: 138946 - protein, 9 aa, Mycobacterium tuberculosis
GIAATHLLA

SEQ ID NO: 138947 - protein, 9 aa, Mycobacterium tuberculosis
AATHLLAGL

SEQ ID NO: 138948 - protein, 9 aa, Mycobacterium tuberculosis
LLAGLSDES

SEQ ID NO: 138949 - protein, 9 aa, Mycobacterium tuberculosis
LAGLSDESM

SEQ ID NO: 138950 - protein, 9 aa, Mycobacterium tuberculosis
GLSDESMSD

SEQ ID NO: 138951 - protein, 9 aa, Mycobacterium tuberculosis
ESMSDSFAS

SEQ ID NO: 138952 - protein, 9 aa, Mycobacterium tuberculosis
FASNIHTTM

SEQ ID NO: 138953 - protein, 9 aa, Mycobacterium tuberculosis
HTTMQSQSA

SEQ ID NO: 138954 - protein, 9 aa, Mycobacterium tuberculosis
TTMQSQSAS

SEQ ID NO: 138955 - protein, 9 aa, Mycobacterium tuberculosis
TMQSQSASV

SEQ ID NO: 138956 - protein, 9 aa, Mycobacterium tuberculosis
MQSQSASVR

SEQ ID NO: 138957 - protein, 9 aa, Mycobacterium tuberculosis
QSQSASVRR

SEQ ID NO: 138958 - protein, 9 aa, Mycobacterium tuberculosis
ASVRRGGFR

SEQ ID NO: 138959 - protein, 9 aa, Mycobacterium tuberculosis
SVRRGGFRV

SEQ ID NO: 138960 - protein, 9 aa, Mycobacterium tuberculosis
RRGGFRVNP

SEQ ID NO: 138961 - protein, 9 aa, Mycobacterium tuberculosis
FRVNPSEAL

SEQ ID NO: 138962 - protein, 9 aa, Mycobacterium tuberculosis
NPSEALTAS

SEQ ID NO: 138963 - protein, 9 aa, Mycobacterium tuberculosis
EALTASTAV

SEQ ID NO: 138964 - protein, 9 aa, Mycobacterium tuberculosis
ALTASTAVM

SEQ ID NO: 138965 - protein, 9 aa, Mycobacterium tuberculosis
LTASTAVMA

SEQ ID NO: 138966 - protein, 9 aa, Mycobacterium tuberculosis
ASTAVMAGI

SEQ ID NO: 138967 - protein, 9 aa, Mycobacterium tuberculosis
STAVMAGIV

SEQ ID NO: 138968 - protein, 9 aa, Mycobacterium tuberculosis
TAVMAGIVR

SEQ ID NO: 138969 - protein, 9 aa, Mycobacterium tuberculosis
AVMAGIVRA

SEQ ID NO: 138970 - protein, 9 aa, Mycobacterium tuberculosis
VMAGIVRAA

SEQ ID NO: 138971 - protein, 9 aa, Mycobacterium tuberculosis
MAGIVRAAK

SEQ ID NO: 138972 - protein, 9 aa, Mycobacterium tuberculosis
RAAKGASEI

SEQ ID NO: 138973 - protein, 9 aa, Mycobacterium tuberculosis
GASEIAAGV

SEQ ID NO: 138974 - protein, 9 aa, Mycobacterium tuberculosis
SEIAAGVLS

SEQ ID NO: 138975 - protein, 9 aa, Mycobacterium tuberculosis
IAAGVLSPA

SEQ ID NO: 138976 - protein, 9 aa, Mycobacterium tuberculosis
VLSPAASSL

SEQ ID NO: 138977 - protein, 9 aa, Mycobacterium tuberculosis
SLNGPISDL

SEQ ID NO: 138978 - protein, 9 aa, Mycobacterium tuberculosis
DLRRYSAAK

SEQ ID NO: 138979 - protein, 9 aa, Mycobacterium tuberculosis
RRYSAAKVP

SEQ ID NO: 138980 - protein, 9 aa, Mycobacterium tuberculosis
RYSAAKVPL

SEQ ID NO: 138981 - protein, 9 aa, Mycobacterium tuberculosis
VPLADVEQV

SEQ ID NO: 138982 - protein, 9 aa, Mycobacterium tuberculosis
PLADVEQVC

SEQ ID NO: 138983 - protein, 9 aa, Mycobacterium tuberculosis
DVTINDVAL

SEQ ID NO: 138984 - protein, 9 aa, Mycobacterium tuberculosis
VTINDVALA

SEQ ID NO: 138985 - protein, 9 aa, Mycobacterium tuberculosis
TINDVALAA

SEQ ID NO: 138986 - protein, 9 aa, Mycobacterium tuberculosis
ALAAITESY

SEQ ID NO: 138987 - protein, 9 aa, Mycobacterium tuberculosis
LAAITESYR

SEQ ID NO: 138988 - protein, 9 aa, Mycobacterium tuberculosis
AITESYRNV

SEQ ID NO: 138989 - protein, 9 aa, Mycobacterium tuberculosis
SYRNVLIQR

SEQ ID NO: 138990 - protein, 9 aa, Mycobacterium tuberculosis
NVLIQRGER

SEQ ID NO: 138991 - protein, 9 aa, Mycobacterium tuberculosis
LIQRGERPR

SEQ ID NO: 138992 - protein, 9 aa, Mycobacterium tuberculosis
IQRGERPRF

SEQ ID NO: 138993 - protein, 9 aa, Mycobacterium tuberculosis
GERPRFDSL

SEQ ID NO: 138994 - protein, 9 aa, Mycobacterium tuberculosis
RPRFDSLRT

SEQ ID NO: 138995 - protein, 9 aa, Mycobacterium tuberculosis
RFDSLRTLV

SEQ ID NO: 138996 - protein, 9 aa, Mycobacterium tuberculosis
DSLRTLVPV

SEQ ID NO: 138997 - protein, 9 aa, Mycobacterium tuberculosis
RTLVPVSTR

SEQ ID NO: 138998 - protein, 9 aa, Mycobacterium tuberculosis
TLVPVSTRS

SEQ ID NO: 138999 - protein, 9 aa, Mycobacterium tuberculosis
STRSNSALS

SEQ ID NO: 139000 - protein, 9 aa, Mycobacterium tuberculosis
TRSNSALSK

SEQ ID NO: 139001 - protein, 9 aa, Mycobacterium tuberculosis
SALSKTDNR

SEQ ID NO: 139002 - protein, 9 aa, Mycobacterium tuberculosis
ALSKTDNRV

SEQ ID NO: 139003 - protein, 9 aa, Mycobacterium tuberculosis
SKTDNRVSL

SEQ ID NO: 139004 - protein, 9 aa, Mycobacterium tuberculosis
KTDNRVSLM

SEQ ID NO: 139005 - protein, 9 aa, Mycobacterium tuberculosis
RVSLMLPNL

SEQ ID NO: 139006 - protein, 9 aa, Mycobacterium tuberculosis
SLMLPNLPV

SEQ ID NO: 139007 - protein, 9 aa, Mycobacterium tuberculosis
MLPNLPVDQ

SEQ ID NO: 139008 - protein, 9 aa, Mycobacterium tuberculosis
LPVDQENPL

SEQ ID NO: 139009 - protein, 9 aa, Mycobacterium tuberculosis
NPLQRLRIV

SEQ ID NO: 139010 - protein, 9 aa, Mycobacterium tuberculosis
QRLRIVHSR

SEQ ID NO: 139011 - protein, 9 aa, Mycobacterium tuberculosis
RLRIVHSRL

SEQ ID NO: 139012 - protein, 9 aa, Mycobacterium tuberculosis
RIVHSRLTR

SEQ ID NO: 139013 - protein, 9 aa, Mycobacterium tuberculosis
IVHSRLTRA

SEQ ID NO: 139014 - protein, 9 aa, Mycobacterium tuberculosis
GQRQFGNTL

SEQ ID NO: 139015 - protein, 9 aa, Mycobacterium tuberculosis
RQFGNTLMA

SEQ ID NO: 139016 - protein, 9 aa, Mycobacterium tuberculosis
QFGNTLMAI

SEQ ID NO: 139017 - protein, 9 aa, Mycobacterium tuberculosis
NTLMAIANR

SEQ ID NO: 139018 - protein, 9 aa, Mycobacterium tuberculosis
TLMAIANRL

SEQ ID NO: 139019 - protein, 9 aa, Mycobacterium tuberculosis
MAIANRLPF

SEQ ID NO: 139020 - protein, 9 aa, Mycobacterium tuberculosis
IANRLPFPM

SEQ ID NO: 139021 - protein, 9 aa, Mycobacterium tuberculosis
LPFPMTAWA

SEQ ID NO: 139022 - protein, 9 aa, Mycobacterium tuberculosis
FPMTAWAVG

SEQ ID NO: 139023 - protein, 9 aa, Mycobacterium tuberculosis
PMTAWAVGL

SEQ ID NO: 139024 - protein, 9 aa, Mycobacterium tuberculosis
MTAWAVGLL

SEQ ID NO: 139025 - protein, 9 aa, Mycobacterium tuberculosis
TAWAVGLLM

SEQ ID NO: 139026 - protein, 9 aa, Mycobacterium tuberculosis
WAVGLLMRL

SEQ ID NO: 139027 - protein, 9 aa, Mycobacterium tuberculosis
GLLMRLPQR

SEQ ID NO: 139028 - protein, 9 aa, Mycobacterium tuberculosis
LMRLPQRGV

SEQ ID NO: 139029 - protein, 9 aa, Mycobacterium tuberculosis
LPQRGVVTV

SEQ ID NO: 139030 - protein, 9 aa, Mycobacterium tuberculosis
GVVTVATNV

SEQ ID NO: 139031 - protein, 9 aa, Mycobacterium tuberculosis
VATNVPGPR

SEQ ID NO: 139032 - protein, 9 aa, Mycobacterium tuberculosis
ATNVPGPRR

SEQ ID NO: 139033 - protein, 9 aa, Mycobacterium tuberculosis
NVPGPRRPL

SEQ ID NO: 139034 - protein, 9 aa, Mycobacterium tuberculosis
GPRRPLQIM

SEQ ID NO: 139035 - protein, 9 aa, Mycobacterium tuberculosis
RRPLQIMGR

SEQ ID NO: 139036 - protein, 9 aa, Mycobacterium tuberculosis
RPLQIMGRR

SEQ ID NO: 139037 - protein, 9 aa, Mycobacterium tuberculosis
PLQIMGRRV

SEQ ID NO: 139038 - protein, 9 aa, Mycobacterium tuberculosis
LQIMGRRVL

SEQ ID NO: 139039 - protein, 9 aa, Mycobacterium tuberculosis
IMGRRVLDL

SEQ ID NO: 139040 - protein, 9 aa, Mycobacterium tuberculosis
RRVLDLYPV

SEQ ID NO: 139041 - protein, 9 aa, Mycobacterium tuberculosis
VLDLYPVSP

SEQ ID NO: 139042 - protein, 9 aa, Mycobacterium tuberculosis
DLYPVSPIA

SEQ ID NO: 139043 - protein, 9 aa, Mycobacterium tuberculosis
LYPVSPIAM

SEQ ID NO: 139044 - protein, 9 aa, Mycobacterium tuberculosis
YPVSPIAMQ

SEQ ID NO: 139045 - protein, 9 aa, Mycobacterium tuberculosis
PVSPIAMQL

SEQ ID NO: 139046 - protein, 9 aa, Mycobacterium tuberculosis
VSPIAMQLR

SEQ ID NO: 139047 - protein, 9 aa, Mycobacterium tuberculosis
IAMQLRTSV

SEQ ID NO: 139048 - protein, 9 aa, Mycobacterium tuberculosis
AMQLRTSVA

SEQ ID NO: 139049 - protein, 9 aa, Mycobacterium tuberculosis
MQLRTSVAM

SEQ ID NO: 139050 - protein, 9 aa, Mycobacterium tuberculosis
QLRTSVAML

SEQ ID NO: 139051 - protein, 9 aa, Mycobacterium tuberculosis
RTSVAMLSY

SEQ ID NO: 139052 - protein, 9 aa, Mycobacterium tuberculosis
TSVAMLSYA

SEQ ID NO: 139053 - protein, 9 aa, Mycobacterium tuberculosis
AMLSYADDL

SEQ ID NO: 139054 - protein, 9 aa, Mycobacterium tuberculosis
MLSYADDLY

SEQ ID NO: 139055 - protein, 9 aa, Mycobacterium tuberculosis
LSYADDLYF

SEQ ID NO: 139056 - protein, 9 aa, Mycobacterium tuberculosis
YADDLYFGI

SEQ ID NO: 139057 - protein, 9 aa, Mycobacterium tuberculosis
LYFGILADY

SEQ ID NO: 139058 - protein, 9 aa, Mycobacterium tuberculosis
FGILADYDV

SEQ ID NO: 139059 - protein, 9 aa, Mycobacterium tuberculosis
GILADYDVV

SEQ ID NO: 139060 - protein, 9 aa, Mycobacterium tuberculosis
ILADYDVVA

SEQ ID NO: 139061 - protein, 9 aa, Mycobacterium tuberculosis
DVVADAGQL

SEQ ID NO: 139062 - protein, 9 aa, Mycobacterium tuberculosis
VVADAGQLA

SEQ ID NO: 139063 - protein, 9 aa, Mycobacterium tuberculosis
QLARGIEDA

SEQ ID NO: 139064 - protein, 9 aa, Mycobacterium tuberculosis
LARGIEDAV

SEQ ID NO: 139065 - protein, 9 aa, Mycobacterium tuberculosis
GIEDAVARL

SEQ ID NO: 139066 - protein, 9 aa, Mycobacterium tuberculosis
DAVARLVAI

SEQ ID NO: 139067 - protein, 9 aa, Mycobacterium tuberculosis
VARLVAISK

SEQ ID NO: 139068 - protein, 9 aa, Mycobacterium tuberculosis
RLVAISKRR

SEQ ID NO: 139069 - protein, 9 aa, Mycobacterium tuberculosis
LVAISKRRK

SEQ ID NO: 139070 - protein, 9 aa, Mycobacterium tuberculosis
ISKRRKVTR

SEQ ID NO: 139071 - protein, 9 aa, Mycobacterium tuberculosis
KRRKVTRRR

SEQ ID NO: 139072 - protein, 9 aa, Mycobacterium tuberculosis
KVTRRRGAL

SEQ ID NO: 139073 - protein, 9 aa, Mycobacterium tuberculosis
RRRGALSLV

SEQ ID NO: 139074 - protein, 9 aa, Mycobacterium tuberculosis
RRGALSLVV

SEQ ID NO: 139075 - protein, 10 aa, Mycobacterium tuberculosis
NHLTTLDAGF

SEQ ID NO: 139076 - protein, 10 aa, Mycobacterium tuberculosis
HLTTLDAGFL

SEQ ID NO: 139077 - protein, 10 aa, Mycobacterium tuberculosis
LTTLDAGFLK

SEQ ID NO: 139078 - protein, 10 aa, Mycobacterium tuberculosis
TTLDAGFLKA

SEQ ID NO: 139079 - protein, 10 aa, Mycobacterium tuberculosis
TLDAGFLKAE

SEQ ID NO: 139080 - protein, 10 aa, Mycobacterium tuberculosis
AEDVDRHVSL

SEQ ID NO: 139081 - protein, 10 aa, Mycobacterium tuberculosis
DVDRHVSLAI

SEQ ID NO: 139082 - protein, 10 aa, Mycobacterium tuberculosis
HVSLAIGALA

SEQ ID NO: 139083 - protein, 10 aa, Mycobacterium tuberculosis
SLAIGALAVI

SEQ ID NO: 139084 - protein, 10 aa, Mycobacterium tuberculosis
EGPAPDQEAF

SEQ ID NO: 139085 - protein, 10 aa, Mycobacterium tuberculosis
EAFLSSLAQR

SEQ ID NO: 139086 - protein, 10 aa, Mycobacterium tuberculosis
AFLSSLAQRL

SEQ ID NO: 139087 - protein, 10 aa, Mycobacterium tuberculosis
FLSSLAQRLR

SEQ ID NO: 139088 - protein, 10 aa, Mycobacterium tuberculosis
SLAQRLRPCT

SEQ ID NO: 139089 - protein, 10 aa, Mycobacterium tuberculosis
LAQRLRPCTR

SEQ ID NO: 139090 - protein, 10 aa, Mycobacterium tuberculosis
AQRLRPCTRF

SEQ ID NO: 139091 - protein, 10 aa, Mycobacterium tuberculosis
RLRPCTRFGQ

SEQ ID NO: 139092 - protein, 10 aa, Mycobacterium tuberculosis
RPCTRFGQRL

SEQ ID NO: 139093 - protein, 10 aa, Mycobacterium tuberculosis
TRFGQRLRLR

SEQ ID NO: 139094 - protein, 10 aa, Mycobacterium tuberculosis
FGQRLRLRPF

SEQ ID NO: 139095 - protein, 10 aa, Mycobacterium tuberculosis
QRLRLRPFDL

SEQ ID NO: 139096 - protein, 10 aa, Mycobacterium tuberculosis
RPFDLGAPKW

SEQ ID NO: 139097 - protein, 10 aa, Mycobacterium tuberculosis
APKWVDDPDF

SEQ ID NO: 139098 - protein, 10 aa, Mycobacterium tuberculosis
KWVDDPDFDL

SEQ ID NO: 139099 - protein, 10 aa, Mycobacterium tuberculosis
DFDLGRHVWR

SEQ ID NO: 139100 - protein, 10 aa, Mycobacterium tuberculosis
DLGRHVWRIA

SEQ ID NO: 139101 - protein, 10 aa, Mycobacterium tuberculosis
LGRHVWRIAL

SEQ ID NO: 139102 - protein, 10 aa, Mycobacterium tuberculosis
RHVWRIALPR

SEQ ID NO: 139103 - protein, 10 aa, Mycobacterium tuberculosis
LPRPGNEDQL

SEQ ID NO: 139104 - protein, 10 aa, Mycobacterium tuberculosis
QLFELIADLM

SEQ ID NO: 139105 - protein, 10 aa, Mycobacterium tuberculosis
ELIADLMARR

SEQ ID NO: 139106 - protein, 10 aa, Mycobacterium tuberculosis
LIADLMARRL

SEQ ID NO: 139107 - protein, 10 aa, Mycobacterium tuberculosis
LMARRLDRGR

SEQ ID NO: 139108 - protein, 10 aa, Mycobacterium tuberculosis
RRLDRGRPLW

SEQ ID NO: 139109 - protein, 10 aa, Mycobacterium tuberculosis
RLDRGRPLWE

SEQ ID NO: 139110 - protein, 10 aa, Mycobacterium tuberculosis
PLWEVWVIEG

SEQ ID NO: 139111 - protein, 10 aa, Mycobacterium tuberculosis
WEVWVIEGLA

SEQ ID NO: 139112 - protein, 10 aa, Mycobacterium tuberculosis
WVIEGLADSK

SEQ ID NO: 139113 - protein, 10 aa, Mycobacterium tuberculosis
GLADSKWAIL

SEQ ID NO: 139114 - protein, 10 aa, Mycobacterium tuberculosis
AILTKLHHCM

SEQ ID NO: 139115 - protein, 10 aa, Mycobacterium tuberculosis
ILTKLHHCMA

SEQ ID NO: 139116 - protein, 10 aa, Mycobacterium tuberculosis
KLHHCMADGI

SEQ ID NO: 139117 - protein, 10 aa, Mycobacterium tuberculosis
CMADGIAATH

SEQ ID NO: 139118 - protein, 10 aa, Mycobacterium tuberculosis
MADGIAATHL

SEQ ID NO: 139119 - protein, 10 aa, Mycobacterium tuberculosis
IAATHLLAGL

SEQ ID NO: 139120 - protein, 10 aa, Mycobacterium tuberculosis
HLLAGLSDES

SEQ ID NO: 139121 - protein, 10 aa, Mycobacterium tuberculosis
LLAGLSDESM

SEQ ID NO: 139122 - protein, 10 aa, Mycobacterium tuberculosis
LSDESMSDSF

SEQ ID NO: 139123 - protein, 10 aa, Mycobacterium tuberculosis
SMSDSFASNI

SEQ ID NO: 139124 - protein, 10 aa, Mycobacterium tuberculosis
MSDSFASNIH

SEQ ID NO: 139125 - protein, 10 aa, Mycobacterium tuberculosis
TTMQSQSASV

SEQ ID NO: 139126 - protein, 10 aa, Mycobacterium tuberculosis
TMQSQSASVR

SEQ ID NO: 139127 - protein, 10 aa, Mycobacterium tuberculosis
MQSQSASVRR

SEQ ID NO: 139128 - protein, 10 aa, Mycobacterium tuberculosis
SASVRRGGFR

SEQ ID NO: 139129 - protein, 10 aa, Mycobacterium tuberculosis
RRGGFRVNPS

SEQ ID NO: 139130 - protein, 10 aa, Mycobacterium tuberculosis
RVNPSEALTA

SEQ ID NO: 139131 - protein, 10 aa, Mycobacterium tuberculosis
NPSEALTAST

SEQ ID NO: 139132 - protein, 10 aa, Mycobacterium tuberculosis
SEALTASTAV

SEQ ID NO: 139133 - protein, 10 aa, Mycobacterium tuberculosis
EALTASTAVM

SEQ ID NO: 139134 - protein, 10 aa, Mycobacterium tuberculosis
ALTASTAVMA

SEQ ID NO: 139135 - protein, 10 aa, Mycobacterium tuberculosis
TASTAVMAGI

SEQ ID NO: 139136 - protein, 10 aa, Mycobacterium tuberculosis
STAVMAGIVR

SEQ ID NO: 139137 - protein, 10 aa, Mycobacterium tuberculosis
AVMAGIVRAA

SEQ ID NO: 139138 - protein, 10 aa, Mycobacterium tuberculosis
VMAGIVRAAK

SEQ ID NO: 139139 - protein, 10 aa, Mycobacterium tuberculosis
EIAAGVLSPA

SEQ ID NO: 139140 - protein, 10 aa, Mycobacterium tuberculosis
IAAGVLSPAA

SEQ ID NO: 139141 - protein, 10 aa, Mycobacterium tuberculosis
GVLSPAASSL

SEQ ID NO: 139142 - protein, 10 aa, Mycobacterium tuberculosis
SLNGPISDLR

SEQ ID NO: 139143 - protein, 10 aa, Mycobacterium tuberculosis
PISDLRRYSA

SEQ ID NO: 139144 - protein, 10 aa, Mycobacterium tuberculosis
DLRRYSAAKV

SEQ ID NO: 139145 - protein, 10 aa, Mycobacterium tuberculosis
RRYSAAKVPL

SEQ ID NO: 139146 - protein, 10 aa, Mycobacterium tuberculosis
SAAKVPLADV

SEQ ID NO: 139147 - protein, 10 aa, Mycobacterium tuberculosis
KVPLADVEQV

SEQ ID NO: 139148 - protein, 10 aa, Mycobacterium tuberculosis
FDVTINDVAL

SEQ ID NO: 139149 - protein, 10 aa, Mycobacterium tuberculosis
VTINDVALAA

SEQ ID NO: 139150 - protein, 10 aa, Mycobacterium tuberculosis
TINDVALAAI

SEQ ID NO: 139151 - protein, 10 aa, Mycobacterium tuberculosis
VALAAITESY

SEQ ID NO: 139152 - protein, 10 aa, Mycobacterium tuberculosis
ALAAITESYR

SEQ ID NO: 139153 - protein, 10 aa, Mycobacterium tuberculosis
AITESYRNVL

SEQ ID NO: 139154 - protein, 10 aa, Mycobacterium tuberculosis
ESYRNVLIQR

SEQ ID NO: 139155 - protein, 10 aa, Mycobacterium tuberculosis
RNVLIQRGER

SEQ ID NO: 139156 - protein, 10 aa, Mycobacterium tuberculosis
RPRFDSLRTL

SEQ ID NO: 139157 - protein, 10 aa, Mycobacterium tuberculosis
SLRTLVPVST

SEQ ID NO: 139158 - protein, 10 aa, Mycobacterium tuberculosis
VPVSTRSNSA

SEQ ID NO: 139159 - protein, 10 aa, Mycobacterium tuberculosis
STRSNSALSK

SEQ ID NO: 139160 - protein, 10 aa, Mycobacterium tuberculosis
NSALSKTDNR

SEQ ID NO: 139161 - protein, 10 aa, Mycobacterium tuberculosis
SALSKTDNRV

SEQ ID NO: 139162 - protein, 10 aa, Mycobacterium tuberculosis
KTDNRVSLML

SEQ ID NO: 139163 - protein, 10 aa, Mycobacterium tuberculosis
LMLPNLPVDQ

SEQ ID NO: 139164 - protein, 10 aa, Mycobacterium tuberculosis
NLPVDQENPL

SEQ ID NO: 139165 - protein, 10 aa, Mycobacterium tuberculosis
LPVDQENPLQ

SEQ ID NO: 139166 - protein, 10 aa, Mycobacterium tuberculosis
NPLQRLRIVH

SEQ ID NO: 139167 - protein, 10 aa, Mycobacterium tuberculosis
LQRLRIVHSR

SEQ ID NO: 139168 - protein, 10 aa, Mycobacterium tuberculosis
QRLRIVHSRL

SEQ ID NO: 139169 - protein, 10 aa, Mycobacterium tuberculosis
RLRIVHSRLT

SEQ ID NO: 139170 - protein, 10 aa, Mycobacterium tuberculosis
LRIVHSRLTR

SEQ ID NO: 139171 - protein, 10 aa, Mycobacterium tuberculosis
RIVHSRLTRA

SEQ ID NO: 139172 - protein, 10 aa, Mycobacterium tuberculosis
IVHSRLTRAK

SEQ ID NO: 139173 - protein, 10 aa, Mycobacterium tuberculosis
LTRAKAGGQR

SEQ ID NO: 139174 - protein, 10 aa, Mycobacterium tuberculosis
RAKAGGQRQF

SEQ ID NO: 139175 - protein, 10 aa, Mycobacterium tuberculosis
GQRQFGNTLM

SEQ ID NO: 139176 - protein, 10 aa, Mycobacterium tuberculosis
RQFGNTLMAI

SEQ ID NO: 139177 - protein, 10 aa, Mycobacterium tuberculosis
NTLMAIANRL

SEQ ID NO: 139178 - protein, 10 aa, Mycobacterium tuberculosis
LMAIANRLPF

SEQ ID NO: 139179 - protein, 10 aa, Mycobacterium tuberculosis
AIANRLPFPM

SEQ ID NO: 139180 - protein, 10 aa, Mycobacterium tuberculosis
RLPFPMTAWA

SEQ ID NO: 139181 - protein, 10 aa, Mycobacterium tuberculosis
LPFPMTAWAV

SEQ ID NO: 139182 - protein, 10 aa, Mycobacterium tuberculosis
FPMTAWAVGL

SEQ ID NO: 139183 - protein, 10 aa, Mycobacterium tuberculosis
PMTAWAVGLL

SEQ ID NO: 139184 - protein, 10 aa, Mycobacterium tuberculosis
MTAWAVGLLM

SEQ ID NO: 139185 - protein, 10 aa, Mycobacterium tuberculosis
TAWAVGLLMR

SEQ ID NO: 139186 - protein, 10 aa, Mycobacterium tuberculosis
LLMRLPQRGV

SEQ ID NO: 139187 - protein, 10 aa, Mycobacterium tuberculosis
LMRLPQRGVV

SEQ ID NO: 139188 - protein, 10 aa, Mycobacterium tuberculosis
RLPQRGVVTV

SEQ ID NO: 139189 - protein, 10 aa, Mycobacterium tuberculosis
LPQRGVVTVA

SEQ ID NO: 139190 - protein, 10 aa, Mycobacterium tuberculosis
TVATNVPGPR

SEQ ID NO: 139191 - protein, 10 aa, Mycobacterium tuberculosis
VATNVPGPRR

SEQ ID NO: 139192 - protein, 10 aa, Mycobacterium tuberculosis
VPGPRRPLQI

SEQ ID NO: 139193 - protein, 10 aa, Mycobacterium tuberculosis
RRPLQIMGRR

SEQ ID NO: 139194 - protein, 10 aa, Mycobacterium tuberculosis
RPLQIMGRRV

SEQ ID NO: 139195 - protein, 10 aa, Mycobacterium tuberculosis
RRVLDLYPVS

SEQ ID NO: 139196 - protein, 10 aa, Mycobacterium tuberculosis
VLDLYPVSPI

SEQ ID NO: 139197 - protein, 10 aa, Mycobacterium tuberculosis
DLYPVSPIAM

SEQ ID NO: 139198 - protein, 10 aa, Mycobacterium tuberculosis
YPVSPIAMQL

SEQ ID NO: 139199 - protein, 10 aa, Mycobacterium tuberculosis
PVSPIAMQLR

SEQ ID NO: 139200 - protein, 10 aa, Mycobacterium tuberculosis
PIAMQLRTSV

SEQ ID NO: 139201 - protein, 10 aa, Mycobacterium tuberculosis
AMQLRTSVAM

SEQ ID NO: 139202 - protein, 10 aa, Mycobacterium tuberculosis
MQLRTSVAML

SEQ ID NO: 139203 - protein, 10 aa, Mycobacterium tuberculosis
LRTSVAMLSY

SEQ ID NO: 139204 - protein, 10 aa, Mycobacterium tuberculosis
RTSVAMLSYA

SEQ ID NO: 139205 - protein, 10 aa, Mycobacterium tuberculosis
AMLSYADDLY

SEQ ID NO: 139206 - protein, 10 aa, Mycobacterium tuberculosis
MLSYADDLYF

SEQ ID NO: 139207 - protein, 10 aa, Mycobacterium tuberculosis
SYADDLYFGI

SEQ ID NO: 139208 - protein, 10 aa, Mycobacterium tuberculosis
YADDLYFGIL

SEQ ID NO: 139209 - protein, 10 aa, Mycobacterium tuberculosis
DLYFGILADY

SEQ ID NO: 139210 - protein, 10 aa, Mycobacterium tuberculosis
FGILADYDVV

SEQ ID NO: 139211 - protein, 10 aa, Mycobacterium tuberculosis
GILADYDVVA

SEQ ID NO: 139212 - protein, 10 aa, Mycobacterium tuberculosis
ILADYDVVAD

SEQ ID NO: 139213 - protein, 10 aa, Mycobacterium tuberculosis
VVADAGQLAR

SEQ ID NO: 139214 - protein, 10 aa, Mycobacterium tuberculosis
GQLARGIEDA

SEQ ID NO: 139215 - protein, 10 aa, Mycobacterium tuberculosis
QLARGIEDAV

SEQ ID NO: 139216 - protein, 10 aa, Mycobacterium tuberculosis
GIEDAVARLV

SEQ ID NO: 139217 - protein, 10 aa, Mycobacterium tuberculosis
AVARLVAISK

SEQ ID NO: 139218 - protein, 10 aa, Mycobacterium tuberculosis
VARLVAISKR

SEQ ID NO: 139219 - protein, 10 aa, Mycobacterium tuberculosis
RLVAISKRRK

SEQ ID NO: 139220 - protein, 10 aa, Mycobacterium tuberculosis
AISKRRKVTR

SEQ ID NO: 139221 - protein, 10 aa, Mycobacterium tuberculosis
ISKRRKVTRR

SEQ ID NO: 139222 - protein, 10 aa, Mycobacterium tuberculosis
SKRRKVTRRR

SEQ ID NO: 139223 - protein, 10 aa, Mycobacterium tuberculosis
RKVTRRRGAL

SEQ ID NO: 139224 - protein, 10 aa, Mycobacterium tuberculosis
VTRRRGALSL

SEQ ID NO: 139225 - protein, 10 aa, Mycobacterium tuberculosis
RRRGALSLVV

SEQ ID NO: 139226 - protein, 11 aa, Mycobacterium tuberculosis
HLTTLDAGFLK

SEQ ID NO: 139227 - protein, 11 aa, Mycobacterium tuberculosis
TLDAGFLKAED

SEQ ID NO: 139228 - protein, 11 aa, Mycobacterium tuberculosis
FLKAEDVDRHV

SEQ ID NO: 139229 - protein, 11 aa, Mycobacterium tuberculosis
HVSLAIGALAV

SEQ ID NO: 139230 - protein, 11 aa, Mycobacterium tuberculosis
IEGPAPDQEAF

SEQ ID NO: 139231 - protein, 11 aa, Mycobacterium tuberculosis
EGPAPDQEAFL

SEQ ID NO: 139232 - protein, 11 aa, Mycobacterium tuberculosis
APDQEAFLSSL

SEQ ID NO: 139233 - protein, 11 aa, Mycobacterium tuberculosis
QEAFLSSLAQR

SEQ ID NO: 139234 - protein, 11 aa, Mycobacterium tuberculosis
EAFLSSLAQRL

SEQ ID NO: 139235 - protein, 11 aa, Mycobacterium tuberculosis
AFLSSLAQRLR

SEQ ID NO: 139236 - protein, 11 aa, Mycobacterium tuberculosis
SLAQRLRPCTR

SEQ ID NO: 139237 - protein, 11 aa, Mycobacterium tuberculosis
RLRPCTRFGQR

SEQ ID NO: 139238 - protein, 11 aa, Mycobacterium tuberculosis
RPCTRFGQRLR

SEQ ID NO: 139239 - protein, 11 aa, Mycobacterium tuberculosis
CTRFGQRLRLR

SEQ ID NO: 139240 - protein, 11 aa, Mycobacterium tuberculosis
RFGQRLRLRPF

SEQ ID NO: 139241 - protein, 11 aa, Mycobacterium tuberculosis
RLRLRPFDLGA

SEQ ID NO: 139242 - protein, 11 aa, Mycobacterium tuberculosis
RLRPFDLGAPK

SEQ ID NO: 139243 - protein, 11 aa, Mycobacterium tuberculosis
RPFDLGAPKWV

SEQ ID NO: 139244 - protein, 11 aa, Mycobacterium tuberculosis
WVDDPDFDLGR

SEQ ID NO: 139245 - protein, 11 aa, Mycobacterium tuberculosis
DPDFDLGRHVW

SEQ ID NO: 139246 - protein, 11 aa, Mycobacterium tuberculosis
DLGRHVWRIAL

SEQ ID NO: 139247 - protein, 11 aa, Mycobacterium tuberculosis
GRHVWRIALPR

SEQ ID NO: 139248 - protein, 11 aa, Mycobacterium tuberculosis
ALPRPGNEDQL

SEQ ID NO: 139249 - protein, 11 aa, Mycobacterium tuberculosis
LPRPGNEDQLF

SEQ ID NO: 139250 - protein, 11 aa, Mycobacterium tuberculosis
RPGNEDQLFEL

SEQ ID NO: 139251 - protein, 11 aa, Mycobacterium tuberculosis
QLFELIADLMA

SEQ ID NO: 139252 - protein, 11 aa, Mycobacterium tuberculosis
LFELIADLMAR

SEQ ID NO: 139253 - protein, 11 aa, Mycobacterium tuberculosis
ELIADLMARRL

SEQ ID NO: 139254 - protein, 11 aa, Mycobacterium tuberculosis
DLMARRLDRGR

SEQ ID NO: 139255 - protein, 11 aa, Mycobacterium tuberculosis
MARRLDRGRPL

SEQ ID NO: 139256 - protein, 11 aa, Mycobacterium tuberculosis
RRLDRGRPLWE

SEQ ID NO: 139257 - protein, 11 aa, Mycobacterium tuberculosis
RLDRGRPLWEV

SEQ ID NO: 139258 - protein, 11 aa, Mycobacterium tuberculosis
RGRPLWEVWVI

SEQ ID NO: 139259 - protein, 11 aa, Mycobacterium tuberculosis
PLWEVWVIEGL

SEQ ID NO: 139260 - protein, 11 aa, Mycobacterium tuberculosis
WEVWVIEGLAD

SEQ ID NO: 139261 - protein, 11 aa, Mycobacterium tuberculosis
WVIEGLADSKW

SEQ ID NO: 139262 - protein, 11 aa, Mycobacterium tuberculosis
GLADSKWAILT

SEQ ID NO: 139263 - protein, 11 aa, Mycobacterium tuberculosis
LADSKWAILTK

SEQ ID NO: 139264 - protein, 11 aa, Mycobacterium tuberculosis
WAILTKLHHCM

SEQ ID NO: 139265 - protein, 11 aa, Mycobacterium tuberculosis
AILTKLHHCMA

SEQ ID NO: 139266 - protein, 11 aa, Mycobacterium tuberculosis
KLHHCMADGIA

SEQ ID NO: 139267 - protein, 11 aa, Mycobacterium tuberculosis
CMADGIAATHL

SEQ ID NO: 139268 - protein, 11 aa, Mycobacterium tuberculosis
MADGIAATHLL

SEQ ID NO: 139269 - protein, 11 aa, Mycobacterium tuberculosis
GIAATHLLAGL

SEQ ID NO: 139270 - protein, 11 aa, Mycobacterium tuberculosis
HLLAGLSDESM

SEQ ID NO: 139271 - protein, 11 aa, Mycobacterium tuberculosis
LLAGLSDESMS

SEQ ID NO: 139272 - protein, 11 aa, Mycobacterium tuberculosis
GLSDESMSDSF

SEQ ID NO: 139273 - protein, 11 aa, Mycobacterium tuberculosis
ESMSDSFASNI

SEQ ID NO: 139274 - protein, 11 aa, Mycobacterium tuberculosis
NIHTTMQSQSA

SEQ ID NO: 139275 - protein, 11 aa, Mycobacterium tuberculosis
HTTMQSQSASV

SEQ ID NO: 139276 - protein, 11 aa, Mycobacterium tuberculosis
TTMQSQSASVR

SEQ ID NO: 139277 - protein, 11 aa, Mycobacterium tuberculosis
TMQSQSASVRR

SEQ ID NO: 139278 - protein, 11 aa, Mycobacterium tuberculosis
SQSASVRRGGF

SEQ ID NO: 139279 - protein, 11 aa, Mycobacterium tuberculosis
QSASVRRGGFR

SEQ ID NO: 139280 - protein, 11 aa, Mycobacterium tuberculosis
SASVRRGGFRV

SEQ ID NO: 139281 - protein, 11 aa, Mycobacterium tuberculosis
RRGGFRVNPSE

SEQ ID NO: 139282 - protein, 11 aa, Mycobacterium tuberculosis
NPSEALTASTA

SEQ ID NO: 139283 - protein, 11 aa, Mycobacterium tuberculosis
EALTASTAVMA

SEQ ID NO: 139284 - protein, 11 aa, Mycobacterium tuberculosis
LTASTAVMAGI

SEQ ID NO: 139285 - protein, 11 aa, Mycobacterium tuberculosis
TASTAVMAGIV

SEQ ID NO: 139286 - protein, 11 aa, Mycobacterium tuberculosis
ASTAVMAGIVR

SEQ ID NO: 139287 - protein, 11 aa, Mycobacterium tuberculosis
STAVMAGIVRA

SEQ ID NO: 139288 - protein, 11 aa, Mycobacterium tuberculosis
AVMAGIVRAAK

SEQ ID NO: 139289 - protein, 11 aa, Mycobacterium tuberculosis
IVRAAKGASEI

SEQ ID NO: 139290 - protein, 11 aa, Mycobacterium tuberculosis
SEIAAGVLSPA

SEQ ID NO: 139291 - protein, 11 aa, Mycobacterium tuberculosis
EIAAGVLSPAA

SEQ ID NO: 139292 - protein, 11 aa, Mycobacterium tuberculosis
SPAASSLNGPI

SEQ ID NO: 139293 - protein, 11 aa, Mycobacterium tuberculosis
SSLNGPISDLR

SEQ ID NO: 139294 - protein, 11 aa, Mycobacterium tuberculosis
SLNGPISDLRR

SEQ ID NO: 139295 - protein, 11 aa, Mycobacterium tuberculosis
GPISDLRRYSA

SEQ ID NO: 139296 - protein, 11 aa, Mycobacterium tuberculosis
ISDLRRYSAAK

SEQ ID NO: 139297 - protein, 11 aa, Mycobacterium tuberculosis
RRYSAAKVPLA

SEQ ID NO: 139298 - protein, 11 aa, Mycobacterium tuberculosis
YSAAKVPLADV

SEQ ID NO: 139299 - protein, 11 aa, Mycobacterium tuberculosis
PLADVEQVCRK

SEQ ID NO: 139300 - protein, 11 aa, Mycobacterium tuberculosis
VTINDVALAAI

SEQ ID NO: 139301 - protein, 11 aa, Mycobacterium tuberculosis
DVALAAITESY

SEQ ID NO: 139302 - protein, 11 aa, Mycobacterium tuberculosis
VALAAITESYR

SEQ ID NO: 139303 - protein, 11 aa, Mycobacterium tuberculosis
AITESYRNVLI

SEQ ID NO: 139304 - protein, 11 aa, Mycobacterium tuberculosis
TESYRNVLIQR

SEQ ID NO: 139305 - protein, 11 aa, Mycobacterium tuberculosis
NVLIQRGERPR

SEQ ID NO: 139306 - protein, 11 aa, Mycobacterium tuberculosis
VLIQRGERPRF

SEQ ID NO: 139307 - protein, 11 aa, Mycobacterium tuberculosis
RGERPRFDSLR

SEQ ID NO: 139308 - protein, 11 aa, Mycobacterium tuberculosis
RPRFDSLRTLV

SEQ ID NO: 139309 - protein, 11 aa, Mycobacterium tuberculosis
RFDSLRTLVPV

SEQ ID NO: 139310 - protein, 11 aa, Mycobacterium tuberculosis
SLRTLVPVSTR

SEQ ID NO: 139311 - protein, 11 aa, Mycobacterium tuberculosis
VPVSTRSNSAL

SEQ ID NO: 139312 - protein, 11 aa, Mycobacterium tuberculosis
VSTRSNSALSK

SEQ ID NO: 139313 - protein, 11 aa, Mycobacterium tuberculosis
NSALSKTDNRV

SEQ ID NO: 139314 - protein, 11 aa, Mycobacterium tuberculosis
ALSKTDNRVSL

SEQ ID NO: 139315 - protein, 11 aa, Mycobacterium tuberculosis
SKTDNRVSLML

SEQ ID NO: 139316 - protein, 11 aa, Mycobacterium tuberculosis
RVSLMLPNLPV

SEQ ID NO: 139317 - protein, 11 aa, Mycobacterium tuberculosis
PVDQENPLQRL

SEQ ID NO: 139318 - protein, 11 aa, Mycobacterium tuberculosis
QENPLQRLRIV

SEQ ID NO: 139319 - protein, 11 aa, Mycobacterium tuberculosis
PLQRLRIVHSR

SEQ ID NO: 139320 - protein, 11 aa, Mycobacterium tuberculosis
LQRLRIVHSRL

SEQ ID NO: 139321 - protein, 11 aa, Mycobacterium tuberculosis
RLRIVHSRLTR

SEQ ID NO: 139322 - protein, 11 aa, Mycobacterium tuberculosis
RIVHSRLTRAK

SEQ ID NO: 139323 - protein, 11 aa, Mycobacterium tuberculosis
IVHSRLTRAKA

SEQ ID NO: 139324 - protein, 11 aa, Mycobacterium tuberculosis
RLTRAKAGGQR

SEQ ID NO: 139325 - protein, 11 aa, Mycobacterium tuberculosis
RQFGNTLMAIA

SEQ ID NO: 139326 - protein, 11 aa, Mycobacterium tuberculosis
FGNTLMAIANR

SEQ ID NO: 139327 - protein, 11 aa, Mycobacterium tuberculosis
TLMAIANRLPF

SEQ ID NO: 139328 - protein, 11 aa, Mycobacterium tuberculosis
MAIANRLPFPM

SEQ ID NO: 139329 - protein, 11 aa, Mycobacterium tuberculosis
RLPFPMTAWAV

SEQ ID NO: 139330 - protein, 11 aa, Mycobacterium tuberculosis
LPFPMTAWAVG

SEQ ID NO: 139331 - protein, 11 aa, Mycobacterium tuberculosis
PFPMTAWAVGL

SEQ ID NO: 139332 - protein, 11 aa, Mycobacterium tuberculosis
FPMTAWAVGLL

SEQ ID NO: 139333 - protein, 11 aa, Mycobacterium tuberculosis
PMTAWAVGLLM

SEQ ID NO: 139334 - protein, 11 aa, Mycobacterium tuberculosis
MTAWAVGLLMR

SEQ ID NO: 139335 - protein, 11 aa, Mycobacterium tuberculosis
TAWAVGLLMRL

SEQ ID NO: 139336 - protein, 11 aa, Mycobacterium tuberculosis
AVGLLMRLPQR

SEQ ID NO: 139337 - protein, 11 aa, Mycobacterium tuberculosis
GLLMRLPQRGV

SEQ ID NO: 139338 - protein, 11 aa, Mycobacterium tuberculosis
LLMRLPQRGVV

SEQ ID NO: 139339 - protein, 11 aa, Mycobacterium tuberculosis
MRLPQRGVVTV

SEQ ID NO: 139340 - protein, 11 aa, Mycobacterium tuberculosis
RLPQRGVVTVA

SEQ ID NO: 139341 - protein, 11 aa, Mycobacterium tuberculosis
LPQRGVVTVAT

SEQ ID NO: 139342 - protein, 11 aa, Mycobacterium tuberculosis
VTVATNVPGPR

SEQ ID NO: 139343 - protein, 11 aa, Mycobacterium tuberculosis
TVATNVPGPRR

SEQ ID NO: 139344 - protein, 11 aa, Mycobacterium tuberculosis
VPGPRRPLQIM

SEQ ID NO: 139345 - protein, 11 aa, Mycobacterium tuberculosis
RPLQIMGRRVL

SEQ ID NO: 139346 - protein, 11 aa, Mycobacterium tuberculosis
LQIMGRRVLDL

SEQ ID NO: 139347 - protein, 11 aa, Mycobacterium tuberculosis
QIMGRRVLDLY

SEQ ID NO: 139348 - protein, 11 aa, Mycobacterium tuberculosis
MGRRVLDLYPV

SEQ ID NO: 139349 - protein, 11 aa, Mycobacterium tuberculosis
RRVLDLYPVSP

SEQ ID NO: 139350 - protein, 11 aa, Mycobacterium tuberculosis
RVLDLYPVSPI

SEQ ID NO: 139351 - protein, 11 aa, Mycobacterium tuberculosis
VLDLYPVSPIA

SEQ ID NO: 139352 - protein, 11 aa, Mycobacterium tuberculosis
DLYPVSPIAMQ

SEQ ID NO: 139353 - protein, 11 aa, Mycobacterium tuberculosis
LYPVSPIAMQL

SEQ ID NO: 139354 - protein, 11 aa, Mycobacterium tuberculosis
YPVSPIAMQLR

SEQ ID NO: 139355 - protein, 11 aa, Mycobacterium tuberculosis
SPIAMQLRTSV

SEQ ID NO: 139356 - protein, 11 aa, Mycobacterium tuberculosis
IAMQLRTSVAM

SEQ ID NO: 139357 - protein, 11 aa, Mycobacterium tuberculosis
AMQLRTSVAML

SEQ ID NO: 139358 - protein, 11 aa, Mycobacterium tuberculosis
MQLRTSVAMLS

SEQ ID NO: 139359 - protein, 11 aa, Mycobacterium tuberculosis
QLRTSVAMLSY

SEQ ID NO: 139360 - protein, 11 aa, Mycobacterium tuberculosis
SVAMLSYADDL

SEQ ID NO: 139361 - protein, 11 aa, Mycobacterium tuberculosis
VAMLSYADDLY

SEQ ID NO: 139362 - protein, 11 aa, Mycobacterium tuberculosis
AMLSYADDLYF

SEQ ID NO: 139363 - protein, 11 aa, Mycobacterium tuberculosis
MLSYADDLYFG

SEQ ID NO: 139364 - protein, 11 aa, Mycobacterium tuberculosis
LSYADDLYFGI

SEQ ID NO: 139365 - protein, 11 aa, Mycobacterium tuberculosis
SYADDLYFGIL

SEQ ID NO: 139366 - protein, 11 aa, Mycobacterium tuberculosis
YADDLYFGILA

SEQ ID NO: 139367 - protein, 11 aa, Mycobacterium tuberculosis
LYFGILADYDV

SEQ ID NO: 139368 - protein, 11 aa, Mycobacterium tuberculosis
ILADYDVVADA

SEQ ID NO: 139369 - protein, 11 aa, Mycobacterium tuberculosis
DYDVVADAGQL

SEQ ID NO: 139370 - protein, 11 aa, Mycobacterium tuberculosis
DVVADAGQLAR

SEQ ID NO: 139371 - protein, 11 aa, Mycobacterium tuberculosis
GQLARGIEDAV

SEQ ID NO: 139372 - protein, 11 aa, Mycobacterium tuberculosis
QLARGIEDAVA

SEQ ID NO: 139373 - protein, 11 aa, Mycobacterium tuberculosis
LARGIEDAVAR

SEQ ID NO: 139374 - protein, 11 aa, Mycobacterium tuberculosis
DAVARLVAISK

SEQ ID NO: 139375 - protein, 11 aa, Mycobacterium tuberculosis
AVARLVAISKR

SEQ ID NO: 139376 - protein, 11 aa, Mycobacterium tuberculosis
VARLVAISKRR

SEQ ID NO: 139377 - protein, 11 aa, Mycobacterium tuberculosis
ARLVAISKRRK

SEQ ID NO: 139378 - protein, 11 aa, Mycobacterium tuberculosis
RLVAISKRRKV

SEQ ID NO: 139379 - protein, 11 aa, Mycobacterium tuberculosis
VAISKRRKVTR

SEQ ID NO: 139380 - protein, 11 aa, Mycobacterium tuberculosis
AISKRRKVTRR

SEQ ID NO: 139381 - protein, 11 aa, Mycobacterium tuberculosis
ISKRRKVTRRR

SEQ ID NO: 139382 - protein, 11 aa, Mycobacterium tuberculosis
RRKVTRRRGAL

SEQ ID NO: 139383 - protein, 11 aa, Mycobacterium tuberculosis
KVTRRRGALSL

SEQ ID NO: 139384 - protein, 11 aa, Mycobacterium tuberculosis
VTRRRGALSLV

SEQ ID NO: 139385 - protein, 13 aa, Mycobacterium tuberculosis
MNHLTTLDAGFLK

SEQ ID NO: 139386 - protein, 13 aa, Mycobacterium tuberculosis
NHLTTLDAGFLKA

SEQ ID NO: 139387 - protein, 13 aa, Mycobacterium tuberculosis
HLTTLDAGFLKAE

SEQ ID NO: 139388 - protein, 13 aa, Mycobacterium tuberculosis
LTTLDAGFLKAED

SEQ ID NO: 139389 - protein, 13 aa, Mycobacterium tuberculosis
TTLDAGFLKAEDV

SEQ ID NO: 139390 - protein, 13 aa, Mycobacterium tuberculosis
TLDAGFLKAEDVD

SEQ ID NO: 139391 - protein, 13 aa, Mycobacterium tuberculosis
LDAGFLKAEDVDR

SEQ ID NO: 139392 - protein, 13 aa, Mycobacterium tuberculosis
DAGFLKAEDVDRH

SEQ ID NO: 139393 - protein, 13 aa, Mycobacterium tuberculosis
AGFLKAEDVDRHV

SEQ ID NO: 139394 - protein, 13 aa, Mycobacterium tuberculosis
GFLKAEDVDRHVS

SEQ ID NO: 139395 - protein, 13 aa, Mycobacterium tuberculosis
FLKAEDVDRHVSL

SEQ ID NO: 139396 - protein, 13 aa, Mycobacterium tuberculosis
LKAEDVDRHVSLA

SEQ ID NO: 139397 - protein, 13 aa, Mycobacterium tuberculosis
KAEDVDRHVSLAI

SEQ ID NO: 139398 - protein, 13 aa, Mycobacterium tuberculosis
AEDVDRHVSLAIG

SEQ ID NO: 139399 - protein, 13 aa, Mycobacterium tuberculosis
EDVDRHVSLAIGA

SEQ ID NO: 139400 - protein, 13 aa, Mycobacterium tuberculosis
DVDRHVSLAIGAL

SEQ ID NO: 139401 - protein, 13 aa, Mycobacterium tuberculosis
VDRHVSLAIGALA

SEQ ID NO: 139402 - protein, 13 aa, Mycobacterium tuberculosis
DRHVSLAIGALAV

SEQ ID NO: 139403 - protein, 13 aa, Mycobacterium tuberculosis
RHVSLAIGALAVI

SEQ ID NO: 139404 - protein, 13 aa, Mycobacterium tuberculosis
HVSLAIGALAVIE

SEQ ID NO: 139405 - protein, 13 aa, Mycobacterium tuberculosis
VSLAIGALAVIEG

SEQ ID NO: 139406 - protein, 13 aa, Mycobacterium tuberculosis
SLAIGALAVIEGP

SEQ ID NO: 139407 - protein, 13 aa, Mycobacterium tuberculosis
LAIGALAVIEGPA

SEQ ID NO: 139408 - protein, 13 aa, Mycobacterium tuberculosis
AIGALAVIEGPAP

SEQ ID NO: 139409 - protein, 13 aa, Mycobacterium tuberculosis
IGALAVIEGPAPD

SEQ ID NO: 139410 - protein, 13 aa, Mycobacterium tuberculosis
GALAVIEGPAPDQ

SEQ ID NO: 139411 - protein, 13 aa, Mycobacterium tuberculosis
ALAVIEGPAPDQE

SEQ ID NO: 139412 - protein, 13 aa, Mycobacterium tuberculosis
LAVIEGPAPDQEA

SEQ ID NO: 139413 - protein, 13 aa, Mycobacterium tuberculosis
AVIEGPAPDQEAF

SEQ ID NO: 139414 - protein, 13 aa, Mycobacterium tuberculosis
VIEGPAPDQEAFL

SEQ ID NO: 139415 - protein, 13 aa, Mycobacterium tuberculosis
IEGPAPDQEAFLS

SEQ ID NO: 139416 - protein, 13 aa, Mycobacterium tuberculosis
EGPAPDQEAFLSS

SEQ ID NO: 139417 - protein, 13 aa, Mycobacterium tuberculosis
GPAPDQEAFLSSL

SEQ ID NO: 139418 - protein, 13 aa, Mycobacterium tuberculosis
PAPDQEAFLSSLA

SEQ ID NO: 139419 - protein, 13 aa, Mycobacterium tuberculosis
APDQEAFLSSLAQ

SEQ ID NO: 139420 - protein, 13 aa, Mycobacterium tuberculosis
PDQEAFLSSLAQR

SEQ ID NO: 139421 - protein, 13 aa, Mycobacterium tuberculosis
DQEAFLSSLAQRL

SEQ ID NO: 139422 - protein, 13 aa, Mycobacterium tuberculosis
QEAFLSSLAQRLR

SEQ ID NO: 139423 - protein, 13 aa, Mycobacterium tuberculosis
EAFLSSLAQRLRP

SEQ ID NO: 139424 - protein, 13 aa, Mycobacterium tuberculosis
AFLSSLAQRLRPC

SEQ ID NO: 139425 - protein, 13 aa, Mycobacterium tuberculosis
FLSSLAQRLRPCT

SEQ ID NO: 139426 - protein, 13 aa, Mycobacterium tuberculosis
LSSLAQRLRPCTR

SEQ ID NO: 139427 - protein, 13 aa, Mycobacterium tuberculosis
SSLAQRLRPCTRF

SEQ ID NO: 139428 - protein, 13 aa, Mycobacterium tuberculosis
SLAQRLRPCTRFG

SEQ ID NO: 139429 - protein, 13 aa, Mycobacterium tuberculosis
LAQRLRPCTRFGQ

SEQ ID NO: 139430 - protein, 13 aa, Mycobacterium tuberculosis
AQRLRPCTRFGQR

SEQ ID NO: 139431 - protein, 13 aa, Mycobacterium tuberculosis
QRLRPCTRFGQRL

SEQ ID NO: 139432 - protein, 13 aa, Mycobacterium tuberculosis
RLRPCTRFGQRLR

SEQ ID NO: 139433 - protein, 13 aa, Mycobacterium tuberculosis
LRPCTRFGQRLRL

SEQ ID NO: 139434 - protein, 13 aa, Mycobacterium tuberculosis
RPCTRFGQRLRLR

SEQ ID NO: 139435 - protein, 13 aa, Mycobacterium tuberculosis
PCTRFGQRLRLRP

SEQ ID NO: 139436 - protein, 13 aa, Mycobacterium tuberculosis
CTRFGQRLRLRPF

SEQ ID NO: 139437 - protein, 13 aa, Mycobacterium tuberculosis
TRFGQRLRLRPFD

SEQ ID NO: 139438 - protein, 13 aa, Mycobacterium tuberculosis
RFGQRLRLRPFDL

SEQ ID NO: 139439 - protein, 13 aa, Mycobacterium tuberculosis
FGQRLRLRPFDLG

SEQ ID NO: 139440 - protein, 13 aa, Mycobacterium tuberculosis
GQRLRLRPFDLGA

SEQ ID NO: 139441 - protein, 13 aa, Mycobacterium tuberculosis
QRLRLRPFDLGAP

SEQ ID NO: 139442 - protein, 13 aa, Mycobacterium tuberculosis
RLRLRPFDLGAPK

SEQ ID NO: 139443 - protein, 13 aa, Mycobacterium tuberculosis
LRLRPFDLGAPKW

SEQ ID NO: 139444 - protein, 13 aa, Mycobacterium tuberculosis
RLRPFDLGAPKWV

SEQ ID NO: 139445 - protein, 13 aa, Mycobacterium tuberculosis
LRPFDLGAPKWVD

SEQ ID NO: 139446 - protein, 13 aa, Mycobacterium tuberculosis
RPFDLGAPKWVDD

SEQ ID NO: 139447 - protein, 13 aa, Mycobacterium tuberculosis
PFDLGAPKWVDDP

SEQ ID NO: 139448 - protein, 13 aa, Mycobacterium tuberculosis
FDLGAPKWVDDPD

SEQ ID NO: 139449 - protein, 13 aa, Mycobacterium tuberculosis
DLGAPKWVDDPDF

SEQ ID NO: 139450 - protein, 13 aa, Mycobacterium tuberculosis
LGAPKWVDDPDFD

SEQ ID NO: 139451 - protein, 13 aa, Mycobacterium tuberculosis
GAPKWVDDPDFDL

SEQ ID NO: 139452 - protein, 13 aa, Mycobacterium tuberculosis
APKWVDDPDFDLG

SEQ ID NO: 139453 - protein, 13 aa, Mycobacterium tuberculosis
PKWVDDPDFDLGR

SEQ ID NO: 139454 - protein, 13 aa, Mycobacterium tuberculosis
KWVDDPDFDLGRH

SEQ ID NO: 139455 - protein, 13 aa, Mycobacterium tuberculosis
WVDDPDFDLGRHV

SEQ ID NO: 139456 - protein, 13 aa, Mycobacterium tuberculosis
VDDPDFDLGRHVW

SEQ ID NO: 139457 - protein, 13 aa, Mycobacterium tuberculosis
DDPDFDLGRHVWR

SEQ ID NO: 139458 - protein, 13 aa, Mycobacterium tuberculosis
DPDFDLGRHVWRI

SEQ ID NO: 139459 - protein, 13 aa, Mycobacterium tuberculosis
PDFDLGRHVWRIA

SEQ ID NO: 139460 - protein, 13 aa, Mycobacterium tuberculosis
DFDLGRHVWRIAL

SEQ ID NO: 139461 - protein, 13 aa, Mycobacterium tuberculosis
FDLGRHVWRIALP

SEQ ID NO: 139462 - protein, 13 aa, Mycobacterium tuberculosis
DLGRHVWRIALPR

SEQ ID NO: 139463 - protein, 13 aa, Mycobacterium tuberculosis
LGRHVWRIALPRP

SEQ ID NO: 139464 - protein, 13 aa, Mycobacterium tuberculosis
GRHVWRIALPRPG

SEQ ID NO: 139465 - protein, 13 aa, Mycobacterium tuberculosis
RHVWRIALPRPGN

SEQ ID NO: 139466 - protein, 13 aa, Mycobacterium tuberculosis
HVWRIALPRPGNE

SEQ ID NO: 139467 - protein, 13 aa, Mycobacterium tuberculosis
VWRIALPRPGNED

SEQ ID NO: 139468 - protein, 13 aa, Mycobacterium tuberculosis
WRIALPRPGNEDQ

SEQ ID NO: 139469 - protein, 13 aa, Mycobacterium tuberculosis
RIALPRPGNEDQL

SEQ ID NO: 139470 - protein, 13 aa, Mycobacterium tuberculosis
IALPRPGNEDQLF

SEQ ID NO: 139471 - protein, 13 aa, Mycobacterium tuberculosis
ALPRPGNEDQLFE

SEQ ID NO: 139472 - protein, 13 aa, Mycobacterium tuberculosis
LPRPGNEDQLFEL

SEQ ID NO: 139473 - protein, 13 aa, Mycobacterium tuberculosis
PRPGNEDQLFELI

SEQ ID NO: 139474 - protein, 13 aa, Mycobacterium tuberculosis
RPGNEDQLFELIA

SEQ ID NO: 139475 - protein, 13 aa, Mycobacterium tuberculosis
PGNEDQLFELIAD

SEQ ID NO: 139476 - protein, 13 aa, Mycobacterium tuberculosis
GNEDQLFELIADL

SEQ ID NO: 139477 - protein, 13 aa, Mycobacterium tuberculosis
NEDQLFELIADLM

SEQ ID NO: 139478 - protein, 13 aa, Mycobacterium tuberculosis
EDQLFELIADLMA

SEQ ID NO: 139479 - protein, 13 aa, Mycobacterium tuberculosis
DQLFELIADLMAR

SEQ ID NO: 139480 - protein, 13 aa, Mycobacterium tuberculosis
QLFELIADLMARR

SEQ ID NO: 139481 - protein, 13 aa, Mycobacterium tuberculosis
LFELIADLMARRL

SEQ ID NO: 139482 - protein, 13 aa, Mycobacterium tuberculosis
FELIADLMARRLD

SEQ ID NO: 139483 - protein, 13 aa, Mycobacterium tuberculosis
ELIADLMARRLDR

SEQ ID NO: 139484 - protein, 13 aa, Mycobacterium tuberculosis
LIADLMARRLDRG

SEQ ID NO: 139485 - protein, 13 aa, Mycobacterium tuberculosis
IADLMARRLDRGR

SEQ ID NO: 139486 - protein, 13 aa, Mycobacterium tuberculosis
ADLMARRLDRGRP

SEQ ID NO: 139487 - protein, 13 aa, Mycobacterium tuberculosis
DLMARRLDRGRPL

SEQ ID NO: 139488 - protein, 13 aa, Mycobacterium tuberculosis
LMARRLDRGRPLW

SEQ ID NO: 139489 - protein, 13 aa, Mycobacterium tuberculosis
MARRLDRGRPLWE

SEQ ID NO: 139490 - protein, 13 aa, Mycobacterium tuberculosis
ARRLDRGRPLWEV

SEQ ID NO: 139491 - protein, 13 aa, Mycobacterium tuberculosis
RRLDRGRPLWEVW

SEQ ID NO: 139492 - protein, 13 aa, Mycobacterium tuberculosis
RLDRGRPLWEVWV

SEQ ID NO: 139493 - protein, 13 aa, Mycobacterium tuberculosis
LDRGRPLWEVWVI

SEQ ID NO: 139494 - protein, 13 aa, Mycobacterium tuberculosis
DRGRPLWEVWVIE

SEQ ID NO: 139495 - protein, 13 aa, Mycobacterium tuberculosis
RGRPLWEVWVIEG

SEQ ID NO: 139496 - protein, 13 aa, Mycobacterium tuberculosis
GRPLWEVWVIEGL

SEQ ID NO: 139497 - protein, 13 aa, Mycobacterium tuberculosis
RPLWEVWVIEGLA

SEQ ID NO: 139498 - protein, 13 aa, Mycobacterium tuberculosis
PLWEVWVIEGLAD

SEQ ID NO: 139499 - protein, 13 aa, Mycobacterium tuberculosis
LWEVWVIEGLADS

SEQ ID NO: 139500 - protein, 13 aa, Mycobacterium tuberculosis
WEVWVIEGLADSK

SEQ ID NO: 139501 - protein, 13 aa, Mycobacterium tuberculosis
EVWVIEGLADSKW

SEQ ID NO: 139502 - protein, 13 aa, Mycobacterium tuberculosis
VWVIEGLADSKWA

SEQ ID NO: 139503 - protein, 13 aa, Mycobacterium tuberculosis
WVIEGLADSKWAI

SEQ ID NO: 139504 - protein, 13 aa, Mycobacterium tuberculosis
VIEGLADSKWAIL

SEQ ID NO: 139505 - protein, 13 aa, Mycobacterium tuberculosis
IEGLADSKWAILT

SEQ ID NO: 139506 - protein, 13 aa, Mycobacterium tuberculosis
EGLADSKWAILTK

SEQ ID NO: 139507 - protein, 13 aa, Mycobacterium tuberculosis
GLADSKWAILTKL

SEQ ID NO: 139508 - protein, 13 aa, Mycobacterium tuberculosis
LADSKWAILTKLH

SEQ ID NO: 139509 - protein, 13 aa, Mycobacterium tuberculosis
ADSKWAILTKLHH

SEQ ID NO: 139510 - protein, 13 aa, Mycobacterium tuberculosis
DSKWAILTKLHHC

SEQ ID NO: 139511 - protein, 13 aa, Mycobacterium tuberculosis
SKWAILTKLHHCM

SEQ ID NO: 139512 - protein, 13 aa, Mycobacterium tuberculosis
KWAILTKLHHCMA

SEQ ID NO: 139513 - protein, 13 aa, Mycobacterium tuberculosis
WAILTKLHHCMAD

SEQ ID NO: 139514 - protein, 13 aa, Mycobacterium tuberculosis
AILTKLHHCMADG

SEQ ID NO: 139515 - protein, 13 aa, Mycobacterium tuberculosis
ILTKLHHCMADGI

SEQ ID NO: 139516 - protein, 13 aa, Mycobacterium tuberculosis
LTKLHHCMADGIA

SEQ ID NO: 139517 - protein, 13 aa, Mycobacterium tuberculosis
TKLHHCMADGIAA

SEQ ID NO: 139518 - protein, 13 aa, Mycobacterium tuberculosis
KLHHCMADGIAAT

SEQ ID NO: 139519 - protein, 13 aa, Mycobacterium tuberculosis
LHHCMADGIAATH

SEQ ID NO: 139520 - protein, 13 aa, Mycobacterium tuberculosis
HHCMADGIAATHL

SEQ ID NO: 139521 - protein, 13 aa, Mycobacterium tuberculosis
HCMADGIAATHLL

SEQ ID NO: 139522 - protein, 13 aa, Mycobacterium tuberculosis
CMADGIAATHLLA

SEQ ID NO: 139523 - protein, 13 aa, Mycobacterium tuberculosis
MADGIAATHLLAG

SEQ ID NO: 139524 - protein, 13 aa, Mycobacterium tuberculosis
ADGIAATHLLAGL

SEQ ID NO: 139525 - protein, 13 aa, Mycobacterium tuberculosis
DGIAATHLLAGLS

SEQ ID NO: 139526 - protein, 13 aa, Mycobacterium tuberculosis
GIAATHLLAGLSD

SEQ ID NO: 139527 - protein, 13 aa, Mycobacterium tuberculosis
IAATHLLAGLSDE

SEQ ID NO: 139528 - protein, 13 aa, Mycobacterium tuberculosis
AATHLLAGLSDES

SEQ ID NO: 139529 - protein, 13 aa, Mycobacterium tuberculosis
ATHLLAGLSDESM

SEQ ID NO: 139530 - protein, 13 aa, Mycobacterium tuberculosis
THLLAGLSDESMS

SEQ ID NO: 139531 - protein, 13 aa, Mycobacterium tuberculosis
HLLAGLSDESMSD

SEQ ID NO: 139532 - protein, 13 aa, Mycobacterium tuberculosis
LLAGLSDESMSDS

SEQ ID NO: 139533 - protein, 13 aa, Mycobacterium tuberculosis
LAGLSDESMSDSF

SEQ ID NO: 139534 - protein, 13 aa, Mycobacterium tuberculosis
AGLSDESMSDSFA

SEQ ID NO: 139535 - protein, 13 aa, Mycobacterium tuberculosis
GLSDESMSDSFAS

SEQ ID NO: 139536 - protein, 13 aa, Mycobacterium tuberculosis
LSDESMSDSFASN

SEQ ID NO: 139537 - protein, 13 aa, Mycobacterium tuberculosis
SDESMSDSFASNI

SEQ ID NO: 139538 - protein, 13 aa, Mycobacterium tuberculosis
DESMSDSFASNIH

SEQ ID NO: 139539 - protein, 13 aa, Mycobacterium tuberculosis
ESMSDSFASNIHT

SEQ ID NO: 139540 - protein, 13 aa, Mycobacterium tuberculosis
SMSDSFASNIHTT

SEQ ID NO: 139541 - protein, 13 aa, Mycobacterium tuberculosis
MSDSFASNIHTTM

SEQ ID NO: 139542 - protein, 13 aa, Mycobacterium tuberculosis
SDSFASNIHTTMQ

SEQ ID NO: 139543 - protein, 13 aa, Mycobacterium tuberculosis
DSFASNIHTTMQS

SEQ ID NO: 139544 - protein, 13 aa, Mycobacterium tuberculosis
SFASNIHTTMQSQ

SEQ ID NO: 139545 - protein, 13 aa, Mycobacterium tuberculosis
FASNIHTTMQSQS

SEQ ID NO: 139546 - protein, 13 aa, Mycobacterium tuberculosis
ASNIHTTMQSQSA

SEQ ID NO: 139547 - protein, 13 aa, Mycobacterium tuberculosis
SNIHTTMQSQSAS

SEQ ID NO: 139548 - protein, 13 aa, Mycobacterium tuberculosis
NIHTTMQSQSASV

SEQ ID NO: 139549 - protein, 13 aa, Mycobacterium tuberculosis
IHTTMQSQSASVR

SEQ ID NO: 139550 - protein, 13 aa, Mycobacterium tuberculosis
HTTMQSQSASVRR

SEQ ID NO: 139551 - protein, 13 aa, Mycobacterium tuberculosis
TTMQSQSASVRRG

SEQ ID NO: 139552 - protein, 13 aa, Mycobacterium tuberculosis
TMQSQSASVRRGG

SEQ ID NO: 139553 - protein, 13 aa, Mycobacterium tuberculosis
MQSQSASVRRGGF

SEQ ID NO: 139554 - protein, 13 aa, Mycobacterium tuberculosis
QSQSASVRRGGFR

SEQ ID NO: 139555 - protein, 13 aa, Mycobacterium tuberculosis
SQSASVRRGGFRV

SEQ ID NO: 139556 - protein, 13 aa, Mycobacterium tuberculosis
QSASVRRGGFRVN

SEQ ID NO: 139557 - protein, 13 aa, Mycobacterium tuberculosis
SASVRRGGFRVNP

SEQ ID NO: 139558 - protein, 13 aa, Mycobacterium tuberculosis
ASVRRGGFRVNPS

SEQ ID NO: 139559 - protein, 13 aa, Mycobacterium tuberculosis
SVRRGGFRVNPSE

SEQ ID NO: 139560 - protein, 13 aa, Mycobacterium tuberculosis
VRRGGFRVNPSEA

SEQ ID NO: 139561 - protein, 13 aa, Mycobacterium tuberculosis
RRGGFRVNPSEAL

SEQ ID NO: 139562 - protein, 13 aa, Mycobacterium tuberculosis
RGGFRVNPSEALT

SEQ ID NO: 139563 - protein, 13 aa, Mycobacterium tuberculosis
GGFRVNPSEALTA

SEQ ID NO: 139564 - protein, 13 aa, Mycobacterium tuberculosis
GFRVNPSEALTAS

SEQ ID NO: 139565 - protein, 13 aa, Mycobacterium tuberculosis
FRVNPSEALTAST

SEQ ID NO: 139566 - protein, 13 aa, Mycobacterium tuberculosis
RVNPSEALTASTA

SEQ ID NO: 139567 - protein, 13 aa, Mycobacterium tuberculosis
VNPSEALTASTAV

SEQ ID NO: 139568 - protein, 13 aa, Mycobacterium tuberculosis
NPSEALTASTAVM

SEQ ID NO: 139569 - protein, 13 aa, Mycobacterium tuberculosis
PSEALTASTAVMA

SEQ ID NO: 139570 - protein, 13 aa, Mycobacterium tuberculosis
SEALTASTAVMAG

SEQ ID NO: 139571 - protein, 13 aa, Mycobacterium tuberculosis
EALTASTAVMAGI

SEQ ID NO: 139572 - protein, 13 aa, Mycobacterium tuberculosis
ALTASTAVMAGIV

SEQ ID NO: 139573 - protein, 13 aa, Mycobacterium tuberculosis
LTASTAVMAGIVR

SEQ ID NO: 139574 - protein, 13 aa, Mycobacterium tuberculosis
TASTAVMAGIVRA

SEQ ID NO: 139575 - protein, 13 aa, Mycobacterium tuberculosis
ASTAVMAGIVRAA

SEQ ID NO: 139576 - protein, 13 aa, Mycobacterium tuberculosis
STAVMAGIVRAAK

SEQ ID NO: 139577 - protein, 13 aa, Mycobacterium tuberculosis
TAVMAGIVRAAKG

SEQ ID NO: 139578 - protein, 13 aa, Mycobacterium tuberculosis
AVMAGIVRAAKGA

SEQ ID NO: 139579 - protein, 13 aa, Mycobacterium tuberculosis
VMAGIVRAAKGAS

SEQ ID NO: 139580 - protein, 13 aa, Mycobacterium tuberculosis
MAGIVRAAKGASE

SEQ ID NO: 139581 - protein, 13 aa, Mycobacterium tuberculosis
AGIVRAAKGASEI

SEQ ID NO: 139582 - protein, 13 aa, Mycobacterium tuberculosis
GIVRAAKGASEIA

SEQ ID NO: 139583 - protein, 13 aa, Mycobacterium tuberculosis
IVRAAKGASEIAA

SEQ ID NO: 139584 - protein, 13 aa, Mycobacterium tuberculosis
VRAAKGASEIAAG

SEQ ID NO: 139585 - protein, 13 aa, Mycobacterium tuberculosis
RAAKGASEIAAGV

SEQ ID NO: 139586 - protein, 13 aa, Mycobacterium tuberculosis
AAKGASEIAAGVL

SEQ ID NO: 139587 - protein, 13 aa, Mycobacterium tuberculosis
AKGASEIAAGVLS

SEQ ID NO: 139588 - protein, 13 aa, Mycobacterium tuberculosis
KGASEIAAGVLSP

SEQ ID NO: 139589 - protein, 13 aa, Mycobacterium tuberculosis
GASEIAAGVLSPA

SEQ ID NO: 139590 - protein, 13 aa, Mycobacterium tuberculosis
ASEIAAGVLSPAA

SEQ ID NO: 139591 - protein, 13 aa, Mycobacterium tuberculosis
SEIAAGVLSPAAS

SEQ ID NO: 139592 - protein, 13 aa, Mycobacterium tuberculosis
EIAAGVLSPAASS

SEQ ID NO: 139593 - protein, 13 aa, Mycobacterium tuberculosis
IAAGVLSPAASSL

SEQ ID NO: 139594 - protein, 13 aa, Mycobacterium tuberculosis
AAGVLSPAASSLN

SEQ ID NO: 139595 - protein, 13 aa, Mycobacterium tuberculosis
AGVLSPAASSLNG

SEQ ID NO: 139596 - protein, 13 aa, Mycobacterium tuberculosis
GVLSPAASSLNGP

SEQ ID NO: 139597 - protein, 13 aa, Mycobacterium tuberculosis
VLSPAASSLNGPI

SEQ ID NO: 139598 - protein, 13 aa, Mycobacterium tuberculosis
LSPAASSLNGPIS

SEQ ID NO: 139599 - protein, 13 aa, Mycobacterium tuberculosis
SPAASSLNGPISD

SEQ ID NO: 139600 - protein, 13 aa, Mycobacterium tuberculosis
PAASSLNGPISDL

SEQ ID NO: 139601 - protein, 13 aa, Mycobacterium tuberculosis
AASSLNGPISDLR

SEQ ID NO: 139602 - protein, 13 aa, Mycobacterium tuberculosis
ASSLNGPISDLRR

SEQ ID NO: 139603 - protein, 13 aa, Mycobacterium tuberculosis
SSLNGPISDLRRY

SEQ ID NO: 139604 - protein, 13 aa, Mycobacterium tuberculosis
SLNGPISDLRRYS

SEQ ID NO: 139605 - protein, 13 aa, Mycobacterium tuberculosis
LNGPISDLRRYSA

SEQ ID NO: 139606 - protein, 13 aa, Mycobacterium tuberculosis
NGPISDLRRYSAA

SEQ ID NO: 139607 - protein, 13 aa, Mycobacterium tuberculosis
GPISDLRRYSAAK

SEQ ID NO: 139608 - protein, 13 aa, Mycobacterium tuberculosis
PISDLRRYSAAKV

SEQ ID NO: 139609 - protein, 13 aa, Mycobacterium tuberculosis
ISDLRRYSAAKVP

SEQ ID NO: 139610 - protein, 13 aa, Mycobacterium tuberculosis
SDLRRYSAAKVPL

SEQ ID NO: 139611 - protein, 13 aa, Mycobacterium tuberculosis
DLRRYSAAKVPLA

SEQ ID NO: 139612 - protein, 13 aa, Mycobacterium tuberculosis
LRRYSAAKVPLAD

SEQ ID NO: 139613 - protein, 13 aa, Mycobacterium tuberculosis
RRYSAAKVPLADV

SEQ ID NO: 139614 - protein, 13 aa, Mycobacterium tuberculosis
RYSAAKVPLADVE

SEQ ID NO: 139615 - protein, 13 aa, Mycobacterium tuberculosis
YSAAKVPLADVEQ

SEQ ID NO: 139616 - protein, 13 aa, Mycobacterium tuberculosis
SAAKVPLADVEQV

SEQ ID NO: 139617 - protein, 13 aa, Mycobacterium tuberculosis
AAKVPLADVEQVC

SEQ ID NO: 139618 - protein, 13 aa, Mycobacterium tuberculosis
AKVPLADVEQVCR

SEQ ID NO: 139619 - protein, 13 aa, Mycobacterium tuberculosis
KVPLADVEQVCRK

SEQ ID NO: 139620 - protein, 13 aa, Mycobacterium tuberculosis
VPLADVEQVCRKF

SEQ ID NO: 139621 - protein, 13 aa, Mycobacterium tuberculosis
PLADVEQVCRKFD

SEQ ID NO: 139622 - protein, 13 aa, Mycobacterium tuberculosis
LADVEQVCRKFDV

SEQ ID NO: 139623 - protein, 13 aa, Mycobacterium tuberculosis
ADVEQVCRKFDVT

SEQ ID NO: 139624 - protein, 13 aa, Mycobacterium tuberculosis
DVEQVCRKFDVTI

SEQ ID NO: 139625 - protein, 13 aa, Mycobacterium tuberculosis
VEQVCRKFDVTIN

SEQ ID NO: 139626 - protein, 13 aa, Mycobacterium tuberculosis
EQVCRKFDVTIND

SEQ ID NO: 139627 - protein, 13 aa, Mycobacterium tuberculosis
QVCRKFDVTINDV

SEQ ID NO: 139628 - protein, 13 aa, Mycobacterium tuberculosis
VCRKFDVTINDVA

SEQ ID NO: 139629 - protein, 13 aa, Mycobacterium tuberculosis
CRKFDVTINDVAL

SEQ ID NO: 139630 - protein, 13 aa, Mycobacterium tuberculosis
RKFDVTINDVALA

SEQ ID NO: 139631 - protein, 13 aa, Mycobacterium tuberculosis
KFDVTINDVALAA

SEQ ID NO: 139632 - protein, 13 aa, Mycobacterium tuberculosis
FDVTINDVALAAI

SEQ ID NO: 139633 - protein, 13 aa, Mycobacterium tuberculosis
DVTINDVALAAIT

SEQ ID NO: 139634 - protein, 13 aa, Mycobacterium tuberculosis
VTINDVALAAITE

SEQ ID NO: 139635 - protein, 13 aa, Mycobacterium tuberculosis
TINDVALAAITES

SEQ ID NO: 139636 - protein, 13 aa, Mycobacterium tuberculosis
INDVALAAITESY

SEQ ID NO: 139637 - protein, 13 aa, Mycobacterium tuberculosis
NDVALAAITESYR

SEQ ID NO: 139638 - protein, 13 aa, Mycobacterium tuberculosis
DVALAAITESYRN

SEQ ID NO: 139639 - protein, 13 aa, Mycobacterium tuberculosis
VALAAITESYRNV

SEQ ID NO: 139640 - protein, 13 aa, Mycobacterium tuberculosis
ALAAITESYRNVL

SEQ ID NO: 139641 - protein, 13 aa, Mycobacterium tuberculosis
LAAITESYRNVLI

SEQ ID NO: 139642 - protein, 13 aa, Mycobacterium tuberculosis
AAITESYRNVLIQ

SEQ ID NO: 139643 - protein, 13 aa, Mycobacterium tuberculosis
AITESYRNVLIQR

SEQ ID NO: 139644 - protein, 13 aa, Mycobacterium tuberculosis
ITESYRNVLIQRG

SEQ ID NO: 139645 - protein, 13 aa, Mycobacterium tuberculosis
TESYRNVLIQRGE

SEQ ID NO: 139646 - protein, 13 aa, Mycobacterium tuberculosis
ESYRNVLIQRGER

SEQ ID NO: 139647 - protein, 13 aa, Mycobacterium tuberculosis
SYRNVLIQRGERP

SEQ ID NO: 139648 - protein, 13 aa, Mycobacterium tuberculosis
YRNVLIQRGERPR

SEQ ID NO: 139649 - protein, 13 aa, Mycobacterium tuberculosis
RNVLIQRGERPRF

SEQ ID NO: 139650 - protein, 13 aa, Mycobacterium tuberculosis
NVLIQRGERPRFD

SEQ ID NO: 139651 - protein, 13 aa, Mycobacterium tuberculosis
VLIQRGERPRFDS

SEQ ID NO: 139652 - protein, 13 aa, Mycobacterium tuberculosis
LIQRGERPRFDSL

SEQ ID NO: 139653 - protein, 13 aa, Mycobacterium tuberculosis
IQRGERPRFDSLR

SEQ ID NO: 139654 - protein, 13 aa, Mycobacterium tuberculosis
QRGERPRFDSLRT

SEQ ID NO: 139655 - protein, 13 aa, Mycobacterium tuberculosis
RGERPRFDSLRTL

SEQ ID NO: 139656 - protein, 13 aa, Mycobacterium tuberculosis
GERPRFDSLRTLV

SEQ ID NO: 139657 - protein, 13 aa, Mycobacterium tuberculosis
ERPRFDSLRTLVP

SEQ ID NO: 139658 - protein, 13 aa, Mycobacterium tuberculosis
RPRFDSLRTLVPV

SEQ ID NO: 139659 - protein, 13 aa, Mycobacterium tuberculosis
PRFDSLRTLVPVS

SEQ ID NO: 139660 - protein, 13 aa, Mycobacterium tuberculosis
RFDSLRTLVPVST

SEQ ID NO: 139661 - protein, 13 aa, Mycobacterium tuberculosis
FDSLRTLVPVSTR

SEQ ID NO: 139662 - protein, 13 aa, Mycobacterium tuberculosis
DSLRTLVPVSTRS

SEQ ID NO: 139663 - protein, 13 aa, Mycobacterium tuberculosis
SLRTLVPVSTRSN

SEQ ID NO: 139664 - protein, 13 aa, Mycobacterium tuberculosis
LRTLVPVSTRSNS

SEQ ID NO: 139665 - protein, 13 aa, Mycobacterium tuberculosis
RTLVPVSTRSNSA

SEQ ID NO: 139666 - protein, 13 aa, Mycobacterium tuberculosis
TLVPVSTRSNSAL

SEQ ID NO: 139667 - protein, 13 aa, Mycobacterium tuberculosis
LVPVSTRSNSALS

SEQ ID NO: 139668 - protein, 13 aa, Mycobacterium tuberculosis
VPVSTRSNSALSK

SEQ ID NO: 139669 - protein, 13 aa, Mycobacterium tuberculosis
PVSTRSNSALSKT

SEQ ID NO: 139670 - protein, 13 aa, Mycobacterium tuberculosis
VSTRSNSALSKTD

SEQ ID NO: 139671 - protein, 13 aa, Mycobacterium tuberculosis
STRSNSALSKTDN

SEQ ID NO: 139672 - protein, 13 aa, Mycobacterium tuberculosis
TRSNSALSKTDNR

SEQ ID NO: 139673 - protein, 13 aa, Mycobacterium tuberculosis
RSNSALSKTDNRV

SEQ ID NO: 139674 - protein, 13 aa, Mycobacterium tuberculosis
SNSALSKTDNRVS

SEQ ID NO: 139675 - protein, 13 aa, Mycobacterium tuberculosis
NSALSKTDNRVSL

SEQ ID NO: 139676 - protein, 13 aa, Mycobacterium tuberculosis
SALSKTDNRVSLM

SEQ ID NO: 139677 - protein, 13 aa, Mycobacterium tuberculosis
ALSKTDNRVSLML

SEQ ID NO: 139678 - protein, 13 aa, Mycobacterium tuberculosis
LSKTDNRVSLMLP

SEQ ID NO: 139679 - protein, 13 aa, Mycobacterium tuberculosis
SKTDNRVSLMLPN

SEQ ID NO: 139680 - protein, 13 aa, Mycobacterium tuberculosis
KTDNRVSLMLPNL

SEQ ID NO: 139681 - protein, 13 aa, Mycobacterium tuberculosis
TDNRVSLMLPNLP

SEQ ID NO: 139682 - protein, 13 aa, Mycobacterium tuberculosis
DNRVSLMLPNLPV

SEQ ID NO: 139683 - protein, 13 aa, Mycobacterium tuberculosis
NRVSLMLPNLPVD

SEQ ID NO: 139684 - protein, 13 aa, Mycobacterium tuberculosis
RVSLMLPNLPVDQ

SEQ ID NO: 139685 - protein, 13 aa, Mycobacterium tuberculosis
VSLMLPNLPVDQE

SEQ ID NO: 139686 - protein, 13 aa, Mycobacterium tuberculosis
SLMLPNLPVDQEN

SEQ ID NO: 139687 - protein, 13 aa, Mycobacterium tuberculosis
LMLPNLPVDQENP

SEQ ID NO: 139688 - protein, 13 aa, Mycobacterium tuberculosis
MLPNLPVDQENPL

SEQ ID NO: 139689 - protein, 13 aa, Mycobacterium tuberculosis
LPNLPVDQENPLQ

SEQ ID NO: 139690 - protein, 13 aa, Mycobacterium tuberculosis
PNLPVDQENPLQR

SEQ ID NO: 139691 - protein, 13 aa, Mycobacterium tuberculosis
NLPVDQENPLQRL

SEQ ID NO: 139692 - protein, 13 aa, Mycobacterium tuberculosis
LPVDQENPLQRLR

SEQ ID NO: 139693 - protein, 13 aa, Mycobacterium tuberculosis
PVDQENPLQRLRI

SEQ ID NO: 139694 - protein, 13 aa, Mycobacterium tuberculosis
VDQENPLQRLRIV

SEQ ID NO: 139695 - protein, 13 aa, Mycobacterium tuberculosis
DQENPLQRLRIVH

SEQ ID NO: 139696 - protein, 13 aa, Mycobacterium tuberculosis
QENPLQRLRIVHS

SEQ ID NO: 139697 - protein, 13 aa, Mycobacterium tuberculosis
ENPLQRLRIVHSR

SEQ ID NO: 139698 - protein, 13 aa, Mycobacterium tuberculosis
NPLQRLRIVHSRL

SEQ ID NO: 139699 - protein, 13 aa, Mycobacterium tuberculosis
PLQRLRIVHSRLT

SEQ ID NO: 139700 - protein, 13 aa, Mycobacterium tuberculosis
LQRLRIVHSRLTR

SEQ ID NO: 139701 - protein, 13 aa, Mycobacterium tuberculosis
QRLRIVHSRLTRA

SEQ ID NO: 139702 - protein, 13 aa, Mycobacterium tuberculosis
RLRIVHSRLTRAK

SEQ ID NO: 139703 - protein, 13 aa, Mycobacterium tuberculosis
LRIVHSRLTRAKA

SEQ ID NO: 139704 - protein, 13 aa, Mycobacterium tuberculosis
RIVHSRLTRAKAG

SEQ ID NO: 139705 - protein, 13 aa, Mycobacterium tuberculosis
IVHSRLTRAKAGG

SEQ ID NO: 139706 - protein, 13 aa, Mycobacterium tuberculosis
VHSRLTRAKAGGQ

SEQ ID NO: 139707 - protein, 13 aa, Mycobacterium tuberculosis
HSRLTRAKAGGQR

SEQ ID NO: 139708 - protein, 13 aa, Mycobacterium tuberculosis
SRLTRAKAGGQRQ

SEQ ID NO: 139709 - protein, 13 aa, Mycobacterium tuberculosis
RLTRAKAGGQRQF

SEQ ID NO: 139710 - protein, 13 aa, Mycobacterium tuberculosis
LTRAKAGGQRQFG

SEQ ID NO: 139711 - protein, 13 aa, Mycobacterium tuberculosis
TRAKAGGQRQFGN

SEQ ID NO: 139712 - protein, 13 aa, Mycobacterium tuberculosis
RAKAGGQRQFGNT

SEQ ID NO: 139713 - protein, 13 aa, Mycobacterium tuberculosis
AKAGGQRQFGNTL

SEQ ID NO: 139714 - protein, 13 aa, Mycobacterium tuberculosis
KAGGQRQFGNTLM

SEQ ID NO: 139715 - protein, 13 aa, Mycobacterium tuberculosis
AGGQRQFGNTLMA

SEQ ID NO: 139716 - protein, 13 aa, Mycobacterium tuberculosis
GGQRQFGNTLMAI

SEQ ID NO: 139717 - protein, 13 aa, Mycobacterium tuberculosis
GQRQFGNTLMAIA

SEQ ID NO: 139718 - protein, 13 aa, Mycobacterium tuberculosis
QRQFGNTLMAIAN

SEQ ID NO: 139719 - protein, 13 aa, Mycobacterium tuberculosis
RQFGNTLMAIANR

SEQ ID NO: 139720 - protein, 13 aa, Mycobacterium tuberculosis
QFGNTLMAIANRL

SEQ ID NO: 139721 - protein, 13 aa, Mycobacterium tuberculosis
FGNTLMAIANRLP

SEQ ID NO: 139722 - protein, 13 aa, Mycobacterium tuberculosis
GNTLMAIANRLPF

SEQ ID NO: 139723 - protein, 13 aa, Mycobacterium tuberculosis
NTLMAIANRLPFP

SEQ ID NO: 139724 - protein, 13 aa, Mycobacterium tuberculosis
TLMAIANRLPFPM

SEQ ID NO: 139725 - protein, 13 aa, Mycobacterium tuberculosis
LMAIANRLPFPMT

SEQ ID NO: 139726 - protein, 13 aa, Mycobacterium tuberculosis
MAIANRLPFPMTA

SEQ ID NO: 139727 - protein, 13 aa, Mycobacterium tuberculosis
AIANRLPFPMTAW

SEQ ID NO: 139728 - protein, 13 aa, Mycobacterium tuberculosis
IANRLPFPMTAWA

SEQ ID NO: 139729 - protein, 13 aa, Mycobacterium tuberculosis
ANRLPFPMTAWAV

SEQ ID NO: 139730 - protein, 13 aa, Mycobacterium tuberculosis
NRLPFPMTAWAVG

SEQ ID NO: 139731 - protein, 13 aa, Mycobacterium tuberculosis
RLPFPMTAWAVGL

SEQ ID NO: 139732 - protein, 13 aa, Mycobacterium tuberculosis
LPFPMTAWAVGLL

SEQ ID NO: 139733 - protein, 13 aa, Mycobacterium tuberculosis
PFPMTAWAVGLLM

SEQ ID NO: 139734 - protein, 13 aa, Mycobacterium tuberculosis
FPMTAWAVGLLMR

SEQ ID NO: 139735 - protein, 13 aa, Mycobacterium tuberculosis
PMTAWAVGLLMRL

SEQ ID NO: 139736 - protein, 13 aa, Mycobacterium tuberculosis
MTAWAVGLLMRLP

SEQ ID NO: 139737 - protein, 13 aa, Mycobacterium tuberculosis
TAWAVGLLMRLPQ

SEQ ID NO: 139738 - protein, 13 aa, Mycobacterium tuberculosis
AWAVGLLMRLPQR

SEQ ID NO: 139739 - protein, 13 aa, Mycobacterium tuberculosis
WAVGLLMRLPQRG

SEQ ID NO: 139740 - protein, 13 aa, Mycobacterium tuberculosis
AVGLLMRLPQRGV

SEQ ID NO: 139741 - protein, 13 aa, Mycobacterium tuberculosis
VGLLMRLPQRGVV

SEQ ID NO: 139742 - protein, 13 aa, Mycobacterium tuberculosis
GLLMRLPQRGVVT

SEQ ID NO: 139743 - protein, 13 aa, Mycobacterium tuberculosis
LLMRLPQRGVVTV

SEQ ID NO: 139744 - protein, 13 aa, Mycobacterium tuberculosis
LMRLPQRGVVTVA

SEQ ID NO: 139745 - protein, 13 aa, Mycobacterium tuberculosis
MRLPQRGVVTVAT

SEQ ID NO: 139746 - protein, 13 aa, Mycobacterium tuberculosis
RLPQRGVVTVATN

SEQ ID NO: 139747 - protein, 13 aa, Mycobacterium tuberculosis
LPQRGVVTVATNV

SEQ ID NO: 139748 - protein, 13 aa, Mycobacterium tuberculosis
PQRGVVTVATNVP

SEQ ID NO: 139749 - protein, 13 aa, Mycobacterium tuberculosis
QRGVVTVATNVPG

SEQ ID NO: 139750 - protein, 13 aa, Mycobacterium tuberculosis
RGVVTVATNVPGP

SEQ ID NO: 139751 - protein, 13 aa, Mycobacterium tuberculosis
GVVTVATNVPGPR

SEQ ID NO: 139752 - protein, 13 aa, Mycobacterium tuberculosis
VVTVATNVPGPRR

SEQ ID NO: 139753 - protein, 13 aa, Mycobacterium tuberculosis
VTVATNVPGPRRP

SEQ ID NO: 139754 - protein, 13 aa, Mycobacterium tuberculosis
TVATNVPGPRRPL

SEQ ID NO: 139755 - protein, 13 aa, Mycobacterium tuberculosis
VATNVPGPRRPLQ

SEQ ID NO: 139756 - protein, 13 aa, Mycobacterium tuberculosis
ATNVPGPRRPLQI

SEQ ID NO: 139757 - protein, 13 aa, Mycobacterium tuberculosis
TNVPGPRRPLQIM

SEQ ID NO: 139758 - protein, 13 aa, Mycobacterium tuberculosis
NVPGPRRPLQIMG

SEQ ID NO: 139759 - protein, 13 aa, Mycobacterium tuberculosis
VPGPRRPLQIMGR

SEQ ID NO: 139760 - protein, 13 aa, Mycobacterium tuberculosis
PGPRRPLQIMGRR

SEQ ID NO: 139761 - protein, 13 aa, Mycobacterium tuberculosis
GPRRPLQIMGRRV

SEQ ID NO: 139762 - protein, 13 aa, Mycobacterium tuberculosis
PRRPLQIMGRRVL

SEQ ID NO: 139763 - protein, 13 aa, Mycobacterium tuberculosis
RRPLQIMGRRVLD

SEQ ID NO: 139764 - protein, 13 aa, Mycobacterium tuberculosis
RPLQIMGRRVLDL

SEQ ID NO: 139765 - protein, 13 aa, Mycobacterium tuberculosis
PLQIMGRRVLDLY

SEQ ID NO: 139766 - protein, 13 aa, Mycobacterium tuberculosis
LQIMGRRVLDLYP

SEQ ID NO: 139767 - protein, 13 aa, Mycobacterium tuberculosis
QIMGRRVLDLYPV

SEQ ID NO: 139768 - protein, 13 aa, Mycobacterium tuberculosis
IMGRRVLDLYPVS

SEQ ID NO: 139769 - protein, 13 aa, Mycobacterium tuberculosis
MGRRVLDLYPVSP

SEQ ID NO: 139770 - protein, 13 aa, Mycobacterium tuberculosis
GRRVLDLYPVSPI

SEQ ID NO: 139771 - protein, 13 aa, Mycobacterium tuberculosis
RRVLDLYPVSPIA

SEQ ID NO: 139772 - protein, 13 aa, Mycobacterium tuberculosis
RVLDLYPVSPIAM

SEQ ID NO: 139773 - protein, 13 aa, Mycobacterium tuberculosis
VLDLYPVSPIAMQ

SEQ ID NO: 139774 - protein, 13 aa, Mycobacterium tuberculosis
LDLYPVSPIAMQL

SEQ ID NO: 139775 - protein, 13 aa, Mycobacterium tuberculosis
DLYPVSPIAMQLR

SEQ ID NO: 139776 - protein, 13 aa, Mycobacterium tuberculosis
LYPVSPIAMQLRT

SEQ ID NO: 139777 - protein, 13 aa, Mycobacterium tuberculosis
YPVSPIAMQLRTS

SEQ ID NO: 139778 - protein, 13 aa, Mycobacterium tuberculosis
PVSPIAMQLRTSV

SEQ ID NO: 139779 - protein, 13 aa, Mycobacterium tuberculosis
VSPIAMQLRTSVA

SEQ ID NO: 139780 - protein, 13 aa, Mycobacterium tuberculosis
SPIAMQLRTSVAM

SEQ ID NO: 139781 - protein, 13 aa, Mycobacterium tuberculosis
PIAMQLRTSVAML

SEQ ID NO: 139782 - protein, 13 aa, Mycobacterium tuberculosis
IAMQLRTSVAMLS

SEQ ID NO: 139783 - protein, 13 aa, Mycobacterium tuberculosis
AMQLRTSVAMLSY

SEQ ID NO: 139784 - protein, 13 aa, Mycobacterium tuberculosis
MQLRTSVAMLSYA

SEQ ID NO: 139785 - protein, 13 aa, Mycobacterium tuberculosis
QLRTSVAMLSYAD

SEQ ID NO: 139786 - protein, 13 aa, Mycobacterium tuberculosis
LRTSVAMLSYADD

SEQ ID NO: 139787 - protein, 13 aa, Mycobacterium tuberculosis
RTSVAMLSYADDL

SEQ ID NO: 139788 - protein, 13 aa, Mycobacterium tuberculosis
TSVAMLSYADDLY

SEQ ID NO: 139789 - protein, 13 aa, Mycobacterium tuberculosis
SVAMLSYADDLYF

SEQ ID NO: 139790 - protein, 13 aa, Mycobacterium tuberculosis
VAMLSYADDLYFG

SEQ ID NO: 139791 - protein, 13 aa, Mycobacterium tuberculosis
AMLSYADDLYFGI

SEQ ID NO: 139792 - protein, 13 aa, Mycobacterium tuberculosis
MLSYADDLYFGIL

SEQ ID NO: 139793 - protein, 13 aa, Mycobacterium tuberculosis
LSYADDLYFGILA

SEQ ID NO: 139794 - protein, 13 aa, Mycobacterium tuberculosis
SYADDLYFGILAD

SEQ ID NO: 139795 - protein, 13 aa, Mycobacterium tuberculosis
YADDLYFGILADY

SEQ ID NO: 139796 - protein, 13 aa, Mycobacterium tuberculosis
ADDLYFGILADYD

SEQ ID NO: 139797 - protein, 13 aa, Mycobacterium tuberculosis
DDLYFGILADYDV

SEQ ID NO: 139798 - protein, 13 aa, Mycobacterium tuberculosis
DLYFGILADYDVV

SEQ ID NO: 139799 - protein, 13 aa, Mycobacterium tuberculosis
LYFGILADYDVVA

SEQ ID NO: 139800 - protein, 13 aa, Mycobacterium tuberculosis
YFGILADYDVVAD

SEQ ID NO: 139801 - protein, 13 aa, Mycobacterium tuberculosis
FGILADYDVVADA

SEQ ID NO: 139802 - protein, 13 aa, Mycobacterium tuberculosis
GILADYDVVADAG

SEQ ID NO: 139803 - protein, 13 aa, Mycobacterium tuberculosis
ILADYDVVADAGQ

SEQ ID NO: 139804 - protein, 13 aa, Mycobacterium tuberculosis
LADYDVVADAGQL

SEQ ID NO: 139805 - protein, 13 aa, Mycobacterium tuberculosis
ADYDVVADAGQLA

SEQ ID NO: 139806 - protein, 13 aa, Mycobacterium tuberculosis
DYDVVADAGQLAR

SEQ ID NO: 139807 - protein, 13 aa, Mycobacterium tuberculosis
YDVVADAGQLARG

SEQ ID NO: 139808 - protein, 13 aa, Mycobacterium tuberculosis
DVVADAGQLARGI

SEQ ID NO: 139809 - protein, 13 aa, Mycobacterium tuberculosis
VVADAGQLARGIE

SEQ ID NO: 139810 - protein, 13 aa, Mycobacterium tuberculosis
VADAGQLARGIED

SEQ ID NO: 139811 - protein, 13 aa, Mycobacterium tuberculosis
ADAGQLARGIEDA

SEQ ID NO: 139812 - protein, 13 aa, Mycobacterium tuberculosis
DAGQLARGIEDAV

SEQ ID NO: 139813 - protein, 13 aa, Mycobacterium tuberculosis
AGQLARGIEDAVA

SEQ ID NO: 139814 - protein, 13 aa, Mycobacterium tuberculosis
GQLARGIEDAVAR

SEQ ID NO: 139815 - protein, 13 aa, Mycobacterium tuberculosis
QLARGIEDAVARL

SEQ ID NO: 139816 - protein, 13 aa, Mycobacterium tuberculosis
LARGIEDAVARLV

SEQ ID NO: 139817 - protein, 13 aa, Mycobacterium tuberculosis
ARGIEDAVARLVA

SEQ ID NO: 139818 - protein, 13 aa, Mycobacterium tuberculosis
RGIEDAVARLVAI

SEQ ID NO: 139819 - protein, 13 aa, Mycobacterium tuberculosis
GIEDAVARLVAIS

SEQ ID NO: 139820 - protein, 13 aa, Mycobacterium tuberculosis
IEDAVARLVAISK

SEQ ID NO: 139821 - protein, 13 aa, Mycobacterium tuberculosis
EDAVARLVAISKR

SEQ ID NO: 139822 - protein, 13 aa, Mycobacterium tuberculosis
DAVARLVAISKRR

SEQ ID NO: 139823 - protein, 13 aa, Mycobacterium tuberculosis
AVARLVAISKRRK

SEQ ID NO: 139824 - protein, 13 aa, Mycobacterium tuberculosis
VARLVAISKRRKV

SEQ ID NO: 139825 - protein, 13 aa, Mycobacterium tuberculosis
ARLVAISKRRKVT

SEQ ID NO: 139826 - protein, 13 aa, Mycobacterium tuberculosis
RLVAISKRRKVTR

SEQ ID NO: 139827 - protein, 13 aa, Mycobacterium tuberculosis
LVAISKRRKVTRR

SEQ ID NO: 139828 - protein, 13 aa, Mycobacterium tuberculosis
VAISKRRKVTRRR

SEQ ID NO: 139829 - protein, 13 aa, Mycobacterium tuberculosis
AISKRRKVTRRRG

SEQ ID NO: 139830 - protein, 13 aa, Mycobacterium tuberculosis
ISKRRKVTRRRGA

SEQ ID NO: 139831 - protein, 13 aa, Mycobacterium tuberculosis
SKRRKVTRRRGAL

SEQ ID NO: 139832 - protein, 13 aa, Mycobacterium tuberculosis
KRRKVTRRRGALS

SEQ ID NO: 139833 - protein, 13 aa, Mycobacterium tuberculosis
RRKVTRRRGALSL

SEQ ID NO: 139834 - protein, 13 aa, Mycobacterium tuberculosis
RKVTRRRGALSLV

SEQ ID NO: 139835 - protein, 13 aa, Mycobacterium tuberculosis
KVTRRRGALSLVV

SEQ ID NO: 139836 - protein, 14 aa, Mycobacterium tuberculosis
MNHLTTLDAGFLKA

SEQ ID NO: 139837 - protein, 14 aa, Mycobacterium tuberculosis
NHLTTLDAGFLKAE

SEQ ID NO: 139838 - protein, 14 aa, Mycobacterium tuberculosis
HLTTLDAGFLKAED

SEQ ID NO: 139839 - protein, 14 aa, Mycobacterium tuberculosis
LTTLDAGFLKAEDV

SEQ ID NO: 139840 - protein, 14 aa, Mycobacterium tuberculosis
TTLDAGFLKAEDVD

SEQ ID NO: 139841 - protein, 14 aa, Mycobacterium tuberculosis
TLDAGFLKAEDVDR

SEQ ID NO: 139842 - protein, 14 aa, Mycobacterium tuberculosis
LDAGFLKAEDVDRH

SEQ ID NO: 139843 - protein, 14 aa, Mycobacterium tuberculosis
DAGFLKAEDVDRHV

SEQ ID NO: 139844 - protein, 14 aa, Mycobacterium tuberculosis
AGFLKAEDVDRHVS

SEQ ID NO: 139845 - protein, 14 aa, Mycobacterium tuberculosis
GFLKAEDVDRHVSL

SEQ ID NO: 139846 - protein, 14 aa, Mycobacterium tuberculosis
FLKAEDVDRHVSLA

SEQ ID NO: 139847 - protein, 14 aa, Mycobacterium tuberculosis
LKAEDVDRHVSLAI

SEQ ID NO: 139848 - protein, 14 aa, Mycobacterium tuberculosis
KAEDVDRHVSLAIG

SEQ ID NO: 139849 - protein, 14 aa, Mycobacterium tuberculosis
AEDVDRHVSLAIGA

SEQ ID NO: 139850 - protein, 14 aa, Mycobacterium tuberculosis
EDVDRHVSLAIGAL

SEQ ID NO: 139851 - protein, 14 aa, Mycobacterium tuberculosis
DVDRHVSLAIGALA

SEQ ID NO: 139852 - protein, 14 aa, Mycobacterium tuberculosis
VDRHVSLAIGALAV

SEQ ID NO: 139853 - protein, 14 aa, Mycobacterium tuberculosis
DRHVSLAIGALAVI

SEQ ID NO: 139854 - protein, 14 aa, Mycobacterium tuberculosis
RHVSLAIGALAVIE

SEQ ID NO: 139855 - protein, 14 aa, Mycobacterium tuberculosis
HVSLAIGALAVIEG

SEQ ID NO: 139856 - protein, 14 aa, Mycobacterium tuberculosis
VSLAIGALAVIEGP

SEQ ID NO: 139857 - protein, 14 aa, Mycobacterium tuberculosis
SLAIGALAVIEGPA

SEQ ID NO: 139858 - protein, 14 aa, Mycobacterium tuberculosis
LAIGALAVIEGPAP

SEQ ID NO: 139859 - protein, 14 aa, Mycobacterium tuberculosis
AIGALAVIEGPAPD

SEQ ID NO: 139860 - protein, 14 aa, Mycobacterium tuberculosis
IGALAVIEGPAPDQ

SEQ ID NO: 139861 - protein, 14 aa, Mycobacterium tuberculosis
GALAVIEGPAPDQE

SEQ ID NO: 139862 - protein, 14 aa, Mycobacterium tuberculosis
ALAVIEGPAPDQEA

SEQ ID NO: 139863 - protein, 14 aa, Mycobacterium tuberculosis
LAVIEGPAPDQEAF

SEQ ID NO: 139864 - protein, 14 aa, Mycobacterium tuberculosis
AVIEGPAPDQEAFL

SEQ ID NO: 139865 - protein, 14 aa, Mycobacterium tuberculosis
VIEGPAPDQEAFLS

SEQ ID NO: 139866 - protein, 14 aa, Mycobacterium tuberculosis
IEGPAPDQEAFLSS

SEQ ID NO: 139867 - protein, 14 aa, Mycobacterium tuberculosis
EGPAPDQEAFLSSL

SEQ ID NO: 139868 - protein, 14 aa, Mycobacterium tuberculosis
GPAPDQEAFLSSLA

SEQ ID NO: 139869 - protein, 14 aa, Mycobacterium tuberculosis
PAPDQEAFLSSLAQ

SEQ ID NO: 139870 - protein, 14 aa, Mycobacterium tuberculosis
APDQEAFLSSLAQR

SEQ ID NO: 139871 - protein, 14 aa, Mycobacterium tuberculosis
PDQEAFLSSLAQRL

SEQ ID NO: 139872 - protein, 14 aa, Mycobacterium tuberculosis
DQEAFLSSLAQRLR

SEQ ID NO: 139873 - protein, 14 aa, Mycobacterium tuberculosis
QEAFLSSLAQRLRP

SEQ ID NO: 139874 - protein, 14 aa, Mycobacterium tuberculosis
EAFLSSLAQRLRPC

SEQ ID NO: 139875 - protein, 14 aa, Mycobacterium tuberculosis
AFLSSLAQRLRPCT

SEQ ID NO: 139876 - protein, 14 aa, Mycobacterium tuberculosis
FLSSLAQRLRPCTR

SEQ ID NO: 139877 - protein, 14 aa, Mycobacterium tuberculosis
LSSLAQRLRPCTRF

SEQ ID NO: 139878 - protein, 14 aa, Mycobacterium tuberculosis
SSLAQRLRPCTRFG

SEQ ID NO: 139879 - protein, 14 aa, Mycobacterium tuberculosis
SLAQRLRPCTRFGQ

SEQ ID NO: 139880 - protein, 14 aa, Mycobacterium tuberculosis
LAQRLRPCTRFGQR

SEQ ID NO: 139881 - protein, 14 aa, Mycobacterium tuberculosis
AQRLRPCTRFGQRL

SEQ ID NO: 139882 - protein, 14 aa, Mycobacterium tuberculosis
QRLRPCTRFGQRLR

SEQ ID NO: 139883 - protein, 14 aa, Mycobacterium tuberculosis
RLRPCTRFGQRLRL

SEQ ID NO: 139884 - protein, 14 aa, Mycobacterium tuberculosis
LRPCTRFGQRLRLR

SEQ ID NO: 139885 - protein, 14 aa, Mycobacterium tuberculosis
RPCTRFGQRLRLRP

SEQ ID NO: 139886 - protein, 14 aa, Mycobacterium tuberculosis
PCTRFGQRLRLRPF

SEQ ID NO: 139887 - protein, 14 aa, Mycobacterium tuberculosis
CTRFGQRLRLRPFD

SEQ ID NO: 139888 - protein, 14 aa, Mycobacterium tuberculosis
TRFGQRLRLRPFDL

SEQ ID NO: 139889 - protein, 14 aa, Mycobacterium tuberculosis
RFGQRLRLRPFDLG

SEQ ID NO: 139890 - protein, 14 aa, Mycobacterium tuberculosis
FGQRLRLRPFDLGA

SEQ ID NO: 139891 - protein, 14 aa, Mycobacterium tuberculosis
GQRLRLRPFDLGAP

SEQ ID NO: 139892 - protein, 14 aa, Mycobacterium tuberculosis
QRLRLRPFDLGAPK

SEQ ID NO: 139893 - protein, 14 aa, Mycobacterium tuberculosis
RLRLRPFDLGAPKW

SEQ ID NO: 139894 - protein, 14 aa, Mycobacterium tuberculosis
LRLRPFDLGAPKWV

SEQ ID NO: 139895 - protein, 14 aa, Mycobacterium tuberculosis
RLRPFDLGAPKWVD

SEQ ID NO: 139896 - protein, 14 aa, Mycobacterium tuberculosis
LRPFDLGAPKWVDD

SEQ ID NO: 139897 - protein, 14 aa, Mycobacterium tuberculosis
RPFDLGAPKWVDDP

SEQ ID NO: 139898 - protein, 14 aa, Mycobacterium tuberculosis
PFDLGAPKWVDDPD

SEQ ID NO: 139899 - protein, 14 aa, Mycobacterium tuberculosis
FDLGAPKWVDDPDF

SEQ ID NO: 139900 - protein, 14 aa, Mycobacterium tuberculosis
DLGAPKWVDDPDFD

SEQ ID NO: 139901 - protein, 14 aa, Mycobacterium tuberculosis
LGAPKWVDDPDFDL

SEQ ID NO: 139902 - protein, 14 aa, Mycobacterium tuberculosis
GAPKWVDDPDFDLG

SEQ ID NO: 139903 - protein, 14 aa, Mycobacterium tuberculosis
APKWVDDPDFDLGR

SEQ ID NO: 139904 - protein, 14 aa, Mycobacterium tuberculosis
PKWVDDPDFDLGRH

SEQ ID NO: 139905 - protein, 14 aa, Mycobacterium tuberculosis
KWVDDPDFDLGRHV

SEQ ID NO: 139906 - protein, 14 aa, Mycobacterium tuberculosis
WVDDPDFDLGRHVW

SEQ ID NO: 139907 - protein, 14 aa, Mycobacterium tuberculosis
VDDPDFDLGRHVWR

SEQ ID NO: 139908 - protein, 14 aa, Mycobacterium tuberculosis
DDPDFDLGRHVWRI

SEQ ID NO: 139909 - protein, 14 aa, Mycobacterium tuberculosis
DPDFDLGRHVWRIA

SEQ ID NO: 139910 - protein, 14 aa, Mycobacterium tuberculosis
PDFDLGRHVWRIAL

SEQ ID NO: 139911 - protein, 14 aa, Mycobacterium tuberculosis
DFDLGRHVWRIALP

SEQ ID NO: 139912 - protein, 14 aa, Mycobacterium tuberculosis
FDLGRHVWRIALPR

SEQ ID NO: 139913 - protein, 14 aa, Mycobacterium tuberculosis
DLGRHVWRIALPRP

SEQ ID NO: 139914 - protein, 14 aa, Mycobacterium tuberculosis
LGRHVWRIALPRPG

SEQ ID NO: 139915 - protein, 14 aa, Mycobacterium tuberculosis
GRHVWRIALPRPGN

SEQ ID NO: 139916 - protein, 14 aa, Mycobacterium tuberculosis
RHVWRIALPRPGNE

SEQ ID NO: 139917 - protein, 14 aa, Mycobacterium tuberculosis
HVWRIALPRPGNED

SEQ ID NO: 139918 - protein, 14 aa, Mycobacterium tuberculosis
VWRIALPRPGNEDQ

SEQ ID NO: 139919 - protein, 14 aa, Mycobacterium tuberculosis
WRIALPRPGNEDQL

SEQ ID NO: 139920 - protein, 14 aa, Mycobacterium tuberculosis
RIALPRPGNEDQLF

SEQ ID NO: 139921 - protein, 14 aa, Mycobacterium tuberculosis
IALPRPGNEDQLFE

SEQ ID NO: 139922 - protein, 14 aa, Mycobacterium tuberculosis
ALPRPGNEDQLFEL

SEQ ID NO: 139923 - protein, 14 aa, Mycobacterium tuberculosis
LPRPGNEDQLFELI

SEQ ID NO: 139924 - protein, 14 aa, Mycobacterium tuberculosis
PRPGNEDQLFELIA

SEQ ID NO: 139925 - protein, 14 aa, Mycobacterium tuberculosis
RPGNEDQLFELIAD

SEQ ID NO: 139926 - protein, 14 aa, Mycobacterium tuberculosis
PGNEDQLFELIADL

SEQ ID NO: 139927 - protein, 14 aa, Mycobacterium tuberculosis
GNEDQLFELIADLM

SEQ ID NO: 139928 - protein, 14 aa, Mycobacterium tuberculosis
NEDQLFELIADLMA

SEQ ID NO: 139929 - protein, 14 aa, Mycobacterium tuberculosis
EDQLFELIADLMAR

SEQ ID NO: 139930 - protein, 14 aa, Mycobacterium tuberculosis
DQLFELIADLMARR

SEQ ID NO: 139931 - protein, 14 aa, Mycobacterium tuberculosis
QLFELIADLMARRL

SEQ ID NO: 139932 - protein, 14 aa, Mycobacterium tuberculosis
LFELIADLMARRLD

SEQ ID NO: 139933 - protein, 14 aa, Mycobacterium tuberculosis
FELIADLMARRLDR

SEQ ID NO: 139934 - protein, 14 aa, Mycobacterium tuberculosis
ELIADLMARRLDRG

SEQ ID NO: 139935 - protein, 14 aa, Mycobacterium tuberculosis
LIADLMARRLDRGR

SEQ ID NO: 139936 - protein, 14 aa, Mycobacterium tuberculosis
IADLMARRLDRGRP

SEQ ID NO: 139937 - protein, 14 aa, Mycobacterium tuberculosis
ADLMARRLDRGRPL

SEQ ID NO: 139938 - protein, 14 aa, Mycobacterium tuberculosis
DLMARRLDRGRPLW

SEQ ID NO: 139939 - protein, 14 aa, Mycobacterium tuberculosis
LMARRLDRGRPLWE

SEQ ID NO: 139940 - protein, 14 aa, Mycobacterium tuberculosis
MARRLDRGRPLWEV

SEQ ID NO: 139941 - protein, 14 aa, Mycobacterium tuberculosis
ARRLDRGRPLWEVW

SEQ ID NO: 139942 - protein, 14 aa, Mycobacterium tuberculosis
RRLDRGRPLWEVWV

SEQ ID NO: 139943 - protein, 14 aa, Mycobacterium tuberculosis
RLDRGRPLWEVWVI

SEQ ID NO: 139944 - protein, 14 aa, Mycobacterium tuberculosis
LDRGRPLWEVWVIE

SEQ ID NO: 139945 - protein, 14 aa, Mycobacterium tuberculosis
DRGRPLWEVWVIEG

SEQ ID NO: 139946 - protein, 14 aa, Mycobacterium tuberculosis
RGRPLWEVWVIEGL

SEQ ID NO: 139947 - protein, 14 aa, Mycobacterium tuberculosis
GRPLWEVWVIEGLA

SEQ ID NO: 139948 - protein, 14 aa, Mycobacterium tuberculosis
RPLWEVWVIEGLAD

SEQ ID NO: 139949 - protein, 14 aa, Mycobacterium tuberculosis
PLWEVWVIEGLADS

SEQ ID NO: 139950 - protein, 14 aa, Mycobacterium tuberculosis
LWEVWVIEGLADSK

SEQ ID NO: 139951 - protein, 14 aa, Mycobacterium tuberculosis
WEVWVIEGLADSKW

SEQ ID NO: 139952 - protein, 14 aa, Mycobacterium tuberculosis
EVWVIEGLADSKWA

SEQ ID NO: 139953 - protein, 14 aa, Mycobacterium tuberculosis
VWVIEGLADSKWAI

SEQ ID NO: 139954 - protein, 14 aa, Mycobacterium tuberculosis
WVIEGLADSKWAIL

SEQ ID NO: 139955 - protein, 14 aa, Mycobacterium tuberculosis
VIEGLADSKWAILT

SEQ ID NO: 139956 - protein, 14 aa, Mycobacterium tuberculosis
IEGLADSKWAILTK

SEQ ID NO: 139957 - protein, 14 aa, Mycobacterium tuberculosis
EGLADSKWAILTKL

SEQ ID NO: 139958 - protein, 14 aa, Mycobacterium tuberculosis
GLADSKWAILTKLH

SEQ ID NO: 139959 - protein, 14 aa, Mycobacterium tuberculosis
LADSKWAILTKLHH

SEQ ID NO: 139960 - protein, 14 aa, Mycobacterium tuberculosis
ADSKWAILTKLHHC

SEQ ID NO: 139961 - protein, 14 aa, Mycobacterium tuberculosis
DSKWAILTKLHHCM

SEQ ID NO: 139962 - protein, 14 aa, Mycobacterium tuberculosis
SKWAILTKLHHCMA

SEQ ID NO: 139963 - protein, 14 aa, Mycobacterium tuberculosis
KWAILTKLHHCMAD

SEQ ID NO: 139964 - protein, 14 aa, Mycobacterium tuberculosis
WAILTKLHHCMADG

SEQ ID NO: 139965 - protein, 14 aa, Mycobacterium tuberculosis
AILTKLHHCMADGI

SEQ ID NO: 139966 - protein, 14 aa, Mycobacterium tuberculosis
ILTKLHHCMADGIA

SEQ ID NO: 139967 - protein, 14 aa, Mycobacterium tuberculosis
LTKLHHCMADGIAA

SEQ ID NO: 139968 - protein, 14 aa, Mycobacterium tuberculosis
TKLHHCMADGIAAT

SEQ ID NO: 139969 - protein, 14 aa, Mycobacterium tuberculosis
KLHHCMADGIAATH

SEQ ID NO: 139970 - protein, 14 aa, Mycobacterium tuberculosis
LHHCMADGIAATHL

SEQ ID NO: 139971 - protein, 14 aa, Mycobacterium tuberculosis
HHCMADGIAATHLL

SEQ ID NO: 139972 - protein, 14 aa, Mycobacterium tuberculosis
HCMADGIAATHLLA

SEQ ID NO: 139973 - protein, 14 aa, Mycobacterium tuberculosis
CMADGIAATHLLAG

SEQ ID NO: 139974 - protein, 14 aa, Mycobacterium tuberculosis
MADGIAATHLLAGL

SEQ ID NO: 139975 - protein, 14 aa, Mycobacterium tuberculosis
ADGIAATHLLAGLS

SEQ ID NO: 139976 - protein, 14 aa, Mycobacterium tuberculosis
DGIAATHLLAGLSD

SEQ ID NO: 139977 - protein, 14 aa, Mycobacterium tuberculosis
GIAATHLLAGLSDE

SEQ ID NO: 139978 - protein, 14 aa, Mycobacterium tuberculosis
IAATHLLAGLSDES

SEQ ID NO: 139979 - protein, 14 aa, Mycobacterium tuberculosis
AATHLLAGLSDESM

SEQ ID NO: 139980 - protein, 14 aa, Mycobacterium tuberculosis
ATHLLAGLSDESMS

SEQ ID NO: 139981 - protein, 14 aa, Mycobacterium tuberculosis
THLLAGLSDESMSD

SEQ ID NO: 139982 - protein, 14 aa, Mycobacterium tuberculosis
HLLAGLSDESMSDS

SEQ ID NO: 139983 - protein, 14 aa, Mycobacterium tuberculosis
LLAGLSDESMSDSF

SEQ ID NO: 139984 - protein, 14 aa, Mycobacterium tuberculosis
LAGLSDESMSDSFA

SEQ ID NO: 139985 - protein, 14 aa, Mycobacterium tuberculosis
AGLSDESMSDSFAS

SEQ ID NO: 139986 - protein, 14 aa, Mycobacterium tuberculosis
GLSDESMSDSFASN

SEQ ID NO: 139987 - protein, 14 aa, Mycobacterium tuberculosis
LSDESMSDSFASNI

SEQ ID NO: 139988 - protein, 14 aa, Mycobacterium tuberculosis
SDESMSDSFASNIH

SEQ ID NO: 139989 - protein, 14 aa, Mycobacterium tuberculosis
DESMSDSFASNIHT

SEQ ID NO: 139990 - protein, 14 aa, Mycobacterium tuberculosis
ESMSDSFASNIHTT

SEQ ID NO: 139991 - protein, 14 aa, Mycobacterium tuberculosis
SMSDSFASNIHTTM

SEQ ID NO: 139992 - protein, 14 aa, Mycobacterium tuberculosis
MSDSFASNIHTTMQ

SEQ ID NO: 139993 - protein, 14 aa, Mycobacterium tuberculosis
SDSFASNIHTTMQS

SEQ ID NO: 139994 - protein, 14 aa, Mycobacterium tuberculosis
DSFASNIHTTMQSQ

SEQ ID NO: 139995 - protein, 14 aa, Mycobacterium tuberculosis
SFASNIHTTMQSQS

SEQ ID NO: 139996 - protein, 14 aa, Mycobacterium tuberculosis
FASNIHTTMQSQSA

SEQ ID NO: 139997 - protein, 14 aa, Mycobacterium tuberculosis
ASNIHTTMQSQSAS

SEQ ID NO: 139998 - protein, 14 aa, Mycobacterium tuberculosis
SNIHTTMQSQSASV

SEQ ID NO: 139999 - protein, 14 aa, Mycobacterium tuberculosis
NIHTTMQSQSASVR

SEQ ID NO: 140000 - protein, 14 aa, Mycobacterium tuberculosis
IHTTMQSQSASVRR

SEQ ID NO: 140001 - protein, 14 aa, Mycobacterium tuberculosis
HTTMQSQSASVRRG

SEQ ID NO: 140002 - protein, 14 aa, Mycobacterium tuberculosis
TTMQSQSASVRRGG

SEQ ID NO: 140003 - protein, 14 aa, Mycobacterium tuberculosis
TMQSQSASVRRGGF

SEQ ID NO: 140004 - protein, 14 aa, Mycobacterium tuberculosis
MQSQSASVRRGGFR

SEQ ID NO: 140005 - protein, 14 aa, Mycobacterium tuberculosis
QSQSASVRRGGFRV

SEQ ID NO: 140006 - protein, 14 aa, Mycobacterium tuberculosis
SQSASVRRGGFRVN

SEQ ID NO: 140007 - protein, 14 aa, Mycobacterium tuberculosis
QSASVRRGGFRVNP

SEQ ID NO: 140008 - protein, 14 aa, Mycobacterium tuberculosis
SASVRRGGFRVNPS

SEQ ID NO: 140009 - protein, 14 aa, Mycobacterium tuberculosis
ASVRRGGFRVNPSE

SEQ ID NO: 140010 - protein, 14 aa, Mycobacterium tuberculosis
SVRRGGFRVNPSEA

SEQ ID NO: 140011 - protein, 14 aa, Mycobacterium tuberculosis
VRRGGFRVNPSEAL

SEQ ID NO: 140012 - protein, 14 aa, Mycobacterium tuberculosis
RRGGFRVNPSEALT

SEQ ID NO: 140013 - protein, 14 aa, Mycobacterium tuberculosis
RGGFRVNPSEALTA

SEQ ID NO: 140014 - protein, 14 aa, Mycobacterium tuberculosis
GGFRVNPSEALTAS

SEQ ID NO: 140015 - protein, 14 aa, Mycobacterium tuberculosis
GFRVNPSEALTAST

SEQ ID NO: 140016 - protein, 14 aa, Mycobacterium tuberculosis
FRVNPSEALTASTA

SEQ ID NO: 140017 - protein, 14 aa, Mycobacterium tuberculosis
RVNPSEALTASTAV

SEQ ID NO: 140018 - protein, 14 aa, Mycobacterium tuberculosis
VNPSEALTASTAVM

SEQ ID NO: 140019 - protein, 14 aa, Mycobacterium tuberculosis
NPSEALTASTAVMA

SEQ ID NO: 140020 - protein, 14 aa, Mycobacterium tuberculosis
PSEALTASTAVMAG

SEQ ID NO: 140021 - protein, 14 aa, Mycobacterium tuberculosis
SEALTASTAVMAGI

SEQ ID NO: 140022 - protein, 14 aa, Mycobacterium tuberculosis
EALTASTAVMAGIV

SEQ ID NO: 140023 - protein, 14 aa, Mycobacterium tuberculosis
ALTASTAVMAGIVR

SEQ ID NO: 140024 - protein, 14 aa, Mycobacterium tuberculosis
LTASTAVMAGIVRA

SEQ ID NO: 140025 - protein, 14 aa, Mycobacterium tuberculosis
TASTAVMAGIVRAA

SEQ ID NO: 140026 - protein, 14 aa, Mycobacterium tuberculosis
ASTAVMAGIVRAAK

SEQ ID NO: 140027 - protein, 14 aa, Mycobacterium tuberculosis
STAVMAGIVRAAKG

SEQ ID NO: 140028 - protein, 14 aa, Mycobacterium tuberculosis
TAVMAGIVRAAKGA

SEQ ID NO: 140029 - protein, 14 aa, Mycobacterium tuberculosis
AVMAGIVRAAKGAS

SEQ ID NO: 140030 - protein, 14 aa, Mycobacterium tuberculosis
VMAGIVRAAKGASE

SEQ ID NO: 140031 - protein, 14 aa, Mycobacterium tuberculosis
MAGIVRAAKGASEI

SEQ ID NO: 140032 - protein, 14 aa, Mycobacterium tuberculosis
AGIVRAAKGASEIA

SEQ ID NO: 140033 - protein, 14 aa, Mycobacterium tuberculosis
GIVRAAKGASEIAA

SEQ ID NO: 140034 - protein, 14 aa, Mycobacterium tuberculosis
IVRAAKGASEIAAG

SEQ ID NO: 140035 - protein, 14 aa, Mycobacterium tuberculosis
VRAAKGASEIAAGV

SEQ ID NO: 140036 - protein, 14 aa, Mycobacterium tuberculosis
RAAKGASEIAAGVL

SEQ ID NO: 140037 - protein, 14 aa, Mycobacterium tuberculosis
AAKGASEIAAGVLS

SEQ ID NO: 140038 - protein, 14 aa, Mycobacterium tuberculosis
AKGASEIAAGVLSP

SEQ ID NO: 140039 - protein, 14 aa, Mycobacterium tuberculosis
KGASEIAAGVLSPA

SEQ ID NO: 140040 - protein, 14 aa, Mycobacterium tuberculosis
GASEIAAGVLSPAA

SEQ ID NO: 140041 - protein, 14 aa, Mycobacterium tuberculosis
ASEIAAGVLSPAAS

SEQ ID NO: 140042 - protein, 14 aa, Mycobacterium tuberculosis
SEIAAGVLSPAASS

SEQ ID NO: 140043 - protein, 14 aa, Mycobacterium tuberculosis
EIAAGVLSPAASSL

SEQ ID NO: 140044 - protein, 14 aa, Mycobacterium tuberculosis
IAAGVLSPAASSLN

SEQ ID NO: 140045 - protein, 14 aa, Mycobacterium tuberculosis
AAGVLSPAASSLNG

SEQ ID NO: 140046 - protein, 14 aa, Mycobacterium tuberculosis
AGVLSPAASSLNGP

SEQ ID NO: 140047 - protein, 14 aa, Mycobacterium tuberculosis
GVLSPAASSLNGPI

SEQ ID NO: 140048 - protein, 14 aa, Mycobacterium tuberculosis
VLSPAASSLNGPIS

SEQ ID NO: 140049 - protein, 14 aa, Mycobacterium tuberculosis
LSPAASSLNGPISD

SEQ ID NO: 140050 - protein, 14 aa, Mycobacterium tuberculosis
SPAASSLNGPISDL

SEQ ID NO: 140051 - protein, 14 aa, Mycobacterium tuberculosis
PAASSLNGPISDLR

SEQ ID NO: 140052 - protein, 14 aa, Mycobacterium tuberculosis
AASSLNGPISDLRR

SEQ ID NO: 140053 - protein, 14 aa, Mycobacterium tuberculosis
ASSLNGPISDLRRY

SEQ ID NO: 140054 - protein, 14 aa, Mycobacterium tuberculosis
SSLNGPISDLRRYS

SEQ ID NO: 140055 - protein, 14 aa, Mycobacterium tuberculosis
SLNGPISDLRRYSA

SEQ ID NO: 140056 - protein, 14 aa, Mycobacterium tuberculosis
LNGPISDLRRYSAA

SEQ ID NO: 140057 - protein, 14 aa, Mycobacterium tuberculosis
NGPISDLRRYSAAK

SEQ ID NO: 140058 - protein, 14 aa, Mycobacterium tuberculosis
GPISDLRRYSAAKV

SEQ ID NO: 140059 - protein, 14 aa, Mycobacterium tuberculosis
PISDLRRYSAAKVP

SEQ ID NO: 140060 - protein, 14 aa, Mycobacterium tuberculosis
ISDLRRYSAAKVPL

SEQ ID NO: 140061 - protein, 14 aa, Mycobacterium tuberculosis
SDLRRYSAAKVPLA

SEQ ID NO: 140062 - protein, 14 aa, Mycobacterium tuberculosis
DLRRYSAAKVPLAD

SEQ ID NO: 140063 - protein, 14 aa, Mycobacterium tuberculosis
LRRYSAAKVPLADV

SEQ ID NO: 140064 - protein, 14 aa, Mycobacterium tuberculosis
RRYSAAKVPLADVE

SEQ ID NO: 140065 - protein, 14 aa, Mycobacterium tuberculosis
RYSAAKVPLADVEQ

SEQ ID NO: 140066 - protein, 14 aa, Mycobacterium tuberculosis
YSAAKVPLADVEQV

SEQ ID NO: 140067 - protein, 14 aa, Mycobacterium tuberculosis
SAAKVPLADVEQVC

SEQ ID NO: 140068 - protein, 14 aa, Mycobacterium tuberculosis
AAKVPLADVEQVCR

SEQ ID NO: 140069 - protein, 14 aa, Mycobacterium tuberculosis
AKVPLADVEQVCRK

SEQ ID NO: 140070 - protein, 14 aa, Mycobacterium tuberculosis
KVPLADVEQVCRKF

SEQ ID NO: 140071 - protein, 14 aa, Mycobacterium tuberculosis
VPLADVEQVCRKFD

SEQ ID NO: 140072 - protein, 14 aa, Mycobacterium tuberculosis
PLADVEQVCRKFDV

SEQ ID NO: 140073 - protein, 14 aa, Mycobacterium tuberculosis
LADVEQVCRKFDVT

SEQ ID NO: 140074 - protein, 14 aa, Mycobacterium tuberculosis
ADVEQVCRKFDVTI

SEQ ID NO: 140075 - protein, 14 aa, Mycobacterium tuberculosis
DVEQVCRKFDVTIN

SEQ ID NO: 140076 - protein, 14 aa, Mycobacterium tuberculosis
VEQVCRKFDVTIND

SEQ ID NO: 140077 - protein, 14 aa, Mycobacterium tuberculosis
EQVCRKFDVTINDV

SEQ ID NO: 140078 - protein, 14 aa, Mycobacterium tuberculosis
QVCRKFDVTINDVA

SEQ ID NO: 140079 - protein, 14 aa, Mycobacterium tuberculosis
VCRKFDVTINDVAL

SEQ ID NO: 140080 - protein, 14 aa, Mycobacterium tuberculosis
CRKFDVTINDVALA

SEQ ID NO: 140081 - protein, 14 aa, Mycobacterium tuberculosis
RKFDVTINDVALAA

SEQ ID NO: 140082 - protein, 14 aa, Mycobacterium tuberculosis
KFDVTINDVALAAI

SEQ ID NO: 140083 - protein, 14 aa, Mycobacterium tuberculosis
FDVTINDVALAAIT

SEQ ID NO: 140084 - protein, 14 aa, Mycobacterium tuberculosis
DVTINDVALAAITE

SEQ ID NO: 140085 - protein, 14 aa, Mycobacterium tuberculosis
VTINDVALAAITES

SEQ ID NO: 140086 - protein, 14 aa, Mycobacterium tuberculosis
TINDVALAAITESY

SEQ ID NO: 140087 - protein, 14 aa, Mycobacterium tuberculosis
INDVALAAITESYR

SEQ ID NO: 140088 - protein, 14 aa, Mycobacterium tuberculosis
NDVALAAITESYRN

SEQ ID NO: 140089 - protein, 14 aa, Mycobacterium tuberculosis
DVALAAITESYRNV

SEQ ID NO: 140090 - protein, 14 aa, Mycobacterium tuberculosis
VALAAITESYRNVL

SEQ ID NO: 140091 - protein, 14 aa, Mycobacterium tuberculosis
ALAAITESYRNVLI

SEQ ID NO: 140092 - protein, 14 aa, Mycobacterium tuberculosis
LAAITESYRNVLIQ

SEQ ID NO: 140093 - protein, 14 aa, Mycobacterium tuberculosis
AAITESYRNVLIQR

SEQ ID NO: 140094 - protein, 14 aa, Mycobacterium tuberculosis
AITESYRNVLIQRG

SEQ ID NO: 140095 - protein, 14 aa, Mycobacterium tuberculosis
ITESYRNVLIQRGE

SEQ ID NO: 140096 - protein, 14 aa, Mycobacterium tuberculosis
TESYRNVLIQRGER

SEQ ID NO: 140097 - protein, 14 aa, Mycobacterium tuberculosis
ESYRNVLIQRGERP

SEQ ID NO: 140098 - protein, 14 aa, Mycobacterium tuberculosis
SYRNVLIQRGERPR

SEQ ID NO: 140099 - protein, 14 aa, Mycobacterium tuberculosis
YRNVLIQRGERPRF

SEQ ID NO: 140100 - protein, 14 aa, Mycobacterium tuberculosis
RNVLIQRGERPRFD

SEQ ID NO: 140101 - protein, 14 aa, Mycobacterium tuberculosis
NVLIQRGERPRFDS

SEQ ID NO: 140102 - protein, 14 aa, Mycobacterium tuberculosis
VLIQRGERPRFDSL

SEQ ID NO: 140103 - protein, 14 aa, Mycobacterium tuberculosis
LIQRGERPRFDSLR

SEQ ID NO: 140104 - protein, 14 aa, Mycobacterium tuberculosis
IQRGERPRFDSLRT

SEQ ID NO: 140105 - protein, 14 aa, Mycobacterium tuberculosis
QRGERPRFDSLRTL

SEQ ID NO: 140106 - protein, 14 aa, Mycobacterium tuberculosis
RGERPRFDSLRTLV

SEQ ID NO: 140107 - protein, 14 aa, Mycobacterium tuberculosis
GERPRFDSLRTLVP

SEQ ID NO: 140108 - protein, 14 aa, Mycobacterium tuberculosis
ERPRFDSLRTLVPV

SEQ ID NO: 140109 - protein, 14 aa, Mycobacterium tuberculosis
RPRFDSLRTLVPVS

SEQ ID NO: 140110 - protein, 14 aa, Mycobacterium tuberculosis
PRFDSLRTLVPVST

SEQ ID NO: 140111 - protein, 14 aa, Mycobacterium tuberculosis
RFDSLRTLVPVSTR

SEQ ID NO: 140112 - protein, 14 aa, Mycobacterium tuberculosis
FDSLRTLVPVSTRS

SEQ ID NO: 140113 - protein, 14 aa, Mycobacterium tuberculosis
DSLRTLVPVSTRSN

SEQ ID NO: 140114 - protein, 14 aa, Mycobacterium tuberculosis
SLRTLVPVSTRSNS

SEQ ID NO: 140115 - protein, 14 aa, Mycobacterium tuberculosis
LRTLVPVSTRSNSA

SEQ ID NO: 140116 - protein, 14 aa, Mycobacterium tuberculosis
RTLVPVSTRSNSAL

SEQ ID NO: 140117 - protein, 14 aa, Mycobacterium tuberculosis
TLVPVSTRSNSALS

SEQ ID NO: 140118 - protein, 14 aa, Mycobacterium tuberculosis
LVPVSTRSNSALSK

SEQ ID NO: 140119 - protein, 14 aa, Mycobacterium tuberculosis
VPVSTRSNSALSKT

SEQ ID NO: 140120 - protein, 14 aa, Mycobacterium tuberculosis
PVSTRSNSALSKTD

SEQ ID NO: 140121 - protein, 14 aa, Mycobacterium tuberculosis
VSTRSNSALSKTDN

SEQ ID NO: 140122 - protein, 14 aa, Mycobacterium tuberculosis
STRSNSALSKTDNR

SEQ ID NO: 140123 - protein, 14 aa, Mycobacterium tuberculosis
TRSNSALSKTDNRV

SEQ ID NO: 140124 - protein, 14 aa, Mycobacterium tuberculosis
RSNSALSKTDNRVS

SEQ ID NO: 140125 - protein, 14 aa, Mycobacterium tuberculosis
SNSALSKTDNRVSL

SEQ ID NO: 140126 - protein, 14 aa, Mycobacterium tuberculosis
NSALSKTDNRVSLM

SEQ ID NO: 140127 - protein, 14 aa, Mycobacterium tuberculosis
SALSKTDNRVSLML

SEQ ID NO: 140128 - protein, 14 aa, Mycobacterium tuberculosis
ALSKTDNRVSLMLP

SEQ ID NO: 140129 - protein, 14 aa, Mycobacterium tuberculosis
LSKTDNRVSLMLPN

SEQ ID NO: 140130 - protein, 14 aa, Mycobacterium tuberculosis
SKTDNRVSLMLPNL

SEQ ID NO: 140131 - protein, 14 aa, Mycobacterium tuberculosis
KTDNRVSLMLPNLP

SEQ ID NO: 140132 - protein, 14 aa, Mycobacterium tuberculosis
TDNRVSLMLPNLPV

SEQ ID NO: 140133 - protein, 14 aa, Mycobacterium tuberculosis
DNRVSLMLPNLPVD

SEQ ID NO: 140134 - protein, 14 aa, Mycobacterium tuberculosis
NRVSLMLPNLPVDQ

SEQ ID NO: 140135 - protein, 14 aa, Mycobacterium tuberculosis
RVSLMLPNLPVDQE

SEQ ID NO: 140136 - protein, 14 aa, Mycobacterium tuberculosis
VSLMLPNLPVDQEN

SEQ ID NO: 140137 - protein, 14 aa, Mycobacterium tuberculosis
SLMLPNLPVDQENP

SEQ ID NO: 140138 - protein, 14 aa, Mycobacterium tuberculosis
LMLPNLPVDQENPL

SEQ ID NO: 140139 - protein, 14 aa, Mycobacterium tuberculosis
MLPNLPVDQENPLQ

SEQ ID NO: 140140 - protein, 14 aa, Mycobacterium tuberculosis
LPNLPVDQENPLQR

SEQ ID NO: 140141 - protein, 14 aa, Mycobacterium tuberculosis
PNLPVDQENPLQRL

SEQ ID NO: 140142 - protein, 14 aa, Mycobacterium tuberculosis
NLPVDQENPLQRLR

SEQ ID NO: 140143 - protein, 14 aa, Mycobacterium tuberculosis
LPVDQENPLQRLRI

SEQ ID NO: 140144 - protein, 14 aa, Mycobacterium tuberculosis
PVDQENPLQRLRIV

SEQ ID NO: 140145 - protein, 14 aa, Mycobacterium tuberculosis
VDQENPLQRLRIVH

SEQ ID NO: 140146 - protein, 14 aa, Mycobacterium tuberculosis
DQENPLQRLRIVHS

SEQ ID NO: 140147 - protein, 14 aa, Mycobacterium tuberculosis
QENPLQRLRIVHSR

SEQ ID NO: 140148 - protein, 14 aa, Mycobacterium tuberculosis
ENPLQRLRIVHSRL

SEQ ID NO: 140149 - protein, 14 aa, Mycobacterium tuberculosis
NPLQRLRIVHSRLT

SEQ ID NO: 140150 - protein, 14 aa, Mycobacterium tuberculosis
PLQRLRIVHSRLTR

SEQ ID NO: 140151 - protein, 14 aa, Mycobacterium tuberculosis
LQRLRIVHSRLTRA

SEQ ID NO: 140152 - protein, 14 aa, Mycobacterium tuberculosis
QRLRIVHSRLTRAK

SEQ ID NO: 140153 - protein, 14 aa, Mycobacterium tuberculosis
RLRIVHSRLTRAKA

SEQ ID NO: 140154 - protein, 14 aa, Mycobacterium tuberculosis
LRIVHSRLTRAKAG

SEQ ID NO: 140155 - protein, 14 aa, Mycobacterium tuberculosis
RIVHSRLTRAKAGG

SEQ ID NO: 140156 - protein, 14 aa, Mycobacterium tuberculosis
IVHSRLTRAKAGGQ

SEQ ID NO: 140157 - protein, 14 aa, Mycobacterium tuberculosis
VHSRLTRAKAGGQR

SEQ ID NO: 140158 - protein, 14 aa, Mycobacterium tuberculosis
HSRLTRAKAGGQRQ

SEQ ID NO: 140159 - protein, 14 aa, Mycobacterium tuberculosis
SRLTRAKAGGQRQF

SEQ ID NO: 140160 - protein, 14 aa, Mycobacterium tuberculosis
RLTRAKAGGQRQFG

SEQ ID NO: 140161 - protein, 14 aa, Mycobacterium tuberculosis
LTRAKAGGQRQFGN

SEQ ID NO: 140162 - protein, 14 aa, Mycobacterium tuberculosis
TRAKAGGQRQFGNT

SEQ ID NO: 140163 - protein, 14 aa, Mycobacterium tuberculosis
RAKAGGQRQFGNTL

SEQ ID NO: 140164 - protein, 14 aa, Mycobacterium tuberculosis
AKAGGQRQFGNTLM

SEQ ID NO: 140165 - protein, 14 aa, Mycobacterium tuberculosis
KAGGQRQFGNTLMA

SEQ ID NO: 140166 - protein, 14 aa, Mycobacterium tuberculosis
AGGQRQFGNTLMAI

SEQ ID NO: 140167 - protein, 14 aa, Mycobacterium tuberculosis
GGQRQFGNTLMAIA

SEQ ID NO: 140168 - protein, 14 aa, Mycobacterium tuberculosis
GQRQFGNTLMAIAN

SEQ ID NO: 140169 - protein, 14 aa, Mycobacterium tuberculosis
QRQFGNTLMAIANR

SEQ ID NO: 140170 - protein, 14 aa, Mycobacterium tuberculosis
RQFGNTLMAIANRL

SEQ ID NO: 140171 - protein, 14 aa, Mycobacterium tuberculosis
QFGNTLMAIANRLP

SEQ ID NO: 140172 - protein, 14 aa, Mycobacterium tuberculosis
FGNTLMAIANRLPF

SEQ ID NO: 140173 - protein, 14 aa, Mycobacterium tuberculosis
GNTLMAIANRLPFP

SEQ ID NO: 140174 - protein, 14 aa, Mycobacterium tuberculosis
NTLMAIANRLPFPM

SEQ ID NO: 140175 - protein, 14 aa, Mycobacterium tuberculosis
TLMAIANRLPFPMT

SEQ ID NO: 140176 - protein, 14 aa, Mycobacterium tuberculosis
LMAIANRLPFPMTA

SEQ ID NO: 140177 - protein, 14 aa, Mycobacterium tuberculosis
MAIANRLPFPMTAW

SEQ ID NO: 140178 - protein, 14 aa, Mycobacterium tuberculosis
AIANRLPFPMTAWA

SEQ ID NO: 140179 - protein, 14 aa, Mycobacterium tuberculosis
IANRLPFPMTAWAV

SEQ ID NO: 140180 - protein, 14 aa, Mycobacterium tuberculosis
ANRLPFPMTAWAVG

SEQ ID NO: 140181 - protein, 14 aa, Mycobacterium tuberculosis
NRLPFPMTAWAVGL

SEQ ID NO: 140182 - protein, 14 aa, Mycobacterium tuberculosis
RLPFPMTAWAVGLL

SEQ ID NO: 140183 - protein, 14 aa, Mycobacterium tuberculosis
LPFPMTAWAVGLLM

SEQ ID NO: 140184 - protein, 14 aa, Mycobacterium tuberculosis
PFPMTAWAVGLLMR

SEQ ID NO: 140185 - protein, 14 aa, Mycobacterium tuberculosis
FPMTAWAVGLLMRL

SEQ ID NO: 140186 - protein, 14 aa, Mycobacterium tuberculosis
PMTAWAVGLLMRLP

SEQ ID NO: 140187 - protein, 14 aa, Mycobacterium tuberculosis
MTAWAVGLLMRLPQ

SEQ ID NO: 140188 - protein, 14 aa, Mycobacterium tuberculosis
TAWAVGLLMRLPQR

SEQ ID NO: 140189 - protein, 14 aa, Mycobacterium tuberculosis
AWAVGLLMRLPQRG

SEQ ID NO: 140190 - protein, 14 aa, Mycobacterium tuberculosis
WAVGLLMRLPQRGV

SEQ ID NO: 140191 - protein, 14 aa, Mycobacterium tuberculosis
AVGLLMRLPQRGVV

SEQ ID NO: 140192 - protein, 14 aa, Mycobacterium tuberculosis
VGLLMRLPQRGVVT

SEQ ID NO: 140193 - protein, 14 aa, Mycobacterium tuberculosis
GLLMRLPQRGVVTV

SEQ ID NO: 140194 - protein, 14 aa, Mycobacterium tuberculosis
LLMRLPQRGVVTVA

SEQ ID NO: 140195 - protein, 14 aa, Mycobacterium tuberculosis
LMRLPQRGVVTVAT

SEQ ID NO: 140196 - protein, 14 aa, Mycobacterium tuberculosis
MRLPQRGVVTVATN

SEQ ID NO: 140197 - protein, 14 aa, Mycobacterium tuberculosis
RLPQRGVVTVATNV

SEQ ID NO: 140198 - protein, 14 aa, Mycobacterium tuberculosis
LPQRGVVTVATNVP

SEQ ID NO: 140199 - protein, 14 aa, Mycobacterium tuberculosis
PQRGVVTVATNVPG

SEQ ID NO: 140200 - protein, 14 aa, Mycobacterium tuberculosis
QRGVVTVATNVPGP

SEQ ID NO: 140201 - protein, 14 aa, Mycobacterium tuberculosis
RGVVTVATNVPGPR

SEQ ID NO: 140202 - protein, 14 aa, Mycobacterium tuberculosis
GVVTVATNVPGPRR

SEQ ID NO: 140203 - protein, 14 aa, Mycobacterium tuberculosis
VVTVATNVPGPRRP

SEQ ID NO: 140204 - protein, 14 aa, Mycobacterium tuberculosis
VTVATNVPGPRRPL

SEQ ID NO: 140205 - protein, 14 aa, Mycobacterium tuberculosis
TVATNVPGPRRPLQ

SEQ ID NO: 140206 - protein, 14 aa, Mycobacterium tuberculosis
VATNVPGPRRPLQI

SEQ ID NO: 140207 - protein, 14 aa, Mycobacterium tuberculosis
ATNVPGPRRPLQIM

SEQ ID NO: 140208 - protein, 14 aa, Mycobacterium tuberculosis
TNVPGPRRPLQIMG

SEQ ID NO: 140209 - protein, 14 aa, Mycobacterium tuberculosis
NVPGPRRPLQIMGR

SEQ ID NO: 140210 - protein, 14 aa, Mycobacterium tuberculosis
VPGPRRPLQIMGRR

SEQ ID NO: 140211 - protein, 14 aa, Mycobacterium tuberculosis
PGPRRPLQIMGRRV

SEQ ID NO: 140212 - protein, 14 aa, Mycobacterium tuberculosis
GPRRPLQIMGRRVL

SEQ ID NO: 140213 - protein, 14 aa, Mycobacterium tuberculosis
PRRPLQIMGRRVLD

SEQ ID NO: 140214 - protein, 14 aa, Mycobacterium tuberculosis
RRPLQIMGRRVLDL

SEQ ID NO: 140215 - protein, 14 aa, Mycobacterium tuberculosis
RPLQIMGRRVLDLY

SEQ ID NO: 140216 - protein, 14 aa, Mycobacterium tuberculosis
PLQIMGRRVLDLYP

SEQ ID NO: 140217 - protein, 14 aa, Mycobacterium tuberculosis
LQIMGRRVLDLYPV

SEQ ID NO: 140218 - protein, 14 aa, Mycobacterium tuberculosis
QIMGRRVLDLYPVS

SEQ ID NO: 140219 - protein, 14 aa, Mycobacterium tuberculosis
IMGRRVLDLYPVSP

SEQ ID NO: 140220 - protein, 14 aa, Mycobacterium tuberculosis
MGRRVLDLYPVSPI

SEQ ID NO: 140221 - protein, 14 aa, Mycobacterium tuberculosis
GRRVLDLYPVSPIA

SEQ ID NO: 140222 - protein, 14 aa, Mycobacterium tuberculosis
RRVLDLYPVSPIAM

SEQ ID NO: 140223 - protein, 14 aa, Mycobacterium tuberculosis
RVLDLYPVSPIAMQ

SEQ ID NO: 140224 - protein, 14 aa, Mycobacterium tuberculosis
VLDLYPVSPIAMQL

SEQ ID NO: 140225 - protein, 14 aa, Mycobacterium tuberculosis
LDLYPVSPIAMQLR

SEQ ID NO: 140226 - protein, 14 aa, Mycobacterium tuberculosis
DLYPVSPIAMQLRT

SEQ ID NO: 140227 - protein, 14 aa, Mycobacterium tuberculosis
LYPVSPIAMQLRTS

SEQ ID NO: 140228 - protein, 14 aa, Mycobacterium tuberculosis
YPVSPIAMQLRTSV

SEQ ID NO: 140229 - protein, 14 aa, Mycobacterium tuberculosis
PVSPIAMQLRTSVA

SEQ ID NO: 140230 - protein, 14 aa, Mycobacterium tuberculosis
VSPIAMQLRTSVAM

SEQ ID NO: 140231 - protein, 14 aa, Mycobacterium tuberculosis
SPIAMQLRTSVAML

SEQ ID NO: 140232 - protein, 14 aa, Mycobacterium tuberculosis
PIAMQLRTSVAMLS

SEQ ID NO: 140233 - protein, 14 aa, Mycobacterium tuberculosis
IAMQLRTSVAMLSY

SEQ ID NO: 140234 - protein, 14 aa, Mycobacterium tuberculosis
AMQLRTSVAMLSYA

SEQ ID NO: 140235 - protein, 14 aa, Mycobacterium tuberculosis
MQLRTSVAMLSYAD

SEQ ID NO: 140236 - protein, 14 aa, Mycobacterium tuberculosis
QLRTSVAMLSYADD

SEQ ID NO: 140237 - protein, 14 aa, Mycobacterium tuberculosis
LRTSVAMLSYADDL

SEQ ID NO: 140238 - protein, 14 aa, Mycobacterium tuberculosis
RTSVAMLSYADDLY

SEQ ID NO: 140239 - protein, 14 aa, Mycobacterium tuberculosis
TSVAMLSYADDLYF

SEQ ID NO: 140240 - protein, 14 aa, Mycobacterium tuberculosis
SVAMLSYADDLYFG

SEQ ID NO: 140241 - protein, 14 aa, Mycobacterium tuberculosis
VAMLSYADDLYFGI

SEQ ID NO: 140242 - protein, 14 aa, Mycobacterium tuberculosis
AMLSYADDLYFGIL

SEQ ID NO: 140243 - protein, 14 aa, Mycobacterium tuberculosis
MLSYADDLYFGILA

SEQ ID NO: 140244 - protein, 14 aa, Mycobacterium tuberculosis
LSYADDLYFGILAD

SEQ ID NO: 140245 - protein, 14 aa, Mycobacterium tuberculosis
SYADDLYFGILADY

SEQ ID NO: 140246 - protein, 14 aa, Mycobacterium tuberculosis
YADDLYFGILADYD

SEQ ID NO: 140247 - protein, 14 aa, Mycobacterium tuberculosis
ADDLYFGILADYDV

SEQ ID NO: 140248 - protein, 14 aa, Mycobacterium tuberculosis
DDLYFGILADYDVV

SEQ ID NO: 140249 - protein, 14 aa, Mycobacterium tuberculosis
DLYFGILADYDVVA

SEQ ID NO: 140250 - protein, 14 aa, Mycobacterium tuberculosis
LYFGILADYDVVAD

SEQ ID NO: 140251 - protein, 14 aa, Mycobacterium tuberculosis
YFGILADYDVVADA

SEQ ID NO: 140252 - protein, 14 aa, Mycobacterium tuberculosis
FGILADYDVVADAG

SEQ ID NO: 140253 - protein, 14 aa, Mycobacterium tuberculosis
GILADYDVVADAGQ

SEQ ID NO: 140254 - protein, 14 aa, Mycobacterium tuberculosis
ILADYDVVADAGQL

SEQ ID NO: 140255 - protein, 14 aa, Mycobacterium tuberculosis
LADYDVVADAGQLA

SEQ ID NO: 140256 - protein, 14 aa, Mycobacterium tuberculosis
ADYDVVADAGQLAR

SEQ ID NO: 140257 - protein, 14 aa, Mycobacterium tuberculosis
DYDVVADAGQLARG

SEQ ID NO: 140258 - protein, 14 aa, Mycobacterium tuberculosis
YDVVADAGQLARGI

SEQ ID NO: 140259 - protein, 14 aa, Mycobacterium tuberculosis
DVVADAGQLARGIE

SEQ ID NO: 140260 - protein, 14 aa, Mycobacterium tuberculosis
VVADAGQLARGIED

SEQ ID NO: 140261 - protein, 14 aa, Mycobacterium tuberculosis
VADAGQLARGIEDA

SEQ ID NO: 140262 - protein, 14 aa, Mycobacterium tuberculosis
ADAGQLARGIEDAV

SEQ ID NO: 140263 - protein, 14 aa, Mycobacterium tuberculosis
DAGQLARGIEDAVA

SEQ ID NO: 140264 - protein, 14 aa, Mycobacterium tuberculosis
AGQLARGIEDAVAR

SEQ ID NO: 140265 - protein, 14 aa, Mycobacterium tuberculosis
GQLARGIEDAVARL

SEQ ID NO: 140266 - protein, 14 aa, Mycobacterium tuberculosis
QLARGIEDAVARLV

SEQ ID NO: 140267 - protein, 14 aa, Mycobacterium tuberculosis
LARGIEDAVARLVA

SEQ ID NO: 140268 - protein, 14 aa, Mycobacterium tuberculosis
ARGIEDAVARLVAI

SEQ ID NO: 140269 - protein, 14 aa, Mycobacterium tuberculosis
RGIEDAVARLVAIS

SEQ ID NO: 140270 - protein, 14 aa, Mycobacterium tuberculosis
GIEDAVARLVAISK

SEQ ID NO: 140271 - protein, 14 aa, Mycobacterium tuberculosis
IEDAVARLVAISKR

SEQ ID NO: 140272 - protein, 14 aa, Mycobacterium tuberculosis
EDAVARLVAISKRR

SEQ ID NO: 140273 - protein, 14 aa, Mycobacterium tuberculosis
DAVARLVAISKRRK

SEQ ID NO: 140274 - protein, 14 aa, Mycobacterium tuberculosis
AVARLVAISKRRKV

SEQ ID NO: 140275 - protein, 14 aa, Mycobacterium tuberculosis
VARLVAISKRRKVT

SEQ ID NO: 140276 - protein, 14 aa, Mycobacterium tuberculosis
ARLVAISKRRKVTR

SEQ ID NO: 140277 - protein, 14 aa, Mycobacterium tuberculosis
RLVAISKRRKVTRR

SEQ ID NO: 140278 - protein, 14 aa, Mycobacterium tuberculosis
LVAISKRRKVTRRR

SEQ ID NO: 140279 - protein, 14 aa, Mycobacterium tuberculosis
VAISKRRKVTRRRG

SEQ ID NO: 140280 - protein, 14 aa, Mycobacterium tuberculosis
AISKRRKVTRRRGA

SEQ ID NO: 140281 - protein, 14 aa, Mycobacterium tuberculosis
ISKRRKVTRRRGAL

SEQ ID NO: 140282 - protein, 14 aa, Mycobacterium tuberculosis
SKRRKVTRRRGALS

SEQ ID NO: 140283 - protein, 14 aa, Mycobacterium tuberculosis
KRRKVTRRRGALSL

SEQ ID NO: 140284 - protein, 14 aa, Mycobacterium tuberculosis
RRKVTRRRGALSLV

SEQ ID NO: 140285 - protein, 14 aa, Mycobacterium tuberculosis
RKVTRRRGALSLVV

SEQ ID NO: 140286 - protein, 15 aa, Mycobacterium tuberculosis
MNHLTTLDAGFLKAE

SEQ ID NO: 140287 - protein, 15 aa, Mycobacterium tuberculosis
NHLTTLDAGFLKAED

SEQ ID NO: 140288 - protein, 15 aa, Mycobacterium tuberculosis
HLTTLDAGFLKAEDV

SEQ ID NO: 140289 - protein, 15 aa, Mycobacterium tuberculosis
LTTLDAGFLKAEDVD

SEQ ID NO: 140290 - protein, 15 aa, Mycobacterium tuberculosis
TTLDAGFLKAEDVDR

SEQ ID NO: 140291 - protein, 15 aa, Mycobacterium tuberculosis
TLDAGFLKAEDVDRH

SEQ ID NO: 140292 - protein, 15 aa, Mycobacterium tuberculosis
LDAGFLKAEDVDRHV

SEQ ID NO: 140293 - protein, 15 aa, Mycobacterium tuberculosis
DAGFLKAEDVDRHVS

SEQ ID NO: 140294 - protein, 15 aa, Mycobacterium tuberculosis
AGFLKAEDVDRHVSL

SEQ ID NO: 140295 - protein, 15 aa, Mycobacterium tuberculosis
GFLKAEDVDRHVSLA

SEQ ID NO: 140296 - protein, 15 aa, Mycobacterium tuberculosis
FLKAEDVDRHVSLAI

SEQ ID NO: 140297 - protein, 15 aa, Mycobacterium tuberculosis
LKAEDVDRHVSLAIG

SEQ ID NO: 140298 - protein, 15 aa, Mycobacterium tuberculosis
KAEDVDRHVSLAIGA

SEQ ID NO: 140299 - protein, 15 aa, Mycobacterium tuberculosis
AEDVDRHVSLAIGAL

SEQ ID NO: 140300 - protein, 15 aa, Mycobacterium tuberculosis
EDVDRHVSLAIGALA

SEQ ID NO: 140301 - protein, 15 aa, Mycobacterium tuberculosis
DVDRHVSLAIGALAV

SEQ ID NO: 140302 - protein, 15 aa, Mycobacterium tuberculosis
VDRHVSLAIGALAVI

SEQ ID NO: 140303 - protein, 15 aa, Mycobacterium tuberculosis
DRHVSLAIGALAVIE

SEQ ID NO: 140304 - protein, 15 aa, Mycobacterium tuberculosis
RHVSLAIGALAVIEG

SEQ ID NO: 140305 - protein, 15 aa, Mycobacterium tuberculosis
HVSLAIGALAVIEGP

SEQ ID NO: 140306 - protein, 15 aa, Mycobacterium tuberculosis
VSLAIGALAVIEGPA

SEQ ID NO: 140307 - protein, 15 aa, Mycobacterium tuberculosis
SLAIGALAVIEGPAP

SEQ ID NO: 140308 - protein, 15 aa, Mycobacterium tuberculosis
LAIGALAVIEGPAPD

SEQ ID NO: 140309 - protein, 15 aa, Mycobacterium tuberculosis
AIGALAVIEGPAPDQ

SEQ ID NO: 140310 - protein, 15 aa, Mycobacterium tuberculosis
IGALAVIEGPAPDQE

SEQ ID NO: 140311 - protein, 15 aa, Mycobacterium tuberculosis
GALAVIEGPAPDQEA

SEQ ID NO: 140312 - protein, 15 aa, Mycobacterium tuberculosis
ALAVIEGPAPDQEAF

SEQ ID NO: 140313 - protein, 15 aa, Mycobacterium tuberculosis
LAVIEGPAPDQEAFL

SEQ ID NO: 140314 - protein, 15 aa, Mycobacterium tuberculosis
AVIEGPAPDQEAFLS

SEQ ID NO: 140315 - protein, 15 aa, Mycobacterium tuberculosis
VIEGPAPDQEAFLSS

SEQ ID NO: 140316 - protein, 15 aa, Mycobacterium tuberculosis
IEGPAPDQEAFLSSL

SEQ ID NO: 140317 - protein, 15 aa, Mycobacterium tuberculosis
EGPAPDQEAFLSSLA

SEQ ID NO: 140318 - protein, 15 aa, Mycobacterium tuberculosis
GPAPDQEAFLSSLAQ

SEQ ID NO: 140319 - protein, 15 aa, Mycobacterium tuberculosis
PAPDQEAFLSSLAQR

SEQ ID NO: 140320 - protein, 15 aa, Mycobacterium tuberculosis
APDQEAFLSSLAQRL

SEQ ID NO: 140321 - protein, 15 aa, Mycobacterium tuberculosis
PDQEAFLSSLAQRLR

SEQ ID NO: 140322 - protein, 15 aa, Mycobacterium tuberculosis
DQEAFLSSLAQRLRP

SEQ ID NO: 140323 - protein, 15 aa, Mycobacterium tuberculosis
QEAFLSSLAQRLRPC

SEQ ID NO: 140324 - protein, 15 aa, Mycobacterium tuberculosis
EAFLSSLAQRLRPCT

SEQ ID NO: 140325 - protein, 15 aa, Mycobacterium tuberculosis
AFLSSLAQRLRPCTR

SEQ ID NO: 140326 - protein, 15 aa, Mycobacterium tuberculosis
FLSSLAQRLRPCTRF

SEQ ID NO: 140327 - protein, 15 aa, Mycobacterium tuberculosis
LSSLAQRLRPCTRFG

SEQ ID NO: 140328 - protein, 15 aa, Mycobacterium tuberculosis
SSLAQRLRPCTRFGQ

SEQ ID NO: 140329 - protein, 15 aa, Mycobacterium tuberculosis
SLAQRLRPCTRFGQR

SEQ ID NO: 140330 - protein, 15 aa, Mycobacterium tuberculosis
LAQRLRPCTRFGQRL

SEQ ID NO: 140331 - protein, 15 aa, Mycobacterium tuberculosis
AQRLRPCTRFGQRLR

SEQ ID NO: 140332 - protein, 15 aa, Mycobacterium tuberculosis
QRLRPCTRFGQRLRL

SEQ ID NO: 140333 - protein, 15 aa, Mycobacterium tuberculosis
RLRPCTRFGQRLRLR

SEQ ID NO: 140334 - protein, 15 aa, Mycobacterium tuberculosis
LRPCTRFGQRLRLRP

SEQ ID NO: 140335 - protein, 15 aa, Mycobacterium tuberculosis
RPCTRFGQRLRLRPF

SEQ ID NO: 140336 - protein, 15 aa, Mycobacterium tuberculosis
PCTRFGQRLRLRPFD

SEQ ID NO: 140337 - protein, 15 aa, Mycobacterium tuberculosis
CTRFGQRLRLRPFDL

SEQ ID NO: 140338 - protein, 15 aa, Mycobacterium tuberculosis
TRFGQRLRLRPFDLG

SEQ ID NO: 140339 - protein, 15 aa, Mycobacterium tuberculosis
RFGQRLRLRPFDLGA

SEQ ID NO: 140340 - protein, 15 aa, Mycobacterium tuberculosis
FGQRLRLRPFDLGAP

SEQ ID NO: 140341 - protein, 15 aa, Mycobacterium tuberculosis
GQRLRLRPFDLGAPK

SEQ ID NO: 140342 - protein, 15 aa, Mycobacterium tuberculosis
QRLRLRPFDLGAPKW

SEQ ID NO: 140343 - protein, 15 aa, Mycobacterium tuberculosis
RLRLRPFDLGAPKWV

SEQ ID NO: 140344 - protein, 15 aa, Mycobacterium tuberculosis
LRLRPFDLGAPKWVD

SEQ ID NO: 140345 - protein, 15 aa, Mycobacterium tuberculosis
RLRPFDLGAPKWVDD

SEQ ID NO: 140346 - protein, 15 aa, Mycobacterium tuberculosis
LRPFDLGAPKWVDDP

SEQ ID NO: 140347 - protein, 15 aa, Mycobacterium tuberculosis
RPFDLGAPKWVDDPD

SEQ ID NO: 140348 - protein, 15 aa, Mycobacterium tuberculosis
PFDLGAPKWVDDPDF

SEQ ID NO: 140349 - protein, 15 aa, Mycobacterium tuberculosis
FDLGAPKWVDDPDFD

SEQ ID NO: 140350 - protein, 15 aa, Mycobacterium tuberculosis
DLGAPKWVDDPDFDL

SEQ ID NO: 140351 - protein, 15 aa, Mycobacterium tuberculosis
LGAPKWVDDPDFDLG

SEQ ID NO: 140352 - protein, 15 aa, Mycobacterium tuberculosis
GAPKWVDDPDFDLGR

SEQ ID NO: 140353 - protein, 15 aa, Mycobacterium tuberculosis
APKWVDDPDFDLGRH

SEQ ID NO: 140354 - protein, 15 aa, Mycobacterium tuberculosis
PKWVDDPDFDLGRHV

SEQ ID NO: 140355 - protein, 15 aa, Mycobacterium tuberculosis
KWVDDPDFDLGRHVW

SEQ ID NO: 140356 - protein, 15 aa, Mycobacterium tuberculosis
WVDDPDFDLGRHVWR

SEQ ID NO: 140357 - protein, 15 aa, Mycobacterium tuberculosis
VDDPDFDLGRHVWRI

SEQ ID NO: 140358 - protein, 15 aa, Mycobacterium tuberculosis
DDPDFDLGRHVWRIA

SEQ ID NO: 140359 - protein, 15 aa, Mycobacterium tuberculosis
DPDFDLGRHVWRIAL

SEQ ID NO: 140360 - protein, 15 aa, Mycobacterium tuberculosis
PDFDLGRHVWRIALP

SEQ ID NO: 140361 - protein, 15 aa, Mycobacterium tuberculosis
DFDLGRHVWRIALPR

SEQ ID NO: 140362 - protein, 15 aa, Mycobacterium tuberculosis
FDLGRHVWRIALPRP

SEQ ID NO: 140363 - protein, 15 aa, Mycobacterium tuberculosis
DLGRHVWRIALPRPG

SEQ ID NO: 140364 - protein, 15 aa, Mycobacterium tuberculosis
LGRHVWRIALPRPGN

SEQ ID NO: 140365 - protein, 15 aa, Mycobacterium tuberculosis
GRHVWRIALPRPGNE

SEQ ID NO: 140366 - protein, 15 aa, Mycobacterium tuberculosis
RHVWRIALPRPGNED

SEQ ID NO: 140367 - protein, 15 aa, Mycobacterium tuberculosis
HVWRIALPRPGNEDQ

SEQ ID NO: 140368 - protein, 15 aa, Mycobacterium tuberculosis
VWRIALPRPGNEDQL

SEQ ID NO: 140369 - protein, 15 aa, Mycobacterium tuberculosis
WRIALPRPGNEDQLF

SEQ ID NO: 140370 - protein, 15 aa, Mycobacterium tuberculosis
RIALPRPGNEDQLFE

SEQ ID NO: 140371 - protein, 15 aa, Mycobacterium tuberculosis
IALPRPGNEDQLFEL

SEQ ID NO: 140372 - protein, 15 aa, Mycobacterium tuberculosis
ALPRPGNEDQLFELI

SEQ ID NO: 140373 - protein, 15 aa, Mycobacterium tuberculosis
LPRPGNEDQLFELIA

SEQ ID NO: 140374 - protein, 15 aa, Mycobacterium tuberculosis
PRPGNEDQLFELIAD

SEQ ID NO: 140375 - protein, 15 aa, Mycobacterium tuberculosis
RPGNEDQLFELIADL

SEQ ID NO: 140376 - protein, 15 aa, Mycobacterium tuberculosis
PGNEDQLFELIADLM

SEQ ID NO: 140377 - protein, 15 aa, Mycobacterium tuberculosis
GNEDQLFELIADLMA

SEQ ID NO: 140378 - protein, 15 aa, Mycobacterium tuberculosis
NEDQLFELIADLMAR

SEQ ID NO: 140379 - protein, 15 aa, Mycobacterium tuberculosis
EDQLFELIADLMARR

SEQ ID NO: 140380 - protein, 15 aa, Mycobacterium tuberculosis
DQLFELIADLMARRL

SEQ ID NO: 140381 - protein, 15 aa, Mycobacterium tuberculosis
QLFELIADLMARRLD

SEQ ID NO: 140382 - protein, 15 aa, Mycobacterium tuberculosis
LFELIADLMARRLDR

SEQ ID NO: 140383 - protein, 15 aa, Mycobacterium tuberculosis
FELIADLMARRLDRG

SEQ ID NO: 140384 - protein, 15 aa, Mycobacterium tuberculosis
ELIADLMARRLDRGR

SEQ ID NO: 140385 - protein, 15 aa, Mycobacterium tuberculosis
LIADLMARRLDRGRP

SEQ ID NO: 140386 - protein, 15 aa, Mycobacterium tuberculosis
IADLMARRLDRGRPL

SEQ ID NO: 140387 - protein, 15 aa, Mycobacterium tuberculosis
ADLMARRLDRGRPLW

SEQ ID NO: 140388 - protein, 15 aa, Mycobacterium tuberculosis
DLMARRLDRGRPLWE

SEQ ID NO: 140389 - protein, 15 aa, Mycobacterium tuberculosis
LMARRLDRGRPLWEV

SEQ ID NO: 140390 - protein, 15 aa, Mycobacterium tuberculosis
MARRLDRGRPLWEVW

SEQ ID NO: 140391 - protein, 15 aa, Mycobacterium tuberculosis
ARRLDRGRPLWEVWV

SEQ ID NO: 140392 - protein, 15 aa, Mycobacterium tuberculosis
RRLDRGRPLWEVWVI

SEQ ID NO: 140393 - protein, 15 aa, Mycobacterium tuberculosis
RLDRGRPLWEVWVIE

SEQ ID NO: 140394 - protein, 15 aa, Mycobacterium tuberculosis
LDRGRPLWEVWVIEG

SEQ ID NO: 140395 - protein, 15 aa, Mycobacterium tuberculosis
DRGRPLWEVWVIEGL

SEQ ID NO: 140396 - protein, 15 aa, Mycobacterium tuberculosis
RGRPLWEVWVIEGLA

SEQ ID NO: 140397 - protein, 15 aa, Mycobacterium tuberculosis
GRPLWEVWVIEGLAD

SEQ ID NO: 140398 - protein, 15 aa, Mycobacterium tuberculosis
RPLWEVWVIEGLADS

SEQ ID NO: 140399 - protein, 15 aa, Mycobacterium tuberculosis
PLWEVWVIEGLADSK

SEQ ID NO: 140400 - protein, 15 aa, Mycobacterium tuberculosis
LWEVWVIEGLADSKW

SEQ ID NO: 140401 - protein, 15 aa, Mycobacterium tuberculosis
WEVWVIEGLADSKWA

SEQ ID NO: 140402 - protein, 15 aa, Mycobacterium tuberculosis
EVWVIEGLADSKWAI

SEQ ID NO: 140403 - protein, 15 aa, Mycobacterium tuberculosis
VWVIEGLADSKWAIL

SEQ ID NO: 140404 - protein, 15 aa, Mycobacterium tuberculosis
WVIEGLADSKWAILT

SEQ ID NO: 140405 - protein, 15 aa, Mycobacterium tuberculosis
VIEGLADSKWAILTK

SEQ ID NO: 140406 - protein, 15 aa, Mycobacterium tuberculosis
IEGLADSKWAILTKL

SEQ ID NO: 140407 - protein, 15 aa, Mycobacterium tuberculosis
EGLADSKWAILTKLH

SEQ ID NO: 140408 - protein, 15 aa, Mycobacterium tuberculosis
GLADSKWAILTKLHH

SEQ ID NO: 140409 - protein, 15 aa, Mycobacterium tuberculosis
LADSKWAILTKLHHC

SEQ ID NO: 140410 - protein, 15 aa, Mycobacterium tuberculosis
ADSKWAILTKLHHCM

SEQ ID NO: 140411 - protein, 15 aa, Mycobacterium tuberculosis
DSKWAILTKLHHCMA

SEQ ID NO: 140412 - protein, 15 aa, Mycobacterium tuberculosis
SKWAILTKLHHCMAD

SEQ ID NO: 140413 - protein, 15 aa, Mycobacterium tuberculosis
KWAILTKLHHCMADG

SEQ ID NO: 140414 - protein, 15 aa, Mycobacterium tuberculosis
WAILTKLHHCMADGI

SEQ ID NO: 140415 - protein, 15 aa, Mycobacterium tuberculosis
AILTKLHHCMADGIA

SEQ ID NO: 140416 - protein, 15 aa, Mycobacterium tuberculosis
ILTKLHHCMADGIAA

SEQ ID NO: 140417 - protein, 15 aa, Mycobacterium tuberculosis
LTKLHHCMADGIAAT

SEQ ID NO: 140418 - protein, 15 aa, Mycobacterium tuberculosis
TKLHHCMADGIAATH

SEQ ID NO: 140419 - protein, 15 aa, Mycobacterium tuberculosis
KLHHCMADGIAATHL

SEQ ID NO: 140420 - protein, 15 aa, Mycobacterium tuberculosis
LHHCMADGIAATHLL

SEQ ID NO: 140421 - protein, 15 aa, Mycobacterium tuberculosis
HHCMADGIAATHLLA

SEQ ID NO: 140422 - protein, 15 aa, Mycobacterium tuberculosis
HCMADGIAATHLLAG

SEQ ID NO: 140423 - protein, 15 aa, Mycobacterium tuberculosis
CMADGIAATHLLAGL

SEQ ID NO: 140424 - protein, 15 aa, Mycobacterium tuberculosis
MADGIAATHLLAGLS

SEQ ID NO: 140425 - protein, 15 aa, Mycobacterium tuberculosis
ADGIAATHLLAGLSD

SEQ ID NO: 140426 - protein, 15 aa, Mycobacterium tuberculosis
DGIAATHLLAGLSDE

SEQ ID NO: 140427 - protein, 15 aa, Mycobacterium tuberculosis
GIAATHLLAGLSDES

SEQ ID NO: 140428 - protein, 15 aa, Mycobacterium tuberculosis
IAATHLLAGLSDESM

SEQ ID NO: 140429 - protein, 15 aa, Mycobacterium tuberculosis
AATHLLAGLSDESMS

SEQ ID NO: 140430 - protein, 15 aa, Mycobacterium tuberculosis
ATHLLAGLSDESMSD

SEQ ID NO: 140431 - protein, 15 aa, Mycobacterium tuberculosis
THLLAGLSDESMSDS

SEQ ID NO: 140432 - protein, 15 aa, Mycobacterium tuberculosis
HLLAGLSDESMSDSF

SEQ ID NO: 140433 - protein, 15 aa, Mycobacterium tuberculosis
LLAGLSDESMSDSFA

SEQ ID NO: 140434 - protein, 15 aa, Mycobacterium tuberculosis
LAGLSDESMSDSFAS

SEQ ID NO: 140435 - protein, 15 aa, Mycobacterium tuberculosis
AGLSDESMSDSFASN

SEQ ID NO: 140436 - protein, 15 aa, Mycobacterium tuberculosis
GLSDESMSDSFASNI

SEQ ID NO: 140437 - protein, 15 aa, Mycobacterium tuberculosis
LSDESMSDSFASNIH

SEQ ID NO: 140438 - protein, 15 aa, Mycobacterium tuberculosis
SDESMSDSFASNIHT

SEQ ID NO: 140439 - protein, 15 aa, Mycobacterium tuberculosis
DESMSDSFASNIHTT

SEQ ID NO: 140440 - protein, 15 aa, Mycobacterium tuberculosis
ESMSDSFASNIHTTM

SEQ ID NO: 140441 - protein, 15 aa, Mycobacterium tuberculosis
SMSDSFASNIHTTMQ

SEQ ID NO: 140442 - protein, 15 aa, Mycobacterium tuberculosis
MSDSFASNIHTTMQS

SEQ ID NO: 140443 - protein, 15 aa, Mycobacterium tuberculosis
SDSFASNIHTTMQSQ

SEQ ID NO: 140444 - protein, 15 aa, Mycobacterium tuberculosis
DSFASNIHTTMQSQS

SEQ ID NO: 140445 - protein, 15 aa, Mycobacterium tuberculosis
SFASNIHTTMQSQSA

SEQ ID NO: 140446 - protein, 15 aa, Mycobacterium tuberculosis
FASNIHTTMQSQSAS

SEQ ID NO: 140447 - protein, 15 aa, Mycobacterium tuberculosis
ASNIHTTMQSQSASV

SEQ ID NO: 140448 - protein, 15 aa, Mycobacterium tuberculosis
SNIHTTMQSQSASVR

SEQ ID NO: 140449 - protein, 15 aa, Mycobacterium tuberculosis
NIHTTMQSQSASVRR

SEQ ID NO: 140450 - protein, 15 aa, Mycobacterium tuberculosis
IHTTMQSQSASVRRG

SEQ ID NO: 140451 - protein, 15 aa, Mycobacterium tuberculosis
HTTMQSQSASVRRGG

SEQ ID NO: 140452 - protein, 15 aa, Mycobacterium tuberculosis
TTMQSQSASVRRGGF

SEQ ID NO: 140453 - protein, 15 aa, Mycobacterium tuberculosis
TMQSQSASVRRGGFR

SEQ ID NO: 140454 - protein, 15 aa, Mycobacterium tuberculosis
MQSQSASVRRGGFRV

SEQ ID NO: 140455 - protein, 15 aa, Mycobacterium tuberculosis
QSQSASVRRGGFRVN

SEQ ID NO: 140456 - protein, 15 aa, Mycobacterium tuberculosis
SQSASVRRGGFRVNP

SEQ ID NO: 140457 - protein, 15 aa, Mycobacterium tuberculosis
QSASVRRGGFRVNPS

SEQ ID NO: 140458 - protein, 15 aa, Mycobacterium tuberculosis
SASVRRGGFRVNPSE

SEQ ID NO: 140459 - protein, 15 aa, Mycobacterium tuberculosis
ASVRRGGFRVNPSEA

SEQ ID NO: 140460 - protein, 15 aa, Mycobacterium tuberculosis
SVRRGGFRVNPSEAL

SEQ ID NO: 140461 - protein, 15 aa, Mycobacterium tuberculosis
VRRGGFRVNPSEALT

SEQ ID NO: 140462 - protein, 15 aa, Mycobacterium tuberculosis
RRGGFRVNPSEALTA

SEQ ID NO: 140463 - protein, 15 aa, Mycobacterium tuberculosis
RGGFRVNPSEALTAS

SEQ ID NO: 140464 - protein, 15 aa, Mycobacterium tuberculosis
GGFRVNPSEALTAST

SEQ ID NO: 140465 - protein, 15 aa, Mycobacterium tuberculosis
GFRVNPSEALTASTA

SEQ ID NO: 140466 - protein, 15 aa, Mycobacterium tuberculosis
FRVNPSEALTASTAV

SEQ ID NO: 140467 - protein, 15 aa, Mycobacterium tuberculosis
RVNPSEALTASTAVM

SEQ ID NO: 140468 - protein, 15 aa, Mycobacterium tuberculosis
VNPSEALTASTAVMA

SEQ ID NO: 140469 - protein, 15 aa, Mycobacterium tuberculosis
NPSEALTASTAVMAG

SEQ ID NO: 140470 - protein, 15 aa, Mycobacterium tuberculosis
PSEALTASTAVMAGI

SEQ ID NO: 140471 - protein, 15 aa, Mycobacterium tuberculosis
SEALTASTAVMAGIV

SEQ ID NO: 140472 - protein, 15 aa, Mycobacterium tuberculosis
EALTASTAVMAGIVR

SEQ ID NO: 140473 - protein, 15 aa, Mycobacterium tuberculosis
ALTASTAVMAGIVRA

SEQ ID NO: 140474 - protein, 15 aa, Mycobacterium tuberculosis
LTASTAVMAGIVRAA

SEQ ID NO: 140475 - protein, 15 aa, Mycobacterium tuberculosis
TASTAVMAGIVRAAK

SEQ ID NO: 140476 - protein, 15 aa, Mycobacterium tuberculosis
ASTAVMAGIVRAAKG

SEQ ID NO: 140477 - protein, 15 aa, Mycobacterium tuberculosis
STAVMAGIVRAAKGA

SEQ ID NO: 140478 - protein, 15 aa, Mycobacterium tuberculosis
TAVMAGIVRAAKGAS

SEQ ID NO: 140479 - protein, 15 aa, Mycobacterium tuberculosis
AVMAGIVRAAKGASE

SEQ ID NO: 140480 - protein, 15 aa, Mycobacterium tuberculosis
VMAGIVRAAKGASEI

SEQ ID NO: 140481 - protein, 15 aa, Mycobacterium tuberculosis
MAGIVRAAKGASEIA

SEQ ID NO: 140482 - protein, 15 aa, Mycobacterium tuberculosis
AGIVRAAKGASEIAA

SEQ ID NO: 140483 - protein, 15 aa, Mycobacterium tuberculosis
GIVRAAKGASEIAAG

SEQ ID NO: 140484 - protein, 15 aa, Mycobacterium tuberculosis
IVRAAKGASEIAAGV

SEQ ID NO: 140485 - protein, 15 aa, Mycobacterium tuberculosis
VRAAKGASEIAAGVL

SEQ ID NO: 140486 - protein, 15 aa, Mycobacterium tuberculosis
RAAKGASEIAAGVLS

SEQ ID NO: 140487 - protein, 15 aa, Mycobacterium tuberculosis
AAKGASEIAAGVLSP

SEQ ID NO: 140488 - protein, 15 aa, Mycobacterium tuberculosis
AKGASEIAAGVLSPA

SEQ ID NO: 140489 - protein, 15 aa, Mycobacterium tuberculosis
KGASEIAAGVLSPAA

SEQ ID NO: 140490 - protein, 15 aa, Mycobacterium tuberculosis
GASEIAAGVLSPAAS

SEQ ID NO: 140491 - protein, 15 aa, Mycobacterium tuberculosis
ASEIAAGVLSPAASS

SEQ ID NO: 140492 - protein, 15 aa, Mycobacterium tuberculosis
SEIAAGVLSPAASSL

SEQ ID NO: 140493 - protein, 15 aa, Mycobacterium tuberculosis
EIAAGVLSPAASSLN

SEQ ID NO: 140494 - protein, 15 aa, Mycobacterium tuberculosis
IAAGVLSPAASSLNG

SEQ ID NO: 140495 - protein, 15 aa, Mycobacterium tuberculosis
AAGVLSPAASSLNGP

SEQ ID NO: 140496 - protein, 15 aa, Mycobacterium tuberculosis
AGVLSPAASSLNGPI

SEQ ID NO: 140497 - protein, 15 aa, Mycobacterium tuberculosis
GVLSPAASSLNGPIS

SEQ ID NO: 140498 - protein, 15 aa, Mycobacterium tuberculosis
VLSPAASSLNGPISD

SEQ ID NO: 140499 - protein, 15 aa, Mycobacterium tuberculosis
LSPAASSLNGPISDL

SEQ ID NO: 140500 - protein, 15 aa, Mycobacterium tuberculosis
SPAASSLNGPISDLR

SEQ ID NO: 140501 - protein, 15 aa, Mycobacterium tuberculosis
PAASSLNGPISDLRR

SEQ ID NO: 140502 - protein, 15 aa, Mycobacterium tuberculosis
AASSLNGPISDLRRY

SEQ ID NO: 140503 - protein, 15 aa, Mycobacterium tuberculosis
ASSLNGPISDLRRYS

SEQ ID NO: 140504 - protein, 15 aa, Mycobacterium tuberculosis
SSLNGPISDLRRYSA

SEQ ID NO: 140505 - protein, 15 aa, Mycobacterium tuberculosis
SLNGPISDLRRYSAA

SEQ ID NO: 140506 - protein, 15 aa, Mycobacterium tuberculosis
LNGPISDLRRYSAAK

SEQ ID NO: 140507 - protein, 15 aa, Mycobacterium tuberculosis
NGPISDLRRYSAAKV

SEQ ID NO: 140508 - protein, 15 aa, Mycobacterium tuberculosis
GPISDLRRYSAAKVP

SEQ ID NO: 140509 - protein, 15 aa, Mycobacterium tuberculosis
PISDLRRYSAAKVPL

SEQ ID NO: 140510 - protein, 15 aa, Mycobacterium tuberculosis
ISDLRRYSAAKVPLA

SEQ ID NO: 140511 - protein, 15 aa, Mycobacterium tuberculosis
SDLRRYSAAKVPLAD

SEQ ID NO: 140512 - protein, 15 aa, Mycobacterium tuberculosis
DLRRYSAAKVPLADV

SEQ ID NO: 140513 - protein, 15 aa, Mycobacterium tuberculosis
LRRYSAAKVPLADVE

SEQ ID NO: 140514 - protein, 15 aa, Mycobacterium tuberculosis
RRYSAAKVPLADVEQ

SEQ ID NO: 140515 - protein, 15 aa, Mycobacterium tuberculosis
RYSAAKVPLADVEQV

SEQ ID NO: 140516 - protein, 15 aa, Mycobacterium tuberculosis
YSAAKVPLADVEQVC

SEQ ID NO: 140517 - protein, 15 aa, Mycobacterium tuberculosis
SAAKVPLADVEQVCR

SEQ ID NO: 140518 - protein, 15 aa, Mycobacterium tuberculosis
AAKVPLADVEQVCRK

SEQ ID NO: 140519 - protein, 15 aa, Mycobacterium tuberculosis
AKVPLADVEQVCRKF

SEQ ID NO: 140520 - protein, 15 aa, Mycobacterium tuberculosis
KVPLADVEQVCRKFD

SEQ ID NO: 140521 - protein, 15 aa, Mycobacterium tuberculosis
VPLADVEQVCRKFDV

SEQ ID NO: 140522 - protein, 15 aa, Mycobacterium tuberculosis
PLADVEQVCRKFDVT

SEQ ID NO: 140523 - protein, 15 aa, Mycobacterium tuberculosis
LADVEQVCRKFDVTI

SEQ ID NO: 140524 - protein, 15 aa, Mycobacterium tuberculosis
ADVEQVCRKFDVTIN

SEQ ID NO: 140525 - protein, 15 aa, Mycobacterium tuberculosis
DVEQVCRKFDVTIND

SEQ ID NO: 140526 - protein, 15 aa, Mycobacterium tuberculosis
VEQVCRKFDVTINDV

SEQ ID NO: 140527 - protein, 15 aa, Mycobacterium tuberculosis
EQVCRKFDVTINDVA

SEQ ID NO: 140528 - protein, 15 aa, Mycobacterium tuberculosis
QVCRKFDVTINDVAL

SEQ ID NO: 140529 - protein, 15 aa, Mycobacterium tuberculosis
VCRKFDVTINDVALA

SEQ ID NO: 140530 - protein, 15 aa, Mycobacterium tuberculosis
CRKFDVTINDVALAA

SEQ ID NO: 140531 - protein, 15 aa, Mycobacterium tuberculosis
RKFDVTINDVALAAI

SEQ ID NO: 140532 - protein, 15 aa, Mycobacterium tuberculosis
KFDVTINDVALAAIT

SEQ ID NO: 140533 - protein, 15 aa, Mycobacterium tuberculosis
FDVTINDVALAAITE

SEQ ID NO: 140534 - protein, 15 aa, Mycobacterium tuberculosis
DVTINDVALAAITES

SEQ ID NO: 140535 - protein, 15 aa, Mycobacterium tuberculosis
VTINDVALAAITESY

SEQ ID NO: 140536 - protein, 15 aa, Mycobacterium tuberculosis
TINDVALAAITESYR

SEQ ID NO: 140537 - protein, 15 aa, Mycobacterium tuberculosis
INDVALAAITESYRN

SEQ ID NO: 140538 - protein, 15 aa, Mycobacterium tuberculosis
NDVALAAITESYRNV

SEQ ID NO: 140539 - protein, 15 aa, Mycobacterium tuberculosis
DVALAAITESYRNVL

SEQ ID NO: 140540 - protein, 15 aa, Mycobacterium tuberculosis
VALAAITESYRNVLI

SEQ ID NO: 140541 - protein, 15 aa, Mycobacterium tuberculosis
ALAAITESYRNVLIQ

SEQ ID NO: 140542 - protein, 15 aa, Mycobacterium tuberculosis
LAAITESYRNVLIQR

SEQ ID NO: 140543 - protein, 15 aa, Mycobacterium tuberculosis
AAITESYRNVLIQRG

SEQ ID NO: 140544 - protein, 15 aa, Mycobacterium tuberculosis
AITESYRNVLIQRGE

SEQ ID NO: 140545 - protein, 15 aa, Mycobacterium tuberculosis
ITESYRNVLIQRGER

SEQ ID NO: 140546 - protein, 15 aa, Mycobacterium tuberculosis
TESYRNVLIQRGERP

SEQ ID NO: 140547 - protein, 15 aa, Mycobacterium tuberculosis
ESYRNVLIQRGERPR

SEQ ID NO: 140548 - protein, 15 aa, Mycobacterium tuberculosis
SYRNVLIQRGERPRF

SEQ ID NO: 140549 - protein, 15 aa, Mycobacterium tuberculosis
YRNVLIQRGERPRFD

SEQ ID NO: 140550 - protein, 15 aa, Mycobacterium tuberculosis
RNVLIQRGERPRFDS

SEQ ID NO: 140551 - protein, 15 aa, Mycobacterium tuberculosis
NVLIQRGERPRFDSL

SEQ ID NO: 140552 - protein, 15 aa, Mycobacterium tuberculosis
VLIQRGERPRFDSLR

SEQ ID NO: 140553 - protein, 15 aa, Mycobacterium tuberculosis
LIQRGERPRFDSLRT

SEQ ID NO: 140554 - protein, 15 aa, Mycobacterium tuberculosis
IQRGERPRFDSLRTL

SEQ ID NO: 140555 - protein, 15 aa, Mycobacterium tuberculosis
QRGERPRFDSLRTLV

SEQ ID NO: 140556 - protein, 15 aa, Mycobacterium tuberculosis
RGERPRFDSLRTLVP

SEQ ID NO: 140557 - protein, 15 aa, Mycobacterium tuberculosis
GERPRFDSLRTLVPV

SEQ ID NO: 140558 - protein, 15 aa, Mycobacterium tuberculosis
ERPRFDSLRTLVPVS

SEQ ID NO: 140559 - protein, 15 aa, Mycobacterium tuberculosis
RPRFDSLRTLVPVST

SEQ ID NO: 140560 - protein, 15 aa, Mycobacterium tuberculosis
PRFDSLRTLVPVSTR

SEQ ID NO: 140561 - protein, 15 aa, Mycobacterium tuberculosis
RFDSLRTLVPVSTRS

SEQ ID NO: 140562 - protein, 15 aa, Mycobacterium tuberculosis
FDSLRTLVPVSTRSN

SEQ ID NO: 140563 - protein, 15 aa, Mycobacterium tuberculosis
DSLRTLVPVSTRSNS

SEQ ID NO: 140564 - protein, 15 aa, Mycobacterium tuberculosis
SLRTLVPVSTRSNSA

SEQ ID NO: 140565 - protein, 15 aa, Mycobacterium tuberculosis
LRTLVPVSTRSNSAL

SEQ ID NO: 140566 - protein, 15 aa, Mycobacterium tuberculosis
RTLVPVSTRSNSALS

SEQ ID NO: 140567 - protein, 15 aa, Mycobacterium tuberculosis
TLVPVSTRSNSALSK

SEQ ID NO: 140568 - protein, 15 aa, Mycobacterium tuberculosis
LVPVSTRSNSALSKT

SEQ ID NO: 140569 - protein, 15 aa, Mycobacterium tuberculosis
VPVSTRSNSALSKTD

SEQ ID NO: 140570 - protein, 15 aa, Mycobacterium tuberculosis
PVSTRSNSALSKTDN

SEQ ID NO: 140571 - protein, 15 aa, Mycobacterium tuberculosis
VSTRSNSALSKTDNR

SEQ ID NO: 140572 - protein, 15 aa, Mycobacterium tuberculosis
STRSNSALSKTDNRV

SEQ ID NO: 140573 - protein, 15 aa, Mycobacterium tuberculosis
TRSNSALSKTDNRVS

SEQ ID NO: 140574 - protein, 15 aa, Mycobacterium tuberculosis
RSNSALSKTDNRVSL

SEQ ID NO: 140575 - protein, 15 aa, Mycobacterium tuberculosis
SNSALSKTDNRVSLM

SEQ ID NO: 140576 - protein, 15 aa, Mycobacterium tuberculosis
NSALSKTDNRVSLML

SEQ ID NO: 140577 - protein, 15 aa, Mycobacterium tuberculosis
SALSKTDNRVSLMLP

SEQ ID NO: 140578 - protein, 15 aa, Mycobacterium tuberculosis
ALSKTDNRVSLMLPN

SEQ ID NO: 140579 - protein, 15 aa, Mycobacterium tuberculosis
LSKTDNRVSLMLPNL

SEQ ID NO: 140580 - protein, 15 aa, Mycobacterium tuberculosis
SKTDNRVSLMLPNLP

SEQ ID NO: 140581 - protein, 15 aa, Mycobacterium tuberculosis
KTDNRVSLMLPNLPV

SEQ ID NO: 140582 - protein, 15 aa, Mycobacterium tuberculosis
TDNRVSLMLPNLPVD

SEQ ID NO: 140583 - protein, 15 aa, Mycobacterium tuberculosis
DNRVSLMLPNLPVDQ

SEQ ID NO: 140584 - protein, 15 aa, Mycobacterium tuberculosis
NRVSLMLPNLPVDQE

SEQ ID NO: 140585 - protein, 15 aa, Mycobacterium tuberculosis
RVSLMLPNLPVDQEN

SEQ ID NO: 140586 - protein, 15 aa, Mycobacterium tuberculosis
VSLMLPNLPVDQENP

SEQ ID NO: 140587 - protein, 15 aa, Mycobacterium tuberculosis
SLMLPNLPVDQENPL

SEQ ID NO: 140588 - protein, 15 aa, Mycobacterium tuberculosis
LMLPNLPVDQENPLQ

SEQ ID NO: 140589 - protein, 15 aa, Mycobacterium tuberculosis
MLPNLPVDQENPLQR

SEQ ID NO: 140590 - protein, 15 aa, Mycobacterium tuberculosis
LPNLPVDQENPLQRL

SEQ ID NO: 140591 - protein, 15 aa, Mycobacterium tuberculosis
PNLPVDQENPLQRLR

SEQ ID NO: 140592 - protein, 15 aa, Mycobacterium tuberculosis
NLPVDQENPLQRLRI

SEQ ID NO: 140593 - protein, 15 aa, Mycobacterium tuberculosis
LPVDQENPLQRLRIV

SEQ ID NO: 140594 - protein, 15 aa, Mycobacterium tuberculosis
PVDQENPLQRLRIVH

SEQ ID NO: 140595 - protein, 15 aa, Mycobacterium tuberculosis
VDQENPLQRLRIVHS

SEQ ID NO: 140596 - protein, 15 aa, Mycobacterium tuberculosis
DQENPLQRLRIVHSR

SEQ ID NO: 140597 - protein, 15 aa, Mycobacterium tuberculosis
QENPLQRLRIVHSRL

SEQ ID NO: 140598 - protein, 15 aa, Mycobacterium tuberculosis
ENPLQRLRIVHSRLT

SEQ ID NO: 140599 - protein, 15 aa, Mycobacterium tuberculosis
NPLQRLRIVHSRLTR

SEQ ID NO: 140600 - protein, 15 aa, Mycobacterium tuberculosis
PLQRLRIVHSRLTRA

SEQ ID NO: 140601 - protein, 15 aa, Mycobacterium tuberculosis
LQRLRIVHSRLTRAK

SEQ ID NO: 140602 - protein, 15 aa, Mycobacterium tuberculosis
QRLRIVHSRLTRAKA

SEQ ID NO: 140603 - protein, 15 aa, Mycobacterium tuberculosis
RLRIVHSRLTRAKAG

SEQ ID NO: 140604 - protein, 15 aa, Mycobacterium tuberculosis
LRIVHSRLTRAKAGG

SEQ ID NO: 140605 - protein, 15 aa, Mycobacterium tuberculosis
RIVHSRLTRAKAGGQ

SEQ ID NO: 140606 - protein, 15 aa, Mycobacterium tuberculosis
IVHSRLTRAKAGGQR

SEQ ID NO: 140607 - protein, 15 aa, Mycobacterium tuberculosis
VHSRLTRAKAGGQRQ

SEQ ID NO: 140608 - protein, 15 aa, Mycobacterium tuberculosis
HSRLTRAKAGGQRQF

SEQ ID NO: 140609 - protein, 15 aa, Mycobacterium tuberculosis
SRLTRAKAGGQRQFG

SEQ ID NO: 140610 - protein, 15 aa, Mycobacterium tuberculosis
RLTRAKAGGQRQFGN

SEQ ID NO: 140611 - protein, 15 aa, Mycobacterium tuberculosis
LTRAKAGGQRQFGNT

SEQ ID NO: 140612 - protein, 15 aa, Mycobacterium tuberculosis
TRAKAGGQRQFGNTL

SEQ ID NO: 140613 - protein, 15 aa, Mycobacterium tuberculosis
RAKAGGQRQFGNTLM

SEQ ID NO: 140614 - protein, 15 aa, Mycobacterium tuberculosis
AKAGGQRQFGNTLMA

SEQ ID NO: 140615 - protein, 15 aa, Mycobacterium tuberculosis
KAGGQRQFGNTLMAI

SEQ ID NO: 140616 - protein, 15 aa, Mycobacterium tuberculosis
AGGQRQFGNTLMAIA

SEQ ID NO: 140617 - protein, 15 aa, Mycobacterium tuberculosis
GGQRQFGNTLMAIAN

SEQ ID NO: 140618 - protein, 15 aa, Mycobacterium tuberculosis
GQRQFGNTLMAIANR

SEQ ID NO: 140619 - protein, 15 aa, Mycobacterium tuberculosis
QRQFGNTLMAIANRL

SEQ ID NO: 140620 - protein, 15 aa, Mycobacterium tuberculosis
RQFGNTLMAIANRLP

SEQ ID NO: 140621 - protein, 15 aa, Mycobacterium tuberculosis
QFGNTLMAIANRLPF

SEQ ID NO: 140622 - protein, 15 aa, Mycobacterium tuberculosis
FGNTLMAIANRLPFP

SEQ ID NO: 140623 - protein, 15 aa, Mycobacterium tuberculosis
GNTLMAIANRLPFPM

SEQ ID NO: 140624 - protein, 15 aa, Mycobacterium tuberculosis
NTLMAIANRLPFPMT

SEQ ID NO: 140625 - protein, 15 aa, Mycobacterium tuberculosis
TLMAIANRLPFPMTA

SEQ ID NO: 140626 - protein, 15 aa, Mycobacterium tuberculosis
LMAIANRLPFPMTAW

SEQ ID NO: 140627 - protein, 15 aa, Mycobacterium tuberculosis
MAIANRLPFPMTAWA

SEQ ID NO: 140628 - protein, 15 aa, Mycobacterium tuberculosis
AIANRLPFPMTAWAV

SEQ ID NO: 140629 - protein, 15 aa, Mycobacterium tuberculosis
IANRLPFPMTAWAVG

SEQ ID NO: 140630 - protein, 15 aa, Mycobacterium tuberculosis
ANRLPFPMTAWAVGL

SEQ ID NO: 140631 - protein, 15 aa, Mycobacterium tuberculosis
NRLPFPMTAWAVGLL

SEQ ID NO: 140632 - protein, 15 aa, Mycobacterium tuberculosis
RLPFPMTAWAVGLLM

SEQ ID NO: 140633 - protein, 15 aa, Mycobacterium tuberculosis
LPFPMTAWAVGLLMR

SEQ ID NO: 140634 - protein, 15 aa, Mycobacterium tuberculosis
PFPMTAWAVGLLMRL

SEQ ID NO: 140635 - protein, 15 aa, Mycobacterium tuberculosis
FPMTAWAVGLLMRLP

SEQ ID NO: 140636 - protein, 15 aa, Mycobacterium tuberculosis
PMTAWAVGLLMRLPQ

SEQ ID NO: 140637 - protein, 15 aa, Mycobacterium tuberculosis
MTAWAVGLLMRLPQR

SEQ ID NO: 140638 - protein, 15 aa, Mycobacterium tuberculosis
TAWAVGLLMRLPQRG

SEQ ID NO: 140639 - protein, 15 aa, Mycobacterium tuberculosis
AWAVGLLMRLPQRGV

SEQ ID NO: 140640 - protein, 15 aa, Mycobacterium tuberculosis
WAVGLLMRLPQRGVV

SEQ ID NO: 140641 - protein, 15 aa, Mycobacterium tuberculosis
AVGLLMRLPQRGVVT

SEQ ID NO: 140642 - protein, 15 aa, Mycobacterium tuberculosis
VGLLMRLPQRGVVTV

SEQ ID NO: 140643 - protein, 15 aa, Mycobacterium tuberculosis
GLLMRLPQRGVVTVA

SEQ ID NO: 140644 - protein, 15 aa, Mycobacterium tuberculosis
LLMRLPQRGVVTVAT

SEQ ID NO: 140645 - protein, 15 aa, Mycobacterium tuberculosis
LMRLPQRGVVTVATN

SEQ ID NO: 140646 - protein, 15 aa, Mycobacterium tuberculosis
MRLPQRGVVTVATNV

SEQ ID NO: 140647 - protein, 15 aa, Mycobacterium tuberculosis
RLPQRGVVTVATNVP

SEQ ID NO: 140648 - protein, 15 aa, Mycobacterium tuberculosis
LPQRGVVTVATNVPG

SEQ ID NO: 140649 - protein, 15 aa, Mycobacterium tuberculosis
PQRGVVTVATNVPGP

SEQ ID NO: 140650 - protein, 15 aa, Mycobacterium tuberculosis
QRGVVTVATNVPGPR

SEQ ID NO: 140651 - protein, 15 aa, Mycobacterium tuberculosis
RGVVTVATNVPGPRR

SEQ ID NO: 140652 - protein, 15 aa, Mycobacterium tuberculosis
GVVTVATNVPGPRRP

SEQ ID NO: 140653 - protein, 15 aa, Mycobacterium tuberculosis
VVTVATNVPGPRRPL

SEQ ID NO: 140654 - protein, 15 aa, Mycobacterium tuberculosis
VTVATNVPGPRRPLQ

SEQ ID NO: 140655 - protein, 15 aa, Mycobacterium tuberculosis
TVATNVPGPRRPLQI

SEQ ID NO: 140656 - protein, 15 aa, Mycobacterium tuberculosis
VATNVPGPRRPLQIM

SEQ ID NO: 140657 - protein, 15 aa, Mycobacterium tuberculosis
ATNVPGPRRPLQIMG

SEQ ID NO: 140658 - protein, 15 aa, Mycobacterium tuberculosis
TNVPGPRRPLQIMGR

SEQ ID NO: 140659 - protein, 15 aa, Mycobacterium tuberculosis
NVPGPRRPLQIMGRR

SEQ ID NO: 140660 - protein, 15 aa, Mycobacterium tuberculosis
VPGPRRPLQIMGRRV

SEQ ID NO: 140661 - protein, 15 aa, Mycobacterium tuberculosis
PGPRRPLQIMGRRVL

SEQ ID NO: 140662 - protein, 15 aa, Mycobacterium tuberculosis
GPRRPLQIMGRRVLD

SEQ ID NO: 140663 - protein, 15 aa, Mycobacterium tuberculosis
PRRPLQIMGRRVLDL

SEQ ID NO: 140664 - protein, 15 aa, Mycobacterium tuberculosis
RRPLQIMGRRVLDLY

SEQ ID NO: 140665 - protein, 15 aa, Mycobacterium tuberculosis
RPLQIMGRRVLDLYP

SEQ ID NO: 140666 - protein, 15 aa, Mycobacterium tuberculosis
PLQIMGRRVLDLYPV

SEQ ID NO: 140667 - protein, 15 aa, Mycobacterium tuberculosis
LQIMGRRVLDLYPVS

SEQ ID NO: 140668 - protein, 15 aa, Mycobacterium tuberculosis
QIMGRRVLDLYPVSP

SEQ ID NO: 140669 - protein, 15 aa, Mycobacterium tuberculosis
IMGRRVLDLYPVSPI

SEQ ID NO: 140670 - protein, 15 aa, Mycobacterium tuberculosis
MGRRVLDLYPVSPIA

SEQ ID NO: 140671 - protein, 15 aa, Mycobacterium tuberculosis
GRRVLDLYPVSPIAM

SEQ ID NO: 140672 - protein, 15 aa, Mycobacterium tuberculosis
RRVLDLYPVSPIAMQ

SEQ ID NO: 140673 - protein, 15 aa, Mycobacterium tuberculosis
RVLDLYPVSPIAMQL

SEQ ID NO: 140674 - protein, 15 aa, Mycobacterium tuberculosis
VLDLYPVSPIAMQLR

SEQ ID NO: 140675 - protein, 15 aa, Mycobacterium tuberculosis
LDLYPVSPIAMQLRT

SEQ ID NO: 140676 - protein, 15 aa, Mycobacterium tuberculosis
DLYPVSPIAMQLRTS

SEQ ID NO: 140677 - protein, 15 aa, Mycobacterium tuberculosis
LYPVSPIAMQLRTSV

SEQ ID NO: 140678 - protein, 15 aa, Mycobacterium tuberculosis
YPVSPIAMQLRTSVA

SEQ ID NO: 140679 - protein, 15 aa, Mycobacterium tuberculosis
PVSPIAMQLRTSVAM

SEQ ID NO: 140680 - protein, 15 aa, Mycobacterium tuberculosis
VSPIAMQLRTSVAML

SEQ ID NO: 140681 - protein, 15 aa, Mycobacterium tuberculosis
SPIAMQLRTSVAMLS

SEQ ID NO: 140682 - protein, 15 aa, Mycobacterium tuberculosis
PIAMQLRTSVAMLSY

SEQ ID NO: 140683 - protein, 15 aa, Mycobacterium tuberculosis
IAMQLRTSVAMLSYA

SEQ ID NO: 140684 - protein, 15 aa, Mycobacterium tuberculosis
AMQLRTSVAMLSYAD

SEQ ID NO: 140685 - protein, 15 aa, Mycobacterium tuberculosis
MQLRTSVAMLSYADD

SEQ ID NO: 140686 - protein, 15 aa, Mycobacterium tuberculosis
QLRTSVAMLSYADDL

SEQ ID NO: 140687 - protein, 15 aa, Mycobacterium tuberculosis
LRTSVAMLSYADDLY

SEQ ID NO: 140688 - protein, 15 aa, Mycobacterium tuberculosis
RTSVAMLSYADDLYF

SEQ ID NO: 140689 - protein, 15 aa, Mycobacterium tuberculosis
TSVAMLSYADDLYFG

SEQ ID NO: 140690 - protein, 15 aa, Mycobacterium tuberculosis
SVAMLSYADDLYFGI

SEQ ID NO: 140691 - protein, 15 aa, Mycobacterium tuberculosis
VAMLSYADDLYFGIL

SEQ ID NO: 140692 - protein, 15 aa, Mycobacterium tuberculosis
AMLSYADDLYFGILA

SEQ ID NO: 140693 - protein, 15 aa, Mycobacterium tuberculosis
MLSYADDLYFGILAD

SEQ ID NO: 140694 - protein, 15 aa, Mycobacterium tuberculosis
LSYADDLYFGILADY

SEQ ID NO: 140695 - protein, 15 aa, Mycobacterium tuberculosis
SYADDLYFGILADYD

SEQ ID NO: 140696 - protein, 15 aa, Mycobacterium tuberculosis
YADDLYFGILADYDV

SEQ ID NO: 140697 - protein, 15 aa, Mycobacterium tuberculosis
ADDLYFGILADYDVV

SEQ ID NO: 140698 - protein, 15 aa, Mycobacterium tuberculosis
DDLYFGILADYDVVA

SEQ ID NO: 140699 - protein, 15 aa, Mycobacterium tuberculosis
DLYFGILADYDVVAD

SEQ ID NO: 140700 - protein, 15 aa, Mycobacterium tuberculosis
LYFGILADYDVVADA

SEQ ID NO: 140701 - protein, 15 aa, Mycobacterium tuberculosis
YFGILADYDVVADAG

SEQ ID NO: 140702 - protein, 15 aa, Mycobacterium tuberculosis
FGILADYDVVADAGQ

SEQ ID NO: 140703 - protein, 15 aa, Mycobacterium tuberculosis
GILADYDVVADAGQL

SEQ ID NO: 140704 - protein, 15 aa, Mycobacterium tuberculosis
ILADYDVVADAGQLA

SEQ ID NO: 140705 - protein, 15 aa, Mycobacterium tuberculosis
LADYDVVADAGQLAR

SEQ ID NO: 140706 - protein, 15 aa, Mycobacterium tuberculosis
ADYDVVADAGQLARG

SEQ ID NO: 140707 - protein, 15 aa, Mycobacterium tuberculosis
DYDVVADAGQLARGI

SEQ ID NO: 140708 - protein, 15 aa, Mycobacterium tuberculosis
YDVVADAGQLARGIE

SEQ ID NO: 140709 - protein, 15 aa, Mycobacterium tuberculosis
DVVADAGQLARGIED

SEQ ID NO: 140710 - protein, 15 aa, Mycobacterium tuberculosis
VVADAGQLARGIEDA

SEQ ID NO: 140711 - protein, 15 aa, Mycobacterium tuberculosis
VADAGQLARGIEDAV

SEQ ID NO: 140712 - protein, 15 aa, Mycobacterium tuberculosis
ADAGQLARGIEDAVA

SEQ ID NO: 140713 - protein, 15 aa, Mycobacterium tuberculosis
DAGQLARGIEDAVAR

SEQ ID NO: 140714 - protein, 15 aa, Mycobacterium tuberculosis
AGQLARGIEDAVARL

SEQ ID NO: 140715 - protein, 15 aa, Mycobacterium tuberculosis
GQLARGIEDAVARLV

SEQ ID NO: 140716 - protein, 15 aa, Mycobacterium tuberculosis
QLARGIEDAVARLVA

SEQ ID NO: 140717 - protein, 15 aa, Mycobacterium tuberculosis
LARGIEDAVARLVAI

SEQ ID NO: 140718 - protein, 15 aa, Mycobacterium tuberculosis
ARGIEDAVARLVAIS

SEQ ID NO: 140719 - protein, 15 aa, Mycobacterium tuberculosis
RGIEDAVARLVAISK

SEQ ID NO: 140720 - protein, 15 aa, Mycobacterium tuberculosis
GIEDAVARLVAISKR

SEQ ID NO: 140721 - protein, 15 aa, Mycobacterium tuberculosis
IEDAVARLVAISKRR

SEQ ID NO: 140722 - protein, 15 aa, Mycobacterium tuberculosis
EDAVARLVAISKRRK

SEQ ID NO: 140723 - protein, 15 aa, Mycobacterium tuberculosis
DAVARLVAISKRRKV

SEQ ID NO: 140724 - protein, 15 aa, Mycobacterium tuberculosis
AVARLVAISKRRKVT

SEQ ID NO: 140725 - protein, 15 aa, Mycobacterium tuberculosis
VARLVAISKRRKVTR

SEQ ID NO: 140726 - protein, 15 aa, Mycobacterium tuberculosis
ARLVAISKRRKVTRR

SEQ ID NO: 140727 - protein, 15 aa, Mycobacterium tuberculosis
RLVAISKRRKVTRRR

SEQ ID NO: 140728 - protein, 15 aa, Mycobacterium tuberculosis
LVAISKRRKVTRRRG

SEQ ID NO: 140729 - protein, 15 aa, Mycobacterium tuberculosis
VAISKRRKVTRRRGA

SEQ ID NO: 140730 - protein, 15 aa, Mycobacterium tuberculosis
AISKRRKVTRRRGAL

SEQ ID NO: 140731 - protein, 15 aa, Mycobacterium tuberculosis
ISKRRKVTRRRGALS

SEQ ID NO: 140732 - protein, 15 aa, Mycobacterium tuberculosis
SKRRKVTRRRGALSL

SEQ ID NO: 140733 - protein, 15 aa, Mycobacterium tuberculosis
KRRKVTRRRGALSLV

SEQ ID NO: 140734 - protein, 15 aa, Mycobacterium tuberculosis
RRKVTRRRGALSLVV

SEQ ID NO: 140735 - protein, 16 aa, Mycobacterium tuberculosis
MNHLTTLDAGFLKAED

SEQ ID NO: 140736 - protein, 16 aa, Mycobacterium tuberculosis
NHLTTLDAGFLKAEDV

SEQ ID NO: 140737 - protein, 16 aa, Mycobacterium tuberculosis
HLTTLDAGFLKAEDVD

SEQ ID NO: 140738 - protein, 16 aa, Mycobacterium tuberculosis
LTTLDAGFLKAEDVDR

SEQ ID NO: 140739 - protein, 16 aa, Mycobacterium tuberculosis
TTLDAGFLKAEDVDRH

SEQ ID NO: 140740 - protein, 16 aa, Mycobacterium tuberculosis
TLDAGFLKAEDVDRHV

SEQ ID NO: 140741 - protein, 16 aa, Mycobacterium tuberculosis
LDAGFLKAEDVDRHVS

SEQ ID NO: 140742 - protein, 16 aa, Mycobacterium tuberculosis
DAGFLKAEDVDRHVSL

SEQ ID NO: 140743 - protein, 16 aa, Mycobacterium tuberculosis
AGFLKAEDVDRHVSLA

SEQ ID NO: 140744 - protein, 16 aa, Mycobacterium tuberculosis
GFLKAEDVDRHVSLAI

SEQ ID NO: 140745 - protein, 16 aa, Mycobacterium tuberculosis
FLKAEDVDRHVSLAIG

SEQ ID NO: 140746 - protein, 16 aa, Mycobacterium tuberculosis
LKAEDVDRHVSLAIGA

SEQ ID NO: 140747 - protein, 16 aa, Mycobacterium tuberculosis
KAEDVDRHVSLAIGAL

SEQ ID NO: 140748 - protein, 16 aa, Mycobacterium tuberculosis
AEDVDRHVSLAIGALA

SEQ ID NO: 140749 - protein, 16 aa, Mycobacterium tuberculosis
EDVDRHVSLAIGALAV

SEQ ID NO: 140750 - protein, 16 aa, Mycobacterium tuberculosis
DVDRHVSLAIGALAVI

SEQ ID NO: 140751 - protein, 16 aa, Mycobacterium tuberculosis
VDRHVSLAIGALAVIE

SEQ ID NO: 140752 - protein, 16 aa, Mycobacterium tuberculosis
DRHVSLAIGALAVIEG

SEQ ID NO: 140753 - protein, 16 aa, Mycobacterium tuberculosis
RHVSLAIGALAVIEGP

SEQ ID NO: 140754 - protein, 16 aa, Mycobacterium tuberculosis
HVSLAIGALAVIEGPA

SEQ ID NO: 140755 - protein, 16 aa, Mycobacterium tuberculosis
VSLAIGALAVIEGPAP

SEQ ID NO: 140756 - protein, 16 aa, Mycobacterium tuberculosis
SLAIGALAVIEGPAPD

SEQ ID NO: 140757 - protein, 16 aa, Mycobacterium tuberculosis
LAIGALAVIEGPAPDQ

SEQ ID NO: 140758 - protein, 16 aa, Mycobacterium tuberculosis
AIGALAVIEGPAPDQE

SEQ ID NO: 140759 - protein, 16 aa, Mycobacterium tuberculosis
IGALAVIEGPAPDQEA

SEQ ID NO: 140760 - protein, 16 aa, Mycobacterium tuberculosis
GALAVIEGPAPDQEAF

SEQ ID NO: 140761 - protein, 16 aa, Mycobacterium tuberculosis
ALAVIEGPAPDQEAFL

SEQ ID NO: 140762 - protein, 16 aa, Mycobacterium tuberculosis
LAVIEGPAPDQEAFLS

SEQ ID NO: 140763 - protein, 16 aa, Mycobacterium tuberculosis
AVIEGPAPDQEAFLSS

SEQ ID NO: 140764 - protein, 16 aa, Mycobacterium tuberculosis
VIEGPAPDQEAFLSSL

SEQ ID NO: 140765 - protein, 16 aa, Mycobacterium tuberculosis
IEGPAPDQEAFLSSLA

SEQ ID NO: 140766 - protein, 16 aa, Mycobacterium tuberculosis
EGPAPDQEAFLSSLAQ

SEQ ID NO: 140767 - protein, 16 aa, Mycobacterium tuberculosis
GPAPDQEAFLSSLAQR

SEQ ID NO: 140768 - protein, 16 aa, Mycobacterium tuberculosis
PAPDQEAFLSSLAQRL

SEQ ID NO: 140769 - protein, 16 aa, Mycobacterium tuberculosis
APDQEAFLSSLAQRLR

SEQ ID NO: 140770 - protein, 16 aa, Mycobacterium tuberculosis
PDQEAFLSSLAQRLRP

SEQ ID NO: 140771 - protein, 16 aa, Mycobacterium tuberculosis
DQEAFLSSLAQRLRPC

SEQ ID NO: 140772 - protein, 16 aa, Mycobacterium tuberculosis
QEAFLSSLAQRLRPCT

SEQ ID NO: 140773 - protein, 16 aa, Mycobacterium tuberculosis
EAFLSSLAQRLRPCTR

SEQ ID NO: 140774 - protein, 16 aa, Mycobacterium tuberculosis
AFLSSLAQRLRPCTRF

SEQ ID NO: 140775 - protein, 16 aa, Mycobacterium tuberculosis
FLSSLAQRLRPCTRFG

SEQ ID NO: 140776 - protein, 16 aa, Mycobacterium tuberculosis
LSSLAQRLRPCTRFGQ

SEQ ID NO: 140777 - protein, 16 aa, Mycobacterium tuberculosis
SSLAQRLRPCTRFGQR

SEQ ID NO: 140778 - protein, 16 aa, Mycobacterium tuberculosis
SLAQRLRPCTRFGQRL

SEQ ID NO: 140779 - protein, 16 aa, Mycobacterium tuberculosis
LAQRLRPCTRFGQRLR

SEQ ID NO: 140780 - protein, 16 aa, Mycobacterium tuberculosis
AQRLRPCTRFGQRLRL

SEQ ID NO: 140781 - protein, 16 aa, Mycobacterium tuberculosis
QRLRPCTRFGQRLRLR

SEQ ID NO: 140782 - protein, 16 aa, Mycobacterium tuberculosis
RLRPCTRFGQRLRLRP

SEQ ID NO: 140783 - protein, 16 aa, Mycobacterium tuberculosis
LRPCTRFGQRLRLRPF

SEQ ID NO: 140784 - protein, 16 aa, Mycobacterium tuberculosis
RPCTRFGQRLRLRPFD

SEQ ID NO: 140785 - protein, 16 aa, Mycobacterium tuberculosis
PCTRFGQRLRLRPFDL

SEQ ID NO: 140786 - protein, 16 aa, Mycobacterium tuberculosis
CTRFGQRLRLRPFDLG

SEQ ID NO: 140787 - protein, 16 aa, Mycobacterium tuberculosis
TRFGQRLRLRPFDLGA

SEQ ID NO: 140788 - protein, 16 aa, Mycobacterium tuberculosis
RFGQRLRLRPFDLGAP

SEQ ID NO: 140789 - protein, 16 aa, Mycobacterium tuberculosis
FGQRLRLRPFDLGAPK

SEQ ID NO: 140790 - protein, 16 aa, Mycobacterium tuberculosis
GQRLRLRPFDLGAPKW

SEQ ID NO: 140791 - protein, 16 aa, Mycobacterium tuberculosis
QRLRLRPFDLGAPKWV

SEQ ID NO: 140792 - protein, 16 aa, Mycobacterium tuberculosis
RLRLRPFDLGAPKWVD

SEQ ID NO: 140793 - protein, 16 aa, Mycobacterium tuberculosis
LRLRPFDLGAPKWVDD

SEQ ID NO: 140794 - protein, 16 aa, Mycobacterium tuberculosis
RLRPFDLGAPKWVDDP

SEQ ID NO: 140795 - protein, 16 aa, Mycobacterium tuberculosis
LRPFDLGAPKWVDDPD

SEQ ID NO: 140796 - protein, 16 aa, Mycobacterium tuberculosis
RPFDLGAPKWVDDPDF

SEQ ID NO: 140797 - protein, 16 aa, Mycobacterium tuberculosis
PFDLGAPKWVDDPDFD

SEQ ID NO: 140798 - protein, 16 aa, Mycobacterium tuberculosis
FDLGAPKWVDDPDFDL

SEQ ID NO: 140799 - protein, 16 aa, Mycobacterium tuberculosis
DLGAPKWVDDPDFDLG

SEQ ID NO: 140800 - protein, 16 aa, Mycobacterium tuberculosis
LGAPKWVDDPDFDLGR

SEQ ID NO: 140801 - protein, 16 aa, Mycobacterium tuberculosis
GAPKWVDDPDFDLGRH

SEQ ID NO: 140802 - protein, 16 aa, Mycobacterium tuberculosis
APKWVDDPDFDLGRHV

SEQ ID NO: 140803 - protein, 16 aa, Mycobacterium tuberculosis
PKWVDDPDFDLGRHVW

SEQ ID NO: 140804 - protein, 16 aa, Mycobacterium tuberculosis
KWVDDPDFDLGRHVWR

SEQ ID NO: 140805 - protein, 16 aa, Mycobacterium tuberculosis
WVDDPDFDLGRHVWRI

SEQ ID NO: 140806 - protein, 16 aa, Mycobacterium tuberculosis
VDDPDFDLGRHVWRIA

SEQ ID NO: 140807 - protein, 16 aa, Mycobacterium tuberculosis
DDPDFDLGRHVWRIAL

SEQ ID NO: 140808 - protein, 16 aa, Mycobacterium tuberculosis
DPDFDLGRHVWRIALP

SEQ ID NO: 140809 - protein, 16 aa, Mycobacterium tuberculosis
PDFDLGRHVWRIALPR

SEQ ID NO: 140810 - protein, 16 aa, Mycobacterium tuberculosis
DFDLGRHVWRIALPRP

SEQ ID NO: 140811 - protein, 16 aa, Mycobacterium tuberculosis
FDLGRHVWRIALPRPG

SEQ ID NO: 140812 - protein, 16 aa, Mycobacterium tuberculosis
DLGRHVWRIALPRPGN

SEQ ID NO: 140813 - protein, 16 aa, Mycobacterium tuberculosis
LGRHVWRIALPRPGNE

SEQ ID NO: 140814 - protein, 16 aa, Mycobacterium tuberculosis
GRHVWRIALPRPGNED

SEQ ID NO: 140815 - protein, 16 aa, Mycobacterium tuberculosis
RHVWRIALPRPGNEDQ

SEQ ID NO: 140816 - protein, 16 aa, Mycobacterium tuberculosis
HVWRIALPRPGNEDQL

SEQ ID NO: 140817 - protein, 16 aa, Mycobacterium tuberculosis
VWRIALPRPGNEDQLF

SEQ ID NO: 140818 - protein, 16 aa, Mycobacterium tuberculosis
WRIALPRPGNEDQLFE

SEQ ID NO: 140819 - protein, 16 aa, Mycobacterium tuberculosis
RIALPRPGNEDQLFEL

SEQ ID NO: 140820 - protein, 16 aa, Mycobacterium tuberculosis
IALPRPGNEDQLFELI

SEQ ID NO: 140821 - protein, 16 aa, Mycobacterium tuberculosis
ALPRPGNEDQLFELIA

SEQ ID NO: 140822 - protein, 16 aa, Mycobacterium tuberculosis
LPRPGNEDQLFELIAD

SEQ ID NO: 140823 - protein, 16 aa, Mycobacterium tuberculosis
PRPGNEDQLFELIADL

SEQ ID NO: 140824 - protein, 16 aa, Mycobacterium tuberculosis
RPGNEDQLFELIADLM

SEQ ID NO: 140825 - protein, 16 aa, Mycobacterium tuberculosis
PGNEDQLFELIADLMA

SEQ ID NO: 140826 - protein, 16 aa, Mycobacterium tuberculosis
GNEDQLFELIADLMAR

SEQ ID NO: 140827 - protein, 16 aa, Mycobacterium tuberculosis
NEDQLFELIADLMARR

SEQ ID NO: 140828 - protein, 16 aa, Mycobacterium tuberculosis
EDQLFELIADLMARRL

SEQ ID NO: 140829 - protein, 16 aa, Mycobacterium tuberculosis
DQLFELIADLMARRLD

SEQ ID NO: 140830 - protein, 16 aa, Mycobacterium tuberculosis
QLFELIADLMARRLDR

SEQ ID NO: 140831 - protein, 16 aa, Mycobacterium tuberculosis
LFELIADLMARRLDRG

SEQ ID NO: 140832 - protein, 16 aa, Mycobacterium tuberculosis
FELIADLMARRLDRGR

SEQ ID NO: 140833 - protein, 16 aa, Mycobacterium tuberculosis
ELIADLMARRLDRGRP

SEQ ID NO: 140834 - protein, 16 aa, Mycobacterium tuberculosis
LIADLMARRLDRGRPL

SEQ ID NO: 140835 - protein, 16 aa, Mycobacterium tuberculosis
IADLMARRLDRGRPLW

SEQ ID NO: 140836 - protein, 16 aa, Mycobacterium tuberculosis
ADLMARRLDRGRPLWE

SEQ ID NO: 140837 - protein, 16 aa, Mycobacterium tuberculosis
DLMARRLDRGRPLWEV

SEQ ID NO: 140838 - protein, 16 aa, Mycobacterium tuberculosis
LMARRLDRGRPLWEVW

SEQ ID NO: 140839 - protein, 16 aa, Mycobacterium tuberculosis
MARRLDRGRPLWEVWV

SEQ ID NO: 140840 - protein, 16 aa, Mycobacterium tuberculosis
ARRLDRGRPLWEVWVI

SEQ ID NO: 140841 - protein, 16 aa, Mycobacterium tuberculosis
RRLDRGRPLWEVWVIE

SEQ ID NO: 140842 - protein, 16 aa, Mycobacterium tuberculosis
RLDRGRPLWEVWVIEG

SEQ ID NO: 140843 - protein, 16 aa, Mycobacterium tuberculosis
LDRGRPLWEVWVIEGL

SEQ ID NO: 140844 - protein, 16 aa, Mycobacterium tuberculosis
DRGRPLWEVWVIEGLA

SEQ ID NO: 140845 - protein, 16 aa, Mycobacterium tuberculosis
RGRPLWEVWVIEGLAD

SEQ ID NO: 140846 - protein, 16 aa, Mycobacterium tuberculosis
GRPLWEVWVIEGLADS

SEQ ID NO: 140847 - protein, 16 aa, Mycobacterium tuberculosis
RPLWEVWVIEGLADSK

SEQ ID NO: 140848 - protein, 16 aa, Mycobacterium tuberculosis
PLWEVWVIEGLADSKW

SEQ ID NO: 140849 - protein, 16 aa, Mycobacterium tuberculosis
LWEVWVIEGLADSKWA

SEQ ID NO: 140850 - protein, 16 aa, Mycobacterium tuberculosis
WEVWVIEGLADSKWAI

SEQ ID NO: 140851 - protein, 16 aa, Mycobacterium tuberculosis
EVWVIEGLADSKWAIL

SEQ ID NO: 140852 - protein, 16 aa, Mycobacterium tuberculosis
VWVIEGLADSKWAILT

SEQ ID NO: 140853 - protein, 16 aa, Mycobacterium tuberculosis
WVIEGLADSKWAILTK

SEQ ID NO: 140854 - protein, 16 aa, Mycobacterium tuberculosis
VIEGLADSKWAILTKL

SEQ ID NO: 140855 - protein, 16 aa, Mycobacterium tuberculosis
IEGLADSKWAILTKLH

SEQ ID NO: 140856 - protein, 16 aa, Mycobacterium tuberculosis
EGLADSKWAILTKLHH

SEQ ID NO: 140857 - protein, 16 aa, Mycobacterium tuberculosis
GLADSKWAILTKLHHC

SEQ ID NO: 140858 - protein, 16 aa, Mycobacterium tuberculosis
LADSKWAILTKLHHCM

SEQ ID NO: 140859 - protein, 16 aa, Mycobacterium tuberculosis
ADSKWAILTKLHHCMA

SEQ ID NO: 140860 - protein, 16 aa, Mycobacterium tuberculosis
DSKWAILTKLHHCMAD

SEQ ID NO: 140861 - protein, 16 aa, Mycobacterium tuberculosis
SKWAILTKLHHCMADG

SEQ ID NO: 140862 - protein, 16 aa, Mycobacterium tuberculosis
KWAILTKLHHCMADGI

SEQ ID NO: 140863 - protein, 16 aa, Mycobacterium tuberculosis
WAILTKLHHCMADGIA

SEQ ID NO: 140864 - protein, 16 aa, Mycobacterium tuberculosis
AILTKLHHCMADGIAA

SEQ ID NO: 140865 - protein, 16 aa, Mycobacterium tuberculosis
ILTKLHHCMADGIAAT

SEQ ID NO: 140866 - protein, 16 aa, Mycobacterium tuberculosis
LTKLHHCMADGIAATH

SEQ ID NO: 140867 - protein, 16 aa, Mycobacterium tuberculosis
TKLHHCMADGIAATHL

SEQ ID NO: 140868 - protein, 16 aa, Mycobacterium tuberculosis
KLHHCMADGIAATHLL

SEQ ID NO: 140869 - protein, 16 aa, Mycobacterium tuberculosis
LHHCMADGIAATHLLA

SEQ ID NO: 140870 - protein, 16 aa, Mycobacterium tuberculosis
HHCMADGIAATHLLAG

SEQ ID NO: 140871 - protein, 16 aa, Mycobacterium tuberculosis
HCMADGIAATHLLAGL

SEQ ID NO: 140872 - protein, 16 aa, Mycobacterium tuberculosis
CMADGIAATHLLAGLS

SEQ ID NO: 140873 - protein, 16 aa, Mycobacterium tuberculosis
MADGIAATHLLAGLSD

SEQ ID NO: 140874 - protein, 16 aa, Mycobacterium tuberculosis
ADGIAATHLLAGLSDE

SEQ ID NO: 140875 - protein, 16 aa, Mycobacterium tuberculosis
DGIAATHLLAGLSDES

SEQ ID NO: 140876 - protein, 16 aa, Mycobacterium tuberculosis
GIAATHLLAGLSDESM

SEQ ID NO: 140877 - protein, 16 aa, Mycobacterium tuberculosis
IAATHLLAGLSDESMS

SEQ ID NO: 140878 - protein, 16 aa, Mycobacterium tuberculosis
AATHLLAGLSDESMSD

SEQ ID NO: 140879 - protein, 16 aa, Mycobacterium tuberculosis
ATHLLAGLSDESMSDS

SEQ ID NO: 140880 - protein, 16 aa, Mycobacterium tuberculosis
THLLAGLSDESMSDSF

SEQ ID NO: 140881 - protein, 16 aa, Mycobacterium tuberculosis
HLLAGLSDESMSDSFA

SEQ ID NO: 140882 - protein, 16 aa, Mycobacterium tuberculosis
LLAGLSDESMSDSFAS

SEQ ID NO: 140883 - protein, 16 aa, Mycobacterium tuberculosis
LAGLSDESMSDSFASN

SEQ ID NO: 140884 - protein, 16 aa, Mycobacterium tuberculosis
AGLSDESMSDSFASNI

SEQ ID NO: 140885 - protein, 16 aa, Mycobacterium tuberculosis
GLSDESMSDSFASNIH

SEQ ID NO: 140886 - protein, 16 aa, Mycobacterium tuberculosis
LSDESMSDSFASNIHT

SEQ ID NO: 140887 - protein, 16 aa, Mycobacterium tuberculosis
SDESMSDSFASNIHTT

SEQ ID NO: 140888 - protein, 16 aa, Mycobacterium tuberculosis
DESMSDSFASNIHTTM

SEQ ID NO: 140889 - protein, 16 aa, Mycobacterium tuberculosis
ESMSDSFASNIHTTMQ

SEQ ID NO: 140890 - protein, 16 aa, Mycobacterium tuberculosis
SMSDSFASNIHTTMQS

SEQ ID NO: 140891 - protein, 16 aa, Mycobacterium tuberculosis
MSDSFASNIHTTMQSQ

SEQ ID NO: 140892 - protein, 16 aa, Mycobacterium tuberculosis
SDSFASNIHTTMQSQS

SEQ ID NO: 140893 - protein, 16 aa, Mycobacterium tuberculosis
DSFASNIHTTMQSQSA

SEQ ID NO: 140894 - protein, 16 aa, Mycobacterium tuberculosis
SFASNIHTTMQSQSAS

SEQ ID NO: 140895 - protein, 16 aa, Mycobacterium tuberculosis
FASNIHTTMQSQSASV

SEQ ID NO: 140896 - protein, 16 aa, Mycobacterium tuberculosis
ASNIHTTMQSQSASVR

SEQ ID NO: 140897 - protein, 16 aa, Mycobacterium tuberculosis
SNIHTTMQSQSASVRR

SEQ ID NO: 140898 - protein, 16 aa, Mycobacterium tuberculosis
NIHTTMQSQSASVRRG

SEQ ID NO: 140899 - protein, 16 aa, Mycobacterium tuberculosis
IHTTMQSQSASVRRGG

SEQ ID NO: 140900 - protein, 16 aa, Mycobacterium tuberculosis
HTTMQSQSASVRRGGF

SEQ ID NO: 140901 - protein, 16 aa, Mycobacterium tuberculosis
TTMQSQSASVRRGGFR

SEQ ID NO: 140902 - protein, 16 aa, Mycobacterium tuberculosis
TMQSQSASVRRGGFRV

SEQ ID NO: 140903 - protein, 16 aa, Mycobacterium tuberculosis
MQSQSASVRRGGFRVN

SEQ ID NO: 140904 - protein, 16 aa, Mycobacterium tuberculosis
QSQSASVRRGGFRVNP

SEQ ID NO: 140905 - protein, 16 aa, Mycobacterium tuberculosis
SQSASVRRGGFRVNPS

SEQ ID NO: 140906 - protein, 16 aa, Mycobacterium tuberculosis
QSASVRRGGFRVNPSE

SEQ ID NO: 140907 - protein, 16 aa, Mycobacterium tuberculosis
SASVRRGGFRVNPSEA

SEQ ID NO: 140908 - protein, 16 aa, Mycobacterium tuberculosis
ASVRRGGFRVNPSEAL

SEQ ID NO: 140909 - protein, 16 aa, Mycobacterium tuberculosis
SVRRGGFRVNPSEALT

SEQ ID NO: 140910 - protein, 16 aa, Mycobacterium tuberculosis
VRRGGFRVNPSEALTA

SEQ ID NO: 140911 - protein, 16 aa, Mycobacterium tuberculosis
RRGGFRVNPSEALTAS

SEQ ID NO: 140912 - protein, 16 aa, Mycobacterium tuberculosis
RGGFRVNPSEALTAST

SEQ ID NO: 140913 - protein, 16 aa, Mycobacterium tuberculosis
GGFRVNPSEALTASTA

SEQ ID NO: 140914 - protein, 16 aa, Mycobacterium tuberculosis
GFRVNPSEALTASTAV

SEQ ID NO: 140915 - protein, 16 aa, Mycobacterium tuberculosis
FRVNPSEALTASTAVM

SEQ ID NO: 140916 - protein, 16 aa, Mycobacterium tuberculosis
RVNPSEALTASTAVMA

SEQ ID NO: 140917 - protein, 16 aa, Mycobacterium tuberculosis
VNPSEALTASTAVMAG

SEQ ID NO: 140918 - protein, 16 aa, Mycobacterium tuberculosis
NPSEALTASTAVMAGI

SEQ ID NO: 140919 - protein, 16 aa, Mycobacterium tuberculosis
PSEALTASTAVMAGIV

SEQ ID NO: 140920 - protein, 16 aa, Mycobacterium tuberculosis
SEALTASTAVMAGIVR

SEQ ID NO: 140921 - protein, 16 aa, Mycobacterium tuberculosis
EALTASTAVMAGIVRA

SEQ ID NO: 140922 - protein, 16 aa, Mycobacterium tuberculosis
ALTASTAVMAGIVRAA

SEQ ID NO: 140923 - protein, 16 aa, Mycobacterium tuberculosis
LTASTAVMAGIVRAAK

SEQ ID NO: 140924 - protein, 16 aa, Mycobacterium tuberculosis
TASTAVMAGIVRAAKG

SEQ ID NO: 140925 - protein, 16 aa, Mycobacterium tuberculosis
ASTAVMAGIVRAAKGA

SEQ ID NO: 140926 - protein, 16 aa, Mycobacterium tuberculosis
STAVMAGIVRAAKGAS

SEQ ID NO: 140927 - protein, 16 aa, Mycobacterium tuberculosis
TAVMAGIVRAAKGASE

SEQ ID NO: 140928 - protein, 16 aa, Mycobacterium tuberculosis
AVMAGIVRAAKGASEI

SEQ ID NO: 140929 - protein, 16 aa, Mycobacterium tuberculosis
VMAGIVRAAKGASEIA

SEQ ID NO: 140930 - protein, 16 aa, Mycobacterium tuberculosis
MAGIVRAAKGASEIAA

SEQ ID NO: 140931 - protein, 16 aa, Mycobacterium tuberculosis
AGIVRAAKGASEIAAG

SEQ ID NO: 140932 - protein, 16 aa, Mycobacterium tuberculosis
GIVRAAKGASEIAAGV

SEQ ID NO: 140933 - protein, 16 aa, Mycobacterium tuberculosis
IVRAAKGASEIAAGVL

SEQ ID NO: 140934 - protein, 16 aa, Mycobacterium tuberculosis
VRAAKGASEIAAGVLS

SEQ ID NO: 140935 - protein, 16 aa, Mycobacterium tuberculosis
RAAKGASEIAAGVLSP

SEQ ID NO: 140936 - protein, 16 aa, Mycobacterium tuberculosis
AAKGASEIAAGVLSPA

SEQ ID NO: 140937 - protein, 16 aa, Mycobacterium tuberculosis
AKGASEIAAGVLSPAA

SEQ ID NO: 140938 - protein, 16 aa, Mycobacterium tuberculosis
KGASEIAAGVLSPAAS

SEQ ID NO: 140939 - protein, 16 aa, Mycobacterium tuberculosis
GASEIAAGVLSPAASS

SEQ ID NO: 140940 - protein, 16 aa, Mycobacterium tuberculosis
ASEIAAGVLSPAASSL

SEQ ID NO: 140941 - protein, 16 aa, Mycobacterium tuberculosis
SEIAAGVLSPAASSLN

SEQ ID NO: 140942 - protein, 16 aa, Mycobacterium tuberculosis
EIAAGVLSPAASSLNG

SEQ ID NO: 140943 - protein, 16 aa, Mycobacterium tuberculosis
IAAGVLSPAASSLNGP

SEQ ID NO: 140944 - protein, 16 aa, Mycobacterium tuberculosis
AAGVLSPAASSLNGPI

SEQ ID NO: 140945 - protein, 16 aa, Mycobacterium tuberculosis
AGVLSPAASSLNGPIS

SEQ ID NO: 140946 - protein, 16 aa, Mycobacterium tuberculosis
GVLSPAASSLNGPISD

SEQ ID NO: 140947 - protein, 16 aa, Mycobacterium tuberculosis
VLSPAASSLNGPISDL

SEQ ID NO: 140948 - protein, 16 aa, Mycobacterium tuberculosis
LSPAASSLNGPISDLR

SEQ ID NO: 140949 - protein, 16 aa, Mycobacterium tuberculosis
SPAASSLNGPISDLRR

SEQ ID NO: 140950 - protein, 16 aa, Mycobacterium tuberculosis
PAASSLNGPISDLRRY

SEQ ID NO: 140951 - protein, 16 aa, Mycobacterium tuberculosis
AASSLNGPISDLRRYS

SEQ ID NO: 140952 - protein, 16 aa, Mycobacterium tuberculosis
ASSLNGPISDLRRYSA

SEQ ID NO: 140953 - protein, 16 aa, Mycobacterium tuberculosis
SSLNGPISDLRRYSAA

SEQ ID NO: 140954 - protein, 16 aa, Mycobacterium tuberculosis
SLNGPISDLRRYSAAK

SEQ ID NO: 140955 - protein, 16 aa, Mycobacterium tuberculosis
LNGPISDLRRYSAAKV

SEQ ID NO: 140956 - protein, 16 aa, Mycobacterium tuberculosis
NGPISDLRRYSAAKVP

SEQ ID NO: 140957 - protein, 16 aa, Mycobacterium tuberculosis
GPISDLRRYSAAKVPL

SEQ ID NO: 140958 - protein, 16 aa, Mycobacterium tuberculosis
PISDLRRYSAAKVPLA

SEQ ID NO: 140959 - protein, 16 aa, Mycobacterium tuberculosis
ISDLRRYSAAKVPLAD

SEQ ID NO: 140960 - protein, 16 aa, Mycobacterium tuberculosis
SDLRRYSAAKVPLADV

SEQ ID NO: 140961 - protein, 16 aa, Mycobacterium tuberculosis
DLRRYSAAKVPLADVE

SEQ ID NO: 140962 - protein, 16 aa, Mycobacterium tuberculosis
LRRYSAAKVPLADVEQ

SEQ ID NO: 140963 - protein, 16 aa, Mycobacterium tuberculosis
RRYSAAKVPLADVEQV

SEQ ID NO: 140964 - protein, 16 aa, Mycobacterium tuberculosis
RYSAAKVPLADVEQVC

SEQ ID NO: 140965 - protein, 16 aa, Mycobacterium tuberculosis
YSAAKVPLADVEQVCR

SEQ ID NO: 140966 - protein, 16 aa, Mycobacterium tuberculosis
SAAKVPLADVEQVCRK

SEQ ID NO: 140967 - protein, 16 aa, Mycobacterium tuberculosis
AAKVPLADVEQVCRKF

SEQ ID NO: 140968 - protein, 16 aa, Mycobacterium tuberculosis
AKVPLADVEQVCRKFD

SEQ ID NO: 140969 - protein, 16 aa, Mycobacterium tuberculosis
KVPLADVEQVCRKFDV

SEQ ID NO: 140970 - protein, 16 aa, Mycobacterium tuberculosis
VPLADVEQVCRKFDVT

SEQ ID NO: 140971 - protein, 16 aa, Mycobacterium tuberculosis
PLADVEQVCRKFDVTI

SEQ ID NO: 140972 - protein, 16 aa, Mycobacterium tuberculosis
LADVEQVCRKFDVTIN

SEQ ID NO: 140973 - protein, 16 aa, Mycobacterium tuberculosis
ADVEQVCRKFDVTIND

SEQ ID NO: 140974 - protein, 16 aa, Mycobacterium tuberculosis
DVEQVCRKFDVTINDV

SEQ ID NO: 140975 - protein, 16 aa, Mycobacterium tuberculosis
VEQVCRKFDVTINDVA

SEQ ID NO: 140976 - protein, 16 aa, Mycobacterium tuberculosis
EQVCRKFDVTINDVAL

SEQ ID NO: 140977 - protein, 16 aa, Mycobacterium tuberculosis
QVCRKFDVTINDVALA

SEQ ID NO: 140978 - protein, 16 aa, Mycobacterium tuberculosis
VCRKFDVTINDVALAA

SEQ ID NO: 140979 - protein, 16 aa, Mycobacterium tuberculosis
CRKFDVTINDVALAAI

SEQ ID NO: 140980 - protein, 16 aa, Mycobacterium tuberculosis
RKFDVTINDVALAAIT

SEQ ID NO: 140981 - protein, 16 aa, Mycobacterium tuberculosis
KFDVTINDVALAAITE

SEQ ID NO: 140982 - protein, 16 aa, Mycobacterium tuberculosis
FDVTINDVALAAITES

SEQ ID NO: 140983 - protein, 16 aa, Mycobacterium tuberculosis
DVTINDVALAAITESY

SEQ ID NO: 140984 - protein, 16 aa, Mycobacterium tuberculosis
VTINDVALAAITESYR

SEQ ID NO: 140985 - protein, 16 aa, Mycobacterium tuberculosis
TINDVALAAITESYRN

SEQ ID NO: 140986 - protein, 16 aa, Mycobacterium tuberculosis
INDVALAAITESYRNV

SEQ ID NO: 140987 - protein, 16 aa, Mycobacterium tuberculosis
NDVALAAITESYRNVL

SEQ ID NO: 140988 - protein, 16 aa, Mycobacterium tuberculosis
DVALAAITESYRNVLI

SEQ ID NO: 140989 - protein, 16 aa, Mycobacterium tuberculosis
VALAAITESYRNVLIQ

SEQ ID NO: 140990 - protein, 16 aa, Mycobacterium tuberculosis
ALAAITESYRNVLIQR

SEQ ID NO: 140991 - protein, 16 aa, Mycobacterium tuberculosis
LAAITESYRNVLIQRG

SEQ ID NO: 140992 - protein, 16 aa, Mycobacterium tuberculosis
AAITESYRNVLIQRGE

SEQ ID NO: 140993 - protein, 16 aa, Mycobacterium tuberculosis
AITESYRNVLIQRGER

SEQ ID NO: 140994 - protein, 16 aa, Mycobacterium tuberculosis
ITESYRNVLIQRGERP

SEQ ID NO: 140995 - protein, 16 aa, Mycobacterium tuberculosis
TESYRNVLIQRGERPR

SEQ ID NO: 140996 - protein, 16 aa, Mycobacterium tuberculosis
ESYRNVLIQRGERPRF

SEQ ID NO: 140997 - protein, 16 aa, Mycobacterium tuberculosis
SYRNVLIQRGERPRFD

SEQ ID NO: 140998 - protein, 16 aa, Mycobacterium tuberculosis
YRNVLIQRGERPRFDS

SEQ ID NO: 140999 - protein, 16 aa, Mycobacterium tuberculosis
RNVLIQRGERPRFDSL

SEQ ID NO: 141000 - protein, 16 aa, Mycobacterium tuberculosis
NVLIQRGERPRFDSLR

SEQ ID NO: 141001 - protein, 16 aa, Mycobacterium tuberculosis
VLIQRGERPRFDSLRT

SEQ ID NO: 141002 - protein, 16 aa, Mycobacterium tuberculosis
LIQRGERPRFDSLRTL

SEQ ID NO: 141003 - protein, 16 aa, Mycobacterium tuberculosis
IQRGERPRFDSLRTLV

SEQ ID NO: 141004 - protein, 16 aa, Mycobacterium tuberculosis
QRGERPRFDSLRTLVP

SEQ ID NO: 141005 - protein, 16 aa, Mycobacterium tuberculosis
RGERPRFDSLRTLVPV

SEQ ID NO: 141006 - protein, 16 aa, Mycobacterium tuberculosis
GERPRFDSLRTLVPVS

SEQ ID NO: 141007 - protein, 16 aa, Mycobacterium tuberculosis
ERPRFDSLRTLVPVST

SEQ ID NO: 141008 - protein, 16 aa, Mycobacterium tuberculosis
RPRFDSLRTLVPVSTR

SEQ ID NO: 141009 - protein, 16 aa, Mycobacterium tuberculosis
PRFDSLRTLVPVSTRS

SEQ ID NO: 141010 - protein, 16 aa, Mycobacterium tuberculosis
RFDSLRTLVPVSTRSN

SEQ ID NO: 141011 - protein, 16 aa, Mycobacterium tuberculosis
FDSLRTLVPVSTRSNS

SEQ ID NO: 141012 - protein, 16 aa, Mycobacterium tuberculosis
DSLRTLVPVSTRSNSA

SEQ ID NO: 141013 - protein, 16 aa, Mycobacterium tuberculosis
SLRTLVPVSTRSNSAL

SEQ ID NO: 141014 - protein, 16 aa, Mycobacterium tuberculosis
LRTLVPVSTRSNSALS

SEQ ID NO: 141015 - protein, 16 aa, Mycobacterium tuberculosis
RTLVPVSTRSNSALSK

SEQ ID NO: 141016 - protein, 16 aa, Mycobacterium tuberculosis
TLVPVSTRSNSALSKT

SEQ ID NO: 141017 - protein, 16 aa, Mycobacterium tuberculosis
LVPVSTRSNSALSKTD

SEQ ID NO: 141018 - protein, 16 aa, Mycobacterium tuberculosis
VPVSTRSNSALSKTDN

SEQ ID NO: 141019 - protein, 16 aa, Mycobacterium tuberculosis
PVSTRSNSALSKTDNR

SEQ ID NO: 141020 - protein, 16 aa, Mycobacterium tuberculosis
VSTRSNSALSKTDNRV

SEQ ID NO: 141021 - protein, 16 aa, Mycobacterium tuberculosis
STRSNSALSKTDNRVS

SEQ ID NO: 141022 - protein, 16 aa, Mycobacterium tuberculosis
TRSNSALSKTDNRVSL

SEQ ID NO: 141023 - protein, 16 aa, Mycobacterium tuberculosis
RSNSALSKTDNRVSLM

SEQ ID NO: 141024 - protein, 16 aa, Mycobacterium tuberculosis
SNSALSKTDNRVSLML

SEQ ID NO: 141025 - protein, 16 aa, Mycobacterium tuberculosis
NSALSKTDNRVSLMLP

SEQ ID NO: 141026 - protein, 16 aa, Mycobacterium tuberculosis
SALSKTDNRVSLMLPN

SEQ ID NO: 141027 - protein, 16 aa, Mycobacterium tuberculosis
ALSKTDNRVSLMLPNL

SEQ ID NO: 141028 - protein, 16 aa, Mycobacterium tuberculosis
LSKTDNRVSLMLPNLP

SEQ ID NO: 141029 - protein, 16 aa, Mycobacterium tuberculosis
SKTDNRVSLMLPNLPV

SEQ ID NO: 141030 - protein, 16 aa, Mycobacterium tuberculosis
KTDNRVSLMLPNLPVD

SEQ ID NO: 141031 - protein, 16 aa, Mycobacterium tuberculosis
TDNRVSLMLPNLPVDQ

SEQ ID NO: 141032 - protein, 16 aa, Mycobacterium tuberculosis
DNRVSLMLPNLPVDQE

SEQ ID NO: 141033 - protein, 16 aa, Mycobacterium tuberculosis
NRVSLMLPNLPVDQEN

SEQ ID NO: 141034 - protein, 16 aa, Mycobacterium tuberculosis
RVSLMLPNLPVDQENP

SEQ ID NO: 141035 - protein, 16 aa, Mycobacterium tuberculosis
VSLMLPNLPVDQENPL

SEQ ID NO: 141036 - protein, 16 aa, Mycobacterium tuberculosis
SLMLPNLPVDQENPLQ

SEQ ID NO: 141037 - protein, 16 aa, Mycobacterium tuberculosis
LMLPNLPVDQENPLQR

SEQ ID NO: 141038 - protein, 16 aa, Mycobacterium tuberculosis
MLPNLPVDQENPLQRL

SEQ ID NO: 141039 - protein, 16 aa, Mycobacterium tuberculosis
LPNLPVDQENPLQRLR

SEQ ID NO: 141040 - protein, 16 aa, Mycobacterium tuberculosis
PNLPVDQENPLQRLRI

SEQ ID NO: 141041 - protein, 16 aa, Mycobacterium tuberculosis
NLPVDQENPLQRLRIV

SEQ ID NO: 141042 - protein, 16 aa, Mycobacterium tuberculosis
LPVDQENPLQRLRIVH

SEQ ID NO: 141043 - protein, 16 aa, Mycobacterium tuberculosis
PVDQENPLQRLRIVHS

SEQ ID NO: 141044 - protein, 16 aa, Mycobacterium tuberculosis
VDQENPLQRLRIVHSR

SEQ ID NO: 141045 - protein, 16 aa, Mycobacterium tuberculosis
DQENPLQRLRIVHSRL

SEQ ID NO: 141046 - protein, 16 aa, Mycobacterium tuberculosis
QENPLQRLRIVHSRLT

SEQ ID NO: 141047 - protein, 16 aa, Mycobacterium tuberculosis
ENPLQRLRIVHSRLTR

SEQ ID NO: 141048 - protein, 16 aa, Mycobacterium tuberculosis
NPLQRLRIVHSRLTRA

SEQ ID NO: 141049 - protein, 16 aa, Mycobacterium tuberculosis
PLQRLRIVHSRLTRAK

SEQ ID NO: 141050 - protein, 16 aa, Mycobacterium tuberculosis
LQRLRIVHSRLTRAKA

SEQ ID NO: 141051 - protein, 16 aa, Mycobacterium tuberculosis
QRLRIVHSRLTRAKAG

SEQ ID NO: 141052 - protein, 16 aa, Mycobacterium tuberculosis
RLRIVHSRLTRAKAGG

SEQ ID NO: 141053 - protein, 16 aa, Mycobacterium tuberculosis
LRIVHSRLTRAKAGGQ

SEQ ID NO: 141054 - protein, 16 aa, Mycobacterium tuberculosis
RIVHSRLTRAKAGGQR

SEQ ID NO: 141055 - protein, 16 aa, Mycobacterium tuberculosis
IVHSRLTRAKAGGQRQ

SEQ ID NO: 141056 - protein, 16 aa, Mycobacterium tuberculosis
VHSRLTRAKAGGQRQF

SEQ ID NO: 141057 - protein, 16 aa, Mycobacterium tuberculosis
HSRLTRAKAGGQRQFG

SEQ ID NO: 141058 - protein, 16 aa, Mycobacterium tuberculosis
SRLTRAKAGGQRQFGN

SEQ ID NO: 141059 - protein, 16 aa, Mycobacterium tuberculosis
RLTRAKAGGQRQFGNT

SEQ ID NO: 141060 - protein, 16 aa, Mycobacterium tuberculosis
LTRAKAGGQRQFGNTL

SEQ ID NO: 141061 - protein, 16 aa, Mycobacterium tuberculosis
TRAKAGGQRQFGNTLM

SEQ ID NO: 141062 - protein, 16 aa, Mycobacterium tuberculosis
RAKAGGQRQFGNTLMA

SEQ ID NO: 141063 - protein, 16 aa, Mycobacterium tuberculosis
AKAGGQRQFGNTLMAI

SEQ ID NO: 141064 - protein, 16 aa, Mycobacterium tuberculosis
KAGGQRQFGNTLMAIA

SEQ ID NO: 141065 - protein, 16 aa, Mycobacterium tuberculosis
AGGQRQFGNTLMAIAN

SEQ ID NO: 141066 - protein, 16 aa, Mycobacterium tuberculosis
GGQRQFGNTLMAIANR

SEQ ID NO: 141067 - protein, 16 aa, Mycobacterium tuberculosis
GQRQFGNTLMAIANRL

SEQ ID NO: 141068 - protein, 16 aa, Mycobacterium tuberculosis
QRQFGNTLMAIANRLP

SEQ ID NO: 141069 - protein, 16 aa, Mycobacterium tuberculosis
RQFGNTLMAIANRLPF

SEQ ID NO: 141070 - protein, 16 aa, Mycobacterium tuberculosis
QFGNTLMAIANRLPFP

SEQ ID NO: 141071 - protein, 16 aa, Mycobacterium tuberculosis
FGNTLMAIANRLPFPM

SEQ ID NO: 141072 - protein, 16 aa, Mycobacterium tuberculosis
GNTLMAIANRLPFPMT

SEQ ID NO: 141073 - protein, 16 aa, Mycobacterium tuberculosis
NTLMAIANRLPFPMTA

SEQ ID NO: 141074 - protein, 16 aa, Mycobacterium tuberculosis
TLMAIANRLPFPMTAW

SEQ ID NO: 141075 - protein, 16 aa, Mycobacterium tuberculosis
LMAIANRLPFPMTAWA

SEQ ID NO: 141076 - protein, 16 aa, Mycobacterium tuberculosis
MAIANRLPFPMTAWAV

SEQ ID NO: 141077 - protein, 16 aa, Mycobacterium tuberculosis
AIANRLPFPMTAWAVG

SEQ ID NO: 141078 - protein, 16 aa, Mycobacterium tuberculosis
IANRLPFPMTAWAVGL

SEQ ID NO: 141079 - protein, 16 aa, Mycobacterium tuberculosis
ANRLPFPMTAWAVGLL

SEQ ID NO: 141080 - protein, 16 aa, Mycobacterium tuberculosis
NRLPFPMTAWAVGLLM

SEQ ID NO: 141081 - protein, 16 aa, Mycobacterium tuberculosis
RLPFPMTAWAVGLLMR

SEQ ID NO: 141082 - protein, 16 aa, Mycobacterium tuberculosis
LPFPMTAWAVGLLMRL

SEQ ID NO: 141083 - protein, 16 aa, Mycobacterium tuberculosis
PFPMTAWAVGLLMRLP

SEQ ID NO: 141084 - protein, 16 aa, Mycobacterium tuberculosis
FPMTAWAVGLLMRLPQ

SEQ ID NO: 141085 - protein, 16 aa, Mycobacterium tuberculosis
PMTAWAVGLLMRLPQR

SEQ ID NO: 141086 - protein, 16 aa, Mycobacterium tuberculosis
MTAWAVGLLMRLPQRG

SEQ ID NO: 141087 - protein, 16 aa, Mycobacterium tuberculosis
TAWAVGLLMRLPQRGV

SEQ ID NO: 141088 - protein, 16 aa, Mycobacterium tuberculosis
AWAVGLLMRLPQRGVV

SEQ ID NO: 141089 - protein, 16 aa, Mycobacterium tuberculosis
WAVGLLMRLPQRGVVT

SEQ ID NO: 141090 - protein, 16 aa, Mycobacterium tuberculosis
AVGLLMRLPQRGVVTV

SEQ ID NO: 141091 - protein, 16 aa, Mycobacterium tuberculosis
VGLLMRLPQRGVVTVA

SEQ ID NO: 141092 - protein, 16 aa, Mycobacterium tuberculosis
GLLMRLPQRGVVTVAT

SEQ ID NO: 141093 - protein, 16 aa, Mycobacterium tuberculosis
LLMRLPQRGVVTVATN

SEQ ID NO: 141094 - protein, 16 aa, Mycobacterium tuberculosis
LMRLPQRGVVTVATNV

SEQ ID NO: 141095 - protein, 16 aa, Mycobacterium tuberculosis
MRLPQRGVVTVATNVP

SEQ ID NO: 141096 - protein, 16 aa, Mycobacterium tuberculosis
RLPQRGVVTVATNVPG

SEQ ID NO: 141097 - protein, 16 aa, Mycobacterium tuberculosis
LPQRGVVTVATNVPGP

SEQ ID NO: 141098 - protein, 16 aa, Mycobacterium tuberculosis
PQRGVVTVATNVPGPR

SEQ ID NO: 141099 - protein, 16 aa, Mycobacterium tuberculosis
QRGVVTVATNVPGPRR

SEQ ID NO: 141100 - protein, 16 aa, Mycobacterium tuberculosis
RGVVTVATNVPGPRRP

SEQ ID NO: 141101 - protein, 16 aa, Mycobacterium tuberculosis
GVVTVATNVPGPRRPL

SEQ ID NO: 141102 - protein, 16 aa, Mycobacterium tuberculosis
VVTVATNVPGPRRPLQ

SEQ ID NO: 141103 - protein, 16 aa, Mycobacterium tuberculosis
VTVATNVPGPRRPLQI

SEQ ID NO: 141104 - protein, 16 aa, Mycobacterium tuberculosis
TVATNVPGPRRPLQIM

SEQ ID NO: 141105 - protein, 16 aa, Mycobacterium tuberculosis
VATNVPGPRRPLQIMG

SEQ ID NO: 141106 - protein, 16 aa, Mycobacterium tuberculosis
ATNVPGPRRPLQIMGR

SEQ ID NO: 141107 - protein, 16 aa, Mycobacterium tuberculosis
TNVPGPRRPLQIMGRR

SEQ ID NO: 141108 - protein, 16 aa, Mycobacterium tuberculosis
NVPGPRRPLQIMGRRV

SEQ ID NO: 141109 - protein, 16 aa, Mycobacterium tuberculosis
VPGPRRPLQIMGRRVL

SEQ ID NO: 141110 - protein, 16 aa, Mycobacterium tuberculosis
PGPRRPLQIMGRRVLD

SEQ ID NO: 141111 - protein, 16 aa, Mycobacterium tuberculosis
GPRRPLQIMGRRVLDL

SEQ ID NO: 141112 - protein, 16 aa, Mycobacterium tuberculosis
PRRPLQIMGRRVLDLY

SEQ ID NO: 141113 - protein, 16 aa, Mycobacterium tuberculosis
RRPLQIMGRRVLDLYP

SEQ ID NO: 141114 - protein, 16 aa, Mycobacterium tuberculosis
RPLQIMGRRVLDLYPV

SEQ ID NO: 141115 - protein, 16 aa, Mycobacterium tuberculosis
PLQIMGRRVLDLYPVS

SEQ ID NO: 141116 - protein, 16 aa, Mycobacterium tuberculosis
LQIMGRRVLDLYPVSP

SEQ ID NO: 141117 - protein, 16 aa, Mycobacterium tuberculosis
QIMGRRVLDLYPVSPI

SEQ ID NO: 141118 - protein, 16 aa, Mycobacterium tuberculosis
IMGRRVLDLYPVSPIA

SEQ ID NO: 141119 - protein, 16 aa, Mycobacterium tuberculosis
MGRRVLDLYPVSPIAM

SEQ ID NO: 141120 - protein, 16 aa, Mycobacterium tuberculosis
GRRVLDLYPVSPIAMQ

SEQ ID NO: 141121 - protein, 16 aa, Mycobacterium tuberculosis
RRVLDLYPVSPIAMQL

SEQ ID NO: 141122 - protein, 16 aa, Mycobacterium tuberculosis
RVLDLYPVSPIAMQLR

SEQ ID NO: 141123 - protein, 16 aa, Mycobacterium tuberculosis
VLDLYPVSPIAMQLRT

SEQ ID NO: 141124 - protein, 16 aa, Mycobacterium tuberculosis
LDLYPVSPIAMQLRTS

SEQ ID NO: 141125 - protein, 16 aa, Mycobacterium tuberculosis
DLYPVSPIAMQLRTSV

SEQ ID NO: 141126 - protein, 16 aa, Mycobacterium tuberculosis
LYPVSPIAMQLRTSVA

SEQ ID NO: 141127 - protein, 16 aa, Mycobacterium tuberculosis
YPVSPIAMQLRTSVAM

SEQ ID NO: 141128 - protein, 16 aa, Mycobacterium tuberculosis
PVSPIAMQLRTSVAML

SEQ ID NO: 141129 - protein, 16 aa, Mycobacterium tuberculosis
VSPIAMQLRTSVAMLS

SEQ ID NO: 141130 - protein, 16 aa, Mycobacterium tuberculosis
SPIAMQLRTSVAMLSY

SEQ ID NO: 141131 - protein, 16 aa, Mycobacterium tuberculosis
PIAMQLRTSVAMLSYA

SEQ ID NO: 141132 - protein, 16 aa, Mycobacterium tuberculosis
IAMQLRTSVAMLSYAD

SEQ ID NO: 141133 - protein, 16 aa, Mycobacterium tuberculosis
AMQLRTSVAMLSYADD

SEQ ID NO: 141134 - protein, 16 aa, Mycobacterium tuberculosis
MQLRTSVAMLSYADDL

SEQ ID NO: 141135 - protein, 16 aa, Mycobacterium tuberculosis
QLRTSVAMLSYADDLY

SEQ ID NO: 141136 - protein, 16 aa, Mycobacterium tuberculosis
LRTSVAMLSYADDLYF

SEQ ID NO: 141137 - protein, 16 aa, Mycobacterium tuberculosis
RTSVAMLSYADDLYFG

SEQ ID NO: 141138 - protein, 16 aa, Mycobacterium tuberculosis
TSVAMLSYADDLYFGI

SEQ ID NO: 141139 - protein, 16 aa, Mycobacterium tuberculosis
SVAMLSYADDLYFGIL

SEQ ID NO: 141140 - protein, 16 aa, Mycobacterium tuberculosis
VAMLSYADDLYFGILA

SEQ ID NO: 141141 - protein, 16 aa, Mycobacterium tuberculosis
AMLSYADDLYFGILAD

SEQ ID NO: 141142 - protein, 16 aa, Mycobacterium tuberculosis
MLSYADDLYFGILADY

SEQ ID NO: 141143 - protein, 16 aa, Mycobacterium tuberculosis
LSYADDLYFGILADYD

SEQ ID NO: 141144 - protein, 16 aa, Mycobacterium tuberculosis
SYADDLYFGILADYDV

SEQ ID NO: 141145 - protein, 16 aa, Mycobacterium tuberculosis
YADDLYFGILADYDVV

SEQ ID NO: 141146 - protein, 16 aa, Mycobacterium tuberculosis
ADDLYFGILADYDVVA

SEQ ID NO: 141147 - protein, 16 aa, Mycobacterium tuberculosis
DDLYFGILADYDVVAD

SEQ ID NO: 141148 - protein, 16 aa, Mycobacterium tuberculosis
DLYFGILADYDVVADA

SEQ ID NO: 141149 - protein, 16 aa, Mycobacterium tuberculosis
LYFGILADYDVVADAG

SEQ ID NO: 141150 - protein, 16 aa, Mycobacterium tuberculosis
YFGILADYDVVADAGQ

SEQ ID NO: 141151 - protein, 16 aa, Mycobacterium tuberculosis
FGILADYDVVADAGQL

SEQ ID NO: 141152 - protein, 16 aa, Mycobacterium tuberculosis
GILADYDVVADAGQLA

SEQ ID NO: 141153 - protein, 16 aa, Mycobacterium tuberculosis
ILADYDVVADAGQLAR

SEQ ID NO: 141154 - protein, 16 aa, Mycobacterium tuberculosis
LADYDVVADAGQLARG

SEQ ID NO: 141155 - protein, 16 aa, Mycobacterium tuberculosis
ADYDVVADAGQLARGI

SEQ ID NO: 141156 - protein, 16 aa, Mycobacterium tuberculosis
DYDVVADAGQLARGIE

SEQ ID NO: 141157 - protein, 16 aa, Mycobacterium tuberculosis
YDVVADAGQLARGIED

SEQ ID NO: 141158 - protein, 16 aa, Mycobacterium tuberculosis
DVVADAGQLARGIEDA

SEQ ID NO: 141159 - protein, 16 aa, Mycobacterium tuberculosis
VVADAGQLARGIEDAV

SEQ ID NO: 141160 - protein, 16 aa, Mycobacterium tuberculosis
VADAGQLARGIEDAVA

SEQ ID NO: 141161 - protein, 16 aa, Mycobacterium tuberculosis
ADAGQLARGIEDAVAR

SEQ ID NO: 141162 - protein, 16 aa, Mycobacterium tuberculosis
DAGQLARGIEDAVARL

SEQ ID NO: 141163 - protein, 16 aa, Mycobacterium tuberculosis
AGQLARGIEDAVARLV

SEQ ID NO: 141164 - protein, 16 aa, Mycobacterium tuberculosis
GQLARGIEDAVARLVA

SEQ ID NO: 141165 - protein, 16 aa, Mycobacterium tuberculosis
QLARGIEDAVARLVAI

SEQ ID NO: 141166 - protein, 16 aa, Mycobacterium tuberculosis
LARGIEDAVARLVAIS

SEQ ID NO: 141167 - protein, 16 aa, Mycobacterium tuberculosis
ARGIEDAVARLVAISK

SEQ ID NO: 141168 - protein, 16 aa, Mycobacterium tuberculosis
RGIEDAVARLVAISKR

SEQ ID NO: 141169 - protein, 16 aa, Mycobacterium tuberculosis
GIEDAVARLVAISKRR

SEQ ID NO: 141170 - protein, 16 aa, Mycobacterium tuberculosis
IEDAVARLVAISKRRK

SEQ ID NO: 141171 - protein, 16 aa, Mycobacterium tuberculosis
EDAVARLVAISKRRKV

SEQ ID NO: 141172 - protein, 16 aa, Mycobacterium tuberculosis
DAVARLVAISKRRKVT

SEQ ID NO: 141173 - protein, 16 aa, Mycobacterium tuberculosis
AVARLVAISKRRKVTR

SEQ ID NO: 141174 - protein, 16 aa, Mycobacterium tuberculosis
VARLVAISKRRKVTRR

SEQ ID NO: 141175 - protein, 16 aa, Mycobacterium tuberculosis
ARLVAISKRRKVTRRR

SEQ ID NO: 141176 - protein, 16 aa, Mycobacterium tuberculosis
RLVAISKRRKVTRRRG

SEQ ID NO: 141177 - protein, 16 aa, Mycobacterium tuberculosis
LVAISKRRKVTRRRGA

SEQ ID NO: 141178 - protein, 16 aa, Mycobacterium tuberculosis
VAISKRRKVTRRRGAL

SEQ ID NO: 141179 - protein, 16 aa, Mycobacterium tuberculosis
AISKRRKVTRRRGALS

SEQ ID NO: 141180 - protein, 16 aa, Mycobacterium tuberculosis
ISKRRKVTRRRGALSL

SEQ ID NO: 141181 - protein, 16 aa, Mycobacterium tuberculosis
SKRRKVTRRRGALSLV

SEQ ID NO: 141182 - protein, 16 aa, Mycobacterium tuberculosis
KRRKVTRRRGALSLVV

SEQ ID NO: 141183 - protein, 332 aa, Mycobacterium tuberculosis
MNTHFPDAETVRTVLTLAVRAPSIHNTQPWRWRVCPTSLELFSRPDMQLRSTDPDGRELILSCGVALHHCVVALASLGWQAKVNRFPDPKDRCHLATIGVQPLVPDQADVALAAAIPRRRTDRRAYSCWPVPGGDIALMAARAARGGVMLRQVSALDRMKAIVAQAVLDHVTDEEYLRELTIWSGRYGSVAGVPARNEPPSDPSAPIPGRLFAGPGLSQPSDVLPADDGAAILALGTETDDRLARLRAGEAASIVLLTATAMGLACCPITEPLEIAKTRDAVRAEVFGAGGYPQMLLRVGWAPINADPLPPTPRRELSQVVEWPEELLRQRC

SEQ ID NO: 141184 - protein, 8 aa, Mycobacterium tuberculosis
HFPDAETV

SEQ ID NO: 141185 - protein, 8 aa, Mycobacterium tuberculosis
AETVRTVL

SEQ ID NO: 141186 - protein, 8 aa, Mycobacterium tuberculosis
ETVRTVLT

SEQ ID NO: 141187 - protein, 8 aa, Mycobacterium tuberculosis
TVRTVLTL

SEQ ID NO: 141188 - protein, 8 aa, Mycobacterium tuberculosis
RTVLTLAV

SEQ ID NO: 141189 - protein, 8 aa, Mycobacterium tuberculosis
TVLTLAVR

SEQ ID NO: 141190 - protein, 8 aa, Mycobacterium tuberculosis
VLTLAVRA

SEQ ID NO: 141191 - protein, 8 aa, Mycobacterium tuberculosis
LAVRAPSI

SEQ ID NO: 141192 - protein, 8 aa, Mycobacterium tuberculosis
NTQPWRWR

SEQ ID NO: 141193 - protein, 8 aa, Mycobacterium tuberculosis
TQPWRWRV

SEQ ID NO: 141194 - protein, 8 aa, Mycobacterium tuberculosis
CPTSLELF

SEQ ID NO: 141195 - protein, 8 aa, Mycobacterium tuberculosis
TSLELFSR

SEQ ID NO: 141196 - protein, 8 aa, Mycobacterium tuberculosis
ELFSRPDM

SEQ ID NO: 141197 - protein, 8 aa, Mycobacterium tuberculosis
RSTDPDGR

SEQ ID NO: 141198 - protein, 8 aa, Mycobacterium tuberculosis
ELILSCGV

SEQ ID NO: 141199 - protein, 8 aa, Mycobacterium tuberculosis
ILSCGVAL

SEQ ID NO: 141200 - protein, 8 aa, Mycobacterium tuberculosis
GVALHHCV

SEQ ID NO: 141201 - protein, 8 aa, Mycobacterium tuberculosis
VALHHCVV

SEQ ID NO: 141202 - protein, 8 aa, Mycobacterium tuberculosis
ALHHCVVA

SEQ ID NO: 141203 - protein, 8 aa, Mycobacterium tuberculosis
LHHCVVAL

SEQ ID NO: 141204 - protein, 8 aa, Mycobacterium tuberculosis
CVVALASL

SEQ ID NO: 141205 - protein, 8 aa, Mycobacterium tuberculosis
VALASLGW

SEQ ID NO: 141206 - protein, 8 aa, Mycobacterium tuberculosis
ALASLGWQ

SEQ ID NO: 141207 - protein, 8 aa, Mycobacterium tuberculosis
ASLGWQAK

SEQ ID NO: 141208 - protein, 8 aa, Mycobacterium tuberculosis
SLGWQAKV

SEQ ID NO: 141209 - protein, 8 aa, Mycobacterium tuberculosis
GWQAKVNR

SEQ ID NO: 141210 - protein, 8 aa, Mycobacterium tuberculosis
WQAKVNRF

SEQ ID NO: 141211 - protein, 8 aa, Mycobacterium tuberculosis
VNRFPDPK

SEQ ID NO: 141212 - protein, 8 aa, Mycobacterium tuberculosis
ATIGVQPL

SEQ ID NO: 141213 - protein, 8 aa, Mycobacterium tuberculosis
TIGVQPLV

SEQ ID NO: 141214 - protein, 8 aa, Mycobacterium tuberculosis
LVPDQADV

SEQ ID NO: 141215 - protein, 8 aa, Mycobacterium tuberculosis
VPDQADVA

SEQ ID NO: 141216 - protein, 8 aa, Mycobacterium tuberculosis
DVALAAAI

SEQ ID NO: 141217 - protein, 8 aa, Mycobacterium tuberculosis
ALAAAIPR

SEQ ID NO: 141218 - protein, 8 aa, Mycobacterium tuberculosis
LAAAIPRR

SEQ ID NO: 141219 - protein, 8 aa, Mycobacterium tuberculosis
AAAIPRRR

SEQ ID NO: 141220 - protein, 8 aa, Mycobacterium tuberculosis
IPRRRTDR

SEQ ID NO: 141221 - protein, 8 aa, Mycobacterium tuberculosis
RRTDRRAY

SEQ ID NO: 141222 - protein, 8 aa, Mycobacterium tuberculosis
RAYSCWPV

SEQ ID NO: 141223 - protein, 8 aa, Mycobacterium tuberculosis
WPVPGGDI

SEQ ID NO: 141224 - protein, 8 aa, Mycobacterium tuberculosis
VPGGDIAL

SEQ ID NO: 141225 - protein, 8 aa, Mycobacterium tuberculosis
DIALMAAR

SEQ ID NO: 141226 - protein, 8 aa, Mycobacterium tuberculosis
ALMAARAA

SEQ ID NO: 141227 - protein, 8 aa, Mycobacterium tuberculosis
LMAARAAR

SEQ ID NO: 141228 - protein, 8 aa, Mycobacterium tuberculosis
RAARGGVM

SEQ ID NO: 141229 - protein, 8 aa, Mycobacterium tuberculosis
AARGGVML

SEQ ID NO: 141230 - protein, 8 aa, Mycobacterium tuberculosis
VMLRQVSA

SEQ ID NO: 141231 - protein, 8 aa, Mycobacterium tuberculosis
MLRQVSAL

SEQ ID NO: 141232 - protein, 8 aa, Mycobacterium tuberculosis
RQVSALDR

SEQ ID NO: 141233 - protein, 8 aa, Mycobacterium tuberculosis
QVSALDRM

SEQ ID NO: 141234 - protein, 8 aa, Mycobacterium tuberculosis
VSALDRMK

SEQ ID NO: 141235 - protein, 8 aa, Mycobacterium tuberculosis
ALDRMKAI

SEQ ID NO: 141236 - protein, 8 aa, Mycobacterium tuberculosis
RMKAIVAQ

SEQ ID NO: 141237 - protein, 8 aa, Mycobacterium tuberculosis
MKAIVAQA

SEQ ID NO: 141238 - protein, 8 aa, Mycobacterium tuberculosis
KAIVAQAV

SEQ ID NO: 141239 - protein, 8 aa, Mycobacterium tuberculosis
AIVAQAVL

SEQ ID NO: 141240 - protein, 8 aa, Mycobacterium tuberculosis
AQAVLDHV

SEQ ID NO: 141241 - protein, 8 aa, Mycobacterium tuberculosis
HVTDEEYL

SEQ ID NO: 141242 - protein, 8 aa, Mycobacterium tuberculosis
VTDEEYLR

SEQ ID NO: 141243 - protein, 8 aa, Mycobacterium tuberculosis
DEEYLREL

SEQ ID NO: 141244 - protein, 8 aa, Mycobacterium tuberculosis
EEYLRELT

SEQ ID NO: 141245 - protein, 8 aa, Mycobacterium tuberculosis
EYLRELTI

SEQ ID NO: 141246 - protein, 8 aa, Mycobacterium tuberculosis
ELTIWSGR

SEQ ID NO: 141247 - protein, 8 aa, Mycobacterium tuberculosis
LTIWSGRY

SEQ ID NO: 141248 - protein, 8 aa, Mycobacterium tuberculosis
RYGSVAGV

SEQ ID NO: 141249 - protein, 8 aa, Mycobacterium tuberculosis
SVAGVPAR

SEQ ID NO: 141250 - protein, 8 aa, Mycobacterium tuberculosis
APIPGRLF

SEQ ID NO: 141251 - protein, 8 aa, Mycobacterium tuberculosis
PIPGRLFA

SEQ ID NO: 141252 - protein, 8 aa, Mycobacterium tuberculosis
IPGRLFAG

SEQ ID NO: 141253 - protein, 8 aa, Mycobacterium tuberculosis
RLFAGPGL

SEQ ID NO: 141254 - protein, 8 aa, Mycobacterium tuberculosis
GLSQPSDV

SEQ ID NO: 141255 - protein, 8 aa, Mycobacterium tuberculosis
QPSDVLPA

SEQ ID NO: 141256 - protein, 8 aa, Mycobacterium tuberculosis
VLPADDGA

SEQ ID NO: 141257 - protein, 8 aa, Mycobacterium tuberculosis
LPADDGAA

SEQ ID NO: 141258 - protein, 8 aa, Mycobacterium tuberculosis
PADDGAAI

SEQ ID NO: 141259 - protein, 8 aa, Mycobacterium tuberculosis
DGAAILAL

SEQ ID NO: 141260 - protein, 8 aa, Mycobacterium tuberculosis
ILALGTET

SEQ ID NO: 141261 - protein, 8 aa, Mycobacterium tuberculosis
ETDDRLAR

SEQ ID NO: 141262 - protein, 8 aa, Mycobacterium tuberculosis
RLRAGEAA

SEQ ID NO: 141263 - protein, 8 aa, Mycobacterium tuberculosis
RAGEAASI

SEQ ID NO: 141264 - protein, 8 aa, Mycobacterium tuberculosis
GEAASIVL

SEQ ID NO: 141265 - protein, 8 aa, Mycobacterium tuberculosis
EAASIVLL

SEQ ID NO: 141266 - protein, 8 aa, Mycobacterium tuberculosis
IVLLTATA

SEQ ID NO: 141267 - protein, 8 aa, Mycobacterium tuberculosis
VLLTATAM

SEQ ID NO: 141268 - protein, 8 aa, Mycobacterium tuberculosis
LTATAMGL

SEQ ID NO: 141269 - protein, 8 aa, Mycobacterium tuberculosis
MGLACCPI

SEQ ID NO: 141270 - protein, 8 aa, Mycobacterium tuberculosis
GLACCPIT

SEQ ID NO: 141271 - protein, 8 aa, Mycobacterium tuberculosis
PITEPLEI

SEQ ID NO: 141272 - protein, 8 aa, Mycobacterium tuberculosis
KTRDAVRA

SEQ ID NO: 141273 - protein, 8 aa, Mycobacterium tuberculosis
DAVRAEVF

SEQ ID NO: 141274 - protein, 8 aa, Mycobacterium tuberculosis
AEVFGAGG

SEQ ID NO: 141275 - protein, 8 aa, Mycobacterium tuberculosis
EVFGAGGY

SEQ ID NO: 141276 - protein, 8 aa, Mycobacterium tuberculosis
YPQMLLRV

SEQ ID NO: 141277 - protein, 8 aa, Mycobacterium tuberculosis
MLLRVGWA

SEQ ID NO: 141278 - protein, 8 aa, Mycobacterium tuberculosis
LRVGWAPI

SEQ ID NO: 141279 - protein, 8 aa, Mycobacterium tuberculosis
APINADPL

SEQ ID NO: 141280 - protein, 8 aa, Mycobacterium tuberculosis
DPLPPTPR

SEQ ID NO: 141281 - protein, 8 aa, Mycobacterium tuberculosis
PPTPRREL

SEQ ID NO: 141282 - protein, 8 aa, Mycobacterium tuberculosis
TPRRELSQ

SEQ ID NO: 141283 - protein, 8 aa, Mycobacterium tuberculosis
SQVVEWPE

SEQ ID NO: 141284 - protein, 8 aa, Mycobacterium tuberculosis
VEWPEELL

SEQ ID NO: 141285 - protein, 9 aa, Mycobacterium tuberculosis
NTHFPDAET

SEQ ID NO: 141286 - protein, 9 aa, Mycobacterium tuberculosis
HFPDAETVR

SEQ ID NO: 141287 - protein, 9 aa, Mycobacterium tuberculosis
FPDAETVRT

SEQ ID NO: 141288 - protein, 9 aa, Mycobacterium tuberculosis
AETVRTVLT

SEQ ID NO: 141289 - protein, 9 aa, Mycobacterium tuberculosis
ETVRTVLTL

SEQ ID NO: 141290 - protein, 9 aa, Mycobacterium tuberculosis
TVRTVLTLA

SEQ ID NO: 141291 - protein, 9 aa, Mycobacterium tuberculosis
RTVLTLAVR

SEQ ID NO: 141292 - protein, 9 aa, Mycobacterium tuberculosis
TLAVRAPSI

SEQ ID NO: 141293 - protein, 9 aa, Mycobacterium tuberculosis
AVRAPSIHN

SEQ ID NO: 141294 - protein, 9 aa, Mycobacterium tuberculosis
SIHNTQPWR

SEQ ID NO: 141295 - protein, 9 aa, Mycobacterium tuberculosis
IHNTQPWRW

SEQ ID NO: 141296 - protein, 9 aa, Mycobacterium tuberculosis
NTQPWRWRV

SEQ ID NO: 141297 - protein, 9 aa, Mycobacterium tuberculosis
RWRVCPTSL

SEQ ID NO: 141298 - protein, 9 aa, Mycobacterium tuberculosis
RVCPTSLEL

SEQ ID NO: 141299 - protein, 9 aa, Mycobacterium tuberculosis
PTSLELFSR

SEQ ID NO: 141300 - protein, 9 aa, Mycobacterium tuberculosis
LFSRPDMQL

SEQ ID NO: 141301 - protein, 9 aa, Mycobacterium tuberculosis
FSRPDMQLR

SEQ ID NO: 141302 - protein, 9 aa, Mycobacterium tuberculosis
RPDMQLRST

SEQ ID NO: 141303 - protein, 9 aa, Mycobacterium tuberculosis
STDPDGREL

SEQ ID NO: 141304 - protein, 9 aa, Mycobacterium tuberculosis
RELILSCGV

SEQ ID NO: 141305 - protein, 9 aa, Mycobacterium tuberculosis
LILSCGVAL

SEQ ID NO: 141306 - protein, 9 aa, Mycobacterium tuberculosis
CGVALHHCV

SEQ ID NO: 141307 - protein, 9 aa, Mycobacterium tuberculosis
GVALHHCVV

SEQ ID NO: 141308 - protein, 9 aa, Mycobacterium tuberculosis
ALHHCVVAL

SEQ ID NO: 141309 - protein, 9 aa, Mycobacterium tuberculosis
HCVVALASL

SEQ ID NO: 141310 - protein, 9 aa, Mycobacterium tuberculosis
VVALASLGW

SEQ ID NO: 141311 - protein, 9 aa, Mycobacterium tuberculosis
ALASLGWQA

SEQ ID NO: 141312 - protein, 9 aa, Mycobacterium tuberculosis
LASLGWQAK

SEQ ID NO: 141313 - protein, 9 aa, Mycobacterium tuberculosis
ASLGWQAKV

SEQ ID NO: 141314 - protein, 9 aa, Mycobacterium tuberculosis
LGWQAKVNR

SEQ ID NO: 141315 - protein, 9 aa, Mycobacterium tuberculosis
GWQAKVNRF

SEQ ID NO: 141316 - protein, 9 aa, Mycobacterium tuberculosis
KVNRFPDPK

SEQ ID NO: 141317 - protein, 9 aa, Mycobacterium tuberculosis
RCHLATIGV

SEQ ID NO: 141318 - protein, 9 aa, Mycobacterium tuberculosis
LATIGVQPL

SEQ ID NO: 141319 - protein, 9 aa, Mycobacterium tuberculosis
ATIGVQPLV

SEQ ID NO: 141320 - protein, 9 aa, Mycobacterium tuberculosis
PLVPDQADV

SEQ ID NO: 141321 - protein, 9 aa, Mycobacterium tuberculosis
VPDQADVAL

SEQ ID NO: 141322 - protein, 9 aa, Mycobacterium tuberculosis
VALAAAIPR

SEQ ID NO: 141323 - protein, 9 aa, Mycobacterium tuberculosis
ALAAAIPRR

SEQ ID NO: 141324 - protein, 9 aa, Mycobacterium tuberculosis
LAAAIPRRR

SEQ ID NO: 141325 - protein, 9 aa, Mycobacterium tuberculosis
AIPRRRTDR

SEQ ID NO: 141326 - protein, 9 aa, Mycobacterium tuberculosis
RRRTDRRAY

SEQ ID NO: 141327 - protein, 9 aa, Mycobacterium tuberculosis
RRTDRRAYS

SEQ ID NO: 141328 - protein, 9 aa, Mycobacterium tuberculosis
RRAYSCWPV

SEQ ID NO: 141329 - protein, 9 aa, Mycobacterium tuberculosis
WPVPGGDIA

SEQ ID NO: 141330 - protein, 9 aa, Mycobacterium tuberculosis
PVPGGDIAL

SEQ ID NO: 141331 - protein, 9 aa, Mycobacterium tuberculosis
VPGGDIALM

SEQ ID NO: 141332 - protein, 9 aa, Mycobacterium tuberculosis
DIALMAARA

SEQ ID NO: 141333 - protein, 9 aa, Mycobacterium tuberculosis
ALMAARAAR

SEQ ID NO: 141334 - protein, 9 aa, Mycobacterium tuberculosis
AARAARGGV

SEQ ID NO: 141335 - protein, 9 aa, Mycobacterium tuberculosis
RAARGGVML

SEQ ID NO: 141336 - protein, 9 aa, Mycobacterium tuberculosis
AARGGVMLR

SEQ ID NO: 141337 - protein, 9 aa, Mycobacterium tuberculosis
GVMLRQVSA

SEQ ID NO: 141338 - protein, 9 aa, Mycobacterium tuberculosis
VMLRQVSAL

SEQ ID NO: 141339 - protein, 9 aa, Mycobacterium tuberculosis
RQVSALDRM

SEQ ID NO: 141340 - protein, 9 aa, Mycobacterium tuberculosis
QVSALDRMK

SEQ ID NO: 141341 - protein, 9 aa, Mycobacterium tuberculosis
SALDRMKAI

SEQ ID NO: 141342 - protein, 9 aa, Mycobacterium tuberculosis
ALDRMKAIV

SEQ ID NO: 141343 - protein, 9 aa, Mycobacterium tuberculosis
RMKAIVAQA

SEQ ID NO: 141344 - protein, 9 aa, Mycobacterium tuberculosis
MKAIVAQAV

SEQ ID NO: 141345 - protein, 9 aa, Mycobacterium tuberculosis
KAIVAQAVL

SEQ ID NO: 141346 - protein, 9 aa, Mycobacterium tuberculosis
VAQAVLDHV

SEQ ID NO: 141347 - protein, 9 aa, Mycobacterium tuberculosis
HVTDEEYLR

SEQ ID NO: 141348 - protein, 9 aa, Mycobacterium tuberculosis
EEYLRELTI

SEQ ID NO: 141349 - protein, 9 aa, Mycobacterium tuberculosis
EYLRELTIW

SEQ ID NO: 141350 - protein, 9 aa, Mycobacterium tuberculosis
YLRELTIWS

SEQ ID NO: 141351 - protein, 9 aa, Mycobacterium tuberculosis
RELTIWSGR

SEQ ID NO: 141352 - protein, 9 aa, Mycobacterium tuberculosis
ELTIWSGRY

SEQ ID NO: 141353 - protein, 9 aa, Mycobacterium tuberculosis
TIWSGRYGS

SEQ ID NO: 141354 - protein, 9 aa, Mycobacterium tuberculosis
GRYGSVAGV

SEQ ID NO: 141355 - protein, 9 aa, Mycobacterium tuberculosis
GSVAGVPAR

SEQ ID NO: 141356 - protein, 9 aa, Mycobacterium tuberculosis
PPSDPSAPI

SEQ ID NO: 141357 - protein, 9 aa, Mycobacterium tuberculosis
DPSAPIPGR

SEQ ID NO: 141358 - protein, 9 aa, Mycobacterium tuberculosis
APIPGRLFA

SEQ ID NO: 141359 - protein, 9 aa, Mycobacterium tuberculosis
IPGRLFAGP

SEQ ID NO: 141360 - protein, 9 aa, Mycobacterium tuberculosis
GRLFAGPGL

SEQ ID NO: 141361 - protein, 9 aa, Mycobacterium tuberculosis
RLFAGPGLS

SEQ ID NO: 141362 - protein, 9 aa, Mycobacterium tuberculosis
GLSQPSDVL

SEQ ID NO: 141363 - protein, 9 aa, Mycobacterium tuberculosis
SQPSDVLPA

SEQ ID NO: 141364 - protein, 9 aa, Mycobacterium tuberculosis
VLPADDGAA

SEQ ID NO: 141365 - protein, 9 aa, Mycobacterium tuberculosis
LPADDGAAI

SEQ ID NO: 141366 - protein, 9 aa, Mycobacterium tuberculosis
PADDGAAIL

SEQ ID NO: 141367 - protein, 9 aa, Mycobacterium tuberculosis
ETDDRLARL

SEQ ID NO: 141368 - protein, 9 aa, Mycobacterium tuberculosis
RLRAGEAAS

SEQ ID NO: 141369 - protein, 9 aa, Mycobacterium tuberculosis
RAGEAASIV

SEQ ID NO: 141370 - protein, 9 aa, Mycobacterium tuberculosis
GEAASIVLL

SEQ ID NO: 141371 - protein, 9 aa, Mycobacterium tuberculosis
EAASIVLLT

SEQ ID NO: 141372 - protein, 9 aa, Mycobacterium tuberculosis
SIVLLTATA

SEQ ID NO: 141373 - protein, 9 aa, Mycobacterium tuberculosis
IVLLTATAM

SEQ ID NO: 141374 - protein, 9 aa, Mycobacterium tuberculosis
LLTATAMGL

SEQ ID NO: 141375 - protein, 9 aa, Mycobacterium tuberculosis
LTATAMGLA

SEQ ID NO: 141376 - protein, 9 aa, Mycobacterium tuberculosis
AMGLACCPI

SEQ ID NO: 141377 - protein, 9 aa, Mycobacterium tuberculosis
ACCPITEPL

SEQ ID NO: 141378 - protein, 9 aa, Mycobacterium tuberculosis
CPITEPLEI

SEQ ID NO: 141379 - protein, 9 aa, Mycobacterium tuberculosis
ITEPLEIAK

SEQ ID NO: 141380 - protein, 9 aa, Mycobacterium tuberculosis
EPLEIAKTR

SEQ ID NO: 141381 - protein, 9 aa, Mycobacterium tuberculosis
EIAKTRDAV

SEQ ID NO: 141382 - protein, 9 aa, Mycobacterium tuberculosis
IAKTRDAVR

SEQ ID NO: 141383 - protein, 9 aa, Mycobacterium tuberculosis
KTRDAVRAE

SEQ ID NO: 141384 - protein, 9 aa, Mycobacterium tuberculosis
TRDAVRAEV

SEQ ID NO: 141385 - protein, 9 aa, Mycobacterium tuberculosis
AVRAEVFGA

SEQ ID NO: 141386 - protein, 9 aa, Mycobacterium tuberculosis
AEVFGAGGY

SEQ ID NO: 141387 - protein, 9 aa, Mycobacterium tuberculosis
GAGGYPQML

SEQ ID NO: 141388 - protein, 9 aa, Mycobacterium tuberculosis
GYPQMLLRV

SEQ ID NO: 141389 - protein, 9 aa, Mycobacterium tuberculosis
YPQMLLRVG

SEQ ID NO: 141390 - protein, 9 aa, Mycobacterium tuberculosis
QMLLRVGWA

SEQ ID NO: 141391 - protein, 9 aa, Mycobacterium tuberculosis
MLLRVGWAP

SEQ ID NO: 141392 - protein, 9 aa, Mycobacterium tuberculosis
LLRVGWAPI

SEQ ID NO: 141393 - protein, 9 aa, Mycobacterium tuberculosis
RVGWAPINA

SEQ ID NO: 141394 - protein, 9 aa, Mycobacterium tuberculosis
WAPINADPL

SEQ ID NO: 141395 - protein, 9 aa, Mycobacterium tuberculosis
LPPTPRREL

SEQ ID NO: 141396 - protein, 9 aa, Mycobacterium tuberculosis
TPRRELSQV

SEQ ID NO: 141397 - protein, 9 aa, Mycobacterium tuberculosis
RELSQVVEW

SEQ ID NO: 141398 - protein, 9 aa, Mycobacterium tuberculosis
SQVVEWPEE

SEQ ID NO: 141399 - protein, 9 aa, Mycobacterium tuberculosis
QVVEWPEEL

SEQ ID NO: 141400 - protein, 10 aa, Mycobacterium tuberculosis
NTHFPDAETV

SEQ ID NO: 141401 - protein, 10 aa, Mycobacterium tuberculosis
THFPDAETVR

SEQ ID NO: 141402 - protein, 10 aa, Mycobacterium tuberculosis
FPDAETVRTV

SEQ ID NO: 141403 - protein, 10 aa, Mycobacterium tuberculosis
AETVRTVLTL

SEQ ID NO: 141404 - protein, 10 aa, Mycobacterium tuberculosis
ETVRTVLTLA

SEQ ID NO: 141405 - protein, 10 aa, Mycobacterium tuberculosis
TVRTVLTLAV

SEQ ID NO: 141406 - protein, 10 aa, Mycobacterium tuberculosis
VRTVLTLAVR

SEQ ID NO: 141407 - protein, 10 aa, Mycobacterium tuberculosis
LTLAVRAPSI

SEQ ID NO: 141408 - protein, 10 aa, Mycobacterium tuberculosis
APSIHNTQPW

SEQ ID NO: 141409 - protein, 10 aa, Mycobacterium tuberculosis
SIHNTQPWRW

SEQ ID NO: 141410 - protein, 10 aa, Mycobacterium tuberculosis
QPWRWRVCPT

SEQ ID NO: 141411 - protein, 10 aa, Mycobacterium tuberculosis
WRWRVCPTSL

SEQ ID NO: 141412 - protein, 10 aa, Mycobacterium tuberculosis
RVCPTSLELF

SEQ ID NO: 141413 - protein, 10 aa, Mycobacterium tuberculosis
CPTSLELFSR

SEQ ID NO: 141414 - protein, 10 aa, Mycobacterium tuberculosis
ELFSRPDMQL

SEQ ID NO: 141415 - protein, 10 aa, Mycobacterium tuberculosis
LFSRPDMQLR

SEQ ID NO: 141416 - protein, 10 aa, Mycobacterium tuberculosis
STDPDGRELI

SEQ ID NO: 141417 - protein, 10 aa, Mycobacterium tuberculosis
RELILSCGVA

SEQ ID NO: 141418 - protein, 10 aa, Mycobacterium tuberculosis
ELILSCGVAL

SEQ ID NO: 141419 - protein, 10 aa, Mycobacterium tuberculosis
SCGVALHHCV

SEQ ID NO: 141420 - protein, 10 aa, Mycobacterium tuberculosis
CGVALHHCVV

SEQ ID NO: 141421 - protein, 10 aa, Mycobacterium tuberculosis
ALHHCVVALA

SEQ ID NO: 141422 - protein, 10 aa, Mycobacterium tuberculosis
HHCVVALASL

SEQ ID NO: 141423 - protein, 10 aa, Mycobacterium tuberculosis
CVVALASLGW

SEQ ID NO: 141424 - protein, 10 aa, Mycobacterium tuberculosis
ALASLGWQAK

SEQ ID NO: 141425 - protein, 10 aa, Mycobacterium tuberculosis
LASLGWQAKV

SEQ ID NO: 141426 - protein, 10 aa, Mycobacterium tuberculosis
SLGWQAKVNR

SEQ ID NO: 141427 - protein, 10 aa, Mycobacterium tuberculosis
FPDPKDRCHL

SEQ ID NO: 141428 - protein, 10 aa, Mycobacterium tuberculosis
HLATIGVQPL

SEQ ID NO: 141429 - protein, 10 aa, Mycobacterium tuberculosis
LATIGVQPLV

SEQ ID NO: 141430 - protein, 10 aa, Mycobacterium tuberculosis
PLVPDQADVA

SEQ ID NO: 141431 - protein, 10 aa, Mycobacterium tuberculosis
LVPDQADVAL

SEQ ID NO: 141432 - protein, 10 aa, Mycobacterium tuberculosis
VPDQADVALA

SEQ ID NO: 141433 - protein, 10 aa, Mycobacterium tuberculosis
QADVALAAAI

SEQ ID NO: 141434 - protein, 10 aa, Mycobacterium tuberculosis
DVALAAAIPR

SEQ ID NO: 141435 - protein, 10 aa, Mycobacterium tuberculosis
VALAAAIPRR

SEQ ID NO: 141436 - protein, 10 aa, Mycobacterium tuberculosis
ALAAAIPRRR

SEQ ID NO: 141437 - protein, 10 aa, Mycobacterium tuberculosis
AAIPRRRTDR

SEQ ID NO: 141438 - protein, 10 aa, Mycobacterium tuberculosis
AIPRRRTDRR

SEQ ID NO: 141439 - protein, 10 aa, Mycobacterium tuberculosis
IPRRRTDRRA

SEQ ID NO: 141440 - protein, 10 aa, Mycobacterium tuberculosis
RRTDRRAYSC

SEQ ID NO: 141441 - protein, 10 aa, Mycobacterium tuberculosis
RTDRRAYSCW

SEQ ID NO: 141442 - protein, 10 aa, Mycobacterium tuberculosis
WPVPGGDIAL

SEQ ID NO: 141443 - protein, 10 aa, Mycobacterium tuberculosis
PVPGGDIALM

SEQ ID NO: 141444 - protein, 10 aa, Mycobacterium tuberculosis
VPGGDIALMA

SEQ ID NO: 141445 - protein, 10 aa, Mycobacterium tuberculosis
IALMAARAAR

SEQ ID NO: 141446 - protein, 10 aa, Mycobacterium tuberculosis
MAARAARGGV

SEQ ID NO: 141447 - protein, 10 aa, Mycobacterium tuberculosis
AARAARGGVM

SEQ ID NO: 141448 - protein, 10 aa, Mycobacterium tuberculosis
RAARGGVMLR

SEQ ID NO: 141449 - protein, 10 aa, Mycobacterium tuberculosis
GVMLRQVSAL

SEQ ID NO: 141450 - protein, 10 aa, Mycobacterium tuberculosis
MLRQVSALDR

SEQ ID NO: 141451 - protein, 10 aa, Mycobacterium tuberculosis
RQVSALDRMK

SEQ ID NO: 141452 - protein, 10 aa, Mycobacterium tuberculosis
QVSALDRMKA

SEQ ID NO: 141453 - protein, 10 aa, Mycobacterium tuberculosis
SALDRMKAIV

SEQ ID NO: 141454 - protein, 10 aa, Mycobacterium tuberculosis
ALDRMKAIVA

SEQ ID NO: 141455 - protein, 10 aa, Mycobacterium tuberculosis
RMKAIVAQAV

SEQ ID NO: 141456 - protein, 10 aa, Mycobacterium tuberculosis
MKAIVAQAVL

SEQ ID NO: 141457 - protein, 10 aa, Mycobacterium tuberculosis
IVAQAVLDHV

SEQ ID NO: 141458 - protein, 10 aa, Mycobacterium tuberculosis
VLDHVTDEEY

SEQ ID NO: 141459 - protein, 10 aa, Mycobacterium tuberculosis
VTDEEYLREL

SEQ ID NO: 141460 - protein, 10 aa, Mycobacterium tuberculosis
EEYLRELTIW

SEQ ID NO: 141461 - protein, 10 aa, Mycobacterium tuberculosis
YLRELTIWSG

SEQ ID NO: 141462 - protein, 10 aa, Mycobacterium tuberculosis
RELTIWSGRY

SEQ ID NO: 141463 - protein, 10 aa, Mycobacterium tuberculosis
TIWSGRYGSV

SEQ ID NO: 141464 - protein, 10 aa, Mycobacterium tuberculosis
EPPSDPSAPI

SEQ ID NO: 141465 - protein, 10 aa, Mycobacterium tuberculosis
APIPGRLFAG

SEQ ID NO: 141466 - protein, 10 aa, Mycobacterium tuberculosis
IPGRLFAGPG

SEQ ID NO: 141467 - protein, 10 aa, Mycobacterium tuberculosis
RLFAGPGLSQ

SEQ ID NO: 141468 - protein, 10 aa, Mycobacterium tuberculosis
VLPADDGAAI

SEQ ID NO: 141469 - protein, 10 aa, Mycobacterium tuberculosis
LPADDGAAIL

SEQ ID NO: 141470 - protein, 10 aa, Mycobacterium tuberculosis
PADDGAAILA

SEQ ID NO: 141471 - protein, 10 aa, Mycobacterium tuberculosis
ALGTETDDRL

SEQ ID NO: 141472 - protein, 10 aa, Mycobacterium tuberculosis
ETDDRLARLR

SEQ ID NO: 141473 - protein, 10 aa, Mycobacterium tuberculosis
RLARLRAGEA

SEQ ID NO: 141474 - protein, 10 aa, Mycobacterium tuberculosis
RLRAGEAASI

SEQ ID NO: 141475 - protein, 10 aa, Mycobacterium tuberculosis
RAGEAASIVL

SEQ ID NO: 141476 - protein, 10 aa, Mycobacterium tuberculosis
EAASIVLLTA

SEQ ID NO: 141477 - protein, 10 aa, Mycobacterium tuberculosis
SIVLLTATAM

SEQ ID NO: 141478 - protein, 10 aa, Mycobacterium tuberculosis
VLLTATAMGL

SEQ ID NO: 141479 - protein, 10 aa, Mycobacterium tuberculosis
LLTATAMGLA

SEQ ID NO: 141480 - protein, 10 aa, Mycobacterium tuberculosis
TAMGLACCPI

SEQ ID NO: 141481 - protein, 10 aa, Mycobacterium tuberculosis
LACCPITEPL

SEQ ID NO: 141482 - protein, 10 aa, Mycobacterium tuberculosis
CPITEPLEIA

SEQ ID NO: 141483 - protein, 10 aa, Mycobacterium tuberculosis
EIAKTRDAVR

SEQ ID NO: 141484 - protein, 10 aa, Mycobacterium tuberculosis
KTRDAVRAEV

SEQ ID NO: 141485 - protein, 10 aa, Mycobacterium tuberculosis
RAEVFGAGGY

SEQ ID NO: 141486 - protein, 10 aa, Mycobacterium tuberculosis
EVFGAGGYPQ

SEQ ID NO: 141487 - protein, 10 aa, Mycobacterium tuberculosis
FGAGGYPQML

SEQ ID NO: 141488 - protein, 10 aa, Mycobacterium tuberculosis
GAGGYPQMLL

SEQ ID NO: 141489 - protein, 10 aa, Mycobacterium tuberculosis
GGYPQMLLRV

SEQ ID NO: 141490 - protein, 10 aa, Mycobacterium tuberculosis
YPQMLLRVGW

SEQ ID NO: 141491 - protein, 10 aa, Mycobacterium tuberculosis
MLLRVGWAPI

SEQ ID NO: 141492 - protein, 10 aa, Mycobacterium tuberculosis
PLPPTPRREL

SEQ ID NO: 141493 - protein, 10 aa, Mycobacterium tuberculosis
PTPRRELSQV

SEQ ID NO: 141494 - protein, 10 aa, Mycobacterium tuberculosis
TPRRELSQVV

SEQ ID NO: 141495 - protein, 10 aa, Mycobacterium tuberculosis
SQVVEWPEEL

SEQ ID NO: 141496 - protein, 10 aa, Mycobacterium tuberculosis
QVVEWPEELL

SEQ ID NO: 141497 - protein, 10 aa, Mycobacterium tuberculosis
VVEWPEELLR

SEQ ID NO: 141498 - protein, 11 aa, Mycobacterium tuberculosis
NTHFPDAETVR

SEQ ID NO: 141499 - protein, 11 aa, Mycobacterium tuberculosis
HFPDAETVRTV

SEQ ID NO: 141500 - protein, 11 aa, Mycobacterium tuberculosis
FPDAETVRTVL

SEQ ID NO: 141501 - protein, 11 aa, Mycobacterium tuberculosis
AETVRTVLTLA

SEQ ID NO: 141502 - protein, 11 aa, Mycobacterium tuberculosis
ETVRTVLTLAV

SEQ ID NO: 141503 - protein, 11 aa, Mycobacterium tuberculosis
TVRTVLTLAVR

SEQ ID NO: 141504 - protein, 11 aa, Mycobacterium tuberculosis
VLTLAVRAPSI

SEQ ID NO: 141505 - protein, 11 aa, Mycobacterium tuberculosis
AVRAPSIHNTQ

SEQ ID NO: 141506 - protein, 11 aa, Mycobacterium tuberculosis
RAPSIHNTQPW

SEQ ID NO: 141507 - protein, 11 aa, Mycobacterium tuberculosis
PSIHNTQPWRW

SEQ ID NO: 141508 - protein, 11 aa, Mycobacterium tuberculosis
SIHNTQPWRWR

SEQ ID NO: 141509 - protein, 11 aa, Mycobacterium tuberculosis
TQPWRWRVCPT

SEQ ID NO: 141510 - protein, 11 aa, Mycobacterium tuberculosis
RWRVCPTSLEL

SEQ ID NO: 141511 - protein, 11 aa, Mycobacterium tuberculosis
LELFSRPDMQL

SEQ ID NO: 141512 - protein, 11 aa, Mycobacterium tuberculosis
ELFSRPDMQLR

SEQ ID NO: 141513 - protein, 11 aa, Mycobacterium tuberculosis
MQLRSTDPDGR

SEQ ID NO: 141514 - protein, 11 aa, Mycobacterium tuberculosis
STDPDGRELIL

SEQ ID NO: 141515 - protein, 11 aa, Mycobacterium tuberculosis
RELILSCGVAL

SEQ ID NO: 141516 - protein, 11 aa, Mycobacterium tuberculosis
ILSCGVALHHC

SEQ ID NO: 141517 - protein, 11 aa, Mycobacterium tuberculosis
GVALHHCVVAL

SEQ ID NO: 141518 - protein, 11 aa, Mycobacterium tuberculosis
HCVVALASLGW

SEQ ID NO: 141519 - protein, 11 aa, Mycobacterium tuberculosis
VVALASLGWQA

SEQ ID NO: 141520 - protein, 11 aa, Mycobacterium tuberculosis
VALASLGWQAK

SEQ ID NO: 141521 - protein, 11 aa, Mycobacterium tuberculosis
ALASLGWQAKV

SEQ ID NO: 141522 - protein, 11 aa, Mycobacterium tuberculosis
ASLGWQAKVNR

SEQ ID NO: 141523 - protein, 11 aa, Mycobacterium tuberculosis
QAKVNRFPDPK

SEQ ID NO: 141524 - protein, 11 aa, Mycobacterium tuberculosis
KVNRFPDPKDR

SEQ ID NO: 141525 - protein, 11 aa, Mycobacterium tuberculosis
RFPDPKDRCHL

SEQ ID NO: 141526 - protein, 11 aa, Mycobacterium tuberculosis
FPDPKDRCHLA

SEQ ID NO: 141527 - protein, 11 aa, Mycobacterium tuberculosis
DPKDRCHLATI

SEQ ID NO: 141528 - protein, 11 aa, Mycobacterium tuberculosis
HLATIGVQPLV

SEQ ID NO: 141529 - protein, 11 aa, Mycobacterium tuberculosis
PLVPDQADVAL

SEQ ID NO: 141530 - protein, 11 aa, Mycobacterium tuberculosis
LVPDQADVALA

SEQ ID NO: 141531 - protein, 11 aa, Mycobacterium tuberculosis
VPDQADVALAA

SEQ ID NO: 141532 - protein, 11 aa, Mycobacterium tuberculosis
DVALAAAIPRR

SEQ ID NO: 141533 - protein, 11 aa, Mycobacterium tuberculosis
VALAAAIPRRR

SEQ ID NO: 141534 - protein, 11 aa, Mycobacterium tuberculosis
ALAAAIPRRRT

SEQ ID NO: 141535 - protein, 11 aa, Mycobacterium tuberculosis
AAAIPRRRTDR

SEQ ID NO: 141536 - protein, 11 aa, Mycobacterium tuberculosis
AAIPRRRTDRR

SEQ ID NO: 141537 - protein, 11 aa, Mycobacterium tuberculosis
IPRRRTDRRAY

SEQ ID NO: 141538 - protein, 11 aa, Mycobacterium tuberculosis
RRTDRRAYSCW

SEQ ID NO: 141539 - protein, 11 aa, Mycobacterium tuberculosis
WPVPGGDIALM

SEQ ID NO: 141540 - protein, 11 aa, Mycobacterium tuberculosis
PVPGGDIALMA

SEQ ID NO: 141541 - protein, 11 aa, Mycobacterium tuberculosis
VPGGDIALMAA

SEQ ID NO: 141542 - protein, 11 aa, Mycobacterium tuberculosis
DIALMAARAAR

SEQ ID NO: 141543 - protein, 11 aa, Mycobacterium tuberculosis
LMAARAARGGV

SEQ ID NO: 141544 - protein, 11 aa, Mycobacterium tuberculosis
MAARAARGGVM

SEQ ID NO: 141545 - protein, 11 aa, Mycobacterium tuberculosis
AARAARGGVML

SEQ ID NO: 141546 - protein, 11 aa, Mycobacterium tuberculosis
AARGGVMLRQV

SEQ ID NO: 141547 - protein, 11 aa, Mycobacterium tuberculosis
VMLRQVSALDR

SEQ ID NO: 141548 - protein, 11 aa, Mycobacterium tuberculosis
MLRQVSALDRM

SEQ ID NO: 141549 - protein, 11 aa, Mycobacterium tuberculosis
RQVSALDRMKA

SEQ ID NO: 141550 - protein, 11 aa, Mycobacterium tuberculosis
QVSALDRMKAI

SEQ ID NO: 141551 - protein, 11 aa, Mycobacterium tuberculosis
ALDRMKAIVAQ

SEQ ID NO: 141552 - protein, 11 aa, Mycobacterium tuberculosis
DRMKAIVAQAV

SEQ ID NO: 141553 - protein, 11 aa, Mycobacterium tuberculosis
RMKAIVAQAVL

SEQ ID NO: 141554 - protein, 11 aa, Mycobacterium tuberculosis
AIVAQAVLDHV

SEQ ID NO: 141555 - protein, 11 aa, Mycobacterium tuberculosis
AVLDHVTDEEY

SEQ ID NO: 141556 - protein, 11 aa, Mycobacterium tuberculosis
VLDHVTDEEYL

SEQ ID NO: 141557 - protein, 11 aa, Mycobacterium tuberculosis
HVTDEEYLREL

SEQ ID NO: 141558 - protein, 11 aa, Mycobacterium tuberculosis
EEYLRELTIWS

SEQ ID NO: 141559 - protein, 11 aa, Mycobacterium tuberculosis
YLRELTIWSGR

SEQ ID NO: 141560 - protein, 11 aa, Mycobacterium tuberculosis
LTIWSGRYGSV

SEQ ID NO: 141561 - protein, 11 aa, Mycobacterium tuberculosis
TIWSGRYGSVA

SEQ ID NO: 141562 - protein, 11 aa, Mycobacterium tuberculosis
GRYGSVAGVPA

SEQ ID NO: 141563 - protein, 11 aa, Mycobacterium tuberculosis
RYGSVAGVPAR

SEQ ID NO: 141564 - protein, 11 aa, Mycobacterium tuberculosis
DPSAPIPGRLF

SEQ ID NO: 141565 - protein, 11 aa, Mycobacterium tuberculosis
IPGRLFAGPGL

SEQ ID NO: 141566 - protein, 11 aa, Mycobacterium tuberculosis
RLFAGPGLSQP

SEQ ID NO: 141567 - protein, 11 aa, Mycobacterium tuberculosis
GPGLSQPSDVL

SEQ ID NO: 141568 - protein, 11 aa, Mycobacterium tuberculosis
GLSQPSDVLPA

SEQ ID NO: 141569 - protein, 11 aa, Mycobacterium tuberculosis
DVLPADDGAAI

SEQ ID NO: 141570 - protein, 11 aa, Mycobacterium tuberculosis
VLPADDGAAIL

SEQ ID NO: 141571 - protein, 11 aa, Mycobacterium tuberculosis
LPADDGAAILA

SEQ ID NO: 141572 - protein, 11 aa, Mycobacterium tuberculosis
PADDGAAILAL

SEQ ID NO: 141573 - protein, 11 aa, Mycobacterium tuberculosis
ILALGTETDDR

SEQ ID NO: 141574 - protein, 11 aa, Mycobacterium tuberculosis
ETDDRLARLRA

SEQ ID NO: 141575 - protein, 11 aa, Mycobacterium tuberculosis
RLARLRAGEAA

SEQ ID NO: 141576 - protein, 11 aa, Mycobacterium tuberculosis
RLRAGEAASIV

SEQ ID NO: 141577 - protein, 11 aa, Mycobacterium tuberculosis
LRAGEAASIVL

SEQ ID NO: 141578 - protein, 11 aa, Mycobacterium tuberculosis
RAGEAASIVLL

SEQ ID NO: 141579 - protein, 11 aa, Mycobacterium tuberculosis
EAASIVLLTAT

SEQ ID NO: 141580 - protein, 11 aa, Mycobacterium tuberculosis
AASIVLLTATA

SEQ ID NO: 141581 - protein, 11 aa, Mycobacterium tuberculosis
IVLLTATAMGL

SEQ ID NO: 141582 - protein, 11 aa, Mycobacterium tuberculosis
VLLTATAMGLA

SEQ ID NO: 141583 - protein, 11 aa, Mycobacterium tuberculosis
LLTATAMGLAC

SEQ ID NO: 141584 - protein, 11 aa, Mycobacterium tuberculosis
ATAMGLACCPI

SEQ ID NO: 141585 - protein, 11 aa, Mycobacterium tuberculosis
GLACCPITEPL

SEQ ID NO: 141586 - protein, 11 aa, Mycobacterium tuberculosis
ITEPLEIAKTR

SEQ ID NO: 141587 - protein, 11 aa, Mycobacterium tuberculosis
EPLEIAKTRDA

SEQ ID NO: 141588 - protein, 11 aa, Mycobacterium tuberculosis
PLEIAKTRDAV

SEQ ID NO: 141589 - protein, 11 aa, Mycobacterium tuberculosis
EIAKTRDAVRA

SEQ ID NO: 141590 - protein, 11 aa, Mycobacterium tuberculosis
KTRDAVRAEVF

SEQ ID NO: 141591 - protein, 11 aa, Mycobacterium tuberculosis
AEVFGAGGYPQ

SEQ ID NO: 141592 - protein, 11 aa, Mycobacterium tuberculosis
EVFGAGGYPQM

SEQ ID NO: 141593 - protein, 11 aa, Mycobacterium tuberculosis
FGAGGYPQMLL

SEQ ID NO: 141594 - protein, 11 aa, Mycobacterium tuberculosis
GYPQMLLRVGW

SEQ ID NO: 141595 - protein, 11 aa, Mycobacterium tuberculosis
YPQMLLRVGWA

SEQ ID NO: 141596 - protein, 11 aa, Mycobacterium tuberculosis
QMLLRVGWAPI

SEQ ID NO: 141597 - protein, 11 aa, Mycobacterium tuberculosis
LLRVGWAPINA

SEQ ID NO: 141598 - protein, 11 aa, Mycobacterium tuberculosis
APINADPLPPT

SEQ ID NO: 141599 - protein, 11 aa, Mycobacterium tuberculosis
NADPLPPTPRR

SEQ ID NO: 141600 - protein, 11 aa, Mycobacterium tuberculosis
DPLPPTPRREL

SEQ ID NO: 141601 - protein, 11 aa, Mycobacterium tuberculosis
SQVVEWPEELL

SEQ ID NO: 141602 - protein, 11 aa, Mycobacterium tuberculosis
QVVEWPEELLR

SEQ ID NO: 141603 - protein, 13 aa, Mycobacterium tuberculosis
MNTHFPDAETVRT

SEQ ID NO: 141604 - protein, 13 aa, Mycobacterium tuberculosis
NTHFPDAETVRTV

SEQ ID NO: 141605 - protein, 13 aa, Mycobacterium tuberculosis
THFPDAETVRTVL

SEQ ID NO: 141606 - protein, 13 aa, Mycobacterium tuberculosis
HFPDAETVRTVLT

SEQ ID NO: 141607 - protein, 13 aa, Mycobacterium tuberculosis
FPDAETVRTVLTL

SEQ ID NO: 141608 - protein, 13 aa, Mycobacterium tuberculosis
PDAETVRTVLTLA

SEQ ID NO: 141609 - protein, 13 aa, Mycobacterium tuberculosis
DAETVRTVLTLAV

SEQ ID NO: 141610 - protein, 13 aa, Mycobacterium tuberculosis
AETVRTVLTLAVR

SEQ ID NO: 141611 - protein, 13 aa, Mycobacterium tuberculosis
ETVRTVLTLAVRA

SEQ ID NO: 141612 - protein, 13 aa, Mycobacterium tuberculosis
TVRTVLTLAVRAP

SEQ ID NO: 141613 - protein, 13 aa, Mycobacterium tuberculosis
VRTVLTLAVRAPS

SEQ ID NO: 141614 - protein, 13 aa, Mycobacterium tuberculosis
RTVLTLAVRAPSI

SEQ ID NO: 141615 - protein, 13 aa, Mycobacterium tuberculosis
TVLTLAVRAPSIH

SEQ ID NO: 141616 - protein, 13 aa, Mycobacterium tuberculosis
VLTLAVRAPSIHN

SEQ ID NO: 141617 - protein, 13 aa, Mycobacterium tuberculosis
LTLAVRAPSIHNT

SEQ ID NO: 141618 - protein, 13 aa, Mycobacterium tuberculosis
TLAVRAPSIHNTQ

SEQ ID NO: 141619 - protein, 13 aa, Mycobacterium tuberculosis
LAVRAPSIHNTQP

SEQ ID NO: 141620 - protein, 13 aa, Mycobacterium tuberculosis
AVRAPSIHNTQPW

SEQ ID NO: 141621 - protein, 13 aa, Mycobacterium tuberculosis
VRAPSIHNTQPWR

SEQ ID NO: 141622 - protein, 13 aa, Mycobacterium tuberculosis
RAPSIHNTQPWRW

SEQ ID NO: 141623 - protein, 13 aa, Mycobacterium tuberculosis
APSIHNTQPWRWR

SEQ ID NO: 141624 - protein, 13 aa, Mycobacterium tuberculosis
PSIHNTQPWRWRV

SEQ ID NO: 141625 - protein, 13 aa, Mycobacterium tuberculosis
SIHNTQPWRWRVC

SEQ ID NO: 141626 - protein, 13 aa, Mycobacterium tuberculosis
IHNTQPWRWRVCP

SEQ ID NO: 141627 - protein, 13 aa, Mycobacterium tuberculosis
HNTQPWRWRVCPT

SEQ ID NO: 141628 - protein, 13 aa, Mycobacterium tuberculosis
NTQPWRWRVCPTS

SEQ ID NO: 141629 - protein, 13 aa, Mycobacterium tuberculosis
TQPWRWRVCPTSL

SEQ ID NO: 141630 - protein, 13 aa, Mycobacterium tuberculosis
QPWRWRVCPTSLE

SEQ ID NO: 141631 - protein, 13 aa, Mycobacterium tuberculosis
PWRWRVCPTSLEL

SEQ ID NO: 141632 - protein, 13 aa, Mycobacterium tuberculosis
WRWRVCPTSLELF

SEQ ID NO: 141633 - protein, 13 aa, Mycobacterium tuberculosis
RWRVCPTSLELFS

SEQ ID NO: 141634 - protein, 13 aa, Mycobacterium tuberculosis
WRVCPTSLELFSR

SEQ ID NO: 141635 - protein, 13 aa, Mycobacterium tuberculosis
RVCPTSLELFSRP

SEQ ID NO: 141636 - protein, 13 aa, Mycobacterium tuberculosis
VCPTSLELFSRPD

SEQ ID NO: 141637 - protein, 13 aa, Mycobacterium tuberculosis
CPTSLELFSRPDM

SEQ ID NO: 141638 - protein, 13 aa, Mycobacterium tuberculosis
PTSLELFSRPDMQ

SEQ ID NO: 141639 - protein, 13 aa, Mycobacterium tuberculosis
TSLELFSRPDMQL

SEQ ID NO: 141640 - protein, 13 aa, Mycobacterium tuberculosis
SLELFSRPDMQLR

SEQ ID NO: 141641 - protein, 13 aa, Mycobacterium tuberculosis
LELFSRPDMQLRS

SEQ ID NO: 141642 - protein, 13 aa, Mycobacterium tuberculosis
ELFSRPDMQLRST

SEQ ID NO: 141643 - protein, 13 aa, Mycobacterium tuberculosis
LFSRPDMQLRSTD

SEQ ID NO: 141644 - protein, 13 aa, Mycobacterium tuberculosis
FSRPDMQLRSTDP

SEQ ID NO: 141645 - protein, 13 aa, Mycobacterium tuberculosis
SRPDMQLRSTDPD

SEQ ID NO: 141646 - protein, 13 aa, Mycobacterium tuberculosis
RPDMQLRSTDPDG

SEQ ID NO: 141647 - protein, 13 aa, Mycobacterium tuberculosis
PDMQLRSTDPDGR

SEQ ID NO: 141648 - protein, 13 aa, Mycobacterium tuberculosis
DMQLRSTDPDGRE

SEQ ID NO: 141649 - protein, 13 aa, Mycobacterium tuberculosis
MQLRSTDPDGREL

SEQ ID NO: 141650 - protein, 13 aa, Mycobacterium tuberculosis
QLRSTDPDGRELI

SEQ ID NO: 141651 - protein, 13 aa, Mycobacterium tuberculosis
LRSTDPDGRELIL

SEQ ID NO: 141652 - protein, 13 aa, Mycobacterium tuberculosis
RSTDPDGRELILS

SEQ ID NO: 141653 - protein, 13 aa, Mycobacterium tuberculosis
STDPDGRELILSC

SEQ ID NO: 141654 - protein, 13 aa, Mycobacterium tuberculosis
TDPDGRELILSCG

SEQ ID NO: 141655 - protein, 13 aa, Mycobacterium tuberculosis
DPDGRELILSCGV

SEQ ID NO: 141656 - protein, 13 aa, Mycobacterium tuberculosis
PDGRELILSCGVA

SEQ ID NO: 141657 - protein, 13 aa, Mycobacterium tuberculosis
DGRELILSCGVAL

SEQ ID NO: 141658 - protein, 13 aa, Mycobacterium tuberculosis
GRELILSCGVALH

SEQ ID NO: 141659 - protein, 13 aa, Mycobacterium tuberculosis
RELILSCGVALHH

SEQ ID NO: 141660 - protein, 13 aa, Mycobacterium tuberculosis
ELILSCGVALHHC

SEQ ID NO: 141661 - protein, 13 aa, Mycobacterium tuberculosis
LILSCGVALHHCV

SEQ ID NO: 141662 - protein, 13 aa, Mycobacterium tuberculosis
ILSCGVALHHCVV

SEQ ID NO: 141663 - protein, 13 aa, Mycobacterium tuberculosis
LSCGVALHHCVVA

SEQ ID NO: 141664 - protein, 13 aa, Mycobacterium tuberculosis
SCGVALHHCVVAL

SEQ ID NO: 141665 - protein, 13 aa, Mycobacterium tuberculosis
CGVALHHCVVALA

SEQ ID NO: 141666 - protein, 13 aa, Mycobacterium tuberculosis
GVALHHCVVALAS

SEQ ID NO: 141667 - protein, 13 aa, Mycobacterium tuberculosis
VALHHCVVALASL

SEQ ID NO: 141668 - protein, 13 aa, Mycobacterium tuberculosis
ALHHCVVALASLG

SEQ ID NO: 141669 - protein, 13 aa, Mycobacterium tuberculosis
LHHCVVALASLGW

SEQ ID NO: 141670 - protein, 13 aa, Mycobacterium tuberculosis
HHCVVALASLGWQ

SEQ ID NO: 141671 - protein, 13 aa, Mycobacterium tuberculosis
HCVVALASLGWQA

SEQ ID NO: 141672 - protein, 13 aa, Mycobacterium tuberculosis
CVVALASLGWQAK

SEQ ID NO: 141673 - protein, 13 aa, Mycobacterium tuberculosis
VVALASLGWQAKV

SEQ ID NO: 141674 - protein, 13 aa, Mycobacterium tuberculosis
VALASLGWQAKVN

SEQ ID NO: 141675 - protein, 13 aa, Mycobacterium tuberculosis
ALASLGWQAKVNR

SEQ ID NO: 141676 - protein, 13 aa, Mycobacterium tuberculosis
LASLGWQAKVNRF

SEQ ID NO: 141677 - protein, 13 aa, Mycobacterium tuberculosis
ASLGWQAKVNRFP

SEQ ID NO: 141678 - protein, 13 aa, Mycobacterium tuberculosis
SLGWQAKVNRFPD

SEQ ID NO: 141679 - protein, 13 aa, Mycobacterium tuberculosis
LGWQAKVNRFPDP

SEQ ID NO: 141680 - protein, 13 aa, Mycobacterium tuberculosis
GWQAKVNRFPDPK

SEQ ID NO: 141681 - protein, 13 aa, Mycobacterium tuberculosis
WQAKVNRFPDPKD

SEQ ID NO: 141682 - protein, 13 aa, Mycobacterium tuberculosis
QAKVNRFPDPKDR

SEQ ID NO: 141683 - protein, 13 aa, Mycobacterium tuberculosis
AKVNRFPDPKDRC

SEQ ID NO: 141684 - protein, 13 aa, Mycobacterium tuberculosis
KVNRFPDPKDRCH

SEQ ID NO: 141685 - protein, 13 aa, Mycobacterium tuberculosis
VNRFPDPKDRCHL

SEQ ID NO: 141686 - protein, 13 aa, Mycobacterium tuberculosis
NRFPDPKDRCHLA

SEQ ID NO: 141687 - protein, 13 aa, Mycobacterium tuberculosis
RFPDPKDRCHLAT

SEQ ID NO: 141688 - protein, 13 aa, Mycobacterium tuberculosis
FPDPKDRCHLATI

SEQ ID NO: 141689 - protein, 13 aa, Mycobacterium tuberculosis
PDPKDRCHLATIG

SEQ ID NO: 141690 - protein, 13 aa, Mycobacterium tuberculosis
DPKDRCHLATIGV

SEQ ID NO: 141691 - protein, 13 aa, Mycobacterium tuberculosis
PKDRCHLATIGVQ

SEQ ID NO: 141692 - protein, 13 aa, Mycobacterium tuberculosis
KDRCHLATIGVQP

SEQ ID NO: 141693 - protein, 13 aa, Mycobacterium tuberculosis
DRCHLATIGVQPL

SEQ ID NO: 141694 - protein, 13 aa, Mycobacterium tuberculosis
RCHLATIGVQPLV

SEQ ID NO: 141695 - protein, 13 aa, Mycobacterium tuberculosis
CHLATIGVQPLVP

SEQ ID NO: 141696 - protein, 13 aa, Mycobacterium tuberculosis
HLATIGVQPLVPD

SEQ ID NO: 141697 - protein, 13 aa, Mycobacterium tuberculosis
LATIGVQPLVPDQ

SEQ ID NO: 141698 - protein, 13 aa, Mycobacterium tuberculosis
ATIGVQPLVPDQA

SEQ ID NO: 141699 - protein, 13 aa, Mycobacterium tuberculosis
TIGVQPLVPDQAD

SEQ ID NO: 141700 - protein, 13 aa, Mycobacterium tuberculosis
IGVQPLVPDQADV

SEQ ID NO: 141701 - protein, 13 aa, Mycobacterium tuberculosis
GVQPLVPDQADVA

SEQ ID NO: 141702 - protein, 13 aa, Mycobacterium tuberculosis
VQPLVPDQADVAL

SEQ ID NO: 141703 - protein, 13 aa, Mycobacterium tuberculosis
QPLVPDQADVALA

SEQ ID NO: 141704 - protein, 13 aa, Mycobacterium tuberculosis
PLVPDQADVALAA

SEQ ID NO: 141705 - protein, 13 aa, Mycobacterium tuberculosis
LVPDQADVALAAA

SEQ ID NO: 141706 - protein, 13 aa, Mycobacterium tuberculosis
VPDQADVALAAAI

SEQ ID NO: 141707 - protein, 13 aa, Mycobacterium tuberculosis
PDQADVALAAAIP

SEQ ID NO: 141708 - protein, 13 aa, Mycobacterium tuberculosis
DQADVALAAAIPR

SEQ ID NO: 141709 - protein, 13 aa, Mycobacterium tuberculosis
QADVALAAAIPRR

SEQ ID NO: 141710 - protein, 13 aa, Mycobacterium tuberculosis
ADVALAAAIPRRR

SEQ ID NO: 141711 - protein, 13 aa, Mycobacterium tuberculosis
DVALAAAIPRRRT

SEQ ID NO: 141712 - protein, 13 aa, Mycobacterium tuberculosis
VALAAAIPRRRTD

SEQ ID NO: 141713 - protein, 13 aa, Mycobacterium tuberculosis
ALAAAIPRRRTDR

SEQ ID NO: 141714 - protein, 13 aa, Mycobacterium tuberculosis
LAAAIPRRRTDRR

SEQ ID NO: 141715 - protein, 13 aa, Mycobacterium tuberculosis
AAAIPRRRTDRRA

SEQ ID NO: 141716 - protein, 13 aa, Mycobacterium tuberculosis
AAIPRRRTDRRAY

SEQ ID NO: 141717 - protein, 13 aa, Mycobacterium tuberculosis
AIPRRRTDRRAYS

SEQ ID NO: 141718 - protein, 13 aa, Mycobacterium tuberculosis
IPRRRTDRRAYSC

SEQ ID NO: 141719 - protein, 13 aa, Mycobacterium tuberculosis
PRRRTDRRAYSCW

SEQ ID NO: 141720 - protein, 13 aa, Mycobacterium tuberculosis
RRRTDRRAYSCWP

SEQ ID NO: 141721 - protein, 13 aa, Mycobacterium tuberculosis
RRTDRRAYSCWPV

SEQ ID NO: 141722 - protein, 13 aa, Mycobacterium tuberculosis
RTDRRAYSCWPVP

SEQ ID NO: 141723 - protein, 13 aa, Mycobacterium tuberculosis
TDRRAYSCWPVPG

SEQ ID NO: 141724 - protein, 13 aa, Mycobacterium tuberculosis
DRRAYSCWPVPGG

SEQ ID NO: 141725 - protein, 13 aa, Mycobacterium tuberculosis
RRAYSCWPVPGGD

SEQ ID NO: 141726 - protein, 13 aa, Mycobacterium tuberculosis
RAYSCWPVPGGDI

SEQ ID NO: 141727 - protein, 13 aa, Mycobacterium tuberculosis
AYSCWPVPGGDIA

SEQ ID NO: 141728 - protein, 13 aa, Mycobacterium tuberculosis
YSCWPVPGGDIAL

SEQ ID NO: 141729 - protein, 13 aa, Mycobacterium tuberculosis
SCWPVPGGDIALM

SEQ ID NO: 141730 - protein, 13 aa, Mycobacterium tuberculosis
CWPVPGGDIALMA

SEQ ID NO: 141731 - protein, 13 aa, Mycobacterium tuberculosis
WPVPGGDIALMAA

SEQ ID NO: 141732 - protein, 13 aa, Mycobacterium tuberculosis
PVPGGDIALMAAR

SEQ ID NO: 141733 - protein, 13 aa, Mycobacterium tuberculosis
VPGGDIALMAARA

SEQ ID NO: 141734 - protein, 13 aa, Mycobacterium tuberculosis
PGGDIALMAARAA

SEQ ID NO: 141735 - protein, 13 aa, Mycobacterium tuberculosis
GGDIALMAARAAR

SEQ ID NO: 141736 - protein, 13 aa, Mycobacterium tuberculosis
GDIALMAARAARG

SEQ ID NO: 141737 - protein, 13 aa, Mycobacterium tuberculosis
DIALMAARAARGG

SEQ ID NO: 141738 - protein, 13 aa, Mycobacterium tuberculosis
IALMAARAARGGV

SEQ ID NO: 141739 - protein, 13 aa, Mycobacterium tuberculosis
ALMAARAARGGVM

SEQ ID NO: 141740 - protein, 13 aa, Mycobacterium tuberculosis
LMAARAARGGVML

SEQ ID NO: 141741 - protein, 13 aa, Mycobacterium tuberculosis
MAARAARGGVMLR

SEQ ID NO: 141742 - protein, 13 aa, Mycobacterium tuberculosis
AARAARGGVMLRQ

SEQ ID NO: 141743 - protein, 13 aa, Mycobacterium tuberculosis
ARAARGGVMLRQV

SEQ ID NO: 141744 - protein, 13 aa, Mycobacterium tuberculosis
RAARGGVMLRQVS

SEQ ID NO: 141745 - protein, 13 aa, Mycobacterium tuberculosis
AARGGVMLRQVSA

SEQ ID NO: 141746 - protein, 13 aa, Mycobacterium tuberculosis
ARGGVMLRQVSAL

SEQ ID NO: 141747 - protein, 13 aa, Mycobacterium tuberculosis
RGGVMLRQVSALD

SEQ ID NO: 141748 - protein, 13 aa, Mycobacterium tuberculosis
GGVMLRQVSALDR

SEQ ID NO: 141749 - protein, 13 aa, Mycobacterium tuberculosis
GVMLRQVSALDRM

SEQ ID NO: 141750 - protein, 13 aa, Mycobacterium tuberculosis
VMLRQVSALDRMK

SEQ ID NO: 141751 - protein, 13 aa, Mycobacterium tuberculosis
MLRQVSALDRMKA

SEQ ID NO: 141752 - protein, 13 aa, Mycobacterium tuberculosis
LRQVSALDRMKAI

SEQ ID NO: 141753 - protein, 13 aa, Mycobacterium tuberculosis
RQVSALDRMKAIV

SEQ ID NO: 141754 - protein, 13 aa, Mycobacterium tuberculosis
QVSALDRMKAIVA

SEQ ID NO: 141755 - protein, 13 aa, Mycobacterium tuberculosis
VSALDRMKAIVAQ

SEQ ID NO: 141756 - protein, 13 aa, Mycobacterium tuberculosis
SALDRMKAIVAQA

SEQ ID NO: 141757 - protein, 13 aa, Mycobacterium tuberculosis
ALDRMKAIVAQAV

SEQ ID NO: 141758 - protein, 13 aa, Mycobacterium tuberculosis
LDRMKAIVAQAVL

SEQ ID NO: 141759 - protein, 13 aa, Mycobacterium tuberculosis
DRMKAIVAQAVLD

SEQ ID NO: 141760 - protein, 13 aa, Mycobacterium tuberculosis
RMKAIVAQAVLDH

SEQ ID NO: 141761 - protein, 13 aa, Mycobacterium tuberculosis
MKAIVAQAVLDHV

SEQ ID NO: 141762 - protein, 13 aa, Mycobacterium tuberculosis
KAIVAQAVLDHVT

SEQ ID NO: 141763 - protein, 13 aa, Mycobacterium tuberculosis
AIVAQAVLDHVTD

SEQ ID NO: 141764 - protein, 13 aa, Mycobacterium tuberculosis
IVAQAVLDHVTDE

SEQ ID NO: 141765 - protein, 13 aa, Mycobacterium tuberculosis
VAQAVLDHVTDEE

SEQ ID NO: 141766 - protein, 13 aa, Mycobacterium tuberculosis
AQAVLDHVTDEEY

SEQ ID NO: 141767 - protein, 13 aa, Mycobacterium tuberculosis
QAVLDHVTDEEYL

SEQ ID NO: 141768 - protein, 13 aa, Mycobacterium tuberculosis
AVLDHVTDEEYLR

SEQ ID NO: 141769 - protein, 13 aa, Mycobacterium tuberculosis
VLDHVTDEEYLRE

SEQ ID NO: 141770 - protein, 13 aa, Mycobacterium tuberculosis
LDHVTDEEYLREL

SEQ ID NO: 141771 - protein, 13 aa, Mycobacterium tuberculosis
DHVTDEEYLRELT

SEQ ID NO: 141772 - protein, 13 aa, Mycobacterium tuberculosis
HVTDEEYLRELTI

SEQ ID NO: 141773 - protein, 13 aa, Mycobacterium tuberculosis
VTDEEYLRELTIW

SEQ ID NO: 141774 - protein, 13 aa, Mycobacterium tuberculosis
TDEEYLRELTIWS

SEQ ID NO: 141775 - protein, 13 aa, Mycobacterium tuberculosis
DEEYLRELTIWSG

SEQ ID NO: 141776 - protein, 13 aa, Mycobacterium tuberculosis
EEYLRELTIWSGR

SEQ ID NO: 141777 - protein, 13 aa, Mycobacterium tuberculosis
EYLRELTIWSGRY

SEQ ID NO: 141778 - protein, 13 aa, Mycobacterium tuberculosis
YLRELTIWSGRYG

SEQ ID NO: 141779 - protein, 13 aa, Mycobacterium tuberculosis
LRELTIWSGRYGS

SEQ ID NO: 141780 - protein, 13 aa, Mycobacterium tuberculosis
RELTIWSGRYGSV

SEQ ID NO: 141781 - protein, 13 aa, Mycobacterium tuberculosis
ELTIWSGRYGSVA

SEQ ID NO: 141782 - protein, 13 aa, Mycobacterium tuberculosis
LTIWSGRYGSVAG

SEQ ID NO: 141783 - protein, 13 aa, Mycobacterium tuberculosis
TIWSGRYGSVAGV

SEQ ID NO: 141784 - protein, 13 aa, Mycobacterium tuberculosis
IWSGRYGSVAGVP

SEQ ID NO: 141785 - protein, 13 aa, Mycobacterium tuberculosis
WSGRYGSVAGVPA

SEQ ID NO: 141786 - protein, 13 aa, Mycobacterium tuberculosis
SGRYGSVAGVPAR

SEQ ID NO: 141787 - protein, 13 aa, Mycobacterium tuberculosis
GRYGSVAGVPARN

SEQ ID NO: 141788 - protein, 13 aa, Mycobacterium tuberculosis
RYGSVAGVPARNE

SEQ ID NO: 141789 - protein, 13 aa, Mycobacterium tuberculosis
YGSVAGVPARNEP

SEQ ID NO: 141790 - protein, 13 aa, Mycobacterium tuberculosis
GSVAGVPARNEPP

SEQ ID NO: 141791 - protein, 13 aa, Mycobacterium tuberculosis
SVAGVPARNEPPS

SEQ ID NO: 141792 - protein, 13 aa, Mycobacterium tuberculosis
VAGVPARNEPPSD

SEQ ID NO: 141793 - protein, 13 aa, Mycobacterium tuberculosis
AGVPARNEPPSDP

SEQ ID NO: 141794 - protein, 13 aa, Mycobacterium tuberculosis
GVPARNEPPSDPS

SEQ ID NO: 141795 - protein, 13 aa, Mycobacterium tuberculosis
VPARNEPPSDPSA

SEQ ID NO: 141796 - protein, 13 aa, Mycobacterium tuberculosis
PARNEPPSDPSAP

SEQ ID NO: 141797 - protein, 13 aa, Mycobacterium tuberculosis
ARNEPPSDPSAPI

SEQ ID NO: 141798 - protein, 13 aa, Mycobacterium tuberculosis
RNEPPSDPSAPIP

SEQ ID NO: 141799 - protein, 13 aa, Mycobacterium tuberculosis
NEPPSDPSAPIPG

SEQ ID NO: 141800 - protein, 13 aa, Mycobacterium tuberculosis
EPPSDPSAPIPGR

SEQ ID NO: 141801 - protein, 13 aa, Mycobacterium tuberculosis
PPSDPSAPIPGRL

SEQ ID NO: 141802 - protein, 13 aa, Mycobacterium tuberculosis
PSDPSAPIPGRLF

SEQ ID NO: 141803 - protein, 13 aa, Mycobacterium tuberculosis
SDPSAPIPGRLFA

SEQ ID NO: 141804 - protein, 13 aa, Mycobacterium tuberculosis
DPSAPIPGRLFAG

SEQ ID NO: 141805 - protein, 13 aa, Mycobacterium tuberculosis
PSAPIPGRLFAGP

SEQ ID NO: 141806 - protein, 13 aa, Mycobacterium tuberculosis
SAPIPGRLFAGPG

SEQ ID NO: 141807 - protein, 13 aa, Mycobacterium tuberculosis
APIPGRLFAGPGL

SEQ ID NO: 141808 - protein, 13 aa, Mycobacterium tuberculosis
PIPGRLFAGPGLS

SEQ ID NO: 141809 - protein, 13 aa, Mycobacterium tuberculosis
IPGRLFAGPGLSQ

SEQ ID NO: 141810 - protein, 13 aa, Mycobacterium tuberculosis
PGRLFAGPGLSQP

SEQ ID NO: 141811 - protein, 13 aa, Mycobacterium tuberculosis
GRLFAGPGLSQPS

SEQ ID NO: 141812 - protein, 13 aa, Mycobacterium tuberculosis
RLFAGPGLSQPSD

SEQ ID NO: 141813 - protein, 13 aa, Mycobacterium tuberculosis
LFAGPGLSQPSDV

SEQ ID NO: 141814 - protein, 13 aa, Mycobacterium tuberculosis
FAGPGLSQPSDVL

SEQ ID NO: 141815 - protein, 13 aa, Mycobacterium tuberculosis
AGPGLSQPSDVLP

SEQ ID NO: 141816 - protein, 13 aa, Mycobacterium tuberculosis
GPGLSQPSDVLPA

SEQ ID NO: 141817 - protein, 13 aa, Mycobacterium tuberculosis
PGLSQPSDVLPAD

SEQ ID NO: 141818 - protein, 13 aa, Mycobacterium tuberculosis
GLSQPSDVLPADD

SEQ ID NO: 141819 - protein, 13 aa, Mycobacterium tuberculosis
LSQPSDVLPADDG

SEQ ID NO: 141820 - protein, 13 aa, Mycobacterium tuberculosis
SQPSDVLPADDGA

SEQ ID NO: 141821 - protein, 13 aa, Mycobacterium tuberculosis
QPSDVLPADDGAA

SEQ ID NO: 141822 - protein, 13 aa, Mycobacterium tuberculosis
PSDVLPADDGAAI

SEQ ID NO: 141823 - protein, 13 aa, Mycobacterium tuberculosis
SDVLPADDGAAIL

SEQ ID NO: 141824 - protein, 13 aa, Mycobacterium tuberculosis
DVLPADDGAAILA

SEQ ID NO: 141825 - protein, 13 aa, Mycobacterium tuberculosis
VLPADDGAAILAL

SEQ ID NO: 141826 - protein, 13 aa, Mycobacterium tuberculosis
LPADDGAAILALG

SEQ ID NO: 141827 - protein, 13 aa, Mycobacterium tuberculosis
PADDGAAILALGT

SEQ ID NO: 141828 - protein, 13 aa, Mycobacterium tuberculosis
ADDGAAILALGTE

SEQ ID NO: 141829 - protein, 13 aa, Mycobacterium tuberculosis
DDGAAILALGTET

SEQ ID NO: 141830 - protein, 13 aa, Mycobacterium tuberculosis
DGAAILALGTETD

SEQ ID NO: 141831 - protein, 13 aa, Mycobacterium tuberculosis
GAAILALGTETDD

SEQ ID NO: 141832 - protein, 13 aa, Mycobacterium tuberculosis
AAILALGTETDDR

SEQ ID NO: 141833 - protein, 13 aa, Mycobacterium tuberculosis
AILALGTETDDRL

SEQ ID NO: 141834 - protein, 13 aa, Mycobacterium tuberculosis
ILALGTETDDRLA

SEQ ID NO: 141835 - protein, 13 aa, Mycobacterium tuberculosis
LALGTETDDRLAR

SEQ ID NO: 141836 - protein, 13 aa, Mycobacterium tuberculosis
ALGTETDDRLARL

SEQ ID NO: 141837 - protein, 13 aa, Mycobacterium tuberculosis
LGTETDDRLARLR

SEQ ID NO: 141838 - protein, 13 aa, Mycobacterium tuberculosis
GTETDDRLARLRA

SEQ ID NO: 141839 - protein, 13 aa, Mycobacterium tuberculosis
TETDDRLARLRAG

SEQ ID NO: 141840 - protein, 13 aa, Mycobacterium tuberculosis
ETDDRLARLRAGE

SEQ ID NO: 141841 - protein, 13 aa, Mycobacterium tuberculosis
TDDRLARLRAGEA

SEQ ID NO: 141842 - protein, 13 aa, Mycobacterium tuberculosis
DDRLARLRAGEAA

SEQ ID NO: 141843 - protein, 13 aa, Mycobacterium tuberculosis
DRLARLRAGEAAS

SEQ ID NO: 141844 - protein, 13 aa, Mycobacterium tuberculosis
RLARLRAGEAASI

SEQ ID NO: 141845 - protein, 13 aa, Mycobacterium tuberculosis
LARLRAGEAASIV

SEQ ID NO: 141846 - protein, 13 aa, Mycobacterium tuberculosis
ARLRAGEAASIVL

SEQ ID NO: 141847 - protein, 13 aa, Mycobacterium tuberculosis
RLRAGEAASIVLL

SEQ ID NO: 141848 - protein, 13 aa, Mycobacterium tuberculosis
LRAGEAASIVLLT

SEQ ID NO: 141849 - protein, 13 aa, Mycobacterium tuberculosis
RAGEAASIVLLTA

SEQ ID NO: 141850 - protein, 13 aa, Mycobacterium tuberculosis
AGEAASIVLLTAT

SEQ ID NO: 141851 - protein, 13 aa, Mycobacterium tuberculosis
GEAASIVLLTATA

SEQ ID NO: 141852 - protein, 13 aa, Mycobacterium tuberculosis
EAASIVLLTATAM

SEQ ID NO: 141853 - protein, 13 aa, Mycobacterium tuberculosis
AASIVLLTATAMG

SEQ ID NO: 141854 - protein, 13 aa, Mycobacterium tuberculosis
ASIVLLTATAMGL

SEQ ID NO: 141855 - protein, 13 aa, Mycobacterium tuberculosis
SIVLLTATAMGLA

SEQ ID NO: 141856 - protein, 13 aa, Mycobacterium tuberculosis
IVLLTATAMGLAC

SEQ ID NO: 141857 - protein, 13 aa, Mycobacterium tuberculosis
VLLTATAMGLACC

SEQ ID NO: 141858 - protein, 13 aa, Mycobacterium tuberculosis
LLTATAMGLACCP

SEQ ID NO: 141859 - protein, 13 aa, Mycobacterium tuberculosis
LTATAMGLACCPI

SEQ ID NO: 141860 - protein, 13 aa, Mycobacterium tuberculosis
TATAMGLACCPIT

SEQ ID NO: 141861 - protein, 13 aa, Mycobacterium tuberculosis
ATAMGLACCPITE

SEQ ID NO: 141862 - protein, 13 aa, Mycobacterium tuberculosis
TAMGLACCPITEP

SEQ ID NO: 141863 - protein, 13 aa, Mycobacterium tuberculosis
AMGLACCPITEPL

SEQ ID NO: 141864 - protein, 13 aa, Mycobacterium tuberculosis
MGLACCPITEPLE

SEQ ID NO: 141865 - protein, 13 aa, Mycobacterium tuberculosis
GLACCPITEPLEI

SEQ ID NO: 141866 - protein, 13 aa, Mycobacterium tuberculosis
LACCPITEPLEIA

SEQ ID NO: 141867 - protein, 13 aa, Mycobacterium tuberculosis
ACCPITEPLEIAK

SEQ ID NO: 141868 - protein, 13 aa, Mycobacterium tuberculosis
CCPITEPLEIAKT

SEQ ID NO: 141869 - protein, 13 aa, Mycobacterium tuberculosis
CPITEPLEIAKTR

SEQ ID NO: 141870 - protein, 13 aa, Mycobacterium tuberculosis
PITEPLEIAKTRD

SEQ ID NO: 141871 - protein, 13 aa, Mycobacterium tuberculosis
ITEPLEIAKTRDA

SEQ ID NO: 141872 - protein, 13 aa, Mycobacterium tuberculosis
TEPLEIAKTRDAV

SEQ ID NO: 141873 - protein, 13 aa, Mycobacterium tuberculosis
EPLEIAKTRDAVR

SEQ ID NO: 141874 - protein, 13 aa, Mycobacterium tuberculosis
PLEIAKTRDAVRA

SEQ ID NO: 141875 - protein, 13 aa, Mycobacterium tuberculosis
LEIAKTRDAVRAE

SEQ ID NO: 141876 - protein, 13 aa, Mycobacterium tuberculosis
EIAKTRDAVRAEV

SEQ ID NO: 141877 - protein, 13 aa, Mycobacterium tuberculosis
IAKTRDAVRAEVF

SEQ ID NO: 141878 - protein, 13 aa, Mycobacterium tuberculosis
AKTRDAVRAEVFG

SEQ ID NO: 141879 - protein, 13 aa, Mycobacterium tuberculosis
KTRDAVRAEVFGA

SEQ ID NO: 141880 - protein, 13 aa, Mycobacterium tuberculosis
TRDAVRAEVFGAG

SEQ ID NO: 141881 - protein, 13 aa, Mycobacterium tuberculosis
RDAVRAEVFGAGG

SEQ ID NO: 141882 - protein, 13 aa, Mycobacterium tuberculosis
DAVRAEVFGAGGY

SEQ ID NO: 141883 - protein, 13 aa, Mycobacterium tuberculosis
AVRAEVFGAGGYP

SEQ ID NO: 141884 - protein, 13 aa, Mycobacterium tuberculosis
VRAEVFGAGGYPQ

SEQ ID NO: 141885 - protein, 13 aa, Mycobacterium tuberculosis
RAEVFGAGGYPQM

SEQ ID NO: 141886 - protein, 13 aa, Mycobacterium tuberculosis
AEVFGAGGYPQML

SEQ ID NO: 141887 - protein, 13 aa, Mycobacterium tuberculosis
EVFGAGGYPQMLL

SEQ ID NO: 141888 - protein, 13 aa, Mycobacterium tuberculosis
VFGAGGYPQMLLR

SEQ ID NO: 141889 - protein, 13 aa, Mycobacterium tuberculosis
FGAGGYPQMLLRV

SEQ ID NO: 141890 - protein, 13 aa, Mycobacterium tuberculosis
GAGGYPQMLLRVG

SEQ ID NO: 141891 - protein, 13 aa, Mycobacterium tuberculosis
AGGYPQMLLRVGW

SEQ ID NO: 141892 - protein, 13 aa, Mycobacterium tuberculosis
GGYPQMLLRVGWA

SEQ ID NO: 141893 - protein, 13 aa, Mycobacterium tuberculosis
GYPQMLLRVGWAP

SEQ ID NO: 141894 - protein, 13 aa, Mycobacterium tuberculosis
YPQMLLRVGWAPI

SEQ ID NO: 141895 - protein, 13 aa, Mycobacterium tuberculosis
PQMLLRVGWAPIN

SEQ ID NO: 141896 - protein, 13 aa, Mycobacterium tuberculosis
QMLLRVGWAPINA

SEQ ID NO: 141897 - protein, 13 aa, Mycobacterium tuberculosis
MLLRVGWAPINAD

SEQ ID NO: 141898 - protein, 13 aa, Mycobacterium tuberculosis
LLRVGWAPINADP

SEQ ID NO: 141899 - protein, 13 aa, Mycobacterium tuberculosis
LRVGWAPINADPL

SEQ ID NO: 141900 - protein, 13 aa, Mycobacterium tuberculosis
RVGWAPINADPLP

SEQ ID NO: 141901 - protein, 13 aa, Mycobacterium tuberculosis
VGWAPINADPLPP

SEQ ID NO: 141902 - protein, 13 aa, Mycobacterium tuberculosis
GWAPINADPLPPT

SEQ ID NO: 141903 - protein, 13 aa, Mycobacterium tuberculosis
WAPINADPLPPTP

SEQ ID NO: 141904 - protein, 13 aa, Mycobacterium tuberculosis
APINADPLPPTPR

SEQ ID NO: 141905 - protein, 13 aa, Mycobacterium tuberculosis
PINADPLPPTPRR

SEQ ID NO: 141906 - protein, 13 aa, Mycobacterium tuberculosis
INADPLPPTPRRE

SEQ ID NO: 141907 - protein, 13 aa, Mycobacterium tuberculosis
NADPLPPTPRREL

SEQ ID NO: 141908 - protein, 13 aa, Mycobacterium tuberculosis
ADPLPPTPRRELS

SEQ ID NO: 141909 - protein, 13 aa, Mycobacterium tuberculosis
DPLPPTPRRELSQ

SEQ ID NO: 141910 - protein, 13 aa, Mycobacterium tuberculosis
PLPPTPRRELSQV

SEQ ID NO: 141911 - protein, 13 aa, Mycobacterium tuberculosis
LPPTPRRELSQVV

SEQ ID NO: 141912 - protein, 13 aa, Mycobacterium tuberculosis
PPTPRRELSQVVE

SEQ ID NO: 141913 - protein, 13 aa, Mycobacterium tuberculosis
PTPRRELSQVVEW

SEQ ID NO: 141914 - protein, 13 aa, Mycobacterium tuberculosis
TPRRELSQVVEWP

SEQ ID NO: 141915 - protein, 13 aa, Mycobacterium tuberculosis
PRRELSQVVEWPE

SEQ ID NO: 141916 - protein, 13 aa, Mycobacterium tuberculosis
RRELSQVVEWPEE

SEQ ID NO: 141917 - protein, 13 aa, Mycobacterium tuberculosis
RELSQVVEWPEEL

SEQ ID NO: 141918 - protein, 13 aa, Mycobacterium tuberculosis
ELSQVVEWPEELL

SEQ ID NO: 141919 - protein, 13 aa, Mycobacterium tuberculosis
LSQVVEWPEELLR

SEQ ID NO: 141920 - protein, 13 aa, Mycobacterium tuberculosis
SQVVEWPEELLRQ

SEQ ID NO: 141921 - protein, 13 aa, Mycobacterium tuberculosis
QVVEWPEELLRQR

SEQ ID NO: 141922 - protein, 13 aa, Mycobacterium tuberculosis
VVEWPEELLRQRC

SEQ ID NO: 141923 - protein, 14 aa, Mycobacterium tuberculosis
MNTHFPDAETVRTV

SEQ ID NO: 141924 - protein, 14 aa, Mycobacterium tuberculosis
NTHFPDAETVRTVL

SEQ ID NO: 141925 - protein, 14 aa, Mycobacterium tuberculosis
THFPDAETVRTVLT

SEQ ID NO: 141926 - protein, 14 aa, Mycobacterium tuberculosis
HFPDAETVRTVLTL

SEQ ID NO: 141927 - protein, 14 aa, Mycobacterium tuberculosis
FPDAETVRTVLTLA

SEQ ID NO: 141928 - protein, 14 aa, Mycobacterium tuberculosis
PDAETVRTVLTLAV

SEQ ID NO: 141929 - protein, 14 aa, Mycobacterium tuberculosis
DAETVRTVLTLAVR

SEQ ID NO: 141930 - protein, 14 aa, Mycobacterium tuberculosis
AETVRTVLTLAVRA

SEQ ID NO: 141931 - protein, 14 aa, Mycobacterium tuberculosis
ETVRTVLTLAVRAP

SEQ ID NO: 141932 - protein, 14 aa, Mycobacterium tuberculosis
TVRTVLTLAVRAPS

SEQ ID NO: 141933 - protein, 14 aa, Mycobacterium tuberculosis
VRTVLTLAVRAPSI

SEQ ID NO: 141934 - protein, 14 aa, Mycobacterium tuberculosis
RTVLTLAVRAPSIH

SEQ ID NO: 141935 - protein, 14 aa, Mycobacterium tuberculosis
TVLTLAVRAPSIHN

SEQ ID NO: 141936 - protein, 14 aa, Mycobacterium tuberculosis
VLTLAVRAPSIHNT

SEQ ID NO: 141937 - protein, 14 aa, Mycobacterium tuberculosis
LTLAVRAPSIHNTQ

SEQ ID NO: 141938 - protein, 14 aa, Mycobacterium tuberculosis
TLAVRAPSIHNTQP

SEQ ID NO: 141939 - protein, 14 aa, Mycobacterium tuberculosis
LAVRAPSIHNTQPW

SEQ ID NO: 141940 - protein, 14 aa, Mycobacterium tuberculosis
AVRAPSIHNTQPWR

SEQ ID NO: 141941 - protein, 14 aa, Mycobacterium tuberculosis
VRAPSIHNTQPWRW

SEQ ID NO: 141942 - protein, 14 aa, Mycobacterium tuberculosis
RAPSIHNTQPWRWR

SEQ ID NO: 141943 - protein, 14 aa, Mycobacterium tuberculosis
APSIHNTQPWRWRV

SEQ ID NO: 141944 - protein, 14 aa, Mycobacterium tuberculosis
PSIHNTQPWRWRVC

SEQ ID NO: 141945 - protein, 14 aa, Mycobacterium tuberculosis
SIHNTQPWRWRVCP

SEQ ID NO: 141946 - protein, 14 aa, Mycobacterium tuberculosis
IHNTQPWRWRVCPT

SEQ ID NO: 141947 - protein, 14 aa, Mycobacterium tuberculosis
HNTQPWRWRVCPTS

SEQ ID NO: 141948 - protein, 14 aa, Mycobacterium tuberculosis
NTQPWRWRVCPTSL

SEQ ID NO: 141949 - protein, 14 aa, Mycobacterium tuberculosis
TQPWRWRVCPTSLE

SEQ ID NO: 141950 - protein, 14 aa, Mycobacterium tuberculosis
QPWRWRVCPTSLEL

SEQ ID NO: 141951 - protein, 14 aa, Mycobacterium tuberculosis
PWRWRVCPTSLELF

SEQ ID NO: 141952 - protein, 14 aa, Mycobacterium tuberculosis
WRWRVCPTSLELFS

SEQ ID NO: 141953 - protein, 14 aa, Mycobacterium tuberculosis
RWRVCPTSLELFSR

SEQ ID NO: 141954 - protein, 14 aa, Mycobacterium tuberculosis
WRVCPTSLELFSRP

SEQ ID NO: 141955 - protein, 14 aa, Mycobacterium tuberculosis
RVCPTSLELFSRPD

SEQ ID NO: 141956 - protein, 14 aa, Mycobacterium tuberculosis
VCPTSLELFSRPDM

SEQ ID NO: 141957 - protein, 14 aa, Mycobacterium tuberculosis
CPTSLELFSRPDMQ

SEQ ID NO: 141958 - protein, 14 aa, Mycobacterium tuberculosis
PTSLELFSRPDMQL

SEQ ID NO: 141959 - protein, 14 aa, Mycobacterium tuberculosis
TSLELFSRPDMQLR

SEQ ID NO: 141960 - protein, 14 aa, Mycobacterium tuberculosis
SLELFSRPDMQLRS

SEQ ID NO: 141961 - protein, 14 aa, Mycobacterium tuberculosis
LELFSRPDMQLRST

SEQ ID NO: 141962 - protein, 14 aa, Mycobacterium tuberculosis
ELFSRPDMQLRSTD

SEQ ID NO: 141963 - protein, 14 aa, Mycobacterium tuberculosis
LFSRPDMQLRSTDP

SEQ ID NO: 141964 - protein, 14 aa, Mycobacterium tuberculosis
FSRPDMQLRSTDPD

SEQ ID NO: 141965 - protein, 14 aa, Mycobacterium tuberculosis
SRPDMQLRSTDPDG

SEQ ID NO: 141966 - protein, 14 aa, Mycobacterium tuberculosis
RPDMQLRSTDPDGR

SEQ ID NO: 141967 - protein, 14 aa, Mycobacterium tuberculosis
PDMQLRSTDPDGRE

SEQ ID NO: 141968 - protein, 14 aa, Mycobacterium tuberculosis
DMQLRSTDPDGREL

SEQ ID NO: 141969 - protein, 14 aa, Mycobacterium tuberculosis
MQLRSTDPDGRELI

SEQ ID NO: 141970 - protein, 14 aa, Mycobacterium tuberculosis
QLRSTDPDGRELIL

SEQ ID NO: 141971 - protein, 14 aa, Mycobacterium tuberculosis
LRSTDPDGRELILS

SEQ ID NO: 141972 - protein, 14 aa, Mycobacterium tuberculosis
RSTDPDGRELILSC

SEQ ID NO: 141973 - protein, 14 aa, Mycobacterium tuberculosis
STDPDGRELILSCG

SEQ ID NO: 141974 - protein, 14 aa, Mycobacterium tuberculosis
TDPDGRELILSCGV

SEQ ID NO: 141975 - protein, 14 aa, Mycobacterium tuberculosis
DPDGRELILSCGVA

SEQ ID NO: 141976 - protein, 14 aa, Mycobacterium tuberculosis
PDGRELILSCGVAL

SEQ ID NO: 141977 - protein, 14 aa, Mycobacterium tuberculosis
DGRELILSCGVALH

SEQ ID NO: 141978 - protein, 14 aa, Mycobacterium tuberculosis
GRELILSCGVALHH

SEQ ID NO: 141979 - protein, 14 aa, Mycobacterium tuberculosis
RELILSCGVALHHC

SEQ ID NO: 141980 - protein, 14 aa, Mycobacterium tuberculosis
ELILSCGVALHHCV

SEQ ID NO: 141981 - protein, 14 aa, Mycobacterium tuberculosis
LILSCGVALHHCVV

SEQ ID NO: 141982 - protein, 14 aa, Mycobacterium tuberculosis
ILSCGVALHHCVVA

SEQ ID NO: 141983 - protein, 14 aa, Mycobacterium tuberculosis
LSCGVALHHCVVAL

SEQ ID NO: 141984 - protein, 14 aa, Mycobacterium tuberculosis
SCGVALHHCVVALA

SEQ ID NO: 141985 - protein, 14 aa, Mycobacterium tuberculosis
CGVALHHCVVALAS

SEQ ID NO: 141986 - protein, 14 aa, Mycobacterium tuberculosis
GVALHHCVVALASL

SEQ ID NO: 141987 - protein, 14 aa, Mycobacterium tuberculosis
VALHHCVVALASLG

SEQ ID NO: 141988 - protein, 14 aa, Mycobacterium tuberculosis
ALHHCVVALASLGW

SEQ ID NO: 141989 - protein, 14 aa, Mycobacterium tuberculosis
LHHCVVALASLGWQ

SEQ ID NO: 141990 - protein, 14 aa, Mycobacterium tuberculosis
HHCVVALASLGWQA

SEQ ID NO: 141991 - protein, 14 aa, Mycobacterium tuberculosis
HCVVALASLGWQAK

SEQ ID NO: 141992 - protein, 14 aa, Mycobacterium tuberculosis
CVVALASLGWQAKV

SEQ ID NO: 141993 - protein, 14 aa, Mycobacterium tuberculosis
VVALASLGWQAKVN

SEQ ID NO: 141994 - protein, 14 aa, Mycobacterium tuberculosis
VALASLGWQAKVNR

SEQ ID NO: 141995 - protein, 14 aa, Mycobacterium tuberculosis
ALASLGWQAKVNRF

SEQ ID NO: 141996 - protein, 14 aa, Mycobacterium tuberculosis
LASLGWQAKVNRFP

SEQ ID NO: 141997 - protein, 14 aa, Mycobacterium tuberculosis
ASLGWQAKVNRFPD

SEQ ID NO: 141998 - protein, 14 aa, Mycobacterium tuberculosis
SLGWQAKVNRFPDP

SEQ ID NO: 141999 - protein, 14 aa, Mycobacterium tuberculosis
LGWQAKVNRFPDPK

SEQ ID NO: 142000 - protein, 14 aa, Mycobacterium tuberculosis
GWQAKVNRFPDPKD

SEQ ID NO: 142001 - protein, 14 aa, Mycobacterium tuberculosis
WQAKVNRFPDPKDR

SEQ ID NO: 142002 - protein, 14 aa, Mycobacterium tuberculosis
QAKVNRFPDPKDRC

SEQ ID NO: 142003 - protein, 14 aa, Mycobacterium tuberculosis
AKVNRFPDPKDRCH

SEQ ID NO: 142004 - protein, 14 aa, Mycobacterium tuberculosis
KVNRFPDPKDRCHL

SEQ ID NO: 142005 - protein, 14 aa, Mycobacterium tuberculosis
VNRFPDPKDRCHLA

SEQ ID NO: 142006 - protein, 14 aa, Mycobacterium tuberculosis
NRFPDPKDRCHLAT

SEQ ID NO: 142007 - protein, 14 aa, Mycobacterium tuberculosis
RFPDPKDRCHLATI

SEQ ID NO: 142008 - protein, 14 aa, Mycobacterium tuberculosis
FPDPKDRCHLATIG

SEQ ID NO: 142009 - protein, 14 aa, Mycobacterium tuberculosis
PDPKDRCHLATIGV

SEQ ID NO: 142010 - protein, 14 aa, Mycobacterium tuberculosis
DPKDRCHLATIGVQ

SEQ ID NO: 142011 - protein, 14 aa, Mycobacterium tuberculosis
PKDRCHLATIGVQP

SEQ ID NO: 142012 - protein, 14 aa, Mycobacterium tuberculosis
KDRCHLATIGVQPL

SEQ ID NO: 142013 - protein, 14 aa, Mycobacterium tuberculosis
DRCHLATIGVQPLV

SEQ ID NO: 142014 - protein, 14 aa, Mycobacterium tuberculosis
RCHLATIGVQPLVP

SEQ ID NO: 142015 - protein, 14 aa, Mycobacterium tuberculosis
CHLATIGVQPLVPD

SEQ ID NO: 142016 - protein, 14 aa, Mycobacterium tuberculosis
HLATIGVQPLVPDQ

SEQ ID NO: 142017 - protein, 14 aa, Mycobacterium tuberculosis
LATIGVQPLVPDQA

SEQ ID NO: 142018 - protein, 14 aa, Mycobacterium tuberculosis
ATIGVQPLVPDQAD

SEQ ID NO: 142019 - protein, 14 aa, Mycobacterium tuberculosis
TIGVQPLVPDQADV

SEQ ID NO: 142020 - protein, 14 aa, Mycobacterium tuberculosis
IGVQPLVPDQADVA

SEQ ID NO: 142021 - protein, 14 aa, Mycobacterium tuberculosis
GVQPLVPDQADVAL

SEQ ID NO: 142022 - protein, 14 aa, Mycobacterium tuberculosis
VQPLVPDQADVALA

SEQ ID NO: 142023 - protein, 14 aa, Mycobacterium tuberculosis
QPLVPDQADVALAA

SEQ ID NO: 142024 - protein, 14 aa, Mycobacterium tuberculosis
PLVPDQADVALAAA

SEQ ID NO: 142025 - protein, 14 aa, Mycobacterium tuberculosis
LVPDQADVALAAAI

SEQ ID NO: 142026 - protein, 14 aa, Mycobacterium tuberculosis
VPDQADVALAAAIP

SEQ ID NO: 142027 - protein, 14 aa, Mycobacterium tuberculosis
PDQADVALAAAIPR

SEQ ID NO: 142028 - protein, 14 aa, Mycobacterium tuberculosis
DQADVALAAAIPRR

SEQ ID NO: 142029 - protein, 14 aa, Mycobacterium tuberculosis
QADVALAAAIPRRR

SEQ ID NO: 142030 - protein, 14 aa, Mycobacterium tuberculosis
ADVALAAAIPRRRT

SEQ ID NO: 142031 - protein, 14 aa, Mycobacterium tuberculosis
DVALAAAIPRRRTD

SEQ ID NO: 142032 - protein, 14 aa, Mycobacterium tuberculosis
VALAAAIPRRRTDR

SEQ ID NO: 142033 - protein, 14 aa, Mycobacterium tuberculosis
ALAAAIPRRRTDRR

SEQ ID NO: 142034 - protein, 14 aa, Mycobacterium tuberculosis
LAAAIPRRRTDRRA

SEQ ID NO: 142035 - protein, 14 aa, Mycobacterium tuberculosis
AAAIPRRRTDRRAY

SEQ ID NO: 142036 - protein, 14 aa, Mycobacterium tuberculosis
AAIPRRRTDRRAYS

SEQ ID NO: 142037 - protein, 14 aa, Mycobacterium tuberculosis
AIPRRRTDRRAYSC

SEQ ID NO: 142038 - protein, 14 aa, Mycobacterium tuberculosis
IPRRRTDRRAYSCW

SEQ ID NO: 142039 - protein, 14 aa, Mycobacterium tuberculosis
PRRRTDRRAYSCWP

SEQ ID NO: 142040 - protein, 14 aa, Mycobacterium tuberculosis
RRRTDRRAYSCWPV

SEQ ID NO: 142041 - protein, 14 aa, Mycobacterium tuberculosis
RRTDRRAYSCWPVP

SEQ ID NO: 142042 - protein, 14 aa, Mycobacterium tuberculosis
RTDRRAYSCWPVPG

SEQ ID NO: 142043 - protein, 14 aa, Mycobacterium tuberculosis
TDRRAYSCWPVPGG

SEQ ID NO: 142044 - protein, 14 aa, Mycobacterium tuberculosis
DRRAYSCWPVPGGD

SEQ ID NO: 142045 - protein, 14 aa, Mycobacterium tuberculosis
RRAYSCWPVPGGDI

SEQ ID NO: 142046 - protein, 14 aa, Mycobacterium tuberculosis
RAYSCWPVPGGDIA

SEQ ID NO: 142047 - protein, 14 aa, Mycobacterium tuberculosis
AYSCWPVPGGDIAL

SEQ ID NO: 142048 - protein, 14 aa, Mycobacterium tuberculosis
YSCWPVPGGDIALM

SEQ ID NO: 142049 - protein, 14 aa, Mycobacterium tuberculosis
SCWPVPGGDIALMA

SEQ ID NO: 142050 - protein, 14 aa, Mycobacterium tuberculosis
CWPVPGGDIALMAA

SEQ ID NO: 142051 - protein, 14 aa, Mycobacterium tuberculosis
WPVPGGDIALMAAR

SEQ ID NO: 142052 - protein, 14 aa, Mycobacterium tuberculosis
PVPGGDIALMAARA

SEQ ID NO: 142053 - protein, 14 aa, Mycobacterium tuberculosis
VPGGDIALMAARAA

SEQ ID NO: 142054 - protein, 14 aa, Mycobacterium tuberculosis
PGGDIALMAARAAR

SEQ ID NO: 142055 - protein, 14 aa, Mycobacterium tuberculosis
GGDIALMAARAARG

SEQ ID NO: 142056 - protein, 14 aa, Mycobacterium tuberculosis
GDIALMAARAARGG

SEQ ID NO: 142057 - protein, 14 aa, Mycobacterium tuberculosis
DIALMAARAARGGV

SEQ ID NO: 142058 - protein, 14 aa, Mycobacterium tuberculosis
IALMAARAARGGVM

SEQ ID NO: 142059 - protein, 14 aa, Mycobacterium tuberculosis
ALMAARAARGGVML

SEQ ID NO: 142060 - protein, 14 aa, Mycobacterium tuberculosis
LMAARAARGGVMLR

SEQ ID NO: 142061 - protein, 14 aa, Mycobacterium tuberculosis
MAARAARGGVMLRQ

SEQ ID NO: 142062 - protein, 14 aa, Mycobacterium tuberculosis
AARAARGGVMLRQV

SEQ ID NO: 142063 - protein, 14 aa, Mycobacterium tuberculosis
ARAARGGVMLRQVS

SEQ ID NO: 142064 - protein, 14 aa, Mycobacterium tuberculosis
RAARGGVMLRQVSA

SEQ ID NO: 142065 - protein, 14 aa, Mycobacterium tuberculosis
AARGGVMLRQVSAL

SEQ ID NO: 142066 - protein, 14 aa, Mycobacterium tuberculosis
ARGGVMLRQVSALD

SEQ ID NO: 142067 - protein, 14 aa, Mycobacterium tuberculosis
RGGVMLRQVSALDR

SEQ ID NO: 142068 - protein, 14 aa, Mycobacterium tuberculosis
GGVMLRQVSALDRM

SEQ ID NO: 142069 - protein, 14 aa, Mycobacterium tuberculosis
GVMLRQVSALDRMK

SEQ ID NO: 142070 - protein, 14 aa, Mycobacterium tuberculosis
VMLRQVSALDRMKA

SEQ ID NO: 142071 - protein, 14 aa, Mycobacterium tuberculosis
MLRQVSALDRMKAI

SEQ ID NO: 142072 - protein, 14 aa, Mycobacterium tuberculosis
LRQVSALDRMKAIV

SEQ ID NO: 142073 - protein, 14 aa, Mycobacterium tuberculosis
RQVSALDRMKAIVA

SEQ ID NO: 142074 - protein, 14 aa, Mycobacterium tuberculosis
QVSALDRMKAIVAQ

SEQ ID NO: 142075 - protein, 14 aa, Mycobacterium tuberculosis
VSALDRMKAIVAQA

SEQ ID NO: 142076 - protein, 14 aa, Mycobacterium tuberculosis
SALDRMKAIVAQAV

SEQ ID NO: 142077 - protein, 14 aa, Mycobacterium tuberculosis
ALDRMKAIVAQAVL

SEQ ID NO: 142078 - protein, 14 aa, Mycobacterium tuberculosis
LDRMKAIVAQAVLD

SEQ ID NO: 142079 - protein, 14 aa, Mycobacterium tuberculosis
DRMKAIVAQAVLDH

SEQ ID NO: 142080 - protein, 14 aa, Mycobacterium tuberculosis
RMKAIVAQAVLDHV

SEQ ID NO: 142081 - protein, 14 aa, Mycobacterium tuberculosis
MKAIVAQAVLDHVT

SEQ ID NO: 142082 - protein, 14 aa, Mycobacterium tuberculosis
KAIVAQAVLDHVTD

SEQ ID NO: 142083 - protein, 14 aa, Mycobacterium tuberculosis
AIVAQAVLDHVTDE

SEQ ID NO: 142084 - protein, 14 aa, Mycobacterium tuberculosis
IVAQAVLDHVTDEE

SEQ ID NO: 142085 - protein, 14 aa, Mycobacterium tuberculosis
VAQAVLDHVTDEEY

SEQ ID NO: 142086 - protein, 14 aa, Mycobacterium tuberculosis
AQAVLDHVTDEEYL

SEQ ID NO: 142087 - protein, 14 aa, Mycobacterium tuberculosis
QAVLDHVTDEEYLR

SEQ ID NO: 142088 - protein, 14 aa, Mycobacterium tuberculosis
AVLDHVTDEEYLRE

SEQ ID NO: 142089 - protein, 14 aa, Mycobacterium tuberculosis
VLDHVTDEEYLREL

SEQ ID NO: 142090 - protein, 14 aa, Mycobacterium tuberculosis
LDHVTDEEYLRELT

SEQ ID NO: 142091 - protein, 14 aa, Mycobacterium tuberculosis
DHVTDEEYLRELTI

SEQ ID NO: 142092 - protein, 14 aa, Mycobacterium tuberculosis
HVTDEEYLRELTIW

SEQ ID NO: 142093 - protein, 14 aa, Mycobacterium tuberculosis
VTDEEYLRELTIWS

SEQ ID NO: 142094 - protein, 14 aa, Mycobacterium tuberculosis
TDEEYLRELTIWSG

SEQ ID NO: 142095 - protein, 14 aa, Mycobacterium tuberculosis
DEEYLRELTIWSGR

SEQ ID NO: 142096 - protein, 14 aa, Mycobacterium tuberculosis
EEYLRELTIWSGRY

SEQ ID NO: 142097 - protein, 14 aa, Mycobacterium tuberculosis
EYLRELTIWSGRYG

SEQ ID NO: 142098 - protein, 14 aa, Mycobacterium tuberculosis
YLRELTIWSGRYGS

SEQ ID NO: 142099 - protein, 14 aa, Mycobacterium tuberculosis
LRELTIWSGRYGSV

SEQ ID NO: 142100 - protein, 14 aa, Mycobacterium tuberculosis
RELTIWSGRYGSVA

SEQ ID NO: 142101 - protein, 14 aa, Mycobacterium tuberculosis
ELTIWSGRYGSVAG

SEQ ID NO: 142102 - protein, 14 aa, Mycobacterium tuberculosis
LTIWSGRYGSVAGV

SEQ ID NO: 142103 - protein, 14 aa, Mycobacterium tuberculosis
TIWSGRYGSVAGVP

SEQ ID NO: 142104 - protein, 14 aa, Mycobacterium tuberculosis
IWSGRYGSVAGVPA

SEQ ID NO: 142105 - protein, 14 aa, Mycobacterium tuberculosis
WSGRYGSVAGVPAR

SEQ ID NO: 142106 - protein, 14 aa, Mycobacterium tuberculosis
SGRYGSVAGVPARN

SEQ ID NO: 142107 - protein, 14 aa, Mycobacterium tuberculosis
GRYGSVAGVPARNE

SEQ ID NO: 142108 - protein, 14 aa, Mycobacterium tuberculosis
RYGSVAGVPARNEP

SEQ ID NO: 142109 - protein, 14 aa, Mycobacterium tuberculosis
YGSVAGVPARNEPP

SEQ ID NO: 142110 - protein, 14 aa, Mycobacterium tuberculosis
GSVAGVPARNEPPS

SEQ ID NO: 142111 - protein, 14 aa, Mycobacterium tuberculosis
SVAGVPARNEPPSD

SEQ ID NO: 142112 - protein, 14 aa, Mycobacterium tuberculosis
VAGVPARNEPPSDP

SEQ ID NO: 142113 - protein, 14 aa, Mycobacterium tuberculosis
AGVPARNEPPSDPS

SEQ ID NO: 142114 - protein, 14 aa, Mycobacterium tuberculosis
GVPARNEPPSDPSA

SEQ ID NO: 142115 - protein, 14 aa, Mycobacterium tuberculosis
VPARNEPPSDPSAP

SEQ ID NO: 142116 - protein, 14 aa, Mycobacterium tuberculosis
PARNEPPSDPSAPI

SEQ ID NO: 142117 - protein, 14 aa, Mycobacterium tuberculosis
ARNEPPSDPSAPIP

SEQ ID NO: 142118 - protein, 14 aa, Mycobacterium tuberculosis
RNEPPSDPSAPIPG

SEQ ID NO: 142119 - protein, 14 aa, Mycobacterium tuberculosis
NEPPSDPSAPIPGR

SEQ ID NO: 142120 - protein, 14 aa, Mycobacterium tuberculosis
EPPSDPSAPIPGRL

SEQ ID NO: 142121 - protein, 14 aa, Mycobacterium tuberculosis
PPSDPSAPIPGRLF

SEQ ID NO: 142122 - protein, 14 aa, Mycobacterium tuberculosis
PSDPSAPIPGRLFA

SEQ ID NO: 142123 - protein, 14 aa, Mycobacterium tuberculosis
SDPSAPIPGRLFAG

SEQ ID NO: 142124 - protein, 14 aa, Mycobacterium tuberculosis
DPSAPIPGRLFAGP

SEQ ID NO: 142125 - protein, 14 aa, Mycobacterium tuberculosis
PSAPIPGRLFAGPG

SEQ ID NO: 142126 - protein, 14 aa, Mycobacterium tuberculosis
SAPIPGRLFAGPGL

SEQ ID NO: 142127 - protein, 14 aa, Mycobacterium tuberculosis
APIPGRLFAGPGLS

SEQ ID NO: 142128 - protein, 14 aa, Mycobacterium tuberculosis
PIPGRLFAGPGLSQ

SEQ ID NO: 142129 - protein, 14 aa, Mycobacterium tuberculosis
IPGRLFAGPGLSQP

SEQ ID NO: 142130 - protein, 14 aa, Mycobacterium tuberculosis
PGRLFAGPGLSQPS

SEQ ID NO: 142131 - protein, 14 aa, Mycobacterium tuberculosis
GRLFAGPGLSQPSD

SEQ ID NO: 142132 - protein, 14 aa, Mycobacterium tuberculosis
RLFAGPGLSQPSDV

SEQ ID NO: 142133 - protein, 14 aa, Mycobacterium tuberculosis
LFAGPGLSQPSDVL

SEQ ID NO: 142134 - protein, 14 aa, Mycobacterium tuberculosis
FAGPGLSQPSDVLP

SEQ ID NO: 142135 - protein, 14 aa, Mycobacterium tuberculosis
AGPGLSQPSDVLPA

SEQ ID NO: 142136 - protein, 14 aa, Mycobacterium tuberculosis
GPGLSQPSDVLPAD

SEQ ID NO: 142137 - protein, 14 aa, Mycobacterium tuberculosis
PGLSQPSDVLPADD

SEQ ID NO: 142138 - protein, 14 aa, Mycobacterium tuberculosis
GLSQPSDVLPADDG

SEQ ID NO: 142139 - protein, 14 aa, Mycobacterium tuberculosis
LSQPSDVLPADDGA

SEQ ID NO: 142140 - protein, 14 aa, Mycobacterium tuberculosis
SQPSDVLPADDGAA

SEQ ID NO: 142141 - protein, 14 aa, Mycobacterium tuberculosis
QPSDVLPADDGAAI

SEQ ID NO: 142142 - protein, 14 aa, Mycobacterium tuberculosis
PSDVLPADDGAAIL

SEQ ID NO: 142143 - protein, 14 aa, Mycobacterium tuberculosis
SDVLPADDGAAILA

SEQ ID NO: 142144 - protein, 14 aa, Mycobacterium tuberculosis
DVLPADDGAAILAL

SEQ ID NO: 142145 - protein, 14 aa, Mycobacterium tuberculosis
VLPADDGAAILALG

SEQ ID NO: 142146 - protein, 14 aa, Mycobacterium tuberculosis
LPADDGAAILALGT

SEQ ID NO: 142147 - protein, 14 aa, Mycobacterium tuberculosis
PADDGAAILALGTE

SEQ ID NO: 142148 - protein, 14 aa, Mycobacterium tuberculosis
ADDGAAILALGTET

SEQ ID NO: 142149 - protein, 14 aa, Mycobacterium tuberculosis
DDGAAILALGTETD

SEQ ID NO: 142150 - protein, 14 aa, Mycobacterium tuberculosis
DGAAILALGTETDD

SEQ ID NO: 142151 - protein, 14 aa, Mycobacterium tuberculosis
GAAILALGTETDDR

SEQ ID NO: 142152 - protein, 14 aa, Mycobacterium tuberculosis
AAILALGTETDDRL

SEQ ID NO: 142153 - protein, 14 aa, Mycobacterium tuberculosis
AILALGTETDDRLA

SEQ ID NO: 142154 - protein, 14 aa, Mycobacterium tuberculosis
ILALGTETDDRLAR

SEQ ID NO: 142155 - protein, 14 aa, Mycobacterium tuberculosis
LALGTETDDRLARL

SEQ ID NO: 142156 - protein, 14 aa, Mycobacterium tuberculosis
ALGTETDDRLARLR

SEQ ID NO: 142157 - protein, 14 aa, Mycobacterium tuberculosis
LGTETDDRLARLRA

SEQ ID NO: 142158 - protein, 14 aa, Mycobacterium tuberculosis
GTETDDRLARLRAG

SEQ ID NO: 142159 - protein, 14 aa, Mycobacterium tuberculosis
TETDDRLARLRAGE

SEQ ID NO: 142160 - protein, 14 aa, Mycobacterium tuberculosis
ETDDRLARLRAGEA

SEQ ID NO: 142161 - protein, 14 aa, Mycobacterium tuberculosis
TDDRLARLRAGEAA

SEQ ID NO: 142162 - protein, 14 aa, Mycobacterium tuberculosis
DDRLARLRAGEAAS

SEQ ID NO: 142163 - protein, 14 aa, Mycobacterium tuberculosis
DRLARLRAGEAASI

SEQ ID NO: 142164 - protein, 14 aa, Mycobacterium tuberculosis
RLARLRAGEAASIV

SEQ ID NO: 142165 - protein, 14 aa, Mycobacterium tuberculosis
LARLRAGEAASIVL

SEQ ID NO: 142166 - protein, 14 aa, Mycobacterium tuberculosis
ARLRAGEAASIVLL

SEQ ID NO: 142167 - protein, 14 aa, Mycobacterium tuberculosis
RLRAGEAASIVLLT

SEQ ID NO: 142168 - protein, 14 aa, Mycobacterium tuberculosis
LRAGEAASIVLLTA

SEQ ID NO: 142169 - protein, 14 aa, Mycobacterium tuberculosis
RAGEAASIVLLTAT

SEQ ID NO: 142170 - protein, 14 aa, Mycobacterium tuberculosis
AGEAASIVLLTATA

SEQ ID NO: 142171 - protein, 14 aa, Mycobacterium tuberculosis
GEAASIVLLTATAM

SEQ ID NO: 142172 - protein, 14 aa, Mycobacterium tuberculosis
EAASIVLLTATAMG

SEQ ID NO: 142173 - protein, 14 aa, Mycobacterium tuberculosis
AASIVLLTATAMGL

SEQ ID NO: 142174 - protein, 14 aa, Mycobacterium tuberculosis
ASIVLLTATAMGLA

SEQ ID NO: 142175 - protein, 14 aa, Mycobacterium tuberculosis
SIVLLTATAMGLAC

SEQ ID NO: 142176 - protein, 14 aa, Mycobacterium tuberculosis
IVLLTATAMGLACC

SEQ ID NO: 142177 - protein, 14 aa, Mycobacterium tuberculosis
VLLTATAMGLACCP

SEQ ID NO: 142178 - protein, 14 aa, Mycobacterium tuberculosis
LLTATAMGLACCPI

SEQ ID NO: 142179 - protein, 14 aa, Mycobacterium tuberculosis
LTATAMGLACCPIT

SEQ ID NO: 142180 - protein, 14 aa, Mycobacterium tuberculosis
TATAMGLACCPITE

SEQ ID NO: 142181 - protein, 14 aa, Mycobacterium tuberculosis
ATAMGLACCPITEP

SEQ ID NO: 142182 - protein, 14 aa, Mycobacterium tuberculosis
TAMGLACCPITEPL

SEQ ID NO: 142183 - protein, 14 aa, Mycobacterium tuberculosis
AMGLACCPITEPLE

SEQ ID NO: 142184 - protein, 14 aa, Mycobacterium tuberculosis
MGLACCPITEPLEI

SEQ ID NO: 142185 - protein, 14 aa, Mycobacterium tuberculosis
GLACCPITEPLEIA

SEQ ID NO: 142186 - protein, 14 aa, Mycobacterium tuberculosis
LACCPITEPLEIAK

SEQ ID NO: 142187 - protein, 14 aa, Mycobacterium tuberculosis
ACCPITEPLEIAKT

SEQ ID NO: 142188 - protein, 14 aa, Mycobacterium tuberculosis
CCPITEPLEIAKTR

SEQ ID NO: 142189 - protein, 14 aa, Mycobacterium tuberculosis
CPITEPLEIAKTRD

SEQ ID NO: 142190 - protein, 14 aa, Mycobacterium tuberculosis
PITEPLEIAKTRDA

SEQ ID NO: 142191 - protein, 14 aa, Mycobacterium tuberculosis
ITEPLEIAKTRDAV

SEQ ID NO: 142192 - protein, 14 aa, Mycobacterium tuberculosis
TEPLEIAKTRDAVR

SEQ ID NO: 142193 - protein, 14 aa, Mycobacterium tuberculosis
EPLEIAKTRDAVRA

SEQ ID NO: 142194 - protein, 14 aa, Mycobacterium tuberculosis
PLEIAKTRDAVRAE

SEQ ID NO: 142195 - protein, 14 aa, Mycobacterium tuberculosis
LEIAKTRDAVRAEV

SEQ ID NO: 142196 - protein, 14 aa, Mycobacterium tuberculosis
EIAKTRDAVRAEVF

SEQ ID NO: 142197 - protein, 14 aa, Mycobacterium tuberculosis
IAKTRDAVRAEVFG

SEQ ID NO: 142198 - protein, 14 aa, Mycobacterium tuberculosis
AKTRDAVRAEVFGA

SEQ ID NO: 142199 - protein, 14 aa, Mycobacterium tuberculosis
KTRDAVRAEVFGAG

SEQ ID NO: 142200 - protein, 14 aa, Mycobacterium tuberculosis
TRDAVRAEVFGAGG

SEQ ID NO: 142201 - protein, 14 aa, Mycobacterium tuberculosis
RDAVRAEVFGAGGY

SEQ ID NO: 142202 - protein, 14 aa, Mycobacterium tuberculosis
DAVRAEVFGAGGYP

SEQ ID NO: 142203 - protein, 14 aa, Mycobacterium tuberculosis
AVRAEVFGAGGYPQ

SEQ ID NO: 142204 - protein, 14 aa, Mycobacterium tuberculosis
VRAEVFGAGGYPQM

SEQ ID NO: 142205 - protein, 14 aa, Mycobacterium tuberculosis
RAEVFGAGGYPQML

SEQ ID NO: 142206 - protein, 14 aa, Mycobacterium tuberculosis
AEVFGAGGYPQMLL

SEQ ID NO: 142207 - protein, 14 aa, Mycobacterium tuberculosis
EVFGAGGYPQMLLR

SEQ ID NO: 142208 - protein, 14 aa, Mycobacterium tuberculosis
VFGAGGYPQMLLRV

SEQ ID NO: 142209 - protein, 14 aa, Mycobacterium tuberculosis
FGAGGYPQMLLRVG

SEQ ID NO: 142210 - protein, 14 aa, Mycobacterium tuberculosis
GAGGYPQMLLRVGW

SEQ ID NO: 142211 - protein, 14 aa, Mycobacterium tuberculosis
AGGYPQMLLRVGWA

SEQ ID NO: 142212 - protein, 14 aa, Mycobacterium tuberculosis
GGYPQMLLRVGWAP

SEQ ID NO: 142213 - protein, 14 aa, Mycobacterium tuberculosis
GYPQMLLRVGWAPI

SEQ ID NO: 142214 - protein, 14 aa, Mycobacterium tuberculosis
YPQMLLRVGWAPIN

SEQ ID NO: 142215 - protein, 14 aa, Mycobacterium tuberculosis
PQMLLRVGWAPINA

SEQ ID NO: 142216 - protein, 14 aa, Mycobacterium tuberculosis
QMLLRVGWAPINAD

SEQ ID NO: 142217 - protein, 14 aa, Mycobacterium tuberculosis
MLLRVGWAPINADP

SEQ ID NO: 142218 - protein, 14 aa, Mycobacterium tuberculosis
LLRVGWAPINADPL

SEQ ID NO: 142219 - protein, 14 aa, Mycobacterium tuberculosis
LRVGWAPINADPLP

SEQ ID NO: 142220 - protein, 14 aa, Mycobacterium tuberculosis
RVGWAPINADPLPP

SEQ ID NO: 142221 - protein, 14 aa, Mycobacterium tuberculosis
VGWAPINADPLPPT

SEQ ID NO: 142222 - protein, 14 aa, Mycobacterium tuberculosis
GWAPINADPLPPTP

SEQ ID NO: 142223 - protein, 14 aa, Mycobacterium tuberculosis
WAPINADPLPPTPR

SEQ ID NO: 142224 - protein, 14 aa, Mycobacterium tuberculosis
APINADPLPPTPRR

SEQ ID NO: 142225 - protein, 14 aa, Mycobacterium tuberculosis
PINADPLPPTPRRE

SEQ ID NO: 142226 - protein, 14 aa, Mycobacterium tuberculosis
INADPLPPTPRREL

SEQ ID NO: 142227 - protein, 14 aa, Mycobacterium tuberculosis
NADPLPPTPRRELS

SEQ ID NO: 142228 - protein, 14 aa, Mycobacterium tuberculosis
ADPLPPTPRRELSQ

SEQ ID NO: 142229 - protein, 14 aa, Mycobacterium tuberculosis
DPLPPTPRRELSQV

SEQ ID NO: 142230 - protein, 14 aa, Mycobacterium tuberculosis
PLPPTPRRELSQVV

SEQ ID NO: 142231 - protein, 14 aa, Mycobacterium tuberculosis
LPPTPRRELSQVVE

SEQ ID NO: 142232 - protein, 14 aa, Mycobacterium tuberculosis
PPTPRRELSQVVEW

SEQ ID NO: 142233 - protein, 14 aa, Mycobacterium tuberculosis
PTPRRELSQVVEWP

SEQ ID NO: 142234 - protein, 14 aa, Mycobacterium tuberculosis
TPRRELSQVVEWPE

SEQ ID NO: 142235 - protein, 14 aa, Mycobacterium tuberculosis
PRRELSQVVEWPEE

SEQ ID NO: 142236 - protein, 14 aa, Mycobacterium tuberculosis
RRELSQVVEWPEEL

SEQ ID NO: 142237 - protein, 14 aa, Mycobacterium tuberculosis
RELSQVVEWPEELL

SEQ ID NO: 142238 - protein, 14 aa, Mycobacterium tuberculosis
ELSQVVEWPEELLR

SEQ ID NO: 142239 - protein, 14 aa, Mycobacterium tuberculosis
LSQVVEWPEELLRQ

SEQ ID NO: 142240 - protein, 14 aa, Mycobacterium tuberculosis
SQVVEWPEELLRQR

SEQ ID NO: 142241 - protein, 14 aa, Mycobacterium tuberculosis
QVVEWPEELLRQRC

SEQ ID NO: 142242 - protein, 15 aa, Mycobacterium tuberculosis
MNTHFPDAETVRTVL

SEQ ID NO: 142243 - protein, 15 aa, Mycobacterium tuberculosis
NTHFPDAETVRTVLT

SEQ ID NO: 142244 - protein, 15 aa, Mycobacterium tuberculosis
THFPDAETVRTVLTL

SEQ ID NO: 142245 - protein, 15 aa, Mycobacterium tuberculosis
HFPDAETVRTVLTLA

SEQ ID NO: 142246 - protein, 15 aa, Mycobacterium tuberculosis
FPDAETVRTVLTLAV

SEQ ID NO: 142247 - protein, 15 aa, Mycobacterium tuberculosis
PDAETVRTVLTLAVR

SEQ ID NO: 142248 - protein, 15 aa, Mycobacterium tuberculosis
DAETVRTVLTLAVRA

SEQ ID NO: 142249 - protein, 15 aa, Mycobacterium tuberculosis
AETVRTVLTLAVRAP

SEQ ID NO: 142250 - protein, 15 aa, Mycobacterium tuberculosis
ETVRTVLTLAVRAPS

SEQ ID NO: 142251 - protein, 15 aa, Mycobacterium tuberculosis
TVRTVLTLAVRAPSI

SEQ ID NO: 142252 - protein, 15 aa, Mycobacterium tuberculosis
VRTVLTLAVRAPSIH

SEQ ID NO: 142253 - protein, 15 aa, Mycobacterium tuberculosis
RTVLTLAVRAPSIHN

SEQ ID NO: 142254 - protein, 15 aa, Mycobacterium tuberculosis
TVLTLAVRAPSIHNT

SEQ ID NO: 142255 - protein, 15 aa, Mycobacterium tuberculosis
VLTLAVRAPSIHNTQ

SEQ ID NO: 142256 - protein, 15 aa, Mycobacterium tuberculosis
LTLAVRAPSIHNTQP

SEQ ID NO: 142257 - protein, 15 aa, Mycobacterium tuberculosis
TLAVRAPSIHNTQPW

SEQ ID NO: 142258 - protein, 15 aa, Mycobacterium tuberculosis
LAVRAPSIHNTQPWR

SEQ ID NO: 142259 - protein, 15 aa, Mycobacterium tuberculosis
AVRAPSIHNTQPWRW

SEQ ID NO: 142260 - protein, 15 aa, Mycobacterium tuberculosis
VRAPSIHNTQPWRWR

SEQ ID NO: 142261 - protein, 15 aa, Mycobacterium tuberculosis
RAPSIHNTQPWRWRV

SEQ ID NO: 142262 - protein, 15 aa, Mycobacterium tuberculosis
APSIHNTQPWRWRVC

SEQ ID NO: 142263 - protein, 15 aa, Mycobacterium tuberculosis
PSIHNTQPWRWRVCP

SEQ ID NO: 142264 - protein, 15 aa, Mycobacterium tuberculosis
SIHNTQPWRWRVCPT

SEQ ID NO: 142265 - protein, 15 aa, Mycobacterium tuberculosis
IHNTQPWRWRVCPTS

SEQ ID NO: 142266 - protein, 15 aa, Mycobacterium tuberculosis
HNTQPWRWRVCPTSL

SEQ ID NO: 142267 - protein, 15 aa, Mycobacterium tuberculosis
NTQPWRWRVCPTSLE

SEQ ID NO: 142268 - protein, 15 aa, Mycobacterium tuberculosis
TQPWRWRVCPTSLEL

SEQ ID NO: 142269 - protein, 15 aa, Mycobacterium tuberculosis
QPWRWRVCPTSLELF

SEQ ID NO: 142270 - protein, 15 aa, Mycobacterium tuberculosis
PWRWRVCPTSLELFS

SEQ ID NO: 142271 - protein, 15 aa, Mycobacterium tuberculosis
WRWRVCPTSLELFSR

SEQ ID NO: 142272 - protein, 15 aa, Mycobacterium tuberculosis
RWRVCPTSLELFSRP

SEQ ID NO: 142273 - protein, 15 aa, Mycobacterium tuberculosis
WRVCPTSLELFSRPD

SEQ ID NO: 142274 - protein, 15 aa, Mycobacterium tuberculosis
RVCPTSLELFSRPDM

SEQ ID NO: 142275 - protein, 15 aa, Mycobacterium tuberculosis
VCPTSLELFSRPDMQ

SEQ ID NO: 142276 - protein, 15 aa, Mycobacterium tuberculosis
CPTSLELFSRPDMQL

SEQ ID NO: 142277 - protein, 15 aa, Mycobacterium tuberculosis
PTSLELFSRPDMQLR

SEQ ID NO: 142278 - protein, 15 aa, Mycobacterium tuberculosis
TSLELFSRPDMQLRS

SEQ ID NO: 142279 - protein, 15 aa, Mycobacterium tuberculosis
SLELFSRPDMQLRST

SEQ ID NO: 142280 - protein, 15 aa, Mycobacterium tuberculosis
LELFSRPDMQLRSTD

SEQ ID NO: 142281 - protein, 15 aa, Mycobacterium tuberculosis
ELFSRPDMQLRSTDP

SEQ ID NO: 142282 - protein, 15 aa, Mycobacterium tuberculosis
LFSRPDMQLRSTDPD

SEQ ID NO: 142283 - protein, 15 aa, Mycobacterium tuberculosis
FSRPDMQLRSTDPDG

SEQ ID NO: 142284 - protein, 15 aa, Mycobacterium tuberculosis
SRPDMQLRSTDPDGR

SEQ ID NO: 142285 - protein, 15 aa, Mycobacterium tuberculosis
RPDMQLRSTDPDGRE

SEQ ID NO: 142286 - protein, 15 aa, Mycobacterium tuberculosis
PDMQLRSTDPDGREL

SEQ ID NO: 142287 - protein, 15 aa, Mycobacterium tuberculosis
DMQLRSTDPDGRELI

SEQ ID NO: 142288 - protein, 15 aa, Mycobacterium tuberculosis
MQLRSTDPDGRELIL

SEQ ID NO: 142289 - protein, 15 aa, Mycobacterium tuberculosis
QLRSTDPDGRELILS

SEQ ID NO: 142290 - protein, 15 aa, Mycobacterium tuberculosis
LRSTDPDGRELILSC

SEQ ID NO: 142291 - protein, 15 aa, Mycobacterium tuberculosis
RSTDPDGRELILSCG

SEQ ID NO: 142292 - protein, 15 aa, Mycobacterium tuberculosis
STDPDGRELILSCGV

SEQ ID NO: 142293 - protein, 15 aa, Mycobacterium tuberculosis
TDPDGRELILSCGVA

SEQ ID NO: 142294 - protein, 15 aa, Mycobacterium tuberculosis
DPDGRELILSCGVAL

SEQ ID NO: 142295 - protein, 15 aa, Mycobacterium tuberculosis
PDGRELILSCGVALH

SEQ ID NO: 142296 - protein, 15 aa, Mycobacterium tuberculosis
DGRELILSCGVALHH

SEQ ID NO: 142297 - protein, 15 aa, Mycobacterium tuberculosis
GRELILSCGVALHHC

SEQ ID NO: 142298 - protein, 15 aa, Mycobacterium tuberculosis
RELILSCGVALHHCV

SEQ ID NO: 142299 - protein, 15 aa, Mycobacterium tuberculosis
ELILSCGVALHHCVV

SEQ ID NO: 142300 - protein, 15 aa, Mycobacterium tuberculosis
LILSCGVALHHCVVA

SEQ ID NO: 142301 - protein, 15 aa, Mycobacterium tuberculosis
ILSCGVALHHCVVAL

SEQ ID NO: 142302 - protein, 15 aa, Mycobacterium tuberculosis
LSCGVALHHCVVALA

SEQ ID NO: 142303 - protein, 15 aa, Mycobacterium tuberculosis
SCGVALHHCVVALAS

SEQ ID NO: 142304 - protein, 15 aa, Mycobacterium tuberculosis
CGVALHHCVVALASL

SEQ ID NO: 142305 - protein, 15 aa, Mycobacterium tuberculosis
GVALHHCVVALASLG

SEQ ID NO: 142306 - protein, 15 aa, Mycobacterium tuberculosis
VALHHCVVALASLGW

SEQ ID NO: 142307 - protein, 15 aa, Mycobacterium tuberculosis
ALHHCVVALASLGWQ

SEQ ID NO: 142308 - protein, 15 aa, Mycobacterium tuberculosis
LHHCVVALASLGWQA

SEQ ID NO: 142309 - protein, 15 aa, Mycobacterium tuberculosis
HHCVVALASLGWQAK

SEQ ID NO: 142310 - protein, 15 aa, Mycobacterium tuberculosis
HCVVALASLGWQAKV

SEQ ID NO: 142311 - protein, 15 aa, Mycobacterium tuberculosis
CVVALASLGWQAKVN

SEQ ID NO: 142312 - protein, 15 aa, Mycobacterium tuberculosis
VVALASLGWQAKVNR

SEQ ID NO: 142313 - protein, 15 aa, Mycobacterium tuberculosis
VALASLGWQAKVNRF

SEQ ID NO: 142314 - protein, 15 aa, Mycobacterium tuberculosis
ALASLGWQAKVNRFP

SEQ ID NO: 142315 - protein, 15 aa, Mycobacterium tuberculosis
LASLGWQAKVNRFPD

SEQ ID NO: 142316 - protein, 15 aa, Mycobacterium tuberculosis
ASLGWQAKVNRFPDP

SEQ ID NO: 142317 - protein, 15 aa, Mycobacterium tuberculosis
SLGWQAKVNRFPDPK

SEQ ID NO: 142318 - protein, 15 aa, Mycobacterium tuberculosis
LGWQAKVNRFPDPKD

SEQ ID NO: 142319 - protein, 15 aa, Mycobacterium tuberculosis
GWQAKVNRFPDPKDR

SEQ ID NO: 142320 - protein, 15 aa, Mycobacterium tuberculosis
WQAKVNRFPDPKDRC

SEQ ID NO: 142321 - protein, 15 aa, Mycobacterium tuberculosis
QAKVNRFPDPKDRCH

SEQ ID NO: 142322 - protein, 15 aa, Mycobacterium tuberculosis
AKVNRFPDPKDRCHL

SEQ ID NO: 142323 - protein, 15 aa, Mycobacterium tuberculosis
KVNRFPDPKDRCHLA

SEQ ID NO: 142324 - protein, 15 aa, Mycobacterium tuberculosis
VNRFPDPKDRCHLAT

SEQ ID NO: 142325 - protein, 15 aa, Mycobacterium tuberculosis
NRFPDPKDRCHLATI

SEQ ID NO: 142326 - protein, 15 aa, Mycobacterium tuberculosis
RFPDPKDRCHLATIG

SEQ ID NO: 142327 - protein, 15 aa, Mycobacterium tuberculosis
FPDPKDRCHLATIGV

SEQ ID NO: 142328 - protein, 15 aa, Mycobacterium tuberculosis
PDPKDRCHLATIGVQ

SEQ ID NO: 142329 - protein, 15 aa, Mycobacterium tuberculosis
DPKDRCHLATIGVQP

SEQ ID NO: 142330 - protein, 15 aa, Mycobacterium tuberculosis
PKDRCHLATIGVQPL

SEQ ID NO: 142331 - protein, 15 aa, Mycobacterium tuberculosis
KDRCHLATIGVQPLV

SEQ ID NO: 142332 - protein, 15 aa, Mycobacterium tuberculosis
DRCHLATIGVQPLVP

SEQ ID NO: 142333 - protein, 15 aa, Mycobacterium tuberculosis
RCHLATIGVQPLVPD

SEQ ID NO: 142334 - protein, 15 aa, Mycobacterium tuberculosis
CHLATIGVQPLVPDQ

SEQ ID NO: 142335 - protein, 15 aa, Mycobacterium tuberculosis
HLATIGVQPLVPDQA

SEQ ID NO: 142336 - protein, 15 aa, Mycobacterium tuberculosis
LATIGVQPLVPDQAD

SEQ ID NO: 142337 - protein, 15 aa, Mycobacterium tuberculosis
ATIGVQPLVPDQADV

SEQ ID NO: 142338 - protein, 15 aa, Mycobacterium tuberculosis
TIGVQPLVPDQADVA

SEQ ID NO: 142339 - protein, 15 aa, Mycobacterium tuberculosis
IGVQPLVPDQADVAL

SEQ ID NO: 142340 - protein, 15 aa, Mycobacterium tuberculosis
GVQPLVPDQADVALA

SEQ ID NO: 142341 - protein, 15 aa, Mycobacterium tuberculosis
VQPLVPDQADVALAA

SEQ ID NO: 142342 - protein, 15 aa, Mycobacterium tuberculosis
QPLVPDQADVALAAA

SEQ ID NO: 142343 - protein, 15 aa, Mycobacterium tuberculosis
PLVPDQADVALAAAI

SEQ ID NO: 142344 - protein, 15 aa, Mycobacterium tuberculosis
LVPDQADVALAAAIP

SEQ ID NO: 142345 - protein, 15 aa, Mycobacterium tuberculosis
VPDQADVALAAAIPR

SEQ ID NO: 142346 - protein, 15 aa, Mycobacterium tuberculosis
PDQADVALAAAIPRR

SEQ ID NO: 142347 - protein, 15 aa, Mycobacterium tuberculosis
DQADVALAAAIPRRR

SEQ ID NO: 142348 - protein, 15 aa, Mycobacterium tuberculosis
QADVALAAAIPRRRT

SEQ ID NO: 142349 - protein, 15 aa, Mycobacterium tuberculosis
ADVALAAAIPRRRTD

SEQ ID NO: 142350 - protein, 15 aa, Mycobacterium tuberculosis
DVALAAAIPRRRTDR

SEQ ID NO: 142351 - protein, 15 aa, Mycobacterium tuberculosis
VALAAAIPRRRTDRR

SEQ ID NO: 142352 - protein, 15 aa, Mycobacterium tuberculosis
ALAAAIPRRRTDRRA

SEQ ID NO: 142353 - protein, 15 aa, Mycobacterium tuberculosis
LAAAIPRRRTDRRAY

SEQ ID NO: 142354 - protein, 15 aa, Mycobacterium tuberculosis
AAAIPRRRTDRRAYS

SEQ ID NO: 142355 - protein, 15 aa, Mycobacterium tuberculosis
AAIPRRRTDRRAYSC

SEQ ID NO: 142356 - protein, 15 aa, Mycobacterium tuberculosis
AIPRRRTDRRAYSCW

SEQ ID NO: 142357 - protein, 15 aa, Mycobacterium tuberculosis
IPRRRTDRRAYSCWP

SEQ ID NO: 142358 - protein, 15 aa, Mycobacterium tuberculosis
PRRRTDRRAYSCWPV

SEQ ID NO: 142359 - protein, 15 aa, Mycobacterium tuberculosis
RRRTDRRAYSCWPVP

SEQ ID NO: 142360 - protein, 15 aa, Mycobacterium tuberculosis
RRTDRRAYSCWPVPG

SEQ ID NO: 142361 - protein, 15 aa, Mycobacterium tuberculosis
RTDRRAYSCWPVPGG

SEQ ID NO: 142362 - protein, 15 aa, Mycobacterium tuberculosis
TDRRAYSCWPVPGGD

SEQ ID NO: 142363 - protein, 15 aa, Mycobacterium tuberculosis
DRRAYSCWPVPGGDI

SEQ ID NO: 142364 - protein, 15 aa, Mycobacterium tuberculosis
RRAYSCWPVPGGDIA

SEQ ID NO: 142365 - protein, 15 aa, Mycobacterium tuberculosis
RAYSCWPVPGGDIAL

SEQ ID NO: 142366 - protein, 15 aa, Mycobacterium tuberculosis
AYSCWPVPGGDIALM

SEQ ID NO: 142367 - protein, 15 aa, Mycobacterium tuberculosis
YSCWPVPGGDIALMA

SEQ ID NO: 142368 - protein, 15 aa, Mycobacterium tuberculosis
SCWPVPGGDIALMAA

SEQ ID NO: 142369 - protein, 15 aa, Mycobacterium tuberculosis
CWPVPGGDIALMAAR

SEQ ID NO: 142370 - protein, 15 aa, Mycobacterium tuberculosis
WPVPGGDIALMAARA

SEQ ID NO: 142371 - protein, 15 aa, Mycobacterium tuberculosis
PVPGGDIALMAARAA

SEQ ID NO: 142372 - protein, 15 aa, Mycobacterium tuberculosis
VPGGDIALMAARAAR

SEQ ID NO: 142373 - protein, 15 aa, Mycobacterium tuberculosis
PGGDIALMAARAARG

SEQ ID NO: 142374 - protein, 15 aa, Mycobacterium tuberculosis
GGDIALMAARAARGG

SEQ ID NO: 142375 - protein, 15 aa, Mycobacterium tuberculosis
GDIALMAARAARGGV

SEQ ID NO: 142376 - protein, 15 aa, Mycobacterium tuberculosis
DIALMAARAARGGVM

SEQ ID NO: 142377 - protein, 15 aa, Mycobacterium tuberculosis
IALMAARAARGGVML

SEQ ID NO: 142378 - protein, 15 aa, Mycobacterium tuberculosis
ALMAARAARGGVMLR

SEQ ID NO: 142379 - protein, 15 aa, Mycobacterium tuberculosis
LMAARAARGGVMLRQ

SEQ ID NO: 142380 - protein, 15 aa, Mycobacterium tuberculosis
MAARAARGGVMLRQV

SEQ ID NO: 142381 - protein, 15 aa, Mycobacterium tuberculosis
AARAARGGVMLRQVS

SEQ ID NO: 142382 - protein, 15 aa, Mycobacterium tuberculosis
ARAARGGVMLRQVSA

SEQ ID NO: 142383 - protein, 15 aa, Mycobacterium tuberculosis
RAARGGVMLRQVSAL

SEQ ID NO: 142384 - protein, 15 aa, Mycobacterium tuberculosis
AARGGVMLRQVSALD

SEQ ID NO: 142385 - protein, 15 aa, Mycobacterium tuberculosis
ARGGVMLRQVSALDR

SEQ ID NO: 142386 - protein, 15 aa, Mycobacterium tuberculosis
RGGVMLRQVSALDRM

SEQ ID NO: 142387 - protein, 15 aa, Mycobacterium tuberculosis
GGVMLRQVSALDRMK

SEQ ID NO: 142388 - protein, 15 aa, Mycobacterium tuberculosis
GVMLRQVSALDRMKA

SEQ ID NO: 142389 - protein, 15 aa, Mycobacterium tuberculosis
VMLRQVSALDRMKAI

SEQ ID NO: 142390 - protein, 15 aa, Mycobacterium tuberculosis
MLRQVSALDRMKAIV

SEQ ID NO: 142391 - protein, 15 aa, Mycobacterium tuberculosis
LRQVSALDRMKAIVA

SEQ ID NO: 142392 - protein, 15 aa, Mycobacterium tuberculosis
RQVSALDRMKAIVAQ

SEQ ID NO: 142393 - protein, 15 aa, Mycobacterium tuberculosis
QVSALDRMKAIVAQA

SEQ ID NO: 142394 - protein, 15 aa, Mycobacterium tuberculosis
VSALDRMKAIVAQAV

SEQ ID NO: 142395 - protein, 15 aa, Mycobacterium tuberculosis
SALDRMKAIVAQAVL

SEQ ID NO: 142396 - protein, 15 aa, Mycobacterium tuberculosis
ALDRMKAIVAQAVLD

SEQ ID NO: 142397 - protein, 15 aa, Mycobacterium tuberculosis
LDRMKAIVAQAVLDH

SEQ ID NO: 142398 - protein, 15 aa, Mycobacterium tuberculosis
DRMKAIVAQAVLDHV

SEQ ID NO: 142399 - protein, 15 aa, Mycobacterium tuberculosis
RMKAIVAQAVLDHVT

SEQ ID NO: 142400 - protein, 15 aa, Mycobacterium tuberculosis
MKAIVAQAVLDHVTD

SEQ ID NO: 142401 - protein, 15 aa, Mycobacterium tuberculosis
KAIVAQAVLDHVTDE

SEQ ID NO: 142402 - protein, 15 aa, Mycobacterium tuberculosis
AIVAQAVLDHVTDEE

SEQ ID NO: 142403 - protein, 15 aa, Mycobacterium tuberculosis
IVAQAVLDHVTDEEY

SEQ ID NO: 142404 - protein, 15 aa, Mycobacterium tuberculosis
VAQAVLDHVTDEEYL

SEQ ID NO: 142405 - protein, 15 aa, Mycobacterium tuberculosis
AQAVLDHVTDEEYLR

SEQ ID NO: 142406 - protein, 15 aa, Mycobacterium tuberculosis
QAVLDHVTDEEYLRE

SEQ ID NO: 142407 - protein, 15 aa, Mycobacterium tuberculosis
AVLDHVTDEEYLREL

SEQ ID NO: 142408 - protein, 15 aa, Mycobacterium tuberculosis
VLDHVTDEEYLRELT

SEQ ID NO: 142409 - protein, 15 aa, Mycobacterium tuberculosis
LDHVTDEEYLRELTI

SEQ ID NO: 142410 - protein, 15 aa, Mycobacterium tuberculosis
DHVTDEEYLRELTIW

SEQ ID NO: 142411 - protein, 15 aa, Mycobacterium tuberculosis
HVTDEEYLRELTIWS

SEQ ID NO: 142412 - protein, 15 aa, Mycobacterium tuberculosis
VTDEEYLRELTIWSG

SEQ ID NO: 142413 - protein, 15 aa, Mycobacterium tuberculosis
TDEEYLRELTIWSGR

SEQ ID NO: 142414 - protein, 15 aa, Mycobacterium tuberculosis
DEEYLRELTIWSGRY

SEQ ID NO: 142415 - protein, 15 aa, Mycobacterium tuberculosis
EEYLRELTIWSGRYG

SEQ ID NO: 142416 - protein, 15 aa, Mycobacterium tuberculosis
EYLRELTIWSGRYGS

SEQ ID NO: 142417 - protein, 15 aa, Mycobacterium tuberculosis
YLRELTIWSGRYGSV

SEQ ID NO: 142418 - protein, 15 aa, Mycobacterium tuberculosis
LRELTIWSGRYGSVA

SEQ ID NO: 142419 - protein, 15 aa, Mycobacterium tuberculosis
RELTIWSGRYGSVAG

SEQ ID NO: 142420 - protein, 15 aa, Mycobacterium tuberculosis
ELTIWSGRYGSVAGV

SEQ ID NO: 142421 - protein, 15 aa, Mycobacterium tuberculosis
LTIWSGRYGSVAGVP

SEQ ID NO: 142422 - protein, 15 aa, Mycobacterium tuberculosis
TIWSGRYGSVAGVPA

SEQ ID NO: 142423 - protein, 15 aa, Mycobacterium tuberculosis
IWSGRYGSVAGVPAR

SEQ ID NO: 142424 - protein, 15 aa, Mycobacterium tuberculosis
WSGRYGSVAGVPARN

SEQ ID NO: 142425 - protein, 15 aa, Mycobacterium tuberculosis
SGRYGSVAGVPARNE

SEQ ID NO: 142426 - protein, 15 aa, Mycobacterium tuberculosis
GRYGSVAGVPARNEP

SEQ ID NO: 142427 - protein, 15 aa, Mycobacterium tuberculosis
RYGSVAGVPARNEPP

SEQ ID NO: 142428 - protein, 15 aa, Mycobacterium tuberculosis
YGSVAGVPARNEPPS

SEQ ID NO: 142429 - protein, 15 aa, Mycobacterium tuberculosis
GSVAGVPARNEPPSD

SEQ ID NO: 142430 - protein, 15 aa, Mycobacterium tuberculosis
SVAGVPARNEPPSDP

SEQ ID NO: 142431 - protein, 15 aa, Mycobacterium tuberculosis
VAGVPARNEPPSDPS

SEQ ID NO: 142432 - protein, 15 aa, Mycobacterium tuberculosis
AGVPARNEPPSDPSA

SEQ ID NO: 142433 - protein, 15 aa, Mycobacterium tuberculosis
GVPARNEPPSDPSAP

SEQ ID NO: 142434 - protein, 15 aa, Mycobacterium tuberculosis
VPARNEPPSDPSAPI

SEQ ID NO: 142435 - protein, 15 aa, Mycobacterium tuberculosis
PARNEPPSDPSAPIP

SEQ ID NO: 142436 - protein, 15 aa, Mycobacterium tuberculosis
ARNEPPSDPSAPIPG

SEQ ID NO: 142437 - protein, 15 aa, Mycobacterium tuberculosis
RNEPPSDPSAPIPGR

SEQ ID NO: 142438 - protein, 15 aa, Mycobacterium tuberculosis
NEPPSDPSAPIPGRL

SEQ ID NO: 142439 - protein, 15 aa, Mycobacterium tuberculosis
EPPSDPSAPIPGRLF

SEQ ID NO: 142440 - protein, 15 aa, Mycobacterium tuberculosis
PPSDPSAPIPGRLFA

SEQ ID NO: 142441 - protein, 15 aa, Mycobacterium tuberculosis
PSDPSAPIPGRLFAG

SEQ ID NO: 142442 - protein, 15 aa, Mycobacterium tuberculosis
SDPSAPIPGRLFAGP

SEQ ID NO: 142443 - protein, 15 aa, Mycobacterium tuberculosis
DPSAPIPGRLFAGPG

SEQ ID NO: 142444 - protein, 15 aa, Mycobacterium tuberculosis
PSAPIPGRLFAGPGL

SEQ ID NO: 142445 - protein, 15 aa, Mycobacterium tuberculosis
SAPIPGRLFAGPGLS

SEQ ID NO: 142446 - protein, 15 aa, Mycobacterium tuberculosis
APIPGRLFAGPGLSQ

SEQ ID NO: 142447 - protein, 15 aa, Mycobacterium tuberculosis
PIPGRLFAGPGLSQP

SEQ ID NO: 142448 - protein, 15 aa, Mycobacterium tuberculosis
IPGRLFAGPGLSQPS

SEQ ID NO: 142449 - protein, 15 aa, Mycobacterium tuberculosis
PGRLFAGPGLSQPSD

SEQ ID NO: 142450 - protein, 15 aa, Mycobacterium tuberculosis
GRLFAGPGLSQPSDV

SEQ ID NO: 142451 - protein, 15 aa, Mycobacterium tuberculosis
RLFAGPGLSQPSDVL

SEQ ID NO: 142452 - protein, 15 aa, Mycobacterium tuberculosis
LFAGPGLSQPSDVLP

SEQ ID NO: 142453 - protein, 15 aa, Mycobacterium tuberculosis
FAGPGLSQPSDVLPA

SEQ ID NO: 142454 - protein, 15 aa, Mycobacterium tuberculosis
AGPGLSQPSDVLPAD

SEQ ID NO: 142455 - protein, 15 aa, Mycobacterium tuberculosis
GPGLSQPSDVLPADD

SEQ ID NO: 142456 - protein, 15 aa, Mycobacterium tuberculosis
PGLSQPSDVLPADDG

SEQ ID NO: 142457 - protein, 15 aa, Mycobacterium tuberculosis
GLSQPSDVLPADDGA

SEQ ID NO: 142458 - protein, 15 aa, Mycobacterium tuberculosis
LSQPSDVLPADDGAA

SEQ ID NO: 142459 - protein, 15 aa, Mycobacterium tuberculosis
SQPSDVLPADDGAAI

SEQ ID NO: 142460 - protein, 15 aa, Mycobacterium tuberculosis
QPSDVLPADDGAAIL

SEQ ID NO: 142461 - protein, 15 aa, Mycobacterium tuberculosis
PSDVLPADDGAAILA

SEQ ID NO: 142462 - protein, 15 aa, Mycobacterium tuberculosis
SDVLPADDGAAILAL

SEQ ID NO: 142463 - protein, 15 aa, Mycobacterium tuberculosis
DVLPADDGAAILALG

SEQ ID NO: 142464 - protein, 15 aa, Mycobacterium tuberculosis
VLPADDGAAILALGT

SEQ ID NO: 142465 - protein, 15 aa, Mycobacterium tuberculosis
LPADDGAAILALGTE

SEQ ID NO: 142466 - protein, 15 aa, Mycobacterium tuberculosis
PADDGAAILALGTET

SEQ ID NO: 142467 - protein, 15 aa, Mycobacterium tuberculosis
ADDGAAILALGTETD

SEQ ID NO: 142468 - protein, 15 aa, Mycobacterium tuberculosis
DDGAAILALGTETDD

SEQ ID NO: 142469 - protein, 15 aa, Mycobacterium tuberculosis
DGAAILALGTETDDR

SEQ ID NO: 142470 - protein, 15 aa, Mycobacterium tuberculosis
GAAILALGTETDDRL

SEQ ID NO: 142471 - protein, 15 aa, Mycobacterium tuberculosis
AAILALGTETDDRLA

SEQ ID NO: 142472 - protein, 15 aa, Mycobacterium tuberculosis
AILALGTETDDRLAR

SEQ ID NO: 142473 - protein, 15 aa, Mycobacterium tuberculosis
ILALGTETDDRLARL

SEQ ID NO: 142474 - protein, 15 aa, Mycobacterium tuberculosis
LALGTETDDRLARLR

SEQ ID NO: 142475 - protein, 15 aa, Mycobacterium tuberculosis
ALGTETDDRLARLRA

SEQ ID NO: 142476 - protein, 15 aa, Mycobacterium tuberculosis
LGTETDDRLARLRAG

SEQ ID NO: 142477 - protein, 15 aa, Mycobacterium tuberculosis
GTETDDRLARLRAGE

SEQ ID NO: 142478 - protein, 15 aa, Mycobacterium tuberculosis
TETDDRLARLRAGEA

SEQ ID NO: 142479 - protein, 15 aa, Mycobacterium tuberculosis
ETDDRLARLRAGEAA

SEQ ID NO: 142480 - protein, 15 aa, Mycobacterium tuberculosis
TDDRLARLRAGEAAS

SEQ ID NO: 142481 - protein, 15 aa, Mycobacterium tuberculosis
DDRLARLRAGEAASI

SEQ ID NO: 142482 - protein, 15 aa, Mycobacterium tuberculosis
DRLARLRAGEAASIV

SEQ ID NO: 142483 - protein, 15 aa, Mycobacterium tuberculosis
RLARLRAGEAASIVL

SEQ ID NO: 142484 - protein, 15 aa, Mycobacterium tuberculosis
LARLRAGEAASIVLL

SEQ ID NO: 142485 - protein, 15 aa, Mycobacterium tuberculosis
ARLRAGEAASIVLLT

SEQ ID NO: 142486 - protein, 15 aa, Mycobacterium tuberculosis
RLRAGEAASIVLLTA

SEQ ID NO: 142487 - protein, 15 aa, Mycobacterium tuberculosis
LRAGEAASIVLLTAT

SEQ ID NO: 142488 - protein, 15 aa, Mycobacterium tuberculosis
RAGEAASIVLLTATA

SEQ ID NO: 142489 - protein, 15 aa, Mycobacterium tuberculosis
AGEAASIVLLTATAM

SEQ ID NO: 142490 - protein, 15 aa, Mycobacterium tuberculosis
GEAASIVLLTATAMG

SEQ ID NO: 142491 - protein, 15 aa, Mycobacterium tuberculosis
EAASIVLLTATAMGL

SEQ ID NO: 142492 - protein, 15 aa, Mycobacterium tuberculosis
AASIVLLTATAMGLA

SEQ ID NO: 142493 - protein, 15 aa, Mycobacterium tuberculosis
ASIVLLTATAMGLAC

SEQ ID NO: 142494 - protein, 15 aa, Mycobacterium tuberculosis
SIVLLTATAMGLACC

SEQ ID NO: 142495 - protein, 15 aa, Mycobacterium tuberculosis
IVLLTATAMGLACCP

SEQ ID NO: 142496 - protein, 15 aa, Mycobacterium tuberculosis
VLLTATAMGLACCPI

SEQ ID NO: 142497 - protein, 15 aa, Mycobacterium tuberculosis
LLTATAMGLACCPIT

SEQ ID NO: 142498 - protein, 15 aa, Mycobacterium tuberculosis
LTATAMGLACCPITE

SEQ ID NO: 142499 - protein, 15 aa, Mycobacterium tuberculosis
TATAMGLACCPITEP

SEQ ID NO: 142500 - protein, 15 aa, Mycobacterium tuberculosis
ATAMGLACCPITEPL

SEQ ID NO: 142501 - protein, 15 aa, Mycobacterium tuberculosis
TAMGLACCPITEPLE

SEQ ID NO: 142502 - protein, 15 aa, Mycobacterium tuberculosis
AMGLACCPITEPLEI

SEQ ID NO: 142503 - protein, 15 aa, Mycobacterium tuberculosis
MGLACCPITEPLEIA

SEQ ID NO: 142504 - protein, 15 aa, Mycobacterium tuberculosis
GLACCPITEPLEIAK

SEQ ID NO: 142505 - protein, 15 aa, Mycobacterium tuberculosis
LACCPITEPLEIAKT

SEQ ID NO: 142506 - protein, 15 aa, Mycobacterium tuberculosis
ACCPITEPLEIAKTR

SEQ ID NO: 142507 - protein, 15 aa, Mycobacterium tuberculosis
CCPITEPLEIAKTRD

SEQ ID NO: 142508 - protein, 15 aa, Mycobacterium tuberculosis
CPITEPLEIAKTRDA

SEQ ID NO: 142509 - protein, 15 aa, Mycobacterium tuberculosis
PITEPLEIAKTRDAV

SEQ ID NO: 142510 - protein, 15 aa, Mycobacterium tuberculosis
ITEPLEIAKTRDAVR

SEQ ID NO: 142511 - protein, 15 aa, Mycobacterium tuberculosis
TEPLEIAKTRDAVRA

SEQ ID NO: 142512 - protein, 15 aa, Mycobacterium tuberculosis
EPLEIAKTRDAVRAE

SEQ ID NO: 142513 - protein, 15 aa, Mycobacterium tuberculosis
PLEIAKTRDAVRAEV

SEQ ID NO: 142514 - protein, 15 aa, Mycobacterium tuberculosis
LEIAKTRDAVRAEVF

SEQ ID NO: 142515 - protein, 15 aa, Mycobacterium tuberculosis
EIAKTRDAVRAEVFG

SEQ ID NO: 142516 - protein, 15 aa, Mycobacterium tuberculosis
IAKTRDAVRAEVFGA

SEQ ID NO: 142517 - protein, 15 aa, Mycobacterium tuberculosis
AKTRDAVRAEVFGAG

SEQ ID NO: 142518 - protein, 15 aa, Mycobacterium tuberculosis
KTRDAVRAEVFGAGG

SEQ ID NO: 142519 - protein, 15 aa, Mycobacterium tuberculosis
TRDAVRAEVFGAGGY

SEQ ID NO: 142520 - protein, 15 aa, Mycobacterium tuberculosis
RDAVRAEVFGAGGYP

SEQ ID NO: 142521 - protein, 15 aa, Mycobacterium tuberculosis
DAVRAEVFGAGGYPQ

SEQ ID NO: 142522 - protein, 15 aa, Mycobacterium tuberculosis
AVRAEVFGAGGYPQM

SEQ ID NO: 142523 - protein, 15 aa, Mycobacterium tuberculosis
VRAEVFGAGGYPQML

SEQ ID NO: 142524 - protein, 15 aa, Mycobacterium tuberculosis
RAEVFGAGGYPQMLL

SEQ ID NO: 142525 - protein, 15 aa, Mycobacterium tuberculosis
AEVFGAGGYPQMLLR

SEQ ID NO: 142526 - protein, 15 aa, Mycobacterium tuberculosis
EVFGAGGYPQMLLRV

SEQ ID NO: 142527 - protein, 15 aa, Mycobacterium tuberculosis
VFGAGGYPQMLLRVG

SEQ ID NO: 142528 - protein, 15 aa, Mycobacterium tuberculosis
FGAGGYPQMLLRVGW

SEQ ID NO: 142529 - protein, 15 aa, Mycobacterium tuberculosis
GAGGYPQMLLRVGWA

SEQ ID NO: 142530 - protein, 15 aa, Mycobacterium tuberculosis
AGGYPQMLLRVGWAP

SEQ ID NO: 142531 - protein, 15 aa, Mycobacterium tuberculosis
GGYPQMLLRVGWAPI

SEQ ID NO: 142532 - protein, 15 aa, Mycobacterium tuberculosis
GYPQMLLRVGWAPIN

SEQ ID NO: 142533 - protein, 15 aa, Mycobacterium tuberculosis
YPQMLLRVGWAPINA

SEQ ID NO: 142534 - protein, 15 aa, Mycobacterium tuberculosis
PQMLLRVGWAPINAD

SEQ ID NO: 142535 - protein, 15 aa, Mycobacterium tuberculosis
QMLLRVGWAPINADP

SEQ ID NO: 142536 - protein, 15 aa, Mycobacterium tuberculosis
MLLRVGWAPINADPL

SEQ ID NO: 142537 - protein, 15 aa, Mycobacterium tuberculosis
LLRVGWAPINADPLP

SEQ ID NO: 142538 - protein, 15 aa, Mycobacterium tuberculosis
LRVGWAPINADPLPP

SEQ ID NO: 142539 - protein, 15 aa, Mycobacterium tuberculosis
RVGWAPINADPLPPT

SEQ ID NO: 142540 - protein, 15 aa, Mycobacterium tuberculosis
VGWAPINADPLPPTP

SEQ ID NO: 142541 - protein, 15 aa, Mycobacterium tuberculosis
GWAPINADPLPPTPR

SEQ ID NO: 142542 - protein, 15 aa, Mycobacterium tuberculosis
WAPINADPLPPTPRR

SEQ ID NO: 142543 - protein, 15 aa, Mycobacterium tuberculosis
APINADPLPPTPRRE

SEQ ID NO: 142544 - protein, 15 aa, Mycobacterium tuberculosis
PINADPLPPTPRREL

SEQ ID NO: 142545 - protein, 15 aa, Mycobacterium tuberculosis
INADPLPPTPRRELS

SEQ ID NO: 142546 - protein, 15 aa, Mycobacterium tuberculosis
NADPLPPTPRRELSQ

SEQ ID NO: 142547 - protein, 15 aa, Mycobacterium tuberculosis
ADPLPPTPRRELSQV

SEQ ID NO: 142548 - protein, 15 aa, Mycobacterium tuberculosis
DPLPPTPRRELSQVV

SEQ ID NO: 142549 - protein, 15 aa, Mycobacterium tuberculosis
PLPPTPRRELSQVVE

SEQ ID NO: 142550 - protein, 15 aa, Mycobacterium tuberculosis
LPPTPRRELSQVVEW

SEQ ID NO: 142551 - protein, 15 aa, Mycobacterium tuberculosis
PPTPRRELSQVVEWP

SEQ ID NO: 142552 - protein, 15 aa, Mycobacterium tuberculosis
PTPRRELSQVVEWPE

SEQ ID NO: 142553 - protein, 15 aa, Mycobacterium tuberculosis
TPRRELSQVVEWPEE

SEQ ID NO: 142554 - protein, 15 aa, Mycobacterium tuberculosis
PRRELSQVVEWPEEL

SEQ ID NO: 142555 - protein, 15 aa, Mycobacterium tuberculosis
RRELSQVVEWPEELL

SEQ ID NO: 142556 - protein, 15 aa, Mycobacterium tuberculosis
RELSQVVEWPEELLR

SEQ ID NO: 142557 - protein, 15 aa, Mycobacterium tuberculosis
ELSQVVEWPEELLRQ

SEQ ID NO: 142558 - protein, 15 aa, Mycobacterium tuberculosis
LSQVVEWPEELLRQR

SEQ ID NO: 142559 - protein, 15 aa, Mycobacterium tuberculosis
SQVVEWPEELLRQRC

SEQ ID NO: 142560 - protein, 16 aa, Mycobacterium tuberculosis
MNTHFPDAETVRTVLT

SEQ ID NO: 142561 - protein, 16 aa, Mycobacterium tuberculosis
NTHFPDAETVRTVLTL

SEQ ID NO: 142562 - protein, 16 aa, Mycobacterium tuberculosis
THFPDAETVRTVLTLA

SEQ ID NO: 142563 - protein, 16 aa, Mycobacterium tuberculosis
HFPDAETVRTVLTLAV

SEQ ID NO: 142564 - protein, 16 aa, Mycobacterium tuberculosis
FPDAETVRTVLTLAVR

SEQ ID NO: 142565 - protein, 16 aa, Mycobacterium tuberculosis
PDAETVRTVLTLAVRA

SEQ ID NO: 142566 - protein, 16 aa, Mycobacterium tuberculosis
DAETVRTVLTLAVRAP

SEQ ID NO: 142567 - protein, 16 aa, Mycobacterium tuberculosis
AETVRTVLTLAVRAPS

SEQ ID NO: 142568 - protein, 16 aa, Mycobacterium tuberculosis
ETVRTVLTLAVRAPSI

SEQ ID NO: 142569 - protein, 16 aa, Mycobacterium tuberculosis
TVRTVLTLAVRAPSIH

SEQ ID NO: 142570 - protein, 16 aa, Mycobacterium tuberculosis
VRTVLTLAVRAPSIHN

SEQ ID NO: 142571 - protein, 16 aa, Mycobacterium tuberculosis
RTVLTLAVRAPSIHNT

SEQ ID NO: 142572 - protein, 16 aa, Mycobacterium tuberculosis
TVLTLAVRAPSIHNTQ

SEQ ID NO: 142573 - protein, 16 aa, Mycobacterium tuberculosis
VLTLAVRAPSIHNTQP

SEQ ID NO: 142574 - protein, 16 aa, Mycobacterium tuberculosis
LTLAVRAPSIHNTQPW

SEQ ID NO: 142575 - protein, 16 aa, Mycobacterium tuberculosis
TLAVRAPSIHNTQPWR

SEQ ID NO: 142576 - protein, 16 aa, Mycobacterium tuberculosis
LAVRAPSIHNTQPWRW

SEQ ID NO: 142577 - protein, 16 aa, Mycobacterium tuberculosis
AVRAPSIHNTQPWRWR

SEQ ID NO: 142578 - protein, 16 aa, Mycobacterium tuberculosis
VRAPSIHNTQPWRWRV

SEQ ID NO: 142579 - protein, 16 aa, Mycobacterium tuberculosis
RAPSIHNTQPWRWRVC

SEQ ID NO: 142580 - protein, 16 aa, Mycobacterium tuberculosis
APSIHNTQPWRWRVCP

SEQ ID NO: 142581 - protein, 16 aa, Mycobacterium tuberculosis
PSIHNTQPWRWRVCPT

SEQ ID NO: 142582 - protein, 16 aa, Mycobacterium tuberculosis
SIHNTQPWRWRVCPTS

SEQ ID NO: 142583 - protein, 16 aa, Mycobacterium tuberculosis
IHNTQPWRWRVCPTSL

SEQ ID NO: 142584 - protein, 16 aa, Mycobacterium tuberculosis
HNTQPWRWRVCPTSLE

SEQ ID NO: 142585 - protein, 16 aa, Mycobacterium tuberculosis
NTQPWRWRVCPTSLEL

SEQ ID NO: 142586 - protein, 16 aa, Mycobacterium tuberculosis
TQPWRWRVCPTSLELF

SEQ ID NO: 142587 - protein, 16 aa, Mycobacterium tuberculosis
QPWRWRVCPTSLELFS

SEQ ID NO: 142588 - protein, 16 aa, Mycobacterium tuberculosis
PWRWRVCPTSLELFSR

SEQ ID NO: 142589 - protein, 16 aa, Mycobacterium tuberculosis
WRWRVCPTSLELFSRP

SEQ ID NO: 142590 - protein, 16 aa, Mycobacterium tuberculosis
RWRVCPTSLELFSRPD

SEQ ID NO: 142591 - protein, 16 aa, Mycobacterium tuberculosis
WRVCPTSLELFSRPDM

SEQ ID NO: 142592 - protein, 16 aa, Mycobacterium tuberculosis
RVCPTSLELFSRPDMQ

SEQ ID NO: 142593 - protein, 16 aa, Mycobacterium tuberculosis
VCPTSLELFSRPDMQL

SEQ ID NO: 142594 - protein, 16 aa, Mycobacterium tuberculosis
CPTSLELFSRPDMQLR

SEQ ID NO: 142595 - protein, 16 aa, Mycobacterium tuberculosis
PTSLELFSRPDMQLRS

SEQ ID NO: 142596 - protein, 16 aa, Mycobacterium tuberculosis
TSLELFSRPDMQLRST

SEQ ID NO: 142597 - protein, 16 aa, Mycobacterium tuberculosis
SLELFSRPDMQLRSTD

SEQ ID NO: 142598 - protein, 16 aa, Mycobacterium tuberculosis
LELFSRPDMQLRSTDP

SEQ ID NO: 142599 - protein, 16 aa, Mycobacterium tuberculosis
ELFSRPDMQLRSTDPD

SEQ ID NO: 142600 - protein, 16 aa, Mycobacterium tuberculosis
LFSRPDMQLRSTDPDG

SEQ ID NO: 142601 - protein, 16 aa, Mycobacterium tuberculosis
FSRPDMQLRSTDPDGR

SEQ ID NO: 142602 - protein, 16 aa, Mycobacterium tuberculosis
SRPDMQLRSTDPDGRE

SEQ ID NO: 142603 - protein, 16 aa, Mycobacterium tuberculosis
RPDMQLRSTDPDGREL

SEQ ID NO: 142604 - protein, 16 aa, Mycobacterium tuberculosis
PDMQLRSTDPDGRELI

SEQ ID NO: 142605 - protein, 16 aa, Mycobacterium tuberculosis
DMQLRSTDPDGRELIL

SEQ ID NO: 142606 - protein, 16 aa, Mycobacterium tuberculosis
MQLRSTDPDGRELILS

SEQ ID NO: 142607 - protein, 16 aa, Mycobacterium tuberculosis
QLRSTDPDGRELILSC

SEQ ID NO: 142608 - protein, 16 aa, Mycobacterium tuberculosis
LRSTDPDGRELILSCG

SEQ ID NO: 142609 - protein, 16 aa, Mycobacterium tuberculosis
RSTDPDGRELILSCGV

SEQ ID NO: 142610 - protein, 16 aa, Mycobacterium tuberculosis
STDPDGRELILSCGVA

SEQ ID NO: 142611 - protein, 16 aa, Mycobacterium tuberculosis
TDPDGRELILSCGVAL

SEQ ID NO: 142612 - protein, 16 aa, Mycobacterium tuberculosis
DPDGRELILSCGVALH

SEQ ID NO: 142613 - protein, 16 aa, Mycobacterium tuberculosis
PDGRELILSCGVALHH

SEQ ID NO: 142614 - protein, 16 aa, Mycobacterium tuberculosis
DGRELILSCGVALHHC

SEQ ID NO: 142615 - protein, 16 aa, Mycobacterium tuberculosis
GRELILSCGVALHHCV

SEQ ID NO: 142616 - protein, 16 aa, Mycobacterium tuberculosis
RELILSCGVALHHCVV

SEQ ID NO: 142617 - protein, 16 aa, Mycobacterium tuberculosis
ELILSCGVALHHCVVA

SEQ ID NO: 142618 - protein, 16 aa, Mycobacterium tuberculosis
LILSCGVALHHCVVAL

SEQ ID NO: 142619 - protein, 16 aa, Mycobacterium tuberculosis
ILSCGVALHHCVVALA

SEQ ID NO: 142620 - protein, 16 aa, Mycobacterium tuberculosis
LSCGVALHHCVVALAS

SEQ ID NO: 142621 - protein, 16 aa, Mycobacterium tuberculosis
SCGVALHHCVVALASL

SEQ ID NO: 142622 - protein, 16 aa, Mycobacterium tuberculosis
CGVALHHCVVALASLG

SEQ ID NO: 142623 - protein, 16 aa, Mycobacterium tuberculosis
GVALHHCVVALASLGW

SEQ ID NO: 142624 - protein, 16 aa, Mycobacterium tuberculosis
VALHHCVVALASLGWQ

SEQ ID NO: 142625 - protein, 16 aa, Mycobacterium tuberculosis
ALHHCVVALASLGWQA

SEQ ID NO: 142626 - protein, 16 aa, Mycobacterium tuberculosis
LHHCVVALASLGWQAK

SEQ ID NO: 142627 - protein, 16 aa, Mycobacterium tuberculosis
HHCVVALASLGWQAKV

SEQ ID NO: 142628 - protein, 16 aa, Mycobacterium tuberculosis
HCVVALASLGWQAKVN

SEQ ID NO: 142629 - protein, 16 aa, Mycobacterium tuberculosis
CVVALASLGWQAKVNR

SEQ ID NO: 142630 - protein, 16 aa, Mycobacterium tuberculosis
VVALASLGWQAKVNRF

SEQ ID NO: 142631 - protein, 16 aa, Mycobacterium tuberculosis
VALASLGWQAKVNRFP

SEQ ID NO: 142632 - protein, 16 aa, Mycobacterium tuberculosis
ALASLGWQAKVNRFPD

SEQ ID NO: 142633 - protein, 16 aa, Mycobacterium tuberculosis
LASLGWQAKVNRFPDP

SEQ ID NO: 142634 - protein, 16 aa, Mycobacterium tuberculosis
ASLGWQAKVNRFPDPK

SEQ ID NO: 142635 - protein, 16 aa, Mycobacterium tuberculosis
SLGWQAKVNRFPDPKD

SEQ ID NO: 142636 - protein, 16 aa, Mycobacterium tuberculosis
LGWQAKVNRFPDPKDR

SEQ ID NO: 142637 - protein, 16 aa, Mycobacterium tuberculosis
GWQAKVNRFPDPKDRC

SEQ ID NO: 142638 - protein, 16 aa, Mycobacterium tuberculosis
WQAKVNRFPDPKDRCH

SEQ ID NO: 142639 - protein, 16 aa, Mycobacterium tuberculosis
QAKVNRFPDPKDRCHL

SEQ ID NO: 142640 - protein, 16 aa, Mycobacterium tuberculosis
AKVNRFPDPKDRCHLA

SEQ ID NO: 142641 - protein, 16 aa, Mycobacterium tuberculosis
KVNRFPDPKDRCHLAT

SEQ ID NO: 142642 - protein, 16 aa, Mycobacterium tuberculosis
VNRFPDPKDRCHLATI

SEQ ID NO: 142643 - protein, 16 aa, Mycobacterium tuberculosis
NRFPDPKDRCHLATIG

SEQ ID NO: 142644 - protein, 16 aa, Mycobacterium tuberculosis
RFPDPKDRCHLATIGV

SEQ ID NO: 142645 - protein, 16 aa, Mycobacterium tuberculosis
FPDPKDRCHLATIGVQ

SEQ ID NO: 142646 - protein, 16 aa, Mycobacterium tuberculosis
PDPKDRCHLATIGVQP

SEQ ID NO: 142647 - protein, 16 aa, Mycobacterium tuberculosis
DPKDRCHLATIGVQPL

SEQ ID NO: 142648 - protein, 16 aa, Mycobacterium tuberculosis
PKDRCHLATIGVQPLV

SEQ ID NO: 142649 - protein, 16 aa, Mycobacterium tuberculosis
KDRCHLATIGVQPLVP

SEQ ID NO: 142650 - protein, 16 aa, Mycobacterium tuberculosis
DRCHLATIGVQPLVPD

SEQ ID NO: 142651 - protein, 16 aa, Mycobacterium tuberculosis
RCHLATIGVQPLVPDQ

SEQ ID NO: 142652 - protein, 16 aa, Mycobacterium tuberculosis
CHLATIGVQPLVPDQA

SEQ ID NO: 142653 - protein, 16 aa, Mycobacterium tuberculosis
HLATIGVQPLVPDQAD

SEQ ID NO: 142654 - protein, 16 aa, Mycobacterium tuberculosis
LATIGVQPLVPDQADV

SEQ ID NO: 142655 - protein, 16 aa, Mycobacterium tuberculosis
ATIGVQPLVPDQADVA

SEQ ID NO: 142656 - protein, 16 aa, Mycobacterium tuberculosis
TIGVQPLVPDQADVAL

SEQ ID NO: 142657 - protein, 16 aa, Mycobacterium tuberculosis
IGVQPLVPDQADVALA

SEQ ID NO: 142658 - protein, 16 aa, Mycobacterium tuberculosis
GVQPLVPDQADVALAA

SEQ ID NO: 142659 - protein, 16 aa, Mycobacterium tuberculosis
VQPLVPDQADVALAAA

SEQ ID NO: 142660 - protein, 16 aa, Mycobacterium tuberculosis
QPLVPDQADVALAAAI

SEQ ID NO: 142661 - protein, 16 aa, Mycobacterium tuberculosis
PLVPDQADVALAAAIP

SEQ ID NO: 142662 - protein, 16 aa, Mycobacterium tuberculosis
LVPDQADVALAAAIPR

SEQ ID NO: 142663 - protein, 16 aa, Mycobacterium tuberculosis
VPDQADVALAAAIPRR

SEQ ID NO: 142664 - protein, 16 aa, Mycobacterium tuberculosis
PDQADVALAAAIPRRR

SEQ ID NO: 142665 - protein, 16 aa, Mycobacterium tuberculosis
DQADVALAAAIPRRRT

SEQ ID NO: 142666 - protein, 16 aa, Mycobacterium tuberculosis
QADVALAAAIPRRRTD

SEQ ID NO: 142667 - protein, 16 aa, Mycobacterium tuberculosis
ADVALAAAIPRRRTDR

SEQ ID NO: 142668 - protein, 16 aa, Mycobacterium tuberculosis
DVALAAAIPRRRTDRR

SEQ ID NO: 142669 - protein, 16 aa, Mycobacterium tuberculosis
VALAAAIPRRRTDRRA

SEQ ID NO: 142670 - protein, 16 aa, Mycobacterium tuberculosis
ALAAAIPRRRTDRRAY

SEQ ID NO: 142671 - protein, 16 aa, Mycobacterium tuberculosis
LAAAIPRRRTDRRAYS

SEQ ID NO: 142672 - protein, 16 aa, Mycobacterium tuberculosis
AAAIPRRRTDRRAYSC

SEQ ID NO: 142673 - protein, 16 aa, Mycobacterium tuberculosis
AAIPRRRTDRRAYSCW

SEQ ID NO: 142674 - protein, 16 aa, Mycobacterium tuberculosis
AIPRRRTDRRAYSCWP

SEQ ID NO: 142675 - protein, 16 aa, Mycobacterium tuberculosis
IPRRRTDRRAYSCWPV

SEQ ID NO: 142676 - protein, 16 aa, Mycobacterium tuberculosis
PRRRTDRRAYSCWPVP

SEQ ID NO: 142677 - protein, 16 aa, Mycobacterium tuberculosis
RRRTDRRAYSCWPVPG

SEQ ID NO: 142678 - protein, 16 aa, Mycobacterium tuberculosis
RRTDRRAYSCWPVPGG

SEQ ID NO: 142679 - protein, 16 aa, Mycobacterium tuberculosis
RTDRRAYSCWPVPGGD

SEQ ID NO: 142680 - protein, 16 aa, Mycobacterium tuberculosis
TDRRAYSCWPVPGGDI

SEQ ID NO: 142681 - protein, 16 aa, Mycobacterium tuberculosis
DRRAYSCWPVPGGDIA

SEQ ID NO: 142682 - protein, 16 aa, Mycobacterium tuberculosis
RRAYSCWPVPGGDIAL

SEQ ID NO: 142683 - protein, 16 aa, Mycobacterium tuberculosis
RAYSCWPVPGGDIALM

SEQ ID NO: 142684 - protein, 16 aa, Mycobacterium tuberculosis
AYSCWPVPGGDIALMA

SEQ ID NO: 142685 - protein, 16 aa, Mycobacterium tuberculosis
YSCWPVPGGDIALMAA

SEQ ID NO: 142686 - protein, 16 aa, Mycobacterium tuberculosis
SCWPVPGGDIALMAAR

SEQ ID NO: 142687 - protein, 16 aa, Mycobacterium tuberculosis
CWPVPGGDIALMAARA

SEQ ID NO: 142688 - protein, 16 aa, Mycobacterium tuberculosis
WPVPGGDIALMAARAA

SEQ ID NO: 142689 - protein, 16 aa, Mycobacterium tuberculosis
PVPGGDIALMAARAAR

SEQ ID NO: 142690 - protein, 16 aa, Mycobacterium tuberculosis
VPGGDIALMAARAARG

SEQ ID NO: 142691 - protein, 16 aa, Mycobacterium tuberculosis
PGGDIALMAARAARGG

SEQ ID NO: 142692 - protein, 16 aa, Mycobacterium tuberculosis
GGDIALMAARAARGGV

SEQ ID NO: 142693 - protein, 16 aa, Mycobacterium tuberculosis
GDIALMAARAARGGVM

SEQ ID NO: 142694 - protein, 16 aa, Mycobacterium tuberculosis
DIALMAARAARGGVML

SEQ ID NO: 142695 - protein, 16 aa, Mycobacterium tuberculosis
IALMAARAARGGVMLR

SEQ ID NO: 142696 - protein, 16 aa, Mycobacterium tuberculosis
ALMAARAARGGVMLRQ

SEQ ID NO: 142697 - protein, 16 aa, Mycobacterium tuberculosis
LMAARAARGGVMLRQV

SEQ ID NO: 142698 - protein, 16 aa, Mycobacterium tuberculosis
MAARAARGGVMLRQVS

SEQ ID NO: 142699 - protein, 16 aa, Mycobacterium tuberculosis
AARAARGGVMLRQVSA

SEQ ID NO: 142700 - protein, 16 aa, Mycobacterium tuberculosis
ARAARGGVMLRQVSAL

SEQ ID NO: 142701 - protein, 16 aa, Mycobacterium tuberculosis
RAARGGVMLRQVSALD

SEQ ID NO: 142702 - protein, 16 aa, Mycobacterium tuberculosis
AARGGVMLRQVSALDR

SEQ ID NO: 142703 - protein, 16 aa, Mycobacterium tuberculosis
ARGGVMLRQVSALDRM

SEQ ID NO: 142704 - protein, 16 aa, Mycobacterium tuberculosis
RGGVMLRQVSALDRMK

SEQ ID NO: 142705 - protein, 16 aa, Mycobacterium tuberculosis
GGVMLRQVSALDRMKA

SEQ ID NO: 142706 - protein, 16 aa, Mycobacterium tuberculosis
GVMLRQVSALDRMKAI

SEQ ID NO: 142707 - protein, 16 aa, Mycobacterium tuberculosis
VMLRQVSALDRMKAIV

SEQ ID NO: 142708 - protein, 16 aa, Mycobacterium tuberculosis
MLRQVSALDRMKAIVA

SEQ ID NO: 142709 - protein, 16 aa, Mycobacterium tuberculosis
LRQVSALDRMKAIVAQ

SEQ ID NO: 142710 - protein, 16 aa, Mycobacterium tuberculosis
RQVSALDRMKAIVAQA

SEQ ID NO: 142711 - protein, 16 aa, Mycobacterium tuberculosis
QVSALDRMKAIVAQAV

SEQ ID NO: 142712 - protein, 16 aa, Mycobacterium tuberculosis
VSALDRMKAIVAQAVL

SEQ ID NO: 142713 - protein, 16 aa, Mycobacterium tuberculosis
SALDRMKAIVAQAVLD

SEQ ID NO: 142714 - protein, 16 aa, Mycobacterium tuberculosis
ALDRMKAIVAQAVLDH

SEQ ID NO: 142715 - protein, 16 aa, Mycobacterium tuberculosis
LDRMKAIVAQAVLDHV

SEQ ID NO: 142716 - protein, 16 aa, Mycobacterium tuberculosis
DRMKAIVAQAVLDHVT

SEQ ID NO: 142717 - protein, 16 aa, Mycobacterium tuberculosis
RMKAIVAQAVLDHVTD

SEQ ID NO: 142718 - protein, 16 aa, Mycobacterium tuberculosis
MKAIVAQAVLDHVTDE

SEQ ID NO: 142719 - protein, 16 aa, Mycobacterium tuberculosis
KAIVAQAVLDHVTDEE

SEQ ID NO: 142720 - protein, 16 aa, Mycobacterium tuberculosis
AIVAQAVLDHVTDEEY

SEQ ID NO: 142721 - protein, 16 aa, Mycobacterium tuberculosis
IVAQAVLDHVTDEEYL

SEQ ID NO: 142722 - protein, 16 aa, Mycobacterium tuberculosis
VAQAVLDHVTDEEYLR

SEQ ID NO: 142723 - protein, 16 aa, Mycobacterium tuberculosis
AQAVLDHVTDEEYLRE

SEQ ID NO: 142724 - protein, 16 aa, Mycobacterium tuberculosis
QAVLDHVTDEEYLREL

SEQ ID NO: 142725 - protein, 16 aa, Mycobacterium tuberculosis
AVLDHVTDEEYLRELT

SEQ ID NO: 142726 - protein, 16 aa, Mycobacterium tuberculosis
VLDHVTDEEYLRELTI

SEQ ID NO: 142727 - protein, 16 aa, Mycobacterium tuberculosis
LDHVTDEEYLRELTIW

SEQ ID NO: 142728 - protein, 16 aa, Mycobacterium tuberculosis
DHVTDEEYLRELTIWS

SEQ ID NO: 142729 - protein, 16 aa, Mycobacterium tuberculosis
HVTDEEYLRELTIWSG

SEQ ID NO: 142730 - protein, 16 aa, Mycobacterium tuberculosis
VTDEEYLRELTIWSGR

SEQ ID NO: 142731 - protein, 16 aa, Mycobacterium tuberculosis
TDEEYLRELTIWSGRY

SEQ ID NO: 142732 - protein, 16 aa, Mycobacterium tuberculosis
DEEYLRELTIWSGRYG

SEQ ID NO: 142733 - protein, 16 aa, Mycobacterium tuberculosis
EEYLRELTIWSGRYGS

SEQ ID NO: 142734 - protein, 16 aa, Mycobacterium tuberculosis
EYLRELTIWSGRYGSV

SEQ ID NO: 142735 - protein, 16 aa, Mycobacterium tuberculosis
YLRELTIWSGRYGSVA

SEQ ID NO: 142736 - protein, 16 aa, Mycobacterium tuberculosis
LRELTIWSGRYGSVAG

SEQ ID NO: 142737 - protein, 16 aa, Mycobacterium tuberculosis
RELTIWSGRYGSVAGV

SEQ ID NO: 142738 - protein, 16 aa, Mycobacterium tuberculosis
ELTIWSGRYGSVAGVP

SEQ ID NO: 142739 - protein, 16 aa, Mycobacterium tuberculosis
LTIWSGRYGSVAGVPA

SEQ ID NO: 142740 - protein, 16 aa, Mycobacterium tuberculosis
TIWSGRYGSVAGVPAR

SEQ ID NO: 142741 - protein, 16 aa, Mycobacterium tuberculosis
IWSGRYGSVAGVPARN

SEQ ID NO: 142742 - protein, 16 aa, Mycobacterium tuberculosis
WSGRYGSVAGVPARNE

SEQ ID NO: 142743 - protein, 16 aa, Mycobacterium tuberculosis
SGRYGSVAGVPARNEP

SEQ ID NO: 142744 - protein, 16 aa, Mycobacterium tuberculosis
GRYGSVAGVPARNEPP

SEQ ID NO: 142745 - protein, 16 aa, Mycobacterium tuberculosis
RYGSVAGVPARNEPPS

SEQ ID NO: 142746 - protein, 16 aa, Mycobacterium tuberculosis
YGSVAGVPARNEPPSD

SEQ ID NO: 142747 - protein, 16 aa, Mycobacterium tuberculosis
GSVAGVPARNEPPSDP

SEQ ID NO: 142748 - protein, 16 aa, Mycobacterium tuberculosis
SVAGVPARNEPPSDPS

SEQ ID NO: 142749 - protein, 16 aa, Mycobacterium tuberculosis
VAGVPARNEPPSDPSA

SEQ ID NO: 142750 - protein, 16 aa, Mycobacterium tuberculosis
AGVPARNEPPSDPSAP

SEQ ID NO: 142751 - protein, 16 aa, Mycobacterium tuberculosis
GVPARNEPPSDPSAPI

SEQ ID NO: 142752 - protein, 16 aa, Mycobacterium tuberculosis
VPARNEPPSDPSAPIP

SEQ ID NO: 142753 - protein, 16 aa, Mycobacterium tuberculosis
PARNEPPSDPSAPIPG

SEQ ID NO: 142754 - protein, 16 aa, Mycobacterium tuberculosis
ARNEPPSDPSAPIPGR

SEQ ID NO: 142755 - protein, 16 aa, Mycobacterium tuberculosis
RNEPPSDPSAPIPGRL

SEQ ID NO: 142756 - protein, 16 aa, Mycobacterium tuberculosis
NEPPSDPSAPIPGRLF

SEQ ID NO: 142757 - protein, 16 aa, Mycobacterium tuberculosis
EPPSDPSAPIPGRLFA

SEQ ID NO: 142758 - protein, 16 aa, Mycobacterium tuberculosis
PPSDPSAPIPGRLFAG

SEQ ID NO: 142759 - protein, 16 aa, Mycobacterium tuberculosis
PSDPSAPIPGRLFAGP

SEQ ID NO: 142760 - protein, 16 aa, Mycobacterium tuberculosis
SDPSAPIPGRLFAGPG

SEQ ID NO: 142761 - protein, 16 aa, Mycobacterium tuberculosis
DPSAPIPGRLFAGPGL

SEQ ID NO: 142762 - protein, 16 aa, Mycobacterium tuberculosis
PSAPIPGRLFAGPGLS

SEQ ID NO: 142763 - protein, 16 aa, Mycobacterium tuberculosis
SAPIPGRLFAGPGLSQ

SEQ ID NO: 142764 - protein, 16 aa, Mycobacterium tuberculosis
APIPGRLFAGPGLSQP

SEQ ID NO: 142765 - protein, 16 aa, Mycobacterium tuberculosis
PIPGRLFAGPGLSQPS

SEQ ID NO: 142766 - protein, 16 aa, Mycobacterium tuberculosis
IPGRLFAGPGLSQPSD

SEQ ID NO: 142767 - protein, 16 aa, Mycobacterium tuberculosis
PGRLFAGPGLSQPSDV

SEQ ID NO: 142768 - protein, 16 aa, Mycobacterium tuberculosis
GRLFAGPGLSQPSDVL

SEQ ID NO: 142769 - protein, 16 aa, Mycobacterium tuberculosis
RLFAGPGLSQPSDVLP

SEQ ID NO: 142770 - protein, 16 aa, Mycobacterium tuberculosis
LFAGPGLSQPSDVLPA

SEQ ID NO: 142771 - protein, 16 aa, Mycobacterium tuberculosis
FAGPGLSQPSDVLPAD

SEQ ID NO: 142772 - protein, 16 aa, Mycobacterium tuberculosis
AGPGLSQPSDVLPADD

SEQ ID NO: 142773 - protein, 16 aa, Mycobacterium tuberculosis
GPGLSQPSDVLPADDG

SEQ ID NO: 142774 - protein, 16 aa, Mycobacterium tuberculosis
PGLSQPSDVLPADDGA

SEQ ID NO: 142775 - protein, 16 aa, Mycobacterium tuberculosis
GLSQPSDVLPADDGAA

SEQ ID NO: 142776 - protein, 16 aa, Mycobacterium tuberculosis
LSQPSDVLPADDGAAI

SEQ ID NO: 142777 - protein, 16 aa, Mycobacterium tuberculosis
SQPSDVLPADDGAAIL

SEQ ID NO: 142778 - protein, 16 aa, Mycobacterium tuberculosis
QPSDVLPADDGAAILA

SEQ ID NO: 142779 - protein, 16 aa, Mycobacterium tuberculosis
PSDVLPADDGAAILAL

SEQ ID NO: 142780 - protein, 16 aa, Mycobacterium tuberculosis
SDVLPADDGAAILALG

SEQ ID NO: 142781 - protein, 16 aa, Mycobacterium tuberculosis
DVLPADDGAAILALGT

SEQ ID NO: 142782 - protein, 16 aa, Mycobacterium tuberculosis
VLPADDGAAILALGTE

SEQ ID NO: 142783 - protein, 16 aa, Mycobacterium tuberculosis
LPADDGAAILALGTET

SEQ ID NO: 142784 - protein, 16 aa, Mycobacterium tuberculosis
PADDGAAILALGTETD

SEQ ID NO: 142785 - protein, 16 aa, Mycobacterium tuberculosis
ADDGAAILALGTETDD

SEQ ID NO: 142786 - protein, 16 aa, Mycobacterium tuberculosis
DDGAAILALGTETDDR

SEQ ID NO: 142787 - protein, 16 aa, Mycobacterium tuberculosis
DGAAILALGTETDDRL

SEQ ID NO: 142788 - protein, 16 aa, Mycobacterium tuberculosis
GAAILALGTETDDRLA

SEQ ID NO: 142789 - protein, 16 aa, Mycobacterium tuberculosis
AAILALGTETDDRLAR

SEQ ID NO: 142790 - protein, 16 aa, Mycobacterium tuberculosis
AILALGTETDDRLARL

SEQ ID NO: 142791 - protein, 16 aa, Mycobacterium tuberculosis
ILALGTETDDRLARLR

SEQ ID NO: 142792 - protein, 16 aa, Mycobacterium tuberculosis
LALGTETDDRLARLRA

SEQ ID NO: 142793 - protein, 16 aa, Mycobacterium tuberculosis
ALGTETDDRLARLRAG

SEQ ID NO: 142794 - protein, 16 aa, Mycobacterium tuberculosis
LGTETDDRLARLRAGE

SEQ ID NO: 142795 - protein, 16 aa, Mycobacterium tuberculosis
GTETDDRLARLRAGEA

SEQ ID NO: 142796 - protein, 16 aa, Mycobacterium tuberculosis
TETDDRLARLRAGEAA

SEQ ID NO: 142797 - protein, 16 aa, Mycobacterium tuberculosis
ETDDRLARLRAGEAAS

SEQ ID NO: 142798 - protein, 16 aa, Mycobacterium tuberculosis
TDDRLARLRAGEAASI

SEQ ID NO: 142799 - protein, 16 aa, Mycobacterium tuberculosis
DDRLARLRAGEAASIV

SEQ ID NO: 142800 - protein, 16 aa, Mycobacterium tuberculosis
DRLARLRAGEAASIVL

SEQ ID NO: 142801 - protein, 16 aa, Mycobacterium tuberculosis
RLARLRAGEAASIVLL

SEQ ID NO: 142802 - protein, 16 aa, Mycobacterium tuberculosis
LARLRAGEAASIVLLT

SEQ ID NO: 142803 - protein, 16 aa, Mycobacterium tuberculosis
ARLRAGEAASIVLLTA

SEQ ID NO: 142804 - protein, 16 aa, Mycobacterium tuberculosis
RLRAGEAASIVLLTAT

SEQ ID NO: 142805 - protein, 16 aa, Mycobacterium tuberculosis
LRAGEAASIVLLTATA

SEQ ID NO: 142806 - protein, 16 aa, Mycobacterium tuberculosis
RAGEAASIVLLTATAM

SEQ ID NO: 142807 - protein, 16 aa, Mycobacterium tuberculosis
AGEAASIVLLTATAMG

SEQ ID NO: 142808 - protein, 16 aa, Mycobacterium tuberculosis
GEAASIVLLTATAMGL

SEQ ID NO: 142809 - protein, 16 aa, Mycobacterium tuberculosis
EAASIVLLTATAMGLA

SEQ ID NO: 142810 - protein, 16 aa, Mycobacterium tuberculosis
AASIVLLTATAMGLAC

SEQ ID NO: 142811 - protein, 16 aa, Mycobacterium tuberculosis
ASIVLLTATAMGLACC

SEQ ID NO: 142812 - protein, 16 aa, Mycobacterium tuberculosis
SIVLLTATAMGLACCP

SEQ ID NO: 142813 - protein, 16 aa, Mycobacterium tuberculosis
IVLLTATAMGLACCPI

SEQ ID NO: 142814 - protein, 16 aa, Mycobacterium tuberculosis
VLLTATAMGLACCPIT

SEQ ID NO: 142815 - protein, 16 aa, Mycobacterium tuberculosis
LLTATAMGLACCPITE

SEQ ID NO: 142816 - protein, 16 aa, Mycobacterium tuberculosis
LTATAMGLACCPITEP

SEQ ID NO: 142817 - protein, 16 aa, Mycobacterium tuberculosis
TATAMGLACCPITEPL

SEQ ID NO: 142818 - protein, 16 aa, Mycobacterium tuberculosis
ATAMGLACCPITEPLE

SEQ ID NO: 142819 - protein, 16 aa, Mycobacterium tuberculosis
TAMGLACCPITEPLEI

SEQ ID NO: 142820 - protein, 16 aa, Mycobacterium tuberculosis
AMGLACCPITEPLEIA

SEQ ID NO: 142821 - protein, 16 aa, Mycobacterium tuberculosis
MGLACCPITEPLEIAK

SEQ ID NO: 142822 - protein, 16 aa, Mycobacterium tuberculosis
GLACCPITEPLEIAKT

SEQ ID NO: 142823 - protein, 16 aa, Mycobacterium tuberculosis
LACCPITEPLEIAKTR

SEQ ID NO: 142824 - protein, 16 aa, Mycobacterium tuberculosis
ACCPITEPLEIAKTRD

SEQ ID NO: 142825 - protein, 16 aa, Mycobacterium tuberculosis
CCPITEPLEIAKTRDA

SEQ ID NO: 142826 - protein, 16 aa, Mycobacterium tuberculosis
CPITEPLEIAKTRDAV

SEQ ID NO: 142827 - protein, 16 aa, Mycobacterium tuberculosis
PITEPLEIAKTRDAVR

SEQ ID NO: 142828 - protein, 16 aa, Mycobacterium tuberculosis
ITEPLEIAKTRDAVRA

SEQ ID NO: 142829 - protein, 16 aa, Mycobacterium tuberculosis
TEPLEIAKTRDAVRAE

SEQ ID NO: 142830 - protein, 16 aa, Mycobacterium tuberculosis
EPLEIAKTRDAVRAEV

SEQ ID NO: 142831 - protein, 16 aa, Mycobacterium tuberculosis
PLEIAKTRDAVRAEVF

SEQ ID NO: 142832 - protein, 16 aa, Mycobacterium tuberculosis
LEIAKTRDAVRAEVFG

SEQ ID NO: 142833 - protein, 16 aa, Mycobacterium tuberculosis
EIAKTRDAVRAEVFGA

SEQ ID NO: 142834 - protein, 16 aa, Mycobacterium tuberculosis
IAKTRDAVRAEVFGAG

SEQ ID NO: 142835 - protein, 16 aa, Mycobacterium tuberculosis
AKTRDAVRAEVFGAGG

SEQ ID NO: 142836 - protein, 16 aa, Mycobacterium tuberculosis
KTRDAVRAEVFGAGGY

SEQ ID NO: 142837 - protein, 16 aa, Mycobacterium tuberculosis
TRDAVRAEVFGAGGYP

SEQ ID NO: 142838 - protein, 16 aa, Mycobacterium tuberculosis
RDAVRAEVFGAGGYPQ

SEQ ID NO: 142839 - protein, 16 aa, Mycobacterium tuberculosis
DAVRAEVFGAGGYPQM

SEQ ID NO: 142840 - protein, 16 aa, Mycobacterium tuberculosis
AVRAEVFGAGGYPQML

SEQ ID NO: 142841 - protein, 16 aa, Mycobacterium tuberculosis
VRAEVFGAGGYPQMLL

SEQ ID NO: 142842 - protein, 16 aa, Mycobacterium tuberculosis
RAEVFGAGGYPQMLLR

SEQ ID NO: 142843 - protein, 16 aa, Mycobacterium tuberculosis
AEVFGAGGYPQMLLRV

SEQ ID NO: 142844 - protein, 16 aa, Mycobacterium tuberculosis
EVFGAGGYPQMLLRVG

SEQ ID NO: 142845 - protein, 16 aa, Mycobacterium tuberculosis
VFGAGGYPQMLLRVGW

SEQ ID NO: 142846 - protein, 16 aa, Mycobacterium tuberculosis
FGAGGYPQMLLRVGWA

SEQ ID NO: 142847 - protein, 16 aa, Mycobacterium tuberculosis
GAGGYPQMLLRVGWAP

SEQ ID NO: 142848 - protein, 16 aa, Mycobacterium tuberculosis
AGGYPQMLLRVGWAPI

SEQ ID NO: 142849 - protein, 16 aa, Mycobacterium tuberculosis
GGYPQMLLRVGWAPIN

SEQ ID NO: 142850 - protein, 16 aa, Mycobacterium tuberculosis
GYPQMLLRVGWAPINA

SEQ ID NO: 142851 - protein, 16 aa, Mycobacterium tuberculosis
YPQMLLRVGWAPINAD

SEQ ID NO: 142852 - protein, 16 aa, Mycobacterium tuberculosis
PQMLLRVGWAPINADP

SEQ ID NO: 142853 - protein, 16 aa, Mycobacterium tuberculosis
QMLLRVGWAPINADPL

SEQ ID NO: 142854 - protein, 16 aa, Mycobacterium tuberculosis
MLLRVGWAPINADPLP

SEQ ID NO: 142855 - protein, 16 aa, Mycobacterium tuberculosis
LLRVGWAPINADPLPP

SEQ ID NO: 142856 - protein, 16 aa, Mycobacterium tuberculosis
LRVGWAPINADPLPPT

SEQ ID NO: 142857 - protein, 16 aa, Mycobacterium tuberculosis
RVGWAPINADPLPPTP

SEQ ID NO: 142858 - protein, 16 aa, Mycobacterium tuberculosis
VGWAPINADPLPPTPR

SEQ ID NO: 142859 - protein, 16 aa, Mycobacterium tuberculosis
GWAPINADPLPPTPRR

SEQ ID NO: 142860 - protein, 16 aa, Mycobacterium tuberculosis
WAPINADPLPPTPRRE

SEQ ID NO: 142861 - protein, 16 aa, Mycobacterium tuberculosis
APINADPLPPTPRREL

SEQ ID NO: 142862 - protein, 16 aa, Mycobacterium tuberculosis
PINADPLPPTPRRELS

SEQ ID NO: 142863 - protein, 16 aa, Mycobacterium tuberculosis
INADPLPPTPRRELSQ

SEQ ID NO: 142864 - protein, 16 aa, Mycobacterium tuberculosis
NADPLPPTPRRELSQV

SEQ ID NO: 142865 - protein, 16 aa, Mycobacterium tuberculosis
ADPLPPTPRRELSQVV

SEQ ID NO: 142866 - protein, 16 aa, Mycobacterium tuberculosis
DPLPPTPRRELSQVVE

SEQ ID NO: 142867 - protein, 16 aa, Mycobacterium tuberculosis
PLPPTPRRELSQVVEW

SEQ ID NO: 142868 - protein, 16 aa, Mycobacterium tuberculosis
LPPTPRRELSQVVEWP

SEQ ID NO: 142869 - protein, 16 aa, Mycobacterium tuberculosis
PPTPRRELSQVVEWPE

SEQ ID NO: 142870 - protein, 16 aa, Mycobacterium tuberculosis
PTPRRELSQVVEWPEE

SEQ ID NO: 142871 - protein, 16 aa, Mycobacterium tuberculosis
TPRRELSQVVEWPEEL

SEQ ID NO: 142872 - protein, 16 aa, Mycobacterium tuberculosis
PRRELSQVVEWPEELL

SEQ ID NO: 142873 - protein, 16 aa, Mycobacterium tuberculosis
RRELSQVVEWPEELLR

SEQ ID NO: 142874 - protein, 16 aa, Mycobacterium tuberculosis
RELSQVVEWPEELLRQ

SEQ ID NO: 142875 - protein, 16 aa, Mycobacterium tuberculosis
ELSQVVEWPEELLRQR

SEQ ID NO: 142876 - protein, 16 aa, Mycobacterium tuberculosis
LSQVVEWPEELLRQRC

SEQ ID NO: 142877 - protein, 338 aa, Mycobacterium tuberculosis
MSAKLTDLQLLHELEPVVEKYLNRHLSMHKPWNPHDYIPWSDGKNYYALGGQDWDPDQSKLSDVAQVAMVQNLVTEDNLPSYHREIAMNMGMDGAWGQWVNRWTAEENRHGIALRDYLVVTRSVDPVELEKLRLEVVNRGFSPGQNHQGHYFAESLTDSVLYVSFQELATRISHRNTGKACNDPVADQLMAKISADENLHMIFYRDVSEAAFDLVPNQAMKSLHLILSHFQMPGFQVPEFRRKAVVIAVGGVYDPRIHLDEVVMPVLKKWRIFEREDFTGEGAKLRDELALVIKDLELACDKFEVSKQRQLDREARTGKKVSAHELHKTAGKLAMSRR

SEQ ID NO: 142878 - protein, 8 aa, Mycobacterium tuberculosis
MSAKLTDL

SEQ ID NO: 142879 - protein, 8 aa, Mycobacterium tuberculosis
KLTDLQLL

SEQ ID NO: 142880 - protein, 8 aa, Mycobacterium tuberculosis
LTDLQLLH

SEQ ID NO: 142881 - protein, 8 aa, Mycobacterium tuberculosis
DLQLLHEL

SEQ ID NO: 142882 - protein, 8 aa, Mycobacterium tuberculosis
LLHELEPV

SEQ ID NO: 142883 - protein, 8 aa, Mycobacterium tuberculosis
ELEPVVEK

SEQ ID NO: 142884 - protein, 8 aa, Mycobacterium tuberculosis
LEPVVEKY

SEQ ID NO: 142885 - protein, 8 aa, Mycobacterium tuberculosis
EPVVEKYL

SEQ ID NO: 142886 - protein, 8 aa, Mycobacterium tuberculosis
VVEKYLNR

SEQ ID NO: 142887 - protein, 8 aa, Mycobacterium tuberculosis
YLNRHLSM

SEQ ID NO: 142888 - protein, 8 aa, Mycobacterium tuberculosis
NRHLSMHK

SEQ ID NO: 142889 - protein, 8 aa, Mycobacterium tuberculosis
HLSMHKPW

SEQ ID NO: 142890 - protein, 8 aa, Mycobacterium tuberculosis
KPWNPHDY

SEQ ID NO: 142891 - protein, 8 aa, Mycobacterium tuberculosis
NPHDYIPW

SEQ ID NO: 142892 - protein, 8 aa, Mycobacterium tuberculosis
YIPWSDGK

SEQ ID NO: 142893 - protein, 8 aa, Mycobacterium tuberculosis
WSDGKNYY

SEQ ID NO: 142894 - protein, 8 aa, Mycobacterium tuberculosis
YALGGQDW

SEQ ID NO: 142895 - protein, 8 aa, Mycobacterium tuberculosis
KLSDVAQV

SEQ ID NO: 142896 - protein, 8 aa, Mycobacterium tuberculosis
DVAQVAMV

SEQ ID NO: 142897 - protein, 8 aa, Mycobacterium tuberculosis
QVAMVQNL

SEQ ID NO: 142898 - protein, 8 aa, Mycobacterium tuberculosis
VAMVQNLV

SEQ ID NO: 142899 - protein, 8 aa, Mycobacterium tuberculosis
NLVTEDNL

SEQ ID NO: 142900 - protein, 8 aa, Mycobacterium tuberculosis
TEDNLPSY

SEQ ID NO: 142901 - protein, 8 aa, Mycobacterium tuberculosis
DNLPSYHR

SEQ ID NO: 142902 - protein, 8 aa, Mycobacterium tuberculosis
LPSYHREI

SEQ ID NO: 142903 - protein, 8 aa, Mycobacterium tuberculosis
SYHREIAM

SEQ ID NO: 142904 - protein, 8 aa, Mycobacterium tuberculosis
EIAMNMGM

SEQ ID NO: 142905 - protein, 8 aa, Mycobacterium tuberculosis
MNMGMDGA

SEQ ID NO: 142906 - protein, 8 aa, Mycobacterium tuberculosis
GMDGAWGQ

SEQ ID NO: 142907 - protein, 8 aa, Mycobacterium tuberculosis
DGAWGQWV

SEQ ID NO: 142908 - protein, 8 aa, Mycobacterium tuberculosis
RWTAEENR

SEQ ID NO: 142909 - protein, 8 aa, Mycobacterium tuberculosis
AEENRHGI

SEQ ID NO: 142910 - protein, 8 aa, Mycobacterium tuberculosis
EENRHGIA

SEQ ID NO: 142911 - protein, 8 aa, Mycobacterium tuberculosis
NRHGIALR

SEQ ID NO: 142912 - protein, 8 aa, Mycobacterium tuberculosis
GIALRDYL

SEQ ID NO: 142913 - protein, 8 aa, Mycobacterium tuberculosis
IALRDYLV

SEQ ID NO: 142914 - protein, 8 aa, Mycobacterium tuberculosis
ALRDYLVV

SEQ ID NO: 142915 - protein, 8 aa, Mycobacterium tuberculosis
RDYLVVTR

SEQ ID NO: 142916 - protein, 8 aa, Mycobacterium tuberculosis
YLVVTRSV

SEQ ID NO: 142917 - protein, 8 aa, Mycobacterium tuberculosis
VTRSVDPV

SEQ ID NO: 142918 - protein, 8 aa, Mycobacterium tuberculosis
DPVELEKL

SEQ ID NO: 142919 - protein, 8 aa, Mycobacterium tuberculosis
VELEKLRL

SEQ ID NO: 142920 - protein, 8 aa, Mycobacterium tuberculosis
LEVVNRGF

SEQ ID NO: 142921 - protein, 8 aa, Mycobacterium tuberculosis
GQNHQGHY

SEQ ID NO: 142922 - protein, 8 aa, Mycobacterium tuberculosis
GHYFAESL

SEQ ID NO: 142923 - protein, 8 aa, Mycobacterium tuberculosis
AESLTDSV

SEQ ID NO: 142924 - protein, 8 aa, Mycobacterium tuberculosis
SLTDSVLY

SEQ ID NO: 142925 - protein, 8 aa, Mycobacterium tuberculosis
LTDSVLYV

SEQ ID NO: 142926 - protein, 8 aa, Mycobacterium tuberculosis
SVLYVSFQ

SEQ ID NO: 142927 - protein, 8 aa, Mycobacterium tuberculosis
LYVSFQEL

SEQ ID NO: 142928 - protein, 8 aa, Mycobacterium tuberculosis
YVSFQELA

SEQ ID NO: 142929 - protein, 8 aa, Mycobacterium tuberculosis
SFQELATR

SEQ ID NO: 142930 - protein, 8 aa, Mycobacterium tuberculosis
FQELATRI

SEQ ID NO: 142931 - protein, 8 aa, Mycobacterium tuberculosis
LATRISHR

SEQ ID NO: 142932 - protein, 8 aa, Mycobacterium tuberculosis
ISHRNTGK

SEQ ID NO: 142933 - protein, 8 aa, Mycobacterium tuberculosis
DPVADQLM

SEQ ID NO: 142934 - protein, 8 aa, Mycobacterium tuberculosis
PVADQLMA

SEQ ID NO: 142935 - protein, 8 aa, Mycobacterium tuberculosis
VADQLMAK

SEQ ID NO: 142936 - protein, 8 aa, Mycobacterium tuberculosis
QLMAKISA

SEQ ID NO: 142937 - protein, 8 aa, Mycobacterium tuberculosis
KISADENL

SEQ ID NO: 142938 - protein, 8 aa, Mycobacterium tuberculosis
DENLHMIF

SEQ ID NO: 142939 - protein, 8 aa, Mycobacterium tuberculosis
ENLHMIFY

SEQ ID NO: 142940 - protein, 8 aa, Mycobacterium tuberculosis
NLHMIFYR

SEQ ID NO: 142941 - protein, 8 aa, Mycobacterium tuberculosis
HMIFYRDV

SEQ ID NO: 142942 - protein, 8 aa, Mycobacterium tuberculosis
SEAAFDLV

SEQ ID NO: 142943 - protein, 8 aa, Mycobacterium tuberculosis
DLVPNQAM

SEQ ID NO: 142944 - protein, 8 aa, Mycobacterium tuberculosis
LVPNQAMK

SEQ ID NO: 142945 - protein, 8 aa, Mycobacterium tuberculosis
AMKSLHLI

SEQ ID NO: 142946 - protein, 8 aa, Mycobacterium tuberculosis
SLHLILSH

SEQ ID NO: 142947 - protein, 8 aa, Mycobacterium tuberculosis
HLILSHFQ

SEQ ID NO: 142948 - protein, 8 aa, Mycobacterium tuberculosis
LILSHFQM

SEQ ID NO: 142949 - protein, 8 aa, Mycobacterium tuberculosis
FQMPGFQV

SEQ ID NO: 142950 - protein, 8 aa, Mycobacterium tuberculosis
MPGFQVPE

SEQ ID NO: 142951 - protein, 8 aa, Mycobacterium tuberculosis
GFQVPEFR

SEQ ID NO: 142952 - protein, 8 aa, Mycobacterium tuberculosis
FQVPEFRR

SEQ ID NO: 142953 - protein, 8 aa, Mycobacterium tuberculosis
QVPEFRRK

SEQ ID NO: 142954 - protein, 8 aa, Mycobacterium tuberculosis
VPEFRRKA

SEQ ID NO: 142955 - protein, 8 aa, Mycobacterium tuberculosis
RKAVVIAV

SEQ ID NO: 142956 - protein, 8 aa, Mycobacterium tuberculosis
VVIAVGGV

SEQ ID NO: 142957 - protein, 8 aa, Mycobacterium tuberculosis
VIAVGGVY

SEQ ID NO: 142958 - protein, 8 aa, Mycobacterium tuberculosis
VYDPRIHL

SEQ ID NO: 142959 - protein, 8 aa, Mycobacterium tuberculosis
RIHLDEVV

SEQ ID NO: 142960 - protein, 8 aa, Mycobacterium tuberculosis
HLDEVVMP

SEQ ID NO: 142961 - protein, 8 aa, Mycobacterium tuberculosis
DEVVMPVL

SEQ ID NO: 142962 - protein, 8 aa, Mycobacterium tuberculosis
EVVMPVLK

SEQ ID NO: 142963 - protein, 8 aa, Mycobacterium tuberculosis
VVMPVLKK

SEQ ID NO: 142964 - protein, 8 aa, Mycobacterium tuberculosis
MPVLKKWR

SEQ ID NO: 142965 - protein, 8 aa, Mycobacterium tuberculosis
VLKKWRIF

SEQ ID NO: 142966 - protein, 8 aa, Mycobacterium tuberculosis
KKWRIFER

SEQ ID NO: 142967 - protein, 8 aa, Mycobacterium tuberculosis
DFTGEGAK

SEQ ID NO: 142968 - protein, 8 aa, Mycobacterium tuberculosis
FTGEGAKL

SEQ ID NO: 142969 - protein, 8 aa, Mycobacterium tuberculosis
KLRDELAL

SEQ ID NO: 142970 - protein, 8 aa, Mycobacterium tuberculosis
LRDELALV

SEQ ID NO: 142971 - protein, 8 aa, Mycobacterium tuberculosis
LVIKDLEL

SEQ ID NO: 142972 - protein, 8 aa, Mycobacterium tuberculosis
VIKDLELA

SEQ ID NO: 142973 - protein, 8 aa, Mycobacterium tuberculosis
LACDKFEV

SEQ ID NO: 142974 - protein, 8 aa, Mycobacterium tuberculosis
KFEVSKQR

SEQ ID NO: 142975 - protein, 8 aa, Mycobacterium tuberculosis
EVSKQRQL

SEQ ID NO: 142976 - protein, 8 aa, Mycobacterium tuberculosis
RQLDREAR

SEQ ID NO: 142977 - protein, 8 aa, Mycobacterium tuberculosis
QLDREART

SEQ ID NO: 142978 - protein, 8 aa, Mycobacterium tuberculosis
VSAHELHK

SEQ ID NO: 142979 - protein, 8 aa, Mycobacterium tuberculosis
ELHKTAGK

SEQ ID NO: 142980 - protein, 8 aa, Mycobacterium tuberculosis
KTAGKLAM

SEQ ID NO: 142981 - protein, 9 aa, Mycobacterium tuberculosis
MSAKLTDLQ

SEQ ID NO: 142982 - protein, 9 aa, Mycobacterium tuberculosis
KLTDLQLLH

SEQ ID NO: 142983 - protein, 9 aa, Mycobacterium tuberculosis
QLLHELEPV

SEQ ID NO: 142984 - protein, 9 aa, Mycobacterium tuberculosis
LLHELEPVV

SEQ ID NO: 142985 - protein, 9 aa, Mycobacterium tuberculosis
ELEPVVEKY

SEQ ID NO: 142986 - protein, 9 aa, Mycobacterium tuberculosis
LEPVVEKYL

SEQ ID NO: 142987 - protein, 9 aa, Mycobacterium tuberculosis
KYLNRHLSM

SEQ ID NO: 142988 - protein, 9 aa, Mycobacterium tuberculosis
YLNRHLSMH

SEQ ID NO: 142989 - protein, 9 aa, Mycobacterium tuberculosis
LNRHLSMHK

SEQ ID NO: 142990 - protein, 9 aa, Mycobacterium tuberculosis
SMHKPWNPH

SEQ ID NO: 142991 - protein, 9 aa, Mycobacterium tuberculosis
KPWNPHDYI

SEQ ID NO: 142992 - protein, 9 aa, Mycobacterium tuberculosis
DYIPWSDGK

SEQ ID NO: 142993 - protein, 9 aa, Mycobacterium tuberculosis
IPWSDGKNY

SEQ ID NO: 142994 - protein, 9 aa, Mycobacterium tuberculosis
PWSDGKNYY

SEQ ID NO: 142995 - protein, 9 aa, Mycobacterium tuberculosis
YYALGGQDW

SEQ ID NO: 142996 - protein, 9 aa, Mycobacterium tuberculosis
SKLSDVAQV

SEQ ID NO: 142997 - protein, 9 aa, Mycobacterium tuberculosis
KLSDVAQVA

SEQ ID NO: 142998 - protein, 9 aa, Mycobacterium tuberculosis
LSDVAQVAM

SEQ ID NO: 142999 - protein, 9 aa, Mycobacterium tuberculosis
DVAQVAMVQ

SEQ ID NO: 143000 - protein, 9 aa, Mycobacterium tuberculosis
AQVAMVQNL

SEQ ID NO: 143001 - protein, 9 aa, Mycobacterium tuberculosis
QVAMVQNLV

SEQ ID NO: 143002 - protein, 9 aa, Mycobacterium tuberculosis
VTEDNLPSY

SEQ ID NO: 143003 - protein, 9 aa, Mycobacterium tuberculosis
EDNLPSYHR

SEQ ID NO: 143004 - protein, 9 aa, Mycobacterium tuberculosis
NLPSYHREI

SEQ ID NO: 143005 - protein, 9 aa, Mycobacterium tuberculosis
LPSYHREIA

SEQ ID NO: 143006 - protein, 9 aa, Mycobacterium tuberculosis
REIAMNMGM

SEQ ID NO: 143007 - protein, 9 aa, Mycobacterium tuberculosis
AMNMGMDGA

SEQ ID NO: 143008 - protein, 9 aa, Mycobacterium tuberculosis
GAWGQWVNR

SEQ ID NO: 143009 - protein, 9 aa, Mycobacterium tuberculosis
AWGQWVNRW

SEQ ID NO: 143010 - protein, 9 aa, Mycobacterium tuberculosis
GQWVNRWTA

SEQ ID NO: 143011 - protein, 9 aa, Mycobacterium tuberculosis
AEENRHGIA

SEQ ID NO: 143012 - protein, 9 aa, Mycobacterium tuberculosis
EENRHGIAL

SEQ ID NO: 143013 - protein, 9 aa, Mycobacterium tuberculosis
ENRHGIALR

SEQ ID NO: 143014 - protein, 9 aa, Mycobacterium tuberculosis
HGIALRDYL

SEQ ID NO: 143015 - protein, 9 aa, Mycobacterium tuberculosis
GIALRDYLV

SEQ ID NO: 143016 - protein, 9 aa, Mycobacterium tuberculosis
IALRDYLVV

SEQ ID NO: 143017 - protein, 9 aa, Mycobacterium tuberculosis
ALRDYLVVT

SEQ ID NO: 143018 - protein, 9 aa, Mycobacterium tuberculosis
DYLVVTRSV

SEQ ID NO: 143019 - protein, 9 aa, Mycobacterium tuberculosis
VVTRSVDPV

SEQ ID NO: 143020 - protein, 9 aa, Mycobacterium tuberculosis
TRSVDPVEL

SEQ ID NO: 143021 - protein, 9 aa, Mycobacterium tuberculosis
SVDPVELEK

SEQ ID NO: 143022 - protein, 9 aa, Mycobacterium tuberculosis
DPVELEKLR

SEQ ID NO: 143023 - protein, 9 aa, Mycobacterium tuberculosis
ELEKLRLEV

SEQ ID NO: 143024 - protein, 9 aa, Mycobacterium tuberculosis
KLRLEVVNR

SEQ ID NO: 143025 - protein, 9 aa, Mycobacterium tuberculosis
GQNHQGHYF

SEQ ID NO: 143026 - protein, 9 aa, Mycobacterium tuberculosis
HQGHYFAES

SEQ ID NO: 143027 - protein, 9 aa, Mycobacterium tuberculosis
FAESLTDSV

SEQ ID NO: 143028 - protein, 9 aa, Mycobacterium tuberculosis
AESLTDSVL

SEQ ID NO: 143029 - protein, 9 aa, Mycobacterium tuberculosis
ESLTDSVLY

SEQ ID NO: 143030 - protein, 9 aa, Mycobacterium tuberculosis
SLTDSVLYV

SEQ ID NO: 143031 - protein, 9 aa, Mycobacterium tuberculosis
DSVLYVSFQ

SEQ ID NO: 143032 - protein, 9 aa, Mycobacterium tuberculosis
VLYVSFQEL

SEQ ID NO: 143033 - protein, 9 aa, Mycobacterium tuberculosis
YVSFQELAT

SEQ ID NO: 143034 - protein, 9 aa, Mycobacterium tuberculosis
VSFQELATR

SEQ ID NO: 143035 - protein, 9 aa, Mycobacterium tuberculosis
ELATRISHR

SEQ ID NO: 143036 - protein, 9 aa, Mycobacterium tuberculosis
RISHRNTGK

SEQ ID NO: 143037 - protein, 9 aa, Mycobacterium tuberculosis
TGKACNDPV

SEQ ID NO: 143038 - protein, 9 aa, Mycobacterium tuberculosis
PVADQLMAK

SEQ ID NO: 143039 - protein, 9 aa, Mycobacterium tuberculosis
ISADENLHM

SEQ ID NO: 143040 - protein, 9 aa, Mycobacterium tuberculosis
SADENLHMI

SEQ ID NO: 143041 - protein, 9 aa, Mycobacterium tuberculosis
DENLHMIFY

SEQ ID NO: 143042 - protein, 9 aa, Mycobacterium tuberculosis
ENLHMIFYR

SEQ ID NO: 143043 - protein, 9 aa, Mycobacterium tuberculosis
FYRDVSEAA

SEQ ID NO: 143044 - protein, 9 aa, Mycobacterium tuberculosis
YRDVSEAAF

SEQ ID NO: 143045 - protein, 9 aa, Mycobacterium tuberculosis
DVSEAAFDL

SEQ ID NO: 143046 - protein, 9 aa, Mycobacterium tuberculosis
DLVPNQAMK

SEQ ID NO: 143047 - protein, 9 aa, Mycobacterium tuberculosis
VPNQAMKSL

SEQ ID NO: 143048 - protein, 9 aa, Mycobacterium tuberculosis
NQAMKSLHL

SEQ ID NO: 143049 - protein, 9 aa, Mycobacterium tuberculosis
QAMKSLHLI

SEQ ID NO: 143050 - protein, 9 aa, Mycobacterium tuberculosis
AMKSLHLIL

SEQ ID NO: 143051 - protein, 9 aa, Mycobacterium tuberculosis
KSLHLILSH

SEQ ID NO: 143052 - protein, 9 aa, Mycobacterium tuberculosis
SLHLILSHF

SEQ ID NO: 143053 - protein, 9 aa, Mycobacterium tuberculosis
HLILSHFQM

SEQ ID NO: 143054 - protein, 9 aa, Mycobacterium tuberculosis
FQMPGFQVP

SEQ ID NO: 143055 - protein, 9 aa, Mycobacterium tuberculosis
QMPGFQVPE

SEQ ID NO: 143056 - protein, 9 aa, Mycobacterium tuberculosis
MPGFQVPEF

SEQ ID NO: 143057 - protein, 9 aa, Mycobacterium tuberculosis
GFQVPEFRR

SEQ ID NO: 143058 - protein, 9 aa, Mycobacterium tuberculosis
VPEFRRKAV

SEQ ID NO: 143059 - protein, 9 aa, Mycobacterium tuberculosis
EFRRKAVVI

SEQ ID NO: 143060 - protein, 9 aa, Mycobacterium tuberculosis
RRKAVVIAV

SEQ ID NO: 143061 - protein, 9 aa, Mycobacterium tuberculosis
AVVIAVGGV

SEQ ID NO: 143062 - protein, 9 aa, Mycobacterium tuberculosis
VVIAVGGVY

SEQ ID NO: 143063 - protein, 9 aa, Mycobacterium tuberculosis
AVGGVYDPR

SEQ ID NO: 143064 - protein, 9 aa, Mycobacterium tuberculosis
GVYDPRIHL

SEQ ID NO: 143065 - protein, 9 aa, Mycobacterium tuberculosis
HLDEVVMPV

SEQ ID NO: 143066 - protein, 9 aa, Mycobacterium tuberculosis
EVVMPVLKK

SEQ ID NO: 143067 - protein, 9 aa, Mycobacterium tuberculosis
VVMPVLKKW

SEQ ID NO: 143068 - protein, 9 aa, Mycobacterium tuberculosis
VMPVLKKWR

SEQ ID NO: 143069 - protein, 9 aa, Mycobacterium tuberculosis
MPVLKKWRI

SEQ ID NO: 143070 - protein, 9 aa, Mycobacterium tuberculosis
PVLKKWRIF

SEQ ID NO: 143071 - protein, 9 aa, Mycobacterium tuberculosis
LKKWRIFER

SEQ ID NO: 143072 - protein, 9 aa, Mycobacterium tuberculosis
FTGEGAKLR

SEQ ID NO: 143073 - protein, 9 aa, Mycobacterium tuberculosis
EGAKLRDEL

SEQ ID NO: 143074 - protein, 9 aa, Mycobacterium tuberculosis
KLRDELALV

SEQ ID NO: 143075 - protein, 9 aa, Mycobacterium tuberculosis
ELALVIKDL

SEQ ID NO: 143076 - protein, 9 aa, Mycobacterium tuberculosis
ALVIKDLEL

SEQ ID NO: 143077 - protein, 9 aa, Mycobacterium tuberculosis
LVIKDLELA

SEQ ID NO: 143078 - protein, 9 aa, Mycobacterium tuberculosis
VIKDLELAC

SEQ ID NO: 143079 - protein, 9 aa, Mycobacterium tuberculosis
ELACDKFEV

SEQ ID NO: 143080 - protein, 9 aa, Mycobacterium tuberculosis
DKFEVSKQR

SEQ ID NO: 143081 - protein, 9 aa, Mycobacterium tuberculosis
RQLDREART

SEQ ID NO: 143082 - protein, 9 aa, Mycobacterium tuberculosis
LDREARTGK

SEQ ID NO: 143083 - protein, 9 aa, Mycobacterium tuberculosis
KVSAHELHK

SEQ ID NO: 143084 - protein, 9 aa, Mycobacterium tuberculosis
ELHKTAGKL

SEQ ID NO: 143085 - protein, 9 aa, Mycobacterium tuberculosis
TAGKLAMSR

SEQ ID NO: 143086 - protein, 10 aa, Mycobacterium tuberculosis
MSAKLTDLQL

SEQ ID NO: 143087 - protein, 10 aa, Mycobacterium tuberculosis
KLTDLQLLHE

SEQ ID NO: 143088 - protein, 10 aa, Mycobacterium tuberculosis
LTDLQLLHEL

SEQ ID NO: 143089 - protein, 10 aa, Mycobacterium tuberculosis
LQLLHELEPV

SEQ ID NO: 143090 - protein, 10 aa, Mycobacterium tuberculosis
QLLHELEPVV

SEQ ID NO: 143091 - protein, 10 aa, Mycobacterium tuberculosis
HELEPVVEKY

SEQ ID NO: 143092 - protein, 10 aa, Mycobacterium tuberculosis
ELEPVVEKYL

SEQ ID NO: 143093 - protein, 10 aa, Mycobacterium tuberculosis
EPVVEKYLNR

SEQ ID NO: 143094 - protein, 10 aa, Mycobacterium tuberculosis
YLNRHLSMHK

SEQ ID NO: 143095 - protein, 10 aa, Mycobacterium tuberculosis
YIPWSDGKNY

SEQ ID NO: 143096 - protein, 10 aa, Mycobacterium tuberculosis
IPWSDGKNYY

SEQ ID NO: 143097 - protein, 10 aa, Mycobacterium tuberculosis
NYYALGGQDW

SEQ ID NO: 143098 - protein, 10 aa, Mycobacterium tuberculosis
KLSDVAQVAM

SEQ ID NO: 143099 - protein, 10 aa, Mycobacterium tuberculosis
AQVAMVQNLV

SEQ ID NO: 143100 - protein, 10 aa, Mycobacterium tuberculosis
LVTEDNLPSY

SEQ ID NO: 143101 - protein, 10 aa, Mycobacterium tuberculosis
NLPSYHREIA

SEQ ID NO: 143102 - protein, 10 aa, Mycobacterium tuberculosis
LPSYHREIAM

SEQ ID NO: 143103 - protein, 10 aa, Mycobacterium tuberculosis
SYHREIAMNM

SEQ ID NO: 143104 - protein, 10 aa, Mycobacterium tuberculosis
IAMNMGMDGA

SEQ ID NO: 143105 - protein, 10 aa, Mycobacterium tuberculosis
NMGMDGAWGQ

SEQ ID NO: 143106 - protein, 10 aa, Mycobacterium tuberculosis
MGMDGAWGQW

SEQ ID NO: 143107 - protein, 10 aa, Mycobacterium tuberculosis
GMDGAWGQWV

SEQ ID NO: 143108 - protein, 10 aa, Mycobacterium tuberculosis
DGAWGQWVNR

SEQ ID NO: 143109 - protein, 10 aa, Mycobacterium tuberculosis
GAWGQWVNRW

SEQ ID NO: 143110 - protein, 10 aa, Mycobacterium tuberculosis
GQWVNRWTAE

SEQ ID NO: 143111 - protein, 10 aa, Mycobacterium tuberculosis
WTAEENRHGI

SEQ ID NO: 143112 - protein, 10 aa, Mycobacterium tuberculosis
AEENRHGIAL

SEQ ID NO: 143113 - protein, 10 aa, Mycobacterium tuberculosis
HGIALRDYLV

SEQ ID NO: 143114 - protein, 10 aa, Mycobacterium tuberculosis
GIALRDYLVV

SEQ ID NO: 143115 - protein, 10 aa, Mycobacterium tuberculosis
ALRDYLVVTR

SEQ ID NO: 143116 - protein, 10 aa, Mycobacterium tuberculosis
LVVTRSVDPV

SEQ ID NO: 143117 - protein, 10 aa, Mycobacterium tuberculosis
RSVDPVELEK

SEQ ID NO: 143118 - protein, 10 aa, Mycobacterium tuberculosis
SVDPVELEKL

SEQ ID NO: 143119 - protein, 10 aa, Mycobacterium tuberculosis
DPVELEKLRL

SEQ ID NO: 143120 - protein, 10 aa, Mycobacterium tuberculosis
VELEKLRLEV

SEQ ID NO: 143121 - protein, 10 aa, Mycobacterium tuberculosis
ELEKLRLEVV

SEQ ID NO: 143122 - protein, 10 aa, Mycobacterium tuberculosis
LRLEVVNRGF

SEQ ID NO: 143123 - protein, 10 aa, Mycobacterium tuberculosis
SPGQNHQGHY

SEQ ID NO: 143124 - protein, 10 aa, Mycobacterium tuberculosis
GQNHQGHYFA

SEQ ID NO: 143125 - protein, 10 aa, Mycobacterium tuberculosis
HQGHYFAESL

SEQ ID NO: 143126 - protein, 10 aa, Mycobacterium tuberculosis
YFAESLTDSV

SEQ ID NO: 143127 - protein, 10 aa, Mycobacterium tuberculosis
FAESLTDSVL

SEQ ID NO: 143128 - protein, 10 aa, Mycobacterium tuberculosis
AESLTDSVLY

SEQ ID NO: 143129 - protein, 10 aa, Mycobacterium tuberculosis
ESLTDSVLYV

SEQ ID NO: 143130 - protein, 10 aa, Mycobacterium tuberculosis
SLTDSVLYVS

SEQ ID NO: 143131 - protein, 10 aa, Mycobacterium tuberculosis
LTDSVLYVSF

SEQ ID NO: 143132 - protein, 10 aa, Mycobacterium tuberculosis
SVLYVSFQEL

SEQ ID NO: 143133 - protein, 10 aa, Mycobacterium tuberculosis
VLYVSFQELA

SEQ ID NO: 143134 - protein, 10 aa, Mycobacterium tuberculosis
YVSFQELATR

SEQ ID NO: 143135 - protein, 10 aa, Mycobacterium tuberculosis
TRISHRNTGK

SEQ ID NO: 143136 - protein, 10 aa, Mycobacterium tuberculosis
RISHRNTGKA

SEQ ID NO: 143137 - protein, 10 aa, Mycobacterium tuberculosis
NTGKACNDPV

SEQ ID NO: 143138 - protein, 10 aa, Mycobacterium tuberculosis
PVADQLMAKI

SEQ ID NO: 143139 - protein, 10 aa, Mycobacterium tuberculosis
KISADENLHM

SEQ ID NO: 143140 - protein, 10 aa, Mycobacterium tuberculosis
SADENLHMIF

SEQ ID NO: 143141 - protein, 10 aa, Mycobacterium tuberculosis
DENLHMIFYR

SEQ ID NO: 143142 - protein, 10 aa, Mycobacterium tuberculosis
NLHMIFYRDV

SEQ ID NO: 143143 - protein, 10 aa, Mycobacterium tuberculosis
MIFYRDVSEA

SEQ ID NO: 143144 - protein, 10 aa, Mycobacterium tuberculosis
FYRDVSEAAF

SEQ ID NO: 143145 - protein, 10 aa, Mycobacterium tuberculosis
DVSEAAFDLV

SEQ ID NO: 143146 - protein, 10 aa, Mycobacterium tuberculosis
LVPNQAMKSL

SEQ ID NO: 143147 - protein, 10 aa, Mycobacterium tuberculosis
VPNQAMKSLH

SEQ ID NO: 143148 - protein, 10 aa, Mycobacterium tuberculosis
NQAMKSLHLI

SEQ ID NO: 143149 - protein, 10 aa, Mycobacterium tuberculosis
KSLHLILSHF

SEQ ID NO: 143150 - protein, 10 aa, Mycobacterium tuberculosis
SLHLILSHFQ

SEQ ID NO: 143151 - protein, 10 aa, Mycobacterium tuberculosis
ILSHFQMPGF

SEQ ID NO: 143152 - protein, 10 aa, Mycobacterium tuberculosis
FQMPGFQVPE

SEQ ID NO: 143153 - protein, 10 aa, Mycobacterium tuberculosis
QMPGFQVPEF

SEQ ID NO: 143154 - protein, 10 aa, Mycobacterium tuberculosis
MPGFQVPEFR

SEQ ID NO: 143155 - protein, 10 aa, Mycobacterium tuberculosis
FQVPEFRRKA

SEQ ID NO: 143156 - protein, 10 aa, Mycobacterium tuberculosis
QVPEFRRKAV

SEQ ID NO: 143157 - protein, 10 aa, Mycobacterium tuberculosis
VPEFRRKAVV

SEQ ID NO: 143158 - protein, 10 aa, Mycobacterium tuberculosis
KAVVIAVGGV

SEQ ID NO: 143159 - protein, 10 aa, Mycobacterium tuberculosis
AVVIAVGGVY

SEQ ID NO: 143160 - protein, 10 aa, Mycobacterium tuberculosis
IAVGGVYDPR

SEQ ID NO: 143161 - protein, 10 aa, Mycobacterium tuberculosis
AVGGVYDPRI

SEQ ID NO: 143162 - protein, 10 aa, Mycobacterium tuberculosis
IHLDEVVMPV

SEQ ID NO: 143163 - protein, 10 aa, Mycobacterium tuberculosis
HLDEVVMPVL

SEQ ID NO: 143164 - protein, 10 aa, Mycobacterium tuberculosis
EVVMPVLKKW

SEQ ID NO: 143165 - protein, 10 aa, Mycobacterium tuberculosis
VVMPVLKKWR

SEQ ID NO: 143166 - protein, 10 aa, Mycobacterium tuberculosis
VMPVLKKWRI

SEQ ID NO: 143167 - protein, 10 aa, Mycobacterium tuberculosis
MPVLKKWRIF

SEQ ID NO: 143168 - protein, 10 aa, Mycobacterium tuberculosis
VLKKWRIFER

SEQ ID NO: 143169 - protein, 10 aa, Mycobacterium tuberculosis
KWRIFEREDF

SEQ ID NO: 143170 - protein, 10 aa, Mycobacterium tuberculosis
DFTGEGAKLR

SEQ ID NO: 143171 - protein, 10 aa, Mycobacterium tuberculosis
GEGAKLRDEL

SEQ ID NO: 143172 - protein, 10 aa, Mycobacterium tuberculosis
EGAKLRDELA

SEQ ID NO: 143173 - protein, 10 aa, Mycobacterium tuberculosis
KLRDELALVI

SEQ ID NO: 143174 - protein, 10 aa, Mycobacterium tuberculosis
DELALVIKDL

SEQ ID NO: 143175 - protein, 10 aa, Mycobacterium tuberculosis
ALVIKDLELA

SEQ ID NO: 143176 - protein, 10 aa, Mycobacterium tuberculosis
LELACDKFEV

SEQ ID NO: 143177 - protein, 10 aa, Mycobacterium tuberculosis
LACDKFEVSK

SEQ ID NO: 143178 - protein, 10 aa, Mycobacterium tuberculosis
EVSKQRQLDR

SEQ ID NO: 143179 - protein, 10 aa, Mycobacterium tuberculosis
KQRQLDREAR

SEQ ID NO: 143180 - protein, 10 aa, Mycobacterium tuberculosis
LDREARTGKK

SEQ ID NO: 143181 - protein, 10 aa, Mycobacterium tuberculosis
KKVSAHELHK

SEQ ID NO: 143182 - protein, 10 aa, Mycobacterium tuberculosis
HELHKTAGKL

SEQ ID NO: 143183 - protein, 10 aa, Mycobacterium tuberculosis
KTAGKLAMSR

SEQ ID NO: 143184 - protein, 10 aa, Mycobacterium tuberculosis
TAGKLAMSRR

SEQ ID NO: 143185 - protein, 11 aa, Mycobacterium tuberculosis
MSAKLTDLQLL

SEQ ID NO: 143186 - protein, 11 aa, Mycobacterium tuberculosis
KLTDLQLLHEL

SEQ ID NO: 143187 - protein, 11 aa, Mycobacterium tuberculosis
DLQLLHELEPV

SEQ ID NO: 143188 - protein, 11 aa, Mycobacterium tuberculosis
LQLLHELEPVV

SEQ ID NO: 143189 - protein, 11 aa, Mycobacterium tuberculosis
LLHELEPVVEK

SEQ ID NO: 143190 - protein, 11 aa, Mycobacterium tuberculosis
HELEPVVEKYL

SEQ ID NO: 143191 - protein, 11 aa, Mycobacterium tuberculosis
EPVVEKYLNRH

SEQ ID NO: 143192 - protein, 11 aa, Mycobacterium tuberculosis
KYLNRHLSMHK

SEQ ID NO: 143193 - protein, 11 aa, Mycobacterium tuberculosis
YLNRHLSMHKP

SEQ ID NO: 143194 - protein, 11 aa, Mycobacterium tuberculosis
SMHKPWNPHDY

SEQ ID NO: 143195 - protein, 11 aa, Mycobacterium tuberculosis
KPWNPHDYIPW

SEQ ID NO: 143196 - protein, 11 aa, Mycobacterium tuberculosis
DYIPWSDGKNY

SEQ ID NO: 143197 - protein, 11 aa, Mycobacterium tuberculosis
YIPWSDGKNYY

SEQ ID NO: 143198 - protein, 11 aa, Mycobacterium tuberculosis
IPWSDGKNYYA

SEQ ID NO: 143199 - protein, 11 aa, Mycobacterium tuberculosis
KNYYALGGQDW

SEQ ID NO: 143200 - protein, 11 aa, Mycobacterium tuberculosis
ALGGQDWDPDQ

SEQ ID NO: 143201 - protein, 11 aa, Mycobacterium tuberculosis
KLSDVAQVAMV

SEQ ID NO: 143202 - protein, 11 aa, Mycobacterium tuberculosis
DVAQVAMVQNL

SEQ ID NO: 143203 - protein, 11 aa, Mycobacterium tuberculosis
AQVAMVQNLVT

SEQ ID NO: 143204 - protein, 11 aa, Mycobacterium tuberculosis
MVQNLVTEDNL

SEQ ID NO: 143205 - protein, 11 aa, Mycobacterium tuberculosis
NLVTEDNLPSY

SEQ ID NO: 143206 - protein, 11 aa, Mycobacterium tuberculosis
VTEDNLPSYHR

SEQ ID NO: 143207 - protein, 11 aa, Mycobacterium tuberculosis
NLPSYHREIAM

SEQ ID NO: 143208 - protein, 11 aa, Mycobacterium tuberculosis
REIAMNMGMDG

SEQ ID NO: 143209 - protein, 11 aa, Mycobacterium tuberculosis
EIAMNMGMDGA

SEQ ID NO: 143210 - protein, 11 aa, Mycobacterium tuberculosis
IAMNMGMDGAW

SEQ ID NO: 143211 - protein, 11 aa, Mycobacterium tuberculosis
MGMDGAWGQWV

SEQ ID NO: 143212 - protein, 11 aa, Mycobacterium tuberculosis
GMDGAWGQWVN

SEQ ID NO: 143213 - protein, 11 aa, Mycobacterium tuberculosis
DGAWGQWVNRW

SEQ ID NO: 143214 - protein, 11 aa, Mycobacterium tuberculosis
WVNRWTAEENR

SEQ ID NO: 143215 - protein, 11 aa, Mycobacterium tuberculosis
WTAEENRHGIA

SEQ ID NO: 143216 - protein, 11 aa, Mycobacterium tuberculosis
TAEENRHGIAL

SEQ ID NO: 143217 - protein, 11 aa, Mycobacterium tuberculosis
HGIALRDYLVV

SEQ ID NO: 143218 - protein, 11 aa, Mycobacterium tuberculosis
IALRDYLVVTR

SEQ ID NO: 143219 - protein, 11 aa, Mycobacterium tuberculosis
ALRDYLVVTRS

SEQ ID NO: 143220 - protein, 11 aa, Mycobacterium tuberculosis
YLVVTRSVDPV

SEQ ID NO: 143221 - protein, 11 aa, Mycobacterium tuberculosis
SVDPVELEKLR

SEQ ID NO: 143222 - protein, 11 aa, Mycobacterium tuberculosis
VELEKLRLEVV

SEQ ID NO: 143223 - protein, 11 aa, Mycobacterium tuberculosis
KLRLEVVNRGF

SEQ ID NO: 143224 - protein, 11 aa, Mycobacterium tuberculosis
FSPGQNHQGHY

SEQ ID NO: 143225 - protein, 11 aa, Mycobacterium tuberculosis
SPGQNHQGHYF

SEQ ID NO: 143226 - protein, 11 aa, Mycobacterium tuberculosis
NHQGHYFAESL

SEQ ID NO: 143227 - protein, 11 aa, Mycobacterium tuberculosis
HYFAESLTDSV

SEQ ID NO: 143228 - protein, 11 aa, Mycobacterium tuberculosis
YFAESLTDSVL

SEQ ID NO: 143229 - protein, 11 aa, Mycobacterium tuberculosis
FAESLTDSVLY

SEQ ID NO: 143230 - protein, 11 aa, Mycobacterium tuberculosis
AESLTDSVLYV

SEQ ID NO: 143231 - protein, 11 aa, Mycobacterium tuberculosis
SLTDSVLYVSF

SEQ ID NO: 143232 - protein, 11 aa, Mycobacterium tuberculosis
DSVLYVSFQEL

SEQ ID NO: 143233 - protein, 11 aa, Mycobacterium tuberculosis
SVLYVSFQELA

SEQ ID NO: 143234 - protein, 11 aa, Mycobacterium tuberculosis
VLYVSFQELAT

SEQ ID NO: 143235 - protein, 11 aa, Mycobacterium tuberculosis
LYVSFQELATR

SEQ ID NO: 143236 - protein, 11 aa, Mycobacterium tuberculosis
YVSFQELATRI

SEQ ID NO: 143237 - protein, 11 aa, Mycobacterium tuberculosis
ATRISHRNTGK

SEQ ID NO: 143238 - protein, 11 aa, Mycobacterium tuberculosis
DPVADQLMAKI

SEQ ID NO: 143239 - protein, 11 aa, Mycobacterium tuberculosis
LMAKISADENL

SEQ ID NO: 143240 - protein, 11 aa, Mycobacterium tuberculosis
KISADENLHMI

SEQ ID NO: 143241 - protein, 11 aa, Mycobacterium tuberculosis
ISADENLHMIF

SEQ ID NO: 143242 - protein, 11 aa, Mycobacterium tuberculosis
SADENLHMIFY

SEQ ID NO: 143243 - protein, 11 aa, Mycobacterium tuberculosis
HMIFYRDVSEA

SEQ ID NO: 143244 - protein, 11 aa, Mycobacterium tuberculosis
MIFYRDVSEAA

SEQ ID NO: 143245 - protein, 11 aa, Mycobacterium tuberculosis
IFYRDVSEAAF

SEQ ID NO: 143246 - protein, 11 aa, Mycobacterium tuberculosis
YRDVSEAAFDL

SEQ ID NO: 143247 - protein, 11 aa, Mycobacterium tuberculosis
EAAFDLVPNQA

SEQ ID NO: 143248 - protein, 11 aa, Mycobacterium tuberculosis
AAFDLVPNQAM

SEQ ID NO: 143249 - protein, 11 aa, Mycobacterium tuberculosis
DLVPNQAMKSL

SEQ ID NO: 143250 - protein, 11 aa, Mycobacterium tuberculosis
VPNQAMKSLHL

SEQ ID NO: 143251 - protein, 11 aa, Mycobacterium tuberculosis
AMKSLHLILSH

SEQ ID NO: 143252 - protein, 11 aa, Mycobacterium tuberculosis
SLHLILSHFQM

SEQ ID NO: 143253 - protein, 11 aa, Mycobacterium tuberculosis
LILSHFQMPGF

SEQ ID NO: 143254 - protein, 11 aa, Mycobacterium tuberculosis
ILSHFQMPGFQ

SEQ ID NO: 143255 - protein, 11 aa, Mycobacterium tuberculosis
FQMPGFQVPEF

SEQ ID NO: 143256 - protein, 11 aa, Mycobacterium tuberculosis
QMPGFQVPEFR

SEQ ID NO: 143257 - protein, 11 aa, Mycobacterium tuberculosis
MPGFQVPEFRR

SEQ ID NO: 143258 - protein, 11 aa, Mycobacterium tuberculosis
FQVPEFRRKAV

SEQ ID NO: 143259 - protein, 11 aa, Mycobacterium tuberculosis
QVPEFRRKAVV

SEQ ID NO: 143260 - protein, 11 aa, Mycobacterium tuberculosis
VPEFRRKAVVI

SEQ ID NO: 143261 - protein, 11 aa, Mycobacterium tuberculosis
RKAVVIAVGGV

SEQ ID NO: 143262 - protein, 11 aa, Mycobacterium tuberculosis
KAVVIAVGGVY

SEQ ID NO: 143263 - protein, 11 aa, Mycobacterium tuberculosis
VIAVGGVYDPR

SEQ ID NO: 143264 - protein, 11 aa, Mycobacterium tuberculosis
VYDPRIHLDEV

SEQ ID NO: 143265 - protein, 11 aa, Mycobacterium tuberculosis
DPRIHLDEVVM

SEQ ID NO: 143266 - protein, 11 aa, Mycobacterium tuberculosis
RIHLDEVVMPV

SEQ ID NO: 143267 - protein, 11 aa, Mycobacterium tuberculosis
IHLDEVVMPVL

SEQ ID NO: 143268 - protein, 11 aa, Mycobacterium tuberculosis
HLDEVVMPVLK

SEQ ID NO: 143269 - protein, 11 aa, Mycobacterium tuberculosis
DEVVMPVLKKW

SEQ ID NO: 143270 - protein, 11 aa, Mycobacterium tuberculosis
EVVMPVLKKWR

SEQ ID NO: 143271 - protein, 11 aa, Mycobacterium tuberculosis
VVMPVLKKWRI

SEQ ID NO: 143272 - protein, 11 aa, Mycobacterium tuberculosis
MPVLKKWRIFE

SEQ ID NO: 143273 - protein, 11 aa, Mycobacterium tuberculosis
PVLKKWRIFER

SEQ ID NO: 143274 - protein, 11 aa, Mycobacterium tuberculosis
RIFEREDFTGE

SEQ ID NO: 143275 - protein, 11 aa, Mycobacterium tuberculosis
FEREDFTGEGA

SEQ ID NO: 143276 - protein, 11 aa, Mycobacterium tuberculosis
REDFTGEGAKL

SEQ ID NO: 143277 - protein, 11 aa, Mycobacterium tuberculosis
EDFTGEGAKLR

SEQ ID NO: 143278 - protein, 11 aa, Mycobacterium tuberculosis
GAKLRDELALV

SEQ ID NO: 143279 - protein, 11 aa, Mycobacterium tuberculosis
KLRDELALVIK

SEQ ID NO: 143280 - protein, 11 aa, Mycobacterium tuberculosis
ELALVIKDLEL

SEQ ID NO: 143281 - protein, 11 aa, Mycobacterium tuberculosis
DLELACDKFEV

SEQ ID NO: 143282 - protein, 11 aa, Mycobacterium tuberculosis
ELACDKFEVSK

SEQ ID NO: 143283 - protein, 11 aa, Mycobacterium tuberculosis
RQLDREARTGK

SEQ ID NO: 143284 - protein, 11 aa, Mycobacterium tuberculosis
QLDREARTGKK

SEQ ID NO: 143285 - protein, 11 aa, Mycobacterium tuberculosis
GKKVSAHELHK

SEQ ID NO: 143286 - protein, 11 aa, Mycobacterium tuberculosis
SAHELHKTAGK

SEQ ID NO: 143287 - protein, 11 aa, Mycobacterium tuberculosis
ELHKTAGKLAM

SEQ ID NO: 143288 - protein, 11 aa, Mycobacterium tuberculosis
KTAGKLAMSRR

SEQ ID NO: 143289 - protein, 13 aa, Mycobacterium tuberculosis
MSAKLTDLQLLHE

SEQ ID NO: 143290 - protein, 13 aa, Mycobacterium tuberculosis
SAKLTDLQLLHEL

SEQ ID NO: 143291 - protein, 13 aa, Mycobacterium tuberculosis
AKLTDLQLLHELE

SEQ ID NO: 143292 - protein, 13 aa, Mycobacterium tuberculosis
KLTDLQLLHELEP

SEQ ID NO: 143293 - protein, 13 aa, Mycobacterium tuberculosis
LTDLQLLHELEPV

SEQ ID NO: 143294 - protein, 13 aa, Mycobacterium tuberculosis
TDLQLLHELEPVV

SEQ ID NO: 143295 - protein, 13 aa, Mycobacterium tuberculosis
DLQLLHELEPVVE

SEQ ID NO: 143296 - protein, 13 aa, Mycobacterium tuberculosis
LQLLHELEPVVEK

SEQ ID NO: 143297 - protein, 13 aa, Mycobacterium tuberculosis
QLLHELEPVVEKY

SEQ ID NO: 143298 - protein, 13 aa, Mycobacterium tuberculosis
LLHELEPVVEKYL

SEQ ID NO: 143299 - protein, 13 aa, Mycobacterium tuberculosis
LHELEPVVEKYLN

SEQ ID NO: 143300 - protein, 13 aa, Mycobacterium tuberculosis
HELEPVVEKYLNR

SEQ ID NO: 143301 - protein, 13 aa, Mycobacterium tuberculosis
ELEPVVEKYLNRH

SEQ ID NO: 143302 - protein, 13 aa, Mycobacterium tuberculosis
LEPVVEKYLNRHL

SEQ ID NO: 143303 - protein, 13 aa, Mycobacterium tuberculosis
EPVVEKYLNRHLS

SEQ ID NO: 143304 - protein, 13 aa, Mycobacterium tuberculosis
PVVEKYLNRHLSM

SEQ ID NO: 143305 - protein, 13 aa, Mycobacterium tuberculosis
VVEKYLNRHLSMH

SEQ ID NO: 143306 - protein, 13 aa, Mycobacterium tuberculosis
VEKYLNRHLSMHK

SEQ ID NO: 143307 - protein, 13 aa, Mycobacterium tuberculosis
EKYLNRHLSMHKP

SEQ ID NO: 143308 - protein, 13 aa, Mycobacterium tuberculosis
KYLNRHLSMHKPW

SEQ ID NO: 143309 - protein, 13 aa, Mycobacterium tuberculosis
YLNRHLSMHKPWN

SEQ ID NO: 143310 - protein, 13 aa, Mycobacterium tuberculosis
LNRHLSMHKPWNP

SEQ ID NO: 143311 - protein, 13 aa, Mycobacterium tuberculosis
NRHLSMHKPWNPH

SEQ ID NO: 143312 - protein, 13 aa, Mycobacterium tuberculosis
RHLSMHKPWNPHD

SEQ ID NO: 143313 - protein, 13 aa, Mycobacterium tuberculosis
HLSMHKPWNPHDY

SEQ ID NO: 143314 - protein, 13 aa, Mycobacterium tuberculosis
LSMHKPWNPHDYI

SEQ ID NO: 143315 - protein, 13 aa, Mycobacterium tuberculosis
SMHKPWNPHDYIP

SEQ ID NO: 143316 - protein, 13 aa, Mycobacterium tuberculosis
MHKPWNPHDYIPW

SEQ ID NO: 143317 - protein, 13 aa, Mycobacterium tuberculosis
HKPWNPHDYIPWS

SEQ ID NO: 143318 - protein, 13 aa, Mycobacterium tuberculosis
KPWNPHDYIPWSD

SEQ ID NO: 143319 - protein, 13 aa, Mycobacterium tuberculosis
PWNPHDYIPWSDG

SEQ ID NO: 143320 - protein, 13 aa, Mycobacterium tuberculosis
WNPHDYIPWSDGK

SEQ ID NO: 143321 - protein, 13 aa, Mycobacterium tuberculosis
NPHDYIPWSDGKN

SEQ ID NO: 143322 - protein, 13 aa, Mycobacterium tuberculosis
PHDYIPWSDGKNY

SEQ ID NO: 143323 - protein, 13 aa, Mycobacterium tuberculosis
HDYIPWSDGKNYY

SEQ ID NO: 143324 - protein, 13 aa, Mycobacterium tuberculosis
DYIPWSDGKNYYA

SEQ ID NO: 143325 - protein, 13 aa, Mycobacterium tuberculosis
YIPWSDGKNYYAL

SEQ ID NO: 143326 - protein, 13 aa, Mycobacterium tuberculosis
IPWSDGKNYYALG

SEQ ID NO: 143327 - protein, 13 aa, Mycobacterium tuberculosis
PWSDGKNYYALGG

SEQ ID NO: 143328 - protein, 13 aa, Mycobacterium tuberculosis
WSDGKNYYALGGQ

SEQ ID NO: 143329 - protein, 13 aa, Mycobacterium tuberculosis
SDGKNYYALGGQD

SEQ ID NO: 143330 - protein, 13 aa, Mycobacterium tuberculosis
DGKNYYALGGQDW

SEQ ID NO: 143331 - protein, 13 aa, Mycobacterium tuberculosis
GKNYYALGGQDWD

SEQ ID NO: 143332 - protein, 13 aa, Mycobacterium tuberculosis
KNYYALGGQDWDP

SEQ ID NO: 143333 - protein, 13 aa, Mycobacterium tuberculosis
NYYALGGQDWDPD

SEQ ID NO: 143334 - protein, 13 aa, Mycobacterium tuberculosis
YYALGGQDWDPDQ

SEQ ID NO: 143335 - protein, 13 aa, Mycobacterium tuberculosis
YALGGQDWDPDQS

SEQ ID NO: 143336 - protein, 13 aa, Mycobacterium tuberculosis
ALGGQDWDPDQSK

SEQ ID NO: 143337 - protein, 13 aa, Mycobacterium tuberculosis
LGGQDWDPDQSKL

SEQ ID NO: 143338 - protein, 13 aa, Mycobacterium tuberculosis
GGQDWDPDQSKLS

SEQ ID NO: 143339 - protein, 13 aa, Mycobacterium tuberculosis
GQDWDPDQSKLSD

SEQ ID NO: 143340 - protein, 13 aa, Mycobacterium tuberculosis
QDWDPDQSKLSDV

SEQ ID NO: 143341 - protein, 13 aa, Mycobacterium tuberculosis
DWDPDQSKLSDVA

SEQ ID NO: 143342 - protein, 13 aa, Mycobacterium tuberculosis
WDPDQSKLSDVAQ

SEQ ID NO: 143343 - protein, 13 aa, Mycobacterium tuberculosis
DPDQSKLSDVAQV

SEQ ID NO: 143344 - protein, 13 aa, Mycobacterium tuberculosis
PDQSKLSDVAQVA

SEQ ID NO: 143345 - protein, 13 aa, Mycobacterium tuberculosis
DQSKLSDVAQVAM

SEQ ID NO: 143346 - protein, 13 aa, Mycobacterium tuberculosis
QSKLSDVAQVAMV

SEQ ID NO: 143347 - protein, 13 aa, Mycobacterium tuberculosis
SKLSDVAQVAMVQ

SEQ ID NO: 143348 - protein, 13 aa, Mycobacterium tuberculosis
KLSDVAQVAMVQN

SEQ ID NO: 143349 - protein, 13 aa, Mycobacterium tuberculosis
LSDVAQVAMVQNL

SEQ ID NO: 143350 - protein, 13 aa, Mycobacterium tuberculosis
SDVAQVAMVQNLV

SEQ ID NO: 143351 - protein, 13 aa, Mycobacterium tuberculosis
DVAQVAMVQNLVT

SEQ ID NO: 143352 - protein, 13 aa, Mycobacterium tuberculosis
VAQVAMVQNLVTE

SEQ ID NO: 143353 - protein, 13 aa, Mycobacterium tuberculosis
AQVAMVQNLVTED

SEQ ID NO: 143354 - protein, 13 aa, Mycobacterium tuberculosis
QVAMVQNLVTEDN

SEQ ID NO: 143355 - protein, 13 aa, Mycobacterium tuberculosis
VAMVQNLVTEDNL

SEQ ID NO: 143356 - protein, 13 aa, Mycobacterium tuberculosis
AMVQNLVTEDNLP

SEQ ID NO: 143357 - protein, 13 aa, Mycobacterium tuberculosis
MVQNLVTEDNLPS

SEQ ID NO: 143358 - protein, 13 aa, Mycobacterium tuberculosis
VQNLVTEDNLPSY

SEQ ID NO: 143359 - protein, 13 aa, Mycobacterium tuberculosis
QNLVTEDNLPSYH

SEQ ID NO: 143360 - protein, 13 aa, Mycobacterium tuberculosis
NLVTEDNLPSYHR

SEQ ID NO: 143361 - protein, 13 aa, Mycobacterium tuberculosis
LVTEDNLPSYHRE

SEQ ID NO: 143362 - protein, 13 aa, Mycobacterium tuberculosis
VTEDNLPSYHREI

SEQ ID NO: 143363 - protein, 13 aa, Mycobacterium tuberculosis
TEDNLPSYHREIA

SEQ ID NO: 143364 - protein, 13 aa, Mycobacterium tuberculosis
EDNLPSYHREIAM

SEQ ID NO: 143365 - protein, 13 aa, Mycobacterium tuberculosis
DNLPSYHREIAMN

SEQ ID NO: 143366 - protein, 13 aa, Mycobacterium tuberculosis
NLPSYHREIAMNM

SEQ ID NO: 143367 - protein, 13 aa, Mycobacterium tuberculosis
LPSYHREIAMNMG

SEQ ID NO: 143368 - protein, 13 aa, Mycobacterium tuberculosis
PSYHREIAMNMGM

SEQ ID NO: 143369 - protein, 13 aa, Mycobacterium tuberculosis
SYHREIAMNMGMD

SEQ ID NO: 143370 - protein, 13 aa, Mycobacterium tuberculosis
YHREIAMNMGMDG

SEQ ID NO: 143371 - protein, 13 aa, Mycobacterium tuberculosis
HREIAMNMGMDGA

SEQ ID NO: 143372 - protein, 13 aa, Mycobacterium tuberculosis
REIAMNMGMDGAW

SEQ ID NO: 143373 - protein, 13 aa, Mycobacterium tuberculosis
EIAMNMGMDGAWG

SEQ ID NO: 143374 - protein, 13 aa, Mycobacterium tuberculosis
IAMNMGMDGAWGQ

SEQ ID NO: 143375 - protein, 13 aa, Mycobacterium tuberculosis
AMNMGMDGAWGQW

SEQ ID NO: 143376 - protein, 13 aa, Mycobacterium tuberculosis
MNMGMDGAWGQWV

SEQ ID NO: 143377 - protein, 13 aa, Mycobacterium tuberculosis
NMGMDGAWGQWVN

SEQ ID NO: 143378 - protein, 13 aa, Mycobacterium tuberculosis
MGMDGAWGQWVNR

SEQ ID NO: 143379 - protein, 13 aa, Mycobacterium tuberculosis
GMDGAWGQWVNRW

SEQ ID NO: 143380 - protein, 13 aa, Mycobacterium tuberculosis
MDGAWGQWVNRWT

SEQ ID NO: 143381 - protein, 13 aa, Mycobacterium tuberculosis
DGAWGQWVNRWTA

SEQ ID NO: 143382 - protein, 13 aa, Mycobacterium tuberculosis
GAWGQWVNRWTAE

SEQ ID NO: 143383 - protein, 13 aa, Mycobacterium tuberculosis
AWGQWVNRWTAEE

SEQ ID NO: 143384 - protein, 13 aa, Mycobacterium tuberculosis
WGQWVNRWTAEEN

SEQ ID NO: 143385 - protein, 13 aa, Mycobacterium tuberculosis
GQWVNRWTAEENR

SEQ ID NO: 143386 - protein, 13 aa, Mycobacterium tuberculosis
QWVNRWTAEENRH

SEQ ID NO: 143387 - protein, 13 aa, Mycobacterium tuberculosis
WVNRWTAEENRHG

SEQ ID NO: 143388 - protein, 13 aa, Mycobacterium tuberculosis
VNRWTAEENRHGI

SEQ ID NO: 143389 - protein, 13 aa, Mycobacterium tuberculosis
NRWTAEENRHGIA

SEQ ID NO: 143390 - protein, 13 aa, Mycobacterium tuberculosis
RWTAEENRHGIAL

SEQ ID NO: 143391 - protein, 13 aa, Mycobacterium tuberculosis
WTAEENRHGIALR

SEQ ID NO: 143392 - protein, 13 aa, Mycobacterium tuberculosis
TAEENRHGIALRD

SEQ ID NO: 143393 - protein, 13 aa, Mycobacterium tuberculosis
AEENRHGIALRDY

SEQ ID NO: 143394 - protein, 13 aa, Mycobacterium tuberculosis
EENRHGIALRDYL

SEQ ID NO: 143395 - protein, 13 aa, Mycobacterium tuberculosis
ENRHGIALRDYLV

SEQ ID NO: 143396 - protein, 13 aa, Mycobacterium tuberculosis
NRHGIALRDYLVV

SEQ ID NO: 143397 - protein, 13 aa, Mycobacterium tuberculosis
RHGIALRDYLVVT

SEQ ID NO: 143398 - protein, 13 aa, Mycobacterium tuberculosis
HGIALRDYLVVTR

SEQ ID NO: 143399 - protein, 13 aa, Mycobacterium tuberculosis
GIALRDYLVVTRS

SEQ ID NO: 143400 - protein, 13 aa, Mycobacterium tuberculosis
IALRDYLVVTRSV

SEQ ID NO: 143401 - protein, 13 aa, Mycobacterium tuberculosis
ALRDYLVVTRSVD

SEQ ID NO: 143402 - protein, 13 aa, Mycobacterium tuberculosis
LRDYLVVTRSVDP

SEQ ID NO: 143403 - protein, 13 aa, Mycobacterium tuberculosis
RDYLVVTRSVDPV

SEQ ID NO: 143404 - protein, 13 aa, Mycobacterium tuberculosis
DYLVVTRSVDPVE

SEQ ID NO: 143405 - protein, 13 aa, Mycobacterium tuberculosis
YLVVTRSVDPVEL

SEQ ID NO: 143406 - protein, 13 aa, Mycobacterium tuberculosis
LVVTRSVDPVELE

SEQ ID NO: 143407 - protein, 13 aa, Mycobacterium tuberculosis
VVTRSVDPVELEK

SEQ ID NO: 143408 - protein, 13 aa, Mycobacterium tuberculosis
VTRSVDPVELEKL

SEQ ID NO: 143409 - protein, 13 aa, Mycobacterium tuberculosis
TRSVDPVELEKLR

SEQ ID NO: 143410 - protein, 13 aa, Mycobacterium tuberculosis
RSVDPVELEKLRL

SEQ ID NO: 143411 - protein, 13 aa, Mycobacterium tuberculosis
SVDPVELEKLRLE

SEQ ID NO: 143412 - protein, 13 aa, Mycobacterium tuberculosis
VDPVELEKLRLEV

SEQ ID NO: 143413 - protein, 13 aa, Mycobacterium tuberculosis
DPVELEKLRLEVV

SEQ ID NO: 143414 - protein, 13 aa, Mycobacterium tuberculosis
PVELEKLRLEVVN

SEQ ID NO: 143415 - protein, 13 aa, Mycobacterium tuberculosis
VELEKLRLEVVNR

SEQ ID NO: 143416 - protein, 13 aa, Mycobacterium tuberculosis
ELEKLRLEVVNRG

SEQ ID NO: 143417 - protein, 13 aa, Mycobacterium tuberculosis
LEKLRLEVVNRGF

SEQ ID NO: 143418 - protein, 13 aa, Mycobacterium tuberculosis
EKLRLEVVNRGFS

SEQ ID NO: 143419 - protein, 13 aa, Mycobacterium tuberculosis
KLRLEVVNRGFSP

SEQ ID NO: 143420 - protein, 13 aa, Mycobacterium tuberculosis
LRLEVVNRGFSPG

SEQ ID NO: 143421 - protein, 13 aa, Mycobacterium tuberculosis
RLEVVNRGFSPGQ

SEQ ID NO: 143422 - protein, 13 aa, Mycobacterium tuberculosis
LEVVNRGFSPGQN

SEQ ID NO: 143423 - protein, 13 aa, Mycobacterium tuberculosis
EVVNRGFSPGQNH

SEQ ID NO: 143424 - protein, 13 aa, Mycobacterium tuberculosis
VVNRGFSPGQNHQ

SEQ ID NO: 143425 - protein, 13 aa, Mycobacterium tuberculosis
VNRGFSPGQNHQG

SEQ ID NO: 143426 - protein, 13 aa, Mycobacterium tuberculosis
NRGFSPGQNHQGH

SEQ ID NO: 143427 - protein, 13 aa, Mycobacterium tuberculosis
RGFSPGQNHQGHY

SEQ ID NO: 143428 - protein, 13 aa, Mycobacterium tuberculosis
GFSPGQNHQGHYF

SEQ ID NO: 143429 - protein, 13 aa, Mycobacterium tuberculosis
FSPGQNHQGHYFA

SEQ ID NO: 143430 - protein, 13 aa, Mycobacterium tuberculosis
SPGQNHQGHYFAE

SEQ ID NO: 143431 - protein, 13 aa, Mycobacterium tuberculosis
PGQNHQGHYFAES

SEQ ID NO: 143432 - protein, 13 aa, Mycobacterium tuberculosis
GQNHQGHYFAESL

SEQ ID NO: 143433 - protein, 13 aa, Mycobacterium tuberculosis
QNHQGHYFAESLT

SEQ ID NO: 143434 - protein, 13 aa, Mycobacterium tuberculosis
NHQGHYFAESLTD

SEQ ID NO: 143435 - protein, 13 aa, Mycobacterium tuberculosis
HQGHYFAESLTDS

SEQ ID NO: 143436 - protein, 13 aa, Mycobacterium tuberculosis
QGHYFAESLTDSV

SEQ ID NO: 143437 - protein, 13 aa, Mycobacterium tuberculosis
GHYFAESLTDSVL

SEQ ID NO: 143438 - protein, 13 aa, Mycobacterium tuberculosis
HYFAESLTDSVLY

SEQ ID NO: 143439 - protein, 13 aa, Mycobacterium tuberculosis
YFAESLTDSVLYV

SEQ ID NO: 143440 - protein, 13 aa, Mycobacterium tuberculosis
FAESLTDSVLYVS

SEQ ID NO: 143441 - protein, 13 aa, Mycobacterium tuberculosis
AESLTDSVLYVSF

SEQ ID NO: 143442 - protein, 13 aa, Mycobacterium tuberculosis
ESLTDSVLYVSFQ

SEQ ID NO: 143443 - protein, 13 aa, Mycobacterium tuberculosis
SLTDSVLYVSFQE

SEQ ID NO: 143444 - protein, 13 aa, Mycobacterium tuberculosis
LTDSVLYVSFQEL

SEQ ID NO: 143445 - protein, 13 aa, Mycobacterium tuberculosis
TDSVLYVSFQELA

SEQ ID NO: 143446 - protein, 13 aa, Mycobacterium tuberculosis
DSVLYVSFQELAT

SEQ ID NO: 143447 - protein, 13 aa, Mycobacterium tuberculosis
SVLYVSFQELATR

SEQ ID NO: 143448 - protein, 13 aa, Mycobacterium tuberculosis
VLYVSFQELATRI

SEQ ID NO: 143449 - protein, 13 aa, Mycobacterium tuberculosis
LYVSFQELATRIS

SEQ ID NO: 143450 - protein, 13 aa, Mycobacterium tuberculosis
YVSFQELATRISH

SEQ ID NO: 143451 - protein, 13 aa, Mycobacterium tuberculosis
VSFQELATRISHR

SEQ ID NO: 143452 - protein, 13 aa, Mycobacterium tuberculosis
SFQELATRISHRN

SEQ ID NO: 143453 - protein, 13 aa, Mycobacterium tuberculosis
FQELATRISHRNT

SEQ ID NO: 143454 - protein, 13 aa, Mycobacterium tuberculosis
QELATRISHRNTG

SEQ ID NO: 143455 - protein, 13 aa, Mycobacterium tuberculosis
ELATRISHRNTGK

SEQ ID NO: 143456 - protein, 13 aa, Mycobacterium tuberculosis
LATRISHRNTGKA

SEQ ID NO: 143457 - protein, 13 aa, Mycobacterium tuberculosis
ATRISHRNTGKAC

SEQ ID NO: 143458 - protein, 13 aa, Mycobacterium tuberculosis
TRISHRNTGKACN

SEQ ID NO: 143459 - protein, 13 aa, Mycobacterium tuberculosis
RISHRNTGKACND

SEQ ID NO: 143460 - protein, 13 aa, Mycobacterium tuberculosis
ISHRNTGKACNDP

SEQ ID NO: 143461 - protein, 13 aa, Mycobacterium tuberculosis
SHRNTGKACNDPV

SEQ ID NO: 143462 - protein, 13 aa, Mycobacterium tuberculosis
HRNTGKACNDPVA

SEQ ID NO: 143463 - protein, 13 aa, Mycobacterium tuberculosis
RNTGKACNDPVAD

SEQ ID NO: 143464 - protein, 13 aa, Mycobacterium tuberculosis
NTGKACNDPVADQ

SEQ ID NO: 143465 - protein, 13 aa, Mycobacterium tuberculosis
TGKACNDPVADQL

SEQ ID NO: 143466 - protein, 13 aa, Mycobacterium tuberculosis
GKACNDPVADQLM

SEQ ID NO: 143467 - protein, 13 aa, Mycobacterium tuberculosis
KACNDPVADQLMA

SEQ ID NO: 143468 - protein, 13 aa, Mycobacterium tuberculosis
ACNDPVADQLMAK

SEQ ID NO: 143469 - protein, 13 aa, Mycobacterium tuberculosis
CNDPVADQLMAKI

SEQ ID NO: 143470 - protein, 13 aa, Mycobacterium tuberculosis
NDPVADQLMAKIS

SEQ ID NO: 143471 - protein, 13 aa, Mycobacterium tuberculosis
DPVADQLMAKISA

SEQ ID NO: 143472 - protein, 13 aa, Mycobacterium tuberculosis
PVADQLMAKISAD

SEQ ID NO: 143473 - protein, 13 aa, Mycobacterium tuberculosis
VADQLMAKISADE

SEQ ID NO: 143474 - protein, 13 aa, Mycobacterium tuberculosis
ADQLMAKISADEN

SEQ ID NO: 143475 - protein, 13 aa, Mycobacterium tuberculosis
DQLMAKISADENL

SEQ ID NO: 143476 - protein, 13 aa, Mycobacterium tuberculosis
QLMAKISADENLH

SEQ ID NO: 143477 - protein, 13 aa, Mycobacterium tuberculosis
LMAKISADENLHM

SEQ ID NO: 143478 - protein, 13 aa, Mycobacterium tuberculosis
MAKISADENLHMI

SEQ ID NO: 143479 - protein, 13 aa, Mycobacterium tuberculosis
AKISADENLHMIF

SEQ ID NO: 143480 - protein, 13 aa, Mycobacterium tuberculosis
KISADENLHMIFY

SEQ ID NO: 143481 - protein, 13 aa, Mycobacterium tuberculosis
ISADENLHMIFYR

SEQ ID NO: 143482 - protein, 13 aa, Mycobacterium tuberculosis
SADENLHMIFYRD

SEQ ID NO: 143483 - protein, 13 aa, Mycobacterium tuberculosis
ADENLHMIFYRDV

SEQ ID NO: 143484 - protein, 13 aa, Mycobacterium tuberculosis
DENLHMIFYRDVS

SEQ ID NO: 143485 - protein, 13 aa, Mycobacterium tuberculosis
ENLHMIFYRDVSE

SEQ ID NO: 143486 - protein, 13 aa, Mycobacterium tuberculosis
NLHMIFYRDVSEA

SEQ ID NO: 143487 - protein, 13 aa, Mycobacterium tuberculosis
LHMIFYRDVSEAA

SEQ ID NO: 143488 - protein, 13 aa, Mycobacterium tuberculosis
HMIFYRDVSEAAF

SEQ ID NO: 143489 - protein, 13 aa, Mycobacterium tuberculosis
MIFYRDVSEAAFD

SEQ ID NO: 143490 - protein, 13 aa, Mycobacterium tuberculosis
IFYRDVSEAAFDL

SEQ ID NO: 143491 - protein, 13 aa, Mycobacterium tuberculosis
FYRDVSEAAFDLV

SEQ ID NO: 143492 - protein, 13 aa, Mycobacterium tuberculosis
YRDVSEAAFDLVP

SEQ ID NO: 143493 - protein, 13 aa, Mycobacterium tuberculosis
RDVSEAAFDLVPN

SEQ ID NO: 143494 - protein, 13 aa, Mycobacterium tuberculosis
DVSEAAFDLVPNQ

SEQ ID NO: 143495 - protein, 13 aa, Mycobacterium tuberculosis
VSEAAFDLVPNQA

SEQ ID NO: 143496 - protein, 13 aa, Mycobacterium tuberculosis
SEAAFDLVPNQAM

SEQ ID NO: 143497 - protein, 13 aa, Mycobacterium tuberculosis
EAAFDLVPNQAMK

SEQ ID NO: 143498 - protein, 13 aa, Mycobacterium tuberculosis
AAFDLVPNQAMKS

SEQ ID NO: 143499 - protein, 13 aa, Mycobacterium tuberculosis
AFDLVPNQAMKSL

SEQ ID NO: 143500 - protein, 13 aa, Mycobacterium tuberculosis
FDLVPNQAMKSLH

SEQ ID NO: 143501 - protein, 13 aa, Mycobacterium tuberculosis
DLVPNQAMKSLHL

SEQ ID NO: 143502 - protein, 13 aa, Mycobacterium tuberculosis
LVPNQAMKSLHLI

SEQ ID NO: 143503 - protein, 13 aa, Mycobacterium tuberculosis
VPNQAMKSLHLIL

SEQ ID NO: 143504 - protein, 13 aa, Mycobacterium tuberculosis
PNQAMKSLHLILS

SEQ ID NO: 143505 - protein, 13 aa, Mycobacterium tuberculosis
NQAMKSLHLILSH

SEQ ID NO: 143506 - protein, 13 aa, Mycobacterium tuberculosis
QAMKSLHLILSHF

SEQ ID NO: 143507 - protein, 13 aa, Mycobacterium tuberculosis
AMKSLHLILSHFQ

SEQ ID NO: 143508 - protein, 13 aa, Mycobacterium tuberculosis
MKSLHLILSHFQM

SEQ ID NO: 143509 - protein, 13 aa, Mycobacterium tuberculosis
KSLHLILSHFQMP

SEQ ID NO: 143510 - protein, 13 aa, Mycobacterium tuberculosis
SLHLILSHFQMPG

SEQ ID NO: 143511 - protein, 13 aa, Mycobacterium tuberculosis
LHLILSHFQMPGF

SEQ ID NO: 143512 - protein, 13 aa, Mycobacterium tuberculosis
HLILSHFQMPGFQ

SEQ ID NO: 143513 - protein, 13 aa, Mycobacterium tuberculosis
LILSHFQMPGFQV

SEQ ID NO: 143514 - protein, 13 aa, Mycobacterium tuberculosis
ILSHFQMPGFQVP

SEQ ID NO: 143515 - protein, 13 aa, Mycobacterium tuberculosis
LSHFQMPGFQVPE

SEQ ID NO: 143516 - protein, 13 aa, Mycobacterium tuberculosis
SHFQMPGFQVPEF

SEQ ID NO: 143517 - protein, 13 aa, Mycobacterium tuberculosis
HFQMPGFQVPEFR

SEQ ID NO: 143518 - protein, 13 aa, Mycobacterium tuberculosis
FQMPGFQVPEFRR

SEQ ID NO: 143519 - protein, 13 aa, Mycobacterium tuberculosis
QMPGFQVPEFRRK

SEQ ID NO: 143520 - protein, 13 aa, Mycobacterium tuberculosis
MPGFQVPEFRRKA

SEQ ID NO: 143521 - protein, 13 aa, Mycobacterium tuberculosis
PGFQVPEFRRKAV

SEQ ID NO: 143522 - protein, 13 aa, Mycobacterium tuberculosis
GFQVPEFRRKAVV

SEQ ID NO: 143523 - protein, 13 aa, Mycobacterium tuberculosis
FQVPEFRRKAVVI

SEQ ID NO: 143524 - protein, 13 aa, Mycobacterium tuberculosis
QVPEFRRKAVVIA

SEQ ID NO: 143525 - protein, 13 aa, Mycobacterium tuberculosis
VPEFRRKAVVIAV

SEQ ID NO: 143526 - protein, 13 aa, Mycobacterium tuberculosis
PEFRRKAVVIAVG

SEQ ID NO: 143527 - protein, 13 aa, Mycobacterium tuberculosis
EFRRKAVVIAVGG

SEQ ID NO: 143528 - protein, 13 aa, Mycobacterium tuberculosis
FRRKAVVIAVGGV

SEQ ID NO: 143529 - protein, 13 aa, Mycobacterium tuberculosis
RRKAVVIAVGGVY

SEQ ID NO: 143530 - protein, 13 aa, Mycobacterium tuberculosis
RKAVVIAVGGVYD

SEQ ID NO: 143531 - protein, 13 aa, Mycobacterium tuberculosis
KAVVIAVGGVYDP

SEQ ID NO: 143532 - protein, 13 aa, Mycobacterium tuberculosis
AVVIAVGGVYDPR

SEQ ID NO: 143533 - protein, 13 aa, Mycobacterium tuberculosis
VVIAVGGVYDPRI

SEQ ID NO: 143534 - protein, 13 aa, Mycobacterium tuberculosis
VIAVGGVYDPRIH

SEQ ID NO: 143535 - protein, 13 aa, Mycobacterium tuberculosis
IAVGGVYDPRIHL

SEQ ID NO: 143536 - protein, 13 aa, Mycobacterium tuberculosis
AVGGVYDPRIHLD

SEQ ID NO: 143537 - protein, 13 aa, Mycobacterium tuberculosis
VGGVYDPRIHLDE

SEQ ID NO: 143538 - protein, 13 aa, Mycobacterium tuberculosis
GGVYDPRIHLDEV

SEQ ID NO: 143539 - protein, 13 aa, Mycobacterium tuberculosis
GVYDPRIHLDEVV

SEQ ID NO: 143540 - protein, 13 aa, Mycobacterium tuberculosis
VYDPRIHLDEVVM

SEQ ID NO: 143541 - protein, 13 aa, Mycobacterium tuberculosis
YDPRIHLDEVVMP

SEQ ID NO: 143542 - protein, 13 aa, Mycobacterium tuberculosis
DPRIHLDEVVMPV

SEQ ID NO: 143543 - protein, 13 aa, Mycobacterium tuberculosis
PRIHLDEVVMPVL

SEQ ID NO: 143544 - protein, 13 aa, Mycobacterium tuberculosis
RIHLDEVVMPVLK

SEQ ID NO: 143545 - protein, 13 aa, Mycobacterium tuberculosis
IHLDEVVMPVLKK

SEQ ID NO: 143546 - protein, 13 aa, Mycobacterium tuberculosis
HLDEVVMPVLKKW

SEQ ID NO: 143547 - protein, 13 aa, Mycobacterium tuberculosis
LDEVVMPVLKKWR

SEQ ID NO: 143548 - protein, 13 aa, Mycobacterium tuberculosis
DEVVMPVLKKWRI

SEQ ID NO: 143549 - protein, 13 aa, Mycobacterium tuberculosis
EVVMPVLKKWRIF

SEQ ID NO: 143550 - protein, 13 aa, Mycobacterium tuberculosis
VVMPVLKKWRIFE

SEQ ID NO: 143551 - protein, 13 aa, Mycobacterium tuberculosis
VMPVLKKWRIFER

SEQ ID NO: 143552 - protein, 13 aa, Mycobacterium tuberculosis
MPVLKKWRIFERE

SEQ ID NO: 143553 - protein, 13 aa, Mycobacterium tuberculosis
PVLKKWRIFERED

SEQ ID NO: 143554 - protein, 13 aa, Mycobacterium tuberculosis
VLKKWRIFEREDF

SEQ ID NO: 143555 - protein, 13 aa, Mycobacterium tuberculosis
LKKWRIFEREDFT

SEQ ID NO: 143556 - protein, 13 aa, Mycobacterium tuberculosis
KKWRIFEREDFTG

SEQ ID NO: 143557 - protein, 13 aa, Mycobacterium tuberculosis
KWRIFEREDFTGE

SEQ ID NO: 143558 - protein, 13 aa, Mycobacterium tuberculosis
WRIFEREDFTGEG

SEQ ID NO: 143559 - protein, 13 aa, Mycobacterium tuberculosis
RIFEREDFTGEGA

SEQ ID NO: 143560 - protein, 13 aa, Mycobacterium tuberculosis
IFEREDFTGEGAK

SEQ ID NO: 143561 - protein, 13 aa, Mycobacterium tuberculosis
FEREDFTGEGAKL

SEQ ID NO: 143562 - protein, 13 aa, Mycobacterium tuberculosis
EREDFTGEGAKLR

SEQ ID NO: 143563 - protein, 13 aa, Mycobacterium tuberculosis
REDFTGEGAKLRD

SEQ ID NO: 143564 - protein, 13 aa, Mycobacterium tuberculosis
EDFTGEGAKLRDE

SEQ ID NO: 143565 - protein, 13 aa, Mycobacterium tuberculosis
DFTGEGAKLRDEL

SEQ ID NO: 143566 - protein, 13 aa, Mycobacterium tuberculosis
FTGEGAKLRDELA

SEQ ID NO: 143567 - protein, 13 aa, Mycobacterium tuberculosis
TGEGAKLRDELAL

SEQ ID NO: 143568 - protein, 13 aa, Mycobacterium tuberculosis
GEGAKLRDELALV

SEQ ID NO: 143569 - protein, 13 aa, Mycobacterium tuberculosis
EGAKLRDELALVI

SEQ ID NO: 143570 - protein, 13 aa, Mycobacterium tuberculosis
GAKLRDELALVIK

SEQ ID NO: 143571 - protein, 13 aa, Mycobacterium tuberculosis
AKLRDELALVIKD

SEQ ID NO: 143572 - protein, 13 aa, Mycobacterium tuberculosis
KLRDELALVIKDL

SEQ ID NO: 143573 - protein, 13 aa, Mycobacterium tuberculosis
LRDELALVIKDLE

SEQ ID NO: 143574 - protein, 13 aa, Mycobacterium tuberculosis
RDELALVIKDLEL

SEQ ID NO: 143575 - protein, 13 aa, Mycobacterium tuberculosis
DELALVIKDLELA

SEQ ID NO: 143576 - protein, 13 aa, Mycobacterium tuberculosis
ELALVIKDLELAC

SEQ ID NO: 143577 - protein, 13 aa, Mycobacterium tuberculosis
LALVIKDLELACD

SEQ ID NO: 143578 - protein, 13 aa, Mycobacterium tuberculosis
ALVIKDLELACDK

SEQ ID NO: 143579 - protein, 13 aa, Mycobacterium tuberculosis
LVIKDLELACDKF

SEQ ID NO: 143580 - protein, 13 aa, Mycobacterium tuberculosis
VIKDLELACDKFE

SEQ ID NO: 143581 - protein, 13 aa, Mycobacterium tuberculosis
IKDLELACDKFEV

SEQ ID NO: 143582 - protein, 13 aa, Mycobacterium tuberculosis
KDLELACDKFEVS

SEQ ID NO: 143583 - protein, 13 aa, Mycobacterium tuberculosis
DLELACDKFEVSK

SEQ ID NO: 143584 - protein, 13 aa, Mycobacterium tuberculosis
LELACDKFEVSKQ

SEQ ID NO: 143585 - protein, 13 aa, Mycobacterium tuberculosis
ELACDKFEVSKQR

SEQ ID NO: 143586 - protein, 13 aa, Mycobacterium tuberculosis
LACDKFEVSKQRQ

SEQ ID NO: 143587 - protein, 13 aa, Mycobacterium tuberculosis
ACDKFEVSKQRQL

SEQ ID NO: 143588 - protein, 13 aa, Mycobacterium tuberculosis
CDKFEVSKQRQLD

SEQ ID NO: 143589 - protein, 13 aa, Mycobacterium tuberculosis
DKFEVSKQRQLDR

SEQ ID NO: 143590 - protein, 13 aa, Mycobacterium tuberculosis
KFEVSKQRQLDRE

SEQ ID NO: 143591 - protein, 13 aa, Mycobacterium tuberculosis
FEVSKQRQLDREA

SEQ ID NO: 143592 - protein, 13 aa, Mycobacterium tuberculosis
EVSKQRQLDREAR

SEQ ID NO: 143593 - protein, 13 aa, Mycobacterium tuberculosis
VSKQRQLDREART

SEQ ID NO: 143594 - protein, 13 aa, Mycobacterium tuberculosis
SKQRQLDREARTG

SEQ ID NO: 143595 - protein, 13 aa, Mycobacterium tuberculosis
KQRQLDREARTGK

SEQ ID NO: 143596 - protein, 13 aa, Mycobacterium tuberculosis
QRQLDREARTGKK

SEQ ID NO: 143597 - protein, 13 aa, Mycobacterium tuberculosis
RQLDREARTGKKV

SEQ ID NO: 143598 - protein, 13 aa, Mycobacterium tuberculosis
QLDREARTGKKVS

SEQ ID NO: 143599 - protein, 13 aa, Mycobacterium tuberculosis
LDREARTGKKVSA

SEQ ID NO: 143600 - protein, 13 aa, Mycobacterium tuberculosis
DREARTGKKVSAH

SEQ ID NO: 143601 - protein, 13 aa, Mycobacterium tuberculosis
REARTGKKVSAHE

SEQ ID NO: 143602 - protein, 13 aa, Mycobacterium tuberculosis
EARTGKKVSAHEL

SEQ ID NO: 143603 - protein, 13 aa, Mycobacterium tuberculosis
ARTGKKVSAHELH

SEQ ID NO: 143604 - protein, 13 aa, Mycobacterium tuberculosis
RTGKKVSAHELHK

SEQ ID NO: 143605 - protein, 13 aa, Mycobacterium tuberculosis
TGKKVSAHELHKT

SEQ ID NO: 143606 - protein, 13 aa, Mycobacterium tuberculosis
GKKVSAHELHKTA

SEQ ID NO: 143607 - protein, 13 aa, Mycobacterium tuberculosis
KKVSAHELHKTAG

SEQ ID NO: 143608 - protein, 13 aa, Mycobacterium tuberculosis
KVSAHELHKTAGK

SEQ ID NO: 143609 - protein, 13 aa, Mycobacterium tuberculosis
VSAHELHKTAGKL

SEQ ID NO: 143610 - protein, 13 aa, Mycobacterium tuberculosis
SAHELHKTAGKLA

SEQ ID NO: 143611 - protein, 13 aa, Mycobacterium tuberculosis
AHELHKTAGKLAM

SEQ ID NO: 143612 - protein, 13 aa, Mycobacterium tuberculosis
HELHKTAGKLAMS

SEQ ID NO: 143613 - protein, 13 aa, Mycobacterium tuberculosis
ELHKTAGKLAMSR

SEQ ID NO: 143614 - protein, 13 aa, Mycobacterium tuberculosis
LHKTAGKLAMSRR

SEQ ID NO: 143615 - protein, 14 aa, Mycobacterium tuberculosis
MSAKLTDLQLLHEL

SEQ ID NO: 143616 - protein, 14 aa, Mycobacterium tuberculosis
SAKLTDLQLLHELE

SEQ ID NO: 143617 - protein, 14 aa, Mycobacterium tuberculosis
AKLTDLQLLHELEP

SEQ ID NO: 143618 - protein, 14 aa, Mycobacterium tuberculosis
KLTDLQLLHELEPV

SEQ ID NO: 143619 - protein, 14 aa, Mycobacterium tuberculosis
LTDLQLLHELEPVV

SEQ ID NO: 143620 - protein, 14 aa, Mycobacterium tuberculosis
TDLQLLHELEPVVE

SEQ ID NO: 143621 - protein, 14 aa, Mycobacterium tuberculosis
DLQLLHELEPVVEK

SEQ ID NO: 143622 - protein, 14 aa, Mycobacterium tuberculosis
LQLLHELEPVVEKY

SEQ ID NO: 143623 - protein, 14 aa, Mycobacterium tuberculosis
QLLHELEPVVEKYL

SEQ ID NO: 143624 - protein, 14 aa, Mycobacterium tuberculosis
LLHELEPVVEKYLN

SEQ ID NO: 143625 - protein, 14 aa, Mycobacterium tuberculosis
LHELEPVVEKYLNR

SEQ ID NO: 143626 - protein, 14 aa, Mycobacterium tuberculosis
HELEPVVEKYLNRH

SEQ ID NO: 143627 - protein, 14 aa, Mycobacterium tuberculosis
ELEPVVEKYLNRHL

SEQ ID NO: 143628 - protein, 14 aa, Mycobacterium tuberculosis
LEPVVEKYLNRHLS

SEQ ID NO: 143629 - protein, 14 aa, Mycobacterium tuberculosis
EPVVEKYLNRHLSM

SEQ ID NO: 143630 - protein, 14 aa, Mycobacterium tuberculosis
PVVEKYLNRHLSMH

SEQ ID NO: 143631 - protein, 14 aa, Mycobacterium tuberculosis
VVEKYLNRHLSMHK

SEQ ID NO: 143632 - protein, 14 aa, Mycobacterium tuberculosis
VEKYLNRHLSMHKP

SEQ ID NO: 143633 - protein, 14 aa, Mycobacterium tuberculosis
EKYLNRHLSMHKPW

SEQ ID NO: 143634 - protein, 14 aa, Mycobacterium tuberculosis
KYLNRHLSMHKPWN

SEQ ID NO: 143635 - protein, 14 aa, Mycobacterium tuberculosis
YLNRHLSMHKPWNP

SEQ ID NO: 143636 - protein, 14 aa, Mycobacterium tuberculosis
LNRHLSMHKPWNPH

SEQ ID NO: 143637 - protein, 14 aa, Mycobacterium tuberculosis
NRHLSMHKPWNPHD

SEQ ID NO: 143638 - protein, 14 aa, Mycobacterium tuberculosis
RHLSMHKPWNPHDY

SEQ ID NO: 143639 - protein, 14 aa, Mycobacterium tuberculosis
HLSMHKPWNPHDYI

SEQ ID NO: 143640 - protein, 14 aa, Mycobacterium tuberculosis
LSMHKPWNPHDYIP

SEQ ID NO: 143641 - protein, 14 aa, Mycobacterium tuberculosis
SMHKPWNPHDYIPW

SEQ ID NO: 143642 - protein, 14 aa, Mycobacterium tuberculosis
MHKPWNPHDYIPWS

SEQ ID NO: 143643 - protein, 14 aa, Mycobacterium tuberculosis
HKPWNPHDYIPWSD

SEQ ID NO: 143644 - protein, 14 aa, Mycobacterium tuberculosis
KPWNPHDYIPWSDG

SEQ ID NO: 143645 - protein, 14 aa, Mycobacterium tuberculosis
PWNPHDYIPWSDGK

SEQ ID NO: 143646 - protein, 14 aa, Mycobacterium tuberculosis
WNPHDYIPWSDGKN

SEQ ID NO: 143647 - protein, 14 aa, Mycobacterium tuberculosis
NPHDYIPWSDGKNY

SEQ ID NO: 143648 - protein, 14 aa, Mycobacterium tuberculosis
PHDYIPWSDGKNYY

SEQ ID NO: 143649 - protein, 14 aa, Mycobacterium tuberculosis
HDYIPWSDGKNYYA

SEQ ID NO: 143650 - protein, 14 aa, Mycobacterium tuberculosis
DYIPWSDGKNYYAL

SEQ ID NO: 143651 - protein, 14 aa, Mycobacterium tuberculosis
YIPWSDGKNYYALG

SEQ ID NO: 143652 - protein, 14 aa, Mycobacterium tuberculosis
IPWSDGKNYYALGG

SEQ ID NO: 143653 - protein, 14 aa, Mycobacterium tuberculosis
PWSDGKNYYALGGQ

SEQ ID NO: 143654 - protein, 14 aa, Mycobacterium tuberculosis
WSDGKNYYALGGQD

SEQ ID NO: 143655 - protein, 14 aa, Mycobacterium tuberculosis
SDGKNYYALGGQDW

SEQ ID NO: 143656 - protein, 14 aa, Mycobacterium tuberculosis
DGKNYYALGGQDWD

SEQ ID NO: 143657 - protein, 14 aa, Mycobacterium tuberculosis
GKNYYALGGQDWDP

SEQ ID NO: 143658 - protein, 14 aa, Mycobacterium tuberculosis
KNYYALGGQDWDPD

SEQ ID NO: 143659 - protein, 14 aa, Mycobacterium tuberculosis
NYYALGGQDWDPDQ

SEQ ID NO: 143660 - protein, 14 aa, Mycobacterium tuberculosis
YYALGGQDWDPDQS

SEQ ID NO: 143661 - protein, 14 aa, Mycobacterium tuberculosis
YALGGQDWDPDQSK

SEQ ID NO: 143662 - protein, 14 aa, Mycobacterium tuberculosis
ALGGQDWDPDQSKL

SEQ ID NO: 143663 - protein, 14 aa, Mycobacterium tuberculosis
LGGQDWDPDQSKLS

SEQ ID NO: 143664 - protein, 14 aa, Mycobacterium tuberculosis
GGQDWDPDQSKLSD

SEQ ID NO: 143665 - protein, 14 aa, Mycobacterium tuberculosis
GQDWDPDQSKLSDV

SEQ ID NO: 143666 - protein, 14 aa, Mycobacterium tuberculosis
QDWDPDQSKLSDVA

SEQ ID NO: 143667 - protein, 14 aa, Mycobacterium tuberculosis
DWDPDQSKLSDVAQ

SEQ ID NO: 143668 - protein, 14 aa, Mycobacterium tuberculosis
WDPDQSKLSDVAQV

SEQ ID NO: 143669 - protein, 14 aa, Mycobacterium tuberculosis
DPDQSKLSDVAQVA

SEQ ID NO: 143670 - protein, 14 aa, Mycobacterium tuberculosis
PDQSKLSDVAQVAM

SEQ ID NO: 143671 - protein, 14 aa, Mycobacterium tuberculosis
DQSKLSDVAQVAMV

SEQ ID NO: 143672 - protein, 14 aa, Mycobacterium tuberculosis
QSKLSDVAQVAMVQ

SEQ ID NO: 143673 - protein, 14 aa, Mycobacterium tuberculosis
SKLSDVAQVAMVQN

SEQ ID NO: 143674 - protein, 14 aa, Mycobacterium tuberculosis
KLSDVAQVAMVQNL

SEQ ID NO: 143675 - protein, 14 aa, Mycobacterium tuberculosis
LSDVAQVAMVQNLV

SEQ ID NO: 143676 - protein, 14 aa, Mycobacterium tuberculosis
SDVAQVAMVQNLVT

SEQ ID NO: 143677 - protein, 14 aa, Mycobacterium tuberculosis
DVAQVAMVQNLVTE

SEQ ID NO: 143678 - protein, 14 aa, Mycobacterium tuberculosis
VAQVAMVQNLVTED

SEQ ID NO: 143679 - protein, 14 aa, Mycobacterium tuberculosis
AQVAMVQNLVTEDN

SEQ ID NO: 143680 - protein, 14 aa, Mycobacterium tuberculosis
QVAMVQNLVTEDNL

SEQ ID NO: 143681 - protein, 14 aa, Mycobacterium tuberculosis
VAMVQNLVTEDNLP

SEQ ID NO: 143682 - protein, 14 aa, Mycobacterium tuberculosis
AMVQNLVTEDNLPS

SEQ ID NO: 143683 - protein, 14 aa, Mycobacterium tuberculosis
MVQNLVTEDNLPSY

SEQ ID NO: 143684 - protein, 14 aa, Mycobacterium tuberculosis
VQNLVTEDNLPSYH

SEQ ID NO: 143685 - protein, 14 aa, Mycobacterium tuberculosis
QNLVTEDNLPSYHR

SEQ ID NO: 143686 - protein, 14 aa, Mycobacterium tuberculosis
NLVTEDNLPSYHRE

SEQ ID NO: 143687 - protein, 14 aa, Mycobacterium tuberculosis
LVTEDNLPSYHREI

SEQ ID NO: 143688 - protein, 14 aa, Mycobacterium tuberculosis
VTEDNLPSYHREIA

SEQ ID NO: 143689 - protein, 14 aa, Mycobacterium tuberculosis
TEDNLPSYHREIAM

SEQ ID NO: 143690 - protein, 14 aa, Mycobacterium tuberculosis
EDNLPSYHREIAMN

SEQ ID NO: 143691 - protein, 14 aa, Mycobacterium tuberculosis
DNLPSYHREIAMNM

SEQ ID NO: 143692 - protein, 14 aa, Mycobacterium tuberculosis
NLPSYHREIAMNMG

SEQ ID NO: 143693 - protein, 14 aa, Mycobacterium tuberculosis
LPSYHREIAMNMGM

SEQ ID NO: 143694 - protein, 14 aa, Mycobacterium tuberculosis
PSYHREIAMNMGMD

SEQ ID NO: 143695 - protein, 14 aa, Mycobacterium tuberculosis
SYHREIAMNMGMDG

SEQ ID NO: 143696 - protein, 14 aa, Mycobacterium tuberculosis
YHREIAMNMGMDGA

SEQ ID NO: 143697 - protein, 14 aa, Mycobacterium tuberculosis
HREIAMNMGMDGAW

SEQ ID NO: 143698 - protein, 14 aa, Mycobacterium tuberculosis
REIAMNMGMDGAWG

SEQ ID NO: 143699 - protein, 14 aa, Mycobacterium tuberculosis
EIAMNMGMDGAWGQ

SEQ ID NO: 143700 - protein, 14 aa, Mycobacterium tuberculosis
IAMNMGMDGAWGQW

SEQ ID NO: 143701 - protein, 14 aa, Mycobacterium tuberculosis
AMNMGMDGAWGQWV

SEQ ID NO: 143702 - protein, 14 aa, Mycobacterium tuberculosis
MNMGMDGAWGQWVN

SEQ ID NO: 143703 - protein, 14 aa, Mycobacterium tuberculosis
NMGMDGAWGQWVNR

SEQ ID NO: 143704 - protein, 14 aa, Mycobacterium tuberculosis
MGMDGAWGQWVNRW

SEQ ID NO: 143705 - protein, 14 aa, Mycobacterium tuberculosis
GMDGAWGQWVNRWT

SEQ ID NO: 143706 - protein, 14 aa, Mycobacterium tuberculosis
MDGAWGQWVNRWTA

SEQ ID NO: 143707 - protein, 14 aa, Mycobacterium tuberculosis
DGAWGQWVNRWTAE

SEQ ID NO: 143708 - protein, 14 aa, Mycobacterium tuberculosis
GAWGQWVNRWTAEE

SEQ ID NO: 143709 - protein, 14 aa, Mycobacterium tuberculosis
AWGQWVNRWTAEEN

SEQ ID NO: 143710 - protein, 14 aa, Mycobacterium tuberculosis
WGQWVNRWTAEENR

SEQ ID NO: 143711 - protein, 14 aa, Mycobacterium tuberculosis
GQWVNRWTAEENRH

SEQ ID NO: 143712 - protein, 14 aa, Mycobacterium tuberculosis
QWVNRWTAEENRHG

SEQ ID NO: 143713 - protein, 14 aa, Mycobacterium tuberculosis
WVNRWTAEENRHGI

SEQ ID NO: 143714 - protein, 14 aa, Mycobacterium tuberculosis
VNRWTAEENRHGIA

SEQ ID NO: 143715 - protein, 14 aa, Mycobacterium tuberculosis
NRWTAEENRHGIAL

SEQ ID NO: 143716 - protein, 14 aa, Mycobacterium tuberculosis
RWTAEENRHGIALR

SEQ ID NO: 143717 - protein, 14 aa, Mycobacterium tuberculosis
WTAEENRHGIALRD

SEQ ID NO: 143718 - protein, 14 aa, Mycobacterium tuberculosis
TAEENRHGIALRDY

SEQ ID NO: 143719 - protein, 14 aa, Mycobacterium tuberculosis
AEENRHGIALRDYL

SEQ ID NO: 143720 - protein, 14 aa, Mycobacterium tuberculosis
EENRHGIALRDYLV

SEQ ID NO: 143721 - protein, 14 aa, Mycobacterium tuberculosis
ENRHGIALRDYLVV

SEQ ID NO: 143722 - protein, 14 aa, Mycobacterium tuberculosis
NRHGIALRDYLVVT

SEQ ID NO: 143723 - protein, 14 aa, Mycobacterium tuberculosis
RHGIALRDYLVVTR

SEQ ID NO: 143724 - protein, 14 aa, Mycobacterium tuberculosis
HGIALRDYLVVTRS

SEQ ID NO: 143725 - protein, 14 aa, Mycobacterium tuberculosis
GIALRDYLVVTRSV

SEQ ID NO: 143726 - protein, 14 aa, Mycobacterium tuberculosis
IALRDYLVVTRSVD

SEQ ID NO: 143727 - protein, 14 aa, Mycobacterium tuberculosis
ALRDYLVVTRSVDP

SEQ ID NO: 143728 - protein, 14 aa, Mycobacterium tuberculosis
LRDYLVVTRSVDPV

SEQ ID NO: 143729 - protein, 14 aa, Mycobacterium tuberculosis
RDYLVVTRSVDPVE

SEQ ID NO: 143730 - protein, 14 aa, Mycobacterium tuberculosis
DYLVVTRSVDPVEL

SEQ ID NO: 143731 - protein, 14 aa, Mycobacterium tuberculosis
YLVVTRSVDPVELE

SEQ ID NO: 143732 - protein, 14 aa, Mycobacterium tuberculosis
LVVTRSVDPVELEK

SEQ ID NO: 143733 - protein, 14 aa, Mycobacterium tuberculosis
VVTRSVDPVELEKL

SEQ ID NO: 143734 - protein, 14 aa, Mycobacterium tuberculosis
VTRSVDPVELEKLR

SEQ ID NO: 143735 - protein, 14 aa, Mycobacterium tuberculosis
TRSVDPVELEKLRL

SEQ ID NO: 143736 - protein, 14 aa, Mycobacterium tuberculosis
RSVDPVELEKLRLE

SEQ ID NO: 143737 - protein, 14 aa, Mycobacterium tuberculosis
SVDPVELEKLRLEV

SEQ ID NO: 143738 - protein, 14 aa, Mycobacterium tuberculosis
VDPVELEKLRLEVV

SEQ ID NO: 143739 - protein, 14 aa, Mycobacterium tuberculosis
DPVELEKLRLEVVN

SEQ ID NO: 143740 - protein, 14 aa, Mycobacterium tuberculosis
PVELEKLRLEVVNR

SEQ ID NO: 143741 - protein, 14 aa, Mycobacterium tuberculosis
VELEKLRLEVVNRG

SEQ ID NO: 143742 - protein, 14 aa, Mycobacterium tuberculosis
ELEKLRLEVVNRGF

SEQ ID NO: 143743 - protein, 14 aa, Mycobacterium tuberculosis
LEKLRLEVVNRGFS

SEQ ID NO: 143744 - protein, 14 aa, Mycobacterium tuberculosis
EKLRLEVVNRGFSP

SEQ ID NO: 143745 - protein, 14 aa, Mycobacterium tuberculosis
KLRLEVVNRGFSPG

SEQ ID NO: 143746 - protein, 14 aa, Mycobacterium tuberculosis
LRLEVVNRGFSPGQ

SEQ ID NO: 143747 - protein, 14 aa, Mycobacterium tuberculosis
RLEVVNRGFSPGQN

SEQ ID NO: 143748 - protein, 14 aa, Mycobacterium tuberculosis
LEVVNRGFSPGQNH

SEQ ID NO: 143749 - protein, 14 aa, Mycobacterium tuberculosis
EVVNRGFSPGQNHQ

SEQ ID NO: 143750 - protein, 14 aa, Mycobacterium tuberculosis
VVNRGFSPGQNHQG

SEQ ID NO: 143751 - protein, 14 aa, Mycobacterium tuberculosis
VNRGFSPGQNHQGH

SEQ ID NO: 143752 - protein, 14 aa, Mycobacterium tuberculosis
NRGFSPGQNHQGHY

SEQ ID NO: 143753 - protein, 14 aa, Mycobacterium tuberculosis
RGFSPGQNHQGHYF

SEQ ID NO: 143754 - protein, 14 aa, Mycobacterium tuberculosis
GFSPGQNHQGHYFA

SEQ ID NO: 143755 - protein, 14 aa, Mycobacterium tuberculosis
FSPGQNHQGHYFAE

SEQ ID NO: 143756 - protein, 14 aa, Mycobacterium tuberculosis
SPGQNHQGHYFAES

SEQ ID NO: 143757 - protein, 14 aa, Mycobacterium tuberculosis
PGQNHQGHYFAESL

SEQ ID NO: 143758 - protein, 14 aa, Mycobacterium tuberculosis
GQNHQGHYFAESLT

SEQ ID NO: 143759 - protein, 14 aa, Mycobacterium tuberculosis
QNHQGHYFAESLTD

SEQ ID NO: 143760 - protein, 14 aa, Mycobacterium tuberculosis
NHQGHYFAESLTDS

SEQ ID NO: 143761 - protein, 14 aa, Mycobacterium tuberculosis
HQGHYFAESLTDSV

SEQ ID NO: 143762 - protein, 14 aa, Mycobacterium tuberculosis
QGHYFAESLTDSVL

SEQ ID NO: 143763 - protein, 14 aa, Mycobacterium tuberculosis
GHYFAESLTDSVLY

SEQ ID NO: 143764 - protein, 14 aa, Mycobacterium tuberculosis
HYFAESLTDSVLYV

SEQ ID NO: 143765 - protein, 14 aa, Mycobacterium tuberculosis
YFAESLTDSVLYVS

SEQ ID NO: 143766 - protein, 14 aa, Mycobacterium tuberculosis
FAESLTDSVLYVSF

SEQ ID NO: 143767 - protein, 14 aa, Mycobacterium tuberculosis
AESLTDSVLYVSFQ

SEQ ID NO: 143768 - protein, 14 aa, Mycobacterium tuberculosis
ESLTDSVLYVSFQE

SEQ ID NO: 143769 - protein, 14 aa, Mycobacterium tuberculosis
SLTDSVLYVSFQEL

SEQ ID NO: 143770 - protein, 14 aa, Mycobacterium tuberculosis
LTDSVLYVSFQELA

SEQ ID NO: 143771 - protein, 14 aa, Mycobacterium tuberculosis
TDSVLYVSFQELAT

SEQ ID NO: 143772 - protein, 14 aa, Mycobacterium tuberculosis
DSVLYVSFQELATR

SEQ ID NO: 143773 - protein, 14 aa, Mycobacterium tuberculosis
SVLYVSFQELATRI

SEQ ID NO: 143774 - protein, 14 aa, Mycobacterium tuberculosis
VLYVSFQELATRIS

SEQ ID NO: 143775 - protein, 14 aa, Mycobacterium tuberculosis
LYVSFQELATRISH

SEQ ID NO: 143776 - protein, 14 aa, Mycobacterium tuberculosis
YVSFQELATRISHR

SEQ ID NO: 143777 - protein, 14 aa, Mycobacterium tuberculosis
VSFQELATRISHRN

SEQ ID NO: 143778 - protein, 14 aa, Mycobacterium tuberculosis
SFQELATRISHRNT

SEQ ID NO: 143779 - protein, 14 aa, Mycobacterium tuberculosis
FQELATRISHRNTG

SEQ ID NO: 143780 - protein, 14 aa, Mycobacterium tuberculosis
QELATRISHRNTGK

SEQ ID NO: 143781 - protein, 14 aa, Mycobacterium tuberculosis
ELATRISHRNTGKA

SEQ ID NO: 143782 - protein, 14 aa, Mycobacterium tuberculosis
LATRISHRNTGKAC

SEQ ID NO: 143783 - protein, 14 aa, Mycobacterium tuberculosis
ATRISHRNTGKACN

SEQ ID NO: 143784 - protein, 14 aa, Mycobacterium tuberculosis
TRISHRNTGKACND

SEQ ID NO: 143785 - protein, 14 aa, Mycobacterium tuberculosis
RISHRNTGKACNDP

SEQ ID NO: 143786 - protein, 14 aa, Mycobacterium tuberculosis
ISHRNTGKACNDPV

SEQ ID NO: 143787 - protein, 14 aa, Mycobacterium tuberculosis
SHRNTGKACNDPVA

SEQ ID NO: 143788 - protein, 14 aa, Mycobacterium tuberculosis
HRNTGKACNDPVAD

SEQ ID NO: 143789 - protein, 14 aa, Mycobacterium tuberculosis
RNTGKACNDPVADQ

SEQ ID NO: 143790 - protein, 14 aa, Mycobacterium tuberculosis
NTGKACNDPVADQL

SEQ ID NO: 143791 - protein, 14 aa, Mycobacterium tuberculosis
TGKACNDPVADQLM

SEQ ID NO: 143792 - protein, 14 aa, Mycobacterium tuberculosis
GKACNDPVADQLMA

SEQ ID NO: 143793 - protein, 14 aa, Mycobacterium tuberculosis
KACNDPVADQLMAK

SEQ ID NO: 143794 - protein, 14 aa, Mycobacterium tuberculosis
ACNDPVADQLMAKI

SEQ ID NO: 143795 - protein, 14 aa, Mycobacterium tuberculosis
CNDPVADQLMAKIS

SEQ ID NO: 143796 - protein, 14 aa, Mycobacterium tuberculosis
NDPVADQLMAKISA

SEQ ID NO: 143797 - protein, 14 aa, Mycobacterium tuberculosis
DPVADQLMAKISAD

SEQ ID NO: 143798 - protein, 14 aa, Mycobacterium tuberculosis
PVADQLMAKISADE

SEQ ID NO: 143799 - protein, 14 aa, Mycobacterium tuberculosis
VADQLMAKISADEN

SEQ ID NO: 143800 - protein, 14 aa, Mycobacterium tuberculosis
ADQLMAKISADENL

SEQ ID NO: 143801 - protein, 14 aa, Mycobacterium tuberculosis
DQLMAKISADENLH

SEQ ID NO: 143802 - protein, 14 aa, Mycobacterium tuberculosis
QLMAKISADENLHM

SEQ ID NO: 143803 - protein, 14 aa, Mycobacterium tuberculosis
LMAKISADENLHMI

SEQ ID NO: 143804 - protein, 14 aa, Mycobacterium tuberculosis
MAKISADENLHMIF

SEQ ID NO: 143805 - protein, 14 aa, Mycobacterium tuberculosis
AKISADENLHMIFY

SEQ ID NO: 143806 - protein, 14 aa, Mycobacterium tuberculosis
KISADENLHMIFYR

SEQ ID NO: 143807 - protein, 14 aa, Mycobacterium tuberculosis
ISADENLHMIFYRD

SEQ ID NO: 143808 - protein, 14 aa, Mycobacterium tuberculosis
SADENLHMIFYRDV

SEQ ID NO: 143809 - protein, 14 aa, Mycobacterium tuberculosis
ADENLHMIFYRDVS

SEQ ID NO: 143810 - protein, 14 aa, Mycobacterium tuberculosis
DENLHMIFYRDVSE

SEQ ID NO: 143811 - protein, 14 aa, Mycobacterium tuberculosis
ENLHMIFYRDVSEA

SEQ ID NO: 143812 - protein, 14 aa, Mycobacterium tuberculosis
NLHMIFYRDVSEAA

SEQ ID NO: 143813 - protein, 14 aa, Mycobacterium tuberculosis
LHMIFYRDVSEAAF

SEQ ID NO: 143814 - protein, 14 aa, Mycobacterium tuberculosis
HMIFYRDVSEAAFD

SEQ ID NO: 143815 - protein, 14 aa, Mycobacterium tuberculosis
MIFYRDVSEAAFDL

SEQ ID NO: 143816 - protein, 14 aa, Mycobacterium tuberculosis
IFYRDVSEAAFDLV

SEQ ID NO: 143817 - protein, 14 aa, Mycobacterium tuberculosis
FYRDVSEAAFDLVP

SEQ ID NO: 143818 - protein, 14 aa, Mycobacterium tuberculosis
YRDVSEAAFDLVPN

SEQ ID NO: 143819 - protein, 14 aa, Mycobacterium tuberculosis
RDVSEAAFDLVPNQ

SEQ ID NO: 143820 - protein, 14 aa, Mycobacterium tuberculosis
DVSEAAFDLVPNQA

SEQ ID NO: 143821 - protein, 14 aa, Mycobacterium tuberculosis
VSEAAFDLVPNQAM

SEQ ID NO: 143822 - protein, 14 aa, Mycobacterium tuberculosis
SEAAFDLVPNQAMK

SEQ ID NO: 143823 - protein, 14 aa, Mycobacterium tuberculosis
EAAFDLVPNQAMKS

SEQ ID NO: 143824 - protein, 14 aa, Mycobacterium tuberculosis
AAFDLVPNQAMKSL

SEQ ID NO: 143825 - protein, 14 aa, Mycobacterium tuberculosis
AFDLVPNQAMKSLH

SEQ ID NO: 143826 - protein, 14 aa, Mycobacterium tuberculosis
FDLVPNQAMKSLHL

SEQ ID NO: 143827 - protein, 14 aa, Mycobacterium tuberculosis
DLVPNQAMKSLHLI

SEQ ID NO: 143828 - protein, 14 aa, Mycobacterium tuberculosis
LVPNQAMKSLHLIL

SEQ ID NO: 143829 - protein, 14 aa, Mycobacterium tuberculosis
VPNQAMKSLHLILS

SEQ ID NO: 143830 - protein, 14 aa, Mycobacterium tuberculosis
PNQAMKSLHLILSH

SEQ ID NO: 143831 - protein, 14 aa, Mycobacterium tuberculosis
NQAMKSLHLILSHF

SEQ ID NO: 143832 - protein, 14 aa, Mycobacterium tuberculosis
QAMKSLHLILSHFQ

SEQ ID NO: 143833 - protein, 14 aa, Mycobacterium tuberculosis
AMKSLHLILSHFQM

SEQ ID NO: 143834 - protein, 14 aa, Mycobacterium tuberculosis
MKSLHLILSHFQMP

SEQ ID NO: 143835 - protein, 14 aa, Mycobacterium tuberculosis
KSLHLILSHFQMPG

SEQ ID NO: 143836 - protein, 14 aa, Mycobacterium tuberculosis
SLHLILSHFQMPGF

SEQ ID NO: 143837 - protein, 14 aa, Mycobacterium tuberculosis
LHLILSHFQMPGFQ

SEQ ID NO: 143838 - protein, 14 aa, Mycobacterium tuberculosis
HLILSHFQMPGFQV

SEQ ID NO: 143839 - protein, 14 aa, Mycobacterium tuberculosis
LILSHFQMPGFQVP

SEQ ID NO: 143840 - protein, 14 aa, Mycobacterium tuberculosis
ILSHFQMPGFQVPE

SEQ ID NO: 143841 - protein, 14 aa, Mycobacterium tuberculosis
LSHFQMPGFQVPEF

SEQ ID NO: 143842 - protein, 14 aa, Mycobacterium tuberculosis
SHFQMPGFQVPEFR

SEQ ID NO: 143843 - protein, 14 aa, Mycobacterium tuberculosis
HFQMPGFQVPEFRR

SEQ ID NO: 143844 - protein, 14 aa, Mycobacterium tuberculosis
FQMPGFQVPEFRRK

SEQ ID NO: 143845 - protein, 14 aa, Mycobacterium tuberculosis
QMPGFQVPEFRRKA

SEQ ID NO: 143846 - protein, 14 aa, Mycobacterium tuberculosis
MPGFQVPEFRRKAV

SEQ ID NO: 143847 - protein, 14 aa, Mycobacterium tuberculosis
PGFQVPEFRRKAVV

SEQ ID NO: 143848 - protein, 14 aa, Mycobacterium tuberculosis
GFQVPEFRRKAVVI

SEQ ID NO: 143849 - protein, 14 aa, Mycobacterium tuberculosis
FQVPEFRRKAVVIA

SEQ ID NO: 143850 - protein, 14 aa, Mycobacterium tuberculosis
QVPEFRRKAVVIAV

SEQ ID NO: 143851 - protein, 14 aa, Mycobacterium tuberculosis
VPEFRRKAVVIAVG

SEQ ID NO: 143852 - protein, 14 aa, Mycobacterium tuberculosis
PEFRRKAVVIAVGG

SEQ ID NO: 143853 - protein, 14 aa, Mycobacterium tuberculosis
EFRRKAVVIAVGGV

SEQ ID NO: 143854 - protein, 14 aa, Mycobacterium tuberculosis
FRRKAVVIAVGGVY

SEQ ID NO: 143855 - protein, 14 aa, Mycobacterium tuberculosis
RRKAVVIAVGGVYD

SEQ ID NO: 143856 - protein, 14 aa, Mycobacterium tuberculosis
RKAVVIAVGGVYDP

SEQ ID NO: 143857 - protein, 14 aa, Mycobacterium tuberculosis
KAVVIAVGGVYDPR

SEQ ID NO: 143858 - protein, 14 aa, Mycobacterium tuberculosis
AVVIAVGGVYDPRI

SEQ ID NO: 143859 - protein, 14 aa, Mycobacterium tuberculosis
VVIAVGGVYDPRIH

SEQ ID NO: 143860 - protein, 14 aa, Mycobacterium tuberculosis
VIAVGGVYDPRIHL

SEQ ID NO: 143861 - protein, 14 aa, Mycobacterium tuberculosis
IAVGGVYDPRIHLD

SEQ ID NO: 143862 - protein, 14 aa, Mycobacterium tuberculosis
AVGGVYDPRIHLDE

SEQ ID NO: 143863 - protein, 14 aa, Mycobacterium tuberculosis
VGGVYDPRIHLDEV

SEQ ID NO: 143864 - protein, 14 aa, Mycobacterium tuberculosis
GGVYDPRIHLDEVV

SEQ ID NO: 143865 - protein, 14 aa, Mycobacterium tuberculosis
GVYDPRIHLDEVVM

SEQ ID NO: 143866 - protein, 14 aa, Mycobacterium tuberculosis
VYDPRIHLDEVVMP

SEQ ID NO: 143867 - protein, 14 aa, Mycobacterium tuberculosis
YDPRIHLDEVVMPV

SEQ ID NO: 143868 - protein, 14 aa, Mycobacterium tuberculosis
DPRIHLDEVVMPVL

SEQ ID NO: 143869 - protein, 14 aa, Mycobacterium tuberculosis
PRIHLDEVVMPVLK

SEQ ID NO: 143870 - protein, 14 aa, Mycobacterium tuberculosis
RIHLDEVVMPVLKK

SEQ ID NO: 143871 - protein, 14 aa, Mycobacterium tuberculosis
IHLDEVVMPVLKKW

SEQ ID NO: 143872 - protein, 14 aa, Mycobacterium tuberculosis
HLDEVVMPVLKKWR

SEQ ID NO: 143873 - protein, 14 aa, Mycobacterium tuberculosis
LDEVVMPVLKKWRI

SEQ ID NO: 143874 - protein, 14 aa, Mycobacterium tuberculosis
DEVVMPVLKKWRIF

SEQ ID NO: 143875 - protein, 14 aa, Mycobacterium tuberculosis
EVVMPVLKKWRIFE

SEQ ID NO: 143876 - protein, 14 aa, Mycobacterium tuberculosis
VVMPVLKKWRIFER

SEQ ID NO: 143877 - protein, 14 aa, Mycobacterium tuberculosis
VMPVLKKWRIFERE

SEQ ID NO: 143878 - protein, 14 aa, Mycobacterium tuberculosis
MPVLKKWRIFERED

SEQ ID NO: 143879 - protein, 14 aa, Mycobacterium tuberculosis
PVLKKWRIFEREDF

SEQ ID NO: 143880 - protein, 14 aa, Mycobacterium tuberculosis
VLKKWRIFEREDFT

SEQ ID NO: 143881 - protein, 14 aa, Mycobacterium tuberculosis
LKKWRIFEREDFTG

SEQ ID NO: 143882 - protein, 14 aa, Mycobacterium tuberculosis
KKWRIFEREDFTGE

SEQ ID NO: 143883 - protein, 14 aa, Mycobacterium tuberculosis
KWRIFEREDFTGEG

SEQ ID NO: 143884 - protein, 14 aa, Mycobacterium tuberculosis
WRIFEREDFTGEGA

SEQ ID NO: 143885 - protein, 14 aa, Mycobacterium tuberculosis
RIFEREDFTGEGAK

SEQ ID NO: 143886 - protein, 14 aa, Mycobacterium tuberculosis
IFEREDFTGEGAKL

SEQ ID NO: 143887 - protein, 14 aa, Mycobacterium tuberculosis
FEREDFTGEGAKLR

SEQ ID NO: 143888 - protein, 14 aa, Mycobacterium tuberculosis
EREDFTGEGAKLRD

SEQ ID NO: 143889 - protein, 14 aa, Mycobacterium tuberculosis
REDFTGEGAKLRDE

SEQ ID NO: 143890 - protein, 14 aa, Mycobacterium tuberculosis
EDFTGEGAKLRDEL

SEQ ID NO: 143891 - protein, 14 aa, Mycobacterium tuberculosis
DFTGEGAKLRDELA

SEQ ID NO: 143892 - protein, 14 aa, Mycobacterium tuberculosis
FTGEGAKLRDELAL

SEQ ID NO: 143893 - protein, 14 aa, Mycobacterium tuberculosis
TGEGAKLRDELALV

SEQ ID NO: 143894 - protein, 14 aa, Mycobacterium tuberculosis
GEGAKLRDELALVI

SEQ ID NO: 143895 - protein, 14 aa, Mycobacterium tuberculosis
EGAKLRDELALVIK

SEQ ID NO: 143896 - protein, 14 aa, Mycobacterium tuberculosis
GAKLRDELALVIKD

SEQ ID NO: 143897 - protein, 14 aa, Mycobacterium tuberculosis
AKLRDELALVIKDL

SEQ ID NO: 143898 - protein, 14 aa, Mycobacterium tuberculosis
KLRDELALVIKDLE

SEQ ID NO: 143899 - protein, 14 aa, Mycobacterium tuberculosis
LRDELALVIKDLEL

SEQ ID NO: 143900 - protein, 14 aa, Mycobacterium tuberculosis
RDELALVIKDLELA

SEQ ID NO: 143901 - protein, 14 aa, Mycobacterium tuberculosis
DELALVIKDLELAC

SEQ ID NO: 143902 - protein, 14 aa, Mycobacterium tuberculosis
ELALVIKDLELACD

SEQ ID NO: 143903 - protein, 14 aa, Mycobacterium tuberculosis
LALVIKDLELACDK

SEQ ID NO: 143904 - protein, 14 aa, Mycobacterium tuberculosis
ALVIKDLELACDKF

SEQ ID NO: 143905 - protein, 14 aa, Mycobacterium tuberculosis
LVIKDLELACDKFE

SEQ ID NO: 143906 - protein, 14 aa, Mycobacterium tuberculosis
VIKDLELACDKFEV

SEQ ID NO: 143907 - protein, 14 aa, Mycobacterium tuberculosis
IKDLELACDKFEVS

SEQ ID NO: 143908 - protein, 14 aa, Mycobacterium tuberculosis
KDLELACDKFEVSK

SEQ ID NO: 143909 - protein, 14 aa, Mycobacterium tuberculosis
DLELACDKFEVSKQ

SEQ ID NO: 143910 - protein, 14 aa, Mycobacterium tuberculosis
LELACDKFEVSKQR

SEQ ID NO: 143911 - protein, 14 aa, Mycobacterium tuberculosis
ELACDKFEVSKQRQ

SEQ ID NO: 143912 - protein, 14 aa, Mycobacterium tuberculosis
LACDKFEVSKQRQL

SEQ ID NO: 143913 - protein, 14 aa, Mycobacterium tuberculosis
ACDKFEVSKQRQLD

SEQ ID NO: 143914 - protein, 14 aa, Mycobacterium tuberculosis
CDKFEVSKQRQLDR

SEQ ID NO: 143915 - protein, 14 aa, Mycobacterium tuberculosis
DKFEVSKQRQLDRE

SEQ ID NO: 143916 - protein, 14 aa, Mycobacterium tuberculosis
KFEVSKQRQLDREA

SEQ ID NO: 143917 - protein, 14 aa, Mycobacterium tuberculosis
FEVSKQRQLDREAR

SEQ ID NO: 143918 - protein, 14 aa, Mycobacterium tuberculosis
EVSKQRQLDREART

SEQ ID NO: 143919 - protein, 14 aa, Mycobacterium tuberculosis
VSKQRQLDREARTG

SEQ ID NO: 143920 - protein, 14 aa, Mycobacterium tuberculosis
SKQRQLDREARTGK

SEQ ID NO: 143921 - protein, 14 aa, Mycobacterium tuberculosis
KQRQLDREARTGKK

SEQ ID NO: 143922 - protein, 14 aa, Mycobacterium tuberculosis
QRQLDREARTGKKV

SEQ ID NO: 143923 - protein, 14 aa, Mycobacterium tuberculosis
RQLDREARTGKKVS

SEQ ID NO: 143924 - protein, 14 aa, Mycobacterium tuberculosis
QLDREARTGKKVSA

SEQ ID NO: 143925 - protein, 14 aa, Mycobacterium tuberculosis
LDREARTGKKVSAH

SEQ ID NO: 143926 - protein, 14 aa, Mycobacterium tuberculosis
DREARTGKKVSAHE

SEQ ID NO: 143927 - protein, 14 aa, Mycobacterium tuberculosis
REARTGKKVSAHEL

SEQ ID NO: 143928 - protein, 14 aa, Mycobacterium tuberculosis
EARTGKKVSAHELH

SEQ ID NO: 143929 - protein, 14 aa, Mycobacterium tuberculosis
ARTGKKVSAHELHK

SEQ ID NO: 143930 - protein, 14 aa, Mycobacterium tuberculosis
RTGKKVSAHELHKT

SEQ ID NO: 143931 - protein, 14 aa, Mycobacterium tuberculosis
TGKKVSAHELHKTA

SEQ ID NO: 143932 - protein, 14 aa, Mycobacterium tuberculosis
GKKVSAHELHKTAG

SEQ ID NO: 143933 - protein, 14 aa, Mycobacterium tuberculosis
KKVSAHELHKTAGK

SEQ ID NO: 143934 - protein, 14 aa, Mycobacterium tuberculosis
KVSAHELHKTAGKL

SEQ ID NO: 143935 - protein, 14 aa, Mycobacterium tuberculosis
VSAHELHKTAGKLA

SEQ ID NO: 143936 - protein, 14 aa, Mycobacterium tuberculosis
SAHELHKTAGKLAM

SEQ ID NO: 143937 - protein, 14 aa, Mycobacterium tuberculosis
AHELHKTAGKLAMS

SEQ ID NO: 143938 - protein, 14 aa, Mycobacterium tuberculosis
HELHKTAGKLAMSR

SEQ ID NO: 143939 - protein, 14 aa, Mycobacterium tuberculosis
ELHKTAGKLAMSRR

SEQ ID NO: 143940 - protein, 15 aa, Mycobacterium tuberculosis
MSAKLTDLQLLHELE

SEQ ID NO: 143941 - protein, 15 aa, Mycobacterium tuberculosis
SAKLTDLQLLHELEP

SEQ ID NO: 143942 - protein, 15 aa, Mycobacterium tuberculosis
AKLTDLQLLHELEPV

SEQ ID NO: 143943 - protein, 15 aa, Mycobacterium tuberculosis
KLTDLQLLHELEPVV

SEQ ID NO: 143944 - protein, 15 aa, Mycobacterium tuberculosis
LTDLQLLHELEPVVE

SEQ ID NO: 143945 - protein, 15 aa, Mycobacterium tuberculosis
TDLQLLHELEPVVEK

SEQ ID NO: 143946 - protein, 15 aa, Mycobacterium tuberculosis
DLQLLHELEPVVEKY

SEQ ID NO: 143947 - protein, 15 aa, Mycobacterium tuberculosis
LQLLHELEPVVEKYL

SEQ ID NO: 143948 - protein, 15 aa, Mycobacterium tuberculosis
QLLHELEPVVEKYLN

SEQ ID NO: 143949 - protein, 15 aa, Mycobacterium tuberculosis
LLHELEPVVEKYLNR

SEQ ID NO: 143950 - protein, 15 aa, Mycobacterium tuberculosis
LHELEPVVEKYLNRH

SEQ ID NO: 143951 - protein, 15 aa, Mycobacterium tuberculosis
HELEPVVEKYLNRHL

SEQ ID NO: 143952 - protein, 15 aa, Mycobacterium tuberculosis
ELEPVVEKYLNRHLS

SEQ ID NO: 143953 - protein, 15 aa, Mycobacterium tuberculosis
LEPVVEKYLNRHLSM

SEQ ID NO: 143954 - protein, 15 aa, Mycobacterium tuberculosis
EPVVEKYLNRHLSMH

SEQ ID NO: 143955 - protein, 15 aa, Mycobacterium tuberculosis
PVVEKYLNRHLSMHK

SEQ ID NO: 143956 - protein, 15 aa, Mycobacterium tuberculosis
VVEKYLNRHLSMHKP

SEQ ID NO: 143957 - protein, 15 aa, Mycobacterium tuberculosis
VEKYLNRHLSMHKPW

SEQ ID NO: 143958 - protein, 15 aa, Mycobacterium tuberculosis
EKYLNRHLSMHKPWN

SEQ ID NO: 143959 - protein, 15 aa, Mycobacterium tuberculosis
KYLNRHLSMHKPWNP

SEQ ID NO: 143960 - protein, 15 aa, Mycobacterium tuberculosis
YLNRHLSMHKPWNPH

SEQ ID NO: 143961 - protein, 15 aa, Mycobacterium tuberculosis
LNRHLSMHKPWNPHD

SEQ ID NO: 143962 - protein, 15 aa, Mycobacterium tuberculosis
NRHLSMHKPWNPHDY

SEQ ID NO: 143963 - protein, 15 aa, Mycobacterium tuberculosis
RHLSMHKPWNPHDYI

SEQ ID NO: 143964 - protein, 15 aa, Mycobacterium tuberculosis
HLSMHKPWNPHDYIP

SEQ ID NO: 143965 - protein, 15 aa, Mycobacterium tuberculosis
LSMHKPWNPHDYIPW

SEQ ID NO: 143966 - protein, 15 aa, Mycobacterium tuberculosis
SMHKPWNPHDYIPWS

SEQ ID NO: 143967 - protein, 15 aa, Mycobacterium tuberculosis
MHKPWNPHDYIPWSD

SEQ ID NO: 143968 - protein, 15 aa, Mycobacterium tuberculosis
HKPWNPHDYIPWSDG

SEQ ID NO: 143969 - protein, 15 aa, Mycobacterium tuberculosis
KPWNPHDYIPWSDGK

SEQ ID NO: 143970 - protein, 15 aa, Mycobacterium tuberculosis
PWNPHDYIPWSDGKN

SEQ ID NO: 143971 - protein, 15 aa, Mycobacterium tuberculosis
WNPHDYIPWSDGKNY

SEQ ID NO: 143972 - protein, 15 aa, Mycobacterium tuberculosis
NPHDYIPWSDGKNYY

SEQ ID NO: 143973 - protein, 15 aa, Mycobacterium tuberculosis
PHDYIPWSDGKNYYA

SEQ ID NO: 143974 - protein, 15 aa, Mycobacterium tuberculosis
HDYIPWSDGKNYYAL

SEQ ID NO: 143975 - protein, 15 aa, Mycobacterium tuberculosis
DYIPWSDGKNYYALG

SEQ ID NO: 143976 - protein, 15 aa, Mycobacterium tuberculosis
YIPWSDGKNYYALGG

SEQ ID NO: 143977 - protein, 15 aa, Mycobacterium tuberculosis
IPWSDGKNYYALGGQ

SEQ ID NO: 143978 - protein, 15 aa, Mycobacterium tuberculosis
PWSDGKNYYALGGQD

SEQ ID NO: 143979 - protein, 15 aa, Mycobacterium tuberculosis
WSDGKNYYALGGQDW

SEQ ID NO: 143980 - protein, 15 aa, Mycobacterium tuberculosis
SDGKNYYALGGQDWD

SEQ ID NO: 143981 - protein, 15 aa, Mycobacterium tuberculosis
DGKNYYALGGQDWDP

SEQ ID NO: 143982 - protein, 15 aa, Mycobacterium tuberculosis
GKNYYALGGQDWDPD

SEQ ID NO: 143983 - protein, 15 aa, Mycobacterium tuberculosis
KNYYALGGQDWDPDQ

SEQ ID NO: 143984 - protein, 15 aa, Mycobacterium tuberculosis
NYYALGGQDWDPDQS

SEQ ID NO: 143985 - protein, 15 aa, Mycobacterium tuberculosis
YYALGGQDWDPDQSK

SEQ ID NO: 143986 - protein, 15 aa, Mycobacterium tuberculosis
YALGGQDWDPDQSKL

SEQ ID NO: 143987 - protein, 15 aa, Mycobacterium tuberculosis
ALGGQDWDPDQSKLS

SEQ ID NO: 143988 - protein, 15 aa, Mycobacterium tuberculosis
LGGQDWDPDQSKLSD

SEQ ID NO: 143989 - protein, 15 aa, Mycobacterium tuberculosis
GGQDWDPDQSKLSDV

SEQ ID NO: 143990 - protein, 15 aa, Mycobacterium tuberculosis
GQDWDPDQSKLSDVA

SEQ ID NO: 143991 - protein, 15 aa, Mycobacterium tuberculosis
QDWDPDQSKLSDVAQ

SEQ ID NO: 143992 - protein, 15 aa, Mycobacterium tuberculosis
DWDPDQSKLSDVAQV

SEQ ID NO: 143993 - protein, 15 aa, Mycobacterium tuberculosis
WDPDQSKLSDVAQVA

SEQ ID NO: 143994 - protein, 15 aa, Mycobacterium tuberculosis
DPDQSKLSDVAQVAM

SEQ ID NO: 143995 - protein, 15 aa, Mycobacterium tuberculosis
PDQSKLSDVAQVAMV

SEQ ID NO: 143996 - protein, 15 aa, Mycobacterium tuberculosis
DQSKLSDVAQVAMVQ

SEQ ID NO: 143997 - protein, 15 aa, Mycobacterium tuberculosis
QSKLSDVAQVAMVQN

SEQ ID NO: 143998 - protein, 15 aa, Mycobacterium tuberculosis
SKLSDVAQVAMVQNL

SEQ ID NO: 143999 - protein, 15 aa, Mycobacterium tuberculosis
KLSDVAQVAMVQNLV

SEQ ID NO: 144000 - protein, 15 aa, Mycobacterium tuberculosis
LSDVAQVAMVQNLVT

SEQ ID NO: 144001 - protein, 15 aa, Mycobacterium tuberculosis
SDVAQVAMVQNLVTE

SEQ ID NO: 144002 - protein, 15 aa, Mycobacterium tuberculosis
DVAQVAMVQNLVTED

SEQ ID NO: 144003 - protein, 15 aa, Mycobacterium tuberculosis
VAQVAMVQNLVTEDN

SEQ ID NO: 144004 - protein, 15 aa, Mycobacterium tuberculosis
AQVAMVQNLVTEDNL

SEQ ID NO: 144005 - protein, 15 aa, Mycobacterium tuberculosis
QVAMVQNLVTEDNLP

SEQ ID NO: 144006 - protein, 15 aa, Mycobacterium tuberculosis
VAMVQNLVTEDNLPS

SEQ ID NO: 144007 - protein, 15 aa, Mycobacterium tuberculosis
AMVQNLVTEDNLPSY

SEQ ID NO: 144008 - protein, 15 aa, Mycobacterium tuberculosis
MVQNLVTEDNLPSYH

SEQ ID NO: 144009 - protein, 15 aa, Mycobacterium tuberculosis
VQNLVTEDNLPSYHR

SEQ ID NO: 144010 - protein, 15 aa, Mycobacterium tuberculosis
QNLVTEDNLPSYHRE

SEQ ID NO: 144011 - protein, 15 aa, Mycobacterium tuberculosis
NLVTEDNLPSYHREI

SEQ ID NO: 144012 - protein, 15 aa, Mycobacterium tuberculosis
LVTEDNLPSYHREIA

SEQ ID NO: 144013 - protein, 15 aa, Mycobacterium tuberculosis
VTEDNLPSYHREIAM

SEQ ID NO: 144014 - protein, 15 aa, Mycobacterium tuberculosis
TEDNLPSYHREIAMN

SEQ ID NO: 144015 - protein, 15 aa, Mycobacterium tuberculosis
EDNLPSYHREIAMNM

SEQ ID NO: 144016 - protein, 15 aa, Mycobacterium tuberculosis
DNLPSYHREIAMNMG

SEQ ID NO: 144017 - protein, 15 aa, Mycobacterium tuberculosis
NLPSYHREIAMNMGM

SEQ ID NO: 144018 - protein, 15 aa, Mycobacterium tuberculosis
LPSYHREIAMNMGMD

SEQ ID NO: 144019 - protein, 15 aa, Mycobacterium tuberculosis
PSYHREIAMNMGMDG

SEQ ID NO: 144020 - protein, 15 aa, Mycobacterium tuberculosis
SYHREIAMNMGMDGA

SEQ ID NO: 144021 - protein, 15 aa, Mycobacterium tuberculosis
YHREIAMNMGMDGAW

SEQ ID NO: 144022 - protein, 15 aa, Mycobacterium tuberculosis
HREIAMNMGMDGAWG

SEQ ID NO: 144023 - protein, 15 aa, Mycobacterium tuberculosis
REIAMNMGMDGAWGQ

SEQ ID NO: 144024 - protein, 15 aa, Mycobacterium tuberculosis
EIAMNMGMDGAWGQW

SEQ ID NO: 144025 - protein, 15 aa, Mycobacterium tuberculosis
IAMNMGMDGAWGQWV

SEQ ID NO: 144026 - protein, 15 aa, Mycobacterium tuberculosis
AMNMGMDGAWGQWVN

SEQ ID NO: 144027 - protein, 15 aa, Mycobacterium tuberculosis
MNMGMDGAWGQWVNR

SEQ ID NO: 144028 - protein, 15 aa, Mycobacterium tuberculosis
NMGMDGAWGQWVNRW

SEQ ID NO: 144029 - protein, 15 aa, Mycobacterium tuberculosis
MGMDGAWGQWVNRWT

SEQ ID NO: 144030 - protein, 15 aa, Mycobacterium tuberculosis
GMDGAWGQWVNRWTA

SEQ ID NO: 144031 - protein, 15 aa, Mycobacterium tuberculosis
MDGAWGQWVNRWTAE

SEQ ID NO: 144032 - protein, 15 aa, Mycobacterium tuberculosis
DGAWGQWVNRWTAEE

SEQ ID NO: 144033 - protein, 15 aa, Mycobacterium tuberculosis
GAWGQWVNRWTAEEN

SEQ ID NO: 144034 - protein, 15 aa, Mycobacterium tuberculosis
AWGQWVNRWTAEENR

SEQ ID NO: 144035 - protein, 15 aa, Mycobacterium tuberculosis
WGQWVNRWTAEENRH

SEQ ID NO: 144036 - protein, 15 aa, Mycobacterium tuberculosis
GQWVNRWTAEENRHG

SEQ ID NO: 144037 - protein, 15 aa, Mycobacterium tuberculosis
QWVNRWTAEENRHGI

SEQ ID NO: 144038 - protein, 15 aa, Mycobacterium tuberculosis
WVNRWTAEENRHGIA

SEQ ID NO: 144039 - protein, 15 aa, Mycobacterium tuberculosis
VNRWTAEENRHGIAL

SEQ ID NO: 144040 - protein, 15 aa, Mycobacterium tuberculosis
NRWTAEENRHGIALR

SEQ ID NO: 144041 - protein, 15 aa, Mycobacterium tuberculosis
RWTAEENRHGIALRD

SEQ ID NO: 144042 - protein, 15 aa, Mycobacterium tuberculosis
WTAEENRHGIALRDY

SEQ ID NO: 144043 - protein, 15 aa, Mycobacterium tuberculosis
TAEENRHGIALRDYL

SEQ ID NO: 144044 - protein, 15 aa, Mycobacterium tuberculosis
AEENRHGIALRDYLV

SEQ ID NO: 144045 - protein, 15 aa, Mycobacterium tuberculosis
EENRHGIALRDYLVV

SEQ ID NO: 144046 - protein, 15 aa, Mycobacterium tuberculosis
ENRHGIALRDYLVVT

SEQ ID NO: 144047 - protein, 15 aa, Mycobacterium tuberculosis
NRHGIALRDYLVVTR

SEQ ID NO: 144048 - protein, 15 aa, Mycobacterium tuberculosis
RHGIALRDYLVVTRS

SEQ ID NO: 144049 - protein, 15 aa, Mycobacterium tuberculosis
HGIALRDYLVVTRSV

SEQ ID NO: 144050 - protein, 15 aa, Mycobacterium tuberculosis
GIALRDYLVVTRSVD

SEQ ID NO: 144051 - protein, 15 aa, Mycobacterium tuberculosis
IALRDYLVVTRSVDP

SEQ ID NO: 144052 - protein, 15 aa, Mycobacterium tuberculosis
ALRDYLVVTRSVDPV

SEQ ID NO: 144053 - protein, 15 aa, Mycobacterium tuberculosis
LRDYLVVTRSVDPVE

SEQ ID NO: 144054 - protein, 15 aa, Mycobacterium tuberculosis
RDYLVVTRSVDPVEL

SEQ ID NO: 144055 - protein, 15 aa, Mycobacterium tuberculosis
DYLVVTRSVDPVELE

SEQ ID NO: 144056 - protein, 15 aa, Mycobacterium tuberculosis
YLVVTRSVDPVELEK

SEQ ID NO: 144057 - protein, 15 aa, Mycobacterium tuberculosis
LVVTRSVDPVELEKL

SEQ ID NO: 144058 - protein, 15 aa, Mycobacterium tuberculosis
VVTRSVDPVELEKLR

SEQ ID NO: 144059 - protein, 15 aa, Mycobacterium tuberculosis
VTRSVDPVELEKLRL

SEQ ID NO: 144060 - protein, 15 aa, Mycobacterium tuberculosis
TRSVDPVELEKLRLE

SEQ ID NO: 144061 - protein, 15 aa, Mycobacterium tuberculosis
RSVDPVELEKLRLEV

SEQ ID NO: 144062 - protein, 15 aa, Mycobacterium tuberculosis
SVDPVELEKLRLEVV

SEQ ID NO: 144063 - protein, 15 aa, Mycobacterium tuberculosis
VDPVELEKLRLEVVN

SEQ ID NO: 144064 - protein, 15 aa, Mycobacterium tuberculosis
DPVELEKLRLEVVNR

SEQ ID NO: 144065 - protein, 15 aa, Mycobacterium tuberculosis
PVELEKLRLEVVNRG

SEQ ID NO: 144066 - protein, 15 aa, Mycobacterium tuberculosis
VELEKLRLEVVNRGF

SEQ ID NO: 144067 - protein, 15 aa, Mycobacterium tuberculosis
ELEKLRLEVVNRGFS

SEQ ID NO: 144068 - protein, 15 aa, Mycobacterium tuberculosis
LEKLRLEVVNRGFSP

SEQ ID NO: 144069 - protein, 15 aa, Mycobacterium tuberculosis
EKLRLEVVNRGFSPG

SEQ ID NO: 144070 - protein, 15 aa, Mycobacterium tuberculosis
KLRLEVVNRGFSPGQ

SEQ ID NO: 144071 - protein, 15 aa, Mycobacterium tuberculosis
LRLEVVNRGFSPGQN

SEQ ID NO: 144072 - protein, 15 aa, Mycobacterium tuberculosis
RLEVVNRGFSPGQNH

SEQ ID NO: 144073 - protein, 15 aa, Mycobacterium tuberculosis
LEVVNRGFSPGQNHQ

SEQ ID NO: 144074 - protein, 15 aa, Mycobacterium tuberculosis
EVVNRGFSPGQNHQG

SEQ ID NO: 144075 - protein, 15 aa, Mycobacterium tuberculosis
VVNRGFSPGQNHQGH

SEQ ID NO: 144076 - protein, 15 aa, Mycobacterium tuberculosis
VNRGFSPGQNHQGHY

SEQ ID NO: 144077 - protein, 15 aa, Mycobacterium tuberculosis
NRGFSPGQNHQGHYF

SEQ ID NO: 144078 - protein, 15 aa, Mycobacterium tuberculosis
RGFSPGQNHQGHYFA

SEQ ID NO: 144079 - protein, 15 aa, Mycobacterium tuberculosis
GFSPGQNHQGHYFAE

SEQ ID NO: 144080 - protein, 15 aa, Mycobacterium tuberculosis
FSPGQNHQGHYFAES

SEQ ID NO: 144081 - protein, 15 aa, Mycobacterium tuberculosis
SPGQNHQGHYFAESL

SEQ ID NO: 144082 - protein, 15 aa, Mycobacterium tuberculosis
PGQNHQGHYFAESLT

SEQ ID NO: 144083 - protein, 15 aa, Mycobacterium tuberculosis
GQNHQGHYFAESLTD

SEQ ID NO: 144084 - protein, 15 aa, Mycobacterium tuberculosis
QNHQGHYFAESLTDS

SEQ ID NO: 144085 - protein, 15 aa, Mycobacterium tuberculosis
NHQGHYFAESLTDSV

SEQ ID NO: 144086 - protein, 15 aa, Mycobacterium tuberculosis
HQGHYFAESLTDSVL

SEQ ID NO: 144087 - protein, 15 aa, Mycobacterium tuberculosis
QGHYFAESLTDSVLY

SEQ ID NO: 144088 - protein, 15 aa, Mycobacterium tuberculosis
GHYFAESLTDSVLYV

SEQ ID NO: 144089 - protein, 15 aa, Mycobacterium tuberculosis
HYFAESLTDSVLYVS

SEQ ID NO: 144090 - protein, 15 aa, Mycobacterium tuberculosis
YFAESLTDSVLYVSF

SEQ ID NO: 144091 - protein, 15 aa, Mycobacterium tuberculosis
FAESLTDSVLYVSFQ

SEQ ID NO: 144092 - protein, 15 aa, Mycobacterium tuberculosis
AESLTDSVLYVSFQE

SEQ ID NO: 144093 - protein, 15 aa, Mycobacterium tuberculosis
ESLTDSVLYVSFQEL

SEQ ID NO: 144094 - protein, 15 aa, Mycobacterium tuberculosis
SLTDSVLYVSFQELA

SEQ ID NO: 144095 - protein, 15 aa, Mycobacterium tuberculosis
LTDSVLYVSFQELAT

SEQ ID NO: 144096 - protein, 15 aa, Mycobacterium tuberculosis
TDSVLYVSFQELATR

SEQ ID NO: 144097 - protein, 15 aa, Mycobacterium tuberculosis
DSVLYVSFQELATRI

SEQ ID NO: 144098 - protein, 15 aa, Mycobacterium tuberculosis
SVLYVSFQELATRIS

SEQ ID NO: 144099 - protein, 15 aa, Mycobacterium tuberculosis
VLYVSFQELATRISH

SEQ ID NO: 144100 - protein, 15 aa, Mycobacterium tuberculosis
LYVSFQELATRISHR

SEQ ID NO: 144101 - protein, 15 aa, Mycobacterium tuberculosis
YVSFQELATRISHRN

SEQ ID NO: 144102 - protein, 15 aa, Mycobacterium tuberculosis
VSFQELATRISHRNT

SEQ ID NO: 144103 - protein, 15 aa, Mycobacterium tuberculosis
SFQELATRISHRNTG

SEQ ID NO: 144104 - protein, 15 aa, Mycobacterium tuberculosis
FQELATRISHRNTGK

SEQ ID NO: 144105 - protein, 15 aa, Mycobacterium tuberculosis
QELATRISHRNTGKA

SEQ ID NO: 144106 - protein, 15 aa, Mycobacterium tuberculosis
ELATRISHRNTGKAC

SEQ ID NO: 144107 - protein, 15 aa, Mycobacterium tuberculosis
LATRISHRNTGKACN

SEQ ID NO: 144108 - protein, 15 aa, Mycobacterium tuberculosis
ATRISHRNTGKACND

SEQ ID NO: 144109 - protein, 15 aa, Mycobacterium tuberculosis
TRISHRNTGKACNDP

SEQ ID NO: 144110 - protein, 15 aa, Mycobacterium tuberculosis
RISHRNTGKACNDPV

SEQ ID NO: 144111 - protein, 15 aa, Mycobacterium tuberculosis
ISHRNTGKACNDPVA

SEQ ID NO: 144112 - protein, 15 aa, Mycobacterium tuberculosis
SHRNTGKACNDPVAD

SEQ ID NO: 144113 - protein, 15 aa, Mycobacterium tuberculosis
HRNTGKACNDPVADQ

SEQ ID NO: 144114 - protein, 15 aa, Mycobacterium tuberculosis
RNTGKACNDPVADQL

SEQ ID NO: 144115 - protein, 15 aa, Mycobacterium tuberculosis
NTGKACNDPVADQLM

SEQ ID NO: 144116 - protein, 15 aa, Mycobacterium tuberculosis
TGKACNDPVADQLMA

SEQ ID NO: 144117 - protein, 15 aa, Mycobacterium tuberculosis
GKACNDPVADQLMAK

SEQ ID NO: 144118 - protein, 15 aa, Mycobacterium tuberculosis
KACNDPVADQLMAKI

SEQ ID NO: 144119 - protein, 15 aa, Mycobacterium tuberculosis
ACNDPVADQLMAKIS

SEQ ID NO: 144120 - protein, 15 aa, Mycobacterium tuberculosis
CNDPVADQLMAKISA

SEQ ID NO: 144121 - protein, 15 aa, Mycobacterium tuberculosis
NDPVADQLMAKISAD

SEQ ID NO: 144122 - protein, 15 aa, Mycobacterium tuberculosis
DPVADQLMAKISADE

SEQ ID NO: 144123 - protein, 15 aa, Mycobacterium tuberculosis
PVADQLMAKISADEN

SEQ ID NO: 144124 - protein, 15 aa, Mycobacterium tuberculosis
VADQLMAKISADENL

SEQ ID NO: 144125 - protein, 15 aa, Mycobacterium tuberculosis
ADQLMAKISADENLH

SEQ ID NO: 144126 - protein, 15 aa, Mycobacterium tuberculosis
DQLMAKISADENLHM

SEQ ID NO: 144127 - protein, 15 aa, Mycobacterium tuberculosis
QLMAKISADENLHMI

SEQ ID NO: 144128 - protein, 15 aa, Mycobacterium tuberculosis
LMAKISADENLHMIF

SEQ ID NO: 144129 - protein, 15 aa, Mycobacterium tuberculosis
MAKISADENLHMIFY

SEQ ID NO: 144130 - protein, 15 aa, Mycobacterium tuberculosis
AKISADENLHMIFYR

SEQ ID NO: 144131 - protein, 15 aa, Mycobacterium tuberculosis
KISADENLHMIFYRD

SEQ ID NO: 144132 - protein, 15 aa, Mycobacterium tuberculosis
ISADENLHMIFYRDV

SEQ ID NO: 144133 - protein, 15 aa, Mycobacterium tuberculosis
SADENLHMIFYRDVS

SEQ ID NO: 144134 - protein, 15 aa, Mycobacterium tuberculosis
ADENLHMIFYRDVSE

SEQ ID NO: 144135 - protein, 15 aa, Mycobacterium tuberculosis
DENLHMIFYRDVSEA

SEQ ID NO: 144136 - protein, 15 aa, Mycobacterium tuberculosis
ENLHMIFYRDVSEAA

SEQ ID NO: 144137 - protein, 15 aa, Mycobacterium tuberculosis
NLHMIFYRDVSEAAF

SEQ ID NO: 144138 - protein, 15 aa, Mycobacterium tuberculosis
LHMIFYRDVSEAAFD

SEQ ID NO: 144139 - protein, 15 aa, Mycobacterium tuberculosis
HMIFYRDVSEAAFDL

SEQ ID NO: 144140 - protein, 15 aa, Mycobacterium tuberculosis
MIFYRDVSEAAFDLV

SEQ ID NO: 144141 - protein, 15 aa, Mycobacterium tuberculosis
IFYRDVSEAAFDLVP

SEQ ID NO: 144142 - protein, 15 aa, Mycobacterium tuberculosis
FYRDVSEAAFDLVPN

SEQ ID NO: 144143 - protein, 15 aa, Mycobacterium tuberculosis
YRDVSEAAFDLVPNQ

SEQ ID NO: 144144 - protein, 15 aa, Mycobacterium tuberculosis
RDVSEAAFDLVPNQA

SEQ ID NO: 144145 - protein, 15 aa, Mycobacterium tuberculosis
DVSEAAFDLVPNQAM

SEQ ID NO: 144146 - protein, 15 aa, Mycobacterium tuberculosis
VSEAAFDLVPNQAMK

SEQ ID NO: 144147 - protein, 15 aa, Mycobacterium tuberculosis
SEAAFDLVPNQAMKS

SEQ ID NO: 144148 - protein, 15 aa, Mycobacterium tuberculosis
EAAFDLVPNQAMKSL

SEQ ID NO: 144149 - protein, 15 aa, Mycobacterium tuberculosis
AAFDLVPNQAMKSLH

SEQ ID NO: 144150 - protein, 15 aa, Mycobacterium tuberculosis
AFDLVPNQAMKSLHL

SEQ ID NO: 144151 - protein, 15 aa, Mycobacterium tuberculosis
FDLVPNQAMKSLHLI

SEQ ID NO: 144152 - protein, 15 aa, Mycobacterium tuberculosis
DLVPNQAMKSLHLIL

SEQ ID NO: 144153 - protein, 15 aa, Mycobacterium tuberculosis
LVPNQAMKSLHLILS

SEQ ID NO: 144154 - protein, 15 aa, Mycobacterium tuberculosis
VPNQAMKSLHLILSH

SEQ ID NO: 144155 - protein, 15 aa, Mycobacterium tuberculosis
PNQAMKSLHLILSHF

SEQ ID NO: 144156 - protein, 15 aa, Mycobacterium tuberculosis
NQAMKSLHLILSHFQ

SEQ ID NO: 144157 - protein, 15 aa, Mycobacterium tuberculosis
QAMKSLHLILSHFQM

SEQ ID NO: 144158 - protein, 15 aa, Mycobacterium tuberculosis
AMKSLHLILSHFQMP

SEQ ID NO: 144159 - protein, 15 aa, Mycobacterium tuberculosis
MKSLHLILSHFQMPG

SEQ ID NO: 144160 - protein, 15 aa, Mycobacterium tuberculosis
KSLHLILSHFQMPGF

SEQ ID NO: 144161 - protein, 15 aa, Mycobacterium tuberculosis
SLHLILSHFQMPGFQ

SEQ ID NO: 144162 - protein, 15 aa, Mycobacterium tuberculosis
LHLILSHFQMPGFQV

SEQ ID NO: 144163 - protein, 15 aa, Mycobacterium tuberculosis
HLILSHFQMPGFQVP

SEQ ID NO: 144164 - protein, 15 aa, Mycobacterium tuberculosis
LILSHFQMPGFQVPE

SEQ ID NO: 144165 - protein, 15 aa, Mycobacterium tuberculosis
ILSHFQMPGFQVPEF

SEQ ID NO: 144166 - protein, 15 aa, Mycobacterium tuberculosis
LSHFQMPGFQVPEFR

SEQ ID NO: 144167 - protein, 15 aa, Mycobacterium tuberculosis
SHFQMPGFQVPEFRR

SEQ ID NO: 144168 - protein, 15 aa, Mycobacterium tuberculosis
HFQMPGFQVPEFRRK

SEQ ID NO: 144169 - protein, 15 aa, Mycobacterium tuberculosis
FQMPGFQVPEFRRKA

SEQ ID NO: 144170 - protein, 15 aa, Mycobacterium tuberculosis
QMPGFQVPEFRRKAV

SEQ ID NO: 144171 - protein, 15 aa, Mycobacterium tuberculosis
MPGFQVPEFRRKAVV

SEQ ID NO: 144172 - protein, 15 aa, Mycobacterium tuberculosis
PGFQVPEFRRKAVVI

SEQ ID NO: 144173 - protein, 15 aa, Mycobacterium tuberculosis
GFQVPEFRRKAVVIA

SEQ ID NO: 144174 - protein, 15 aa, Mycobacterium tuberculosis
FQVPEFRRKAVVIAV

SEQ ID NO: 144175 - protein, 15 aa, Mycobacterium tuberculosis
QVPEFRRKAVVIAVG

SEQ ID NO: 144176 - protein, 15 aa, Mycobacterium tuberculosis
VPEFRRKAVVIAVGG

SEQ ID NO: 144177 - protein, 15 aa, Mycobacterium tuberculosis
PEFRRKAVVIAVGGV

SEQ ID NO: 144178 - protein, 15 aa, Mycobacterium tuberculosis
EFRRKAVVIAVGGVY

SEQ ID NO: 144179 - protein, 15 aa, Mycobacterium tuberculosis
FRRKAVVIAVGGVYD

SEQ ID NO: 144180 - protein, 15 aa, Mycobacterium tuberculosis
RRKAVVIAVGGVYDP

SEQ ID NO: 144181 - protein, 15 aa, Mycobacterium tuberculosis
RKAVVIAVGGVYDPR

SEQ ID NO: 144182 - protein, 15 aa, Mycobacterium tuberculosis
KAVVIAVGGVYDPRI

SEQ ID NO: 144183 - protein, 15 aa, Mycobacterium tuberculosis
AVVIAVGGVYDPRIH

SEQ ID NO: 144184 - protein, 15 aa, Mycobacterium tuberculosis
VVIAVGGVYDPRIHL

SEQ ID NO: 144185 - protein, 15 aa, Mycobacterium tuberculosis
VIAVGGVYDPRIHLD

SEQ ID NO: 144186 - protein, 15 aa, Mycobacterium tuberculosis
IAVGGVYDPRIHLDE

SEQ ID NO: 144187 - protein, 15 aa, Mycobacterium tuberculosis
AVGGVYDPRIHLDEV

SEQ ID NO: 144188 - protein, 15 aa, Mycobacterium tuberculosis
VGGVYDPRIHLDEVV

SEQ ID NO: 144189 - protein, 15 aa, Mycobacterium tuberculosis
GGVYDPRIHLDEVVM

SEQ ID NO: 144190 - protein, 15 aa, Mycobacterium tuberculosis
GVYDPRIHLDEVVMP

SEQ ID NO: 144191 - protein, 15 aa, Mycobacterium tuberculosis
VYDPRIHLDEVVMPV

SEQ ID NO: 144192 - protein, 15 aa, Mycobacterium tuberculosis
YDPRIHLDEVVMPVL

SEQ ID NO: 144193 - protein, 15 aa, Mycobacterium tuberculosis
DPRIHLDEVVMPVLK

SEQ ID NO: 144194 - protein, 15 aa, Mycobacterium tuberculosis
PRIHLDEVVMPVLKK

SEQ ID NO: 144195 - protein, 15 aa, Mycobacterium tuberculosis
RIHLDEVVMPVLKKW

SEQ ID NO: 144196 - protein, 15 aa, Mycobacterium tuberculosis
IHLDEVVMPVLKKWR

SEQ ID NO: 144197 - protein, 15 aa, Mycobacterium tuberculosis
HLDEVVMPVLKKWRI

SEQ ID NO: 144198 - protein, 15 aa, Mycobacterium tuberculosis
LDEVVMPVLKKWRIF

SEQ ID NO: 144199 - protein, 15 aa, Mycobacterium tuberculosis
DEVVMPVLKKWRIFE

SEQ ID NO: 144200 - protein, 15 aa, Mycobacterium tuberculosis
EVVMPVLKKWRIFER

SEQ ID NO: 144201 - protein, 15 aa, Mycobacterium tuberculosis
VVMPVLKKWRIFERE

SEQ ID NO: 144202 - protein, 15 aa, Mycobacterium tuberculosis
VMPVLKKWRIFERED

SEQ ID NO: 144203 - protein, 15 aa, Mycobacterium tuberculosis
MPVLKKWRIFEREDF

SEQ ID NO: 144204 - protein, 15 aa, Mycobacterium tuberculosis
PVLKKWRIFEREDFT

SEQ ID NO: 144205 - protein, 15 aa, Mycobacterium tuberculosis
VLKKWRIFEREDFTG

SEQ ID NO: 144206 - protein, 15 aa, Mycobacterium tuberculosis
LKKWRIFEREDFTGE

SEQ ID NO: 144207 - protein, 15 aa, Mycobacterium tuberculosis
KKWRIFEREDFTGEG

SEQ ID NO: 144208 - protein, 15 aa, Mycobacterium tuberculosis
KWRIFEREDFTGEGA

SEQ ID NO: 144209 - protein, 15 aa, Mycobacterium tuberculosis
WRIFEREDFTGEGAK

SEQ ID NO: 144210 - protein, 15 aa, Mycobacterium tuberculosis
RIFEREDFTGEGAKL

SEQ ID NO: 144211 - protein, 15 aa, Mycobacterium tuberculosis
IFEREDFTGEGAKLR

SEQ ID NO: 144212 - protein, 15 aa, Mycobacterium tuberculosis
FEREDFTGEGAKLRD

SEQ ID NO: 144213 - protein, 15 aa, Mycobacterium tuberculosis
EREDFTGEGAKLRDE

SEQ ID NO: 144214 - protein, 15 aa, Mycobacterium tuberculosis
REDFTGEGAKLRDEL

SEQ ID NO: 144215 - protein, 15 aa, Mycobacterium tuberculosis
EDFTGEGAKLRDELA

SEQ ID NO: 144216 - protein, 15 aa, Mycobacterium tuberculosis
DFTGEGAKLRDELAL

SEQ ID NO: 144217 - protein, 15 aa, Mycobacterium tuberculosis
FTGEGAKLRDELALV

SEQ ID NO: 144218 - protein, 15 aa, Mycobacterium tuberculosis
TGEGAKLRDELALVI

SEQ ID NO: 144219 - protein, 15 aa, Mycobacterium tuberculosis
GEGAKLRDELALVIK

SEQ ID NO: 144220 - protein, 15 aa, Mycobacterium tuberculosis
EGAKLRDELALVIKD

SEQ ID NO: 144221 - protein, 15 aa, Mycobacterium tuberculosis
GAKLRDELALVIKDL

SEQ ID NO: 144222 - protein, 15 aa, Mycobacterium tuberculosis
AKLRDELALVIKDLE

SEQ ID NO: 144223 - protein, 15 aa, Mycobacterium tuberculosis
KLRDELALVIKDLEL

SEQ ID NO: 144224 - protein, 15 aa, Mycobacterium tuberculosis
LRDELALVIKDLELA

SEQ ID NO: 144225 - protein, 15 aa, Mycobacterium tuberculosis
RDELALVIKDLELAC

SEQ ID NO: 144226 - protein, 15 aa, Mycobacterium tuberculosis
DELALVIKDLELACD

SEQ ID NO: 144227 - protein, 15 aa, Mycobacterium tuberculosis
ELALVIKDLELACDK

SEQ ID NO: 144228 - protein, 15 aa, Mycobacterium tuberculosis
LALVIKDLELACDKF

SEQ ID NO: 144229 - protein, 15 aa, Mycobacterium tuberculosis
ALVIKDLELACDKFE

SEQ ID NO: 144230 - protein, 15 aa, Mycobacterium tuberculosis
LVIKDLELACDKFEV

SEQ ID NO: 144231 - protein, 15 aa, Mycobacterium tuberculosis
VIKDLELACDKFEVS

SEQ ID NO: 144232 - protein, 15 aa, Mycobacterium tuberculosis
IKDLELACDKFEVSK

SEQ ID NO: 144233 - protein, 15 aa, Mycobacterium tuberculosis
KDLELACDKFEVSKQ

SEQ ID NO: 144234 - protein, 15 aa, Mycobacterium tuberculosis
DLELACDKFEVSKQR

SEQ ID NO: 144235 - protein, 15 aa, Mycobacterium tuberculosis
LELACDKFEVSKQRQ

SEQ ID NO: 144236 - protein, 15 aa, Mycobacterium tuberculosis
ELACDKFEVSKQRQL

SEQ ID NO: 144237 - protein, 15 aa, Mycobacterium tuberculosis
LACDKFEVSKQRQLD

SEQ ID NO: 144238 - protein, 15 aa, Mycobacterium tuberculosis
ACDKFEVSKQRQLDR

SEQ ID NO: 144239 - protein, 15 aa, Mycobacterium tuberculosis
CDKFEVSKQRQLDRE

SEQ ID NO: 144240 - protein, 15 aa, Mycobacterium tuberculosis
DKFEVSKQRQLDREA

SEQ ID NO: 144241 - protein, 15 aa, Mycobacterium tuberculosis
KFEVSKQRQLDREAR

SEQ ID NO: 144242 - protein, 15 aa, Mycobacterium tuberculosis
FEVSKQRQLDREART

SEQ ID NO: 144243 - protein, 15 aa, Mycobacterium tuberculosis
EVSKQRQLDREARTG

SEQ ID NO: 144244 - protein, 15 aa, Mycobacterium tuberculosis
VSKQRQLDREARTGK

SEQ ID NO: 144245 - protein, 15 aa, Mycobacterium tuberculosis
SKQRQLDREARTGKK

SEQ ID NO: 144246 - protein, 15 aa, Mycobacterium tuberculosis
KQRQLDREARTGKKV

SEQ ID NO: 144247 - protein, 15 aa, Mycobacterium tuberculosis
QRQLDREARTGKKVS

SEQ ID NO: 144248 - protein, 15 aa, Mycobacterium tuberculosis
RQLDREARTGKKVSA

SEQ ID NO: 144249 - protein, 15 aa, Mycobacterium tuberculosis
QLDREARTGKKVSAH

SEQ ID NO: 144250 - protein, 15 aa, Mycobacterium tuberculosis
LDREARTGKKVSAHE

SEQ ID NO: 144251 - protein, 15 aa, Mycobacterium tuberculosis
DREARTGKKVSAHEL

SEQ ID NO: 144252 - protein, 15 aa, Mycobacterium tuberculosis
REARTGKKVSAHELH

SEQ ID NO: 144253 - protein, 15 aa, Mycobacterium tuberculosis
EARTGKKVSAHELHK

SEQ ID NO: 144254 - protein, 15 aa, Mycobacterium tuberculosis
ARTGKKVSAHELHKT

SEQ ID NO: 144255 - protein, 15 aa, Mycobacterium tuberculosis
RTGKKVSAHELHKTA

SEQ ID NO: 144256 - protein, 15 aa, Mycobacterium tuberculosis
TGKKVSAHELHKTAG

SEQ ID NO: 144257 - protein, 15 aa, Mycobacterium tuberculosis
GKKVSAHELHKTAGK

SEQ ID NO: 144258 - protein, 15 aa, Mycobacterium tuberculosis
KKVSAHELHKTAGKL

SEQ ID NO: 144259 - protein, 15 aa, Mycobacterium tuberculosis
KVSAHELHKTAGKLA

SEQ ID NO: 144260 - protein, 15 aa, Mycobacterium tuberculosis
VSAHELHKTAGKLAM

SEQ ID NO: 144261 - protein, 15 aa, Mycobacterium tuberculosis
SAHELHKTAGKLAMS

SEQ ID NO: 144262 - protein, 15 aa, Mycobacterium tuberculosis
AHELHKTAGKLAMSR

SEQ ID NO: 144263 - protein, 15 aa, Mycobacterium tuberculosis
HELHKTAGKLAMSRR

SEQ ID NO: 144264 - protein, 16 aa, Mycobacterium tuberculosis
MSAKLTDLQLLHELEP

SEQ ID NO: 144265 - protein, 16 aa, Mycobacterium tuberculosis
SAKLTDLQLLHELEPV

SEQ ID NO: 144266 - protein, 16 aa, Mycobacterium tuberculosis
AKLTDLQLLHELEPVV

SEQ ID NO: 144267 - protein, 16 aa, Mycobacterium tuberculosis
KLTDLQLLHELEPVVE

SEQ ID NO: 144268 - protein, 16 aa, Mycobacterium tuberculosis
LTDLQLLHELEPVVEK

SEQ ID NO: 144269 - protein, 16 aa, Mycobacterium tuberculosis
TDLQLLHELEPVVEKY

SEQ ID NO: 144270 - protein, 16 aa, Mycobacterium tuberculosis
DLQLLHELEPVVEKYL

SEQ ID NO: 144271 - protein, 16 aa, Mycobacterium tuberculosis
LQLLHELEPVVEKYLN

SEQ ID NO: 144272 - protein, 16 aa, Mycobacterium tuberculosis
QLLHELEPVVEKYLNR

SEQ ID NO: 144273 - protein, 16 aa, Mycobacterium tuberculosis
LLHELEPVVEKYLNRH

SEQ ID NO: 144274 - protein, 16 aa, Mycobacterium tuberculosis
LHELEPVVEKYLNRHL

SEQ ID NO: 144275 - protein, 16 aa, Mycobacterium tuberculosis
HELEPVVEKYLNRHLS

SEQ ID NO: 144276 - protein, 16 aa, Mycobacterium tuberculosis
ELEPVVEKYLNRHLSM

SEQ ID NO: 144277 - protein, 16 aa, Mycobacterium tuberculosis
LEPVVEKYLNRHLSMH

SEQ ID NO: 144278 - protein, 16 aa, Mycobacterium tuberculosis
EPVVEKYLNRHLSMHK

SEQ ID NO: 144279 - protein, 16 aa, Mycobacterium tuberculosis
PVVEKYLNRHLSMHKP

SEQ ID NO: 144280 - protein, 16 aa, Mycobacterium tuberculosis
VVEKYLNRHLSMHKPW

SEQ ID NO: 144281 - protein, 16 aa, Mycobacterium tuberculosis
VEKYLNRHLSMHKPWN

SEQ ID NO: 144282 - protein, 16 aa, Mycobacterium tuberculosis
EKYLNRHLSMHKPWNP

SEQ ID NO: 144283 - protein, 16 aa, Mycobacterium tuberculosis
KYLNRHLSMHKPWNPH

SEQ ID NO: 144284 - protein, 16 aa, Mycobacterium tuberculosis
YLNRHLSMHKPWNPHD

SEQ ID NO: 144285 - protein, 16 aa, Mycobacterium tuberculosis
LNRHLSMHKPWNPHDY

SEQ ID NO: 144286 - protein, 16 aa, Mycobacterium tuberculosis
NRHLSMHKPWNPHDYI

SEQ ID NO: 144287 - protein, 16 aa, Mycobacterium tuberculosis
RHLSMHKPWNPHDYIP

SEQ ID NO: 144288 - protein, 16 aa, Mycobacterium tuberculosis
HLSMHKPWNPHDYIPW

SEQ ID NO: 144289 - protein, 16 aa, Mycobacterium tuberculosis
LSMHKPWNPHDYIPWS

SEQ ID NO: 144290 - protein, 16 aa, Mycobacterium tuberculosis
SMHKPWNPHDYIPWSD

SEQ ID NO: 144291 - protein, 16 aa, Mycobacterium tuberculosis
MHKPWNPHDYIPWSDG

SEQ ID NO: 144292 - protein, 16 aa, Mycobacterium tuberculosis
HKPWNPHDYIPWSDGK

SEQ ID NO: 144293 - protein, 16 aa, Mycobacterium tuberculosis
KPWNPHDYIPWSDGKN

SEQ ID NO: 144294 - protein, 16 aa, Mycobacterium tuberculosis
PWNPHDYIPWSDGKNY

SEQ ID NO: 144295 - protein, 16 aa, Mycobacterium tuberculosis
WNPHDYIPWSDGKNYY

SEQ ID NO: 144296 - protein, 16 aa, Mycobacterium tuberculosis
NPHDYIPWSDGKNYYA

SEQ ID NO: 144297 - protein, 16 aa, Mycobacterium tuberculosis
PHDYIPWSDGKNYYAL

SEQ ID NO: 144298 - protein, 16 aa, Mycobacterium tuberculosis
HDYIPWSDGKNYYALG

SEQ ID NO: 144299 - protein, 16 aa, Mycobacterium tuberculosis
DYIPWSDGKNYYALGG

SEQ ID NO: 144300 - protein, 16 aa, Mycobacterium tuberculosis
YIPWSDGKNYYALGGQ

SEQ ID NO: 144301 - protein, 16 aa, Mycobacterium tuberculosis
IPWSDGKNYYALGGQD

SEQ ID NO: 144302 - protein, 16 aa, Mycobacterium tuberculosis
PWSDGKNYYALGGQDW

SEQ ID NO: 144303 - protein, 16 aa, Mycobacterium tuberculosis
WSDGKNYYALGGQDWD

SEQ ID NO: 144304 - protein, 16 aa, Mycobacterium tuberculosis
SDGKNYYALGGQDWDP

SEQ ID NO: 144305 - protein, 16 aa, Mycobacterium tuberculosis
DGKNYYALGGQDWDPD

SEQ ID NO: 144306 - protein, 16 aa, Mycobacterium tuberculosis
GKNYYALGGQDWDPDQ

SEQ ID NO: 144307 - protein, 16 aa, Mycobacterium tuberculosis
KNYYALGGQDWDPDQS

SEQ ID NO: 144308 - protein, 16 aa, Mycobacterium tuberculosis
NYYALGGQDWDPDQSK

SEQ ID NO: 144309 - protein, 16 aa, Mycobacterium tuberculosis
YYALGGQDWDPDQSKL

SEQ ID NO: 144310 - protein, 16 aa, Mycobacterium tuberculosis
YALGGQDWDPDQSKLS

SEQ ID NO: 144311 - protein, 16 aa, Mycobacterium tuberculosis
ALGGQDWDPDQSKLSD

SEQ ID NO: 144312 - protein, 16 aa, Mycobacterium tuberculosis
LGGQDWDPDQSKLSDV

SEQ ID NO: 144313 - protein, 16 aa, Mycobacterium tuberculosis
GGQDWDPDQSKLSDVA

SEQ ID NO: 144314 - protein, 16 aa, Mycobacterium tuberculosis
GQDWDPDQSKLSDVAQ

SEQ ID NO: 144315 - protein, 16 aa, Mycobacterium tuberculosis
QDWDPDQSKLSDVAQV

SEQ ID NO: 144316 - protein, 16 aa, Mycobacterium tuberculosis
DWDPDQSKLSDVAQVA

SEQ ID NO: 144317 - protein, 16 aa, Mycobacterium tuberculosis
WDPDQSKLSDVAQVAM

SEQ ID NO: 144318 - protein, 16 aa, Mycobacterium tuberculosis
DPDQSKLSDVAQVAMV

SEQ ID NO: 144319 - protein, 16 aa, Mycobacterium tuberculosis
PDQSKLSDVAQVAMVQ

SEQ ID NO: 144320 - protein, 16 aa, Mycobacterium tuberculosis
DQSKLSDVAQVAMVQN

SEQ ID NO: 144321 - protein, 16 aa, Mycobacterium tuberculosis
QSKLSDVAQVAMVQNL

SEQ ID NO: 144322 - protein, 16 aa, Mycobacterium tuberculosis
SKLSDVAQVAMVQNLV

SEQ ID NO: 144323 - protein, 16 aa, Mycobacterium tuberculosis
KLSDVAQVAMVQNLVT

SEQ ID NO: 144324 - protein, 16 aa, Mycobacterium tuberculosis
LSDVAQVAMVQNLVTE

SEQ ID NO: 144325 - protein, 16 aa, Mycobacterium tuberculosis
SDVAQVAMVQNLVTED

SEQ ID NO: 144326 - protein, 16 aa, Mycobacterium tuberculosis
DVAQVAMVQNLVTEDN

SEQ ID NO: 144327 - protein, 16 aa, Mycobacterium tuberculosis
VAQVAMVQNLVTEDNL

SEQ ID NO: 144328 - protein, 16 aa, Mycobacterium tuberculosis
AQVAMVQNLVTEDNLP

SEQ ID NO: 144329 - protein, 16 aa, Mycobacterium tuberculosis
QVAMVQNLVTEDNLPS

SEQ ID NO: 144330 - protein, 16 aa, Mycobacterium tuberculosis
VAMVQNLVTEDNLPSY

SEQ ID NO: 144331 - protein, 16 aa, Mycobacterium tuberculosis
AMVQNLVTEDNLPSYH

SEQ ID NO: 144332 - protein, 16 aa, Mycobacterium tuberculosis
MVQNLVTEDNLPSYHR

SEQ ID NO: 144333 - protein, 16 aa, Mycobacterium tuberculosis
VQNLVTEDNLPSYHRE

SEQ ID NO: 144334 - protein, 16 aa, Mycobacterium tuberculosis
QNLVTEDNLPSYHREI

SEQ ID NO: 144335 - protein, 16 aa, Mycobacterium tuberculosis
NLVTEDNLPSYHREIA

SEQ ID NO: 144336 - protein, 16 aa, Mycobacterium tuberculosis
LVTEDNLPSYHREIAM

SEQ ID NO: 144337 - protein, 16 aa, Mycobacterium tuberculosis
VTEDNLPSYHREIAMN

SEQ ID NO: 144338 - protein, 16 aa, Mycobacterium tuberculosis
TEDNLPSYHREIAMNM

SEQ ID NO: 144339 - protein, 16 aa, Mycobacterium tuberculosis
EDNLPSYHREIAMNMG

SEQ ID NO: 144340 - protein, 16 aa, Mycobacterium tuberculosis
DNLPSYHREIAMNMGM

SEQ ID NO: 144341 - protein, 16 aa, Mycobacterium tuberculosis
NLPSYHREIAMNMGMD

SEQ ID NO: 144342 - protein, 16 aa, Mycobacterium tuberculosis
LPSYHREIAMNMGMDG

SEQ ID NO: 144343 - protein, 16 aa, Mycobacterium tuberculosis
PSYHREIAMNMGMDGA

SEQ ID NO: 144344 - protein, 16 aa, Mycobacterium tuberculosis
SYHREIAMNMGMDGAW

SEQ ID NO: 144345 - protein, 16 aa, Mycobacterium tuberculosis
YHREIAMNMGMDGAWG

SEQ ID NO: 144346 - protein, 16 aa, Mycobacterium tuberculosis
HREIAMNMGMDGAWGQ

SEQ ID NO: 144347 - protein, 16 aa, Mycobacterium tuberculosis
REIAMNMGMDGAWGQW

SEQ ID NO: 144348 - protein, 16 aa, Mycobacterium tuberculosis
EIAMNMGMDGAWGQWV

SEQ ID NO: 144349 - protein, 16 aa, Mycobacterium tuberculosis
IAMNMGMDGAWGQWVN

SEQ ID NO: 144350 - protein, 16 aa, Mycobacterium tuberculosis
AMNMGMDGAWGQWVNR

SEQ ID NO: 144351 - protein, 16 aa, Mycobacterium tuberculosis
MNMGMDGAWGQWVNRW

SEQ ID NO: 144352 - protein, 16 aa, Mycobacterium tuberculosis
NMGMDGAWGQWVNRWT

SEQ ID NO: 144353 - protein, 16 aa, Mycobacterium tuberculosis
MGMDGAWGQWVNRWTA

SEQ ID NO: 144354 - protein, 16 aa, Mycobacterium tuberculosis
GMDGAWGQWVNRWTAE

SEQ ID NO: 144355 - protein, 16 aa, Mycobacterium tuberculosis
MDGAWGQWVNRWTAEE

SEQ ID NO: 144356 - protein, 16 aa, Mycobacterium tuberculosis
DGAWGQWVNRWTAEEN

SEQ ID NO: 144357 - protein, 16 aa, Mycobacterium tuberculosis
GAWGQWVNRWTAEENR

SEQ ID NO: 144358 - protein, 16 aa, Mycobacterium tuberculosis
AWGQWVNRWTAEENRH

SEQ ID NO: 144359 - protein, 16 aa, Mycobacterium tuberculosis
WGQWVNRWTAEENRHG

SEQ ID NO: 144360 - protein, 16 aa, Mycobacterium tuberculosis
GQWVNRWTAEENRHGI

SEQ ID NO: 144361 - protein, 16 aa, Mycobacterium tuberculosis
QWVNRWTAEENRHGIA

SEQ ID NO: 144362 - protein, 16 aa, Mycobacterium tuberculosis
WVNRWTAEENRHGIAL

SEQ ID NO: 144363 - protein, 16 aa, Mycobacterium tuberculosis
VNRWTAEENRHGIALR

SEQ ID NO: 144364 - protein, 16 aa, Mycobacterium tuberculosis
NRWTAEENRHGIALRD

SEQ ID NO: 144365 - protein, 16 aa, Mycobacterium tuberculosis
RWTAEENRHGIALRDY

SEQ ID NO: 144366 - protein, 16 aa, Mycobacterium tuberculosis
WTAEENRHGIALRDYL

SEQ ID NO: 144367 - protein, 16 aa, Mycobacterium tuberculosis
TAEENRHGIALRDYLV

SEQ ID NO: 144368 - protein, 16 aa, Mycobacterium tuberculosis
AEENRHGIALRDYLVV

SEQ ID NO: 144369 - protein, 16 aa, Mycobacterium tuberculosis
EENRHGIALRDYLVVT

SEQ ID NO: 144370 - protein, 16 aa, Mycobacterium tuberculosis
ENRHGIALRDYLVVTR

SEQ ID NO: 144371 - protein, 16 aa, Mycobacterium tuberculosis
NRHGIALRDYLVVTRS

SEQ ID NO: 144372 - protein, 16 aa, Mycobacterium tuberculosis
RHGIALRDYLVVTRSV

SEQ ID NO: 144373 - protein, 16 aa, Mycobacterium tuberculosis
HGIALRDYLVVTRSVD

SEQ ID NO: 144374 - protein, 16 aa, Mycobacterium tuberculosis
GIALRDYLVVTRSVDP

SEQ ID NO: 144375 - protein, 16 aa, Mycobacterium tuberculosis
IALRDYLVVTRSVDPV

SEQ ID NO: 144376 - protein, 16 aa, Mycobacterium tuberculosis
ALRDYLVVTRSVDPVE

SEQ ID NO: 144377 - protein, 16 aa, Mycobacterium tuberculosis
LRDYLVVTRSVDPVEL

SEQ ID NO: 144378 - protein, 16 aa, Mycobacterium tuberculosis
RDYLVVTRSVDPVELE

SEQ ID NO: 144379 - protein, 16 aa, Mycobacterium tuberculosis
DYLVVTRSVDPVELEK

SEQ ID NO: 144380 - protein, 16 aa, Mycobacterium tuberculosis
YLVVTRSVDPVELEKL

SEQ ID NO: 144381 - protein, 16 aa, Mycobacterium tuberculosis
LVVTRSVDPVELEKLR

SEQ ID NO: 144382 - protein, 16 aa, Mycobacterium tuberculosis
VVTRSVDPVELEKLRL

SEQ ID NO: 144383 - protein, 16 aa, Mycobacterium tuberculosis
VTRSVDPVELEKLRLE

SEQ ID NO: 144384 - protein, 16 aa, Mycobacterium tuberculosis
TRSVDPVELEKLRLEV

SEQ ID NO: 144385 - protein, 16 aa, Mycobacterium tuberculosis
RSVDPVELEKLRLEVV

SEQ ID NO: 144386 - protein, 16 aa, Mycobacterium tuberculosis
SVDPVELEKLRLEVVN

SEQ ID NO: 144387 - protein, 16 aa, Mycobacterium tuberculosis
VDPVELEKLRLEVVNR

SEQ ID NO: 144388 - protein, 16 aa, Mycobacterium tuberculosis
DPVELEKLRLEVVNRG

SEQ ID NO: 144389 - protein, 16 aa, Mycobacterium tuberculosis
PVELEKLRLEVVNRGF

SEQ ID NO: 144390 - protein, 16 aa, Mycobacterium tuberculosis
VELEKLRLEVVNRGFS

SEQ ID NO: 144391 - protein, 16 aa, Mycobacterium tuberculosis
ELEKLRLEVVNRGFSP

SEQ ID NO: 144392 - protein, 16 aa, Mycobacterium tuberculosis
LEKLRLEVVNRGFSPG

SEQ ID NO: 144393 - protein, 16 aa, Mycobacterium tuberculosis
EKLRLEVVNRGFSPGQ

SEQ ID NO: 144394 - protein, 16 aa, Mycobacterium tuberculosis
KLRLEVVNRGFSPGQN

SEQ ID NO: 144395 - protein, 16 aa, Mycobacterium tuberculosis
LRLEVVNRGFSPGQNH

SEQ ID NO: 144396 - protein, 16 aa, Mycobacterium tuberculosis
RLEVVNRGFSPGQNHQ

SEQ ID NO: 144397 - protein, 16 aa, Mycobacterium tuberculosis
LEVVNRGFSPGQNHQG

SEQ ID NO: 144398 - protein, 16 aa, Mycobacterium tuberculosis
EVVNRGFSPGQNHQGH

SEQ ID NO: 144399 - protein, 16 aa, Mycobacterium tuberculosis
VVNRGFSPGQNHQGHY

SEQ ID NO: 144400 - protein, 16 aa, Mycobacterium tuberculosis
VNRGFSPGQNHQGHYF

SEQ ID NO: 144401 - protein, 16 aa, Mycobacterium tuberculosis
NRGFSPGQNHQGHYFA

SEQ ID NO: 144402 - protein, 16 aa, Mycobacterium tuberculosis
RGFSPGQNHQGHYFAE

SEQ ID NO: 144403 - protein, 16 aa, Mycobacterium tuberculosis
GFSPGQNHQGHYFAES

SEQ ID NO: 144404 - protein, 16 aa, Mycobacterium tuberculosis
FSPGQNHQGHYFAESL

SEQ ID NO: 144405 - protein, 16 aa, Mycobacterium tuberculosis
SPGQNHQGHYFAESLT

SEQ ID NO: 144406 - protein, 16 aa, Mycobacterium tuberculosis
PGQNHQGHYFAESLTD

SEQ ID NO: 144407 - protein, 16 aa, Mycobacterium tuberculosis
GQNHQGHYFAESLTDS

SEQ ID NO: 144408 - protein, 16 aa, Mycobacterium tuberculosis
QNHQGHYFAESLTDSV

SEQ ID NO: 144409 - protein, 16 aa, Mycobacterium tuberculosis
NHQGHYFAESLTDSVL

SEQ ID NO: 144410 - protein, 16 aa, Mycobacterium tuberculosis
HQGHYFAESLTDSVLY

SEQ ID NO: 144411 - protein, 16 aa, Mycobacterium tuberculosis
QGHYFAESLTDSVLYV

SEQ ID NO: 144412 - protein, 16 aa, Mycobacterium tuberculosis
GHYFAESLTDSVLYVS

SEQ ID NO: 144413 - protein, 16 aa, Mycobacterium tuberculosis
HYFAESLTDSVLYVSF

SEQ ID NO: 144414 - protein, 16 aa, Mycobacterium tuberculosis
YFAESLTDSVLYVSFQ

SEQ ID NO: 144415 - protein, 16 aa, Mycobacterium tuberculosis
FAESLTDSVLYVSFQE

SEQ ID NO: 144416 - protein, 16 aa, Mycobacterium tuberculosis
AESLTDSVLYVSFQEL

SEQ ID NO: 144417 - protein, 16 aa, Mycobacterium tuberculosis
ESLTDSVLYVSFQELA

SEQ ID NO: 144418 - protein, 16 aa, Mycobacterium tuberculosis
SLTDSVLYVSFQELAT

SEQ ID NO: 144419 - protein, 16 aa, Mycobacterium tuberculosis
LTDSVLYVSFQELATR

SEQ ID NO: 144420 - protein, 16 aa, Mycobacterium tuberculosis
TDSVLYVSFQELATRI

SEQ ID NO: 144421 - protein, 16 aa, Mycobacterium tuberculosis
DSVLYVSFQELATRIS

SEQ ID NO: 144422 - protein, 16 aa, Mycobacterium tuberculosis
SVLYVSFQELATRISH

SEQ ID NO: 144423 - protein, 16 aa, Mycobacterium tuberculosis
VLYVSFQELATRISHR

SEQ ID NO: 144424 - protein, 16 aa, Mycobacterium tuberculosis
LYVSFQELATRISHRN

SEQ ID NO: 144425 - protein, 16 aa, Mycobacterium tuberculosis
YVSFQELATRISHRNT

SEQ ID NO: 144426 - protein, 16 aa, Mycobacterium tuberculosis
VSFQELATRISHRNTG

SEQ ID NO: 144427 - protein, 16 aa, Mycobacterium tuberculosis
SFQELATRISHRNTGK

SEQ ID NO: 144428 - protein, 16 aa, Mycobacterium tuberculosis
FQELATRISHRNTGKA

SEQ ID NO: 144429 - protein, 16 aa, Mycobacterium tuberculosis
QELATRISHRNTGKAC

SEQ ID NO: 144430 - protein, 16 aa, Mycobacterium tuberculosis
ELATRISHRNTGKACN

SEQ ID NO: 144431 - protein, 16 aa, Mycobacterium tuberculosis
LATRISHRNTGKACND

SEQ ID NO: 144432 - protein, 16 aa, Mycobacterium tuberculosis
ATRISHRNTGKACNDP

SEQ ID NO: 144433 - protein, 16 aa, Mycobacterium tuberculosis
TRISHRNTGKACNDPV

SEQ ID NO: 144434 - protein, 16 aa, Mycobacterium tuberculosis
RISHRNTGKACNDPVA

SEQ ID NO: 144435 - protein, 16 aa, Mycobacterium tuberculosis
ISHRNTGKACNDPVAD

SEQ ID NO: 144436 - protein, 16 aa, Mycobacterium tuberculosis
SHRNTGKACNDPVADQ

SEQ ID NO: 144437 - protein, 16 aa, Mycobacterium tuberculosis
HRNTGKACNDPVADQL

SEQ ID NO: 144438 - protein, 16 aa, Mycobacterium tuberculosis
RNTGKACNDPVADQLM

SEQ ID NO: 144439 - protein, 16 aa, Mycobacterium tuberculosis
NTGKACNDPVADQLMA

SEQ ID NO: 144440 - protein, 16 aa, Mycobacterium tuberculosis
TGKACNDPVADQLMAK

SEQ ID NO: 144441 - protein, 16 aa, Mycobacterium tuberculosis
GKACNDPVADQLMAKI

SEQ ID NO: 144442 - protein, 16 aa, Mycobacterium tuberculosis
KACNDPVADQLMAKIS

SEQ ID NO: 144443 - protein, 16 aa, Mycobacterium tuberculosis
ACNDPVADQLMAKISA

SEQ ID NO: 144444 - protein, 16 aa, Mycobacterium tuberculosis
CNDPVADQLMAKISAD

SEQ ID NO: 144445 - protein, 16 aa, Mycobacterium tuberculosis
NDPVADQLMAKISADE

SEQ ID NO: 144446 - protein, 16 aa, Mycobacterium tuberculosis
DPVADQLMAKISADEN

SEQ ID NO: 144447 - protein, 16 aa, Mycobacterium tuberculosis
PVADQLMAKISADENL

SEQ ID NO: 144448 - protein, 16 aa, Mycobacterium tuberculosis
VADQLMAKISADENLH

SEQ ID NO: 144449 - protein, 16 aa, Mycobacterium tuberculosis
ADQLMAKISADENLHM

SEQ ID NO: 144450 - protein, 16 aa, Mycobacterium tuberculosis
DQLMAKISADENLHMI

SEQ ID NO: 144451 - protein, 16 aa, Mycobacterium tuberculosis
QLMAKISADENLHMIF

SEQ ID NO: 144452 - protein, 16 aa, Mycobacterium tuberculosis
LMAKISADENLHMIFY

SEQ ID NO: 144453 - protein, 16 aa, Mycobacterium tuberculosis
MAKISADENLHMIFYR

SEQ ID NO: 144454 - protein, 16 aa, Mycobacterium tuberculosis
AKISADENLHMIFYRD

SEQ ID NO: 144455 - protein, 16 aa, Mycobacterium tuberculosis
KISADENLHMIFYRDV

SEQ ID NO: 144456 - protein, 16 aa, Mycobacterium tuberculosis
ISADENLHMIFYRDVS

SEQ ID NO: 144457 - protein, 16 aa, Mycobacterium tuberculosis
SADENLHMIFYRDVSE

SEQ ID NO: 144458 - protein, 16 aa, Mycobacterium tuberculosis
ADENLHMIFYRDVSEA

SEQ ID NO: 144459 - protein, 16 aa, Mycobacterium tuberculosis
DENLHMIFYRDVSEAA

SEQ ID NO: 144460 - protein, 16 aa, Mycobacterium tuberculosis
ENLHMIFYRDVSEAAF

SEQ ID NO: 144461 - protein, 16 aa, Mycobacterium tuberculosis
NLHMIFYRDVSEAAFD

SEQ ID NO: 144462 - protein, 16 aa, Mycobacterium tuberculosis
LHMIFYRDVSEAAFDL

SEQ ID NO: 144463 - protein, 16 aa, Mycobacterium tuberculosis
HMIFYRDVSEAAFDLV

SEQ ID NO: 144464 - protein, 16 aa, Mycobacterium tuberculosis
MIFYRDVSEAAFDLVP

SEQ ID NO: 144465 - protein, 16 aa, Mycobacterium tuberculosis
IFYRDVSEAAFDLVPN

SEQ ID NO: 144466 - protein, 16 aa, Mycobacterium tuberculosis
FYRDVSEAAFDLVPNQ

SEQ ID NO: 144467 - protein, 16 aa, Mycobacterium tuberculosis
YRDVSEAAFDLVPNQA

SEQ ID NO: 144468 - protein, 16 aa, Mycobacterium tuberculosis
RDVSEAAFDLVPNQAM

SEQ ID NO: 144469 - protein, 16 aa, Mycobacterium tuberculosis
DVSEAAFDLVPNQAMK

SEQ ID NO: 144470 - protein, 16 aa, Mycobacterium tuberculosis
VSEAAFDLVPNQAMKS

SEQ ID NO: 144471 - protein, 16 aa, Mycobacterium tuberculosis
SEAAFDLVPNQAMKSL

SEQ ID NO: 144472 - protein, 16 aa, Mycobacterium tuberculosis
EAAFDLVPNQAMKSLH

SEQ ID NO: 144473 - protein, 16 aa, Mycobacterium tuberculosis
AAFDLVPNQAMKSLHL

SEQ ID NO: 144474 - protein, 16 aa, Mycobacterium tuberculosis
AFDLVPNQAMKSLHLI

SEQ ID NO: 144475 - protein, 16 aa, Mycobacterium tuberculosis
FDLVPNQAMKSLHLIL

SEQ ID NO: 144476 - protein, 16 aa, Mycobacterium tuberculosis
DLVPNQAMKSLHLILS

SEQ ID NO: 144477 - protein, 16 aa, Mycobacterium tuberculosis
LVPNQAMKSLHLILSH

SEQ ID NO: 144478 - protein, 16 aa, Mycobacterium tuberculosis
VPNQAMKSLHLILSHF

SEQ ID NO: 144479 - protein, 16 aa, Mycobacterium tuberculosis
PNQAMKSLHLILSHFQ

SEQ ID NO: 144480 - protein, 16 aa, Mycobacterium tuberculosis
NQAMKSLHLILSHFQM

SEQ ID NO: 144481 - protein, 16 aa, Mycobacterium tuberculosis
QAMKSLHLILSHFQMP

SEQ ID NO: 144482 - protein, 16 aa, Mycobacterium tuberculosis
AMKSLHLILSHFQMPG

SEQ ID NO: 144483 - protein, 16 aa, Mycobacterium tuberculosis
MKSLHLILSHFQMPGF

SEQ ID NO: 144484 - protein, 16 aa, Mycobacterium tuberculosis
KSLHLILSHFQMPGFQ

SEQ ID NO: 144485 - protein, 16 aa, Mycobacterium tuberculosis
SLHLILSHFQMPGFQV

SEQ ID NO: 144486 - protein, 16 aa, Mycobacterium tuberculosis
LHLILSHFQMPGFQVP

SEQ ID NO: 144487 - protein, 16 aa, Mycobacterium tuberculosis
HLILSHFQMPGFQVPE

SEQ ID NO: 144488 - protein, 16 aa, Mycobacterium tuberculosis
LILSHFQMPGFQVPEF

SEQ ID NO: 144489 - protein, 16 aa, Mycobacterium tuberculosis
ILSHFQMPGFQVPEFR

SEQ ID NO: 144490 - protein, 16 aa, Mycobacterium tuberculosis
LSHFQMPGFQVPEFRR

SEQ ID NO: 144491 - protein, 16 aa, Mycobacterium tuberculosis
SHFQMPGFQVPEFRRK

SEQ ID NO: 144492 - protein, 16 aa, Mycobacterium tuberculosis
HFQMPGFQVPEFRRKA

SEQ ID NO: 144493 - protein, 16 aa, Mycobacterium tuberculosis
FQMPGFQVPEFRRKAV

SEQ ID NO: 144494 - protein, 16 aa, Mycobacterium tuberculosis
QMPGFQVPEFRRKAVV

SEQ ID NO: 144495 - protein, 16 aa, Mycobacterium tuberculosis
MPGFQVPEFRRKAVVI

SEQ ID NO: 144496 - protein, 16 aa, Mycobacterium tuberculosis
PGFQVPEFRRKAVVIA

SEQ ID NO: 144497 - protein, 16 aa, Mycobacterium tuberculosis
GFQVPEFRRKAVVIAV

SEQ ID NO: 144498 - protein, 16 aa, Mycobacterium tuberculosis
FQVPEFRRKAVVIAVG

SEQ ID NO: 144499 - protein, 16 aa, Mycobacterium tuberculosis
QVPEFRRKAVVIAVGG

SEQ ID NO: 144500 - protein, 16 aa, Mycobacterium tuberculosis
VPEFRRKAVVIAVGGV

SEQ ID NO: 144501 - protein, 16 aa, Mycobacterium tuberculosis
PEFRRKAVVIAVGGVY

SEQ ID NO: 144502 - protein, 16 aa, Mycobacterium tuberculosis
EFRRKAVVIAVGGVYD

SEQ ID NO: 144503 - protein, 16 aa, Mycobacterium tuberculosis
FRRKAVVIAVGGVYDP

SEQ ID NO: 144504 - protein, 16 aa, Mycobacterium tuberculosis
RRKAVVIAVGGVYDPR

SEQ ID NO: 144505 - protein, 16 aa, Mycobacterium tuberculosis
RKAVVIAVGGVYDPRI

SEQ ID NO: 144506 - protein, 16 aa, Mycobacterium tuberculosis
KAVVIAVGGVYDPRIH

SEQ ID NO: 144507 - protein, 16 aa, Mycobacterium tuberculosis
AVVIAVGGVYDPRIHL

SEQ ID NO: 144508 - protein, 16 aa, Mycobacterium tuberculosis
VVIAVGGVYDPRIHLD

SEQ ID NO: 144509 - protein, 16 aa, Mycobacterium tuberculosis
VIAVGGVYDPRIHLDE

SEQ ID NO: 144510 - protein, 16 aa, Mycobacterium tuberculosis
IAVGGVYDPRIHLDEV

SEQ ID NO: 144511 - protein, 16 aa, Mycobacterium tuberculosis
AVGGVYDPRIHLDEVV

SEQ ID NO: 144512 - protein, 16 aa, Mycobacterium tuberculosis
VGGVYDPRIHLDEVVM

SEQ ID NO: 144513 - protein, 16 aa, Mycobacterium tuberculosis
GGVYDPRIHLDEVVMP

SEQ ID NO: 144514 - protein, 16 aa, Mycobacterium tuberculosis
GVYDPRIHLDEVVMPV

SEQ ID NO: 144515 - protein, 16 aa, Mycobacterium tuberculosis
VYDPRIHLDEVVMPVL

SEQ ID NO: 144516 - protein, 16 aa, Mycobacterium tuberculosis
YDPRIHLDEVVMPVLK

SEQ ID NO: 144517 - protein, 16 aa, Mycobacterium tuberculosis
DPRIHLDEVVMPVLKK

SEQ ID NO: 144518 - protein, 16 aa, Mycobacterium tuberculosis
PRIHLDEVVMPVLKKW

SEQ ID NO: 144519 - protein, 16 aa, Mycobacterium tuberculosis
RIHLDEVVMPVLKKWR

SEQ ID NO: 144520 - protein, 16 aa, Mycobacterium tuberculosis
IHLDEVVMPVLKKWRI

SEQ ID NO: 144521 - protein, 16 aa, Mycobacterium tuberculosis
HLDEVVMPVLKKWRIF

SEQ ID NO: 144522 - protein, 16 aa, Mycobacterium tuberculosis
LDEVVMPVLKKWRIFE

SEQ ID NO: 144523 - protein, 16 aa, Mycobacterium tuberculosis
DEVVMPVLKKWRIFER

SEQ ID NO: 144524 - protein, 16 aa, Mycobacterium tuberculosis
EVVMPVLKKWRIFERE

SEQ ID NO: 144525 - protein, 16 aa, Mycobacterium tuberculosis
VVMPVLKKWRIFERED

SEQ ID NO: 144526 - protein, 16 aa, Mycobacterium tuberculosis
VMPVLKKWRIFEREDF

SEQ ID NO: 144527 - protein, 16 aa, Mycobacterium tuberculosis
MPVLKKWRIFEREDFT

SEQ ID NO: 144528 - protein, 16 aa, Mycobacterium tuberculosis
PVLKKWRIFEREDFTG

SEQ ID NO: 144529 - protein, 16 aa, Mycobacterium tuberculosis
VLKKWRIFEREDFTGE

SEQ ID NO: 144530 - protein, 16 aa, Mycobacterium tuberculosis
LKKWRIFEREDFTGEG

SEQ ID NO: 144531 - protein, 16 aa, Mycobacterium tuberculosis
KKWRIFEREDFTGEGA

SEQ ID NO: 144532 - protein, 16 aa, Mycobacterium tuberculosis
KWRIFEREDFTGEGAK

SEQ ID NO: 144533 - protein, 16 aa, Mycobacterium tuberculosis
WRIFEREDFTGEGAKL

SEQ ID NO: 144534 - protein, 16 aa, Mycobacterium tuberculosis
RIFEREDFTGEGAKLR

SEQ ID NO: 144535 - protein, 16 aa, Mycobacterium tuberculosis
IFEREDFTGEGAKLRD

SEQ ID NO: 144536 - protein, 16 aa, Mycobacterium tuberculosis
FEREDFTGEGAKLRDE

SEQ ID NO: 144537 - protein, 16 aa, Mycobacterium tuberculosis
EREDFTGEGAKLRDEL

SEQ ID NO: 144538 - protein, 16 aa, Mycobacterium tuberculosis
REDFTGEGAKLRDELA

SEQ ID NO: 144539 - protein, 16 aa, Mycobacterium tuberculosis
EDFTGEGAKLRDELAL

SEQ ID NO: 144540 - protein, 16 aa, Mycobacterium tuberculosis
DFTGEGAKLRDELALV

SEQ ID NO: 144541 - protein, 16 aa, Mycobacterium tuberculosis
FTGEGAKLRDELALVI

SEQ ID NO: 144542 - protein, 16 aa, Mycobacterium tuberculosis
TGEGAKLRDELALVIK

SEQ ID NO: 144543 - protein, 16 aa, Mycobacterium tuberculosis
GEGAKLRDELALVIKD

SEQ ID NO: 144544 - protein, 16 aa, Mycobacterium tuberculosis
EGAKLRDELALVIKDL

SEQ ID NO: 144545 - protein, 16 aa, Mycobacterium tuberculosis
GAKLRDELALVIKDLE

SEQ ID NO: 144546 - protein, 16 aa, Mycobacterium tuberculosis
AKLRDELALVIKDLEL

SEQ ID NO: 144547 - protein, 16 aa, Mycobacterium tuberculosis
KLRDELALVIKDLELA

SEQ ID NO: 144548 - protein, 16 aa, Mycobacterium tuberculosis
LRDELALVIKDLELAC

SEQ ID NO: 144549 - protein, 16 aa, Mycobacterium tuberculosis
RDELALVIKDLELACD

SEQ ID NO: 144550 - protein, 16 aa, Mycobacterium tuberculosis
DELALVIKDLELACDK

SEQ ID NO: 144551 - protein, 16 aa, Mycobacterium tuberculosis
ELALVIKDLELACDKF

SEQ ID NO: 144552 - protein, 16 aa, Mycobacterium tuberculosis
LALVIKDLELACDKFE

SEQ ID NO: 144553 - protein, 16 aa, Mycobacterium tuberculosis
ALVIKDLELACDKFEV

SEQ ID NO: 144554 - protein, 16 aa, Mycobacterium tuberculosis
LVIKDLELACDKFEVS

SEQ ID NO: 144555 - protein, 16 aa, Mycobacterium tuberculosis
VIKDLELACDKFEVSK

SEQ ID NO: 144556 - protein, 16 aa, Mycobacterium tuberculosis
IKDLELACDKFEVSKQ

SEQ ID NO: 144557 - protein, 16 aa, Mycobacterium tuberculosis
KDLELACDKFEVSKQR

SEQ ID NO: 144558 - protein, 16 aa, Mycobacterium tuberculosis
DLELACDKFEVSKQRQ

SEQ ID NO: 144559 - protein, 16 aa, Mycobacterium tuberculosis
LELACDKFEVSKQRQL

SEQ ID NO: 144560 - protein, 16 aa, Mycobacterium tuberculosis
ELACDKFEVSKQRQLD

SEQ ID NO: 144561 - protein, 16 aa, Mycobacterium tuberculosis
LACDKFEVSKQRQLDR

SEQ ID NO: 144562 - protein, 16 aa, Mycobacterium tuberculosis
ACDKFEVSKQRQLDRE

SEQ ID NO: 144563 - protein, 16 aa, Mycobacterium tuberculosis
CDKFEVSKQRQLDREA

SEQ ID NO: 144564 - protein, 16 aa, Mycobacterium tuberculosis
DKFEVSKQRQLDREAR

SEQ ID NO: 144565 - protein, 16 aa, Mycobacterium tuberculosis
KFEVSKQRQLDREART

SEQ ID NO: 144566 - protein, 16 aa, Mycobacterium tuberculosis
FEVSKQRQLDREARTG

SEQ ID NO: 144567 - protein, 16 aa, Mycobacterium tuberculosis
EVSKQRQLDREARTGK

SEQ ID NO: 144568 - protein, 16 aa, Mycobacterium tuberculosis
VSKQRQLDREARTGKK

SEQ ID NO: 144569 - protein, 16 aa, Mycobacterium tuberculosis
SKQRQLDREARTGKKV

SEQ ID NO: 144570 - protein, 16 aa, Mycobacterium tuberculosis
KQRQLDREARTGKKVS

SEQ ID NO: 144571 - protein, 16 aa, Mycobacterium tuberculosis
QRQLDREARTGKKVSA

SEQ ID NO: 144572 - protein, 16 aa, Mycobacterium tuberculosis
RQLDREARTGKKVSAH

SEQ ID NO: 144573 - protein, 16 aa, Mycobacterium tuberculosis
QLDREARTGKKVSAHE

SEQ ID NO: 144574 - protein, 16 aa, Mycobacterium tuberculosis
LDREARTGKKVSAHEL

SEQ ID NO: 144575 - protein, 16 aa, Mycobacterium tuberculosis
DREARTGKKVSAHELH

SEQ ID NO: 144576 - protein, 16 aa, Mycobacterium tuberculosis
REARTGKKVSAHELHK

SEQ ID NO: 144577 - protein, 16 aa, Mycobacterium tuberculosis
EARTGKKVSAHELHKT

SEQ ID NO: 144578 - protein, 16 aa, Mycobacterium tuberculosis
ARTGKKVSAHELHKTA

SEQ ID NO: 144579 - protein, 16 aa, Mycobacterium tuberculosis
RTGKKVSAHELHKTAG

SEQ ID NO: 144580 - protein, 16 aa, Mycobacterium tuberculosis
TGKKVSAHELHKTAGK

SEQ ID NO: 144581 - protein, 16 aa, Mycobacterium tuberculosis
GKKVSAHELHKTAGKL

SEQ ID NO: 144582 - protein, 16 aa, Mycobacterium tuberculosis
KKVSAHELHKTAGKLA

SEQ ID NO: 144583 - protein, 16 aa, Mycobacterium tuberculosis
KVSAHELHKTAGKLAM

SEQ ID NO: 144584 - protein, 16 aa, Mycobacterium tuberculosis
VSAHELHKTAGKLAMS

SEQ ID NO: 144585 - protein, 16 aa, Mycobacterium tuberculosis
SAHELHKTAGKLAMSR

SEQ ID NO: 144586 - protein, 16 aa, Mycobacterium tuberculosis
AHELHKTAGKLAMSRR

SEQ ID NO: 144587 - protein, 740 aa, Mycobacterium tuberculosis
MPEQHPPITETTTGAASNGCPVVGHMKYPVEGGGNQDWWPNRLNLKVLHQNPAVADPMGAAFDYAAEVATIDVDALTRDIEEVMTTSQPWWPADYGHYGPLFIRMAWHAAGTYRIHDGRGGAGGGMQRFAPLNSWPDNASLDKARRLLWPVKKKYGKKLSWADLIVFAGNCALESMGFKTFGFGFGRVDQWEPDEVYWGKEATWLGDERYSGKRDLENPLAAVQMGLIYVNPEGPNGNPDPMAAAVDIRETFRRMAMNDVETAALIVGGHTFGKTHGAGPADLVGPEPEAAPLEQMGLGWKSSYGTGTGKDAITSGIEVVWTNTPTKWDNSFLEILYGYEWELTKSPAGAWQYTAKDGAGAGTIPDPFGGPGRSPTMLATDLSLRVDPIYERITRRWLEHPEELADEFAKAWYKLIHRDMGPVARYLGPLVPKQTLLWQDPVPAVSHDLVGEAEIASLKSQIRASGLTVSQLVSTAWAAASSFRGSDKRGGANGGRIRLQPQVGWEVNDPDGDLRKVIRTLEEIQESFNSAAPGNIKVSFADLVVLGGCAAIEKAAKAAGHNITVPFTPGRTDASQEQTDVESFAVLEPKADGFRNYLGKGNPLPAEYMLLDKANLLTLSAPEMTVLVGGLRVLGANYKRLPLGVFTEASESLTNDFFVNLLDMGITWEPSPADDGTYQGKDGSGKVKWTGSRVDLVFGSNSELRALVEVYGADDAQPKFVQDFVAAWDKVMNLDRFDVR

SEQ ID NO: 144588 - protein, 8 aa, Mycobacterium tuberculosis
MPEQHPPI

SEQ ID NO: 144589 - protein, 8 aa, Mycobacterium tuberculosis
AASNGCPV

SEQ ID NO: 144590 - protein, 8 aa, Mycobacterium tuberculosis
CPVVGHMK

SEQ ID NO: 144591 - protein, 8 aa, Mycobacterium tuberculosis
PVVGHMKY

SEQ ID NO: 144592 - protein, 8 aa, Mycobacterium tuberculosis
YPVEGGGN

SEQ ID NO: 144593 - protein, 8 aa, Mycobacterium tuberculosis
WWPNRLNL

SEQ ID NO: 144594 - protein, 8 aa, Mycobacterium tuberculosis
RLNLKVLH

SEQ ID NO: 144595 - protein, 8 aa, Mycobacterium tuberculosis
KVLHQNPA

SEQ ID NO: 144596 - protein, 8 aa, Mycobacterium tuberculosis
VLHQNPAV

SEQ ID NO: 144597 - protein, 8 aa, Mycobacterium tuberculosis
NPAVADPM

SEQ ID NO: 144598 - protein, 8 aa, Mycobacterium tuberculosis
AVADPMGA

SEQ ID NO: 144599 - protein, 8 aa, Mycobacterium tuberculosis
MGAAFDYA

SEQ ID NO: 144600 - protein, 8 aa, Mycobacterium tuberculosis
AFDYAAEV

SEQ ID NO: 144601 - protein, 8 aa, Mycobacterium tuberculosis
YAAEVATI

SEQ ID NO: 144602 - protein, 8 aa, Mycobacterium tuberculosis
AEVATIDV

SEQ ID NO: 144603 - protein, 8 aa, Mycobacterium tuberculosis
ATIDVDAL

SEQ ID NO: 144604 - protein, 8 aa, Mycobacterium tuberculosis
LTRDIEEV

SEQ ID NO: 144605 - protein, 8 aa, Mycobacterium tuberculosis
VMTTSQPW

SEQ ID NO: 144606 - protein, 8 aa, Mycobacterium tuberculosis
MTTSQPWW

SEQ ID NO: 144607 - protein, 8 aa, Mycobacterium tuberculosis
TSQPWWPA

SEQ ID NO: 144608 - protein, 8 aa, Mycobacterium tuberculosis
QPWWPADY

SEQ ID NO: 144609 - protein, 8 aa, Mycobacterium tuberculosis
WPADYGHY

SEQ ID NO: 144610 - protein, 8 aa, Mycobacterium tuberculosis
HYGPLFIR

SEQ ID NO: 144611 - protein, 8 aa, Mycobacterium tuberculosis
GPLFIRMA

SEQ ID NO: 144612 - protein, 8 aa, Mycobacterium tuberculosis
FIRMAWHA

SEQ ID NO: 144613 - protein, 8 aa, Mycobacterium tuberculosis
MAWHAAGT

SEQ ID NO: 144614 - protein, 8 aa, Mycobacterium tuberculosis
HAAGTYRI

SEQ ID NO: 144615 - protein, 8 aa, Mycobacterium tuberculosis
TYRIHDGR

SEQ ID NO: 144616 - protein, 8 aa, Mycobacterium tuberculosis
GMQRFAPL

SEQ ID NO: 144617 - protein, 8 aa, Mycobacterium tuberculosis
RFAPLNSW

SEQ ID NO: 144618 - protein, 8 aa, Mycobacterium tuberculosis
SWPDNASL

SEQ ID NO: 144619 - protein, 8 aa, Mycobacterium tuberculosis
NASLDKAR

SEQ ID NO: 144620 - protein, 8 aa, Mycobacterium tuberculosis
ASLDKARR

SEQ ID NO: 144621 - protein, 8 aa, Mycobacterium tuberculosis
SLDKARRL

SEQ ID NO: 144622 - protein, 8 aa, Mycobacterium tuberculosis
RRLLWPVK

SEQ ID NO: 144623 - protein, 8 aa, Mycobacterium tuberculosis
RLLWPVKK

SEQ ID NO: 144624 - protein, 8 aa, Mycobacterium tuberculosis
LLWPVKKK

SEQ ID NO: 144625 - protein, 8 aa, Mycobacterium tuberculosis
PVKKKYGK

SEQ ID NO: 144626 - protein, 8 aa, Mycobacterium tuberculosis
KYGKKLSW

SEQ ID NO: 144627 - protein, 8 aa, Mycobacterium tuberculosis
KLSWADLI

SEQ ID NO: 144628 - protein, 8 aa, Mycobacterium tuberculosis
LSWADLIV

SEQ ID NO: 144629 - protein, 8 aa, Mycobacterium tuberculosis
SWADLIVF

SEQ ID NO: 144630 - protein, 8 aa, Mycobacterium tuberculosis
CALESMGF

SEQ ID NO: 144631 - protein, 8 aa, Mycobacterium tuberculosis
ALESMGFK

SEQ ID NO: 144632 - protein, 8 aa, Mycobacterium tuberculosis
TFGFGFGR

SEQ ID NO: 144633 - protein, 8 aa, Mycobacterium tuberculosis
FGFGFGRV

SEQ ID NO: 144634 - protein, 8 aa, Mycobacterium tuberculosis
GFGRVDQW

SEQ ID NO: 144635 - protein, 8 aa, Mycobacterium tuberculosis
DQWEPDEV

SEQ ID NO: 144636 - protein, 8 aa, Mycobacterium tuberculosis
QWEPDEVY

SEQ ID NO: 144637 - protein, 8 aa, Mycobacterium tuberculosis
WEPDEVYW

SEQ ID NO: 144638 - protein, 8 aa, Mycobacterium tuberculosis
EVYWGKEA

SEQ ID NO: 144639 - protein, 8 aa, Mycobacterium tuberculosis
YWGKEATW

SEQ ID NO: 144640 - protein, 8 aa, Mycobacterium tuberculosis
ATWLGDER

SEQ ID NO: 144641 - protein, 8 aa, Mycobacterium tuberculosis
WLGDERYS

SEQ ID NO: 144642 - protein, 8 aa, Mycobacterium tuberculosis
DERYSGKR

SEQ ID NO: 144643 - protein, 8 aa, Mycobacterium tuberculosis
RYSGKRDL

SEQ ID NO: 144644 - protein, 8 aa, Mycobacterium tuberculosis
LENPLAAV

SEQ ID NO: 144645 - protein, 8 aa, Mycobacterium tuberculosis
NPLAAVQM

SEQ ID NO: 144646 - protein, 8 aa, Mycobacterium tuberculosis
LAAVQMGL

SEQ ID NO: 144647 - protein, 8 aa, Mycobacterium tuberculosis
AVQMGLIY

SEQ ID NO: 144648 - protein, 8 aa, Mycobacterium tuberculosis
VQMGLIYV

SEQ ID NO: 144649 - protein, 8 aa, Mycobacterium tuberculosis
NPDPMAAA

SEQ ID NO: 144650 - protein, 8 aa, Mycobacterium tuberculosis
MAAAVDIR

SEQ ID NO: 144651 - protein, 8 aa, Mycobacterium tuberculosis
DIRETFRR

SEQ ID NO: 144652 - protein, 8 aa, Mycobacterium tuberculosis
ETFRRMAM

SEQ ID NO: 144653 - protein, 8 aa, Mycobacterium tuberculosis
RRMAMNDV

SEQ ID NO: 144654 - protein, 8 aa, Mycobacterium tuberculosis
MAMNDVET

SEQ ID NO: 144655 - protein, 8 aa, Mycobacterium tuberculosis
AMNDVETA

SEQ ID NO: 144656 - protein, 8 aa, Mycobacterium tuberculosis
VETAALIV

SEQ ID NO: 144657 - protein, 8 aa, Mycobacterium tuberculosis
LIVGGHTF

SEQ ID NO: 144658 - protein, 8 aa, Mycobacterium tuberculosis
KTHGAGPA

SEQ ID NO: 144659 - protein, 8 aa, Mycobacterium tuberculosis
GAGPADLV

SEQ ID NO: 144660 - protein, 8 aa, Mycobacterium tuberculosis
PEPEAAPL

SEQ ID NO: 144661 - protein, 8 aa, Mycobacterium tuberculosis
EAAPLEQM

SEQ ID NO: 144662 - protein, 8 aa, Mycobacterium tuberculosis
APLEQMGL

SEQ ID NO: 144663 - protein, 8 aa, Mycobacterium tuberculosis
EQMGLGWK

SEQ ID NO: 144664 - protein, 8 aa, Mycobacterium tuberculosis
SYGTGTGK

SEQ ID NO: 144665 - protein, 8 aa, Mycobacterium tuberculosis
AITSGIEV

SEQ ID NO: 144666 - protein, 8 aa, Mycobacterium tuberculosis
ITSGIEVV

SEQ ID NO: 144667 - protein, 8 aa, Mycobacterium tuberculosis
TSGIEVVW

SEQ ID NO: 144668 - protein, 8 aa, Mycobacterium tuberculosis
VWTNTPTK

SEQ ID NO: 144669 - protein, 8 aa, Mycobacterium tuberculosis
WTNTPTKW

SEQ ID NO: 144670 - protein, 8 aa, Mycobacterium tuberculosis
TKWDNSFL

SEQ ID NO: 144671 - protein, 8 aa, Mycobacterium tuberculosis
NSFLEILY

SEQ ID NO: 144672 - protein, 8 aa, Mycobacterium tuberculosis
FLEILYGY

SEQ ID NO: 144673 - protein, 8 aa, Mycobacterium tuberculosis
ILYGYEWE

SEQ ID NO: 144674 - protein, 8 aa, Mycobacterium tuberculosis
LYGYEWEL

SEQ ID NO: 144675 - protein, 8 aa, Mycobacterium tuberculosis
GYEWELTK

SEQ ID NO: 144676 - protein, 8 aa, Mycobacterium tuberculosis
SPAGAWQY

SEQ ID NO: 144677 - protein, 8 aa, Mycobacterium tuberculosis
GAWQYTAK

SEQ ID NO: 144678 - protein, 8 aa, Mycobacterium tuberculosis
DPFGGPGR

SEQ ID NO: 144679 - protein, 8 aa, Mycobacterium tuberculosis
GPGRSPTM

SEQ ID NO: 144680 - protein, 8 aa, Mycobacterium tuberculosis
MLATDLSL

SEQ ID NO: 144681 - protein, 8 aa, Mycobacterium tuberculosis
LATDLSLR

SEQ ID NO: 144682 - protein, 8 aa, Mycobacterium tuberculosis
ATDLSLRV

SEQ ID NO: 144683 - protein, 8 aa, Mycobacterium tuberculosis
SLRVDPIY

SEQ ID NO: 144684 - protein, 8 aa, Mycobacterium tuberculosis
RVDPIYER

SEQ ID NO: 144685 - protein, 8 aa, Mycobacterium tuberculosis
PIYERITR

SEQ ID NO: 144686 - protein, 8 aa, Mycobacterium tuberculosis
IYERITRR

SEQ ID NO: 144687 - protein, 8 aa, Mycobacterium tuberculosis
YERITRRW

SEQ ID NO: 144688 - protein, 8 aa, Mycobacterium tuberculosis
RRWLEHPE

SEQ ID NO: 144689 - protein, 8 aa, Mycobacterium tuberculosis
WLEHPEEL

SEQ ID NO: 144690 - protein, 8 aa, Mycobacterium tuberculosis
EELADEFA

SEQ ID NO: 144691 - protein, 8 aa, Mycobacterium tuberculosis
ELADEFAK

SEQ ID NO: 144692 - protein, 8 aa, Mycobacterium tuberculosis
DEFAKAWY

SEQ ID NO: 144693 - protein, 8 aa, Mycobacterium tuberculosis
EFAKAWYK

SEQ ID NO: 144694 - protein, 8 aa, Mycobacterium tuberculosis
FAKAWYKL

SEQ ID NO: 144695 - protein, 8 aa, Mycobacterium tuberculosis
AWYKLIHR

SEQ ID NO: 144696 - protein, 8 aa, Mycobacterium tuberculosis
VARYLGPL

SEQ ID NO: 144697 - protein, 8 aa, Mycobacterium tuberculosis
YLGPLVPK

SEQ ID NO: 144698 - protein, 8 aa, Mycobacterium tuberculosis
PLVPKQTL

SEQ ID NO: 144699 - protein, 8 aa, Mycobacterium tuberculosis
LVPKQTLL

SEQ ID NO: 144700 - protein, 8 aa, Mycobacterium tuberculosis
VPKQTLLW

SEQ ID NO: 144701 - protein, 8 aa, Mycobacterium tuberculosis
TLLWQDPV

SEQ ID NO: 144702 - protein, 8 aa, Mycobacterium tuberculosis
WQDPVPAV

SEQ ID NO: 144703 - protein, 8 aa, Mycobacterium tuberculosis
DPVPAVSH

SEQ ID NO: 144704 - protein, 8 aa, Mycobacterium tuberculosis
VPAVSHDL

SEQ ID NO: 144705 - protein, 8 aa, Mycobacterium tuberculosis
DLVGEAEI

SEQ ID NO: 144706 - protein, 8 aa, Mycobacterium tuberculosis
GEAEIASL

SEQ ID NO: 144707 - protein, 8 aa, Mycobacterium tuberculosis
EAEIASLK

SEQ ID NO: 144708 - protein, 8 aa, Mycobacterium tuberculosis
AEIASLKS

SEQ ID NO: 144709 - protein, 8 aa, Mycobacterium tuberculosis
ASLKSQIR

SEQ ID NO: 144710 - protein, 8 aa, Mycobacterium tuberculosis
SLKSQIRA

SEQ ID NO: 144711 - protein, 8 aa, Mycobacterium tuberculosis
SQIRASGL

SEQ ID NO: 144712 - protein, 8 aa, Mycobacterium tuberculosis
GLTVSQLV

SEQ ID NO: 144713 - protein, 8 aa, Mycobacterium tuberculosis
SQLVSTAW

SEQ ID NO: 144714 - protein, 8 aa, Mycobacterium tuberculosis
QLVSTAWA

SEQ ID NO: 144715 - protein, 8 aa, Mycobacterium tuberculosis
LVSTAWAA

SEQ ID NO: 144716 - protein, 8 aa, Mycobacterium tuberculosis
STAWAAAS

SEQ ID NO: 144717 - protein, 8 aa, Mycobacterium tuberculosis
AWAAASSF

SEQ ID NO: 144718 - protein, 8 aa, Mycobacterium tuberculosis
WAAASSFR

SEQ ID NO: 144719 - protein, 8 aa, Mycobacterium tuberculosis
SSFRGSDK

SEQ ID NO: 144720 - protein, 8 aa, Mycobacterium tuberculosis
SFRGSDKR

SEQ ID NO: 144721 - protein, 8 aa, Mycobacterium tuberculosis
GANGGRIR

SEQ ID NO: 144722 - protein, 8 aa, Mycobacterium tuberculosis
RIRLQPQV

SEQ ID NO: 144723 - protein, 8 aa, Mycobacterium tuberculosis
RLQPQVGW

SEQ ID NO: 144724 - protein, 8 aa, Mycobacterium tuberculosis
VIRTLEEI

SEQ ID NO: 144725 - protein, 8 aa, Mycobacterium tuberculosis
IQESFNSA

SEQ ID NO: 144726 - protein, 8 aa, Mycobacterium tuberculosis
NSAAPGNI

SEQ ID NO: 144727 - protein, 8 aa, Mycobacterium tuberculosis
SAAPGNIK

SEQ ID NO: 144728 - protein, 8 aa, Mycobacterium tuberculosis
AAPGNIKV

SEQ ID NO: 144729 - protein, 8 aa, Mycobacterium tuberculosis
KVSFADLV

SEQ ID NO: 144730 - protein, 8 aa, Mycobacterium tuberculosis
SFADLVVL

SEQ ID NO: 144731 - protein, 8 aa, Mycobacterium tuberculosis
VVLGGCAA

SEQ ID NO: 144732 - protein, 8 aa, Mycobacterium tuberculosis
VLGGCAAI

SEQ ID NO: 144733 - protein, 8 aa, Mycobacterium tuberculosis
AAIEKAAK

SEQ ID NO: 144734 - protein, 8 aa, Mycobacterium tuberculosis
AAGHNITV

SEQ ID NO: 144735 - protein, 8 aa, Mycobacterium tuberculosis
TVPFTPGR

SEQ ID NO: 144736 - protein, 8 aa, Mycobacterium tuberculosis
VPFTPGRT

SEQ ID NO: 144737 - protein, 8 aa, Mycobacterium tuberculosis
EQTDVESF

SEQ ID NO: 144738 - protein, 8 aa, Mycobacterium tuberculosis
TDVESFAV

SEQ ID NO: 144739 - protein, 8 aa, Mycobacterium tuberculosis
DVESFAVL

SEQ ID NO: 144740 - protein, 8 aa, Mycobacterium tuberculosis
SFAVLEPK

SEQ ID NO: 144741 - protein, 8 aa, Mycobacterium tuberculosis
EPKADGFR

SEQ ID NO: 144742 - protein, 8 aa, Mycobacterium tuberculosis
GFRNYLGK

SEQ ID NO: 144743 - protein, 8 aa, Mycobacterium tuberculosis
YLGKGNPL

SEQ ID NO: 144744 - protein, 8 aa, Mycobacterium tuberculosis
NPLPAEYM

SEQ ID NO: 144745 - protein, 8 aa, Mycobacterium tuberculosis
PLPAEYML

SEQ ID NO: 144746 - protein, 8 aa, Mycobacterium tuberculosis
LPAEYMLL

SEQ ID NO: 144747 - protein, 8 aa, Mycobacterium tuberculosis
AEYMLLDK

SEQ ID NO: 144748 - protein, 8 aa, Mycobacterium tuberculosis
MLLDKANL

SEQ ID NO: 144749 - protein, 8 aa, Mycobacterium tuberculosis
LLDKANLL

SEQ ID NO: 144750 - protein, 8 aa, Mycobacterium tuberculosis
LTLSAPEM

SEQ ID NO: 144751 - protein, 8 aa, Mycobacterium tuberculosis
LSAPEMTV

SEQ ID NO: 144752 - protein, 8 aa, Mycobacterium tuberculosis
SAPEMTVL

SEQ ID NO: 144753 - protein, 8 aa, Mycobacterium tuberculosis
APEMTVLV

SEQ ID NO: 144754 - protein, 8 aa, Mycobacterium tuberculosis
MTVLVGGL

SEQ ID NO: 144755 - protein, 8 aa, Mycobacterium tuberculosis
TVLVGGLR

SEQ ID NO: 144756 - protein, 8 aa, Mycobacterium tuberculosis
VLVGGLRV

SEQ ID NO: 144757 - protein, 8 aa, Mycobacterium tuberculosis
LVGGLRVL

SEQ ID NO: 144758 - protein, 8 aa, Mycobacterium tuberculosis
RVLGANYK

SEQ ID NO: 144759 - protein, 8 aa, Mycobacterium tuberculosis
VLGANYKR

SEQ ID NO: 144760 - protein, 8 aa, Mycobacterium tuberculosis
KRLPLGVF

SEQ ID NO: 144761 - protein, 8 aa, Mycobacterium tuberculosis
RLPLGVFT

SEQ ID NO: 144762 - protein, 8 aa, Mycobacterium tuberculosis
LPLGVFTE

SEQ ID NO: 144763 - protein, 8 aa, Mycobacterium tuberculosis
PLGVFTEA

SEQ ID NO: 144764 - protein, 8 aa, Mycobacterium tuberculosis
FTEASESL

SEQ ID NO: 144765 - protein, 8 aa, Mycobacterium tuberculosis
ESLTNDFF

SEQ ID NO: 144766 - protein, 8 aa, Mycobacterium tuberculosis
SLTNDFFV

SEQ ID NO: 144767 - protein, 8 aa, Mycobacterium tuberculosis
FFVNLLDM

SEQ ID NO: 144768 - protein, 8 aa, Mycobacterium tuberculosis
NLLDMGIT

SEQ ID NO: 144769 - protein, 8 aa, Mycobacterium tuberculosis
LLDMGITW

SEQ ID NO: 144770 - protein, 8 aa, Mycobacterium tuberculosis
ITWEPSPA

SEQ ID NO: 144771 - protein, 8 aa, Mycobacterium tuberculosis
SPADDGTY

SEQ ID NO: 144772 - protein, 8 aa, Mycobacterium tuberculosis
QGKDGSGK

SEQ ID NO: 144773 - protein, 8 aa, Mycobacterium tuberculosis
KVKWTGSR

SEQ ID NO: 144774 - protein, 8 aa, Mycobacterium tuberculosis
VKWTGSRV

SEQ ID NO: 144775 - protein, 8 aa, Mycobacterium tuberculosis
TGSRVDLV

SEQ ID NO: 144776 - protein, 8 aa, Mycobacterium tuberculosis
VFGSNSEL

SEQ ID NO: 144777 - protein, 8 aa, Mycobacterium tuberculosis
FGSNSELR

SEQ ID NO: 144778 - protein, 8 aa, Mycobacterium tuberculosis
ELRALVEV

SEQ ID NO: 144779 - protein, 8 aa, Mycobacterium tuberculosis
ALVEVYGA

SEQ ID NO: 144780 - protein, 8 aa, Mycobacterium tuberculosis
GADDAQPK

SEQ ID NO: 144781 - protein, 8 aa, Mycobacterium tuberculosis
FVQDFVAA

SEQ ID NO: 144782 - protein, 8 aa, Mycobacterium tuberculosis
DFVAAWDK

SEQ ID NO: 144783 - protein, 8 aa, Mycobacterium tuberculosis
FVAAWDKV

SEQ ID NO: 144784 - protein, 8 aa, Mycobacterium tuberculosis
VAAWDKVM

SEQ ID NO: 144785 - protein, 8 aa, Mycobacterium tuberculosis
KVMNLDRF

SEQ ID NO: 144786 - protein, 9 aa, Mycobacterium tuberculosis
MPEQHPPIT

SEQ ID NO: 144787 - protein, 9 aa, Mycobacterium tuberculosis
GAASNGCPV

SEQ ID NO: 144788 - protein, 9 aa, Mycobacterium tuberculosis
AASNGCPVV

SEQ ID NO: 144789 - protein, 9 aa, Mycobacterium tuberculosis
CPVVGHMKY

SEQ ID NO: 144790 - protein, 9 aa, Mycobacterium tuberculosis
VVGHMKYPV

SEQ ID NO: 144791 - protein, 9 aa, Mycobacterium tuberculosis
NQDWWPNRL

SEQ ID NO: 144792 - protein, 9 aa, Mycobacterium tuberculosis
DWWPNRLNL

SEQ ID NO: 144793 - protein, 9 aa, Mycobacterium tuberculosis
WWPNRLNLK

SEQ ID NO: 144794 - protein, 9 aa, Mycobacterium tuberculosis
WPNRLNLKV

SEQ ID NO: 144795 - protein, 9 aa, Mycobacterium tuberculosis
KVLHQNPAV

SEQ ID NO: 144796 - protein, 9 aa, Mycobacterium tuberculosis
VLHQNPAVA

SEQ ID NO: 144797 - protein, 9 aa, Mycobacterium tuberculosis
NPAVADPMG

SEQ ID NO: 144798 - protein, 9 aa, Mycobacterium tuberculosis
AVADPMGAA

SEQ ID NO: 144799 - protein, 9 aa, Mycobacterium tuberculosis
VADPMGAAF

SEQ ID NO: 144800 - protein, 9 aa, Mycobacterium tuberculosis
DPMGAAFDY

SEQ ID NO: 144801 - protein, 9 aa, Mycobacterium tuberculosis
PMGAAFDYA

SEQ ID NO: 144802 - protein, 9 aa, Mycobacterium tuberculosis
MGAAFDYAA

SEQ ID NO: 144803 - protein, 9 aa, Mycobacterium tuberculosis
AAFDYAAEV

SEQ ID NO: 144804 - protein, 9 aa, Mycobacterium tuberculosis
DYAAEVATI

SEQ ID NO: 144805 - protein, 9 aa, Mycobacterium tuberculosis
EVATIDVDA

SEQ ID NO: 144806 - protein, 9 aa, Mycobacterium tuberculosis
ATIDVDALT

SEQ ID NO: 144807 - protein, 9 aa, Mycobacterium tuberculosis
TIDVDALTR

SEQ ID NO: 144808 - protein, 9 aa, Mycobacterium tuberculosis
ALTRDIEEV

SEQ ID NO: 144809 - protein, 9 aa, Mycobacterium tuberculosis
EVMTTSQPW

SEQ ID NO: 144810 - protein, 9 aa, Mycobacterium tuberculosis
VMTTSQPWW

SEQ ID NO: 144811 - protein, 9 aa, Mycobacterium tuberculosis
TTSQPWWPA

SEQ ID NO: 144812 - protein, 9 aa, Mycobacterium tuberculosis
SQPWWPADY

SEQ ID NO: 144813 - protein, 9 aa, Mycobacterium tuberculosis
WWPADYGHY

SEQ ID NO: 144814 - protein, 9 aa, Mycobacterium tuberculosis
WPADYGHYG

SEQ ID NO: 144815 - protein, 9 aa, Mycobacterium tuberculosis
DYGHYGPLF

SEQ ID NO: 144816 - protein, 9 aa, Mycobacterium tuberculosis
HYGPLFIRM

SEQ ID NO: 144817 - protein, 9 aa, Mycobacterium tuberculosis
GPLFIRMAW

SEQ ID NO: 144818 - protein, 9 aa, Mycobacterium tuberculosis
FIRMAWHAA

SEQ ID NO: 144819 - protein, 9 aa, Mycobacterium tuberculosis
RMAWHAAGT

SEQ ID NO: 144820 - protein, 9 aa, Mycobacterium tuberculosis
MAWHAAGTY

SEQ ID NO: 144821 - protein, 9 aa, Mycobacterium tuberculosis
AWHAAGTYR

SEQ ID NO: 144822 - protein, 9 aa, Mycobacterium tuberculosis
WHAAGTYRI

SEQ ID NO: 144823 - protein, 9 aa, Mycobacterium tuberculosis
GTYRIHDGR

SEQ ID NO: 144824 - protein, 9 aa, Mycobacterium tuberculosis
RIHDGRGGA

SEQ ID NO: 144825 - protein, 9 aa, Mycobacterium tuberculosis
GGMQRFAPL

SEQ ID NO: 144826 - protein, 9 aa, Mycobacterium tuberculosis
PLNSWPDNA

SEQ ID NO: 144827 - protein, 9 aa, Mycobacterium tuberculosis
NSWPDNASL

SEQ ID NO: 144828 - protein, 9 aa, Mycobacterium tuberculosis
NASLDKARR

SEQ ID NO: 144829 - protein, 9 aa, Mycobacterium tuberculosis
SLDKARRLL

SEQ ID NO: 144830 - protein, 9 aa, Mycobacterium tuberculosis
KARRLLWPV

SEQ ID NO: 144831 - protein, 9 aa, Mycobacterium tuberculosis
ARRLLWPVK

SEQ ID NO: 144832 - protein, 9 aa, Mycobacterium tuberculosis
RRLLWPVKK

SEQ ID NO: 144833 - protein, 9 aa, Mycobacterium tuberculosis
RLLWPVKKK

SEQ ID NO: 144834 - protein, 9 aa, Mycobacterium tuberculosis
LLWPVKKKY

SEQ ID NO: 144835 - protein, 9 aa, Mycobacterium tuberculosis
WPVKKKYGK

SEQ ID NO: 144836 - protein, 9 aa, Mycobacterium tuberculosis
PVKKKYGKK

SEQ ID NO: 144837 - protein, 9 aa, Mycobacterium tuberculosis
KKYGKKLSW

SEQ ID NO: 144838 - protein, 9 aa, Mycobacterium tuberculosis
KLSWADLIV

SEQ ID NO: 144839 - protein, 9 aa, Mycobacterium tuberculosis
LSWADLIVF

SEQ ID NO: 144840 - protein, 9 aa, Mycobacterium tuberculosis
SWADLIVFA

SEQ ID NO: 144841 - protein, 9 aa, Mycobacterium tuberculosis
IVFAGNCAL

SEQ ID NO: 144842 - protein, 9 aa, Mycobacterium tuberculosis
CALESMGFK

SEQ ID NO: 144843 - protein, 9 aa, Mycobacterium tuberculosis
LESMGFKTF

SEQ ID NO: 144844 - protein, 9 aa, Mycobacterium tuberculosis
SMGFKTFGF

SEQ ID NO: 144845 - protein, 9 aa, Mycobacterium tuberculosis
GFKTFGFGF

SEQ ID NO: 144846 - protein, 9 aa, Mycobacterium tuberculosis
KTFGFGFGR

SEQ ID NO: 144847 - protein, 9 aa, Mycobacterium tuberculosis
FGFGRVDQW

SEQ ID NO: 144848 - protein, 9 aa, Mycobacterium tuberculosis
DQWEPDEVY

SEQ ID NO: 144849 - protein, 9 aa, Mycobacterium tuberculosis
QWEPDEVYW

SEQ ID NO: 144850 - protein, 9 aa, Mycobacterium tuberculosis
EVYWGKEAT

SEQ ID NO: 144851 - protein, 9 aa, Mycobacterium tuberculosis
VYWGKEATW

SEQ ID NO: 144852 - protein, 9 aa, Mycobacterium tuberculosis
YWGKEATWL

SEQ ID NO: 144853 - protein, 9 aa, Mycobacterium tuberculosis
EATWLGDER

SEQ ID NO: 144854 - protein, 9 aa, Mycobacterium tuberculosis
ATWLGDERY

SEQ ID NO: 144855 - protein, 9 aa, Mycobacterium tuberculosis
WLGDERYSG

SEQ ID NO: 144856 - protein, 9 aa, Mycobacterium tuberculosis
DLENPLAAV

SEQ ID NO: 144857 - protein, 9 aa, Mycobacterium tuberculosis
PLAAVQMGL

SEQ ID NO: 144858 - protein, 9 aa, Mycobacterium tuberculosis
LAAVQMGLI

SEQ ID NO: 144859 - protein, 9 aa, Mycobacterium tuberculosis
AAVQMGLIY

SEQ ID NO: 144860 - protein, 9 aa, Mycobacterium tuberculosis
AVQMGLIYV

SEQ ID NO: 144861 - protein, 9 aa, Mycobacterium tuberculosis
GPNGNPDPM

SEQ ID NO: 144862 - protein, 9 aa, Mycobacterium tuberculosis
NPDPMAAAV

SEQ ID NO: 144863 - protein, 9 aa, Mycobacterium tuberculosis
DPMAAAVDI

SEQ ID NO: 144864 - protein, 9 aa, Mycobacterium tuberculosis
AAVDIRETF

SEQ ID NO: 144865 - protein, 9 aa, Mycobacterium tuberculosis
AVDIRETFR

SEQ ID NO: 144866 - protein, 9 aa, Mycobacterium tuberculosis
DIRETFRRM

SEQ ID NO: 144867 - protein, 9 aa, Mycobacterium tuberculosis
RETFRRMAM

SEQ ID NO: 144868 - protein, 9 aa, Mycobacterium tuberculosis
ETFRRMAMN

SEQ ID NO: 144869 - protein, 9 aa, Mycobacterium tuberculosis
RMAMNDVET

SEQ ID NO: 144870 - protein, 9 aa, Mycobacterium tuberculosis
MAMNDVETA

SEQ ID NO: 144871 - protein, 9 aa, Mycobacterium tuberculosis
AMNDVETAA

SEQ ID NO: 144872 - protein, 9 aa, Mycobacterium tuberculosis
MNDVETAAL

SEQ ID NO: 144873 - protein, 9 aa, Mycobacterium tuberculosis
ETAALIVGG

SEQ ID NO: 144874 - protein, 9 aa, Mycobacterium tuberculosis
ALIVGGHTF

SEQ ID NO: 144875 - protein, 9 aa, Mycobacterium tuberculosis
IVGGHTFGK

SEQ ID NO: 144876 - protein, 9 aa, Mycobacterium tuberculosis
HTFGKTHGA

SEQ ID NO: 144877 - protein, 9 aa, Mycobacterium tuberculosis
KTHGAGPAD

SEQ ID NO: 144878 - protein, 9 aa, Mycobacterium tuberculosis
HGAGPADLV

SEQ ID NO: 144879 - protein, 9 aa, Mycobacterium tuberculosis
DLVGPEPEA

SEQ ID NO: 144880 - protein, 9 aa, Mycobacterium tuberculosis
GPEPEAAPL

SEQ ID NO: 144881 - protein, 9 aa, Mycobacterium tuberculosis
SSYGTGTGK

SEQ ID NO: 144882 - protein, 9 aa, Mycobacterium tuberculosis
DAITSGIEV

SEQ ID NO: 144883 - protein, 9 aa, Mycobacterium tuberculosis
AITSGIEVV

SEQ ID NO: 144884 - protein, 9 aa, Mycobacterium tuberculosis
ITSGIEVVW

SEQ ID NO: 144885 - protein, 9 aa, Mycobacterium tuberculosis
EVVWTNTPT

SEQ ID NO: 144886 - protein, 9 aa, Mycobacterium tuberculosis
VVWTNTPTK

SEQ ID NO: 144887 - protein, 9 aa, Mycobacterium tuberculosis
VWTNTPTKW

SEQ ID NO: 144888 - protein, 9 aa, Mycobacterium tuberculosis
TPTKWDNSF

SEQ ID NO: 144889 - protein, 9 aa, Mycobacterium tuberculosis
KWDNSFLEI

SEQ ID NO: 144890 - protein, 9 aa, Mycobacterium tuberculosis
SFLEILYGY

SEQ ID NO: 144891 - protein, 9 aa, Mycobacterium tuberculosis
LEILYGYEW

SEQ ID NO: 144892 - protein, 9 aa, Mycobacterium tuberculosis
ILYGYEWEL

SEQ ID NO: 144893 - protein, 9 aa, Mycobacterium tuberculosis
KSPAGAWQY

SEQ ID NO: 144894 - protein, 9 aa, Mycobacterium tuberculosis
WQYTAKDGA

SEQ ID NO: 144895 - protein, 9 aa, Mycobacterium tuberculosis
YTAKDGAGA

SEQ ID NO: 144896 - protein, 9 aa, Mycobacterium tuberculosis
GPGRSPTML

SEQ ID NO: 144897 - protein, 9 aa, Mycobacterium tuberculosis
SPTMLATDL

SEQ ID NO: 144898 - protein, 9 aa, Mycobacterium tuberculosis
TMLATDLSL

SEQ ID NO: 144899 - protein, 9 aa, Mycobacterium tuberculosis
MLATDLSLR

SEQ ID NO: 144900 - protein, 9 aa, Mycobacterium tuberculosis
LATDLSLRV

SEQ ID NO: 144901 - protein, 9 aa, Mycobacterium tuberculosis
LSLRVDPIY

SEQ ID NO: 144902 - protein, 9 aa, Mycobacterium tuberculosis
RVDPIYERI

SEQ ID NO: 144903 - protein, 9 aa, Mycobacterium tuberculosis
DPIYERITR

SEQ ID NO: 144904 - protein, 9 aa, Mycobacterium tuberculosis
PIYERITRR

SEQ ID NO: 144905 - protein, 9 aa, Mycobacterium tuberculosis
IYERITRRW

SEQ ID NO: 144906 - protein, 9 aa, Mycobacterium tuberculosis
YERITRRWL

SEQ ID NO: 144907 - protein, 9 aa, Mycobacterium tuberculosis
RITRRWLEH

SEQ ID NO: 144908 - protein, 9 aa, Mycobacterium tuberculosis
RRWLEHPEE

SEQ ID NO: 144909 - protein, 9 aa, Mycobacterium tuberculosis
RWLEHPEEL

SEQ ID NO: 144910 - protein, 9 aa, Mycobacterium tuberculosis
WLEHPEELA

SEQ ID NO: 144911 - protein, 9 aa, Mycobacterium tuberculosis
HPEELADEF

SEQ ID NO: 144912 - protein, 9 aa, Mycobacterium tuberculosis
ELADEFAKA

SEQ ID NO: 144913 - protein, 9 aa, Mycobacterium tuberculosis
LADEFAKAW

SEQ ID NO: 144914 - protein, 9 aa, Mycobacterium tuberculosis
DEFAKAWYK

SEQ ID NO: 144915 - protein, 9 aa, Mycobacterium tuberculosis
EFAKAWYKL

SEQ ID NO: 144916 - protein, 9 aa, Mycobacterium tuberculosis
FAKAWYKLI

SEQ ID NO: 144917 - protein, 9 aa, Mycobacterium tuberculosis
KAWYKLIHR

SEQ ID NO: 144918 - protein, 9 aa, Mycobacterium tuberculosis
LIHRDMGPV

SEQ ID NO: 144919 - protein, 9 aa, Mycobacterium tuberculosis
DMGPVARYL

SEQ ID NO: 144920 - protein, 9 aa, Mycobacterium tuberculosis
PVARYLGPL

SEQ ID NO: 144921 - protein, 9 aa, Mycobacterium tuberculosis
RYLGPLVPK

SEQ ID NO: 144922 - protein, 9 aa, Mycobacterium tuberculosis
YLGPLVPKQ

SEQ ID NO: 144923 - protein, 9 aa, Mycobacterium tuberculosis
GPLVPKQTL

SEQ ID NO: 144924 - protein, 9 aa, Mycobacterium tuberculosis
PLVPKQTLL

SEQ ID NO: 144925 - protein, 9 aa, Mycobacterium tuberculosis
QTLLWQDPV

SEQ ID NO: 144926 - protein, 9 aa, Mycobacterium tuberculosis
LLWQDPVPA

SEQ ID NO: 144927 - protein, 9 aa, Mycobacterium tuberculosis
LWQDPVPAV

SEQ ID NO: 144928 - protein, 9 aa, Mycobacterium tuberculosis
WQDPVPAVS

SEQ ID NO: 144929 - protein, 9 aa, Mycobacterium tuberculosis
VPAVSHDLV

SEQ ID NO: 144930 - protein, 9 aa, Mycobacterium tuberculosis
AEIASLKSQ

SEQ ID NO: 144931 - protein, 9 aa, Mycobacterium tuberculosis
EIASLKSQI

SEQ ID NO: 144932 - protein, 9 aa, Mycobacterium tuberculosis
IASLKSQIR

SEQ ID NO: 144933 - protein, 9 aa, Mycobacterium tuberculosis
SQIRASGLT

SEQ ID NO: 144934 - protein, 9 aa, Mycobacterium tuberculosis
QIRASGLTV

SEQ ID NO: 144935 - protein, 9 aa, Mycobacterium tuberculosis
SGLTVSQLV

SEQ ID NO: 144936 - protein, 9 aa, Mycobacterium tuberculosis
TVSQLVSTA

SEQ ID NO: 144937 - protein, 9 aa, Mycobacterium tuberculosis
VSQLVSTAW

SEQ ID NO: 144938 - protein, 9 aa, Mycobacterium tuberculosis
SQLVSTAWA

SEQ ID NO: 144939 - protein, 9 aa, Mycobacterium tuberculosis
QLVSTAWAA

SEQ ID NO: 144940 - protein, 9 aa, Mycobacterium tuberculosis
LVSTAWAAA

SEQ ID NO: 144941 - protein, 9 aa, Mycobacterium tuberculosis
STAWAAASS

SEQ ID NO: 144942 - protein, 9 aa, Mycobacterium tuberculosis
TAWAAASSF

SEQ ID NO: 144943 - protein, 9 aa, Mycobacterium tuberculosis
AWAAASSFR

SEQ ID NO: 144944 - protein, 9 aa, Mycobacterium tuberculosis
ASSFRGSDK

SEQ ID NO: 144945 - protein, 9 aa, Mycobacterium tuberculosis
SSFRGSDKR

SEQ ID NO: 144946 - protein, 9 aa, Mycobacterium tuberculosis
KRGGANGGR

SEQ ID NO: 144947 - protein, 9 aa, Mycobacterium tuberculosis
GANGGRIRL

SEQ ID NO: 144948 - protein, 9 aa, Mycobacterium tuberculosis
LQPQVGWEV

SEQ ID NO: 144949 - protein, 9 aa, Mycobacterium tuberculosis
EVNDPDGDL

SEQ ID NO: 144950 - protein, 9 aa, Mycobacterium tuberculosis
DLRKVIRTL

SEQ ID NO: 144951 - protein, 9 aa, Mycobacterium tuberculosis
KVIRTLEEI

SEQ ID NO: 144952 - protein, 9 aa, Mycobacterium tuberculosis
TLEEIQESF

SEQ ID NO: 144953 - protein, 9 aa, Mycobacterium tuberculosis
EEIQESFNS

SEQ ID NO: 144954 - protein, 9 aa, Mycobacterium tuberculosis
EIQESFNSA

SEQ ID NO: 144955 - protein, 9 aa, Mycobacterium tuberculosis
NSAAPGNIK

SEQ ID NO: 144956 - protein, 9 aa, Mycobacterium tuberculosis
SAAPGNIKV

SEQ ID NO: 144957 - protein, 9 aa, Mycobacterium tuberculosis
APGNIKVSF

SEQ ID NO: 144958 - protein, 9 aa, Mycobacterium tuberculosis
NIKVSFADL

SEQ ID NO: 144959 - protein, 9 aa, Mycobacterium tuberculosis
KVSFADLVV

SEQ ID NO: 144960 - protein, 9 aa, Mycobacterium tuberculosis
LVVLGGCAA

SEQ ID NO: 144961 - protein, 9 aa, Mycobacterium tuberculosis
VVLGGCAAI

SEQ ID NO: 144962 - protein, 9 aa, Mycobacterium tuberculosis
LGGCAAIEK

SEQ ID NO: 144963 - protein, 9 aa, Mycobacterium tuberculosis
CAAIEKAAK

SEQ ID NO: 144964 - protein, 9 aa, Mycobacterium tuberculosis
KAAGHNITV

SEQ ID NO: 144965 - protein, 9 aa, Mycobacterium tuberculosis
ITVPFTPGR

SEQ ID NO: 144966 - protein, 9 aa, Mycobacterium tuberculosis
QEQTDVESF

SEQ ID NO: 144967 - protein, 9 aa, Mycobacterium tuberculosis
QTDVESFAV

SEQ ID NO: 144968 - protein, 9 aa, Mycobacterium tuberculosis
ESFAVLEPK

SEQ ID NO: 144969 - protein, 9 aa, Mycobacterium tuberculosis
KADGFRNYL

SEQ ID NO: 144970 - protein, 9 aa, Mycobacterium tuberculosis
NYLGKGNPL

SEQ ID NO: 144971 - protein, 9 aa, Mycobacterium tuberculosis
YLGKGNPLP

SEQ ID NO: 144972 - protein, 9 aa, Mycobacterium tuberculosis
KGNPLPAEY

SEQ ID NO: 144973 - protein, 9 aa, Mycobacterium tuberculosis
NPLPAEYML

SEQ ID NO: 144974 - protein, 9 aa, Mycobacterium tuberculosis
PLPAEYMLL

SEQ ID NO: 144975 - protein, 9 aa, Mycobacterium tuberculosis
AEYMLLDKA

SEQ ID NO: 144976 - protein, 9 aa, Mycobacterium tuberculosis
YMLLDKANL

SEQ ID NO: 144977 - protein, 9 aa, Mycobacterium tuberculosis
MLLDKANLL

SEQ ID NO: 144978 - protein, 9 aa, Mycobacterium tuberculosis
LLDKANLLT

SEQ ID NO: 144979 - protein, 9 aa, Mycobacterium tuberculosis
KANLLTLSA

SEQ ID NO: 144980 - protein, 9 aa, Mycobacterium tuberculosis
LLTLSAPEM

SEQ ID NO: 144981 - protein, 9 aa, Mycobacterium tuberculosis
LTLSAPEMT

SEQ ID NO: 144982 - protein, 9 aa, Mycobacterium tuberculosis
TLSAPEMTV

SEQ ID NO: 144983 - protein, 9 aa, Mycobacterium tuberculosis
LSAPEMTVL

SEQ ID NO: 144984 - protein, 9 aa, Mycobacterium tuberculosis
SAPEMTVLV

SEQ ID NO: 144985 - protein, 9 aa, Mycobacterium tuberculosis
EMTVLVGGL

SEQ ID NO: 144986 - protein, 9 aa, Mycobacterium tuberculosis
MTVLVGGLR

SEQ ID NO: 144987 - protein, 9 aa, Mycobacterium tuberculosis
TVLVGGLRV

SEQ ID NO: 144988 - protein, 9 aa, Mycobacterium tuberculosis
VLVGGLRVL

SEQ ID NO: 144989 - protein, 9 aa, Mycobacterium tuberculosis
GLRVLGANY

SEQ ID NO: 144990 - protein, 9 aa, Mycobacterium tuberculosis
RVLGANYKR

SEQ ID NO: 144991 - protein, 9 aa, Mycobacterium tuberculosis
VLGANYKRL

SEQ ID NO: 144992 - protein, 9 aa, Mycobacterium tuberculosis
GANYKRLPL

SEQ ID NO: 144993 - protein, 9 aa, Mycobacterium tuberculosis
RLPLGVFTE

SEQ ID NO: 144994 - protein, 9 aa, Mycobacterium tuberculosis
LPLGVFTEA

SEQ ID NO: 144995 - protein, 9 aa, Mycobacterium tuberculosis
SESLTNDFF

SEQ ID NO: 144996 - protein, 9 aa, Mycobacterium tuberculosis
ESLTNDFFV

SEQ ID NO: 144997 - protein, 9 aa, Mycobacterium tuberculosis
LTNDFFVNL

SEQ ID NO: 144998 - protein, 9 aa, Mycobacterium tuberculosis
FVNLLDMGI

SEQ ID NO: 144999 - protein, 9 aa, Mycobacterium tuberculosis
NLLDMGITW

SEQ ID NO: 145000 - protein, 9 aa, Mycobacterium tuberculosis
LLDMGITWE

SEQ ID NO: 145001 - protein, 9 aa, Mycobacterium tuberculosis
GITWEPSPA

SEQ ID NO: 145002 - protein, 9 aa, Mycobacterium tuberculosis
EPSPADDGT

SEQ ID NO: 145003 - protein, 9 aa, Mycobacterium tuberculosis
KVKWTGSRV

SEQ ID NO: 145004 - protein, 9 aa, Mycobacterium tuberculosis
WTGSRVDLV

SEQ ID NO: 145005 - protein, 9 aa, Mycobacterium tuberculosis
TGSRVDLVF

SEQ ID NO: 145006 - protein, 9 aa, Mycobacterium tuberculosis
LVFGSNSEL

SEQ ID NO: 145007 - protein, 9 aa, Mycobacterium tuberculosis
VFGSNSELR

SEQ ID NO: 145008 - protein, 9 aa, Mycobacterium tuberculosis
SNSELRALV

SEQ ID NO: 145009 - protein, 9 aa, Mycobacterium tuberculosis
SELRALVEV

SEQ ID NO: 145010 - protein, 9 aa, Mycobacterium tuberculosis
ELRALVEVY

SEQ ID NO: 145011 - protein, 9 aa, Mycobacterium tuberculosis
AQPKFVQDF

SEQ ID NO: 145012 - protein, 9 aa, Mycobacterium tuberculosis
FVQDFVAAW

SEQ ID NO: 145013 - protein, 9 aa, Mycobacterium tuberculosis
FVAAWDKVM

SEQ ID NO: 145014 - protein, 9 aa, Mycobacterium tuberculosis
AAWDKVMNL

SEQ ID NO: 145015 - protein, 9 aa, Mycobacterium tuberculosis
VMNLDRFDV

SEQ ID NO: 145016 - protein, 9 aa, Mycobacterium tuberculosis
MNLDRFDVR

SEQ ID NO: 145017 - protein, 10 aa, Mycobacterium tuberculosis
MPEQHPPITE

SEQ ID NO: 145018 - protein, 10 aa, Mycobacterium tuberculosis
TGAASNGCPV

SEQ ID NO: 145019 - protein, 10 aa, Mycobacterium tuberculosis
GAASNGCPVV

SEQ ID NO: 145020 - protein, 10 aa, Mycobacterium tuberculosis
PVVGHMKYPV

SEQ ID NO: 145021 - protein, 10 aa, Mycobacterium tuberculosis
YPVEGGGNQD

SEQ ID NO: 145022 - protein, 10 aa, Mycobacterium tuberculosis
DWWPNRLNLK

SEQ ID NO: 145023 - protein, 10 aa, Mycobacterium tuberculosis
WPNRLNLKVL

SEQ ID NO: 145024 - protein, 10 aa, Mycobacterium tuberculosis
NLKVLHQNPA

SEQ ID NO: 145025 - protein, 10 aa, Mycobacterium tuberculosis
HQNPAVADPM

SEQ ID NO: 145026 - protein, 10 aa, Mycobacterium tuberculosis
AVADPMGAAF

SEQ ID NO: 145027 - protein, 10 aa, Mycobacterium tuberculosis
DPMGAAFDYA

SEQ ID NO: 145028 - protein, 10 aa, Mycobacterium tuberculosis
PMGAAFDYAA

SEQ ID NO: 145029 - protein, 10 aa, Mycobacterium tuberculosis
GAAFDYAAEV

SEQ ID NO: 145030 - protein, 10 aa, Mycobacterium tuberculosis
AAFDYAAEVA

SEQ ID NO: 145031 - protein, 10 aa, Mycobacterium tuberculosis
FDYAAEVATI

SEQ ID NO: 145032 - protein, 10 aa, Mycobacterium tuberculosis
YAAEVATIDV

SEQ ID NO: 145033 - protein, 10 aa, Mycobacterium tuberculosis
AEVATIDVDA

SEQ ID NO: 145034 - protein, 10 aa, Mycobacterium tuberculosis
EVATIDVDAL

SEQ ID NO: 145035 - protein, 10 aa, Mycobacterium tuberculosis
ATIDVDALTR

SEQ ID NO: 145036 - protein, 10 aa, Mycobacterium tuberculosis
ALTRDIEEVM

SEQ ID NO: 145037 - protein, 10 aa, Mycobacterium tuberculosis
EEVMTTSQPW

SEQ ID NO: 145038 - protein, 10 aa, Mycobacterium tuberculosis
EVMTTSQPWW

SEQ ID NO: 145039 - protein, 10 aa, Mycobacterium tuberculosis
MTTSQPWWPA

SEQ ID NO: 145040 - protein, 10 aa, Mycobacterium tuberculosis
TSQPWWPADY

SEQ ID NO: 145041 - protein, 10 aa, Mycobacterium tuberculosis
QPWWPADYGH

SEQ ID NO: 145042 - protein, 10 aa, Mycobacterium tuberculosis
PWWPADYGHY

SEQ ID NO: 145043 - protein, 10 aa, Mycobacterium tuberculosis
WPADYGHYGP

SEQ ID NO: 145044 - protein, 10 aa, Mycobacterium tuberculosis
DYGHYGPLFI

SEQ ID NO: 145045 - protein, 10 aa, Mycobacterium tuberculosis
PLFIRMAWHA

SEQ ID NO: 145046 - protein, 10 aa, Mycobacterium tuberculosis
RMAWHAAGTY

SEQ ID NO: 145047 - protein, 10 aa, Mycobacterium tuberculosis
MAWHAAGTYR

SEQ ID NO: 145048 - protein, 10 aa, Mycobacterium tuberculosis
AWHAAGTYRI

SEQ ID NO: 145049 - protein, 10 aa, Mycobacterium tuberculosis
MQRFAPLNSW

SEQ ID NO: 145050 - protein, 10 aa, Mycobacterium tuberculosis
SWPDNASLDK

SEQ ID NO: 145051 - protein, 10 aa, Mycobacterium tuberculosis
WPDNASLDKA

SEQ ID NO: 145052 - protein, 10 aa, Mycobacterium tuberculosis
DNASLDKARR

SEQ ID NO: 145053 - protein, 10 aa, Mycobacterium tuberculosis
SLDKARRLLW

SEQ ID NO: 145054 - protein, 10 aa, Mycobacterium tuberculosis
DKARRLLWPV

SEQ ID NO: 145055 - protein, 10 aa, Mycobacterium tuberculosis
KARRLLWPVK

SEQ ID NO: 145056 - protein, 10 aa, Mycobacterium tuberculosis
ARRLLWPVKK

SEQ ID NO: 145057 - protein, 10 aa, Mycobacterium tuberculosis
RRLLWPVKKK

SEQ ID NO: 145058 - protein, 10 aa, Mycobacterium tuberculosis
RLLWPVKKKY

SEQ ID NO: 145059 - protein, 10 aa, Mycobacterium tuberculosis
LLWPVKKKYG

SEQ ID NO: 145060 - protein, 10 aa, Mycobacterium tuberculosis
KLSWADLIVF

SEQ ID NO: 145061 - protein, 10 aa, Mycobacterium tuberculosis
LSWADLIVFA

SEQ ID NO: 145062 - protein, 10 aa, Mycobacterium tuberculosis
LIVFAGNCAL

SEQ ID NO: 145063 - protein, 10 aa, Mycobacterium tuberculosis
FAGNCALESM

SEQ ID NO: 145064 - protein, 10 aa, Mycobacterium tuberculosis
ESMGFKTFGF

SEQ ID NO: 145065 - protein, 10 aa, Mycobacterium tuberculosis
FKTFGFGFGR

SEQ ID NO: 145066 - protein, 10 aa, Mycobacterium tuberculosis
KTFGFGFGRV

SEQ ID NO: 145067 - protein, 10 aa, Mycobacterium tuberculosis
GFGFGRVDQW

SEQ ID NO: 145068 - protein, 10 aa, Mycobacterium tuberculosis
RVDQWEPDEV

SEQ ID NO: 145069 - protein, 10 aa, Mycobacterium tuberculosis
EVYWGKEATW

SEQ ID NO: 145070 - protein, 10 aa, Mycobacterium tuberculosis
VYWGKEATWL

SEQ ID NO: 145071 - protein, 10 aa, Mycobacterium tuberculosis
EATWLGDERY

SEQ ID NO: 145072 - protein, 10 aa, Mycobacterium tuberculosis
WLGDERYSGK

SEQ ID NO: 145073 - protein, 10 aa, Mycobacterium tuberculosis
LENPLAAVQM

SEQ ID NO: 145074 - protein, 10 aa, Mycobacterium tuberculosis
NPLAAVQMGL

SEQ ID NO: 145075 - protein, 10 aa, Mycobacterium tuberculosis
PLAAVQMGLI

SEQ ID NO: 145076 - protein, 10 aa, Mycobacterium tuberculosis
LAAVQMGLIY

SEQ ID NO: 145077 - protein, 10 aa, Mycobacterium tuberculosis
AAVQMGLIYV

SEQ ID NO: 145078 - protein, 10 aa, Mycobacterium tuberculosis
EGPNGNPDPM

SEQ ID NO: 145079 - protein, 10 aa, Mycobacterium tuberculosis
DPMAAAVDIR

SEQ ID NO: 145080 - protein, 10 aa, Mycobacterium tuberculosis
MAAAVDIRET

SEQ ID NO: 145081 - protein, 10 aa, Mycobacterium tuberculosis
AAAVDIRETF

SEQ ID NO: 145082 - protein, 10 aa, Mycobacterium tuberculosis
AAVDIRETFR

SEQ ID NO: 145083 - protein, 10 aa, Mycobacterium tuberculosis
AVDIRETFRR

SEQ ID NO: 145084 - protein, 10 aa, Mycobacterium tuberculosis
RMAMNDVETA

SEQ ID NO: 145085 - protein, 10 aa, Mycobacterium tuberculosis
MAMNDVETAA

SEQ ID NO: 145086 - protein, 10 aa, Mycobacterium tuberculosis
AMNDVETAAL

SEQ ID NO: 145087 - protein, 10 aa, Mycobacterium tuberculosis
ETAALIVGGH

SEQ ID NO: 145088 - protein, 10 aa, Mycobacterium tuberculosis
AALIVGGHTF

SEQ ID NO: 145089 - protein, 10 aa, Mycobacterium tuberculosis
LIVGGHTFGK

SEQ ID NO: 145090 - protein, 10 aa, Mycobacterium tuberculosis
DLVGPEPEAA

SEQ ID NO: 145091 - protein, 10 aa, Mycobacterium tuberculosis
EPEAAPLEQM

SEQ ID NO: 145092 - protein, 10 aa, Mycobacterium tuberculosis
EAAPLEQMGL

SEQ ID NO: 145093 - protein, 10 aa, Mycobacterium tuberculosis
APLEQMGLGW

SEQ ID NO: 145094 - protein, 10 aa, Mycobacterium tuberculosis
QMGLGWKSSY

SEQ ID NO: 145095 - protein, 10 aa, Mycobacterium tuberculosis
GLGWKSSYGT

SEQ ID NO: 145096 - protein, 10 aa, Mycobacterium tuberculosis
KSSYGTGTGK

SEQ ID NO: 145097 - protein, 10 aa, Mycobacterium tuberculosis
TGKDAITSGI

SEQ ID NO: 145098 - protein, 10 aa, Mycobacterium tuberculosis
DAITSGIEVV

SEQ ID NO: 145099 - protein, 10 aa, Mycobacterium tuberculosis
EVVWTNTPTK

SEQ ID NO: 145100 - protein, 10 aa, Mycobacterium tuberculosis
VVWTNTPTKW

SEQ ID NO: 145101 - protein, 10 aa, Mycobacterium tuberculosis
NTPTKWDNSF

SEQ ID NO: 145102 - protein, 10 aa, Mycobacterium tuberculosis
TPTKWDNSFL

SEQ ID NO: 145103 - protein, 10 aa, Mycobacterium tuberculosis
TKWDNSFLEI

SEQ ID NO: 145104 - protein, 10 aa, Mycobacterium tuberculosis
NSFLEILYGY

SEQ ID NO: 145105 - protein, 10 aa, Mycobacterium tuberculosis
EILYGYEWEL

SEQ ID NO: 145106 - protein, 10 aa, Mycobacterium tuberculosis
ILYGYEWELT

SEQ ID NO: 145107 - protein, 10 aa, Mycobacterium tuberculosis
LYGYEWELTK

SEQ ID NO: 145108 - protein, 10 aa, Mycobacterium tuberculosis
SPAGAWQYTA

SEQ ID NO: 145109 - protein, 10 aa, Mycobacterium tuberculosis
TMLATDLSLR

SEQ ID NO: 145110 - protein, 10 aa, Mycobacterium tuberculosis
MLATDLSLRV

SEQ ID NO: 145111 - protein, 10 aa, Mycobacterium tuberculosis
DLSLRVDPIY

SEQ ID NO: 145112 - protein, 10 aa, Mycobacterium tuberculosis
SLRVDPIYER

SEQ ID NO: 145113 - protein, 10 aa, Mycobacterium tuberculosis
LRVDPIYERI

SEQ ID NO: 145114 - protein, 10 aa, Mycobacterium tuberculosis
DPIYERITRR

SEQ ID NO: 145115 - protein, 10 aa, Mycobacterium tuberculosis
IYERITRRWL

SEQ ID NO: 145116 - protein, 10 aa, Mycobacterium tuberculosis
RRWLEHPEEL

SEQ ID NO: 145117 - protein, 10 aa, Mycobacterium tuberculosis
HPEELADEFA

SEQ ID NO: 145118 - protein, 10 aa, Mycobacterium tuberculosis
ELADEFAKAW

SEQ ID NO: 145119 - protein, 10 aa, Mycobacterium tuberculosis
LADEFAKAWY

SEQ ID NO: 145120 - protein, 10 aa, Mycobacterium tuberculosis
ADEFAKAWYK

SEQ ID NO: 145121 - protein, 10 aa, Mycobacterium tuberculosis
DEFAKAWYKL

SEQ ID NO: 145122 - protein, 10 aa, Mycobacterium tuberculosis
EFAKAWYKLI

SEQ ID NO: 145123 - protein, 10 aa, Mycobacterium tuberculosis
AKAWYKLIHR

SEQ ID NO: 145124 - protein, 10 aa, Mycobacterium tuberculosis
KLIHRDMGPV

SEQ ID NO: 145125 - protein, 10 aa, Mycobacterium tuberculosis
GPVARYLGPL

SEQ ID NO: 145126 - protein, 10 aa, Mycobacterium tuberculosis
PVARYLGPLV

SEQ ID NO: 145127 - protein, 10 aa, Mycobacterium tuberculosis
ARYLGPLVPK

SEQ ID NO: 145128 - protein, 10 aa, Mycobacterium tuberculosis
YLGPLVPKQT

SEQ ID NO: 145129 - protein, 10 aa, Mycobacterium tuberculosis
GPLVPKQTLL

SEQ ID NO: 145130 - protein, 10 aa, Mycobacterium tuberculosis
KQTLLWQDPV

SEQ ID NO: 145131 - protein, 10 aa, Mycobacterium tuberculosis
TLLWQDPVPA

SEQ ID NO: 145132 - protein, 10 aa, Mycobacterium tuberculosis
LLWQDPVPAV

SEQ ID NO: 145133 - protein, 10 aa, Mycobacterium tuberculosis
DPVPAVSHDL

SEQ ID NO: 145134 - protein, 10 aa, Mycobacterium tuberculosis
PVPAVSHDLV

SEQ ID NO: 145135 - protein, 10 aa, Mycobacterium tuberculosis
AVSHDLVGEA

SEQ ID NO: 145136 - protein, 10 aa, Mycobacterium tuberculosis
LVGEAEIASL

SEQ ID NO: 145137 - protein, 10 aa, Mycobacterium tuberculosis
AEIASLKSQI

SEQ ID NO: 145138 - protein, 10 aa, Mycobacterium tuberculosis
EIASLKSQIR

SEQ ID NO: 145139 - protein, 10 aa, Mycobacterium tuberculosis
SQIRASGLTV

SEQ ID NO: 145140 - protein, 10 aa, Mycobacterium tuberculosis
RASGLTVSQL

SEQ ID NO: 145141 - protein, 10 aa, Mycobacterium tuberculosis
LTVSQLVSTA

SEQ ID NO: 145142 - protein, 10 aa, Mycobacterium tuberculosis
TVSQLVSTAW

SEQ ID NO: 145143 - protein, 10 aa, Mycobacterium tuberculosis
SQLVSTAWAA

SEQ ID NO: 145144 - protein, 10 aa, Mycobacterium tuberculosis
QLVSTAWAAA

SEQ ID NO: 145145 - protein, 10 aa, Mycobacterium tuberculosis
STAWAAASSF

SEQ ID NO: 145146 - protein, 10 aa, Mycobacterium tuberculosis
TAWAAASSFR

SEQ ID NO: 145147 - protein, 10 aa, Mycobacterium tuberculosis
AASSFRGSDK

SEQ ID NO: 145148 - protein, 10 aa, Mycobacterium tuberculosis
ASSFRGSDKR

SEQ ID NO: 145149 - protein, 10 aa, Mycobacterium tuberculosis
RLQPQVGWEV

SEQ ID NO: 145150 - protein, 10 aa, Mycobacterium tuberculosis
WEVNDPDGDL

SEQ ID NO: 145151 - protein, 10 aa, Mycobacterium tuberculosis
EVNDPDGDLR

SEQ ID NO: 145152 - protein, 10 aa, Mycobacterium tuberculosis
RTLEEIQESF

SEQ ID NO: 145153 - protein, 10 aa, Mycobacterium tuberculosis
EEIQESFNSA

SEQ ID NO: 145154 - protein, 10 aa, Mycobacterium tuberculosis
EIQESFNSAA

SEQ ID NO: 145155 - protein, 10 aa, Mycobacterium tuberculosis
NSAAPGNIKV

SEQ ID NO: 145156 - protein, 10 aa, Mycobacterium tuberculosis
APGNIKVSFA

SEQ ID NO: 145157 - protein, 10 aa, Mycobacterium tuberculosis
NIKVSFADLV

SEQ ID NO: 145158 - protein, 10 aa, Mycobacterium tuberculosis
KVSFADLVVL

SEQ ID NO: 145159 - protein, 10 aa, Mycobacterium tuberculosis
LVVLGGCAAI

SEQ ID NO: 145160 - protein, 10 aa, Mycobacterium tuberculosis
VLGGCAAIEK

SEQ ID NO: 145161 - protein, 10 aa, Mycobacterium tuberculosis
KAAKAAGHNI

SEQ ID NO: 145162 - protein, 10 aa, Mycobacterium tuberculosis
AKAAGHNITV

SEQ ID NO: 145163 - protein, 10 aa, Mycobacterium tuberculosis
AAGHNITVPF

SEQ ID NO: 145164 - protein, 10 aa, Mycobacterium tuberculosis
NITVPFTPGR

SEQ ID NO: 145165 - protein, 10 aa, Mycobacterium tuberculosis
VPFTPGRTDA

SEQ ID NO: 145166 - protein, 10 aa, Mycobacterium tuberculosis
SQEQTDVESF

SEQ ID NO: 145167 - protein, 10 aa, Mycobacterium tuberculosis
EQTDVESFAV

SEQ ID NO: 145168 - protein, 10 aa, Mycobacterium tuberculosis
QTDVESFAVL

SEQ ID NO: 145169 - protein, 10 aa, Mycobacterium tuberculosis
ESFAVLEPKA

SEQ ID NO: 145170 - protein, 10 aa, Mycobacterium tuberculosis
AVLEPKADGF

SEQ ID NO: 145171 - protein, 10 aa, Mycobacterium tuberculosis
EPKADGFRNY

SEQ ID NO: 145172 - protein, 10 aa, Mycobacterium tuberculosis
YLGKGNPLPA

SEQ ID NO: 145173 - protein, 10 aa, Mycobacterium tuberculosis
NPLPAEYMLL

SEQ ID NO: 145174 - protein, 10 aa, Mycobacterium tuberculosis
EYMLLDKANL

SEQ ID NO: 145175 - protein, 10 aa, Mycobacterium tuberculosis
YMLLDKANLL

SEQ ID NO: 145176 - protein, 10 aa, Mycobacterium tuberculosis
MLLDKANLLT

SEQ ID NO: 145177 - protein, 10 aa, Mycobacterium tuberculosis
LLDKANLLTL

SEQ ID NO: 145178 - protein, 10 aa, Mycobacterium tuberculosis
NLLTLSAPEM

SEQ ID NO: 145179 - protein, 10 aa, Mycobacterium tuberculosis
LTLSAPEMTV

SEQ ID NO: 145180 - protein, 10 aa, Mycobacterium tuberculosis
TLSAPEMTVL

SEQ ID NO: 145181 - protein, 10 aa, Mycobacterium tuberculosis
LSAPEMTVLV

SEQ ID NO: 145182 - protein, 10 aa, Mycobacterium tuberculosis
PEMTVLVGGL

SEQ ID NO: 145183 - protein, 10 aa, Mycobacterium tuberculosis
EMTVLVGGLR

SEQ ID NO: 145184 - protein, 10 aa, Mycobacterium tuberculosis
MTVLVGGLRV

SEQ ID NO: 145185 - protein, 10 aa, Mycobacterium tuberculosis
TVLVGGLRVL

SEQ ID NO: 145186 - protein, 10 aa, Mycobacterium tuberculosis
VLVGGLRVLG

SEQ ID NO: 145187 - protein, 10 aa, Mycobacterium tuberculosis
GLRVLGANYK

SEQ ID NO: 145188 - protein, 10 aa, Mycobacterium tuberculosis
RVLGANYKRL

SEQ ID NO: 145189 - protein, 10 aa, Mycobacterium tuberculosis
NYKRLPLGVF

SEQ ID NO: 145190 - protein, 10 aa, Mycobacterium tuberculosis
RLPLGVFTEA

SEQ ID NO: 145191 - protein, 10 aa, Mycobacterium tuberculosis
LPLGVFTEAS

SEQ ID NO: 145192 - protein, 10 aa, Mycobacterium tuberculosis
GVFTEASESL

SEQ ID NO: 145193 - protein, 10 aa, Mycobacterium tuberculosis
EASESLTNDF

SEQ ID NO: 145194 - protein, 10 aa, Mycobacterium tuberculosis
SESLTNDFFV

SEQ ID NO: 145195 - protein, 10 aa, Mycobacterium tuberculosis
SLTNDFFVNL

SEQ ID NO: 145196 - protein, 10 aa, Mycobacterium tuberculosis
LTNDFFVNLL

SEQ ID NO: 145197 - protein, 10 aa, Mycobacterium tuberculosis
FFVNLLDMGI

SEQ ID NO: 145198 - protein, 10 aa, Mycobacterium tuberculosis
NLLDMGITWE

SEQ ID NO: 145199 - protein, 10 aa, Mycobacterium tuberculosis
LLDMGITWEP

SEQ ID NO: 145200 - protein, 10 aa, Mycobacterium tuberculosis
EPSPADDGTY

SEQ ID NO: 145201 - protein, 10 aa, Mycobacterium tuberculosis
TYQGKDGSGK

SEQ ID NO: 145202 - protein, 10 aa, Mycobacterium tuberculosis
YQGKDGSGKV

SEQ ID NO: 145203 - protein, 10 aa, Mycobacterium tuberculosis
QGKDGSGKVK

SEQ ID NO: 145204 - protein, 10 aa, Mycobacterium tuberculosis
SGKVKWTGSR

SEQ ID NO: 145205 - protein, 10 aa, Mycobacterium tuberculosis
DLVFGSNSEL

SEQ ID NO: 145206 - protein, 10 aa, Mycobacterium tuberculosis
LVFGSNSELR

SEQ ID NO: 145207 - protein, 10 aa, Mycobacterium tuberculosis
SELRALVEVY

SEQ ID NO: 145208 - protein, 10 aa, Mycobacterium tuberculosis
VYGADDAQPK

SEQ ID NO: 145209 - protein, 10 aa, Mycobacterium tuberculosis
YGADDAQPKF

SEQ ID NO: 145210 - protein, 10 aa, Mycobacterium tuberculosis
GADDAQPKFV

SEQ ID NO: 145211 - protein, 10 aa, Mycobacterium tuberculosis
AQPKFVQDFV

SEQ ID NO: 145212 - protein, 10 aa, Mycobacterium tuberculosis
KFVQDFVAAW

SEQ ID NO: 145213 - protein, 10 aa, Mycobacterium tuberculosis
VQDFVAAWDK

SEQ ID NO: 145214 - protein, 10 aa, Mycobacterium tuberculosis
DFVAAWDKVM

SEQ ID NO: 145215 - protein, 10 aa, Mycobacterium tuberculosis
AWDKVMNLDR

SEQ ID NO: 145216 - protein, 10 aa, Mycobacterium tuberculosis
KVMNLDRFDV

SEQ ID NO: 145217 - protein, 10 aa, Mycobacterium tuberculosis
VMNLDRFDVR

SEQ ID NO: 145218 - protein, 11 aa, Mycobacterium tuberculosis
MPEQHPPITET

SEQ ID NO: 145219 - protein, 11 aa, Mycobacterium tuberculosis
HPPITETTTGA

SEQ ID NO: 145220 - protein, 11 aa, Mycobacterium tuberculosis
PPITETTTGAA

SEQ ID NO: 145221 - protein, 11 aa, Mycobacterium tuberculosis
TTGAASNGCPV

SEQ ID NO: 145222 - protein, 11 aa, Mycobacterium tuberculosis
TGAASNGCPVV

SEQ ID NO: 145223 - protein, 11 aa, Mycobacterium tuberculosis
CPVVGHMKYPV

SEQ ID NO: 145224 - protein, 11 aa, Mycobacterium tuberculosis
YPVEGGGNQDW

SEQ ID NO: 145225 - protein, 11 aa, Mycobacterium tuberculosis
NQDWWPNRLNL

SEQ ID NO: 145226 - protein, 11 aa, Mycobacterium tuberculosis
WWPNRLNLKVL

SEQ ID NO: 145227 - protein, 11 aa, Mycobacterium tuberculosis
WPNRLNLKVLH

SEQ ID NO: 145228 - protein, 11 aa, Mycobacterium tuberculosis
NLKVLHQNPAV

SEQ ID NO: 145229 - protein, 11 aa, Mycobacterium tuberculosis
NPAVADPMGAA

SEQ ID NO: 145230 - protein, 11 aa, Mycobacterium tuberculosis
PAVADPMGAAF

SEQ ID NO: 145231 - protein, 11 aa, Mycobacterium tuberculosis
VADPMGAAFDY

SEQ ID NO: 145232 - protein, 11 aa, Mycobacterium tuberculosis
DPMGAAFDYAA

SEQ ID NO: 145233 - protein, 11 aa, Mycobacterium tuberculosis
MGAAFDYAAEV

SEQ ID NO: 145234 - protein, 11 aa, Mycobacterium tuberculosis
AEVATIDVDAL

SEQ ID NO: 145235 - protein, 11 aa, Mycobacterium tuberculosis
EVATIDVDALT

SEQ ID NO: 145236 - protein, 11 aa, Mycobacterium tuberculosis
VATIDVDALTR

SEQ ID NO: 145237 - protein, 11 aa, Mycobacterium tuberculosis
DALTRDIEEVM

SEQ ID NO: 145238 - protein, 11 aa, Mycobacterium tuberculosis
ALTRDIEEVMT

SEQ ID NO: 145239 - protein, 11 aa, Mycobacterium tuberculosis
IEEVMTTSQPW

SEQ ID NO: 145240 - protein, 11 aa, Mycobacterium tuberculosis
EEVMTTSQPWW

SEQ ID NO: 145241 - protein, 11 aa, Mycobacterium tuberculosis
VMTTSQPWWPA

SEQ ID NO: 145242 - protein, 11 aa, Mycobacterium tuberculosis
TTSQPWWPADY

SEQ ID NO: 145243 - protein, 11 aa, Mycobacterium tuberculosis
QPWWPADYGHY

SEQ ID NO: 145244 - protein, 11 aa, Mycobacterium tuberculosis
WPADYGHYGPL

SEQ ID NO: 145245 - protein, 11 aa, Mycobacterium tuberculosis
DYGHYGPLFIR

SEQ ID NO: 145246 - protein, 11 aa, Mycobacterium tuberculosis
HYGPLFIRMAW

SEQ ID NO: 145247 - protein, 11 aa, Mycobacterium tuberculosis
GPLFIRMAWHA

SEQ ID NO: 145248 - protein, 11 aa, Mycobacterium tuberculosis
PLFIRMAWHAA

SEQ ID NO: 145249 - protein, 11 aa, Mycobacterium tuberculosis
FIRMAWHAAGT

SEQ ID NO: 145250 - protein, 11 aa, Mycobacterium tuberculosis
IRMAWHAAGTY

SEQ ID NO: 145251 - protein, 11 aa, Mycobacterium tuberculosis
RMAWHAAGTYR

SEQ ID NO: 145252 - protein, 11 aa, Mycobacterium tuberculosis
MAWHAAGTYRI

SEQ ID NO: 145253 - protein, 11 aa, Mycobacterium tuberculosis
AAGTYRIHDGR

SEQ ID NO: 145254 - protein, 11 aa, Mycobacterium tuberculosis
FAPLNSWPDNA

SEQ ID NO: 145255 - protein, 11 aa, Mycobacterium tuberculosis
PLNSWPDNASL

SEQ ID NO: 145256 - protein, 11 aa, Mycobacterium tuberculosis
WPDNASLDKAR

SEQ ID NO: 145257 - protein, 11 aa, Mycobacterium tuberculosis
ASLDKARRLLW

SEQ ID NO: 145258 - protein, 11 aa, Mycobacterium tuberculosis
SLDKARRLLWP

SEQ ID NO: 145259 - protein, 11 aa, Mycobacterium tuberculosis
KARRLLWPVKK

SEQ ID NO: 145260 - protein, 11 aa, Mycobacterium tuberculosis
ARRLLWPVKKK

SEQ ID NO: 145261 - protein, 11 aa, Mycobacterium tuberculosis
RRLLWPVKKKY

SEQ ID NO: 145262 - protein, 11 aa, Mycobacterium tuberculosis
LLWPVKKKYGK

SEQ ID NO: 145263 - protein, 11 aa, Mycobacterium tuberculosis
WPVKKKYGKKL

SEQ ID NO: 145264 - protein, 11 aa, Mycobacterium tuberculosis
KYGKKLSWADL

SEQ ID NO: 145265 - protein, 11 aa, Mycobacterium tuberculosis
KLSWADLIVFA

SEQ ID NO: 145266 - protein, 11 aa, Mycobacterium tuberculosis
DLIVFAGNCAL

SEQ ID NO: 145267 - protein, 11 aa, Mycobacterium tuberculosis
GNCALESMGFK

SEQ ID NO: 145268 - protein, 11 aa, Mycobacterium tuberculosis
CALESMGFKTF

SEQ ID NO: 145269 - protein, 11 aa, Mycobacterium tuberculosis
LESMGFKTFGF

SEQ ID NO: 145270 - protein, 11 aa, Mycobacterium tuberculosis
SMGFKTFGFGF

SEQ ID NO: 145271 - protein, 11 aa, Mycobacterium tuberculosis
GFKTFGFGFGR

SEQ ID NO: 145272 - protein, 11 aa, Mycobacterium tuberculosis
FKTFGFGFGRV

SEQ ID NO: 145273 - protein, 11 aa, Mycobacterium tuberculosis
FGFGFGRVDQW

SEQ ID NO: 145274 - protein, 11 aa, Mycobacterium tuberculosis
RVDQWEPDEVY

SEQ ID NO: 145275 - protein, 11 aa, Mycobacterium tuberculosis
EPDEVYWGKEA

SEQ ID NO: 145276 - protein, 11 aa, Mycobacterium tuberculosis
DEVYWGKEATW

SEQ ID NO: 145277 - protein, 11 aa, Mycobacterium tuberculosis
EVYWGKEATWL

SEQ ID NO: 145278 - protein, 11 aa, Mycobacterium tuberculosis
TWLGDERYSGK

SEQ ID NO: 145279 - protein, 11 aa, Mycobacterium tuberculosis
DLENPLAAVQM

SEQ ID NO: 145280 - protein, 11 aa, Mycobacterium tuberculosis
NPLAAVQMGLI

SEQ ID NO: 145281 - protein, 11 aa, Mycobacterium tuberculosis
PLAAVQMGLIY

SEQ ID NO: 145282 - protein, 11 aa, Mycobacterium tuberculosis
LAAVQMGLIYV

SEQ ID NO: 145283 - protein, 11 aa, Mycobacterium tuberculosis
VQMGLIYVNPE

SEQ ID NO: 145284 - protein, 11 aa, Mycobacterium tuberculosis
NGNPDPMAAAV

SEQ ID NO: 145285 - protein, 11 aa, Mycobacterium tuberculosis
NPDPMAAAVDI

SEQ ID NO: 145286 - protein, 11 aa, Mycobacterium tuberculosis
MAAAVDIRETF

SEQ ID NO: 145287 - protein, 11 aa, Mycobacterium tuberculosis
AAAVDIRETFR

SEQ ID NO: 145288 - protein, 11 aa, Mycobacterium tuberculosis
AAVDIRETFRR

SEQ ID NO: 145289 - protein, 11 aa, Mycobacterium tuberculosis
AVDIRETFRRM

SEQ ID NO: 145290 - protein, 11 aa, Mycobacterium tuberculosis
DIRETFRRMAM

SEQ ID NO: 145291 - protein, 11 aa, Mycobacterium tuberculosis
ETFRRMAMNDV

SEQ ID NO: 145292 - protein, 11 aa, Mycobacterium tuberculosis
RRMAMNDVETA

SEQ ID NO: 145293 - protein, 11 aa, Mycobacterium tuberculosis
RMAMNDVETAA

SEQ ID NO: 145294 - protein, 11 aa, Mycobacterium tuberculosis
MAMNDVETAAL

SEQ ID NO: 145295 - protein, 11 aa, Mycobacterium tuberculosis
AMNDVETAALI

SEQ ID NO: 145296 - protein, 11 aa, Mycobacterium tuberculosis
ETAALIVGGHT

SEQ ID NO: 145297 - protein, 11 aa, Mycobacterium tuberculosis
TAALIVGGHTF

SEQ ID NO: 145298 - protein, 11 aa, Mycobacterium tuberculosis
ALIVGGHTFGK

SEQ ID NO: 145299 - protein, 11 aa, Mycobacterium tuberculosis
KTHGAGPADLV

SEQ ID NO: 145300 - protein, 11 aa, Mycobacterium tuberculosis
LVGPEPEAAPL

SEQ ID NO: 145301 - protein, 11 aa, Mycobacterium tuberculosis
PEAAPLEQMGL

SEQ ID NO: 145302 - protein, 11 aa, Mycobacterium tuberculosis
EQMGLGWKSSY

SEQ ID NO: 145303 - protein, 11 aa, Mycobacterium tuberculosis
SYGTGTGKDAI

SEQ ID NO: 145304 - protein, 11 aa, Mycobacterium tuberculosis
GKDAITSGIEV

SEQ ID NO: 145305 - protein, 11 aa, Mycobacterium tuberculosis
DAITSGIEVVW

SEQ ID NO: 145306 - protein, 11 aa, Mycobacterium tuberculosis
EVVWTNTPTKW

SEQ ID NO: 145307 - protein, 11 aa, Mycobacterium tuberculosis
NTPTKWDNSFL

SEQ ID NO: 145308 - protein, 11 aa, Mycobacterium tuberculosis
TKWDNSFLEIL

SEQ ID NO: 145309 - protein, 11 aa, Mycobacterium tuberculosis
KWDNSFLEILY

SEQ ID NO: 145310 - protein, 11 aa, Mycobacterium tuberculosis
SFLEILYGYEW

SEQ ID NO: 145311 - protein, 11 aa, Mycobacterium tuberculosis
LEILYGYEWEL

SEQ ID NO: 145312 - protein, 11 aa, Mycobacterium tuberculosis
ILYGYEWELTK

SEQ ID NO: 145313 - protein, 11 aa, Mycobacterium tuberculosis
WELTKSPAGAW

SEQ ID NO: 145314 - protein, 11 aa, Mycobacterium tuberculosis
LTKSPAGAWQY

SEQ ID NO: 145315 - protein, 11 aa, Mycobacterium tuberculosis
WQYTAKDGAGA

SEQ ID NO: 145316 - protein, 11 aa, Mycobacterium tuberculosis
TIPDPFGGPGR

SEQ ID NO: 145317 - protein, 11 aa, Mycobacterium tuberculosis
GPGRSPTMLAT

SEQ ID NO: 145318 - protein, 11 aa, Mycobacterium tuberculosis
SPTMLATDLSL

SEQ ID NO: 145319 - protein, 11 aa, Mycobacterium tuberculosis
PTMLATDLSLR

SEQ ID NO: 145320 - protein, 11 aa, Mycobacterium tuberculosis
TMLATDLSLRV

SEQ ID NO: 145321 - protein, 11 aa, Mycobacterium tuberculosis
LSLRVDPIYER

SEQ ID NO: 145322 - protein, 11 aa, Mycobacterium tuberculosis
SLRVDPIYERI

SEQ ID NO: 145323 - protein, 11 aa, Mycobacterium tuberculosis
RVDPIYERITR

SEQ ID NO: 145324 - protein, 11 aa, Mycobacterium tuberculosis
DPIYERITRRW

SEQ ID NO: 145325 - protein, 11 aa, Mycobacterium tuberculosis
PIYERITRRWL

SEQ ID NO: 145326 - protein, 11 aa, Mycobacterium tuberculosis
LEHPEELADEF

SEQ ID NO: 145327 - protein, 11 aa, Mycobacterium tuberculosis
EELADEFAKAW

SEQ ID NO: 145328 - protein, 11 aa, Mycobacterium tuberculosis
ELADEFAKAWY

SEQ ID NO: 145329 - protein, 11 aa, Mycobacterium tuberculosis
LADEFAKAWYK

SEQ ID NO: 145330 - protein, 11 aa, Mycobacterium tuberculosis
FAKAWYKLIHR

SEQ ID NO: 145331 - protein, 11 aa, Mycobacterium tuberculosis
KLIHRDMGPVA

SEQ ID NO: 145332 - protein, 11 aa, Mycobacterium tuberculosis
LIHRDMGPVAR

SEQ ID NO: 145333 - protein, 11 aa, Mycobacterium tuberculosis
HRDMGPVARYL

SEQ ID NO: 145334 - protein, 11 aa, Mycobacterium tuberculosis
MGPVARYLGPL

SEQ ID NO: 145335 - protein, 11 aa, Mycobacterium tuberculosis
GPVARYLGPLV

SEQ ID NO: 145336 - protein, 11 aa, Mycobacterium tuberculosis
VARYLGPLVPK

SEQ ID NO: 145337 - protein, 11 aa, Mycobacterium tuberculosis
YLGPLVPKQTL

SEQ ID NO: 145338 - protein, 11 aa, Mycobacterium tuberculosis
GPLVPKQTLLW

SEQ ID NO: 145339 - protein, 11 aa, Mycobacterium tuberculosis
PLVPKQTLLWQ

SEQ ID NO: 145340 - protein, 11 aa, Mycobacterium tuberculosis
QTLLWQDPVPA

SEQ ID NO: 145341 - protein, 11 aa, Mycobacterium tuberculosis
TLLWQDPVPAV

SEQ ID NO: 145342 - protein, 11 aa, Mycobacterium tuberculosis
LLWQDPVPAVS

SEQ ID NO: 145343 - protein, 11 aa, Mycobacterium tuberculosis
DPVPAVSHDLV

SEQ ID NO: 145344 - protein, 11 aa, Mycobacterium tuberculosis
DLVGEAEIASL

SEQ ID NO: 145345 - protein, 11 aa, Mycobacterium tuberculosis
LVGEAEIASLK

SEQ ID NO: 145346 - protein, 11 aa, Mycobacterium tuberculosis
EIASLKSQIRA

SEQ ID NO: 145347 - protein, 11 aa, Mycobacterium tuberculosis
SLKSQIRASGL

SEQ ID NO: 145348 - protein, 11 aa, Mycobacterium tuberculosis
SQIRASGLTVS

SEQ ID NO: 145349 - protein, 11 aa, Mycobacterium tuberculosis
RASGLTVSQLV

SEQ ID NO: 145350 - protein, 11 aa, Mycobacterium tuberculosis
GLTVSQLVSTA

SEQ ID NO: 145351 - protein, 11 aa, Mycobacterium tuberculosis
LTVSQLVSTAW

SEQ ID NO: 145352 - protein, 11 aa, Mycobacterium tuberculosis
TVSQLVSTAWA

SEQ ID NO: 145353 - protein, 11 aa, Mycobacterium tuberculosis
SQLVSTAWAAA

SEQ ID NO: 145354 - protein, 11 aa, Mycobacterium tuberculosis
VSTAWAAASSF

SEQ ID NO: 145355 - protein, 11 aa, Mycobacterium tuberculosis
STAWAAASSFR

SEQ ID NO: 145356 - protein, 11 aa, Mycobacterium tuberculosis
AAASSFRGSDK

SEQ ID NO: 145357 - protein, 11 aa, Mycobacterium tuberculosis
AASSFRGSDKR

SEQ ID NO: 145358 - protein, 11 aa, Mycobacterium tuberculosis
IRLQPQVGWEV

SEQ ID NO: 145359 - protein, 11 aa, Mycobacterium tuberculosis
EVNDPDGDLRK

SEQ ID NO: 145360 - protein, 11 aa, Mycobacterium tuberculosis
EEIQESFNSAA

SEQ ID NO: 145361 - protein, 11 aa, Mycobacterium tuberculosis
ESFNSAAPGNI

SEQ ID NO: 145362 - protein, 11 aa, Mycobacterium tuberculosis
SFNSAAPGNIK

SEQ ID NO: 145363 - protein, 11 aa, Mycobacterium tuberculosis
SAAPGNIKVSF

SEQ ID NO: 145364 - protein, 11 aa, Mycobacterium tuberculosis
NIKVSFADLVV

SEQ ID NO: 145365 - protein, 11 aa, Mycobacterium tuberculosis
DLVVLGGCAAI

SEQ ID NO: 145366 - protein, 11 aa, Mycobacterium tuberculosis
VVLGGCAAIEK

SEQ ID NO: 145367 - protein, 11 aa, Mycobacterium tuberculosis
VLGGCAAIEKA

SEQ ID NO: 145368 - protein, 11 aa, Mycobacterium tuberculosis
EKAAKAAGHNI

SEQ ID NO: 145369 - protein, 11 aa, Mycobacterium tuberculosis
AAKAAGHNITV

SEQ ID NO: 145370 - protein, 11 aa, Mycobacterium tuberculosis
KAAGHNITVPF

SEQ ID NO: 145371 - protein, 11 aa, Mycobacterium tuberculosis
HNITVPFTPGR

SEQ ID NO: 145372 - protein, 11 aa, Mycobacterium tuberculosis
VPFTPGRTDAS

SEQ ID NO: 145373 - protein, 11 aa, Mycobacterium tuberculosis
RTDASQEQTDV

SEQ ID NO: 145374 - protein, 11 aa, Mycobacterium tuberculosis
ASQEQTDVESF

SEQ ID NO: 145375 - protein, 11 aa, Mycobacterium tuberculosis
SQEQTDVESFA

SEQ ID NO: 145376 - protein, 11 aa, Mycobacterium tuberculosis
DVESFAVLEPK

SEQ ID NO: 145377 - protein, 11 aa, Mycobacterium tuberculosis
FAVLEPKADGF

SEQ ID NO: 145378 - protein, 11 aa, Mycobacterium tuberculosis
AVLEPKADGFR

SEQ ID NO: 145379 - protein, 11 aa, Mycobacterium tuberculosis
EPKADGFRNYL

SEQ ID NO: 145380 - protein, 11 aa, Mycobacterium tuberculosis
KADGFRNYLGK

SEQ ID NO: 145381 - protein, 11 aa, Mycobacterium tuberculosis
YLGKGNPLPAE

SEQ ID NO: 145382 - protein, 11 aa, Mycobacterium tuberculosis
LPAEYMLLDKA

SEQ ID NO: 145383 - protein, 11 aa, Mycobacterium tuberculosis
AEYMLLDKANL

SEQ ID NO: 145384 - protein, 11 aa, Mycobacterium tuberculosis
EYMLLDKANLL

SEQ ID NO: 145385 - protein, 11 aa, Mycobacterium tuberculosis
YMLLDKANLLT

SEQ ID NO: 145386 - protein, 11 aa, Mycobacterium tuberculosis
MLLDKANLLTL

SEQ ID NO: 145387 - protein, 11 aa, Mycobacterium tuberculosis
LLDKANLLTLS

SEQ ID NO: 145388 - protein, 11 aa, Mycobacterium tuberculosis
LLTLSAPEMTV

SEQ ID NO: 145389 - protein, 11 aa, Mycobacterium tuberculosis
LTLSAPEMTVL

SEQ ID NO: 145390 - protein, 11 aa, Mycobacterium tuberculosis
TLSAPEMTVLV

SEQ ID NO: 145391 - protein, 11 aa, Mycobacterium tuberculosis
APEMTVLVGGL

SEQ ID NO: 145392 - protein, 11 aa, Mycobacterium tuberculosis
EMTVLVGGLRV

SEQ ID NO: 145393 - protein, 11 aa, Mycobacterium tuberculosis
MTVLVGGLRVL

SEQ ID NO: 145394 - protein, 11 aa, Mycobacterium tuberculosis
VLVGGLRVLGA

SEQ ID NO: 145395 - protein, 11 aa, Mycobacterium tuberculosis
GLRVLGANYKR

SEQ ID NO: 145396 - protein, 11 aa, Mycobacterium tuberculosis
VLGANYKRLPL

SEQ ID NO: 145397 - protein, 11 aa, Mycobacterium tuberculosis
GANYKRLPLGV

SEQ ID NO: 145398 - protein, 11 aa, Mycobacterium tuberculosis
RLPLGVFTEAS

SEQ ID NO: 145399 - protein, 11 aa, Mycobacterium tuberculosis
LPLGVFTEASE

SEQ ID NO: 145400 - protein, 11 aa, Mycobacterium tuberculosis
EASESLTNDFF

SEQ ID NO: 145401 - protein, 11 aa, Mycobacterium tuberculosis
ESLTNDFFVNL

SEQ ID NO: 145402 - protein, 11 aa, Mycobacterium tuberculosis
SLTNDFFVNLL

SEQ ID NO: 145403 - protein, 11 aa, Mycobacterium tuberculosis
FVNLLDMGITW

SEQ ID NO: 145404 - protein, 11 aa, Mycobacterium tuberculosis
NLLDMGITWEP

SEQ ID NO: 145405 - protein, 11 aa, Mycobacterium tuberculosis
LLDMGITWEPS

SEQ ID NO: 145406 - protein, 11 aa, Mycobacterium tuberculosis
WEPSPADDGTY

SEQ ID NO: 145407 - protein, 11 aa, Mycobacterium tuberculosis
GTYQGKDGSGK

SEQ ID NO: 145408 - protein, 11 aa, Mycobacterium tuberculosis
GSGKVKWTGSR

SEQ ID NO: 145409 - protein, 11 aa, Mycobacterium tuberculosis
VKWTGSRVDLV

SEQ ID NO: 145410 - protein, 11 aa, Mycobacterium tuberculosis
KWTGSRVDLVF

SEQ ID NO: 145411 - protein, 11 aa, Mycobacterium tuberculosis
DLVFGSNSELR

SEQ ID NO: 145412 - protein, 11 aa, Mycobacterium tuberculosis
LVFGSNSELRA

SEQ ID NO: 145413 - protein, 11 aa, Mycobacterium tuberculosis
FGSNSELRALV

SEQ ID NO: 145414 - protein, 11 aa, Mycobacterium tuberculosis
SNSELRALVEV

SEQ ID NO: 145415 - protein, 11 aa, Mycobacterium tuberculosis
NSELRALVEVY

SEQ ID NO: 145416 - protein, 11 aa, Mycobacterium tuberculosis
ELRALVEVYGA

SEQ ID NO: 145417 - protein, 11 aa, Mycobacterium tuberculosis
ALVEVYGADDA

SEQ ID NO: 145418 - protein, 11 aa, Mycobacterium tuberculosis
EVYGADDAQPK

SEQ ID NO: 145419 - protein, 11 aa, Mycobacterium tuberculosis
VYGADDAQPKF

SEQ ID NO: 145420 - protein, 11 aa, Mycobacterium tuberculosis
YGADDAQPKFV

SEQ ID NO: 145421 - protein, 11 aa, Mycobacterium tuberculosis
DAQPKFVQDFV

SEQ ID NO: 145422 - protein, 11 aa, Mycobacterium tuberculosis
AQPKFVQDFVA

SEQ ID NO: 145423 - protein, 11 aa, Mycobacterium tuberculosis
QPKFVQDFVAA

SEQ ID NO: 145424 - protein, 11 aa, Mycobacterium tuberculosis
FVQDFVAAWDK

SEQ ID NO: 145425 - protein, 11 aa, Mycobacterium tuberculosis
VQDFVAAWDKV

SEQ ID NO: 145426 - protein, 11 aa, Mycobacterium tuberculosis
FVAAWDKVMNL

SEQ ID NO: 145427 - protein, 11 aa, Mycobacterium tuberculosis
AAWDKVMNLDR

SEQ ID NO: 145428 - protein, 11 aa, Mycobacterium tuberculosis
AWDKVMNLDRF

SEQ ID NO: 145429 - protein, 11 aa, Mycobacterium tuberculosis
KVMNLDRFDVR

SEQ ID NO: 145430 - protein, 13 aa, Mycobacterium tuberculosis
MPEQHPPITETTT

SEQ ID NO: 145431 - protein, 13 aa, Mycobacterium tuberculosis
PEQHPPITETTTG

SEQ ID NO: 145432 - protein, 13 aa, Mycobacterium tuberculosis
EQHPPITETTTGA

SEQ ID NO: 145433 - protein, 13 aa, Mycobacterium tuberculosis
QHPPITETTTGAA

SEQ ID NO: 145434 - protein, 13 aa, Mycobacterium tuberculosis
HPPITETTTGAAS

SEQ ID NO: 145435 - protein, 13 aa, Mycobacterium tuberculosis
PPITETTTGAASN

SEQ ID NO: 145436 - protein, 13 aa, Mycobacterium tuberculosis
PITETTTGAASNG

SEQ ID NO: 145437 - protein, 13 aa, Mycobacterium tuberculosis
ITETTTGAASNGC

SEQ ID NO: 145438 - protein, 13 aa, Mycobacterium tuberculosis
TETTTGAASNGCP

SEQ ID NO: 145439 - protein, 13 aa, Mycobacterium tuberculosis
ETTTGAASNGCPV

SEQ ID NO: 145440 - protein, 13 aa, Mycobacterium tuberculosis
TTTGAASNGCPVV

SEQ ID NO: 145441 - protein, 13 aa, Mycobacterium tuberculosis
TTGAASNGCPVVG

SEQ ID NO: 145442 - protein, 13 aa, Mycobacterium tuberculosis
TGAASNGCPVVGH

SEQ ID NO: 145443 - protein, 13 aa, Mycobacterium tuberculosis
GAASNGCPVVGHM

SEQ ID NO: 145444 - protein, 13 aa, Mycobacterium tuberculosis
AASNGCPVVGHMK

SEQ ID NO: 145445 - protein, 13 aa, Mycobacterium tuberculosis
ASNGCPVVGHMKY

SEQ ID NO: 145446 - protein, 13 aa, Mycobacterium tuberculosis
SNGCPVVGHMKYP

SEQ ID NO: 145447 - protein, 13 aa, Mycobacterium tuberculosis
NGCPVVGHMKYPV

SEQ ID NO: 145448 - protein, 13 aa, Mycobacterium tuberculosis
GCPVVGHMKYPVE

SEQ ID NO: 145449 - protein, 13 aa, Mycobacterium tuberculosis
CPVVGHMKYPVEG

SEQ ID NO: 145450 - protein, 13 aa, Mycobacterium tuberculosis
PVVGHMKYPVEGG

SEQ ID NO: 145451 - protein, 13 aa, Mycobacterium tuberculosis
VVGHMKYPVEGGG

SEQ ID NO: 145452 - protein, 13 aa, Mycobacterium tuberculosis
VGHMKYPVEGGGN

SEQ ID NO: 145453 - protein, 13 aa, Mycobacterium tuberculosis
GHMKYPVEGGGNQ

SEQ ID NO: 145454 - protein, 13 aa, Mycobacterium tuberculosis
HMKYPVEGGGNQD

SEQ ID NO: 145455 - protein, 13 aa, Mycobacterium tuberculosis
MKYPVEGGGNQDW

SEQ ID NO: 145456 - protein, 13 aa, Mycobacterium tuberculosis
KYPVEGGGNQDWW

SEQ ID NO: 145457 - protein, 13 aa, Mycobacterium tuberculosis
YPVEGGGNQDWWP

SEQ ID NO: 145458 - protein, 13 aa, Mycobacterium tuberculosis
PVEGGGNQDWWPN

SEQ ID NO: 145459 - protein, 13 aa, Mycobacterium tuberculosis
VEGGGNQDWWPNR

SEQ ID NO: 145460 - protein, 13 aa, Mycobacterium tuberculosis
EGGGNQDWWPNRL

SEQ ID NO: 145461 - protein, 13 aa, Mycobacterium tuberculosis
GGGNQDWWPNRLN

SEQ ID NO: 145462 - protein, 13 aa, Mycobacterium tuberculosis
GGNQDWWPNRLNL

SEQ ID NO: 145463 - protein, 13 aa, Mycobacterium tuberculosis
GNQDWWPNRLNLK

SEQ ID NO: 145464 - protein, 13 aa, Mycobacterium tuberculosis
NQDWWPNRLNLKV

SEQ ID NO: 145465 - protein, 13 aa, Mycobacterium tuberculosis
QDWWPNRLNLKVL

SEQ ID NO: 145466 - protein, 13 aa, Mycobacterium tuberculosis
DWWPNRLNLKVLH

SEQ ID NO: 145467 - protein, 13 aa, Mycobacterium tuberculosis
WWPNRLNLKVLHQ

SEQ ID NO: 145468 - protein, 13 aa, Mycobacterium tuberculosis
WPNRLNLKVLHQN

SEQ ID NO: 145469 - protein, 13 aa, Mycobacterium tuberculosis
PNRLNLKVLHQNP

SEQ ID NO: 145470 - protein, 13 aa, Mycobacterium tuberculosis
NRLNLKVLHQNPA

SEQ ID NO: 145471 - protein, 13 aa, Mycobacterium tuberculosis
RLNLKVLHQNPAV

SEQ ID NO: 145472 - protein, 13 aa, Mycobacterium tuberculosis
LNLKVLHQNPAVA

SEQ ID NO: 145473 - protein, 13 aa, Mycobacterium tuberculosis
NLKVLHQNPAVAD

SEQ ID NO: 145474 - protein, 13 aa, Mycobacterium tuberculosis
LKVLHQNPAVADP

SEQ ID NO: 145475 - protein, 13 aa, Mycobacterium tuberculosis
KVLHQNPAVADPM

SEQ ID NO: 145476 - protein, 13 aa, Mycobacterium tuberculosis
VLHQNPAVADPMG

SEQ ID NO: 145477 - protein, 13 aa, Mycobacterium tuberculosis
LHQNPAVADPMGA

SEQ ID NO: 145478 - protein, 13 aa, Mycobacterium tuberculosis
HQNPAVADPMGAA

SEQ ID NO: 145479 - protein, 13 aa, Mycobacterium tuberculosis
QNPAVADPMGAAF

SEQ ID NO: 145480 - protein, 13 aa, Mycobacterium tuberculosis
NPAVADPMGAAFD

SEQ ID NO: 145481 - protein, 13 aa, Mycobacterium tuberculosis
PAVADPMGAAFDY

SEQ ID NO: 145482 - protein, 13 aa, Mycobacterium tuberculosis
AVADPMGAAFDYA

SEQ ID NO: 145483 - protein, 13 aa, Mycobacterium tuberculosis
VADPMGAAFDYAA

SEQ ID NO: 145484 - protein, 13 aa, Mycobacterium tuberculosis
ADPMGAAFDYAAE

SEQ ID NO: 145485 - protein, 13 aa, Mycobacterium tuberculosis
DPMGAAFDYAAEV

SEQ ID NO: 145486 - protein, 13 aa, Mycobacterium tuberculosis
PMGAAFDYAAEVA

SEQ ID NO: 145487 - protein, 13 aa, Mycobacterium tuberculosis
MGAAFDYAAEVAT

SEQ ID NO: 145488 - protein, 13 aa, Mycobacterium tuberculosis
GAAFDYAAEVATI

SEQ ID NO: 145489 - protein, 13 aa, Mycobacterium tuberculosis
AAFDYAAEVATID

SEQ ID NO: 145490 - protein, 13 aa, Mycobacterium tuberculosis
AFDYAAEVATIDV

SEQ ID NO: 145491 - protein, 13 aa, Mycobacterium tuberculosis
FDYAAEVATIDVD

SEQ ID NO: 145492 - protein, 13 aa, Mycobacterium tuberculosis
DYAAEVATIDVDA

SEQ ID NO: 145493 - protein, 13 aa, Mycobacterium tuberculosis
YAAEVATIDVDAL

SEQ ID NO: 145494 - protein, 13 aa, Mycobacterium tuberculosis
AAEVATIDVDALT

SEQ ID NO: 145495 - protein, 13 aa, Mycobacterium tuberculosis
AEVATIDVDALTR

SEQ ID NO: 145496 - protein, 13 aa, Mycobacterium tuberculosis
EVATIDVDALTRD

SEQ ID NO: 145497 - protein, 13 aa, Mycobacterium tuberculosis
VATIDVDALTRDI

SEQ ID NO: 145498 - protein, 13 aa, Mycobacterium tuberculosis
ATIDVDALTRDIE

SEQ ID NO: 145499 - protein, 13 aa, Mycobacterium tuberculosis
TIDVDALTRDIEE

SEQ ID NO: 145500 - protein, 13 aa, Mycobacterium tuberculosis
IDVDALTRDIEEV

SEQ ID NO: 145501 - protein, 13 aa, Mycobacterium tuberculosis
DVDALTRDIEEVM

SEQ ID NO: 145502 - protein, 13 aa, Mycobacterium tuberculosis
VDALTRDIEEVMT

SEQ ID NO: 145503 - protein, 13 aa, Mycobacterium tuberculosis
DALTRDIEEVMTT

SEQ ID NO: 145504 - protein, 13 aa, Mycobacterium tuberculosis
ALTRDIEEVMTTS

SEQ ID NO: 145505 - protein, 13 aa, Mycobacterium tuberculosis
LTRDIEEVMTTSQ

SEQ ID NO: 145506 - protein, 13 aa, Mycobacterium tuberculosis
TRDIEEVMTTSQP

SEQ ID NO: 145507 - protein, 13 aa, Mycobacterium tuberculosis
RDIEEVMTTSQPW

SEQ ID NO: 145508 - protein, 13 aa, Mycobacterium tuberculosis
DIEEVMTTSQPWW

SEQ ID NO: 145509 - protein, 13 aa, Mycobacterium tuberculosis
IEEVMTTSQPWWP

SEQ ID NO: 145510 - protein, 13 aa, Mycobacterium tuberculosis
EEVMTTSQPWWPA

SEQ ID NO: 145511 - protein, 13 aa, Mycobacterium tuberculosis
EVMTTSQPWWPAD

SEQ ID NO: 145512 - protein, 13 aa, Mycobacterium tuberculosis
VMTTSQPWWPADY

SEQ ID NO: 145513 - protein, 13 aa, Mycobacterium tuberculosis
MTTSQPWWPADYG

SEQ ID NO: 145514 - protein, 13 aa, Mycobacterium tuberculosis
TTSQPWWPADYGH

SEQ ID NO: 145515 - protein, 13 aa, Mycobacterium tuberculosis
TSQPWWPADYGHY

SEQ ID NO: 145516 - protein, 13 aa, Mycobacterium tuberculosis
SQPWWPADYGHYG

SEQ ID NO: 145517 - protein, 13 aa, Mycobacterium tuberculosis
QPWWPADYGHYGP

SEQ ID NO: 145518 - protein, 13 aa, Mycobacterium tuberculosis
PWWPADYGHYGPL

SEQ ID NO: 145519 - protein, 13 aa, Mycobacterium tuberculosis
WWPADYGHYGPLF

SEQ ID NO: 145520 - protein, 13 aa, Mycobacterium tuberculosis
WPADYGHYGPLFI

SEQ ID NO: 145521 - protein, 13 aa, Mycobacterium tuberculosis
PADYGHYGPLFIR

SEQ ID NO: 145522 - protein, 13 aa, Mycobacterium tuberculosis
ADYGHYGPLFIRM

SEQ ID NO: 145523 - protein, 13 aa, Mycobacterium tuberculosis
DYGHYGPLFIRMA

SEQ ID NO: 145524 - protein, 13 aa, Mycobacterium tuberculosis
YGHYGPLFIRMAW

SEQ ID NO: 145525 - protein, 13 aa, Mycobacterium tuberculosis
GHYGPLFIRMAWH

SEQ ID NO: 145526 - protein, 13 aa, Mycobacterium tuberculosis
HYGPLFIRMAWHA

SEQ ID NO: 145527 - protein, 13 aa, Mycobacterium tuberculosis
YGPLFIRMAWHAA

SEQ ID NO: 145528 - protein, 13 aa, Mycobacterium tuberculosis
GPLFIRMAWHAAG

SEQ ID NO: 145529 - protein, 13 aa, Mycobacterium tuberculosis
PLFIRMAWHAAGT

SEQ ID NO: 145530 - protein, 13 aa, Mycobacterium tuberculosis
LFIRMAWHAAGTY

SEQ ID NO: 145531 - protein, 13 aa, Mycobacterium tuberculosis
FIRMAWHAAGTYR

SEQ ID NO: 145532 - protein, 13 aa, Mycobacterium tuberculosis
IRMAWHAAGTYRI

SEQ ID NO: 145533 - protein, 13 aa, Mycobacterium tuberculosis
RMAWHAAGTYRIH

SEQ ID NO: 145534 - protein, 13 aa, Mycobacterium tuberculosis
MAWHAAGTYRIHD

SEQ ID NO: 145535 - protein, 13 aa, Mycobacterium tuberculosis
AWHAAGTYRIHDG

SEQ ID NO: 145536 - protein, 13 aa, Mycobacterium tuberculosis
WHAAGTYRIHDGR

SEQ ID NO: 145537 - protein, 13 aa, Mycobacterium tuberculosis
HAAGTYRIHDGRG

SEQ ID NO: 145538 - protein, 13 aa, Mycobacterium tuberculosis
AAGTYRIHDGRGG

SEQ ID NO: 145539 - protein, 13 aa, Mycobacterium tuberculosis
AGTYRIHDGRGGA

SEQ ID NO: 145540 - protein, 13 aa, Mycobacterium tuberculosis
GTYRIHDGRGGAG

SEQ ID NO: 145541 - protein, 13 aa, Mycobacterium tuberculosis
TYRIHDGRGGAGG

SEQ ID NO: 145542 - protein, 13 aa, Mycobacterium tuberculosis
YRIHDGRGGAGGG

SEQ ID NO: 145543 - protein, 13 aa, Mycobacterium tuberculosis
RIHDGRGGAGGGM

SEQ ID NO: 145544 - protein, 13 aa, Mycobacterium tuberculosis
IHDGRGGAGGGMQ

SEQ ID NO: 145545 - protein, 13 aa, Mycobacterium tuberculosis
HDGRGGAGGGMQR

SEQ ID NO: 145546 - protein, 13 aa, Mycobacterium tuberculosis
DGRGGAGGGMQRF

SEQ ID NO: 145547 - protein, 13 aa, Mycobacterium tuberculosis
GRGGAGGGMQRFA

SEQ ID NO: 145548 - protein, 13 aa, Mycobacterium tuberculosis
RGGAGGGMQRFAP

SEQ ID NO: 145549 - protein, 13 aa, Mycobacterium tuberculosis
GGAGGGMQRFAPL

SEQ ID NO: 145550 - protein, 13 aa, Mycobacterium tuberculosis
GAGGGMQRFAPLN

SEQ ID NO: 145551 - protein, 13 aa, Mycobacterium tuberculosis
AGGGMQRFAPLNS

SEQ ID NO: 145552 - protein, 13 aa, Mycobacterium tuberculosis
GGGMQRFAPLNSW

SEQ ID NO: 145553 - protein, 13 aa, Mycobacterium tuberculosis
GGMQRFAPLNSWP

SEQ ID NO: 145554 - protein, 13 aa, Mycobacterium tuberculosis
GMQRFAPLNSWPD

SEQ ID NO: 145555 - protein, 13 aa, Mycobacterium tuberculosis
MQRFAPLNSWPDN

SEQ ID NO: 145556 - protein, 13 aa, Mycobacterium tuberculosis
QRFAPLNSWPDNA

SEQ ID NO: 145557 - protein, 13 aa, Mycobacterium tuberculosis
RFAPLNSWPDNAS

SEQ ID NO: 145558 - protein, 13 aa, Mycobacterium tuberculosis
FAPLNSWPDNASL

SEQ ID NO: 145559 - protein, 13 aa, Mycobacterium tuberculosis
APLNSWPDNASLD

SEQ ID NO: 145560 - protein, 13 aa, Mycobacterium tuberculosis
PLNSWPDNASLDK

SEQ ID NO: 145561 - protein, 13 aa, Mycobacterium tuberculosis
LNSWPDNASLDKA

SEQ ID NO: 145562 - protein, 13 aa, Mycobacterium tuberculosis
NSWPDNASLDKAR

SEQ ID NO: 145563 - protein, 13 aa, Mycobacterium tuberculosis
SWPDNASLDKARR

SEQ ID NO: 145564 - protein, 13 aa, Mycobacterium tuberculosis
WPDNASLDKARRL

SEQ ID NO: 145565 - protein, 13 aa, Mycobacterium tuberculosis
PDNASLDKARRLL

SEQ ID NO: 145566 - protein, 13 aa, Mycobacterium tuberculosis
DNASLDKARRLLW

SEQ ID NO: 145567 - protein, 13 aa, Mycobacterium tuberculosis
NASLDKARRLLWP

SEQ ID NO: 145568 - protein, 13 aa, Mycobacterium tuberculosis
ASLDKARRLLWPV

SEQ ID NO: 145569 - protein, 13 aa, Mycobacterium tuberculosis
SLDKARRLLWPVK

SEQ ID NO: 145570 - protein, 13 aa, Mycobacterium tuberculosis
LDKARRLLWPVKK

SEQ ID NO: 145571 - protein, 13 aa, Mycobacterium tuberculosis
DKARRLLWPVKKK

SEQ ID NO: 145572 - protein, 13 aa, Mycobacterium tuberculosis
KARRLLWPVKKKY

SEQ ID NO: 145573 - protein, 13 aa, Mycobacterium tuberculosis
ARRLLWPVKKKYG

SEQ ID NO: 145574 - protein, 13 aa, Mycobacterium tuberculosis
RRLLWPVKKKYGK

SEQ ID NO: 145575 - protein, 13 aa, Mycobacterium tuberculosis
RLLWPVKKKYGKK

SEQ ID NO: 145576 - protein, 13 aa, Mycobacterium tuberculosis
LLWPVKKKYGKKL

SEQ ID NO: 145577 - protein, 13 aa, Mycobacterium tuberculosis
LWPVKKKYGKKLS

SEQ ID NO: 145578 - protein, 13 aa, Mycobacterium tuberculosis
WPVKKKYGKKLSW

SEQ ID NO: 145579 - protein, 13 aa, Mycobacterium tuberculosis
PVKKKYGKKLSWA

SEQ ID NO: 145580 - protein, 13 aa, Mycobacterium tuberculosis
VKKKYGKKLSWAD

SEQ ID NO: 145581 - protein, 13 aa, Mycobacterium tuberculosis
KKKYGKKLSWADL

SEQ ID NO: 145582 - protein, 13 aa, Mycobacterium tuberculosis
KKYGKKLSWADLI

SEQ ID NO: 145583 - protein, 13 aa, Mycobacterium tuberculosis
KYGKKLSWADLIV

SEQ ID NO: 145584 - protein, 13 aa, Mycobacterium tuberculosis
YGKKLSWADLIVF

SEQ ID NO: 145585 - protein, 13 aa, Mycobacterium tuberculosis
GKKLSWADLIVFA

SEQ ID NO: 145586 - protein, 13 aa, Mycobacterium tuberculosis
KKLSWADLIVFAG

SEQ ID NO: 145587 - protein, 13 aa, Mycobacterium tuberculosis
KLSWADLIVFAGN

SEQ ID NO: 145588 - protein, 13 aa, Mycobacterium tuberculosis
LSWADLIVFAGNC

SEQ ID NO: 145589 - protein, 13 aa, Mycobacterium tuberculosis
SWADLIVFAGNCA

SEQ ID NO: 145590 - protein, 13 aa, Mycobacterium tuberculosis
WADLIVFAGNCAL

SEQ ID NO: 145591 - protein, 13 aa, Mycobacterium tuberculosis
ADLIVFAGNCALE

SEQ ID NO: 145592 - protein, 13 aa, Mycobacterium tuberculosis
DLIVFAGNCALES

SEQ ID NO: 145593 - protein, 13 aa, Mycobacterium tuberculosis
LIVFAGNCALESM

SEQ ID NO: 145594 - protein, 13 aa, Mycobacterium tuberculosis
IVFAGNCALESMG

SEQ ID NO: 145595 - protein, 13 aa, Mycobacterium tuberculosis
VFAGNCALESMGF

SEQ ID NO: 145596 - protein, 13 aa, Mycobacterium tuberculosis
FAGNCALESMGFK

SEQ ID NO: 145597 - protein, 13 aa, Mycobacterium tuberculosis
AGNCALESMGFKT

SEQ ID NO: 145598 - protein, 13 aa, Mycobacterium tuberculosis
GNCALESMGFKTF

SEQ ID NO: 145599 - protein, 13 aa, Mycobacterium tuberculosis
NCALESMGFKTFG

SEQ ID NO: 145600 - protein, 13 aa, Mycobacterium tuberculosis
CALESMGFKTFGF

SEQ ID NO: 145601 - protein, 13 aa, Mycobacterium tuberculosis
ALESMGFKTFGFG

SEQ ID NO: 145602 - protein, 13 aa, Mycobacterium tuberculosis
LESMGFKTFGFGF

SEQ ID NO: 145603 - protein, 13 aa, Mycobacterium tuberculosis
ESMGFKTFGFGFG

SEQ ID NO: 145604 - protein, 13 aa, Mycobacterium tuberculosis
SMGFKTFGFGFGR

SEQ ID NO: 145605 - protein, 13 aa, Mycobacterium tuberculosis
MGFKTFGFGFGRV

SEQ ID NO: 145606 - protein, 13 aa, Mycobacterium tuberculosis
GFKTFGFGFGRVD

SEQ ID NO: 145607 - protein, 13 aa, Mycobacterium tuberculosis
FKTFGFGFGRVDQ

SEQ ID NO: 145608 - protein, 13 aa, Mycobacterium tuberculosis
KTFGFGFGRVDQW

SEQ ID NO: 145609 - protein, 13 aa, Mycobacterium tuberculosis
TFGFGFGRVDQWE

SEQ ID NO: 145610 - protein, 13 aa, Mycobacterium tuberculosis
FGFGFGRVDQWEP

SEQ ID NO: 145611 - protein, 13 aa, Mycobacterium tuberculosis
GFGFGRVDQWEPD

SEQ ID NO: 145612 - protein, 13 aa, Mycobacterium tuberculosis
FGFGRVDQWEPDE

SEQ ID NO: 145613 - protein, 13 aa, Mycobacterium tuberculosis
GFGRVDQWEPDEV

SEQ ID NO: 145614 - protein, 13 aa, Mycobacterium tuberculosis
FGRVDQWEPDEVY

SEQ ID NO: 145615 - protein, 13 aa, Mycobacterium tuberculosis
GRVDQWEPDEVYW

SEQ ID NO: 145616 - protein, 13 aa, Mycobacterium tuberculosis
RVDQWEPDEVYWG

SEQ ID NO: 145617 - protein, 13 aa, Mycobacterium tuberculosis
VDQWEPDEVYWGK

SEQ ID NO: 145618 - protein, 13 aa, Mycobacterium tuberculosis
DQWEPDEVYWGKE

SEQ ID NO: 145619 - protein, 13 aa, Mycobacterium tuberculosis
QWEPDEVYWGKEA

SEQ ID NO: 145620 - protein, 13 aa, Mycobacterium tuberculosis
WEPDEVYWGKEAT

SEQ ID NO: 145621 - protein, 13 aa, Mycobacterium tuberculosis
EPDEVYWGKEATW

SEQ ID NO: 145622 - protein, 13 aa, Mycobacterium tuberculosis
PDEVYWGKEATWL

SEQ ID NO: 145623 - protein, 13 aa, Mycobacterium tuberculosis
DEVYWGKEATWLG

SEQ ID NO: 145624 - protein, 13 aa, Mycobacterium tuberculosis
EVYWGKEATWLGD

SEQ ID NO: 145625 - protein, 13 aa, Mycobacterium tuberculosis
VYWGKEATWLGDE

SEQ ID NO: 145626 - protein, 13 aa, Mycobacterium tuberculosis
YWGKEATWLGDER

SEQ ID NO: 145627 - protein, 13 aa, Mycobacterium tuberculosis
WGKEATWLGDERY

SEQ ID NO: 145628 - protein, 13 aa, Mycobacterium tuberculosis
GKEATWLGDERYS

SEQ ID NO: 145629 - protein, 13 aa, Mycobacterium tuberculosis
KEATWLGDERYSG

SEQ ID NO: 145630 - protein, 13 aa, Mycobacterium tuberculosis
EATWLGDERYSGK

SEQ ID NO: 145631 - protein, 13 aa, Mycobacterium tuberculosis
ATWLGDERYSGKR

SEQ ID NO: 145632 - protein, 13 aa, Mycobacterium tuberculosis
TWLGDERYSGKRD

SEQ ID NO: 145633 - protein, 13 aa, Mycobacterium tuberculosis
WLGDERYSGKRDL

SEQ ID NO: 145634 - protein, 13 aa, Mycobacterium tuberculosis
LGDERYSGKRDLE

SEQ ID NO: 145635 - protein, 13 aa, Mycobacterium tuberculosis
GDERYSGKRDLEN

SEQ ID NO: 145636 - protein, 13 aa, Mycobacterium tuberculosis
DERYSGKRDLENP

SEQ ID NO: 145637 - protein, 13 aa, Mycobacterium tuberculosis
ERYSGKRDLENPL

SEQ ID NO: 145638 - protein, 13 aa, Mycobacterium tuberculosis
RYSGKRDLENPLA

SEQ ID NO: 145639 - protein, 13 aa, Mycobacterium tuberculosis
YSGKRDLENPLAA

SEQ ID NO: 145640 - protein, 13 aa, Mycobacterium tuberculosis
SGKRDLENPLAAV

SEQ ID NO: 145641 - protein, 13 aa, Mycobacterium tuberculosis
GKRDLENPLAAVQ

SEQ ID NO: 145642 - protein, 13 aa, Mycobacterium tuberculosis
KRDLENPLAAVQM

SEQ ID NO: 145643 - protein, 13 aa, Mycobacterium tuberculosis
RDLENPLAAVQMG

SEQ ID NO: 145644 - protein, 13 aa, Mycobacterium tuberculosis
DLENPLAAVQMGL

SEQ ID NO: 145645 - protein, 13 aa, Mycobacterium tuberculosis
LENPLAAVQMGLI

SEQ ID NO: 145646 - protein, 13 aa, Mycobacterium tuberculosis
ENPLAAVQMGLIY

SEQ ID NO: 145647 - protein, 13 aa, Mycobacterium tuberculosis
NPLAAVQMGLIYV

SEQ ID NO: 145648 - protein, 13 aa, Mycobacterium tuberculosis
PLAAVQMGLIYVN

SEQ ID NO: 145649 - protein, 13 aa, Mycobacterium tuberculosis
LAAVQMGLIYVNP

SEQ ID NO: 145650 - protein, 13 aa, Mycobacterium tuberculosis
AAVQMGLIYVNPE

SEQ ID NO: 145651 - protein, 13 aa, Mycobacterium tuberculosis
AVQMGLIYVNPEG

SEQ ID NO: 145652 - protein, 13 aa, Mycobacterium tuberculosis
VQMGLIYVNPEGP

SEQ ID NO: 145653 - protein, 13 aa, Mycobacterium tuberculosis
QMGLIYVNPEGPN

SEQ ID NO: 145654 - protein, 13 aa, Mycobacterium tuberculosis
MGLIYVNPEGPNG

SEQ ID NO: 145655 - protein, 13 aa, Mycobacterium tuberculosis
GLIYVNPEGPNGN

SEQ ID NO: 145656 - protein, 13 aa, Mycobacterium tuberculosis
LIYVNPEGPNGNP

SEQ ID NO: 145657 - protein, 13 aa, Mycobacterium tuberculosis
IYVNPEGPNGNPD

SEQ ID NO: 145658 - protein, 13 aa, Mycobacterium tuberculosis
YVNPEGPNGNPDP

SEQ ID NO: 145659 - protein, 13 aa, Mycobacterium tuberculosis
VNPEGPNGNPDPM

SEQ ID NO: 145660 - protein, 13 aa, Mycobacterium tuberculosis
NPEGPNGNPDPMA

SEQ ID NO: 145661 - protein, 13 aa, Mycobacterium tuberculosis
PEGPNGNPDPMAA

SEQ ID NO: 145662 - protein, 13 aa, Mycobacterium tuberculosis
EGPNGNPDPMAAA

SEQ ID NO: 145663 - protein, 13 aa, Mycobacterium tuberculosis
GPNGNPDPMAAAV

SEQ ID NO: 145664 - protein, 13 aa, Mycobacterium tuberculosis
PNGNPDPMAAAVD

SEQ ID NO: 145665 - protein, 13 aa, Mycobacterium tuberculosis
NGNPDPMAAAVDI

SEQ ID NO: 145666 - protein, 13 aa, Mycobacterium tuberculosis
GNPDPMAAAVDIR

SEQ ID NO: 145667 - protein, 13 aa, Mycobacterium tuberculosis
NPDPMAAAVDIRE

SEQ ID NO: 145668 - protein, 13 aa, Mycobacterium tuberculosis
PDPMAAAVDIRET

SEQ ID NO: 145669 - protein, 13 aa, Mycobacterium tuberculosis
DPMAAAVDIRETF

SEQ ID NO: 145670 - protein, 13 aa, Mycobacterium tuberculosis
PMAAAVDIRETFR

SEQ ID NO: 145671 - protein, 13 aa, Mycobacterium tuberculosis
MAAAVDIRETFRR

SEQ ID NO: 145672 - protein, 13 aa, Mycobacterium tuberculosis
AAAVDIRETFRRM

SEQ ID NO: 145673 - protein, 13 aa, Mycobacterium tuberculosis
AAVDIRETFRRMA

SEQ ID NO: 145674 - protein, 13 aa, Mycobacterium tuberculosis
AVDIRETFRRMAM

SEQ ID NO: 145675 - protein, 13 aa, Mycobacterium tuberculosis
VDIRETFRRMAMN

SEQ ID NO: 145676 - protein, 13 aa, Mycobacterium tuberculosis
DIRETFRRMAMND

SEQ ID NO: 145677 - protein, 13 aa, Mycobacterium tuberculosis
IRETFRRMAMNDV

SEQ ID NO: 145678 - protein, 13 aa, Mycobacterium tuberculosis
RETFRRMAMNDVE

SEQ ID NO: 145679 - protein, 13 aa, Mycobacterium tuberculosis
ETFRRMAMNDVET

SEQ ID NO: 145680 - protein, 13 aa, Mycobacterium tuberculosis
TFRRMAMNDVETA

SEQ ID NO: 145681 - protein, 13 aa, Mycobacterium tuberculosis
FRRMAMNDVETAA

SEQ ID NO: 145682 - protein, 13 aa, Mycobacterium tuberculosis
RRMAMNDVETAAL

SEQ ID NO: 145683 - protein, 13 aa, Mycobacterium tuberculosis
RMAMNDVETAALI

SEQ ID NO: 145684 - protein, 13 aa, Mycobacterium tuberculosis
MAMNDVETAALIV

SEQ ID NO: 145685 - protein, 13 aa, Mycobacterium tuberculosis
AMNDVETAALIVG

SEQ ID NO: 145686 - protein, 13 aa, Mycobacterium tuberculosis
MNDVETAALIVGG

SEQ ID NO: 145687 - protein, 13 aa, Mycobacterium tuberculosis
NDVETAALIVGGH

SEQ ID NO: 145688 - protein, 13 aa, Mycobacterium tuberculosis
DVETAALIVGGHT

SEQ ID NO: 145689 - protein, 13 aa, Mycobacterium tuberculosis
VETAALIVGGHTF

SEQ ID NO: 145690 - protein, 13 aa, Mycobacterium tuberculosis
ETAALIVGGHTFG

SEQ ID NO: 145691 - protein, 13 aa, Mycobacterium tuberculosis
TAALIVGGHTFGK

SEQ ID NO: 145692 - protein, 13 aa, Mycobacterium tuberculosis
AALIVGGHTFGKT

SEQ ID NO: 145693 - protein, 13 aa, Mycobacterium tuberculosis
ALIVGGHTFGKTH

SEQ ID NO: 145694 - protein, 13 aa, Mycobacterium tuberculosis
LIVGGHTFGKTHG

SEQ ID NO: 145695 - protein, 13 aa, Mycobacterium tuberculosis
IVGGHTFGKTHGA

SEQ ID NO: 145696 - protein, 13 aa, Mycobacterium tuberculosis
VGGHTFGKTHGAG

SEQ ID NO: 145697 - protein, 13 aa, Mycobacterium tuberculosis
GGHTFGKTHGAGP

SEQ ID NO: 145698 - protein, 13 aa, Mycobacterium tuberculosis
GHTFGKTHGAGPA

SEQ ID NO: 145699 - protein, 13 aa, Mycobacterium tuberculosis
HTFGKTHGAGPAD

SEQ ID NO: 145700 - protein, 13 aa, Mycobacterium tuberculosis
TFGKTHGAGPADL

SEQ ID NO: 145701 - protein, 13 aa, Mycobacterium tuberculosis
FGKTHGAGPADLV

SEQ ID NO: 145702 - protein, 13 aa, Mycobacterium tuberculosis
GKTHGAGPADLVG

SEQ ID NO: 145703 - protein, 13 aa, Mycobacterium tuberculosis
KTHGAGPADLVGP

SEQ ID NO: 145704 - protein, 13 aa, Mycobacterium tuberculosis
THGAGPADLVGPE

SEQ ID NO: 145705 - protein, 13 aa, Mycobacterium tuberculosis
HGAGPADLVGPEP

SEQ ID NO: 145706 - protein, 13 aa, Mycobacterium tuberculosis
GAGPADLVGPEPE

SEQ ID NO: 145707 - protein, 13 aa, Mycobacterium tuberculosis
AGPADLVGPEPEA

SEQ ID NO: 145708 - protein, 13 aa, Mycobacterium tuberculosis
GPADLVGPEPEAA

SEQ ID NO: 145709 - protein, 13 aa, Mycobacterium tuberculosis
PADLVGPEPEAAP

SEQ ID NO: 145710 - protein, 13 aa, Mycobacterium tuberculosis
ADLVGPEPEAAPL

SEQ ID NO: 145711 - protein, 13 aa, Mycobacterium tuberculosis
DLVGPEPEAAPLE

SEQ ID NO: 145712 - protein, 13 aa, Mycobacterium tuberculosis
LVGPEPEAAPLEQ

SEQ ID NO: 145713 - protein, 13 aa, Mycobacterium tuberculosis
VGPEPEAAPLEQM

SEQ ID NO: 145714 - protein, 13 aa, Mycobacterium tuberculosis
GPEPEAAPLEQMG

SEQ ID NO: 145715 - protein, 13 aa, Mycobacterium tuberculosis
PEPEAAPLEQMGL

SEQ ID NO: 145716 - protein, 13 aa, Mycobacterium tuberculosis
EPEAAPLEQMGLG

SEQ ID NO: 145717 - protein, 13 aa, Mycobacterium tuberculosis
PEAAPLEQMGLGW

SEQ ID NO: 145718 - protein, 13 aa, Mycobacterium tuberculosis
EAAPLEQMGLGWK

SEQ ID NO: 145719 - protein, 13 aa, Mycobacterium tuberculosis
AAPLEQMGLGWKS

SEQ ID NO: 145720 - protein, 13 aa, Mycobacterium tuberculosis
APLEQMGLGWKSS

SEQ ID NO: 145721 - protein, 13 aa, Mycobacterium tuberculosis
PLEQMGLGWKSSY

SEQ ID NO: 145722 - protein, 13 aa, Mycobacterium tuberculosis
LEQMGLGWKSSYG

SEQ ID NO: 145723 - protein, 13 aa, Mycobacterium tuberculosis
EQMGLGWKSSYGT

SEQ ID NO: 145724 - protein, 13 aa, Mycobacterium tuberculosis
QMGLGWKSSYGTG

SEQ ID NO: 145725 - protein, 13 aa, Mycobacterium tuberculosis
MGLGWKSSYGTGT

SEQ ID NO: 145726 - protein, 13 aa, Mycobacterium tuberculosis
GLGWKSSYGTGTG

SEQ ID NO: 145727 - protein, 13 aa, Mycobacterium tuberculosis
LGWKSSYGTGTGK

SEQ ID NO: 145728 - protein, 13 aa, Mycobacterium tuberculosis
GWKSSYGTGTGKD

SEQ ID NO: 145729 - protein, 13 aa, Mycobacterium tuberculosis
WKSSYGTGTGKDA

SEQ ID NO: 145730 - protein, 13 aa, Mycobacterium tuberculosis
KSSYGTGTGKDAI

SEQ ID NO: 145731 - protein, 13 aa, Mycobacterium tuberculosis
SSYGTGTGKDAIT

SEQ ID NO: 145732 - protein, 13 aa, Mycobacterium tuberculosis
SYGTGTGKDAITS

SEQ ID NO: 145733 - protein, 13 aa, Mycobacterium tuberculosis
YGTGTGKDAITSG

SEQ ID NO: 145734 - protein, 13 aa, Mycobacterium tuberculosis
GTGTGKDAITSGI

SEQ ID NO: 145735 - protein, 13 aa, Mycobacterium tuberculosis
TGTGKDAITSGIE

SEQ ID NO: 145736 - protein, 13 aa, Mycobacterium tuberculosis
GTGKDAITSGIEV

SEQ ID NO: 145737 - protein, 13 aa, Mycobacterium tuberculosis
TGKDAITSGIEVV

SEQ ID NO: 145738 - protein, 13 aa, Mycobacterium tuberculosis
GKDAITSGIEVVW

SEQ ID NO: 145739 - protein, 13 aa, Mycobacterium tuberculosis
KDAITSGIEVVWT

SEQ ID NO: 145740 - protein, 13 aa, Mycobacterium tuberculosis
DAITSGIEVVWTN

SEQ ID NO: 145741 - protein, 13 aa, Mycobacterium tuberculosis
AITSGIEVVWTNT

SEQ ID NO: 145742 - protein, 13 aa, Mycobacterium tuberculosis
ITSGIEVVWTNTP

SEQ ID NO: 145743 - protein, 13 aa, Mycobacterium tuberculosis
TSGIEVVWTNTPT

SEQ ID NO: 145744 - protein, 13 aa, Mycobacterium tuberculosis
SGIEVVWTNTPTK

SEQ ID NO: 145745 - protein, 13 aa, Mycobacterium tuberculosis
GIEVVWTNTPTKW

SEQ ID NO: 145746 - protein, 13 aa, Mycobacterium tuberculosis
IEVVWTNTPTKWD

SEQ ID NO: 145747 - protein, 13 aa, Mycobacterium tuberculosis
EVVWTNTPTKWDN

SEQ ID NO: 145748 - protein, 13 aa, Mycobacterium tuberculosis
VVWTNTPTKWDNS

SEQ ID NO: 145749 - protein, 13 aa, Mycobacterium tuberculosis
VWTNTPTKWDNSF

SEQ ID NO: 145750 - protein, 13 aa, Mycobacterium tuberculosis
WTNTPTKWDNSFL

SEQ ID NO: 145751 - protein, 13 aa, Mycobacterium tuberculosis
TNTPTKWDNSFLE

SEQ ID NO: 145752 - protein, 13 aa, Mycobacterium tuberculosis
NTPTKWDNSFLEI

SEQ ID NO: 145753 - protein, 13 aa, Mycobacterium tuberculosis
TPTKWDNSFLEIL

SEQ ID NO: 145754 - protein, 13 aa, Mycobacterium tuberculosis
PTKWDNSFLEILY

SEQ ID NO: 145755 - protein, 13 aa, Mycobacterium tuberculosis
TKWDNSFLEILYG

SEQ ID NO: 145756 - protein, 13 aa, Mycobacterium tuberculosis
KWDNSFLEILYGY

SEQ ID NO: 145757 - protein, 13 aa, Mycobacterium tuberculosis
WDNSFLEILYGYE

SEQ ID NO: 145758 - protein, 13 aa, Mycobacterium tuberculosis
DNSFLEILYGYEW

SEQ ID NO: 145759 - protein, 13 aa, Mycobacterium tuberculosis
NSFLEILYGYEWE

SEQ ID NO: 145760 - protein, 13 aa, Mycobacterium tuberculosis
SFLEILYGYEWEL

SEQ ID NO: 145761 - protein, 13 aa, Mycobacterium tuberculosis
FLEILYGYEWELT

SEQ ID NO: 145762 - protein, 13 aa, Mycobacterium tuberculosis
LEILYGYEWELTK

SEQ ID NO: 145763 - protein, 13 aa, Mycobacterium tuberculosis
EILYGYEWELTKS

SEQ ID NO: 145764 - protein, 13 aa, Mycobacterium tuberculosis
ILYGYEWELTKSP

SEQ ID NO: 145765 - protein, 13 aa, Mycobacterium tuberculosis
LYGYEWELTKSPA

SEQ ID NO: 145766 - protein, 13 aa, Mycobacterium tuberculosis
YGYEWELTKSPAG

SEQ ID NO: 145767 - protein, 13 aa, Mycobacterium tuberculosis
GYEWELTKSPAGA

SEQ ID NO: 145768 - protein, 13 aa, Mycobacterium tuberculosis
YEWELTKSPAGAW

SEQ ID NO: 145769 - protein, 13 aa, Mycobacterium tuberculosis
EWELTKSPAGAWQ

SEQ ID NO: 145770 - protein, 13 aa, Mycobacterium tuberculosis
WELTKSPAGAWQY

SEQ ID NO: 145771 - protein, 13 aa, Mycobacterium tuberculosis
ELTKSPAGAWQYT

SEQ ID NO: 145772 - protein, 13 aa, Mycobacterium tuberculosis
LTKSPAGAWQYTA

SEQ ID NO: 145773 - protein, 13 aa, Mycobacterium tuberculosis
TKSPAGAWQYTAK

SEQ ID NO: 145774 - protein, 13 aa, Mycobacterium tuberculosis
KSPAGAWQYTAKD

SEQ ID NO: 145775 - protein, 13 aa, Mycobacterium tuberculosis
SPAGAWQYTAKDG

SEQ ID NO: 145776 - protein, 13 aa, Mycobacterium tuberculosis
PAGAWQYTAKDGA

SEQ ID NO: 145777 - protein, 13 aa, Mycobacterium tuberculosis
AGAWQYTAKDGAG

SEQ ID NO: 145778 - protein, 13 aa, Mycobacterium tuberculosis
GAWQYTAKDGAGA

SEQ ID NO: 145779 - protein, 13 aa, Mycobacterium tuberculosis
AWQYTAKDGAGAG

SEQ ID NO: 145780 - protein, 13 aa, Mycobacterium tuberculosis
WQYTAKDGAGAGT

SEQ ID NO: 145781 - protein, 13 aa, Mycobacterium tuberculosis
QYTAKDGAGAGTI

SEQ ID NO: 145782 - protein, 13 aa, Mycobacterium tuberculosis
YTAKDGAGAGTIP

SEQ ID NO: 145783 - protein, 13 aa, Mycobacterium tuberculosis
TAKDGAGAGTIPD

SEQ ID NO: 145784 - protein, 13 aa, Mycobacterium tuberculosis
AKDGAGAGTIPDP

SEQ ID NO: 145785 - protein, 13 aa, Mycobacterium tuberculosis
KDGAGAGTIPDPF

SEQ ID NO: 145786 - protein, 13 aa, Mycobacterium tuberculosis
DGAGAGTIPDPFG

SEQ ID NO: 145787 - protein, 13 aa, Mycobacterium tuberculosis
GAGAGTIPDPFGG

SEQ ID NO: 145788 - protein, 13 aa, Mycobacterium tuberculosis
AGAGTIPDPFGGP

SEQ ID NO: 145789 - protein, 13 aa, Mycobacterium tuberculosis
GAGTIPDPFGGPG

SEQ ID NO: 145790 - protein, 13 aa, Mycobacterium tuberculosis
AGTIPDPFGGPGR

SEQ ID NO: 145791 - protein, 13 aa, Mycobacterium tuberculosis
GTIPDPFGGPGRS

SEQ ID NO: 145792 - protein, 13 aa, Mycobacterium tuberculosis
TIPDPFGGPGRSP

SEQ ID NO: 145793 - protein, 13 aa, Mycobacterium tuberculosis
IPDPFGGPGRSPT

SEQ ID NO: 145794 - protein, 13 aa, Mycobacterium tuberculosis
PDPFGGPGRSPTM

SEQ ID NO: 145795 - protein, 13 aa, Mycobacterium tuberculosis
DPFGGPGRSPTML

SEQ ID NO: 145796 - protein, 13 aa, Mycobacterium tuberculosis
PFGGPGRSPTMLA

SEQ ID NO: 145797 - protein, 13 aa, Mycobacterium tuberculosis
FGGPGRSPTMLAT

SEQ ID NO: 145798 - protein, 13 aa, Mycobacterium tuberculosis
GGPGRSPTMLATD

SEQ ID NO: 145799 - protein, 13 aa, Mycobacterium tuberculosis
GPGRSPTMLATDL

SEQ ID NO: 145800 - protein, 13 aa, Mycobacterium tuberculosis
PGRSPTMLATDLS

SEQ ID NO: 145801 - protein, 13 aa, Mycobacterium tuberculosis
GRSPTMLATDLSL

SEQ ID NO: 145802 - protein, 13 aa, Mycobacterium tuberculosis
RSPTMLATDLSLR

SEQ ID NO: 145803 - protein, 13 aa, Mycobacterium tuberculosis
SPTMLATDLSLRV

SEQ ID NO: 145804 - protein, 13 aa, Mycobacterium tuberculosis
PTMLATDLSLRVD

SEQ ID NO: 145805 - protein, 13 aa, Mycobacterium tuberculosis
TMLATDLSLRVDP

SEQ ID NO: 145806 - protein, 13 aa, Mycobacterium tuberculosis
MLATDLSLRVDPI

SEQ ID NO: 145807 - protein, 13 aa, Mycobacterium tuberculosis
LATDLSLRVDPIY

SEQ ID NO: 145808 - protein, 13 aa, Mycobacterium tuberculosis
ATDLSLRVDPIYE

SEQ ID NO: 145809 - protein, 13 aa, Mycobacterium tuberculosis
TDLSLRVDPIYER

SEQ ID NO: 145810 - protein, 13 aa, Mycobacterium tuberculosis
DLSLRVDPIYERI

SEQ ID NO: 145811 - protein, 13 aa, Mycobacterium tuberculosis
LSLRVDPIYERIT

SEQ ID NO: 145812 - protein, 13 aa, Mycobacterium tuberculosis
SLRVDPIYERITR

SEQ ID NO: 145813 - protein, 13 aa, Mycobacterium tuberculosis
LRVDPIYERITRR

SEQ ID NO: 145814 - protein, 13 aa, Mycobacterium tuberculosis
RVDPIYERITRRW

SEQ ID NO: 145815 - protein, 13 aa, Mycobacterium tuberculosis
VDPIYERITRRWL

SEQ ID NO: 145816 - protein, 13 aa, Mycobacterium tuberculosis
DPIYERITRRWLE

SEQ ID NO: 145817 - protein, 13 aa, Mycobacterium tuberculosis
PIYERITRRWLEH

SEQ ID NO: 145818 - protein, 13 aa, Mycobacterium tuberculosis
IYERITRRWLEHP

SEQ ID NO: 145819 - protein, 13 aa, Mycobacterium tuberculosis
YERITRRWLEHPE

SEQ ID NO: 145820 - protein, 13 aa, Mycobacterium tuberculosis
ERITRRWLEHPEE

SEQ ID NO: 145821 - protein, 13 aa, Mycobacterium tuberculosis
RITRRWLEHPEEL

SEQ ID NO: 145822 - protein, 13 aa, Mycobacterium tuberculosis
ITRRWLEHPEELA

SEQ ID NO: 145823 - protein, 13 aa, Mycobacterium tuberculosis
TRRWLEHPEELAD

SEQ ID NO: 145824 - protein, 13 aa, Mycobacterium tuberculosis
RRWLEHPEELADE

SEQ ID NO: 145825 - protein, 13 aa, Mycobacterium tuberculosis
RWLEHPEELADEF

SEQ ID NO: 145826 - protein, 13 aa, Mycobacterium tuberculosis
WLEHPEELADEFA

SEQ ID NO: 145827 - protein, 13 aa, Mycobacterium tuberculosis
LEHPEELADEFAK

SEQ ID NO: 145828 - protein, 13 aa, Mycobacterium tuberculosis
EHPEELADEFAKA

SEQ ID NO: 145829 - protein, 13 aa, Mycobacterium tuberculosis
HPEELADEFAKAW

SEQ ID NO: 145830 - protein, 13 aa, Mycobacterium tuberculosis
PEELADEFAKAWY

SEQ ID NO: 145831 - protein, 13 aa, Mycobacterium tuberculosis
EELADEFAKAWYK

SEQ ID NO: 145832 - protein, 13 aa, Mycobacterium tuberculosis
ELADEFAKAWYKL

SEQ ID NO: 145833 - protein, 13 aa, Mycobacterium tuberculosis
LADEFAKAWYKLI

SEQ ID NO: 145834 - protein, 13 aa, Mycobacterium tuberculosis
ADEFAKAWYKLIH

SEQ ID NO: 145835 - protein, 13 aa, Mycobacterium tuberculosis
DEFAKAWYKLIHR

SEQ ID NO: 145836 - protein, 13 aa, Mycobacterium tuberculosis
EFAKAWYKLIHRD

SEQ ID NO: 145837 - protein, 13 aa, Mycobacterium tuberculosis
FAKAWYKLIHRDM

SEQ ID NO: 145838 - protein, 13 aa, Mycobacterium tuberculosis
AKAWYKLIHRDMG

SEQ ID NO: 145839 - protein, 13 aa, Mycobacterium tuberculosis
KAWYKLIHRDMGP

SEQ ID NO: 145840 - protein, 13 aa, Mycobacterium tuberculosis
AWYKLIHRDMGPV

SEQ ID NO: 145841 - protein, 13 aa, Mycobacterium tuberculosis
WYKLIHRDMGPVA

SEQ ID NO: 145842 - protein, 13 aa, Mycobacterium tuberculosis
YKLIHRDMGPVAR

SEQ ID NO: 145843 - protein, 13 aa, Mycobacterium tuberculosis
KLIHRDMGPVARY

SEQ ID NO: 145844 - protein, 13 aa, Mycobacterium tuberculosis
LIHRDMGPVARYL

SEQ ID NO: 145845 - protein, 13 aa, Mycobacterium tuberculosis
IHRDMGPVARYLG

SEQ ID NO: 145846 - protein, 13 aa, Mycobacterium tuberculosis
HRDMGPVARYLGP

SEQ ID NO: 145847 - protein, 13 aa, Mycobacterium tuberculosis
RDMGPVARYLGPL

SEQ ID NO: 145848 - protein, 13 aa, Mycobacterium tuberculosis
DMGPVARYLGPLV

SEQ ID NO: 145849 - protein, 13 aa, Mycobacterium tuberculosis
MGPVARYLGPLVP

SEQ ID NO: 145850 - protein, 13 aa, Mycobacterium tuberculosis
GPVARYLGPLVPK

SEQ ID NO: 145851 - protein, 13 aa, Mycobacterium tuberculosis
PVARYLGPLVPKQ

SEQ ID NO: 145852 - protein, 13 aa, Mycobacterium tuberculosis
VARYLGPLVPKQT

SEQ ID NO: 145853 - protein, 13 aa, Mycobacterium tuberculosis
ARYLGPLVPKQTL

SEQ ID NO: 145854 - protein, 13 aa, Mycobacterium tuberculosis
RYLGPLVPKQTLL

SEQ ID NO: 145855 - protein, 13 aa, Mycobacterium tuberculosis
YLGPLVPKQTLLW

SEQ ID NO: 145856 - protein, 13 aa, Mycobacterium tuberculosis
LGPLVPKQTLLWQ

SEQ ID NO: 145857 - protein, 13 aa, Mycobacterium tuberculosis
GPLVPKQTLLWQD

SEQ ID NO: 145858 - protein, 13 aa, Mycobacterium tuberculosis
PLVPKQTLLWQDP

SEQ ID NO: 145859 - protein, 13 aa, Mycobacterium tuberculosis
LVPKQTLLWQDPV

SEQ ID NO: 145860 - protein, 13 aa, Mycobacterium tuberculosis
VPKQTLLWQDPVP

SEQ ID NO: 145861 - protein, 13 aa, Mycobacterium tuberculosis
PKQTLLWQDPVPA

SEQ ID NO: 145862 - protein, 13 aa, Mycobacterium tuberculosis
KQTLLWQDPVPAV

SEQ ID NO: 145863 - protein, 13 aa, Mycobacterium tuberculosis
QTLLWQDPVPAVS

SEQ ID NO: 145864 - protein, 13 aa, Mycobacterium tuberculosis
TLLWQDPVPAVSH

SEQ ID NO: 145865 - protein, 13 aa, Mycobacterium tuberculosis
LLWQDPVPAVSHD

SEQ ID NO: 145866 - protein, 13 aa, Mycobacterium tuberculosis
LWQDPVPAVSHDL

SEQ ID NO: 145867 - protein, 13 aa, Mycobacterium tuberculosis
WQDPVPAVSHDLV

SEQ ID NO: 145868 - protein, 13 aa, Mycobacterium tuberculosis
QDPVPAVSHDLVG

SEQ ID NO: 145869 - protein, 13 aa, Mycobacterium tuberculosis
DPVPAVSHDLVGE

SEQ ID NO: 145870 - protein, 13 aa, Mycobacterium tuberculosis
PVPAVSHDLVGEA

SEQ ID NO: 145871 - protein, 13 aa, Mycobacterium tuberculosis
VPAVSHDLVGEAE

SEQ ID NO: 145872 - protein, 13 aa, Mycobacterium tuberculosis
PAVSHDLVGEAEI

SEQ ID NO: 145873 - protein, 13 aa, Mycobacterium tuberculosis
AVSHDLVGEAEIA

SEQ ID NO: 145874 - protein, 13 aa, Mycobacterium tuberculosis
VSHDLVGEAEIAS

SEQ ID NO: 145875 - protein, 13 aa, Mycobacterium tuberculosis
SHDLVGEAEIASL

SEQ ID NO: 145876 - protein, 13 aa, Mycobacterium tuberculosis
HDLVGEAEIASLK

SEQ ID NO: 145877 - protein, 13 aa, Mycobacterium tuberculosis
DLVGEAEIASLKS

SEQ ID NO: 145878 - protein, 13 aa, Mycobacterium tuberculosis
LVGEAEIASLKSQ

SEQ ID NO: 145879 - protein, 13 aa, Mycobacterium tuberculosis
VGEAEIASLKSQI

SEQ ID NO: 145880 - protein, 13 aa, Mycobacterium tuberculosis
GEAEIASLKSQIR

SEQ ID NO: 145881 - protein, 13 aa, Mycobacterium tuberculosis
EAEIASLKSQIRA

SEQ ID NO: 145882 - protein, 13 aa, Mycobacterium tuberculosis
AEIASLKSQIRAS

SEQ ID NO: 145883 - protein, 13 aa, Mycobacterium tuberculosis
EIASLKSQIRASG

SEQ ID NO: 145884 - protein, 13 aa, Mycobacterium tuberculosis
IASLKSQIRASGL

SEQ ID NO: 145885 - protein, 13 aa, Mycobacterium tuberculosis
ASLKSQIRASGLT

SEQ ID NO: 145886 - protein, 13 aa, Mycobacterium tuberculosis
SLKSQIRASGLTV

SEQ ID NO: 145887 - protein, 13 aa, Mycobacterium tuberculosis
LKSQIRASGLTVS

SEQ ID NO: 145888 - protein, 13 aa, Mycobacterium tuberculosis
KSQIRASGLTVSQ

SEQ ID NO: 145889 - protein, 13 aa, Mycobacterium tuberculosis
SQIRASGLTVSQL

SEQ ID NO: 145890 - protein, 13 aa, Mycobacterium tuberculosis
QIRASGLTVSQLV

SEQ ID NO: 145891 - protein, 13 aa, Mycobacterium tuberculosis
IRASGLTVSQLVS

SEQ ID NO: 145892 - protein, 13 aa, Mycobacterium tuberculosis
RASGLTVSQLVST

SEQ ID NO: 145893 - protein, 13 aa, Mycobacterium tuberculosis
ASGLTVSQLVSTA

SEQ ID NO: 145894 - protein, 13 aa, Mycobacterium tuberculosis
SGLTVSQLVSTAW

SEQ ID NO: 145895 - protein, 13 aa, Mycobacterium tuberculosis
GLTVSQLVSTAWA

SEQ ID NO: 145896 - protein, 13 aa, Mycobacterium tuberculosis
LTVSQLVSTAWAA

SEQ ID NO: 145897 - protein, 13 aa, Mycobacterium tuberculosis
TVSQLVSTAWAAA

SEQ ID NO: 145898 - protein, 13 aa, Mycobacterium tuberculosis
VSQLVSTAWAAAS

SEQ ID NO: 145899 - protein, 13 aa, Mycobacterium tuberculosis
SQLVSTAWAAASS

SEQ ID NO: 145900 - protein, 13 aa, Mycobacterium tuberculosis
QLVSTAWAAASSF

SEQ ID NO: 145901 - protein, 13 aa, Mycobacterium tuberculosis
LVSTAWAAASSFR

SEQ ID NO: 145902 - protein, 13 aa, Mycobacterium tuberculosis
VSTAWAAASSFRG

SEQ ID NO: 145903 - protein, 13 aa, Mycobacterium tuberculosis
STAWAAASSFRGS

SEQ ID NO: 145904 - protein, 13 aa, Mycobacterium tuberculosis
TAWAAASSFRGSD

SEQ ID NO: 145905 - protein, 13 aa, Mycobacterium tuberculosis
AWAAASSFRGSDK

SEQ ID NO: 145906 - protein, 13 aa, Mycobacterium tuberculosis
WAAASSFRGSDKR

SEQ ID NO: 145907 - protein, 13 aa, Mycobacterium tuberculosis
AAASSFRGSDKRG

SEQ ID NO: 145908 - protein, 13 aa, Mycobacterium tuberculosis
AASSFRGSDKRGG

SEQ ID NO: 145909 - protein, 13 aa, Mycobacterium tuberculosis
ASSFRGSDKRGGA

SEQ ID NO: 145910 - protein, 13 aa, Mycobacterium tuberculosis
SSFRGSDKRGGAN

SEQ ID NO: 145911 - protein, 13 aa, Mycobacterium tuberculosis
SFRGSDKRGGANG

SEQ ID NO: 145912 - protein, 13 aa, Mycobacterium tuberculosis
FRGSDKRGGANGG

SEQ ID NO: 145913 - protein, 13 aa, Mycobacterium tuberculosis
RGSDKRGGANGGR

SEQ ID NO: 145914 - protein, 13 aa, Mycobacterium tuberculosis
GSDKRGGANGGRI

SEQ ID NO: 145915 - protein, 13 aa, Mycobacterium tuberculosis
SDKRGGANGGRIR

SEQ ID NO: 145916 - protein, 13 aa, Mycobacterium tuberculosis
DKRGGANGGRIRL

SEQ ID NO: 145917 - protein, 13 aa, Mycobacterium tuberculosis
KRGGANGGRIRLQ

SEQ ID NO: 145918 - protein, 13 aa, Mycobacterium tuberculosis
RGGANGGRIRLQP

SEQ ID NO: 145919 - protein, 13 aa, Mycobacterium tuberculosis
GGANGGRIRLQPQ

SEQ ID NO: 145920 - protein, 13 aa, Mycobacterium tuberculosis
GANGGRIRLQPQV

SEQ ID NO: 145921 - protein, 13 aa, Mycobacterium tuberculosis
ANGGRIRLQPQVG

SEQ ID NO: 145922 - protein, 13 aa, Mycobacterium tuberculosis
NGGRIRLQPQVGW

SEQ ID NO: 145923 - protein, 13 aa, Mycobacterium tuberculosis
GGRIRLQPQVGWE

SEQ ID NO: 145924 - protein, 13 aa, Mycobacterium tuberculosis
GRIRLQPQVGWEV

SEQ ID NO: 145925 - protein, 13 aa, Mycobacterium tuberculosis
RIRLQPQVGWEVN

SEQ ID NO: 145926 - protein, 13 aa, Mycobacterium tuberculosis
IRLQPQVGWEVND

SEQ ID NO: 145927 - protein, 13 aa, Mycobacterium tuberculosis
RLQPQVGWEVNDP

SEQ ID NO: 145928 - protein, 13 aa, Mycobacterium tuberculosis
LQPQVGWEVNDPD

SEQ ID NO: 145929 - protein, 13 aa, Mycobacterium tuberculosis
QPQVGWEVNDPDG

SEQ ID NO: 145930 - protein, 13 aa, Mycobacterium tuberculosis
PQVGWEVNDPDGD

SEQ ID NO: 145931 - protein, 13 aa, Mycobacterium tuberculosis
QVGWEVNDPDGDL

SEQ ID NO: 145932 - protein, 13 aa, Mycobacterium tuberculosis
VGWEVNDPDGDLR

SEQ ID NO: 145933 - protein, 13 aa, Mycobacterium tuberculosis
GWEVNDPDGDLRK

SEQ ID NO: 145934 - protein, 13 aa, Mycobacterium tuberculosis
WEVNDPDGDLRKV

SEQ ID NO: 145935 - protein, 13 aa, Mycobacterium tuberculosis
EVNDPDGDLRKVI

SEQ ID NO: 145936 - protein, 13 aa, Mycobacterium tuberculosis
VNDPDGDLRKVIR

SEQ ID NO: 145937 - protein, 13 aa, Mycobacterium tuberculosis
NDPDGDLRKVIRT

SEQ ID NO: 145938 - protein, 13 aa, Mycobacterium tuberculosis
DPDGDLRKVIRTL

SEQ ID NO: 145939 - protein, 13 aa, Mycobacterium tuberculosis
PDGDLRKVIRTLE

SEQ ID NO: 145940 - protein, 13 aa, Mycobacterium tuberculosis
DGDLRKVIRTLEE

SEQ ID NO: 145941 - protein, 13 aa, Mycobacterium tuberculosis
GDLRKVIRTLEEI

SEQ ID NO: 145942 - protein, 13 aa, Mycobacterium tuberculosis
DLRKVIRTLEEIQ

SEQ ID NO: 145943 - protein, 13 aa, Mycobacterium tuberculosis
LRKVIRTLEEIQE

SEQ ID NO: 145944 - protein, 13 aa, Mycobacterium tuberculosis
RKVIRTLEEIQES

SEQ ID NO: 145945 - protein, 13 aa, Mycobacterium tuberculosis
KVIRTLEEIQESF

SEQ ID NO: 145946 - protein, 13 aa, Mycobacterium tuberculosis
VIRTLEEIQESFN

SEQ ID NO: 145947 - protein, 13 aa, Mycobacterium tuberculosis
IRTLEEIQESFNS

SEQ ID NO: 145948 - protein, 13 aa, Mycobacterium tuberculosis
RTLEEIQESFNSA

SEQ ID NO: 145949 - protein, 13 aa, Mycobacterium tuberculosis
TLEEIQESFNSAA

SEQ ID NO: 145950 - protein, 13 aa, Mycobacterium tuberculosis
LEEIQESFNSAAP

SEQ ID NO: 145951 - protein, 13 aa, Mycobacterium tuberculosis
EEIQESFNSAAPG

SEQ ID NO: 145952 - protein, 13 aa, Mycobacterium tuberculosis
EIQESFNSAAPGN

SEQ ID NO: 145953 - protein, 13 aa, Mycobacterium tuberculosis
IQESFNSAAPGNI

SEQ ID NO: 145954 - protein, 13 aa, Mycobacterium tuberculosis
QESFNSAAPGNIK

SEQ ID NO: 145955 - protein, 13 aa, Mycobacterium tuberculosis
ESFNSAAPGNIKV

SEQ ID NO: 145956 - protein, 13 aa, Mycobacterium tuberculosis
SFNSAAPGNIKVS

SEQ ID NO: 145957 - protein, 13 aa, Mycobacterium tuberculosis
FNSAAPGNIKVSF

SEQ ID NO: 145958 - protein, 13 aa, Mycobacterium tuberculosis
NSAAPGNIKVSFA

SEQ ID NO: 145959 - protein, 13 aa, Mycobacterium tuberculosis
SAAPGNIKVSFAD

SEQ ID NO: 145960 - protein, 13 aa, Mycobacterium tuberculosis
AAPGNIKVSFADL

SEQ ID NO: 145961 - protein, 13 aa, Mycobacterium tuberculosis
APGNIKVSFADLV

SEQ ID NO: 145962 - protein, 13 aa, Mycobacterium tuberculosis
PGNIKVSFADLVV

SEQ ID NO: 145963 - protein, 13 aa, Mycobacterium tuberculosis
GNIKVSFADLVVL

SEQ ID NO: 145964 - protein, 13 aa, Mycobacterium tuberculosis
NIKVSFADLVVLG

SEQ ID NO: 145965 - protein, 13 aa, Mycobacterium tuberculosis
IKVSFADLVVLGG

SEQ ID NO: 145966 - protein, 13 aa, Mycobacterium tuberculosis
KVSFADLVVLGGC

SEQ ID NO: 145967 - protein, 13 aa, Mycobacterium tuberculosis
VSFADLVVLGGCA

SEQ ID NO: 145968 - protein, 13 aa, Mycobacterium tuberculosis
SFADLVVLGGCAA

SEQ ID NO: 145969 - protein, 13 aa, Mycobacterium tuberculosis
FADLVVLGGCAAI

SEQ ID NO: 145970 - protein, 13 aa, Mycobacterium tuberculosis
ADLVVLGGCAAIE

SEQ ID NO: 145971 - protein, 13 aa, Mycobacterium tuberculosis
DLVVLGGCAAIEK

SEQ ID NO: 145972 - protein, 13 aa, Mycobacterium tuberculosis
LVVLGGCAAIEKA

SEQ ID NO: 145973 - protein, 13 aa, Mycobacterium tuberculosis
VVLGGCAAIEKAA

SEQ ID NO: 145974 - protein, 13 aa, Mycobacterium tuberculosis
VLGGCAAIEKAAK

SEQ ID NO: 145975 - protein, 13 aa, Mycobacterium tuberculosis
LGGCAAIEKAAKA

SEQ ID NO: 145976 - protein, 13 aa, Mycobacterium tuberculosis
GGCAAIEKAAKAA

SEQ ID NO: 145977 - protein, 13 aa, Mycobacterium tuberculosis
GCAAIEKAAKAAG

SEQ ID NO: 145978 - protein, 13 aa, Mycobacterium tuberculosis
CAAIEKAAKAAGH

SEQ ID NO: 145979 - protein, 13 aa, Mycobacterium tuberculosis
AAIEKAAKAAGHN

SEQ ID NO: 145980 - protein, 13 aa, Mycobacterium tuberculosis
AIEKAAKAAGHNI

SEQ ID NO: 145981 - protein, 13 aa, Mycobacterium tuberculosis
IEKAAKAAGHNIT

SEQ ID NO: 145982 - protein, 13 aa, Mycobacterium tuberculosis
EKAAKAAGHNITV

SEQ ID NO: 145983 - protein, 13 aa, Mycobacterium tuberculosis
KAAKAAGHNITVP

SEQ ID NO: 145984 - protein, 13 aa, Mycobacterium tuberculosis
AAKAAGHNITVPF

SEQ ID NO: 145985 - protein, 13 aa, Mycobacterium tuberculosis
AKAAGHNITVPFT

SEQ ID NO: 145986 - protein, 13 aa, Mycobacterium tuberculosis
KAAGHNITVPFTP

SEQ ID NO: 145987 - protein, 13 aa, Mycobacterium tuberculosis
AAGHNITVPFTPG

SEQ ID NO: 145988 - protein, 13 aa, Mycobacterium tuberculosis
AGHNITVPFTPGR

SEQ ID NO: 145989 - protein, 13 aa, Mycobacterium tuberculosis
GHNITVPFTPGRT

SEQ ID NO: 145990 - protein, 13 aa, Mycobacterium tuberculosis
HNITVPFTPGRTD

SEQ ID NO: 145991 - protein, 13 aa, Mycobacterium tuberculosis
NITVPFTPGRTDA

SEQ ID NO: 145992 - protein, 13 aa, Mycobacterium tuberculosis
ITVPFTPGRTDAS

SEQ ID NO: 145993 - protein, 13 aa, Mycobacterium tuberculosis
TVPFTPGRTDASQ

SEQ ID NO: 145994 - protein, 13 aa, Mycobacterium tuberculosis
VPFTPGRTDASQE

SEQ ID NO: 145995 - protein, 13 aa, Mycobacterium tuberculosis
PFTPGRTDASQEQ

SEQ ID NO: 145996 - protein, 13 aa, Mycobacterium tuberculosis
FTPGRTDASQEQT

SEQ ID NO: 145997 - protein, 13 aa, Mycobacterium tuberculosis
TPGRTDASQEQTD

SEQ ID NO: 145998 - protein, 13 aa, Mycobacterium tuberculosis
PGRTDASQEQTDV

SEQ ID NO: 145999 - protein, 13 aa, Mycobacterium tuberculosis
GRTDASQEQTDVE

SEQ ID NO: 146000 - protein, 13 aa, Mycobacterium tuberculosis
RTDASQEQTDVES

SEQ ID NO: 146001 - protein, 13 aa, Mycobacterium tuberculosis
TDASQEQTDVESF

SEQ ID NO: 146002 - protein, 13 aa, Mycobacterium tuberculosis
DASQEQTDVESFA

SEQ ID NO: 146003 - protein, 13 aa, Mycobacterium tuberculosis
ASQEQTDVESFAV

SEQ ID NO: 146004 - protein, 13 aa, Mycobacterium tuberculosis
SQEQTDVESFAVL

SEQ ID NO: 146005 - protein, 13 aa, Mycobacterium tuberculosis
QEQTDVESFAVLE

SEQ ID NO: 146006 - protein, 13 aa, Mycobacterium tuberculosis
EQTDVESFAVLEP

SEQ ID NO: 146007 - protein, 13 aa, Mycobacterium tuberculosis
QTDVESFAVLEPK

SEQ ID NO: 146008 - protein, 13 aa, Mycobacterium tuberculosis
TDVESFAVLEPKA

SEQ ID NO: 146009 - protein, 13 aa, Mycobacterium tuberculosis
DVESFAVLEPKAD

SEQ ID NO: 146010 - protein, 13 aa, Mycobacterium tuberculosis
VESFAVLEPKADG

SEQ ID NO: 146011 - protein, 13 aa, Mycobacterium tuberculosis
ESFAVLEPKADGF

SEQ ID NO: 146012 - protein, 13 aa, Mycobacterium tuberculosis
SFAVLEPKADGFR

SEQ ID NO: 146013 - protein, 13 aa, Mycobacterium tuberculosis
FAVLEPKADGFRN

SEQ ID NO: 146014 - protein, 13 aa, Mycobacterium tuberculosis
AVLEPKADGFRNY

SEQ ID NO: 146015 - protein, 13 aa, Mycobacterium tuberculosis
VLEPKADGFRNYL

SEQ ID NO: 146016 - protein, 13 aa, Mycobacterium tuberculosis
LEPKADGFRNYLG

SEQ ID NO: 146017 - protein, 13 aa, Mycobacterium tuberculosis
EPKADGFRNYLGK

SEQ ID NO: 146018 - protein, 13 aa, Mycobacterium tuberculosis
PKADGFRNYLGKG

SEQ ID NO: 146019 - protein, 13 aa, Mycobacterium tuberculosis
KADGFRNYLGKGN

SEQ ID NO: 146020 - protein, 13 aa, Mycobacterium tuberculosis
ADGFRNYLGKGNP

SEQ ID NO: 146021 - protein, 13 aa, Mycobacterium tuberculosis
DGFRNYLGKGNPL

SEQ ID NO: 146022 - protein, 13 aa, Mycobacterium tuberculosis
GFRNYLGKGNPLP

SEQ ID NO: 146023 - protein, 13 aa, Mycobacterium tuberculosis
FRNYLGKGNPLPA

SEQ ID NO: 146024 - protein, 13 aa, Mycobacterium tuberculosis
RNYLGKGNPLPAE

SEQ ID NO: 146025 - protein, 13 aa, Mycobacterium tuberculosis
NYLGKGNPLPAEY

SEQ ID NO: 146026 - protein, 13 aa, Mycobacterium tuberculosis
YLGKGNPLPAEYM

SEQ ID NO: 146027 - protein, 13 aa, Mycobacterium tuberculosis
LGKGNPLPAEYML

SEQ ID NO: 146028 - protein, 13 aa, Mycobacterium tuberculosis
GKGNPLPAEYMLL

SEQ ID NO: 146029 - protein, 13 aa, Mycobacterium tuberculosis
KGNPLPAEYMLLD

SEQ ID NO: 146030 - protein, 13 aa, Mycobacterium tuberculosis
GNPLPAEYMLLDK

SEQ ID NO: 146031 - protein, 13 aa, Mycobacterium tuberculosis
NPLPAEYMLLDKA

SEQ ID NO: 146032 - protein, 13 aa, Mycobacterium tuberculosis
PLPAEYMLLDKAN

SEQ ID NO: 146033 - protein, 13 aa, Mycobacterium tuberculosis
LPAEYMLLDKANL

SEQ ID NO: 146034 - protein, 13 aa, Mycobacterium tuberculosis
PAEYMLLDKANLL

SEQ ID NO: 146035 - protein, 13 aa, Mycobacterium tuberculosis
AEYMLLDKANLLT

SEQ ID NO: 146036 - protein, 13 aa, Mycobacterium tuberculosis
EYMLLDKANLLTL

SEQ ID NO: 146037 - protein, 13 aa, Mycobacterium tuberculosis
YMLLDKANLLTLS

SEQ ID NO: 146038 - protein, 13 aa, Mycobacterium tuberculosis
MLLDKANLLTLSA

SEQ ID NO: 146039 - protein, 13 aa, Mycobacterium tuberculosis
LLDKANLLTLSAP

SEQ ID NO: 146040 - protein, 13 aa, Mycobacterium tuberculosis
LDKANLLTLSAPE

SEQ ID NO: 146041 - protein, 13 aa, Mycobacterium tuberculosis
DKANLLTLSAPEM

SEQ ID NO: 146042 - protein, 13 aa, Mycobacterium tuberculosis
KANLLTLSAPEMT

SEQ ID NO: 146043 - protein, 13 aa, Mycobacterium tuberculosis
ANLLTLSAPEMTV

SEQ ID NO: 146044 - protein, 13 aa, Mycobacterium tuberculosis
NLLTLSAPEMTVL

SEQ ID NO: 146045 - protein, 13 aa, Mycobacterium tuberculosis
LLTLSAPEMTVLV

SEQ ID NO: 146046 - protein, 13 aa, Mycobacterium tuberculosis
LTLSAPEMTVLVG

SEQ ID NO: 146047 - protein, 13 aa, Mycobacterium tuberculosis
TLSAPEMTVLVGG

SEQ ID NO: 146048 - protein, 13 aa, Mycobacterium tuberculosis
LSAPEMTVLVGGL

SEQ ID NO: 146049 - protein, 13 aa, Mycobacterium tuberculosis
SAPEMTVLVGGLR

SEQ ID NO: 146050 - protein, 13 aa, Mycobacterium tuberculosis
APEMTVLVGGLRV

SEQ ID NO: 146051 - protein, 13 aa, Mycobacterium tuberculosis
PEMTVLVGGLRVL

SEQ ID NO: 146052 - protein, 13 aa, Mycobacterium tuberculosis
EMTVLVGGLRVLG

SEQ ID NO: 146053 - protein, 13 aa, Mycobacterium tuberculosis
MTVLVGGLRVLGA

SEQ ID NO: 146054 - protein, 13 aa, Mycobacterium tuberculosis
TVLVGGLRVLGAN

SEQ ID NO: 146055 - protein, 13 aa, Mycobacterium tuberculosis
VLVGGLRVLGANY

SEQ ID NO: 146056 - protein, 13 aa, Mycobacterium tuberculosis
LVGGLRVLGANYK

SEQ ID NO: 146057 - protein, 13 aa, Mycobacterium tuberculosis
VGGLRVLGANYKR

SEQ ID NO: 146058 - protein, 13 aa, Mycobacterium tuberculosis
GGLRVLGANYKRL

SEQ ID NO: 146059 - protein, 13 aa, Mycobacterium tuberculosis
GLRVLGANYKRLP

SEQ ID NO: 146060 - protein, 13 aa, Mycobacterium tuberculosis
LRVLGANYKRLPL

SEQ ID NO: 146061 - protein, 13 aa, Mycobacterium tuberculosis
RVLGANYKRLPLG

SEQ ID NO: 146062 - protein, 13 aa, Mycobacterium tuberculosis
VLGANYKRLPLGV

SEQ ID NO: 146063 - protein, 13 aa, Mycobacterium tuberculosis
LGANYKRLPLGVF

SEQ ID NO: 146064 - protein, 13 aa, Mycobacterium tuberculosis
GANYKRLPLGVFT

SEQ ID NO: 146065 - protein, 13 aa, Mycobacterium tuberculosis
ANYKRLPLGVFTE

SEQ ID NO: 146066 - protein, 13 aa, Mycobacterium tuberculosis
NYKRLPLGVFTEA

SEQ ID NO: 146067 - protein, 13 aa, Mycobacterium tuberculosis
YKRLPLGVFTEAS

SEQ ID NO: 146068 - protein, 13 aa, Mycobacterium tuberculosis
KRLPLGVFTEASE

SEQ ID NO: 146069 - protein, 13 aa, Mycobacterium tuberculosis
RLPLGVFTEASES

SEQ ID NO: 146070 - protein, 13 aa, Mycobacterium tuberculosis
LPLGVFTEASESL

SEQ ID NO: 146071 - protein, 13 aa, Mycobacterium tuberculosis
PLGVFTEASESLT

SEQ ID NO: 146072 - protein, 13 aa, Mycobacterium tuberculosis
LGVFTEASESLTN

SEQ ID NO: 146073 - protein, 13 aa, Mycobacterium tuberculosis
GVFTEASESLTND

SEQ ID NO: 146074 - protein, 13 aa, Mycobacterium tuberculosis
VFTEASESLTNDF

SEQ ID NO: 146075 - protein, 13 aa, Mycobacterium tuberculosis
FTEASESLTNDFF

SEQ ID NO: 146076 - protein, 13 aa, Mycobacterium tuberculosis
TEASESLTNDFFV

SEQ ID NO: 146077 - protein, 13 aa, Mycobacterium tuberculosis
EASESLTNDFFVN

SEQ ID NO: 146078 - protein, 13 aa, Mycobacterium tuberculosis
ASESLTNDFFVNL

SEQ ID NO: 146079 - protein, 13 aa, Mycobacterium tuberculosis
SESLTNDFFVNLL

SEQ ID NO: 146080 - protein, 13 aa, Mycobacterium tuberculosis
ESLTNDFFVNLLD

SEQ ID NO: 146081 - protein, 13 aa, Mycobacterium tuberculosis
SLTNDFFVNLLDM

SEQ ID NO: 146082 - protein, 13 aa, Mycobacterium tuberculosis
LTNDFFVNLLDMG

SEQ ID NO: 146083 - protein, 13 aa, Mycobacterium tuberculosis
TNDFFVNLLDMGI

SEQ ID NO: 146084 - protein, 13 aa, Mycobacterium tuberculosis
NDFFVNLLDMGIT

SEQ ID NO: 146085 - protein, 13 aa, Mycobacterium tuberculosis
DFFVNLLDMGITW

SEQ ID NO: 146086 - protein, 13 aa, Mycobacterium tuberculosis
FFVNLLDMGITWE

SEQ ID NO: 146087 - protein, 13 aa, Mycobacterium tuberculosis
FVNLLDMGITWEP

SEQ ID NO: 146088 - protein, 13 aa, Mycobacterium tuberculosis
VNLLDMGITWEPS

SEQ ID NO: 146089 - protein, 13 aa, Mycobacterium tuberculosis
NLLDMGITWEPSP

SEQ ID NO: 146090 - protein, 13 aa, Mycobacterium tuberculosis
LLDMGITWEPSPA

SEQ ID NO: 146091 - protein, 13 aa, Mycobacterium tuberculosis
LDMGITWEPSPAD

SEQ ID NO: 146092 - protein, 13 aa, Mycobacterium tuberculosis
DMGITWEPSPADD

SEQ ID NO: 146093 - protein, 13 aa, Mycobacterium tuberculosis
MGITWEPSPADDG

SEQ ID NO: 146094 - protein, 13 aa, Mycobacterium tuberculosis
GITWEPSPADDGT

SEQ ID NO: 146095 - protein, 13 aa, Mycobacterium tuberculosis
ITWEPSPADDGTY

SEQ ID NO: 146096 - protein, 13 aa, Mycobacterium tuberculosis
TWEPSPADDGTYQ

SEQ ID NO: 146097 - protein, 13 aa, Mycobacterium tuberculosis
WEPSPADDGTYQG

SEQ ID NO: 146098 - protein, 13 aa, Mycobacterium tuberculosis
EPSPADDGTYQGK

SEQ ID NO: 146099 - protein, 13 aa, Mycobacterium tuberculosis
PSPADDGTYQGKD

SEQ ID NO: 146100 - protein, 13 aa, Mycobacterium tuberculosis
SPADDGTYQGKDG

SEQ ID NO: 146101 - protein, 13 aa, Mycobacterium tuberculosis
PADDGTYQGKDGS

SEQ ID NO: 146102 - protein, 13 aa, Mycobacterium tuberculosis
ADDGTYQGKDGSG

SEQ ID NO: 146103 - protein, 13 aa, Mycobacterium tuberculosis
DDGTYQGKDGSGK

SEQ ID NO: 146104 - protein, 13 aa, Mycobacterium tuberculosis
DGTYQGKDGSGKV

SEQ ID NO: 146105 - protein, 13 aa, Mycobacterium tuberculosis
GTYQGKDGSGKVK

SEQ ID NO: 146106 - protein, 13 aa, Mycobacterium tuberculosis
TYQGKDGSGKVKW

SEQ ID NO: 146107 - protein, 13 aa, Mycobacterium tuberculosis
YQGKDGSGKVKWT

SEQ ID NO: 146108 - protein, 13 aa, Mycobacterium tuberculosis
QGKDGSGKVKWTG

SEQ ID NO: 146109 - protein, 13 aa, Mycobacterium tuberculosis
GKDGSGKVKWTGS

SEQ ID NO: 146110 - protein, 13 aa, Mycobacterium tuberculosis
KDGSGKVKWTGSR

SEQ ID NO: 146111 - protein, 13 aa, Mycobacterium tuberculosis
DGSGKVKWTGSRV

SEQ ID NO: 146112 - protein, 13 aa, Mycobacterium tuberculosis
GSGKVKWTGSRVD

SEQ ID NO: 146113 - protein, 13 aa, Mycobacterium tuberculosis
SGKVKWTGSRVDL

SEQ ID NO: 146114 - protein, 13 aa, Mycobacterium tuberculosis
GKVKWTGSRVDLV

SEQ ID NO: 146115 - protein, 13 aa, Mycobacterium tuberculosis
KVKWTGSRVDLVF

SEQ ID NO: 146116 - protein, 13 aa, Mycobacterium tuberculosis
VKWTGSRVDLVFG

SEQ ID NO: 146117 - protein, 13 aa, Mycobacterium tuberculosis
KWTGSRVDLVFGS

SEQ ID NO: 146118 - protein, 13 aa, Mycobacterium tuberculosis
WTGSRVDLVFGSN

SEQ ID NO: 146119 - protein, 13 aa, Mycobacterium tuberculosis
TGSRVDLVFGSNS

SEQ ID NO: 146120 - protein, 13 aa, Mycobacterium tuberculosis
GSRVDLVFGSNSE

SEQ ID NO: 146121 - protein, 13 aa, Mycobacterium tuberculosis
SRVDLVFGSNSEL

SEQ ID NO: 146122 - protein, 13 aa, Mycobacterium tuberculosis
RVDLVFGSNSELR

SEQ ID NO: 146123 - protein, 13 aa, Mycobacterium tuberculosis
VDLVFGSNSELRA

SEQ ID NO: 146124 - protein, 13 aa, Mycobacterium tuberculosis
DLVFGSNSELRAL

SEQ ID NO: 146125 - protein, 13 aa, Mycobacterium tuberculosis
LVFGSNSELRALV

SEQ ID NO: 146126 - protein, 13 aa, Mycobacterium tuberculosis
VFGSNSELRALVE

SEQ ID NO: 146127 - protein, 13 aa, Mycobacterium tuberculosis
FGSNSELRALVEV

SEQ ID NO: 146128 - protein, 13 aa, Mycobacterium tuberculosis
GSNSELRALVEVY

SEQ ID NO: 146129 - protein, 13 aa, Mycobacterium tuberculosis
SNSELRALVEVYG

SEQ ID NO: 146130 - protein, 13 aa, Mycobacterium tuberculosis
NSELRALVEVYGA

SEQ ID NO: 146131 - protein, 13 aa, Mycobacterium tuberculosis
SELRALVEVYGAD

SEQ ID NO: 146132 - protein, 13 aa, Mycobacterium tuberculosis
ELRALVEVYGADD

SEQ ID NO: 146133 - protein, 13 aa, Mycobacterium tuberculosis
LRALVEVYGADDA

SEQ ID NO: 146134 - protein, 13 aa, Mycobacterium tuberculosis
RALVEVYGADDAQ

SEQ ID NO: 146135 - protein, 13 aa, Mycobacterium tuberculosis
ALVEVYGADDAQP

SEQ ID NO: 146136 - protein, 13 aa, Mycobacterium tuberculosis
LVEVYGADDAQPK

SEQ ID NO: 146137 - protein, 13 aa, Mycobacterium tuberculosis
VEVYGADDAQPKF

SEQ ID NO: 146138 - protein, 13 aa, Mycobacterium tuberculosis
EVYGADDAQPKFV

SEQ ID NO: 146139 - protein, 13 aa, Mycobacterium tuberculosis
VYGADDAQPKFVQ

SEQ ID NO: 146140 - protein, 13 aa, Mycobacterium tuberculosis
YGADDAQPKFVQD

SEQ ID NO: 146141 - protein, 13 aa, Mycobacterium tuberculosis
GADDAQPKFVQDF

SEQ ID NO: 146142 - protein, 13 aa, Mycobacterium tuberculosis
ADDAQPKFVQDFV

SEQ ID NO: 146143 - protein, 13 aa, Mycobacterium tuberculosis
DDAQPKFVQDFVA

SEQ ID NO: 146144 - protein, 13 aa, Mycobacterium tuberculosis
DAQPKFVQDFVAA

SEQ ID NO: 146145 - protein, 13 aa, Mycobacterium tuberculosis
AQPKFVQDFVAAW

SEQ ID NO: 146146 - protein, 13 aa, Mycobacterium tuberculosis
QPKFVQDFVAAWD

SEQ ID NO: 146147 - protein, 13 aa, Mycobacterium tuberculosis
PKFVQDFVAAWDK

SEQ ID NO: 146148 - protein, 13 aa, Mycobacterium tuberculosis
KFVQDFVAAWDKV

SEQ ID NO: 146149 - protein, 13 aa, Mycobacterium tuberculosis
FVQDFVAAWDKVM

SEQ ID NO: 146150 - protein, 13 aa, Mycobacterium tuberculosis
VQDFVAAWDKVMN

SEQ ID NO: 146151 - protein, 13 aa, Mycobacterium tuberculosis
QDFVAAWDKVMNL

SEQ ID NO: 146152 - protein, 13 aa, Mycobacterium tuberculosis
DFVAAWDKVMNLD

SEQ ID NO: 146153 - protein, 13 aa, Mycobacterium tuberculosis
FVAAWDKVMNLDR

SEQ ID NO: 146154 - protein, 13 aa, Mycobacterium tuberculosis
VAAWDKVMNLDRF

SEQ ID NO: 146155 - protein, 13 aa, Mycobacterium tuberculosis
AAWDKVMNLDRFD

SEQ ID NO: 146156 - protein, 13 aa, Mycobacterium tuberculosis
AWDKVMNLDRFDV

SEQ ID NO: 146157 - protein, 13 aa, Mycobacterium tuberculosis
WDKVMNLDRFDVR

SEQ ID NO: 146158 - protein, 14 aa, Mycobacterium tuberculosis
MPEQHPPITETTTG

SEQ ID NO: 146159 - protein, 14 aa, Mycobacterium tuberculosis
PEQHPPITETTTGA

SEQ ID NO: 146160 - protein, 14 aa, Mycobacterium tuberculosis
EQHPPITETTTGAA

SEQ ID NO: 146161 - protein, 14 aa, Mycobacterium tuberculosis
QHPPITETTTGAAS

SEQ ID NO: 146162 - protein, 14 aa, Mycobacterium tuberculosis
HPPITETTTGAASN

SEQ ID NO: 146163 - protein, 14 aa, Mycobacterium tuberculosis
PPITETTTGAASNG

SEQ ID NO: 146164 - protein, 14 aa, Mycobacterium tuberculosis
PITETTTGAASNGC

SEQ ID NO: 146165 - protein, 14 aa, Mycobacterium tuberculosis
ITETTTGAASNGCP

SEQ ID NO: 146166 - protein, 14 aa, Mycobacterium tuberculosis
TETTTGAASNGCPV

SEQ ID NO: 146167 - protein, 14 aa, Mycobacterium tuberculosis
ETTTGAASNGCPVV

SEQ ID NO: 146168 - protein, 14 aa, Mycobacterium tuberculosis
TTTGAASNGCPVVG

SEQ ID NO: 146169 - protein, 14 aa, Mycobacterium tuberculosis
TTGAASNGCPVVGH

SEQ ID NO: 146170 - protein, 14 aa, Mycobacterium tuberculosis
TGAASNGCPVVGHM

SEQ ID NO: 146171 - protein, 14 aa, Mycobacterium tuberculosis
GAASNGCPVVGHMK

SEQ ID NO: 146172 - protein, 14 aa, Mycobacterium tuberculosis
AASNGCPVVGHMKY

SEQ ID NO: 146173 - protein, 14 aa, Mycobacterium tuberculosis
ASNGCPVVGHMKYP

SEQ ID NO: 146174 - protein, 14 aa, Mycobacterium tuberculosis
SNGCPVVGHMKYPV

SEQ ID NO: 146175 - protein, 14 aa, Mycobacterium tuberculosis
NGCPVVGHMKYPVE

SEQ ID NO: 146176 - protein, 14 aa, Mycobacterium tuberculosis
GCPVVGHMKYPVEG

SEQ ID NO: 146177 - protein, 14 aa, Mycobacterium tuberculosis
CPVVGHMKYPVEGG

SEQ ID NO: 146178 - protein, 14 aa, Mycobacterium tuberculosis
PVVGHMKYPVEGGG

SEQ ID NO: 146179 - protein, 14 aa, Mycobacterium tuberculosis
VVGHMKYPVEGGGN

SEQ ID NO: 146180 - protein, 14 aa, Mycobacterium tuberculosis
VGHMKYPVEGGGNQ

SEQ ID NO: 146181 - protein, 14 aa, Mycobacterium tuberculosis
GHMKYPVEGGGNQD

SEQ ID NO: 146182 - protein, 14 aa, Mycobacterium tuberculosis
HMKYPVEGGGNQDW

SEQ ID NO: 146183 - protein, 14 aa, Mycobacterium tuberculosis
MKYPVEGGGNQDWW

SEQ ID NO: 146184 - protein, 14 aa, Mycobacterium tuberculosis
KYPVEGGGNQDWWP

SEQ ID NO: 146185 - protein, 14 aa, Mycobacterium tuberculosis
YPVEGGGNQDWWPN

SEQ ID NO: 146186 - protein, 14 aa, Mycobacterium tuberculosis
PVEGGGNQDWWPNR

SEQ ID NO: 146187 - protein, 14 aa, Mycobacterium tuberculosis
VEGGGNQDWWPNRL

SEQ ID NO: 146188 - protein, 14 aa, Mycobacterium tuberculosis
EGGGNQDWWPNRLN

SEQ ID NO: 146189 - protein, 14 aa, Mycobacterium tuberculosis
GGGNQDWWPNRLNL

SEQ ID NO: 146190 - protein, 14 aa, Mycobacterium tuberculosis
GGNQDWWPNRLNLK

SEQ ID NO: 146191 - protein, 14 aa, Mycobacterium tuberculosis
GNQDWWPNRLNLKV

SEQ ID NO: 146192 - protein, 14 aa, Mycobacterium tuberculosis
NQDWWPNRLNLKVL

SEQ ID NO: 146193 - protein, 14 aa, Mycobacterium tuberculosis
QDWWPNRLNLKVLH

SEQ ID NO: 146194 - protein, 14 aa, Mycobacterium tuberculosis
DWWPNRLNLKVLHQ

SEQ ID NO: 146195 - protein, 14 aa, Mycobacterium tuberculosis
WWPNRLNLKVLHQN

SEQ ID NO: 146196 - protein, 14 aa, Mycobacterium tuberculosis
WPNRLNLKVLHQNP

SEQ ID NO: 146197 - protein, 14 aa, Mycobacterium tuberculosis
PNRLNLKVLHQNPA

SEQ ID NO: 146198 - protein, 14 aa, Mycobacterium tuberculosis
NRLNLKVLHQNPAV

SEQ ID NO: 146199 - protein, 14 aa, Mycobacterium tuberculosis
RLNLKVLHQNPAVA

SEQ ID NO: 146200 - protein, 14 aa, Mycobacterium tuberculosis
LNLKVLHQNPAVAD

SEQ ID NO: 146201 - protein, 14 aa, Mycobacterium tuberculosis
NLKVLHQNPAVADP

SEQ ID NO: 146202 - protein, 14 aa, Mycobacterium tuberculosis
LKVLHQNPAVADPM

SEQ ID NO: 146203 - protein, 14 aa, Mycobacterium tuberculosis
KVLHQNPAVADPMG

SEQ ID NO: 146204 - protein, 14 aa, Mycobacterium tuberculosis
VLHQNPAVADPMGA

SEQ ID NO: 146205 - protein, 14 aa, Mycobacterium tuberculosis
LHQNPAVADPMGAA

SEQ ID NO: 146206 - protein, 14 aa, Mycobacterium tuberculosis
HQNPAVADPMGAAF

SEQ ID NO: 146207 - protein, 14 aa, Mycobacterium tuberculosis
QNPAVADPMGAAFD

SEQ ID NO: 146208 - protein, 14 aa, Mycobacterium tuberculosis
NPAVADPMGAAFDY

SEQ ID NO: 146209 - protein, 14 aa, Mycobacterium tuberculosis
PAVADPMGAAFDYA

SEQ ID NO: 146210 - protein, 14 aa, Mycobacterium tuberculosis
AVADPMGAAFDYAA

SEQ ID NO: 146211 - protein, 14 aa, Mycobacterium tuberculosis
VADPMGAAFDYAAE

SEQ ID NO: 146212 - protein, 14 aa, Mycobacterium tuberculosis
ADPMGAAFDYAAEV

SEQ ID NO: 146213 - protein, 14 aa, Mycobacterium tuberculosis
DPMGAAFDYAAEVA

SEQ ID NO: 146214 - protein, 14 aa, Mycobacterium tuberculosis
PMGAAFDYAAEVAT

SEQ ID NO: 146215 - protein, 14 aa, Mycobacterium tuberculosis
MGAAFDYAAEVATI

SEQ ID NO: 146216 - protein, 14 aa, Mycobacterium tuberculosis
GAAFDYAAEVATID

SEQ ID NO: 146217 - protein, 14 aa, Mycobacterium tuberculosis
AAFDYAAEVATIDV

SEQ ID NO: 146218 - protein, 14 aa, Mycobacterium tuberculosis
AFDYAAEVATIDVD

SEQ ID NO: 146219 - protein, 14 aa, Mycobacterium tuberculosis
FDYAAEVATIDVDA

SEQ ID NO: 146220 - protein, 14 aa, Mycobacterium tuberculosis
DYAAEVATIDVDAL

SEQ ID NO: 146221 - protein, 14 aa, Mycobacterium tuberculosis
YAAEVATIDVDALT

SEQ ID NO: 146222 - protein, 14 aa, Mycobacterium tuberculosis
AAEVATIDVDALTR

SEQ ID NO: 146223 - protein, 14 aa, Mycobacterium tuberculosis
AEVATIDVDALTRD

SEQ ID NO: 146224 - protein, 14 aa, Mycobacterium tuberculosis
EVATIDVDALTRDI

SEQ ID NO: 146225 - protein, 14 aa, Mycobacterium tuberculosis
VATIDVDALTRDIE

SEQ ID NO: 146226 - protein, 14 aa, Mycobacterium tuberculosis
ATIDVDALTRDIEE

SEQ ID NO: 146227 - protein, 14 aa, Mycobacterium tuberculosis
TIDVDALTRDIEEV

SEQ ID NO: 146228 - protein, 14 aa, Mycobacterium tuberculosis
IDVDALTRDIEEVM

SEQ ID NO: 146229 - protein, 14 aa, Mycobacterium tuberculosis
DVDALTRDIEEVMT

SEQ ID NO: 146230 - protein, 14 aa, Mycobacterium tuberculosis
VDALTRDIEEVMTT

SEQ ID NO: 146231 - protein, 14 aa, Mycobacterium tuberculosis
DALTRDIEEVMTTS

SEQ ID NO: 146232 - protein, 14 aa, Mycobacterium tuberculosis
ALTRDIEEVMTTSQ

SEQ ID NO: 146233 - protein, 14 aa, Mycobacterium tuberculosis
LTRDIEEVMTTSQP

SEQ ID NO: 146234 - protein, 14 aa, Mycobacterium tuberculosis
TRDIEEVMTTSQPW

SEQ ID NO: 146235 - protein, 14 aa, Mycobacterium tuberculosis
RDIEEVMTTSQPWW

SEQ ID NO: 146236 - protein, 14 aa, Mycobacterium tuberculosis
DIEEVMTTSQPWWP

SEQ ID NO: 146237 - protein, 14 aa, Mycobacterium tuberculosis
IEEVMTTSQPWWPA

SEQ ID NO: 146238 - protein, 14 aa, Mycobacterium tuberculosis
EEVMTTSQPWWPAD

SEQ ID NO: 146239 - protein, 14 aa, Mycobacterium tuberculosis
EVMTTSQPWWPADY

SEQ ID NO: 146240 - protein, 14 aa, Mycobacterium tuberculosis
VMTTSQPWWPADYG

SEQ ID NO: 146241 - protein, 14 aa, Mycobacterium tuberculosis
MTTSQPWWPADYGH

SEQ ID NO: 146242 - protein, 14 aa, Mycobacterium tuberculosis
TTSQPWWPADYGHY

SEQ ID NO: 146243 - protein, 14 aa, Mycobacterium tuberculosis
TSQPWWPADYGHYG

SEQ ID NO: 146244 - protein, 14 aa, Mycobacterium tuberculosis
SQPWWPADYGHYGP

SEQ ID NO: 146245 - protein, 14 aa, Mycobacterium tuberculosis
QPWWPADYGHYGPL

SEQ ID NO: 146246 - protein, 14 aa, Mycobacterium tuberculosis
PWWPADYGHYGPLF

SEQ ID NO: 146247 - protein, 14 aa, Mycobacterium tuberculosis
WWPADYGHYGPLFI

SEQ ID NO: 146248 - protein, 14 aa, Mycobacterium tuberculosis
WPADYGHYGPLFIR

SEQ ID NO: 146249 - protein, 14 aa, Mycobacterium tuberculosis
PADYGHYGPLFIRM

SEQ ID NO: 146250 - protein, 14 aa, Mycobacterium tuberculosis
ADYGHYGPLFIRMA

SEQ ID NO: 146251 - protein, 14 aa, Mycobacterium tuberculosis
DYGHYGPLFIRMAW

SEQ ID NO: 146252 - protein, 14 aa, Mycobacterium tuberculosis
YGHYGPLFIRMAWH

SEQ ID NO: 146253 - protein, 14 aa, Mycobacterium tuberculosis
GHYGPLFIRMAWHA

SEQ ID NO: 146254 - protein, 14 aa, Mycobacterium tuberculosis
HYGPLFIRMAWHAA

SEQ ID NO: 146255 - protein, 14 aa, Mycobacterium tuberculosis
YGPLFIRMAWHAAG

SEQ ID NO: 146256 - protein, 14 aa, Mycobacterium tuberculosis
GPLFIRMAWHAAGT

SEQ ID NO: 146257 - protein, 14 aa, Mycobacterium tuberculosis
PLFIRMAWHAAGTY

SEQ ID NO: 146258 - protein, 14 aa, Mycobacterium tuberculosis
LFIRMAWHAAGTYR

SEQ ID NO: 146259 - protein, 14 aa, Mycobacterium tuberculosis
FIRMAWHAAGTYRI

SEQ ID NO: 146260 - protein, 14 aa, Mycobacterium tuberculosis
IRMAWHAAGTYRIH

SEQ ID NO: 146261 - protein, 14 aa, Mycobacterium tuberculosis
RMAWHAAGTYRIHD

SEQ ID NO: 146262 - protein, 14 aa, Mycobacterium tuberculosis
MAWHAAGTYRIHDG

SEQ ID NO: 146263 - protein, 14 aa, Mycobacterium tuberculosis
AWHAAGTYRIHDGR

SEQ ID NO: 146264 - protein, 14 aa, Mycobacterium tuberculosis
WHAAGTYRIHDGRG

SEQ ID NO: 146265 - protein, 14 aa, Mycobacterium tuberculosis
HAAGTYRIHDGRGG

SEQ ID NO: 146266 - protein, 14 aa, Mycobacterium tuberculosis
AAGTYRIHDGRGGA

SEQ ID NO: 146267 - protein, 14 aa, Mycobacterium tuberculosis
AGTYRIHDGRGGAG

SEQ ID NO: 146268 - protein, 14 aa, Mycobacterium tuberculosis
GTYRIHDGRGGAGG

SEQ ID NO: 146269 - protein, 14 aa, Mycobacterium tuberculosis
TYRIHDGRGGAGGG

SEQ ID NO: 146270 - protein, 14 aa, Mycobacterium tuberculosis
YRIHDGRGGAGGGM

SEQ ID NO: 146271 - protein, 14 aa, Mycobacterium tuberculosis
RIHDGRGGAGGGMQ

SEQ ID NO: 146272 - protein, 14 aa, Mycobacterium tuberculosis
IHDGRGGAGGGMQR

SEQ ID NO: 146273 - protein, 14 aa, Mycobacterium tuberculosis
HDGRGGAGGGMQRF

SEQ ID NO: 146274 - protein, 14 aa, Mycobacterium tuberculosis
DGRGGAGGGMQRFA

SEQ ID NO: 146275 - protein, 14 aa, Mycobacterium tuberculosis
GRGGAGGGMQRFAP

SEQ ID NO: 146276 - protein, 14 aa, Mycobacterium tuberculosis
RGGAGGGMQRFAPL

SEQ ID NO: 146277 - protein, 14 aa, Mycobacterium tuberculosis
GGAGGGMQRFAPLN

SEQ ID NO: 146278 - protein, 14 aa, Mycobacterium tuberculosis
GAGGGMQRFAPLNS

SEQ ID NO: 146279 - protein, 14 aa, Mycobacterium tuberculosis
AGGGMQRFAPLNSW

SEQ ID NO: 146280 - protein, 14 aa, Mycobacterium tuberculosis
GGGMQRFAPLNSWP

SEQ ID NO: 146281 - protein, 14 aa, Mycobacterium tuberculosis
GGMQRFAPLNSWPD

SEQ ID NO: 146282 - protein, 14 aa, Mycobacterium tuberculosis
GMQRFAPLNSWPDN

SEQ ID NO: 146283 - protein, 14 aa, Mycobacterium tuberculosis
MQRFAPLNSWPDNA

SEQ ID NO: 146284 - protein, 14 aa, Mycobacterium tuberculosis
QRFAPLNSWPDNAS

SEQ ID NO: 146285 - protein, 14 aa, Mycobacterium tuberculosis
RFAPLNSWPDNASL

SEQ ID NO: 146286 - protein, 14 aa, Mycobacterium tuberculosis
FAPLNSWPDNASLD

SEQ ID NO: 146287 - protein, 14 aa, Mycobacterium tuberculosis
APLNSWPDNASLDK

SEQ ID NO: 146288 - protein, 14 aa, Mycobacterium tuberculosis
PLNSWPDNASLDKA

SEQ ID NO: 146289 - protein, 14 aa, Mycobacterium tuberculosis
LNSWPDNASLDKAR

SEQ ID NO: 146290 - protein, 14 aa, Mycobacterium tuberculosis
NSWPDNASLDKARR

SEQ ID NO: 146291 - protein, 14 aa, Mycobacterium tuberculosis
SWPDNASLDKARRL

SEQ ID NO: 146292 - protein, 14 aa, Mycobacterium tuberculosis
WPDNASLDKARRLL

SEQ ID NO: 146293 - protein, 14 aa, Mycobacterium tuberculosis
PDNASLDKARRLLW

SEQ ID NO: 146294 - protein, 14 aa, Mycobacterium tuberculosis
DNASLDKARRLLWP

SEQ ID NO: 146295 - protein, 14 aa, Mycobacterium tuberculosis
NASLDKARRLLWPV

SEQ ID NO: 146296 - protein, 14 aa, Mycobacterium tuberculosis
ASLDKARRLLWPVK

SEQ ID NO: 146297 - protein, 14 aa, Mycobacterium tuberculosis
SLDKARRLLWPVKK

SEQ ID NO: 146298 - protein, 14 aa, Mycobacterium tuberculosis
LDKARRLLWPVKKK

SEQ ID NO: 146299 - protein, 14 aa, Mycobacterium tuberculosis
DKARRLLWPVKKKY

SEQ ID NO: 146300 - protein, 14 aa, Mycobacterium tuberculosis
KARRLLWPVKKKYG

SEQ ID NO: 146301 - protein, 14 aa, Mycobacterium tuberculosis
ARRLLWPVKKKYGK

SEQ ID NO: 146302 - protein, 14 aa, Mycobacterium tuberculosis
RRLLWPVKKKYGKK

SEQ ID NO: 146303 - protein, 14 aa, Mycobacterium tuberculosis
RLLWPVKKKYGKKL

SEQ ID NO: 146304 - protein, 14 aa, Mycobacterium tuberculosis
LLWPVKKKYGKKLS

SEQ ID NO: 146305 - protein, 14 aa, Mycobacterium tuberculosis
LWPVKKKYGKKLSW

SEQ ID NO: 146306 - protein, 14 aa, Mycobacterium tuberculosis
WPVKKKYGKKLSWA

SEQ ID NO: 146307 - protein, 14 aa, Mycobacterium tuberculosis
PVKKKYGKKLSWAD

SEQ ID NO: 146308 - protein, 14 aa, Mycobacterium tuberculosis
VKKKYGKKLSWADL

SEQ ID NO: 146309 - protein, 14 aa, Mycobacterium tuberculosis
KKKYGKKLSWADLI

SEQ ID NO: 146310 - protein, 14 aa, Mycobacterium tuberculosis
KKYGKKLSWADLIV

SEQ ID NO: 146311 - protein, 14 aa, Mycobacterium tuberculosis
KYGKKLSWADLIVF

SEQ ID NO: 146312 - protein, 14 aa, Mycobacterium tuberculosis
YGKKLSWADLIVFA

SEQ ID NO: 146313 - protein, 14 aa, Mycobacterium tuberculosis
GKKLSWADLIVFAG

SEQ ID NO: 146314 - protein, 14 aa, Mycobacterium tuberculosis
KKLSWADLIVFAGN

SEQ ID NO: 146315 - protein, 14 aa, Mycobacterium tuberculosis
KLSWADLIVFAGNC

SEQ ID NO: 146316 - protein, 14 aa, Mycobacterium tuberculosis
LSWADLIVFAGNCA

SEQ ID NO: 146317 - protein, 14 aa, Mycobacterium tuberculosis
SWADLIVFAGNCAL

SEQ ID NO: 146318 - protein, 14 aa, Mycobacterium tuberculosis
WADLIVFAGNCALE

SEQ ID NO: 146319 - protein, 14 aa, Mycobacterium tuberculosis
ADLIVFAGNCALES

SEQ ID NO: 146320 - protein, 14 aa, Mycobacterium tuberculosis
DLIVFAGNCALESM

SEQ ID NO: 146321 - protein, 14 aa, Mycobacterium tuberculosis
LIVFAGNCALESMG

SEQ ID NO: 146322 - protein, 14 aa, Mycobacterium tuberculosis
IVFAGNCALESMGF

SEQ ID NO: 146323 - protein, 14 aa, Mycobacterium tuberculosis
VFAGNCALESMGFK

SEQ ID NO: 146324 - protein, 14 aa, Mycobacterium tuberculosis
FAGNCALESMGFKT

SEQ ID NO: 146325 - protein, 14 aa, Mycobacterium tuberculosis
AGNCALESMGFKTF

SEQ ID NO: 146326 - protein, 14 aa, Mycobacterium tuberculosis
GNCALESMGFKTFG

SEQ ID NO: 146327 - protein, 14 aa, Mycobacterium tuberculosis
NCALESMGFKTFGF

SEQ ID NO: 146328 - protein, 14 aa, Mycobacterium tuberculosis
CALESMGFKTFGFG

SEQ ID NO: 146329 - protein, 14 aa, Mycobacterium tuberculosis
ALESMGFKTFGFGF

SEQ ID NO: 146330 - protein, 14 aa, Mycobacterium tuberculosis
LESMGFKTFGFGFG

SEQ ID NO: 146331 - protein, 14 aa, Mycobacterium tuberculosis
ESMGFKTFGFGFGR

SEQ ID NO: 146332 - protein, 14 aa, Mycobacterium tuberculosis
SMGFKTFGFGFGRV

SEQ ID NO: 146333 - protein, 14 aa, Mycobacterium tuberculosis
MGFKTFGFGFGRVD

SEQ ID NO: 146334 - protein, 14 aa, Mycobacterium tuberculosis
GFKTFGFGFGRVDQ

SEQ ID NO: 146335 - protein, 14 aa, Mycobacterium tuberculosis
FKTFGFGFGRVDQW

SEQ ID NO: 146336 - protein, 14 aa, Mycobacterium tuberculosis
KTFGFGFGRVDQWE

SEQ ID NO: 146337 - protein, 14 aa, Mycobacterium tuberculosis
TFGFGFGRVDQWEP

SEQ ID NO: 146338 - protein, 14 aa, Mycobacterium tuberculosis
FGFGFGRVDQWEPD

SEQ ID NO: 146339 - protein, 14 aa, Mycobacterium tuberculosis
GFGFGRVDQWEPDE

SEQ ID NO: 146340 - protein, 14 aa, Mycobacterium tuberculosis
FGFGRVDQWEPDEV

SEQ ID NO: 146341 - protein, 14 aa, Mycobacterium tuberculosis
GFGRVDQWEPDEVY

SEQ ID NO: 146342 - protein, 14 aa, Mycobacterium tuberculosis
FGRVDQWEPDEVYW

SEQ ID NO: 146343 - protein, 14 aa, Mycobacterium tuberculosis
GRVDQWEPDEVYWG

SEQ ID NO: 146344 - protein, 14 aa, Mycobacterium tuberculosis
RVDQWEPDEVYWGK

SEQ ID NO: 146345 - protein, 14 aa, Mycobacterium tuberculosis
VDQWEPDEVYWGKE

SEQ ID NO: 146346 - protein, 14 aa, Mycobacterium tuberculosis
DQWEPDEVYWGKEA

SEQ ID NO: 146347 - protein, 14 aa, Mycobacterium tuberculosis
QWEPDEVYWGKEAT

SEQ ID NO: 146348 - protein, 14 aa, Mycobacterium tuberculosis
WEPDEVYWGKEATW

SEQ ID NO: 146349 - protein, 14 aa, Mycobacterium tuberculosis
EPDEVYWGKEATWL

SEQ ID NO: 146350 - protein, 14 aa, Mycobacterium tuberculosis
PDEVYWGKEATWLG

SEQ ID NO: 146351 - protein, 14 aa, Mycobacterium tuberculosis
DEVYWGKEATWLGD

SEQ ID NO: 146352 - protein, 14 aa, Mycobacterium tuberculosis
EVYWGKEATWLGDE

SEQ ID NO: 146353 - protein, 14 aa, Mycobacterium tuberculosis
VYWGKEATWLGDER

SEQ ID NO: 146354 - protein, 14 aa, Mycobacterium tuberculosis
YWGKEATWLGDERY

SEQ ID NO: 146355 - protein, 14 aa, Mycobacterium tuberculosis
WGKEATWLGDERYS

SEQ ID NO: 146356 - protein, 14 aa, Mycobacterium tuberculosis
GKEATWLGDERYSG

SEQ ID NO: 146357 - protein, 14 aa, Mycobacterium tuberculosis
KEATWLGDERYSGK

SEQ ID NO: 146358 - protein, 14 aa, Mycobacterium tuberculosis
EATWLGDERYSGKR

SEQ ID NO: 146359 - protein, 14 aa, Mycobacterium tuberculosis
ATWLGDERYSGKRD

SEQ ID NO: 146360 - protein, 14 aa, Mycobacterium tuberculosis
TWLGDERYSGKRDL

SEQ ID NO: 146361 - protein, 14 aa, Mycobacterium tuberculosis
WLGDERYSGKRDLE

SEQ ID NO: 146362 - protein, 14 aa, Mycobacterium tuberculosis
LGDERYSGKRDLEN

SEQ ID NO: 146363 - protein, 14 aa, Mycobacterium tuberculosis
GDERYSGKRDLENP

SEQ ID NO: 146364 - protein, 14 aa, Mycobacterium tuberculosis
DERYSGKRDLENPL

SEQ ID NO: 146365 - protein, 14 aa, Mycobacterium tuberculosis
ERYSGKRDLENPLA

SEQ ID NO: 146366 - protein, 14 aa, Mycobacterium tuberculosis
RYSGKRDLENPLAA

SEQ ID NO: 146367 - protein, 14 aa, Mycobacterium tuberculosis
YSGKRDLENPLAAV

SEQ ID NO: 146368 - protein, 14 aa, Mycobacterium tuberculosis
SGKRDLENPLAAVQ

SEQ ID NO: 146369 - protein, 14 aa, Mycobacterium tuberculosis
GKRDLENPLAAVQM

SEQ ID NO: 146370 - protein, 14 aa, Mycobacterium tuberculosis
KRDLENPLAAVQMG

SEQ ID NO: 146371 - protein, 14 aa, Mycobacterium tuberculosis
RDLENPLAAVQMGL

SEQ ID NO: 146372 - protein, 14 aa, Mycobacterium tuberculosis
DLENPLAAVQMGLI

SEQ ID NO: 146373 - protein, 14 aa, Mycobacterium tuberculosis
LENPLAAVQMGLIY

SEQ ID NO: 146374 - protein, 14 aa, Mycobacterium tuberculosis
ENPLAAVQMGLIYV

SEQ ID NO: 146375 - protein, 14 aa, Mycobacterium tuberculosis
NPLAAVQMGLIYVN

SEQ ID NO: 146376 - protein, 14 aa, Mycobacterium tuberculosis
PLAAVQMGLIYVNP

SEQ ID NO: 146377 - protein, 14 aa, Mycobacterium tuberculosis
LAAVQMGLIYVNPE

SEQ ID NO: 146378 - protein, 14 aa, Mycobacterium tuberculosis
AAVQMGLIYVNPEG

SEQ ID NO: 146379 - protein, 14 aa, Mycobacterium tuberculosis
AVQMGLIYVNPEGP

SEQ ID NO: 146380 - protein, 14 aa, Mycobacterium tuberculosis
VQMGLIYVNPEGPN

SEQ ID NO: 146381 - protein, 14 aa, Mycobacterium tuberculosis
QMGLIYVNPEGPNG

SEQ ID NO: 146382 - protein, 14 aa, Mycobacterium tuberculosis
MGLIYVNPEGPNGN

SEQ ID NO: 146383 - protein, 14 aa, Mycobacterium tuberculosis
GLIYVNPEGPNGNP

SEQ ID NO: 146384 - protein, 14 aa, Mycobacterium tuberculosis
LIYVNPEGPNGNPD

SEQ ID NO: 146385 - protein, 14 aa, Mycobacterium tuberculosis
IYVNPEGPNGNPDP

SEQ ID NO: 146386 - protein, 14 aa, Mycobacterium tuberculosis
YVNPEGPNGNPDPM

SEQ ID NO: 146387 - protein, 14 aa, Mycobacterium tuberculosis
VNPEGPNGNPDPMA

SEQ ID NO: 146388 - protein, 14 aa, Mycobacterium tuberculosis
NPEGPNGNPDPMAA

SEQ ID NO: 146389 - protein, 14 aa, Mycobacterium tuberculosis
PEGPNGNPDPMAAA

SEQ ID NO: 146390 - protein, 14 aa, Mycobacterium tuberculosis
EGPNGNPDPMAAAV

SEQ ID NO: 146391 - protein, 14 aa, Mycobacterium tuberculosis
GPNGNPDPMAAAVD

SEQ ID NO: 146392 - protein, 14 aa, Mycobacterium tuberculosis
PNGNPDPMAAAVDI

SEQ ID NO: 146393 - protein, 14 aa, Mycobacterium tuberculosis
NGNPDPMAAAVDIR

SEQ ID NO: 146394 - protein, 14 aa, Mycobacterium tuberculosis
GNPDPMAAAVDIRE

SEQ ID NO: 146395 - protein, 14 aa, Mycobacterium tuberculosis
NPDPMAAAVDIRET

SEQ ID NO: 146396 - protein, 14 aa, Mycobacterium tuberculosis
PDPMAAAVDIRETF

SEQ ID NO: 146397 - protein, 14 aa, Mycobacterium tuberculosis
DPMAAAVDIRETFR

SEQ ID NO: 146398 - protein, 14 aa, Mycobacterium tuberculosis
PMAAAVDIRETFRR

SEQ ID NO: 146399 - protein, 14 aa, Mycobacterium tuberculosis
MAAAVDIRETFRRM

SEQ ID NO: 146400 - protein, 14 aa, Mycobacterium tuberculosis
AAAVDIRETFRRMA

SEQ ID NO: 146401 - protein, 14 aa, Mycobacterium tuberculosis
AAVDIRETFRRMAM

SEQ ID NO: 146402 - protein, 14 aa, Mycobacterium tuberculosis
AVDIRETFRRMAMN

SEQ ID NO: 146403 - protein, 14 aa, Mycobacterium tuberculosis
VDIRETFRRMAMND

SEQ ID NO: 146404 - protein, 14 aa, Mycobacterium tuberculosis
DIRETFRRMAMNDV

SEQ ID NO: 146405 - protein, 14 aa, Mycobacterium tuberculosis
IRETFRRMAMNDVE

SEQ ID NO: 146406 - protein, 14 aa, Mycobacterium tuberculosis
RETFRRMAMNDVET

SEQ ID NO: 146407 - protein, 14 aa, Mycobacterium tuberculosis
ETFRRMAMNDVETA

SEQ ID NO: 146408 - protein, 14 aa, Mycobacterium tuberculosis
TFRRMAMNDVETAA

SEQ ID NO: 146409 - protein, 14 aa, Mycobacterium tuberculosis
FRRMAMNDVETAAL

SEQ ID NO: 146410 - protein, 14 aa, Mycobacterium tuberculosis
RRMAMNDVETAALI

SEQ ID NO: 146411 - protein, 14 aa, Mycobacterium tuberculosis
RMAMNDVETAALIV

SEQ ID NO: 146412 - protein, 14 aa, Mycobacterium tuberculosis
MAMNDVETAALIVG

SEQ ID NO: 146413 - protein, 14 aa, Mycobacterium tuberculosis
AMNDVETAALIVGG

SEQ ID NO: 146414 - protein, 14 aa, Mycobacterium tuberculosis
MNDVETAALIVGGH

SEQ ID NO: 146415 - protein, 14 aa, Mycobacterium tuberculosis
NDVETAALIVGGHT

SEQ ID NO: 146416 - protein, 14 aa, Mycobacterium tuberculosis
DVETAALIVGGHTF

SEQ ID NO: 146417 - protein, 14 aa, Mycobacterium tuberculosis
VETAALIVGGHTFG

SEQ ID NO: 146418 - protein, 14 aa, Mycobacterium tuberculosis
ETAALIVGGHTFGK

SEQ ID NO: 146419 - protein, 14 aa, Mycobacterium tuberculosis
TAALIVGGHTFGKT

SEQ ID NO: 146420 - protein, 14 aa, Mycobacterium tuberculosis
AALIVGGHTFGKTH

SEQ ID NO: 146421 - protein, 14 aa, Mycobacterium tuberculosis
ALIVGGHTFGKTHG

SEQ ID NO: 146422 - protein, 14 aa, Mycobacterium tuberculosis
LIVGGHTFGKTHGA

SEQ ID NO: 146423 - protein, 14 aa, Mycobacterium tuberculosis
IVGGHTFGKTHGAG

SEQ ID NO: 146424 - protein, 14 aa, Mycobacterium tuberculosis
VGGHTFGKTHGAGP

SEQ ID NO: 146425 - protein, 14 aa, Mycobacterium tuberculosis
GGHTFGKTHGAGPA

SEQ ID NO: 146426 - protein, 14 aa, Mycobacterium tuberculosis
GHTFGKTHGAGPAD

SEQ ID NO: 146427 - protein, 14 aa, Mycobacterium tuberculosis
HTFGKTHGAGPADL

SEQ ID NO: 146428 - protein, 14 aa, Mycobacterium tuberculosis
TFGKTHGAGPADLV

SEQ ID NO: 146429 - protein, 14 aa, Mycobacterium tuberculosis
FGKTHGAGPADLVG

SEQ ID NO: 146430 - protein, 14 aa, Mycobacterium tuberculosis
GKTHGAGPADLVGP

SEQ ID NO: 146431 - protein, 14 aa, Mycobacterium tuberculosis
KTHGAGPADLVGPE

SEQ ID NO: 146432 - protein, 14 aa, Mycobacterium tuberculosis
THGAGPADLVGPEP

SEQ ID NO: 146433 - protein, 14 aa, Mycobacterium tuberculosis
HGAGPADLVGPEPE

SEQ ID NO: 146434 - protein, 14 aa, Mycobacterium tuberculosis
GAGPADLVGPEPEA

SEQ ID NO: 146435 - protein, 14 aa, Mycobacterium tuberculosis
AGPADLVGPEPEAA

SEQ ID NO: 146436 - protein, 14 aa, Mycobacterium tuberculosis
GPADLVGPEPEAAP

SEQ ID NO: 146437 - protein, 14 aa, Mycobacterium tuberculosis
PADLVGPEPEAAPL

SEQ ID NO: 146438 - protein, 14 aa, Mycobacterium tuberculosis
ADLVGPEPEAAPLE

SEQ ID NO: 146439 - protein, 14 aa, Mycobacterium tuberculosis
DLVGPEPEAAPLEQ

SEQ ID NO: 146440 - protein, 14 aa, Mycobacterium tuberculosis
LVGPEPEAAPLEQM

SEQ ID NO: 146441 - protein, 14 aa, Mycobacterium tuberculosis
VGPEPEAAPLEQMG

SEQ ID NO: 146442 - protein, 14 aa, Mycobacterium tuberculosis
GPEPEAAPLEQMGL

SEQ ID NO: 146443 - protein, 14 aa, Mycobacterium tuberculosis
PEPEAAPLEQMGLG

SEQ ID NO: 146444 - protein, 14 aa, Mycobacterium tuberculosis
EPEAAPLEQMGLGW

SEQ ID NO: 146445 - protein, 14 aa, Mycobacterium tuberculosis
PEAAPLEQMGLGWK

SEQ ID NO: 146446 - protein, 14 aa, Mycobacterium tuberculosis
EAAPLEQMGLGWKS

SEQ ID NO: 146447 - protein, 14 aa, Mycobacterium tuberculosis
AAPLEQMGLGWKSS

SEQ ID NO: 146448 - protein, 14 aa, Mycobacterium tuberculosis
APLEQMGLGWKSSY

SEQ ID NO: 146449 - protein, 14 aa, Mycobacterium tuberculosis
PLEQMGLGWKSSYG

SEQ ID NO: 146450 - protein, 14 aa, Mycobacterium tuberculosis
LEQMGLGWKSSYGT

SEQ ID NO: 146451 - protein, 14 aa, Mycobacterium tuberculosis
EQMGLGWKSSYGTG

SEQ ID NO: 146452 - protein, 14 aa, Mycobacterium tuberculosis
QMGLGWKSSYGTGT

SEQ ID NO: 146453 - protein, 14 aa, Mycobacterium tuberculosis
MGLGWKSSYGTGTG

SEQ ID NO: 146454 - protein, 14 aa, Mycobacterium tuberculosis
GLGWKSSYGTGTGK

SEQ ID NO: 146455 - protein, 14 aa, Mycobacterium tuberculosis
LGWKSSYGTGTGKD

SEQ ID NO: 146456 - protein, 14 aa, Mycobacterium tuberculosis
GWKSSYGTGTGKDA

SEQ ID NO: 146457 - protein, 14 aa, Mycobacterium tuberculosis
WKSSYGTGTGKDAI

SEQ ID NO: 146458 - protein, 14 aa, Mycobacterium tuberculosis
KSSYGTGTGKDAIT

SEQ ID NO: 146459 - protein, 14 aa, Mycobacterium tuberculosis
SSYGTGTGKDAITS

SEQ ID NO: 146460 - protein, 14 aa, Mycobacterium tuberculosis
SYGTGTGKDAITSG

SEQ ID NO: 146461 - protein, 14 aa, Mycobacterium tuberculosis
YGTGTGKDAITSGI

SEQ ID NO: 146462 - protein, 14 aa, Mycobacterium tuberculosis
GTGTGKDAITSGIE

SEQ ID NO: 146463 - protein, 14 aa, Mycobacterium tuberculosis
TGTGKDAITSGIEV

SEQ ID NO: 146464 - protein, 14 aa, Mycobacterium tuberculosis
GTGKDAITSGIEVV

SEQ ID NO: 146465 - protein, 14 aa, Mycobacterium tuberculosis
TGKDAITSGIEVVW

SEQ ID NO: 146466 - protein, 14 aa, Mycobacterium tuberculosis
GKDAITSGIEVVWT

SEQ ID NO: 146467 - protein, 14 aa, Mycobacterium tuberculosis
KDAITSGIEVVWTN

SEQ ID NO: 146468 - protein, 14 aa, Mycobacterium tuberculosis
DAITSGIEVVWTNT

SEQ ID NO: 146469 - protein, 14 aa, Mycobacterium tuberculosis
AITSGIEVVWTNTP

SEQ ID NO: 146470 - protein, 14 aa, Mycobacterium tuberculosis
ITSGIEVVWTNTPT

SEQ ID NO: 146471 - protein, 14 aa, Mycobacterium tuberculosis
TSGIEVVWTNTPTK

SEQ ID NO: 146472 - protein, 14 aa, Mycobacterium tuberculosis
SGIEVVWTNTPTKW

SEQ ID NO: 146473 - protein, 14 aa, Mycobacterium tuberculosis
GIEVVWTNTPTKWD

SEQ ID NO: 146474 - protein, 14 aa, Mycobacterium tuberculosis
IEVVWTNTPTKWDN

SEQ ID NO: 146475 - protein, 14 aa, Mycobacterium tuberculosis
EVVWTNTPTKWDNS

SEQ ID NO: 146476 - protein, 14 aa, Mycobacterium tuberculosis
VVWTNTPTKWDNSF

SEQ ID NO: 146477 - protein, 14 aa, Mycobacterium tuberculosis
VWTNTPTKWDNSFL

SEQ ID NO: 146478 - protein, 14 aa, Mycobacterium tuberculosis
WTNTPTKWDNSFLE

SEQ ID NO: 146479 - protein, 14 aa, Mycobacterium tuberculosis
TNTPTKWDNSFLEI

SEQ ID NO: 146480 - protein, 14 aa, Mycobacterium tuberculosis
NTPTKWDNSFLEIL

SEQ ID NO: 146481 - protein, 14 aa, Mycobacterium tuberculosis
TPTKWDNSFLEILY

SEQ ID NO: 146482 - protein, 14 aa, Mycobacterium tuberculosis
PTKWDNSFLEILYG

SEQ ID NO: 146483 - protein, 14 aa, Mycobacterium tuberculosis
TKWDNSFLEILYGY

SEQ ID NO: 146484 - protein, 14 aa, Mycobacterium tuberculosis
KWDNSFLEILYGYE

SEQ ID NO: 146485 - protein, 14 aa, Mycobacterium tuberculosis
WDNSFLEILYGYEW

SEQ ID NO: 146486 - protein, 14 aa, Mycobacterium tuberculosis
DNSFLEILYGYEWE

SEQ ID NO: 146487 - protein, 14 aa, Mycobacterium tuberculosis
NSFLEILYGYEWEL

SEQ ID NO: 146488 - protein, 14 aa, Mycobacterium tuberculosis
SFLEILYGYEWELT

SEQ ID NO: 146489 - protein, 14 aa, Mycobacterium tuberculosis
FLEILYGYEWELTK

SEQ ID NO: 146490 - protein, 14 aa, Mycobacterium tuberculosis
LEILYGYEWELTKS

SEQ ID NO: 146491 - protein, 14 aa, Mycobacterium tuberculosis
EILYGYEWELTKSP

SEQ ID NO: 146492 - protein, 14 aa, Mycobacterium tuberculosis
ILYGYEWELTKSPA

SEQ ID NO: 146493 - protein, 14 aa, Mycobacterium tuberculosis
LYGYEWELTKSPAG

SEQ ID NO: 146494 - protein, 14 aa, Mycobacterium tuberculosis
YGYEWELTKSPAGA

SEQ ID NO: 146495 - protein, 14 aa, Mycobacterium tuberculosis
GYEWELTKSPAGAW

SEQ ID NO: 146496 - protein, 14 aa, Mycobacterium tuberculosis
YEWELTKSPAGAWQ

SEQ ID NO: 146497 - protein, 14 aa, Mycobacterium tuberculosis
EWELTKSPAGAWQY

SEQ ID NO: 146498 - protein, 14 aa, Mycobacterium tuberculosis
WELTKSPAGAWQYT

SEQ ID NO: 146499 - protein, 14 aa, Mycobacterium tuberculosis
ELTKSPAGAWQYTA

SEQ ID NO: 146500 - protein, 14 aa, Mycobacterium tuberculosis
LTKSPAGAWQYTAK

SEQ ID NO: 146501 - protein, 14 aa, Mycobacterium tuberculosis
TKSPAGAWQYTAKD

SEQ ID NO: 146502 - protein, 14 aa, Mycobacterium tuberculosis
KSPAGAWQYTAKDG

SEQ ID NO: 146503 - protein, 14 aa, Mycobacterium tuberculosis
SPAGAWQYTAKDGA

SEQ ID NO: 146504 - protein, 14 aa, Mycobacterium tuberculosis
PAGAWQYTAKDGAG

SEQ ID NO: 146505 - protein, 14 aa, Mycobacterium tuberculosis
AGAWQYTAKDGAGA

SEQ ID NO: 146506 - protein, 14 aa, Mycobacterium tuberculosis
GAWQYTAKDGAGAG

SEQ ID NO: 146507 - protein, 14 aa, Mycobacterium tuberculosis
AWQYTAKDGAGAGT

SEQ ID NO: 146508 - protein, 14 aa, Mycobacterium tuberculosis
WQYTAKDGAGAGTI

SEQ ID NO: 146509 - protein, 14 aa, Mycobacterium tuberculosis
QYTAKDGAGAGTIP

SEQ ID NO: 146510 - protein, 14 aa, Mycobacterium tuberculosis
YTAKDGAGAGTIPD

SEQ ID NO: 146511 - protein, 14 aa, Mycobacterium tuberculosis
TAKDGAGAGTIPDP

SEQ ID NO: 146512 - protein, 14 aa, Mycobacterium tuberculosis
AKDGAGAGTIPDPF

SEQ ID NO: 146513 - protein, 14 aa, Mycobacterium tuberculosis
KDGAGAGTIPDPFG

SEQ ID NO: 146514 - protein, 14 aa, Mycobacterium tuberculosis
DGAGAGTIPDPFGG

SEQ ID NO: 146515 - protein, 14 aa, Mycobacterium tuberculosis
GAGAGTIPDPFGGP

SEQ ID NO: 146516 - protein, 14 aa, Mycobacterium tuberculosis
AGAGTIPDPFGGPG

SEQ ID NO: 146517 - protein, 14 aa, Mycobacterium tuberculosis
GAGTIPDPFGGPGR

SEQ ID NO: 146518 - protein, 14 aa, Mycobacterium tuberculosis
AGTIPDPFGGPGRS

SEQ ID NO: 146519 - protein, 14 aa, Mycobacterium tuberculosis
GTIPDPFGGPGRSP

SEQ ID NO: 146520 - protein, 14 aa, Mycobacterium tuberculosis
TIPDPFGGPGRSPT

SEQ ID NO: 146521 - protein, 14 aa, Mycobacterium tuberculosis
IPDPFGGPGRSPTM

SEQ ID NO: 146522 - protein, 14 aa, Mycobacterium tuberculosis
PDPFGGPGRSPTML

SEQ ID NO: 146523 - protein, 14 aa, Mycobacterium tuberculosis
DPFGGPGRSPTMLA

SEQ ID NO: 146524 - protein, 14 aa, Mycobacterium tuberculosis
PFGGPGRSPTMLAT

SEQ ID NO: 146525 - protein, 14 aa, Mycobacterium tuberculosis
FGGPGRSPTMLATD

SEQ ID NO: 146526 - protein, 14 aa, Mycobacterium tuberculosis
GGPGRSPTMLATDL

SEQ ID NO: 146527 - protein, 14 aa, Mycobacterium tuberculosis
GPGRSPTMLATDLS

SEQ ID NO: 146528 - protein, 14 aa, Mycobacterium tuberculosis
PGRSPTMLATDLSL

SEQ ID NO: 146529 - protein, 14 aa, Mycobacterium tuberculosis
GRSPTMLATDLSLR

SEQ ID NO: 146530 - protein, 14 aa, Mycobacterium tuberculosis
RSPTMLATDLSLRV

SEQ ID NO: 146531 - protein, 14 aa, Mycobacterium tuberculosis
SPTMLATDLSLRVD

SEQ ID NO: 146532 - protein, 14 aa, Mycobacterium tuberculosis
PTMLATDLSLRVDP

SEQ ID NO: 146533 - protein, 14 aa, Mycobacterium tuberculosis
TMLATDLSLRVDPI

SEQ ID NO: 146534 - protein, 14 aa, Mycobacterium tuberculosis
MLATDLSLRVDPIY

SEQ ID NO: 146535 - protein, 14 aa, Mycobacterium tuberculosis
LATDLSLRVDPIYE

SEQ ID NO: 146536 - protein, 14 aa, Mycobacterium tuberculosis
ATDLSLRVDPIYER

SEQ ID NO: 146537 - protein, 14 aa, Mycobacterium tuberculosis
TDLSLRVDPIYERI

SEQ ID NO: 146538 - protein, 14 aa, Mycobacterium tuberculosis
DLSLRVDPIYERIT

SEQ ID NO: 146539 - protein, 14 aa, Mycobacterium tuberculosis
LSLRVDPIYERITR

SEQ ID NO: 146540 - protein, 14 aa, Mycobacterium tuberculosis
SLRVDPIYERITRR

SEQ ID NO: 146541 - protein, 14 aa, Mycobacterium tuberculosis
LRVDPIYERITRRW

SEQ ID NO: 146542 - protein, 14 aa, Mycobacterium tuberculosis
RVDPIYERITRRWL

SEQ ID NO: 146543 - protein, 14 aa, Mycobacterium tuberculosis
VDPIYERITRRWLE

SEQ ID NO: 146544 - protein, 14 aa, Mycobacterium tuberculosis
DPIYERITRRWLEH

SEQ ID NO: 146545 - protein, 14 aa, Mycobacterium tuberculosis
PIYERITRRWLEHP

SEQ ID NO: 146546 - protein, 14 aa, Mycobacterium tuberculosis
IYERITRRWLEHPE

SEQ ID NO: 146547 - protein, 14 aa, Mycobacterium tuberculosis
YERITRRWLEHPEE

SEQ ID NO: 146548 - protein, 14 aa, Mycobacterium tuberculosis
ERITRRWLEHPEEL

SEQ ID NO: 146549 - protein, 14 aa, Mycobacterium tuberculosis
RITRRWLEHPEELA

SEQ ID NO: 146550 - protein, 14 aa, Mycobacterium tuberculosis
ITRRWLEHPEELAD

SEQ ID NO: 146551 - protein, 14 aa, Mycobacterium tuberculosis
TRRWLEHPEELADE

SEQ ID NO: 146552 - protein, 14 aa, Mycobacterium tuberculosis
RRWLEHPEELADEF

SEQ ID NO: 146553 - protein, 14 aa, Mycobacterium tuberculosis
RWLEHPEELADEFA

SEQ ID NO: 146554 - protein, 14 aa, Mycobacterium tuberculosis
WLEHPEELADEFAK

SEQ ID NO: 146555 - protein, 14 aa, Mycobacterium tuberculosis
LEHPEELADEFAKA

SEQ ID NO: 146556 - protein, 14 aa, Mycobacterium tuberculosis
EHPEELADEFAKAW

SEQ ID NO: 146557 - protein, 14 aa, Mycobacterium tuberculosis
HPEELADEFAKAWY

SEQ ID NO: 146558 - protein, 14 aa, Mycobacterium tuberculosis
PEELADEFAKAWYK

SEQ ID NO: 146559 - protein, 14 aa, Mycobacterium tuberculosis
EELADEFAKAWYKL

SEQ ID NO: 146560 - protein, 14 aa, Mycobacterium tuberculosis
ELADEFAKAWYKLI

SEQ ID NO: 146561 - protein, 14 aa, Mycobacterium tuberculosis
LADEFAKAWYKLIH

SEQ ID NO: 146562 - protein, 14 aa, Mycobacterium tuberculosis
ADEFAKAWYKLIHR

SEQ ID NO: 146563 - protein, 14 aa, Mycobacterium tuberculosis
DEFAKAWYKLIHRD

SEQ ID NO: 146564 - protein, 14 aa, Mycobacterium tuberculosis
EFAKAWYKLIHRDM

SEQ ID NO: 146565 - protein, 14 aa, Mycobacterium tuberculosis
FAKAWYKLIHRDMG

SEQ ID NO: 146566 - protein, 14 aa, Mycobacterium tuberculosis
AKAWYKLIHRDMGP

SEQ ID NO: 146567 - protein, 14 aa, Mycobacterium tuberculosis
KAWYKLIHRDMGPV

SEQ ID NO: 146568 - protein, 14 aa, Mycobacterium tuberculosis
AWYKLIHRDMGPVA

SEQ ID NO: 146569 - protein, 14 aa, Mycobacterium tuberculosis
WYKLIHRDMGPVAR

SEQ ID NO: 146570 - protein, 14 aa, Mycobacterium tuberculosis
YKLIHRDMGPVARY

SEQ ID NO: 146571 - protein, 14 aa, Mycobacterium tuberculosis
KLIHRDMGPVARYL

SEQ ID NO: 146572 - protein, 14 aa, Mycobacterium tuberculosis
LIHRDMGPVARYLG

SEQ ID NO: 146573 - protein, 14 aa, Mycobacterium tuberculosis
IHRDMGPVARYLGP

SEQ ID NO: 146574 - protein, 14 aa, Mycobacterium tuberculosis
HRDMGPVARYLGPL

SEQ ID NO: 146575 - protein, 14 aa, Mycobacterium tuberculosis
RDMGPVARYLGPLV

SEQ ID NO: 146576 - protein, 14 aa, Mycobacterium tuberculosis
DMGPVARYLGPLVP

SEQ ID NO: 146577 - protein, 14 aa, Mycobacterium tuberculosis
MGPVARYLGPLVPK

SEQ ID NO: 146578 - protein, 14 aa, Mycobacterium tuberculosis
GPVARYLGPLVPKQ

SEQ ID NO: 146579 - protein, 14 aa, Mycobacterium tuberculosis
PVARYLGPLVPKQT

SEQ ID NO: 146580 - protein, 14 aa, Mycobacterium tuberculosis
VARYLGPLVPKQTL

SEQ ID NO: 146581 - protein, 14 aa, Mycobacterium tuberculosis
ARYLGPLVPKQTLL

SEQ ID NO: 146582 - protein, 14 aa, Mycobacterium tuberculosis
RYLGPLVPKQTLLW

SEQ ID NO: 146583 - protein, 14 aa, Mycobacterium tuberculosis
YLGPLVPKQTLLWQ

SEQ ID NO: 146584 - protein, 14 aa, Mycobacterium tuberculosis
LGPLVPKQTLLWQD

SEQ ID NO: 146585 - protein, 14 aa, Mycobacterium tuberculosis
GPLVPKQTLLWQDP

SEQ ID NO: 146586 - protein, 14 aa, Mycobacterium tuberculosis
PLVPKQTLLWQDPV

SEQ ID NO: 146587 - protein, 14 aa, Mycobacterium tuberculosis
LVPKQTLLWQDPVP

SEQ ID NO: 146588 - protein, 14 aa, Mycobacterium tuberculosis
VPKQTLLWQDPVPA

SEQ ID NO: 146589 - protein, 14 aa, Mycobacterium tuberculosis
PKQTLLWQDPVPAV

SEQ ID NO: 146590 - protein, 14 aa, Mycobacterium tuberculosis
KQTLLWQDPVPAVS

SEQ ID NO: 146591 - protein, 14 aa, Mycobacterium tuberculosis
QTLLWQDPVPAVSH

SEQ ID NO: 146592 - protein, 14 aa, Mycobacterium tuberculosis
TLLWQDPVPAVSHD

SEQ ID NO: 146593 - protein, 14 aa, Mycobacterium tuberculosis
LLWQDPVPAVSHDL

SEQ ID NO: 146594 - protein, 14 aa, Mycobacterium tuberculosis
LWQDPVPAVSHDLV

SEQ ID NO: 146595 - protein, 14 aa, Mycobacterium tuberculosis
WQDPVPAVSHDLVG

SEQ ID NO: 146596 - protein, 14 aa, Mycobacterium tuberculosis
QDPVPAVSHDLVGE

SEQ ID NO: 146597 - protein, 14 aa, Mycobacterium tuberculosis
DPVPAVSHDLVGEA

SEQ ID NO: 146598 - protein, 14 aa, Mycobacterium tuberculosis
PVPAVSHDLVGEAE

SEQ ID NO: 146599 - protein, 14 aa, Mycobacterium tuberculosis
VPAVSHDLVGEAEI

SEQ ID NO: 146600 - protein, 14 aa, Mycobacterium tuberculosis
PAVSHDLVGEAEIA

SEQ ID NO: 146601 - protein, 14 aa, Mycobacterium tuberculosis
AVSHDLVGEAEIAS

SEQ ID NO: 146602 - protein, 14 aa, Mycobacterium tuberculosis
VSHDLVGEAEIASL

SEQ ID NO: 146603 - protein, 14 aa, Mycobacterium tuberculosis
SHDLVGEAEIASLK

SEQ ID NO: 146604 - protein, 14 aa, Mycobacterium tuberculosis
HDLVGEAEIASLKS

SEQ ID NO: 146605 - protein, 14 aa, Mycobacterium tuberculosis
DLVGEAEIASLKSQ

SEQ ID NO: 146606 - protein, 14 aa, Mycobacterium tuberculosis
LVGEAEIASLKSQI

SEQ ID NO: 146607 - protein, 14 aa, Mycobacterium tuberculosis
VGEAEIASLKSQIR

SEQ ID NO: 146608 - protein, 14 aa, Mycobacterium tuberculosis
GEAEIASLKSQIRA

SEQ ID NO: 146609 - protein, 14 aa, Mycobacterium tuberculosis
EAEIASLKSQIRAS

SEQ ID NO: 146610 - protein, 14 aa, Mycobacterium tuberculosis
AEIASLKSQIRASG

SEQ ID NO: 146611 - protein, 14 aa, Mycobacterium tuberculosis
EIASLKSQIRASGL

SEQ ID NO: 146612 - protein, 14 aa, Mycobacterium tuberculosis
IASLKSQIRASGLT

SEQ ID NO: 146613 - protein, 14 aa, Mycobacterium tuberculosis
ASLKSQIRASGLTV

SEQ ID NO: 146614 - protein, 14 aa, Mycobacterium tuberculosis
SLKSQIRASGLTVS

SEQ ID NO: 146615 - protein, 14 aa, Mycobacterium tuberculosis
LKSQIRASGLTVSQ

SEQ ID NO: 146616 - protein, 14 aa, Mycobacterium tuberculosis
KSQIRASGLTVSQL

SEQ ID NO: 146617 - protein, 14 aa, Mycobacterium tuberculosis
SQIRASGLTVSQLV

SEQ ID NO: 146618 - protein, 14 aa, Mycobacterium tuberculosis
QIRASGLTVSQLVS

SEQ ID NO: 146619 - protein, 14 aa, Mycobacterium tuberculosis
IRASGLTVSQLVST

SEQ ID NO: 146620 - protein, 14 aa, Mycobacterium tuberculosis
RASGLTVSQLVSTA

SEQ ID NO: 146621 - protein, 14 aa, Mycobacterium tuberculosis
ASGLTVSQLVSTAW

SEQ ID NO: 146622 - protein, 14 aa, Mycobacterium tuberculosis
SGLTVSQLVSTAWA

SEQ ID NO: 146623 - protein, 14 aa, Mycobacterium tuberculosis
GLTVSQLVSTAWAA

SEQ ID NO: 146624 - protein, 14 aa, Mycobacterium tuberculosis
LTVSQLVSTAWAAA

SEQ ID NO: 146625 - protein, 14 aa, Mycobacterium tuberculosis
TVSQLVSTAWAAAS

SEQ ID NO: 146626 - protein, 14 aa, Mycobacterium tuberculosis
VSQLVSTAWAAASS

SEQ ID NO: 146627 - protein, 14 aa, Mycobacterium tuberculosis
SQLVSTAWAAASSF

SEQ ID NO: 146628 - protein, 14 aa, Mycobacterium tuberculosis
QLVSTAWAAASSFR

SEQ ID NO: 146629 - protein, 14 aa, Mycobacterium tuberculosis
LVSTAWAAASSFRG

SEQ ID NO: 146630 - protein, 14 aa, Mycobacterium tuberculosis
VSTAWAAASSFRGS

SEQ ID NO: 146631 - protein, 14 aa, Mycobacterium tuberculosis
STAWAAASSFRGSD

SEQ ID NO: 146632 - protein, 14 aa, Mycobacterium tuberculosis
TAWAAASSFRGSDK

SEQ ID NO: 146633 - protein, 14 aa, Mycobacterium tuberculosis
AWAAASSFRGSDKR

SEQ ID NO: 146634 - protein, 14 aa, Mycobacterium tuberculosis
WAAASSFRGSDKRG

SEQ ID NO: 146635 - protein, 14 aa, Mycobacterium tuberculosis
AAASSFRGSDKRGG

SEQ ID NO: 146636 - protein, 14 aa, Mycobacterium tuberculosis
AASSFRGSDKRGGA

SEQ ID NO: 146637 - protein, 14 aa, Mycobacterium tuberculosis
ASSFRGSDKRGGAN

SEQ ID NO: 146638 - protein, 14 aa, Mycobacterium tuberculosis
SSFRGSDKRGGANG

SEQ ID NO: 146639 - protein, 14 aa, Mycobacterium tuberculosis
SFRGSDKRGGANGG

SEQ ID NO: 146640 - protein, 14 aa, Mycobacterium tuberculosis
FRGSDKRGGANGGR

SEQ ID NO: 146641 - protein, 14 aa, Mycobacterium tuberculosis
RGSDKRGGANGGRI

SEQ ID NO: 146642 - protein, 14 aa, Mycobacterium tuberculosis
GSDKRGGANGGRIR

SEQ ID NO: 146643 - protein, 14 aa, Mycobacterium tuberculosis
SDKRGGANGGRIRL

SEQ ID NO: 146644 - protein, 14 aa, Mycobacterium tuberculosis
DKRGGANGGRIRLQ

SEQ ID NO: 146645 - protein, 14 aa, Mycobacterium tuberculosis
KRGGANGGRIRLQP

SEQ ID NO: 146646 - protein, 14 aa, Mycobacterium tuberculosis
RGGANGGRIRLQPQ

SEQ ID NO: 146647 - protein, 14 aa, Mycobacterium tuberculosis
GGANGGRIRLQPQV

SEQ ID NO: 146648 - protein, 14 aa, Mycobacterium tuberculosis
GANGGRIRLQPQVG

SEQ ID NO: 146649 - protein, 14 aa, Mycobacterium tuberculosis
ANGGRIRLQPQVGW

SEQ ID NO: 146650 - protein, 14 aa, Mycobacterium tuberculosis
NGGRIRLQPQVGWE

SEQ ID NO: 146651 - protein, 14 aa, Mycobacterium tuberculosis
GGRIRLQPQVGWEV

SEQ ID NO: 146652 - protein, 14 aa, Mycobacterium tuberculosis
GRIRLQPQVGWEVN

SEQ ID NO: 146653 - protein, 14 aa, Mycobacterium tuberculosis
RIRLQPQVGWEVND

SEQ ID NO: 146654 - protein, 14 aa, Mycobacterium tuberculosis
IRLQPQVGWEVNDP

SEQ ID NO: 146655 - protein, 14 aa, Mycobacterium tuberculosis
RLQPQVGWEVNDPD

SEQ ID NO: 146656 - protein, 14 aa, Mycobacterium tuberculosis
LQPQVGWEVNDPDG

SEQ ID NO: 146657 - protein, 14 aa, Mycobacterium tuberculosis
QPQVGWEVNDPDGD

SEQ ID NO: 146658 - protein, 14 aa, Mycobacterium tuberculosis
PQVGWEVNDPDGDL

SEQ ID NO: 146659 - protein, 14 aa, Mycobacterium tuberculosis
QVGWEVNDPDGDLR

SEQ ID NO: 146660 - protein, 14 aa, Mycobacterium tuberculosis
VGWEVNDPDGDLRK

SEQ ID NO: 146661 - protein, 14 aa, Mycobacterium tuberculosis
GWEVNDPDGDLRKV

SEQ ID NO: 146662 - protein, 14 aa, Mycobacterium tuberculosis
WEVNDPDGDLRKVI

SEQ ID NO: 146663 - protein, 14 aa, Mycobacterium tuberculosis
EVNDPDGDLRKVIR

SEQ ID NO: 146664 - protein, 14 aa, Mycobacterium tuberculosis
VNDPDGDLRKVIRT

SEQ ID NO: 146665 - protein, 14 aa, Mycobacterium tuberculosis
NDPDGDLRKVIRTL

SEQ ID NO: 146666 - protein, 14 aa, Mycobacterium tuberculosis
DPDGDLRKVIRTLE

SEQ ID NO: 146667 - protein, 14 aa, Mycobacterium tuberculosis
PDGDLRKVIRTLEE

SEQ ID NO: 146668 - protein, 14 aa, Mycobacterium tuberculosis
DGDLRKVIRTLEEI

SEQ ID NO: 146669 - protein, 14 aa, Mycobacterium tuberculosis
GDLRKVIRTLEEIQ

SEQ ID NO: 146670 - protein, 14 aa, Mycobacterium tuberculosis
DLRKVIRTLEEIQE

SEQ ID NO: 146671 - protein, 14 aa, Mycobacterium tuberculosis
LRKVIRTLEEIQES

SEQ ID NO: 146672 - protein, 14 aa, Mycobacterium tuberculosis
RKVIRTLEEIQESF

SEQ ID NO: 146673 - protein, 14 aa, Mycobacterium tuberculosis
KVIRTLEEIQESFN

SEQ ID NO: 146674 - protein, 14 aa, Mycobacterium tuberculosis
VIRTLEEIQESFNS

SEQ ID NO: 146675 - protein, 14 aa, Mycobacterium tuberculosis
IRTLEEIQESFNSA

SEQ ID NO: 146676 - protein, 14 aa, Mycobacterium tuberculosis
RTLEEIQESFNSAA

SEQ ID NO: 146677 - protein, 14 aa, Mycobacterium tuberculosis
TLEEIQESFNSAAP

SEQ ID NO: 146678 - protein, 14 aa, Mycobacterium tuberculosis
LEEIQESFNSAAPG

SEQ ID NO: 146679 - protein, 14 aa, Mycobacterium tuberculosis
EEIQESFNSAAPGN

SEQ ID NO: 146680 - protein, 14 aa, Mycobacterium tuberculosis
EIQESFNSAAPGNI

SEQ ID NO: 146681 - protein, 14 aa, Mycobacterium tuberculosis
IQESFNSAAPGNIK

SEQ ID NO: 146682 - protein, 14 aa, Mycobacterium tuberculosis
QESFNSAAPGNIKV

SEQ ID NO: 146683 - protein, 14 aa, Mycobacterium tuberculosis
ESFNSAAPGNIKVS

SEQ ID NO: 146684 - protein, 14 aa, Mycobacterium tuberculosis
SFNSAAPGNIKVSF

SEQ ID NO: 146685 - protein, 14 aa, Mycobacterium tuberculosis
FNSAAPGNIKVSFA

SEQ ID NO: 146686 - protein, 14 aa, Mycobacterium tuberculosis
NSAAPGNIKVSFAD

SEQ ID NO: 146687 - protein, 14 aa, Mycobacterium tuberculosis
SAAPGNIKVSFADL

SEQ ID NO: 146688 - protein, 14 aa, Mycobacterium tuberculosis
AAPGNIKVSFADLV

SEQ ID NO: 146689 - protein, 14 aa, Mycobacterium tuberculosis
APGNIKVSFADLVV

SEQ ID NO: 146690 - protein, 14 aa, Mycobacterium tuberculosis
PGNIKVSFADLVVL

SEQ ID NO: 146691 - protein, 14 aa, Mycobacterium tuberculosis
GNIKVSFADLVVLG

SEQ ID NO: 146692 - protein, 14 aa, Mycobacterium tuberculosis
NIKVSFADLVVLGG

SEQ ID NO: 146693 - protein, 14 aa, Mycobacterium tuberculosis
IKVSFADLVVLGGC

SEQ ID NO: 146694 - protein, 14 aa, Mycobacterium tuberculosis
KVSFADLVVLGGCA

SEQ ID NO: 146695 - protein, 14 aa, Mycobacterium tuberculosis
VSFADLVVLGGCAA

SEQ ID NO: 146696 - protein, 14 aa, Mycobacterium tuberculosis
SFADLVVLGGCAAI

SEQ ID NO: 146697 - protein, 14 aa, Mycobacterium tuberculosis
FADLVVLGGCAAIE

SEQ ID NO: 146698 - protein, 14 aa, Mycobacterium tuberculosis
ADLVVLGGCAAIEK

SEQ ID NO: 146699 - protein, 14 aa, Mycobacterium tuberculosis
DLVVLGGCAAIEKA

SEQ ID NO: 146700 - protein, 14 aa, Mycobacterium tuberculosis
LVVLGGCAAIEKAA

SEQ ID NO: 146701 - protein, 14 aa, Mycobacterium tuberculosis
VVLGGCAAIEKAAK

SEQ ID NO: 146702 - protein, 14 aa, Mycobacterium tuberculosis
VLGGCAAIEKAAKA

SEQ ID NO: 146703 - protein, 14 aa, Mycobacterium tuberculosis
LGGCAAIEKAAKAA

SEQ ID NO: 146704 - protein, 14 aa, Mycobacterium tuberculosis
GGCAAIEKAAKAAG

SEQ ID NO: 146705 - protein, 14 aa, Mycobacterium tuberculosis
GCAAIEKAAKAAGH

SEQ ID NO: 146706 - protein, 14 aa, Mycobacterium tuberculosis
CAAIEKAAKAAGHN

SEQ ID NO: 146707 - protein, 14 aa, Mycobacterium tuberculosis
AAIEKAAKAAGHNI

SEQ ID NO: 146708 - protein, 14 aa, Mycobacterium tuberculosis
AIEKAAKAAGHNIT

SEQ ID NO: 146709 - protein, 14 aa, Mycobacterium tuberculosis
IEKAAKAAGHNITV

SEQ ID NO: 146710 - protein, 14 aa, Mycobacterium tuberculosis
EKAAKAAGHNITVP

SEQ ID NO: 146711 - protein, 14 aa, Mycobacterium tuberculosis
KAAKAAGHNITVPF

SEQ ID NO: 146712 - protein, 14 aa, Mycobacterium tuberculosis
AAKAAGHNITVPFT

SEQ ID NO: 146713 - protein, 14 aa, Mycobacterium tuberculosis
AKAAGHNITVPFTP

SEQ ID NO: 146714 - protein, 14 aa, Mycobacterium tuberculosis
KAAGHNITVPFTPG

SEQ ID NO: 146715 - protein, 14 aa, Mycobacterium tuberculosis
AAGHNITVPFTPGR

SEQ ID NO: 146716 - protein, 14 aa, Mycobacterium tuberculosis
AGHNITVPFTPGRT

SEQ ID NO: 146717 - protein, 14 aa, Mycobacterium tuberculosis
GHNITVPFTPGRTD

SEQ ID NO: 146718 - protein, 14 aa, Mycobacterium tuberculosis
HNITVPFTPGRTDA

SEQ ID NO: 146719 - protein, 14 aa, Mycobacterium tuberculosis
NITVPFTPGRTDAS

SEQ ID NO: 146720 - protein, 14 aa, Mycobacterium tuberculosis
ITVPFTPGRTDASQ

SEQ ID NO: 146721 - protein, 14 aa, Mycobacterium tuberculosis
TVPFTPGRTDASQE

SEQ ID NO: 146722 - protein, 14 aa, Mycobacterium tuberculosis
VPFTPGRTDASQEQ

SEQ ID NO: 146723 - protein, 14 aa, Mycobacterium tuberculosis
PFTPGRTDASQEQT

SEQ ID NO: 146724 - protein, 14 aa, Mycobacterium tuberculosis
FTPGRTDASQEQTD

SEQ ID NO: 146725 - protein, 14 aa, Mycobacterium tuberculosis
TPGRTDASQEQTDV

SEQ ID NO: 146726 - protein, 14 aa, Mycobacterium tuberculosis
PGRTDASQEQTDVE

SEQ ID NO: 146727 - protein, 14 aa, Mycobacterium tuberculosis
GRTDASQEQTDVES

SEQ ID NO: 146728 - protein, 14 aa, Mycobacterium tuberculosis
RTDASQEQTDVESF

SEQ ID NO: 146729 - protein, 14 aa, Mycobacterium tuberculosis
TDASQEQTDVESFA

SEQ ID NO: 146730 - protein, 14 aa, Mycobacterium tuberculosis
DASQEQTDVESFAV

SEQ ID NO: 146731 - protein, 14 aa, Mycobacterium tuberculosis
ASQEQTDVESFAVL

SEQ ID NO: 146732 - protein, 14 aa, Mycobacterium tuberculosis
SQEQTDVESFAVLE

SEQ ID NO: 146733 - protein, 14 aa, Mycobacterium tuberculosis
QEQTDVESFAVLEP

SEQ ID NO: 146734 - protein, 14 aa, Mycobacterium tuberculosis
EQTDVESFAVLEPK

SEQ ID NO: 146735 - protein, 14 aa, Mycobacterium tuberculosis
QTDVESFAVLEPKA

SEQ ID NO: 146736 - protein, 14 aa, Mycobacterium tuberculosis
TDVESFAVLEPKAD

SEQ ID NO: 146737 - protein, 14 aa, Mycobacterium tuberculosis
DVESFAVLEPKADG

SEQ ID NO: 146738 - protein, 14 aa, Mycobacterium tuberculosis
VESFAVLEPKADGF

SEQ ID NO: 146739 - protein, 14 aa, Mycobacterium tuberculosis
ESFAVLEPKADGFR

SEQ ID NO: 146740 - protein, 14 aa, Mycobacterium tuberculosis
SFAVLEPKADGFRN

SEQ ID NO: 146741 - protein, 14 aa, Mycobacterium tuberculosis
FAVLEPKADGFRNY

SEQ ID NO: 146742 - protein, 14 aa, Mycobacterium tuberculosis
AVLEPKADGFRNYL

SEQ ID NO: 146743 - protein, 14 aa, Mycobacterium tuberculosis
VLEPKADGFRNYLG

SEQ ID NO: 146744 - protein, 14 aa, Mycobacterium tuberculosis
LEPKADGFRNYLGK

SEQ ID NO: 146745 - protein, 14 aa, Mycobacterium tuberculosis
EPKADGFRNYLGKG

SEQ ID NO: 146746 - protein, 14 aa, Mycobacterium tuberculosis
PKADGFRNYLGKGN

SEQ ID NO: 146747 - protein, 14 aa, Mycobacterium tuberculosis
KADGFRNYLGKGNP

SEQ ID NO: 146748 - protein, 14 aa, Mycobacterium tuberculosis
ADGFRNYLGKGNPL

SEQ ID NO: 146749 - protein, 14 aa, Mycobacterium tuberculosis
DGFRNYLGKGNPLP

SEQ ID NO: 146750 - protein, 14 aa, Mycobacterium tuberculosis
GFRNYLGKGNPLPA

SEQ ID NO: 146751 - protein, 14 aa, Mycobacterium tuberculosis
FRNYLGKGNPLPAE

SEQ ID NO: 146752 - protein, 14 aa, Mycobacterium tuberculosis
RNYLGKGNPLPAEY

SEQ ID NO: 146753 - protein, 14 aa, Mycobacterium tuberculosis
NYLGKGNPLPAEYM

SEQ ID NO: 146754 - protein, 14 aa, Mycobacterium tuberculosis
YLGKGNPLPAEYML

SEQ ID NO: 146755 - protein, 14 aa, Mycobacterium tuberculosis
LGKGNPLPAEYMLL

SEQ ID NO: 146756 - protein, 14 aa, Mycobacterium tuberculosis
GKGNPLPAEYMLLD

SEQ ID NO: 146757 - protein, 14 aa, Mycobacterium tuberculosis
KGNPLPAEYMLLDK

SEQ ID NO: 146758 - protein, 14 aa, Mycobacterium tuberculosis
GNPLPAEYMLLDKA

SEQ ID NO: 146759 - protein, 14 aa, Mycobacterium tuberculosis
NPLPAEYMLLDKAN

SEQ ID NO: 146760 - protein, 14 aa, Mycobacterium tuberculosis
PLPAEYMLLDKANL

SEQ ID NO: 146761 - protein, 14 aa, Mycobacterium tuberculosis
LPAEYMLLDKANLL

SEQ ID NO: 146762 - protein, 14 aa, Mycobacterium tuberculosis
PAEYMLLDKANLLT

SEQ ID NO: 146763 - protein, 14 aa, Mycobacterium tuberculosis
AEYMLLDKANLLTL

SEQ ID NO: 146764 - protein, 14 aa, Mycobacterium tuberculosis
EYMLLDKANLLTLS

SEQ ID NO: 146765 - protein, 14 aa, Mycobacterium tuberculosis
YMLLDKANLLTLSA

SEQ ID NO: 146766 - protein, 14 aa, Mycobacterium tuberculosis
MLLDKANLLTLSAP

SEQ ID NO: 146767 - protein, 14 aa, Mycobacterium tuberculosis
LLDKANLLTLSAPE

SEQ ID NO: 146768 - protein, 14 aa, Mycobacterium tuberculosis
LDKANLLTLSAPEM

SEQ ID NO: 146769 - protein, 14 aa, Mycobacterium tuberculosis
DKANLLTLSAPEMT

SEQ ID NO: 146770 - protein, 14 aa, Mycobacterium tuberculosis
KANLLTLSAPEMTV

SEQ ID NO: 146771 - protein, 14 aa, Mycobacterium tuberculosis
ANLLTLSAPEMTVL

SEQ ID NO: 146772 - protein, 14 aa, Mycobacterium tuberculosis
NLLTLSAPEMTVLV

SEQ ID NO: 146773 - protein, 14 aa, Mycobacterium tuberculosis
LLTLSAPEMTVLVG

SEQ ID NO: 146774 - protein, 14 aa, Mycobacterium tuberculosis
LTLSAPEMTVLVGG

SEQ ID NO: 146775 - protein, 14 aa, Mycobacterium tuberculosis
TLSAPEMTVLVGGL

SEQ ID NO: 146776 - protein, 14 aa, Mycobacterium tuberculosis
LSAPEMTVLVGGLR

SEQ ID NO: 146777 - protein, 14 aa, Mycobacterium tuberculosis
SAPEMTVLVGGLRV

SEQ ID NO: 146778 - protein, 14 aa, Mycobacterium tuberculosis
APEMTVLVGGLRVL

SEQ ID NO: 146779 - protein, 14 aa, Mycobacterium tuberculosis
PEMTVLVGGLRVLG

SEQ ID NO: 146780 - protein, 14 aa, Mycobacterium tuberculosis
EMTVLVGGLRVLGA

SEQ ID NO: 146781 - protein, 14 aa, Mycobacterium tuberculosis
MTVLVGGLRVLGAN

SEQ ID NO: 146782 - protein, 14 aa, Mycobacterium tuberculosis
TVLVGGLRVLGANY

SEQ ID NO: 146783 - protein, 14 aa, Mycobacterium tuberculosis
VLVGGLRVLGANYK

SEQ ID NO: 146784 - protein, 14 aa, Mycobacterium tuberculosis
LVGGLRVLGANYKR

SEQ ID NO: 146785 - protein, 14 aa, Mycobacterium tuberculosis
VGGLRVLGANYKRL

SEQ ID NO: 146786 - protein, 14 aa, Mycobacterium tuberculosis
GGLRVLGANYKRLP

SEQ ID NO: 146787 - protein, 14 aa, Mycobacterium tuberculosis
GLRVLGANYKRLPL

SEQ ID NO: 146788 - protein, 14 aa, Mycobacterium tuberculosis
LRVLGANYKRLPLG

SEQ ID NO: 146789 - protein, 14 aa, Mycobacterium tuberculosis
RVLGANYKRLPLGV

SEQ ID NO: 146790 - protein, 14 aa, Mycobacterium tuberculosis
VLGANYKRLPLGVF

SEQ ID NO: 146791 - protein, 14 aa, Mycobacterium tuberculosis
LGANYKRLPLGVFT

SEQ ID NO: 146792 - protein, 14 aa, Mycobacterium tuberculosis
GANYKRLPLGVFTE

SEQ ID NO: 146793 - protein, 14 aa, Mycobacterium tuberculosis
ANYKRLPLGVFTEA

SEQ ID NO: 146794 - protein, 14 aa, Mycobacterium tuberculosis
NYKRLPLGVFTEAS

SEQ ID NO: 146795 - protein, 14 aa, Mycobacterium tuberculosis
YKRLPLGVFTEASE

SEQ ID NO: 146796 - protein, 14 aa, Mycobacterium tuberculosis
KRLPLGVFTEASES

SEQ ID NO: 146797 - protein, 14 aa, Mycobacterium tuberculosis
RLPLGVFTEASESL

SEQ ID NO: 146798 - protein, 14 aa, Mycobacterium tuberculosis
LPLGVFTEASESLT

SEQ ID NO: 146799 - protein, 14 aa, Mycobacterium tuberculosis
PLGVFTEASESLTN

SEQ ID NO: 146800 - protein, 14 aa, Mycobacterium tuberculosis
LGVFTEASESLTND

SEQ ID NO: 146801 - protein, 14 aa, Mycobacterium tuberculosis
GVFTEASESLTNDF

SEQ ID NO: 146802 - protein, 14 aa, Mycobacterium tuberculosis
VFTEASESLTNDFF

SEQ ID NO: 146803 - protein, 14 aa, Mycobacterium tuberculosis
FTEASESLTNDFFV

SEQ ID NO: 146804 - protein, 14 aa, Mycobacterium tuberculosis
TEASESLTNDFFVN

SEQ ID NO: 146805 - protein, 14 aa, Mycobacterium tuberculosis
EASESLTNDFFVNL

SEQ ID NO: 146806 - protein, 14 aa, Mycobacterium tuberculosis
ASESLTNDFFVNLL

SEQ ID NO: 146807 - protein, 14 aa, Mycobacterium tuberculosis
SESLTNDFFVNLLD

SEQ ID NO: 146808 - protein, 14 aa, Mycobacterium tuberculosis
ESLTNDFFVNLLDM

SEQ ID NO: 146809 - protein, 14 aa, Mycobacterium tuberculosis
SLTNDFFVNLLDMG

SEQ ID NO: 146810 - protein, 14 aa, Mycobacterium tuberculosis
LTNDFFVNLLDMGI

SEQ ID NO: 146811 - protein, 14 aa, Mycobacterium tuberculosis
TNDFFVNLLDMGIT

SEQ ID NO: 146812 - protein, 14 aa, Mycobacterium tuberculosis
NDFFVNLLDMGITW

SEQ ID NO: 146813 - protein, 14 aa, Mycobacterium tuberculosis
DFFVNLLDMGITWE

SEQ ID NO: 146814 - protein, 14 aa, Mycobacterium tuberculosis
FFVNLLDMGITWEP

SEQ ID NO: 146815 - protein, 14 aa, Mycobacterium tuberculosis
FVNLLDMGITWEPS

SEQ ID NO: 146816 - protein, 14 aa, Mycobacterium tuberculosis
VNLLDMGITWEPSP

SEQ ID NO: 146817 - protein, 14 aa, Mycobacterium tuberculosis
NLLDMGITWEPSPA

SEQ ID NO: 146818 - protein, 14 aa, Mycobacterium tuberculosis
LLDMGITWEPSPAD

SEQ ID NO: 146819 - protein, 14 aa, Mycobacterium tuberculosis
LDMGITWEPSPADD

SEQ ID NO: 146820 - protein, 14 aa, Mycobacterium tuberculosis
DMGITWEPSPADDG

SEQ ID NO: 146821 - protein, 14 aa, Mycobacterium tuberculosis
MGITWEPSPADDGT

SEQ ID NO: 146822 - protein, 14 aa, Mycobacterium tuberculosis
GITWEPSPADDGTY

SEQ ID NO: 146823 - protein, 14 aa, Mycobacterium tuberculosis
ITWEPSPADDGTYQ

SEQ ID NO: 146824 - protein, 14 aa, Mycobacterium tuberculosis
TWEPSPADDGTYQG

SEQ ID NO: 146825 - protein, 14 aa, Mycobacterium tuberculosis
WEPSPADDGTYQGK

SEQ ID NO: 146826 - protein, 14 aa, Mycobacterium tuberculosis
EPSPADDGTYQGKD

SEQ ID NO: 146827 - protein, 14 aa, Mycobacterium tuberculosis
PSPADDGTYQGKDG

SEQ ID NO: 146828 - protein, 14 aa, Mycobacterium tuberculosis
SPADDGTYQGKDGS

SEQ ID NO: 146829 - protein, 14 aa, Mycobacterium tuberculosis
PADDGTYQGKDGSG

SEQ ID NO: 146830 - protein, 14 aa, Mycobacterium tuberculosis
ADDGTYQGKDGSGK

SEQ ID NO: 146831 - protein, 14 aa, Mycobacterium tuberculosis
DDGTYQGKDGSGKV

SEQ ID NO: 146832 - protein, 14 aa, Mycobacterium tuberculosis
DGTYQGKDGSGKVK

SEQ ID NO: 146833 - protein, 14 aa, Mycobacterium tuberculosis
GTYQGKDGSGKVKW

SEQ ID NO: 146834 - protein, 14 aa, Mycobacterium tuberculosis
TYQGKDGSGKVKWT

SEQ ID NO: 146835 - protein, 14 aa, Mycobacterium tuberculosis
YQGKDGSGKVKWTG

SEQ ID NO: 146836 - protein, 14 aa, Mycobacterium tuberculosis
QGKDGSGKVKWTGS

SEQ ID NO: 146837 - protein, 14 aa, Mycobacterium tuberculosis
GKDGSGKVKWTGSR

SEQ ID NO: 146838 - protein, 14 aa, Mycobacterium tuberculosis
KDGSGKVKWTGSRV

SEQ ID NO: 146839 - protein, 14 aa, Mycobacterium tuberculosis
DGSGKVKWTGSRVD

SEQ ID NO: 146840 - protein, 14 aa, Mycobacterium tuberculosis
GSGKVKWTGSRVDL

SEQ ID NO: 146841 - protein, 14 aa, Mycobacterium tuberculosis
SGKVKWTGSRVDLV

SEQ ID NO: 146842 - protein, 14 aa, Mycobacterium tuberculosis
GKVKWTGSRVDLVF

SEQ ID NO: 146843 - protein, 14 aa, Mycobacterium tuberculosis
KVKWTGSRVDLVFG

SEQ ID NO: 146844 - protein, 14 aa, Mycobacterium tuberculosis
VKWTGSRVDLVFGS

SEQ ID NO: 146845 - protein, 14 aa, Mycobacterium tuberculosis
KWTGSRVDLVFGSN

SEQ ID NO: 146846 - protein, 14 aa, Mycobacterium tuberculosis
WTGSRVDLVFGSNS

SEQ ID NO: 146847 - protein, 14 aa, Mycobacterium tuberculosis
TGSRVDLVFGSNSE

SEQ ID NO: 146848 - protein, 14 aa, Mycobacterium tuberculosis
GSRVDLVFGSNSEL

SEQ ID NO: 146849 - protein, 14 aa, Mycobacterium tuberculosis
SRVDLVFGSNSELR

SEQ ID NO: 146850 - protein, 14 aa, Mycobacterium tuberculosis
RVDLVFGSNSELRA

SEQ ID NO: 146851 - protein, 14 aa, Mycobacterium tuberculosis
VDLVFGSNSELRAL

SEQ ID NO: 146852 - protein, 14 aa, Mycobacterium tuberculosis
DLVFGSNSELRALV

SEQ ID NO: 146853 - protein, 14 aa, Mycobacterium tuberculosis
LVFGSNSELRALVE

SEQ ID NO: 146854 - protein, 14 aa, Mycobacterium tuberculosis
VFGSNSELRALVEV

SEQ ID NO: 146855 - protein, 14 aa, Mycobacterium tuberculosis
FGSNSELRALVEVY

SEQ ID NO: 146856 - protein, 14 aa, Mycobacterium tuberculosis
GSNSELRALVEVYG

SEQ ID NO: 146857 - protein, 14 aa, Mycobacterium tuberculosis
SNSELRALVEVYGA

SEQ ID NO: 146858 - protein, 14 aa, Mycobacterium tuberculosis
NSELRALVEVYGAD

SEQ ID NO: 146859 - protein, 14 aa, Mycobacterium tuberculosis
SELRALVEVYGADD

SEQ ID NO: 146860 - protein, 14 aa, Mycobacterium tuberculosis
ELRALVEVYGADDA

SEQ ID NO: 146861 - protein, 14 aa, Mycobacterium tuberculosis
LRALVEVYGADDAQ

SEQ ID NO: 146862 - protein, 14 aa, Mycobacterium tuberculosis
RALVEVYGADDAQP

SEQ ID NO: 146863 - protein, 14 aa, Mycobacterium tuberculosis
ALVEVYGADDAQPK

SEQ ID NO: 146864 - protein, 14 aa, Mycobacterium tuberculosis
LVEVYGADDAQPKF

SEQ ID NO: 146865 - protein, 14 aa, Mycobacterium tuberculosis
VEVYGADDAQPKFV

SEQ ID NO: 146866 - protein, 14 aa, Mycobacterium tuberculosis
EVYGADDAQPKFVQ

SEQ ID NO: 146867 - protein, 14 aa, Mycobacterium tuberculosis
VYGADDAQPKFVQD

SEQ ID NO: 146868 - protein, 14 aa, Mycobacterium tuberculosis
YGADDAQPKFVQDF

SEQ ID NO: 146869 - protein, 14 aa, Mycobacterium tuberculosis
GADDAQPKFVQDFV

SEQ ID NO: 146870 - protein, 14 aa, Mycobacterium tuberculosis
ADDAQPKFVQDFVA

SEQ ID NO: 146871 - protein, 14 aa, Mycobacterium tuberculosis
DDAQPKFVQDFVAA

SEQ ID NO: 146872 - protein, 14 aa, Mycobacterium tuberculosis
DAQPKFVQDFVAAW

SEQ ID NO: 146873 - protein, 14 aa, Mycobacterium tuberculosis
AQPKFVQDFVAAWD

SEQ ID NO: 146874 - protein, 14 aa, Mycobacterium tuberculosis
QPKFVQDFVAAWDK

SEQ ID NO: 146875 - protein, 14 aa, Mycobacterium tuberculosis
PKFVQDFVAAWDKV

SEQ ID NO: 146876 - protein, 14 aa, Mycobacterium tuberculosis
KFVQDFVAAWDKVM

SEQ ID NO: 146877 - protein, 14 aa, Mycobacterium tuberculosis
FVQDFVAAWDKVMN

SEQ ID NO: 146878 - protein, 14 aa, Mycobacterium tuberculosis
VQDFVAAWDKVMNL

SEQ ID NO: 146879 - protein, 14 aa, Mycobacterium tuberculosis
QDFVAAWDKVMNLD

SEQ ID NO: 146880 - protein, 14 aa, Mycobacterium tuberculosis
DFVAAWDKVMNLDR

SEQ ID NO: 146881 - protein, 14 aa, Mycobacterium tuberculosis
FVAAWDKVMNLDRF

SEQ ID NO: 146882 - protein, 14 aa, Mycobacterium tuberculosis
VAAWDKVMNLDRFD

SEQ ID NO: 146883 - protein, 14 aa, Mycobacterium tuberculosis
AAWDKVMNLDRFDV

SEQ ID NO: 146884 - protein, 14 aa, Mycobacterium tuberculosis
AWDKVMNLDRFDVR

SEQ ID NO: 146885 - protein, 15 aa, Mycobacterium tuberculosis
MPEQHPPITETTTGA

SEQ ID NO: 146886 - protein, 15 aa, Mycobacterium tuberculosis
PEQHPPITETTTGAA

SEQ ID NO: 146887 - protein, 15 aa, Mycobacterium tuberculosis
EQHPPITETTTGAAS

SEQ ID NO: 146888 - protein, 15 aa, Mycobacterium tuberculosis
QHPPITETTTGAASN

SEQ ID NO: 146889 - protein, 15 aa, Mycobacterium tuberculosis
HPPITETTTGAASNG

SEQ ID NO: 146890 - protein, 15 aa, Mycobacterium tuberculosis
PPITETTTGAASNGC

SEQ ID NO: 146891 - protein, 15 aa, Mycobacterium tuberculosis
PITETTTGAASNGCP

SEQ ID NO: 146892 - protein, 15 aa, Mycobacterium tuberculosis
ITETTTGAASNGCPV

SEQ ID NO: 146893 - protein, 15 aa, Mycobacterium tuberculosis
TETTTGAASNGCPVV

SEQ ID NO: 146894 - protein, 15 aa, Mycobacterium tuberculosis
ETTTGAASNGCPVVG

SEQ ID NO: 146895 - protein, 15 aa, Mycobacterium tuberculosis
TTTGAASNGCPVVGH

SEQ ID NO: 146896 - protein, 15 aa, Mycobacterium tuberculosis
TTGAASNGCPVVGHM

SEQ ID NO: 146897 - protein, 15 aa, Mycobacterium tuberculosis
TGAASNGCPVVGHMK

SEQ ID NO: 146898 - protein, 15 aa, Mycobacterium tuberculosis
GAASNGCPVVGHMKY

SEQ ID NO: 146899 - protein, 15 aa, Mycobacterium tuberculosis
AASNGCPVVGHMKYP

SEQ ID NO: 146900 - protein, 15 aa, Mycobacterium tuberculosis
ASNGCPVVGHMKYPV

SEQ ID NO: 146901 - protein, 15 aa, Mycobacterium tuberculosis
SNGCPVVGHMKYPVE

SEQ ID NO: 146902 - protein, 15 aa, Mycobacterium tuberculosis
NGCPVVGHMKYPVEG

SEQ ID NO: 146903 - protein, 15 aa, Mycobacterium tuberculosis
GCPVVGHMKYPVEGG

SEQ ID NO: 146904 - protein, 15 aa, Mycobacterium tuberculosis
CPVVGHMKYPVEGGG

SEQ ID NO: 146905 - protein, 15 aa, Mycobacterium tuberculosis
PVVGHMKYPVEGGGN

SEQ ID NO: 146906 - protein, 15 aa, Mycobacterium tuberculosis
VVGHMKYPVEGGGNQ

SEQ ID NO: 146907 - protein, 15 aa, Mycobacterium tuberculosis
VGHMKYPVEGGGNQD

SEQ ID NO: 146908 - protein, 15 aa, Mycobacterium tuberculosis
GHMKYPVEGGGNQDW

SEQ ID NO: 146909 - protein, 15 aa, Mycobacterium tuberculosis
HMKYPVEGGGNQDWW

SEQ ID NO: 146910 - protein, 15 aa, Mycobacterium tuberculosis
MKYPVEGGGNQDWWP

SEQ ID NO: 146911 - protein, 15 aa, Mycobacterium tuberculosis
KYPVEGGGNQDWWPN

SEQ ID NO: 146912 - protein, 15 aa, Mycobacterium tuberculosis
YPVEGGGNQDWWPNR

SEQ ID NO: 146913 - protein, 15 aa, Mycobacterium tuberculosis
PVEGGGNQDWWPNRL

SEQ ID NO: 146914 - protein, 15 aa, Mycobacterium tuberculosis
VEGGGNQDWWPNRLN

SEQ ID NO: 146915 - protein, 15 aa, Mycobacterium tuberculosis
EGGGNQDWWPNRLNL

SEQ ID NO: 146916 - protein, 15 aa, Mycobacterium tuberculosis
GGGNQDWWPNRLNLK

SEQ ID NO: 146917 - protein, 15 aa, Mycobacterium tuberculosis
GGNQDWWPNRLNLKV

SEQ ID NO: 146918 - protein, 15 aa, Mycobacterium tuberculosis
GNQDWWPNRLNLKVL

SEQ ID NO: 146919 - protein, 15 aa, Mycobacterium tuberculosis
NQDWWPNRLNLKVLH

SEQ ID NO: 146920 - protein, 15 aa, Mycobacterium tuberculosis
QDWWPNRLNLKVLHQ

SEQ ID NO: 146921 - protein, 15 aa, Mycobacterium tuberculosis
DWWPNRLNLKVLHQN

SEQ ID NO: 146922 - protein, 15 aa, Mycobacterium tuberculosis
WWPNRLNLKVLHQNP

SEQ ID NO: 146923 - protein, 15 aa, Mycobacterium tuberculosis
WPNRLNLKVLHQNPA

SEQ ID NO: 146924 - protein, 15 aa, Mycobacterium tuberculosis
PNRLNLKVLHQNPAV

SEQ ID NO: 146925 - protein, 15 aa, Mycobacterium tuberculosis
NRLNLKVLHQNPAVA

SEQ ID NO: 146926 - protein, 15 aa, Mycobacterium tuberculosis
RLNLKVLHQNPAVAD

SEQ ID NO: 146927 - protein, 15 aa, Mycobacterium tuberculosis
LNLKVLHQNPAVADP

SEQ ID NO: 146928 - protein, 15 aa, Mycobacterium tuberculosis
NLKVLHQNPAVADPM

SEQ ID NO: 146929 - protein, 15 aa, Mycobacterium tuberculosis
LKVLHQNPAVADPMG

SEQ ID NO: 146930 - protein, 15 aa, Mycobacterium tuberculosis
KVLHQNPAVADPMGA

SEQ ID NO: 146931 - protein, 15 aa, Mycobacterium tuberculosis
VLHQNPAVADPMGAA

SEQ ID NO: 146932 - protein, 15 aa, Mycobacterium tuberculosis
LHQNPAVADPMGAAF

SEQ ID NO: 146933 - protein, 15 aa, Mycobacterium tuberculosis
HQNPAVADPMGAAFD

SEQ ID NO: 146934 - protein, 15 aa, Mycobacterium tuberculosis
QNPAVADPMGAAFDY

SEQ ID NO: 146935 - protein, 15 aa, Mycobacterium tuberculosis
NPAVADPMGAAFDYA

SEQ ID NO: 146936 - protein, 15 aa, Mycobacterium tuberculosis
PAVADPMGAAFDYAA

SEQ ID NO: 146937 - protein, 15 aa, Mycobacterium tuberculosis
AVADPMGAAFDYAAE

SEQ ID NO: 146938 - protein, 15 aa, Mycobacterium tuberculosis
VADPMGAAFDYAAEV

SEQ ID NO: 146939 - protein, 15 aa, Mycobacterium tuberculosis
ADPMGAAFDYAAEVA

SEQ ID NO: 146940 - protein, 15 aa, Mycobacterium tuberculosis
DPMGAAFDYAAEVAT

SEQ ID NO: 146941 - protein, 15 aa, Mycobacterium tuberculosis
PMGAAFDYAAEVATI

SEQ ID NO: 146942 - protein, 15 aa, Mycobacterium tuberculosis
MGAAFDYAAEVATID

SEQ ID NO: 146943 - protein, 15 aa, Mycobacterium tuberculosis
GAAFDYAAEVATIDV

SEQ ID NO: 146944 - protein, 15 aa, Mycobacterium tuberculosis
AAFDYAAEVATIDVD

SEQ ID NO: 146945 - protein, 15 aa, Mycobacterium tuberculosis
AFDYAAEVATIDVDA

SEQ ID NO: 146946 - protein, 15 aa, Mycobacterium tuberculosis
FDYAAEVATIDVDAL

SEQ ID NO: 146947 - protein, 15 aa, Mycobacterium tuberculosis
DYAAEVATIDVDALT

SEQ ID NO: 146948 - protein, 15 aa, Mycobacterium tuberculosis
YAAEVATIDVDALTR

SEQ ID NO: 146949 - protein, 15 aa, Mycobacterium tuberculosis
AAEVATIDVDALTRD

SEQ ID NO: 146950 - protein, 15 aa, Mycobacterium tuberculosis
AEVATIDVDALTRDI

SEQ ID NO: 146951 - protein, 15 aa, Mycobacterium tuberculosis
EVATIDVDALTRDIE

SEQ ID NO: 146952 - protein, 15 aa, Mycobacterium tuberculosis
VATIDVDALTRDIEE

SEQ ID NO: 146953 - protein, 15 aa, Mycobacterium tuberculosis
ATIDVDALTRDIEEV

SEQ ID NO: 146954 - protein, 15 aa, Mycobacterium tuberculosis
TIDVDALTRDIEEVM

SEQ ID NO: 146955 - protein, 15 aa, Mycobacterium tuberculosis
IDVDALTRDIEEVMT

SEQ ID NO: 146956 - protein, 15 aa, Mycobacterium tuberculosis
DVDALTRDIEEVMTT

SEQ ID NO: 146957 - protein, 15 aa, Mycobacterium tuberculosis
VDALTRDIEEVMTTS

SEQ ID NO: 146958 - protein, 15 aa, Mycobacterium tuberculosis
DALTRDIEEVMTTSQ

SEQ ID NO: 146959 - protein, 15 aa, Mycobacterium tuberculosis
ALTRDIEEVMTTSQP

SEQ ID NO: 146960 - protein, 15 aa, Mycobacterium tuberculosis
LTRDIEEVMTTSQPW

SEQ ID NO: 146961 - protein, 15 aa, Mycobacterium tuberculosis
TRDIEEVMTTSQPWW

SEQ ID NO: 146962 - protein, 15 aa, Mycobacterium tuberculosis
RDIEEVMTTSQPWWP

SEQ ID NO: 146963 - protein, 15 aa, Mycobacterium tuberculosis
DIEEVMTTSQPWWPA

SEQ ID NO: 146964 - protein, 15 aa, Mycobacterium tuberculosis
IEEVMTTSQPWWPAD

SEQ ID NO: 146965 - protein, 15 aa, Mycobacterium tuberculosis
EEVMTTSQPWWPADY

SEQ ID NO: 146966 - protein, 15 aa, Mycobacterium tuberculosis
EVMTTSQPWWPADYG

SEQ ID NO: 146967 - protein, 15 aa, Mycobacterium tuberculosis
VMTTSQPWWPADYGH

SEQ ID NO: 146968 - protein, 15 aa, Mycobacterium tuberculosis
MTTSQPWWPADYGHY

SEQ ID NO: 146969 - protein, 15 aa, Mycobacterium tuberculosis
TTSQPWWPADYGHYG

SEQ ID NO: 146970 - protein, 15 aa, Mycobacterium tuberculosis
TSQPWWPADYGHYGP

SEQ ID NO: 146971 - protein, 15 aa, Mycobacterium tuberculosis
SQPWWPADYGHYGPL

SEQ ID NO: 146972 - protein, 15 aa, Mycobacterium tuberculosis
QPWWPADYGHYGPLF

SEQ ID NO: 146973 - protein, 15 aa, Mycobacterium tuberculosis
PWWPADYGHYGPLFI

SEQ ID NO: 146974 - protein, 15 aa, Mycobacterium tuberculosis
WWPADYGHYGPLFIR

SEQ ID NO: 146975 - protein, 15 aa, Mycobacterium tuberculosis
WPADYGHYGPLFIRM

SEQ ID NO: 146976 - protein, 15 aa, Mycobacterium tuberculosis
PADYGHYGPLFIRMA

SEQ ID NO: 146977 - protein, 15 aa, Mycobacterium tuberculosis
ADYGHYGPLFIRMAW

SEQ ID NO: 146978 - protein, 15 aa, Mycobacterium tuberculosis
DYGHYGPLFIRMAWH

SEQ ID NO: 146979 - protein, 15 aa, Mycobacterium tuberculosis
YGHYGPLFIRMAWHA

SEQ ID NO: 146980 - protein, 15 aa, Mycobacterium tuberculosis
GHYGPLFIRMAWHAA

SEQ ID NO: 146981 - protein, 15 aa, Mycobacterium tuberculosis
HYGPLFIRMAWHAAG

SEQ ID NO: 146982 - protein, 15 aa, Mycobacterium tuberculosis
YGPLFIRMAWHAAGT

SEQ ID NO: 146983 - protein, 15 aa, Mycobacterium tuberculosis
GPLFIRMAWHAAGTY

SEQ ID NO: 146984 - protein, 15 aa, Mycobacterium tuberculosis
PLFIRMAWHAAGTYR

SEQ ID NO: 146985 - protein, 15 aa, Mycobacterium tuberculosis
LFIRMAWHAAGTYRI

SEQ ID NO: 146986 - protein, 15 aa, Mycobacterium tuberculosis
FIRMAWHAAGTYRIH

SEQ ID NO: 146987 - protein, 15 aa, Mycobacterium tuberculosis
IRMAWHAAGTYRIHD

SEQ ID NO: 146988 - protein, 15 aa, Mycobacterium tuberculosis
RMAWHAAGTYRIHDG

SEQ ID NO: 146989 - protein, 15 aa, Mycobacterium tuberculosis
MAWHAAGTYRIHDGR

SEQ ID NO: 146990 - protein, 15 aa, Mycobacterium tuberculosis
AWHAAGTYRIHDGRG

SEQ ID NO: 146991 - protein, 15 aa, Mycobacterium tuberculosis
WHAAGTYRIHDGRGG

SEQ ID NO: 146992 - protein, 15 aa, Mycobacterium tuberculosis
HAAGTYRIHDGRGGA

SEQ ID NO: 146993 - protein, 15 aa, Mycobacterium tuberculosis
AAGTYRIHDGRGGAG

SEQ ID NO: 146994 - protein, 15 aa, Mycobacterium tuberculosis
AGTYRIHDGRGGAGG

SEQ ID NO: 146995 - protein, 15 aa, Mycobacterium tuberculosis
GTYRIHDGRGGAGGG

SEQ ID NO: 146996 - protein, 15 aa, Mycobacterium tuberculosis
TYRIHDGRGGAGGGM

SEQ ID NO: 146997 - protein, 15 aa, Mycobacterium tuberculosis
YRIHDGRGGAGGGMQ

SEQ ID NO: 146998 - protein, 15 aa, Mycobacterium tuberculosis
RIHDGRGGAGGGMQR

SEQ ID NO: 146999 - protein, 15 aa, Mycobacterium tuberculosis
IHDGRGGAGGGMQRF

SEQ ID NO: 147000 - protein, 15 aa, Mycobacterium tuberculosis
HDGRGGAGGGMQRFA

SEQ ID NO: 147001 - protein, 15 aa, Mycobacterium tuberculosis
DGRGGAGGGMQRFAP

SEQ ID NO: 147002 - protein, 15 aa, Mycobacterium tuberculosis
GRGGAGGGMQRFAPL

SEQ ID NO: 147003 - protein, 15 aa, Mycobacterium tuberculosis
RGGAGGGMQRFAPLN

SEQ ID NO: 147004 - protein, 15 aa, Mycobacterium tuberculosis
GGAGGGMQRFAPLNS

SEQ ID NO: 147005 - protein, 15 aa, Mycobacterium tuberculosis
GAGGGMQRFAPLNSW

SEQ ID NO: 147006 - protein, 15 aa, Mycobacterium tuberculosis
AGGGMQRFAPLNSWP

SEQ ID NO: 147007 - protein, 15 aa, Mycobacterium tuberculosis
GGGMQRFAPLNSWPD

SEQ ID NO: 147008 - protein, 15 aa, Mycobacterium tuberculosis
GGMQRFAPLNSWPDN

SEQ ID NO: 147009 - protein, 15 aa, Mycobacterium tuberculosis
GMQRFAPLNSWPDNA

SEQ ID NO: 147010 - protein, 15 aa, Mycobacterium tuberculosis
MQRFAPLNSWPDNAS

SEQ ID NO: 147011 - protein, 15 aa, Mycobacterium tuberculosis
QRFAPLNSWPDNASL

SEQ ID NO: 147012 - protein, 15 aa, Mycobacterium tuberculosis
RFAPLNSWPDNASLD

SEQ ID NO: 147013 - protein, 15 aa, Mycobacterium tuberculosis
FAPLNSWPDNASLDK

SEQ ID NO: 147014 - protein, 15 aa, Mycobacterium tuberculosis
APLNSWPDNASLDKA

SEQ ID NO: 147015 - protein, 15 aa, Mycobacterium tuberculosis
PLNSWPDNASLDKAR

SEQ ID NO: 147016 - protein, 15 aa, Mycobacterium tuberculosis
LNSWPDNASLDKARR

SEQ ID NO: 147017 - protein, 15 aa, Mycobacterium tuberculosis
NSWPDNASLDKARRL

SEQ ID NO: 147018 - protein, 15 aa, Mycobacterium tuberculosis
SWPDNASLDKARRLL

SEQ ID NO: 147019 - protein, 15 aa, Mycobacterium tuberculosis
WPDNASLDKARRLLW

SEQ ID NO: 147020 - protein, 15 aa, Mycobacterium tuberculosis
PDNASLDKARRLLWP

SEQ ID NO: 147021 - protein, 15 aa, Mycobacterium tuberculosis
DNASLDKARRLLWPV

SEQ ID NO: 147022 - protein, 15 aa, Mycobacterium tuberculosis
NASLDKARRLLWPVK

SEQ ID NO: 147023 - protein, 15 aa, Mycobacterium tuberculosis
ASLDKARRLLWPVKK

SEQ ID NO: 147024 - protein, 15 aa, Mycobacterium tuberculosis
SLDKARRLLWPVKKK

SEQ ID NO: 147025 - protein, 15 aa, Mycobacterium tuberculosis
LDKARRLLWPVKKKY

SEQ ID NO: 147026 - protein, 15 aa, Mycobacterium tuberculosis
DKARRLLWPVKKKYG

SEQ ID NO: 147027 - protein, 15 aa, Mycobacterium tuberculosis
KARRLLWPVKKKYGK

SEQ ID NO: 147028 - protein, 15 aa, Mycobacterium tuberculosis
ARRLLWPVKKKYGKK

SEQ ID NO: 147029 - protein, 15 aa, Mycobacterium tuberculosis
RRLLWPVKKKYGKKL

SEQ ID NO: 147030 - protein, 15 aa, Mycobacterium tuberculosis
RLLWPVKKKYGKKLS

SEQ ID NO: 147031 - protein, 15 aa, Mycobacterium tuberculosis
LLWPVKKKYGKKLSW

SEQ ID NO: 147032 - protein, 15 aa, Mycobacterium tuberculosis
LWPVKKKYGKKLSWA

SEQ ID NO: 147033 - protein, 15 aa, Mycobacterium tuberculosis
WPVKKKYGKKLSWAD

SEQ ID NO: 147034 - protein, 15 aa, Mycobacterium tuberculosis
PVKKKYGKKLSWADL

SEQ ID NO: 147035 - protein, 15 aa, Mycobacterium tuberculosis
VKKKYGKKLSWADLI

SEQ ID NO: 147036 - protein, 15 aa, Mycobacterium tuberculosis
KKKYGKKLSWADLIV

SEQ ID NO: 147037 - protein, 15 aa, Mycobacterium tuberculosis
KKYGKKLSWADLIVF

SEQ ID NO: 147038 - protein, 15 aa, Mycobacterium tuberculosis
KYGKKLSWADLIVFA

SEQ ID NO: 147039 - protein, 15 aa, Mycobacterium tuberculosis
YGKKLSWADLIVFAG

SEQ ID NO: 147040 - protein, 15 aa, Mycobacterium tuberculosis
GKKLSWADLIVFAGN

SEQ ID NO: 147041 - protein, 15 aa, Mycobacterium tuberculosis
KKLSWADLIVFAGNC

SEQ ID NO: 147042 - protein, 15 aa, Mycobacterium tuberculosis
KLSWADLIVFAGNCA

SEQ ID NO: 147043 - protein, 15 aa, Mycobacterium tuberculosis
LSWADLIVFAGNCAL

SEQ ID NO: 147044 - protein, 15 aa, Mycobacterium tuberculosis
SWADLIVFAGNCALE

SEQ ID NO: 147045 - protein, 15 aa, Mycobacterium tuberculosis
WADLIVFAGNCALES

SEQ ID NO: 147046 - protein, 15 aa, Mycobacterium tuberculosis
ADLIVFAGNCALESM

SEQ ID NO: 147047 - protein, 15 aa, Mycobacterium tuberculosis
DLIVFAGNCALESMG

SEQ ID NO: 147048 - protein, 15 aa, Mycobacterium tuberculosis
LIVFAGNCALESMGF

SEQ ID NO: 147049 - protein, 15 aa, Mycobacterium tuberculosis
IVFAGNCALESMGFK

SEQ ID NO: 147050 - protein, 15 aa, Mycobacterium tuberculosis
VFAGNCALESMGFKT

SEQ ID NO: 147051 - protein, 15 aa, Mycobacterium tuberculosis
FAGNCALESMGFKTF

SEQ ID NO: 147052 - protein, 15 aa, Mycobacterium tuberculosis
AGNCALESMGFKTFG

SEQ ID NO: 147053 - protein, 15 aa, Mycobacterium tuberculosis
GNCALESMGFKTFGF

SEQ ID NO: 147054 - protein, 15 aa, Mycobacterium tuberculosis
NCALESMGFKTFGFG

SEQ ID NO: 147055 - protein, 15 aa, Mycobacterium tuberculosis
CALESMGFKTFGFGF

SEQ ID NO: 147056 - protein, 15 aa, Mycobacterium tuberculosis
ALESMGFKTFGFGFG

SEQ ID NO: 147057 - protein, 15 aa, Mycobacterium tuberculosis
LESMGFKTFGFGFGR

SEQ ID NO: 147058 - protein, 15 aa, Mycobacterium tuberculosis
ESMGFKTFGFGFGRV

SEQ ID NO: 147059 - protein, 15 aa, Mycobacterium tuberculosis
SMGFKTFGFGFGRVD

SEQ ID NO: 147060 - protein, 15 aa, Mycobacterium tuberculosis
MGFKTFGFGFGRVDQ

SEQ ID NO: 147061 - protein, 15 aa, Mycobacterium tuberculosis
GFKTFGFGFGRVDQW

SEQ ID NO: 147062 - protein, 15 aa, Mycobacterium tuberculosis
FKTFGFGFGRVDQWE

SEQ ID NO: 147063 - protein, 15 aa, Mycobacterium tuberculosis
KTFGFGFGRVDQWEP

SEQ ID NO: 147064 - protein, 15 aa, Mycobacterium tuberculosis
TFGFGFGRVDQWEPD

SEQ ID NO: 147065 - protein, 15 aa, Mycobacterium tuberculosis
FGFGFGRVDQWEPDE

SEQ ID NO: 147066 - protein, 15 aa, Mycobacterium tuberculosis
GFGFGRVDQWEPDEV

SEQ ID NO: 147067 - protein, 15 aa, Mycobacterium tuberculosis
FGFGRVDQWEPDEVY

SEQ ID NO: 147068 - protein, 15 aa, Mycobacterium tuberculosis
GFGRVDQWEPDEVYW

SEQ ID NO: 147069 - protein, 15 aa, Mycobacterium tuberculosis
FGRVDQWEPDEVYWG

SEQ ID NO: 147070 - protein, 15 aa, Mycobacterium tuberculosis
GRVDQWEPDEVYWGK

SEQ ID NO: 147071 - protein, 15 aa, Mycobacterium tuberculosis
RVDQWEPDEVYWGKE

SEQ ID NO: 147072 - protein, 15 aa, Mycobacterium tuberculosis
VDQWEPDEVYWGKEA

SEQ ID NO: 147073 - protein, 15 aa, Mycobacterium tuberculosis
DQWEPDEVYWGKEAT

SEQ ID NO: 147074 - protein, 15 aa, Mycobacterium tuberculosis
QWEPDEVYWGKEATW

SEQ ID NO: 147075 - protein, 15 aa, Mycobacterium tuberculosis
WEPDEVYWGKEATWL

SEQ ID NO: 147076 - protein, 15 aa, Mycobacterium tuberculosis
EPDEVYWGKEATWLG

SEQ ID NO: 147077 - protein, 15 aa, Mycobacterium tuberculosis
PDEVYWGKEATWLGD

SEQ ID NO: 147078 - protein, 15 aa, Mycobacterium tuberculosis
DEVYWGKEATWLGDE

SEQ ID NO: 147079 - protein, 15 aa, Mycobacterium tuberculosis
EVYWGKEATWLGDER

SEQ ID NO: 147080 - protein, 15 aa, Mycobacterium tuberculosis
VYWGKEATWLGDERY

SEQ ID NO: 147081 - protein, 15 aa, Mycobacterium tuberculosis
YWGKEATWLGDERYS

SEQ ID NO: 147082 - protein, 15 aa, Mycobacterium tuberculosis
WGKEATWLGDERYSG

SEQ ID NO: 147083 - protein, 15 aa, Mycobacterium tuberculosis
GKEATWLGDERYSGK

SEQ ID NO: 147084 - protein, 15 aa, Mycobacterium tuberculosis
KEATWLGDERYSGKR

SEQ ID NO: 147085 - protein, 15 aa, Mycobacterium tuberculosis
EATWLGDERYSGKRD

SEQ ID NO: 147086 - protein, 15 aa, Mycobacterium tuberculosis
ATWLGDERYSGKRDL

SEQ ID NO: 147087 - protein, 15 aa, Mycobacterium tuberculosis
TWLGDERYSGKRDLE

SEQ ID NO: 147088 - protein, 15 aa, Mycobacterium tuberculosis
WLGDERYSGKRDLEN

SEQ ID NO: 147089 - protein, 15 aa, Mycobacterium tuberculosis
LGDERYSGKRDLENP

SEQ ID NO: 147090 - protein, 15 aa, Mycobacterium tuberculosis
GDERYSGKRDLENPL

SEQ ID NO: 147091 - protein, 15 aa, Mycobacterium tuberculosis
DERYSGKRDLENPLA

SEQ ID NO: 147092 - protein, 15 aa, Mycobacterium tuberculosis
ERYSGKRDLENPLAA

SEQ ID NO: 147093 - protein, 15 aa, Mycobacterium tuberculosis
RYSGKRDLENPLAAV

SEQ ID NO: 147094 - protein, 15 aa, Mycobacterium tuberculosis
YSGKRDLENPLAAVQ

SEQ ID NO: 147095 - protein, 15 aa, Mycobacterium tuberculosis
SGKRDLENPLAAVQM

SEQ ID NO: 147096 - protein, 15 aa, Mycobacterium tuberculosis
GKRDLENPLAAVQMG

SEQ ID NO: 147097 - protein, 15 aa, Mycobacterium tuberculosis
KRDLENPLAAVQMGL

SEQ ID NO: 147098 - protein, 15 aa, Mycobacterium tuberculosis
RDLENPLAAVQMGLI

SEQ ID NO: 147099 - protein, 15 aa, Mycobacterium tuberculosis
DLENPLAAVQMGLIY

SEQ ID NO: 147100 - protein, 15 aa, Mycobacterium tuberculosis
LENPLAAVQMGLIYV

SEQ ID NO: 147101 - protein, 15 aa, Mycobacterium tuberculosis
ENPLAAVQMGLIYVN

SEQ ID NO: 147102 - protein, 15 aa, Mycobacterium tuberculosis
NPLAAVQMGLIYVNP

SEQ ID NO: 147103 - protein, 15 aa, Mycobacterium tuberculosis
PLAAVQMGLIYVNPE

SEQ ID NO: 147104 - protein, 15 aa, Mycobacterium tuberculosis
LAAVQMGLIYVNPEG

SEQ ID NO: 147105 - protein, 15 aa, Mycobacterium tuberculosis
AAVQMGLIYVNPEGP

SEQ ID NO: 147106 - protein, 15 aa, Mycobacterium tuberculosis
AVQMGLIYVNPEGPN

SEQ ID NO: 147107 - protein, 15 aa, Mycobacterium tuberculosis
VQMGLIYVNPEGPNG

SEQ ID NO: 147108 - protein, 15 aa, Mycobacterium tuberculosis
QMGLIYVNPEGPNGN

SEQ ID NO: 147109 - protein, 15 aa, Mycobacterium tuberculosis
MGLIYVNPEGPNGNP

SEQ ID NO: 147110 - protein, 15 aa, Mycobacterium tuberculosis
GLIYVNPEGPNGNPD

SEQ ID NO: 147111 - protein, 15 aa, Mycobacterium tuberculosis
LIYVNPEGPNGNPDP

SEQ ID NO: 147112 - protein, 15 aa, Mycobacterium tuberculosis
IYVNPEGPNGNPDPM

SEQ ID NO: 147113 - protein, 15 aa, Mycobacterium tuberculosis
YVNPEGPNGNPDPMA

SEQ ID NO: 147114 - protein, 15 aa, Mycobacterium tuberculosis
VNPEGPNGNPDPMAA

SEQ ID NO: 147115 - protein, 15 aa, Mycobacterium tuberculosis
NPEGPNGNPDPMAAA

SEQ ID NO: 147116 - protein, 15 aa, Mycobacterium tuberculosis
PEGPNGNPDPMAAAV

SEQ ID NO: 147117 - protein, 15 aa, Mycobacterium tuberculosis
EGPNGNPDPMAAAVD

SEQ ID NO: 147118 - protein, 15 aa, Mycobacterium tuberculosis
GPNGNPDPMAAAVDI

SEQ ID NO: 147119 - protein, 15 aa, Mycobacterium tuberculosis
PNGNPDPMAAAVDIR

SEQ ID NO: 147120 - protein, 15 aa, Mycobacterium tuberculosis
NGNPDPMAAAVDIRE

SEQ ID NO: 147121 - protein, 15 aa, Mycobacterium tuberculosis
GNPDPMAAAVDIRET

SEQ ID NO: 147122 - protein, 15 aa, Mycobacterium tuberculosis
NPDPMAAAVDIRETF

SEQ ID NO: 147123 - protein, 15 aa, Mycobacterium tuberculosis
PDPMAAAVDIRETFR

SEQ ID NO: 147124 - protein, 15 aa, Mycobacterium tuberculosis
DPMAAAVDIRETFRR

SEQ ID NO: 147125 - protein, 15 aa, Mycobacterium tuberculosis
PMAAAVDIRETFRRM

SEQ ID NO: 147126 - protein, 15 aa, Mycobacterium tuberculosis
MAAAVDIRETFRRMA

SEQ ID NO: 147127 - protein, 15 aa, Mycobacterium tuberculosis
AAAVDIRETFRRMAM

SEQ ID NO: 147128 - protein, 15 aa, Mycobacterium tuberculosis
AAVDIRETFRRMAMN

SEQ ID NO: 147129 - protein, 15 aa, Mycobacterium tuberculosis
AVDIRETFRRMAMND

SEQ ID NO: 147130 - protein, 15 aa, Mycobacterium tuberculosis
VDIRETFRRMAMNDV

SEQ ID NO: 147131 - protein, 15 aa, Mycobacterium tuberculosis
DIRETFRRMAMNDVE

SEQ ID NO: 147132 - protein, 15 aa, Mycobacterium tuberculosis
IRETFRRMAMNDVET

SEQ ID NO: 147133 - protein, 15 aa, Mycobacterium tuberculosis
RETFRRMAMNDVETA

SEQ ID NO: 147134 - protein, 15 aa, Mycobacterium tuberculosis
ETFRRMAMNDVETAA

SEQ ID NO: 147135 - protein, 15 aa, Mycobacterium tuberculosis
TFRRMAMNDVETAAL

SEQ ID NO: 147136 - protein, 15 aa, Mycobacterium tuberculosis
FRRMAMNDVETAALI

SEQ ID NO: 147137 - protein, 15 aa, Mycobacterium tuberculosis
RRMAMNDVETAALIV

SEQ ID NO: 147138 - protein, 15 aa, Mycobacterium tuberculosis
RMAMNDVETAALIVG

SEQ ID NO: 147139 - protein, 15 aa, Mycobacterium tuberculosis
MAMNDVETAALIVGG

SEQ ID NO: 147140 - protein, 15 aa, Mycobacterium tuberculosis
AMNDVETAALIVGGH

SEQ ID NO: 147141 - protein, 15 aa, Mycobacterium tuberculosis
MNDVETAALIVGGHT

SEQ ID NO: 147142 - protein, 15 aa, Mycobacterium tuberculosis
NDVETAALIVGGHTF

SEQ ID NO: 147143 - protein, 15 aa, Mycobacterium tuberculosis
DVETAALIVGGHTFG

SEQ ID NO: 147144 - protein, 15 aa, Mycobacterium tuberculosis
VETAALIVGGHTFGK

SEQ ID NO: 147145 - protein, 15 aa, Mycobacterium tuberculosis
ETAALIVGGHTFGKT

SEQ ID NO: 147146 - protein, 15 aa, Mycobacterium tuberculosis
TAALIVGGHTFGKTH

SEQ ID NO: 147147 - protein, 15 aa, Mycobacterium tuberculosis
AALIVGGHTFGKTHG

SEQ ID NO: 147148 - protein, 15 aa, Mycobacterium tuberculosis
ALIVGGHTFGKTHGA

SEQ ID NO: 147149 - protein, 15 aa, Mycobacterium tuberculosis
LIVGGHTFGKTHGAG

SEQ ID NO: 147150 - protein, 15 aa, Mycobacterium tuberculosis
IVGGHTFGKTHGAGP

SEQ ID NO: 147151 - protein, 15 aa, Mycobacterium tuberculosis
VGGHTFGKTHGAGPA

SEQ ID NO: 147152 - protein, 15 aa, Mycobacterium tuberculosis
GGHTFGKTHGAGPAD

SEQ ID NO: 147153 - protein, 15 aa, Mycobacterium tuberculosis
GHTFGKTHGAGPADL

SEQ ID NO: 147154 - protein, 15 aa, Mycobacterium tuberculosis
HTFGKTHGAGPADLV

SEQ ID NO: 147155 - protein, 15 aa, Mycobacterium tuberculosis
TFGKTHGAGPADLVG

SEQ ID NO: 147156 - protein, 15 aa, Mycobacterium tuberculosis
FGKTHGAGPADLVGP

SEQ ID NO: 147157 - protein, 15 aa, Mycobacterium tuberculosis
GKTHGAGPADLVGPE

SEQ ID NO: 147158 - protein, 15 aa, Mycobacterium tuberculosis
KTHGAGPADLVGPEP

SEQ ID NO: 147159 - protein, 15 aa, Mycobacterium tuberculosis
THGAGPADLVGPEPE

SEQ ID NO: 147160 - protein, 15 aa, Mycobacterium tuberculosis
HGAGPADLVGPEPEA

SEQ ID NO: 147161 - protein, 15 aa, Mycobacterium tuberculosis
GAGPADLVGPEPEAA

SEQ ID NO: 147162 - protein, 15 aa, Mycobacterium tuberculosis
AGPADLVGPEPEAAP

SEQ ID NO: 147163 - protein, 15 aa, Mycobacterium tuberculosis
GPADLVGPEPEAAPL

SEQ ID NO: 147164 - protein, 15 aa, Mycobacterium tuberculosis
PADLVGPEPEAAPLE

SEQ ID NO: 147165 - protein, 15 aa, Mycobacterium tuberculosis
ADLVGPEPEAAPLEQ

SEQ ID NO: 147166 - protein, 15 aa, Mycobacterium tuberculosis
DLVGPEPEAAPLEQM

SEQ ID NO: 147167 - protein, 15 aa, Mycobacterium tuberculosis
LVGPEPEAAPLEQMG

SEQ ID NO: 147168 - protein, 15 aa, Mycobacterium tuberculosis
VGPEPEAAPLEQMGL

SEQ ID NO: 147169 - protein, 15 aa, Mycobacterium tuberculosis
GPEPEAAPLEQMGLG

SEQ ID NO: 147170 - protein, 15 aa, Mycobacterium tuberculosis
PEPEAAPLEQMGLGW

SEQ ID NO: 147171 - protein, 15 aa, Mycobacterium tuberculosis
EPEAAPLEQMGLGWK

SEQ ID NO: 147172 - protein, 15 aa, Mycobacterium tuberculosis
PEAAPLEQMGLGWKS

SEQ ID NO: 147173 - protein, 15 aa, Mycobacterium tuberculosis
EAAPLEQMGLGWKSS

SEQ ID NO: 147174 - protein, 15 aa, Mycobacterium tuberculosis
AAPLEQMGLGWKSSY

SEQ ID NO: 147175 - protein, 15 aa, Mycobacterium tuberculosis
APLEQMGLGWKSSYG

SEQ ID NO: 147176 - protein, 15 aa, Mycobacterium tuberculosis
PLEQMGLGWKSSYGT

SEQ ID NO: 147177 - protein, 15 aa, Mycobacterium tuberculosis
LEQMGLGWKSSYGTG

SEQ ID NO: 147178 - protein, 15 aa, Mycobacterium tuberculosis
EQMGLGWKSSYGTGT

SEQ ID NO: 147179 - protein, 15 aa, Mycobacterium tuberculosis
QMGLGWKSSYGTGTG

SEQ ID NO: 147180 - protein, 15 aa, Mycobacterium tuberculosis
MGLGWKSSYGTGTGK

SEQ ID NO: 147181 - protein, 15 aa, Mycobacterium tuberculosis
GLGWKSSYGTGTGKD

SEQ ID NO: 147182 - protein, 15 aa, Mycobacterium tuberculosis
LGWKSSYGTGTGKDA

SEQ ID NO: 147183 - protein, 15 aa, Mycobacterium tuberculosis
GWKSSYGTGTGKDAI

SEQ ID NO: 147184 - protein, 15 aa, Mycobacterium tuberculosis
WKSSYGTGTGKDAIT

SEQ ID NO: 147185 - protein, 15 aa, Mycobacterium tuberculosis
KSSYGTGTGKDAITS

SEQ ID NO: 147186 - protein, 15 aa, Mycobacterium tuberculosis
SSYGTGTGKDAITSG

SEQ ID NO: 147187 - protein, 15 aa, Mycobacterium tuberculosis
SYGTGTGKDAITSGI

SEQ ID NO: 147188 - protein, 15 aa, Mycobacterium tuberculosis
YGTGTGKDAITSGIE

SEQ ID NO: 147189 - protein, 15 aa, Mycobacterium tuberculosis
GTGTGKDAITSGIEV

SEQ ID NO: 147190 - protein, 15 aa, Mycobacterium tuberculosis
TGTGKDAITSGIEVV

SEQ ID NO: 147191 - protein, 15 aa, Mycobacterium tuberculosis
GTGKDAITSGIEVVW

SEQ ID NO: 147192 - protein, 15 aa, Mycobacterium tuberculosis
TGKDAITSGIEVVWT

SEQ ID NO: 147193 - protein, 15 aa, Mycobacterium tuberculosis
GKDAITSGIEVVWTN

SEQ ID NO: 147194 - protein, 15 aa, Mycobacterium tuberculosis
KDAITSGIEVVWTNT

SEQ ID NO: 147195 - protein, 15 aa, Mycobacterium tuberculosis
DAITSGIEVVWTNTP

SEQ ID NO: 147196 - protein, 15 aa, Mycobacterium tuberculosis
AITSGIEVVWTNTPT

SEQ ID NO: 147197 - protein, 15 aa, Mycobacterium tuberculosis
ITSGIEVVWTNTPTK

SEQ ID NO: 147198 - protein, 15 aa, Mycobacterium tuberculosis
TSGIEVVWTNTPTKW

SEQ ID NO: 147199 - protein, 15 aa, Mycobacterium tuberculosis
SGIEVVWTNTPTKWD

SEQ ID NO: 147200 - protein, 15 aa, Mycobacterium tuberculosis
GIEVVWTNTPTKWDN

SEQ ID NO: 147201 - protein, 15 aa, Mycobacterium tuberculosis
IEVVWTNTPTKWDNS

SEQ ID NO: 147202 - protein, 15 aa, Mycobacterium tuberculosis
EVVWTNTPTKWDNSF

SEQ ID NO: 147203 - protein, 15 aa, Mycobacterium tuberculosis
VVWTNTPTKWDNSFL

SEQ ID NO: 147204 - protein, 15 aa, Mycobacterium tuberculosis
VWTNTPTKWDNSFLE

SEQ ID NO: 147205 - protein, 15 aa, Mycobacterium tuberculosis
WTNTPTKWDNSFLEI

SEQ ID NO: 147206 - protein, 15 aa, Mycobacterium tuberculosis
TNTPTKWDNSFLEIL

SEQ ID NO: 147207 - protein, 15 aa, Mycobacterium tuberculosis
NTPTKWDNSFLEILY

SEQ ID NO: 147208 - protein, 15 aa, Mycobacterium tuberculosis
TPTKWDNSFLEILYG

SEQ ID NO: 147209 - protein, 15 aa, Mycobacterium tuberculosis
PTKWDNSFLEILYGY

SEQ ID NO: 147210 - protein, 15 aa, Mycobacterium tuberculosis
TKWDNSFLEILYGYE

SEQ ID NO: 147211 - protein, 15 aa, Mycobacterium tuberculosis
KWDNSFLEILYGYEW

SEQ ID NO: 147212 - protein, 15 aa, Mycobacterium tuberculosis
WDNSFLEILYGYEWE

SEQ ID NO: 147213 - protein, 15 aa, Mycobacterium tuberculosis
DNSFLEILYGYEWEL

SEQ ID NO: 147214 - protein, 15 aa, Mycobacterium tuberculosis
NSFLEILYGYEWELT

SEQ ID NO: 147215 - protein, 15 aa, Mycobacterium tuberculosis
SFLEILYGYEWELTK

SEQ ID NO: 147216 - protein, 15 aa, Mycobacterium tuberculosis
FLEILYGYEWELTKS

SEQ ID NO: 147217 - protein, 15 aa, Mycobacterium tuberculosis
LEILYGYEWELTKSP

SEQ ID NO: 147218 - protein, 15 aa, Mycobacterium tuberculosis
EILYGYEWELTKSPA

SEQ ID NO: 147219 - protein, 15 aa, Mycobacterium tuberculosis
ILYGYEWELTKSPAG

SEQ ID NO: 147220 - protein, 15 aa, Mycobacterium tuberculosis
LYGYEWELTKSPAGA

SEQ ID NO: 147221 - protein, 15 aa, Mycobacterium tuberculosis
YGYEWELTKSPAGAW

SEQ ID NO: 147222 - protein, 15 aa, Mycobacterium tuberculosis
GYEWELTKSPAGAWQ

SEQ ID NO: 147223 - protein, 15 aa, Mycobacterium tuberculosis
YEWELTKSPAGAWQY

SEQ ID NO: 147224 - protein, 15 aa, Mycobacterium tuberculosis
EWELTKSPAGAWQYT

SEQ ID NO: 147225 - protein, 15 aa, Mycobacterium tuberculosis
WELTKSPAGAWQYTA

SEQ ID NO: 147226 - protein, 15 aa, Mycobacterium tuberculosis
ELTKSPAGAWQYTAK

SEQ ID NO: 147227 - protein, 15 aa, Mycobacterium tuberculosis
LTKSPAGAWQYTAKD

SEQ ID NO: 147228 - protein, 15 aa, Mycobacterium tuberculosis
TKSPAGAWQYTAKDG

SEQ ID NO: 147229 - protein, 15 aa, Mycobacterium tuberculosis
KSPAGAWQYTAKDGA

SEQ ID NO: 147230 - protein, 15 aa, Mycobacterium tuberculosis
SPAGAWQYTAKDGAG

SEQ ID NO: 147231 - protein, 15 aa, Mycobacterium tuberculosis
PAGAWQYTAKDGAGA

SEQ ID NO: 147232 - protein, 15 aa, Mycobacterium tuberculosis
AGAWQYTAKDGAGAG

SEQ ID NO: 147233 - protein, 15 aa, Mycobacterium tuberculosis
GAWQYTAKDGAGAGT

SEQ ID NO: 147234 - protein, 15 aa, Mycobacterium tuberculosis
AWQYTAKDGAGAGTI

SEQ ID NO: 147235 - protein, 15 aa, Mycobacterium tuberculosis
WQYTAKDGAGAGTIP

SEQ ID NO: 147236 - protein, 15 aa, Mycobacterium tuberculosis
QYTAKDGAGAGTIPD

SEQ ID NO: 147237 - protein, 15 aa, Mycobacterium tuberculosis
YTAKDGAGAGTIPDP

SEQ ID NO: 147238 - protein, 15 aa, Mycobacterium tuberculosis
TAKDGAGAGTIPDPF

SEQ ID NO: 147239 - protein, 15 aa, Mycobacterium tuberculosis
AKDGAGAGTIPDPFG

SEQ ID NO: 147240 - protein, 15 aa, Mycobacterium tuberculosis
KDGAGAGTIPDPFGG

SEQ ID NO: 147241 - protein, 15 aa, Mycobacterium tuberculosis
DGAGAGTIPDPFGGP

SEQ ID NO: 147242 - protein, 15 aa, Mycobacterium tuberculosis
GAGAGTIPDPFGGPG

SEQ ID NO: 147243 - protein, 15 aa, Mycobacterium tuberculosis
AGAGTIPDPFGGPGR

SEQ ID NO: 147244 - protein, 15 aa, Mycobacterium tuberculosis
GAGTIPDPFGGPGRS

SEQ ID NO: 147245 - protein, 15 aa, Mycobacterium tuberculosis
AGTIPDPFGGPGRSP

SEQ ID NO: 147246 - protein, 15 aa, Mycobacterium tuberculosis
GTIPDPFGGPGRSPT

SEQ ID NO: 147247 - protein, 15 aa, Mycobacterium tuberculosis
TIPDPFGGPGRSPTM

SEQ ID NO: 147248 - protein, 15 aa, Mycobacterium tuberculosis
IPDPFGGPGRSPTML

SEQ ID NO: 147249 - protein, 15 aa, Mycobacterium tuberculosis
PDPFGGPGRSPTMLA

SEQ ID NO: 147250 - protein, 15 aa, Mycobacterium tuberculosis
DPFGGPGRSPTMLAT

SEQ ID NO: 147251 - protein, 15 aa, Mycobacterium tuberculosis
PFGGPGRSPTMLATD

SEQ ID NO: 147252 - protein, 15 aa, Mycobacterium tuberculosis
FGGPGRSPTMLATDL

SEQ ID NO: 147253 - protein, 15 aa, Mycobacterium tuberculosis
GGPGRSPTMLATDLS

SEQ ID NO: 147254 - protein, 15 aa, Mycobacterium tuberculosis
GPGRSPTMLATDLSL

SEQ ID NO: 147255 - protein, 15 aa, Mycobacterium tuberculosis
PGRSPTMLATDLSLR

SEQ ID NO: 147256 - protein, 15 aa, Mycobacterium tuberculosis
GRSPTMLATDLSLRV

SEQ ID NO: 147257 - protein, 15 aa, Mycobacterium tuberculosis
RSPTMLATDLSLRVD

SEQ ID NO: 147258 - protein, 15 aa, Mycobacterium tuberculosis
SPTMLATDLSLRVDP

SEQ ID NO: 147259 - protein, 15 aa, Mycobacterium tuberculosis
PTMLATDLSLRVDPI

SEQ ID NO: 147260 - protein, 15 aa, Mycobacterium tuberculosis
TMLATDLSLRVDPIY

SEQ ID NO: 147261 - protein, 15 aa, Mycobacterium tuberculosis
MLATDLSLRVDPIYE

SEQ ID NO: 147262 - protein, 15 aa, Mycobacterium tuberculosis
LATDLSLRVDPIYER

SEQ ID NO: 147263 - protein, 15 aa, Mycobacterium tuberculosis
ATDLSLRVDPIYERI

SEQ ID NO: 147264 - protein, 15 aa, Mycobacterium tuberculosis
TDLSLRVDPIYERIT

SEQ ID NO: 147265 - protein, 15 aa, Mycobacterium tuberculosis
DLSLRVDPIYERITR

SEQ ID NO: 147266 - protein, 15 aa, Mycobacterium tuberculosis
LSLRVDPIYERITRR

SEQ ID NO: 147267 - protein, 15 aa, Mycobacterium tuberculosis
SLRVDPIYERITRRW

SEQ ID NO: 147268 - protein, 15 aa, Mycobacterium tuberculosis
LRVDPIYERITRRWL

SEQ ID NO: 147269 - protein, 15 aa, Mycobacterium tuberculosis
RVDPIYERITRRWLE

SEQ ID NO: 147270 - protein, 15 aa, Mycobacterium tuberculosis
VDPIYERITRRWLEH

SEQ ID NO: 147271 - protein, 15 aa, Mycobacterium tuberculosis
DPIYERITRRWLEHP

SEQ ID NO: 147272 - protein, 15 aa, Mycobacterium tuberculosis
PIYERITRRWLEHPE

SEQ ID NO: 147273 - protein, 15 aa, Mycobacterium tuberculosis
IYERITRRWLEHPEE

SEQ ID NO: 147274 - protein, 15 aa, Mycobacterium tuberculosis
YERITRRWLEHPEEL

SEQ ID NO: 147275 - protein, 15 aa, Mycobacterium tuberculosis
ERITRRWLEHPEELA

SEQ ID NO: 147276 - protein, 15 aa, Mycobacterium tuberculosis
RITRRWLEHPEELAD

SEQ ID NO: 147277 - protein, 15 aa, Mycobacterium tuberculosis
ITRRWLEHPEELADE

SEQ ID NO: 147278 - protein, 15 aa, Mycobacterium tuberculosis
TRRWLEHPEELADEF

SEQ ID NO: 147279 - protein, 15 aa, Mycobacterium tuberculosis
RRWLEHPEELADEFA

SEQ ID NO: 147280 - protein, 15 aa, Mycobacterium tuberculosis
RWLEHPEELADEFAK

SEQ ID NO: 147281 - protein, 15 aa, Mycobacterium tuberculosis
WLEHPEELADEFAKA

SEQ ID NO: 147282 - protein, 15 aa, Mycobacterium tuberculosis
LEHPEELADEFAKAW

SEQ ID NO: 147283 - protein, 15 aa, Mycobacterium tuberculosis
EHPEELADEFAKAWY

SEQ ID NO: 147284 - protein, 15 aa, Mycobacterium tuberculosis
HPEELADEFAKAWYK

SEQ ID NO: 147285 - protein, 15 aa, Mycobacterium tuberculosis
PEELADEFAKAWYKL

SEQ ID NO: 147286 - protein, 15 aa, Mycobacterium tuberculosis
EELADEFAKAWYKLI

SEQ ID NO: 147287 - protein, 15 aa, Mycobacterium tuberculosis
ELADEFAKAWYKLIH

SEQ ID NO: 147288 - protein, 15 aa, Mycobacterium tuberculosis
LADEFAKAWYKLIHR

SEQ ID NO: 147289 - protein, 15 aa, Mycobacterium tuberculosis
ADEFAKAWYKLIHRD

SEQ ID NO: 147290 - protein, 15 aa, Mycobacterium tuberculosis
DEFAKAWYKLIHRDM

SEQ ID NO: 147291 - protein, 15 aa, Mycobacterium tuberculosis
EFAKAWYKLIHRDMG

SEQ ID NO: 147292 - protein, 15 aa, Mycobacterium tuberculosis
FAKAWYKLIHRDMGP

SEQ ID NO: 147293 - protein, 15 aa, Mycobacterium tuberculosis
AKAWYKLIHRDMGPV

SEQ ID NO: 147294 - protein, 15 aa, Mycobacterium tuberculosis
KAWYKLIHRDMGPVA

SEQ ID NO: 147295 - protein, 15 aa, Mycobacterium tuberculosis
AWYKLIHRDMGPVAR

SEQ ID NO: 147296 - protein, 15 aa, Mycobacterium tuberculosis
WYKLIHRDMGPVARY

SEQ ID NO: 147297 - protein, 15 aa, Mycobacterium tuberculosis
YKLIHRDMGPVARYL

SEQ ID NO: 147298 - protein, 15 aa, Mycobacterium tuberculosis
KLIHRDMGPVARYLG

SEQ ID NO: 147299 - protein, 15 aa, Mycobacterium tuberculosis
LIHRDMGPVARYLGP

SEQ ID NO: 147300 - protein, 15 aa, Mycobacterium tuberculosis
IHRDMGPVARYLGPL

SEQ ID NO: 147301 - protein, 15 aa, Mycobacterium tuberculosis
HRDMGPVARYLGPLV

SEQ ID NO: 147302 - protein, 15 aa, Mycobacterium tuberculosis
RDMGPVARYLGPLVP

SEQ ID NO: 147303 - protein, 15 aa, Mycobacterium tuberculosis
DMGPVARYLGPLVPK

SEQ ID NO: 147304 - protein, 15 aa, Mycobacterium tuberculosis
MGPVARYLGPLVPKQ

SEQ ID NO: 147305 - protein, 15 aa, Mycobacterium tuberculosis
GPVARYLGPLVPKQT

SEQ ID NO: 147306 - protein, 15 aa, Mycobacterium tuberculosis
PVARYLGPLVPKQTL

SEQ ID NO: 147307 - protein, 15 aa, Mycobacterium tuberculosis
VARYLGPLVPKQTLL

SEQ ID NO: 147308 - protein, 15 aa, Mycobacterium tuberculosis
ARYLGPLVPKQTLLW

SEQ ID NO: 147309 - protein, 15 aa, Mycobacterium tuberculosis
RYLGPLVPKQTLLWQ

SEQ ID NO: 147310 - protein, 15 aa, Mycobacterium tuberculosis
YLGPLVPKQTLLWQD

SEQ ID NO: 147311 - protein, 15 aa, Mycobacterium tuberculosis
LGPLVPKQTLLWQDP

SEQ ID NO: 147312 - protein, 15 aa, Mycobacterium tuberculosis
GPLVPKQTLLWQDPV

SEQ ID NO: 147313 - protein, 15 aa, Mycobacterium tuberculosis
PLVPKQTLLWQDPVP

SEQ ID NO: 147314 - protein, 15 aa, Mycobacterium tuberculosis
LVPKQTLLWQDPVPA

SEQ ID NO: 147315 - protein, 15 aa, Mycobacterium tuberculosis
VPKQTLLWQDPVPAV

SEQ ID NO: 147316 - protein, 15 aa, Mycobacterium tuberculosis
PKQTLLWQDPVPAVS

SEQ ID NO: 147317 - protein, 15 aa, Mycobacterium tuberculosis
KQTLLWQDPVPAVSH

SEQ ID NO: 147318 - protein, 15 aa, Mycobacterium tuberculosis
QTLLWQDPVPAVSHD

SEQ ID NO: 147319 - protein, 15 aa, Mycobacterium tuberculosis
TLLWQDPVPAVSHDL

SEQ ID NO: 147320 - protein, 15 aa, Mycobacterium tuberculosis
LLWQDPVPAVSHDLV

SEQ ID NO: 147321 - protein, 15 aa, Mycobacterium tuberculosis
LWQDPVPAVSHDLVG

SEQ ID NO: 147322 - protein, 15 aa, Mycobacterium tuberculosis
WQDPVPAVSHDLVGE

SEQ ID NO: 147323 - protein, 15 aa, Mycobacterium tuberculosis
QDPVPAVSHDLVGEA

SEQ ID NO: 147324 - protein, 15 aa, Mycobacterium tuberculosis
DPVPAVSHDLVGEAE

SEQ ID NO: 147325 - protein, 15 aa, Mycobacterium tuberculosis
PVPAVSHDLVGEAEI

SEQ ID NO: 147326 - protein, 15 aa, Mycobacterium tuberculosis
VPAVSHDLVGEAEIA

SEQ ID NO: 147327 - protein, 15 aa, Mycobacterium tuberculosis
PAVSHDLVGEAEIAS

SEQ ID NO: 147328 - protein, 15 aa, Mycobacterium tuberculosis
AVSHDLVGEAEIASL

SEQ ID NO: 147329 - protein, 15 aa, Mycobacterium tuberculosis
VSHDLVGEAEIASLK

SEQ ID NO: 147330 - protein, 15 aa, Mycobacterium tuberculosis
SHDLVGEAEIASLKS

SEQ ID NO: 147331 - protein, 15 aa, Mycobacterium tuberculosis
HDLVGEAEIASLKSQ

SEQ ID NO: 147332 - protein, 15 aa, Mycobacterium tuberculosis
DLVGEAEIASLKSQI

SEQ ID NO: 147333 - protein, 15 aa, Mycobacterium tuberculosis
LVGEAEIASLKSQIR

SEQ ID NO: 147334 - protein, 15 aa, Mycobacterium tuberculosis
VGEAEIASLKSQIRA

SEQ ID NO: 147335 - protein, 15 aa, Mycobacterium tuberculosis
GEAEIASLKSQIRAS

SEQ ID NO: 147336 - protein, 15 aa, Mycobacterium tuberculosis
EAEIASLKSQIRASG

SEQ ID NO: 147337 - protein, 15 aa, Mycobacterium tuberculosis
AEIASLKSQIRASGL

SEQ ID NO: 147338 - protein, 15 aa, Mycobacterium tuberculosis
EIASLKSQIRASGLT

SEQ ID NO: 147339 - protein, 15 aa, Mycobacterium tuberculosis
IASLKSQIRASGLTV

SEQ ID NO: 147340 - protein, 15 aa, Mycobacterium tuberculosis
ASLKSQIRASGLTVS

SEQ ID NO: 147341 - protein, 15 aa, Mycobacterium tuberculosis
SLKSQIRASGLTVSQ

SEQ ID NO: 147342 - protein, 15 aa, Mycobacterium tuberculosis
LKSQIRASGLTVSQL

SEQ ID NO: 147343 - protein, 15 aa, Mycobacterium tuberculosis
KSQIRASGLTVSQLV

SEQ ID NO: 147344 - protein, 15 aa, Mycobacterium tuberculosis
SQIRASGLTVSQLVS

SEQ ID NO: 147345 - protein, 15 aa, Mycobacterium tuberculosis
QIRASGLTVSQLVST

SEQ ID NO: 147346 - protein, 15 aa, Mycobacterium tuberculosis
IRASGLTVSQLVSTA

SEQ ID NO: 147347 - protein, 15 aa, Mycobacterium tuberculosis
RASGLTVSQLVSTAW

SEQ ID NO: 147348 - protein, 15 aa, Mycobacterium tuberculosis
ASGLTVSQLVSTAWA

SEQ ID NO: 147349 - protein, 15 aa, Mycobacterium tuberculosis
SGLTVSQLVSTAWAA

SEQ ID NO: 147350 - protein, 15 aa, Mycobacterium tuberculosis
GLTVSQLVSTAWAAA

SEQ ID NO: 147351 - protein, 15 aa, Mycobacterium tuberculosis
LTVSQLVSTAWAAAS

SEQ ID NO: 147352 - protein, 15 aa, Mycobacterium tuberculosis
TVSQLVSTAWAAASS

SEQ ID NO: 147353 - protein, 15 aa, Mycobacterium tuberculosis
VSQLVSTAWAAASSF

SEQ ID NO: 147354 - protein, 15 aa, Mycobacterium tuberculosis
SQLVSTAWAAASSFR

SEQ ID NO: 147355 - protein, 15 aa, Mycobacterium tuberculosis
QLVSTAWAAASSFRG

SEQ ID NO: 147356 - protein, 15 aa, Mycobacterium tuberculosis
LVSTAWAAASSFRGS

SEQ ID NO: 147357 - protein, 15 aa, Mycobacterium tuberculosis
VSTAWAAASSFRGSD

SEQ ID NO: 147358 - protein, 15 aa, Mycobacterium tuberculosis
STAWAAASSFRGSDK

SEQ ID NO: 147359 - protein, 15 aa, Mycobacterium tuberculosis
TAWAAASSFRGSDKR

SEQ ID NO: 147360 - protein, 15 aa, Mycobacterium tuberculosis
AWAAASSFRGSDKRG

SEQ ID NO: 147361 - protein, 15 aa, Mycobacterium tuberculosis
WAAASSFRGSDKRGG

SEQ ID NO: 147362 - protein, 15 aa, Mycobacterium tuberculosis
AAASSFRGSDKRGGA

SEQ ID NO: 147363 - protein, 15 aa, Mycobacterium tuberculosis
AASSFRGSDKRGGAN

SEQ ID NO: 147364 - protein, 15 aa, Mycobacterium tuberculosis
ASSFRGSDKRGGANG

SEQ ID NO: 147365 - protein, 15 aa, Mycobacterium tuberculosis
SSFRGSDKRGGANGG

SEQ ID NO: 147366 - protein, 15 aa, Mycobacterium tuberculosis
SFRGSDKRGGANGGR

SEQ ID NO: 147367 - protein, 15 aa, Mycobacterium tuberculosis
FRGSDKRGGANGGRI

SEQ ID NO: 147368 - protein, 15 aa, Mycobacterium tuberculosis
RGSDKRGGANGGRIR

SEQ ID NO: 147369 - protein, 15 aa, Mycobacterium tuberculosis
GSDKRGGANGGRIRL

SEQ ID NO: 147370 - protein, 15 aa, Mycobacterium tuberculosis
SDKRGGANGGRIRLQ

SEQ ID NO: 147371 - protein, 15 aa, Mycobacterium tuberculosis
DKRGGANGGRIRLQP

SEQ ID NO: 147372 - protein, 15 aa, Mycobacterium tuberculosis
KRGGANGGRIRLQPQ

SEQ ID NO: 147373 - protein, 15 aa, Mycobacterium tuberculosis
RGGANGGRIRLQPQV

SEQ ID NO: 147374 - protein, 15 aa, Mycobacterium tuberculosis
GGANGGRIRLQPQVG

SEQ ID NO: 147375 - protein, 15 aa, Mycobacterium tuberculosis
GANGGRIRLQPQVGW

SEQ ID NO: 147376 - protein, 15 aa, Mycobacterium tuberculosis
ANGGRIRLQPQVGWE

SEQ ID NO: 147377 - protein, 15 aa, Mycobacterium tuberculosis
NGGRIRLQPQVGWEV

SEQ ID NO: 147378 - protein, 15 aa, Mycobacterium tuberculosis
GGRIRLQPQVGWEVN

SEQ ID NO: 147379 - protein, 15 aa, Mycobacterium tuberculosis
GRIRLQPQVGWEVND

SEQ ID NO: 147380 - protein, 15 aa, Mycobacterium tuberculosis
RIRLQPQVGWEVNDP

SEQ ID NO: 147381 - protein, 15 aa, Mycobacterium tuberculosis
IRLQPQVGWEVNDPD

SEQ ID NO: 147382 - protein, 15 aa, Mycobacterium tuberculosis
RLQPQVGWEVNDPDG

SEQ ID NO: 147383 - protein, 15 aa, Mycobacterium tuberculosis
LQPQVGWEVNDPDGD

SEQ ID NO: 147384 - protein, 15 aa, Mycobacterium tuberculosis
QPQVGWEVNDPDGDL

SEQ ID NO: 147385 - protein, 15 aa, Mycobacterium tuberculosis
PQVGWEVNDPDGDLR

SEQ ID NO: 147386 - protein, 15 aa, Mycobacterium tuberculosis
QVGWEVNDPDGDLRK

SEQ ID NO: 147387 - protein, 15 aa, Mycobacterium tuberculosis
VGWEVNDPDGDLRKV

SEQ ID NO: 147388 - protein, 15 aa, Mycobacterium tuberculosis
GWEVNDPDGDLRKVI

SEQ ID NO: 147389 - protein, 15 aa, Mycobacterium tuberculosis
WEVNDPDGDLRKVIR

SEQ ID NO: 147390 - protein, 15 aa, Mycobacterium tuberculosis
EVNDPDGDLRKVIRT

SEQ ID NO: 147391 - protein, 15 aa, Mycobacterium tuberculosis
VNDPDGDLRKVIRTL

SEQ ID NO: 147392 - protein, 15 aa, Mycobacterium tuberculosis
NDPDGDLRKVIRTLE

SEQ ID NO: 147393 - protein, 15 aa, Mycobacterium tuberculosis
DPDGDLRKVIRTLEE

SEQ ID NO: 147394 - protein, 15 aa, Mycobacterium tuberculosis
PDGDLRKVIRTLEEI

SEQ ID NO: 147395 - protein, 15 aa, Mycobacterium tuberculosis
DGDLRKVIRTLEEIQ

SEQ ID NO: 147396 - protein, 15 aa, Mycobacterium tuberculosis
GDLRKVIRTLEEIQE

SEQ ID NO: 147397 - protein, 15 aa, Mycobacterium tuberculosis
DLRKVIRTLEEIQES

SEQ ID NO: 147398 - protein, 15 aa, Mycobacterium tuberculosis
LRKVIRTLEEIQESF

SEQ ID NO: 147399 - protein, 15 aa, Mycobacterium tuberculosis
RKVIRTLEEIQESFN

SEQ ID NO: 147400 - protein, 15 aa, Mycobacterium tuberculosis
KVIRTLEEIQESFNS

SEQ ID NO: 147401 - protein, 15 aa, Mycobacterium tuberculosis
VIRTLEEIQESFNSA

SEQ ID NO: 147402 - protein, 15 aa, Mycobacterium tuberculosis
IRTLEEIQESFNSAA

SEQ ID NO: 147403 - protein, 15 aa, Mycobacterium tuberculosis
RTLEEIQESFNSAAP

SEQ ID NO: 147404 - protein, 15 aa, Mycobacterium tuberculosis
TLEEIQESFNSAAPG

SEQ ID NO: 147405 - protein, 15 aa, Mycobacterium tuberculosis
LEEIQESFNSAAPGN

SEQ ID NO: 147406 - protein, 15 aa, Mycobacterium tuberculosis
EEIQESFNSAAPGNI

SEQ ID NO: 147407 - protein, 15 aa, Mycobacterium tuberculosis
EIQESFNSAAPGNIK

SEQ ID NO: 147408 - protein, 15 aa, Mycobacterium tuberculosis
IQESFNSAAPGNIKV

SEQ ID NO: 147409 - protein, 15 aa, Mycobacterium tuberculosis
QESFNSAAPGNIKVS

SEQ ID NO: 147410 - protein, 15 aa, Mycobacterium tuberculosis
ESFNSAAPGNIKVSF

SEQ ID NO: 147411 - protein, 15 aa, Mycobacterium tuberculosis
SFNSAAPGNIKVSFA

SEQ ID NO: 147412 - protein, 15 aa, Mycobacterium tuberculosis
FNSAAPGNIKVSFAD

SEQ ID NO: 147413 - protein, 15 aa, Mycobacterium tuberculosis
NSAAPGNIKVSFADL

SEQ ID NO: 147414 - protein, 15 aa, Mycobacterium tuberculosis
SAAPGNIKVSFADLV

SEQ ID NO: 147415 - protein, 15 aa, Mycobacterium tuberculosis
AAPGNIKVSFADLVV

SEQ ID NO: 147416 - protein, 15 aa, Mycobacterium tuberculosis
APGNIKVSFADLVVL

SEQ ID NO: 147417 - protein, 15 aa, Mycobacterium tuberculosis
PGNIKVSFADLVVLG

SEQ ID NO: 147418 - protein, 15 aa, Mycobacterium tuberculosis
GNIKVSFADLVVLGG

SEQ ID NO: 147419 - protein, 15 aa, Mycobacterium tuberculosis
NIKVSFADLVVLGGC

SEQ ID NO: 147420 - protein, 15 aa, Mycobacterium tuberculosis
IKVSFADLVVLGGCA

SEQ ID NO: 147421 - protein, 15 aa, Mycobacterium tuberculosis
KVSFADLVVLGGCAA

SEQ ID NO: 147422 - protein, 15 aa, Mycobacterium tuberculosis
VSFADLVVLGGCAAI

SEQ ID NO: 147423 - protein, 15 aa, Mycobacterium tuberculosis
SFADLVVLGGCAAIE

SEQ ID NO: 147424 - protein, 15 aa, Mycobacterium tuberculosis
FADLVVLGGCAAIEK

SEQ ID NO: 147425 - protein, 15 aa, Mycobacterium tuberculosis
ADLVVLGGCAAIEKA

SEQ ID NO: 147426 - protein, 15 aa, Mycobacterium tuberculosis
DLVVLGGCAAIEKAA

SEQ ID NO: 147427 - protein, 15 aa, Mycobacterium tuberculosis
LVVLGGCAAIEKAAK

SEQ ID NO: 147428 - protein, 15 aa, Mycobacterium tuberculosis
VVLGGCAAIEKAAKA

SEQ ID NO: 147429 - protein, 15 aa, Mycobacterium tuberculosis
VLGGCAAIEKAAKAA

SEQ ID NO: 147430 - protein, 15 aa, Mycobacterium tuberculosis
LGGCAAIEKAAKAAG

SEQ ID NO: 147431 - protein, 15 aa, Mycobacterium tuberculosis
GGCAAIEKAAKAAGH

SEQ ID NO: 147432 - protein, 15 aa, Mycobacterium tuberculosis
GCAAIEKAAKAAGHN

SEQ ID NO: 147433 - protein, 15 aa, Mycobacterium tuberculosis
CAAIEKAAKAAGHNI

SEQ ID NO: 147434 - protein, 15 aa, Mycobacterium tuberculosis
AAIEKAAKAAGHNIT

SEQ ID NO: 147435 - protein, 15 aa, Mycobacterium tuberculosis
AIEKAAKAAGHNITV

SEQ ID NO: 147436 - protein, 15 aa, Mycobacterium tuberculosis
IEKAAKAAGHNITVP

SEQ ID NO: 147437 - protein, 15 aa, Mycobacterium tuberculosis
EKAAKAAGHNITVPF

SEQ ID NO: 147438 - protein, 15 aa, Mycobacterium tuberculosis
KAAKAAGHNITVPFT

SEQ ID NO: 147439 - protein, 15 aa, Mycobacterium tuberculosis
AAKAAGHNITVPFTP

SEQ ID NO: 147440 - protein, 15 aa, Mycobacterium tuberculosis
AKAAGHNITVPFTPG

SEQ ID NO: 147441 - protein, 15 aa, Mycobacterium tuberculosis
KAAGHNITVPFTPGR

SEQ ID NO: 147442 - protein, 15 aa, Mycobacterium tuberculosis
AAGHNITVPFTPGRT

SEQ ID NO: 147443 - protein, 15 aa, Mycobacterium tuberculosis
AGHNITVPFTPGRTD

SEQ ID NO: 147444 - protein, 15 aa, Mycobacterium tuberculosis
GHNITVPFTPGRTDA

SEQ ID NO: 147445 - protein, 15 aa, Mycobacterium tuberculosis
HNITVPFTPGRTDAS

SEQ ID NO: 147446 - protein, 15 aa, Mycobacterium tuberculosis
NITVPFTPGRTDASQ

SEQ ID NO: 147447 - protein, 15 aa, Mycobacterium tuberculosis
ITVPFTPGRTDASQE

SEQ ID NO: 147448 - protein, 15 aa, Mycobacterium tuberculosis
TVPFTPGRTDASQEQ

SEQ ID NO: 147449 - protein, 15 aa, Mycobacterium tuberculosis
VPFTPGRTDASQEQT

SEQ ID NO: 147450 - protein, 15 aa, Mycobacterium tuberculosis
PFTPGRTDASQEQTD

SEQ ID NO: 147451 - protein, 15 aa, Mycobacterium tuberculosis
FTPGRTDASQEQTDV

SEQ ID NO: 147452 - protein, 15 aa, Mycobacterium tuberculosis
TPGRTDASQEQTDVE

SEQ ID NO: 147453 - protein, 15 aa, Mycobacterium tuberculosis
PGRTDASQEQTDVES

SEQ ID NO: 147454 - protein, 15 aa, Mycobacterium tuberculosis
GRTDASQEQTDVESF

SEQ ID NO: 147455 - protein, 15 aa, Mycobacterium tuberculosis
RTDASQEQTDVESFA

SEQ ID NO: 147456 - protein, 15 aa, Mycobacterium tuberculosis
TDASQEQTDVESFAV

SEQ ID NO: 147457 - protein, 15 aa, Mycobacterium tuberculosis
DASQEQTDVESFAVL

SEQ ID NO: 147458 - protein, 15 aa, Mycobacterium tuberculosis
ASQEQTDVESFAVLE

SEQ ID NO: 147459 - protein, 15 aa, Mycobacterium tuberculosis
SQEQTDVESFAVLEP

SEQ ID NO: 147460 - protein, 15 aa, Mycobacterium tuberculosis
QEQTDVESFAVLEPK

SEQ ID NO: 147461 - protein, 15 aa, Mycobacterium tuberculosis
EQTDVESFAVLEPKA

SEQ ID NO: 147462 - protein, 15 aa, Mycobacterium tuberculosis
QTDVESFAVLEPKAD

SEQ ID NO: 147463 - protein, 15 aa, Mycobacterium tuberculosis
TDVESFAVLEPKADG

SEQ ID NO: 147464 - protein, 15 aa, Mycobacterium tuberculosis
DVESFAVLEPKADGF

SEQ ID NO: 147465 - protein, 15 aa, Mycobacterium tuberculosis
VESFAVLEPKADGFR

SEQ ID NO: 147466 - protein, 15 aa, Mycobacterium tuberculosis
ESFAVLEPKADGFRN

SEQ ID NO: 147467 - protein, 15 aa, Mycobacterium tuberculosis
SFAVLEPKADGFRNY

SEQ ID NO: 147468 - protein, 15 aa, Mycobacterium tuberculosis
FAVLEPKADGFRNYL

SEQ ID NO: 147469 - protein, 15 aa, Mycobacterium tuberculosis
AVLEPKADGFRNYLG

SEQ ID NO: 147470 - protein, 15 aa, Mycobacterium tuberculosis
VLEPKADGFRNYLGK

SEQ ID NO: 147471 - protein, 15 aa, Mycobacterium tuberculosis
LEPKADGFRNYLGKG

SEQ ID NO: 147472 - protein, 15 aa, Mycobacterium tuberculosis
EPKADGFRNYLGKGN

SEQ ID NO: 147473 - protein, 15 aa, Mycobacterium tuberculosis
PKADGFRNYLGKGNP

SEQ ID NO: 147474 - protein, 15 aa, Mycobacterium tuberculosis
KADGFRNYLGKGNPL

SEQ ID NO: 147475 - protein, 15 aa, Mycobacterium tuberculosis
ADGFRNYLGKGNPLP

SEQ ID NO: 147476 - protein, 15 aa, Mycobacterium tuberculosis
DGFRNYLGKGNPLPA

SEQ ID NO: 147477 - protein, 15 aa, Mycobacterium tuberculosis
GFRNYLGKGNPLPAE

SEQ ID NO: 147478 - protein, 15 aa, Mycobacterium tuberculosis
FRNYLGKGNPLPAEY

SEQ ID NO: 147479 - protein, 15 aa, Mycobacterium tuberculosis
RNYLGKGNPLPAEYM

SEQ ID NO: 147480 - protein, 15 aa, Mycobacterium tuberculosis
NYLGKGNPLPAEYML

SEQ ID NO: 147481 - protein, 15 aa, Mycobacterium tuberculosis
YLGKGNPLPAEYMLL

SEQ ID NO: 147482 - protein, 15 aa, Mycobacterium tuberculosis
LGKGNPLPAEYMLLD

SEQ ID NO: 147483 - protein, 15 aa, Mycobacterium tuberculosis
GKGNPLPAEYMLLDK

SEQ ID NO: 147484 - protein, 15 aa, Mycobacterium tuberculosis
KGNPLPAEYMLLDKA

SEQ ID NO: 147485 - protein, 15 aa, Mycobacterium tuberculosis
GNPLPAEYMLLDKAN

SEQ ID NO: 147486 - protein, 15 aa, Mycobacterium tuberculosis
NPLPAEYMLLDKANL

SEQ ID NO: 147487 - protein, 15 aa, Mycobacterium tuberculosis
PLPAEYMLLDKANLL

SEQ ID NO: 147488 - protein, 15 aa, Mycobacterium tuberculosis
LPAEYMLLDKANLLT

SEQ ID NO: 147489 - protein, 15 aa, Mycobacterium tuberculosis
PAEYMLLDKANLLTL

SEQ ID NO: 147490 - protein, 15 aa, Mycobacterium tuberculosis
AEYMLLDKANLLTLS

SEQ ID NO: 147491 - protein, 15 aa, Mycobacterium tuberculosis
EYMLLDKANLLTLSA

SEQ ID NO: 147492 - protein, 15 aa, Mycobacterium tuberculosis
YMLLDKANLLTLSAP

SEQ ID NO: 147493 - protein, 15 aa, Mycobacterium tuberculosis
MLLDKANLLTLSAPE

SEQ ID NO: 147494 - protein, 15 aa, Mycobacterium tuberculosis
LLDKANLLTLSAPEM

SEQ ID NO: 147495 - protein, 15 aa, Mycobacterium tuberculosis
LDKANLLTLSAPEMT

SEQ ID NO: 147496 - protein, 15 aa, Mycobacterium tuberculosis
DKANLLTLSAPEMTV

SEQ ID NO: 147497 - protein, 15 aa, Mycobacterium tuberculosis
KANLLTLSAPEMTVL

SEQ ID NO: 147498 - protein, 15 aa, Mycobacterium tuberculosis
ANLLTLSAPEMTVLV

SEQ ID NO: 147499 - protein, 15 aa, Mycobacterium tuberculosis
NLLTLSAPEMTVLVG

SEQ ID NO: 147500 - protein, 15 aa, Mycobacterium tuberculosis
LLTLSAPEMTVLVGG

SEQ ID NO: 147501 - protein, 15 aa, Mycobacterium tuberculosis
LTLSAPEMTVLVGGL

SEQ ID NO: 147502 - protein, 15 aa, Mycobacterium tuberculosis
TLSAPEMTVLVGGLR

SEQ ID NO: 147503 - protein, 15 aa, Mycobacterium tuberculosis
LSAPEMTVLVGGLRV

SEQ ID NO: 147504 - protein, 15 aa, Mycobacterium tuberculosis
SAPEMTVLVGGLRVL

SEQ ID NO: 147505 - protein, 15 aa, Mycobacterium tuberculosis
APEMTVLVGGLRVLG

SEQ ID NO: 147506 - protein, 15 aa, Mycobacterium tuberculosis
PEMTVLVGGLRVLGA

SEQ ID NO: 147507 - protein, 15 aa, Mycobacterium tuberculosis
EMTVLVGGLRVLGAN

SEQ ID NO: 147508 - protein, 15 aa, Mycobacterium tuberculosis
MTVLVGGLRVLGANY

SEQ ID NO: 147509 - protein, 15 aa, Mycobacterium tuberculosis
TVLVGGLRVLGANYK

SEQ ID NO: 147510 - protein, 15 aa, Mycobacterium tuberculosis
VLVGGLRVLGANYKR

SEQ ID NO: 147511 - protein, 15 aa, Mycobacterium tuberculosis
LVGGLRVLGANYKRL

SEQ ID NO: 147512 - protein, 15 aa, Mycobacterium tuberculosis
VGGLRVLGANYKRLP

SEQ ID NO: 147513 - protein, 15 aa, Mycobacterium tuberculosis
GGLRVLGANYKRLPL

SEQ ID NO: 147514 - protein, 15 aa, Mycobacterium tuberculosis
GLRVLGANYKRLPLG

SEQ ID NO: 147515 - protein, 15 aa, Mycobacterium tuberculosis
LRVLGANYKRLPLGV

SEQ ID NO: 147516 - protein, 15 aa, Mycobacterium tuberculosis
RVLGANYKRLPLGVF

SEQ ID NO: 147517 - protein, 15 aa, Mycobacterium tuberculosis
VLGANYKRLPLGVFT

SEQ ID NO: 147518 - protein, 15 aa, Mycobacterium tuberculosis
LGANYKRLPLGVFTE

SEQ ID NO: 147519 - protein, 15 aa, Mycobacterium tuberculosis
GANYKRLPLGVFTEA

SEQ ID NO: 147520 - protein, 15 aa, Mycobacterium tuberculosis
ANYKRLPLGVFTEAS

SEQ ID NO: 147521 - protein, 15 aa, Mycobacterium tuberculosis
NYKRLPLGVFTEASE

SEQ ID NO: 147522 - protein, 15 aa, Mycobacterium tuberculosis
YKRLPLGVFTEASES

SEQ ID NO: 147523 - protein, 15 aa, Mycobacterium tuberculosis
KRLPLGVFTEASESL

SEQ ID NO: 147524 - protein, 15 aa, Mycobacterium tuberculosis
RLPLGVFTEASESLT

SEQ ID NO: 147525 - protein, 15 aa, Mycobacterium tuberculosis
LPLGVFTEASESLTN

SEQ ID NO: 147526 - protein, 15 aa, Mycobacterium tuberculosis
PLGVFTEASESLTND

SEQ ID NO: 147527 - protein, 15 aa, Mycobacterium tuberculosis
LGVFTEASESLTNDF

SEQ ID NO: 147528 - protein, 15 aa, Mycobacterium tuberculosis
GVFTEASESLTNDFF

SEQ ID NO: 147529 - protein, 15 aa, Mycobacterium tuberculosis
VFTEASESLTNDFFV

SEQ ID NO: 147530 - protein, 15 aa, Mycobacterium tuberculosis
FTEASESLTNDFFVN

SEQ ID NO: 147531 - protein, 15 aa, Mycobacterium tuberculosis
TEASESLTNDFFVNL

SEQ ID NO: 147532 - protein, 15 aa, Mycobacterium tuberculosis
EASESLTNDFFVNLL

SEQ ID NO: 147533 - protein, 15 aa, Mycobacterium tuberculosis
ASESLTNDFFVNLLD

SEQ ID NO: 147534 - protein, 15 aa, Mycobacterium tuberculosis
SESLTNDFFVNLLDM

SEQ ID NO: 147535 - protein, 15 aa, Mycobacterium tuberculosis
ESLTNDFFVNLLDMG

SEQ ID NO: 147536 - protein, 15 aa, Mycobacterium tuberculosis
SLTNDFFVNLLDMGI

SEQ ID NO: 147537 - protein, 15 aa, Mycobacterium tuberculosis
LTNDFFVNLLDMGIT

SEQ ID NO: 147538 - protein, 15 aa, Mycobacterium tuberculosis
TNDFFVNLLDMGITW

SEQ ID NO: 147539 - protein, 15 aa, Mycobacterium tuberculosis
NDFFVNLLDMGITWE

SEQ ID NO: 147540 - protein, 15 aa, Mycobacterium tuberculosis
DFFVNLLDMGITWEP

SEQ ID NO: 147541 - protein, 15 aa, Mycobacterium tuberculosis
FFVNLLDMGITWEPS

SEQ ID NO: 147542 - protein, 15 aa, Mycobacterium tuberculosis
FVNLLDMGITWEPSP

SEQ ID NO: 147543 - protein, 15 aa, Mycobacterium tuberculosis
VNLLDMGITWEPSPA

SEQ ID NO: 147544 - protein, 15 aa, Mycobacterium tuberculosis
NLLDMGITWEPSPAD

SEQ ID NO: 147545 - protein, 15 aa, Mycobacterium tuberculosis
LLDMGITWEPSPADD

SEQ ID NO: 147546 - protein, 15 aa, Mycobacterium tuberculosis
LDMGITWEPSPADDG

SEQ ID NO: 147547 - protein, 15 aa, Mycobacterium tuberculosis
DMGITWEPSPADDGT

SEQ ID NO: 147548 - protein, 15 aa, Mycobacterium tuberculosis
MGITWEPSPADDGTY

SEQ ID NO: 147549 - protein, 15 aa, Mycobacterium tuberculosis
GITWEPSPADDGTYQ

SEQ ID NO: 147550 - protein, 15 aa, Mycobacterium tuberculosis
ITWEPSPADDGTYQG

SEQ ID NO: 147551 - protein, 15 aa, Mycobacterium tuberculosis
TWEPSPADDGTYQGK

SEQ ID NO: 147552 - protein, 15 aa, Mycobacterium tuberculosis
WEPSPADDGTYQGKD

SEQ ID NO: 147553 - protein, 15 aa, Mycobacterium tuberculosis
EPSPADDGTYQGKDG

SEQ ID NO: 147554 - protein, 15 aa, Mycobacterium tuberculosis
PSPADDGTYQGKDGS

SEQ ID NO: 147555 - protein, 15 aa, Mycobacterium tuberculosis
SPADDGTYQGKDGSG

SEQ ID NO: 147556 - protein, 15 aa, Mycobacterium tuberculosis
PADDGTYQGKDGSGK

SEQ ID NO: 147557 - protein, 15 aa, Mycobacterium tuberculosis
ADDGTYQGKDGSGKV

SEQ ID NO: 147558 - protein, 15 aa, Mycobacterium tuberculosis
DDGTYQGKDGSGKVK

SEQ ID NO: 147559 - protein, 15 aa, Mycobacterium tuberculosis
DGTYQGKDGSGKVKW

SEQ ID NO: 147560 - protein, 15 aa, Mycobacterium tuberculosis
GTYQGKDGSGKVKWT

SEQ ID NO: 147561 - protein, 15 aa, Mycobacterium tuberculosis
TYQGKDGSGKVKWTG

SEQ ID NO: 147562 - protein, 15 aa, Mycobacterium tuberculosis
YQGKDGSGKVKWTGS

SEQ ID NO: 147563 - protein, 15 aa, Mycobacterium tuberculosis
QGKDGSGKVKWTGSR

SEQ ID NO: 147564 - protein, 15 aa, Mycobacterium tuberculosis
GKDGSGKVKWTGSRV

SEQ ID NO: 147565 - protein, 15 aa, Mycobacterium tuberculosis
KDGSGKVKWTGSRVD

SEQ ID NO: 147566 - protein, 15 aa, Mycobacterium tuberculosis
DGSGKVKWTGSRVDL

SEQ ID NO: 147567 - protein, 15 aa, Mycobacterium tuberculosis
GSGKVKWTGSRVDLV

SEQ ID NO: 147568 - protein, 15 aa, Mycobacterium tuberculosis
SGKVKWTGSRVDLVF

SEQ ID NO: 147569 - protein, 15 aa, Mycobacterium tuberculosis
GKVKWTGSRVDLVFG

SEQ ID NO: 147570 - protein, 15 aa, Mycobacterium tuberculosis
KVKWTGSRVDLVFGS

SEQ ID NO: 147571 - protein, 15 aa, Mycobacterium tuberculosis
VKWTGSRVDLVFGSN

SEQ ID NO: 147572 - protein, 15 aa, Mycobacterium tuberculosis
KWTGSRVDLVFGSNS

SEQ ID NO: 147573 - protein, 15 aa, Mycobacterium tuberculosis
WTGSRVDLVFGSNSE

SEQ ID NO: 147574 - protein, 15 aa, Mycobacterium tuberculosis
TGSRVDLVFGSNSEL

SEQ ID NO: 147575 - protein, 15 aa, Mycobacterium tuberculosis
GSRVDLVFGSNSELR

SEQ ID NO: 147576 - protein, 15 aa, Mycobacterium tuberculosis
SRVDLVFGSNSELRA

SEQ ID NO: 147577 - protein, 15 aa, Mycobacterium tuberculosis
RVDLVFGSNSELRAL

SEQ ID NO: 147578 - protein, 15 aa, Mycobacterium tuberculosis
VDLVFGSNSELRALV

SEQ ID NO: 147579 - protein, 15 aa, Mycobacterium tuberculosis
DLVFGSNSELRALVE

SEQ ID NO: 147580 - protein, 15 aa, Mycobacterium tuberculosis
LVFGSNSELRALVEV

SEQ ID NO: 147581 - protein, 15 aa, Mycobacterium tuberculosis
VFGSNSELRALVEVY

SEQ ID NO: 147582 - protein, 15 aa, Mycobacterium tuberculosis
FGSNSELRALVEVYG

SEQ ID NO: 147583 - protein, 15 aa, Mycobacterium tuberculosis
GSNSELRALVEVYGA

SEQ ID NO: 147584 - protein, 15 aa, Mycobacterium tuberculosis
SNSELRALVEVYGAD

SEQ ID NO: 147585 - protein, 15 aa, Mycobacterium tuberculosis
NSELRALVEVYGADD

SEQ ID NO: 147586 - protein, 15 aa, Mycobacterium tuberculosis
SELRALVEVYGADDA

SEQ ID NO: 147587 - protein, 15 aa, Mycobacterium tuberculosis
ELRALVEVYGADDAQ

SEQ ID NO: 147588 - protein, 15 aa, Mycobacterium tuberculosis
LRALVEVYGADDAQP

SEQ ID NO: 147589 - protein, 15 aa, Mycobacterium tuberculosis
RALVEVYGADDAQPK

SEQ ID NO: 147590 - protein, 15 aa, Mycobacterium tuberculosis
ALVEVYGADDAQPKF

SEQ ID NO: 147591 - protein, 15 aa, Mycobacterium tuberculosis
LVEVYGADDAQPKFV

SEQ ID NO: 147592 - protein, 15 aa, Mycobacterium tuberculosis
VEVYGADDAQPKFVQ

SEQ ID NO: 147593 - protein, 15 aa, Mycobacterium tuberculosis
EVYGADDAQPKFVQD

SEQ ID NO: 147594 - protein, 15 aa, Mycobacterium tuberculosis
VYGADDAQPKFVQDF

SEQ ID NO: 147595 - protein, 15 aa, Mycobacterium tuberculosis
YGADDAQPKFVQDFV

SEQ ID NO: 147596 - protein, 15 aa, Mycobacterium tuberculosis
GADDAQPKFVQDFVA

SEQ ID NO: 147597 - protein, 15 aa, Mycobacterium tuberculosis
ADDAQPKFVQDFVAA

SEQ ID NO: 147598 - protein, 15 aa, Mycobacterium tuberculosis
DDAQPKFVQDFVAAW

SEQ ID NO: 147599 - protein, 15 aa, Mycobacterium tuberculosis
DAQPKFVQDFVAAWD

SEQ ID NO: 147600 - protein, 15 aa, Mycobacterium tuberculosis
AQPKFVQDFVAAWDK

SEQ ID NO: 147601 - protein, 15 aa, Mycobacterium tuberculosis
QPKFVQDFVAAWDKV

SEQ ID NO: 147602 - protein, 15 aa, Mycobacterium tuberculosis
PKFVQDFVAAWDKVM

SEQ ID NO: 147603 - protein, 15 aa, Mycobacterium tuberculosis
KFVQDFVAAWDKVMN

SEQ ID NO: 147604 - protein, 15 aa, Mycobacterium tuberculosis
FVQDFVAAWDKVMNL

SEQ ID NO: 147605 - protein, 15 aa, Mycobacterium tuberculosis
VQDFVAAWDKVMNLD

SEQ ID NO: 147606 - protein, 15 aa, Mycobacterium tuberculosis
QDFVAAWDKVMNLDR

SEQ ID NO: 147607 - protein, 15 aa, Mycobacterium tuberculosis
DFVAAWDKVMNLDRF

SEQ ID NO: 147608 - protein, 15 aa, Mycobacterium tuberculosis
FVAAWDKVMNLDRFD

SEQ ID NO: 147609 - protein, 15 aa, Mycobacterium tuberculosis
VAAWDKVMNLDRFDV

SEQ ID NO: 147610 - protein, 15 aa, Mycobacterium tuberculosis
AAWDKVMNLDRFDVR

SEQ ID NO: 147611 - protein, 16 aa, Mycobacterium tuberculosis
MPEQHPPITETTTGAA

SEQ ID NO: 147612 - protein, 16 aa, Mycobacterium tuberculosis
PEQHPPITETTTGAAS

SEQ ID NO: 147613 - protein, 16 aa, Mycobacterium tuberculosis
EQHPPITETTTGAASN

SEQ ID NO: 147614 - protein, 16 aa, Mycobacterium tuberculosis
QHPPITETTTGAASNG

SEQ ID NO: 147615 - protein, 16 aa, Mycobacterium tuberculosis
HPPITETTTGAASNGC

SEQ ID NO: 147616 - protein, 16 aa, Mycobacterium tuberculosis
PPITETTTGAASNGCP

SEQ ID NO: 147617 - protein, 16 aa, Mycobacterium tuberculosis
PITETTTGAASNGCPV

SEQ ID NO: 147618 - protein, 16 aa, Mycobacterium tuberculosis
ITETTTGAASNGCPVV

SEQ ID NO: 147619 - protein, 16 aa, Mycobacterium tuberculosis
TETTTGAASNGCPVVG

SEQ ID NO: 147620 - protein, 16 aa, Mycobacterium tuberculosis
ETTTGAASNGCPVVGH

SEQ ID NO: 147621 - protein, 16 aa, Mycobacterium tuberculosis
TTTGAASNGCPVVGHM

SEQ ID NO: 147622 - protein, 16 aa, Mycobacterium tuberculosis
TTGAASNGCPVVGHMK

SEQ ID NO: 147623 - protein, 16 aa, Mycobacterium tuberculosis
TGAASNGCPVVGHMKY

SEQ ID NO: 147624 - protein, 16 aa, Mycobacterium tuberculosis
GAASNGCPVVGHMKYP

SEQ ID NO: 147625 - protein, 16 aa, Mycobacterium tuberculosis
AASNGCPVVGHMKYPV

SEQ ID NO: 147626 - protein, 16 aa, Mycobacterium tuberculosis
ASNGCPVVGHMKYPVE

SEQ ID NO: 147627 - protein, 16 aa, Mycobacterium tuberculosis
SNGCPVVGHMKYPVEG

SEQ ID NO: 147628 - protein, 16 aa, Mycobacterium tuberculosis
NGCPVVGHMKYPVEGG

SEQ ID NO: 147629 - protein, 16 aa, Mycobacterium tuberculosis
GCPVVGHMKYPVEGGG

SEQ ID NO: 147630 - protein, 16 aa, Mycobacterium tuberculosis
CPVVGHMKYPVEGGGN

SEQ ID NO: 147631 - protein, 16 aa, Mycobacterium tuberculosis
PVVGHMKYPVEGGGNQ

SEQ ID NO: 147632 - protein, 16 aa, Mycobacterium tuberculosis
VVGHMKYPVEGGGNQD

SEQ ID NO: 147633 - protein, 16 aa, Mycobacterium tuberculosis
VGHMKYPVEGGGNQDW

SEQ ID NO: 147634 - protein, 16 aa, Mycobacterium tuberculosis
GHMKYPVEGGGNQDWW

SEQ ID NO: 147635 - protein, 16 aa, Mycobacterium tuberculosis
HMKYPVEGGGNQDWWP

SEQ ID NO: 147636 - protein, 16 aa, Mycobacterium tuberculosis
MKYPVEGGGNQDWWPN

SEQ ID NO: 147637 - protein, 16 aa, Mycobacterium tuberculosis
KYPVEGGGNQDWWPNR

SEQ ID NO: 147638 - protein, 16 aa, Mycobacterium tuberculosis
YPVEGGGNQDWWPNRL

SEQ ID NO: 147639 - protein, 16 aa, Mycobacterium tuberculosis
PVEGGGNQDWWPNRLN

SEQ ID NO: 147640 - protein, 16 aa, Mycobacterium tuberculosis
VEGGGNQDWWPNRLNL

SEQ ID NO: 147641 - protein, 16 aa, Mycobacterium tuberculosis
EGGGNQDWWPNRLNLK

SEQ ID NO: 147642 - protein, 16 aa, Mycobacterium tuberculosis
GGGNQDWWPNRLNLKV

SEQ ID NO: 147643 - protein, 16 aa, Mycobacterium tuberculosis
GGNQDWWPNRLNLKVL

SEQ ID NO: 147644 - protein, 16 aa, Mycobacterium tuberculosis
GNQDWWPNRLNLKVLH

SEQ ID NO: 147645 - protein, 16 aa, Mycobacterium tuberculosis
NQDWWPNRLNLKVLHQ

SEQ ID NO: 147646 - protein, 16 aa, Mycobacterium tuberculosis
QDWWPNRLNLKVLHQN

SEQ ID NO: 147647 - protein, 16 aa, Mycobacterium tuberculosis
DWWPNRLNLKVLHQNP

SEQ ID NO: 147648 - protein, 16 aa, Mycobacterium tuberculosis
WWPNRLNLKVLHQNPA

SEQ ID NO: 147649 - protein, 16 aa, Mycobacterium tuberculosis
WPNRLNLKVLHQNPAV

SEQ ID NO: 147650 - protein, 16 aa, Mycobacterium tuberculosis
PNRLNLKVLHQNPAVA

SEQ ID NO: 147651 - protein, 16 aa, Mycobacterium tuberculosis
NRLNLKVLHQNPAVAD

SEQ ID NO: 147652 - protein, 16 aa, Mycobacterium tuberculosis
RLNLKVLHQNPAVADP

SEQ ID NO: 147653 - protein, 16 aa, Mycobacterium tuberculosis
LNLKVLHQNPAVADPM

SEQ ID NO: 147654 - protein, 16 aa, Mycobacterium tuberculosis
NLKVLHQNPAVADPMG

SEQ ID NO: 147655 - protein, 16 aa, Mycobacterium tuberculosis
LKVLHQNPAVADPMGA

SEQ ID NO: 147656 - protein, 16 aa, Mycobacterium tuberculosis
KVLHQNPAVADPMGAA

SEQ ID NO: 147657 - protein, 16 aa, Mycobacterium tuberculosis
VLHQNPAVADPMGAAF

SEQ ID NO: 147658 - protein, 16 aa, Mycobacterium tuberculosis
LHQNPAVADPMGAAFD

SEQ ID NO: 147659 - protein, 16 aa, Mycobacterium tuberculosis
HQNPAVADPMGAAFDY

SEQ ID NO: 147660 - protein, 16 aa, Mycobacterium tuberculosis
QNPAVADPMGAAFDYA

SEQ ID NO: 147661 - protein, 16 aa, Mycobacterium tuberculosis
NPAVADPMGAAFDYAA

SEQ ID NO: 147662 - protein, 16 aa, Mycobacterium tuberculosis
PAVADPMGAAFDYAAE

SEQ ID NO: 147663 - protein, 16 aa, Mycobacterium tuberculosis
AVADPMGAAFDYAAEV

SEQ ID NO: 147664 - protein, 16 aa, Mycobacterium tuberculosis
VADPMGAAFDYAAEVA

SEQ ID NO: 147665 - protein, 16 aa, Mycobacterium tuberculosis
ADPMGAAFDYAAEVAT

SEQ ID NO: 147666 - protein, 16 aa, Mycobacterium tuberculosis
DPMGAAFDYAAEVATI

SEQ ID NO: 147667 - protein, 16 aa, Mycobacterium tuberculosis
PMGAAFDYAAEVATID

SEQ ID NO: 147668 - protein, 16 aa, Mycobacterium tuberculosis
MGAAFDYAAEVATIDV

SEQ ID NO: 147669 - protein, 16 aa, Mycobacterium tuberculosis
GAAFDYAAEVATIDVD

SEQ ID NO: 147670 - protein, 16 aa, Mycobacterium tuberculosis
AAFDYAAEVATIDVDA

SEQ ID NO: 147671 - protein, 16 aa, Mycobacterium tuberculosis
AFDYAAEVATIDVDAL

SEQ ID NO: 147672 - protein, 16 aa, Mycobacterium tuberculosis
FDYAAEVATIDVDALT

SEQ ID NO: 147673 - protein, 16 aa, Mycobacterium tuberculosis
DYAAEVATIDVDALTR

SEQ ID NO: 147674 - protein, 16 aa, Mycobacterium tuberculosis
YAAEVATIDVDALTRD

SEQ ID NO: 147675 - protein, 16 aa, Mycobacterium tuberculosis
AAEVATIDVDALTRDI

SEQ ID NO: 147676 - protein, 16 aa, Mycobacterium tuberculosis
AEVATIDVDALTRDIE

SEQ ID NO: 147677 - protein, 16 aa, Mycobacterium tuberculosis
EVATIDVDALTRDIEE

SEQ ID NO: 147678 - protein, 16 aa, Mycobacterium tuberculosis
VATIDVDALTRDIEEV

SEQ ID NO: 147679 - protein, 16 aa, Mycobacterium tuberculosis
ATIDVDALTRDIEEVM

SEQ ID NO: 147680 - protein, 16 aa, Mycobacterium tuberculosis
TIDVDALTRDIEEVMT

SEQ ID NO: 147681 - protein, 16 aa, Mycobacterium tuberculosis
IDVDALTRDIEEVMTT

SEQ ID NO: 147682 - protein, 16 aa, Mycobacterium tuberculosis
DVDALTRDIEEVMTTS

SEQ ID NO: 147683 - protein, 16 aa, Mycobacterium tuberculosis
VDALTRDIEEVMTTSQ

SEQ ID NO: 147684 - protein, 16 aa, Mycobacterium tuberculosis
DALTRDIEEVMTTSQP

SEQ ID NO: 147685 - protein, 16 aa, Mycobacterium tuberculosis
ALTRDIEEVMTTSQPW

SEQ ID NO: 147686 - protein, 16 aa, Mycobacterium tuberculosis
LTRDIEEVMTTSQPWW

SEQ ID NO: 147687 - protein, 16 aa, Mycobacterium tuberculosis
TRDIEEVMTTSQPWWP

SEQ ID NO: 147688 - protein, 16 aa, Mycobacterium tuberculosis
RDIEEVMTTSQPWWPA

SEQ ID NO: 147689 - protein, 16 aa, Mycobacterium tuberculosis
DIEEVMTTSQPWWPAD

SEQ ID NO: 147690 - protein, 16 aa, Mycobacterium tuberculosis
IEEVMTTSQPWWPADY

SEQ ID NO: 147691 - protein, 16 aa, Mycobacterium tuberculosis
EEVMTTSQPWWPADYG

SEQ ID NO: 147692 - protein, 16 aa, Mycobacterium tuberculosis
EVMTTSQPWWPADYGH

SEQ ID NO: 147693 - protein, 16 aa, Mycobacterium tuberculosis
VMTTSQPWWPADYGHY

SEQ ID NO: 147694 - protein, 16 aa, Mycobacterium tuberculosis
MTTSQPWWPADYGHYG

SEQ ID NO: 147695 - protein, 16 aa, Mycobacterium tuberculosis
TTSQPWWPADYGHYGP

SEQ ID NO: 147696 - protein, 16 aa, Mycobacterium tuberculosis
TSQPWWPADYGHYGPL

SEQ ID NO: 147697 - protein, 16 aa, Mycobacterium tuberculosis
SQPWWPADYGHYGPLF

SEQ ID NO: 147698 - protein, 16 aa, Mycobacterium tuberculosis
QPWWPADYGHYGPLFI

SEQ ID NO: 147699 - protein, 16 aa, Mycobacterium tuberculosis
PWWPADYGHYGPLFIR

SEQ ID NO: 147700 - protein, 16 aa, Mycobacterium tuberculosis
WWPADYGHYGPLFIRM

SEQ ID NO: 147701 - protein, 16 aa, Mycobacterium tuberculosis
WPADYGHYGPLFIRMA

SEQ ID NO: 147702 - protein, 16 aa, Mycobacterium tuberculosis
PADYGHYGPLFIRMAW

SEQ ID NO: 147703 - protein, 16 aa, Mycobacterium tuberculosis
ADYGHYGPLFIRMAWH

SEQ ID NO: 147704 - protein, 16 aa, Mycobacterium tuberculosis
DYGHYGPLFIRMAWHA

SEQ ID NO: 147705 - protein, 16 aa, Mycobacterium tuberculosis
YGHYGPLFIRMAWHAA

SEQ ID NO: 147706 - protein, 16 aa, Mycobacterium tuberculosis
GHYGPLFIRMAWHAAG

SEQ ID NO: 147707 - protein, 16 aa, Mycobacterium tuberculosis
HYGPLFIRMAWHAAGT

SEQ ID NO: 147708 - protein, 16 aa, Mycobacterium tuberculosis
YGPLFIRMAWHAAGTY

SEQ ID NO: 147709 - protein, 16 aa, Mycobacterium tuberculosis
GPLFIRMAWHAAGTYR

SEQ ID NO: 147710 - protein, 16 aa, Mycobacterium tuberculosis
PLFIRMAWHAAGTYRI

SEQ ID NO: 147711 - protein, 16 aa, Mycobacterium tuberculosis
LFIRMAWHAAGTYRIH

SEQ ID NO: 147712 - protein, 16 aa, Mycobacterium tuberculosis
FIRMAWHAAGTYRIHD

SEQ ID NO: 147713 - protein, 16 aa, Mycobacterium tuberculosis
IRMAWHAAGTYRIHDG

SEQ ID NO: 147714 - protein, 16 aa, Mycobacterium tuberculosis
RMAWHAAGTYRIHDGR

SEQ ID NO: 147715 - protein, 16 aa, Mycobacterium tuberculosis
MAWHAAGTYRIHDGRG

SEQ ID NO: 147716 - protein, 16 aa, Mycobacterium tuberculosis
AWHAAGTYRIHDGRGG

SEQ ID NO: 147717 - protein, 16 aa, Mycobacterium tuberculosis
WHAAGTYRIHDGRGGA

SEQ ID NO: 147718 - protein, 16 aa, Mycobacterium tuberculosis
HAAGTYRIHDGRGGAG

SEQ ID NO: 147719 - protein, 16 aa, Mycobacterium tuberculosis
AAGTYRIHDGRGGAGG

SEQ ID NO: 147720 - protein, 16 aa, Mycobacterium tuberculosis
AGTYRIHDGRGGAGGG

SEQ ID NO: 147721 - protein, 16 aa, Mycobacterium tuberculosis
GTYRIHDGRGGAGGGM

SEQ ID NO: 147722 - protein, 16 aa, Mycobacterium tuberculosis
TYRIHDGRGGAGGGMQ

SEQ ID NO: 147723 - protein, 16 aa, Mycobacterium tuberculosis
YRIHDGRGGAGGGMQR

SEQ ID NO: 147724 - protein, 16 aa, Mycobacterium tuberculosis
RIHDGRGGAGGGMQRF

SEQ ID NO: 147725 - protein, 16 aa, Mycobacterium tuberculosis
IHDGRGGAGGGMQRFA

SEQ ID NO: 147726 - protein, 16 aa, Mycobacterium tuberculosis
HDGRGGAGGGMQRFAP

SEQ ID NO: 147727 - protein, 16 aa, Mycobacterium tuberculosis
DGRGGAGGGMQRFAPL

SEQ ID NO: 147728 - protein, 16 aa, Mycobacterium tuberculosis
GRGGAGGGMQRFAPLN

SEQ ID NO: 147729 - protein, 16 aa, Mycobacterium tuberculosis
RGGAGGGMQRFAPLNS

SEQ ID NO: 147730 - protein, 16 aa, Mycobacterium tuberculosis
GGAGGGMQRFAPLNSW

SEQ ID NO: 147731 - protein, 16 aa, Mycobacterium tuberculosis
GAGGGMQRFAPLNSWP

SEQ ID NO: 147732 - protein, 16 aa, Mycobacterium tuberculosis
AGGGMQRFAPLNSWPD

SEQ ID NO: 147733 - protein, 16 aa, Mycobacterium tuberculosis
GGGMQRFAPLNSWPDN

SEQ ID NO: 147734 - protein, 16 aa, Mycobacterium tuberculosis
GGMQRFAPLNSWPDNA

SEQ ID NO: 147735 - protein, 16 aa, Mycobacterium tuberculosis
GMQRFAPLNSWPDNAS

SEQ ID NO: 147736 - protein, 16 aa, Mycobacterium tuberculosis
MQRFAPLNSWPDNASL

SEQ ID NO: 147737 - protein, 16 aa, Mycobacterium tuberculosis
QRFAPLNSWPDNASLD

SEQ ID NO: 147738 - protein, 16 aa, Mycobacterium tuberculosis
RFAPLNSWPDNASLDK

SEQ ID NO: 147739 - protein, 16 aa, Mycobacterium tuberculosis
FAPLNSWPDNASLDKA

SEQ ID NO: 147740 - protein, 16 aa, Mycobacterium tuberculosis
APLNSWPDNASLDKAR

SEQ ID NO: 147741 - protein, 16 aa, Mycobacterium tuberculosis
PLNSWPDNASLDKARR

SEQ ID NO: 147742 - protein, 16 aa, Mycobacterium tuberculosis
LNSWPDNASLDKARRL

SEQ ID NO: 147743 - protein, 16 aa, Mycobacterium tuberculosis
NSWPDNASLDKARRLL

SEQ ID NO: 147744 - protein, 16 aa, Mycobacterium tuberculosis
SWPDNASLDKARRLLW

SEQ ID NO: 147745 - protein, 16 aa, Mycobacterium tuberculosis
WPDNASLDKARRLLWP

SEQ ID NO: 147746 - protein, 16 aa, Mycobacterium tuberculosis
PDNASLDKARRLLWPV

SEQ ID NO: 147747 - protein, 16 aa, Mycobacterium tuberculosis
DNASLDKARRLLWPVK

SEQ ID NO: 147748 - protein, 16 aa, Mycobacterium tuberculosis
NASLDKARRLLWPVKK

SEQ ID NO: 147749 - protein, 16 aa, Mycobacterium tuberculosis
ASLDKARRLLWPVKKK

SEQ ID NO: 147750 - protein, 16 aa, Mycobacterium tuberculosis
SLDKARRLLWPVKKKY

SEQ ID NO: 147751 - protein, 16 aa, Mycobacterium tuberculosis
LDKARRLLWPVKKKYG

SEQ ID NO: 147752 - protein, 16 aa, Mycobacterium tuberculosis
DKARRLLWPVKKKYGK

SEQ ID NO: 147753 - protein, 16 aa, Mycobacterium tuberculosis
KARRLLWPVKKKYGKK

SEQ ID NO: 147754 - protein, 16 aa, Mycobacterium tuberculosis
ARRLLWPVKKKYGKKL

SEQ ID NO: 147755 - protein, 16 aa, Mycobacterium tuberculosis
RRLLWPVKKKYGKKLS

SEQ ID NO: 147756 - protein, 16 aa, Mycobacterium tuberculosis
RLLWPVKKKYGKKLSW

SEQ ID NO: 147757 - protein, 16 aa, Mycobacterium tuberculosis
LLWPVKKKYGKKLSWA

SEQ ID NO: 147758 - protein, 16 aa, Mycobacterium tuberculosis
LWPVKKKYGKKLSWAD

SEQ ID NO: 147759 - protein, 16 aa, Mycobacterium tuberculosis
WPVKKKYGKKLSWADL

SEQ ID NO: 147760 - protein, 16 aa, Mycobacterium tuberculosis
PVKKKYGKKLSWADLI

SEQ ID NO: 147761 - protein, 16 aa, Mycobacterium tuberculosis
VKKKYGKKLSWADLIV

SEQ ID NO: 147762 - protein, 16 aa, Mycobacterium tuberculosis
KKKYGKKLSWADLIVF

SEQ ID NO: 147763 - protein, 16 aa, Mycobacterium tuberculosis
KKYGKKLSWADLIVFA

SEQ ID NO: 147764 - protein, 16 aa, Mycobacterium tuberculosis
KYGKKLSWADLIVFAG

SEQ ID NO: 147765 - protein, 16 aa, Mycobacterium tuberculosis
YGKKLSWADLIVFAGN

SEQ ID NO: 147766 - protein, 16 aa, Mycobacterium tuberculosis
GKKLSWADLIVFAGNC

SEQ ID NO: 147767 - protein, 16 aa, Mycobacterium tuberculosis
KKLSWADLIVFAGNCA

SEQ ID NO: 147768 - protein, 16 aa, Mycobacterium tuberculosis
KLSWADLIVFAGNCAL

SEQ ID NO: 147769 - protein, 16 aa, Mycobacterium tuberculosis
LSWADLIVFAGNCALE

SEQ ID NO: 147770 - protein, 16 aa, Mycobacterium tuberculosis
SWADLIVFAGNCALES

SEQ ID NO: 147771 - protein, 16 aa, Mycobacterium tuberculosis
WADLIVFAGNCALESM

SEQ ID NO: 147772 - protein, 16 aa, Mycobacterium tuberculosis
ADLIVFAGNCALESMG

SEQ ID NO: 147773 - protein, 16 aa, Mycobacterium tuberculosis
DLIVFAGNCALESMGF

SEQ ID NO: 147774 - protein, 16 aa, Mycobacterium tuberculosis
LIVFAGNCALESMGFK

SEQ ID NO: 147775 - protein, 16 aa, Mycobacterium tuberculosis
IVFAGNCALESMGFKT

SEQ ID NO: 147776 - protein, 16 aa, Mycobacterium tuberculosis
VFAGNCALESMGFKTF

SEQ ID NO: 147777 - protein, 16 aa, Mycobacterium tuberculosis
FAGNCALESMGFKTFG

SEQ ID NO: 147778 - protein, 16 aa, Mycobacterium tuberculosis
AGNCALESMGFKTFGF

SEQ ID NO: 147779 - protein, 16 aa, Mycobacterium tuberculosis
GNCALESMGFKTFGFG

SEQ ID NO: 147780 - protein, 16 aa, Mycobacterium tuberculosis
NCALESMGFKTFGFGF

SEQ ID NO: 147781 - protein, 16 aa, Mycobacterium tuberculosis
CALESMGFKTFGFGFG

SEQ ID NO: 147782 - protein, 16 aa, Mycobacterium tuberculosis
ALESMGFKTFGFGFGR

SEQ ID NO: 147783 - protein, 16 aa, Mycobacterium tuberculosis
LESMGFKTFGFGFGRV

SEQ ID NO: 147784 - protein, 16 aa, Mycobacterium tuberculosis
ESMGFKTFGFGFGRVD

SEQ ID NO: 147785 - protein, 16 aa, Mycobacterium tuberculosis
SMGFKTFGFGFGRVDQ

SEQ ID NO: 147786 - protein, 16 aa, Mycobacterium tuberculosis
MGFKTFGFGFGRVDQW

SEQ ID NO: 147787 - protein, 16 aa, Mycobacterium tuberculosis
GFKTFGFGFGRVDQWE

SEQ ID NO: 147788 - protein, 16 aa, Mycobacterium tuberculosis
FKTFGFGFGRVDQWEP

SEQ ID NO: 147789 - protein, 16 aa, Mycobacterium tuberculosis
KTFGFGFGRVDQWEPD

SEQ ID NO: 147790 - protein, 16 aa, Mycobacterium tuberculosis
TFGFGFGRVDQWEPDE

SEQ ID NO: 147791 - protein, 16 aa, Mycobacterium tuberculosis
FGFGFGRVDQWEPDEV

SEQ ID NO: 147792 - protein, 16 aa, Mycobacterium tuberculosis
GFGFGRVDQWEPDEVY

SEQ ID NO: 147793 - protein, 16 aa, Mycobacterium tuberculosis
FGFGRVDQWEPDEVYW

SEQ ID NO: 147794 - protein, 16 aa, Mycobacterium tuberculosis
GFGRVDQWEPDEVYWG

SEQ ID NO: 147795 - protein, 16 aa, Mycobacterium tuberculosis
FGRVDQWEPDEVYWGK

SEQ ID NO: 147796 - protein, 16 aa, Mycobacterium tuberculosis
GRVDQWEPDEVYWGKE

SEQ ID NO: 147797 - protein, 16 aa, Mycobacterium tuberculosis
RVDQWEPDEVYWGKEA

SEQ ID NO: 147798 - protein, 16 aa, Mycobacterium tuberculosis
VDQWEPDEVYWGKEAT

SEQ ID NO: 147799 - protein, 16 aa, Mycobacterium tuberculosis
DQWEPDEVYWGKEATW

SEQ ID NO: 147800 - protein, 16 aa, Mycobacterium tuberculosis
QWEPDEVYWGKEATWL

SEQ ID NO: 147801 - protein, 16 aa, Mycobacterium tuberculosis
WEPDEVYWGKEATWLG

SEQ ID NO: 147802 - protein, 16 aa, Mycobacterium tuberculosis
EPDEVYWGKEATWLGD

SEQ ID NO: 147803 - protein, 16 aa, Mycobacterium tuberculosis
PDEVYWGKEATWLGDE

SEQ ID NO: 147804 - protein, 16 aa, Mycobacterium tuberculosis
DEVYWGKEATWLGDER

SEQ ID NO: 147805 - protein, 16 aa, Mycobacterium tuberculosis
EVYWGKEATWLGDERY

SEQ ID NO: 147806 - protein, 16 aa, Mycobacterium tuberculosis
VYWGKEATWLGDERYS

SEQ ID NO: 147807 - protein, 16 aa, Mycobacterium tuberculosis
YWGKEATWLGDERYSG

SEQ ID NO: 147808 - protein, 16 aa, Mycobacterium tuberculosis
WGKEATWLGDERYSGK

SEQ ID NO: 147809 - protein, 16 aa, Mycobacterium tuberculosis
GKEATWLGDERYSGKR

SEQ ID NO: 147810 - protein, 16 aa, Mycobacterium tuberculosis
KEATWLGDERYSGKRD

SEQ ID NO: 147811 - protein, 16 aa, Mycobacterium tuberculosis
EATWLGDERYSGKRDL

SEQ ID NO: 147812 - protein, 16 aa, Mycobacterium tuberculosis
ATWLGDERYSGKRDLE

SEQ ID NO: 147813 - protein, 16 aa, Mycobacterium tuberculosis
TWLGDERYSGKRDLEN

SEQ ID NO: 147814 - protein, 16 aa, Mycobacterium tuberculosis
WLGDERYSGKRDLENP

SEQ ID NO: 147815 - protein, 16 aa, Mycobacterium tuberculosis
LGDERYSGKRDLENPL

SEQ ID NO: 147816 - protein, 16 aa, Mycobacterium tuberculosis
GDERYSGKRDLENPLA

SEQ ID NO: 147817 - protein, 16 aa, Mycobacterium tuberculosis
DERYSGKRDLENPLAA

SEQ ID NO: 147818 - protein, 16 aa, Mycobacterium tuberculosis
ERYSGKRDLENPLAAV

SEQ ID NO: 147819 - protein, 16 aa, Mycobacterium tuberculosis
RYSGKRDLENPLAAVQ

SEQ ID NO: 147820 - protein, 16 aa, Mycobacterium tuberculosis
YSGKRDLENPLAAVQM

SEQ ID NO: 147821 - protein, 16 aa, Mycobacterium tuberculosis
SGKRDLENPLAAVQMG

SEQ ID NO: 147822 - protein, 16 aa, Mycobacterium tuberculosis
GKRDLENPLAAVQMGL

SEQ ID NO: 147823 - protein, 16 aa, Mycobacterium tuberculosis
KRDLENPLAAVQMGLI

SEQ ID NO: 147824 - protein, 16 aa, Mycobacterium tuberculosis
RDLENPLAAVQMGLIY

SEQ ID NO: 147825 - protein, 16 aa, Mycobacterium tuberculosis
DLENPLAAVQMGLIYV

SEQ ID NO: 147826 - protein, 16 aa, Mycobacterium tuberculosis
LENPLAAVQMGLIYVN

SEQ ID NO: 147827 - protein, 16 aa, Mycobacterium tuberculosis
ENPLAAVQMGLIYVNP

SEQ ID NO: 147828 - protein, 16 aa, Mycobacterium tuberculosis
NPLAAVQMGLIYVNPE

SEQ ID NO: 147829 - protein, 16 aa, Mycobacterium tuberculosis
PLAAVQMGLIYVNPEG

SEQ ID NO: 147830 - protein, 16 aa, Mycobacterium tuberculosis
LAAVQMGLIYVNPEGP

SEQ ID NO: 147831 - protein, 16 aa, Mycobacterium tuberculosis
AAVQMGLIYVNPEGPN

SEQ ID NO: 147832 - protein, 16 aa, Mycobacterium tuberculosis
AVQMGLIYVNPEGPNG

SEQ ID NO: 147833 - protein, 16 aa, Mycobacterium tuberculosis
VQMGLIYVNPEGPNGN

SEQ ID NO: 147834 - protein, 16 aa, Mycobacterium tuberculosis
QMGLIYVNPEGPNGNP

SEQ ID NO: 147835 - protein, 16 aa, Mycobacterium tuberculosis
MGLIYVNPEGPNGNPD

SEQ ID NO: 147836 - protein, 16 aa, Mycobacterium tuberculosis
GLIYVNPEGPNGNPDP

SEQ ID NO: 147837 - protein, 16 aa, Mycobacterium tuberculosis
LIYVNPEGPNGNPDPM

SEQ ID NO: 147838 - protein, 16 aa, Mycobacterium tuberculosis
IYVNPEGPNGNPDPMA

SEQ ID NO: 147839 - protein, 16 aa, Mycobacterium tuberculosis
YVNPEGPNGNPDPMAA

SEQ ID NO: 147840 - protein, 16 aa, Mycobacterium tuberculosis
VNPEGPNGNPDPMAAA

SEQ ID NO: 147841 - protein, 16 aa, Mycobacterium tuberculosis
NPEGPNGNPDPMAAAV

SEQ ID NO: 147842 - protein, 16 aa, Mycobacterium tuberculosis
PEGPNGNPDPMAAAVD

SEQ ID NO: 147843 - protein, 16 aa, Mycobacterium tuberculosis
EGPNGNPDPMAAAVDI

SEQ ID NO: 147844 - protein, 16 aa, Mycobacterium tuberculosis
GPNGNPDPMAAAVDIR

SEQ ID NO: 147845 - protein, 16 aa, Mycobacterium tuberculosis
PNGNPDPMAAAVDIRE

SEQ ID NO: 147846 - protein, 16 aa, Mycobacterium tuberculosis
NGNPDPMAAAVDIRET

SEQ ID NO: 147847 - protein, 16 aa, Mycobacterium tuberculosis
GNPDPMAAAVDIRETF

SEQ ID NO: 147848 - protein, 16 aa, Mycobacterium tuberculosis
NPDPMAAAVDIRETFR

SEQ ID NO: 147849 - protein, 16 aa, Mycobacterium tuberculosis
PDPMAAAVDIRETFRR

SEQ ID NO: 147850 - protein, 16 aa, Mycobacterium tuberculosis
DPMAAAVDIRETFRRM

SEQ ID NO: 147851 - protein, 16 aa, Mycobacterium tuberculosis
PMAAAVDIRETFRRMA

SEQ ID NO: 147852 - protein, 16 aa, Mycobacterium tuberculosis
MAAAVDIRETFRRMAM

SEQ ID NO: 147853 - protein, 16 aa, Mycobacterium tuberculosis
AAAVDIRETFRRMAMN

SEQ ID NO: 147854 - protein, 16 aa, Mycobacterium tuberculosis
AAVDIRETFRRMAMND

SEQ ID NO: 147855 - protein, 16 aa, Mycobacterium tuberculosis
AVDIRETFRRMAMNDV

SEQ ID NO: 147856 - protein, 16 aa, Mycobacterium tuberculosis
VDIRETFRRMAMNDVE

SEQ ID NO: 147857 - protein, 16 aa, Mycobacterium tuberculosis
DIRETFRRMAMNDVET

SEQ ID NO: 147858 - protein, 16 aa, Mycobacterium tuberculosis
IRETFRRMAMNDVETA

SEQ ID NO: 147859 - protein, 16 aa, Mycobacterium tuberculosis
RETFRRMAMNDVETAA

SEQ ID NO: 147860 - protein, 16 aa, Mycobacterium tuberculosis
ETFRRMAMNDVETAAL

SEQ ID NO: 147861 - protein, 16 aa, Mycobacterium tuberculosis
TFRRMAMNDVETAALI

SEQ ID NO: 147862 - protein, 16 aa, Mycobacterium tuberculosis
FRRMAMNDVETAALIV

SEQ ID NO: 147863 - protein, 16 aa, Mycobacterium tuberculosis
RRMAMNDVETAALIVG

SEQ ID NO: 147864 - protein, 16 aa, Mycobacterium tuberculosis
RMAMNDVETAALIVGG

SEQ ID NO: 147865 - protein, 16 aa, Mycobacterium tuberculosis
MAMNDVETAALIVGGH

SEQ ID NO: 147866 - protein, 16 aa, Mycobacterium tuberculosis
AMNDVETAALIVGGHT

SEQ ID NO: 147867 - protein, 16 aa, Mycobacterium tuberculosis
MNDVETAALIVGGHTF

SEQ ID NO: 147868 - protein, 16 aa, Mycobacterium tuberculosis
NDVETAALIVGGHTFG

SEQ ID NO: 147869 - protein, 16 aa, Mycobacterium tuberculosis
DVETAALIVGGHTFGK

SEQ ID NO: 147870 - protein, 16 aa, Mycobacterium tuberculosis
VETAALIVGGHTFGKT

SEQ ID NO: 147871 - protein, 16 aa, Mycobacterium tuberculosis
ETAALIVGGHTFGKTH

SEQ ID NO: 147872 - protein, 16 aa, Mycobacterium tuberculosis
TAALIVGGHTFGKTHG

SEQ ID NO: 147873 - protein, 16 aa, Mycobacterium tuberculosis
AALIVGGHTFGKTHGA

SEQ ID NO: 147874 - protein, 16 aa, Mycobacterium tuberculosis
ALIVGGHTFGKTHGAG

SEQ ID NO: 147875 - protein, 16 aa, Mycobacterium tuberculosis
LIVGGHTFGKTHGAGP

SEQ ID NO: 147876 - protein, 16 aa, Mycobacterium tuberculosis
IVGGHTFGKTHGAGPA

SEQ ID NO: 147877 - protein, 16 aa, Mycobacterium tuberculosis
VGGHTFGKTHGAGPAD

SEQ ID NO: 147878 - protein, 16 aa, Mycobacterium tuberculosis
GGHTFGKTHGAGPADL

SEQ ID NO: 147879 - protein, 16 aa, Mycobacterium tuberculosis
GHTFGKTHGAGPADLV

SEQ ID NO: 147880 - protein, 16 aa, Mycobacterium tuberculosis
HTFGKTHGAGPADLVG

SEQ ID NO: 147881 - protein, 16 aa, Mycobacterium tuberculosis
TFGKTHGAGPADLVGP

SEQ ID NO: 147882 - protein, 16 aa, Mycobacterium tuberculosis
FGKTHGAGPADLVGPE

SEQ ID NO: 147883 - protein, 16 aa, Mycobacterium tuberculosis
GKTHGAGPADLVGPEP

SEQ ID NO: 147884 - protein, 16 aa, Mycobacterium tuberculosis
KTHGAGPADLVGPEPE

SEQ ID NO: 147885 - protein, 16 aa, Mycobacterium tuberculosis
THGAGPADLVGPEPEA

SEQ ID NO: 147886 - protein, 16 aa, Mycobacterium tuberculosis
HGAGPADLVGPEPEAA

SEQ ID NO: 147887 - protein, 16 aa, Mycobacterium tuberculosis
GAGPADLVGPEPEAAP

SEQ ID NO: 147888 - protein, 16 aa, Mycobacterium tuberculosis
AGPADLVGPEPEAAPL

SEQ ID NO: 147889 - protein, 16 aa, Mycobacterium tuberculosis
GPADLVGPEPEAAPLE

SEQ ID NO: 147890 - protein, 16 aa, Mycobacterium tuberculosis
PADLVGPEPEAAPLEQ

SEQ ID NO: 147891 - protein, 16 aa, Mycobacterium tuberculosis
ADLVGPEPEAAPLEQM

SEQ ID NO: 147892 - protein, 16 aa, Mycobacterium tuberculosis
DLVGPEPEAAPLEQMG

SEQ ID NO: 147893 - protein, 16 aa, Mycobacterium tuberculosis
LVGPEPEAAPLEQMGL

SEQ ID NO: 147894 - protein, 16 aa, Mycobacterium tuberculosis
VGPEPEAAPLEQMGLG

SEQ ID NO: 147895 - protein, 16 aa, Mycobacterium tuberculosis
GPEPEAAPLEQMGLGW

SEQ ID NO: 147896 - protein, 16 aa, Mycobacterium tuberculosis
PEPEAAPLEQMGLGWK

SEQ ID NO: 147897 - protein, 16 aa, Mycobacterium tuberculosis
EPEAAPLEQMGLGWKS

SEQ ID NO: 147898 - protein, 16 aa, Mycobacterium tuberculosis
PEAAPLEQMGLGWKSS

SEQ ID NO: 147899 - protein, 16 aa, Mycobacterium tuberculosis
EAAPLEQMGLGWKSSY

SEQ ID NO: 147900 - protein, 16 aa, Mycobacterium tuberculosis
AAPLEQMGLGWKSSYG

SEQ ID NO: 147901 - protein, 16 aa, Mycobacterium tuberculosis
APLEQMGLGWKSSYGT

SEQ ID NO: 147902 - protein, 16 aa, Mycobacterium tuberculosis
PLEQMGLGWKSSYGTG

SEQ ID NO: 147903 - protein, 16 aa, Mycobacterium tuberculosis
LEQMGLGWKSSYGTGT

SEQ ID NO: 147904 - protein, 16 aa, Mycobacterium tuberculosis
EQMGLGWKSSYGTGTG

SEQ ID NO: 147905 - protein, 16 aa, Mycobacterium tuberculosis
QMGLGWKSSYGTGTGK

SEQ ID NO: 147906 - protein, 16 aa, Mycobacterium tuberculosis
MGLGWKSSYGTGTGKD

SEQ ID NO: 147907 - protein, 16 aa, Mycobacterium tuberculosis
GLGWKSSYGTGTGKDA

SEQ ID NO: 147908 - protein, 16 aa, Mycobacterium tuberculosis
LGWKSSYGTGTGKDAI

SEQ ID NO: 147909 - protein, 16 aa, Mycobacterium tuberculosis
GWKSSYGTGTGKDAIT

SEQ ID NO: 147910 - protein, 16 aa, Mycobacterium tuberculosis
WKSSYGTGTGKDAITS

SEQ ID NO: 147911 - protein, 16 aa, Mycobacterium tuberculosis
KSSYGTGTGKDAITSG

SEQ ID NO: 147912 - protein, 16 aa, Mycobacterium tuberculosis
SSYGTGTGKDAITSGI

SEQ ID NO: 147913 - protein, 16 aa, Mycobacterium tuberculosis
SYGTGTGKDAITSGIE

SEQ ID NO: 147914 - protein, 16 aa, Mycobacterium tuberculosis
YGTGTGKDAITSGIEV

SEQ ID NO: 147915 - protein, 16 aa, Mycobacterium tuberculosis
GTGTGKDAITSGIEVV

SEQ ID NO: 147916 - protein, 16 aa, Mycobacterium tuberculosis
TGTGKDAITSGIEVVW

SEQ ID NO: 147917 - protein, 16 aa, Mycobacterium tuberculosis
GTGKDAITSGIEVVWT

SEQ ID NO: 147918 - protein, 16 aa, Mycobacterium tuberculosis
TGKDAITSGIEVVWTN

SEQ ID NO: 147919 - protein, 16 aa, Mycobacterium tuberculosis
GKDAITSGIEVVWTNT

SEQ ID NO: 147920 - protein, 16 aa, Mycobacterium tuberculosis
KDAITSGIEVVWTNTP

SEQ ID NO: 147921 - protein, 16 aa, Mycobacterium tuberculosis
DAITSGIEVVWTNTPT

SEQ ID NO: 147922 - protein, 16 aa, Mycobacterium tuberculosis
AITSGIEVVWTNTPTK

SEQ ID NO: 147923 - protein, 16 aa, Mycobacterium tuberculosis
ITSGIEVVWTNTPTKW

SEQ ID NO: 147924 - protein, 16 aa, Mycobacterium tuberculosis
TSGIEVVWTNTPTKWD

SEQ ID NO: 147925 - protein, 16 aa, Mycobacterium tuberculosis
SGIEVVWTNTPTKWDN

SEQ ID NO: 147926 - protein, 16 aa, Mycobacterium tuberculosis
GIEVVWTNTPTKWDNS

SEQ ID NO: 147927 - protein, 16 aa, Mycobacterium tuberculosis
IEVVWTNTPTKWDNSF

SEQ ID NO: 147928 - protein, 16 aa, Mycobacterium tuberculosis
EVVWTNTPTKWDNSFL

SEQ ID NO: 147929 - protein, 16 aa, Mycobacterium tuberculosis
VVWTNTPTKWDNSFLE

SEQ ID NO: 147930 - protein, 16 aa, Mycobacterium tuberculosis
VWTNTPTKWDNSFLEI

SEQ ID NO: 147931 - protein, 16 aa, Mycobacterium tuberculosis
WTNTPTKWDNSFLEIL

SEQ ID NO: 147932 - protein, 16 aa, Mycobacterium tuberculosis
TNTPTKWDNSFLEILY

SEQ ID NO: 147933 - protein, 16 aa, Mycobacterium tuberculosis
NTPTKWDNSFLEILYG

SEQ ID NO: 147934 - protein, 16 aa, Mycobacterium tuberculosis
TPTKWDNSFLEILYGY

SEQ ID NO: 147935 - protein, 16 aa, Mycobacterium tuberculosis
PTKWDNSFLEILYGYE

SEQ ID NO: 147936 - protein, 16 aa, Mycobacterium tuberculosis
TKWDNSFLEILYGYEW

SEQ ID NO: 147937 - protein, 16 aa, Mycobacterium tuberculosis
KWDNSFLEILYGYEWE

SEQ ID NO: 147938 - protein, 16 aa, Mycobacterium tuberculosis
WDNSFLEILYGYEWEL

SEQ ID NO: 147939 - protein, 16 aa, Mycobacterium tuberculosis
DNSFLEILYGYEWELT

SEQ ID NO: 147940 - protein, 16 aa, Mycobacterium tuberculosis
NSFLEILYGYEWELTK

SEQ ID NO: 147941 - protein, 16 aa, Mycobacterium tuberculosis
SFLEILYGYEWELTKS

SEQ ID NO: 147942 - protein, 16 aa, Mycobacterium tuberculosis
FLEILYGYEWELTKSP

SEQ ID NO: 147943 - protein, 16 aa, Mycobacterium tuberculosis
LEILYGYEWELTKSPA

SEQ ID NO: 147944 - protein, 16 aa, Mycobacterium tuberculosis
EILYGYEWELTKSPAG

SEQ ID NO: 147945 - protein, 16 aa, Mycobacterium tuberculosis
ILYGYEWELTKSPAGA

SEQ ID NO: 147946 - protein, 16 aa, Mycobacterium tuberculosis
LYGYEWELTKSPAGAW

SEQ ID NO: 147947 - protein, 16 aa, Mycobacterium tuberculosis
YGYEWELTKSPAGAWQ

SEQ ID NO: 147948 - protein, 16 aa, Mycobacterium tuberculosis
GYEWELTKSPAGAWQY

SEQ ID NO: 147949 - protein, 16 aa, Mycobacterium tuberculosis
YEWELTKSPAGAWQYT

SEQ ID NO: 147950 - protein, 16 aa, Mycobacterium tuberculosis
EWELTKSPAGAWQYTA

SEQ ID NO: 147951 - protein, 16 aa, Mycobacterium tuberculosis
WELTKSPAGAWQYTAK

SEQ ID NO: 147952 - protein, 16 aa, Mycobacterium tuberculosis
ELTKSPAGAWQYTAKD

SEQ ID NO: 147953 - protein, 16 aa, Mycobacterium tuberculosis
LTKSPAGAWQYTAKDG

SEQ ID NO: 147954 - protein, 16 aa, Mycobacterium tuberculosis
TKSPAGAWQYTAKDGA

SEQ ID NO: 147955 - protein, 16 aa, Mycobacterium tuberculosis
KSPAGAWQYTAKDGAG

SEQ ID NO: 147956 - protein, 16 aa, Mycobacterium tuberculosis
SPAGAWQYTAKDGAGA

SEQ ID NO: 147957 - protein, 16 aa, Mycobacterium tuberculosis
PAGAWQYTAKDGAGAG

SEQ ID NO: 147958 - protein, 16 aa, Mycobacterium tuberculosis
AGAWQYTAKDGAGAGT

SEQ ID NO: 147959 - protein, 16 aa, Mycobacterium tuberculosis
GAWQYTAKDGAGAGTI

SEQ ID NO: 147960 - protein, 16 aa, Mycobacterium tuberculosis
AWQYTAKDGAGAGTIP

SEQ ID NO: 147961 - protein, 16 aa, Mycobacterium tuberculosis
WQYTAKDGAGAGTIPD

SEQ ID NO: 147962 - protein, 16 aa, Mycobacterium tuberculosis
QYTAKDGAGAGTIPDP

SEQ ID NO: 147963 - protein, 16 aa, Mycobacterium tuberculosis
YTAKDGAGAGTIPDPF

SEQ ID NO: 147964 - protein, 16 aa, Mycobacterium tuberculosis
TAKDGAGAGTIPDPFG

SEQ ID NO: 147965 - protein, 16 aa, Mycobacterium tuberculosis
AKDGAGAGTIPDPFGG

SEQ ID NO: 147966 - protein, 16 aa, Mycobacterium tuberculosis
KDGAGAGTIPDPFGGP

SEQ ID NO: 147967 - protein, 16 aa, Mycobacterium tuberculosis
DGAGAGTIPDPFGGPG

SEQ ID NO: 147968 - protein, 16 aa, Mycobacterium tuberculosis
GAGAGTIPDPFGGPGR

SEQ ID NO: 147969 - protein, 16 aa, Mycobacterium tuberculosis
AGAGTIPDPFGGPGRS

SEQ ID NO: 147970 - protein, 16 aa, Mycobacterium tuberculosis
GAGTIPDPFGGPGRSP

SEQ ID NO: 147971 - protein, 16 aa, Mycobacterium tuberculosis
AGTIPDPFGGPGRSPT

SEQ ID NO: 147972 - protein, 16 aa, Mycobacterium tuberculosis
GTIPDPFGGPGRSPTM

SEQ ID NO: 147973 - protein, 16 aa, Mycobacterium tuberculosis
TIPDPFGGPGRSPTML

SEQ ID NO: 147974 - protein, 16 aa, Mycobacterium tuberculosis
IPDPFGGPGRSPTMLA

SEQ ID NO: 147975 - protein, 16 aa, Mycobacterium tuberculosis
PDPFGGPGRSPTMLAT

SEQ ID NO: 147976 - protein, 16 aa, Mycobacterium tuberculosis
DPFGGPGRSPTMLATD

SEQ ID NO: 147977 - protein, 16 aa, Mycobacterium tuberculosis
PFGGPGRSPTMLATDL

SEQ ID NO: 147978 - protein, 16 aa, Mycobacterium tuberculosis
FGGPGRSPTMLATDLS

SEQ ID NO: 147979 - protein, 16 aa, Mycobacterium tuberculosis
GGPGRSPTMLATDLSL

SEQ ID NO: 147980 - protein, 16 aa, Mycobacterium tuberculosis
GPGRSPTMLATDLSLR

SEQ ID NO: 147981 - protein, 16 aa, Mycobacterium tuberculosis
PGRSPTMLATDLSLRV

SEQ ID NO: 147982 - protein, 16 aa, Mycobacterium tuberculosis
GRSPTMLATDLSLRVD

SEQ ID NO: 147983 - protein, 16 aa, Mycobacterium tuberculosis
RSPTMLATDLSLRVDP

SEQ ID NO: 147984 - protein, 16 aa, Mycobacterium tuberculosis
SPTMLATDLSLRVDPI

SEQ ID NO: 147985 - protein, 16 aa, Mycobacterium tuberculosis
PTMLATDLSLRVDPIY

SEQ ID NO: 147986 - protein, 16 aa, Mycobacterium tuberculosis
TMLATDLSLRVDPIYE

SEQ ID NO: 147987 - protein, 16 aa, Mycobacterium tuberculosis
MLATDLSLRVDPIYER

SEQ ID NO: 147988 - protein, 16 aa, Mycobacterium tuberculosis
LATDLSLRVDPIYERI

SEQ ID NO: 147989 - protein, 16 aa, Mycobacterium tuberculosis
ATDLSLRVDPIYERIT

SEQ ID NO: 147990 - protein, 16 aa, Mycobacterium tuberculosis
TDLSLRVDPIYERITR

SEQ ID NO: 147991 - protein, 16 aa, Mycobacterium tuberculosis
DLSLRVDPIYERITRR

SEQ ID NO: 147992 - protein, 16 aa, Mycobacterium tuberculosis
LSLRVDPIYERITRRW

SEQ ID NO: 147993 - protein, 16 aa, Mycobacterium tuberculosis
SLRVDPIYERITRRWL

SEQ ID NO: 147994 - protein, 16 aa, Mycobacterium tuberculosis
LRVDPIYERITRRWLE

SEQ ID NO: 147995 - protein, 16 aa, Mycobacterium tuberculosis
RVDPIYERITRRWLEH

SEQ ID NO: 147996 - protein, 16 aa, Mycobacterium tuberculosis
VDPIYERITRRWLEHP

SEQ ID NO: 147997 - protein, 16 aa, Mycobacterium tuberculosis
DPIYERITRRWLEHPE

SEQ ID NO: 147998 - protein, 16 aa, Mycobacterium tuberculosis
PIYERITRRWLEHPEE

SEQ ID NO: 147999 - protein, 16 aa, Mycobacterium tuberculosis
IYERITRRWLEHPEEL

SEQ ID NO: 148000 - protein, 16 aa, Mycobacterium tuberculosis
YERITRRWLEHPEELA

SEQ ID NO: 148001 - protein, 16 aa, Mycobacterium tuberculosis
ERITRRWLEHPEELAD

SEQ ID NO: 148002 - protein, 16 aa, Mycobacterium tuberculosis
RITRRWLEHPEELADE

SEQ ID NO: 148003 - protein, 16 aa, Mycobacterium tuberculosis
ITRRWLEHPEELADEF

SEQ ID NO: 148004 - protein, 16 aa, Mycobacterium tuberculosis
TRRWLEHPEELADEFA

SEQ ID NO: 148005 - protein, 16 aa, Mycobacterium tuberculosis
RRWLEHPEELADEFAK

SEQ ID NO: 148006 - protein, 16 aa, Mycobacterium tuberculosis
RWLEHPEELADEFAKA

SEQ ID NO: 148007 - protein, 16 aa, Mycobacterium tuberculosis
WLEHPEELADEFAKAW

SEQ ID NO: 148008 - protein, 16 aa, Mycobacterium tuberculosis
LEHPEELADEFAKAWY

SEQ ID NO: 148009 - protein, 16 aa, Mycobacterium tuberculosis
EHPEELADEFAKAWYK

SEQ ID NO: 148010 - protein, 16 aa, Mycobacterium tuberculosis
HPEELADEFAKAWYKL

SEQ ID NO: 148011 - protein, 16 aa, Mycobacterium tuberculosis
PEELADEFAKAWYKLI

SEQ ID NO: 148012 - protein, 16 aa, Mycobacterium tuberculosis
EELADEFAKAWYKLIH

SEQ ID NO: 148013 - protein, 16 aa, Mycobacterium tuberculosis
ELADEFAKAWYKLIHR

SEQ ID NO: 148014 - protein, 16 aa, Mycobacterium tuberculosis
LADEFAKAWYKLIHRD

SEQ ID NO: 148015 - protein, 16 aa, Mycobacterium tuberculosis
ADEFAKAWYKLIHRDM

SEQ ID NO: 148016 - protein, 16 aa, Mycobacterium tuberculosis
DEFAKAWYKLIHRDMG

SEQ ID NO: 148017 - protein, 16 aa, Mycobacterium tuberculosis
EFAKAWYKLIHRDMGP

SEQ ID NO: 148018 - protein, 16 aa, Mycobacterium tuberculosis
FAKAWYKLIHRDMGPV

SEQ ID NO: 148019 - protein, 16 aa, Mycobacterium tuberculosis
AKAWYKLIHRDMGPVA

SEQ ID NO: 148020 - protein, 16 aa, Mycobacterium tuberculosis
KAWYKLIHRDMGPVAR

SEQ ID NO: 148021 - protein, 16 aa, Mycobacterium tuberculosis
AWYKLIHRDMGPVARY

SEQ ID NO: 148022 - protein, 16 aa, Mycobacterium tuberculosis
WYKLIHRDMGPVARYL

SEQ ID NO: 148023 - protein, 16 aa, Mycobacterium tuberculosis
YKLIHRDMGPVARYLG

SEQ ID NO: 148024 - protein, 16 aa, Mycobacterium tuberculosis
KLIHRDMGPVARYLGP

SEQ ID NO: 148025 - protein, 16 aa, Mycobacterium tuberculosis
LIHRDMGPVARYLGPL

SEQ ID NO: 148026 - protein, 16 aa, Mycobacterium tuberculosis
IHRDMGPVARYLGPLV

SEQ ID NO: 148027 - protein, 16 aa, Mycobacterium tuberculosis
HRDMGPVARYLGPLVP

SEQ ID NO: 148028 - protein, 16 aa, Mycobacterium tuberculosis
RDMGPVARYLGPLVPK

SEQ ID NO: 148029 - protein, 16 aa, Mycobacterium tuberculosis
DMGPVARYLGPLVPKQ

SEQ ID NO: 148030 - protein, 16 aa, Mycobacterium tuberculosis
MGPVARYLGPLVPKQT

SEQ ID NO: 148031 - protein, 16 aa, Mycobacterium tuberculosis
GPVARYLGPLVPKQTL

SEQ ID NO: 148032 - protein, 16 aa, Mycobacterium tuberculosis
PVARYLGPLVPKQTLL

SEQ ID NO: 148033 - protein, 16 aa, Mycobacterium tuberculosis
VARYLGPLVPKQTLLW

SEQ ID NO: 148034 - protein, 16 aa, Mycobacterium tuberculosis
ARYLGPLVPKQTLLWQ

SEQ ID NO: 148035 - protein, 16 aa, Mycobacterium tuberculosis
RYLGPLVPKQTLLWQD

SEQ ID NO: 148036 - protein, 16 aa, Mycobacterium tuberculosis
YLGPLVPKQTLLWQDP

SEQ ID NO: 148037 - protein, 16 aa, Mycobacterium tuberculosis
LGPLVPKQTLLWQDPV

SEQ ID NO: 148038 - protein, 16 aa, Mycobacterium tuberculosis
GPLVPKQTLLWQDPVP

SEQ ID NO: 148039 - protein, 16 aa, Mycobacterium tuberculosis
PLVPKQTLLWQDPVPA

SEQ ID NO: 148040 - protein, 16 aa, Mycobacterium tuberculosis
LVPKQTLLWQDPVPAV

SEQ ID NO: 148041 - protein, 16 aa, Mycobacterium tuberculosis
VPKQTLLWQDPVPAVS

SEQ ID NO: 148042 - protein, 16 aa, Mycobacterium tuberculosis
PKQTLLWQDPVPAVSH

SEQ ID NO: 148043 - protein, 16 aa, Mycobacterium tuberculosis
KQTLLWQDPVPAVSHD

SEQ ID NO: 148044 - protein, 16 aa, Mycobacterium tuberculosis
QTLLWQDPVPAVSHDL

SEQ ID NO: 148045 - protein, 16 aa, Mycobacterium tuberculosis
TLLWQDPVPAVSHDLV

SEQ ID NO: 148046 - protein, 16 aa, Mycobacterium tuberculosis
LLWQDPVPAVSHDLVG

SEQ ID NO: 148047 - protein, 16 aa, Mycobacterium tuberculosis
LWQDPVPAVSHDLVGE

SEQ ID NO: 148048 - protein, 16 aa, Mycobacterium tuberculosis
WQDPVPAVSHDLVGEA

SEQ ID NO: 148049 - protein, 16 aa, Mycobacterium tuberculosis
QDPVPAVSHDLVGEAE

SEQ ID NO: 148050 - protein, 16 aa, Mycobacterium tuberculosis
DPVPAVSHDLVGEAEI

SEQ ID NO: 148051 - protein, 16 aa, Mycobacterium tuberculosis
PVPAVSHDLVGEAEIA

SEQ ID NO: 148052 - protein, 16 aa, Mycobacterium tuberculosis
VPAVSHDLVGEAEIAS

SEQ ID NO: 148053 - protein, 16 aa, Mycobacterium tuberculosis
PAVSHDLVGEAEIASL

SEQ ID NO: 148054 - protein, 16 aa, Mycobacterium tuberculosis
AVSHDLVGEAEIASLK

SEQ ID NO: 148055 - protein, 16 aa, Mycobacterium tuberculosis
VSHDLVGEAEIASLKS

SEQ ID NO: 148056 - protein, 16 aa, Mycobacterium tuberculosis
SHDLVGEAEIASLKSQ

SEQ ID NO: 148057 - protein, 16 aa, Mycobacterium tuberculosis
HDLVGEAEIASLKSQI

SEQ ID NO: 148058 - protein, 16 aa, Mycobacterium tuberculosis
DLVGEAEIASLKSQIR

SEQ ID NO: 148059 - protein, 16 aa, Mycobacterium tuberculosis
LVGEAEIASLKSQIRA

SEQ ID NO: 148060 - protein, 16 aa, Mycobacterium tuberculosis
VGEAEIASLKSQIRAS

SEQ ID NO: 148061 - protein, 16 aa, Mycobacterium tuberculosis
GEAEIASLKSQIRASG

SEQ ID NO: 148062 - protein, 16 aa, Mycobacterium tuberculosis
EAEIASLKSQIRASGL

SEQ ID NO: 148063 - protein, 16 aa, Mycobacterium tuberculosis
AEIASLKSQIRASGLT

SEQ ID NO: 148064 - protein, 16 aa, Mycobacterium tuberculosis
EIASLKSQIRASGLTV

SEQ ID NO: 148065 - protein, 16 aa, Mycobacterium tuberculosis
IASLKSQIRASGLTVS

SEQ ID NO: 148066 - protein, 16 aa, Mycobacterium tuberculosis
ASLKSQIRASGLTVSQ

SEQ ID NO: 148067 - protein, 16 aa, Mycobacterium tuberculosis
SLKSQIRASGLTVSQL

SEQ ID NO: 148068 - protein, 16 aa, Mycobacterium tuberculosis
LKSQIRASGLTVSQLV

SEQ ID NO: 148069 - protein, 16 aa, Mycobacterium tuberculosis
KSQIRASGLTVSQLVS

SEQ ID NO: 148070 - protein, 16 aa, Mycobacterium tuberculosis
SQIRASGLTVSQLVST

SEQ ID NO: 148071 - protein, 16 aa, Mycobacterium tuberculosis
QIRASGLTVSQLVSTA

SEQ ID NO: 148072 - protein, 16 aa, Mycobacterium tuberculosis
IRASGLTVSQLVSTAW

SEQ ID NO: 148073 - protein, 16 aa, Mycobacterium tuberculosis
RASGLTVSQLVSTAWA

SEQ ID NO: 148074 - protein, 16 aa, Mycobacterium tuberculosis
ASGLTVSQLVSTAWAA

SEQ ID NO: 148075 - protein, 16 aa, Mycobacterium tuberculosis
SGLTVSQLVSTAWAAA

SEQ ID NO: 148076 - protein, 16 aa, Mycobacterium tuberculosis
GLTVSQLVSTAWAAAS

SEQ ID NO: 148077 - protein, 16 aa, Mycobacterium tuberculosis
LTVSQLVSTAWAAASS

SEQ ID NO: 148078 - protein, 16 aa, Mycobacterium tuberculosis
TVSQLVSTAWAAASSF

SEQ ID NO: 148079 - protein, 16 aa, Mycobacterium tuberculosis
VSQLVSTAWAAASSFR

SEQ ID NO: 148080 - protein, 16 aa, Mycobacterium tuberculosis
SQLVSTAWAAASSFRG

SEQ ID NO: 148081 - protein, 16 aa, Mycobacterium tuberculosis
QLVSTAWAAASSFRGS

SEQ ID NO: 148082 - protein, 16 aa, Mycobacterium tuberculosis
LVSTAWAAASSFRGSD

SEQ ID NO: 148083 - protein, 16 aa, Mycobacterium tuberculosis
VSTAWAAASSFRGSDK

SEQ ID NO: 148084 - protein, 16 aa, Mycobacterium tuberculosis
STAWAAASSFRGSDKR

SEQ ID NO: 148085 - protein, 16 aa, Mycobacterium tuberculosis
TAWAAASSFRGSDKRG

SEQ ID NO: 148086 - protein, 16 aa, Mycobacterium tuberculosis
AWAAASSFRGSDKRGG

SEQ ID NO: 148087 - protein, 16 aa, Mycobacterium tuberculosis
WAAASSFRGSDKRGGA

SEQ ID NO: 148088 - protein, 16 aa, Mycobacterium tuberculosis
AAASSFRGSDKRGGAN

SEQ ID NO: 148089 - protein, 16 aa, Mycobacterium tuberculosis
AASSFRGSDKRGGANG

SEQ ID NO: 148090 - protein, 16 aa, Mycobacterium tuberculosis
ASSFRGSDKRGGANGG

SEQ ID NO: 148091 - protein, 16 aa, Mycobacterium tuberculosis
SSFRGSDKRGGANGGR

SEQ ID NO: 148092 - protein, 16 aa, Mycobacterium tuberculosis
SFRGSDKRGGANGGRI

SEQ ID NO: 148093 - protein, 16 aa, Mycobacterium tuberculosis
FRGSDKRGGANGGRIR

SEQ ID NO: 148094 - protein, 16 aa, Mycobacterium tuberculosis
RGSDKRGGANGGRIRL

SEQ ID NO: 148095 - protein, 16 aa, Mycobacterium tuberculosis
GSDKRGGANGGRIRLQ

SEQ ID NO: 148096 - protein, 16 aa, Mycobacterium tuberculosis
SDKRGGANGGRIRLQP

SEQ ID NO: 148097 - protein, 16 aa, Mycobacterium tuberculosis
DKRGGANGGRIRLQPQ

SEQ ID NO: 148098 - protein, 16 aa, Mycobacterium tuberculosis
KRGGANGGRIRLQPQV

SEQ ID NO: 148099 - protein, 16 aa, Mycobacterium tuberculosis
RGGANGGRIRLQPQVG

SEQ ID NO: 148100 - protein, 16 aa, Mycobacterium tuberculosis
GGANGGRIRLQPQVGW

SEQ ID NO: 148101 - protein, 16 aa, Mycobacterium tuberculosis
GANGGRIRLQPQVGWE

SEQ ID NO: 148102 - protein, 16 aa, Mycobacterium tuberculosis
ANGGRIRLQPQVGWEV

SEQ ID NO: 148103 - protein, 16 aa, Mycobacterium tuberculosis
NGGRIRLQPQVGWEVN

SEQ ID NO: 148104 - protein, 16 aa, Mycobacterium tuberculosis
GGRIRLQPQVGWEVND

SEQ ID NO: 148105 - protein, 16 aa, Mycobacterium tuberculosis
GRIRLQPQVGWEVNDP

SEQ ID NO: 148106 - protein, 16 aa, Mycobacterium tuberculosis
RIRLQPQVGWEVNDPD

SEQ ID NO: 148107 - protein, 16 aa, Mycobacterium tuberculosis
IRLQPQVGWEVNDPDG

SEQ ID NO: 148108 - protein, 16 aa, Mycobacterium tuberculosis
RLQPQVGWEVNDPDGD

SEQ ID NO: 148109 - protein, 16 aa, Mycobacterium tuberculosis
LQPQVGWEVNDPDGDL

SEQ ID NO: 148110 - protein, 16 aa, Mycobacterium tuberculosis
QPQVGWEVNDPDGDLR

SEQ ID NO: 148111 - protein, 16 aa, Mycobacterium tuberculosis
PQVGWEVNDPDGDLRK

SEQ ID NO: 148112 - protein, 16 aa, Mycobacterium tuberculosis
QVGWEVNDPDGDLRKV

SEQ ID NO: 148113 - protein, 16 aa, Mycobacterium tuberculosis
VGWEVNDPDGDLRKVI

SEQ ID NO: 148114 - protein, 16 aa, Mycobacterium tuberculosis
GWEVNDPDGDLRKVIR

SEQ ID NO: 148115 - protein, 16 aa, Mycobacterium tuberculosis
WEVNDPDGDLRKVIRT

SEQ ID NO: 148116 - protein, 16 aa, Mycobacterium tuberculosis
EVNDPDGDLRKVIRTL

SEQ ID NO: 148117 - protein, 16 aa, Mycobacterium tuberculosis
VNDPDGDLRKVIRTLE

SEQ ID NO: 148118 - protein, 16 aa, Mycobacterium tuberculosis
NDPDGDLRKVIRTLEE

SEQ ID NO: 148119 - protein, 16 aa, Mycobacterium tuberculosis
DPDGDLRKVIRTLEEI

SEQ ID NO: 148120 - protein, 16 aa, Mycobacterium tuberculosis
PDGDLRKVIRTLEEIQ

SEQ ID NO: 148121 - protein, 16 aa, Mycobacterium tuberculosis
DGDLRKVIRTLEEIQE

SEQ ID NO: 148122 - protein, 16 aa, Mycobacterium tuberculosis
GDLRKVIRTLEEIQES

SEQ ID NO: 148123 - protein, 16 aa, Mycobacterium tuberculosis
DLRKVIRTLEEIQESF

SEQ ID NO: 148124 - protein, 16 aa, Mycobacterium tuberculosis
LRKVIRTLEEIQESFN

SEQ ID NO: 148125 - protein, 16 aa, Mycobacterium tuberculosis
RKVIRTLEEIQESFNS

SEQ ID NO: 148126 - protein, 16 aa, Mycobacterium tuberculosis
KVIRTLEEIQESFNSA

SEQ ID NO: 148127 - protein, 16 aa, Mycobacterium tuberculosis
VIRTLEEIQESFNSAA

SEQ ID NO: 148128 - protein, 16 aa, Mycobacterium tuberculosis
IRTLEEIQESFNSAAP

SEQ ID NO: 148129 - protein, 16 aa, Mycobacterium tuberculosis
RTLEEIQESFNSAAPG

SEQ ID NO: 148130 - protein, 16 aa, Mycobacterium tuberculosis
TLEEIQESFNSAAPGN

SEQ ID NO: 148131 - protein, 16 aa, Mycobacterium tuberculosis
LEEIQESFNSAAPGNI

SEQ ID NO: 148132 - protein, 16 aa, Mycobacterium tuberculosis
EEIQESFNSAAPGNIK

SEQ ID NO: 148133 - protein, 16 aa, Mycobacterium tuberculosis
EIQESFNSAAPGNIKV

SEQ ID NO: 148134 - protein, 16 aa, Mycobacterium tuberculosis
IQESFNSAAPGNIKVS

SEQ ID NO: 148135 - protein, 16 aa, Mycobacterium tuberculosis
QESFNSAAPGNIKVSF

SEQ ID NO: 148136 - protein, 16 aa, Mycobacterium tuberculosis
ESFNSAAPGNIKVSFA

SEQ ID NO: 148137 - protein, 16 aa, Mycobacterium tuberculosis
SFNSAAPGNIKVSFAD

SEQ ID NO: 148138 - protein, 16 aa, Mycobacterium tuberculosis
FNSAAPGNIKVSFADL

SEQ ID NO: 148139 - protein, 16 aa, Mycobacterium tuberculosis
NSAAPGNIKVSFADLV

SEQ ID NO: 148140 - protein, 16 aa, Mycobacterium tuberculosis
SAAPGNIKVSFADLVV

SEQ ID NO: 148141 - protein, 16 aa, Mycobacterium tuberculosis
AAPGNIKVSFADLVVL

SEQ ID NO: 148142 - protein, 16 aa, Mycobacterium tuberculosis
APGNIKVSFADLVVLG

SEQ ID NO: 148143 - protein, 16 aa, Mycobacterium tuberculosis
PGNIKVSFADLVVLGG

SEQ ID NO: 148144 - protein, 16 aa, Mycobacterium tuberculosis
GNIKVSFADLVVLGGC

SEQ ID NO: 148145 - protein, 16 aa, Mycobacterium tuberculosis
NIKVSFADLVVLGGCA

SEQ ID NO: 148146 - protein, 16 aa, Mycobacterium tuberculosis
IKVSFADLVVLGGCAA

SEQ ID NO: 148147 - protein, 16 aa, Mycobacterium tuberculosis
KVSFADLVVLGGCAAI

SEQ ID NO: 148148 - protein, 16 aa, Mycobacterium tuberculosis
VSFADLVVLGGCAAIE

SEQ ID NO: 148149 - protein, 16 aa, Mycobacterium tuberculosis
SFADLVVLGGCAAIEK

SEQ ID NO: 148150 - protein, 16 aa, Mycobacterium tuberculosis
FADLVVLGGCAAIEKA

SEQ ID NO: 148151 - protein, 16 aa, Mycobacterium tuberculosis
ADLVVLGGCAAIEKAA

SEQ ID NO: 148152 - protein, 16 aa, Mycobacterium tuberculosis
DLVVLGGCAAIEKAAK

SEQ ID NO: 148153 - protein, 16 aa, Mycobacterium tuberculosis
LVVLGGCAAIEKAAKA

SEQ ID NO: 148154 - protein, 16 aa, Mycobacterium tuberculosis
VVLGGCAAIEKAAKAA

SEQ ID NO: 148155 - protein, 16 aa, Mycobacterium tuberculosis
VLGGCAAIEKAAKAAG

SEQ ID NO: 148156 - protein, 16 aa, Mycobacterium tuberculosis
LGGCAAIEKAAKAAGH

SEQ ID NO: 148157 - protein, 16 aa, Mycobacterium tuberculosis
GGCAAIEKAAKAAGHN

SEQ ID NO: 148158 - protein, 16 aa, Mycobacterium tuberculosis
GCAAIEKAAKAAGHNI

SEQ ID NO: 148159 - protein, 16 aa, Mycobacterium tuberculosis
CAAIEKAAKAAGHNIT

SEQ ID NO: 148160 - protein, 16 aa, Mycobacterium tuberculosis
AAIEKAAKAAGHNITV

SEQ ID NO: 148161 - protein, 16 aa, Mycobacterium tuberculosis
AIEKAAKAAGHNITVP

SEQ ID NO: 148162 - protein, 16 aa, Mycobacterium tuberculosis
IEKAAKAAGHNITVPF

SEQ ID NO: 148163 - protein, 16 aa, Mycobacterium tuberculosis
EKAAKAAGHNITVPFT

SEQ ID NO: 148164 - protein, 16 aa, Mycobacterium tuberculosis
KAAKAAGHNITVPFTP

SEQ ID NO: 148165 - protein, 16 aa, Mycobacterium tuberculosis
AAKAAGHNITVPFTPG

SEQ ID NO: 148166 - protein, 16 aa, Mycobacterium tuberculosis
AKAAGHNITVPFTPGR

SEQ ID NO: 148167 - protein, 16 aa, Mycobacterium tuberculosis
KAAGHNITVPFTPGRT

SEQ ID NO: 148168 - protein, 16 aa, Mycobacterium tuberculosis
AAGHNITVPFTPGRTD

SEQ ID NO: 148169 - protein, 16 aa, Mycobacterium tuberculosis
AGHNITVPFTPGRTDA

SEQ ID NO: 148170 - protein, 16 aa, Mycobacterium tuberculosis
GHNITVPFTPGRTDAS

SEQ ID NO: 148171 - protein, 16 aa, Mycobacterium tuberculosis
HNITVPFTPGRTDASQ

SEQ ID NO: 148172 - protein, 16 aa, Mycobacterium tuberculosis
NITVPFTPGRTDASQE

SEQ ID NO: 148173 - protein, 16 aa, Mycobacterium tuberculosis
ITVPFTPGRTDASQEQ

SEQ ID NO: 148174 - protein, 16 aa, Mycobacterium tuberculosis
TVPFTPGRTDASQEQT

SEQ ID NO: 148175 - protein, 16 aa, Mycobacterium tuberculosis
VPFTPGRTDASQEQTD

SEQ ID NO: 148176 - protein, 16 aa, Mycobacterium tuberculosis
PFTPGRTDASQEQTDV

SEQ ID NO: 148177 - protein, 16 aa, Mycobacterium tuberculosis
FTPGRTDASQEQTDVE

SEQ ID NO: 148178 - protein, 16 aa, Mycobacterium tuberculosis
TPGRTDASQEQTDVES

SEQ ID NO: 148179 - protein, 16 aa, Mycobacterium tuberculosis
PGRTDASQEQTDVESF

SEQ ID NO: 148180 - protein, 16 aa, Mycobacterium tuberculosis
GRTDASQEQTDVESFA

SEQ ID NO: 148181 - protein, 16 aa, Mycobacterium tuberculosis
RTDASQEQTDVESFAV

SEQ ID NO: 148182 - protein, 16 aa, Mycobacterium tuberculosis
TDASQEQTDVESFAVL

SEQ ID NO: 148183 - protein, 16 aa, Mycobacterium tuberculosis
DASQEQTDVESFAVLE

SEQ ID NO: 148184 - protein, 16 aa, Mycobacterium tuberculosis
ASQEQTDVESFAVLEP

SEQ ID NO: 148185 - protein, 16 aa, Mycobacterium tuberculosis
SQEQTDVESFAVLEPK

SEQ ID NO: 148186 - protein, 16 aa, Mycobacterium tuberculosis
QEQTDVESFAVLEPKA

SEQ ID NO: 148187 - protein, 16 aa, Mycobacterium tuberculosis
EQTDVESFAVLEPKAD

SEQ ID NO: 148188 - protein, 16 aa, Mycobacterium tuberculosis
QTDVESFAVLEPKADG

SEQ ID NO: 148189 - protein, 16 aa, Mycobacterium tuberculosis
TDVESFAVLEPKADGF

SEQ ID NO: 148190 - protein, 16 aa, Mycobacterium tuberculosis
DVESFAVLEPKADGFR

SEQ ID NO: 148191 - protein, 16 aa, Mycobacterium tuberculosis
VESFAVLEPKADGFRN

SEQ ID NO: 148192 - protein, 16 aa, Mycobacterium tuberculosis
ESFAVLEPKADGFRNY

SEQ ID NO: 148193 - protein, 16 aa, Mycobacterium tuberculosis
SFAVLEPKADGFRNYL

SEQ ID NO: 148194 - protein, 16 aa, Mycobacterium tuberculosis
FAVLEPKADGFRNYLG

SEQ ID NO: 148195 - protein, 16 aa, Mycobacterium tuberculosis
AVLEPKADGFRNYLGK

SEQ ID NO: 148196 - protein, 16 aa, Mycobacterium tuberculosis
VLEPKADGFRNYLGKG

SEQ ID NO: 148197 - protein, 16 aa, Mycobacterium tuberculosis
LEPKADGFRNYLGKGN

SEQ ID NO: 148198 - protein, 16 aa, Mycobacterium tuberculosis
EPKADGFRNYLGKGNP

SEQ ID NO: 148199 - protein, 16 aa, Mycobacterium tuberculosis
PKADGFRNYLGKGNPL

SEQ ID NO: 148200 - protein, 16 aa, Mycobacterium tuberculosis
KADGFRNYLGKGNPLP

SEQ ID NO: 148201 - protein, 16 aa, Mycobacterium tuberculosis
ADGFRNYLGKGNPLPA

SEQ ID NO: 148202 - protein, 16 aa, Mycobacterium tuberculosis
DGFRNYLGKGNPLPAE

SEQ ID NO: 148203 - protein, 16 aa, Mycobacterium tuberculosis
GFRNYLGKGNPLPAEY

SEQ ID NO: 148204 - protein, 16 aa, Mycobacterium tuberculosis
FRNYLGKGNPLPAEYM

SEQ ID NO: 148205 - protein, 16 aa, Mycobacterium tuberculosis
RNYLGKGNPLPAEYML

SEQ ID NO: 148206 - protein, 16 aa, Mycobacterium tuberculosis
NYLGKGNPLPAEYMLL

SEQ ID NO: 148207 - protein, 16 aa, Mycobacterium tuberculosis
YLGKGNPLPAEYMLLD

SEQ ID NO: 148208 - protein, 16 aa, Mycobacterium tuberculosis
LGKGNPLPAEYMLLDK

SEQ ID NO: 148209 - protein, 16 aa, Mycobacterium tuberculosis
GKGNPLPAEYMLLDKA

SEQ ID NO: 148210 - protein, 16 aa, Mycobacterium tuberculosis
KGNPLPAEYMLLDKAN

SEQ ID NO: 148211 - protein, 16 aa, Mycobacterium tuberculosis
GNPLPAEYMLLDKANL

SEQ ID NO: 148212 - protein, 16 aa, Mycobacterium tuberculosis
NPLPAEYMLLDKANLL

SEQ ID NO: 148213 - protein, 16 aa, Mycobacterium tuberculosis
PLPAEYMLLDKANLLT

SEQ ID NO: 148214 - protein, 16 aa, Mycobacterium tuberculosis
LPAEYMLLDKANLLTL

SEQ ID NO: 148215 - protein, 16 aa, Mycobacterium tuberculosis
PAEYMLLDKANLLTLS

SEQ ID NO: 148216 - protein, 16 aa, Mycobacterium tuberculosis
AEYMLLDKANLLTLSA

SEQ ID NO: 148217 - protein, 16 aa, Mycobacterium tuberculosis
EYMLLDKANLLTLSAP

SEQ ID NO: 148218 - protein, 16 aa, Mycobacterium tuberculosis
YMLLDKANLLTLSAPE

SEQ ID NO: 148219 - protein, 16 aa, Mycobacterium tuberculosis
MLLDKANLLTLSAPEM

SEQ ID NO: 148220 - protein, 16 aa, Mycobacterium tuberculosis
LLDKANLLTLSAPEMT

SEQ ID NO: 148221 - protein, 16 aa, Mycobacterium tuberculosis
LDKANLLTLSAPEMTV

SEQ ID NO: 148222 - protein, 16 aa, Mycobacterium tuberculosis
DKANLLTLSAPEMTVL

SEQ ID NO: 148223 - protein, 16 aa, Mycobacterium tuberculosis
KANLLTLSAPEMTVLV

SEQ ID NO: 148224 - protein, 16 aa, Mycobacterium tuberculosis
ANLLTLSAPEMTVLVG

SEQ ID NO: 148225 - protein, 16 aa, Mycobacterium tuberculosis
NLLTLSAPEMTVLVGG

SEQ ID NO: 148226 - protein, 16 aa, Mycobacterium tuberculosis
LLTLSAPEMTVLVGGL

SEQ ID NO: 148227 - protein, 16 aa, Mycobacterium tuberculosis
LTLSAPEMTVLVGGLR

SEQ ID NO: 148228 - protein, 16 aa, Mycobacterium tuberculosis
TLSAPEMTVLVGGLRV

SEQ ID NO: 148229 - protein, 16 aa, Mycobacterium tuberculosis
LSAPEMTVLVGGLRVL

SEQ ID NO: 148230 - protein, 16 aa, Mycobacterium tuberculosis
SAPEMTVLVGGLRVLG

SEQ ID NO: 148231 - protein, 16 aa, Mycobacterium tuberculosis
APEMTVLVGGLRVLGA

SEQ ID NO: 148232 - protein, 16 aa, Mycobacterium tuberculosis
PEMTVLVGGLRVLGAN

SEQ ID NO: 148233 - protein, 16 aa, Mycobacterium tuberculosis
EMTVLVGGLRVLGANY

SEQ ID NO: 148234 - protein, 16 aa, Mycobacterium tuberculosis
MTVLVGGLRVLGANYK

SEQ ID NO: 148235 - protein, 16 aa, Mycobacterium tuberculosis
TVLVGGLRVLGANYKR

SEQ ID NO: 148236 - protein, 16 aa, Mycobacterium tuberculosis
VLVGGLRVLGANYKRL

SEQ ID NO: 148237 - protein, 16 aa, Mycobacterium tuberculosis
LVGGLRVLGANYKRLP

SEQ ID NO: 148238 - protein, 16 aa, Mycobacterium tuberculosis
VGGLRVLGANYKRLPL

SEQ ID NO: 148239 - protein, 16 aa, Mycobacterium tuberculosis
GGLRVLGANYKRLPLG

SEQ ID NO: 148240 - protein, 16 aa, Mycobacterium tuberculosis
GLRVLGANYKRLPLGV

SEQ ID NO: 148241 - protein, 16 aa, Mycobacterium tuberculosis
LRVLGANYKRLPLGVF

SEQ ID NO: 148242 - protein, 16 aa, Mycobacterium tuberculosis
RVLGANYKRLPLGVFT

SEQ ID NO: 148243 - protein, 16 aa, Mycobacterium tuberculosis
VLGANYKRLPLGVFTE

SEQ ID NO: 148244 - protein, 16 aa, Mycobacterium tuberculosis
LGANYKRLPLGVFTEA

SEQ ID NO: 148245 - protein, 16 aa, Mycobacterium tuberculosis
GANYKRLPLGVFTEAS

SEQ ID NO: 148246 - protein, 16 aa, Mycobacterium tuberculosis
ANYKRLPLGVFTEASE

SEQ ID NO: 148247 - protein, 16 aa, Mycobacterium tuberculosis
NYKRLPLGVFTEASES

SEQ ID NO: 148248 - protein, 16 aa, Mycobacterium tuberculosis
YKRLPLGVFTEASESL

SEQ ID NO: 148249 - protein, 16 aa, Mycobacterium tuberculosis
KRLPLGVFTEASESLT

SEQ ID NO: 148250 - protein, 16 aa, Mycobacterium tuberculosis
RLPLGVFTEASESLTN

SEQ ID NO: 148251 - protein, 16 aa, Mycobacterium tuberculosis
LPLGVFTEASESLTND

SEQ ID NO: 148252 - protein, 16 aa, Mycobacterium tuberculosis
PLGVFTEASESLTNDF

SEQ ID NO: 148253 - protein, 16 aa, Mycobacterium tuberculosis
LGVFTEASESLTNDFF

SEQ ID NO: 148254 - protein, 16 aa, Mycobacterium tuberculosis
GVFTEASESLTNDFFV

SEQ ID NO: 148255 - protein, 16 aa, Mycobacterium tuberculosis
VFTEASESLTNDFFVN

SEQ ID NO: 148256 - protein, 16 aa, Mycobacterium tuberculosis
FTEASESLTNDFFVNL

SEQ ID NO: 148257 - protein, 16 aa, Mycobacterium tuberculosis
TEASESLTNDFFVNLL

SEQ ID NO: 148258 - protein, 16 aa, Mycobacterium tuberculosis
EASESLTNDFFVNLLD

SEQ ID NO: 148259 - protein, 16 aa, Mycobacterium tuberculosis
ASESLTNDFFVNLLDM

SEQ ID NO: 148260 - protein, 16 aa, Mycobacterium tuberculosis
SESLTNDFFVNLLDMG

SEQ ID NO: 148261 - protein, 16 aa, Mycobacterium tuberculosis
ESLTNDFFVNLLDMGI

SEQ ID NO: 148262 - protein, 16 aa, Mycobacterium tuberculosis
SLTNDFFVNLLDMGIT

SEQ ID NO: 148263 - protein, 16 aa, Mycobacterium tuberculosis
LTNDFFVNLLDMGITW

SEQ ID NO: 148264 - protein, 16 aa, Mycobacterium tuberculosis
TNDFFVNLLDMGITWE

SEQ ID NO: 148265 - protein, 16 aa, Mycobacterium tuberculosis
NDFFVNLLDMGITWEP

SEQ ID NO: 148266 - protein, 16 aa, Mycobacterium tuberculosis
DFFVNLLDMGITWEPS

SEQ ID NO: 148267 - protein, 16 aa, Mycobacterium tuberculosis
FFVNLLDMGITWEPSP

SEQ ID NO: 148268 - protein, 16 aa, Mycobacterium tuberculosis
FVNLLDMGITWEPSPA

SEQ ID NO: 148269 - protein, 16 aa, Mycobacterium tuberculosis
VNLLDMGITWEPSPAD

SEQ ID NO: 148270 - protein, 16 aa, Mycobacterium tuberculosis
NLLDMGITWEPSPADD

SEQ ID NO: 148271 - protein, 16 aa, Mycobacterium tuberculosis
LLDMGITWEPSPADDG

SEQ ID NO: 148272 - protein, 16 aa, Mycobacterium tuberculosis
LDMGITWEPSPADDGT

SEQ ID NO: 148273 - protein, 16 aa, Mycobacterium tuberculosis
DMGITWEPSPADDGTY

SEQ ID NO: 148274 - protein, 16 aa, Mycobacterium tuberculosis
MGITWEPSPADDGTYQ

SEQ ID NO: 148275 - protein, 16 aa, Mycobacterium tuberculosis
GITWEPSPADDGTYQG

SEQ ID NO: 148276 - protein, 16 aa, Mycobacterium tuberculosis
ITWEPSPADDGTYQGK

SEQ ID NO: 148277 - protein, 16 aa, Mycobacterium tuberculosis
TWEPSPADDGTYQGKD

SEQ ID NO: 148278 - protein, 16 aa, Mycobacterium tuberculosis
WEPSPADDGTYQGKDG

SEQ ID NO: 148279 - protein, 16 aa, Mycobacterium tuberculosis
EPSPADDGTYQGKDGS

SEQ ID NO: 148280 - protein, 16 aa, Mycobacterium tuberculosis
PSPADDGTYQGKDGSG

SEQ ID NO: 148281 - protein, 16 aa, Mycobacterium tuberculosis
SPADDGTYQGKDGSGK

SEQ ID NO: 148282 - protein, 16 aa, Mycobacterium tuberculosis
PADDGTYQGKDGSGKV

SEQ ID NO: 148283 - protein, 16 aa, Mycobacterium tuberculosis
ADDGTYQGKDGSGKVK

SEQ ID NO: 148284 - protein, 16 aa, Mycobacterium tuberculosis
DDGTYQGKDGSGKVKW

SEQ ID NO: 148285 - protein, 16 aa, Mycobacterium tuberculosis
DGTYQGKDGSGKVKWT

SEQ ID NO: 148286 - protein, 16 aa, Mycobacterium tuberculosis
GTYQGKDGSGKVKWTG

SEQ ID NO: 148287 - protein, 16 aa, Mycobacterium tuberculosis
TYQGKDGSGKVKWTGS

SEQ ID NO: 148288 - protein, 16 aa, Mycobacterium tuberculosis
YQGKDGSGKVKWTGSR

SEQ ID NO: 148289 - protein, 16 aa, Mycobacterium tuberculosis
QGKDGSGKVKWTGSRV

SEQ ID NO: 148290 - protein, 16 aa, Mycobacterium tuberculosis
GKDGSGKVKWTGSRVD

SEQ ID NO: 148291 - protein, 16 aa, Mycobacterium tuberculosis
KDGSGKVKWTGSRVDL

SEQ ID NO: 148292 - protein, 16 aa, Mycobacterium tuberculosis
DGSGKVKWTGSRVDLV

SEQ ID NO: 148293 - protein, 16 aa, Mycobacterium tuberculosis
GSGKVKWTGSRVDLVF

SEQ ID NO: 148294 - protein, 16 aa, Mycobacterium tuberculosis
SGKVKWTGSRVDLVFG

SEQ ID NO: 148295 - protein, 16 aa, Mycobacterium tuberculosis
GKVKWTGSRVDLVFGS

SEQ ID NO: 148296 - protein, 16 aa, Mycobacterium tuberculosis
KVKWTGSRVDLVFGSN

SEQ ID NO: 148297 - protein, 16 aa, Mycobacterium tuberculosis
VKWTGSRVDLVFGSNS

SEQ ID NO: 148298 - protein, 16 aa, Mycobacterium tuberculosis
KWTGSRVDLVFGSNSE

SEQ ID NO: 148299 - protein, 16 aa, Mycobacterium tuberculosis
WTGSRVDLVFGSNSEL

SEQ ID NO: 148300 - protein, 16 aa, Mycobacterium tuberculosis
TGSRVDLVFGSNSELR

SEQ ID NO: 148301 - protein, 16 aa, Mycobacterium tuberculosis
GSRVDLVFGSNSELRA

SEQ ID NO: 148302 - protein, 16 aa, Mycobacterium tuberculosis
SRVDLVFGSNSELRAL

SEQ ID NO: 148303 - protein, 16 aa, Mycobacterium tuberculosis
RVDLVFGSNSELRALV

SEQ ID NO: 148304 - protein, 16 aa, Mycobacterium tuberculosis
VDLVFGSNSELRALVE

SEQ ID NO: 148305 - protein, 16 aa, Mycobacterium tuberculosis
DLVFGSNSELRALVEV

SEQ ID NO: 148306 - protein, 16 aa, Mycobacterium tuberculosis
LVFGSNSELRALVEVY

SEQ ID NO: 148307 - protein, 16 aa, Mycobacterium tuberculosis
VFGSNSELRALVEVYG

SEQ ID NO: 148308 - protein, 16 aa, Mycobacterium tuberculosis
FGSNSELRALVEVYGA

SEQ ID NO: 148309 - protein, 16 aa, Mycobacterium tuberculosis
GSNSELRALVEVYGAD

SEQ ID NO: 148310 - protein, 16 aa, Mycobacterium tuberculosis
SNSELRALVEVYGADD

SEQ ID NO: 148311 - protein, 16 aa, Mycobacterium tuberculosis
NSELRALVEVYGADDA

SEQ ID NO: 148312 - protein, 16 aa, Mycobacterium tuberculosis
SELRALVEVYGADDAQ

SEQ ID NO: 148313 - protein, 16 aa, Mycobacterium tuberculosis
ELRALVEVYGADDAQP

SEQ ID NO: 148314 - protein, 16 aa, Mycobacterium tuberculosis
LRALVEVYGADDAQPK

SEQ ID NO: 148315 - protein, 16 aa, Mycobacterium tuberculosis
RALVEVYGADDAQPKF

SEQ ID NO: 148316 - protein, 16 aa, Mycobacterium tuberculosis
ALVEVYGADDAQPKFV

SEQ ID NO: 148317 - protein, 16 aa, Mycobacterium tuberculosis
LVEVYGADDAQPKFVQ

SEQ ID NO: 148318 - protein, 16 aa, Mycobacterium tuberculosis
VEVYGADDAQPKFVQD

SEQ ID NO: 148319 - protein, 16 aa, Mycobacterium tuberculosis
EVYGADDAQPKFVQDF

SEQ ID NO: 148320 - protein, 16 aa, Mycobacterium tuberculosis
VYGADDAQPKFVQDFV

SEQ ID NO: 148321 - protein, 16 aa, Mycobacterium tuberculosis
YGADDAQPKFVQDFVA

SEQ ID NO: 148322 - protein, 16 aa, Mycobacterium tuberculosis
GADDAQPKFVQDFVAA

SEQ ID NO: 148323 - protein, 16 aa, Mycobacterium tuberculosis
ADDAQPKFVQDFVAAW

SEQ ID NO: 148324 - protein, 16 aa, Mycobacterium tuberculosis
DDAQPKFVQDFVAAWD

SEQ ID NO: 148325 - protein, 16 aa, Mycobacterium tuberculosis
DAQPKFVQDFVAAWDK

SEQ ID NO: 148326 - protein, 16 aa, Mycobacterium tuberculosis
AQPKFVQDFVAAWDKV

SEQ ID NO: 148327 - protein, 16 aa, Mycobacterium tuberculosis
QPKFVQDFVAAWDKVM

SEQ ID NO: 148328 - protein, 16 aa, Mycobacterium tuberculosis
PKFVQDFVAAWDKVMN

SEQ ID NO: 148329 - protein, 16 aa, Mycobacterium tuberculosis
KFVQDFVAAWDKVMNL

SEQ ID NO: 148330 - protein, 16 aa, Mycobacterium tuberculosis
FVQDFVAAWDKVMNLD

SEQ ID NO: 148331 - protein, 16 aa, Mycobacterium tuberculosis
VQDFVAAWDKVMNLDR

SEQ ID NO: 148332 - protein, 16 aa, Mycobacterium tuberculosis
QDFVAAWDKVMNLDRF

SEQ ID NO: 148333 - protein, 16 aa, Mycobacterium tuberculosis
DFVAAWDKVMNLDRFD

SEQ ID NO: 148334 - protein, 16 aa, Mycobacterium tuberculosis
FVAAWDKVMNLDRFDV

SEQ ID NO: 148335 - protein, 16 aa, Mycobacterium tuberculosis
VAAWDKVMNLDRFDVR

SEQ ID NO: 148336 - protein, 110 aa, Mycobacterium tuberculosis
MRLSLTALSAGVGAVAMSLTVGAGVASADPVDAVINTTCNYGQVVAALNATDPGAAAQFNASPVAQSYLRNFLAAPPPQRAAMAAQLQAVPGAAQYIGLVESVAGSCNNY

SEQ ID NO: 148337 - protein, 8 aa, Mycobacterium tuberculosis
MRLSLTAL

SEQ ID NO: 148338 - protein, 8 aa, Mycobacterium tuberculosis
LTALSAGV

SEQ ID NO: 148339 - protein, 8 aa, Mycobacterium tuberculosis
ALSAGVGA

SEQ ID NO: 148340 - protein, 8 aa, Mycobacterium tuberculosis
LSAGVGAV

SEQ ID NO: 148341 - protein, 8 aa, Mycobacterium tuberculosis
AVAMSLTV

SEQ ID NO: 148342 - protein, 8 aa, Mycobacterium tuberculosis
AMSLTVGA

SEQ ID NO: 148343 - protein, 8 aa, Mycobacterium tuberculosis
SLTVGAGV

SEQ ID NO: 148344 - protein, 8 aa, Mycobacterium tuberculosis
GVASADPV

SEQ ID NO: 148345 - protein, 8 aa, Mycobacterium tuberculosis
SADPVDAV

SEQ ID NO: 148346 - protein, 8 aa, Mycobacterium tuberculosis
VINTTCNY

SEQ ID NO: 148347 - protein, 8 aa, Mycobacterium tuberculosis
TTCNYGQV

SEQ ID NO: 148348 - protein, 8 aa, Mycobacterium tuberculosis
YGQVVAAL

SEQ ID NO: 148349 - protein, 8 aa, Mycobacterium tuberculosis
QVVAALNA

SEQ ID NO: 148350 - protein, 8 aa, Mycobacterium tuberculosis
ATDPGAAA

SEQ ID NO: 148351 - protein, 8 aa, Mycobacterium tuberculosis
DPGAAAQF

SEQ ID NO: 148352 - protein, 8 aa, Mycobacterium tuberculosis
AQFNASPV

SEQ ID NO: 148353 - protein, 8 aa, Mycobacterium tuberculosis
SPVAQSYL

SEQ ID NO: 148354 - protein, 8 aa, Mycobacterium tuberculosis
PVAQSYLR

SEQ ID NO: 148355 - protein, 8 aa, Mycobacterium tuberculosis
AQSYLRNF

SEQ ID NO: 148356 - protein, 8 aa, Mycobacterium tuberculosis
QSYLRNFL

SEQ ID NO: 148357 - protein, 8 aa, Mycobacterium tuberculosis
SYLRNFLA

SEQ ID NO: 148358 - protein, 8 aa, Mycobacterium tuberculosis
YLRNFLAA

SEQ ID NO: 148359 - protein, 8 aa, Mycobacterium tuberculosis
FLAAPPPQ

SEQ ID NO: 148360 - protein, 8 aa, Mycobacterium tuberculosis
LAAPPPQR

SEQ ID NO: 148361 - protein, 8 aa, Mycobacterium tuberculosis
APPPQRAA

SEQ ID NO: 148362 - protein, 8 aa, Mycobacterium tuberculosis
PPPQRAAM

SEQ ID NO: 148363 - protein, 8 aa, Mycobacterium tuberculosis
RAAMAAQL

SEQ ID NO: 148364 - protein, 8 aa, Mycobacterium tuberculosis
AMAAQLQA

SEQ ID NO: 148365 - protein, 8 aa, Mycobacterium tuberculosis
MAAQLQAV

SEQ ID NO: 148366 - protein, 8 aa, Mycobacterium tuberculosis
QLQAVPGA

SEQ ID NO: 148367 - protein, 8 aa, Mycobacterium tuberculosis
LQAVPGAA

SEQ ID NO: 148368 - protein, 8 aa, Mycobacterium tuberculosis
AVPGAAQY

SEQ ID NO: 148369 - protein, 8 aa, Mycobacterium tuberculosis
VPGAAQYI

SEQ ID NO: 148370 - protein, 8 aa, Mycobacterium tuberculosis
GAAQYIGL

SEQ ID NO: 148371 - protein, 8 aa, Mycobacterium tuberculosis
YIGLVESV

SEQ ID NO: 148372 - protein, 9 aa, Mycobacterium tuberculosis
RLSLTALSA

SEQ ID NO: 148373 - protein, 9 aa, Mycobacterium tuberculosis
SLTALSAGV

SEQ ID NO: 148374 - protein, 9 aa, Mycobacterium tuberculosis
ALSAGVGAV

SEQ ID NO: 148375 - protein, 9 aa, Mycobacterium tuberculosis
SAGVGAVAM

SEQ ID NO: 148376 - protein, 9 aa, Mycobacterium tuberculosis
GVGAVAMSL

SEQ ID NO: 148377 - protein, 9 aa, Mycobacterium tuberculosis
GAVAMSLTV

SEQ ID NO: 148378 - protein, 9 aa, Mycobacterium tuberculosis
VAMSLTVGA

SEQ ID NO: 148379 - protein, 9 aa, Mycobacterium tuberculosis
MSLTVGAGV

SEQ ID NO: 148380 - protein, 9 aa, Mycobacterium tuberculosis
SLTVGAGVA

SEQ ID NO: 148381 - protein, 9 aa, Mycobacterium tuberculosis
TVGAGVASA

SEQ ID NO: 148382 - protein, 9 aa, Mycobacterium tuberculosis
ASADPVDAV

SEQ ID NO: 148383 - protein, 9 aa, Mycobacterium tuberculosis
SADPVDAVI

SEQ ID NO: 148384 - protein, 9 aa, Mycobacterium tuberculosis
AVINTTCNY

SEQ ID NO: 148385 - protein, 9 aa, Mycobacterium tuberculosis
NTTCNYGQV

SEQ ID NO: 148386 - protein, 9 aa, Mycobacterium tuberculosis
TTCNYGQVV

SEQ ID NO: 148387 - protein, 9 aa, Mycobacterium tuberculosis
NYGQVVAAL

SEQ ID NO: 148388 - protein, 9 aa, Mycobacterium tuberculosis
GQVVAALNA

SEQ ID NO: 148389 - protein, 9 aa, Mycobacterium tuberculosis
QVVAALNAT

SEQ ID NO: 148390 - protein, 9 aa, Mycobacterium tuberculosis
ALNATDPGA

SEQ ID NO: 148391 - protein, 9 aa, Mycobacterium tuberculosis
NATDPGAAA

SEQ ID NO: 148392 - protein, 9 aa, Mycobacterium tuberculosis
ATDPGAAAQ

SEQ ID NO: 148393 - protein, 9 aa, Mycobacterium tuberculosis
AQFNASPVA

SEQ ID NO: 148394 - protein, 9 aa, Mycobacterium tuberculosis
NASPVAQSY

SEQ ID NO: 148395 - protein, 9 aa, Mycobacterium tuberculosis
SPVAQSYLR

SEQ ID NO: 148396 - protein, 9 aa, Mycobacterium tuberculosis
AQSYLRNFL

SEQ ID NO: 148397 - protein, 9 aa, Mycobacterium tuberculosis
QSYLRNFLA

SEQ ID NO: 148398 - protein, 9 aa, Mycobacterium tuberculosis
SYLRNFLAA

SEQ ID NO: 148399 - protein, 9 aa, Mycobacterium tuberculosis
YLRNFLAAP

SEQ ID NO: 148400 - protein, 9 aa, Mycobacterium tuberculosis
FLAAPPPQR

SEQ ID NO: 148401 - protein, 9 aa, Mycobacterium tuberculosis
LAAPPPQRA

SEQ ID NO: 148402 - protein, 9 aa, Mycobacterium tuberculosis
APPPQRAAM

SEQ ID NO: 148403 - protein, 9 aa, Mycobacterium tuberculosis
QRAAMAAQL

SEQ ID NO: 148404 - protein, 9 aa, Mycobacterium tuberculosis
AMAAQLQAV

SEQ ID NO: 148405 - protein, 9 aa, Mycobacterium tuberculosis
AQLQAVPGA

SEQ ID NO: 148406 - protein, 9 aa, Mycobacterium tuberculosis
QLQAVPGAA

SEQ ID NO: 148407 - protein, 9 aa, Mycobacterium tuberculosis
LQAVPGAAQ

SEQ ID NO: 148408 - protein, 9 aa, Mycobacterium tuberculosis
QAVPGAAQY

SEQ ID NO: 148409 - protein, 9 aa, Mycobacterium tuberculosis
AVPGAAQYI

SEQ ID NO: 148410 - protein, 9 aa, Mycobacterium tuberculosis
GAAQYIGLV

SEQ ID NO: 148411 - protein, 9 aa, Mycobacterium tuberculosis
AQYIGLVES

SEQ ID NO: 148412 - protein, 9 aa, Mycobacterium tuberculosis
QYIGLVESV

SEQ ID NO: 148413 - protein, 9 aa, Mycobacterium tuberculosis
GLVESVAGS

SEQ ID NO: 148414 - protein, 9 aa, Mycobacterium tuberculosis
SVAGSCNNY

SEQ ID NO: 148415 - protein, 10 aa, Mycobacterium tuberculosis
LSLTALSAGV

SEQ ID NO: 148416 - protein, 10 aa, Mycobacterium tuberculosis
LTALSAGVGA

SEQ ID NO: 148417 - protein, 10 aa, Mycobacterium tuberculosis
TALSAGVGAV

SEQ ID NO: 148418 - protein, 10 aa, Mycobacterium tuberculosis
ALSAGVGAVA

SEQ ID NO: 148419 - protein, 10 aa, Mycobacterium tuberculosis
LSAGVGAVAM

SEQ ID NO: 148420 - protein, 10 aa, Mycobacterium tuberculosis
AVAMSLTVGA

SEQ ID NO: 148421 - protein, 10 aa, Mycobacterium tuberculosis
AMSLTVGAGV

SEQ ID NO: 148422 - protein, 10 aa, Mycobacterium tuberculosis
LTVGAGVASA

SEQ ID NO: 148423 - protein, 10 aa, Mycobacterium tuberculosis
ASADPVDAVI

SEQ ID NO: 148424 - protein, 10 aa, Mycobacterium tuberculosis
DPVDAVINTT

SEQ ID NO: 148425 - protein, 10 aa, Mycobacterium tuberculosis
DAVINTTCNY

SEQ ID NO: 148426 - protein, 10 aa, Mycobacterium tuberculosis
NTTCNYGQVV

SEQ ID NO: 148427 - protein, 10 aa, Mycobacterium tuberculosis
GQVVAALNAT

SEQ ID NO: 148428 - protein, 10 aa, Mycobacterium tuberculosis
AALNATDPGA

SEQ ID NO: 148429 - protein, 10 aa, Mycobacterium tuberculosis
ALNATDPGAA

SEQ ID NO: 148430 - protein, 10 aa, Mycobacterium tuberculosis
ATDPGAAAQF

SEQ ID NO: 148431 - protein, 10 aa, Mycobacterium tuberculosis
AAAQFNASPV

SEQ ID NO: 148432 - protein, 10 aa, Mycobacterium tuberculosis
AQFNASPVAQ

SEQ ID NO: 148433 - protein, 10 aa, Mycobacterium tuberculosis
FNASPVAQSY

SEQ ID NO: 148434 - protein, 10 aa, Mycobacterium tuberculosis
NASPVAQSYL

SEQ ID NO: 148435 - protein, 10 aa, Mycobacterium tuberculosis
ASPVAQSYLR

SEQ ID NO: 148436 - protein, 10 aa, Mycobacterium tuberculosis
PVAQSYLRNF

SEQ ID NO: 148437 - protein, 10 aa, Mycobacterium tuberculosis
AQSYLRNFLA

SEQ ID NO: 148438 - protein, 10 aa, Mycobacterium tuberculosis
YLRNFLAAPP

SEQ ID NO: 148439 - protein, 10 aa, Mycobacterium tuberculosis
RNFLAAPPPQ

SEQ ID NO: 148440 - protein, 10 aa, Mycobacterium tuberculosis
FLAAPPPQRA

SEQ ID NO: 148441 - protein, 10 aa, Mycobacterium tuberculosis
AAPPPQRAAM

SEQ ID NO: 148442 - protein, 10 aa, Mycobacterium tuberculosis
APPPQRAAMA

SEQ ID NO: 148443 - protein, 10 aa, Mycobacterium tuberculosis
AAMAAQLQAV

SEQ ID NO: 148444 - protein, 10 aa, Mycobacterium tuberculosis
AQLQAVPGAA

SEQ ID NO: 148445 - protein, 10 aa, Mycobacterium tuberculosis
LQAVPGAAQY

SEQ ID NO: 148446 - protein, 10 aa, Mycobacterium tuberculosis
QAVPGAAQYI

SEQ ID NO: 148447 - protein, 10 aa, Mycobacterium tuberculosis
AQYIGLVESV

SEQ ID NO: 148448 - protein, 10 aa, Mycobacterium tuberculosis
GLVESVAGSC

SEQ ID NO: 148449 - protein, 10 aa, Mycobacterium tuberculosis
ESVAGSCNNY

SEQ ID NO: 148450 - protein, 11 aa, Mycobacterium tuberculosis
RLSLTALSAGV

SEQ ID NO: 148451 - protein, 11 aa, Mycobacterium tuberculosis
SLTALSAGVGA

SEQ ID NO: 148452 - protein, 11 aa, Mycobacterium tuberculosis
LTALSAGVGAV

SEQ ID NO: 148453 - protein, 11 aa, Mycobacterium tuberculosis
ALSAGVGAVAM

SEQ ID NO: 148454 - protein, 11 aa, Mycobacterium tuberculosis
GVGAVAMSLTV

SEQ ID NO: 148455 - protein, 11 aa, Mycobacterium tuberculosis
GAVAMSLTVGA

SEQ ID NO: 148456 - protein, 11 aa, Mycobacterium tuberculosis
VAMSLTVGAGV

SEQ ID NO: 148457 - protein, 11 aa, Mycobacterium tuberculosis
AMSLTVGAGVA

SEQ ID NO: 148458 - protein, 11 aa, Mycobacterium tuberculosis
SLTVGAGVASA

SEQ ID NO: 148459 - protein, 11 aa, Mycobacterium tuberculosis
VGAGVASADPV

SEQ ID NO: 148460 - protein, 11 aa, Mycobacterium tuberculosis
GVASADPVDAV

SEQ ID NO: 148461 - protein, 11 aa, Mycobacterium tuberculosis
DPVDAVINTTC

SEQ ID NO: 148462 - protein, 11 aa, Mycobacterium tuberculosis
VINTTCNYGQV

SEQ ID NO: 148463 - protein, 11 aa, Mycobacterium tuberculosis
NTTCNYGQVVA

SEQ ID NO: 148464 - protein, 11 aa, Mycobacterium tuberculosis
TTCNYGQVVAA

SEQ ID NO: 148465 - protein, 11 aa, Mycobacterium tuberculosis
TCNYGQVVAAL

SEQ ID NO: 148466 - protein, 11 aa, Mycobacterium tuberculosis
ALNATDPGAAA

SEQ ID NO: 148467 - protein, 11 aa, Mycobacterium tuberculosis
NATDPGAAAQF

SEQ ID NO: 148468 - protein, 11 aa, Mycobacterium tuberculosis
DPGAAAQFNAS

SEQ ID NO: 148469 - protein, 11 aa, Mycobacterium tuberculosis
GAAAQFNASPV

SEQ ID NO: 148470 - protein, 11 aa, Mycobacterium tuberculosis
QFNASPVAQSY

SEQ ID NO: 148471 - protein, 11 aa, Mycobacterium tuberculosis
FNASPVAQSYL

SEQ ID NO: 148472 - protein, 11 aa, Mycobacterium tuberculosis
NASPVAQSYLR

SEQ ID NO: 148473 - protein, 11 aa, Mycobacterium tuberculosis
SPVAQSYLRNF

SEQ ID NO: 148474 - protein, 11 aa, Mycobacterium tuberculosis
PVAQSYLRNFL

SEQ ID NO: 148475 - protein, 11 aa, Mycobacterium tuberculosis
AQSYLRNFLAA

SEQ ID NO: 148476 - protein, 11 aa, Mycobacterium tuberculosis
RNFLAAPPPQR

SEQ ID NO: 148477 - protein, 11 aa, Mycobacterium tuberculosis
FLAAPPPQRAA

SEQ ID NO: 148478 - protein, 11 aa, Mycobacterium tuberculosis
LAAPPPQRAAM

SEQ ID NO: 148479 - protein, 11 aa, Mycobacterium tuberculosis
APPPQRAAMAA

SEQ ID NO: 148480 - protein, 11 aa, Mycobacterium tuberculosis
RAAMAAQLQAV

SEQ ID NO: 148481 - protein, 11 aa, Mycobacterium tuberculosis
MAAQLQAVPGA

SEQ ID NO: 148482 - protein, 11 aa, Mycobacterium tuberculosis
AQLQAVPGAAQ

SEQ ID NO: 148483 - protein, 11 aa, Mycobacterium tuberculosis
QLQAVPGAAQY

SEQ ID NO: 148484 - protein, 11 aa, Mycobacterium tuberculosis
LQAVPGAAQYI

SEQ ID NO: 148485 - protein, 11 aa, Mycobacterium tuberculosis
AVPGAAQYIGL

SEQ ID NO: 148486 - protein, 11 aa, Mycobacterium tuberculosis
VPGAAQYIGLV

SEQ ID NO: 148487 - protein, 11 aa, Mycobacterium tuberculosis
AAQYIGLVESV

SEQ ID NO: 148488 - protein, 11 aa, Mycobacterium tuberculosis
AQYIGLVESVA

SEQ ID NO: 148489 - protein, 11 aa, Mycobacterium tuberculosis
VESVAGSCNNY

SEQ ID NO: 148490 - protein, 13 aa, Mycobacterium tuberculosis
MRLSLTALSAGVG

SEQ ID NO: 148491 - protein, 13 aa, Mycobacterium tuberculosis
RLSLTALSAGVGA

SEQ ID NO: 148492 - protein, 13 aa, Mycobacterium tuberculosis
LSLTALSAGVGAV

SEQ ID NO: 148493 - protein, 13 aa, Mycobacterium tuberculosis
SLTALSAGVGAVA

SEQ ID NO: 148494 - protein, 13 aa, Mycobacterium tuberculosis
LTALSAGVGAVAM

SEQ ID NO: 148495 - protein, 13 aa, Mycobacterium tuberculosis
TALSAGVGAVAMS

SEQ ID NO: 148496 - protein, 13 aa, Mycobacterium tuberculosis
ALSAGVGAVAMSL

SEQ ID NO: 148497 - protein, 13 aa, Mycobacterium tuberculosis
LSAGVGAVAMSLT

SEQ ID NO: 148498 - protein, 13 aa, Mycobacterium tuberculosis
SAGVGAVAMSLTV

SEQ ID NO: 148499 - protein, 13 aa, Mycobacterium tuberculosis
AGVGAVAMSLTVG

SEQ ID NO: 148500 - protein, 13 aa, Mycobacterium tuberculosis
GVGAVAMSLTVGA

SEQ ID NO: 148501 - protein, 13 aa, Mycobacterium tuberculosis
VGAVAMSLTVGAG

SEQ ID NO: 148502 - protein, 13 aa, Mycobacterium tuberculosis
GAVAMSLTVGAGV

SEQ ID NO: 148503 - protein, 13 aa, Mycobacterium tuberculosis
AVAMSLTVGAGVA

SEQ ID NO: 148504 - protein, 13 aa, Mycobacterium tuberculosis
VAMSLTVGAGVAS

SEQ ID NO: 148505 - protein, 13 aa, Mycobacterium tuberculosis
AMSLTVGAGVASA

SEQ ID NO: 148506 - protein, 13 aa, Mycobacterium tuberculosis
MSLTVGAGVASAD

SEQ ID NO: 148507 - protein, 13 aa, Mycobacterium tuberculosis
SLTVGAGVASADP

SEQ ID NO: 148508 - protein, 13 aa, Mycobacterium tuberculosis
LTVGAGVASADPV

SEQ ID NO: 148509 - protein, 13 aa, Mycobacterium tuberculosis
TVGAGVASADPVD

SEQ ID NO: 148510 - protein, 13 aa, Mycobacterium tuberculosis
VGAGVASADPVDA

SEQ ID NO: 148511 - protein, 13 aa, Mycobacterium tuberculosis
GAGVASADPVDAV

SEQ ID NO: 148512 - protein, 13 aa, Mycobacterium tuberculosis
AGVASADPVDAVI

SEQ ID NO: 148513 - protein, 13 aa, Mycobacterium tuberculosis
GVASADPVDAVIN

SEQ ID NO: 148514 - protein, 13 aa, Mycobacterium tuberculosis
VASADPVDAVINT

SEQ ID NO: 148515 - protein, 13 aa, Mycobacterium tuberculosis
ASADPVDAVINTT

SEQ ID NO: 148516 - protein, 13 aa, Mycobacterium tuberculosis
SADPVDAVINTTC

SEQ ID NO: 148517 - protein, 13 aa, Mycobacterium tuberculosis
ADPVDAVINTTCN

SEQ ID NO: 148518 - protein, 13 aa, Mycobacterium tuberculosis
DPVDAVINTTCNY

SEQ ID NO: 148519 - protein, 13 aa, Mycobacterium tuberculosis
PVDAVINTTCNYG

SEQ ID NO: 148520 - protein, 13 aa, Mycobacterium tuberculosis
VDAVINTTCNYGQ

SEQ ID NO: 148521 - protein, 13 aa, Mycobacterium tuberculosis
DAVINTTCNYGQV

SEQ ID NO: 148522 - protein, 13 aa, Mycobacterium tuberculosis
AVINTTCNYGQVV

SEQ ID NO: 148523 - protein, 13 aa, Mycobacterium tuberculosis
VINTTCNYGQVVA

SEQ ID NO: 148524 - protein, 13 aa, Mycobacterium tuberculosis
INTTCNYGQVVAA

SEQ ID NO: 148525 - protein, 13 aa, Mycobacterium tuberculosis
NTTCNYGQVVAAL

SEQ ID NO: 148526 - protein, 13 aa, Mycobacterium tuberculosis
TTCNYGQVVAALN

SEQ ID NO: 148527 - protein, 13 aa, Mycobacterium tuberculosis
TCNYGQVVAALNA

SEQ ID NO: 148528 - protein, 13 aa, Mycobacterium tuberculosis
CNYGQVVAALNAT

SEQ ID NO: 148529 - protein, 13 aa, Mycobacterium tuberculosis
NYGQVVAALNATD

SEQ ID NO: 148530 - protein, 13 aa, Mycobacterium tuberculosis
YGQVVAALNATDP

SEQ ID NO: 148531 - protein, 13 aa, Mycobacterium tuberculosis
GQVVAALNATDPG

SEQ ID NO: 148532 - protein, 13 aa, Mycobacterium tuberculosis
QVVAALNATDPGA

SEQ ID NO: 148533 - protein, 13 aa, Mycobacterium tuberculosis
VVAALNATDPGAA

SEQ ID NO: 148534 - protein, 13 aa, Mycobacterium tuberculosis
VAALNATDPGAAA

SEQ ID NO: 148535 - protein, 13 aa, Mycobacterium tuberculosis
AALNATDPGAAAQ

SEQ ID NO: 148536 - protein, 13 aa, Mycobacterium tuberculosis
ALNATDPGAAAQF

SEQ ID NO: 148537 - protein, 13 aa, Mycobacterium tuberculosis
LNATDPGAAAQFN

SEQ ID NO: 148538 - protein, 13 aa, Mycobacterium tuberculosis
NATDPGAAAQFNA

SEQ ID NO: 148539 - protein, 13 aa, Mycobacterium tuberculosis
ATDPGAAAQFNAS

SEQ ID NO: 148540 - protein, 13 aa, Mycobacterium tuberculosis
TDPGAAAQFNASP

SEQ ID NO: 148541 - protein, 13 aa, Mycobacterium tuberculosis
DPGAAAQFNASPV

SEQ ID NO: 148542 - protein, 13 aa, Mycobacterium tuberculosis
PGAAAQFNASPVA

SEQ ID NO: 148543 - protein, 13 aa, Mycobacterium tuberculosis
GAAAQFNASPVAQ

SEQ ID NO: 148544 - protein, 13 aa, Mycobacterium tuberculosis
AAAQFNASPVAQS

SEQ ID NO: 148545 - protein, 13 aa, Mycobacterium tuberculosis
AAQFNASPVAQSY

SEQ ID NO: 148546 - protein, 13 aa, Mycobacterium tuberculosis
AQFNASPVAQSYL

SEQ ID NO: 148547 - protein, 13 aa, Mycobacterium tuberculosis
QFNASPVAQSYLR

SEQ ID NO: 148548 - protein, 13 aa, Mycobacterium tuberculosis
FNASPVAQSYLRN

SEQ ID NO: 148549 - protein, 13 aa, Mycobacterium tuberculosis
NASPVAQSYLRNF

SEQ ID NO: 148550 - protein, 13 aa, Mycobacterium tuberculosis
ASPVAQSYLRNFL

SEQ ID NO: 148551 - protein, 13 aa, Mycobacterium tuberculosis
SPVAQSYLRNFLA

SEQ ID NO: 148552 - protein, 13 aa, Mycobacterium tuberculosis
PVAQSYLRNFLAA

SEQ ID NO: 148553 - protein, 13 aa, Mycobacterium tuberculosis
VAQSYLRNFLAAP

SEQ ID NO: 148554 - protein, 13 aa, Mycobacterium tuberculosis
AQSYLRNFLAAPP

SEQ ID NO: 148555 - protein, 13 aa, Mycobacterium tuberculosis
QSYLRNFLAAPPP

SEQ ID NO: 148556 - protein, 13 aa, Mycobacterium tuberculosis
SYLRNFLAAPPPQ

SEQ ID NO: 148557 - protein, 13 aa, Mycobacterium tuberculosis
YLRNFLAAPPPQR

SEQ ID NO: 148558 - protein, 13 aa, Mycobacterium tuberculosis
LRNFLAAPPPQRA

SEQ ID NO: 148559 - protein, 13 aa, Mycobacterium tuberculosis
RNFLAAPPPQRAA

SEQ ID NO: 148560 - protein, 13 aa, Mycobacterium tuberculosis
NFLAAPPPQRAAM

SEQ ID NO: 148561 - protein, 13 aa, Mycobacterium tuberculosis
FLAAPPPQRAAMA

SEQ ID NO: 148562 - protein, 13 aa, Mycobacterium tuberculosis
LAAPPPQRAAMAA

SEQ ID NO: 148563 - protein, 13 aa, Mycobacterium tuberculosis
AAPPPQRAAMAAQ

SEQ ID NO: 148564 - protein, 13 aa, Mycobacterium tuberculosis
APPPQRAAMAAQL

SEQ ID NO: 148565 - protein, 13 aa, Mycobacterium tuberculosis
PPPQRAAMAAQLQ

SEQ ID NO: 148566 - protein, 13 aa, Mycobacterium tuberculosis
PPQRAAMAAQLQA

SEQ ID NO: 148567 - protein, 13 aa, Mycobacterium tuberculosis
PQRAAMAAQLQAV

SEQ ID NO: 148568 - protein, 13 aa, Mycobacterium tuberculosis
QRAAMAAQLQAVP

SEQ ID NO: 148569 - protein, 13 aa, Mycobacterium tuberculosis
RAAMAAQLQAVPG

SEQ ID NO: 148570 - protein, 13 aa, Mycobacterium tuberculosis
AAMAAQLQAVPGA

SEQ ID NO: 148571 - protein, 13 aa, Mycobacterium tuberculosis
AMAAQLQAVPGAA

SEQ ID NO: 148572 - protein, 13 aa, Mycobacterium tuberculosis
MAAQLQAVPGAAQ

SEQ ID NO: 148573 - protein, 13 aa, Mycobacterium tuberculosis
AAQLQAVPGAAQY

SEQ ID NO: 148574 - protein, 13 aa, Mycobacterium tuberculosis
AQLQAVPGAAQYI

SEQ ID NO: 148575 - protein, 13 aa, Mycobacterium tuberculosis
QLQAVPGAAQYIG

SEQ ID NO: 148576 - protein, 13 aa, Mycobacterium tuberculosis
LQAVPGAAQYIGL

SEQ ID NO: 148577 - protein, 13 aa, Mycobacterium tuberculosis
QAVPGAAQYIGLV

SEQ ID NO: 148578 - protein, 13 aa, Mycobacterium tuberculosis
AVPGAAQYIGLVE

SEQ ID NO: 148579 - protein, 13 aa, Mycobacterium tuberculosis
VPGAAQYIGLVES

SEQ ID NO: 148580 - protein, 13 aa, Mycobacterium tuberculosis
PGAAQYIGLVESV

SEQ ID NO: 148581 - protein, 13 aa, Mycobacterium tuberculosis
GAAQYIGLVESVA

SEQ ID NO: 148582 - protein, 13 aa, Mycobacterium tuberculosis
AAQYIGLVESVAG

SEQ ID NO: 148583 - protein, 13 aa, Mycobacterium tuberculosis
AQYIGLVESVAGS

SEQ ID NO: 148584 - protein, 13 aa, Mycobacterium tuberculosis
QYIGLVESVAGSC

SEQ ID NO: 148585 - protein, 13 aa, Mycobacterium tuberculosis
YIGLVESVAGSCN

SEQ ID NO: 148586 - protein, 13 aa, Mycobacterium tuberculosis
IGLVESVAGSCNN

SEQ ID NO: 148587 - protein, 13 aa, Mycobacterium tuberculosis
GLVESVAGSCNNY

SEQ ID NO: 148588 - protein, 14 aa, Mycobacterium tuberculosis
MRLSLTALSAGVGA

SEQ ID NO: 148589 - protein, 14 aa, Mycobacterium tuberculosis
RLSLTALSAGVGAV

SEQ ID NO: 148590 - protein, 14 aa, Mycobacterium tuberculosis
LSLTALSAGVGAVA

SEQ ID NO: 148591 - protein, 14 aa, Mycobacterium tuberculosis
SLTALSAGVGAVAM

SEQ ID NO: 148592 - protein, 14 aa, Mycobacterium tuberculosis
LTALSAGVGAVAMS

SEQ ID NO: 148593 - protein, 14 aa, Mycobacterium tuberculosis
TALSAGVGAVAMSL

SEQ ID NO: 148594 - protein, 14 aa, Mycobacterium tuberculosis
ALSAGVGAVAMSLT

SEQ ID NO: 148595 - protein, 14 aa, Mycobacterium tuberculosis
LSAGVGAVAMSLTV

SEQ ID NO: 148596 - protein, 14 aa, Mycobacterium tuberculosis
SAGVGAVAMSLTVG

SEQ ID NO: 148597 - protein, 14 aa, Mycobacterium tuberculosis
AGVGAVAMSLTVGA

SEQ ID NO: 148598 - protein, 14 aa, Mycobacterium tuberculosis
GVGAVAMSLTVGAG

SEQ ID NO: 148599 - protein, 14 aa, Mycobacterium tuberculosis
VGAVAMSLTVGAGV

SEQ ID NO: 148600 - protein, 14 aa, Mycobacterium tuberculosis
GAVAMSLTVGAGVA

SEQ ID NO: 148601 - protein, 14 aa, Mycobacterium tuberculosis
AVAMSLTVGAGVAS

SEQ ID NO: 148602 - protein, 14 aa, Mycobacterium tuberculosis
VAMSLTVGAGVASA

SEQ ID NO: 148603 - protein, 14 aa, Mycobacterium tuberculosis
AMSLTVGAGVASAD

SEQ ID NO: 148604 - protein, 14 aa, Mycobacterium tuberculosis
MSLTVGAGVASADP

SEQ ID NO: 148605 - protein, 14 aa, Mycobacterium tuberculosis
SLTVGAGVASADPV

SEQ ID NO: 148606 - protein, 14 aa, Mycobacterium tuberculosis
LTVGAGVASADPVD

SEQ ID NO: 148607 - protein, 14 aa, Mycobacterium tuberculosis
TVGAGVASADPVDA

SEQ ID NO: 148608 - protein, 14 aa, Mycobacterium tuberculosis
VGAGVASADPVDAV

SEQ ID NO: 148609 - protein, 14 aa, Mycobacterium tuberculosis
GAGVASADPVDAVI

SEQ ID NO: 148610 - protein, 14 aa, Mycobacterium tuberculosis
AGVASADPVDAVIN

SEQ ID NO: 148611 - protein, 14 aa, Mycobacterium tuberculosis
GVASADPVDAVINT

SEQ ID NO: 148612 - protein, 14 aa, Mycobacterium tuberculosis
VASADPVDAVINTT

SEQ ID NO: 148613 - protein, 14 aa, Mycobacterium tuberculosis
ASADPVDAVINTTC

SEQ ID NO: 148614 - protein, 14 aa, Mycobacterium tuberculosis
SADPVDAVINTTCN

SEQ ID NO: 148615 - protein, 14 aa, Mycobacterium tuberculosis
ADPVDAVINTTCNY

SEQ ID NO: 148616 - protein, 14 aa, Mycobacterium tuberculosis
DPVDAVINTTCNYG

SEQ ID NO: 148617 - protein, 14 aa, Mycobacterium tuberculosis
PVDAVINTTCNYGQ

SEQ ID NO: 148618 - protein, 14 aa, Mycobacterium tuberculosis
VDAVINTTCNYGQV

SEQ ID NO: 148619 - protein, 14 aa, Mycobacterium tuberculosis
DAVINTTCNYGQVV

SEQ ID NO: 148620 - protein, 14 aa, Mycobacterium tuberculosis
AVINTTCNYGQVVA

SEQ ID NO: 148621 - protein, 14 aa, Mycobacterium tuberculosis
VINTTCNYGQVVAA

SEQ ID NO: 148622 - protein, 14 aa, Mycobacterium tuberculosis
INTTCNYGQVVAAL

SEQ ID NO: 148623 - protein, 14 aa, Mycobacterium tuberculosis
NTTCNYGQVVAALN

SEQ ID NO: 148624 - protein, 14 aa, Mycobacterium tuberculosis
TTCNYGQVVAALNA

SEQ ID NO: 148625 - protein, 14 aa, Mycobacterium tuberculosis
TCNYGQVVAALNAT

SEQ ID NO: 148626 - protein, 14 aa, Mycobacterium tuberculosis
CNYGQVVAALNATD

SEQ ID NO: 148627 - protein, 14 aa, Mycobacterium tuberculosis
NYGQVVAALNATDP

SEQ ID NO: 148628 - protein, 14 aa, Mycobacterium tuberculosis
YGQVVAALNATDPG

SEQ ID NO: 148629 - protein, 14 aa, Mycobacterium tuberculosis
GQVVAALNATDPGA

SEQ ID NO: 148630 - protein, 14 aa, Mycobacterium tuberculosis
QVVAALNATDPGAA

SEQ ID NO: 148631 - protein, 14 aa, Mycobacterium tuberculosis
VVAALNATDPGAAA

SEQ ID NO: 148632 - protein, 14 aa, Mycobacterium tuberculosis
VAALNATDPGAAAQ

SEQ ID NO: 148633 - protein, 14 aa, Mycobacterium tuberculosis
AALNATDPGAAAQF

SEQ ID NO: 148634 - protein, 14 aa, Mycobacterium tuberculosis
ALNATDPGAAAQFN

SEQ ID NO: 148635 - protein, 14 aa, Mycobacterium tuberculosis
LNATDPGAAAQFNA

SEQ ID NO: 148636 - protein, 14 aa, Mycobacterium tuberculosis
NATDPGAAAQFNAS

SEQ ID NO: 148637 - protein, 14 aa, Mycobacterium tuberculosis
ATDPGAAAQFNASP

SEQ ID NO: 148638 - protein, 14 aa, Mycobacterium tuberculosis
TDPGAAAQFNASPV

SEQ ID NO: 148639 - protein, 14 aa, Mycobacterium tuberculosis
DPGAAAQFNASPVA

SEQ ID NO: 148640 - protein, 14 aa, Mycobacterium tuberculosis
PGAAAQFNASPVAQ

SEQ ID NO: 148641 - protein, 14 aa, Mycobacterium tuberculosis
GAAAQFNASPVAQS

SEQ ID NO: 148642 - protein, 14 aa, Mycobacterium tuberculosis
AAAQFNASPVAQSY

SEQ ID NO: 148643 - protein, 14 aa, Mycobacterium tuberculosis
AAQFNASPVAQSYL

SEQ ID NO: 148644 - protein, 14 aa, Mycobacterium tuberculosis
AQFNASPVAQSYLR

SEQ ID NO: 148645 - protein, 14 aa, Mycobacterium tuberculosis
QFNASPVAQSYLRN

SEQ ID NO: 148646 - protein, 14 aa, Mycobacterium tuberculosis
FNASPVAQSYLRNF

SEQ ID NO: 148647 - protein, 14 aa, Mycobacterium tuberculosis
NASPVAQSYLRNFL

SEQ ID NO: 148648 - protein, 14 aa, Mycobacterium tuberculosis
ASPVAQSYLRNFLA

SEQ ID NO: 148649 - protein, 14 aa, Mycobacterium tuberculosis
SPVAQSYLRNFLAA

SEQ ID NO: 148650 - protein, 14 aa, Mycobacterium tuberculosis
PVAQSYLRNFLAAP

SEQ ID NO: 148651 - protein, 14 aa, Mycobacterium tuberculosis
VAQSYLRNFLAAPP

SEQ ID NO: 148652 - protein, 14 aa, Mycobacterium tuberculosis
AQSYLRNFLAAPPP

SEQ ID NO: 148653 - protein, 14 aa, Mycobacterium tuberculosis
QSYLRNFLAAPPPQ

SEQ ID NO: 148654 - protein, 14 aa, Mycobacterium tuberculosis
SYLRNFLAAPPPQR

SEQ ID NO: 148655 - protein, 14 aa, Mycobacterium tuberculosis
YLRNFLAAPPPQRA

SEQ ID NO: 148656 - protein, 14 aa, Mycobacterium tuberculosis
LRNFLAAPPPQRAA

SEQ ID NO: 148657 - protein, 14 aa, Mycobacterium tuberculosis
RNFLAAPPPQRAAM

SEQ ID NO: 148658 - protein, 14 aa, Mycobacterium tuberculosis
NFLAAPPPQRAAMA

SEQ ID NO: 148659 - protein, 14 aa, Mycobacterium tuberculosis
FLAAPPPQRAAMAA

SEQ ID NO: 148660 - protein, 14 aa, Mycobacterium tuberculosis
LAAPPPQRAAMAAQ

SEQ ID NO: 148661 - protein, 14 aa, Mycobacterium tuberculosis
AAPPPQRAAMAAQL

SEQ ID NO: 148662 - protein, 14 aa, Mycobacterium tuberculosis
APPPQRAAMAAQLQ

SEQ ID NO: 148663 - protein, 14 aa, Mycobacterium tuberculosis
PPPQRAAMAAQLQA

SEQ ID NO: 148664 - protein, 14 aa, Mycobacterium tuberculosis
PPQRAAMAAQLQAV

SEQ ID NO: 148665 - protein, 14 aa, Mycobacterium tuberculosis
PQRAAMAAQLQAVP

SEQ ID NO: 148666 - protein, 14 aa, Mycobacterium tuberculosis
QRAAMAAQLQAVPG

SEQ ID NO: 148667 - protein, 14 aa, Mycobacterium tuberculosis
RAAMAAQLQAVPGA

SEQ ID NO: 148668 - protein, 14 aa, Mycobacterium tuberculosis
AAMAAQLQAVPGAA

SEQ ID NO: 148669 - protein, 14 aa, Mycobacterium tuberculosis
AMAAQLQAVPGAAQ

SEQ ID NO: 148670 - protein, 14 aa, Mycobacterium tuberculosis
MAAQLQAVPGAAQY

SEQ ID NO: 148671 - protein, 14 aa, Mycobacterium tuberculosis
AAQLQAVPGAAQYI

SEQ ID NO: 148672 - protein, 14 aa, Mycobacterium tuberculosis
AQLQAVPGAAQYIG

SEQ ID NO: 148673 - protein, 14 aa, Mycobacterium tuberculosis
QLQAVPGAAQYIGL

SEQ ID NO: 148674 - protein, 14 aa, Mycobacterium tuberculosis
LQAVPGAAQYIGLV

SEQ ID NO: 148675 - protein, 14 aa, Mycobacterium tuberculosis
QAVPGAAQYIGLVE

SEQ ID NO: 148676 - protein, 14 aa, Mycobacterium tuberculosis
AVPGAAQYIGLVES

SEQ ID NO: 148677 - protein, 14 aa, Mycobacterium tuberculosis
VPGAAQYIGLVESV

SEQ ID NO: 148678 - protein, 14 aa, Mycobacterium tuberculosis
PGAAQYIGLVESVA

SEQ ID NO: 148679 - protein, 14 aa, Mycobacterium tuberculosis
GAAQYIGLVESVAG

SEQ ID NO: 148680 - protein, 14 aa, Mycobacterium tuberculosis
AAQYIGLVESVAGS

SEQ ID NO: 148681 - protein, 14 aa, Mycobacterium tuberculosis
AQYIGLVESVAGSC

SEQ ID NO: 148682 - protein, 14 aa, Mycobacterium tuberculosis
QYIGLVESVAGSCN

SEQ ID NO: 148683 - protein, 14 aa, Mycobacterium tuberculosis
YIGLVESVAGSCNN

SEQ ID NO: 148684 - protein, 14 aa, Mycobacterium tuberculosis
IGLVESVAGSCNNY

SEQ ID NO: 148685 - protein, 15 aa, Mycobacterium tuberculosis
MRLSLTALSAGVGAV

SEQ ID NO: 148686 - protein, 15 aa, Mycobacterium tuberculosis
RLSLTALSAGVGAVA

SEQ ID NO: 148687 - protein, 15 aa, Mycobacterium tuberculosis
LSLTALSAGVGAVAM

SEQ ID NO: 148688 - protein, 15 aa, Mycobacterium tuberculosis
SLTALSAGVGAVAMS

SEQ ID NO: 148689 - protein, 15 aa, Mycobacterium tuberculosis
LTALSAGVGAVAMSL

SEQ ID NO: 148690 - protein, 15 aa, Mycobacterium tuberculosis
TALSAGVGAVAMSLT

SEQ ID NO: 148691 - protein, 15 aa, Mycobacterium tuberculosis
ALSAGVGAVAMSLTV

SEQ ID NO: 148692 - protein, 15 aa, Mycobacterium tuberculosis
LSAGVGAVAMSLTVG

SEQ ID NO: 148693 - protein, 15 aa, Mycobacterium tuberculosis
SAGVGAVAMSLTVGA

SEQ ID NO: 148694 - protein, 15 aa, Mycobacterium tuberculosis
AGVGAVAMSLTVGAG

SEQ ID NO: 148695 - protein, 15 aa, Mycobacterium tuberculosis
GVGAVAMSLTVGAGV

SEQ ID NO: 148696 - protein, 15 aa, Mycobacterium tuberculosis
VGAVAMSLTVGAGVA

SEQ ID NO: 148697 - protein, 15 aa, Mycobacterium tuberculosis
GAVAMSLTVGAGVAS

SEQ ID NO: 148698 - protein, 15 aa, Mycobacterium tuberculosis
AVAMSLTVGAGVASA

SEQ ID NO: 148699 - protein, 15 aa, Mycobacterium tuberculosis
VAMSLTVGAGVASAD

SEQ ID NO: 148700 - protein, 15 aa, Mycobacterium tuberculosis
AMSLTVGAGVASADP

SEQ ID NO: 148701 - protein, 15 aa, Mycobacterium tuberculosis
MSLTVGAGVASADPV

SEQ ID NO: 148702 - protein, 15 aa, Mycobacterium tuberculosis
SLTVGAGVASADPVD

SEQ ID NO: 148703 - protein, 15 aa, Mycobacterium tuberculosis
LTVGAGVASADPVDA

SEQ ID NO: 148704 - protein, 15 aa, Mycobacterium tuberculosis
TVGAGVASADPVDAV

SEQ ID NO: 148705 - protein, 15 aa, Mycobacterium tuberculosis
VGAGVASADPVDAVI

SEQ ID NO: 148706 - protein, 15 aa, Mycobacterium tuberculosis
GAGVASADPVDAVIN

SEQ ID NO: 148707 - protein, 15 aa, Mycobacterium tuberculosis
AGVASADPVDAVINT

SEQ ID NO: 148708 - protein, 15 aa, Mycobacterium tuberculosis
GVASADPVDAVINTT

SEQ ID NO: 148709 - protein, 15 aa, Mycobacterium tuberculosis
VASADPVDAVINTTC

SEQ ID NO: 148710 - protein, 15 aa, Mycobacterium tuberculosis
ASADPVDAVINTTCN

SEQ ID NO: 148711 - protein, 15 aa, Mycobacterium tuberculosis
SADPVDAVINTTCNY

SEQ ID NO: 148712 - protein, 15 aa, Mycobacterium tuberculosis
ADPVDAVINTTCNYG

SEQ ID NO: 148713 - protein, 15 aa, Mycobacterium tuberculosis
DPVDAVINTTCNYGQ

SEQ ID NO: 148714 - protein, 15 aa, Mycobacterium tuberculosis
PVDAVINTTCNYGQV

SEQ ID NO: 148715 - protein, 15 aa, Mycobacterium tuberculosis
VDAVINTTCNYGQVV

SEQ ID NO: 148716 - protein, 15 aa, Mycobacterium tuberculosis
DAVINTTCNYGQVVA

SEQ ID NO: 148717 - protein, 15 aa, Mycobacterium tuberculosis
AVINTTCNYGQVVAA

SEQ ID NO: 148718 - protein, 15 aa, Mycobacterium tuberculosis
VINTTCNYGQVVAAL

SEQ ID NO: 148719 - protein, 15 aa, Mycobacterium tuberculosis
INTTCNYGQVVAALN

SEQ ID NO: 148720 - protein, 15 aa, Mycobacterium tuberculosis
NTTCNYGQVVAALNA

SEQ ID NO: 148721 - protein, 15 aa, Mycobacterium tuberculosis
TTCNYGQVVAALNAT

SEQ ID NO: 148722 - protein, 15 aa, Mycobacterium tuberculosis
TCNYGQVVAALNATD

SEQ ID NO: 148723 - protein, 15 aa, Mycobacterium tuberculosis
CNYGQVVAALNATDP

SEQ ID NO: 148724 - protein, 15 aa, Mycobacterium tuberculosis
NYGQVVAALNATDPG

SEQ ID NO: 148725 - protein, 15 aa, Mycobacterium tuberculosis
YGQVVAALNATDPGA

SEQ ID NO: 148726 - protein, 15 aa, Mycobacterium tuberculosis
GQVVAALNATDPGAA

SEQ ID NO: 148727 - protein, 15 aa, Mycobacterium tuberculosis
QVVAALNATDPGAAA

SEQ ID NO: 148728 - protein, 15 aa, Mycobacterium tuberculosis
VVAALNATDPGAAAQ

SEQ ID NO: 148729 - protein, 15 aa, Mycobacterium tuberculosis
VAALNATDPGAAAQF

SEQ ID NO: 148730 - protein, 15 aa, Mycobacterium tuberculosis
AALNATDPGAAAQFN

SEQ ID NO: 148731 - protein, 15 aa, Mycobacterium tuberculosis
ALNATDPGAAAQFNA

SEQ ID NO: 148732 - protein, 15 aa, Mycobacterium tuberculosis
LNATDPGAAAQFNAS

SEQ ID NO: 148733 - protein, 15 aa, Mycobacterium tuberculosis
NATDPGAAAQFNASP

SEQ ID NO: 148734 - protein, 15 aa, Mycobacterium tuberculosis
ATDPGAAAQFNASPV

SEQ ID NO: 148735 - protein, 15 aa, Mycobacterium tuberculosis
TDPGAAAQFNASPVA

SEQ ID NO: 148736 - protein, 15 aa, Mycobacterium tuberculosis
DPGAAAQFNASPVAQ

SEQ ID NO: 148737 - protein, 15 aa, Mycobacterium tuberculosis
PGAAAQFNASPVAQS

SEQ ID NO: 148738 - protein, 15 aa, Mycobacterium tuberculosis
GAAAQFNASPVAQSY

SEQ ID NO: 148739 - protein, 15 aa, Mycobacterium tuberculosis
AAAQFNASPVAQSYL

SEQ ID NO: 148740 - protein, 15 aa, Mycobacterium tuberculosis
AAQFNASPVAQSYLR

SEQ ID NO: 148741 - protein, 15 aa, Mycobacterium tuberculosis
AQFNASPVAQSYLRN

SEQ ID NO: 148742 - protein, 15 aa, Mycobacterium tuberculosis
QFNASPVAQSYLRNF

SEQ ID NO: 148743 - protein, 15 aa, Mycobacterium tuberculosis
FNASPVAQSYLRNFL

SEQ ID NO: 148744 - protein, 15 aa, Mycobacterium tuberculosis
NASPVAQSYLRNFLA

SEQ ID NO: 148745 - protein, 15 aa, Mycobacterium tuberculosis
ASPVAQSYLRNFLAA

SEQ ID NO: 148746 - protein, 15 aa, Mycobacterium tuberculosis
SPVAQSYLRNFLAAP

SEQ ID NO: 148747 - protein, 15 aa, Mycobacterium tuberculosis
PVAQSYLRNFLAAPP

SEQ ID NO: 148748 - protein, 15 aa, Mycobacterium tuberculosis
VAQSYLRNFLAAPPP

SEQ ID NO: 148749 - protein, 15 aa, Mycobacterium tuberculosis
AQSYLRNFLAAPPPQ

SEQ ID NO: 148750 - protein, 15 aa, Mycobacterium tuberculosis
QSYLRNFLAAPPPQR

SEQ ID NO: 148751 - protein, 15 aa, Mycobacterium tuberculosis
SYLRNFLAAPPPQRA

SEQ ID NO: 148752 - protein, 15 aa, Mycobacterium tuberculosis
YLRNFLAAPPPQRAA

SEQ ID NO: 148753 - protein, 15 aa, Mycobacterium tuberculosis
LRNFLAAPPPQRAAM

SEQ ID NO: 148754 - protein, 15 aa, Mycobacterium tuberculosis
RNFLAAPPPQRAAMA

SEQ ID NO: 148755 - protein, 15 aa, Mycobacterium tuberculosis
NFLAAPPPQRAAMAA

SEQ ID NO: 148756 - protein, 15 aa, Mycobacterium tuberculosis
FLAAPPPQRAAMAAQ

SEQ ID NO: 148757 - protein, 15 aa, Mycobacterium tuberculosis
LAAPPPQRAAMAAQL

SEQ ID NO: 148758 - protein, 15 aa, Mycobacterium tuberculosis
AAPPPQRAAMAAQLQ

SEQ ID NO: 148759 - protein, 15 aa, Mycobacterium tuberculosis
APPPQRAAMAAQLQA

SEQ ID NO: 148760 - protein, 15 aa, Mycobacterium tuberculosis
PPPQRAAMAAQLQAV

SEQ ID NO: 148761 - protein, 15 aa, Mycobacterium tuberculosis
PPQRAAMAAQLQAVP

SEQ ID NO: 148762 - protein, 15 aa, Mycobacterium tuberculosis
PQRAAMAAQLQAVPG

SEQ ID NO: 148763 - protein, 15 aa, Mycobacterium tuberculosis
QRAAMAAQLQAVPGA

SEQ ID NO: 148764 - protein, 15 aa, Mycobacterium tuberculosis
RAAMAAQLQAVPGAA

SEQ ID NO: 148765 - protein, 15 aa, Mycobacterium tuberculosis
AAMAAQLQAVPGAAQ

SEQ ID NO: 148766 - protein, 15 aa, Mycobacterium tuberculosis
AMAAQLQAVPGAAQY

SEQ ID NO: 148767 - protein, 15 aa, Mycobacterium tuberculosis
MAAQLQAVPGAAQYI

SEQ ID NO: 148768 - protein, 15 aa, Mycobacterium tuberculosis
AAQLQAVPGAAQYIG

SEQ ID NO: 148769 - protein, 15 aa, Mycobacterium tuberculosis
AQLQAVPGAAQYIGL

SEQ ID NO: 148770 - protein, 15 aa, Mycobacterium tuberculosis
QLQAVPGAAQYIGLV

SEQ ID NO: 148771 - protein, 15 aa, Mycobacterium tuberculosis
LQAVPGAAQYIGLVE

SEQ ID NO: 148772 - protein, 15 aa, Mycobacterium tuberculosis
QAVPGAAQYIGLVES

SEQ ID NO: 148773 - protein, 15 aa, Mycobacterium tuberculosis
AVPGAAQYIGLVESV

SEQ ID NO: 148774 - protein, 15 aa, Mycobacterium tuberculosis
VPGAAQYIGLVESVA

SEQ ID NO: 148775 - protein, 15 aa, Mycobacterium tuberculosis
PGAAQYIGLVESVAG

SEQ ID NO: 148776 - protein, 15 aa, Mycobacterium tuberculosis
GAAQYIGLVESVAGS

SEQ ID NO: 148777 - protein, 15 aa, Mycobacterium tuberculosis
AAQYIGLVESVAGSC

SEQ ID NO: 148778 - protein, 15 aa, Mycobacterium tuberculosis
AQYIGLVESVAGSCN

SEQ ID NO: 148779 - protein, 15 aa, Mycobacterium tuberculosis
QYIGLVESVAGSCNN

SEQ ID NO: 148780 - protein, 15 aa, Mycobacterium tuberculosis
YIGLVESVAGSCNNY

SEQ ID NO: 148781 - protein, 16 aa, Mycobacterium tuberculosis
MRLSLTALSAGVGAVA

SEQ ID NO: 148782 - protein, 16 aa, Mycobacterium tuberculosis
RLSLTALSAGVGAVAM

SEQ ID NO: 148783 - protein, 16 aa, Mycobacterium tuberculosis
LSLTALSAGVGAVAMS

SEQ ID NO: 148784 - protein, 16 aa, Mycobacterium tuberculosis
SLTALSAGVGAVAMSL

SEQ ID NO: 148785 - protein, 16 aa, Mycobacterium tuberculosis
LTALSAGVGAVAMSLT

SEQ ID NO: 148786 - protein, 16 aa, Mycobacterium tuberculosis
TALSAGVGAVAMSLTV

SEQ ID NO: 148787 - protein, 16 aa, Mycobacterium tuberculosis
ALSAGVGAVAMSLTVG

SEQ ID NO: 148788 - protein, 16 aa, Mycobacterium tuberculosis
LSAGVGAVAMSLTVGA

SEQ ID NO: 148789 - protein, 16 aa, Mycobacterium tuberculosis
SAGVGAVAMSLTVGAG

SEQ ID NO: 148790 - protein, 16 aa, Mycobacterium tuberculosis
AGVGAVAMSLTVGAGV

SEQ ID NO: 148791 - protein, 16 aa, Mycobacterium tuberculosis
GVGAVAMSLTVGAGVA

SEQ ID NO: 148792 - protein, 16 aa, Mycobacterium tuberculosis
VGAVAMSLTVGAGVAS

SEQ ID NO: 148793 - protein, 16 aa, Mycobacterium tuberculosis
GAVAMSLTVGAGVASA

SEQ ID NO: 148794 - protein, 16 aa, Mycobacterium tuberculosis
AVAMSLTVGAGVASAD

SEQ ID NO: 148795 - protein, 16 aa, Mycobacterium tuberculosis
VAMSLTVGAGVASADP

SEQ ID NO: 148796 - protein, 16 aa, Mycobacterium tuberculosis
AMSLTVGAGVASADPV

SEQ ID NO: 148797 - protein, 16 aa, Mycobacterium tuberculosis
MSLTVGAGVASADPVD

SEQ ID NO: 148798 - protein, 16 aa, Mycobacterium tuberculosis
SLTVGAGVASADPVDA

SEQ ID NO: 148799 - protein, 16 aa, Mycobacterium tuberculosis
LTVGAGVASADPVDAV

SEQ ID NO: 148800 - protein, 16 aa, Mycobacterium tuberculosis
TVGAGVASADPVDAVI

SEQ ID NO: 148801 - protein, 16 aa, Mycobacterium tuberculosis
VGAGVASADPVDAVIN

SEQ ID NO: 148802 - protein, 16 aa, Mycobacterium tuberculosis
GAGVASADPVDAVINT

SEQ ID NO: 148803 - protein, 16 aa, Mycobacterium tuberculosis
AGVASADPVDAVINTT

SEQ ID NO: 148804 - protein, 16 aa, Mycobacterium tuberculosis
GVASADPVDAVINTTC

SEQ ID NO: 148805 - protein, 16 aa, Mycobacterium tuberculosis
VASADPVDAVINTTCN

SEQ ID NO: 148806 - protein, 16 aa, Mycobacterium tuberculosis
ASADPVDAVINTTCNY

SEQ ID NO: 148807 - protein, 16 aa, Mycobacterium tuberculosis
SADPVDAVINTTCNYG

SEQ ID NO: 148808 - protein, 16 aa, Mycobacterium tuberculosis
ADPVDAVINTTCNYGQ

SEQ ID NO: 148809 - protein, 16 aa, Mycobacterium tuberculosis
DPVDAVINTTCNYGQV

SEQ ID NO: 148810 - protein, 16 aa, Mycobacterium tuberculosis
PVDAVINTTCNYGQVV

SEQ ID NO: 148811 - protein, 16 aa, Mycobacterium tuberculosis
VDAVINTTCNYGQVVA

SEQ ID NO: 148812 - protein, 16 aa, Mycobacterium tuberculosis
DAVINTTCNYGQVVAA

SEQ ID NO: 148813 - protein, 16 aa, Mycobacterium tuberculosis
AVINTTCNYGQVVAAL

SEQ ID NO: 148814 - protein, 16 aa, Mycobacterium tuberculosis
VINTTCNYGQVVAALN

SEQ ID NO: 148815 - protein, 16 aa, Mycobacterium tuberculosis
INTTCNYGQVVAALNA

SEQ ID NO: 148816 - protein, 16 aa, Mycobacterium tuberculosis
NTTCNYGQVVAALNAT

SEQ ID NO: 148817 - protein, 16 aa, Mycobacterium tuberculosis
TTCNYGQVVAALNATD

SEQ ID NO: 148818 - protein, 16 aa, Mycobacterium tuberculosis
TCNYGQVVAALNATDP

SEQ ID NO: 148819 - protein, 16 aa, Mycobacterium tuberculosis
CNYGQVVAALNATDPG

SEQ ID NO: 148820 - protein, 16 aa, Mycobacterium tuberculosis
NYGQVVAALNATDPGA

SEQ ID NO: 148821 - protein, 16 aa, Mycobacterium tuberculosis
YGQVVAALNATDPGAA

SEQ ID NO: 148822 - protein, 16 aa, Mycobacterium tuberculosis
GQVVAALNATDPGAAA

SEQ ID NO: 148823 - protein, 16 aa, Mycobacterium tuberculosis
QVVAALNATDPGAAAQ

SEQ ID NO: 148824 - protein, 16 aa, Mycobacterium tuberculosis
VVAALNATDPGAAAQF

SEQ ID NO: 148825 - protein, 16 aa, Mycobacterium tuberculosis
VAALNATDPGAAAQFN

SEQ ID NO: 148826 - protein, 16 aa, Mycobacterium tuberculosis
AALNATDPGAAAQFNA

SEQ ID NO: 148827 - protein, 16 aa, Mycobacterium tuberculosis
ALNATDPGAAAQFNAS

SEQ ID NO: 148828 - protein, 16 aa, Mycobacterium tuberculosis
LNATDPGAAAQFNASP

SEQ ID NO: 148829 - protein, 16 aa, Mycobacterium tuberculosis
NATDPGAAAQFNASPV

SEQ ID NO: 148830 - protein, 16 aa, Mycobacterium tuberculosis
ATDPGAAAQFNASPVA

SEQ ID NO: 148831 - protein, 16 aa, Mycobacterium tuberculosis
TDPGAAAQFNASPVAQ

SEQ ID NO: 148832 - protein, 16 aa, Mycobacterium tuberculosis
DPGAAAQFNASPVAQS

SEQ ID NO: 148833 - protein, 16 aa, Mycobacterium tuberculosis
PGAAAQFNASPVAQSY

SEQ ID NO: 148834 - protein, 16 aa, Mycobacterium tuberculosis
GAAAQFNASPVAQSYL

SEQ ID NO: 148835 - protein, 16 aa, Mycobacterium tuberculosis
AAAQFNASPVAQSYLR

SEQ ID NO: 148836 - protein, 16 aa, Mycobacterium tuberculosis
AAQFNASPVAQSYLRN

SEQ ID NO: 148837 - protein, 16 aa, Mycobacterium tuberculosis
AQFNASPVAQSYLRNF

SEQ ID NO: 148838 - protein, 16 aa, Mycobacterium tuberculosis
QFNASPVAQSYLRNFL

SEQ ID NO: 148839 - protein, 16 aa, Mycobacterium tuberculosis
FNASPVAQSYLRNFLA

SEQ ID NO: 148840 - protein, 16 aa, Mycobacterium tuberculosis
NASPVAQSYLRNFLAA

SEQ ID NO: 148841 - protein, 16 aa, Mycobacterium tuberculosis
ASPVAQSYLRNFLAAP

SEQ ID NO: 148842 - protein, 16 aa, Mycobacterium tuberculosis
SPVAQSYLRNFLAAPP

SEQ ID NO: 148843 - protein, 16 aa, Mycobacterium tuberculosis
PVAQSYLRNFLAAPPP

SEQ ID NO: 148844 - protein, 16 aa, Mycobacterium tuberculosis
VAQSYLRNFLAAPPPQ

SEQ ID NO: 148845 - protein, 16 aa, Mycobacterium tuberculosis
AQSYLRNFLAAPPPQR

SEQ ID NO: 148846 - protein, 16 aa, Mycobacterium tuberculosis
QSYLRNFLAAPPPQRA

SEQ ID NO: 148847 - protein, 16 aa, Mycobacterium tuberculosis
SYLRNFLAAPPPQRAA

SEQ ID NO: 148848 - protein, 16 aa, Mycobacterium tuberculosis
YLRNFLAAPPPQRAAM

SEQ ID NO: 148849 - protein, 16 aa, Mycobacterium tuberculosis
LRNFLAAPPPQRAAMA

SEQ ID NO: 148850 - protein, 16 aa, Mycobacterium tuberculosis
RNFLAAPPPQRAAMAA

SEQ ID NO: 148851 - protein, 16 aa, Mycobacterium tuberculosis
NFLAAPPPQRAAMAAQ

SEQ ID NO: 148852 - protein, 16 aa, Mycobacterium tuberculosis
FLAAPPPQRAAMAAQL

SEQ ID NO: 148853 - protein, 16 aa, Mycobacterium tuberculosis
LAAPPPQRAAMAAQLQ

SEQ ID NO: 148854 - protein, 16 aa, Mycobacterium tuberculosis
AAPPPQRAAMAAQLQA

SEQ ID NO: 148855 - protein, 16 aa, Mycobacterium tuberculosis
APPPQRAAMAAQLQAV

SEQ ID NO: 148856 - protein, 16 aa, Mycobacterium tuberculosis
PPPQRAAMAAQLQAVP

SEQ ID NO: 148857 - protein, 16 aa, Mycobacterium tuberculosis
PPQRAAMAAQLQAVPG

SEQ ID NO: 148858 - protein, 16 aa, Mycobacterium tuberculosis
PQRAAMAAQLQAVPGA

SEQ ID NO: 148859 - protein, 16 aa, Mycobacterium tuberculosis
QRAAMAAQLQAVPGAA

SEQ ID NO: 148860 - protein, 16 aa, Mycobacterium tuberculosis
RAAMAAQLQAVPGAAQ

SEQ ID NO: 148861 - protein, 16 aa, Mycobacterium tuberculosis
AAMAAQLQAVPGAAQY

SEQ ID NO: 148862 - protein, 16 aa, Mycobacterium tuberculosis
AMAAQLQAVPGAAQYI

SEQ ID NO: 148863 - protein, 16 aa, Mycobacterium tuberculosis
MAAQLQAVPGAAQYIG

SEQ ID NO: 148864 - protein, 16 aa, Mycobacterium tuberculosis
AAQLQAVPGAAQYIGL

SEQ ID NO: 148865 - protein, 16 aa, Mycobacterium tuberculosis
AQLQAVPGAAQYIGLV

SEQ ID NO: 148866 - protein, 16 aa, Mycobacterium tuberculosis
QLQAVPGAAQYIGLVE

SEQ ID NO: 148867 - protein, 16 aa, Mycobacterium tuberculosis
LQAVPGAAQYIGLVES

SEQ ID NO: 148868 - protein, 16 aa, Mycobacterium tuberculosis
QAVPGAAQYIGLVESV

SEQ ID NO: 148869 - protein, 16 aa, Mycobacterium tuberculosis
AVPGAAQYIGLVESVA

SEQ ID NO: 148870 - protein, 16 aa, Mycobacterium tuberculosis
VPGAAQYIGLVESVAG

SEQ ID NO: 148871 - protein, 16 aa, Mycobacterium tuberculosis
PGAAQYIGLVESVAGS

SEQ ID NO: 148872 - protein, 16 aa, Mycobacterium tuberculosis
GAAQYIGLVESVAGSC

SEQ ID NO: 148873 - protein, 16 aa, Mycobacterium tuberculosis
AAQYIGLVESVAGSCN

SEQ ID NO: 148874 - protein, 16 aa, Mycobacterium tuberculosis
AQYIGLVESVAGSCNN

SEQ ID NO: 148875 - protein, 16 aa, Mycobacterium tuberculosis
QYIGLVESVAGSCNNY

SEQ ID NO: 148876 - protein, 579 aa, Mycobacterium tuberculosis
MIRTWIALVPNDHRARLIGFALLAFCSVVARAVGTVLLVPLMAALFGEAPQRAWLWLGWLSAATVAGWVLDAVTARIGIELGFAVLNHTQHDVADRLPVVRLDWFTAENTATARQAIAATGPELVGLVVNLVTPLTSAILLPAVIALALLPISWQLGVAALAGVPLLLGALWASAAFARRADTAADKANTALTERIIEFARTQQALRAARRVEPARSLVGNALASQHTATMRLLGMQIPGQLLFSIASQLALIVLAGTTAALTITGTLTVPEAIALIVVMVRYLEPFTAVSELAPALESTRATLGRIGSVLTAPVMVAGSGTWRDGAVVPRIEFDDVAFGYDGGSGPVLDGVSFCLQPGTTTAIVGPSGCGKSTILALIAGLHQPTRGRVLIDGTDVATLDARAQQAVCSVVFQHPYLFHGTIRDNVFAADPGASDDQFAQAVRLARVDELIARLPDGANTIVGEAGSALSGGERQRVSIARALLKAAPVLLVDEATSALDAENEAAVVDALAADPRSRTRVIVAHRLASIRHADRVLFVDDGRVVEDGSISELLTAGGRFSQFWRQQHEAAEWQILAE

SEQ ID NO: 148877 - protein, 8 aa, Mycobacterium tuberculosis
MIRTWIAL

SEQ ID NO: 148878 - protein, 8 aa, Mycobacterium tuberculosis
HRARLIGF

SEQ ID NO: 148879 - protein, 8 aa, Mycobacterium tuberculosis
RARLIGFA

SEQ ID NO: 148880 - protein, 8 aa, Mycobacterium tuberculosis
RLIGFALL

SEQ ID NO: 148881 - protein, 8 aa, Mycobacterium tuberculosis
LIGFALLA

SEQ ID NO: 148882 - protein, 8 aa, Mycobacterium tuberculosis
IGFALLAF

SEQ ID NO: 148883 - protein, 8 aa, Mycobacterium tuberculosis
ALLAFCSV

SEQ ID NO: 148884 - protein, 8 aa, Mycobacterium tuberculosis
LLAFCSVV

SEQ ID NO: 148885 - protein, 8 aa, Mycobacterium tuberculosis
LAFCSVVA

SEQ ID NO: 148886 - protein, 8 aa, Mycobacterium tuberculosis
AFCSVVAR

SEQ ID NO: 148887 - protein, 8 aa, Mycobacterium tuberculosis
CSVVARAV

SEQ ID NO: 148888 - protein, 8 aa, Mycobacterium tuberculosis
VARAVGTV

SEQ ID NO: 148889 - protein, 8 aa, Mycobacterium tuberculosis
ARAVGTVL

SEQ ID NO: 148890 - protein, 8 aa, Mycobacterium tuberculosis
RAVGTVLL

SEQ ID NO: 148891 - protein, 8 aa, Mycobacterium tuberculosis
AVGTVLLV

SEQ ID NO: 148892 - protein, 8 aa, Mycobacterium tuberculosis
GTVLLVPL

SEQ ID NO: 148893 - protein, 8 aa, Mycobacterium tuberculosis
VLLVPLMA

SEQ ID NO: 148894 - protein, 8 aa, Mycobacterium tuberculosis
LLVPLMAA

SEQ ID NO: 148895 - protein, 8 aa, Mycobacterium tuberculosis
LVPLMAAL

SEQ ID NO: 148896 - protein, 8 aa, Mycobacterium tuberculosis
VPLMAALF

SEQ ID NO: 148897 - protein, 8 aa, Mycobacterium tuberculosis
LMAALFGE

SEQ ID NO: 148898 - protein, 8 aa, Mycobacterium tuberculosis
MAALFGEA

SEQ ID NO: 148899 - protein, 8 aa, Mycobacterium tuberculosis
ALFGEAPQ

SEQ ID NO: 148900 - protein, 8 aa, Mycobacterium tuberculosis
EAPQRAWL

SEQ ID NO: 148901 - protein, 8 aa, Mycobacterium tuberculosis
APQRAWLW

SEQ ID NO: 148902 - protein, 8 aa, Mycobacterium tuberculosis
RAWLWLGW

SEQ ID NO: 148903 - protein, 8 aa, Mycobacterium tuberculosis
AWLWLGWL

SEQ ID NO: 148904 - protein, 8 aa, Mycobacterium tuberculosis
WLWLGWLS

SEQ ID NO: 148905 - protein, 8 aa, Mycobacterium tuberculosis
WLGWLSAA

SEQ ID NO: 148906 - protein, 8 aa, Mycobacterium tuberculosis
WLSAATVA

SEQ ID NO: 148907 - protein, 8 aa, Mycobacterium tuberculosis
SAATVAGW

SEQ ID NO: 148908 - protein, 8 aa, Mycobacterium tuberculosis
ATVAGWVL

SEQ ID NO: 148909 - protein, 8 aa, Mycobacterium tuberculosis
WVLDAVTA

SEQ ID NO: 148910 - protein, 8 aa, Mycobacterium tuberculosis
VLDAVTAR

SEQ ID NO: 148911 - protein, 8 aa, Mycobacterium tuberculosis
AVTARIGI

SEQ ID NO: 148912 - protein, 8 aa, Mycobacterium tuberculosis
GIELGFAV

SEQ ID NO: 148913 - protein, 8 aa, Mycobacterium tuberculosis
IELGFAVL

SEQ ID NO: 148914 - protein, 8 aa, Mycobacterium tuberculosis
TQHDVADR

SEQ ID NO: 148915 - protein, 8 aa, Mycobacterium tuberculosis
QHDVADRL

SEQ ID NO: 148916 - protein, 8 aa, Mycobacterium tuberculosis
DVADRLPV

SEQ ID NO: 148917 - protein, 8 aa, Mycobacterium tuberculosis
VADRLPVV

SEQ ID NO: 148918 - protein, 8 aa, Mycobacterium tuberculosis
LPVVRLDW

SEQ ID NO: 148919 - protein, 8 aa, Mycobacterium tuberculosis
PVVRLDWF

SEQ ID NO: 148920 - protein, 8 aa, Mycobacterium tuberculosis
RLDWFTAE

SEQ ID NO: 148921 - protein, 8 aa, Mycobacterium tuberculosis
FTAENTAT

SEQ ID NO: 148922 - protein, 8 aa, Mycobacterium tuberculosis
AENTATAR

SEQ ID NO: 148923 - protein, 8 aa, Mycobacterium tuberculosis
NTATARQA

SEQ ID NO: 148924 - protein, 8 aa, Mycobacterium tuberculosis
TATARQAI

SEQ ID NO: 148925 - protein, 8 aa, Mycobacterium tuberculosis
IAATGPEL

SEQ ID NO: 148926 - protein, 8 aa, Mycobacterium tuberculosis
AATGPELV

SEQ ID NO: 148927 - protein, 8 aa, Mycobacterium tuberculosis
PELVGLVV

SEQ ID NO: 148928 - protein, 8 aa, Mycobacterium tuberculosis
LVGLVVNL

SEQ ID NO: 148929 - protein, 8 aa, Mycobacterium tuberculosis
VVNLVTPL

SEQ ID NO: 148930 - protein, 8 aa, Mycobacterium tuberculosis
LVTPLTSA

SEQ ID NO: 148931 - protein, 8 aa, Mycobacterium tuberculosis
TPLTSAIL

SEQ ID NO: 148932 - protein, 8 aa, Mycobacterium tuberculosis
PLTSAILL

SEQ ID NO: 148933 - protein, 8 aa, Mycobacterium tuberculosis
TSAILLPA

SEQ ID NO: 148934 - protein, 8 aa, Mycobacterium tuberculosis
SAILLPAV

SEQ ID NO: 148935 - protein, 8 aa, Mycobacterium tuberculosis
ILLPAVIA

SEQ ID NO: 148936 - protein, 8 aa, Mycobacterium tuberculosis
LLPAVIAL

SEQ ID NO: 148937 - protein, 8 aa, Mycobacterium tuberculosis
LPAVIALA

SEQ ID NO: 148938 - protein, 8 aa, Mycobacterium tuberculosis
AVIALALL

SEQ ID NO: 148939 - protein, 8 aa, Mycobacterium tuberculosis
IALALLPI

SEQ ID NO: 148940 - protein, 8 aa, Mycobacterium tuberculosis
LALLPISW

SEQ ID NO: 148941 - protein, 8 aa, Mycobacterium tuberculosis
ALLPISWQ

SEQ ID NO: 148942 - protein, 8 aa, Mycobacterium tuberculosis
LLPISWQL

SEQ ID NO: 148943 - protein, 8 aa, Mycobacterium tuberculosis
PISWQLGV

SEQ ID NO: 148944 - protein, 8 aa, Mycobacterium tuberculosis
WQLGVAAL

SEQ ID NO: 148945 - protein, 8 aa, Mycobacterium tuberculosis
QLGVAALA

SEQ ID NO: 148946 - protein, 8 aa, Mycobacterium tuberculosis
GVAALAGV

SEQ ID NO: 148947 - protein, 8 aa, Mycobacterium tuberculosis
AALAGVPL

SEQ ID NO: 148948 - protein, 8 aa, Mycobacterium tuberculosis
ALAGVPLL

SEQ ID NO: 148949 - protein, 8 aa, Mycobacterium tuberculosis
VPLLLGAL

SEQ ID NO: 148950 - protein, 8 aa, Mycobacterium tuberculosis
LLLGALWA

SEQ ID NO: 148951 - protein, 8 aa, Mycobacterium tuberculosis
LLGALWAS

SEQ ID NO: 148952 - protein, 8 aa, Mycobacterium tuberculosis
GALWASAA

SEQ ID NO: 148953 - protein, 8 aa, Mycobacterium tuberculosis
ALWASAAF

SEQ ID NO: 148954 - protein, 8 aa, Mycobacterium tuberculosis
WASAAFAR

SEQ ID NO: 148955 - protein, 8 aa, Mycobacterium tuberculosis
ASAAFARR

SEQ ID NO: 148956 - protein, 8 aa, Mycobacterium tuberculosis
NTALTERI

SEQ ID NO: 148957 - protein, 8 aa, Mycobacterium tuberculosis
LTERIIEF

SEQ ID NO: 148958 - protein, 8 aa, Mycobacterium tuberculosis
ERIIEFAR

SEQ ID NO: 148959 - protein, 8 aa, Mycobacterium tuberculosis
RIIEFART

SEQ ID NO: 148960 - protein, 8 aa, Mycobacterium tuberculosis
FARTQQAL

SEQ ID NO: 148961 - protein, 8 aa, Mycobacterium tuberculosis
QQALRAAR

SEQ ID NO: 148962 - protein, 8 aa, Mycobacterium tuberculosis
QALRAARR

SEQ ID NO: 148963 - protein, 8 aa, Mycobacterium tuberculosis
ALRAARRV

SEQ ID NO: 148964 - protein, 8 aa, Mycobacterium tuberculosis
AARRVEPA

SEQ ID NO: 148965 - protein, 8 aa, Mycobacterium tuberculosis
RVEPARSL

SEQ ID NO: 148966 - protein, 8 aa, Mycobacterium tuberculosis
SLVGNALA

SEQ ID NO: 148967 - protein, 8 aa, Mycobacterium tuberculosis
ALASQHTA

SEQ ID NO: 148968 - protein, 8 aa, Mycobacterium tuberculosis
LASQHTAT

SEQ ID NO: 148969 - protein, 8 aa, Mycobacterium tuberculosis
SQHTATMR

SEQ ID NO: 148970 - protein, 8 aa, Mycobacterium tuberculosis
QHTATMRL

SEQ ID NO: 148971 - protein, 8 aa, Mycobacterium tuberculosis
HTATMRLL

SEQ ID NO: 148972 - protein, 8 aa, Mycobacterium tuberculosis
ATMRLLGM

SEQ ID NO: 148973 - protein, 8 aa, Mycobacterium tuberculosis
RLLGMQIP

SEQ ID NO: 148974 - protein, 8 aa, Mycobacterium tuberculosis
GMQIPGQL

SEQ ID NO: 148975 - protein, 8 aa, Mycobacterium tuberculosis
MQIPGQLL

SEQ ID NO: 148976 - protein, 8 aa, Mycobacterium tuberculosis
QIPGQLLF

SEQ ID NO: 148977 - protein, 8 aa, Mycobacterium tuberculosis
GQLLFSIA

SEQ ID NO: 148978 - protein, 8 aa, Mycobacterium tuberculosis
LLFSIASQ

SEQ ID NO: 148979 - protein, 8 aa, Mycobacterium tuberculosis
FSIASQLA

SEQ ID NO: 148980 - protein, 8 aa, Mycobacterium tuberculosis
SIASQLAL

SEQ ID NO: 148981 - protein, 8 aa, Mycobacterium tuberculosis
SQLALIVL

SEQ ID NO: 148982 - protein, 8 aa, Mycobacterium tuberculosis
QLALIVLA

SEQ ID NO: 148983 - protein, 8 aa, Mycobacterium tuberculosis
ALIVLAGT

SEQ ID NO: 148984 - protein, 8 aa, Mycobacterium tuberculosis
IVLAGTTA

SEQ ID NO: 148985 - protein, 8 aa, Mycobacterium tuberculosis
VLAGTTAA

SEQ ID NO: 148986 - protein, 8 aa, Mycobacterium tuberculosis
LAGTTAAL

SEQ ID NO: 148987 - protein, 8 aa, Mycobacterium tuberculosis
TTAALTIT

SEQ ID NO: 148988 - protein, 8 aa, Mycobacterium tuberculosis
ALTITGTL

SEQ ID NO: 148989 - protein, 8 aa, Mycobacterium tuberculosis
TITGTLTV

SEQ ID NO: 148990 - protein, 8 aa, Mycobacterium tuberculosis
TLTVPEAI

SEQ ID NO: 148991 - protein, 8 aa, Mycobacterium tuberculosis
TVPEAIAL

SEQ ID NO: 148992 - protein, 8 aa, Mycobacterium tuberculosis
VPEAIALI

SEQ ID NO: 148993 - protein, 8 aa, Mycobacterium tuberculosis
EAIALIVV

SEQ ID NO: 148994 - protein, 8 aa, Mycobacterium tuberculosis
AIALIVVM

SEQ ID NO: 148995 - protein, 8 aa, Mycobacterium tuberculosis
IALIVVMV

SEQ ID NO: 148996 - protein, 8 aa, Mycobacterium tuberculosis
ALIVVMVR

SEQ ID NO: 148997 - protein, 8 aa, Mycobacterium tuberculosis
LIVVMVRY

SEQ ID NO: 148998 - protein, 8 aa, Mycobacterium tuberculosis
IVVMVRYL

SEQ ID NO: 148999 - protein, 8 aa, Mycobacterium tuberculosis
MVRYLEPF

SEQ ID NO: 149000 - protein, 8 aa, Mycobacterium tuberculosis
YLEPFTAV

SEQ ID NO: 149001 - protein, 8 aa, Mycobacterium tuberculosis
FTAVSELA

SEQ ID NO: 149002 - protein, 8 aa, Mycobacterium tuberculosis
AVSELAPA

SEQ ID NO: 149003 - protein, 8 aa, Mycobacterium tuberculosis
ELAPALES

SEQ ID NO: 149004 - protein, 8 aa, Mycobacterium tuberculosis
LESTRATL

SEQ ID NO: 149005 - protein, 8 aa, Mycobacterium tuberculosis
STRATLGR

SEQ ID NO: 149006 - protein, 8 aa, Mycobacterium tuberculosis
TLGRIGSV

SEQ ID NO: 149007 - protein, 8 aa, Mycobacterium tuberculosis
RIGSVLTA

SEQ ID NO: 149008 - protein, 8 aa, Mycobacterium tuberculosis
SVLTAPVM

SEQ ID NO: 149009 - protein, 8 aa, Mycobacterium tuberculosis
VLTAPVMV

SEQ ID NO: 149010 - protein, 8 aa, Mycobacterium tuberculosis
LTAPVMVA

SEQ ID NO: 149011 - protein, 8 aa, Mycobacterium tuberculosis
APVMVAGS

SEQ ID NO: 149012 - protein, 8 aa, Mycobacterium tuberculosis
VMVAGSGT

SEQ ID NO: 149013 - protein, 8 aa, Mycobacterium tuberculosis
MVAGSGTW

SEQ ID NO: 149014 - protein, 8 aa, Mycobacterium tuberculosis
VAGSGTWR

SEQ ID NO: 149015 - protein, 8 aa, Mycobacterium tuberculosis
GTWRDGAV

SEQ ID NO: 149016 - protein, 8 aa, Mycobacterium tuberculosis
AVVPRIEF

SEQ ID NO: 149017 - protein, 8 aa, Mycobacterium tuberculosis
IEFDDVAF

SEQ ID NO: 149018 - protein, 8 aa, Mycobacterium tuberculosis
VLDGVSFC

SEQ ID NO: 149019 - protein, 8 aa, Mycobacterium tuberculosis
CLQPGTTT

SEQ ID NO: 149020 - protein, 8 aa, Mycobacterium tuberculosis
LQPGTTTA

SEQ ID NO: 149021 - protein, 8 aa, Mycobacterium tuberculosis
QPGTTTAI

SEQ ID NO: 149022 - protein, 8 aa, Mycobacterium tuberculosis
TTAIVGPS

SEQ ID NO: 149023 - protein, 8 aa, Mycobacterium tuberculosis
ILALIAGL

SEQ ID NO: 149024 - protein, 8 aa, Mycobacterium tuberculosis
ALIAGLHQ

SEQ ID NO: 149025 - protein, 8 aa, Mycobacterium tuberculosis
QPTRGRVL

SEQ ID NO: 149026 - protein, 8 aa, Mycobacterium tuberculosis
VLIDGTDV

SEQ ID NO: 149027 - protein, 8 aa, Mycobacterium tuberculosis
LIDGTDVA

SEQ ID NO: 149028 - protein, 8 aa, Mycobacterium tuberculosis
DVATLDAR

SEQ ID NO: 149029 - protein, 8 aa, Mycobacterium tuberculosis
TLDARAQQ

SEQ ID NO: 149030 - protein, 8 aa, Mycobacterium tuberculosis
AQQAVCSV

SEQ ID NO: 149031 - protein, 8 aa, Mycobacterium tuberculosis
QQAVCSVV

SEQ ID NO: 149032 - protein, 8 aa, Mycobacterium tuberculosis
QAVCSVVF

SEQ ID NO: 149033 - protein, 8 aa, Mycobacterium tuberculosis
AVCSVVFQ

SEQ ID NO: 149034 - protein, 8 aa, Mycobacterium tuberculosis
SVVFQHPY

SEQ ID NO: 149035 - protein, 8 aa, Mycobacterium tuberculosis
VVFQHPYL

SEQ ID NO: 149036 - protein, 8 aa, Mycobacterium tuberculosis
VFQHPYLF

SEQ ID NO: 149037 - protein, 8 aa, Mycobacterium tuberculosis
FQHPYLFH

SEQ ID NO: 149038 - protein, 8 aa, Mycobacterium tuberculosis
HPYLFHGT

SEQ ID NO: 149039 - protein, 8 aa, Mycobacterium tuberculosis
PYLFHGTI

SEQ ID NO: 149040 - protein, 8 aa, Mycobacterium tuberculosis
YLFHGTIR

SEQ ID NO: 149041 - protein, 8 aa, Mycobacterium tuberculosis
GTIRDNVF

SEQ ID NO: 149042 - protein, 8 aa, Mycobacterium tuberculosis
TIRDNVFA

SEQ ID NO: 149043 - protein, 8 aa, Mycobacterium tuberculosis
DQFAQAVR

SEQ ID NO: 149044 - protein, 8 aa, Mycobacterium tuberculosis
AQAVRLAR

SEQ ID NO: 149045 - protein, 8 aa, Mycobacterium tuberculosis
QAVRLARV

SEQ ID NO: 149046 - protein, 8 aa, Mycobacterium tuberculosis
RLARVDEL

SEQ ID NO: 149047 - protein, 8 aa, Mycobacterium tuberculosis
RVDELIAR

SEQ ID NO: 149048 - protein, 8 aa, Mycobacterium tuberculosis
RLPDGANT

SEQ ID NO: 149049 - protein, 8 aa, Mycobacterium tuberculosis
LPDGANTI

SEQ ID NO: 149050 - protein, 8 aa, Mycobacterium tuberculosis
SALSGGER

SEQ ID NO: 149051 - protein, 8 aa, Mycobacterium tuberculosis
ALSGGERQ

SEQ ID NO: 149052 - protein, 8 aa, Mycobacterium tuberculosis
RQRVSIAR

SEQ ID NO: 149053 - protein, 8 aa, Mycobacterium tuberculosis
RVSIARAL

SEQ ID NO: 149054 - protein, 8 aa, Mycobacterium tuberculosis
SIARALLK

SEQ ID NO: 149055 - protein, 8 aa, Mycobacterium tuberculosis
ALLKAAPV

SEQ ID NO: 149056 - protein, 8 aa, Mycobacterium tuberculosis
LLKAAPVL

SEQ ID NO: 149057 - protein, 8 aa, Mycobacterium tuberculosis
KAAPVLLV

SEQ ID NO: 149058 - protein, 8 aa, Mycobacterium tuberculosis
VLLVDEAT

SEQ ID NO: 149059 - protein, 8 aa, Mycobacterium tuberculosis
LLVDEATS

SEQ ID NO: 149060 - protein, 8 aa, Mycobacterium tuberculosis
LVDEATSA

SEQ ID NO: 149061 - protein, 8 aa, Mycobacterium tuberculosis
ALDAENEA

SEQ ID NO: 149062 - protein, 8 aa, Mycobacterium tuberculosis
AENEAAVV

SEQ ID NO: 149063 - protein, 8 aa, Mycobacterium tuberculosis
EAAVVDAL

SEQ ID NO: 149064 - protein, 8 aa, Mycobacterium tuberculosis
AVVDALAA

SEQ ID NO: 149065 - protein, 8 aa, Mycobacterium tuberculosis
DALAADPR

SEQ ID NO: 149066 - protein, 8 aa, Mycobacterium tuberculosis
LAADPRSR

SEQ ID NO: 149067 - protein, 8 aa, Mycobacterium tuberculosis
DPRSRTRV

SEQ ID NO: 149068 - protein, 8 aa, Mycobacterium tuberculosis
RSRTRVIV

SEQ ID NO: 149069 - protein, 8 aa, Mycobacterium tuberculosis
RTRVIVAH

SEQ ID NO: 149070 - protein, 8 aa, Mycobacterium tuberculosis
TRVIVAHR

SEQ ID NO: 149071 - protein, 8 aa, Mycobacterium tuberculosis
RVIVAHRL

SEQ ID NO: 149072 - protein, 8 aa, Mycobacterium tuberculosis
VAHRLASI

SEQ ID NO: 149073 - protein, 8 aa, Mycobacterium tuberculosis
RLASIRHA

SEQ ID NO: 149074 - protein, 8 aa, Mycobacterium tuberculosis
ASIRHADR

SEQ ID NO: 149075 - protein, 8 aa, Mycobacterium tuberculosis
SIRHADRV

SEQ ID NO: 149076 - protein, 8 aa, Mycobacterium tuberculosis
HADRVLFV

SEQ ID NO: 149077 - protein, 8 aa, Mycobacterium tuberculosis
VLFVDDGR

SEQ ID NO: 149078 - protein, 8 aa, Mycobacterium tuberculosis
FVDDGRVV

SEQ ID NO: 149079 - protein, 8 aa, Mycobacterium tuberculosis
RVVEDGSI

SEQ ID NO: 149080 - protein, 8 aa, Mycobacterium tuberculosis
SISELLTA

SEQ ID NO: 149081 - protein, 8 aa, Mycobacterium tuberculosis
ELLTAGGR

SEQ ID NO: 149082 - protein, 8 aa, Mycobacterium tuberculosis
LLTAGGRF

SEQ ID NO: 149083 - protein, 8 aa, Mycobacterium tuberculosis
GRFSQFWR

SEQ ID NO: 149084 - protein, 8 aa, Mycobacterium tuberculosis
SQFWRQQH

SEQ ID NO: 149085 - protein, 8 aa, Mycobacterium tuberculosis
QQHEAAEW

SEQ ID NO: 149086 - protein, 8 aa, Mycobacterium tuberculosis
HEAAEWQI

SEQ ID NO: 149087 - protein, 8 aa, Mycobacterium tuberculosis
EAAEWQIL

SEQ ID NO: 149088 - protein, 9 aa, Mycobacterium tuberculosis
MIRTWIALV

SEQ ID NO: 149089 - protein, 9 aa, Mycobacterium tuberculosis
IALVPNDHR

SEQ ID NO: 149090 - protein, 9 aa, Mycobacterium tuberculosis
ALVPNDHRA

SEQ ID NO: 149091 - protein, 9 aa, Mycobacterium tuberculosis
LVPNDHRAR

SEQ ID NO: 149092 - protein, 9 aa, Mycobacterium tuberculosis
VPNDHRARL

SEQ ID NO: 149093 - protein, 9 aa, Mycobacterium tuberculosis
RARLIGFAL

SEQ ID NO: 149094 - protein, 9 aa, Mycobacterium tuberculosis
RLIGFALLA

SEQ ID NO: 149095 - protein, 9 aa, Mycobacterium tuberculosis
LIGFALLAF

SEQ ID NO: 149096 - protein, 9 aa, Mycobacterium tuberculosis
FALLAFCSV

SEQ ID NO: 149097 - protein, 9 aa, Mycobacterium tuberculosis
ALLAFCSVV

SEQ ID NO: 149098 - protein, 9 aa, Mycobacterium tuberculosis
LLAFCSVVA

SEQ ID NO: 149099 - protein, 9 aa, Mycobacterium tuberculosis
LAFCSVVAR

SEQ ID NO: 149100 - protein, 9 aa, Mycobacterium tuberculosis
FCSVVARAV

SEQ ID NO: 149101 - protein, 9 aa, Mycobacterium tuberculosis
VVARAVGTV

SEQ ID NO: 149102 - protein, 9 aa, Mycobacterium tuberculosis
VARAVGTVL

SEQ ID NO: 149103 - protein, 9 aa, Mycobacterium tuberculosis
ARAVGTVLL

SEQ ID NO: 149104 - protein, 9 aa, Mycobacterium tuberculosis
RAVGTVLLV

SEQ ID NO: 149105 - protein, 9 aa, Mycobacterium tuberculosis
VLLVPLMAA

SEQ ID NO: 149106 - protein, 9 aa, Mycobacterium tuberculosis
LLVPLMAAL

SEQ ID NO: 149107 - protein, 9 aa, Mycobacterium tuberculosis
LVPLMAALF

SEQ ID NO: 149108 - protein, 9 aa, Mycobacterium tuberculosis
LMAALFGEA

SEQ ID NO: 149109 - protein, 9 aa, Mycobacterium tuberculosis
ALFGEAPQR

SEQ ID NO: 149110 - protein, 9 aa, Mycobacterium tuberculosis
GEAPQRAWL

SEQ ID NO: 149111 - protein, 9 aa, Mycobacterium tuberculosis
APQRAWLWL

SEQ ID NO: 149112 - protein, 9 aa, Mycobacterium tuberculosis
RAWLWLGWL

SEQ ID NO: 149113 - protein, 9 aa, Mycobacterium tuberculosis
WLWLGWLSA

SEQ ID NO: 149114 - protein, 9 aa, Mycobacterium tuberculosis
WLGWLSAAT

SEQ ID NO: 149115 - protein, 9 aa, Mycobacterium tuberculosis
LSAATVAGW

SEQ ID NO: 149116 - protein, 9 aa, Mycobacterium tuberculosis
SAATVAGWV

SEQ ID NO: 149117 - protein, 9 aa, Mycobacterium tuberculosis
TVAGWVLDA

SEQ ID NO: 149118 - protein, 9 aa, Mycobacterium tuberculosis
VAGWVLDAV

SEQ ID NO: 149119 - protein, 9 aa, Mycobacterium tuberculosis
WVLDAVTAR

SEQ ID NO: 149120 - protein, 9 aa, Mycobacterium tuberculosis
VLDAVTARI

SEQ ID NO: 149121 - protein, 9 aa, Mycobacterium tuberculosis
DAVTARIGI

SEQ ID NO: 149122 - protein, 9 aa, Mycobacterium tuberculosis
VTARIGIEL

SEQ ID NO: 149123 - protein, 9 aa, Mycobacterium tuberculosis
ARIGIELGF

SEQ ID NO: 149124 - protein, 9 aa, Mycobacterium tuberculosis
RIGIELGFA

SEQ ID NO: 149125 - protein, 9 aa, Mycobacterium tuberculosis
IGIELGFAV

SEQ ID NO: 149126 - protein, 9 aa, Mycobacterium tuberculosis
VLNHTQHDV

SEQ ID NO: 149127 - protein, 9 aa, Mycobacterium tuberculosis
HTQHDVADR

SEQ ID NO: 149128 - protein, 9 aa, Mycobacterium tuberculosis
TQHDVADRL

SEQ ID NO: 149129 - protein, 9 aa, Mycobacterium tuberculosis
DVADRLPVV

SEQ ID NO: 149130 - protein, 9 aa, Mycobacterium tuberculosis
RLPVVRLDW

SEQ ID NO: 149131 - protein, 9 aa, Mycobacterium tuberculosis
LPVVRLDWF

SEQ ID NO: 149132 - protein, 9 aa, Mycobacterium tuberculosis
RLDWFTAEN

SEQ ID NO: 149133 - protein, 9 aa, Mycobacterium tuberculosis
FTAENTATA

SEQ ID NO: 149134 - protein, 9 aa, Mycobacterium tuberculosis
TAENTATAR

SEQ ID NO: 149135 - protein, 9 aa, Mycobacterium tuberculosis
AENTATARQ

SEQ ID NO: 149136 - protein, 9 aa, Mycobacterium tuberculosis
NTATARQAI

SEQ ID NO: 149137 - protein, 9 aa, Mycobacterium tuberculosis
TARQAIAAT

SEQ ID NO: 149138 - protein, 9 aa, Mycobacterium tuberculosis
AIAATGPEL

SEQ ID NO: 149139 - protein, 9 aa, Mycobacterium tuberculosis
IAATGPELV

SEQ ID NO: 149140 - protein, 9 aa, Mycobacterium tuberculosis
ATGPELVGL

SEQ ID NO: 149141 - protein, 9 aa, Mycobacterium tuberculosis
TGPELVGLV

SEQ ID NO: 149142 - protein, 9 aa, Mycobacterium tuberculosis
GPELVGLVV

SEQ ID NO: 149143 - protein, 9 aa, Mycobacterium tuberculosis
ELVGLVVNL

SEQ ID NO: 149144 - protein, 9 aa, Mycobacterium tuberculosis
LVGLVVNLV

SEQ ID NO: 149145 - protein, 9 aa, Mycobacterium tuberculosis
LVVNLVTPL

SEQ ID NO: 149146 - protein, 9 aa, Mycobacterium tuberculosis
NLVTPLTSA

SEQ ID NO: 149147 - protein, 9 aa, Mycobacterium tuberculosis
LVTPLTSAI

SEQ ID NO: 149148 - protein, 9 aa, Mycobacterium tuberculosis
VTPLTSAIL

SEQ ID NO: 149149 - protein, 9 aa, Mycobacterium tuberculosis
TPLTSAILL

SEQ ID NO: 149150 - protein, 9 aa, Mycobacterium tuberculosis
LTSAILLPA

SEQ ID NO: 149151 - protein, 9 aa, Mycobacterium tuberculosis
TSAILLPAV

SEQ ID NO: 149152 - protein, 9 aa, Mycobacterium tuberculosis
SAILLPAVI

SEQ ID NO: 149153 - protein, 9 aa, Mycobacterium tuberculosis
ILLPAVIAL

SEQ ID NO: 149154 - protein, 9 aa, Mycobacterium tuberculosis
LLPAVIALA

SEQ ID NO: 149155 - protein, 9 aa, Mycobacterium tuberculosis
LPAVIALAL

SEQ ID NO: 149156 - protein, 9 aa, Mycobacterium tuberculosis
VIALALLPI

SEQ ID NO: 149157 - protein, 9 aa, Mycobacterium tuberculosis
ALLPISWQL

SEQ ID NO: 149158 - protein, 9 aa, Mycobacterium tuberculosis
LPISWQLGV

SEQ ID NO: 149159 - protein, 9 aa, Mycobacterium tuberculosis
ISWQLGVAA

SEQ ID NO: 149160 - protein, 9 aa, Mycobacterium tuberculosis
WQLGVAALA

SEQ ID NO: 149161 - protein, 9 aa, Mycobacterium tuberculosis
LGVAALAGV

SEQ ID NO: 149162 - protein, 9 aa, Mycobacterium tuberculosis
VAALAGVPL

SEQ ID NO: 149163 - protein, 9 aa, Mycobacterium tuberculosis
AALAGVPLL

SEQ ID NO: 149164 - protein, 9 aa, Mycobacterium tuberculosis
ALAGVPLLL

SEQ ID NO: 149165 - protein, 9 aa, Mycobacterium tuberculosis
GVPLLLGAL

SEQ ID NO: 149166 - protein, 9 aa, Mycobacterium tuberculosis
VPLLLGALW

SEQ ID NO: 149167 - protein, 9 aa, Mycobacterium tuberculosis
PLLLGALWA

SEQ ID NO: 149168 - protein, 9 aa, Mycobacterium tuberculosis
LLLGALWAS

SEQ ID NO: 149169 - protein, 9 aa, Mycobacterium tuberculosis
LLGALWASA

SEQ ID NO: 149170 - protein, 9 aa, Mycobacterium tuberculosis
GALWASAAF

SEQ ID NO: 149171 - protein, 9 aa, Mycobacterium tuberculosis
ALWASAAFA

SEQ ID NO: 149172 - protein, 9 aa, Mycobacterium tuberculosis
LWASAAFAR

SEQ ID NO: 149173 - protein, 9 aa, Mycobacterium tuberculosis
WASAAFARR

SEQ ID NO: 149174 - protein, 9 aa, Mycobacterium tuberculosis
FARRADTAA

SEQ ID NO: 149175 - protein, 9 aa, Mycobacterium tuberculosis
RRADTAADK

SEQ ID NO: 149176 - protein, 9 aa, Mycobacterium tuberculosis
DTAADKANT

SEQ ID NO: 149177 - protein, 9 aa, Mycobacterium tuberculosis
AADKANTAL

SEQ ID NO: 149178 - protein, 9 aa, Mycobacterium tuberculosis
KANTALTER

SEQ ID NO: 149179 - protein, 9 aa, Mycobacterium tuberculosis
ALTERIIEF

SEQ ID NO: 149180 - protein, 9 aa, Mycobacterium tuberculosis
LTERIIEFA

SEQ ID NO: 149181 - protein, 9 aa, Mycobacterium tuberculosis
TERIIEFAR

SEQ ID NO: 149182 - protein, 9 aa, Mycobacterium tuberculosis
EFARTQQAL

SEQ ID NO: 149183 - protein, 9 aa, Mycobacterium tuberculosis
FARTQQALR

SEQ ID NO: 149184 - protein, 9 aa, Mycobacterium tuberculosis
TQQALRAAR

SEQ ID NO: 149185 - protein, 9 aa, Mycobacterium tuberculosis
QQALRAARR

SEQ ID NO: 149186 - protein, 9 aa, Mycobacterium tuberculosis
RAARRVEPA

SEQ ID NO: 149187 - protein, 9 aa, Mycobacterium tuberculosis
AARRVEPAR

SEQ ID NO: 149188 - protein, 9 aa, Mycobacterium tuberculosis
RRVEPARSL

SEQ ID NO: 149189 - protein, 9 aa, Mycobacterium tuberculosis
RVEPARSLV

SEQ ID NO: 149190 - protein, 9 aa, Mycobacterium tuberculosis
SLVGNALAS

SEQ ID NO: 149191 - protein, 9 aa, Mycobacterium tuberculosis
NALASQHTA

SEQ ID NO: 149192 - protein, 9 aa, Mycobacterium tuberculosis
ALASQHTAT

SEQ ID NO: 149193 - protein, 9 aa, Mycobacterium tuberculosis
LASQHTATM

SEQ ID NO: 149194 - protein, 9 aa, Mycobacterium tuberculosis
ASQHTATMR

SEQ ID NO: 149195 - protein, 9 aa, Mycobacterium tuberculosis
SQHTATMRL

SEQ ID NO: 149196 - protein, 9 aa, Mycobacterium tuberculosis
TMRLLGMQI

SEQ ID NO: 149197 - protein, 9 aa, Mycobacterium tuberculosis
RLLGMQIPG

SEQ ID NO: 149198 - protein, 9 aa, Mycobacterium tuberculosis
GMQIPGQLL

SEQ ID NO: 149199 - protein, 9 aa, Mycobacterium tuberculosis
MQIPGQLLF

SEQ ID NO: 149200 - protein, 9 aa, Mycobacterium tuberculosis
IPGQLLFSI

SEQ ID NO: 149201 - protein, 9 aa, Mycobacterium tuberculosis
QLLFSIASQ

SEQ ID NO: 149202 - protein, 9 aa, Mycobacterium tuberculosis
LLFSIASQL

SEQ ID NO: 149203 - protein, 9 aa, Mycobacterium tuberculosis
FSIASQLAL

SEQ ID NO: 149204 - protein, 9 aa, Mycobacterium tuberculosis
SIASQLALI

SEQ ID NO: 149205 - protein, 9 aa, Mycobacterium tuberculosis
IASQLALIV

SEQ ID NO: 149206 - protein, 9 aa, Mycobacterium tuberculosis
SQLALIVLA

SEQ ID NO: 149207 - protein, 9 aa, Mycobacterium tuberculosis
LIVLAGTTA

SEQ ID NO: 149208 - protein, 9 aa, Mycobacterium tuberculosis
IVLAGTTAA

SEQ ID NO: 149209 - protein, 9 aa, Mycobacterium tuberculosis
VLAGTTAAL

SEQ ID NO: 149210 - protein, 9 aa, Mycobacterium tuberculosis
TAALTITGT

SEQ ID NO: 149211 - protein, 9 aa, Mycobacterium tuberculosis
AALTITGTL

SEQ ID NO: 149212 - protein, 9 aa, Mycobacterium tuberculosis
LTITGTLTV

SEQ ID NO: 149213 - protein, 9 aa, Mycobacterium tuberculosis
LTVPEAIAL

SEQ ID NO: 149214 - protein, 9 aa, Mycobacterium tuberculosis
TVPEAIALI

SEQ ID NO: 149215 - protein, 9 aa, Mycobacterium tuberculosis
EAIALIVVM

SEQ ID NO: 149216 - protein, 9 aa, Mycobacterium tuberculosis
AIALIVVMV

SEQ ID NO: 149217 - protein, 9 aa, Mycobacterium tuberculosis
IALIVVMVR

SEQ ID NO: 149218 - protein, 9 aa, Mycobacterium tuberculosis
ALIVVMVRY

SEQ ID NO: 149219 - protein, 9 aa, Mycobacterium tuberculosis
LIVVMVRYL

SEQ ID NO: 149220 - protein, 9 aa, Mycobacterium tuberculosis
VMVRYLEPF

SEQ ID NO: 149221 - protein, 9 aa, Mycobacterium tuberculosis
MVRYLEPFT

SEQ ID NO: 149222 - protein, 9 aa, Mycobacterium tuberculosis
RYLEPFTAV

SEQ ID NO: 149223 - protein, 9 aa, Mycobacterium tuberculosis
YLEPFTAVS

SEQ ID NO: 149224 - protein, 9 aa, Mycobacterium tuberculosis
EPFTAVSEL

SEQ ID NO: 149225 - protein, 9 aa, Mycobacterium tuberculosis
TAVSELAPA

SEQ ID NO: 149226 - protein, 9 aa, Mycobacterium tuberculosis
AVSELAPAL

SEQ ID NO: 149227 - protein, 9 aa, Mycobacterium tuberculosis
ELAPALEST

SEQ ID NO: 149228 - protein, 9 aa, Mycobacterium tuberculosis
LAPALESTR

SEQ ID NO: 149229 - protein, 9 aa, Mycobacterium tuberculosis
APALESTRA

SEQ ID NO: 149230 - protein, 9 aa, Mycobacterium tuberculosis
ALESTRATL

SEQ ID NO: 149231 - protein, 9 aa, Mycobacterium tuberculosis
ESTRATLGR

SEQ ID NO: 149232 - protein, 9 aa, Mycobacterium tuberculosis
STRATLGRI

SEQ ID NO: 149233 - protein, 9 aa, Mycobacterium tuberculosis
ATLGRIGSV

SEQ ID NO: 149234 - protein, 9 aa, Mycobacterium tuberculosis
TLGRIGSVL

SEQ ID NO: 149235 - protein, 9 aa, Mycobacterium tuberculosis
GRIGSVLTA

SEQ ID NO: 149236 - protein, 9 aa, Mycobacterium tuberculosis
IGSVLTAPV

SEQ ID NO: 149237 - protein, 9 aa, Mycobacterium tuberculosis
SVLTAPVMV

SEQ ID NO: 149238 - protein, 9 aa, Mycobacterium tuberculosis
VLTAPVMVA

SEQ ID NO: 149239 - protein, 9 aa, Mycobacterium tuberculosis
APVMVAGSG

SEQ ID NO: 149240 - protein, 9 aa, Mycobacterium tuberculosis
VMVAGSGTW

SEQ ID NO: 149241 - protein, 9 aa, Mycobacterium tuberculosis
MVAGSGTWR

SEQ ID NO: 149242 - protein, 9 aa, Mycobacterium tuberculosis
GTWRDGAVV

SEQ ID NO: 149243 - protein, 9 aa, Mycobacterium tuberculosis
WRDGAVVPR

SEQ ID NO: 149244 - protein, 9 aa, Mycobacterium tuberculosis
RIEFDDVAF

SEQ ID NO: 149245 - protein, 9 aa, Mycobacterium tuberculosis
EFDDVAFGY

SEQ ID NO: 149246 - protein, 9 aa, Mycobacterium tuberculosis
GYDGGSGPV

SEQ ID NO: 149247 - protein, 9 aa, Mycobacterium tuberculosis
YDGGSGPVL

SEQ ID NO: 149248 - protein, 9 aa, Mycobacterium tuberculosis
GSGPVLDGV

SEQ ID NO: 149249 - protein, 9 aa, Mycobacterium tuberculosis
GPVLDGVSF

SEQ ID NO: 149250 - protein, 9 aa, Mycobacterium tuberculosis
PVLDGVSFC

SEQ ID NO: 149251 - protein, 9 aa, Mycobacterium tuberculosis
VLDGVSFCL

SEQ ID NO: 149252 - protein, 9 aa, Mycobacterium tuberculosis
CLQPGTTTA

SEQ ID NO: 149253 - protein, 9 aa, Mycobacterium tuberculosis
LQPGTTTAI

SEQ ID NO: 149254 - protein, 9 aa, Mycobacterium tuberculosis
QPGTTTAIV

SEQ ID NO: 149255 - protein, 9 aa, Mycobacterium tuberculosis
TTTAIVGPS

SEQ ID NO: 149256 - protein, 9 aa, Mycobacterium tuberculosis
IVGPSGCGK

SEQ ID NO: 149257 - protein, 9 aa, Mycobacterium tuberculosis
TILALIAGL

SEQ ID NO: 149258 - protein, 9 aa, Mycobacterium tuberculosis
ILALIAGLH

SEQ ID NO: 149259 - protein, 9 aa, Mycobacterium tuberculosis
ALIAGLHQP

SEQ ID NO: 149260 - protein, 9 aa, Mycobacterium tuberculosis
LIAGLHQPT

SEQ ID NO: 149261 - protein, 9 aa, Mycobacterium tuberculosis
IAGLHQPTR

SEQ ID NO: 149262 - protein, 9 aa, Mycobacterium tuberculosis
GLHQPTRGR

SEQ ID NO: 149263 - protein, 9 aa, Mycobacterium tuberculosis
QPTRGRVLI

SEQ ID NO: 149264 - protein, 9 aa, Mycobacterium tuberculosis
VLIDGTDVA

SEQ ID NO: 149265 - protein, 9 aa, Mycobacterium tuberculosis
LIDGTDVAT

SEQ ID NO: 149266 - protein, 9 aa, Mycobacterium tuberculosis
DVATLDARA

SEQ ID NO: 149267 - protein, 9 aa, Mycobacterium tuberculosis
TLDARAQQA

SEQ ID NO: 149268 - protein, 9 aa, Mycobacterium tuberculosis
RAQQAVCSV

SEQ ID NO: 149269 - protein, 9 aa, Mycobacterium tuberculosis
AQQAVCSVV

SEQ ID NO: 149270 - protein, 9 aa, Mycobacterium tuberculosis
QQAVCSVVF

SEQ ID NO: 149271 - protein, 9 aa, Mycobacterium tuberculosis
AVCSVVFQH

SEQ ID NO: 149272 - protein, 9 aa, Mycobacterium tuberculosis
CSVVFQHPY

SEQ ID NO: 149273 - protein, 9 aa, Mycobacterium tuberculosis
SVVFQHPYL

SEQ ID NO: 149274 - protein, 9 aa, Mycobacterium tuberculosis
VVFQHPYLF

SEQ ID NO: 149275 - protein, 9 aa, Mycobacterium tuberculosis
FQHPYLFHG

SEQ ID NO: 149276 - protein, 9 aa, Mycobacterium tuberculosis
HPYLFHGTI

SEQ ID NO: 149277 - protein, 9 aa, Mycobacterium tuberculosis
PYLFHGTIR

SEQ ID NO: 149278 - protein, 9 aa, Mycobacterium tuberculosis
YLFHGTIRD

SEQ ID NO: 149279 - protein, 9 aa, Mycobacterium tuberculosis
TIRDNVFAA

SEQ ID NO: 149280 - protein, 9 aa, Mycobacterium tuberculosis
NVFAADPGA

SEQ ID NO: 149281 - protein, 9 aa, Mycobacterium tuberculosis
DPGASDDQF

SEQ ID NO: 149282 - protein, 9 aa, Mycobacterium tuberculosis
SDDQFAQAV

SEQ ID NO: 149283 - protein, 9 aa, Mycobacterium tuberculosis
FAQAVRLAR

SEQ ID NO: 149284 - protein, 9 aa, Mycobacterium tuberculosis
AQAVRLARV

SEQ ID NO: 149285 - protein, 9 aa, Mycobacterium tuberculosis
RLARVDELI

SEQ ID NO: 149286 - protein, 9 aa, Mycobacterium tuberculosis
RVDELIARL

SEQ ID NO: 149287 - protein, 9 aa, Mycobacterium tuberculosis
LIARLPDGA

SEQ ID NO: 149288 - protein, 9 aa, Mycobacterium tuberculosis
RLPDGANTI

SEQ ID NO: 149289 - protein, 9 aa, Mycobacterium tuberculosis
LPDGANTIV

SEQ ID NO: 149290 - protein, 9 aa, Mycobacterium tuberculosis
GANTIVGEA

SEQ ID NO: 149291 - protein, 9 aa, Mycobacterium tuberculosis
IVGEAGSAL

SEQ ID NO: 149292 - protein, 9 aa, Mycobacterium tuberculosis
RQRVSIARA

SEQ ID NO: 149293 - protein, 9 aa, Mycobacterium tuberculosis
QRVSIARAL

SEQ ID NO: 149294 - protein, 9 aa, Mycobacterium tuberculosis
RVSIARALL

SEQ ID NO: 149295 - protein, 9 aa, Mycobacterium tuberculosis
VSIARALLK

SEQ ID NO: 149296 - protein, 9 aa, Mycobacterium tuberculosis
SIARALLKA

SEQ ID NO: 149297 - protein, 9 aa, Mycobacterium tuberculosis
RALLKAAPV

SEQ ID NO: 149298 - protein, 9 aa, Mycobacterium tuberculosis
ALLKAAPVL

SEQ ID NO: 149299 - protein, 9 aa, Mycobacterium tuberculosis
LLKAAPVLL

SEQ ID NO: 149300 - protein, 9 aa, Mycobacterium tuberculosis
APVLLVDEA

SEQ ID NO: 149301 - protein, 9 aa, Mycobacterium tuberculosis
LLVDEATSA

SEQ ID NO: 149302 - protein, 9 aa, Mycobacterium tuberculosis
LVDEATSAL

SEQ ID NO: 149303 - protein, 9 aa, Mycobacterium tuberculosis
ALDAENEAA

SEQ ID NO: 149304 - protein, 9 aa, Mycobacterium tuberculosis
AENEAAVVD

SEQ ID NO: 149305 - protein, 9 aa, Mycobacterium tuberculosis
NEAAVVDAL

SEQ ID NO: 149306 - protein, 9 aa, Mycobacterium tuberculosis
EAAVVDALA

SEQ ID NO: 149307 - protein, 9 aa, Mycobacterium tuberculosis
DPRSRTRVI

SEQ ID NO: 149308 - protein, 9 aa, Mycobacterium tuberculosis
RTRVIVAHR

SEQ ID NO: 149309 - protein, 9 aa, Mycobacterium tuberculosis
IVAHRLASI

SEQ ID NO: 149310 - protein, 9 aa, Mycobacterium tuberculosis
VAHRLASIR

SEQ ID NO: 149311 - protein, 9 aa, Mycobacterium tuberculosis
LASIRHADR

SEQ ID NO: 149312 - protein, 9 aa, Mycobacterium tuberculosis
SIRHADRVL

SEQ ID NO: 149313 - protein, 9 aa, Mycobacterium tuberculosis
RHADRVLFV

SEQ ID NO: 149314 - protein, 9 aa, Mycobacterium tuberculosis
RVLFVDDGR

SEQ ID NO: 149315 - protein, 9 aa, Mycobacterium tuberculosis
VLFVDDGRV

SEQ ID NO: 149316 - protein, 9 aa, Mycobacterium tuberculosis
FVDDGRVVE

SEQ ID NO: 149317 - protein, 9 aa, Mycobacterium tuberculosis
VEDGSISEL

SEQ ID NO: 149318 - protein, 9 aa, Mycobacterium tuberculosis
LTAGGRFSQ

SEQ ID NO: 149319 - protein, 9 aa, Mycobacterium tuberculosis
GGRFSQFWR

SEQ ID NO: 149320 - protein, 9 aa, Mycobacterium tuberculosis
SQFWRQQHE

SEQ ID NO: 149321 - protein, 9 aa, Mycobacterium tuberculosis
RQQHEAAEW

SEQ ID NO: 149322 - protein, 9 aa, Mycobacterium tuberculosis
HEAAEWQIL

SEQ ID NO: 149323 - protein, 9 aa, Mycobacterium tuberculosis
EAAEWQILA

SEQ ID NO: 149324 - protein, 10 aa, Mycobacterium tuberculosis
WIALVPNDHR

SEQ ID NO: 149325 - protein, 10 aa, Mycobacterium tuberculosis
ALVPNDHRAR

SEQ ID NO: 149326 - protein, 10 aa, Mycobacterium tuberculosis
LVPNDHRARL

SEQ ID NO: 149327 - protein, 10 aa, Mycobacterium tuberculosis
VPNDHRARLI

SEQ ID NO: 149328 - protein, 10 aa, Mycobacterium tuberculosis
HRARLIGFAL

SEQ ID NO: 149329 - protein, 10 aa, Mycobacterium tuberculosis
RARLIGFALL

SEQ ID NO: 149330 - protein, 10 aa, Mycobacterium tuberculosis
RLIGFALLAF

SEQ ID NO: 149331 - protein, 10 aa, Mycobacterium tuberculosis
FALLAFCSVV

SEQ ID NO: 149332 - protein, 10 aa, Mycobacterium tuberculosis
ALLAFCSVVA

SEQ ID NO: 149333 - protein, 10 aa, Mycobacterium tuberculosis
LLAFCSVVAR

SEQ ID NO: 149334 - protein, 10 aa, Mycobacterium tuberculosis
LAFCSVVARA

SEQ ID NO: 149335 - protein, 10 aa, Mycobacterium tuberculosis
SVVARAVGTV

SEQ ID NO: 149336 - protein, 10 aa, Mycobacterium tuberculosis
VVARAVGTVL

SEQ ID NO: 149337 - protein, 10 aa, Mycobacterium tuberculosis
VARAVGTVLL

SEQ ID NO: 149338 - protein, 10 aa, Mycobacterium tuberculosis
AVGTVLLVPL

SEQ ID NO: 149339 - protein, 10 aa, Mycobacterium tuberculosis
TVLLVPLMAA

SEQ ID NO: 149340 - protein, 10 aa, Mycobacterium tuberculosis
VLLVPLMAAL

SEQ ID NO: 149341 - protein, 10 aa, Mycobacterium tuberculosis
LLVPLMAALF

SEQ ID NO: 149342 - protein, 10 aa, Mycobacterium tuberculosis
PLMAALFGEA

SEQ ID NO: 149343 - protein, 10 aa, Mycobacterium tuberculosis
MAALFGEAPQ

SEQ ID NO: 149344 - protein, 10 aa, Mycobacterium tuberculosis
AALFGEAPQR

SEQ ID NO: 149345 - protein, 10 aa, Mycobacterium tuberculosis
ALFGEAPQRA

SEQ ID NO: 149346 - protein, 10 aa, Mycobacterium tuberculosis
GEAPQRAWLW

SEQ ID NO: 149347 - protein, 10 aa, Mycobacterium tuberculosis
EAPQRAWLWL

SEQ ID NO: 149348 - protein, 10 aa, Mycobacterium tuberculosis
QRAWLWLGWL

SEQ ID NO: 149349 - protein, 10 aa, Mycobacterium tuberculosis
WLWLGWLSAA

SEQ ID NO: 149350 - protein, 10 aa, Mycobacterium tuberculosis
WLGWLSAATV

SEQ ID NO: 149351 - protein, 10 aa, Mycobacterium tuberculosis
WLSAATVAGW

SEQ ID NO: 149352 - protein, 10 aa, Mycobacterium tuberculosis
LSAATVAGWV

SEQ ID NO: 149353 - protein, 10 aa, Mycobacterium tuberculosis
SAATVAGWVL

SEQ ID NO: 149354 - protein, 10 aa, Mycobacterium tuberculosis
TVAGWVLDAV

SEQ ID NO: 149355 - protein, 10 aa, Mycobacterium tuberculosis
WVLDAVTARI

SEQ ID NO: 149356 - protein, 10 aa, Mycobacterium tuberculosis
AVTARIGIEL

SEQ ID NO: 149357 - protein, 10 aa, Mycobacterium tuberculosis
RIGIELGFAV

SEQ ID NO: 149358 - protein, 10 aa, Mycobacterium tuberculosis
IELGFAVLNH

SEQ ID NO: 149359 - protein, 10 aa, Mycobacterium tuberculosis
AVLNHTQHDV

SEQ ID NO: 149360 - protein, 10 aa, Mycobacterium tuberculosis
VLNHTQHDVA

SEQ ID NO: 149361 - protein, 10 aa, Mycobacterium tuberculosis
HTQHDVADRL

SEQ ID NO: 149362 - protein, 10 aa, Mycobacterium tuberculosis
DVADRLPVVR

SEQ ID NO: 149363 - protein, 10 aa, Mycobacterium tuberculosis
RLPVVRLDWF

SEQ ID NO: 149364 - protein, 10 aa, Mycobacterium tuberculosis
LPVVRLDWFT

SEQ ID NO: 149365 - protein, 10 aa, Mycobacterium tuberculosis
RLDWFTAENT

SEQ ID NO: 149366 - protein, 10 aa, Mycobacterium tuberculosis
FTAENTATAR

SEQ ID NO: 149367 - protein, 10 aa, Mycobacterium tuberculosis
AENTATARQA

SEQ ID NO: 149368 - protein, 10 aa, Mycobacterium tuberculosis
NTATARQAIA

SEQ ID NO: 149369 - protein, 10 aa, Mycobacterium tuberculosis
RQAIAATGPE

SEQ ID NO: 149370 - protein, 10 aa, Mycobacterium tuberculosis
QAIAATGPEL

SEQ ID NO: 149371 - protein, 10 aa, Mycobacterium tuberculosis
AIAATGPELV

SEQ ID NO: 149372 - protein, 10 aa, Mycobacterium tuberculosis
ATGPELVGLV

SEQ ID NO: 149373 - protein, 10 aa, Mycobacterium tuberculosis
PELVGLVVNL

SEQ ID NO: 149374 - protein, 10 aa, Mycobacterium tuberculosis
ELVGLVVNLV

SEQ ID NO: 149375 - protein, 10 aa, Mycobacterium tuberculosis
GLVVNLVTPL

SEQ ID NO: 149376 - protein, 10 aa, Mycobacterium tuberculosis
NLVTPLTSAI

SEQ ID NO: 149377 - protein, 10 aa, Mycobacterium tuberculosis
LVTPLTSAIL

SEQ ID NO: 149378 - protein, 10 aa, Mycobacterium tuberculosis
PLTSAILLPA

SEQ ID NO: 149379 - protein, 10 aa, Mycobacterium tuberculosis
LTSAILLPAV

SEQ ID NO: 149380 - protein, 10 aa, Mycobacterium tuberculosis
TSAILLPAVI

SEQ ID NO: 149381 - protein, 10 aa, Mycobacterium tuberculosis
AILLPAVIAL

SEQ ID NO: 149382 - protein, 10 aa, Mycobacterium tuberculosis
ILLPAVIALA

SEQ ID NO: 149383 - protein, 10 aa, Mycobacterium tuberculosis
LLPAVIALAL

SEQ ID NO: 149384 - protein, 10 aa, Mycobacterium tuberculosis
LPAVIALALL

SEQ ID NO: 149385 - protein, 10 aa, Mycobacterium tuberculosis
AVIALALLPI

SEQ ID NO: 149386 - protein, 10 aa, Mycobacterium tuberculosis
IALALLPISW

SEQ ID NO: 149387 - protein, 10 aa, Mycobacterium tuberculosis
ALALLPISWQ

SEQ ID NO: 149388 - protein, 10 aa, Mycobacterium tuberculosis
LALLPISWQL

SEQ ID NO: 149389 - protein, 10 aa, Mycobacterium tuberculosis
ALLPISWQLG

SEQ ID NO: 149390 - protein, 10 aa, Mycobacterium tuberculosis
LLPISWQLGV

SEQ ID NO: 149391 - protein, 10 aa, Mycobacterium tuberculosis
LPISWQLGVA

SEQ ID NO: 149392 - protein, 10 aa, Mycobacterium tuberculosis
ISWQLGVAAL

SEQ ID NO: 149393 - protein, 10 aa, Mycobacterium tuberculosis
QLGVAALAGV

SEQ ID NO: 149394 - protein, 10 aa, Mycobacterium tuberculosis
GVAALAGVPL

SEQ ID NO: 149395 - protein, 10 aa, Mycobacterium tuberculosis
AALAGVPLLL

SEQ ID NO: 149396 - protein, 10 aa, Mycobacterium tuberculosis
ALAGVPLLLG

SEQ ID NO: 149397 - protein, 10 aa, Mycobacterium tuberculosis
VPLLLGALWA

SEQ ID NO: 149398 - protein, 10 aa, Mycobacterium tuberculosis
PLLLGALWAS

SEQ ID NO: 149399 - protein, 10 aa, Mycobacterium tuberculosis
LLLGALWASA

SEQ ID NO: 149400 - protein, 10 aa, Mycobacterium tuberculosis
LLGALWASAA

SEQ ID NO: 149401 - protein, 10 aa, Mycobacterium tuberculosis
LGALWASAAF

SEQ ID NO: 149402 - protein, 10 aa, Mycobacterium tuberculosis
GALWASAAFA

SEQ ID NO: 149403 - protein, 10 aa, Mycobacterium tuberculosis
ALWASAAFAR

SEQ ID NO: 149404 - protein, 10 aa, Mycobacterium tuberculosis
LWASAAFARR

SEQ ID NO: 149405 - protein, 10 aa, Mycobacterium tuberculosis
WASAAFARRA

SEQ ID NO: 149406 - protein, 10 aa, Mycobacterium tuberculosis
ARRADTAADK

SEQ ID NO: 149407 - protein, 10 aa, Mycobacterium tuberculosis
DTAADKANTA

SEQ ID NO: 149408 - protein, 10 aa, Mycobacterium tuberculosis
TAADKANTAL

SEQ ID NO: 149409 - protein, 10 aa, Mycobacterium tuberculosis
DKANTALTER

SEQ ID NO: 149410 - protein, 10 aa, Mycobacterium tuberculosis
KANTALTERI

SEQ ID NO: 149411 - protein, 10 aa, Mycobacterium tuberculosis
TALTERIIEF

SEQ ID NO: 149412 - protein, 10 aa, Mycobacterium tuberculosis
ALTERIIEFA

SEQ ID NO: 149413 - protein, 10 aa, Mycobacterium tuberculosis
LTERIIEFAR

SEQ ID NO: 149414 - protein, 10 aa, Mycobacterium tuberculosis
IEFARTQQAL

SEQ ID NO: 149415 - protein, 10 aa, Mycobacterium tuberculosis
EFARTQQALR

SEQ ID NO: 149416 - protein, 10 aa, Mycobacterium tuberculosis
RTQQALRAAR

SEQ ID NO: 149417 - protein, 10 aa, Mycobacterium tuberculosis
TQQALRAARR

SEQ ID NO: 149418 - protein, 10 aa, Mycobacterium tuberculosis
QQALRAARRV

SEQ ID NO: 149419 - protein, 10 aa, Mycobacterium tuberculosis
RAARRVEPAR

SEQ ID NO: 149420 - protein, 10 aa, Mycobacterium tuberculosis
RRVEPARSLV

SEQ ID NO: 149421 - protein, 10 aa, Mycobacterium tuberculosis
EPARSLVGNA

SEQ ID NO: 149422 - protein, 10 aa, Mycobacterium tuberculosis
SLVGNALASQ

SEQ ID NO: 149423 - protein, 10 aa, Mycobacterium tuberculosis
ALASQHTATM

SEQ ID NO: 149424 - protein, 10 aa, Mycobacterium tuberculosis
LASQHTATMR

SEQ ID NO: 149425 - protein, 10 aa, Mycobacterium tuberculosis
SQHTATMRLL

SEQ ID NO: 149426 - protein, 10 aa, Mycobacterium tuberculosis
HTATMRLLGM

SEQ ID NO: 149427 - protein, 10 aa, Mycobacterium tuberculosis
ATMRLLGMQI

SEQ ID NO: 149428 - protein, 10 aa, Mycobacterium tuberculosis
RLLGMQIPGQ

SEQ ID NO: 149429 - protein, 10 aa, Mycobacterium tuberculosis
LLGMQIPGQL

SEQ ID NO: 149430 - protein, 10 aa, Mycobacterium tuberculosis
GMQIPGQLLF

SEQ ID NO: 149431 - protein, 10 aa, Mycobacterium tuberculosis
MQIPGQLLFS

SEQ ID NO: 149432 - protein, 10 aa, Mycobacterium tuberculosis
QIPGQLLFSI

SEQ ID NO: 149433 - protein, 10 aa, Mycobacterium tuberculosis
IPGQLLFSIA

SEQ ID NO: 149434 - protein, 10 aa, Mycobacterium tuberculosis
QLLFSIASQL

SEQ ID NO: 149435 - protein, 10 aa, Mycobacterium tuberculosis
LLFSIASQLA

SEQ ID NO: 149436 - protein, 10 aa, Mycobacterium tuberculosis
FSIASQLALI

SEQ ID NO: 149437 - protein, 10 aa, Mycobacterium tuberculosis
SIASQLALIV

SEQ ID NO: 149438 - protein, 10 aa, Mycobacterium tuberculosis
IASQLALIVL

SEQ ID NO: 149439 - protein, 10 aa, Mycobacterium tuberculosis
QLALIVLAGT

SEQ ID NO: 149440 - protein, 10 aa, Mycobacterium tuberculosis
ALIVLAGTTA

SEQ ID NO: 149441 - protein, 10 aa, Mycobacterium tuberculosis
LIVLAGTTAA

SEQ ID NO: 149442 - protein, 10 aa, Mycobacterium tuberculosis
IVLAGTTAAL

SEQ ID NO: 149443 - protein, 10 aa, Mycobacterium tuberculosis
VLAGTTAALT

SEQ ID NO: 149444 - protein, 10 aa, Mycobacterium tuberculosis
LAGTTAALTI

SEQ ID NO: 149445 - protein, 10 aa, Mycobacterium tuberculosis
TTAALTITGT

SEQ ID NO: 149446 - protein, 10 aa, Mycobacterium tuberculosis
TAALTITGTL

SEQ ID NO: 149447 - protein, 10 aa, Mycobacterium tuberculosis
ALTITGTLTV

SEQ ID NO: 149448 - protein, 10 aa, Mycobacterium tuberculosis
TLTVPEAIAL

SEQ ID NO: 149449 - protein, 10 aa, Mycobacterium tuberculosis
LTVPEAIALI

SEQ ID NO: 149450 - protein, 10 aa, Mycobacterium tuberculosis
TVPEAIALIV

SEQ ID NO: 149451 - protein, 10 aa, Mycobacterium tuberculosis
VPEAIALIVV

SEQ ID NO: 149452 - protein, 10 aa, Mycobacterium tuberculosis
EAIALIVVMV

SEQ ID NO: 149453 - protein, 10 aa, Mycobacterium tuberculosis
AIALIVVMVR

SEQ ID NO: 149454 - protein, 10 aa, Mycobacterium tuberculosis
IALIVVMVRY

SEQ ID NO: 149455 - protein, 10 aa, Mycobacterium tuberculosis
ALIVVMVRYL

SEQ ID NO: 149456 - protein, 10 aa, Mycobacterium tuberculosis
VVMVRYLEPF

SEQ ID NO: 149457 - protein, 10 aa, Mycobacterium tuberculosis
VMVRYLEPFT

SEQ ID NO: 149458 - protein, 10 aa, Mycobacterium tuberculosis
MVRYLEPFTA

SEQ ID NO: 149459 - protein, 10 aa, Mycobacterium tuberculosis
YLEPFTAVSE

SEQ ID NO: 149460 - protein, 10 aa, Mycobacterium tuberculosis
LEPFTAVSEL

SEQ ID NO: 149461 - protein, 10 aa, Mycobacterium tuberculosis
EPFTAVSELA

SEQ ID NO: 149462 - protein, 10 aa, Mycobacterium tuberculosis
FTAVSELAPA

SEQ ID NO: 149463 - protein, 10 aa, Mycobacterium tuberculosis
TAVSELAPAL

SEQ ID NO: 149464 - protein, 10 aa, Mycobacterium tuberculosis
ELAPALESTR

SEQ ID NO: 149465 - protein, 10 aa, Mycobacterium tuberculosis
APALESTRAT

SEQ ID NO: 149466 - protein, 10 aa, Mycobacterium tuberculosis
ESTRATLGRI

SEQ ID NO: 149467 - protein, 10 aa, Mycobacterium tuberculosis
RATLGRIGSV

SEQ ID NO: 149468 - protein, 10 aa, Mycobacterium tuberculosis
TLGRIGSVLT

SEQ ID NO: 149469 - protein, 10 aa, Mycobacterium tuberculosis
RIGSVLTAPV

SEQ ID NO: 149470 - protein, 10 aa, Mycobacterium tuberculosis
SVLTAPVMVA

SEQ ID NO: 149471 - protein, 10 aa, Mycobacterium tuberculosis
LTAPVMVAGS

SEQ ID NO: 149472 - protein, 10 aa, Mycobacterium tuberculosis
APVMVAGSGT

SEQ ID NO: 149473 - protein, 10 aa, Mycobacterium tuberculosis
VMVAGSGTWR

SEQ ID NO: 149474 - protein, 10 aa, Mycobacterium tuberculosis
TWRDGAVVPR

SEQ ID NO: 149475 - protein, 10 aa, Mycobacterium tuberculosis
VVPRIEFDDV

SEQ ID NO: 149476 - protein, 10 aa, Mycobacterium tuberculosis
VPRIEFDDVA

SEQ ID NO: 149477 - protein, 10 aa, Mycobacterium tuberculosis
IEFDDVAFGY

SEQ ID NO: 149478 - protein, 10 aa, Mycobacterium tuberculosis
FGYDGGSGPV

SEQ ID NO: 149479 - protein, 10 aa, Mycobacterium tuberculosis
PVLDGVSFCL

SEQ ID NO: 149480 - protein, 10 aa, Mycobacterium tuberculosis
VLDGVSFCLQ

SEQ ID NO: 149481 - protein, 10 aa, Mycobacterium tuberculosis
CLQPGTTTAI

SEQ ID NO: 149482 - protein, 10 aa, Mycobacterium tuberculosis
LQPGTTTAIV

SEQ ID NO: 149483 - protein, 10 aa, Mycobacterium tuberculosis
AIVGPSGCGK

SEQ ID NO: 149484 - protein, 10 aa, Mycobacterium tuberculosis
GPSGCGKSTI

SEQ ID NO: 149485 - protein, 10 aa, Mycobacterium tuberculosis
STILALIAGL

SEQ ID NO: 149486 - protein, 10 aa, Mycobacterium tuberculosis
ALIAGLHQPT

SEQ ID NO: 149487 - protein, 10 aa, Mycobacterium tuberculosis
LIAGLHQPTR

SEQ ID NO: 149488 - protein, 10 aa, Mycobacterium tuberculosis
GLHQPTRGRV

SEQ ID NO: 149489 - protein, 10 aa, Mycobacterium tuberculosis
LHQPTRGRVL

SEQ ID NO: 149490 - protein, 10 aa, Mycobacterium tuberculosis
VLIDGTDVAT

SEQ ID NO: 149491 - protein, 10 aa, Mycobacterium tuberculosis
LIDGTDVATL

SEQ ID NO: 149492 - protein, 10 aa, Mycobacterium tuberculosis
ATLDARAQQA

SEQ ID NO: 149493 - protein, 10 aa, Mycobacterium tuberculosis
TLDARAQQAV

SEQ ID NO: 149494 - protein, 10 aa, Mycobacterium tuberculosis
RAQQAVCSVV

SEQ ID NO: 149495 - protein, 10 aa, Mycobacterium tuberculosis
AQQAVCSVVF

SEQ ID NO: 149496 - protein, 10 aa, Mycobacterium tuberculosis
VCSVVFQHPY

SEQ ID NO: 149497 - protein, 10 aa, Mycobacterium tuberculosis
CSVVFQHPYL

SEQ ID NO: 149498 - protein, 10 aa, Mycobacterium tuberculosis
SVVFQHPYLF

SEQ ID NO: 149499 - protein, 10 aa, Mycobacterium tuberculosis
VVFQHPYLFH

SEQ ID NO: 149500 - protein, 10 aa, Mycobacterium tuberculosis
FQHPYLFHGT

SEQ ID NO: 149501 - protein, 10 aa, Mycobacterium tuberculosis
HPYLFHGTIR

SEQ ID NO: 149502 - protein, 10 aa, Mycobacterium tuberculosis
FHGTIRDNVF

SEQ ID NO: 149503 - protein, 10 aa, Mycobacterium tuberculosis
GTIRDNVFAA

SEQ ID NO: 149504 - protein, 10 aa, Mycobacterium tuberculosis
ASDDQFAQAV

SEQ ID NO: 149505 - protein, 10 aa, Mycobacterium tuberculosis
QFAQAVRLAR

SEQ ID NO: 149506 - protein, 10 aa, Mycobacterium tuberculosis
FAQAVRLARV

SEQ ID NO: 149507 - protein, 10 aa, Mycobacterium tuberculosis
AVRLARVDEL

SEQ ID NO: 149508 - protein, 10 aa, Mycobacterium tuberculosis
RLARVDELIA

SEQ ID NO: 149509 - protein, 10 aa, Mycobacterium tuberculosis
LARVDELIAR

SEQ ID NO: 149510 - protein, 10 aa, Mycobacterium tuberculosis
ELIARLPDGA

SEQ ID NO: 149511 - protein, 10 aa, Mycobacterium tuberculosis
RLPDGANTIV

SEQ ID NO: 149512 - protein, 10 aa, Mycobacterium tuberculosis
NTIVGEAGSA

SEQ ID NO: 149513 - protein, 10 aa, Mycobacterium tuberculosis
TIVGEAGSAL

SEQ ID NO: 149514 - protein, 10 aa, Mycobacterium tuberculosis
ALSGGERQRV

SEQ ID NO: 149515 - protein, 10 aa, Mycobacterium tuberculosis
RQRVSIARAL

SEQ ID NO: 149516 - protein, 10 aa, Mycobacterium tuberculosis
QRVSIARALL

SEQ ID NO: 149517 - protein, 10 aa, Mycobacterium tuberculosis
RVSIARALLK

SEQ ID NO: 149518 - protein, 10 aa, Mycobacterium tuberculosis
SIARALLKAA

SEQ ID NO: 149519 - protein, 10 aa, Mycobacterium tuberculosis
ALLKAAPVLL

SEQ ID NO: 149520 - protein, 10 aa, Mycobacterium tuberculosis
LLKAAPVLLV

SEQ ID NO: 149521 - protein, 10 aa, Mycobacterium tuberculosis
APVLLVDEAT

SEQ ID NO: 149522 - protein, 10 aa, Mycobacterium tuberculosis
VLLVDEATSA

SEQ ID NO: 149523 - protein, 10 aa, Mycobacterium tuberculosis
LLVDEATSAL

SEQ ID NO: 149524 - protein, 10 aa, Mycobacterium tuberculosis
TSALDAENEA

SEQ ID NO: 149525 - protein, 10 aa, Mycobacterium tuberculosis
SALDAENEAA

SEQ ID NO: 149526 - protein, 10 aa, Mycobacterium tuberculosis
ALDAENEAAV

SEQ ID NO: 149527 - protein, 10 aa, Mycobacterium tuberculosis
AENEAAVVDA

SEQ ID NO: 149528 - protein, 10 aa, Mycobacterium tuberculosis
EAAVVDALAA

SEQ ID NO: 149529 - protein, 10 aa, Mycobacterium tuberculosis
VVDALAADPR

SEQ ID NO: 149530 - protein, 10 aa, Mycobacterium tuberculosis
DALAADPRSR

SEQ ID NO: 149531 - protein, 10 aa, Mycobacterium tuberculosis
ALAADPRSRT

SEQ ID NO: 149532 - protein, 10 aa, Mycobacterium tuberculosis
LAADPRSRTR

SEQ ID NO: 149533 - protein, 10 aa, Mycobacterium tuberculosis
AADPRSRTRV

SEQ ID NO: 149534 - protein, 10 aa, Mycobacterium tuberculosis
DPRSRTRVIV

SEQ ID NO: 149535 - protein, 10 aa, Mycobacterium tuberculosis
SRTRVIVAHR

SEQ ID NO: 149536 - protein, 10 aa, Mycobacterium tuberculosis
RTRVIVAHRL

SEQ ID NO: 149537 - protein, 10 aa, Mycobacterium tuberculosis
VIVAHRLASI

SEQ ID NO: 149538 - protein, 10 aa, Mycobacterium tuberculosis
IVAHRLASIR

SEQ ID NO: 149539 - protein, 10 aa, Mycobacterium tuberculosis
RLASIRHADR

SEQ ID NO: 149540 - protein, 10 aa, Mycobacterium tuberculosis
RVLFVDDGRV

SEQ ID NO: 149541 - protein, 10 aa, Mycobacterium tuberculosis
VLFVDDGRVV

SEQ ID NO: 149542 - protein, 10 aa, Mycobacterium tuberculosis
FVDDGRVVED

SEQ ID NO: 149543 - protein, 10 aa, Mycobacterium tuberculosis
VVEDGSISEL

SEQ ID NO: 149544 - protein, 10 aa, Mycobacterium tuberculosis
VEDGSISELL

SEQ ID NO: 149545 - protein, 10 aa, Mycobacterium tuberculosis
ISELLTAGGR

SEQ ID NO: 149546 - protein, 10 aa, Mycobacterium tuberculosis
SELLTAGGRF

SEQ ID NO: 149547 - protein, 10 aa, Mycobacterium tuberculosis
LLTAGGRFSQ

SEQ ID NO: 149548 - protein, 10 aa, Mycobacterium tuberculosis
LTAGGRFSQF

SEQ ID NO: 149549 - protein, 10 aa, Mycobacterium tuberculosis
TAGGRFSQFW

SEQ ID NO: 149550 - protein, 10 aa, Mycobacterium tuberculosis
AGGRFSQFWR

SEQ ID NO: 149551 - protein, 10 aa, Mycobacterium tuberculosis
SQFWRQQHEA

SEQ ID NO: 149552 - protein, 10 aa, Mycobacterium tuberculosis
QQHEAAEWQI

SEQ ID NO: 149553 - protein, 10 aa, Mycobacterium tuberculosis
QHEAAEWQIL

SEQ ID NO: 149554 - protein, 11 aa, Mycobacterium tuberculosis
TWIALVPNDHR

SEQ ID NO: 149555 - protein, 11 aa, Mycobacterium tuberculosis
WIALVPNDHRA

SEQ ID NO: 149556 - protein, 11 aa, Mycobacterium tuberculosis
IALVPNDHRAR

SEQ ID NO: 149557 - protein, 11 aa, Mycobacterium tuberculosis
ALVPNDHRARL

SEQ ID NO: 149558 - protein, 11 aa, Mycobacterium tuberculosis
HRARLIGFALL

SEQ ID NO: 149559 - protein, 11 aa, Mycobacterium tuberculosis
RARLIGFALLA

SEQ ID NO: 149560 - protein, 11 aa, Mycobacterium tuberculosis
ARLIGFALLAF

SEQ ID NO: 149561 - protein, 11 aa, Mycobacterium tuberculosis
RLIGFALLAFC

SEQ ID NO: 149562 - protein, 11 aa, Mycobacterium tuberculosis
IGFALLAFCSV

SEQ ID NO: 149563 - protein, 11 aa, Mycobacterium tuberculosis
FALLAFCSVVA

SEQ ID NO: 149564 - protein, 11 aa, Mycobacterium tuberculosis
ALLAFCSVVAR

SEQ ID NO: 149565 - protein, 11 aa, Mycobacterium tuberculosis
LLAFCSVVARA

SEQ ID NO: 149566 - protein, 11 aa, Mycobacterium tuberculosis
LAFCSVVARAV

SEQ ID NO: 149567 - protein, 11 aa, Mycobacterium tuberculosis
CSVVARAVGTV

SEQ ID NO: 149568 - protein, 11 aa, Mycobacterium tuberculosis
SVVARAVGTVL

SEQ ID NO: 149569 - protein, 11 aa, Mycobacterium tuberculosis
VVARAVGTVLL

SEQ ID NO: 149570 - protein, 11 aa, Mycobacterium tuberculosis
VARAVGTVLLV

SEQ ID NO: 149571 - protein, 11 aa, Mycobacterium tuberculosis
RAVGTVLLVPL

SEQ ID NO: 149572 - protein, 11 aa, Mycobacterium tuberculosis
TVLLVPLMAAL

SEQ ID NO: 149573 - protein, 11 aa, Mycobacterium tuberculosis
VLLVPLMAALF

SEQ ID NO: 149574 - protein, 11 aa, Mycobacterium tuberculosis
VPLMAALFGEA

SEQ ID NO: 149575 - protein, 11 aa, Mycobacterium tuberculosis
LMAALFGEAPQ

SEQ ID NO: 149576 - protein, 11 aa, Mycobacterium tuberculosis
MAALFGEAPQR

SEQ ID NO: 149577 - protein, 11 aa, Mycobacterium tuberculosis
GEAPQRAWLWL

SEQ ID NO: 149578 - protein, 11 aa, Mycobacterium tuberculosis
PQRAWLWLGWL

SEQ ID NO: 149579 - protein, 11 aa, Mycobacterium tuberculosis
RAWLWLGWLSA

SEQ ID NO: 149580 - protein, 11 aa, Mycobacterium tuberculosis
WLWLGWLSAAT

SEQ ID NO: 149581 - protein, 11 aa, Mycobacterium tuberculosis
LWLGWLSAATV

SEQ ID NO: 149582 - protein, 11 aa, Mycobacterium tuberculosis
WLGWLSAATVA

SEQ ID NO: 149583 - protein, 11 aa, Mycobacterium tuberculosis
GWLSAATVAGW

SEQ ID NO: 149584 - protein, 11 aa, Mycobacterium tuberculosis
WLSAATVAGWV

SEQ ID NO: 149585 - protein, 11 aa, Mycobacterium tuberculosis
LSAATVAGWVL

SEQ ID NO: 149586 - protein, 11 aa, Mycobacterium tuberculosis
ATVAGWVLDAV

SEQ ID NO: 149587 - protein, 11 aa, Mycobacterium tuberculosis
TVAGWVLDAVT

SEQ ID NO: 149588 - protein, 11 aa, Mycobacterium tuberculosis
AGWVLDAVTAR

SEQ ID NO: 149589 - protein, 11 aa, Mycobacterium tuberculosis
VLDAVTARIGI

SEQ ID NO: 149590 - protein, 11 aa, Mycobacterium tuberculosis
DAVTARIGIEL

SEQ ID NO: 149591 - protein, 11 aa, Mycobacterium tuberculosis
VTARIGIELGF

SEQ ID NO: 149592 - protein, 11 aa, Mycobacterium tuberculosis
RIGIELGFAVL

SEQ ID NO: 149593 - protein, 11 aa, Mycobacterium tuberculosis
ELGFAVLNHTQ

SEQ ID NO: 149594 - protein, 11 aa, Mycobacterium tuberculosis
FAVLNHTQHDV

SEQ ID NO: 149595 - protein, 11 aa, Mycobacterium tuberculosis
TQHDVADRLPV

SEQ ID NO: 149596 - protein, 11 aa, Mycobacterium tuberculosis
DVADRLPVVRL

SEQ ID NO: 149597 - protein, 11 aa, Mycobacterium tuberculosis
RLPVVRLDWFT

SEQ ID NO: 149598 - protein, 11 aa, Mycobacterium tuberculosis
LPVVRLDWFTA

SEQ ID NO: 149599 - protein, 11 aa, Mycobacterium tuberculosis
RLDWFTAENTA

SEQ ID NO: 149600 - protein, 11 aa, Mycobacterium tuberculosis
WFTAENTATAR

SEQ ID NO: 149601 - protein, 11 aa, Mycobacterium tuberculosis
FTAENTATARQ

SEQ ID NO: 149602 - protein, 11 aa, Mycobacterium tuberculosis
AENTATARQAI

SEQ ID NO: 149603 - protein, 11 aa, Mycobacterium tuberculosis
NTATARQAIAA

SEQ ID NO: 149604 - protein, 11 aa, Mycobacterium tuberculosis
RQAIAATGPEL

SEQ ID NO: 149605 - protein, 11 aa, Mycobacterium tuberculosis
QAIAATGPELV

SEQ ID NO: 149606 - protein, 11 aa, Mycobacterium tuberculosis
IAATGPELVGL

SEQ ID NO: 149607 - protein, 11 aa, Mycobacterium tuberculosis
AATGPELVGLV

SEQ ID NO: 149608 - protein, 11 aa, Mycobacterium tuberculosis
ATGPELVGLVV

SEQ ID NO: 149609 - protein, 11 aa, Mycobacterium tuberculosis
ELVGLVVNLVT

SEQ ID NO: 149610 - protein, 11 aa, Mycobacterium tuberculosis
VVNLVTPLTSA

SEQ ID NO: 149611 - protein, 11 aa, Mycobacterium tuberculosis
NLVTPLTSAIL

SEQ ID NO: 149612 - protein, 11 aa, Mycobacterium tuberculosis
LVTPLTSAILL

SEQ ID NO: 149613 - protein, 11 aa, Mycobacterium tuberculosis
TPLTSAILLPA

SEQ ID NO: 149614 - protein, 11 aa, Mycobacterium tuberculosis
PLTSAILLPAV

SEQ ID NO: 149615 - protein, 11 aa, Mycobacterium tuberculosis
LTSAILLPAVI

SEQ ID NO: 149616 - protein, 11 aa, Mycobacterium tuberculosis
SAILLPAVIAL

SEQ ID NO: 149617 - protein, 11 aa, Mycobacterium tuberculosis
AILLPAVIALA

SEQ ID NO: 149618 - protein, 11 aa, Mycobacterium tuberculosis
ILLPAVIALAL

SEQ ID NO: 149619 - protein, 11 aa, Mycobacterium tuberculosis
LLPAVIALALL

SEQ ID NO: 149620 - protein, 11 aa, Mycobacterium tuberculosis
LPAVIALALLP

SEQ ID NO: 149621 - protein, 11 aa, Mycobacterium tuberculosis
VIALALLPISW

SEQ ID NO: 149622 - protein, 11 aa, Mycobacterium tuberculosis
ALALLPISWQL

SEQ ID NO: 149623 - protein, 11 aa, Mycobacterium tuberculosis
ALLPISWQLGV

SEQ ID NO: 149624 - protein, 11 aa, Mycobacterium tuberculosis
LLPISWQLGVA

SEQ ID NO: 149625 - protein, 11 aa, Mycobacterium tuberculosis
LPISWQLGVAA

SEQ ID NO: 149626 - protein, 11 aa, Mycobacterium tuberculosis
PISWQLGVAAL

SEQ ID NO: 149627 - protein, 11 aa, Mycobacterium tuberculosis
WQLGVAALAGV

SEQ ID NO: 149628 - protein, 11 aa, Mycobacterium tuberculosis
GVAALAGVPLL

SEQ ID NO: 149629 - protein, 11 aa, Mycobacterium tuberculosis
ALAGVPLLLGA

SEQ ID NO: 149630 - protein, 11 aa, Mycobacterium tuberculosis
VPLLLGALWAS

SEQ ID NO: 149631 - protein, 11 aa, Mycobacterium tuberculosis
PLLLGALWASA

SEQ ID NO: 149632 - protein, 11 aa, Mycobacterium tuberculosis
LLLGALWASAA

SEQ ID NO: 149633 - protein, 11 aa, Mycobacterium tuberculosis
LLGALWASAAF

SEQ ID NO: 149634 - protein, 11 aa, Mycobacterium tuberculosis
GALWASAAFAR

SEQ ID NO: 149635 - protein, 11 aa, Mycobacterium tuberculosis
ALWASAAFARR

SEQ ID NO: 149636 - protein, 11 aa, Mycobacterium tuberculosis
FARRADTAADK

SEQ ID NO: 149637 - protein, 11 aa, Mycobacterium tuberculosis
DTAADKANTAL

SEQ ID NO: 149638 - protein, 11 aa, Mycobacterium tuberculosis
TAADKANTALT

SEQ ID NO: 149639 - protein, 11 aa, Mycobacterium tuberculosis
NTALTERIIEF

SEQ ID NO: 149640 - protein, 11 aa, Mycobacterium tuberculosis
ALTERIIEFAR

SEQ ID NO: 149641 - protein, 11 aa, Mycobacterium tuberculosis
RIIEFARTQQA

SEQ ID NO: 149642 - protein, 11 aa, Mycobacterium tuberculosis
IEFARTQQALR

SEQ ID NO: 149643 - protein, 11 aa, Mycobacterium tuberculosis
FARTQQALRAA

SEQ ID NO: 149644 - protein, 11 aa, Mycobacterium tuberculosis
RTQQALRAARR

SEQ ID NO: 149645 - protein, 11 aa, Mycobacterium tuberculosis
ALRAARRVEPA

SEQ ID NO: 149646 - protein, 11 aa, Mycobacterium tuberculosis
AARRVEPARSL

SEQ ID NO: 149647 - protein, 11 aa, Mycobacterium tuberculosis
EPARSLVGNAL

SEQ ID NO: 149648 - protein, 11 aa, Mycobacterium tuberculosis
NALASQHTATM

SEQ ID NO: 149649 - protein, 11 aa, Mycobacterium tuberculosis
ALASQHTATMR

SEQ ID NO: 149650 - protein, 11 aa, Mycobacterium tuberculosis
LASQHTATMRL

SEQ ID NO: 149651 - protein, 11 aa, Mycobacterium tuberculosis
HTATMRLLGMQ

SEQ ID NO: 149652 - protein, 11 aa, Mycobacterium tuberculosis
RLLGMQIPGQL

SEQ ID NO: 149653 - protein, 11 aa, Mycobacterium tuberculosis
LLGMQIPGQLL

SEQ ID NO: 149654 - protein, 11 aa, Mycobacterium tuberculosis
LGMQIPGQLLF

SEQ ID NO: 149655 - protein, 11 aa, Mycobacterium tuberculosis
MQIPGQLLFSI

SEQ ID NO: 149656 - protein, 11 aa, Mycobacterium tuberculosis
IPGQLLFSIAS

SEQ ID NO: 149657 - protein, 11 aa, Mycobacterium tuberculosis
GQLLFSIASQL

SEQ ID NO: 149658 - protein, 11 aa, Mycobacterium tuberculosis
QLLFSIASQLA

SEQ ID NO: 149659 - protein, 11 aa, Mycobacterium tuberculosis
LLFSIASQLAL

SEQ ID NO: 149660 - protein, 11 aa, Mycobacterium tuberculosis
LFSIASQLALI

SEQ ID NO: 149661 - protein, 11 aa, Mycobacterium tuberculosis
FSIASQLALIV

SEQ ID NO: 149662 - protein, 11 aa, Mycobacterium tuberculosis
SIASQLALIVL

SEQ ID NO: 149663 - protein, 11 aa, Mycobacterium tuberculosis
SQLALIVLAGT

SEQ ID NO: 149664 - protein, 11 aa, Mycobacterium tuberculosis
LALIVLAGTTA

SEQ ID NO: 149665 - protein, 11 aa, Mycobacterium tuberculosis
ALIVLAGTTAA

SEQ ID NO: 149666 - protein, 11 aa, Mycobacterium tuberculosis
LIVLAGTTAAL

SEQ ID NO: 149667 - protein, 11 aa, Mycobacterium tuberculosis
IVLAGTTAALT

SEQ ID NO: 149668 - protein, 11 aa, Mycobacterium tuberculosis
VLAGTTAALTI

SEQ ID NO: 149669 - protein, 11 aa, Mycobacterium tuberculosis
TTAALTITGTL

SEQ ID NO: 149670 - protein, 11 aa, Mycobacterium tuberculosis
AALTITGTLTV

SEQ ID NO: 149671 - protein, 11 aa, Mycobacterium tuberculosis
TITGTLTVPEA

SEQ ID NO: 149672 - protein, 11 aa, Mycobacterium tuberculosis
ITGTLTVPEAI

SEQ ID NO: 149673 - protein, 11 aa, Mycobacterium tuberculosis
TLTVPEAIALI

SEQ ID NO: 149674 - protein, 11 aa, Mycobacterium tuberculosis
LTVPEAIALIV

SEQ ID NO: 149675 - protein, 11 aa, Mycobacterium tuberculosis
TVPEAIALIVV

SEQ ID NO: 149676 - protein, 11 aa, Mycobacterium tuberculosis
VPEAIALIVVM

SEQ ID NO: 149677 - protein, 11 aa, Mycobacterium tuberculosis
EAIALIVVMVR

SEQ ID NO: 149678 - protein, 11 aa, Mycobacterium tuberculosis
AIALIVVMVRY

SEQ ID NO: 149679 - protein, 11 aa, Mycobacterium tuberculosis
IVVMVRYLEPF

SEQ ID NO: 149680 - protein, 11 aa, Mycobacterium tuberculosis
VMVRYLEPFTA

SEQ ID NO: 149681 - protein, 11 aa, Mycobacterium tuberculosis
MVRYLEPFTAV

SEQ ID NO: 149682 - protein, 11 aa, Mycobacterium tuberculosis
YLEPFTAVSEL

SEQ ID NO: 149683 - protein, 11 aa, Mycobacterium tuberculosis
FTAVSELAPAL

SEQ ID NO: 149684 - protein, 11 aa, Mycobacterium tuberculosis
ELAPALESTRA

SEQ ID NO: 149685 - protein, 11 aa, Mycobacterium tuberculosis
APALESTRATL

SEQ ID NO: 149686 - protein, 11 aa, Mycobacterium tuberculosis
ALESTRATLGR

SEQ ID NO: 149687 - protein, 11 aa, Mycobacterium tuberculosis
TRATLGRIGSV

SEQ ID NO: 149688 - protein, 11 aa, Mycobacterium tuberculosis
RATLGRIGSVL

SEQ ID NO: 149689 - protein, 11 aa, Mycobacterium tuberculosis
TLGRIGSVLTA

SEQ ID NO: 149690 - protein, 11 aa, Mycobacterium tuberculosis
GRIGSVLTAPV

SEQ ID NO: 149691 - protein, 11 aa, Mycobacterium tuberculosis
APVMVAGSGTW

SEQ ID NO: 149692 - protein, 11 aa, Mycobacterium tuberculosis
GTWRDGAVVPR

SEQ ID NO: 149693 - protein, 11 aa, Mycobacterium tuberculosis
AVVPRIEFDDV

SEQ ID NO: 149694 - protein, 11 aa, Mycobacterium tuberculosis
VPRIEFDDVAF

SEQ ID NO: 149695 - protein, 11 aa, Mycobacterium tuberculosis
RIEFDDVAFGY

SEQ ID NO: 149696 - protein, 11 aa, Mycobacterium tuberculosis
FGYDGGSGPVL

SEQ ID NO: 149697 - protein, 11 aa, Mycobacterium tuberculosis
GPVLDGVSFCL

SEQ ID NO: 149698 - protein, 11 aa, Mycobacterium tuberculosis
VLDGVSFCLQP

SEQ ID NO: 149699 - protein, 11 aa, Mycobacterium tuberculosis
FCLQPGTTTAI

SEQ ID NO: 149700 - protein, 11 aa, Mycobacterium tuberculosis
CLQPGTTTAIV

SEQ ID NO: 149701 - protein, 11 aa, Mycobacterium tuberculosis
TAIVGPSGCGK

SEQ ID NO: 149702 - protein, 11 aa, Mycobacterium tuberculosis
GPSGCGKSTIL

SEQ ID NO: 149703 - protein, 11 aa, Mycobacterium tuberculosis
STILALIAGLH

SEQ ID NO: 149704 - protein, 11 aa, Mycobacterium tuberculosis
ALIAGLHQPTR

SEQ ID NO: 149705 - protein, 11 aa, Mycobacterium tuberculosis
GLHQPTRGRVL

SEQ ID NO: 149706 - protein, 11 aa, Mycobacterium tuberculosis
VLIDGTDVATL

SEQ ID NO: 149707 - protein, 11 aa, Mycobacterium tuberculosis
DGTDVATLDAR

SEQ ID NO: 149708 - protein, 11 aa, Mycobacterium tuberculosis
ATLDARAQQAV

SEQ ID NO: 149709 - protein, 11 aa, Mycobacterium tuberculosis
TLDARAQQAVC

SEQ ID NO: 149710 - protein, 11 aa, Mycobacterium tuberculosis
RAQQAVCSVVF

SEQ ID NO: 149711 - protein, 11 aa, Mycobacterium tuberculosis
AVCSVVFQHPY

SEQ ID NO: 149712 - protein, 11 aa, Mycobacterium tuberculosis
CSVVFQHPYLF

SEQ ID NO: 149713 - protein, 11 aa, Mycobacterium tuberculosis
SVVFQHPYLFH

SEQ ID NO: 149714 - protein, 11 aa, Mycobacterium tuberculosis
FQHPYLFHGTI

SEQ ID NO: 149715 - protein, 11 aa, Mycobacterium tuberculosis
YLFHGTIRDNV

SEQ ID NO: 149716 - protein, 11 aa, Mycobacterium tuberculosis
LFHGTIRDNVF

SEQ ID NO: 149717 - protein, 11 aa, Mycobacterium tuberculosis
GASDDQFAQAV

SEQ ID NO: 149718 - protein, 11 aa, Mycobacterium tuberculosis
ASDDQFAQAVR

SEQ ID NO: 149719 - protein, 11 aa, Mycobacterium tuberculosis
DQFAQAVRLAR

SEQ ID NO: 149720 - protein, 11 aa, Mycobacterium tuberculosis
AVRLARVDELI

SEQ ID NO: 149721 - protein, 11 aa, Mycobacterium tuberculosis
RLARVDELIAR

SEQ ID NO: 149722 - protein, 11 aa, Mycobacterium tuberculosis
RLPDGANTIVG

SEQ ID NO: 149723 - protein, 11 aa, Mycobacterium tuberculosis
NTIVGEAGSAL

SEQ ID NO: 149724 - protein, 11 aa, Mycobacterium tuberculosis
EAGSALSGGER

SEQ ID NO: 149725 - protein, 11 aa, Mycobacterium tuberculosis
SALSGGERQRV

SEQ ID NO: 149726 - protein, 11 aa, Mycobacterium tuberculosis
RQRVSIARALL

SEQ ID NO: 149727 - protein, 11 aa, Mycobacterium tuberculosis
QRVSIARALLK

SEQ ID NO: 149728 - protein, 11 aa, Mycobacterium tuberculosis
IARALLKAAPV

SEQ ID NO: 149729 - protein, 11 aa, Mycobacterium tuberculosis
ALLKAAPVLLV

SEQ ID NO: 149730 - protein, 11 aa, Mycobacterium tuberculosis
KAAPVLLVDEA

SEQ ID NO: 149731 - protein, 11 aa, Mycobacterium tuberculosis
VLLVDEATSAL

SEQ ID NO: 149732 - protein, 11 aa, Mycobacterium tuberculosis
TSALDAENEAA

SEQ ID NO: 149733 - protein, 11 aa, Mycobacterium tuberculosis
SALDAENEAAV

SEQ ID NO: 149734 - protein, 11 aa, Mycobacterium tuberculosis
ALDAENEAAVV

SEQ ID NO: 149735 - protein, 11 aa, Mycobacterium tuberculosis
AENEAAVVDAL

SEQ ID NO: 149736 - protein, 11 aa, Mycobacterium tuberculosis
AVVDALAADPR

SEQ ID NO: 149737 - protein, 11 aa, Mycobacterium tuberculosis
LAADPRSRTRV

SEQ ID NO: 149738 - protein, 11 aa, Mycobacterium tuberculosis
DPRSRTRVIVA

SEQ ID NO: 149739 - protein, 11 aa, Mycobacterium tuberculosis
RSRTRVIVAHR

SEQ ID NO: 149740 - protein, 11 aa, Mycobacterium tuberculosis
RTRVIVAHRLA

SEQ ID NO: 149741 - protein, 11 aa, Mycobacterium tuberculosis
RVIVAHRLASI

SEQ ID NO: 149742 - protein, 11 aa, Mycobacterium tuberculosis
VIVAHRLASIR

SEQ ID NO: 149743 - protein, 11 aa, Mycobacterium tuberculosis
IVAHRLASIRH

SEQ ID NO: 149744 - protein, 11 aa, Mycobacterium tuberculosis
HRLASIRHADR

SEQ ID NO: 149745 - protein, 11 aa, Mycobacterium tuberculosis
RLASIRHADRV

SEQ ID NO: 149746 - protein, 11 aa, Mycobacterium tuberculosis
SIRHADRVLFV

SEQ ID NO: 149747 - protein, 11 aa, Mycobacterium tuberculosis
RVLFVDDGRVV

SEQ ID NO: 149748 - protein, 11 aa, Mycobacterium tuberculosis
RVVEDGSISEL

SEQ ID NO: 149749 - protein, 11 aa, Mycobacterium tuberculosis
VVEDGSISELL

SEQ ID NO: 149750 - protein, 11 aa, Mycobacterium tuberculosis
SISELLTAGGR

SEQ ID NO: 149751 - protein, 11 aa, Mycobacterium tuberculosis
ELLTAGGRFSQ

SEQ ID NO: 149752 - protein, 11 aa, Mycobacterium tuberculosis
LLTAGGRFSQF

SEQ ID NO: 149753 - protein, 11 aa, Mycobacterium tuberculosis
LTAGGRFSQFW

SEQ ID NO: 149754 - protein, 11 aa, Mycobacterium tuberculosis
TAGGRFSQFWR

SEQ ID NO: 149755 - protein, 11 aa, Mycobacterium tuberculosis
GRFSQFWRQQH

SEQ ID NO: 149756 - protein, 11 aa, Mycobacterium tuberculosis
SQFWRQQHEAA

SEQ ID NO: 149757 - protein, 11 aa, Mycobacterium tuberculosis
FWRQQHEAAEW

SEQ ID NO: 149758 - protein, 11 aa, Mycobacterium tuberculosis
RQQHEAAEWQI

SEQ ID NO: 149759 - protein, 11 aa, Mycobacterium tuberculosis
QQHEAAEWQIL

SEQ ID NO: 149760 - protein, 13 aa, Mycobacterium tuberculosis
MIRTWIALVPNDH

SEQ ID NO: 149761 - protein, 13 aa, Mycobacterium tuberculosis
IRTWIALVPNDHR

SEQ ID NO: 149762 - protein, 13 aa, Mycobacterium tuberculosis
RTWIALVPNDHRA

SEQ ID NO: 149763 - protein, 13 aa, Mycobacterium tuberculosis
TWIALVPNDHRAR

SEQ ID NO: 149764 - protein, 13 aa, Mycobacterium tuberculosis
WIALVPNDHRARL

SEQ ID NO: 149765 - protein, 13 aa, Mycobacterium tuberculosis
IALVPNDHRARLI

SEQ ID NO: 149766 - protein, 13 aa, Mycobacterium tuberculosis
ALVPNDHRARLIG

SEQ ID NO: 149767 - protein, 13 aa, Mycobacterium tuberculosis
LVPNDHRARLIGF

SEQ ID NO: 149768 - protein, 13 aa, Mycobacterium tuberculosis
VPNDHRARLIGFA

SEQ ID NO: 149769 - protein, 13 aa, Mycobacterium tuberculosis
PNDHRARLIGFAL

SEQ ID NO: 149770 - protein, 13 aa, Mycobacterium tuberculosis
NDHRARLIGFALL

SEQ ID NO: 149771 - protein, 13 aa, Mycobacterium tuberculosis
DHRARLIGFALLA

SEQ ID NO: 149772 - protein, 13 aa, Mycobacterium tuberculosis
HRARLIGFALLAF

SEQ ID NO: 149773 - protein, 13 aa, Mycobacterium tuberculosis
RARLIGFALLAFC

SEQ ID NO: 149774 - protein, 13 aa, Mycobacterium tuberculosis
ARLIGFALLAFCS

SEQ ID NO: 149775 - protein, 13 aa, Mycobacterium tuberculosis
RLIGFALLAFCSV

SEQ ID NO: 149776 - protein, 13 aa, Mycobacterium tuberculosis
LIGFALLAFCSVV

SEQ ID NO: 149777 - protein, 13 aa, Mycobacterium tuberculosis
IGFALLAFCSVVA

SEQ ID NO: 149778 - protein, 13 aa, Mycobacterium tuberculosis
GFALLAFCSVVAR

SEQ ID NO: 149779 - protein, 13 aa, Mycobacterium tuberculosis
FALLAFCSVVARA

SEQ ID NO: 149780 - protein, 13 aa, Mycobacterium tuberculosis
ALLAFCSVVARAV

SEQ ID NO: 149781 - protein, 13 aa, Mycobacterium tuberculosis
LLAFCSVVARAVG

SEQ ID NO: 149782 - protein, 13 aa, Mycobacterium tuberculosis
LAFCSVVARAVGT

SEQ ID NO: 149783 - protein, 13 aa, Mycobacterium tuberculosis
AFCSVVARAVGTV

SEQ ID NO: 149784 - protein, 13 aa, Mycobacterium tuberculosis
FCSVVARAVGTVL

SEQ ID NO: 149785 - protein, 13 aa, Mycobacterium tuberculosis
CSVVARAVGTVLL

SEQ ID NO: 149786 - protein, 13 aa, Mycobacterium tuberculosis
SVVARAVGTVLLV

SEQ ID NO: 149787 - protein, 13 aa, Mycobacterium tuberculosis
VVARAVGTVLLVP

SEQ ID NO: 149788 - protein, 13 aa, Mycobacterium tuberculosis
VARAVGTVLLVPL

SEQ ID NO: 149789 - protein, 13 aa, Mycobacterium tuberculosis
ARAVGTVLLVPLM

SEQ ID NO: 149790 - protein, 13 aa, Mycobacterium tuberculosis
RAVGTVLLVPLMA

SEQ ID NO: 149791 - protein, 13 aa, Mycobacterium tuberculosis
AVGTVLLVPLMAA

SEQ ID NO: 149792 - protein, 13 aa, Mycobacterium tuberculosis
VGTVLLVPLMAAL

SEQ ID NO: 149793 - protein, 13 aa, Mycobacterium tuberculosis
GTVLLVPLMAALF

SEQ ID NO: 149794 - protein, 13 aa, Mycobacterium tuberculosis
TVLLVPLMAALFG

SEQ ID NO: 149795 - protein, 13 aa, Mycobacterium tuberculosis
VLLVPLMAALFGE

SEQ ID NO: 149796 - protein, 13 aa, Mycobacterium tuberculosis
LLVPLMAALFGEA

SEQ ID NO: 149797 - protein, 13 aa, Mycobacterium tuberculosis
LVPLMAALFGEAP

SEQ ID NO: 149798 - protein, 13 aa, Mycobacterium tuberculosis
VPLMAALFGEAPQ

SEQ ID NO: 149799 - protein, 13 aa, Mycobacterium tuberculosis
PLMAALFGEAPQR

SEQ ID NO: 149800 - protein, 13 aa, Mycobacterium tuberculosis
LMAALFGEAPQRA

SEQ ID NO: 149801 - protein, 13 aa, Mycobacterium tuberculosis
MAALFGEAPQRAW

SEQ ID NO: 149802 - protein, 13 aa, Mycobacterium tuberculosis
AALFGEAPQRAWL

SEQ ID NO: 149803 - protein, 13 aa, Mycobacterium tuberculosis
ALFGEAPQRAWLW

SEQ ID NO: 149804 - protein, 13 aa, Mycobacterium tuberculosis
LFGEAPQRAWLWL

SEQ ID NO: 149805 - protein, 13 aa, Mycobacterium tuberculosis
FGEAPQRAWLWLG

SEQ ID NO: 149806 - protein, 13 aa, Mycobacterium tuberculosis
GEAPQRAWLWLGW

SEQ ID NO: 149807 - protein, 13 aa, Mycobacterium tuberculosis
EAPQRAWLWLGWL

SEQ ID NO: 149808 - protein, 13 aa, Mycobacterium tuberculosis
APQRAWLWLGWLS

SEQ ID NO: 149809 - protein, 13 aa, Mycobacterium tuberculosis
PQRAWLWLGWLSA

SEQ ID NO: 149810 - protein, 13 aa, Mycobacterium tuberculosis
QRAWLWLGWLSAA

SEQ ID NO: 149811 - protein, 13 aa, Mycobacterium tuberculosis
RAWLWLGWLSAAT

SEQ ID NO: 149812 - protein, 13 aa, Mycobacterium tuberculosis
AWLWLGWLSAATV

SEQ ID NO: 149813 - protein, 13 aa, Mycobacterium tuberculosis
WLWLGWLSAATVA

SEQ ID NO: 149814 - protein, 13 aa, Mycobacterium tuberculosis
LWLGWLSAATVAG

SEQ ID NO: 149815 - protein, 13 aa, Mycobacterium tuberculosis
WLGWLSAATVAGW

SEQ ID NO: 149816 - protein, 13 aa, Mycobacterium tuberculosis
LGWLSAATVAGWV

SEQ ID NO: 149817 - protein, 13 aa, Mycobacterium tuberculosis
GWLSAATVAGWVL

SEQ ID NO: 149818 - protein, 13 aa, Mycobacterium tuberculosis
WLSAATVAGWVLD

SEQ ID NO: 149819 - protein, 13 aa, Mycobacterium tuberculosis
LSAATVAGWVLDA

SEQ ID NO: 149820 - protein, 13 aa, Mycobacterium tuberculosis
SAATVAGWVLDAV

SEQ ID NO: 149821 - protein, 13 aa, Mycobacterium tuberculosis
AATVAGWVLDAVT

SEQ ID NO: 149822 - protein, 13 aa, Mycobacterium tuberculosis
ATVAGWVLDAVTA

SEQ ID NO: 149823 - protein, 13 aa, Mycobacterium tuberculosis
TVAGWVLDAVTAR

SEQ ID NO: 149824 - protein, 13 aa, Mycobacterium tuberculosis
VAGWVLDAVTARI

SEQ ID NO: 149825 - protein, 13 aa, Mycobacterium tuberculosis
AGWVLDAVTARIG

SEQ ID NO: 149826 - protein, 13 aa, Mycobacterium tuberculosis
GWVLDAVTARIGI

SEQ ID NO: 149827 - protein, 13 aa, Mycobacterium tuberculosis
WVLDAVTARIGIE

SEQ ID NO: 149828 - protein, 13 aa, Mycobacterium tuberculosis
VLDAVTARIGIEL

SEQ ID NO: 149829 - protein, 13 aa, Mycobacterium tuberculosis
LDAVTARIGIELG

SEQ ID NO: 149830 - protein, 13 aa, Mycobacterium tuberculosis
DAVTARIGIELGF

SEQ ID NO: 149831 - protein, 13 aa, Mycobacterium tuberculosis
AVTARIGIELGFA

SEQ ID NO: 149832 - protein, 13 aa, Mycobacterium tuberculosis
VTARIGIELGFAV

SEQ ID NO: 149833 - protein, 13 aa, Mycobacterium tuberculosis
TARIGIELGFAVL

SEQ ID NO: 149834 - protein, 13 aa, Mycobacterium tuberculosis
ARIGIELGFAVLN

SEQ ID NO: 149835 - protein, 13 aa, Mycobacterium tuberculosis
RIGIELGFAVLNH

SEQ ID NO: 149836 - protein, 13 aa, Mycobacterium tuberculosis
IGIELGFAVLNHT

SEQ ID NO: 149837 - protein, 13 aa, Mycobacterium tuberculosis
GIELGFAVLNHTQ

SEQ ID NO: 149838 - protein, 13 aa, Mycobacterium tuberculosis
IELGFAVLNHTQH

SEQ ID NO: 149839 - protein, 13 aa, Mycobacterium tuberculosis
ELGFAVLNHTQHD

SEQ ID NO: 149840 - protein, 13 aa, Mycobacterium tuberculosis
LGFAVLNHTQHDV

SEQ ID NO: 149841 - protein, 13 aa, Mycobacterium tuberculosis
GFAVLNHTQHDVA

SEQ ID NO: 149842 - protein, 13 aa, Mycobacterium tuberculosis
FAVLNHTQHDVAD

SEQ ID NO: 149843 - protein, 13 aa, Mycobacterium tuberculosis
AVLNHTQHDVADR

SEQ ID NO: 149844 - protein, 13 aa, Mycobacterium tuberculosis
VLNHTQHDVADRL

SEQ ID NO: 149845 - protein, 13 aa, Mycobacterium tuberculosis
LNHTQHDVADRLP

SEQ ID NO: 149846 - protein, 13 aa, Mycobacterium tuberculosis
NHTQHDVADRLPV

SEQ ID NO: 149847 - protein, 13 aa, Mycobacterium tuberculosis
HTQHDVADRLPVV

SEQ ID NO: 149848 - protein, 13 aa, Mycobacterium tuberculosis
TQHDVADRLPVVR

SEQ ID NO: 149849 - protein, 13 aa, Mycobacterium tuberculosis
QHDVADRLPVVRL

SEQ ID NO: 149850 - protein, 13 aa, Mycobacterium tuberculosis
HDVADRLPVVRLD

SEQ ID NO: 149851 - protein, 13 aa, Mycobacterium tuberculosis
DVADRLPVVRLDW

SEQ ID NO: 149852 - protein, 13 aa, Mycobacterium tuberculosis
VADRLPVVRLDWF

SEQ ID NO: 149853 - protein, 13 aa, Mycobacterium tuberculosis
ADRLPVVRLDWFT

SEQ ID NO: 149854 - protein, 13 aa, Mycobacterium tuberculosis
DRLPVVRLDWFTA

SEQ ID NO: 149855 - protein, 13 aa, Mycobacterium tuberculosis
RLPVVRLDWFTAE

SEQ ID NO: 149856 - protein, 13 aa, Mycobacterium tuberculosis
LPVVRLDWFTAEN

SEQ ID NO: 149857 - protein, 13 aa, Mycobacterium tuberculosis
PVVRLDWFTAENT

SEQ ID NO: 149858 - protein, 13 aa, Mycobacterium tuberculosis
VVRLDWFTAENTA

SEQ ID NO: 149859 - protein, 13 aa, Mycobacterium tuberculosis
VRLDWFTAENTAT

SEQ ID NO: 149860 - protein, 13 aa, Mycobacterium tuberculosis
RLDWFTAENTATA

SEQ ID NO: 149861 - protein, 13 aa, Mycobacterium tuberculosis
LDWFTAENTATAR

SEQ ID NO: 149862 - protein, 13 aa, Mycobacterium tuberculosis
DWFTAENTATARQ

SEQ ID NO: 149863 - protein, 13 aa, Mycobacterium tuberculosis
WFTAENTATARQA

SEQ ID NO: 149864 - protein, 13 aa, Mycobacterium tuberculosis
FTAENTATARQAI

SEQ ID NO: 149865 - protein, 13 aa, Mycobacterium tuberculosis
TAENTATARQAIA

SEQ ID NO: 149866 - protein, 13 aa, Mycobacterium tuberculosis
AENTATARQAIAA

SEQ ID NO: 149867 - protein, 13 aa, Mycobacterium tuberculosis
ENTATARQAIAAT

SEQ ID NO: 149868 - protein, 13 aa, Mycobacterium tuberculosis
NTATARQAIAATG

SEQ ID NO: 149869 - protein, 13 aa, Mycobacterium tuberculosis
TATARQAIAATGP

SEQ ID NO: 149870 - protein, 13 aa, Mycobacterium tuberculosis
ATARQAIAATGPE

SEQ ID NO: 149871 - protein, 13 aa, Mycobacterium tuberculosis
TARQAIAATGPEL

SEQ ID NO: 149872 - protein, 13 aa, Mycobacterium tuberculosis
ARQAIAATGPELV

SEQ ID NO: 149873 - protein, 13 aa, Mycobacterium tuberculosis
RQAIAATGPELVG

SEQ ID NO: 149874 - protein, 13 aa, Mycobacterium tuberculosis
QAIAATGPELVGL

SEQ ID NO: 149875 - protein, 13 aa, Mycobacterium tuberculosis
AIAATGPELVGLV

SEQ ID NO: 149876 - protein, 13 aa, Mycobacterium tuberculosis
IAATGPELVGLVV

SEQ ID NO: 149877 - protein, 13 aa, Mycobacterium tuberculosis
AATGPELVGLVVN

SEQ ID NO: 149878 - protein, 13 aa, Mycobacterium tuberculosis
ATGPELVGLVVNL

SEQ ID NO: 149879 - protein, 13 aa, Mycobacterium tuberculosis
TGPELVGLVVNLV

SEQ ID NO: 149880 - protein, 13 aa, Mycobacterium tuberculosis
GPELVGLVVNLVT

SEQ ID NO: 149881 - protein, 13 aa, Mycobacterium tuberculosis
PELVGLVVNLVTP

SEQ ID NO: 149882 - protein, 13 aa, Mycobacterium tuberculosis
ELVGLVVNLVTPL

SEQ ID NO: 149883 - protein, 13 aa, Mycobacterium tuberculosis
LVGLVVNLVTPLT

SEQ ID NO: 149884 - protein, 13 aa, Mycobacterium tuberculosis
VGLVVNLVTPLTS

SEQ ID NO: 149885 - protein, 13 aa, Mycobacterium tuberculosis
GLVVNLVTPLTSA

SEQ ID NO: 149886 - protein, 13 aa, Mycobacterium tuberculosis
LVVNLVTPLTSAI

SEQ ID NO: 149887 - protein, 13 aa, Mycobacterium tuberculosis
VVNLVTPLTSAIL

SEQ ID NO: 149888 - protein, 13 aa, Mycobacterium tuberculosis
VNLVTPLTSAILL

SEQ ID NO: 149889 - protein, 13 aa, Mycobacterium tuberculosis
NLVTPLTSAILLP

SEQ ID NO: 149890 - protein, 13 aa, Mycobacterium tuberculosis
LVTPLTSAILLPA

SEQ ID NO: 149891 - protein, 13 aa, Mycobacterium tuberculosis
VTPLTSAILLPAV

SEQ ID NO: 149892 - protein, 13 aa, Mycobacterium tuberculosis
TPLTSAILLPAVI

SEQ ID NO: 149893 - protein, 13 aa, Mycobacterium tuberculosis
PLTSAILLPAVIA

SEQ ID NO: 149894 - protein, 13 aa, Mycobacterium tuberculosis
LTSAILLPAVIAL

SEQ ID NO: 149895 - protein, 13 aa, Mycobacterium tuberculosis
TSAILLPAVIALA

SEQ ID NO: 149896 - protein, 13 aa, Mycobacterium tuberculosis
SAILLPAVIALAL

SEQ ID NO: 149897 - protein, 13 aa, Mycobacterium tuberculosis
AILLPAVIALALL

SEQ ID NO: 149898 - protein, 13 aa, Mycobacterium tuberculosis
ILLPAVIALALLP

SEQ ID NO: 149899 - protein, 13 aa, Mycobacterium tuberculosis
LLPAVIALALLPI

SEQ ID NO: 149900 - protein, 13 aa, Mycobacterium tuberculosis
LPAVIALALLPIS

SEQ ID NO: 149901 - protein, 13 aa, Mycobacterium tuberculosis
PAVIALALLPISW

SEQ ID NO: 149902 - protein, 13 aa, Mycobacterium tuberculosis
AVIALALLPISWQ

SEQ ID NO: 149903 - protein, 13 aa, Mycobacterium tuberculosis
VIALALLPISWQL

SEQ ID NO: 149904 - protein, 13 aa, Mycobacterium tuberculosis
IALALLPISWQLG

SEQ ID NO: 149905 - protein, 13 aa, Mycobacterium tuberculosis
ALALLPISWQLGV

SEQ ID NO: 149906 - protein, 13 aa, Mycobacterium tuberculosis
LALLPISWQLGVA

SEQ ID NO: 149907 - protein, 13 aa, Mycobacterium tuberculosis
ALLPISWQLGVAA

SEQ ID NO: 149908 - protein, 13 aa, Mycobacterium tuberculosis
LLPISWQLGVAAL

SEQ ID NO: 149909 - protein, 13 aa, Mycobacterium tuberculosis
LPISWQLGVAALA

SEQ ID NO: 149910 - protein, 13 aa, Mycobacterium tuberculosis
PISWQLGVAALAG

SEQ ID NO: 149911 - protein, 13 aa, Mycobacterium tuberculosis
ISWQLGVAALAGV

SEQ ID NO: 149912 - protein, 13 aa, Mycobacterium tuberculosis
SWQLGVAALAGVP

SEQ ID NO: 149913 - protein, 13 aa, Mycobacterium tuberculosis
WQLGVAALAGVPL

SEQ ID NO: 149914 - protein, 13 aa, Mycobacterium tuberculosis
QLGVAALAGVPLL

SEQ ID NO: 149915 - protein, 13 aa, Mycobacterium tuberculosis
LGVAALAGVPLLL

SEQ ID NO: 149916 - protein, 13 aa, Mycobacterium tuberculosis
GVAALAGVPLLLG

SEQ ID NO: 149917 - protein, 13 aa, Mycobacterium tuberculosis
VAALAGVPLLLGA

SEQ ID NO: 149918 - protein, 13 aa, Mycobacterium tuberculosis
AALAGVPLLLGAL

SEQ ID NO: 149919 - protein, 13 aa, Mycobacterium tuberculosis
ALAGVPLLLGALW

SEQ ID NO: 149920 - protein, 13 aa, Mycobacterium tuberculosis
LAGVPLLLGALWA

SEQ ID NO: 149921 - protein, 13 aa, Mycobacterium tuberculosis
AGVPLLLGALWAS

SEQ ID NO: 149922 - protein, 13 aa, Mycobacterium tuberculosis
GVPLLLGALWASA

SEQ ID NO: 149923 - protein, 13 aa, Mycobacterium tuberculosis
VPLLLGALWASAA

SEQ ID NO: 149924 - protein, 13 aa, Mycobacterium tuberculosis
PLLLGALWASAAF

SEQ ID NO: 149925 - protein, 13 aa, Mycobacterium tuberculosis
LLLGALWASAAFA

SEQ ID NO: 149926 - protein, 13 aa, Mycobacterium tuberculosis
LLGALWASAAFAR

SEQ ID NO: 149927 - protein, 13 aa, Mycobacterium tuberculosis
LGALWASAAFARR

SEQ ID NO: 149928 - protein, 13 aa, Mycobacterium tuberculosis
GALWASAAFARRA

SEQ ID NO: 149929 - protein, 13 aa, Mycobacterium tuberculosis
ALWASAAFARRAD

SEQ ID NO: 149930 - protein, 13 aa, Mycobacterium tuberculosis
LWASAAFARRADT

SEQ ID NO: 149931 - protein, 13 aa, Mycobacterium tuberculosis
WASAAFARRADTA

SEQ ID NO: 149932 - protein, 13 aa, Mycobacterium tuberculosis
ASAAFARRADTAA

SEQ ID NO: 149933 - protein, 13 aa, Mycobacterium tuberculosis
SAAFARRADTAAD

SEQ ID NO: 149934 - protein, 13 aa, Mycobacterium tuberculosis
AAFARRADTAADK

SEQ ID NO: 149935 - protein, 13 aa, Mycobacterium tuberculosis
AFARRADTAADKA

SEQ ID NO: 149936 - protein, 13 aa, Mycobacterium tuberculosis
FARRADTAADKAN

SEQ ID NO: 149937 - protein, 13 aa, Mycobacterium tuberculosis
ARRADTAADKANT

SEQ ID NO: 149938 - protein, 13 aa, Mycobacterium tuberculosis
RRADTAADKANTA

SEQ ID NO: 149939 - protein, 13 aa, Mycobacterium tuberculosis
RADTAADKANTAL

SEQ ID NO: 149940 - protein, 13 aa, Mycobacterium tuberculosis
ADTAADKANTALT

SEQ ID NO: 149941 - protein, 13 aa, Mycobacterium tuberculosis
DTAADKANTALTE

SEQ ID NO: 149942 - protein, 13 aa, Mycobacterium tuberculosis
TAADKANTALTER

SEQ ID NO: 149943 - protein, 13 aa, Mycobacterium tuberculosis
AADKANTALTERI

SEQ ID NO: 149944 - protein, 13 aa, Mycobacterium tuberculosis
ADKANTALTERII

SEQ ID NO: 149945 - protein, 13 aa, Mycobacterium tuberculosis
DKANTALTERIIE

SEQ ID NO: 149946 - protein, 13 aa, Mycobacterium tuberculosis
KANTALTERIIEF

SEQ ID NO: 149947 - protein, 13 aa, Mycobacterium tuberculosis
ANTALTERIIEFA

SEQ ID NO: 149948 - protein, 13 aa, Mycobacterium tuberculosis
NTALTERIIEFAR

SEQ ID NO: 149949 - protein, 13 aa, Mycobacterium tuberculosis
TALTERIIEFART

SEQ ID NO: 149950 - protein, 13 aa, Mycobacterium tuberculosis
ALTERIIEFARTQ

SEQ ID NO: 149951 - protein, 13 aa, Mycobacterium tuberculosis
LTERIIEFARTQQ

SEQ ID NO: 149952 - protein, 13 aa, Mycobacterium tuberculosis
TERIIEFARTQQA

SEQ ID NO: 149953 - protein, 13 aa, Mycobacterium tuberculosis
ERIIEFARTQQAL

SEQ ID NO: 149954 - protein, 13 aa, Mycobacterium tuberculosis
RIIEFARTQQALR

SEQ ID NO: 149955 - protein, 13 aa, Mycobacterium tuberculosis
IIEFARTQQALRA

SEQ ID NO: 149956 - protein, 13 aa, Mycobacterium tuberculosis
IEFARTQQALRAA

SEQ ID NO: 149957 - protein, 13 aa, Mycobacterium tuberculosis
EFARTQQALRAAR

SEQ ID NO: 149958 - protein, 13 aa, Mycobacterium tuberculosis
FARTQQALRAARR

SEQ ID NO: 149959 - protein, 13 aa, Mycobacterium tuberculosis
ARTQQALRAARRV

SEQ ID NO: 149960 - protein, 13 aa, Mycobacterium tuberculosis
RTQQALRAARRVE

SEQ ID NO: 149961 - protein, 13 aa, Mycobacterium tuberculosis
TQQALRAARRVEP

SEQ ID NO: 149962 - protein, 13 aa, Mycobacterium tuberculosis
QQALRAARRVEPA

SEQ ID NO: 149963 - protein, 13 aa, Mycobacterium tuberculosis
QALRAARRVEPAR

SEQ ID NO: 149964 - protein, 13 aa, Mycobacterium tuberculosis
ALRAARRVEPARS

SEQ ID NO: 149965 - protein, 13 aa, Mycobacterium tuberculosis
LRAARRVEPARSL

SEQ ID NO: 149966 - protein, 13 aa, Mycobacterium tuberculosis
RAARRVEPARSLV

SEQ ID NO: 149967 - protein, 13 aa, Mycobacterium tuberculosis
AARRVEPARSLVG

SEQ ID NO: 149968 - protein, 13 aa, Mycobacterium tuberculosis
ARRVEPARSLVGN

SEQ ID NO: 149969 - protein, 13 aa, Mycobacterium tuberculosis
RRVEPARSLVGNA

SEQ ID NO: 149970 - protein, 13 aa, Mycobacterium tuberculosis
RVEPARSLVGNAL

SEQ ID NO: 149971 - protein, 13 aa, Mycobacterium tuberculosis
VEPARSLVGNALA

SEQ ID NO: 149972 - protein, 13 aa, Mycobacterium tuberculosis
EPARSLVGNALAS

SEQ ID NO: 149973 - protein, 13 aa, Mycobacterium tuberculosis
PARSLVGNALASQ

SEQ ID NO: 149974 - protein, 13 aa, Mycobacterium tuberculosis
ARSLVGNALASQH

SEQ ID NO: 149975 - protein, 13 aa, Mycobacterium tuberculosis
RSLVGNALASQHT

SEQ ID NO: 149976 - protein, 13 aa, Mycobacterium tuberculosis
SLVGNALASQHTA

SEQ ID NO: 149977 - protein, 13 aa, Mycobacterium tuberculosis
LVGNALASQHTAT

SEQ ID NO: 149978 - protein, 13 aa, Mycobacterium tuberculosis
VGNALASQHTATM

SEQ ID NO: 149979 - protein, 13 aa, Mycobacterium tuberculosis
GNALASQHTATMR

SEQ ID NO: 149980 - protein, 13 aa, Mycobacterium tuberculosis
NALASQHTATMRL

SEQ ID NO: 149981 - protein, 13 aa, Mycobacterium tuberculosis
ALASQHTATMRLL

SEQ ID NO: 149982 - protein, 13 aa, Mycobacterium tuberculosis
LASQHTATMRLLG

SEQ ID NO: 149983 - protein, 13 aa, Mycobacterium tuberculosis
ASQHTATMRLLGM

SEQ ID NO: 149984 - protein, 13 aa, Mycobacterium tuberculosis
SQHTATMRLLGMQ

SEQ ID NO: 149985 - protein, 13 aa, Mycobacterium tuberculosis
QHTATMRLLGMQI

SEQ ID NO: 149986 - protein, 13 aa, Mycobacterium tuberculosis
HTATMRLLGMQIP

SEQ ID NO: 149987 - protein, 13 aa, Mycobacterium tuberculosis
TATMRLLGMQIPG

SEQ ID NO: 149988 - protein, 13 aa, Mycobacterium tuberculosis
ATMRLLGMQIPGQ

SEQ ID NO: 149989 - protein, 13 aa, Mycobacterium tuberculosis
TMRLLGMQIPGQL

SEQ ID NO: 149990 - protein, 13 aa, Mycobacterium tuberculosis
MRLLGMQIPGQLL

SEQ ID NO: 149991 - protein, 13 aa, Mycobacterium tuberculosis
RLLGMQIPGQLLF

SEQ ID NO: 149992 - protein, 13 aa, Mycobacterium tuberculosis
LLGMQIPGQLLFS

SEQ ID NO: 149993 - protein, 13 aa, Mycobacterium tuberculosis
LGMQIPGQLLFSI

SEQ ID NO: 149994 - protein, 13 aa, Mycobacterium tuberculosis
GMQIPGQLLFSIA

SEQ ID NO: 149995 - protein, 13 aa, Mycobacterium tuberculosis
MQIPGQLLFSIAS

SEQ ID NO: 149996 - protein, 13 aa, Mycobacterium tuberculosis
QIPGQLLFSIASQ

SEQ ID NO: 149997 - protein, 13 aa, Mycobacterium tuberculosis
IPGQLLFSIASQL

SEQ ID NO: 149998 - protein, 13 aa, Mycobacterium tuberculosis
PGQLLFSIASQLA

SEQ ID NO: 149999 - protein, 13 aa, Mycobacterium tuberculosis
GQLLFSIASQLAL

SEQ ID NO: 150000 - protein, 13 aa, Mycobacterium tuberculosis
QLLFSIASQLALI

SEQ ID NO: 150001 - protein, 13 aa, Mycobacterium tuberculosis
LLFSIASQLALIV

SEQ ID NO: 150002 - protein, 13 aa, Mycobacterium tuberculosis
LFSIASQLALIVL

SEQ ID NO: 150003 - protein, 13 aa, Mycobacterium tuberculosis
FSIASQLALIVLA

SEQ ID NO: 150004 - protein, 13 aa, Mycobacterium tuberculosis
SIASQLALIVLAG

SEQ ID NO: 150005 - protein, 13 aa, Mycobacterium tuberculosis
IASQLALIVLAGT

SEQ ID NO: 150006 - protein, 13 aa, Mycobacterium tuberculosis
ASQLALIVLAGTT

SEQ ID NO: 150007 - protein, 13 aa, Mycobacterium tuberculosis
SQLALIVLAGTTA

SEQ ID NO: 150008 - protein, 13 aa, Mycobacterium tuberculosis
QLALIVLAGTTAA

SEQ ID NO: 150009 - protein, 13 aa, Mycobacterium tuberculosis
LALIVLAGTTAAL

SEQ ID NO: 150010 - protein, 13 aa, Mycobacterium tuberculosis
ALIVLAGTTAALT

SEQ ID NO: 150011 - protein, 13 aa, Mycobacterium tuberculosis
LIVLAGTTAALTI

SEQ ID NO: 150012 - protein, 13 aa, Mycobacterium tuberculosis
IVLAGTTAALTIT

SEQ ID NO: 150013 - protein, 13 aa, Mycobacterium tuberculosis
VLAGTTAALTITG

SEQ ID NO: 150014 - protein, 13 aa, Mycobacterium tuberculosis
LAGTTAALTITGT

SEQ ID NO: 150015 - protein, 13 aa, Mycobacterium tuberculosis
AGTTAALTITGTL

SEQ ID NO: 150016 - protein, 13 aa, Mycobacterium tuberculosis
GTTAALTITGTLT

SEQ ID NO: 150017 - protein, 13 aa, Mycobacterium tuberculosis
TTAALTITGTLTV

SEQ ID NO: 150018 - protein, 13 aa, Mycobacterium tuberculosis
TAALTITGTLTVP

SEQ ID NO: 150019 - protein, 13 aa, Mycobacterium tuberculosis
AALTITGTLTVPE

SEQ ID NO: 150020 - protein, 13 aa, Mycobacterium tuberculosis
ALTITGTLTVPEA

SEQ ID NO: 150021 - protein, 13 aa, Mycobacterium tuberculosis
LTITGTLTVPEAI

SEQ ID NO: 150022 - protein, 13 aa, Mycobacterium tuberculosis
TITGTLTVPEAIA

SEQ ID NO: 150023 - protein, 13 aa, Mycobacterium tuberculosis
ITGTLTVPEAIAL

SEQ ID NO: 150024 - protein, 13 aa, Mycobacterium tuberculosis
TGTLTVPEAIALI

SEQ ID NO: 150025 - protein, 13 aa, Mycobacterium tuberculosis
GTLTVPEAIALIV

SEQ ID NO: 150026 - protein, 13 aa, Mycobacterium tuberculosis
TLTVPEAIALIVV

SEQ ID NO: 150027 - protein, 13 aa, Mycobacterium tuberculosis
LTVPEAIALIVVM

SEQ ID NO: 150028 - protein, 13 aa, Mycobacterium tuberculosis
TVPEAIALIVVMV

SEQ ID NO: 150029 - protein, 13 aa, Mycobacterium tuberculosis
VPEAIALIVVMVR

SEQ ID NO: 150030 - protein, 13 aa, Mycobacterium tuberculosis
PEAIALIVVMVRY

SEQ ID NO: 150031 - protein, 13 aa, Mycobacterium tuberculosis
EAIALIVVMVRYL

SEQ ID NO: 150032 - protein, 13 aa, Mycobacterium tuberculosis
AIALIVVMVRYLE

SEQ ID NO: 150033 - protein, 13 aa, Mycobacterium tuberculosis
IALIVVMVRYLEP

SEQ ID NO: 150034 - protein, 13 aa, Mycobacterium tuberculosis
ALIVVMVRYLEPF

SEQ ID NO: 150035 - protein, 13 aa, Mycobacterium tuberculosis
LIVVMVRYLEPFT

SEQ ID NO: 150036 - protein, 13 aa, Mycobacterium tuberculosis
IVVMVRYLEPFTA

SEQ ID NO: 150037 - protein, 13 aa, Mycobacterium tuberculosis
VVMVRYLEPFTAV

SEQ ID NO: 150038 - protein, 13 aa, Mycobacterium tuberculosis
VMVRYLEPFTAVS

SEQ ID NO: 150039 - protein, 13 aa, Mycobacterium tuberculosis
MVRYLEPFTAVSE

SEQ ID NO: 150040 - protein, 13 aa, Mycobacterium tuberculosis
VRYLEPFTAVSEL

SEQ ID NO: 150041 - protein, 13 aa, Mycobacterium tuberculosis
RYLEPFTAVSELA

SEQ ID NO: 150042 - protein, 13 aa, Mycobacterium tuberculosis
YLEPFTAVSELAP

SEQ ID NO: 150043 - protein, 13 aa, Mycobacterium tuberculosis
LEPFTAVSELAPA

SEQ ID NO: 150044 - protein, 13 aa, Mycobacterium tuberculosis
EPFTAVSELAPAL

SEQ ID NO: 150045 - protein, 13 aa, Mycobacterium tuberculosis
PFTAVSELAPALE

SEQ ID NO: 150046 - protein, 13 aa, Mycobacterium tuberculosis
FTAVSELAPALES

SEQ ID NO: 150047 - protein, 13 aa, Mycobacterium tuberculosis
TAVSELAPALEST

SEQ ID NO: 150048 - protein, 13 aa, Mycobacterium tuberculosis
AVSELAPALESTR

SEQ ID NO: 150049 - protein, 13 aa, Mycobacterium tuberculosis
VSELAPALESTRA

SEQ ID NO: 150050 - protein, 13 aa, Mycobacterium tuberculosis
SELAPALESTRAT

SEQ ID NO: 150051 - protein, 13 aa, Mycobacterium tuberculosis
ELAPALESTRATL

SEQ ID NO: 150052 - protein, 13 aa, Mycobacterium tuberculosis
LAPALESTRATLG

SEQ ID NO: 150053 - protein, 13 aa, Mycobacterium tuberculosis
APALESTRATLGR

SEQ ID NO: 150054 - protein, 13 aa, Mycobacterium tuberculosis
PALESTRATLGRI

SEQ ID NO: 150055 - protein, 13 aa, Mycobacterium tuberculosis
ALESTRATLGRIG

SEQ ID NO: 150056 - protein, 13 aa, Mycobacterium tuberculosis
LESTRATLGRIGS

SEQ ID NO: 150057 - protein, 13 aa, Mycobacterium tuberculosis
ESTRATLGRIGSV

SEQ ID NO: 150058 - protein, 13 aa, Mycobacterium tuberculosis
STRATLGRIGSVL

SEQ ID NO: 150059 - protein, 13 aa, Mycobacterium tuberculosis
TRATLGRIGSVLT

SEQ ID NO: 150060 - protein, 13 aa, Mycobacterium tuberculosis
RATLGRIGSVLTA

SEQ ID NO: 150061 - protein, 13 aa, Mycobacterium tuberculosis
ATLGRIGSVLTAP

SEQ ID NO: 150062 - protein, 13 aa, Mycobacterium tuberculosis
TLGRIGSVLTAPV

SEQ ID NO: 150063 - protein, 13 aa, Mycobacterium tuberculosis
LGRIGSVLTAPVM

SEQ ID NO: 150064 - protein, 13 aa, Mycobacterium tuberculosis
GRIGSVLTAPVMV

SEQ ID NO: 150065 - protein, 13 aa, Mycobacterium tuberculosis
RIGSVLTAPVMVA

SEQ ID NO: 150066 - protein, 13 aa, Mycobacterium tuberculosis
IGSVLTAPVMVAG

SEQ ID NO: 150067 - protein, 13 aa, Mycobacterium tuberculosis
GSVLTAPVMVAGS

SEQ ID NO: 150068 - protein, 13 aa, Mycobacterium tuberculosis
SVLTAPVMVAGSG

SEQ ID NO: 150069 - protein, 13 aa, Mycobacterium tuberculosis
VLTAPVMVAGSGT

SEQ ID NO: 150070 - protein, 13 aa, Mycobacterium tuberculosis
LTAPVMVAGSGTW

SEQ ID NO: 150071 - protein, 13 aa, Mycobacterium tuberculosis
TAPVMVAGSGTWR

SEQ ID NO: 150072 - protein, 13 aa, Mycobacterium tuberculosis
APVMVAGSGTWRD

SEQ ID NO: 150073 - protein, 13 aa, Mycobacterium tuberculosis
PVMVAGSGTWRDG

SEQ ID NO: 150074 - protein, 13 aa, Mycobacterium tuberculosis
VMVAGSGTWRDGA

SEQ ID NO: 150075 - protein, 13 aa, Mycobacterium tuberculosis
MVAGSGTWRDGAV

SEQ ID NO: 150076 - protein, 13 aa, Mycobacterium tuberculosis
VAGSGTWRDGAVV

SEQ ID NO: 150077 - protein, 13 aa, Mycobacterium tuberculosis
AGSGTWRDGAVVP

SEQ ID NO: 150078 - protein, 13 aa, Mycobacterium tuberculosis
GSGTWRDGAVVPR

SEQ ID NO: 150079 - protein, 13 aa, Mycobacterium tuberculosis
SGTWRDGAVVPRI

SEQ ID NO: 150080 - protein, 13 aa, Mycobacterium tuberculosis
GTWRDGAVVPRIE

SEQ ID NO: 150081 - protein, 13 aa, Mycobacterium tuberculosis
TWRDGAVVPRIEF

SEQ ID NO: 150082 - protein, 13 aa, Mycobacterium tuberculosis
WRDGAVVPRIEFD

SEQ ID NO: 150083 - protein, 13 aa, Mycobacterium tuberculosis
RDGAVVPRIEFDD

SEQ ID NO: 150084 - protein, 13 aa, Mycobacterium tuberculosis
DGAVVPRIEFDDV

SEQ ID NO: 150085 - protein, 13 aa, Mycobacterium tuberculosis
GAVVPRIEFDDVA

SEQ ID NO: 150086 - protein, 13 aa, Mycobacterium tuberculosis
AVVPRIEFDDVAF

SEQ ID NO: 150087 - protein, 13 aa, Mycobacterium tuberculosis
VVPRIEFDDVAFG

SEQ ID NO: 150088 - protein, 13 aa, Mycobacterium tuberculosis
VPRIEFDDVAFGY

SEQ ID NO: 150089 - protein, 13 aa, Mycobacterium tuberculosis
PRIEFDDVAFGYD

SEQ ID NO: 150090 - protein, 13 aa, Mycobacterium tuberculosis
RIEFDDVAFGYDG

SEQ ID NO: 150091 - protein, 13 aa, Mycobacterium tuberculosis
IEFDDVAFGYDGG

SEQ ID NO: 150092 - protein, 13 aa, Mycobacterium tuberculosis
EFDDVAFGYDGGS

SEQ ID NO: 150093 - protein, 13 aa, Mycobacterium tuberculosis
FDDVAFGYDGGSG

SEQ ID NO: 150094 - protein, 13 aa, Mycobacterium tuberculosis
DDVAFGYDGGSGP

SEQ ID NO: 150095 - protein, 13 aa, Mycobacterium tuberculosis
DVAFGYDGGSGPV

SEQ ID NO: 150096 - protein, 13 aa, Mycobacterium tuberculosis
VAFGYDGGSGPVL

SEQ ID NO: 150097 - protein, 13 aa, Mycobacterium tuberculosis
AFGYDGGSGPVLD

SEQ ID NO: 150098 - protein, 13 aa, Mycobacterium tuberculosis
FGYDGGSGPVLDG

SEQ ID NO: 150099 - protein, 13 aa, Mycobacterium tuberculosis
GYDGGSGPVLDGV

SEQ ID NO: 150100 - protein, 13 aa, Mycobacterium tuberculosis
YDGGSGPVLDGVS

SEQ ID NO: 150101 - protein, 13 aa, Mycobacterium tuberculosis
DGGSGPVLDGVSF

SEQ ID NO: 150102 - protein, 13 aa, Mycobacterium tuberculosis
GGSGPVLDGVSFC

SEQ ID NO: 150103 - protein, 13 aa, Mycobacterium tuberculosis
GSGPVLDGVSFCL

SEQ ID NO: 150104 - protein, 13 aa, Mycobacterium tuberculosis
SGPVLDGVSFCLQ

SEQ ID NO: 150105 - protein, 13 aa, Mycobacterium tuberculosis
GPVLDGVSFCLQP

SEQ ID NO: 150106 - protein, 13 aa, Mycobacterium tuberculosis
PVLDGVSFCLQPG

SEQ ID NO: 150107 - protein, 13 aa, Mycobacterium tuberculosis
VLDGVSFCLQPGT

SEQ ID NO: 150108 - protein, 13 aa, Mycobacterium tuberculosis
LDGVSFCLQPGTT

SEQ ID NO: 150109 - protein, 13 aa, Mycobacterium tuberculosis
DGVSFCLQPGTTT

SEQ ID NO: 150110 - protein, 13 aa, Mycobacterium tuberculosis
GVSFCLQPGTTTA

SEQ ID NO: 150111 - protein, 13 aa, Mycobacterium tuberculosis
VSFCLQPGTTTAI

SEQ ID NO: 150112 - protein, 13 aa, Mycobacterium tuberculosis
SFCLQPGTTTAIV

SEQ ID NO: 150113 - protein, 13 aa, Mycobacterium tuberculosis
FCLQPGTTTAIVG

SEQ ID NO: 150114 - protein, 13 aa, Mycobacterium tuberculosis
CLQPGTTTAIVGP

SEQ ID NO: 150115 - protein, 13 aa, Mycobacterium tuberculosis
LQPGTTTAIVGPS

SEQ ID NO: 150116 - protein, 13 aa, Mycobacterium tuberculosis
QPGTTTAIVGPSG

SEQ ID NO: 150117 - protein, 13 aa, Mycobacterium tuberculosis
PGTTTAIVGPSGC

SEQ ID NO: 150118 - protein, 13 aa, Mycobacterium tuberculosis
GTTTAIVGPSGCG

SEQ ID NO: 150119 - protein, 13 aa, Mycobacterium tuberculosis
TTTAIVGPSGCGK

SEQ ID NO: 150120 - protein, 13 aa, Mycobacterium tuberculosis
TTAIVGPSGCGKS

SEQ ID NO: 150121 - protein, 13 aa, Mycobacterium tuberculosis
TAIVGPSGCGKST

SEQ ID NO: 150122 - protein, 13 aa, Mycobacterium tuberculosis
AIVGPSGCGKSTI

SEQ ID NO: 150123 - protein, 13 aa, Mycobacterium tuberculosis
IVGPSGCGKSTIL

SEQ ID NO: 150124 - protein, 13 aa, Mycobacterium tuberculosis
VGPSGCGKSTILA

SEQ ID NO: 150125 - protein, 13 aa, Mycobacterium tuberculosis
GPSGCGKSTILAL

SEQ ID NO: 150126 - protein, 13 aa, Mycobacterium tuberculosis
PSGCGKSTILALI

SEQ ID NO: 150127 - protein, 13 aa, Mycobacterium tuberculosis
SGCGKSTILALIA

SEQ ID NO: 150128 - protein, 13 aa, Mycobacterium tuberculosis
GCGKSTILALIAG

SEQ ID NO: 150129 - protein, 13 aa, Mycobacterium tuberculosis
CGKSTILALIAGL

SEQ ID NO: 150130 - protein, 13 aa, Mycobacterium tuberculosis
GKSTILALIAGLH

SEQ ID NO: 150131 - protein, 13 aa, Mycobacterium tuberculosis
KSTILALIAGLHQ

SEQ ID NO: 150132 - protein, 13 aa, Mycobacterium tuberculosis
STILALIAGLHQP

SEQ ID NO: 150133 - protein, 13 aa, Mycobacterium tuberculosis
TILALIAGLHQPT

SEQ ID NO: 150134 - protein, 13 aa, Mycobacterium tuberculosis
ILALIAGLHQPTR

SEQ ID NO: 150135 - protein, 13 aa, Mycobacterium tuberculosis
LALIAGLHQPTRG

SEQ ID NO: 150136 - protein, 13 aa, Mycobacterium tuberculosis
ALIAGLHQPTRGR

SEQ ID NO: 150137 - protein, 13 aa, Mycobacterium tuberculosis
LIAGLHQPTRGRV

SEQ ID NO: 150138 - protein, 13 aa, Mycobacterium tuberculosis
IAGLHQPTRGRVL

SEQ ID NO: 150139 - protein, 13 aa, Mycobacterium tuberculosis
AGLHQPTRGRVLI

SEQ ID NO: 150140 - protein, 13 aa, Mycobacterium tuberculosis
GLHQPTRGRVLID

SEQ ID NO: 150141 - protein, 13 aa, Mycobacterium tuberculosis
LHQPTRGRVLIDG

SEQ ID NO: 150142 - protein, 13 aa, Mycobacterium tuberculosis
HQPTRGRVLIDGT

SEQ ID NO: 150143 - protein, 13 aa, Mycobacterium tuberculosis
QPTRGRVLIDGTD

SEQ ID NO: 150144 - protein, 13 aa, Mycobacterium tuberculosis
PTRGRVLIDGTDV

SEQ ID NO: 150145 - protein, 13 aa, Mycobacterium tuberculosis
TRGRVLIDGTDVA

SEQ ID NO: 150146 - protein, 13 aa, Mycobacterium tuberculosis
RGRVLIDGTDVAT

SEQ ID NO: 150147 - protein, 13 aa, Mycobacterium tuberculosis
GRVLIDGTDVATL

SEQ ID NO: 150148 - protein, 13 aa, Mycobacterium tuberculosis
RVLIDGTDVATLD

SEQ ID NO: 150149 - protein, 13 aa, Mycobacterium tuberculosis
VLIDGTDVATLDA

SEQ ID NO: 150150 - protein, 13 aa, Mycobacterium tuberculosis
LIDGTDVATLDAR

SEQ ID NO: 150151 - protein, 13 aa, Mycobacterium tuberculosis
IDGTDVATLDARA

SEQ ID NO: 150152 - protein, 13 aa, Mycobacterium tuberculosis
DGTDVATLDARAQ

SEQ ID NO: 150153 - protein, 13 aa, Mycobacterium tuberculosis
GTDVATLDARAQQ

SEQ ID NO: 150154 - protein, 13 aa, Mycobacterium tuberculosis
TDVATLDARAQQA

SEQ ID NO: 150155 - protein, 13 aa, Mycobacterium tuberculosis
DVATLDARAQQAV

SEQ ID NO: 150156 - protein, 13 aa, Mycobacterium tuberculosis
VATLDARAQQAVC

SEQ ID NO: 150157 - protein, 13 aa, Mycobacterium tuberculosis
ATLDARAQQAVCS

SEQ ID NO: 150158 - protein, 13 aa, Mycobacterium tuberculosis
TLDARAQQAVCSV

SEQ ID NO: 150159 - protein, 13 aa, Mycobacterium tuberculosis
LDARAQQAVCSVV

SEQ ID NO: 150160 - protein, 13 aa, Mycobacterium tuberculosis
DARAQQAVCSVVF

SEQ ID NO: 150161 - protein, 13 aa, Mycobacterium tuberculosis
ARAQQAVCSVVFQ

SEQ ID NO: 150162 - protein, 13 aa, Mycobacterium tuberculosis
RAQQAVCSVVFQH

SEQ ID NO: 150163 - protein, 13 aa, Mycobacterium tuberculosis
AQQAVCSVVFQHP

SEQ ID NO: 150164 - protein, 13 aa, Mycobacterium tuberculosis
QQAVCSVVFQHPY

SEQ ID NO: 150165 - protein, 13 aa, Mycobacterium tuberculosis
QAVCSVVFQHPYL

SEQ ID NO: 150166 - protein, 13 aa, Mycobacterium tuberculosis
AVCSVVFQHPYLF

SEQ ID NO: 150167 - protein, 13 aa, Mycobacterium tuberculosis
VCSVVFQHPYLFH

SEQ ID NO: 150168 - protein, 13 aa, Mycobacterium tuberculosis
CSVVFQHPYLFHG

SEQ ID NO: 150169 - protein, 13 aa, Mycobacterium tuberculosis
SVVFQHPYLFHGT

SEQ ID NO: 150170 - protein, 13 aa, Mycobacterium tuberculosis
VVFQHPYLFHGTI

SEQ ID NO: 150171 - protein, 13 aa, Mycobacterium tuberculosis
VFQHPYLFHGTIR

SEQ ID NO: 150172 - protein, 13 aa, Mycobacterium tuberculosis
FQHPYLFHGTIRD

SEQ ID NO: 150173 - protein, 13 aa, Mycobacterium tuberculosis
QHPYLFHGTIRDN

SEQ ID NO: 150174 - protein, 13 aa, Mycobacterium tuberculosis
HPYLFHGTIRDNV

SEQ ID NO: 150175 - protein, 13 aa, Mycobacterium tuberculosis
PYLFHGTIRDNVF

SEQ ID NO: 150176 - protein, 13 aa, Mycobacterium tuberculosis
YLFHGTIRDNVFA

SEQ ID NO: 150177 - protein, 13 aa, Mycobacterium tuberculosis
LFHGTIRDNVFAA

SEQ ID NO: 150178 - protein, 13 aa, Mycobacterium tuberculosis
FHGTIRDNVFAAD

SEQ ID NO: 150179 - protein, 13 aa, Mycobacterium tuberculosis
HGTIRDNVFAADP

SEQ ID NO: 150180 - protein, 13 aa, Mycobacterium tuberculosis
GTIRDNVFAADPG

SEQ ID NO: 150181 - protein, 13 aa, Mycobacterium tuberculosis
TIRDNVFAADPGA

SEQ ID NO: 150182 - protein, 13 aa, Mycobacterium tuberculosis
IRDNVFAADPGAS

SEQ ID NO: 150183 - protein, 13 aa, Mycobacterium tuberculosis
RDNVFAADPGASD

SEQ ID NO: 150184 - protein, 13 aa, Mycobacterium tuberculosis
DNVFAADPGASDD

SEQ ID NO: 150185 - protein, 13 aa, Mycobacterium tuberculosis
NVFAADPGASDDQ

SEQ ID NO: 150186 - protein, 13 aa, Mycobacterium tuberculosis
VFAADPGASDDQF

SEQ ID NO: 150187 - protein, 13 aa, Mycobacterium tuberculosis
FAADPGASDDQFA

SEQ ID NO: 150188 - protein, 13 aa, Mycobacterium tuberculosis
AADPGASDDQFAQ

SEQ ID NO: 150189 - protein, 13 aa, Mycobacterium tuberculosis
ADPGASDDQFAQA

SEQ ID NO: 150190 - protein, 13 aa, Mycobacterium tuberculosis
DPGASDDQFAQAV

SEQ ID NO: 150191 - protein, 13 aa, Mycobacterium tuberculosis
PGASDDQFAQAVR

SEQ ID NO: 150192 - protein, 13 aa, Mycobacterium tuberculosis
GASDDQFAQAVRL

SEQ ID NO: 150193 - protein, 13 aa, Mycobacterium tuberculosis
ASDDQFAQAVRLA

SEQ ID NO: 150194 - protein, 13 aa, Mycobacterium tuberculosis
SDDQFAQAVRLAR

SEQ ID NO: 150195 - protein, 13 aa, Mycobacterium tuberculosis
DDQFAQAVRLARV

SEQ ID NO: 150196 - protein, 13 aa, Mycobacterium tuberculosis
DQFAQAVRLARVD

SEQ ID NO: 150197 - protein, 13 aa, Mycobacterium tuberculosis
QFAQAVRLARVDE

SEQ ID NO: 150198 - protein, 13 aa, Mycobacterium tuberculosis
FAQAVRLARVDEL

SEQ ID NO: 150199 - protein, 13 aa, Mycobacterium tuberculosis
AQAVRLARVDELI

SEQ ID NO: 150200 - protein, 13 aa, Mycobacterium tuberculosis
QAVRLARVDELIA

SEQ ID NO: 150201 - protein, 13 aa, Mycobacterium tuberculosis
AVRLARVDELIAR

SEQ ID NO: 150202 - protein, 13 aa, Mycobacterium tuberculosis
VRLARVDELIARL

SEQ ID NO: 150203 - protein, 13 aa, Mycobacterium tuberculosis
RLARVDELIARLP

SEQ ID NO: 150204 - protein, 13 aa, Mycobacterium tuberculosis
LARVDELIARLPD

SEQ ID NO: 150205 - protein, 13 aa, Mycobacterium tuberculosis
ARVDELIARLPDG

SEQ ID NO: 150206 - protein, 13 aa, Mycobacterium tuberculosis
RVDELIARLPDGA

SEQ ID NO: 150207 - protein, 13 aa, Mycobacterium tuberculosis
VDELIARLPDGAN

SEQ ID NO: 150208 - protein, 13 aa, Mycobacterium tuberculosis
DELIARLPDGANT

SEQ ID NO: 150209 - protein, 13 aa, Mycobacterium tuberculosis
ELIARLPDGANTI

SEQ ID NO: 150210 - protein, 13 aa, Mycobacterium tuberculosis
LIARLPDGANTIV

SEQ ID NO: 150211 - protein, 13 aa, Mycobacterium tuberculosis
IARLPDGANTIVG

SEQ ID NO: 150212 - protein, 13 aa, Mycobacterium tuberculosis
ARLPDGANTIVGE

SEQ ID NO: 150213 - protein, 13 aa, Mycobacterium tuberculosis
RLPDGANTIVGEA

SEQ ID NO: 150214 - protein, 13 aa, Mycobacterium tuberculosis
LPDGANTIVGEAG

SEQ ID NO: 150215 - protein, 13 aa, Mycobacterium tuberculosis
PDGANTIVGEAGS

SEQ ID NO: 150216 - protein, 13 aa, Mycobacterium tuberculosis
DGANTIVGEAGSA

SEQ ID NO: 150217 - protein, 13 aa, Mycobacterium tuberculosis
GANTIVGEAGSAL

SEQ ID NO: 150218 - protein, 13 aa, Mycobacterium tuberculosis
ANTIVGEAGSALS

SEQ ID NO: 150219 - protein, 13 aa, Mycobacterium tuberculosis
NTIVGEAGSALSG

SEQ ID NO: 150220 - protein, 13 aa, Mycobacterium tuberculosis
TIVGEAGSALSGG

SEQ ID NO: 150221 - protein, 13 aa, Mycobacterium tuberculosis
IVGEAGSALSGGE

SEQ ID NO: 150222 - protein, 13 aa, Mycobacterium tuberculosis
VGEAGSALSGGER

SEQ ID NO: 150223 - protein, 13 aa, Mycobacterium tuberculosis
GEAGSALSGGERQ

SEQ ID NO: 150224 - protein, 13 aa, Mycobacterium tuberculosis
EAGSALSGGERQR

SEQ ID NO: 150225 - protein, 13 aa, Mycobacterium tuberculosis
AGSALSGGERQRV

SEQ ID NO: 150226 - protein, 13 aa, Mycobacterium tuberculosis
GSALSGGERQRVS

SEQ ID NO: 150227 - protein, 13 aa, Mycobacterium tuberculosis
SALSGGERQRVSI

SEQ ID NO: 150228 - protein, 13 aa, Mycobacterium tuberculosis
ALSGGERQRVSIA

SEQ ID NO: 150229 - protein, 13 aa, Mycobacterium tuberculosis
LSGGERQRVSIAR

SEQ ID NO: 150230 - protein, 13 aa, Mycobacterium tuberculosis
SGGERQRVSIARA

SEQ ID NO: 150231 - protein, 13 aa, Mycobacterium tuberculosis
GGERQRVSIARAL

SEQ ID NO: 150232 - protein, 13 aa, Mycobacterium tuberculosis
GERQRVSIARALL

SEQ ID NO: 150233 - protein, 13 aa, Mycobacterium tuberculosis
ERQRVSIARALLK

SEQ ID NO: 150234 - protein, 13 aa, Mycobacterium tuberculosis
RQRVSIARALLKA

SEQ ID NO: 150235 - protein, 13 aa, Mycobacterium tuberculosis
QRVSIARALLKAA

SEQ ID NO: 150236 - protein, 13 aa, Mycobacterium tuberculosis
RVSIARALLKAAP

SEQ ID NO: 150237 - protein, 13 aa, Mycobacterium tuberculosis
VSIARALLKAAPV

SEQ ID NO: 150238 - protein, 13 aa, Mycobacterium tuberculosis
SIARALLKAAPVL

SEQ ID NO: 150239 - protein, 13 aa, Mycobacterium tuberculosis
IARALLKAAPVLL

SEQ ID NO: 150240 - protein, 13 aa, Mycobacterium tuberculosis
ARALLKAAPVLLV

SEQ ID NO: 150241 - protein, 13 aa, Mycobacterium tuberculosis
RALLKAAPVLLVD

SEQ ID NO: 150242 - protein, 13 aa, Mycobacterium tuberculosis
ALLKAAPVLLVDE

SEQ ID NO: 150243 - protein, 13 aa, Mycobacterium tuberculosis
LLKAAPVLLVDEA

SEQ ID NO: 150244 - protein, 13 aa, Mycobacterium tuberculosis
LKAAPVLLVDEAT

SEQ ID NO: 150245 - protein, 13 aa, Mycobacterium tuberculosis
KAAPVLLVDEATS

SEQ ID NO: 150246 - protein, 13 aa, Mycobacterium tuberculosis
AAPVLLVDEATSA

SEQ ID NO: 150247 - protein, 13 aa, Mycobacterium tuberculosis
APVLLVDEATSAL

SEQ ID NO: 150248 - protein, 13 aa, Mycobacterium tuberculosis
PVLLVDEATSALD

SEQ ID NO: 150249 - protein, 13 aa, Mycobacterium tuberculosis
VLLVDEATSALDA

SEQ ID NO: 150250 - protein, 13 aa, Mycobacterium tuberculosis
LLVDEATSALDAE

SEQ ID NO: 150251 - protein, 13 aa, Mycobacterium tuberculosis
LVDEATSALDAEN

SEQ ID NO: 150252 - protein, 13 aa, Mycobacterium tuberculosis
VDEATSALDAENE

SEQ ID NO: 150253 - protein, 13 aa, Mycobacterium tuberculosis
DEATSALDAENEA

SEQ ID NO: 150254 - protein, 13 aa, Mycobacterium tuberculosis
EATSALDAENEAA

SEQ ID NO: 150255 - protein, 13 aa, Mycobacterium tuberculosis
ATSALDAENEAAV

SEQ ID NO: 150256 - protein, 13 aa, Mycobacterium tuberculosis
TSALDAENEAAVV

SEQ ID NO: 150257 - protein, 13 aa, Mycobacterium tuberculosis
SALDAENEAAVVD

SEQ ID NO: 150258 - protein, 13 aa, Mycobacterium tuberculosis
ALDAENEAAVVDA

SEQ ID NO: 150259 - protein, 13 aa, Mycobacterium tuberculosis
LDAENEAAVVDAL

SEQ ID NO: 150260 - protein, 13 aa, Mycobacterium tuberculosis
DAENEAAVVDALA

SEQ ID NO: 150261 - protein, 13 aa, Mycobacterium tuberculosis
AENEAAVVDALAA

SEQ ID NO: 150262 - protein, 13 aa, Mycobacterium tuberculosis
ENEAAVVDALAAD

SEQ ID NO: 150263 - protein, 13 aa, Mycobacterium tuberculosis
NEAAVVDALAADP

SEQ ID NO: 150264 - protein, 13 aa, Mycobacterium tuberculosis
EAAVVDALAADPR

SEQ ID NO: 150265 - protein, 13 aa, Mycobacterium tuberculosis
AAVVDALAADPRS

SEQ ID NO: 150266 - protein, 13 aa, Mycobacterium tuberculosis
AVVDALAADPRSR

SEQ ID NO: 150267 - protein, 13 aa, Mycobacterium tuberculosis
VVDALAADPRSRT

SEQ ID NO: 150268 - protein, 13 aa, Mycobacterium tuberculosis
VDALAADPRSRTR

SEQ ID NO: 150269 - protein, 13 aa, Mycobacterium tuberculosis
DALAADPRSRTRV

SEQ ID NO: 150270 - protein, 13 aa, Mycobacterium tuberculosis
ALAADPRSRTRVI

SEQ ID NO: 150271 - protein, 13 aa, Mycobacterium tuberculosis
LAADPRSRTRVIV

SEQ ID NO: 150272 - protein, 13 aa, Mycobacterium tuberculosis
AADPRSRTRVIVA

SEQ ID NO: 150273 - protein, 13 aa, Mycobacterium tuberculosis
ADPRSRTRVIVAH

SEQ ID NO: 150274 - protein, 13 aa, Mycobacterium tuberculosis
DPRSRTRVIVAHR

SEQ ID NO: 150275 - protein, 13 aa, Mycobacterium tuberculosis
PRSRTRVIVAHRL

SEQ ID NO: 150276 - protein, 13 aa, Mycobacterium tuberculosis
RSRTRVIVAHRLA

SEQ ID NO: 150277 - protein, 13 aa, Mycobacterium tuberculosis
SRTRVIVAHRLAS

SEQ ID NO: 150278 - protein, 13 aa, Mycobacterium tuberculosis
RTRVIVAHRLASI

SEQ ID NO: 150279 - protein, 13 aa, Mycobacterium tuberculosis
TRVIVAHRLASIR

SEQ ID NO: 150280 - protein, 13 aa, Mycobacterium tuberculosis
RVIVAHRLASIRH

SEQ ID NO: 150281 - protein, 13 aa, Mycobacterium tuberculosis
VIVAHRLASIRHA

SEQ ID NO: 150282 - protein, 13 aa, Mycobacterium tuberculosis
IVAHRLASIRHAD

SEQ ID NO: 150283 - protein, 13 aa, Mycobacterium tuberculosis
VAHRLASIRHADR

SEQ ID NO: 150284 - protein, 13 aa, Mycobacterium tuberculosis
AHRLASIRHADRV

SEQ ID NO: 150285 - protein, 13 aa, Mycobacterium tuberculosis
HRLASIRHADRVL

SEQ ID NO: 150286 - protein, 13 aa, Mycobacterium tuberculosis
RLASIRHADRVLF

SEQ ID NO: 150287 - protein, 13 aa, Mycobacterium tuberculosis
LASIRHADRVLFV

SEQ ID NO: 150288 - protein, 13 aa, Mycobacterium tuberculosis
ASIRHADRVLFVD

SEQ ID NO: 150289 - protein, 13 aa, Mycobacterium tuberculosis
SIRHADRVLFVDD

SEQ ID NO: 150290 - protein, 13 aa, Mycobacterium tuberculosis
IRHADRVLFVDDG

SEQ ID NO: 150291 - protein, 13 aa, Mycobacterium tuberculosis
RHADRVLFVDDGR

SEQ ID NO: 150292 - protein, 13 aa, Mycobacterium tuberculosis
HADRVLFVDDGRV

SEQ ID NO: 150293 - protein, 13 aa, Mycobacterium tuberculosis
ADRVLFVDDGRVV

SEQ ID NO: 150294 - protein, 13 aa, Mycobacterium tuberculosis
DRVLFVDDGRVVE

SEQ ID NO: 150295 - protein, 13 aa, Mycobacterium tuberculosis
RVLFVDDGRVVED

SEQ ID NO: 150296 - protein, 13 aa, Mycobacterium tuberculosis
VLFVDDGRVVEDG

SEQ ID NO: 150297 - protein, 13 aa, Mycobacterium tuberculosis
LFVDDGRVVEDGS

SEQ ID NO: 150298 - protein, 13 aa, Mycobacterium tuberculosis
FVDDGRVVEDGSI

SEQ ID NO: 150299 - protein, 13 aa, Mycobacterium tuberculosis
VDDGRVVEDGSIS

SEQ ID NO: 150300 - protein, 13 aa, Mycobacterium tuberculosis
DDGRVVEDGSISE

SEQ ID NO: 150301 - protein, 13 aa, Mycobacterium tuberculosis
DGRVVEDGSISEL

SEQ ID NO: 150302 - protein, 13 aa, Mycobacterium tuberculosis
GRVVEDGSISELL

SEQ ID NO: 150303 - protein, 13 aa, Mycobacterium tuberculosis
RVVEDGSISELLT

SEQ ID NO: 150304 - protein, 13 aa, Mycobacterium tuberculosis
VVEDGSISELLTA

SEQ ID NO: 150305 - protein, 13 aa, Mycobacterium tuberculosis
VEDGSISELLTAG

SEQ ID NO: 150306 - protein, 13 aa, Mycobacterium tuberculosis
EDGSISELLTAGG

SEQ ID NO: 150307 - protein, 13 aa, Mycobacterium tuberculosis
DGSISELLTAGGR

SEQ ID NO: 150308 - protein, 13 aa, Mycobacterium tuberculosis
GSISELLTAGGRF

SEQ ID NO: 150309 - protein, 13 aa, Mycobacterium tuberculosis
SISELLTAGGRFS

SEQ ID NO: 150310 - protein, 13 aa, Mycobacterium tuberculosis
ISELLTAGGRFSQ

SEQ ID NO: 150311 - protein, 13 aa, Mycobacterium tuberculosis
SELLTAGGRFSQF

SEQ ID NO: 150312 - protein, 13 aa, Mycobacterium tuberculosis
ELLTAGGRFSQFW

SEQ ID NO: 150313 - protein, 13 aa, Mycobacterium tuberculosis
LLTAGGRFSQFWR

SEQ ID NO: 150314 - protein, 13 aa, Mycobacterium tuberculosis
LTAGGRFSQFWRQ

SEQ ID NO: 150315 - protein, 13 aa, Mycobacterium tuberculosis
TAGGRFSQFWRQQ

SEQ ID NO: 150316 - protein, 13 aa, Mycobacterium tuberculosis
AGGRFSQFWRQQH

SEQ ID NO: 150317 - protein, 13 aa, Mycobacterium tuberculosis
GGRFSQFWRQQHE

SEQ ID NO: 150318 - protein, 13 aa, Mycobacterium tuberculosis
GRFSQFWRQQHEA

SEQ ID NO: 150319 - protein, 13 aa, Mycobacterium tuberculosis
RFSQFWRQQHEAA

SEQ ID NO: 150320 - protein, 13 aa, Mycobacterium tuberculosis
FSQFWRQQHEAAE

SEQ ID NO: 150321 - protein, 13 aa, Mycobacterium tuberculosis
SQFWRQQHEAAEW

SEQ ID NO: 150322 - protein, 13 aa, Mycobacterium tuberculosis
QFWRQQHEAAEWQ

SEQ ID NO: 150323 - protein, 13 aa, Mycobacterium tuberculosis
FWRQQHEAAEWQI

SEQ ID NO: 150324 - protein, 13 aa, Mycobacterium tuberculosis
WRQQHEAAEWQIL

SEQ ID NO: 150325 - protein, 13 aa, Mycobacterium tuberculosis
RQQHEAAEWQILA

SEQ ID NO: 150326 - protein, 13 aa, Mycobacterium tuberculosis
QQHEAAEWQILAE

SEQ ID NO: 150327 - protein, 14 aa, Mycobacterium tuberculosis
MIRTWIALVPNDHR

SEQ ID NO: 150328 - protein, 14 aa, Mycobacterium tuberculosis
IRTWIALVPNDHRA

SEQ ID NO: 150329 - protein, 14 aa, Mycobacterium tuberculosis
RTWIALVPNDHRAR

SEQ ID NO: 150330 - protein, 14 aa, Mycobacterium tuberculosis
TWIALVPNDHRARL

SEQ ID NO: 150331 - protein, 14 aa, Mycobacterium tuberculosis
WIALVPNDHRARLI

SEQ ID NO: 150332 - protein, 14 aa, Mycobacterium tuberculosis
IALVPNDHRARLIG

SEQ ID NO: 150333 - protein, 14 aa, Mycobacterium tuberculosis
ALVPNDHRARLIGF

SEQ ID NO: 150334 - protein, 14 aa, Mycobacterium tuberculosis
LVPNDHRARLIGFA

SEQ ID NO: 150335 - protein, 14 aa, Mycobacterium tuberculosis
VPNDHRARLIGFAL

SEQ ID NO: 150336 - protein, 14 aa, Mycobacterium tuberculosis
PNDHRARLIGFALL

SEQ ID NO: 150337 - protein, 14 aa, Mycobacterium tuberculosis
NDHRARLIGFALLA

SEQ ID NO: 150338 - protein, 14 aa, Mycobacterium tuberculosis
DHRARLIGFALLAF

SEQ ID NO: 150339 - protein, 14 aa, Mycobacterium tuberculosis
HRARLIGFALLAFC

SEQ ID NO: 150340 - protein, 14 aa, Mycobacterium tuberculosis
RARLIGFALLAFCS

SEQ ID NO: 150341 - protein, 14 aa, Mycobacterium tuberculosis
ARLIGFALLAFCSV

SEQ ID NO: 150342 - protein, 14 aa, Mycobacterium tuberculosis
RLIGFALLAFCSVV

SEQ ID NO: 150343 - protein, 14 aa, Mycobacterium tuberculosis
LIGFALLAFCSVVA

SEQ ID NO: 150344 - protein, 14 aa, Mycobacterium tuberculosis
IGFALLAFCSVVAR

SEQ ID NO: 150345 - protein, 14 aa, Mycobacterium tuberculosis
GFALLAFCSVVARA

SEQ ID NO: 150346 - protein, 14 aa, Mycobacterium tuberculosis
FALLAFCSVVARAV

SEQ ID NO: 150347 - protein, 14 aa, Mycobacterium tuberculosis
ALLAFCSVVARAVG

SEQ ID NO: 150348 - protein, 14 aa, Mycobacterium tuberculosis
LLAFCSVVARAVGT

SEQ ID NO: 150349 - protein, 14 aa, Mycobacterium tuberculosis
LAFCSVVARAVGTV

SEQ ID NO: 150350 - protein, 14 aa, Mycobacterium tuberculosis
AFCSVVARAVGTVL

SEQ ID NO: 150351 - protein, 14 aa, Mycobacterium tuberculosis
FCSVVARAVGTVLL

SEQ ID NO: 150352 - protein, 14 aa, Mycobacterium tuberculosis
CSVVARAVGTVLLV

SEQ ID NO: 150353 - protein, 14 aa, Mycobacterium tuberculosis
SVVARAVGTVLLVP

SEQ ID NO: 150354 - protein, 14 aa, Mycobacterium tuberculosis
VVARAVGTVLLVPL

SEQ ID NO: 150355 - protein, 14 aa, Mycobacterium tuberculosis
VARAVGTVLLVPLM

SEQ ID NO: 150356 - protein, 14 aa, Mycobacterium tuberculosis
ARAVGTVLLVPLMA

SEQ ID NO: 150357 - protein, 14 aa, Mycobacterium tuberculosis
RAVGTVLLVPLMAA

SEQ ID NO: 150358 - protein, 14 aa, Mycobacterium tuberculosis
AVGTVLLVPLMAAL

SEQ ID NO: 150359 - protein, 14 aa, Mycobacterium tuberculosis
VGTVLLVPLMAALF

SEQ ID NO: 150360 - protein, 14 aa, Mycobacterium tuberculosis
GTVLLVPLMAALFG

SEQ ID NO: 150361 - protein, 14 aa, Mycobacterium tuberculosis
TVLLVPLMAALFGE

SEQ ID NO: 150362 - protein, 14 aa, Mycobacterium tuberculosis
VLLVPLMAALFGEA

SEQ ID NO: 150363 - protein, 14 aa, Mycobacterium tuberculosis
LLVPLMAALFGEAP

SEQ ID NO: 150364 - protein, 14 aa, Mycobacterium tuberculosis
LVPLMAALFGEAPQ

SEQ ID NO: 150365 - protein, 14 aa, Mycobacterium tuberculosis
VPLMAALFGEAPQR

SEQ ID NO: 150366 - protein, 14 aa, Mycobacterium tuberculosis
PLMAALFGEAPQRA

SEQ ID NO: 150367 - protein, 14 aa, Mycobacterium tuberculosis
LMAALFGEAPQRAW

SEQ ID NO: 150368 - protein, 14 aa, Mycobacterium tuberculosis
MAALFGEAPQRAWL

SEQ ID NO: 150369 - protein, 14 aa, Mycobacterium tuberculosis
AALFGEAPQRAWLW

SEQ ID NO: 150370 - protein, 14 aa, Mycobacterium tuberculosis
ALFGEAPQRAWLWL

SEQ ID NO: 150371 - protein, 14 aa, Mycobacterium tuberculosis
LFGEAPQRAWLWLG

SEQ ID NO: 150372 - protein, 14 aa, Mycobacterium tuberculosis
FGEAPQRAWLWLGW

SEQ ID NO: 150373 - protein, 14 aa, Mycobacterium tuberculosis
GEAPQRAWLWLGWL

SEQ ID NO: 150374 - protein, 14 aa, Mycobacterium tuberculosis
EAPQRAWLWLGWLS

SEQ ID NO: 150375 - protein, 14 aa, Mycobacterium tuberculosis
APQRAWLWLGWLSA

SEQ ID NO: 150376 - protein, 14 aa, Mycobacterium tuberculosis
PQRAWLWLGWLSAA

SEQ ID NO: 150377 - protein, 14 aa, Mycobacterium tuberculosis
QRAWLWLGWLSAAT

SEQ ID NO: 150378 - protein, 14 aa, Mycobacterium tuberculosis
RAWLWLGWLSAATV

SEQ ID NO: 150379 - protein, 14 aa, Mycobacterium tuberculosis
AWLWLGWLSAATVA

SEQ ID NO: 150380 - protein, 14 aa, Mycobacterium tuberculosis
WLWLGWLSAATVAG

SEQ ID NO: 150381 - protein, 14 aa, Mycobacterium tuberculosis
LWLGWLSAATVAGW

SEQ ID NO: 150382 - protein, 14 aa, Mycobacterium tuberculosis
WLGWLSAATVAGWV

SEQ ID NO: 150383 - protein, 14 aa, Mycobacterium tuberculosis
LGWLSAATVAGWVL

SEQ ID NO: 150384 - protein, 14 aa, Mycobacterium tuberculosis
GWLSAATVAGWVLD

SEQ ID NO: 150385 - protein, 14 aa, Mycobacterium tuberculosis
WLSAATVAGWVLDA

SEQ ID NO: 150386 - protein, 14 aa, Mycobacterium tuberculosis
LSAATVAGWVLDAV

SEQ ID NO: 150387 - protein, 14 aa, Mycobacterium tuberculosis
SAATVAGWVLDAVT

SEQ ID NO: 150388 - protein, 14 aa, Mycobacterium tuberculosis
AATVAGWVLDAVTA

SEQ ID NO: 150389 - protein, 14 aa, Mycobacterium tuberculosis
ATVAGWVLDAVTAR

SEQ ID NO: 150390 - protein, 14 aa, Mycobacterium tuberculosis
TVAGWVLDAVTARI

SEQ ID NO: 150391 - protein, 14 aa, Mycobacterium tuberculosis
VAGWVLDAVTARIG

SEQ ID NO: 150392 - protein, 14 aa, Mycobacterium tuberculosis
AGWVLDAVTARIGI

SEQ ID NO: 150393 - protein, 14 aa, Mycobacterium tuberculosis
GWVLDAVTARIGIE

SEQ ID NO: 150394 - protein, 14 aa, Mycobacterium tuberculosis
WVLDAVTARIGIEL

SEQ ID NO: 150395 - protein, 14 aa, Mycobacterium tuberculosis
VLDAVTARIGIELG

SEQ ID NO: 150396 - protein, 14 aa, Mycobacterium tuberculosis
LDAVTARIGIELGF

SEQ ID NO: 150397 - protein, 14 aa, Mycobacterium tuberculosis
DAVTARIGIELGFA

SEQ ID NO: 150398 - protein, 14 aa, Mycobacterium tuberculosis
AVTARIGIELGFAV

SEQ ID NO: 150399 - protein, 14 aa, Mycobacterium tuberculosis
VTARIGIELGFAVL

SEQ ID NO: 150400 - protein, 14 aa, Mycobacterium tuberculosis
TARIGIELGFAVLN

SEQ ID NO: 150401 - protein, 14 aa, Mycobacterium tuberculosis
ARIGIELGFAVLNH

SEQ ID NO: 150402 - protein, 14 aa, Mycobacterium tuberculosis
RIGIELGFAVLNHT

SEQ ID NO: 150403 - protein, 14 aa, Mycobacterium tuberculosis
IGIELGFAVLNHTQ

SEQ ID NO: 150404 - protein, 14 aa, Mycobacterium tuberculosis
GIELGFAVLNHTQH

SEQ ID NO: 150405 - protein, 14 aa, Mycobacterium tuberculosis
IELGFAVLNHTQHD

SEQ ID NO: 150406 - protein, 14 aa, Mycobacterium tuberculosis
ELGFAVLNHTQHDV

SEQ ID NO: 150407 - protein, 14 aa, Mycobacterium tuberculosis
LGFAVLNHTQHDVA

SEQ ID NO: 150408 - protein, 14 aa, Mycobacterium tuberculosis
GFAVLNHTQHDVAD

SEQ ID NO: 150409 - protein, 14 aa, Mycobacterium tuberculosis
FAVLNHTQHDVADR

SEQ ID NO: 150410 - protein, 14 aa, Mycobacterium tuberculosis
AVLNHTQHDVADRL

SEQ ID NO: 150411 - protein, 14 aa, Mycobacterium tuberculosis
VLNHTQHDVADRLP

SEQ ID NO: 150412 - protein, 14 aa, Mycobacterium tuberculosis
LNHTQHDVADRLPV

SEQ ID NO: 150413 - protein, 14 aa, Mycobacterium tuberculosis
NHTQHDVADRLPVV

SEQ ID NO: 150414 - protein, 14 aa, Mycobacterium tuberculosis
HTQHDVADRLPVVR

SEQ ID NO: 150415 - protein, 14 aa, Mycobacterium tuberculosis
TQHDVADRLPVVRL

SEQ ID NO: 150416 - protein, 14 aa, Mycobacterium tuberculosis
QHDVADRLPVVRLD

SEQ ID NO: 150417 - protein, 14 aa, Mycobacterium tuberculosis
HDVADRLPVVRLDW

SEQ ID NO: 150418 - protein, 14 aa, Mycobacterium tuberculosis
DVADRLPVVRLDWF

SEQ ID NO: 150419 - protein, 14 aa, Mycobacterium tuberculosis
VADRLPVVRLDWFT

SEQ ID NO: 150420 - protein, 14 aa, Mycobacterium tuberculosis
ADRLPVVRLDWFTA

SEQ ID NO: 150421 - protein, 14 aa, Mycobacterium tuberculosis
DRLPVVRLDWFTAE

SEQ ID NO: 150422 - protein, 14 aa, Mycobacterium tuberculosis
RLPVVRLDWFTAEN

SEQ ID NO: 150423 - protein, 14 aa, Mycobacterium tuberculosis
LPVVRLDWFTAENT

SEQ ID NO: 150424 - protein, 14 aa, Mycobacterium tuberculosis
PVVRLDWFTAENTA

SEQ ID NO: 150425 - protein, 14 aa, Mycobacterium tuberculosis
VVRLDWFTAENTAT

SEQ ID NO: 150426 - protein, 14 aa, Mycobacterium tuberculosis
VRLDWFTAENTATA

SEQ ID NO: 150427 - protein, 14 aa, Mycobacterium tuberculosis
RLDWFTAENTATAR

SEQ ID NO: 150428 - protein, 14 aa, Mycobacterium tuberculosis
LDWFTAENTATARQ

SEQ ID NO: 150429 - protein, 14 aa, Mycobacterium tuberculosis
DWFTAENTATARQA

SEQ ID NO: 150430 - protein, 14 aa, Mycobacterium tuberculosis
WFTAENTATARQAI

SEQ ID NO: 150431 - protein, 14 aa, Mycobacterium tuberculosis
FTAENTATARQAIA

SEQ ID NO: 150432 - protein, 14 aa, Mycobacterium tuberculosis
TAENTATARQAIAA

SEQ ID NO: 150433 - protein, 14 aa, Mycobacterium tuberculosis
AENTATARQAIAAT

SEQ ID NO: 150434 - protein, 14 aa, Mycobacterium tuberculosis
ENTATARQAIAATG

SEQ ID NO: 150435 - protein, 14 aa, Mycobacterium tuberculosis
NTATARQAIAATGP

SEQ ID NO: 150436 - protein, 14 aa, Mycobacterium tuberculosis
TATARQAIAATGPE

SEQ ID NO: 150437 - protein, 14 aa, Mycobacterium tuberculosis
ATARQAIAATGPEL

SEQ ID NO: 150438 - protein, 14 aa, Mycobacterium tuberculosis
TARQAIAATGPELV

SEQ ID NO: 150439 - protein, 14 aa, Mycobacterium tuberculosis
ARQAIAATGPELVG

SEQ ID NO: 150440 - protein, 14 aa, Mycobacterium tuberculosis
RQAIAATGPELVGL

SEQ ID NO: 150441 - protein, 14 aa, Mycobacterium tuberculosis
QAIAATGPELVGLV

SEQ ID NO: 150442 - protein, 14 aa, Mycobacterium tuberculosis
AIAATGPELVGLVV

SEQ ID NO: 150443 - protein, 14 aa, Mycobacterium tuberculosis
IAATGPELVGLVVN

SEQ ID NO: 150444 - protein, 14 aa, Mycobacterium tuberculosis
AATGPELVGLVVNL

SEQ ID NO: 150445 - protein, 14 aa, Mycobacterium tuberculosis
ATGPELVGLVVNLV

SEQ ID NO: 150446 - protein, 14 aa, Mycobacterium tuberculosis
TGPELVGLVVNLVT

SEQ ID NO: 150447 - protein, 14 aa, Mycobacterium tuberculosis
GPELVGLVVNLVTP

SEQ ID NO: 150448 - protein, 14 aa, Mycobacterium tuberculosis
PELVGLVVNLVTPL

SEQ ID NO: 150449 - protein, 14 aa, Mycobacterium tuberculosis
ELVGLVVNLVTPLT

SEQ ID NO: 150450 - protein, 14 aa, Mycobacterium tuberculosis
LVGLVVNLVTPLTS

SEQ ID NO: 150451 - protein, 14 aa, Mycobacterium tuberculosis
VGLVVNLVTPLTSA

SEQ ID NO: 150452 - protein, 14 aa, Mycobacterium tuberculosis
GLVVNLVTPLTSAI

SEQ ID NO: 150453 - protein, 14 aa, Mycobacterium tuberculosis
LVVNLVTPLTSAIL

SEQ ID NO: 150454 - protein, 14 aa, Mycobacterium tuberculosis
VVNLVTPLTSAILL

SEQ ID NO: 150455 - protein, 14 aa, Mycobacterium tuberculosis
VNLVTPLTSAILLP

SEQ ID NO: 150456 - protein, 14 aa, Mycobacterium tuberculosis
NLVTPLTSAILLPA

SEQ ID NO: 150457 - protein, 14 aa, Mycobacterium tuberculosis
LVTPLTSAILLPAV

SEQ ID NO: 150458 - protein, 14 aa, Mycobacterium tuberculosis
VTPLTSAILLPAVI

SEQ ID NO: 150459 - protein, 14 aa, Mycobacterium tuberculosis
TPLTSAILLPAVIA

SEQ ID NO: 150460 - protein, 14 aa, Mycobacterium tuberculosis
PLTSAILLPAVIAL

SEQ ID NO: 150461 - protein, 14 aa, Mycobacterium tuberculosis
LTSAILLPAVIALA

SEQ ID NO: 150462 - protein, 14 aa, Mycobacterium tuberculosis
TSAILLPAVIALAL

SEQ ID NO: 150463 - protein, 14 aa, Mycobacterium tuberculosis
SAILLPAVIALALL

SEQ ID NO: 150464 - protein, 14 aa, Mycobacterium tuberculosis
AILLPAVIALALLP

SEQ ID NO: 150465 - protein, 14 aa, Mycobacterium tuberculosis
ILLPAVIALALLPI

SEQ ID NO: 150466 - protein, 14 aa, Mycobacterium tuberculosis
LLPAVIALALLPIS

SEQ ID NO: 150467 - protein, 14 aa, Mycobacterium tuberculosis
LPAVIALALLPISW

SEQ ID NO: 150468 - protein, 14 aa, Mycobacterium tuberculosis
PAVIALALLPISWQ

SEQ ID NO: 150469 - protein, 14 aa, Mycobacterium tuberculosis
AVIALALLPISWQL

SEQ ID NO: 150470 - protein, 14 aa, Mycobacterium tuberculosis
VIALALLPISWQLG

SEQ ID NO: 150471 - protein, 14 aa, Mycobacterium tuberculosis
IALALLPISWQLGV

SEQ ID NO: 150472 - protein, 14 aa, Mycobacterium tuberculosis
ALALLPISWQLGVA

SEQ ID NO: 150473 - protein, 14 aa, Mycobacterium tuberculosis
LALLPISWQLGVAA

SEQ ID NO: 150474 - protein, 14 aa, Mycobacterium tuberculosis
ALLPISWQLGVAAL

SEQ ID NO: 150475 - protein, 14 aa, Mycobacterium tuberculosis
LLPISWQLGVAALA

SEQ ID NO: 150476 - protein, 14 aa, Mycobacterium tuberculosis
LPISWQLGVAALAG

SEQ ID NO: 150477 - protein, 14 aa, Mycobacterium tuberculosis
PISWQLGVAALAGV

SEQ ID NO: 150478 - protein, 14 aa, Mycobacterium tuberculosis
ISWQLGVAALAGVP

SEQ ID NO: 150479 - protein, 14 aa, Mycobacterium tuberculosis
SWQLGVAALAGVPL

SEQ ID NO: 150480 - protein, 14 aa, Mycobacterium tuberculosis
WQLGVAALAGVPLL

SEQ ID NO: 150481 - protein, 14 aa, Mycobacterium tuberculosis
QLGVAALAGVPLLL

SEQ ID NO: 150482 - protein, 14 aa, Mycobacterium tuberculosis
LGVAALAGVPLLLG

SEQ ID NO: 150483 - protein, 14 aa, Mycobacterium tuberculosis
GVAALAGVPLLLGA

SEQ ID NO: 150484 - protein, 14 aa, Mycobacterium tuberculosis
VAALAGVPLLLGAL

SEQ ID NO: 150485 - protein, 14 aa, Mycobacterium tuberculosis
AALAGVPLLLGALW

SEQ ID NO: 150486 - protein, 14 aa, Mycobacterium tuberculosis
ALAGVPLLLGALWA

SEQ ID NO: 150487 - protein, 14 aa, Mycobacterium tuberculosis
LAGVPLLLGALWAS

SEQ ID NO: 150488 - protein, 14 aa, Mycobacterium tuberculosis
AGVPLLLGALWASA

SEQ ID NO: 150489 - protein, 14 aa, Mycobacterium tuberculosis
GVPLLLGALWASAA

SEQ ID NO: 150490 - protein, 14 aa, Mycobacterium tuberculosis
VPLLLGALWASAAF

SEQ ID NO: 150491 - protein, 14 aa, Mycobacterium tuberculosis
PLLLGALWASAAFA

SEQ ID NO: 150492 - protein, 14 aa, Mycobacterium tuberculosis
LLLGALWASAAFAR

SEQ ID NO: 150493 - protein, 14 aa, Mycobacterium tuberculosis
LLGALWASAAFARR

SEQ ID NO: 150494 - protein, 14 aa, Mycobacterium tuberculosis
LGALWASAAFARRA

SEQ ID NO: 150495 - protein, 14 aa, Mycobacterium tuberculosis
GALWASAAFARRAD

SEQ ID NO: 150496 - protein, 14 aa, Mycobacterium tuberculosis
ALWASAAFARRADT

SEQ ID NO: 150497 - protein, 14 aa, Mycobacterium tuberculosis
LWASAAFARRADTA

SEQ ID NO: 150498 - protein, 14 aa, Mycobacterium tuberculosis
WASAAFARRADTAA

SEQ ID NO: 150499 - protein, 14 aa, Mycobacterium tuberculosis
ASAAFARRADTAAD

SEQ ID NO: 150500 - protein, 14 aa, Mycobacterium tuberculosis
SAAFARRADTAADK

SEQ ID NO: 150501 - protein, 14 aa, Mycobacterium tuberculosis
AAFARRADTAADKA

SEQ ID NO: 150502 - protein, 14 aa, Mycobacterium tuberculosis
AFARRADTAADKAN

SEQ ID NO: 150503 - protein, 14 aa, Mycobacterium tuberculosis
FARRADTAADKANT

SEQ ID NO: 150504 - protein, 14 aa, Mycobacterium tuberculosis
ARRADTAADKANTA

SEQ ID NO: 150505 - protein, 14 aa, Mycobacterium tuberculosis
RRADTAADKANTAL

SEQ ID NO: 150506 - protein, 14 aa, Mycobacterium tuberculosis
RADTAADKANTALT

SEQ ID NO: 150507 - protein, 14 aa, Mycobacterium tuberculosis
ADTAADKANTALTE

SEQ ID NO: 150508 - protein, 14 aa, Mycobacterium tuberculosis
DTAADKANTALTER

SEQ ID NO: 150509 - protein, 14 aa, Mycobacterium tuberculosis
TAADKANTALTERI

SEQ ID NO: 150510 - protein, 14 aa, Mycobacterium tuberculosis
AADKANTALTERII

SEQ ID NO: 150511 - protein, 14 aa, Mycobacterium tuberculosis
ADKANTALTERIIE

SEQ ID NO: 150512 - protein, 14 aa, Mycobacterium tuberculosis
DKANTALTERIIEF

SEQ ID NO: 150513 - protein, 14 aa, Mycobacterium tuberculosis
KANTALTERIIEFA

SEQ ID NO: 150514 - protein, 14 aa, Mycobacterium tuberculosis
ANTALTERIIEFAR

SEQ ID NO: 150515 - protein, 14 aa, Mycobacterium tuberculosis
NTALTERIIEFART

SEQ ID NO: 150516 - protein, 14 aa, Mycobacterium tuberculosis
TALTERIIEFARTQ

SEQ ID NO: 150517 - protein, 14 aa, Mycobacterium tuberculosis
ALTERIIEFARTQQ

SEQ ID NO: 150518 - protein, 14 aa, Mycobacterium tuberculosis
LTERIIEFARTQQA

SEQ ID NO: 150519 - protein, 14 aa, Mycobacterium tuberculosis
TERIIEFARTQQAL

SEQ ID NO: 150520 - protein, 14 aa, Mycobacterium tuberculosis
ERIIEFARTQQALR

SEQ ID NO: 150521 - protein, 14 aa, Mycobacterium tuberculosis
RIIEFARTQQALRA

SEQ ID NO: 150522 - protein, 14 aa, Mycobacterium tuberculosis
IIEFARTQQALRAA

SEQ ID NO: 150523 - protein, 14 aa, Mycobacterium tuberculosis
IEFARTQQALRAAR

SEQ ID NO: 150524 - protein, 14 aa, Mycobacterium tuberculosis
EFARTQQALRAARR

SEQ ID NO: 150525 - protein, 14 aa, Mycobacterium tuberculosis
FARTQQALRAARRV

SEQ ID NO: 150526 - protein, 14 aa, Mycobacterium tuberculosis
ARTQQALRAARRVE

SEQ ID NO: 150527 - protein, 14 aa, Mycobacterium tuberculosis
RTQQALRAARRVEP

SEQ ID NO: 150528 - protein, 14 aa, Mycobacterium tuberculosis
TQQALRAARRVEPA

SEQ ID NO: 150529 - protein, 14 aa, Mycobacterium tuberculosis
QQALRAARRVEPAR

SEQ ID NO: 150530 - protein, 14 aa, Mycobacterium tuberculosis
QALRAARRVEPARS

SEQ ID NO: 150531 - protein, 14 aa, Mycobacterium tuberculosis
ALRAARRVEPARSL

SEQ ID NO: 150532 - protein, 14 aa, Mycobacterium tuberculosis
LRAARRVEPARSLV

SEQ ID NO: 150533 - protein, 14 aa, Mycobacterium tuberculosis
RAARRVEPARSLVG

SEQ ID NO: 150534 - protein, 14 aa, Mycobacterium tuberculosis
AARRVEPARSLVGN

SEQ ID NO: 150535 - protein, 14 aa, Mycobacterium tuberculosis
ARRVEPARSLVGNA

SEQ ID NO: 150536 - protein, 14 aa, Mycobacterium tuberculosis
RRVEPARSLVGNAL

SEQ ID NO: 150537 - protein, 14 aa, Mycobacterium tuberculosis
RVEPARSLVGNALA

SEQ ID NO: 150538 - protein, 14 aa, Mycobacterium tuberculosis
VEPARSLVGNALAS

SEQ ID NO: 150539 - protein, 14 aa, Mycobacterium tuberculosis
EPARSLVGNALASQ

SEQ ID NO: 150540 - protein, 14 aa, Mycobacterium tuberculosis
PARSLVGNALASQH

SEQ ID NO: 150541 - protein, 14 aa, Mycobacterium tuberculosis
ARSLVGNALASQHT

SEQ ID NO: 150542 - protein, 14 aa, Mycobacterium tuberculosis
RSLVGNALASQHTA

SEQ ID NO: 150543 - protein, 14 aa, Mycobacterium tuberculosis
SLVGNALASQHTAT

SEQ ID NO: 150544 - protein, 14 aa, Mycobacterium tuberculosis
LVGNALASQHTATM

SEQ ID NO: 150545 - protein, 14 aa, Mycobacterium tuberculosis
VGNALASQHTATMR

SEQ ID NO: 150546 - protein, 14 aa, Mycobacterium tuberculosis
GNALASQHTATMRL

SEQ ID NO: 150547 - protein, 14 aa, Mycobacterium tuberculosis
NALASQHTATMRLL

SEQ ID NO: 150548 - protein, 14 aa, Mycobacterium tuberculosis
ALASQHTATMRLLG

SEQ ID NO: 150549 - protein, 14 aa, Mycobacterium tuberculosis
LASQHTATMRLLGM

SEQ ID NO: 150550 - protein, 14 aa, Mycobacterium tuberculosis
ASQHTATMRLLGMQ

SEQ ID NO: 150551 - protein, 14 aa, Mycobacterium tuberculosis
SQHTATMRLLGMQI

SEQ ID NO: 150552 - protein, 14 aa, Mycobacterium tuberculosis
QHTATMRLLGMQIP

SEQ ID NO: 150553 - protein, 14 aa, Mycobacterium tuberculosis
HTATMRLLGMQIPG

SEQ ID NO: 150554 - protein, 14 aa, Mycobacterium tuberculosis
TATMRLLGMQIPGQ

SEQ ID NO: 150555 - protein, 14 aa, Mycobacterium tuberculosis
ATMRLLGMQIPGQL

SEQ ID NO: 150556 - protein, 14 aa, Mycobacterium tuberculosis
TMRLLGMQIPGQLL

SEQ ID NO: 150557 - protein, 14 aa, Mycobacterium tuberculosis
MRLLGMQIPGQLLF

SEQ ID NO: 150558 - protein, 14 aa, Mycobacterium tuberculosis
RLLGMQIPGQLLFS

SEQ ID NO: 150559 - protein, 14 aa, Mycobacterium tuberculosis
LLGMQIPGQLLFSI

SEQ ID NO: 150560 - protein, 14 aa, Mycobacterium tuberculosis
LGMQIPGQLLFSIA

SEQ ID NO: 150561 - protein, 14 aa, Mycobacterium tuberculosis
GMQIPGQLLFSIAS

SEQ ID NO: 150562 - protein, 14 aa, Mycobacterium tuberculosis
MQIPGQLLFSIASQ

SEQ ID NO: 150563 - protein, 14 aa, Mycobacterium tuberculosis
QIPGQLLFSIASQL

SEQ ID NO: 150564 - protein, 14 aa, Mycobacterium tuberculosis
IPGQLLFSIASQLA

SEQ ID NO: 150565 - protein, 14 aa, Mycobacterium tuberculosis
PGQLLFSIASQLAL

SEQ ID NO: 150566 - protein, 14 aa, Mycobacterium tuberculosis
GQLLFSIASQLALI

SEQ ID NO: 150567 - protein, 14 aa, Mycobacterium tuberculosis
QLLFSIASQLALIV

SEQ ID NO: 150568 - protein, 14 aa, Mycobacterium tuberculosis
LLFSIASQLALIVL

SEQ ID NO: 150569 - protein, 14 aa, Mycobacterium tuberculosis
LFSIASQLALIVLA

SEQ ID NO: 150570 - protein, 14 aa, Mycobacterium tuberculosis
FSIASQLALIVLAG

SEQ ID NO: 150571 - protein, 14 aa, Mycobacterium tuberculosis
SIASQLALIVLAGT

SEQ ID NO: 150572 - protein, 14 aa, Mycobacterium tuberculosis
IASQLALIVLAGTT

SEQ ID NO: 150573 - protein, 14 aa, Mycobacterium tuberculosis
ASQLALIVLAGTTA

SEQ ID NO: 150574 - protein, 14 aa, Mycobacterium tuberculosis
SQLALIVLAGTTAA

SEQ ID NO: 150575 - protein, 14 aa, Mycobacterium tuberculosis
QLALIVLAGTTAAL

SEQ ID NO: 150576 - protein, 14 aa, Mycobacterium tuberculosis
LALIVLAGTTAALT

SEQ ID NO: 150577 - protein, 14 aa, Mycobacterium tuberculosis
ALIVLAGTTAALTI

SEQ ID NO: 150578 - protein, 14 aa, Mycobacterium tuberculosis
LIVLAGTTAALTIT

SEQ ID NO: 150579 - protein, 14 aa, Mycobacterium tuberculosis
IVLAGTTAALTITG

SEQ ID NO: 150580 - protein, 14 aa, Mycobacterium tuberculosis
VLAGTTAALTITGT

SEQ ID NO: 150581 - protein, 14 aa, Mycobacterium tuberculosis
LAGTTAALTITGTL

SEQ ID NO: 150582 - protein, 14 aa, Mycobacterium tuberculosis
AGTTAALTITGTLT

SEQ ID NO: 150583 - protein, 14 aa, Mycobacterium tuberculosis
GTTAALTITGTLTV

SEQ ID NO: 150584 - protein, 14 aa, Mycobacterium tuberculosis
TTAALTITGTLTVP

SEQ ID NO: 150585 - protein, 14 aa, Mycobacterium tuberculosis
TAALTITGTLTVPE

SEQ ID NO: 150586 - protein, 14 aa, Mycobacterium tuberculosis
AALTITGTLTVPEA

SEQ ID NO: 150587 - protein, 14 aa, Mycobacterium tuberculosis
ALTITGTLTVPEAI

SEQ ID NO: 150588 - protein, 14 aa, Mycobacterium tuberculosis
LTITGTLTVPEAIA

SEQ ID NO: 150589 - protein, 14 aa, Mycobacterium tuberculosis
TITGTLTVPEAIAL

SEQ ID NO: 150590 - protein, 14 aa, Mycobacterium tuberculosis
ITGTLTVPEAIALI

SEQ ID NO: 150591 - protein, 14 aa, Mycobacterium tuberculosis
TGTLTVPEAIALIV

SEQ ID NO: 150592 - protein, 14 aa, Mycobacterium tuberculosis
GTLTVPEAIALIVV

SEQ ID NO: 150593 - protein, 14 aa, Mycobacterium tuberculosis
TLTVPEAIALIVVM

SEQ ID NO: 150594 - protein, 14 aa, Mycobacterium tuberculosis
LTVPEAIALIVVMV

SEQ ID NO: 150595 - protein, 14 aa, Mycobacterium tuberculosis
TVPEAIALIVVMVR

SEQ ID NO: 150596 - protein, 14 aa, Mycobacterium tuberculosis
VPEAIALIVVMVRY

SEQ ID NO: 150597 - protein, 14 aa, Mycobacterium tuberculosis
PEAIALIVVMVRYL

SEQ ID NO: 150598 - protein, 14 aa, Mycobacterium tuberculosis
EAIALIVVMVRYLE

SEQ ID NO: 150599 - protein, 14 aa, Mycobacterium tuberculosis
AIALIVVMVRYLEP

SEQ ID NO: 150600 - protein, 14 aa, Mycobacterium tuberculosis
IALIVVMVRYLEPF

SEQ ID NO: 150601 - protein, 14 aa, Mycobacterium tuberculosis
ALIVVMVRYLEPFT

SEQ ID NO: 150602 - protein, 14 aa, Mycobacterium tuberculosis
LIVVMVRYLEPFTA

SEQ ID NO: 150603 - protein, 14 aa, Mycobacterium tuberculosis
IVVMVRYLEPFTAV

SEQ ID NO: 150604 - protein, 14 aa, Mycobacterium tuberculosis
VVMVRYLEPFTAVS

SEQ ID NO: 150605 - protein, 14 aa, Mycobacterium tuberculosis
VMVRYLEPFTAVSE

SEQ ID NO: 150606 - protein, 14 aa, Mycobacterium tuberculosis
MVRYLEPFTAVSEL

SEQ ID NO: 150607 - protein, 14 aa, Mycobacterium tuberculosis
VRYLEPFTAVSELA

SEQ ID NO: 150608 - protein, 14 aa, Mycobacterium tuberculosis
RYLEPFTAVSELAP

SEQ ID NO: 150609 - protein, 14 aa, Mycobacterium tuberculosis
YLEPFTAVSELAPA

SEQ ID NO: 150610 - protein, 14 aa, Mycobacterium tuberculosis
LEPFTAVSELAPAL

SEQ ID NO: 150611 - protein, 14 aa, Mycobacterium tuberculosis
EPFTAVSELAPALE

SEQ ID NO: 150612 - protein, 14 aa, Mycobacterium tuberculosis
PFTAVSELAPALES

SEQ ID NO: 150613 - protein, 14 aa, Mycobacterium tuberculosis
FTAVSELAPALEST

SEQ ID NO: 150614 - protein, 14 aa, Mycobacterium tuberculosis
TAVSELAPALESTR

SEQ ID NO: 150615 - protein, 14 aa, Mycobacterium tuberculosis
AVSELAPALESTRA

SEQ ID NO: 150616 - protein, 14 aa, Mycobacterium tuberculosis
VSELAPALESTRAT

SEQ ID NO: 150617 - protein, 14 aa, Mycobacterium tuberculosis
SELAPALESTRATL

SEQ ID NO: 150618 - protein, 14 aa, Mycobacterium tuberculosis
ELAPALESTRATLG

SEQ ID NO: 150619 - protein, 14 aa, Mycobacterium tuberculosis
LAPALESTRATLGR

SEQ ID NO: 150620 - protein, 14 aa, Mycobacterium tuberculosis
APALESTRATLGRI

SEQ ID NO: 150621 - protein, 14 aa, Mycobacterium tuberculosis
PALESTRATLGRIG

SEQ ID NO: 150622 - protein, 14 aa, Mycobacterium tuberculosis
ALESTRATLGRIGS

SEQ ID NO: 150623 - protein, 14 aa, Mycobacterium tuberculosis
LESTRATLGRIGSV

SEQ ID NO: 150624 - protein, 14 aa, Mycobacterium tuberculosis
ESTRATLGRIGSVL

SEQ ID NO: 150625 - protein, 14 aa, Mycobacterium tuberculosis
STRATLGRIGSVLT

SEQ ID NO: 150626 - protein, 14 aa, Mycobacterium tuberculosis
TRATLGRIGSVLTA

SEQ ID NO: 150627 - protein, 14 aa, Mycobacterium tuberculosis
RATLGRIGSVLTAP

SEQ ID NO: 150628 - protein, 14 aa, Mycobacterium tuberculosis
ATLGRIGSVLTAPV

SEQ ID NO: 150629 - protein, 14 aa, Mycobacterium tuberculosis
TLGRIGSVLTAPVM

SEQ ID NO: 150630 - protein, 14 aa, Mycobacterium tuberculosis
LGRIGSVLTAPVMV

SEQ ID NO: 150631 - protein, 14 aa, Mycobacterium tuberculosis
GRIGSVLTAPVMVA

SEQ ID NO: 150632 - protein, 14 aa, Mycobacterium tuberculosis
RIGSVLTAPVMVAG

SEQ ID NO: 150633 - protein, 14 aa, Mycobacterium tuberculosis
IGSVLTAPVMVAGS

SEQ ID NO: 150634 - protein, 14 aa, Mycobacterium tuberculosis
GSVLTAPVMVAGSG

SEQ ID NO: 150635 - protein, 14 aa, Mycobacterium tuberculosis
SVLTAPVMVAGSGT

SEQ ID NO: 150636 - protein, 14 aa, Mycobacterium tuberculosis
VLTAPVMVAGSGTW

SEQ ID NO: 150637 - protein, 14 aa, Mycobacterium tuberculosis
LTAPVMVAGSGTWR

SEQ ID NO: 150638 - protein, 14 aa, Mycobacterium tuberculosis
TAPVMVAGSGTWRD

SEQ ID NO: 150639 - protein, 14 aa, Mycobacterium tuberculosis
APVMVAGSGTWRDG

SEQ ID NO: 150640 - protein, 14 aa, Mycobacterium tuberculosis
PVMVAGSGTWRDGA

SEQ ID NO: 150641 - protein, 14 aa, Mycobacterium tuberculosis
VMVAGSGTWRDGAV

SEQ ID NO: 150642 - protein, 14 aa, Mycobacterium tuberculosis
MVAGSGTWRDGAVV

SEQ ID NO: 150643 - protein, 14 aa, Mycobacterium tuberculosis
VAGSGTWRDGAVVP

SEQ ID NO: 150644 - protein, 14 aa, Mycobacterium tuberculosis
AGSGTWRDGAVVPR

SEQ ID NO: 150645 - protein, 14 aa, Mycobacterium tuberculosis
GSGTWRDGAVVPRI

SEQ ID NO: 150646 - protein, 14 aa, Mycobacterium tuberculosis
SGTWRDGAVVPRIE

SEQ ID NO: 150647 - protein, 14 aa, Mycobacterium tuberculosis
GTWRDGAVVPRIEF

SEQ ID NO: 150648 - protein, 14 aa, Mycobacterium tuberculosis
TWRDGAVVPRIEFD

SEQ ID NO: 150649 - protein, 14 aa, Mycobacterium tuberculosis
WRDGAVVPRIEFDD

SEQ ID NO: 150650 - protein, 14 aa, Mycobacterium tuberculosis
RDGAVVPRIEFDDV

SEQ ID NO: 150651 - protein, 14 aa, Mycobacterium tuberculosis
DGAVVPRIEFDDVA

SEQ ID NO: 150652 - protein, 14 aa, Mycobacterium tuberculosis
GAVVPRIEFDDVAF

SEQ ID NO: 150653 - protein, 14 aa, Mycobacterium tuberculosis
AVVPRIEFDDVAFG

SEQ ID NO: 150654 - protein, 14 aa, Mycobacterium tuberculosis
VVPRIEFDDVAFGY

SEQ ID NO: 150655 - protein, 14 aa, Mycobacterium tuberculosis
VPRIEFDDVAFGYD

SEQ ID NO: 150656 - protein, 14 aa, Mycobacterium tuberculosis
PRIEFDDVAFGYDG

SEQ ID NO: 150657 - protein, 14 aa, Mycobacterium tuberculosis
RIEFDDVAFGYDGG

SEQ ID NO: 150658 - protein, 14 aa, Mycobacterium tuberculosis
IEFDDVAFGYDGGS

SEQ ID NO: 150659 - protein, 14 aa, Mycobacterium tuberculosis
EFDDVAFGYDGGSG

SEQ ID NO: 150660 - protein, 14 aa, Mycobacterium tuberculosis
FDDVAFGYDGGSGP

SEQ ID NO: 150661 - protein, 14 aa, Mycobacterium tuberculosis
DDVAFGYDGGSGPV

SEQ ID NO: 150662 - protein, 14 aa, Mycobacterium tuberculosis
DVAFGYDGGSGPVL

SEQ ID NO: 150663 - protein, 14 aa, Mycobacterium tuberculosis
VAFGYDGGSGPVLD

SEQ ID NO: 150664 - protein, 14 aa, Mycobacterium tuberculosis
AFGYDGGSGPVLDG

SEQ ID NO: 150665 - protein, 14 aa, Mycobacterium tuberculosis
FGYDGGSGPVLDGV

SEQ ID NO: 150666 - protein, 14 aa, Mycobacterium tuberculosis
GYDGGSGPVLDGVS

SEQ ID NO: 150667 - protein, 14 aa, Mycobacterium tuberculosis
YDGGSGPVLDGVSF

SEQ ID NO: 150668 - protein, 14 aa, Mycobacterium tuberculosis
DGGSGPVLDGVSFC

SEQ ID NO: 150669 - protein, 14 aa, Mycobacterium tuberculosis
GGSGPVLDGVSFCL

SEQ ID NO: 150670 - protein, 14 aa, Mycobacterium tuberculosis
GSGPVLDGVSFCLQ

SEQ ID NO: 150671 - protein, 14 aa, Mycobacterium tuberculosis
SGPVLDGVSFCLQP

SEQ ID NO: 150672 - protein, 14 aa, Mycobacterium tuberculosis
GPVLDGVSFCLQPG

SEQ ID NO: 150673 - protein, 14 aa, Mycobacterium tuberculosis
PVLDGVSFCLQPGT

SEQ ID NO: 150674 - protein, 14 aa, Mycobacterium tuberculosis
VLDGVSFCLQPGTT

SEQ ID NO: 150675 - protein, 14 aa, Mycobacterium tuberculosis
LDGVSFCLQPGTTT

SEQ ID NO: 150676 - protein, 14 aa, Mycobacterium tuberculosis
DGVSFCLQPGTTTA

SEQ ID NO: 150677 - protein, 14 aa, Mycobacterium tuberculosis
GVSFCLQPGTTTAI

SEQ ID NO: 150678 - protein, 14 aa, Mycobacterium tuberculosis
VSFCLQPGTTTAIV

SEQ ID NO: 150679 - protein, 14 aa, Mycobacterium tuberculosis
SFCLQPGTTTAIVG

SEQ ID NO: 150680 - protein, 14 aa, Mycobacterium tuberculosis
FCLQPGTTTAIVGP

SEQ ID NO: 150681 - protein, 14 aa, Mycobacterium tuberculosis
CLQPGTTTAIVGPS

SEQ ID NO: 150682 - protein, 14 aa, Mycobacterium tuberculosis
LQPGTTTAIVGPSG

SEQ ID NO: 150683 - protein, 14 aa, Mycobacterium tuberculosis
QPGTTTAIVGPSGC

SEQ ID NO: 150684 - protein, 14 aa, Mycobacterium tuberculosis
PGTTTAIVGPSGCG

SEQ ID NO: 150685 - protein, 14 aa, Mycobacterium tuberculosis
GTTTAIVGPSGCGK

SEQ ID NO: 150686 - protein, 14 aa, Mycobacterium tuberculosis
TTTAIVGPSGCGKS

SEQ ID NO: 150687 - protein, 14 aa, Mycobacterium tuberculosis
TTAIVGPSGCGKST

SEQ ID NO: 150688 - protein, 14 aa, Mycobacterium tuberculosis
TAIVGPSGCGKSTI

SEQ ID NO: 150689 - protein, 14 aa, Mycobacterium tuberculosis
AIVGPSGCGKSTIL

SEQ ID NO: 150690 - protein, 14 aa, Mycobacterium tuberculosis
IVGPSGCGKSTILA

SEQ ID NO: 150691 - protein, 14 aa, Mycobacterium tuberculosis
VGPSGCGKSTILAL

SEQ ID NO: 150692 - protein, 14 aa, Mycobacterium tuberculosis
GPSGCGKSTILALI

SEQ ID NO: 150693 - protein, 14 aa, Mycobacterium tuberculosis
PSGCGKSTILALIA

SEQ ID NO: 150694 - protein, 14 aa, Mycobacterium tuberculosis
SGCGKSTILALIAG

SEQ ID NO: 150695 - protein, 14 aa, Mycobacterium tuberculosis
GCGKSTILALIAGL

SEQ ID NO: 150696 - protein, 14 aa, Mycobacterium tuberculosis
CGKSTILALIAGLH

SEQ ID NO: 150697 - protein, 14 aa, Mycobacterium tuberculosis
GKSTILALIAGLHQ

SEQ ID NO: 150698 - protein, 14 aa, Mycobacterium tuberculosis
KSTILALIAGLHQP

SEQ ID NO: 150699 - protein, 14 aa, Mycobacterium tuberculosis
STILALIAGLHQPT

SEQ ID NO: 150700 - protein, 14 aa, Mycobacterium tuberculosis
TILALIAGLHQPTR

SEQ ID NO: 150701 - protein, 14 aa, Mycobacterium tuberculosis
ILALIAGLHQPTRG

SEQ ID NO: 150702 - protein, 14 aa, Mycobacterium tuberculosis
LALIAGLHQPTRGR

SEQ ID NO: 150703 - protein, 14 aa, Mycobacterium tuberculosis
ALIAGLHQPTRGRV

SEQ ID NO: 150704 - protein, 14 aa, Mycobacterium tuberculosis
LIAGLHQPTRGRVL

SEQ ID NO: 150705 - protein, 14 aa, Mycobacterium tuberculosis
IAGLHQPTRGRVLI

SEQ ID NO: 150706 - protein, 14 aa, Mycobacterium tuberculosis
AGLHQPTRGRVLID

SEQ ID NO: 150707 - protein, 14 aa, Mycobacterium tuberculosis
GLHQPTRGRVLIDG

SEQ ID NO: 150708 - protein, 14 aa, Mycobacterium tuberculosis
LHQPTRGRVLIDGT

SEQ ID NO: 150709 - protein, 14 aa, Mycobacterium tuberculosis
HQPTRGRVLIDGTD

SEQ ID NO: 150710 - protein, 14 aa, Mycobacterium tuberculosis
QPTRGRVLIDGTDV

SEQ ID NO: 150711 - protein, 14 aa, Mycobacterium tuberculosis
PTRGRVLIDGTDVA

SEQ ID NO: 150712 - protein, 14 aa, Mycobacterium tuberculosis
TRGRVLIDGTDVAT

SEQ ID NO: 150713 - protein, 14 aa, Mycobacterium tuberculosis
RGRVLIDGTDVATL

SEQ ID NO: 150714 - protein, 14 aa, Mycobacterium tuberculosis
GRVLIDGTDVATLD

SEQ ID NO: 150715 - protein, 14 aa, Mycobacterium tuberculosis
RVLIDGTDVATLDA

SEQ ID NO: 150716 - protein, 14 aa, Mycobacterium tuberculosis
VLIDGTDVATLDAR

SEQ ID NO: 150717 - protein, 14 aa, Mycobacterium tuberculosis
LIDGTDVATLDARA

SEQ ID NO: 150718 - protein, 14 aa, Mycobacterium tuberculosis
IDGTDVATLDARAQ

SEQ ID NO: 150719 - protein, 14 aa, Mycobacterium tuberculosis
DGTDVATLDARAQQ

SEQ ID NO: 150720 - protein, 14 aa, Mycobacterium tuberculosis
GTDVATLDARAQQA

SEQ ID NO: 150721 - protein, 14 aa, Mycobacterium tuberculosis
TDVATLDARAQQAV

SEQ ID NO: 150722 - protein, 14 aa, Mycobacterium tuberculosis
DVATLDARAQQAVC

SEQ ID NO: 150723 - protein, 14 aa, Mycobacterium tuberculosis
VATLDARAQQAVCS

SEQ ID NO: 150724 - protein, 14 aa, Mycobacterium tuberculosis
ATLDARAQQAVCSV

SEQ ID NO: 150725 - protein, 14 aa, Mycobacterium tuberculosis
TLDARAQQAVCSVV

SEQ ID NO: 150726 - protein, 14 aa, Mycobacterium tuberculosis
LDARAQQAVCSVVF

SEQ ID NO: 150727 - protein, 14 aa, Mycobacterium tuberculosis
DARAQQAVCSVVFQ

SEQ ID NO: 150728 - protein, 14 aa, Mycobacterium tuberculosis
ARAQQAVCSVVFQH

SEQ ID NO: 150729 - protein, 14 aa, Mycobacterium tuberculosis
RAQQAVCSVVFQHP

SEQ ID NO: 150730 - protein, 14 aa, Mycobacterium tuberculosis
AQQAVCSVVFQHPY

SEQ ID NO: 150731 - protein, 14 aa, Mycobacterium tuberculosis
QQAVCSVVFQHPYL

SEQ ID NO: 150732 - protein, 14 aa, Mycobacterium tuberculosis
QAVCSVVFQHPYLF

SEQ ID NO: 150733 - protein, 14 aa, Mycobacterium tuberculosis
AVCSVVFQHPYLFH

SEQ ID NO: 150734 - protein, 14 aa, Mycobacterium tuberculosis
VCSVVFQHPYLFHG

SEQ ID NO: 150735 - protein, 14 aa, Mycobacterium tuberculosis
CSVVFQHPYLFHGT

SEQ ID NO: 150736 - protein, 14 aa, Mycobacterium tuberculosis
SVVFQHPYLFHGTI

SEQ ID NO: 150737 - protein, 14 aa, Mycobacterium tuberculosis
VVFQHPYLFHGTIR

SEQ ID NO: 150738 - protein, 14 aa, Mycobacterium tuberculosis
VFQHPYLFHGTIRD

SEQ ID NO: 150739 - protein, 14 aa, Mycobacterium tuberculosis
FQHPYLFHGTIRDN

SEQ ID NO: 150740 - protein, 14 aa, Mycobacterium tuberculosis
QHPYLFHGTIRDNV

SEQ ID NO: 150741 - protein, 14 aa, Mycobacterium tuberculosis
HPYLFHGTIRDNVF

SEQ ID NO: 150742 - protein, 14 aa, Mycobacterium tuberculosis
PYLFHGTIRDNVFA

SEQ ID NO: 150743 - protein, 14 aa, Mycobacterium tuberculosis
YLFHGTIRDNVFAA

SEQ ID NO: 150744 - protein, 14 aa, Mycobacterium tuberculosis
LFHGTIRDNVFAAD

SEQ ID NO: 150745 - protein, 14 aa, Mycobacterium tuberculosis
FHGTIRDNVFAADP

SEQ ID NO: 150746 - protein, 14 aa, Mycobacterium tuberculosis
HGTIRDNVFAADPG

SEQ ID NO: 150747 - protein, 14 aa, Mycobacterium tuberculosis
GTIRDNVFAADPGA

SEQ ID NO: 150748 - protein, 14 aa, Mycobacterium tuberculosis
TIRDNVFAADPGAS

SEQ ID NO: 150749 - protein, 14 aa, Mycobacterium tuberculosis
IRDNVFAADPGASD

SEQ ID NO: 150750 - protein, 14 aa, Mycobacterium tuberculosis
RDNVFAADPGASDD

SEQ ID NO: 150751 - protein, 14 aa, Mycobacterium tuberculosis
DNVFAADPGASDDQ

SEQ ID NO: 150752 - protein, 14 aa, Mycobacterium tuberculosis
NVFAADPGASDDQF

SEQ ID NO: 150753 - protein, 14 aa, Mycobacterium tuberculosis
VFAADPGASDDQFA

SEQ ID NO: 150754 - protein, 14 aa, Mycobacterium tuberculosis
FAADPGASDDQFAQ

SEQ ID NO: 150755 - protein, 14 aa, Mycobacterium tuberculosis
AADPGASDDQFAQA

SEQ ID NO: 150756 - protein, 14 aa, Mycobacterium tuberculosis
ADPGASDDQFAQAV

SEQ ID NO: 150757 - protein, 14 aa, Mycobacterium tuberculosis
DPGASDDQFAQAVR

SEQ ID NO: 150758 - protein, 14 aa, Mycobacterium tuberculosis
PGASDDQFAQAVRL

SEQ ID NO: 150759 - protein, 14 aa, Mycobacterium tuberculosis
GASDDQFAQAVRLA

SEQ ID NO: 150760 - protein, 14 aa, Mycobacterium tuberculosis
ASDDQFAQAVRLAR

SEQ ID NO: 150761 - protein, 14 aa, Mycobacterium tuberculosis
SDDQFAQAVRLARV

SEQ ID NO: 150762 - protein, 14 aa, Mycobacterium tuberculosis
DDQFAQAVRLARVD

SEQ ID NO: 150763 - protein, 14 aa, Mycobacterium tuberculosis
DQFAQAVRLARVDE

SEQ ID NO: 150764 - protein, 14 aa, Mycobacterium tuberculosis
QFAQAVRLARVDEL

SEQ ID NO: 150765 - protein, 14 aa, Mycobacterium tuberculosis
FAQAVRLARVDELI

SEQ ID NO: 150766 - protein, 14 aa, Mycobacterium tuberculosis
AQAVRLARVDELIA

SEQ ID NO: 150767 - protein, 14 aa, Mycobacterium tuberculosis
QAVRLARVDELIAR

SEQ ID NO: 150768 - protein, 14 aa, Mycobacterium tuberculosis
AVRLARVDELIARL

SEQ ID NO: 150769 - protein, 14 aa, Mycobacterium tuberculosis
VRLARVDELIARLP

SEQ ID NO: 150770 - protein, 14 aa, Mycobacterium tuberculosis
RLARVDELIARLPD

SEQ ID NO: 150771 - protein, 14 aa, Mycobacterium tuberculosis
LARVDELIARLPDG

SEQ ID NO: 150772 - protein, 14 aa, Mycobacterium tuberculosis
ARVDELIARLPDGA

SEQ ID NO: 150773 - protein, 14 aa, Mycobacterium tuberculosis
RVDELIARLPDGAN

SEQ ID NO: 150774 - protein, 14 aa, Mycobacterium tuberculosis
VDELIARLPDGANT

SEQ ID NO: 150775 - protein, 14 aa, Mycobacterium tuberculosis
DELIARLPDGANTI

SEQ ID NO: 150776 - protein, 14 aa, Mycobacterium tuberculosis
ELIARLPDGANTIV

SEQ ID NO: 150777 - protein, 14 aa, Mycobacterium tuberculosis
LIARLPDGANTIVG

SEQ ID NO: 150778 - protein, 14 aa, Mycobacterium tuberculosis
IARLPDGANTIVGE

SEQ ID NO: 150779 - protein, 14 aa, Mycobacterium tuberculosis
ARLPDGANTIVGEA

SEQ ID NO: 150780 - protein, 14 aa, Mycobacterium tuberculosis
RLPDGANTIVGEAG

SEQ ID NO: 150781 - protein, 14 aa, Mycobacterium tuberculosis
LPDGANTIVGEAGS

SEQ ID NO: 150782 - protein, 14 aa, Mycobacterium tuberculosis
PDGANTIVGEAGSA

SEQ ID NO: 150783 - protein, 14 aa, Mycobacterium tuberculosis
DGANTIVGEAGSAL

SEQ ID NO: 150784 - protein, 14 aa, Mycobacterium tuberculosis
GANTIVGEAGSALS

SEQ ID NO: 150785 - protein, 14 aa, Mycobacterium tuberculosis
ANTIVGEAGSALSG

SEQ ID NO: 150786 - protein, 14 aa, Mycobacterium tuberculosis
NTIVGEAGSALSGG

SEQ ID NO: 150787 - protein, 14 aa, Mycobacterium tuberculosis
TIVGEAGSALSGGE

SEQ ID NO: 150788 - protein, 14 aa, Mycobacterium tuberculosis
IVGEAGSALSGGER

SEQ ID NO: 150789 - protein, 14 aa, Mycobacterium tuberculosis
VGEAGSALSGGERQ

SEQ ID NO: 150790 - protein, 14 aa, Mycobacterium tuberculosis
GEAGSALSGGERQR

SEQ ID NO: 150791 - protein, 14 aa, Mycobacterium tuberculosis
EAGSALSGGERQRV

SEQ ID NO: 150792 - protein, 14 aa, Mycobacterium tuberculosis
AGSALSGGERQRVS

SEQ ID NO: 150793 - protein, 14 aa, Mycobacterium tuberculosis
GSALSGGERQRVSI

SEQ ID NO: 150794 - protein, 14 aa, Mycobacterium tuberculosis
SALSGGERQRVSIA

SEQ ID NO: 150795 - protein, 14 aa, Mycobacterium tuberculosis
ALSGGERQRVSIAR

SEQ ID NO: 150796 - protein, 14 aa, Mycobacterium tuberculosis
LSGGERQRVSIARA

SEQ ID NO: 150797 - protein, 14 aa, Mycobacterium tuberculosis
SGGERQRVSIARAL

SEQ ID NO: 150798 - protein, 14 aa, Mycobacterium tuberculosis
GGERQRVSIARALL

SEQ ID NO: 150799 - protein, 14 aa, Mycobacterium tuberculosis
GERQRVSIARALLK

SEQ ID NO: 150800 - protein, 14 aa, Mycobacterium tuberculosis
ERQRVSIARALLKA

SEQ ID NO: 150801 - protein, 14 aa, Mycobacterium tuberculosis
RQRVSIARALLKAA

SEQ ID NO: 150802 - protein, 14 aa, Mycobacterium tuberculosis
QRVSIARALLKAAP

SEQ ID NO: 150803 - protein, 14 aa, Mycobacterium tuberculosis
RVSIARALLKAAPV

SEQ ID NO: 150804 - protein, 14 aa, Mycobacterium tuberculosis
VSIARALLKAAPVL

SEQ ID NO: 150805 - protein, 14 aa, Mycobacterium tuberculosis
SIARALLKAAPVLL

SEQ ID NO: 150806 - protein, 14 aa, Mycobacterium tuberculosis
IARALLKAAPVLLV

SEQ ID NO: 150807 - protein, 14 aa, Mycobacterium tuberculosis
ARALLKAAPVLLVD

SEQ ID NO: 150808 - protein, 14 aa, Mycobacterium tuberculosis
RALLKAAPVLLVDE

SEQ ID NO: 150809 - protein, 14 aa, Mycobacterium tuberculosis
ALLKAAPVLLVDEA

SEQ ID NO: 150810 - protein, 14 aa, Mycobacterium tuberculosis
LLKAAPVLLVDEAT

SEQ ID NO: 150811 - protein, 14 aa, Mycobacterium tuberculosis
LKAAPVLLVDEATS

SEQ ID NO: 150812 - protein, 14 aa, Mycobacterium tuberculosis
KAAPVLLVDEATSA

SEQ ID NO: 150813 - protein, 14 aa, Mycobacterium tuberculosis
AAPVLLVDEATSAL

SEQ ID NO: 150814 - protein, 14 aa, Mycobacterium tuberculosis
APVLLVDEATSALD

SEQ ID NO: 150815 - protein, 14 aa, Mycobacterium tuberculosis
PVLLVDEATSALDA

SEQ ID NO: 150816 - protein, 14 aa, Mycobacterium tuberculosis
VLLVDEATSALDAE

SEQ ID NO: 150817 - protein, 14 aa, Mycobacterium tuberculosis
LLVDEATSALDAEN

SEQ ID NO: 150818 - protein, 14 aa, Mycobacterium tuberculosis
LVDEATSALDAENE

SEQ ID NO: 150819 - protein, 14 aa, Mycobacterium tuberculosis
VDEATSALDAENEA

SEQ ID NO: 150820 - protein, 14 aa, Mycobacterium tuberculosis
DEATSALDAENEAA

SEQ ID NO: 150821 - protein, 14 aa, Mycobacterium tuberculosis
EATSALDAENEAAV

SEQ ID NO: 150822 - protein, 14 aa, Mycobacterium tuberculosis
ATSALDAENEAAVV

SEQ ID NO: 150823 - protein, 14 aa, Mycobacterium tuberculosis
TSALDAENEAAVVD

SEQ ID NO: 150824 - protein, 14 aa, Mycobacterium tuberculosis
SALDAENEAAVVDA

SEQ ID NO: 150825 - protein, 14 aa, Mycobacterium tuberculosis
ALDAENEAAVVDAL

SEQ ID NO: 150826 - protein, 14 aa, Mycobacterium tuberculosis
LDAENEAAVVDALA

SEQ ID NO: 150827 - protein, 14 aa, Mycobacterium tuberculosis
DAENEAAVVDALAA

SEQ ID NO: 150828 - protein, 14 aa, Mycobacterium tuberculosis
AENEAAVVDALAAD

SEQ ID NO: 150829 - protein, 14 aa, Mycobacterium tuberculosis
ENEAAVVDALAADP

SEQ ID NO: 150830 - protein, 14 aa, Mycobacterium tuberculosis
NEAAVVDALAADPR

SEQ ID NO: 150831 - protein, 14 aa, Mycobacterium tuberculosis
EAAVVDALAADPRS

SEQ ID NO: 150832 - protein, 14 aa, Mycobacterium tuberculosis
AAVVDALAADPRSR

SEQ ID NO: 150833 - protein, 14 aa, Mycobacterium tuberculosis
AVVDALAADPRSRT

SEQ ID NO: 150834 - protein, 14 aa, Mycobacterium tuberculosis
VVDALAADPRSRTR

SEQ ID NO: 150835 - protein, 14 aa, Mycobacterium tuberculosis
VDALAADPRSRTRV

SEQ ID NO: 150836 - protein, 14 aa, Mycobacterium tuberculosis
DALAADPRSRTRVI

SEQ ID NO: 150837 - protein, 14 aa, Mycobacterium tuberculosis
ALAADPRSRTRVIV

SEQ ID NO: 150838 - protein, 14 aa, Mycobacterium tuberculosis
LAADPRSRTRVIVA

SEQ ID NO: 150839 - protein, 14 aa, Mycobacterium tuberculosis
AADPRSRTRVIVAH

SEQ ID NO: 150840 - protein, 14 aa, Mycobacterium tuberculosis
ADPRSRTRVIVAHR

SEQ ID NO: 150841 - protein, 14 aa, Mycobacterium tuberculosis
DPRSRTRVIVAHRL

SEQ ID NO: 150842 - protein, 14 aa, Mycobacterium tuberculosis
PRSRTRVIVAHRLA

SEQ ID NO: 150843 - protein, 14 aa, Mycobacterium tuberculosis
RSRTRVIVAHRLAS

SEQ ID NO: 150844 - protein, 14 aa, Mycobacterium tuberculosis
SRTRVIVAHRLASI

SEQ ID NO: 150845 - protein, 14 aa, Mycobacterium tuberculosis
RTRVIVAHRLASIR

SEQ ID NO: 150846 - protein, 14 aa, Mycobacterium tuberculosis
TRVIVAHRLASIRH

SEQ ID NO: 150847 - protein, 14 aa, Mycobacterium tuberculosis
RVIVAHRLASIRHA

SEQ ID NO: 150848 - protein, 14 aa, Mycobacterium tuberculosis
VIVAHRLASIRHAD

SEQ ID NO: 150849 - protein, 14 aa, Mycobacterium tuberculosis
IVAHRLASIRHADR

SEQ ID NO: 150850 - protein, 14 aa, Mycobacterium tuberculosis
VAHRLASIRHADRV

SEQ ID NO: 150851 - protein, 14 aa, Mycobacterium tuberculosis
AHRLASIRHADRVL

SEQ ID NO: 150852 - protein, 14 aa, Mycobacterium tuberculosis
HRLASIRHADRVLF

SEQ ID NO: 150853 - protein, 14 aa, Mycobacterium tuberculosis
RLASIRHADRVLFV

SEQ ID NO: 150854 - protein, 14 aa, Mycobacterium tuberculosis
LASIRHADRVLFVD

SEQ ID NO: 150855 - protein, 14 aa, Mycobacterium tuberculosis
ASIRHADRVLFVDD

SEQ ID NO: 150856 - protein, 14 aa, Mycobacterium tuberculosis
SIRHADRVLFVDDG

SEQ ID NO: 150857 - protein, 14 aa, Mycobacterium tuberculosis
IRHADRVLFVDDGR

SEQ ID NO: 150858 - protein, 14 aa, Mycobacterium tuberculosis
RHADRVLFVDDGRV

SEQ ID NO: 150859 - protein, 14 aa, Mycobacterium tuberculosis
HADRVLFVDDGRVV

SEQ ID NO: 150860 - protein, 14 aa, Mycobacterium tuberculosis
ADRVLFVDDGRVVE

SEQ ID NO: 150861 - protein, 14 aa, Mycobacterium tuberculosis
DRVLFVDDGRVVED

SEQ ID NO: 150862 - protein, 14 aa, Mycobacterium tuberculosis
RVLFVDDGRVVEDG

SEQ ID NO: 150863 - protein, 14 aa, Mycobacterium tuberculosis
VLFVDDGRVVEDGS

SEQ ID NO: 150864 - protein, 14 aa, Mycobacterium tuberculosis
LFVDDGRVVEDGSI

SEQ ID NO: 150865 - protein, 14 aa, Mycobacterium tuberculosis
FVDDGRVVEDGSIS

SEQ ID NO: 150866 - protein, 14 aa, Mycobacterium tuberculosis
VDDGRVVEDGSISE

SEQ ID NO: 150867 - protein, 14 aa, Mycobacterium tuberculosis
DDGRVVEDGSISEL

SEQ ID NO: 150868 - protein, 14 aa, Mycobacterium tuberculosis
DGRVVEDGSISELL

SEQ ID NO: 150869 - protein, 14 aa, Mycobacterium tuberculosis
GRVVEDGSISELLT

SEQ ID NO: 150870 - protein, 14 aa, Mycobacterium tuberculosis
RVVEDGSISELLTA

SEQ ID NO: 150871 - protein, 14 aa, Mycobacterium tuberculosis
VVEDGSISELLTAG

SEQ ID NO: 150872 - protein, 14 aa, Mycobacterium tuberculosis
VEDGSISELLTAGG

SEQ ID NO: 150873 - protein, 14 aa, Mycobacterium tuberculosis
EDGSISELLTAGGR

SEQ ID NO: 150874 - protein, 14 aa, Mycobacterium tuberculosis
DGSISELLTAGGRF

SEQ ID NO: 150875 - protein, 14 aa, Mycobacterium tuberculosis
GSISELLTAGGRFS

SEQ ID NO: 150876 - protein, 14 aa, Mycobacterium tuberculosis
SISELLTAGGRFSQ

SEQ ID NO: 150877 - protein, 14 aa, Mycobacterium tuberculosis
ISELLTAGGRFSQF

SEQ ID NO: 150878 - protein, 14 aa, Mycobacterium tuberculosis
SELLTAGGRFSQFW

SEQ ID NO: 150879 - protein, 14 aa, Mycobacterium tuberculosis
ELLTAGGRFSQFWR

SEQ ID NO: 150880 - protein, 14 aa, Mycobacterium tuberculosis
LLTAGGRFSQFWRQ

SEQ ID NO: 150881 - protein, 14 aa, Mycobacterium tuberculosis
LTAGGRFSQFWRQQ

SEQ ID NO: 150882 - protein, 14 aa, Mycobacterium tuberculosis
TAGGRFSQFWRQQH

SEQ ID NO: 150883 - protein, 14 aa, Mycobacterium tuberculosis
AGGRFSQFWRQQHE

SEQ ID NO: 150884 - protein, 14 aa, Mycobacterium tuberculosis
GGRFSQFWRQQHEA

SEQ ID NO: 150885 - protein, 14 aa, Mycobacterium tuberculosis
GRFSQFWRQQHEAA

SEQ ID NO: 150886 - protein, 14 aa, Mycobacterium tuberculosis
RFSQFWRQQHEAAE

SEQ ID NO: 150887 - protein, 14 aa, Mycobacterium tuberculosis
FSQFWRQQHEAAEW

SEQ ID NO: 150888 - protein, 14 aa, Mycobacterium tuberculosis
SQFWRQQHEAAEWQ

SEQ ID NO: 150889 - protein, 14 aa, Mycobacterium tuberculosis
QFWRQQHEAAEWQI

SEQ ID NO: 150890 - protein, 14 aa, Mycobacterium tuberculosis
FWRQQHEAAEWQIL

SEQ ID NO: 150891 - protein, 14 aa, Mycobacterium tuberculosis
WRQQHEAAEWQILA

SEQ ID NO: 150892 - protein, 14 aa, Mycobacterium tuberculosis
RQQHEAAEWQILAE

SEQ ID NO: 150893 - protein, 15 aa, Mycobacterium tuberculosis
MIRTWIALVPNDHRA

SEQ ID NO: 150894 - protein, 15 aa, Mycobacterium tuberculosis
IRTWIALVPNDHRAR

SEQ ID NO: 150895 - protein, 15 aa, Mycobacterium tuberculosis
RTWIALVPNDHRARL

SEQ ID NO: 150896 - protein, 15 aa, Mycobacterium tuberculosis
TWIALVPNDHRARLI

SEQ ID NO: 150897 - protein, 15 aa, Mycobacterium tuberculosis
WIALVPNDHRARLIG

SEQ ID NO: 150898 - protein, 15 aa, Mycobacterium tuberculosis
IALVPNDHRARLIGF

SEQ ID NO: 150899 - protein, 15 aa, Mycobacterium tuberculosis
ALVPNDHRARLIGFA

SEQ ID NO: 150900 - protein, 15 aa, Mycobacterium tuberculosis
LVPNDHRARLIGFAL

SEQ ID NO: 150901 - protein, 15 aa, Mycobacterium tuberculosis
VPNDHRARLIGFALL

SEQ ID NO: 150902 - protein, 15 aa, Mycobacterium tuberculosis
PNDHRARLIGFALLA

SEQ ID NO: 150903 - protein, 15 aa, Mycobacterium tuberculosis
NDHRARLIGFALLAF

SEQ ID NO: 150904 - protein, 15 aa, Mycobacterium tuberculosis
DHRARLIGFALLAFC

SEQ ID NO: 150905 - protein, 15 aa, Mycobacterium tuberculosis
HRARLIGFALLAFCS

SEQ ID NO: 150906 - protein, 15 aa, Mycobacterium tuberculosis
RARLIGFALLAFCSV

SEQ ID NO: 150907 - protein, 15 aa, Mycobacterium tuberculosis
ARLIGFALLAFCSVV

SEQ ID NO: 150908 - protein, 15 aa, Mycobacterium tuberculosis
RLIGFALLAFCSVVA

SEQ ID NO: 150909 - protein, 15 aa, Mycobacterium tuberculosis
LIGFALLAFCSVVAR

SEQ ID NO: 150910 - protein, 15 aa, Mycobacterium tuberculosis
IGFALLAFCSVVARA

SEQ ID NO: 150911 - protein, 15 aa, Mycobacterium tuberculosis
GFALLAFCSVVARAV

SEQ ID NO: 150912 - protein, 15 aa, Mycobacterium tuberculosis
FALLAFCSVVARAVG

SEQ ID NO: 150913 - protein, 15 aa, Mycobacterium tuberculosis
ALLAFCSVVARAVGT

SEQ ID NO: 150914 - protein, 15 aa, Mycobacterium tuberculosis
LLAFCSVVARAVGTV

SEQ ID NO: 150915 - protein, 15 aa, Mycobacterium tuberculosis
LAFCSVVARAVGTVL

SEQ ID NO: 150916 - protein, 15 aa, Mycobacterium tuberculosis
AFCSVVARAVGTVLL

SEQ ID NO: 150917 - protein, 15 aa, Mycobacterium tuberculosis
FCSVVARAVGTVLLV

SEQ ID NO: 150918 - protein, 15 aa, Mycobacterium tuberculosis
CSVVARAVGTVLLVP

SEQ ID NO: 150919 - protein, 15 aa, Mycobacterium tuberculosis
SVVARAVGTVLLVPL

SEQ ID NO: 150920 - protein, 15 aa, Mycobacterium tuberculosis
VVARAVGTVLLVPLM

SEQ ID NO: 150921 - protein, 15 aa, Mycobacterium tuberculosis
VARAVGTVLLVPLMA

SEQ ID NO: 150922 - protein, 15 aa, Mycobacterium tuberculosis
ARAVGTVLLVPLMAA

SEQ ID NO: 150923 - protein, 15 aa, Mycobacterium tuberculosis
RAVGTVLLVPLMAAL

SEQ ID NO: 150924 - protein, 15 aa, Mycobacterium tuberculosis
AVGTVLLVPLMAALF

SEQ ID NO: 150925 - protein, 15 aa, Mycobacterium tuberculosis
VGTVLLVPLMAALFG

SEQ ID NO: 150926 - protein, 15 aa, Mycobacterium tuberculosis
GTVLLVPLMAALFGE

SEQ ID NO: 150927 - protein, 15 aa, Mycobacterium tuberculosis
TVLLVPLMAALFGEA

SEQ ID NO: 150928 - protein, 15 aa, Mycobacterium tuberculosis
VLLVPLMAALFGEAP

SEQ ID NO: 150929 - protein, 15 aa, Mycobacterium tuberculosis
LLVPLMAALFGEAPQ

SEQ ID NO: 150930 - protein, 15 aa, Mycobacterium tuberculosis
LVPLMAALFGEAPQR

SEQ ID NO: 150931 - protein, 15 aa, Mycobacterium tuberculosis
VPLMAALFGEAPQRA

SEQ ID NO: 150932 - protein, 15 aa, Mycobacterium tuberculosis
PLMAALFGEAPQRAW

SEQ ID NO: 150933 - protein, 15 aa, Mycobacterium tuberculosis
LMAALFGEAPQRAWL

SEQ ID NO: 150934 - protein, 15 aa, Mycobacterium tuberculosis
MAALFGEAPQRAWLW

SEQ ID NO: 150935 - protein, 15 aa, Mycobacterium tuberculosis
AALFGEAPQRAWLWL

SEQ ID NO: 150936 - protein, 15 aa, Mycobacterium tuberculosis
ALFGEAPQRAWLWLG

SEQ ID NO: 150937 - protein, 15 aa, Mycobacterium tuberculosis
LFGEAPQRAWLWLGW

SEQ ID NO: 150938 - protein, 15 aa, Mycobacterium tuberculosis
FGEAPQRAWLWLGWL

SEQ ID NO: 150939 - protein, 15 aa, Mycobacterium tuberculosis
GEAPQRAWLWLGWLS

SEQ ID NO: 150940 - protein, 15 aa, Mycobacterium tuberculosis
EAPQRAWLWLGWLSA

SEQ ID NO: 150941 - protein, 15 aa, Mycobacterium tuberculosis
APQRAWLWLGWLSAA

SEQ ID NO: 150942 - protein, 15 aa, Mycobacterium tuberculosis
PQRAWLWLGWLSAAT

SEQ ID NO: 150943 - protein, 15 aa, Mycobacterium tuberculosis
QRAWLWLGWLSAATV

SEQ ID NO: 150944 - protein, 15 aa, Mycobacterium tuberculosis
RAWLWLGWLSAATVA

SEQ ID NO: 150945 - protein, 15 aa, Mycobacterium tuberculosis
AWLWLGWLSAATVAG

SEQ ID NO: 150946 - protein, 15 aa, Mycobacterium tuberculosis
WLWLGWLSAATVAGW

SEQ ID NO: 150947 - protein, 15 aa, Mycobacterium tuberculosis
LWLGWLSAATVAGWV

SEQ ID NO: 150948 - protein, 15 aa, Mycobacterium tuberculosis
WLGWLSAATVAGWVL

SEQ ID NO: 150949 - protein, 15 aa, Mycobacterium tuberculosis
LGWLSAATVAGWVLD

SEQ ID NO: 150950 - protein, 15 aa, Mycobacterium tuberculosis
GWLSAATVAGWVLDA

SEQ ID NO: 150951 - protein, 15 aa, Mycobacterium tuberculosis
WLSAATVAGWVLDAV

SEQ ID NO: 150952 - protein, 15 aa, Mycobacterium tuberculosis
LSAATVAGWVLDAVT

SEQ ID NO: 150953 - protein, 15 aa, Mycobacterium tuberculosis
SAATVAGWVLDAVTA

SEQ ID NO: 150954 - protein, 15 aa, Mycobacterium tuberculosis
AATVAGWVLDAVTAR

SEQ ID NO: 150955 - protein, 15 aa, Mycobacterium tuberculosis
ATVAGWVLDAVTARI

SEQ ID NO: 150956 - protein, 15 aa, Mycobacterium tuberculosis
TVAGWVLDAVTARIG

SEQ ID NO: 150957 - protein, 15 aa, Mycobacterium tuberculosis
VAGWVLDAVTARIGI

SEQ ID NO: 150958 - protein, 15 aa, Mycobacterium tuberculosis
AGWVLDAVTARIGIE

SEQ ID NO: 150959 - protein, 15 aa, Mycobacterium tuberculosis
GWVLDAVTARIGIEL

SEQ ID NO: 150960 - protein, 15 aa, Mycobacterium tuberculosis
WVLDAVTARIGIELG

SEQ ID NO: 150961 - protein, 15 aa, Mycobacterium tuberculosis
VLDAVTARIGIELGF

SEQ ID NO: 150962 - protein, 15 aa, Mycobacterium tuberculosis
LDAVTARIGIELGFA

SEQ ID NO: 150963 - protein, 15 aa, Mycobacterium tuberculosis
DAVTARIGIELGFAV

SEQ ID NO: 150964 - protein, 15 aa, Mycobacterium tuberculosis
AVTARIGIELGFAVL

SEQ ID NO: 150965 - protein, 15 aa, Mycobacterium tuberculosis
VTARIGIELGFAVLN

SEQ ID NO: 150966 - protein, 15 aa, Mycobacterium tuberculosis
TARIGIELGFAVLNH

SEQ ID NO: 150967 - protein, 15 aa, Mycobacterium tuberculosis
ARIGIELGFAVLNHT

SEQ ID NO: 150968 - protein, 15 aa, Mycobacterium tuberculosis
RIGIELGFAVLNHTQ

SEQ ID NO: 150969 - protein, 15 aa, Mycobacterium tuberculosis
IGIELGFAVLNHTQH

SEQ ID NO: 150970 - protein, 15 aa, Mycobacterium tuberculosis
GIELGFAVLNHTQHD

SEQ ID NO: 150971 - protein, 15 aa, Mycobacterium tuberculosis
IELGFAVLNHTQHDV

SEQ ID NO: 150972 - protein, 15 aa, Mycobacterium tuberculosis
ELGFAVLNHTQHDVA

SEQ ID NO: 150973 - protein, 15 aa, Mycobacterium tuberculosis
LGFAVLNHTQHDVAD

SEQ ID NO: 150974 - protein, 15 aa, Mycobacterium tuberculosis
GFAVLNHTQHDVADR

SEQ ID NO: 150975 - protein, 15 aa, Mycobacterium tuberculosis
FAVLNHTQHDVADRL

SEQ ID NO: 150976 - protein, 15 aa, Mycobacterium tuberculosis
AVLNHTQHDVADRLP

SEQ ID NO: 150977 - protein, 15 aa, Mycobacterium tuberculosis
VLNHTQHDVADRLPV

SEQ ID NO: 150978 - protein, 15 aa, Mycobacterium tuberculosis
LNHTQHDVADRLPVV

SEQ ID NO: 150979 - protein, 15 aa, Mycobacterium tuberculosis
NHTQHDVADRLPVVR

SEQ ID NO: 150980 - protein, 15 aa, Mycobacterium tuberculosis
HTQHDVADRLPVVRL

SEQ ID NO: 150981 - protein, 15 aa, Mycobacterium tuberculosis
TQHDVADRLPVVRLD

SEQ ID NO: 150982 - protein, 15 aa, Mycobacterium tuberculosis
QHDVADRLPVVRLDW

SEQ ID NO: 150983 - protein, 15 aa, Mycobacterium tuberculosis
HDVADRLPVVRLDWF

SEQ ID NO: 150984 - protein, 15 aa, Mycobacterium tuberculosis
DVADRLPVVRLDWFT

SEQ ID NO: 150985 - protein, 15 aa, Mycobacterium tuberculosis
VADRLPVVRLDWFTA

SEQ ID NO: 150986 - protein, 15 aa, Mycobacterium tuberculosis
ADRLPVVRLDWFTAE

SEQ ID NO: 150987 - protein, 15 aa, Mycobacterium tuberculosis
DRLPVVRLDWFTAEN

SEQ ID NO: 150988 - protein, 15 aa, Mycobacterium tuberculosis
RLPVVRLDWFTAENT

SEQ ID NO: 150989 - protein, 15 aa, Mycobacterium tuberculosis
LPVVRLDWFTAENTA

SEQ ID NO: 150990 - protein, 15 aa, Mycobacterium tuberculosis
PVVRLDWFTAENTAT

SEQ ID NO: 150991 - protein, 15 aa, Mycobacterium tuberculosis
VVRLDWFTAENTATA

SEQ ID NO: 150992 - protein, 15 aa, Mycobacterium tuberculosis
VRLDWFTAENTATAR

SEQ ID NO: 150993 - protein, 15 aa, Mycobacterium tuberculosis
RLDWFTAENTATARQ

SEQ ID NO: 150994 - protein, 15 aa, Mycobacterium tuberculosis
LDWFTAENTATARQA

SEQ ID NO: 150995 - protein, 15 aa, Mycobacterium tuberculosis
DWFTAENTATARQAI

SEQ ID NO: 150996 - protein, 15 aa, Mycobacterium tuberculosis
WFTAENTATARQAIA

SEQ ID NO: 150997 - protein, 15 aa, Mycobacterium tuberculosis
FTAENTATARQAIAA

SEQ ID NO: 150998 - protein, 15 aa, Mycobacterium tuberculosis
TAENTATARQAIAAT

SEQ ID NO: 150999 - protein, 15 aa, Mycobacterium tuberculosis
AENTATARQAIAATG

SEQ ID NO: 151000 - protein, 15 aa, Mycobacterium tuberculosis
ENTATARQAIAATGP

SEQ ID NO: 151001 - protein, 15 aa, Mycobacterium tuberculosis
NTATARQAIAATGPE

SEQ ID NO: 151002 - protein, 15 aa, Mycobacterium tuberculosis
TATARQAIAATGPEL

SEQ ID NO: 151003 - protein, 15 aa, Mycobacterium tuberculosis
ATARQAIAATGPELV

SEQ ID NO: 151004 - protein, 15 aa, Mycobacterium tuberculosis
TARQAIAATGPELVG

SEQ ID NO: 151005 - protein, 15 aa, Mycobacterium tuberculosis
ARQAIAATGPELVGL

SEQ ID NO: 151006 - protein, 15 aa, Mycobacterium tuberculosis
RQAIAATGPELVGLV

SEQ ID NO: 151007 - protein, 15 aa, Mycobacterium tuberculosis
QAIAATGPELVGLVV

SEQ ID NO: 151008 - protein, 15 aa, Mycobacterium tuberculosis
AIAATGPELVGLVVN

SEQ ID NO: 151009 - protein, 15 aa, Mycobacterium tuberculosis
IAATGPELVGLVVNL

SEQ ID NO: 151010 - protein, 15 aa, Mycobacterium tuberculosis
AATGPELVGLVVNLV

SEQ ID NO: 151011 - protein, 15 aa, Mycobacterium tuberculosis
ATGPELVGLVVNLVT

SEQ ID NO: 151012 - protein, 15 aa, Mycobacterium tuberculosis
TGPELVGLVVNLVTP

SEQ ID NO: 151013 - protein, 15 aa, Mycobacterium tuberculosis
GPELVGLVVNLVTPL

SEQ ID NO: 151014 - protein, 15 aa, Mycobacterium tuberculosis
PELVGLVVNLVTPLT

SEQ ID NO: 151015 - protein, 15 aa, Mycobacterium tuberculosis
ELVGLVVNLVTPLTS

SEQ ID NO: 151016 - protein, 15 aa, Mycobacterium tuberculosis
LVGLVVNLVTPLTSA

SEQ ID NO: 151017 - protein, 15 aa, Mycobacterium tuberculosis
VGLVVNLVTPLTSAI

SEQ ID NO: 151018 - protein, 15 aa, Mycobacterium tuberculosis
GLVVNLVTPLTSAIL

SEQ ID NO: 151019 - protein, 15 aa, Mycobacterium tuberculosis
LVVNLVTPLTSAILL

SEQ ID NO: 151020 - protein, 15 aa, Mycobacterium tuberculosis
VVNLVTPLTSAILLP

SEQ ID NO: 151021 - protein, 15 aa, Mycobacterium tuberculosis
VNLVTPLTSAILLPA

SEQ ID NO: 151022 - protein, 15 aa, Mycobacterium tuberculosis
NLVTPLTSAILLPAV

SEQ ID NO: 151023 - protein, 15 aa, Mycobacterium tuberculosis
LVTPLTSAILLPAVI

SEQ ID NO: 151024 - protein, 15 aa, Mycobacterium tuberculosis
VTPLTSAILLPAVIA

SEQ ID NO: 151025 - protein, 15 aa, Mycobacterium tuberculosis
TPLTSAILLPAVIAL

SEQ ID NO: 151026 - protein, 15 aa, Mycobacterium tuberculosis
PLTSAILLPAVIALA

SEQ ID NO: 151027 - protein, 15 aa, Mycobacterium tuberculosis
LTSAILLPAVIALAL

SEQ ID NO: 151028 - protein, 15 aa, Mycobacterium tuberculosis
TSAILLPAVIALALL

SEQ ID NO: 151029 - protein, 15 aa, Mycobacterium tuberculosis
SAILLPAVIALALLP

SEQ ID NO: 151030 - protein, 15 aa, Mycobacterium tuberculosis
AILLPAVIALALLPI

SEQ ID NO: 151031 - protein, 15 aa, Mycobacterium tuberculosis
ILLPAVIALALLPIS

SEQ ID NO: 151032 - protein, 15 aa, Mycobacterium tuberculosis
LLPAVIALALLPISW

SEQ ID NO: 151033 - protein, 15 aa, Mycobacterium tuberculosis
LPAVIALALLPISWQ

SEQ ID NO: 151034 - protein, 15 aa, Mycobacterium tuberculosis
PAVIALALLPISWQL

SEQ ID NO: 151035 - protein, 15 aa, Mycobacterium tuberculosis
AVIALALLPISWQLG

SEQ ID NO: 151036 - protein, 15 aa, Mycobacterium tuberculosis
VIALALLPISWQLGV

SEQ ID NO: 151037 - protein, 15 aa, Mycobacterium tuberculosis
IALALLPISWQLGVA

SEQ ID NO: 151038 - protein, 15 aa, Mycobacterium tuberculosis
ALALLPISWQLGVAA

SEQ ID NO: 151039 - protein, 15 aa, Mycobacterium tuberculosis
LALLPISWQLGVAAL

SEQ ID NO: 151040 - protein, 15 aa, Mycobacterium tuberculosis
ALLPISWQLGVAALA

SEQ ID NO: 151041 - protein, 15 aa, Mycobacterium tuberculosis
LLPISWQLGVAALAG

SEQ ID NO: 151042 - protein, 15 aa, Mycobacterium tuberculosis
LPISWQLGVAALAGV

SEQ ID NO: 151043 - protein, 15 aa, Mycobacterium tuberculosis
PISWQLGVAALAGVP

SEQ ID NO: 151044 - protein, 15 aa, Mycobacterium tuberculosis
ISWQLGVAALAGVPL

SEQ ID NO: 151045 - protein, 15 aa, Mycobacterium tuberculosis
SWQLGVAALAGVPLL

SEQ ID NO: 151046 - protein, 15 aa, Mycobacterium tuberculosis
WQLGVAALAGVPLLL

SEQ ID NO: 151047 - protein, 15 aa, Mycobacterium tuberculosis
QLGVAALAGVPLLLG

SEQ ID NO: 151048 - protein, 15 aa, Mycobacterium tuberculosis
LGVAALAGVPLLLGA

SEQ ID NO: 151049 - protein, 15 aa, Mycobacterium tuberculosis
GVAALAGVPLLLGAL

SEQ ID NO: 151050 - protein, 15 aa, Mycobacterium tuberculosis
VAALAGVPLLLGALW

SEQ ID NO: 151051 - protein, 15 aa, Mycobacterium tuberculosis
AALAGVPLLLGALWA

SEQ ID NO: 151052 - protein, 15 aa, Mycobacterium tuberculosis
ALAGVPLLLGALWAS

SEQ ID NO: 151053 - protein, 15 aa, Mycobacterium tuberculosis
LAGVPLLLGALWASA

SEQ ID NO: 151054 - protein, 15 aa, Mycobacterium tuberculosis
AGVPLLLGALWASAA

SEQ ID NO: 151055 - protein, 15 aa, Mycobacterium tuberculosis
GVPLLLGALWASAAF

SEQ ID NO: 151056 - protein, 15 aa, Mycobacterium tuberculosis
VPLLLGALWASAAFA

SEQ ID NO: 151057 - protein, 15 aa, Mycobacterium tuberculosis
PLLLGALWASAAFAR

SEQ ID NO: 151058 - protein, 15 aa, Mycobacterium tuberculosis
LLLGALWASAAFARR

SEQ ID NO: 151059 - protein, 15 aa, Mycobacterium tuberculosis
LLGALWASAAFARRA

SEQ ID NO: 151060 - protein, 15 aa, Mycobacterium tuberculosis
LGALWASAAFARRAD

SEQ ID NO: 151061 - protein, 15 aa, Mycobacterium tuberculosis
GALWASAAFARRADT

SEQ ID NO: 151062 - protein, 15 aa, Mycobacterium tuberculosis
ALWASAAFARRADTA

SEQ ID NO: 151063 - protein, 15 aa, Mycobacterium tuberculosis
LWASAAFARRADTAA

SEQ ID NO: 151064 - protein, 15 aa, Mycobacterium tuberculosis
WASAAFARRADTAAD

SEQ ID NO: 151065 - protein, 15 aa, Mycobacterium tuberculosis
ASAAFARRADTAADK

SEQ ID NO: 151066 - protein, 15 aa, Mycobacterium tuberculosis
SAAFARRADTAADKA

SEQ ID NO: 151067 - protein, 15 aa, Mycobacterium tuberculosis
AAFARRADTAADKAN

SEQ ID NO: 151068 - protein, 15 aa, Mycobacterium tuberculosis
AFARRADTAADKANT

SEQ ID NO: 151069 - protein, 15 aa, Mycobacterium tuberculosis
FARRADTAADKANTA

SEQ ID NO: 151070 - protein, 15 aa, Mycobacterium tuberculosis
ARRADTAADKANTAL

SEQ ID NO: 151071 - protein, 15 aa, Mycobacterium tuberculosis
RRADTAADKANTALT

SEQ ID NO: 151072 - protein, 15 aa, Mycobacterium tuberculosis
RADTAADKANTALTE

SEQ ID NO: 151073 - protein, 15 aa, Mycobacterium tuberculosis
ADTAADKANTALTER

SEQ ID NO: 151074 - protein, 15 aa, Mycobacterium tuberculosis
DTAADKANTALTERI

SEQ ID NO: 151075 - protein, 15 aa, Mycobacterium tuberculosis
TAADKANTALTERII

SEQ ID NO: 151076 - protein, 15 aa, Mycobacterium tuberculosis
AADKANTALTERIIE

SEQ ID NO: 151077 - protein, 15 aa, Mycobacterium tuberculosis
ADKANTALTERIIEF

SEQ ID NO: 151078 - protein, 15 aa, Mycobacterium tuberculosis
DKANTALTERIIEFA

SEQ ID NO: 151079 - protein, 15 aa, Mycobacterium tuberculosis
KANTALTERIIEFAR

SEQ ID NO: 151080 - protein, 15 aa, Mycobacterium tuberculosis
ANTALTERIIEFART

SEQ ID NO: 151081 - protein, 15 aa, Mycobacterium tuberculosis
NTALTERIIEFARTQ

SEQ ID NO: 151082 - protein, 15 aa, Mycobacterium tuberculosis
TALTERIIEFARTQQ

SEQ ID NO: 151083 - protein, 15 aa, Mycobacterium tuberculosis
ALTERIIEFARTQQA

SEQ ID NO: 151084 - protein, 15 aa, Mycobacterium tuberculosis
LTERIIEFARTQQAL

SEQ ID NO: 151085 - protein, 15 aa, Mycobacterium tuberculosis
TERIIEFARTQQALR

SEQ ID NO: 151086 - protein, 15 aa, Mycobacterium tuberculosis
ERIIEFARTQQALRA

SEQ ID NO: 151087 - protein, 15 aa, Mycobacterium tuberculosis
RIIEFARTQQALRAA

SEQ ID NO: 151088 - protein, 15 aa, Mycobacterium tuberculosis
IIEFARTQQALRAAR

SEQ ID NO: 151089 - protein, 15 aa, Mycobacterium tuberculosis
IEFARTQQALRAARR

SEQ ID NO: 151090 - protein, 15 aa, Mycobacterium tuberculosis
EFARTQQALRAARRV

SEQ ID NO: 151091 - protein, 15 aa, Mycobacterium tuberculosis
FARTQQALRAARRVE

SEQ ID NO: 151092 - protein, 15 aa, Mycobacterium tuberculosis
ARTQQALRAARRVEP

SEQ ID NO: 151093 - protein, 15 aa, Mycobacterium tuberculosis
RTQQALRAARRVEPA

SEQ ID NO: 151094 - protein, 15 aa, Mycobacterium tuberculosis
TQQALRAARRVEPAR

SEQ ID NO: 151095 - protein, 15 aa, Mycobacterium tuberculosis
QQALRAARRVEPARS

SEQ ID NO: 151096 - protein, 15 aa, Mycobacterium tuberculosis
QALRAARRVEPARSL

SEQ ID NO: 151097 - protein, 15 aa, Mycobacterium tuberculosis
ALRAARRVEPARSLV

SEQ ID NO: 151098 - protein, 15 aa, Mycobacterium tuberculosis
LRAARRVEPARSLVG

SEQ ID NO: 151099 - protein, 15 aa, Mycobacterium tuberculosis
RAARRVEPARSLVGN

SEQ ID NO: 151100 - protein, 15 aa, Mycobacterium tuberculosis
AARRVEPARSLVGNA

SEQ ID NO: 151101 - protein, 15 aa, Mycobacterium tuberculosis
ARRVEPARSLVGNAL

SEQ ID NO: 151102 - protein, 15 aa, Mycobacterium tuberculosis
RRVEPARSLVGNALA

SEQ ID NO: 151103 - protein, 15 aa, Mycobacterium tuberculosis
RVEPARSLVGNALAS

SEQ ID NO: 151104 - protein, 15 aa, Mycobacterium tuberculosis
VEPARSLVGNALASQ

SEQ ID NO: 151105 - protein, 15 aa, Mycobacterium tuberculosis
EPARSLVGNALASQH

SEQ ID NO: 151106 - protein, 15 aa, Mycobacterium tuberculosis
PARSLVGNALASQHT

SEQ ID NO: 151107 - protein, 15 aa, Mycobacterium tuberculosis
ARSLVGNALASQHTA

SEQ ID NO: 151108 - protein, 15 aa, Mycobacterium tuberculosis
RSLVGNALASQHTAT

SEQ ID NO: 151109 - protein, 15 aa, Mycobacterium tuberculosis
SLVGNALASQHTATM

SEQ ID NO: 151110 - protein, 15 aa, Mycobacterium tuberculosis
LVGNALASQHTATMR

SEQ ID NO: 151111 - protein, 15 aa, Mycobacterium tuberculosis
VGNALASQHTATMRL

SEQ ID NO: 151112 - protein, 15 aa, Mycobacterium tuberculosis
GNALASQHTATMRLL

SEQ ID NO: 151113 - protein, 15 aa, Mycobacterium tuberculosis
NALASQHTATMRLLG

SEQ ID NO: 151114 - protein, 15 aa, Mycobacterium tuberculosis
ALASQHTATMRLLGM

SEQ ID NO: 151115 - protein, 15 aa, Mycobacterium tuberculosis
LASQHTATMRLLGMQ

SEQ ID NO: 151116 - protein, 15 aa, Mycobacterium tuberculosis
ASQHTATMRLLGMQI

SEQ ID NO: 151117 - protein, 15 aa, Mycobacterium tuberculosis
SQHTATMRLLGMQIP

SEQ ID NO: 151118 - protein, 15 aa, Mycobacterium tuberculosis
QHTATMRLLGMQIPG

SEQ ID NO: 151119 - protein, 15 aa, Mycobacterium tuberculosis
HTATMRLLGMQIPGQ

SEQ ID NO: 151120 - protein, 15 aa, Mycobacterium tuberculosis
TATMRLLGMQIPGQL

SEQ ID NO: 151121 - protein, 15 aa, Mycobacterium tuberculosis
ATMRLLGMQIPGQLL

SEQ ID NO: 151122 - protein, 15 aa, Mycobacterium tuberculosis
TMRLLGMQIPGQLLF

SEQ ID NO: 151123 - protein, 15 aa, Mycobacterium tuberculosis
MRLLGMQIPGQLLFS

SEQ ID NO: 151124 - protein, 15 aa, Mycobacterium tuberculosis
RLLGMQIPGQLLFSI

SEQ ID NO: 151125 - protein, 15 aa, Mycobacterium tuberculosis
LLGMQIPGQLLFSIA

SEQ ID NO: 151126 - protein, 15 aa, Mycobacterium tuberculosis
LGMQIPGQLLFSIAS

SEQ ID NO: 151127 - protein, 15 aa, Mycobacterium tuberculosis
GMQIPGQLLFSIASQ

SEQ ID NO: 151128 - protein, 15 aa, Mycobacterium tuberculosis
MQIPGQLLFSIASQL

SEQ ID NO: 151129 - protein, 15 aa, Mycobacterium tuberculosis
QIPGQLLFSIASQLA

SEQ ID NO: 151130 - protein, 15 aa, Mycobacterium tuberculosis
IPGQLLFSIASQLAL

SEQ ID NO: 151131 - protein, 15 aa, Mycobacterium tuberculosis
PGQLLFSIASQLALI

SEQ ID NO: 151132 - protein, 15 aa, Mycobacterium tuberculosis
GQLLFSIASQLALIV

SEQ ID NO: 151133 - protein, 15 aa, Mycobacterium tuberculosis
QLLFSIASQLALIVL

SEQ ID NO: 151134 - protein, 15 aa, Mycobacterium tuberculosis
LLFSIASQLALIVLA

SEQ ID NO: 151135 - protein, 15 aa, Mycobacterium tuberculosis
LFSIASQLALIVLAG

SEQ ID NO: 151136 - protein, 15 aa, Mycobacterium tuberculosis
FSIASQLALIVLAGT

SEQ ID NO: 151137 - protein, 15 aa, Mycobacterium tuberculosis
SIASQLALIVLAGTT

SEQ ID NO: 151138 - protein, 15 aa, Mycobacterium tuberculosis
IASQLALIVLAGTTA

SEQ ID NO: 151139 - protein, 15 aa, Mycobacterium tuberculosis
ASQLALIVLAGTTAA

SEQ ID NO: 151140 - protein, 15 aa, Mycobacterium tuberculosis
SQLALIVLAGTTAAL

SEQ ID NO: 151141 - protein, 15 aa, Mycobacterium tuberculosis
QLALIVLAGTTAALT

SEQ ID NO: 151142 - protein, 15 aa, Mycobacterium tuberculosis
LALIVLAGTTAALTI

SEQ ID NO: 151143 - protein, 15 aa, Mycobacterium tuberculosis
ALIVLAGTTAALTIT

SEQ ID NO: 151144 - protein, 15 aa, Mycobacterium tuberculosis
LIVLAGTTAALTITG

SEQ ID NO: 151145 - protein, 15 aa, Mycobacterium tuberculosis
IVLAGTTAALTITGT

SEQ ID NO: 151146 - protein, 15 aa, Mycobacterium tuberculosis
VLAGTTAALTITGTL

SEQ ID NO: 151147 - protein, 15 aa, Mycobacterium tuberculosis
LAGTTAALTITGTLT

SEQ ID NO: 151148 - protein, 15 aa, Mycobacterium tuberculosis
AGTTAALTITGTLTV

SEQ ID NO: 151149 - protein, 15 aa, Mycobacterium tuberculosis
GTTAALTITGTLTVP

SEQ ID NO: 151150 - protein, 15 aa, Mycobacterium tuberculosis
TTAALTITGTLTVPE

SEQ ID NO: 151151 - protein, 15 aa, Mycobacterium tuberculosis
TAALTITGTLTVPEA

SEQ ID NO: 151152 - protein, 15 aa, Mycobacterium tuberculosis
AALTITGTLTVPEAI

SEQ ID NO: 151153 - protein, 15 aa, Mycobacterium tuberculosis
ALTITGTLTVPEAIA

SEQ ID NO: 151154 - protein, 15 aa, Mycobacterium tuberculosis
LTITGTLTVPEAIAL

SEQ ID NO: 151155 - protein, 15 aa, Mycobacterium tuberculosis
TITGTLTVPEAIALI

SEQ ID NO: 151156 - protein, 15 aa, Mycobacterium tuberculosis
ITGTLTVPEAIALIV

SEQ ID NO: 151157 - protein, 15 aa, Mycobacterium tuberculosis
TGTLTVPEAIALIVV

SEQ ID NO: 151158 - protein, 15 aa, Mycobacterium tuberculosis
GTLTVPEAIALIVVM

SEQ ID NO: 151159 - protein, 15 aa, Mycobacterium tuberculosis
TLTVPEAIALIVVMV

SEQ ID NO: 151160 - protein, 15 aa, Mycobacterium tuberculosis
LTVPEAIALIVVMVR

SEQ ID NO: 151161 - protein, 15 aa, Mycobacterium tuberculosis
TVPEAIALIVVMVRY

SEQ ID NO: 151162 - protein, 15 aa, Mycobacterium tuberculosis
VPEAIALIVVMVRYL

SEQ ID NO: 151163 - protein, 15 aa, Mycobacterium tuberculosis
PEAIALIVVMVRYLE

SEQ ID NO: 151164 - protein, 15 aa, Mycobacterium tuberculosis
EAIALIVVMVRYLEP

SEQ ID NO: 151165 - protein, 15 aa, Mycobacterium tuberculosis
AIALIVVMVRYLEPF

SEQ ID NO: 151166 - protein, 15 aa, Mycobacterium tuberculosis
IALIVVMVRYLEPFT

SEQ ID NO: 151167 - protein, 15 aa, Mycobacterium tuberculosis
ALIVVMVRYLEPFTA

SEQ ID NO: 151168 - protein, 15 aa, Mycobacterium tuberculosis
LIVVMVRYLEPFTAV

SEQ ID NO: 151169 - protein, 15 aa, Mycobacterium tuberculosis
IVVMVRYLEPFTAVS

SEQ ID NO: 151170 - protein, 15 aa, Mycobacterium tuberculosis
VVMVRYLEPFTAVSE

SEQ ID NO: 151171 - protein, 15 aa, Mycobacterium tuberculosis
VMVRYLEPFTAVSEL

SEQ ID NO: 151172 - protein, 15 aa, Mycobacterium tuberculosis
MVRYLEPFTAVSELA

SEQ ID NO: 151173 - protein, 15 aa, Mycobacterium tuberculosis
VRYLEPFTAVSELAP

SEQ ID NO: 151174 - protein, 15 aa, Mycobacterium tuberculosis
RYLEPFTAVSELAPA

SEQ ID NO: 151175 - protein, 15 aa, Mycobacterium tuberculosis
YLEPFTAVSELAPAL

SEQ ID NO: 151176 - protein, 15 aa, Mycobacterium tuberculosis
LEPFTAVSELAPALE

SEQ ID NO: 151177 - protein, 15 aa, Mycobacterium tuberculosis
EPFTAVSELAPALES

SEQ ID NO: 151178 - protein, 15 aa, Mycobacterium tuberculosis
PFTAVSELAPALEST

SEQ ID NO: 151179 - protein, 15 aa, Mycobacterium tuberculosis
FTAVSELAPALESTR

SEQ ID NO: 151180 - protein, 15 aa, Mycobacterium tuberculosis
TAVSELAPALESTRA

SEQ ID NO: 151181 - protein, 15 aa, Mycobacterium tuberculosis
AVSELAPALESTRAT

SEQ ID NO: 151182 - protein, 15 aa, Mycobacterium tuberculosis
VSELAPALESTRATL

SEQ ID NO: 151183 - protein, 15 aa, Mycobacterium tuberculosis
SELAPALESTRATLG

SEQ ID NO: 151184 - protein, 15 aa, Mycobacterium tuberculosis
ELAPALESTRATLGR

SEQ ID NO: 151185 - protein, 15 aa, Mycobacterium tuberculosis
LAPALESTRATLGRI

SEQ ID NO: 151186 - protein, 15 aa, Mycobacterium tuberculosis
APALESTRATLGRIG

SEQ ID NO: 151187 - protein, 15 aa, Mycobacterium tuberculosis
PALESTRATLGRIGS

SEQ ID NO: 151188 - protein, 15 aa, Mycobacterium tuberculosis
ALESTRATLGRIGSV

SEQ ID NO: 151189 - protein, 15 aa, Mycobacterium tuberculosis
LESTRATLGRIGSVL

SEQ ID NO: 151190 - protein, 15 aa, Mycobacterium tuberculosis
ESTRATLGRIGSVLT

SEQ ID NO: 151191 - protein, 15 aa, Mycobacterium tuberculosis
STRATLGRIGSVLTA

SEQ ID NO: 151192 - protein, 15 aa, Mycobacterium tuberculosis
TRATLGRIGSVLTAP

SEQ ID NO: 151193 - protein, 15 aa, Mycobacterium tuberculosis
RATLGRIGSVLTAPV

SEQ ID NO: 151194 - protein, 15 aa, Mycobacterium tuberculosis
ATLGRIGSVLTAPVM

SEQ ID NO: 151195 - protein, 15 aa, Mycobacterium tuberculosis
TLGRIGSVLTAPVMV

SEQ ID NO: 151196 - protein, 15 aa, Mycobacterium tuberculosis
LGRIGSVLTAPVMVA

SEQ ID NO: 151197 - protein, 15 aa, Mycobacterium tuberculosis
GRIGSVLTAPVMVAG

SEQ ID NO: 151198 - protein, 15 aa, Mycobacterium tuberculosis
RIGSVLTAPVMVAGS

SEQ ID NO: 151199 - protein, 15 aa, Mycobacterium tuberculosis
IGSVLTAPVMVAGSG

SEQ ID NO: 151200 - protein, 15 aa, Mycobacterium tuberculosis
GSVLTAPVMVAGSGT

SEQ ID NO: 151201 - protein, 15 aa, Mycobacterium tuberculosis
SVLTAPVMVAGSGTW

SEQ ID NO: 151202 - protein, 15 aa, Mycobacterium tuberculosis
VLTAPVMVAGSGTWR

SEQ ID NO: 151203 - protein, 15 aa, Mycobacterium tuberculosis
LTAPVMVAGSGTWRD

SEQ ID NO: 151204 - protein, 15 aa, Mycobacterium tuberculosis
TAPVMVAGSGTWRDG

SEQ ID NO: 151205 - protein, 15 aa, Mycobacterium tuberculosis
APVMVAGSGTWRDGA

SEQ ID NO: 151206 - protein, 15 aa, Mycobacterium tuberculosis
PVMVAGSGTWRDGAV

SEQ ID NO: 151207 - protein, 15 aa, Mycobacterium tuberculosis
VMVAGSGTWRDGAVV

SEQ ID NO: 151208 - protein, 15 aa, Mycobacterium tuberculosis
MVAGSGTWRDGAVVP

SEQ ID NO: 151209 - protein, 15 aa, Mycobacterium tuberculosis
VAGSGTWRDGAVVPR

SEQ ID NO: 151210 - protein, 15 aa, Mycobacterium tuberculosis
AGSGTWRDGAVVPRI

SEQ ID NO: 151211 - protein, 15 aa, Mycobacterium tuberculosis
GSGTWRDGAVVPRIE

SEQ ID NO: 151212 - protein, 15 aa, Mycobacterium tuberculosis
SGTWRDGAVVPRIEF

SEQ ID NO: 151213 - protein, 15 aa, Mycobacterium tuberculosis
GTWRDGAVVPRIEFD

SEQ ID NO: 151214 - protein, 15 aa, Mycobacterium tuberculosis
TWRDGAVVPRIEFDD

SEQ ID NO: 151215 - protein, 15 aa, Mycobacterium tuberculosis
WRDGAVVPRIEFDDV

SEQ ID NO: 151216 - protein, 15 aa, Mycobacterium tuberculosis
RDGAVVPRIEFDDVA

SEQ ID NO: 151217 - protein, 15 aa, Mycobacterium tuberculosis
DGAVVPRIEFDDVAF

SEQ ID NO: 151218 - protein, 15 aa, Mycobacterium tuberculosis
GAVVPRIEFDDVAFG

SEQ ID NO: 151219 - protein, 15 aa, Mycobacterium tuberculosis
AVVPRIEFDDVAFGY

SEQ ID NO: 151220 - protein, 15 aa, Mycobacterium tuberculosis
VVPRIEFDDVAFGYD

SEQ ID NO: 151221 - protein, 15 aa, Mycobacterium tuberculosis
VPRIEFDDVAFGYDG

SEQ ID NO: 151222 - protein, 15 aa, Mycobacterium tuberculosis
PRIEFDDVAFGYDGG

SEQ ID NO: 151223 - protein, 15 aa, Mycobacterium tuberculosis
RIEFDDVAFGYDGGS

SEQ ID NO: 151224 - protein, 15 aa, Mycobacterium tuberculosis
IEFDDVAFGYDGGSG

SEQ ID NO: 151225 - protein, 15 aa, Mycobacterium tuberculosis
EFDDVAFGYDGGSGP

SEQ ID NO: 151226 - protein, 15 aa, Mycobacterium tuberculosis
FDDVAFGYDGGSGPV

SEQ ID NO: 151227 - protein, 15 aa, Mycobacterium tuberculosis
DDVAFGYDGGSGPVL

SEQ ID NO: 151228 - protein, 15 aa, Mycobacterium tuberculosis
DVAFGYDGGSGPVLD

SEQ ID NO: 151229 - protein, 15 aa, Mycobacterium tuberculosis
VAFGYDGGSGPVLDG

SEQ ID NO: 151230 - protein, 15 aa, Mycobacterium tuberculosis
AFGYDGGSGPVLDGV

SEQ ID NO: 151231 - protein, 15 aa, Mycobacterium tuberculosis
FGYDGGSGPVLDGVS

SEQ ID NO: 151232 - protein, 15 aa, Mycobacterium tuberculosis
GYDGGSGPVLDGVSF

SEQ ID NO: 151233 - protein, 15 aa, Mycobacterium tuberculosis
YDGGSGPVLDGVSFC

SEQ ID NO: 151234 - protein, 15 aa, Mycobacterium tuberculosis
DGGSGPVLDGVSFCL

SEQ ID NO: 151235 - protein, 15 aa, Mycobacterium tuberculosis
GGSGPVLDGVSFCLQ

SEQ ID NO: 151236 - protein, 15 aa, Mycobacterium tuberculosis
GSGPVLDGVSFCLQP

SEQ ID NO: 151237 - protein, 15 aa, Mycobacterium tuberculosis
SGPVLDGVSFCLQPG

SEQ ID NO: 151238 - protein, 15 aa, Mycobacterium tuberculosis
GPVLDGVSFCLQPGT

SEQ ID NO: 151239 - protein, 15 aa, Mycobacterium tuberculosis
PVLDGVSFCLQPGTT

SEQ ID NO: 151240 - protein, 15 aa, Mycobacterium tuberculosis
VLDGVSFCLQPGTTT

SEQ ID NO: 151241 - protein, 15 aa, Mycobacterium tuberculosis
LDGVSFCLQPGTTTA

SEQ ID NO: 151242 - protein, 15 aa, Mycobacterium tuberculosis
DGVSFCLQPGTTTAI

SEQ ID NO: 151243 - protein, 15 aa, Mycobacterium tuberculosis
GVSFCLQPGTTTAIV

SEQ ID NO: 151244 - protein, 15 aa, Mycobacterium tuberculosis
VSFCLQPGTTTAIVG

SEQ ID NO: 151245 - protein, 15 aa, Mycobacterium tuberculosis
SFCLQPGTTTAIVGP

SEQ ID NO: 151246 - protein, 15 aa, Mycobacterium tuberculosis
FCLQPGTTTAIVGPS

SEQ ID NO: 151247 - protein, 15 aa, Mycobacterium tuberculosis
CLQPGTTTAIVGPSG

SEQ ID NO: 151248 - protein, 15 aa, Mycobacterium tuberculosis
LQPGTTTAIVGPSGC

SEQ ID NO: 151249 - protein, 15 aa, Mycobacterium tuberculosis
QPGTTTAIVGPSGCG

SEQ ID NO: 151250 - protein, 15 aa, Mycobacterium tuberculosis
PGTTTAIVGPSGCGK

SEQ ID NO: 151251 - protein, 15 aa, Mycobacterium tuberculosis
GTTTAIVGPSGCGKS

SEQ ID NO: 151252 - protein, 15 aa, Mycobacterium tuberculosis
TTTAIVGPSGCGKST

SEQ ID NO: 151253 - protein, 15 aa, Mycobacterium tuberculosis
TTAIVGPSGCGKSTI

SEQ ID NO: 151254 - protein, 15 aa, Mycobacterium tuberculosis
TAIVGPSGCGKSTIL

SEQ ID NO: 151255 - protein, 15 aa, Mycobacterium tuberculosis
AIVGPSGCGKSTILA

SEQ ID NO: 151256 - protein, 15 aa, Mycobacterium tuberculosis
IVGPSGCGKSTILAL

SEQ ID NO: 151257 - protein, 15 aa, Mycobacterium tuberculosis
VGPSGCGKSTILALI

SEQ ID NO: 151258 - protein, 15 aa, Mycobacterium tuberculosis
GPSGCGKSTILALIA

SEQ ID NO: 151259 - protein, 15 aa, Mycobacterium tuberculosis
PSGCGKSTILALIAG

SEQ ID NO: 151260 - protein, 15 aa, Mycobacterium tuberculosis
SGCGKSTILALIAGL

SEQ ID NO: 151261 - protein, 15 aa, Mycobacterium tuberculosis
GCGKSTILALIAGLH

SEQ ID NO: 151262 - protein, 15 aa, Mycobacterium tuberculosis
CGKSTILALIAGLHQ

SEQ ID NO: 151263 - protein, 15 aa, Mycobacterium tuberculosis
GKSTILALIAGLHQP

SEQ ID NO: 151264 - protein, 15 aa, Mycobacterium tuberculosis
KSTILALIAGLHQPT

SEQ ID NO: 151265 - protein, 15 aa, Mycobacterium tuberculosis
STILALIAGLHQPTR

SEQ ID NO: 151266 - protein, 15 aa, Mycobacterium tuberculosis
TILALIAGLHQPTRG

SEQ ID NO: 151267 - protein, 15 aa, Mycobacterium tuberculosis
ILALIAGLHQPTRGR

SEQ ID NO: 151268 - protein, 15 aa, Mycobacterium tuberculosis
LALIAGLHQPTRGRV

SEQ ID NO: 151269 - protein, 15 aa, Mycobacterium tuberculosis
ALIAGLHQPTRGRVL

SEQ ID NO: 151270 - protein, 15 aa, Mycobacterium tuberculosis
LIAGLHQPTRGRVLI

SEQ ID NO: 151271 - protein, 15 aa, Mycobacterium tuberculosis
IAGLHQPTRGRVLID

SEQ ID NO: 151272 - protein, 15 aa, Mycobacterium tuberculosis
AGLHQPTRGRVLIDG

SEQ ID NO: 151273 - protein, 15 aa, Mycobacterium tuberculosis
GLHQPTRGRVLIDGT

SEQ ID NO: 151274 - protein, 15 aa, Mycobacterium tuberculosis
LHQPTRGRVLIDGTD

SEQ ID NO: 151275 - protein, 15 aa, Mycobacterium tuberculosis
HQPTRGRVLIDGTDV

SEQ ID NO: 151276 - protein, 15 aa, Mycobacterium tuberculosis
QPTRGRVLIDGTDVA

SEQ ID NO: 151277 - protein, 15 aa, Mycobacterium tuberculosis
PTRGRVLIDGTDVAT

SEQ ID NO: 151278 - protein, 15 aa, Mycobacterium tuberculosis
TRGRVLIDGTDVATL

SEQ ID NO: 151279 - protein, 15 aa, Mycobacterium tuberculosis
RGRVLIDGTDVATLD

SEQ ID NO: 151280 - protein, 15 aa, Mycobacterium tuberculosis
GRVLIDGTDVATLDA

SEQ ID NO: 151281 - protein, 15 aa, Mycobacterium tuberculosis
RVLIDGTDVATLDAR

SEQ ID NO: 151282 - protein, 15 aa, Mycobacterium tuberculosis
VLIDGTDVATLDARA

SEQ ID NO: 151283 - protein, 15 aa, Mycobacterium tuberculosis
LIDGTDVATLDARAQ

SEQ ID NO: 151284 - protein, 15 aa, Mycobacterium tuberculosis
IDGTDVATLDARAQQ

SEQ ID NO: 151285 - protein, 15 aa, Mycobacterium tuberculosis
DGTDVATLDARAQQA

SEQ ID NO: 151286 - protein, 15 aa, Mycobacterium tuberculosis
GTDVATLDARAQQAV

SEQ ID NO: 151287 - protein, 15 aa, Mycobacterium tuberculosis
TDVATLDARAQQAVC

SEQ ID NO: 151288 - protein, 15 aa, Mycobacterium tuberculosis
DVATLDARAQQAVCS

SEQ ID NO: 151289 - protein, 15 aa, Mycobacterium tuberculosis
VATLDARAQQAVCSV

SEQ ID NO: 151290 - protein, 15 aa, Mycobacterium tuberculosis
ATLDARAQQAVCSVV

SEQ ID NO: 151291 - protein, 15 aa, Mycobacterium tuberculosis
TLDARAQQAVCSVVF

SEQ ID NO: 151292 - protein, 15 aa, Mycobacterium tuberculosis
LDARAQQAVCSVVFQ

SEQ ID NO: 151293 - protein, 15 aa, Mycobacterium tuberculosis
DARAQQAVCSVVFQH

SEQ ID NO: 151294 - protein, 15 aa, Mycobacterium tuberculosis
ARAQQAVCSVVFQHP

SEQ ID NO: 151295 - protein, 15 aa, Mycobacterium tuberculosis
RAQQAVCSVVFQHPY

SEQ ID NO: 151296 - protein, 15 aa, Mycobacterium tuberculosis
AQQAVCSVVFQHPYL

SEQ ID NO: 151297 - protein, 15 aa, Mycobacterium tuberculosis
QQAVCSVVFQHPYLF

SEQ ID NO: 151298 - protein, 15 aa, Mycobacterium tuberculosis
QAVCSVVFQHPYLFH

SEQ ID NO: 151299 - protein, 15 aa, Mycobacterium tuberculosis
AVCSVVFQHPYLFHG

SEQ ID NO: 151300 - protein, 15 aa, Mycobacterium tuberculosis
VCSVVFQHPYLFHGT

SEQ ID NO: 151301 - protein, 15 aa, Mycobacterium tuberculosis
CSVVFQHPYLFHGTI

SEQ ID NO: 151302 - protein, 15 aa, Mycobacterium tuberculosis
SVVFQHPYLFHGTIR

SEQ ID NO: 151303 - protein, 15 aa, Mycobacterium tuberculosis
VVFQHPYLFHGTIRD

SEQ ID NO: 151304 - protein, 15 aa, Mycobacterium tuberculosis
VFQHPYLFHGTIRDN

SEQ ID NO: 151305 - protein, 15 aa, Mycobacterium tuberculosis
FQHPYLFHGTIRDNV

SEQ ID NO: 151306 - protein, 15 aa, Mycobacterium tuberculosis
QHPYLFHGTIRDNVF

SEQ ID NO: 151307 - protein, 15 aa, Mycobacterium tuberculosis
HPYLFHGTIRDNVFA

SEQ ID NO: 151308 - protein, 15 aa, Mycobacterium tuberculosis
PYLFHGTIRDNVFAA

SEQ ID NO: 151309 - protein, 15 aa, Mycobacterium tuberculosis
YLFHGTIRDNVFAAD

SEQ ID NO: 151310 - protein, 15 aa, Mycobacterium tuberculosis
LFHGTIRDNVFAADP

SEQ ID NO: 151311 - protein, 15 aa, Mycobacterium tuberculosis
FHGTIRDNVFAADPG

SEQ ID NO: 151312 - protein, 15 aa, Mycobacterium tuberculosis
HGTIRDNVFAADPGA

SEQ ID NO: 151313 - protein, 15 aa, Mycobacterium tuberculosis
GTIRDNVFAADPGAS

SEQ ID NO: 151314 - protein, 15 aa, Mycobacterium tuberculosis
TIRDNVFAADPGASD

SEQ ID NO: 151315 - protein, 15 aa, Mycobacterium tuberculosis
IRDNVFAADPGASDD

SEQ ID NO: 151316 - protein, 15 aa, Mycobacterium tuberculosis
RDNVFAADPGASDDQ

SEQ ID NO: 151317 - protein, 15 aa, Mycobacterium tuberculosis
DNVFAADPGASDDQF

SEQ ID NO: 151318 - protein, 15 aa, Mycobacterium tuberculosis
NVFAADPGASDDQFA

SEQ ID NO: 151319 - protein, 15 aa, Mycobacterium tuberculosis
VFAADPGASDDQFAQ

SEQ ID NO: 151320 - protein, 15 aa, Mycobacterium tuberculosis
FAADPGASDDQFAQA

SEQ ID NO: 151321 - protein, 15 aa, Mycobacterium tuberculosis
AADPGASDDQFAQAV

SEQ ID NO: 151322 - protein, 15 aa, Mycobacterium tuberculosis
ADPGASDDQFAQAVR

SEQ ID NO: 151323 - protein, 15 aa, Mycobacterium tuberculosis
DPGASDDQFAQAVRL

SEQ ID NO: 151324 - protein, 15 aa, Mycobacterium tuberculosis
PGASDDQFAQAVRLA

SEQ ID NO: 151325 - protein, 15 aa, Mycobacterium tuberculosis
GASDDQFAQAVRLAR

SEQ ID NO: 151326 - protein, 15 aa, Mycobacterium tuberculosis
ASDDQFAQAVRLARV

SEQ ID NO: 151327 - protein, 15 aa, Mycobacterium tuberculosis
SDDQFAQAVRLARVD

SEQ ID NO: 151328 - protein, 15 aa, Mycobacterium tuberculosis
DDQFAQAVRLARVDE

SEQ ID NO: 151329 - protein, 15 aa, Mycobacterium tuberculosis
DQFAQAVRLARVDEL

SEQ ID NO: 151330 - protein, 15 aa, Mycobacterium tuberculosis
QFAQAVRLARVDELI

SEQ ID NO: 151331 - protein, 15 aa, Mycobacterium tuberculosis
FAQAVRLARVDELIA

SEQ ID NO: 151332 - protein, 15 aa, Mycobacterium tuberculosis
AQAVRLARVDELIAR

SEQ ID NO: 151333 - protein, 15 aa, Mycobacterium tuberculosis
QAVRLARVDELIARL

SEQ ID NO: 151334 - protein, 15 aa, Mycobacterium tuberculosis
AVRLARVDELIARLP

SEQ ID NO: 151335 - protein, 15 aa, Mycobacterium tuberculosis
VRLARVDELIARLPD

SEQ ID NO: 151336 - protein, 15 aa, Mycobacterium tuberculosis
RLARVDELIARLPDG

SEQ ID NO: 151337 - protein, 15 aa, Mycobacterium tuberculosis
LARVDELIARLPDGA

SEQ ID NO: 151338 - protein, 15 aa, Mycobacterium tuberculosis
ARVDELIARLPDGAN

SEQ ID NO: 151339 - protein, 15 aa, Mycobacterium tuberculosis
RVDELIARLPDGANT

SEQ ID NO: 151340 - protein, 15 aa, Mycobacterium tuberculosis
VDELIARLPDGANTI

SEQ ID NO: 151341 - protein, 15 aa, Mycobacterium tuberculosis
DELIARLPDGANTIV

SEQ ID NO: 151342 - protein, 15 aa, Mycobacterium tuberculosis
ELIARLPDGANTIVG

SEQ ID NO: 151343 - protein, 15 aa, Mycobacterium tuberculosis
LIARLPDGANTIVGE

SEQ ID NO: 151344 - protein, 15 aa, Mycobacterium tuberculosis
IARLPDGANTIVGEA

SEQ ID NO: 151345 - protein, 15 aa, Mycobacterium tuberculosis
ARLPDGANTIVGEAG

SEQ ID NO: 151346 - protein, 15 aa, Mycobacterium tuberculosis
RLPDGANTIVGEAGS

SEQ ID NO: 151347 - protein, 15 aa, Mycobacterium tuberculosis
LPDGANTIVGEAGSA

SEQ ID NO: 151348 - protein, 15 aa, Mycobacterium tuberculosis
PDGANTIVGEAGSAL

SEQ ID NO: 151349 - protein, 15 aa, Mycobacterium tuberculosis
DGANTIVGEAGSALS

SEQ ID NO: 151350 - protein, 15 aa, Mycobacterium tuberculosis
GANTIVGEAGSALSG

SEQ ID NO: 151351 - protein, 15 aa, Mycobacterium tuberculosis
ANTIVGEAGSALSGG

SEQ ID NO: 151352 - protein, 15 aa, Mycobacterium tuberculosis
NTIVGEAGSALSGGE

SEQ ID NO: 151353 - protein, 15 aa, Mycobacterium tuberculosis
TIVGEAGSALSGGER

SEQ ID NO: 151354 - protein, 15 aa, Mycobacterium tuberculosis
IVGEAGSALSGGERQ

SEQ ID NO: 151355 - protein, 15 aa, Mycobacterium tuberculosis
VGEAGSALSGGERQR

SEQ ID NO: 151356 - protein, 15 aa, Mycobacterium tuberculosis
GEAGSALSGGERQRV

SEQ ID NO: 151357 - protein, 15 aa, Mycobacterium tuberculosis
EAGSALSGGERQRVS

SEQ ID NO: 151358 - protein, 15 aa, Mycobacterium tuberculosis
AGSALSGGERQRVSI

SEQ ID NO: 151359 - protein, 15 aa, Mycobacterium tuberculosis
GSALSGGERQRVSIA

SEQ ID NO: 151360 - protein, 15 aa, Mycobacterium tuberculosis
SALSGGERQRVSIAR

SEQ ID NO: 151361 - protein, 15 aa, Mycobacterium tuberculosis
ALSGGERQRVSIARA

SEQ ID NO: 151362 - protein, 15 aa, Mycobacterium tuberculosis
LSGGERQRVSIARAL

SEQ ID NO: 151363 - protein, 15 aa, Mycobacterium tuberculosis
SGGERQRVSIARALL

SEQ ID NO: 151364 - protein, 15 aa, Mycobacterium tuberculosis
GGERQRVSIARALLK

SEQ ID NO: 151365 - protein, 15 aa, Mycobacterium tuberculosis
GERQRVSIARALLKA

SEQ ID NO: 151366 - protein, 15 aa, Mycobacterium tuberculosis
ERQRVSIARALLKAA

SEQ ID NO: 151367 - protein, 15 aa, Mycobacterium tuberculosis
RQRVSIARALLKAAP

SEQ ID NO: 151368 - protein, 15 aa, Mycobacterium tuberculosis
QRVSIARALLKAAPV

SEQ ID NO: 151369 - protein, 15 aa, Mycobacterium tuberculosis
RVSIARALLKAAPVL

SEQ ID NO: 151370 - protein, 15 aa, Mycobacterium tuberculosis
VSIARALLKAAPVLL

SEQ ID NO: 151371 - protein, 15 aa, Mycobacterium tuberculosis
SIARALLKAAPVLLV

SEQ ID NO: 151372 - protein, 15 aa, Mycobacterium tuberculosis
IARALLKAAPVLLVD

SEQ ID NO: 151373 - protein, 15 aa, Mycobacterium tuberculosis
ARALLKAAPVLLVDE

SEQ ID NO: 151374 - protein, 15 aa, Mycobacterium tuberculosis
RALLKAAPVLLVDEA

SEQ ID NO: 151375 - protein, 15 aa, Mycobacterium tuberculosis
ALLKAAPVLLVDEAT

SEQ ID NO: 151376 - protein, 15 aa, Mycobacterium tuberculosis
LLKAAPVLLVDEATS

SEQ ID NO: 151377 - protein, 15 aa, Mycobacterium tuberculosis
LKAAPVLLVDEATSA

SEQ ID NO: 151378 - protein, 15 aa, Mycobacterium tuberculosis
KAAPVLLVDEATSAL

SEQ ID NO: 151379 - protein, 15 aa, Mycobacterium tuberculosis
AAPVLLVDEATSALD

SEQ ID NO: 151380 - protein, 15 aa, Mycobacterium tuberculosis
APVLLVDEATSALDA

SEQ ID NO: 151381 - protein, 15 aa, Mycobacterium tuberculosis
PVLLVDEATSALDAE

SEQ ID NO: 151382 - protein, 15 aa, Mycobacterium tuberculosis
VLLVDEATSALDAEN

SEQ ID NO: 151383 - protein, 15 aa, Mycobacterium tuberculosis
LLVDEATSALDAENE

SEQ ID NO: 151384 - protein, 15 aa, Mycobacterium tuberculosis
LVDEATSALDAENEA

SEQ ID NO: 151385 - protein, 15 aa, Mycobacterium tuberculosis
VDEATSALDAENEAA

SEQ ID NO: 151386 - protein, 15 aa, Mycobacterium tuberculosis
DEATSALDAENEAAV

SEQ ID NO: 151387 - protein, 15 aa, Mycobacterium tuberculosis
EATSALDAENEAAVV

SEQ ID NO: 151388 - protein, 15 aa, Mycobacterium tuberculosis
ATSALDAENEAAVVD

SEQ ID NO: 151389 - protein, 15 aa, Mycobacterium tuberculosis
TSALDAENEAAVVDA

SEQ ID NO: 151390 - protein, 15 aa, Mycobacterium tuberculosis
SALDAENEAAVVDAL

SEQ ID NO: 151391 - protein, 15 aa, Mycobacterium tuberculosis
ALDAENEAAVVDALA

SEQ ID NO: 151392 - protein, 15 aa, Mycobacterium tuberculosis
LDAENEAAVVDALAA

SEQ ID NO: 151393 - protein, 15 aa, Mycobacterium tuberculosis
DAENEAAVVDALAAD

SEQ ID NO: 151394 - protein, 15 aa, Mycobacterium tuberculosis
AENEAAVVDALAADP

SEQ ID NO: 151395 - protein, 15 aa, Mycobacterium tuberculosis
ENEAAVVDALAADPR

SEQ ID NO: 151396 - protein, 15 aa, Mycobacterium tuberculosis
NEAAVVDALAADPRS

SEQ ID NO: 151397 - protein, 15 aa, Mycobacterium tuberculosis
EAAVVDALAADPRSR

SEQ ID NO: 151398 - protein, 15 aa, Mycobacterium tuberculosis
AAVVDALAADPRSRT

SEQ ID NO: 151399 - protein, 15 aa, Mycobacterium tuberculosis
AVVDALAADPRSRTR

SEQ ID NO: 151400 - protein, 15 aa, Mycobacterium tuberculosis
VVDALAADPRSRTRV

SEQ ID NO: 151401 - protein, 15 aa, Mycobacterium tuberculosis
VDALAADPRSRTRVI

SEQ ID NO: 151402 - protein, 15 aa, Mycobacterium tuberculosis
DALAADPRSRTRVIV

SEQ ID NO: 151403 - protein, 15 aa, Mycobacterium tuberculosis
ALAADPRSRTRVIVA

SEQ ID NO: 151404 - protein, 15 aa, Mycobacterium tuberculosis
LAADPRSRTRVIVAH

SEQ ID NO: 151405 - protein, 15 aa, Mycobacterium tuberculosis
AADPRSRTRVIVAHR

SEQ ID NO: 151406 - protein, 15 aa, Mycobacterium tuberculosis
ADPRSRTRVIVAHRL

SEQ ID NO: 151407 - protein, 15 aa, Mycobacterium tuberculosis
DPRSRTRVIVAHRLA

SEQ ID NO: 151408 - protein, 15 aa, Mycobacterium tuberculosis
PRSRTRVIVAHRLAS

SEQ ID NO: 151409 - protein, 15 aa, Mycobacterium tuberculosis
RSRTRVIVAHRLASI

SEQ ID NO: 151410 - protein, 15 aa, Mycobacterium tuberculosis
SRTRVIVAHRLASIR

SEQ ID NO: 151411 - protein, 15 aa, Mycobacterium tuberculosis
RTRVIVAHRLASIRH

SEQ ID NO: 151412 - protein, 15 aa, Mycobacterium tuberculosis
TRVIVAHRLASIRHA

SEQ ID NO: 151413 - protein, 15 aa, Mycobacterium tuberculosis
RVIVAHRLASIRHAD

SEQ ID NO: 151414 - protein, 15 aa, Mycobacterium tuberculosis
VIVAHRLASIRHADR

SEQ ID NO: 151415 - protein, 15 aa, Mycobacterium tuberculosis
IVAHRLASIRHADRV

SEQ ID NO: 151416 - protein, 15 aa, Mycobacterium tuberculosis
VAHRLASIRHADRVL

SEQ ID NO: 151417 - protein, 15 aa, Mycobacterium tuberculosis
AHRLASIRHADRVLF

SEQ ID NO: 151418 - protein, 15 aa, Mycobacterium tuberculosis
HRLASIRHADRVLFV

SEQ ID NO: 151419 - protein, 15 aa, Mycobacterium tuberculosis
RLASIRHADRVLFVD

SEQ ID NO: 151420 - protein, 15 aa, Mycobacterium tuberculosis
LASIRHADRVLFVDD

SEQ ID NO: 151421 - protein, 15 aa, Mycobacterium tuberculosis
ASIRHADRVLFVDDG

SEQ ID NO: 151422 - protein, 15 aa, Mycobacterium tuberculosis
SIRHADRVLFVDDGR

SEQ ID NO: 151423 - protein, 15 aa, Mycobacterium tuberculosis
IRHADRVLFVDDGRV

SEQ ID NO: 151424 - protein, 15 aa, Mycobacterium tuberculosis
RHADRVLFVDDGRVV

SEQ ID NO: 151425 - protein, 15 aa, Mycobacterium tuberculosis
HADRVLFVDDGRVVE

SEQ ID NO: 151426 - protein, 15 aa, Mycobacterium tuberculosis
ADRVLFVDDGRVVED

SEQ ID NO: 151427 - protein, 15 aa, Mycobacterium tuberculosis
DRVLFVDDGRVVEDG

SEQ ID NO: 151428 - protein, 15 aa, Mycobacterium tuberculosis
RVLFVDDGRVVEDGS

SEQ ID NO: 151429 - protein, 15 aa, Mycobacterium tuberculosis
VLFVDDGRVVEDGSI

SEQ ID NO: 151430 - protein, 15 aa, Mycobacterium tuberculosis
LFVDDGRVVEDGSIS

SEQ ID NO: 151431 - protein, 15 aa, Mycobacterium tuberculosis
FVDDGRVVEDGSISE

SEQ ID NO: 151432 - protein, 15 aa, Mycobacterium tuberculosis
VDDGRVVEDGSISEL

SEQ ID NO: 151433 - protein, 15 aa, Mycobacterium tuberculosis
DDGRVVEDGSISELL

SEQ ID NO: 151434 - protein, 15 aa, Mycobacterium tuberculosis
DGRVVEDGSISELLT

SEQ ID NO: 151435 - protein, 15 aa, Mycobacterium tuberculosis
GRVVEDGSISELLTA

SEQ ID NO: 151436 - protein, 15 aa, Mycobacterium tuberculosis
RVVEDGSISELLTAG

SEQ ID NO: 151437 - protein, 15 aa, Mycobacterium tuberculosis
VVEDGSISELLTAGG

SEQ ID NO: 151438 - protein, 15 aa, Mycobacterium tuberculosis
VEDGSISELLTAGGR

SEQ ID NO: 151439 - protein, 15 aa, Mycobacterium tuberculosis
EDGSISELLTAGGRF

SEQ ID NO: 151440 - protein, 15 aa, Mycobacterium tuberculosis
DGSISELLTAGGRFS

SEQ ID NO: 151441 - protein, 15 aa, Mycobacterium tuberculosis
GSISELLTAGGRFSQ

SEQ ID NO: 151442 - protein, 15 aa, Mycobacterium tuberculosis
SISELLTAGGRFSQF

SEQ ID NO: 151443 - protein, 15 aa, Mycobacterium tuberculosis
ISELLTAGGRFSQFW

SEQ ID NO: 151444 - protein, 15 aa, Mycobacterium tuberculosis
SELLTAGGRFSQFWR

SEQ ID NO: 151445 - protein, 15 aa, Mycobacterium tuberculosis
ELLTAGGRFSQFWRQ

SEQ ID NO: 151446 - protein, 15 aa, Mycobacterium tuberculosis
LLTAGGRFSQFWRQQ

SEQ ID NO: 151447 - protein, 15 aa, Mycobacterium tuberculosis
LTAGGRFSQFWRQQH

SEQ ID NO: 151448 - protein, 15 aa, Mycobacterium tuberculosis
TAGGRFSQFWRQQHE

SEQ ID NO: 151449 - protein, 15 aa, Mycobacterium tuberculosis
AGGRFSQFWRQQHEA

SEQ ID NO: 151450 - protein, 15 aa, Mycobacterium tuberculosis
GGRFSQFWRQQHEAA

SEQ ID NO: 151451 - protein, 15 aa, Mycobacterium tuberculosis
GRFSQFWRQQHEAAE

SEQ ID NO: 151452 - protein, 15 aa, Mycobacterium tuberculosis
RFSQFWRQQHEAAEW

SEQ ID NO: 151453 - protein, 15 aa, Mycobacterium tuberculosis
FSQFWRQQHEAAEWQ

SEQ ID NO: 151454 - protein, 15 aa, Mycobacterium tuberculosis
SQFWRQQHEAAEWQI

SEQ ID NO: 151455 - protein, 15 aa, Mycobacterium tuberculosis
QFWRQQHEAAEWQIL

SEQ ID NO: 151456 - protein, 15 aa, Mycobacterium tuberculosis
FWRQQHEAAEWQILA

SEQ ID NO: 151457 - protein, 15 aa, Mycobacterium tuberculosis
WRQQHEAAEWQILAE

SEQ ID NO: 151458 - protein, 16 aa, Mycobacterium tuberculosis
MIRTWIALVPNDHRAR

SEQ ID NO: 151459 - protein, 16 aa, Mycobacterium tuberculosis
IRTWIALVPNDHRARL

SEQ ID NO: 151460 - protein, 16 aa, Mycobacterium tuberculosis
RTWIALVPNDHRARLI

SEQ ID NO: 151461 - protein, 16 aa, Mycobacterium tuberculosis
TWIALVPNDHRARLIG

SEQ ID NO: 151462 - protein, 16 aa, Mycobacterium tuberculosis
WIALVPNDHRARLIGF

SEQ ID NO: 151463 - protein, 16 aa, Mycobacterium tuberculosis
IALVPNDHRARLIGFA

SEQ ID NO: 151464 - protein, 16 aa, Mycobacterium tuberculosis
ALVPNDHRARLIGFAL

SEQ ID NO: 151465 - protein, 16 aa, Mycobacterium tuberculosis
LVPNDHRARLIGFALL

SEQ ID NO: 151466 - protein, 16 aa, Mycobacterium tuberculosis
VPNDHRARLIGFALLA

SEQ ID NO: 151467 - protein, 16 aa, Mycobacterium tuberculosis
PNDHRARLIGFALLAF

SEQ ID NO: 151468 - protein, 16 aa, Mycobacterium tuberculosis
NDHRARLIGFALLAFC

SEQ ID NO: 151469 - protein, 16 aa, Mycobacterium tuberculosis
DHRARLIGFALLAFCS

SEQ ID NO: 151470 - protein, 16 aa, Mycobacterium tuberculosis
HRARLIGFALLAFCSV

SEQ ID NO: 151471 - protein, 16 aa, Mycobacterium tuberculosis
RARLIGFALLAFCSVV

SEQ ID NO: 151472 - protein, 16 aa, Mycobacterium tuberculosis
ARLIGFALLAFCSVVA

SEQ ID NO: 151473 - protein, 16 aa, Mycobacterium tuberculosis
RLIGFALLAFCSVVAR

SEQ ID NO: 151474 - protein, 16 aa, Mycobacterium tuberculosis
LIGFALLAFCSVVARA

SEQ ID NO: 151475 - protein, 16 aa, Mycobacterium tuberculosis
IGFALLAFCSVVARAV

SEQ ID NO: 151476 - protein, 16 aa, Mycobacterium tuberculosis
GFALLAFCSVVARAVG

SEQ ID NO: 151477 - protein, 16 aa, Mycobacterium tuberculosis
FALLAFCSVVARAVGT

SEQ ID NO: 151478 - protein, 16 aa, Mycobacterium tuberculosis
ALLAFCSVVARAVGTV

SEQ ID NO: 151479 - protein, 16 aa, Mycobacterium tuberculosis
LLAFCSVVARAVGTVL

SEQ ID NO: 151480 - protein, 16 aa, Mycobacterium tuberculosis
LAFCSVVARAVGTVLL

SEQ ID NO: 151481 - protein, 16 aa, Mycobacterium tuberculosis
AFCSVVARAVGTVLLV

SEQ ID NO: 151482 - protein, 16 aa, Mycobacterium tuberculosis
FCSVVARAVGTVLLVP

SEQ ID NO: 151483 - protein, 16 aa, Mycobacterium tuberculosis
CSVVARAVGTVLLVPL

SEQ ID NO: 151484 - protein, 16 aa, Mycobacterium tuberculosis
SVVARAVGTVLLVPLM

SEQ ID NO: 151485 - protein, 16 aa, Mycobacterium tuberculosis
VVARAVGTVLLVPLMA

SEQ ID NO: 151486 - protein, 16 aa, Mycobacterium tuberculosis
VARAVGTVLLVPLMAA

SEQ ID NO: 151487 - protein, 16 aa, Mycobacterium tuberculosis
ARAVGTVLLVPLMAAL

SEQ ID NO: 151488 - protein, 16 aa, Mycobacterium tuberculosis
RAVGTVLLVPLMAALF

SEQ ID NO: 151489 - protein, 16 aa, Mycobacterium tuberculosis
AVGTVLLVPLMAALFG

SEQ ID NO: 151490 - protein, 16 aa, Mycobacterium tuberculosis
VGTVLLVPLMAALFGE

SEQ ID NO: 151491 - protein, 16 aa, Mycobacterium tuberculosis
GTVLLVPLMAALFGEA

SEQ ID NO: 151492 - protein, 16 aa, Mycobacterium tuberculosis
TVLLVPLMAALFGEAP

SEQ ID NO: 151493 - protein, 16 aa, Mycobacterium tuberculosis
VLLVPLMAALFGEAPQ

SEQ ID NO: 151494 - protein, 16 aa, Mycobacterium tuberculosis
LLVPLMAALFGEAPQR

SEQ ID NO: 151495 - protein, 16 aa, Mycobacterium tuberculosis
LVPLMAALFGEAPQRA

SEQ ID NO: 151496 - protein, 16 aa, Mycobacterium tuberculosis
VPLMAALFGEAPQRAW

SEQ ID NO: 151497 - protein, 16 aa, Mycobacterium tuberculosis
PLMAALFGEAPQRAWL

SEQ ID NO: 151498 - protein, 16 aa, Mycobacterium tuberculosis
LMAALFGEAPQRAWLW

SEQ ID NO: 151499 - protein, 16 aa, Mycobacterium tuberculosis
MAALFGEAPQRAWLWL

SEQ ID NO: 151500 - protein, 16 aa, Mycobacterium tuberculosis
AALFGEAPQRAWLWLG

SEQ ID NO: 151501 - protein, 16 aa, Mycobacterium tuberculosis
ALFGEAPQRAWLWLGW

SEQ ID NO: 151502 - protein, 16 aa, Mycobacterium tuberculosis
LFGEAPQRAWLWLGWL

SEQ ID NO: 151503 - protein, 16 aa, Mycobacterium tuberculosis
FGEAPQRAWLWLGWLS

SEQ ID NO: 151504 - protein, 16 aa, Mycobacterium tuberculosis
GEAPQRAWLWLGWLSA

SEQ ID NO: 151505 - protein, 16 aa, Mycobacterium tuberculosis
EAPQRAWLWLGWLSAA

SEQ ID NO: 151506 - protein, 16 aa, Mycobacterium tuberculosis
APQRAWLWLGWLSAAT

SEQ ID NO: 151507 - protein, 16 aa, Mycobacterium tuberculosis
PQRAWLWLGWLSAATV

SEQ ID NO: 151508 - protein, 16 aa, Mycobacterium tuberculosis
QRAWLWLGWLSAATVA

SEQ ID NO: 151509 - protein, 16 aa, Mycobacterium tuberculosis
RAWLWLGWLSAATVAG

SEQ ID NO: 151510 - protein, 16 aa, Mycobacterium tuberculosis
AWLWLGWLSAATVAGW

SEQ ID NO: 151511 - protein, 16 aa, Mycobacterium tuberculosis
WLWLGWLSAATVAGWV

SEQ ID NO: 151512 - protein, 16 aa, Mycobacterium tuberculosis
LWLGWLSAATVAGWVL

SEQ ID NO: 151513 - protein, 16 aa, Mycobacterium tuberculosis
WLGWLSAATVAGWVLD

SEQ ID NO: 151514 - protein, 16 aa, Mycobacterium tuberculosis
LGWLSAATVAGWVLDA

SEQ ID NO: 151515 - protein, 16 aa, Mycobacterium tuberculosis
GWLSAATVAGWVLDAV

SEQ ID NO: 151516 - protein, 16 aa, Mycobacterium tuberculosis
WLSAATVAGWVLDAVT

SEQ ID NO: 151517 - protein, 16 aa, Mycobacterium tuberculosis
LSAATVAGWVLDAVTA

SEQ ID NO: 151518 - protein, 16 aa, Mycobacterium tuberculosis
SAATVAGWVLDAVTAR

SEQ ID NO: 151519 - protein, 16 aa, Mycobacterium tuberculosis
AATVAGWVLDAVTARI

SEQ ID NO: 151520 - protein, 16 aa, Mycobacterium tuberculosis
ATVAGWVLDAVTARIG

SEQ ID NO: 151521 - protein, 16 aa, Mycobacterium tuberculosis
TVAGWVLDAVTARIGI

SEQ ID NO: 151522 - protein, 16 aa, Mycobacterium tuberculosis
VAGWVLDAVTARIGIE

SEQ ID NO: 151523 - protein, 16 aa, Mycobacterium tuberculosis
AGWVLDAVTARIGIEL

SEQ ID NO: 151524 - protein, 16 aa, Mycobacterium tuberculosis
GWVLDAVTARIGIELG

SEQ ID NO: 151525 - protein, 16 aa, Mycobacterium tuberculosis
WVLDAVTARIGIELGF

SEQ ID NO: 151526 - protein, 16 aa, Mycobacterium tuberculosis
VLDAVTARIGIELGFA

SEQ ID NO: 151527 - protein, 16 aa, Mycobacterium tuberculosis
LDAVTARIGIELGFAV

SEQ ID NO: 151528 - protein, 16 aa, Mycobacterium tuberculosis
DAVTARIGIELGFAVL

SEQ ID NO: 151529 - protein, 16 aa, Mycobacterium tuberculosis
AVTARIGIELGFAVLN

SEQ ID NO: 151530 - protein, 16 aa, Mycobacterium tuberculosis
VTARIGIELGFAVLNH

SEQ ID NO: 151531 - protein, 16 aa, Mycobacterium tuberculosis
TARIGIELGFAVLNHT

SEQ ID NO: 151532 - protein, 16 aa, Mycobacterium tuberculosis
ARIGIELGFAVLNHTQ

SEQ ID NO: 151533 - protein, 16 aa, Mycobacterium tuberculosis
RIGIELGFAVLNHTQH

SEQ ID NO: 151534 - protein, 16 aa, Mycobacterium tuberculosis
IGIELGFAVLNHTQHD

SEQ ID NO: 151535 - protein, 16 aa, Mycobacterium tuberculosis
GIELGFAVLNHTQHDV

SEQ ID NO: 151536 - protein, 16 aa, Mycobacterium tuberculosis
IELGFAVLNHTQHDVA

SEQ ID NO: 151537 - protein, 16 aa, Mycobacterium tuberculosis
ELGFAVLNHTQHDVAD

SEQ ID NO: 151538 - protein, 16 aa, Mycobacterium tuberculosis
LGFAVLNHTQHDVADR

SEQ ID NO: 151539 - protein, 16 aa, Mycobacterium tuberculosis
GFAVLNHTQHDVADRL

SEQ ID NO: 151540 - protein, 16 aa, Mycobacterium tuberculosis
FAVLNHTQHDVADRLP

SEQ ID NO: 151541 - protein, 16 aa, Mycobacterium tuberculosis
AVLNHTQHDVADRLPV

SEQ ID NO: 151542 - protein, 16 aa, Mycobacterium tuberculosis
VLNHTQHDVADRLPVV

SEQ ID NO: 151543 - protein, 16 aa, Mycobacterium tuberculosis
LNHTQHDVADRLPVVR

SEQ ID NO: 151544 - protein, 16 aa, Mycobacterium tuberculosis
NHTQHDVADRLPVVRL

SEQ ID NO: 151545 - protein, 16 aa, Mycobacterium tuberculosis
HTQHDVADRLPVVRLD

SEQ ID NO: 151546 - protein, 16 aa, Mycobacterium tuberculosis
TQHDVADRLPVVRLDW

SEQ ID NO: 151547 - protein, 16 aa, Mycobacterium tuberculosis
QHDVADRLPVVRLDWF

SEQ ID NO: 151548 - protein, 16 aa, Mycobacterium tuberculosis
HDVADRLPVVRLDWFT

SEQ ID NO: 151549 - protein, 16 aa, Mycobacterium tuberculosis
DVADRLPVVRLDWFTA

SEQ ID NO: 151550 - protein, 16 aa, Mycobacterium tuberculosis
VADRLPVVRLDWFTAE

SEQ ID NO: 151551 - protein, 16 aa, Mycobacterium tuberculosis
ADRLPVVRLDWFTAEN

SEQ ID NO: 151552 - protein, 16 aa, Mycobacterium tuberculosis
DRLPVVRLDWFTAENT

SEQ ID NO: 151553 - protein, 16 aa, Mycobacterium tuberculosis
RLPVVRLDWFTAENTA

SEQ ID NO: 151554 - protein, 16 aa, Mycobacterium tuberculosis
LPVVRLDWFTAENTAT

SEQ ID NO: 151555 - protein, 16 aa, Mycobacterium tuberculosis
PVVRLDWFTAENTATA

SEQ ID NO: 151556 - protein, 16 aa, Mycobacterium tuberculosis
VVRLDWFTAENTATAR

SEQ ID NO: 151557 - protein, 16 aa, Mycobacterium tuberculosis
VRLDWFTAENTATARQ

SEQ ID NO: 151558 - protein, 16 aa, Mycobacterium tuberculosis
RLDWFTAENTATARQA

SEQ ID NO: 151559 - protein, 16 aa, Mycobacterium tuberculosis
LDWFTAENTATARQAI

SEQ ID NO: 151560 - protein, 16 aa, Mycobacterium tuberculosis
DWFTAENTATARQAIA

SEQ ID NO: 151561 - protein, 16 aa, Mycobacterium tuberculosis
WFTAENTATARQAIAA

SEQ ID NO: 151562 - protein, 16 aa, Mycobacterium tuberculosis
FTAENTATARQAIAAT

SEQ ID NO: 151563 - protein, 16 aa, Mycobacterium tuberculosis
TAENTATARQAIAATG

SEQ ID NO: 151564 - protein, 16 aa, Mycobacterium tuberculosis
AENTATARQAIAATGP

SEQ ID NO: 151565 - protein, 16 aa, Mycobacterium tuberculosis
ENTATARQAIAATGPE

SEQ ID NO: 151566 - protein, 16 aa, Mycobacterium tuberculosis
NTATARQAIAATGPEL

SEQ ID NO: 151567 - protein, 16 aa, Mycobacterium tuberculosis
TATARQAIAATGPELV

SEQ ID NO: 151568 - protein, 16 aa, Mycobacterium tuberculosis
ATARQAIAATGPELVG

SEQ ID NO: 151569 - protein, 16 aa, Mycobacterium tuberculosis
TARQAIAATGPELVGL

SEQ ID NO: 151570 - protein, 16 aa, Mycobacterium tuberculosis
ARQAIAATGPELVGLV

SEQ ID NO: 151571 - protein, 16 aa, Mycobacterium tuberculosis
RQAIAATGPELVGLVV

SEQ ID NO: 151572 - protein, 16 aa, Mycobacterium tuberculosis
QAIAATGPELVGLVVN

SEQ ID NO: 151573 - protein, 16 aa, Mycobacterium tuberculosis
AIAATGPELVGLVVNL

SEQ ID NO: 151574 - protein, 16 aa, Mycobacterium tuberculosis
IAATGPELVGLVVNLV

SEQ ID NO: 151575 - protein, 16 aa, Mycobacterium tuberculosis
AATGPELVGLVVNLVT

SEQ ID NO: 151576 - protein, 16 aa, Mycobacterium tuberculosis
ATGPELVGLVVNLVTP

SEQ ID NO: 151577 - protein, 16 aa, Mycobacterium tuberculosis
TGPELVGLVVNLVTPL

SEQ ID NO: 151578 - protein, 16 aa, Mycobacterium tuberculosis
GPELVGLVVNLVTPLT

SEQ ID NO: 151579 - protein, 16 aa, Mycobacterium tuberculosis
PELVGLVVNLVTPLTS

SEQ ID NO: 151580 - protein, 16 aa, Mycobacterium tuberculosis
ELVGLVVNLVTPLTSA

SEQ ID NO: 151581 - protein, 16 aa, Mycobacterium tuberculosis
LVGLVVNLVTPLTSAI

SEQ ID NO: 151582 - protein, 16 aa, Mycobacterium tuberculosis
VGLVVNLVTPLTSAIL

SEQ ID NO: 151583 - protein, 16 aa, Mycobacterium tuberculosis
GLVVNLVTPLTSAILL

SEQ ID NO: 151584 - protein, 16 aa, Mycobacterium tuberculosis
LVVNLVTPLTSAILLP

SEQ ID NO: 151585 - protein, 16 aa, Mycobacterium tuberculosis
VVNLVTPLTSAILLPA

SEQ ID NO: 151586 - protein, 16 aa, Mycobacterium tuberculosis
VNLVTPLTSAILLPAV

SEQ ID NO: 151587 - protein, 16 aa, Mycobacterium tuberculosis
NLVTPLTSAILLPAVI

SEQ ID NO: 151588 - protein, 16 aa, Mycobacterium tuberculosis
LVTPLTSAILLPAVIA

SEQ ID NO: 151589 - protein, 16 aa, Mycobacterium tuberculosis
VTPLTSAILLPAVIAL

SEQ ID NO: 151590 - protein, 16 aa, Mycobacterium tuberculosis
TPLTSAILLPAVIALA

SEQ ID NO: 151591 - protein, 16 aa, Mycobacterium tuberculosis
PLTSAILLPAVIALAL

SEQ ID NO: 151592 - protein, 16 aa, Mycobacterium tuberculosis
LTSAILLPAVIALALL

SEQ ID NO: 151593 - protein, 16 aa, Mycobacterium tuberculosis
TSAILLPAVIALALLP

SEQ ID NO: 151594 - protein, 16 aa, Mycobacterium tuberculosis
SAILLPAVIALALLPI

SEQ ID NO: 151595 - protein, 16 aa, Mycobacterium tuberculosis
AILLPAVIALALLPIS

SEQ ID NO: 151596 - protein, 16 aa, Mycobacterium tuberculosis
ILLPAVIALALLPISW

SEQ ID NO: 151597 - protein, 16 aa, Mycobacterium tuberculosis
LLPAVIALALLPISWQ

SEQ ID NO: 151598 - protein, 16 aa, Mycobacterium tuberculosis
LPAVIALALLPISWQL

SEQ ID NO: 151599 - protein, 16 aa, Mycobacterium tuberculosis
PAVIALALLPISWQLG

SEQ ID NO: 151600 - protein, 16 aa, Mycobacterium tuberculosis
AVIALALLPISWQLGV

SEQ ID NO: 151601 - protein, 16 aa, Mycobacterium tuberculosis
VIALALLPISWQLGVA

SEQ ID NO: 151602 - protein, 16 aa, Mycobacterium tuberculosis
IALALLPISWQLGVAA

SEQ ID NO: 151603 - protein, 16 aa, Mycobacterium tuberculosis
ALALLPISWQLGVAAL

SEQ ID NO: 151604 - protein, 16 aa, Mycobacterium tuberculosis
LALLPISWQLGVAALA

SEQ ID NO: 151605 - protein, 16 aa, Mycobacterium tuberculosis
ALLPISWQLGVAALAG

SEQ ID NO: 151606 - protein, 16 aa, Mycobacterium tuberculosis
LLPISWQLGVAALAGV

SEQ ID NO: 151607 - protein, 16 aa, Mycobacterium tuberculosis
LPISWQLGVAALAGVP

SEQ ID NO: 151608 - protein, 16 aa, Mycobacterium tuberculosis
PISWQLGVAALAGVPL

SEQ ID NO: 151609 - protein, 16 aa, Mycobacterium tuberculosis
ISWQLGVAALAGVPLL

SEQ ID NO: 151610 - protein, 16 aa, Mycobacterium tuberculosis
SWQLGVAALAGVPLLL

SEQ ID NO: 151611 - protein, 16 aa, Mycobacterium tuberculosis
WQLGVAALAGVPLLLG

SEQ ID NO: 151612 - protein, 16 aa, Mycobacterium tuberculosis
QLGVAALAGVPLLLGA

SEQ ID NO: 151613 - protein, 16 aa, Mycobacterium tuberculosis
LGVAALAGVPLLLGAL

SEQ ID NO: 151614 - protein, 16 aa, Mycobacterium tuberculosis
GVAALAGVPLLLGALW

SEQ ID NO: 151615 - protein, 16 aa, Mycobacterium tuberculosis
VAALAGVPLLLGALWA

SEQ ID NO: 151616 - protein, 16 aa, Mycobacterium tuberculosis
AALAGVPLLLGALWAS

SEQ ID NO: 151617 - protein, 16 aa, Mycobacterium tuberculosis
ALAGVPLLLGALWASA

SEQ ID NO: 151618 - protein, 16 aa, Mycobacterium tuberculosis
LAGVPLLLGALWASAA

SEQ ID NO: 151619 - protein, 16 aa, Mycobacterium tuberculosis
AGVPLLLGALWASAAF

SEQ ID NO: 151620 - protein, 16 aa, Mycobacterium tuberculosis
GVPLLLGALWASAAFA

SEQ ID NO: 151621 - protein, 16 aa, Mycobacterium tuberculosis
VPLLLGALWASAAFAR

SEQ ID NO: 151622 - protein, 16 aa, Mycobacterium tuberculosis
PLLLGALWASAAFARR

SEQ ID NO: 151623 - protein, 16 aa, Mycobacterium tuberculosis
LLLGALWASAAFARRA

SEQ ID NO: 151624 - protein, 16 aa, Mycobacterium tuberculosis
LLGALWASAAFARRAD

SEQ ID NO: 151625 - protein, 16 aa, Mycobacterium tuberculosis
LGALWASAAFARRADT

SEQ ID NO: 151626 - protein, 16 aa, Mycobacterium tuberculosis
GALWASAAFARRADTA

SEQ ID NO: 151627 - protein, 16 aa, Mycobacterium tuberculosis
ALWASAAFARRADTAA

SEQ ID NO: 151628 - protein, 16 aa, Mycobacterium tuberculosis
LWASAAFARRADTAAD

SEQ ID NO: 151629 - protein, 16 aa, Mycobacterium tuberculosis
WASAAFARRADTAADK

SEQ ID NO: 151630 - protein, 16 aa, Mycobacterium tuberculosis
ASAAFARRADTAADKA

SEQ ID NO: 151631 - protein, 16 aa, Mycobacterium tuberculosis
SAAFARRADTAADKAN

SEQ ID NO: 151632 - protein, 16 aa, Mycobacterium tuberculosis
AAFARRADTAADKANT

SEQ ID NO: 151633 - protein, 16 aa, Mycobacterium tuberculosis
AFARRADTAADKANTA

SEQ ID NO: 151634 - protein, 16 aa, Mycobacterium tuberculosis
FARRADTAADKANTAL

SEQ ID NO: 151635 - protein, 16 aa, Mycobacterium tuberculosis
ARRADTAADKANTALT

SEQ ID NO: 151636 - protein, 16 aa, Mycobacterium tuberculosis
RRADTAADKANTALTE

SEQ ID NO: 151637 - protein, 16 aa, Mycobacterium tuberculosis
RADTAADKANTALTER

SEQ ID NO: 151638 - protein, 16 aa, Mycobacterium tuberculosis
ADTAADKANTALTERI

SEQ ID NO: 151639 - protein, 16 aa, Mycobacterium tuberculosis
DTAADKANTALTERII

SEQ ID NO: 151640 - protein, 16 aa, Mycobacterium tuberculosis
TAADKANTALTERIIE

SEQ ID NO: 151641 - protein, 16 aa, Mycobacterium tuberculosis
AADKANTALTERIIEF

SEQ ID NO: 151642 - protein, 16 aa, Mycobacterium tuberculosis
ADKANTALTERIIEFA

SEQ ID NO: 151643 - protein, 16 aa, Mycobacterium tuberculosis
DKANTALTERIIEFAR

SEQ ID NO: 151644 - protein, 16 aa, Mycobacterium tuberculosis
KANTALTERIIEFART

SEQ ID NO: 151645 - protein, 16 aa, Mycobacterium tuberculosis
ANTALTERIIEFARTQ

SEQ ID NO: 151646 - protein, 16 aa, Mycobacterium tuberculosis
NTALTERIIEFARTQQ

SEQ ID NO: 151647 - protein, 16 aa, Mycobacterium tuberculosis
TALTERIIEFARTQQA

SEQ ID NO: 151648 - protein, 16 aa, Mycobacterium tuberculosis
ALTERIIEFARTQQAL

SEQ ID NO: 151649 - protein, 16 aa, Mycobacterium tuberculosis
LTERIIEFARTQQALR

SEQ ID NO: 151650 - protein, 16 aa, Mycobacterium tuberculosis
TERIIEFARTQQALRA

SEQ ID NO: 151651 - protein, 16 aa, Mycobacterium tuberculosis
ERIIEFARTQQALRAA

SEQ ID NO: 151652 - protein, 16 aa, Mycobacterium tuberculosis
RIIEFARTQQALRAAR

SEQ ID NO: 151653 - protein, 16 aa, Mycobacterium tuberculosis
IIEFARTQQALRAARR

SEQ ID NO: 151654 - protein, 16 aa, Mycobacterium tuberculosis
IEFARTQQALRAARRV

SEQ ID NO: 151655 - protein, 16 aa, Mycobacterium tuberculosis
EFARTQQALRAARRVE

SEQ ID NO: 151656 - protein, 16 aa, Mycobacterium tuberculosis
FARTQQALRAARRVEP

SEQ ID NO: 151657 - protein, 16 aa, Mycobacterium tuberculosis
ARTQQALRAARRVEPA

SEQ ID NO: 151658 - protein, 16 aa, Mycobacterium tuberculosis
RTQQALRAARRVEPAR

SEQ ID NO: 151659 - protein, 16 aa, Mycobacterium tuberculosis
TQQALRAARRVEPARS

SEQ ID NO: 151660 - protein, 16 aa, Mycobacterium tuberculosis
QQALRAARRVEPARSL

SEQ ID NO: 151661 - protein, 16 aa, Mycobacterium tuberculosis
QALRAARRVEPARSLV

SEQ ID NO: 151662 - protein, 16 aa, Mycobacterium tuberculosis
ALRAARRVEPARSLVG

SEQ ID NO: 151663 - protein, 16 aa, Mycobacterium tuberculosis
LRAARRVEPARSLVGN

SEQ ID NO: 151664 - protein, 16 aa, Mycobacterium tuberculosis
RAARRVEPARSLVGNA

SEQ ID NO: 151665 - protein, 16 aa, Mycobacterium tuberculosis
AARRVEPARSLVGNAL

SEQ ID NO: 151666 - protein, 16 aa, Mycobacterium tuberculosis
ARRVEPARSLVGNALA

SEQ ID NO: 151667 - protein, 16 aa, Mycobacterium tuberculosis
RRVEPARSLVGNALAS

SEQ ID NO: 151668 - protein, 16 aa, Mycobacterium tuberculosis
RVEPARSLVGNALASQ

SEQ ID NO: 151669 - protein, 16 aa, Mycobacterium tuberculosis
VEPARSLVGNALASQH

SEQ ID NO: 151670 - protein, 16 aa, Mycobacterium tuberculosis
EPARSLVGNALASQHT

SEQ ID NO: 151671 - protein, 16 aa, Mycobacterium tuberculosis
PARSLVGNALASQHTA

SEQ ID NO: 151672 - protein, 16 aa, Mycobacterium tuberculosis
ARSLVGNALASQHTAT

SEQ ID NO: 151673 - protein, 16 aa, Mycobacterium tuberculosis
RSLVGNALASQHTATM

SEQ ID NO: 151674 - protein, 16 aa, Mycobacterium tuberculosis
SLVGNALASQHTATMR

SEQ ID NO: 151675 - protein, 16 aa, Mycobacterium tuberculosis
LVGNALASQHTATMRL

SEQ ID NO: 151676 - protein, 16 aa, Mycobacterium tuberculosis
VGNALASQHTATMRLL

SEQ ID NO: 151677 - protein, 16 aa, Mycobacterium tuberculosis
GNALASQHTATMRLLG

SEQ ID NO: 151678 - protein, 16 aa, Mycobacterium tuberculosis
NALASQHTATMRLLGM

SEQ ID NO: 151679 - protein, 16 aa, Mycobacterium tuberculosis
ALASQHTATMRLLGMQ

SEQ ID NO: 151680 - protein, 16 aa, Mycobacterium tuberculosis
LASQHTATMRLLGMQI

SEQ ID NO: 151681 - protein, 16 aa, Mycobacterium tuberculosis
ASQHTATMRLLGMQIP

SEQ ID NO: 151682 - protein, 16 aa, Mycobacterium tuberculosis
SQHTATMRLLGMQIPG

SEQ ID NO: 151683 - protein, 16 aa, Mycobacterium tuberculosis
QHTATMRLLGMQIPGQ

SEQ ID NO: 151684 - protein, 16 aa, Mycobacterium tuberculosis
HTATMRLLGMQIPGQL

SEQ ID NO: 151685 - protein, 16 aa, Mycobacterium tuberculosis
TATMRLLGMQIPGQLL

SEQ ID NO: 151686 - protein, 16 aa, Mycobacterium tuberculosis
ATMRLLGMQIPGQLLF

SEQ ID NO: 151687 - protein, 16 aa, Mycobacterium tuberculosis
TMRLLGMQIPGQLLFS

SEQ ID NO: 151688 - protein, 16 aa, Mycobacterium tuberculosis
MRLLGMQIPGQLLFSI

SEQ ID NO: 151689 - protein, 16 aa, Mycobacterium tuberculosis
RLLGMQIPGQLLFSIA

SEQ ID NO: 151690 - protein, 16 aa, Mycobacterium tuberculosis
LLGMQIPGQLLFSIAS

SEQ ID NO: 151691 - protein, 16 aa, Mycobacterium tuberculosis
LGMQIPGQLLFSIASQ

SEQ ID NO: 151692 - protein, 16 aa, Mycobacterium tuberculosis
GMQIPGQLLFSIASQL

SEQ ID NO: 151693 - protein, 16 aa, Mycobacterium tuberculosis
MQIPGQLLFSIASQLA

SEQ ID NO: 151694 - protein, 16 aa, Mycobacterium tuberculosis
QIPGQLLFSIASQLAL

SEQ ID NO: 151695 - protein, 16 aa, Mycobacterium tuberculosis
IPGQLLFSIASQLALI

SEQ ID NO: 151696 - protein, 16 aa, Mycobacterium tuberculosis
PGQLLFSIASQLALIV

SEQ ID NO: 151697 - protein, 16 aa, Mycobacterium tuberculosis
GQLLFSIASQLALIVL

SEQ ID NO: 151698 - protein, 16 aa, Mycobacterium tuberculosis
QLLFSIASQLALIVLA

SEQ ID NO: 151699 - protein, 16 aa, Mycobacterium tuberculosis
LLFSIASQLALIVLAG

SEQ ID NO: 151700 - protein, 16 aa, Mycobacterium tuberculosis
LFSIASQLALIVLAGT

SEQ ID NO: 151701 - protein, 16 aa, Mycobacterium tuberculosis
FSIASQLALIVLAGTT

SEQ ID NO: 151702 - protein, 16 aa, Mycobacterium tuberculosis
SIASQLALIVLAGTTA

SEQ ID NO: 151703 - protein, 16 aa, Mycobacterium tuberculosis
IASQLALIVLAGTTAA

SEQ ID NO: 151704 - protein, 16 aa, Mycobacterium tuberculosis
ASQLALIVLAGTTAAL

SEQ ID NO: 151705 - protein, 16 aa, Mycobacterium tuberculosis
SQLALIVLAGTTAALT

SEQ ID NO: 151706 - protein, 16 aa, Mycobacterium tuberculosis
QLALIVLAGTTAALTI

SEQ ID NO: 151707 - protein, 16 aa, Mycobacterium tuberculosis
LALIVLAGTTAALTIT

SEQ ID NO: 151708 - protein, 16 aa, Mycobacterium tuberculosis
ALIVLAGTTAALTITG

SEQ ID NO: 151709 - protein, 16 aa, Mycobacterium tuberculosis
LIVLAGTTAALTITGT

SEQ ID NO: 151710 - protein, 16 aa, Mycobacterium tuberculosis
IVLAGTTAALTITGTL

SEQ ID NO: 151711 - protein, 16 aa, Mycobacterium tuberculosis
VLAGTTAALTITGTLT

SEQ ID NO: 151712 - protein, 16 aa, Mycobacterium tuberculosis
LAGTTAALTITGTLTV

SEQ ID NO: 151713 - protein, 16 aa, Mycobacterium tuberculosis
AGTTAALTITGTLTVP

SEQ ID NO: 151714 - protein, 16 aa, Mycobacterium tuberculosis
GTTAALTITGTLTVPE

SEQ ID NO: 151715 - protein, 16 aa, Mycobacterium tuberculosis
TTAALTITGTLTVPEA

SEQ ID NO: 151716 - protein, 16 aa, Mycobacterium tuberculosis
TAALTITGTLTVPEAI

SEQ ID NO: 151717 - protein, 16 aa, Mycobacterium tuberculosis
AALTITGTLTVPEAIA

SEQ ID NO: 151718 - protein, 16 aa, Mycobacterium tuberculosis
ALTITGTLTVPEAIAL

SEQ ID NO: 151719 - protein, 16 aa, Mycobacterium tuberculosis
LTITGTLTVPEAIALI

SEQ ID NO: 151720 - protein, 16 aa, Mycobacterium tuberculosis
TITGTLTVPEAIALIV

SEQ ID NO: 151721 - protein, 16 aa, Mycobacterium tuberculosis
ITGTLTVPEAIALIVV

SEQ ID NO: 151722 - protein, 16 aa, Mycobacterium tuberculosis
TGTLTVPEAIALIVVM

SEQ ID NO: 151723 - protein, 16 aa, Mycobacterium tuberculosis
GTLTVPEAIALIVVMV

SEQ ID NO: 151724 - protein, 16 aa, Mycobacterium tuberculosis
TLTVPEAIALIVVMVR

SEQ ID NO: 151725 - protein, 16 aa, Mycobacterium tuberculosis
LTVPEAIALIVVMVRY

SEQ ID NO: 151726 - protein, 16 aa, Mycobacterium tuberculosis
TVPEAIALIVVMVRYL

SEQ ID NO: 151727 - protein, 16 aa, Mycobacterium tuberculosis
VPEAIALIVVMVRYLE

SEQ ID NO: 151728 - protein, 16 aa, Mycobacterium tuberculosis
PEAIALIVVMVRYLEP

SEQ ID NO: 151729 - protein, 16 aa, Mycobacterium tuberculosis
EAIALIVVMVRYLEPF

SEQ ID NO: 151730 - protein, 16 aa, Mycobacterium tuberculosis
AIALIVVMVRYLEPFT

SEQ ID NO: 151731 - protein, 16 aa, Mycobacterium tuberculosis
IALIVVMVRYLEPFTA

SEQ ID NO: 151732 - protein, 16 aa, Mycobacterium tuberculosis
ALIVVMVRYLEPFTAV

SEQ ID NO: 151733 - protein, 16 aa, Mycobacterium tuberculosis
LIVVMVRYLEPFTAVS

SEQ ID NO: 151734 - protein, 16 aa, Mycobacterium tuberculosis
IVVMVRYLEPFTAVSE

SEQ ID NO: 151735 - protein, 16 aa, Mycobacterium tuberculosis
VVMVRYLEPFTAVSEL

SEQ ID NO: 151736 - protein, 16 aa, Mycobacterium tuberculosis
VMVRYLEPFTAVSELA

SEQ ID NO: 151737 - protein, 16 aa, Mycobacterium tuberculosis
MVRYLEPFTAVSELAP

SEQ ID NO: 151738 - protein, 16 aa, Mycobacterium tuberculosis
VRYLEPFTAVSELAPA

SEQ ID NO: 151739 - protein, 16 aa, Mycobacterium tuberculosis
RYLEPFTAVSELAPAL

SEQ ID NO: 151740 - protein, 16 aa, Mycobacterium tuberculosis
YLEPFTAVSELAPALE

SEQ ID NO: 151741 - protein, 16 aa, Mycobacterium tuberculosis
LEPFTAVSELAPALES

SEQ ID NO: 151742 - protein, 16 aa, Mycobacterium tuberculosis
EPFTAVSELAPALEST

SEQ ID NO: 151743 - protein, 16 aa, Mycobacterium tuberculosis
PFTAVSELAPALESTR

SEQ ID NO: 151744 - protein, 16 aa, Mycobacterium tuberculosis
FTAVSELAPALESTRA

SEQ ID NO: 151745 - protein, 16 aa, Mycobacterium tuberculosis
TAVSELAPALESTRAT

SEQ ID NO: 151746 - protein, 16 aa, Mycobacterium tuberculosis
AVSELAPALESTRATL

SEQ ID NO: 151747 - protein, 16 aa, Mycobacterium tuberculosis
VSELAPALESTRATLG

SEQ ID NO: 151748 - protein, 16 aa, Mycobacterium tuberculosis
SELAPALESTRATLGR

SEQ ID NO: 151749 - protein, 16 aa, Mycobacterium tuberculosis
ELAPALESTRATLGRI

SEQ ID NO: 151750 - protein, 16 aa, Mycobacterium tuberculosis
LAPALESTRATLGRIG

SEQ ID NO: 151751 - protein, 16 aa, Mycobacterium tuberculosis
APALESTRATLGRIGS

SEQ ID NO: 151752 - protein, 16 aa, Mycobacterium tuberculosis
PALESTRATLGRIGSV

SEQ ID NO: 151753 - protein, 16 aa, Mycobacterium tuberculosis
ALESTRATLGRIGSVL

SEQ ID NO: 151754 - protein, 16 aa, Mycobacterium tuberculosis
LESTRATLGRIGSVLT

SEQ ID NO: 151755 - protein, 16 aa, Mycobacterium tuberculosis
ESTRATLGRIGSVLTA

SEQ ID NO: 151756 - protein, 16 aa, Mycobacterium tuberculosis
STRATLGRIGSVLTAP

SEQ ID NO: 151757 - protein, 16 aa, Mycobacterium tuberculosis
TRATLGRIGSVLTAPV

SEQ ID NO: 151758 - protein, 16 aa, Mycobacterium tuberculosis
RATLGRIGSVLTAPVM

SEQ ID NO: 151759 - protein, 16 aa, Mycobacterium tuberculosis
ATLGRIGSVLTAPVMV

SEQ ID NO: 151760 - protein, 16 aa, Mycobacterium tuberculosis
TLGRIGSVLTAPVMVA

SEQ ID NO: 151761 - protein, 16 aa, Mycobacterium tuberculosis
LGRIGSVLTAPVMVAG

SEQ ID NO: 151762 - protein, 16 aa, Mycobacterium tuberculosis
GRIGSVLTAPVMVAGS

SEQ ID NO: 151763 - protein, 16 aa, Mycobacterium tuberculosis
RIGSVLTAPVMVAGSG

SEQ ID NO: 151764 - protein, 16 aa, Mycobacterium tuberculosis
IGSVLTAPVMVAGSGT

SEQ ID NO: 151765 - protein, 16 aa, Mycobacterium tuberculosis
GSVLTAPVMVAGSGTW

SEQ ID NO: 151766 - protein, 16 aa, Mycobacterium tuberculosis
SVLTAPVMVAGSGTWR

SEQ ID NO: 151767 - protein, 16 aa, Mycobacterium tuberculosis
VLTAPVMVAGSGTWRD

SEQ ID NO: 151768 - protein, 16 aa, Mycobacterium tuberculosis
LTAPVMVAGSGTWRDG

SEQ ID NO: 151769 - protein, 16 aa, Mycobacterium tuberculosis
TAPVMVAGSGTWRDGA

SEQ ID NO: 151770 - protein, 16 aa, Mycobacterium tuberculosis
APVMVAGSGTWRDGAV

SEQ ID NO: 151771 - protein, 16 aa, Mycobacterium tuberculosis
PVMVAGSGTWRDGAVV

SEQ ID NO: 151772 - protein, 16 aa, Mycobacterium tuberculosis
VMVAGSGTWRDGAVVP

SEQ ID NO: 151773 - protein, 16 aa, Mycobacterium tuberculosis
MVAGSGTWRDGAVVPR

SEQ ID NO: 151774 - protein, 16 aa, Mycobacterium tuberculosis
VAGSGTWRDGAVVPRI

SEQ ID NO: 151775 - protein, 16 aa, Mycobacterium tuberculosis
AGSGTWRDGAVVPRIE

SEQ ID NO: 151776 - protein, 16 aa, Mycobacterium tuberculosis
GSGTWRDGAVVPRIEF

SEQ ID NO: 151777 - protein, 16 aa, Mycobacterium tuberculosis
SGTWRDGAVVPRIEFD

SEQ ID NO: 151778 - protein, 16 aa, Mycobacterium tuberculosis
GTWRDGAVVPRIEFDD

SEQ ID NO: 151779 - protein, 16 aa, Mycobacterium tuberculosis
TWRDGAVVPRIEFDDV

SEQ ID NO: 151780 - protein, 16 aa, Mycobacterium tuberculosis
WRDGAVVPRIEFDDVA

SEQ ID NO: 151781 - protein, 16 aa, Mycobacterium tuberculosis
RDGAVVPRIEFDDVAF

SEQ ID NO: 151782 - protein, 16 aa, Mycobacterium tuberculosis
DGAVVPRIEFDDVAFG

SEQ ID NO: 151783 - protein, 16 aa, Mycobacterium tuberculosis
GAVVPRIEFDDVAFGY

SEQ ID NO: 151784 - protein, 16 aa, Mycobacterium tuberculosis
AVVPRIEFDDVAFGYD

SEQ ID NO: 151785 - protein, 16 aa, Mycobacterium tuberculosis
VVPRIEFDDVAFGYDG

SEQ ID NO: 151786 - protein, 16 aa, Mycobacterium tuberculosis
VPRIEFDDVAFGYDGG

SEQ ID NO: 151787 - protein, 16 aa, Mycobacterium tuberculosis
PRIEFDDVAFGYDGGS

SEQ ID NO: 151788 - protein, 16 aa, Mycobacterium tuberculosis
RIEFDDVAFGYDGGSG

SEQ ID NO: 151789 - protein, 16 aa, Mycobacterium tuberculosis
IEFDDVAFGYDGGSGP

SEQ ID NO: 151790 - protein, 16 aa, Mycobacterium tuberculosis
EFDDVAFGYDGGSGPV

SEQ ID NO: 151791 - protein, 16 aa, Mycobacterium tuberculosis
FDDVAFGYDGGSGPVL

SEQ ID NO: 151792 - protein, 16 aa, Mycobacterium tuberculosis
DDVAFGYDGGSGPVLD

SEQ ID NO: 151793 - protein, 16 aa, Mycobacterium tuberculosis
DVAFGYDGGSGPVLDG

SEQ ID NO: 151794 - protein, 16 aa, Mycobacterium tuberculosis
VAFGYDGGSGPVLDGV

SEQ ID NO: 151795 - protein, 16 aa, Mycobacterium tuberculosis
AFGYDGGSGPVLDGVS

SEQ ID NO: 151796 - protein, 16 aa, Mycobacterium tuberculosis
FGYDGGSGPVLDGVSF

SEQ ID NO: 151797 - protein, 16 aa, Mycobacterium tuberculosis
GYDGGSGPVLDGVSFC

SEQ ID NO: 151798 - protein, 16 aa, Mycobacterium tuberculosis
YDGGSGPVLDGVSFCL

SEQ ID NO: 151799 - protein, 16 aa, Mycobacterium tuberculosis
DGGSGPVLDGVSFCLQ

SEQ ID NO: 151800 - protein, 16 aa, Mycobacterium tuberculosis
GGSGPVLDGVSFCLQP

SEQ ID NO: 151801 - protein, 16 aa, Mycobacterium tuberculosis
GSGPVLDGVSFCLQPG

SEQ ID NO: 151802 - protein, 16 aa, Mycobacterium tuberculosis
SGPVLDGVSFCLQPGT

SEQ ID NO: 151803 - protein, 16 aa, Mycobacterium tuberculosis
GPVLDGVSFCLQPGTT

SEQ ID NO: 151804 - protein, 16 aa, Mycobacterium tuberculosis
PVLDGVSFCLQPGTTT

SEQ ID NO: 151805 - protein, 16 aa, Mycobacterium tuberculosis
VLDGVSFCLQPGTTTA

SEQ ID NO: 151806 - protein, 16 aa, Mycobacterium tuberculosis
LDGVSFCLQPGTTTAI

SEQ ID NO: 151807 - protein, 16 aa, Mycobacterium tuberculosis
DGVSFCLQPGTTTAIV

SEQ ID NO: 151808 - protein, 16 aa, Mycobacterium tuberculosis
GVSFCLQPGTTTAIVG

SEQ ID NO: 151809 - protein, 16 aa, Mycobacterium tuberculosis
VSFCLQPGTTTAIVGP

SEQ ID NO: 151810 - protein, 16 aa, Mycobacterium tuberculosis
SFCLQPGTTTAIVGPS

SEQ ID NO: 151811 - protein, 16 aa, Mycobacterium tuberculosis
FCLQPGTTTAIVGPSG

SEQ ID NO: 151812 - protein, 16 aa, Mycobacterium tuberculosis
CLQPGTTTAIVGPSGC

SEQ ID NO: 151813 - protein, 16 aa, Mycobacterium tuberculosis
LQPGTTTAIVGPSGCG

SEQ ID NO: 151814 - protein, 16 aa, Mycobacterium tuberculosis
QPGTTTAIVGPSGCGK

SEQ ID NO: 151815 - protein, 16 aa, Mycobacterium tuberculosis
PGTTTAIVGPSGCGKS

SEQ ID NO: 151816 - protein, 16 aa, Mycobacterium tuberculosis
GTTTAIVGPSGCGKST

SEQ ID NO: 151817 - protein, 16 aa, Mycobacterium tuberculosis
TTTAIVGPSGCGKSTI

SEQ ID NO: 151818 - protein, 16 aa, Mycobacterium tuberculosis
TTAIVGPSGCGKSTIL

SEQ ID NO: 151819 - protein, 16 aa, Mycobacterium tuberculosis
TAIVGPSGCGKSTILA

SEQ ID NO: 151820 - protein, 16 aa, Mycobacterium tuberculosis
AIVGPSGCGKSTILAL

SEQ ID NO: 151821 - protein, 16 aa, Mycobacterium tuberculosis
IVGPSGCGKSTILALI

SEQ ID NO: 151822 - protein, 16 aa, Mycobacterium tuberculosis
VGPSGCGKSTILALIA

SEQ ID NO: 151823 - protein, 16 aa, Mycobacterium tuberculosis
GPSGCGKSTILALIAG

SEQ ID NO: 151824 - protein, 16 aa, Mycobacterium tuberculosis
PSGCGKSTILALIAGL

SEQ ID NO: 151825 - protein, 16 aa, Mycobacterium tuberculosis
SGCGKSTILALIAGLH

SEQ ID NO: 151826 - protein, 16 aa, Mycobacterium tuberculosis
GCGKSTILALIAGLHQ

SEQ ID NO: 151827 - protein, 16 aa, Mycobacterium tuberculosis
CGKSTILALIAGLHQP

SEQ ID NO: 151828 - protein, 16 aa, Mycobacterium tuberculosis
GKSTILALIAGLHQPT

SEQ ID NO: 151829 - protein, 16 aa, Mycobacterium tuberculosis
KSTILALIAGLHQPTR

SEQ ID NO: 151830 - protein, 16 aa, Mycobacterium tuberculosis
STILALIAGLHQPTRG

SEQ ID NO: 151831 - protein, 16 aa, Mycobacterium tuberculosis
TILALIAGLHQPTRGR

SEQ ID NO: 151832 - protein, 16 aa, Mycobacterium tuberculosis
ILALIAGLHQPTRGRV

SEQ ID NO: 151833 - protein, 16 aa, Mycobacterium tuberculosis
LALIAGLHQPTRGRVL

SEQ ID NO: 151834 - protein, 16 aa, Mycobacterium tuberculosis
ALIAGLHQPTRGRVLI

SEQ ID NO: 151835 - protein, 16 aa, Mycobacterium tuberculosis
LIAGLHQPTRGRVLID

SEQ ID NO: 151836 - protein, 16 aa, Mycobacterium tuberculosis
IAGLHQPTRGRVLIDG

SEQ ID NO: 151837 - protein, 16 aa, Mycobacterium tuberculosis
AGLHQPTRGRVLIDGT

SEQ ID NO: 151838 - protein, 16 aa, Mycobacterium tuberculosis
GLHQPTRGRVLIDGTD

SEQ ID NO: 151839 - protein, 16 aa, Mycobacterium tuberculosis
LHQPTRGRVLIDGTDV

SEQ ID NO: 151840 - protein, 16 aa, Mycobacterium tuberculosis
HQPTRGRVLIDGTDVA

SEQ ID NO: 151841 - protein, 16 aa, Mycobacterium tuberculosis
QPTRGRVLIDGTDVAT

SEQ ID NO: 151842 - protein, 16 aa, Mycobacterium tuberculosis
PTRGRVLIDGTDVATL

SEQ ID NO: 151843 - protein, 16 aa, Mycobacterium tuberculosis
TRGRVLIDGTDVATLD

SEQ ID NO: 151844 - protein, 16 aa, Mycobacterium tuberculosis
RGRVLIDGTDVATLDA

SEQ ID NO: 151845 - protein, 16 aa, Mycobacterium tuberculosis
GRVLIDGTDVATLDAR

SEQ ID NO: 151846 - protein, 16 aa, Mycobacterium tuberculosis
RVLIDGTDVATLDARA

SEQ ID NO: 151847 - protein, 16 aa, Mycobacterium tuberculosis
VLIDGTDVATLDARAQ

SEQ ID NO: 151848 - protein, 16 aa, Mycobacterium tuberculosis
LIDGTDVATLDARAQQ

SEQ ID NO: 151849 - protein, 16 aa, Mycobacterium tuberculosis
IDGTDVATLDARAQQA

SEQ ID NO: 151850 - protein, 16 aa, Mycobacterium tuberculosis
DGTDVATLDARAQQAV

SEQ ID NO: 151851 - protein, 16 aa, Mycobacterium tuberculosis
GTDVATLDARAQQAVC

SEQ ID NO: 151852 - protein, 16 aa, Mycobacterium tuberculosis
TDVATLDARAQQAVCS

SEQ ID NO: 151853 - protein, 16 aa, Mycobacterium tuberculosis
DVATLDARAQQAVCSV

SEQ ID NO: 151854 - protein, 16 aa, Mycobacterium tuberculosis
VATLDARAQQAVCSVV

SEQ ID NO: 151855 - protein, 16 aa, Mycobacterium tuberculosis
ATLDARAQQAVCSVVF

SEQ ID NO: 151856 - protein, 16 aa, Mycobacterium tuberculosis
TLDARAQQAVCSVVFQ

SEQ ID NO: 151857 - protein, 16 aa, Mycobacterium tuberculosis
LDARAQQAVCSVVFQH

SEQ ID NO: 151858 - protein, 16 aa, Mycobacterium tuberculosis
DARAQQAVCSVVFQHP

SEQ ID NO: 151859 - protein, 16 aa, Mycobacterium tuberculosis
ARAQQAVCSVVFQHPY

SEQ ID NO: 151860 - protein, 16 aa, Mycobacterium tuberculosis
RAQQAVCSVVFQHPYL

SEQ ID NO: 151861 - protein, 16 aa, Mycobacterium tuberculosis
AQQAVCSVVFQHPYLF

SEQ ID NO: 151862 - protein, 16 aa, Mycobacterium tuberculosis
QQAVCSVVFQHPYLFH

SEQ ID NO: 151863 - protein, 16 aa, Mycobacterium tuberculosis
QAVCSVVFQHPYLFHG

SEQ ID NO: 151864 - protein, 16 aa, Mycobacterium tuberculosis
AVCSVVFQHPYLFHGT

SEQ ID NO: 151865 - protein, 16 aa, Mycobacterium tuberculosis
VCSVVFQHPYLFHGTI

SEQ ID NO: 151866 - protein, 16 aa, Mycobacterium tuberculosis
CSVVFQHPYLFHGTIR

SEQ ID NO: 151867 - protein, 16 aa, Mycobacterium tuberculosis
SVVFQHPYLFHGTIRD

SEQ ID NO: 151868 - protein, 16 aa, Mycobacterium tuberculosis
VVFQHPYLFHGTIRDN

SEQ ID NO: 151869 - protein, 16 aa, Mycobacterium tuberculosis
VFQHPYLFHGTIRDNV

SEQ ID NO: 151870 - protein, 16 aa, Mycobacterium tuberculosis
FQHPYLFHGTIRDNVF

SEQ ID NO: 151871 - protein, 16 aa, Mycobacterium tuberculosis
QHPYLFHGTIRDNVFA

SEQ ID NO: 151872 - protein, 16 aa, Mycobacterium tuberculosis
HPYLFHGTIRDNVFAA

SEQ ID NO: 151873 - protein, 16 aa, Mycobacterium tuberculosis
PYLFHGTIRDNVFAAD

SEQ ID NO: 151874 - protein, 16 aa, Mycobacterium tuberculosis
YLFHGTIRDNVFAADP

SEQ ID NO: 151875 - protein, 16 aa, Mycobacterium tuberculosis
LFHGTIRDNVFAADPG

SEQ ID NO: 151876 - protein, 16 aa, Mycobacterium tuberculosis
FHGTIRDNVFAADPGA

SEQ ID NO: 151877 - protein, 16 aa, Mycobacterium tuberculosis
HGTIRDNVFAADPGAS

SEQ ID NO: 151878 - protein, 16 aa, Mycobacterium tuberculosis
GTIRDNVFAADPGASD

SEQ ID NO: 151879 - protein, 16 aa, Mycobacterium tuberculosis
TIRDNVFAADPGASDD

SEQ ID NO: 151880 - protein, 16 aa, Mycobacterium tuberculosis
IRDNVFAADPGASDDQ

SEQ ID NO: 151881 - protein, 16 aa, Mycobacterium tuberculosis
RDNVFAADPGASDDQF

SEQ ID NO: 151882 - protein, 16 aa, Mycobacterium tuberculosis
DNVFAADPGASDDQFA

SEQ ID NO: 151883 - protein, 16 aa, Mycobacterium tuberculosis
NVFAADPGASDDQFAQ

SEQ ID NO: 151884 - protein, 16 aa, Mycobacterium tuberculosis
VFAADPGASDDQFAQA

SEQ ID NO: 151885 - protein, 16 aa, Mycobacterium tuberculosis
FAADPGASDDQFAQAV

SEQ ID NO: 151886 - protein, 16 aa, Mycobacterium tuberculosis
AADPGASDDQFAQAVR

SEQ ID NO: 151887 - protein, 16 aa, Mycobacterium tuberculosis
ADPGASDDQFAQAVRL

SEQ ID NO: 151888 - protein, 16 aa, Mycobacterium tuberculosis
DPGASDDQFAQAVRLA

SEQ ID NO: 151889 - protein, 16 aa, Mycobacterium tuberculosis
PGASDDQFAQAVRLAR

SEQ ID NO: 151890 - protein, 16 aa, Mycobacterium tuberculosis
GASDDQFAQAVRLARV

SEQ ID NO: 151891 - protein, 16 aa, Mycobacterium tuberculosis
ASDDQFAQAVRLARVD

SEQ ID NO: 151892 - protein, 16 aa, Mycobacterium tuberculosis
SDDQFAQAVRLARVDE

SEQ ID NO: 151893 - protein, 16 aa, Mycobacterium tuberculosis
DDQFAQAVRLARVDEL

SEQ ID NO: 151894 - protein, 16 aa, Mycobacterium tuberculosis
DQFAQAVRLARVDELI

SEQ ID NO: 151895 - protein, 16 aa, Mycobacterium tuberculosis
QFAQAVRLARVDELIA

SEQ ID NO: 151896 - protein, 16 aa, Mycobacterium tuberculosis
FAQAVRLARVDELIAR

SEQ ID NO: 151897 - protein, 16 aa, Mycobacterium tuberculosis
AQAVRLARVDELIARL

SEQ ID NO: 151898 - protein, 16 aa, Mycobacterium tuberculosis
QAVRLARVDELIARLP

SEQ ID NO: 151899 - protein, 16 aa, Mycobacterium tuberculosis
AVRLARVDELIARLPD

SEQ ID NO: 151900 - protein, 16 aa, Mycobacterium tuberculosis
VRLARVDELIARLPDG

SEQ ID NO: 151901 - protein, 16 aa, Mycobacterium tuberculosis
RLARVDELIARLPDGA

SEQ ID NO: 151902 - protein, 16 aa, Mycobacterium tuberculosis
LARVDELIARLPDGAN

SEQ ID NO: 151903 - protein, 16 aa, Mycobacterium tuberculosis
ARVDELIARLPDGANT

SEQ ID NO: 151904 - protein, 16 aa, Mycobacterium tuberculosis
RVDELIARLPDGANTI

SEQ ID NO: 151905 - protein, 16 aa, Mycobacterium tuberculosis
VDELIARLPDGANTIV

SEQ ID NO: 151906 - protein, 16 aa, Mycobacterium tuberculosis
DELIARLPDGANTIVG

SEQ ID NO: 151907 - protein, 16 aa, Mycobacterium tuberculosis
ELIARLPDGANTIVGE

SEQ ID NO: 151908 - protein, 16 aa, Mycobacterium tuberculosis
LIARLPDGANTIVGEA

SEQ ID NO: 151909 - protein, 16 aa, Mycobacterium tuberculosis
IARLPDGANTIVGEAG

SEQ ID NO: 151910 - protein, 16 aa, Mycobacterium tuberculosis
ARLPDGANTIVGEAGS

SEQ ID NO: 151911 - protein, 16 aa, Mycobacterium tuberculosis
RLPDGANTIVGEAGSA

SEQ ID NO: 151912 - protein, 16 aa, Mycobacterium tuberculosis
LPDGANTIVGEAGSAL

SEQ ID NO: 151913 - protein, 16 aa, Mycobacterium tuberculosis
PDGANTIVGEAGSALS

SEQ ID NO: 151914 - protein, 16 aa, Mycobacterium tuberculosis
DGANTIVGEAGSALSG

SEQ ID NO: 151915 - protein, 16 aa, Mycobacterium tuberculosis
GANTIVGEAGSALSGG

SEQ ID NO: 151916 - protein, 16 aa, Mycobacterium tuberculosis
ANTIVGEAGSALSGGE

SEQ ID NO: 151917 - protein, 16 aa, Mycobacterium tuberculosis
NTIVGEAGSALSGGER

SEQ ID NO: 151918 - protein, 16 aa, Mycobacterium tuberculosis
TIVGEAGSALSGGERQ

SEQ ID NO: 151919 - protein, 16 aa, Mycobacterium tuberculosis
IVGEAGSALSGGERQR

SEQ ID NO: 151920 - protein, 16 aa, Mycobacterium tuberculosis
VGEAGSALSGGERQRV

SEQ ID NO: 151921 - protein, 16 aa, Mycobacterium tuberculosis
GEAGSALSGGERQRVS

SEQ ID NO: 151922 - protein, 16 aa, Mycobacterium tuberculosis
EAGSALSGGERQRVSI

SEQ ID NO: 151923 - protein, 16 aa, Mycobacterium tuberculosis
AGSALSGGERQRVSIA

SEQ ID NO: 151924 - protein, 16 aa, Mycobacterium tuberculosis
GSALSGGERQRVSIAR

SEQ ID NO: 151925 - protein, 16 aa, Mycobacterium tuberculosis
SALSGGERQRVSIARA

SEQ ID NO: 151926 - protein, 16 aa, Mycobacterium tuberculosis
ALSGGERQRVSIARAL

SEQ ID NO: 151927 - protein, 16 aa, Mycobacterium tuberculosis
LSGGERQRVSIARALL

SEQ ID NO: 151928 - protein, 16 aa, Mycobacterium tuberculosis
SGGERQRVSIARALLK

SEQ ID NO: 151929 - protein, 16 aa, Mycobacterium tuberculosis
GGERQRVSIARALLKA

SEQ ID NO: 151930 - protein, 16 aa, Mycobacterium tuberculosis
GERQRVSIARALLKAA

SEQ ID NO: 151931 - protein, 16 aa, Mycobacterium tuberculosis
ERQRVSIARALLKAAP

SEQ ID NO: 151932 - protein, 16 aa, Mycobacterium tuberculosis
RQRVSIARALLKAAPV

SEQ ID NO: 151933 - protein, 16 aa, Mycobacterium tuberculosis
QRVSIARALLKAAPVL

SEQ ID NO: 151934 - protein, 16 aa, Mycobacterium tuberculosis
RVSIARALLKAAPVLL

SEQ ID NO: 151935 - protein, 16 aa, Mycobacterium tuberculosis
VSIARALLKAAPVLLV

SEQ ID NO: 151936 - protein, 16 aa, Mycobacterium tuberculosis
SIARALLKAAPVLLVD

SEQ ID NO: 151937 - protein, 16 aa, Mycobacterium tuberculosis
IARALLKAAPVLLVDE

SEQ ID NO: 151938 - protein, 16 aa, Mycobacterium tuberculosis
ARALLKAAPVLLVDEA

SEQ ID NO: 151939 - protein, 16 aa, Mycobacterium tuberculosis
RALLKAAPVLLVDEAT

SEQ ID NO: 151940 - protein, 16 aa, Mycobacterium tuberculosis
ALLKAAPVLLVDEATS

SEQ ID NO: 151941 - protein, 16 aa, Mycobacterium tuberculosis
LLKAAPVLLVDEATSA

SEQ ID NO: 151942 - protein, 16 aa, Mycobacterium tuberculosis
LKAAPVLLVDEATSAL

SEQ ID NO: 151943 - protein, 16 aa, Mycobacterium tuberculosis
KAAPVLLVDEATSALD

SEQ ID NO: 151944 - protein, 16 aa, Mycobacterium tuberculosis
AAPVLLVDEATSALDA

SEQ ID NO: 151945 - protein, 16 aa, Mycobacterium tuberculosis
APVLLVDEATSALDAE

SEQ ID NO: 151946 - protein, 16 aa, Mycobacterium tuberculosis
PVLLVDEATSALDAEN

SEQ ID NO: 151947 - protein, 16 aa, Mycobacterium tuberculosis
VLLVDEATSALDAENE

SEQ ID NO: 151948 - protein, 16 aa, Mycobacterium tuberculosis
LLVDEATSALDAENEA

SEQ ID NO: 151949 - protein, 16 aa, Mycobacterium tuberculosis
LVDEATSALDAENEAA

SEQ ID NO: 151950 - protein, 16 aa, Mycobacterium tuberculosis
VDEATSALDAENEAAV

SEQ ID NO: 151951 - protein, 16 aa, Mycobacterium tuberculosis
DEATSALDAENEAAVV

SEQ ID NO: 151952 - protein, 16 aa, Mycobacterium tuberculosis
EATSALDAENEAAVVD

SEQ ID NO: 151953 - protein, 16 aa, Mycobacterium tuberculosis
ATSALDAENEAAVVDA

SEQ ID NO: 151954 - protein, 16 aa, Mycobacterium tuberculosis
TSALDAENEAAVVDAL

SEQ ID NO: 151955 - protein, 16 aa, Mycobacterium tuberculosis
SALDAENEAAVVDALA

SEQ ID NO: 151956 - protein, 16 aa, Mycobacterium tuberculosis
ALDAENEAAVVDALAA

SEQ ID NO: 151957 - protein, 16 aa, Mycobacterium tuberculosis
LDAENEAAVVDALAAD

SEQ ID NO: 151958 - protein, 16 aa, Mycobacterium tuberculosis
DAENEAAVVDALAADP

SEQ ID NO: 151959 - protein, 16 aa, Mycobacterium tuberculosis
AENEAAVVDALAADPR

SEQ ID NO: 151960 - protein, 16 aa, Mycobacterium tuberculosis
ENEAAVVDALAADPRS

SEQ ID NO: 151961 - protein, 16 aa, Mycobacterium tuberculosis
NEAAVVDALAADPRSR

SEQ ID NO: 151962 - protein, 16 aa, Mycobacterium tuberculosis
EAAVVDALAADPRSRT

SEQ ID NO: 151963 - protein, 16 aa, Mycobacterium tuberculosis
AAVVDALAADPRSRTR

SEQ ID NO: 151964 - protein, 16 aa, Mycobacterium tuberculosis
AVVDALAADPRSRTRV

SEQ ID NO: 151965 - protein, 16 aa, Mycobacterium tuberculosis
VVDALAADPRSRTRVI

SEQ ID NO: 151966 - protein, 16 aa, Mycobacterium tuberculosis
VDALAADPRSRTRVIV

SEQ ID NO: 151967 - protein, 16 aa, Mycobacterium tuberculosis
DALAADPRSRTRVIVA

SEQ ID NO: 151968 - protein, 16 aa, Mycobacterium tuberculosis
ALAADPRSRTRVIVAH

SEQ ID NO: 151969 - protein, 16 aa, Mycobacterium tuberculosis
LAADPRSRTRVIVAHR

SEQ ID NO: 151970 - protein, 16 aa, Mycobacterium tuberculosis
AADPRSRTRVIVAHRL

SEQ ID NO: 151971 - protein, 16 aa, Mycobacterium tuberculosis
ADPRSRTRVIVAHRLA

SEQ ID NO: 151972 - protein, 16 aa, Mycobacterium tuberculosis
DPRSRTRVIVAHRLAS

SEQ ID NO: 151973 - protein, 16 aa, Mycobacterium tuberculosis
PRSRTRVIVAHRLASI

SEQ ID NO: 151974 - protein, 16 aa, Mycobacterium tuberculosis
RSRTRVIVAHRLASIR

SEQ ID NO: 151975 - protein, 16 aa, Mycobacterium tuberculosis
SRTRVIVAHRLASIRH

SEQ ID NO: 151976 - protein, 16 aa, Mycobacterium tuberculosis
RTRVIVAHRLASIRHA

SEQ ID NO: 151977 - protein, 16 aa, Mycobacterium tuberculosis
TRVIVAHRLASIRHAD

SEQ ID NO: 151978 - protein, 16 aa, Mycobacterium tuberculosis
RVIVAHRLASIRHADR

SEQ ID NO: 151979 - protein, 16 aa, Mycobacterium tuberculosis
VIVAHRLASIRHADRV

SEQ ID NO: 151980 - protein, 16 aa, Mycobacterium tuberculosis
IVAHRLASIRHADRVL

SEQ ID NO: 151981 - protein, 16 aa, Mycobacterium tuberculosis
VAHRLASIRHADRVLF

SEQ ID NO: 151982 - protein, 16 aa, Mycobacterium tuberculosis
AHRLASIRHADRVLFV

SEQ ID NO: 151983 - protein, 16 aa, Mycobacterium tuberculosis
HRLASIRHADRVLFVD

SEQ ID NO: 151984 - protein, 16 aa, Mycobacterium tuberculosis
RLASIRHADRVLFVDD

SEQ ID NO: 151985 - protein, 16 aa, Mycobacterium tuberculosis
LASIRHADRVLFVDDG

SEQ ID NO: 151986 - protein, 16 aa, Mycobacterium tuberculosis
ASIRHADRVLFVDDGR

SEQ ID NO: 151987 - protein, 16 aa, Mycobacterium tuberculosis
SIRHADRVLFVDDGRV

SEQ ID NO: 151988 - protein, 16 aa, Mycobacterium tuberculosis
IRHADRVLFVDDGRVV

SEQ ID NO: 151989 - protein, 16 aa, Mycobacterium tuberculosis
RHADRVLFVDDGRVVE

SEQ ID NO: 151990 - protein, 16 aa, Mycobacterium tuberculosis
HADRVLFVDDGRVVED

SEQ ID NO: 151991 - protein, 16 aa, Mycobacterium tuberculosis
ADRVLFVDDGRVVEDG

SEQ ID NO: 151992 - protein, 16 aa, Mycobacterium tuberculosis
DRVLFVDDGRVVEDGS

SEQ ID NO: 151993 - protein, 16 aa, Mycobacterium tuberculosis
RVLFVDDGRVVEDGSI

SEQ ID NO: 151994 - protein, 16 aa, Mycobacterium tuberculosis
VLFVDDGRVVEDGSIS

SEQ ID NO: 151995 - protein, 16 aa, Mycobacterium tuberculosis
LFVDDGRVVEDGSISE

SEQ ID NO: 151996 - protein, 16 aa, Mycobacterium tuberculosis
FVDDGRVVEDGSISEL

SEQ ID NO: 151997 - protein, 16 aa, Mycobacterium tuberculosis
VDDGRVVEDGSISELL

SEQ ID NO: 151998 - protein, 16 aa, Mycobacterium tuberculosis
DDGRVVEDGSISELLT

SEQ ID NO: 151999 - protein, 16 aa, Mycobacterium tuberculosis
DGRVVEDGSISELLTA

SEQ ID NO: 152000 - protein, 16 aa, Mycobacterium tuberculosis
GRVVEDGSISELLTAG

SEQ ID NO: 152001 - protein, 16 aa, Mycobacterium tuberculosis
RVVEDGSISELLTAGG

SEQ ID NO: 152002 - protein, 16 aa, Mycobacterium tuberculosis
VVEDGSISELLTAGGR

SEQ ID NO: 152003 - protein, 16 aa, Mycobacterium tuberculosis
VEDGSISELLTAGGRF

SEQ ID NO: 152004 - protein, 16 aa, Mycobacterium tuberculosis
EDGSISELLTAGGRFS

SEQ ID NO: 152005 - protein, 16 aa, Mycobacterium tuberculosis
DGSISELLTAGGRFSQ

SEQ ID NO: 152006 - protein, 16 aa, Mycobacterium tuberculosis
GSISELLTAGGRFSQF

SEQ ID NO: 152007 - protein, 16 aa, Mycobacterium tuberculosis
SISELLTAGGRFSQFW

SEQ ID NO: 152008 - protein, 16 aa, Mycobacterium tuberculosis
ISELLTAGGRFSQFWR

SEQ ID NO: 152009 - protein, 16 aa, Mycobacterium tuberculosis
SELLTAGGRFSQFWRQ

SEQ ID NO: 152010 - protein, 16 aa, Mycobacterium tuberculosis
ELLTAGGRFSQFWRQQ

SEQ ID NO: 152011 - protein, 16 aa, Mycobacterium tuberculosis
LLTAGGRFSQFWRQQH

SEQ ID NO: 152012 - protein, 16 aa, Mycobacterium tuberculosis
LTAGGRFSQFWRQQHE

SEQ ID NO: 152013 - protein, 16 aa, Mycobacterium tuberculosis
TAGGRFSQFWRQQHEA

SEQ ID NO: 152014 - protein, 16 aa, Mycobacterium tuberculosis
AGGRFSQFWRQQHEAA

SEQ ID NO: 152015 - protein, 16 aa, Mycobacterium tuberculosis
GGRFSQFWRQQHEAAE

SEQ ID NO: 152016 - protein, 16 aa, Mycobacterium tuberculosis
GRFSQFWRQQHEAAEW

SEQ ID NO: 152017 - protein, 16 aa, Mycobacterium tuberculosis
RFSQFWRQQHEAAEWQ

SEQ ID NO: 152018 - protein, 16 aa, Mycobacterium tuberculosis
FSQFWRQQHEAAEWQI

SEQ ID NO: 152019 - protein, 16 aa, Mycobacterium tuberculosis
SQFWRQQHEAAEWQIL

SEQ ID NO: 152020 - protein, 16 aa, Mycobacterium tuberculosis
QFWRQQHEAAEWQILA

SEQ ID NO: 152021 - protein, 16 aa, Mycobacterium tuberculosis
FWRQQHEAAEWQILAE

SEQ ID NO: 152022 - protein, 143 aa, Mycobacterium tuberculosis
MITNLRRRTAMAAAGLGAALGLGILLVPTVDAHLANGSMSEVMMSEIAGLPIPPIIHYGAIAYAPSGASGKAWHQRTPARAEQVALEKCGDKTCKVVSRFTRCGAVAYNGSKYQGGTGLTRRAAEDDAVNRLEGGRIVNWACN

SEQ ID NO: 152023 - protein, 8 aa, Mycobacterium tuberculosis
MITNLRRR

SEQ ID NO: 152024 - protein, 8 aa, Mycobacterium tuberculosis
NLRRRTAM

SEQ ID NO: 152025 - protein, 8 aa, Mycobacterium tuberculosis
RRRTAMAA

SEQ ID NO: 152026 - protein, 8 aa, Mycobacterium tuberculosis
RRTAMAAA

SEQ ID NO: 152027 - protein, 8 aa, Mycobacterium tuberculosis
TAMAAAGL

SEQ ID NO: 152028 - protein, 8 aa, Mycobacterium tuberculosis
MAAAGLGA

SEQ ID NO: 152029 - protein, 8 aa, Mycobacterium tuberculosis
AAAGLGAA

SEQ ID NO: 152030 - protein, 8 aa, Mycobacterium tuberculosis
GLGAALGL

SEQ ID NO: 152031 - protein, 8 aa, Mycobacterium tuberculosis
ALGLGILL

SEQ ID NO: 152032 - protein, 8 aa, Mycobacterium tuberculosis
LGLGILLV

SEQ ID NO: 152033 - protein, 8 aa, Mycobacterium tuberculosis
GILLVPTV

SEQ ID NO: 152034 - protein, 8 aa, Mycobacterium tuberculosis
LLVPTVDA

SEQ ID NO: 152035 - protein, 8 aa, Mycobacterium tuberculosis
VPTVDAHL

SEQ ID NO: 152036 - protein, 8 aa, Mycobacterium tuberculosis
SMSEVMMS

SEQ ID NO: 152037 - protein, 8 aa, Mycobacterium tuberculosis
SEVMMSEI

SEQ ID NO: 152038 - protein, 8 aa, Mycobacterium tuberculosis
EVMMSEIA

SEQ ID NO: 152039 - protein, 8 aa, Mycobacterium tuberculosis
MMSEIAGL

SEQ ID NO: 152040 - protein, 8 aa, Mycobacterium tuberculosis
SEIAGLPI

SEQ ID NO: 152041 - protein, 8 aa, Mycobacterium tuberculosis
GLPIPPII

SEQ ID NO: 152042 - protein, 8 aa, Mycobacterium tuberculosis
LPIPPIIH

SEQ ID NO: 152043 - protein, 8 aa, Mycobacterium tuberculosis
PIPPIIHY

SEQ ID NO: 152044 - protein, 8 aa, Mycobacterium tuberculosis
PPIIHYGA

SEQ ID NO: 152045 - protein, 8 aa, Mycobacterium tuberculosis
IHYGAIAY

SEQ ID NO: 152046 - protein, 8 aa, Mycobacterium tuberculosis
IAYAPSGA

SEQ ID NO: 152047 - protein, 8 aa, Mycobacterium tuberculosis
SGKAWHQR

SEQ ID NO: 152048 - protein, 8 aa, Mycobacterium tuberculosis
ARAEQVAL

SEQ ID NO: 152049 - protein, 8 aa, Mycobacterium tuberculosis
KCGDKTCK

SEQ ID NO: 152050 - protein, 8 aa, Mycobacterium tuberculosis
KTCKVVSR

SEQ ID NO: 152051 - protein, 8 aa, Mycobacterium tuberculosis
KVVSRFTR

SEQ ID NO: 152052 - protein, 8 aa, Mycobacterium tuberculosis
FTRCGAVA

SEQ ID NO: 152053 - protein, 8 aa, Mycobacterium tuberculosis
TRCGAVAY

SEQ ID NO: 152054 - protein, 8 aa, Mycobacterium tuberculosis
AVAYNGSK

SEQ ID NO: 152055 - protein, 8 aa, Mycobacterium tuberculosis
VAYNGSKY

SEQ ID NO: 152056 - protein, 8 aa, Mycobacterium tuberculosis
KYQGGTGL

SEQ ID NO: 152057 - protein, 8 aa, Mycobacterium tuberculosis
YQGGTGLT

SEQ ID NO: 152058 - protein, 8 aa, Mycobacterium tuberculosis
RAAEDDAV

SEQ ID NO: 152059 - protein, 8 aa, Mycobacterium tuberculosis
RLEGGRIV

SEQ ID NO: 152060 - protein, 9 aa, Mycobacterium tuberculosis
NLRRRTAMA

SEQ ID NO: 152061 - protein, 9 aa, Mycobacterium tuberculosis
RRRTAMAAA

SEQ ID NO: 152062 - protein, 9 aa, Mycobacterium tuberculosis
RTAMAAAGL

SEQ ID NO: 152063 - protein, 9 aa, Mycobacterium tuberculosis
AMAAAGLGA

SEQ ID NO: 152064 - protein, 9 aa, Mycobacterium tuberculosis
MAAAGLGAA

SEQ ID NO: 152065 - protein, 9 aa, Mycobacterium tuberculosis
AAAGLGAAL

SEQ ID NO: 152066 - protein, 9 aa, Mycobacterium tuberculosis
AALGLGILL

SEQ ID NO: 152067 - protein, 9 aa, Mycobacterium tuberculosis
ALGLGILLV

SEQ ID NO: 152068 - protein, 9 aa, Mycobacterium tuberculosis
GLGILLVPT

SEQ ID NO: 152069 - protein, 9 aa, Mycobacterium tuberculosis
ILLVPTVDA

SEQ ID NO: 152070 - protein, 9 aa, Mycobacterium tuberculosis
LVPTVDAHL

SEQ ID NO: 152071 - protein, 9 aa, Mycobacterium tuberculosis
VPTVDAHLA

SEQ ID NO: 152072 - protein, 9 aa, Mycobacterium tuberculosis
DAHLANGSM

SEQ ID NO: 152073 - protein, 9 aa, Mycobacterium tuberculosis
HLANGSMSE

SEQ ID NO: 152074 - protein, 9 aa, Mycobacterium tuberculosis
LANGSMSEV

SEQ ID NO: 152075 - protein, 9 aa, Mycobacterium tuberculosis
SMSEVMMSE

SEQ ID NO: 152076 - protein, 9 aa, Mycobacterium tuberculosis
MSEVMMSEI

SEQ ID NO: 152077 - protein, 9 aa, Mycobacterium tuberculosis
VMMSEIAGL

SEQ ID NO: 152078 - protein, 9 aa, Mycobacterium tuberculosis
MMSEIAGLP

SEQ ID NO: 152079 - protein, 9 aa, Mycobacterium tuberculosis
LPIPPIIHY

SEQ ID NO: 152080 - protein, 9 aa, Mycobacterium tuberculosis
IPPIIHYGA

SEQ ID NO: 152081 - protein, 9 aa, Mycobacterium tuberculosis
PPIIHYGAI

SEQ ID NO: 152082 - protein, 9 aa, Mycobacterium tuberculosis
IIHYGAIAY

SEQ ID NO: 152083 - protein, 9 aa, Mycobacterium tuberculosis
AIAYAPSGA

SEQ ID NO: 152084 - protein, 9 aa, Mycobacterium tuberculosis
YAPSGASGK

SEQ ID NO: 152085 - protein, 9 aa, Mycobacterium tuberculosis
APSGASGKA

SEQ ID NO: 152086 - protein, 9 aa, Mycobacterium tuberculosis
ASGKAWHQR

SEQ ID NO: 152087 - protein, 9 aa, Mycobacterium tuberculosis
KAWHQRTPA

SEQ ID NO: 152088 - protein, 9 aa, Mycobacterium tuberculosis
AWHQRTPAR

SEQ ID NO: 152089 - protein, 9 aa, Mycobacterium tuberculosis
RTPARAEQV

SEQ ID NO: 152090 - protein, 9 aa, Mycobacterium tuberculosis
TPARAEQVA

SEQ ID NO: 152091 - protein, 9 aa, Mycobacterium tuberculosis
RAEQVALEK

SEQ ID NO: 152092 - protein, 9 aa, Mycobacterium tuberculosis
KCGDKTCKV

SEQ ID NO: 152093 - protein, 9 aa, Mycobacterium tuberculosis
KTCKVVSRF

SEQ ID NO: 152094 - protein, 9 aa, Mycobacterium tuberculosis
CKVVSRFTR

SEQ ID NO: 152095 - protein, 9 aa, Mycobacterium tuberculosis
KVVSRFTRC

SEQ ID NO: 152096 - protein, 9 aa, Mycobacterium tuberculosis
FTRCGAVAY

SEQ ID NO: 152097 - protein, 9 aa, Mycobacterium tuberculosis
GAVAYNGSK

SEQ ID NO: 152098 - protein, 9 aa, Mycobacterium tuberculosis
AVAYNGSKY

SEQ ID NO: 152099 - protein, 9 aa, Mycobacterium tuberculosis
AEDDAVNRL

SEQ ID NO: 152100 - protein, 9 aa, Mycobacterium tuberculosis
AVNRLEGGR

SEQ ID NO: 152101 - protein, 10 aa, Mycobacterium tuberculosis
ITNLRRRTAM

SEQ ID NO: 152102 - protein, 10 aa, Mycobacterium tuberculosis
NLRRRTAMAA

SEQ ID NO: 152103 - protein, 10 aa, Mycobacterium tuberculosis
RRTAMAAAGL

SEQ ID NO: 152104 - protein, 10 aa, Mycobacterium tuberculosis
TAMAAAGLGA

SEQ ID NO: 152105 - protein, 10 aa, Mycobacterium tuberculosis
AMAAAGLGAA

SEQ ID NO: 152106 - protein, 10 aa, Mycobacterium tuberculosis
MAAAGLGAAL

SEQ ID NO: 152107 - protein, 10 aa, Mycobacterium tuberculosis
GLGAALGLGI

SEQ ID NO: 152108 - protein, 10 aa, Mycobacterium tuberculosis
AALGLGILLV

SEQ ID NO: 152109 - protein, 10 aa, Mycobacterium tuberculosis
GLGILLVPTV

SEQ ID NO: 152110 - protein, 10 aa, Mycobacterium tuberculosis
LLVPTVDAHL

SEQ ID NO: 152111 - protein, 10 aa, Mycobacterium tuberculosis
HLANGSMSEV

SEQ ID NO: 152112 - protein, 10 aa, Mycobacterium tuberculosis
LANGSMSEVM

SEQ ID NO: 152113 - protein, 10 aa, Mycobacterium tuberculosis
SMSEVMMSEI

SEQ ID NO: 152114 - protein, 10 aa, Mycobacterium tuberculosis
EVMMSEIAGL

SEQ ID NO: 152115 - protein, 10 aa, Mycobacterium tuberculosis
MMSEIAGLPI

SEQ ID NO: 152116 - protein, 10 aa, Mycobacterium tuberculosis
EIAGLPIPPI

SEQ ID NO: 152117 - protein, 10 aa, Mycobacterium tuberculosis
GLPIPPIIHY

SEQ ID NO: 152118 - protein, 10 aa, Mycobacterium tuberculosis
LPIPPIIHYG

SEQ ID NO: 152119 - protein, 10 aa, Mycobacterium tuberculosis
PIPPIIHYGA

SEQ ID NO: 152120 - protein, 10 aa, Mycobacterium tuberculosis
IPPIIHYGAI

SEQ ID NO: 152121 - protein, 10 aa, Mycobacterium tuberculosis
PPIIHYGAIA

SEQ ID NO: 152122 - protein, 10 aa, Mycobacterium tuberculosis
PIIHYGAIAY

SEQ ID NO: 152123 - protein, 10 aa, Mycobacterium tuberculosis
IIHYGAIAYA

SEQ ID NO: 152124 - protein, 10 aa, Mycobacterium tuberculosis
AYAPSGASGK

SEQ ID NO: 152125 - protein, 10 aa, Mycobacterium tuberculosis
APSGASGKAW

SEQ ID NO: 152126 - protein, 10 aa, Mycobacterium tuberculosis
GASGKAWHQR

SEQ ID NO: 152127 - protein, 10 aa, Mycobacterium tuberculosis
KAWHQRTPAR

SEQ ID NO: 152128 - protein, 10 aa, Mycobacterium tuberculosis
TPARAEQVAL

SEQ ID NO: 152129 - protein, 10 aa, Mycobacterium tuberculosis
ARAEQVALEK

SEQ ID NO: 152130 - protein, 10 aa, Mycobacterium tuberculosis
QVALEKCGDK

SEQ ID NO: 152131 - protein, 10 aa, Mycobacterium tuberculosis
TCKVVSRFTR

SEQ ID NO: 152132 - protein, 10 aa, Mycobacterium tuberculosis
RFTRCGAVAY

SEQ ID NO: 152133 - protein, 10 aa, Mycobacterium tuberculosis
KYQGGTGLTR

SEQ ID NO: 152134 - protein, 10 aa, Mycobacterium tuberculosis
RAAEDDAVNR

SEQ ID NO: 152135 - protein, 10 aa, Mycobacterium tuberculosis
DAVNRLEGGR

SEQ ID NO: 152136 - protein, 11 aa, Mycobacterium tuberculosis
MITNLRRRTAM

SEQ ID NO: 152137 - protein, 11 aa, Mycobacterium tuberculosis
NLRRRTAMAAA

SEQ ID NO: 152138 - protein, 11 aa, Mycobacterium tuberculosis
RRRTAMAAAGL

SEQ ID NO: 152139 - protein, 11 aa, Mycobacterium tuberculosis
RTAMAAAGLGA

SEQ ID NO: 152140 - protein, 11 aa, Mycobacterium tuberculosis
TAMAAAGLGAA

SEQ ID NO: 152141 - protein, 11 aa, Mycobacterium tuberculosis
AMAAAGLGAAL

SEQ ID NO: 152142 - protein, 11 aa, Mycobacterium tuberculosis
AAAGLGAALGL

SEQ ID NO: 152143 - protein, 11 aa, Mycobacterium tuberculosis
GLGAALGLGIL

SEQ ID NO: 152144 - protein, 11 aa, Mycobacterium tuberculosis
GAALGLGILLV

SEQ ID NO: 152145 - protein, 11 aa, Mycobacterium tuberculosis
ALGLGILLVPT

SEQ ID NO: 152146 - protein, 11 aa, Mycobacterium tuberculosis
LGLGILLVPTV

SEQ ID NO: 152147 - protein, 11 aa, Mycobacterium tuberculosis
ILLVPTVDAHL

SEQ ID NO: 152148 - protein, 11 aa, Mycobacterium tuberculosis
LLVPTVDAHLA

SEQ ID NO: 152149 - protein, 11 aa, Mycobacterium tuberculosis
TVDAHLANGSM

SEQ ID NO: 152150 - protein, 11 aa, Mycobacterium tuberculosis
HLANGSMSEVM

SEQ ID NO: 152151 - protein, 11 aa, Mycobacterium tuberculosis
LANGSMSEVMM

SEQ ID NO: 152152 - protein, 11 aa, Mycobacterium tuberculosis
SMSEVMMSEIA

SEQ ID NO: 152153 - protein, 11 aa, Mycobacterium tuberculosis
SEVMMSEIAGL

SEQ ID NO: 152154 - protein, 11 aa, Mycobacterium tuberculosis
VMMSEIAGLPI

SEQ ID NO: 152155 - protein, 11 aa, Mycobacterium tuberculosis
SEIAGLPIPPI

SEQ ID NO: 152156 - protein, 11 aa, Mycobacterium tuberculosis
EIAGLPIPPII

SEQ ID NO: 152157 - protein, 11 aa, Mycobacterium tuberculosis
LPIPPIIHYGA

SEQ ID NO: 152158 - protein, 11 aa, Mycobacterium tuberculosis
PIPPIIHYGAI

SEQ ID NO: 152159 - protein, 11 aa, Mycobacterium tuberculosis
IPPIIHYGAIA

SEQ ID NO: 152160 - protein, 11 aa, Mycobacterium tuberculosis
PPIIHYGAIAY

SEQ ID NO: 152161 - protein, 11 aa, Mycobacterium tuberculosis
PIIHYGAIAYA

SEQ ID NO: 152162 - protein, 11 aa, Mycobacterium tuberculosis
YGAIAYAPSGA

SEQ ID NO: 152163 - protein, 11 aa, Mycobacterium tuberculosis
IAYAPSGASGK

SEQ ID NO: 152164 - protein, 11 aa, Mycobacterium tuberculosis
YAPSGASGKAW

SEQ ID NO: 152165 - protein, 11 aa, Mycobacterium tuberculosis
SGASGKAWHQR

SEQ ID NO: 152166 - protein, 11 aa, Mycobacterium tuberculosis
RTPARAEQVAL

SEQ ID NO: 152167 - protein, 11 aa, Mycobacterium tuberculosis
PARAEQVALEK

SEQ ID NO: 152168 - protein, 11 aa, Mycobacterium tuberculosis
KTCKVVSRFTR

SEQ ID NO: 152169 - protein, 11 aa, Mycobacterium tuberculosis
KVVSRFTRCGA

SEQ ID NO: 152170 - protein, 11 aa, Mycobacterium tuberculosis
VVSRFTRCGAV

SEQ ID NO: 152171 - protein, 11 aa, Mycobacterium tuberculosis
SRFTRCGAVAY

SEQ ID NO: 152172 - protein, 11 aa, Mycobacterium tuberculosis
RCGAVAYNGSK

SEQ ID NO: 152173 - protein, 11 aa, Mycobacterium tuberculosis
KYQGGTGLTRR

SEQ ID NO: 152174 - protein, 11 aa, Mycobacterium tuberculosis
YQGGTGLTRRA

SEQ ID NO: 152175 - protein, 11 aa, Mycobacterium tuberculosis
RRAAEDDAVNR

SEQ ID NO: 152176 - protein, 11 aa, Mycobacterium tuberculosis
RAAEDDAVNRL

SEQ ID NO: 152177 - protein, 11 aa, Mycobacterium tuberculosis
AVNRLEGGRIV

SEQ ID NO: 152178 - protein, 11 aa, Mycobacterium tuberculosis
RLEGGRIVNWA

SEQ ID NO: 152179 - protein, 13 aa, Mycobacterium tuberculosis
MITNLRRRTAMAA

SEQ ID NO: 152180 - protein, 13 aa, Mycobacterium tuberculosis
ITNLRRRTAMAAA

SEQ ID NO: 152181 - protein, 13 aa, Mycobacterium tuberculosis
TNLRRRTAMAAAG

SEQ ID NO: 152182 - protein, 13 aa, Mycobacterium tuberculosis
NLRRRTAMAAAGL

SEQ ID NO: 152183 - protein, 13 aa, Mycobacterium tuberculosis
LRRRTAMAAAGLG

SEQ ID NO: 152184 - protein, 13 aa, Mycobacterium tuberculosis
RRRTAMAAAGLGA

SEQ ID NO: 152185 - protein, 13 aa, Mycobacterium tuberculosis
RRTAMAAAGLGAA

SEQ ID NO: 152186 - protein, 13 aa, Mycobacterium tuberculosis
RTAMAAAGLGAAL

SEQ ID NO: 152187 - protein, 13 aa, Mycobacterium tuberculosis
TAMAAAGLGAALG

SEQ ID NO: 152188 - protein, 13 aa, Mycobacterium tuberculosis
AMAAAGLGAALGL

SEQ ID NO: 152189 - protein, 13 aa, Mycobacterium tuberculosis
MAAAGLGAALGLG

SEQ ID NO: 152190 - protein, 13 aa, Mycobacterium tuberculosis
AAAGLGAALGLGI

SEQ ID NO: 152191 - protein, 13 aa, Mycobacterium tuberculosis
AAGLGAALGLGIL

SEQ ID NO: 152192 - protein, 13 aa, Mycobacterium tuberculosis
AGLGAALGLGILL

SEQ ID NO: 152193 - protein, 13 aa, Mycobacterium tuberculosis
GLGAALGLGILLV

SEQ ID NO: 152194 - protein, 13 aa, Mycobacterium tuberculosis
LGAALGLGILLVP

SEQ ID NO: 152195 - protein, 13 aa, Mycobacterium tuberculosis
GAALGLGILLVPT

SEQ ID NO: 152196 - protein, 13 aa, Mycobacterium tuberculosis
AALGLGILLVPTV

SEQ ID NO: 152197 - protein, 13 aa, Mycobacterium tuberculosis
ALGLGILLVPTVD

SEQ ID NO: 152198 - protein, 13 aa, Mycobacterium tuberculosis
LGLGILLVPTVDA

SEQ ID NO: 152199 - protein, 13 aa, Mycobacterium tuberculosis
GLGILLVPTVDAH

SEQ ID NO: 152200 - protein, 13 aa, Mycobacterium tuberculosis
LGILLVPTVDAHL

SEQ ID NO: 152201 - protein, 13 aa, Mycobacterium tuberculosis
GILLVPTVDAHLA

SEQ ID NO: 152202 - protein, 13 aa, Mycobacterium tuberculosis
ILLVPTVDAHLAN

SEQ ID NO: 152203 - protein, 13 aa, Mycobacterium tuberculosis
LLVPTVDAHLANG

SEQ ID NO: 152204 - protein, 13 aa, Mycobacterium tuberculosis
LVPTVDAHLANGS

SEQ ID NO: 152205 - protein, 13 aa, Mycobacterium tuberculosis
VPTVDAHLANGSM

SEQ ID NO: 152206 - protein, 13 aa, Mycobacterium tuberculosis
PTVDAHLANGSMS

SEQ ID NO: 152207 - protein, 13 aa, Mycobacterium tuberculosis
TVDAHLANGSMSE

SEQ ID NO: 152208 - protein, 13 aa, Mycobacterium tuberculosis
VDAHLANGSMSEV

SEQ ID NO: 152209 - protein, 13 aa, Mycobacterium tuberculosis
DAHLANGSMSEVM

SEQ ID NO: 152210 - protein, 13 aa, Mycobacterium tuberculosis
AHLANGSMSEVMM

SEQ ID NO: 152211 - protein, 13 aa, Mycobacterium tuberculosis
HLANGSMSEVMMS

SEQ ID NO: 152212 - protein, 13 aa, Mycobacterium tuberculosis
LANGSMSEVMMSE

SEQ ID NO: 152213 - protein, 13 aa, Mycobacterium tuberculosis
ANGSMSEVMMSEI

SEQ ID NO: 152214 - protein, 13 aa, Mycobacterium tuberculosis
NGSMSEVMMSEIA

SEQ ID NO: 152215 - protein, 13 aa, Mycobacterium tuberculosis
GSMSEVMMSEIAG

SEQ ID NO: 152216 - protein, 13 aa, Mycobacterium tuberculosis
SMSEVMMSEIAGL

SEQ ID NO: 152217 - protein, 13 aa, Mycobacterium tuberculosis
MSEVMMSEIAGLP

SEQ ID NO: 152218 - protein, 13 aa, Mycobacterium tuberculosis
SEVMMSEIAGLPI

SEQ ID NO: 152219 - protein, 13 aa, Mycobacterium tuberculosis
EVMMSEIAGLPIP

SEQ ID NO: 152220 - protein, 13 aa, Mycobacterium tuberculosis
VMMSEIAGLPIPP

SEQ ID NO: 152221 - protein, 13 aa, Mycobacterium tuberculosis
MMSEIAGLPIPPI

SEQ ID NO: 152222 - protein, 13 aa, Mycobacterium tuberculosis
MSEIAGLPIPPII

SEQ ID NO: 152223 - protein, 13 aa, Mycobacterium tuberculosis
SEIAGLPIPPIIH

SEQ ID NO: 152224 - protein, 13 aa, Mycobacterium tuberculosis
EIAGLPIPPIIHY

SEQ ID NO: 152225 - protein, 13 aa, Mycobacterium tuberculosis
IAGLPIPPIIHYG

SEQ ID NO: 152226 - protein, 13 aa, Mycobacterium tuberculosis
AGLPIPPIIHYGA

SEQ ID NO: 152227 - protein, 13 aa, Mycobacterium tuberculosis
GLPIPPIIHYGAI

SEQ ID NO: 152228 - protein, 13 aa, Mycobacterium tuberculosis
LPIPPIIHYGAIA

SEQ ID NO: 152229 - protein, 13 aa, Mycobacterium tuberculosis
PIPPIIHYGAIAY

SEQ ID NO: 152230 - protein, 13 aa, Mycobacterium tuberculosis
IPPIIHYGAIAYA

SEQ ID NO: 152231 - protein, 13 aa, Mycobacterium tuberculosis
PPIIHYGAIAYAP

SEQ ID NO: 152232 - protein, 13 aa, Mycobacterium tuberculosis
PIIHYGAIAYAPS

SEQ ID NO: 152233 - protein, 13 aa, Mycobacterium tuberculosis
IIHYGAIAYAPSG

SEQ ID NO: 152234 - protein, 13 aa, Mycobacterium tuberculosis
IHYGAIAYAPSGA

SEQ ID NO: 152235 - protein, 13 aa, Mycobacterium tuberculosis
HYGAIAYAPSGAS

SEQ ID NO: 152236 - protein, 13 aa, Mycobacterium tuberculosis
YGAIAYAPSGASG

SEQ ID NO: 152237 - protein, 13 aa, Mycobacterium tuberculosis
GAIAYAPSGASGK

SEQ ID NO: 152238 - protein, 13 aa, Mycobacterium tuberculosis
AIAYAPSGASGKA

SEQ ID NO: 152239 - protein, 13 aa, Mycobacterium tuberculosis
IAYAPSGASGKAW

SEQ ID NO: 152240 - protein, 13 aa, Mycobacterium tuberculosis
AYAPSGASGKAWH

SEQ ID NO: 152241 - protein, 13 aa, Mycobacterium tuberculosis
YAPSGASGKAWHQ

SEQ ID NO: 152242 - protein, 13 aa, Mycobacterium tuberculosis
APSGASGKAWHQR

SEQ ID NO: 152243 - protein, 13 aa, Mycobacterium tuberculosis
PSGASGKAWHQRT

SEQ ID NO: 152244 - protein, 13 aa, Mycobacterium tuberculosis
SGASGKAWHQRTP

SEQ ID NO: 152245 - protein, 13 aa, Mycobacterium tuberculosis
GASGKAWHQRTPA

SEQ ID NO: 152246 - protein, 13 aa, Mycobacterium tuberculosis
ASGKAWHQRTPAR

SEQ ID NO: 152247 - protein, 13 aa, Mycobacterium tuberculosis
SGKAWHQRTPARA

SEQ ID NO: 152248 - protein, 13 aa, Mycobacterium tuberculosis
GKAWHQRTPARAE

SEQ ID NO: 152249 - protein, 13 aa, Mycobacterium tuberculosis
KAWHQRTPARAEQ

SEQ ID NO: 152250 - protein, 13 aa, Mycobacterium tuberculosis
AWHQRTPARAEQV

SEQ ID NO: 152251 - protein, 13 aa, Mycobacterium tuberculosis
WHQRTPARAEQVA

SEQ ID NO: 152252 - protein, 13 aa, Mycobacterium tuberculosis
HQRTPARAEQVAL

SEQ ID NO: 152253 - protein, 13 aa, Mycobacterium tuberculosis
QRTPARAEQVALE

SEQ ID NO: 152254 - protein, 13 aa, Mycobacterium tuberculosis
RTPARAEQVALEK

SEQ ID NO: 152255 - protein, 13 aa, Mycobacterium tuberculosis
TPARAEQVALEKC

SEQ ID NO: 152256 - protein, 13 aa, Mycobacterium tuberculosis
PARAEQVALEKCG

SEQ ID NO: 152257 - protein, 13 aa, Mycobacterium tuberculosis
ARAEQVALEKCGD

SEQ ID NO: 152258 - protein, 13 aa, Mycobacterium tuberculosis
RAEQVALEKCGDK

SEQ ID NO: 152259 - protein, 13 aa, Mycobacterium tuberculosis
AEQVALEKCGDKT

SEQ ID NO: 152260 - protein, 13 aa, Mycobacterium tuberculosis
EQVALEKCGDKTC

SEQ ID NO: 152261 - protein, 13 aa, Mycobacterium tuberculosis
QVALEKCGDKTCK

SEQ ID NO: 152262 - protein, 13 aa, Mycobacterium tuberculosis
VALEKCGDKTCKV

SEQ ID NO: 152263 - protein, 13 aa, Mycobacterium tuberculosis
ALEKCGDKTCKVV

SEQ ID NO: 152264 - protein, 13 aa, Mycobacterium tuberculosis
LEKCGDKTCKVVS

SEQ ID NO: 152265 - protein, 13 aa, Mycobacterium tuberculosis
EKCGDKTCKVVSR

SEQ ID NO: 152266 - protein, 13 aa, Mycobacterium tuberculosis
KCGDKTCKVVSRF

SEQ ID NO: 152267 - protein, 13 aa, Mycobacterium tuberculosis
CGDKTCKVVSRFT

SEQ ID NO: 152268 - protein, 13 aa, Mycobacterium tuberculosis
GDKTCKVVSRFTR

SEQ ID NO: 152269 - protein, 13 aa, Mycobacterium tuberculosis
DKTCKVVSRFTRC

SEQ ID NO: 152270 - protein, 13 aa, Mycobacterium tuberculosis
KTCKVVSRFTRCG

SEQ ID NO: 152271 - protein, 13 aa, Mycobacterium tuberculosis
TCKVVSRFTRCGA

SEQ ID NO: 152272 - protein, 13 aa, Mycobacterium tuberculosis
CKVVSRFTRCGAV

SEQ ID NO: 152273 - protein, 13 aa, Mycobacterium tuberculosis
KVVSRFTRCGAVA

SEQ ID NO: 152274 - protein, 13 aa, Mycobacterium tuberculosis
VVSRFTRCGAVAY

SEQ ID NO: 152275 - protein, 13 aa, Mycobacterium tuberculosis
VSRFTRCGAVAYN

SEQ ID NO: 152276 - protein, 13 aa, Mycobacterium tuberculosis
SRFTRCGAVAYNG

SEQ ID NO: 152277 - protein, 13 aa, Mycobacterium tuberculosis
RFTRCGAVAYNGS

SEQ ID NO: 152278 - protein, 13 aa, Mycobacterium tuberculosis
FTRCGAVAYNGSK

SEQ ID NO: 152279 - protein, 13 aa, Mycobacterium tuberculosis
TRCGAVAYNGSKY

SEQ ID NO: 152280 - protein, 13 aa, Mycobacterium tuberculosis
RCGAVAYNGSKYQ

SEQ ID NO: 152281 - protein, 13 aa, Mycobacterium tuberculosis
CGAVAYNGSKYQG

SEQ ID NO: 152282 - protein, 13 aa, Mycobacterium tuberculosis
GAVAYNGSKYQGG

SEQ ID NO: 152283 - protein, 13 aa, Mycobacterium tuberculosis
AVAYNGSKYQGGT

SEQ ID NO: 152284 - protein, 13 aa, Mycobacterium tuberculosis
VAYNGSKYQGGTG

SEQ ID NO: 152285 - protein, 13 aa, Mycobacterium tuberculosis
AYNGSKYQGGTGL

SEQ ID NO: 152286 - protein, 13 aa, Mycobacterium tuberculosis
YNGSKYQGGTGLT

SEQ ID NO: 152287 - protein, 13 aa, Mycobacterium tuberculosis
NGSKYQGGTGLTR

SEQ ID NO: 152288 - protein, 13 aa, Mycobacterium tuberculosis
GSKYQGGTGLTRR

SEQ ID NO: 152289 - protein, 13 aa, Mycobacterium tuberculosis
SKYQGGTGLTRRA

SEQ ID NO: 152290 - protein, 13 aa, Mycobacterium tuberculosis
KYQGGTGLTRRAA

SEQ ID NO: 152291 - protein, 13 aa, Mycobacterium tuberculosis
YQGGTGLTRRAAE

SEQ ID NO: 152292 - protein, 13 aa, Mycobacterium tuberculosis
QGGTGLTRRAAED

SEQ ID NO: 152293 - protein, 13 aa, Mycobacterium tuberculosis
GGTGLTRRAAEDD

SEQ ID NO: 152294 - protein, 13 aa, Mycobacterium tuberculosis
GTGLTRRAAEDDA

SEQ ID NO: 152295 - protein, 13 aa, Mycobacterium tuberculosis
TGLTRRAAEDDAV

SEQ ID NO: 152296 - protein, 13 aa, Mycobacterium tuberculosis
GLTRRAAEDDAVN

SEQ ID NO: 152297 - protein, 13 aa, Mycobacterium tuberculosis
LTRRAAEDDAVNR

SEQ ID NO: 152298 - protein, 13 aa, Mycobacterium tuberculosis
TRRAAEDDAVNRL

SEQ ID NO: 152299 - protein, 13 aa, Mycobacterium tuberculosis
RRAAEDDAVNRLE

SEQ ID NO: 152300 - protein, 13 aa, Mycobacterium tuberculosis
RAAEDDAVNRLEG

SEQ ID NO: 152301 - protein, 13 aa, Mycobacterium tuberculosis
AAEDDAVNRLEGG

SEQ ID NO: 152302 - protein, 13 aa, Mycobacterium tuberculosis
AEDDAVNRLEGGR

SEQ ID NO: 152303 - protein, 13 aa, Mycobacterium tuberculosis
EDDAVNRLEGGRI

SEQ ID NO: 152304 - protein, 13 aa, Mycobacterium tuberculosis
DDAVNRLEGGRIV

SEQ ID NO: 152305 - protein, 13 aa, Mycobacterium tuberculosis
DAVNRLEGGRIVN

SEQ ID NO: 152306 - protein, 13 aa, Mycobacterium tuberculosis
AVNRLEGGRIVNW

SEQ ID NO: 152307 - protein, 13 aa, Mycobacterium tuberculosis
VNRLEGGRIVNWA

SEQ ID NO: 152308 - protein, 13 aa, Mycobacterium tuberculosis
NRLEGGRIVNWAC

SEQ ID NO: 152309 - protein, 13 aa, Mycobacterium tuberculosis
RLEGGRIVNWACN

SEQ ID NO: 152310 - protein, 14 aa, Mycobacterium tuberculosis
MITNLRRRTAMAAA

SEQ ID NO: 152311 - protein, 14 aa, Mycobacterium tuberculosis
ITNLRRRTAMAAAG

SEQ ID NO: 152312 - protein, 14 aa, Mycobacterium tuberculosis
TNLRRRTAMAAAGL

SEQ ID NO: 152313 - protein, 14 aa, Mycobacterium tuberculosis
NLRRRTAMAAAGLG

SEQ ID NO: 152314 - protein, 14 aa, Mycobacterium tuberculosis
LRRRTAMAAAGLGA

SEQ ID NO: 152315 - protein, 14 aa, Mycobacterium tuberculosis
RRRTAMAAAGLGAA

SEQ ID NO: 152316 - protein, 14 aa, Mycobacterium tuberculosis
RRTAMAAAGLGAAL

SEQ ID NO: 152317 - protein, 14 aa, Mycobacterium tuberculosis
RTAMAAAGLGAALG

SEQ ID NO: 152318 - protein, 14 aa, Mycobacterium tuberculosis
TAMAAAGLGAALGL

SEQ ID NO: 152319 - protein, 14 aa, Mycobacterium tuberculosis
AMAAAGLGAALGLG

SEQ ID NO: 152320 - protein, 14 aa, Mycobacterium tuberculosis
MAAAGLGAALGLGI

SEQ ID NO: 152321 - protein, 14 aa, Mycobacterium tuberculosis
AAAGLGAALGLGIL

SEQ ID NO: 152322 - protein, 14 aa, Mycobacterium tuberculosis
AAGLGAALGLGILL

SEQ ID NO: 152323 - protein, 14 aa, Mycobacterium tuberculosis
AGLGAALGLGILLV

SEQ ID NO: 152324 - protein, 14 aa, Mycobacterium tuberculosis
GLGAALGLGILLVP

SEQ ID NO: 152325 - protein, 14 aa, Mycobacterium tuberculosis
LGAALGLGILLVPT

SEQ ID NO: 152326 - protein, 14 aa, Mycobacterium tuberculosis
GAALGLGILLVPTV

SEQ ID NO: 152327 - protein, 14 aa, Mycobacterium tuberculosis
AALGLGILLVPTVD

SEQ ID NO: 152328 - protein, 14 aa, Mycobacterium tuberculosis
ALGLGILLVPTVDA

SEQ ID NO: 152329 - protein, 14 aa, Mycobacterium tuberculosis
LGLGILLVPTVDAH

SEQ ID NO: 152330 - protein, 14 aa, Mycobacterium tuberculosis
GLGILLVPTVDAHL

SEQ ID NO: 152331 - protein, 14 aa, Mycobacterium tuberculosis
LGILLVPTVDAHLA

SEQ ID NO: 152332 - protein, 14 aa, Mycobacterium tuberculosis
GILLVPTVDAHLAN

SEQ ID NO: 152333 - protein, 14 aa, Mycobacterium tuberculosis
ILLVPTVDAHLANG

SEQ ID NO: 152334 - protein, 14 aa, Mycobacterium tuberculosis
LLVPTVDAHLANGS

SEQ ID NO: 152335 - protein, 14 aa, Mycobacterium tuberculosis
LVPTVDAHLANGSM

SEQ ID NO: 152336 - protein, 14 aa, Mycobacterium tuberculosis
VPTVDAHLANGSMS

SEQ ID NO: 152337 - protein, 14 aa, Mycobacterium tuberculosis
PTVDAHLANGSMSE

SEQ ID NO: 152338 - protein, 14 aa, Mycobacterium tuberculosis
TVDAHLANGSMSEV

SEQ ID NO: 152339 - protein, 14 aa, Mycobacterium tuberculosis
VDAHLANGSMSEVM

SEQ ID NO: 152340 - protein, 14 aa, Mycobacterium tuberculosis
DAHLANGSMSEVMM

SEQ ID NO: 152341 - protein, 14 aa, Mycobacterium tuberculosis
AHLANGSMSEVMMS

SEQ ID NO: 152342 - protein, 14 aa, Mycobacterium tuberculosis
HLANGSMSEVMMSE

SEQ ID NO: 152343 - protein, 14 aa, Mycobacterium tuberculosis
LANGSMSEVMMSEI

SEQ ID NO: 152344 - protein, 14 aa, Mycobacterium tuberculosis
ANGSMSEVMMSEIA

SEQ ID NO: 152345 - protein, 14 aa, Mycobacterium tuberculosis
NGSMSEVMMSEIAG

SEQ ID NO: 152346 - protein, 14 aa, Mycobacterium tuberculosis
GSMSEVMMSEIAGL

SEQ ID NO: 152347 - protein, 14 aa, Mycobacterium tuberculosis
SMSEVMMSEIAGLP

SEQ ID NO: 152348 - protein, 14 aa, Mycobacterium tuberculosis
MSEVMMSEIAGLPI

SEQ ID NO: 152349 - protein, 14 aa, Mycobacterium tuberculosis
SEVMMSEIAGLPIP

SEQ ID NO: 152350 - protein, 14 aa, Mycobacterium tuberculosis
EVMMSEIAGLPIPP

SEQ ID NO: 152351 - protein, 14 aa, Mycobacterium tuberculosis
VMMSEIAGLPIPPI

SEQ ID NO: 152352 - protein, 14 aa, Mycobacterium tuberculosis
MMSEIAGLPIPPII

SEQ ID NO: 152353 - protein, 14 aa, Mycobacterium tuberculosis
MSEIAGLPIPPIIH

SEQ ID NO: 152354 - protein, 14 aa, Mycobacterium tuberculosis
SEIAGLPIPPIIHY

SEQ ID NO: 152355 - protein, 14 aa, Mycobacterium tuberculosis
EIAGLPIPPIIHYG

SEQ ID NO: 152356 - protein, 14 aa, Mycobacterium tuberculosis
IAGLPIPPIIHYGA

SEQ ID NO: 152357 - protein, 14 aa, Mycobacterium tuberculosis
AGLPIPPIIHYGAI

SEQ ID NO: 152358 - protein, 14 aa, Mycobacterium tuberculosis
GLPIPPIIHYGAIA

SEQ ID NO: 152359 - protein, 14 aa, Mycobacterium tuberculosis
LPIPPIIHYGAIAY

SEQ ID NO: 152360 - protein, 14 aa, Mycobacterium tuberculosis
PIPPIIHYGAIAYA

SEQ ID NO: 152361 - protein, 14 aa, Mycobacterium tuberculosis
IPPIIHYGAIAYAP

SEQ ID NO: 152362 - protein, 14 aa, Mycobacterium tuberculosis
PPIIHYGAIAYAPS

SEQ ID NO: 152363 - protein, 14 aa, Mycobacterium tuberculosis
PIIHYGAIAYAPSG

SEQ ID NO: 152364 - protein, 14 aa, Mycobacterium tuberculosis
IIHYGAIAYAPSGA

SEQ ID NO: 152365 - protein, 14 aa, Mycobacterium tuberculosis
IHYGAIAYAPSGAS

SEQ ID NO: 152366 - protein, 14 aa, Mycobacterium tuberculosis
HYGAIAYAPSGASG

SEQ ID NO: 152367 - protein, 14 aa, Mycobacterium tuberculosis
YGAIAYAPSGASGK

SEQ ID NO: 152368 - protein, 14 aa, Mycobacterium tuberculosis
GAIAYAPSGASGKA

SEQ ID NO: 152369 - protein, 14 aa, Mycobacterium tuberculosis
AIAYAPSGASGKAW

SEQ ID NO: 152370 - protein, 14 aa, Mycobacterium tuberculosis
IAYAPSGASGKAWH

SEQ ID NO: 152371 - protein, 14 aa, Mycobacterium tuberculosis
AYAPSGASGKAWHQ

SEQ ID NO: 152372 - protein, 14 aa, Mycobacterium tuberculosis
YAPSGASGKAWHQR

SEQ ID NO: 152373 - protein, 14 aa, Mycobacterium tuberculosis
APSGASGKAWHQRT

SEQ ID NO: 152374 - protein, 14 aa, Mycobacterium tuberculosis
PSGASGKAWHQRTP

SEQ ID NO: 152375 - protein, 14 aa, Mycobacterium tuberculosis
SGASGKAWHQRTPA

SEQ ID NO: 152376 - protein, 14 aa, Mycobacterium tuberculosis
GASGKAWHQRTPAR

SEQ ID NO: 152377 - protein, 14 aa, Mycobacterium tuberculosis
ASGKAWHQRTPARA

SEQ ID NO: 152378 - protein, 14 aa, Mycobacterium tuberculosis
SGKAWHQRTPARAE

SEQ ID NO: 152379 - protein, 14 aa, Mycobacterium tuberculosis
GKAWHQRTPARAEQ

SEQ ID NO: 152380 - protein, 14 aa, Mycobacterium tuberculosis
KAWHQRTPARAEQV

SEQ ID NO: 152381 - protein, 14 aa, Mycobacterium tuberculosis
AWHQRTPARAEQVA

SEQ ID NO: 152382 - protein, 14 aa, Mycobacterium tuberculosis
WHQRTPARAEQVAL

SEQ ID NO: 152383 - protein, 14 aa, Mycobacterium tuberculosis
HQRTPARAEQVALE

SEQ ID NO: 152384 - protein, 14 aa, Mycobacterium tuberculosis
QRTPARAEQVALEK

SEQ ID NO: 152385 - protein, 14 aa, Mycobacterium tuberculosis
RTPARAEQVALEKC

SEQ ID NO: 152386 - protein, 14 aa, Mycobacterium tuberculosis
TPARAEQVALEKCG

SEQ ID NO: 152387 - protein, 14 aa, Mycobacterium tuberculosis
PARAEQVALEKCGD

SEQ ID NO: 152388 - protein, 14 aa, Mycobacterium tuberculosis
ARAEQVALEKCGDK

SEQ ID NO: 152389 - protein, 14 aa, Mycobacterium tuberculosis
RAEQVALEKCGDKT

SEQ ID NO: 152390 - protein, 14 aa, Mycobacterium tuberculosis
AEQVALEKCGDKTC

SEQ ID NO: 152391 - protein, 14 aa, Mycobacterium tuberculosis
EQVALEKCGDKTCK

SEQ ID NO: 152392 - protein, 14 aa, Mycobacterium tuberculosis
QVALEKCGDKTCKV

SEQ ID NO: 152393 - protein, 14 aa, Mycobacterium tuberculosis
VALEKCGDKTCKVV

SEQ ID NO: 152394 - protein, 14 aa, Mycobacterium tuberculosis
ALEKCGDKTCKVVS

SEQ ID NO: 152395 - protein, 14 aa, Mycobacterium tuberculosis
LEKCGDKTCKVVSR

SEQ ID NO: 152396 - protein, 14 aa, Mycobacterium tuberculosis
EKCGDKTCKVVSRF

SEQ ID NO: 152397 - protein, 14 aa, Mycobacterium tuberculosis
KCGDKTCKVVSRFT

SEQ ID NO: 152398 - protein, 14 aa, Mycobacterium tuberculosis
CGDKTCKVVSRFTR

SEQ ID NO: 152399 - protein, 14 aa, Mycobacterium tuberculosis
GDKTCKVVSRFTRC

SEQ ID NO: 152400 - protein, 14 aa, Mycobacterium tuberculosis
DKTCKVVSRFTRCG

SEQ ID NO: 152401 - protein, 14 aa, Mycobacterium tuberculosis
KTCKVVSRFTRCGA

SEQ ID NO: 152402 - protein, 14 aa, Mycobacterium tuberculosis
TCKVVSRFTRCGAV

SEQ ID NO: 152403 - protein, 14 aa, Mycobacterium tuberculosis
CKVVSRFTRCGAVA

SEQ ID NO: 152404 - protein, 14 aa, Mycobacterium tuberculosis
KVVSRFTRCGAVAY

SEQ ID NO: 152405 - protein, 14 aa, Mycobacterium tuberculosis
VVSRFTRCGAVAYN

SEQ ID NO: 152406 - protein, 14 aa, Mycobacterium tuberculosis
VSRFTRCGAVAYNG

SEQ ID NO: 152407 - protein, 14 aa, Mycobacterium tuberculosis
SRFTRCGAVAYNGS

SEQ ID NO: 152408 - protein, 14 aa, Mycobacterium tuberculosis
RFTRCGAVAYNGSK

SEQ ID NO: 152409 - protein, 14 aa, Mycobacterium tuberculosis
FTRCGAVAYNGSKY

SEQ ID NO: 152410 - protein, 14 aa, Mycobacterium tuberculosis
TRCGAVAYNGSKYQ

SEQ ID NO: 152411 - protein, 14 aa, Mycobacterium tuberculosis
RCGAVAYNGSKYQG

SEQ ID NO: 152412 - protein, 14 aa, Mycobacterium tuberculosis
CGAVAYNGSKYQGG

SEQ ID NO: 152413 - protein, 14 aa, Mycobacterium tuberculosis
GAVAYNGSKYQGGT

SEQ ID NO: 152414 - protein, 14 aa, Mycobacterium tuberculosis
AVAYNGSKYQGGTG

SEQ ID NO: 152415 - protein, 14 aa, Mycobacterium tuberculosis
VAYNGSKYQGGTGL

SEQ ID NO: 152416 - protein, 14 aa, Mycobacterium tuberculosis
AYNGSKYQGGTGLT

SEQ ID NO: 152417 - protein, 14 aa, Mycobacterium tuberculosis
YNGSKYQGGTGLTR

SEQ ID NO: 152418 - protein, 14 aa, Mycobacterium tuberculosis
NGSKYQGGTGLTRR

SEQ ID NO: 152419 - protein, 14 aa, Mycobacterium tuberculosis
GSKYQGGTGLTRRA

SEQ ID NO: 152420 - protein, 14 aa, Mycobacterium tuberculosis
SKYQGGTGLTRRAA

SEQ ID NO: 152421 - protein, 14 aa, Mycobacterium tuberculosis
KYQGGTGLTRRAAE

SEQ ID NO: 152422 - protein, 14 aa, Mycobacterium tuberculosis
YQGGTGLTRRAAED

SEQ ID NO: 152423 - protein, 14 aa, Mycobacterium tuberculosis
QGGTGLTRRAAEDD

SEQ ID NO: 152424 - protein, 14 aa, Mycobacterium tuberculosis
GGTGLTRRAAEDDA

SEQ ID NO: 152425 - protein, 14 aa, Mycobacterium tuberculosis
GTGLTRRAAEDDAV

SEQ ID NO: 152426 - protein, 14 aa, Mycobacterium tuberculosis
TGLTRRAAEDDAVN

SEQ ID NO: 152427 - protein, 14 aa, Mycobacterium tuberculosis
GLTRRAAEDDAVNR

SEQ ID NO: 152428 - protein, 14 aa, Mycobacterium tuberculosis
LTRRAAEDDAVNRL

SEQ ID NO: 152429 - protein, 14 aa, Mycobacterium tuberculosis
TRRAAEDDAVNRLE

SEQ ID NO: 152430 - protein, 14 aa, Mycobacterium tuberculosis
RRAAEDDAVNRLEG

SEQ ID NO: 152431 - protein, 14 aa, Mycobacterium tuberculosis
RAAEDDAVNRLEGG

SEQ ID NO: 152432 - protein, 14 aa, Mycobacterium tuberculosis
AAEDDAVNRLEGGR

SEQ ID NO: 152433 - protein, 14 aa, Mycobacterium tuberculosis
AEDDAVNRLEGGRI

SEQ ID NO: 152434 - protein, 14 aa, Mycobacterium tuberculosis
EDDAVNRLEGGRIV

SEQ ID NO: 152435 - protein, 14 aa, Mycobacterium tuberculosis
DDAVNRLEGGRIVN

SEQ ID NO: 152436 - protein, 14 aa, Mycobacterium tuberculosis
DAVNRLEGGRIVNW

SEQ ID NO: 152437 - protein, 14 aa, Mycobacterium tuberculosis
AVNRLEGGRIVNWA

SEQ ID NO: 152438 - protein, 14 aa, Mycobacterium tuberculosis
VNRLEGGRIVNWAC

SEQ ID NO: 152439 - protein, 14 aa, Mycobacterium tuberculosis
NRLEGGRIVNWACN

SEQ ID NO: 152440 - protein, 15 aa, Mycobacterium tuberculosis
MITNLRRRTAMAAAG

SEQ ID NO: 152441 - protein, 15 aa, Mycobacterium tuberculosis
ITNLRRRTAMAAAGL

SEQ ID NO: 152442 - protein, 15 aa, Mycobacterium tuberculosis
TNLRRRTAMAAAGLG

SEQ ID NO: 152443 - protein, 15 aa, Mycobacterium tuberculosis
NLRRRTAMAAAGLGA

SEQ ID NO: 152444 - protein, 15 aa, Mycobacterium tuberculosis
LRRRTAMAAAGLGAA

SEQ ID NO: 152445 - protein, 15 aa, Mycobacterium tuberculosis
RRRTAMAAAGLGAAL

SEQ ID NO: 152446 - protein, 15 aa, Mycobacterium tuberculosis
RRTAMAAAGLGAALG

SEQ ID NO: 152447 - protein, 15 aa, Mycobacterium tuberculosis
RTAMAAAGLGAALGL

SEQ ID NO: 152448 - protein, 15 aa, Mycobacterium tuberculosis
TAMAAAGLGAALGLG

SEQ ID NO: 152449 - protein, 15 aa, Mycobacterium tuberculosis
AMAAAGLGAALGLGI

SEQ ID NO: 152450 - protein, 15 aa, Mycobacterium tuberculosis
MAAAGLGAALGLGIL

SEQ ID NO: 152451 - protein, 15 aa, Mycobacterium tuberculosis
AAAGLGAALGLGILL

SEQ ID NO: 152452 - protein, 15 aa, Mycobacterium tuberculosis
AAGLGAALGLGILLV

SEQ ID NO: 152453 - protein, 15 aa, Mycobacterium tuberculosis
AGLGAALGLGILLVP

SEQ ID NO: 152454 - protein, 15 aa, Mycobacterium tuberculosis
GLGAALGLGILLVPT

SEQ ID NO: 152455 - protein, 15 aa, Mycobacterium tuberculosis
LGAALGLGILLVPTV

SEQ ID NO: 152456 - protein, 15 aa, Mycobacterium tuberculosis
GAALGLGILLVPTVD

SEQ ID NO: 152457 - protein, 15 aa, Mycobacterium tuberculosis
AALGLGILLVPTVDA

SEQ ID NO: 152458 - protein, 15 aa, Mycobacterium tuberculosis
ALGLGILLVPTVDAH

SEQ ID NO: 152459 - protein, 15 aa, Mycobacterium tuberculosis
LGLGILLVPTVDAHL

SEQ ID NO: 152460 - protein, 15 aa, Mycobacterium tuberculosis
GLGILLVPTVDAHLA

SEQ ID NO: 152461 - protein, 15 aa, Mycobacterium tuberculosis
LGILLVPTVDAHLAN

SEQ ID NO: 152462 - protein, 15 aa, Mycobacterium tuberculosis
GILLVPTVDAHLANG

SEQ ID NO: 152463 - protein, 15 aa, Mycobacterium tuberculosis
ILLVPTVDAHLANGS

SEQ ID NO: 152464 - protein, 15 aa, Mycobacterium tuberculosis
LLVPTVDAHLANGSM

SEQ ID NO: 152465 - protein, 15 aa, Mycobacterium tuberculosis
LVPTVDAHLANGSMS

SEQ ID NO: 152466 - protein, 15 aa, Mycobacterium tuberculosis
VPTVDAHLANGSMSE

SEQ ID NO: 152467 - protein, 15 aa, Mycobacterium tuberculosis
PTVDAHLANGSMSEV

SEQ ID NO: 152468 - protein, 15 aa, Mycobacterium tuberculosis
TVDAHLANGSMSEVM

SEQ ID NO: 152469 - protein, 15 aa, Mycobacterium tuberculosis
VDAHLANGSMSEVMM

SEQ ID NO: 152470 - protein, 15 aa, Mycobacterium tuberculosis
DAHLANGSMSEVMMS

SEQ ID NO: 152471 - protein, 15 aa, Mycobacterium tuberculosis
AHLANGSMSEVMMSE

SEQ ID NO: 152472 - protein, 15 aa, Mycobacterium tuberculosis
HLANGSMSEVMMSEI

SEQ ID NO: 152473 - protein, 15 aa, Mycobacterium tuberculosis
LANGSMSEVMMSEIA

SEQ ID NO: 152474 - protein, 15 aa, Mycobacterium tuberculosis
ANGSMSEVMMSEIAG

SEQ ID NO: 152475 - protein, 15 aa, Mycobacterium tuberculosis
NGSMSEVMMSEIAGL

SEQ ID NO: 152476 - protein, 15 aa, Mycobacterium tuberculosis
GSMSEVMMSEIAGLP

SEQ ID NO: 152477 - protein, 15 aa, Mycobacterium tuberculosis
SMSEVMMSEIAGLPI

SEQ ID NO: 152478 - protein, 15 aa, Mycobacterium tuberculosis
MSEVMMSEIAGLPIP

SEQ ID NO: 152479 - protein, 15 aa, Mycobacterium tuberculosis
SEVMMSEIAGLPIPP

SEQ ID NO: 152480 - protein, 15 aa, Mycobacterium tuberculosis
EVMMSEIAGLPIPPI

SEQ ID NO: 152481 - protein, 15 aa, Mycobacterium tuberculosis
VMMSEIAGLPIPPII

SEQ ID NO: 152482 - protein, 15 aa, Mycobacterium tuberculosis
MMSEIAGLPIPPIIH

SEQ ID NO: 152483 - protein, 15 aa, Mycobacterium tuberculosis
MSEIAGLPIPPIIHY

SEQ ID NO: 152484 - protein, 15 aa, Mycobacterium tuberculosis
SEIAGLPIPPIIHYG

SEQ ID NO: 152485 - protein, 15 aa, Mycobacterium tuberculosis
EIAGLPIPPIIHYGA

SEQ ID NO: 152486 - protein, 15 aa, Mycobacterium tuberculosis
IAGLPIPPIIHYGAI

SEQ ID NO: 152487 - protein, 15 aa, Mycobacterium tuberculosis
AGLPIPPIIHYGAIA

SEQ ID NO: 152488 - protein, 15 aa, Mycobacterium tuberculosis
GLPIPPIIHYGAIAY

SEQ ID NO: 152489 - protein, 15 aa, Mycobacterium tuberculosis
LPIPPIIHYGAIAYA

SEQ ID NO: 152490 - protein, 15 aa, Mycobacterium tuberculosis
PIPPIIHYGAIAYAP

SEQ ID NO: 152491 - protein, 15 aa, Mycobacterium tuberculosis
IPPIIHYGAIAYAPS

SEQ ID NO: 152492 - protein, 15 aa, Mycobacterium tuberculosis
PPIIHYGAIAYAPSG

SEQ ID NO: 152493 - protein, 15 aa, Mycobacterium tuberculosis
PIIHYGAIAYAPSGA

SEQ ID NO: 152494 - protein, 15 aa, Mycobacterium tuberculosis
IIHYGAIAYAPSGAS

SEQ ID NO: 152495 - protein, 15 aa, Mycobacterium tuberculosis
IHYGAIAYAPSGASG

SEQ ID NO: 152496 - protein, 15 aa, Mycobacterium tuberculosis
HYGAIAYAPSGASGK

SEQ ID NO: 152497 - protein, 15 aa, Mycobacterium tuberculosis
YGAIAYAPSGASGKA

SEQ ID NO: 152498 - protein, 15 aa, Mycobacterium tuberculosis
GAIAYAPSGASGKAW

SEQ ID NO: 152499 - protein, 15 aa, Mycobacterium tuberculosis
AIAYAPSGASGKAWH

SEQ ID NO: 152500 - protein, 15 aa, Mycobacterium tuberculosis
IAYAPSGASGKAWHQ

SEQ ID NO: 152501 - protein, 15 aa, Mycobacterium tuberculosis
AYAPSGASGKAWHQR

SEQ ID NO: 152502 - protein, 15 aa, Mycobacterium tuberculosis
YAPSGASGKAWHQRT

SEQ ID NO: 152503 - protein, 15 aa, Mycobacterium tuberculosis
APSGASGKAWHQRTP

SEQ ID NO: 152504 - protein, 15 aa, Mycobacterium tuberculosis
PSGASGKAWHQRTPA

SEQ ID NO: 152505 - protein, 15 aa, Mycobacterium tuberculosis
SGASGKAWHQRTPAR

SEQ ID NO: 152506 - protein, 15 aa, Mycobacterium tuberculosis
GASGKAWHQRTPARA

SEQ ID NO: 152507 - protein, 15 aa, Mycobacterium tuberculosis
ASGKAWHQRTPARAE

SEQ ID NO: 152508 - protein, 15 aa, Mycobacterium tuberculosis
SGKAWHQRTPARAEQ

SEQ ID NO: 152509 - protein, 15 aa, Mycobacterium tuberculosis
GKAWHQRTPARAEQV

SEQ ID NO: 152510 - protein, 15 aa, Mycobacterium tuberculosis
KAWHQRTPARAEQVA

SEQ ID NO: 152511 - protein, 15 aa, Mycobacterium tuberculosis
AWHQRTPARAEQVAL

SEQ ID NO: 152512 - protein, 15 aa, Mycobacterium tuberculosis
WHQRTPARAEQVALE

SEQ ID NO: 152513 - protein, 15 aa, Mycobacterium tuberculosis
HQRTPARAEQVALEK

SEQ ID NO: 152514 - protein, 15 aa, Mycobacterium tuberculosis
QRTPARAEQVALEKC

SEQ ID NO: 152515 - protein, 15 aa, Mycobacterium tuberculosis
RTPARAEQVALEKCG

SEQ ID NO: 152516 - protein, 15 aa, Mycobacterium tuberculosis
TPARAEQVALEKCGD

SEQ ID NO: 152517 - protein, 15 aa, Mycobacterium tuberculosis
PARAEQVALEKCGDK

SEQ ID NO: 152518 - protein, 15 aa, Mycobacterium tuberculosis
ARAEQVALEKCGDKT

SEQ ID NO: 152519 - protein, 15 aa, Mycobacterium tuberculosis
RAEQVALEKCGDKTC

SEQ ID NO: 152520 - protein, 15 aa, Mycobacterium tuberculosis
AEQVALEKCGDKTCK

SEQ ID NO: 152521 - protein, 15 aa, Mycobacterium tuberculosis
EQVALEKCGDKTCKV

SEQ ID NO: 152522 - protein, 15 aa, Mycobacterium tuberculosis
QVALEKCGDKTCKVV

SEQ ID NO: 152523 - protein, 15 aa, Mycobacterium tuberculosis
VALEKCGDKTCKVVS

SEQ ID NO: 152524 - protein, 15 aa, Mycobacterium tuberculosis
ALEKCGDKTCKVVSR

SEQ ID NO: 152525 - protein, 15 aa, Mycobacterium tuberculosis
LEKCGDKTCKVVSRF

SEQ ID NO: 152526 - protein, 15 aa, Mycobacterium tuberculosis
EKCGDKTCKVVSRFT

SEQ ID NO: 152527 - protein, 15 aa, Mycobacterium tuberculosis
KCGDKTCKVVSRFTR

SEQ ID NO: 152528 - protein, 15 aa, Mycobacterium tuberculosis
CGDKTCKVVSRFTRC

SEQ ID NO: 152529 - protein, 15 aa, Mycobacterium tuberculosis
GDKTCKVVSRFTRCG

SEQ ID NO: 152530 - protein, 15 aa, Mycobacterium tuberculosis
DKTCKVVSRFTRCGA

SEQ ID NO: 152531 - protein, 15 aa, Mycobacterium tuberculosis
KTCKVVSRFTRCGAV

SEQ ID NO: 152532 - protein, 15 aa, Mycobacterium tuberculosis
TCKVVSRFTRCGAVA

SEQ ID NO: 152533 - protein, 15 aa, Mycobacterium tuberculosis
CKVVSRFTRCGAVAY

SEQ ID NO: 152534 - protein, 15 aa, Mycobacterium tuberculosis
KVVSRFTRCGAVAYN

SEQ ID NO: 152535 - protein, 15 aa, Mycobacterium tuberculosis
VVSRFTRCGAVAYNG

SEQ ID NO: 152536 - protein, 15 aa, Mycobacterium tuberculosis
VSRFTRCGAVAYNGS

SEQ ID NO: 152537 - protein, 15 aa, Mycobacterium tuberculosis
SRFTRCGAVAYNGSK

SEQ ID NO: 152538 - protein, 15 aa, Mycobacterium tuberculosis
RFTRCGAVAYNGSKY

SEQ ID NO: 152539 - protein, 15 aa, Mycobacterium tuberculosis
FTRCGAVAYNGSKYQ

SEQ ID NO: 152540 - protein, 15 aa, Mycobacterium tuberculosis
TRCGAVAYNGSKYQG

SEQ ID NO: 152541 - protein, 15 aa, Mycobacterium tuberculosis
RCGAVAYNGSKYQGG

SEQ ID NO: 152542 - protein, 15 aa, Mycobacterium tuberculosis
CGAVAYNGSKYQGGT

SEQ ID NO: 152543 - protein, 15 aa, Mycobacterium tuberculosis
GAVAYNGSKYQGGTG

SEQ ID NO: 152544 - protein, 15 aa, Mycobacterium tuberculosis
AVAYNGSKYQGGTGL

SEQ ID NO: 152545 - protein, 15 aa, Mycobacterium tuberculosis
VAYNGSKYQGGTGLT

SEQ ID NO: 152546 - protein, 15 aa, Mycobacterium tuberculosis
AYNGSKYQGGTGLTR

SEQ ID NO: 152547 - protein, 15 aa, Mycobacterium tuberculosis
YNGSKYQGGTGLTRR

SEQ ID NO: 152548 - protein, 15 aa, Mycobacterium tuberculosis
NGSKYQGGTGLTRRA

SEQ ID NO: 152549 - protein, 15 aa, Mycobacterium tuberculosis
GSKYQGGTGLTRRAA

SEQ ID NO: 152550 - protein, 15 aa, Mycobacterium tuberculosis
SKYQGGTGLTRRAAE

SEQ ID NO: 152551 - protein, 15 aa, Mycobacterium tuberculosis
KYQGGTGLTRRAAED

SEQ ID NO: 152552 - protein, 15 aa, Mycobacterium tuberculosis
YQGGTGLTRRAAEDD

SEQ ID NO: 152553 - protein, 15 aa, Mycobacterium tuberculosis
QGGTGLTRRAAEDDA

SEQ ID NO: 152554 - protein, 15 aa, Mycobacterium tuberculosis
GGTGLTRRAAEDDAV

SEQ ID NO: 152555 - protein, 15 aa, Mycobacterium tuberculosis
GTGLTRRAAEDDAVN

SEQ ID NO: 152556 - protein, 15 aa, Mycobacterium tuberculosis
TGLTRRAAEDDAVNR

SEQ ID NO: 152557 - protein, 15 aa, Mycobacterium tuberculosis
GLTRRAAEDDAVNRL

SEQ ID NO: 152558 - protein, 15 aa, Mycobacterium tuberculosis
LTRRAAEDDAVNRLE

SEQ ID NO: 152559 - protein, 15 aa, Mycobacterium tuberculosis
TRRAAEDDAVNRLEG

SEQ ID NO: 152560 - protein, 15 aa, Mycobacterium tuberculosis
RRAAEDDAVNRLEGG

SEQ ID NO: 152561 - protein, 15 aa, Mycobacterium tuberculosis
RAAEDDAVNRLEGGR

SEQ ID NO: 152562 - protein, 15 aa, Mycobacterium tuberculosis
AAEDDAVNRLEGGRI

SEQ ID NO: 152563 - protein, 15 aa, Mycobacterium tuberculosis
AEDDAVNRLEGGRIV

SEQ ID NO: 152564 - protein, 15 aa, Mycobacterium tuberculosis
EDDAVNRLEGGRIVN

SEQ ID NO: 152565 - protein, 15 aa, Mycobacterium tuberculosis
DDAVNRLEGGRIVNW

SEQ ID NO: 152566 - protein, 15 aa, Mycobacterium tuberculosis
DAVNRLEGGRIVNWA

SEQ ID NO: 152567 - protein, 15 aa, Mycobacterium tuberculosis
AVNRLEGGRIVNWAC

SEQ ID NO: 152568 - protein, 15 aa, Mycobacterium tuberculosis
VNRLEGGRIVNWACN

SEQ ID NO: 152569 - protein, 16 aa, Mycobacterium tuberculosis
MITNLRRRTAMAAAGL

SEQ ID NO: 152570 - protein, 16 aa, Mycobacterium tuberculosis
ITNLRRRTAMAAAGLG

SEQ ID NO: 152571 - protein, 16 aa, Mycobacterium tuberculosis
TNLRRRTAMAAAGLGA

SEQ ID NO: 152572 - protein, 16 aa, Mycobacterium tuberculosis
NLRRRTAMAAAGLGAA

SEQ ID NO: 152573 - protein, 16 aa, Mycobacterium tuberculosis
LRRRTAMAAAGLGAAL

SEQ ID NO: 152574 - protein, 16 aa, Mycobacterium tuberculosis
RRRTAMAAAGLGAALG

SEQ ID NO: 152575 - protein, 16 aa, Mycobacterium tuberculosis
RRTAMAAAGLGAALGL

SEQ ID NO: 152576 - protein, 16 aa, Mycobacterium tuberculosis
RTAMAAAGLGAALGLG

SEQ ID NO: 152577 - protein, 16 aa, Mycobacterium tuberculosis
TAMAAAGLGAALGLGI

SEQ ID NO: 152578 - protein, 16 aa, Mycobacterium tuberculosis
AMAAAGLGAALGLGIL

SEQ ID NO: 152579 - protein, 16 aa, Mycobacterium tuberculosis
MAAAGLGAALGLGILL

SEQ ID NO: 152580 - protein, 16 aa, Mycobacterium tuberculosis
AAAGLGAALGLGILLV

SEQ ID NO: 152581 - protein, 16 aa, Mycobacterium tuberculosis
AAGLGAALGLGILLVP

SEQ ID NO: 152582 - protein, 16 aa, Mycobacterium tuberculosis
AGLGAALGLGILLVPT

SEQ ID NO: 152583 - protein, 16 aa, Mycobacterium tuberculosis
GLGAALGLGILLVPTV

SEQ ID NO: 152584 - protein, 16 aa, Mycobacterium tuberculosis
LGAALGLGILLVPTVD

SEQ ID NO: 152585 - protein, 16 aa, Mycobacterium tuberculosis
GAALGLGILLVPTVDA

SEQ ID NO: 152586 - protein, 16 aa, Mycobacterium tuberculosis
AALGLGILLVPTVDAH

SEQ ID NO: 152587 - protein, 16 aa, Mycobacterium tuberculosis
ALGLGILLVPTVDAHL

SEQ ID NO: 152588 - protein, 16 aa, Mycobacterium tuberculosis
LGLGILLVPTVDAHLA

SEQ ID NO: 152589 - protein, 16 aa, Mycobacterium tuberculosis
GLGILLVPTVDAHLAN

SEQ ID NO: 152590 - protein, 16 aa, Mycobacterium tuberculosis
LGILLVPTVDAHLANG

SEQ ID NO: 152591 - protein, 16 aa, Mycobacterium tuberculosis
GILLVPTVDAHLANGS

SEQ ID NO: 152592 - protein, 16 aa, Mycobacterium tuberculosis
ILLVPTVDAHLANGSM

SEQ ID NO: 152593 - protein, 16 aa, Mycobacterium tuberculosis
LLVPTVDAHLANGSMS

SEQ ID NO: 152594 - protein, 16 aa, Mycobacterium tuberculosis
LVPTVDAHLANGSMSE

SEQ ID NO: 152595 - protein, 16 aa, Mycobacterium tuberculosis
VPTVDAHLANGSMSEV

SEQ ID NO: 152596 - protein, 16 aa, Mycobacterium tuberculosis
PTVDAHLANGSMSEVM

SEQ ID NO: 152597 - protein, 16 aa, Mycobacterium tuberculosis
TVDAHLANGSMSEVMM

SEQ ID NO: 152598 - protein, 16 aa, Mycobacterium tuberculosis
VDAHLANGSMSEVMMS

SEQ ID NO: 152599 - protein, 16 aa, Mycobacterium tuberculosis
DAHLANGSMSEVMMSE

SEQ ID NO: 152600 - protein, 16 aa, Mycobacterium tuberculosis
AHLANGSMSEVMMSEI

SEQ ID NO: 152601 - protein, 16 aa, Mycobacterium tuberculosis
HLANGSMSEVMMSEIA

SEQ ID NO: 152602 - protein, 16 aa, Mycobacterium tuberculosis
LANGSMSEVMMSEIAG

SEQ ID NO: 152603 - protein, 16 aa, Mycobacterium tuberculosis
ANGSMSEVMMSEIAGL

SEQ ID NO: 152604 - protein, 16 aa, Mycobacterium tuberculosis
NGSMSEVMMSEIAGLP

SEQ ID NO: 152605 - protein, 16 aa, Mycobacterium tuberculosis
GSMSEVMMSEIAGLPI

SEQ ID NO: 152606 - protein, 16 aa, Mycobacterium tuberculosis
SMSEVMMSEIAGLPIP

SEQ ID NO: 152607 - protein, 16 aa, Mycobacterium tuberculosis
MSEVMMSEIAGLPIPP

SEQ ID NO: 152608 - protein, 16 aa, Mycobacterium tuberculosis
SEVMMSEIAGLPIPPI

SEQ ID NO: 152609 - protein, 16 aa, Mycobacterium tuberculosis
EVMMSEIAGLPIPPII

SEQ ID NO: 152610 - protein, 16 aa, Mycobacterium tuberculosis
VMMSEIAGLPIPPIIH

SEQ ID NO: 152611 - protein, 16 aa, Mycobacterium tuberculosis
MMSEIAGLPIPPIIHY

SEQ ID NO: 152612 - protein, 16 aa, Mycobacterium tuberculosis
MSEIAGLPIPPIIHYG

SEQ ID NO: 152613 - protein, 16 aa, Mycobacterium tuberculosis
SEIAGLPIPPIIHYGA

SEQ ID NO: 152614 - protein, 16 aa, Mycobacterium tuberculosis
EIAGLPIPPIIHYGAI

SEQ ID NO: 152615 - protein, 16 aa, Mycobacterium tuberculosis
IAGLPIPPIIHYGAIA

SEQ ID NO: 152616 - protein, 16 aa, Mycobacterium tuberculosis
AGLPIPPIIHYGAIAY

SEQ ID NO: 152617 - protein, 16 aa, Mycobacterium tuberculosis
GLPIPPIIHYGAIAYA

SEQ ID NO: 152618 - protein, 16 aa, Mycobacterium tuberculosis
LPIPPIIHYGAIAYAP

SEQ ID NO: 152619 - protein, 16 aa, Mycobacterium tuberculosis
PIPPIIHYGAIAYAPS

SEQ ID NO: 152620 - protein, 16 aa, Mycobacterium tuberculosis
IPPIIHYGAIAYAPSG

SEQ ID NO: 152621 - protein, 16 aa, Mycobacterium tuberculosis
PPIIHYGAIAYAPSGA

SEQ ID NO: 152622 - protein, 16 aa, Mycobacterium tuberculosis
PIIHYGAIAYAPSGAS

SEQ ID NO: 152623 - protein, 16 aa, Mycobacterium tuberculosis
IIHYGAIAYAPSGASG

SEQ ID NO: 152624 - protein, 16 aa, Mycobacterium tuberculosis
IHYGAIAYAPSGASGK

SEQ ID NO: 152625 - protein, 16 aa, Mycobacterium tuberculosis
HYGAIAYAPSGASGKA

SEQ ID NO: 152626 - protein, 16 aa, Mycobacterium tuberculosis
YGAIAYAPSGASGKAW

SEQ ID NO: 152627 - protein, 16 aa, Mycobacterium tuberculosis
GAIAYAPSGASGKAWH

SEQ ID NO: 152628 - protein, 16 aa, Mycobacterium tuberculosis
AIAYAPSGASGKAWHQ

SEQ ID NO: 152629 - protein, 16 aa, Mycobacterium tuberculosis
IAYAPSGASGKAWHQR

SEQ ID NO: 152630 - protein, 16 aa, Mycobacterium tuberculosis
AYAPSGASGKAWHQRT

SEQ ID NO: 152631 - protein, 16 aa, Mycobacterium tuberculosis
YAPSGASGKAWHQRTP

SEQ ID NO: 152632 - protein, 16 aa, Mycobacterium tuberculosis
APSGASGKAWHQRTPA

SEQ ID NO: 152633 - protein, 16 aa, Mycobacterium tuberculosis
PSGASGKAWHQRTPAR

SEQ ID NO: 152634 - protein, 16 aa, Mycobacterium tuberculosis
SGASGKAWHQRTPARA

SEQ ID NO: 152635 - protein, 16 aa, Mycobacterium tuberculosis
GASGKAWHQRTPARAE

SEQ ID NO: 152636 - protein, 16 aa, Mycobacterium tuberculosis
ASGKAWHQRTPARAEQ

SEQ ID NO: 152637 - protein, 16 aa, Mycobacterium tuberculosis
SGKAWHQRTPARAEQV

SEQ ID NO: 152638 - protein, 16 aa, Mycobacterium tuberculosis
GKAWHQRTPARAEQVA

SEQ ID NO: 152639 - protein, 16 aa, Mycobacterium tuberculosis
KAWHQRTPARAEQVAL

SEQ ID NO: 152640 - protein, 16 aa, Mycobacterium tuberculosis
AWHQRTPARAEQVALE

SEQ ID NO: 152641 - protein, 16 aa, Mycobacterium tuberculosis
WHQRTPARAEQVALEK

SEQ ID NO: 152642 - protein, 16 aa, Mycobacterium tuberculosis
HQRTPARAEQVALEKC

SEQ ID NO: 152643 - protein, 16 aa, Mycobacterium tuberculosis
QRTPARAEQVALEKCG

SEQ ID NO: 152644 - protein, 16 aa, Mycobacterium tuberculosis
RTPARAEQVALEKCGD

SEQ ID NO: 152645 - protein, 16 aa, Mycobacterium tuberculosis
TPARAEQVALEKCGDK

SEQ ID NO: 152646 - protein, 16 aa, Mycobacterium tuberculosis
PARAEQVALEKCGDKT

SEQ ID NO: 152647 - protein, 16 aa, Mycobacterium tuberculosis
ARAEQVALEKCGDKTC

SEQ ID NO: 152648 - protein, 16 aa, Mycobacterium tuberculosis
RAEQVALEKCGDKTCK

SEQ ID NO: 152649 - protein, 16 aa, Mycobacterium tuberculosis
AEQVALEKCGDKTCKV

SEQ ID NO: 152650 - protein, 16 aa, Mycobacterium tuberculosis
EQVALEKCGDKTCKVV

SEQ ID NO: 152651 - protein, 16 aa, Mycobacterium tuberculosis
QVALEKCGDKTCKVVS

SEQ ID NO: 152652 - protein, 16 aa, Mycobacterium tuberculosis
VALEKCGDKTCKVVSR

SEQ ID NO: 152653 - protein, 16 aa, Mycobacterium tuberculosis
ALEKCGDKTCKVVSRF

SEQ ID NO: 152654 - protein, 16 aa, Mycobacterium tuberculosis
LEKCGDKTCKVVSRFT

SEQ ID NO: 152655 - protein, 16 aa, Mycobacterium tuberculosis
EKCGDKTCKVVSRFTR

SEQ ID NO: 152656 - protein, 16 aa, Mycobacterium tuberculosis
KCGDKTCKVVSRFTRC

SEQ ID NO: 152657 - protein, 16 aa, Mycobacterium tuberculosis
CGDKTCKVVSRFTRCG

SEQ ID NO: 152658 - protein, 16 aa, Mycobacterium tuberculosis
GDKTCKVVSRFTRCGA

SEQ ID NO: 152659 - protein, 16 aa, Mycobacterium tuberculosis
DKTCKVVSRFTRCGAV

SEQ ID NO: 152660 - protein, 16 aa, Mycobacterium tuberculosis
KTCKVVSRFTRCGAVA

SEQ ID NO: 152661 - protein, 16 aa, Mycobacterium tuberculosis
TCKVVSRFTRCGAVAY

SEQ ID NO: 152662 - protein, 16 aa, Mycobacterium tuberculosis
CKVVSRFTRCGAVAYN

SEQ ID NO: 152663 - protein, 16 aa, Mycobacterium tuberculosis
KVVSRFTRCGAVAYNG

SEQ ID NO: 152664 - protein, 16 aa, Mycobacterium tuberculosis
VVSRFTRCGAVAYNGS

SEQ ID NO: 152665 - protein, 16 aa, Mycobacterium tuberculosis
VSRFTRCGAVAYNGSK

SEQ ID NO: 152666 - protein, 16 aa, Mycobacterium tuberculosis
SRFTRCGAVAYNGSKY

SEQ ID NO: 152667 - protein, 16 aa, Mycobacterium tuberculosis
RFTRCGAVAYNGSKYQ

SEQ ID NO: 152668 - protein, 16 aa, Mycobacterium tuberculosis
FTRCGAVAYNGSKYQG

SEQ ID NO: 152669 - protein, 16 aa, Mycobacterium tuberculosis
TRCGAVAYNGSKYQGG

SEQ ID NO: 152670 - protein, 16 aa, Mycobacterium tuberculosis
RCGAVAYNGSKYQGGT

SEQ ID NO: 152671 - protein, 16 aa, Mycobacterium tuberculosis
CGAVAYNGSKYQGGTG

SEQ ID NO: 152672 - protein, 16 aa, Mycobacterium tuberculosis
GAVAYNGSKYQGGTGL

SEQ ID NO: 152673 - protein, 16 aa, Mycobacterium tuberculosis
AVAYNGSKYQGGTGLT

SEQ ID NO: 152674 - protein, 16 aa, Mycobacterium tuberculosis
VAYNGSKYQGGTGLTR

SEQ ID NO: 152675 - protein, 16 aa, Mycobacterium tuberculosis
AYNGSKYQGGTGLTRR

SEQ ID NO: 152676 - protein, 16 aa, Mycobacterium tuberculosis
YNGSKYQGGTGLTRRA

SEQ ID NO: 152677 - protein, 16 aa, Mycobacterium tuberculosis
NGSKYQGGTGLTRRAA

SEQ ID NO: 152678 - protein, 16 aa, Mycobacterium tuberculosis
GSKYQGGTGLTRRAAE

SEQ ID NO: 152679 - protein, 16 aa, Mycobacterium tuberculosis
SKYQGGTGLTRRAAED

SEQ ID NO: 152680 - protein, 16 aa, Mycobacterium tuberculosis
KYQGGTGLTRRAAEDD

SEQ ID NO: 152681 - protein, 16 aa, Mycobacterium tuberculosis
YQGGTGLTRRAAEDDA

SEQ ID NO: 152682 - protein, 16 aa, Mycobacterium tuberculosis
QGGTGLTRRAAEDDAV

SEQ ID NO: 152683 - protein, 16 aa, Mycobacterium tuberculosis
GGTGLTRRAAEDDAVN

SEQ ID NO: 152684 - protein, 16 aa, Mycobacterium tuberculosis
GTGLTRRAAEDDAVNR

SEQ ID NO: 152685 - protein, 16 aa, Mycobacterium tuberculosis
TGLTRRAAEDDAVNRL

SEQ ID NO: 152686 - protein, 16 aa, Mycobacterium tuberculosis
GLTRRAAEDDAVNRLE

SEQ ID NO: 152687 - protein, 16 aa, Mycobacterium tuberculosis
LTRRAAEDDAVNRLEG

SEQ ID NO: 152688 - protein, 16 aa, Mycobacterium tuberculosis
TRRAAEDDAVNRLEGG

SEQ ID NO: 152689 - protein, 16 aa, Mycobacterium tuberculosis
RRAAEDDAVNRLEGGR

SEQ ID NO: 152690 - protein, 16 aa, Mycobacterium tuberculosis
RAAEDDAVNRLEGGRI

SEQ ID NO: 152691 - protein, 16 aa, Mycobacterium tuberculosis
AAEDDAVNRLEGGRIV

SEQ ID NO: 152692 - protein, 16 aa, Mycobacterium tuberculosis
AEDDAVNRLEGGRIVN

SEQ ID NO: 152693 - protein, 16 aa, Mycobacterium tuberculosis
EDDAVNRLEGGRIVNW

SEQ ID NO: 152694 - protein, 16 aa, Mycobacterium tuberculosis
DDAVNRLEGGRIVNWA

SEQ ID NO: 152695 - protein, 16 aa, Mycobacterium tuberculosis
DAVNRLEGGRIVNWAC

SEQ ID NO: 152696 - protein, 16 aa, Mycobacterium tuberculosis
AVNRLEGGRIVNWACN

SEQ ID NO: 152697 - protein, 1327 aa, Mycobacterium tuberculosis
MRCGIVVNVTGPPPTIDRRYHDAVIVGLDNVVDKATRVHAAAWTKFLDDYLTRRPQRTGEDHCPLTHDDYRRFLAGKPDGVADFLAARGIRLPPGSPTDLTDDTVYGLQNLERQTFLQLLNTGVPEGKSIASFARRLQVAGVRVAAHTSHRNYGHTLDATGLAEVFAVFVDGAVTAELGLPAEPNPAGLIETAKRLGANPGRCVVIDSCQTGLRAGRNGGFALVIAVDAHGDAENLLSSGADAVVADLAAVTVGSGDAAISTIPDALQVYSQLKRLLTGRRPAVFLDFDGTLSDIVERPEAATLVDGAAEALRALAAQCPVAVISGRDLADVRNRVKVDGLWLAGSHGFELVAPDGSHHQNAAATAAIDGLAEAAAQLADALREIAGAVVEHKRFAVAVHYRNVADDSVDNLIAAVRRLGHAAGLRVTTGRKVVELRPDIAWDKGKALDWIGERLGPAEVGPDLRLPIYIGDDLTDEDAFDAVRFTGVGIVVRHNEHGDRRSAATFRLECPYTVCQFLSQLACDLQEAVQHDDPWTLVFHGYDPGQERLREALCAVGNGYLGSRGCAPESAESEAHYPGTYVAGVYNQLTDHIEGCTVDNESLVNLPNWLSLTFRIDGGAWFNVDTVELLSYRQTFDLRRATLTRSLRFRDAGGRVTTMTQERFASMNRPNLVALQTRIESENWSGTVDFRSLVDGGVHNTLVDRYRQLSSQHLTTAEIEVLADSVLLRTQTSQSGIAIAVAARSTLWRDGQRVDAQYRVARDTNRGGHDIQVTLSAGQSVTLEKVATIFTSRDAATLTAAISAQRCLGEAGRYAELCQQHVRAWARLWERCAIDLTGNTEELRLVRLHLLHLLQTISPHTAELDAGVPARGLNGEAYRGHVFWDALFVAPVLSLRMPKVARSLLDYRYRRLPAARRAAHRAGHLGAMYPWQSGSDGSEVSQQLHLNPRSGRWTPDPSDRAHHVGLAVAYNAWHYYQVTGDRQYLVDCGAELLVEIARFWVGLAKLDDSRGRYLIRGVIGPDEFHSGYPGNEYDGIDNNAYTNVMAVWVILRAMEALDLLPLTDRRHLIEKLGLTTQERDQWDDVSRRMFVPFHDGVISQFEGYSELAELDWDHYRHRYGNIQRLDRILEAEGDSVNNYQASKQADALMLLYLLSSDELIGLLARLGYRFAPTQIPGTVDYYLARTSDGSTLSAVVHAWVLARANRSNAMEYFRQVLRSDIADVQGGTTQEGIHLAAMAGSIDLLQRCYSGLELRDDRLVLSPQWPEALGPLEFPFVYRRHQLSLRISGRSATLTAESGDAEPIEVECRGHVQRLRCGHTIEVGCSR

SEQ ID NO: 152698 - protein, 8 aa, Mycobacterium tuberculosis
VTGPPPTI

SEQ ID NO: 152699 - protein, 8 aa, Mycobacterium tuberculosis
RRYHDAVI

SEQ ID NO: 152700 - protein, 8 aa, Mycobacterium tuberculosis
RYHDAVIV

SEQ ID NO: 152701 - protein, 8 aa, Mycobacterium tuberculosis
HDAVIVGL

SEQ ID NO: 152702 - protein, 8 aa, Mycobacterium tuberculosis
VIVGLDNV

SEQ ID NO: 152703 - protein, 8 aa, Mycobacterium tuberculosis
IVGLDNVV

SEQ ID NO: 152704 - protein, 8 aa, Mycobacterium tuberculosis
NVVDKATR

SEQ ID NO: 152705 - protein, 8 aa, Mycobacterium tuberculosis
VVDKATRV

SEQ ID NO: 152706 - protein, 8 aa, Mycobacterium tuberculosis
ATRVHAAA

SEQ ID NO: 152707 - protein, 8 aa, Mycobacterium tuberculosis
HAAAWTKF

SEQ ID NO: 152708 - protein, 8 aa, Mycobacterium tuberculosis
WTKFLDDY

SEQ ID NO: 152709 - protein, 8 aa, Mycobacterium tuberculosis
FLDDYLTR

SEQ ID NO: 152710 - protein, 8 aa, Mycobacterium tuberculosis
YLTRRPQR

SEQ ID NO: 152711 - protein, 8 aa, Mycobacterium tuberculosis
CPLTHDDY

SEQ ID NO: 152712 - protein, 8 aa, Mycobacterium tuberculosis
LTHDDYRR

SEQ ID NO: 152713 - protein, 8 aa, Mycobacterium tuberculosis
THDDYRRF

SEQ ID NO: 152714 - protein, 8 aa, Mycobacterium tuberculosis
YRRFLAGK

SEQ ID NO: 152715 - protein, 8 aa, Mycobacterium tuberculosis
RRFLAGKP

SEQ ID NO: 152716 - protein, 8 aa, Mycobacterium tuberculosis
KPDGVADF

SEQ ID NO: 152717 - protein, 8 aa, Mycobacterium tuberculosis
GVADFLAA

SEQ ID NO: 152718 - protein, 8 aa, Mycobacterium tuberculosis
FLAARGIR

SEQ ID NO: 152719 - protein, 8 aa, Mycobacterium tuberculosis
RLPPGSPT

SEQ ID NO: 152720 - protein, 8 aa, Mycobacterium tuberculosis
DLTDDTVY

SEQ ID NO: 152721 - protein, 8 aa, Mycobacterium tuberculosis
TVYGLQNL

SEQ ID NO: 152722 - protein, 8 aa, Mycobacterium tuberculosis
NLERQTFL

SEQ ID NO: 152723 - protein, 8 aa, Mycobacterium tuberculosis
RQTFLQLL

SEQ ID NO: 152724 - protein, 8 aa, Mycobacterium tuberculosis
LQLLNTGV

SEQ ID NO: 152725 - protein, 8 aa, Mycobacterium tuberculosis
NTGVPEGK

SEQ ID NO: 152726 - protein, 8 aa, Mycobacterium tuberculosis
GVPEGKSI

SEQ ID NO: 152727 - protein, 8 aa, Mycobacterium tuberculosis
VPEGKSIA

SEQ ID NO: 152728 - protein, 8 aa, Mycobacterium tuberculosis
EGKSIASF

SEQ ID NO: 152729 - protein, 8 aa, Mycobacterium tuberculosis
KSIASFAR

SEQ ID NO: 152730 - protein, 8 aa, Mycobacterium tuberculosis
SIASFARR

SEQ ID NO: 152731 - protein, 8 aa, Mycobacterium tuberculosis
SFARRLQV

SEQ ID NO: 152732 - protein, 8 aa, Mycobacterium tuberculosis
FARRLQVA

SEQ ID NO: 152733 - protein, 8 aa, Mycobacterium tuberculosis
RRLQVAGV

SEQ ID NO: 152734 - protein, 8 aa, Mycobacterium tuberculosis
RLQVAGVR

SEQ ID NO: 152735 - protein, 8 aa, Mycobacterium tuberculosis
LQVAGVRV

SEQ ID NO: 152736 - protein, 8 aa, Mycobacterium tuberculosis
QVAGVRVA

SEQ ID NO: 152737 - protein, 8 aa, Mycobacterium tuberculosis
RVAAHTSH

SEQ ID NO: 152738 - protein, 8 aa, Mycobacterium tuberculosis
VAAHTSHR

SEQ ID NO: 152739 - protein, 8 aa, Mycobacterium tuberculosis
HRNYGHTL

SEQ ID NO: 152740 - protein, 8 aa, Mycobacterium tuberculosis
HTLDATGL

SEQ ID NO: 152741 - protein, 8 aa, Mycobacterium tuberculosis
TLDATGLA

SEQ ID NO: 152742 - protein, 8 aa, Mycobacterium tuberculosis
DATGLAEV

SEQ ID NO: 152743 - protein, 8 aa, Mycobacterium tuberculosis
GLAEVFAV

SEQ ID NO: 152744 - protein, 8 aa, Mycobacterium tuberculosis
LAEVFAVF

SEQ ID NO: 152745 - protein, 8 aa, Mycobacterium tuberculosis
AEVFAVFV

SEQ ID NO: 152746 - protein, 8 aa, Mycobacterium tuberculosis
FAVFVDGA

SEQ ID NO: 152747 - protein, 8 aa, Mycobacterium tuberculosis
AVFVDGAV

SEQ ID NO: 152748 - protein, 8 aa, Mycobacterium tuberculosis
FVDGAVTA

SEQ ID NO: 152749 - protein, 8 aa, Mycobacterium tuberculosis
DGAVTAEL

SEQ ID NO: 152750 - protein, 8 aa, Mycobacterium tuberculosis
AVTAELGL

SEQ ID NO: 152751 - protein, 8 aa, Mycobacterium tuberculosis
LPAEPNPA

SEQ ID NO: 152752 - protein, 8 aa, Mycobacterium tuberculosis
AEPNPAGL

SEQ ID NO: 152753 - protein, 8 aa, Mycobacterium tuberculosis
EPNPAGLI

SEQ ID NO: 152754 - protein, 8 aa, Mycobacterium tuberculosis
NPAGLIET

SEQ ID NO: 152755 - protein, 8 aa, Mycobacterium tuberculosis
ETAKRLGA

SEQ ID NO: 152756 - protein, 8 aa, Mycobacterium tuberculosis
RLGANPGR

SEQ ID NO: 152757 - protein, 8 aa, Mycobacterium tuberculosis
GANPGRCV

SEQ ID NO: 152758 - protein, 8 aa, Mycobacterium tuberculosis
NPGRCVVI

SEQ ID NO: 152759 - protein, 8 aa, Mycobacterium tuberculosis
DSCQTGLR

SEQ ID NO: 152760 - protein, 8 aa, Mycobacterium tuberculosis
QTGLRAGR

SEQ ID NO: 152761 - protein, 8 aa, Mycobacterium tuberculosis
GRNGGFAL

SEQ ID NO: 152762 - protein, 8 aa, Mycobacterium tuberculosis
GFALVIAV

SEQ ID NO: 152763 - protein, 8 aa, Mycobacterium tuberculosis
ALVIAVDA

SEQ ID NO: 152764 - protein, 8 aa, Mycobacterium tuberculosis
AHGDAENL

SEQ ID NO: 152765 - protein, 8 aa, Mycobacterium tuberculosis
AENLLSSG

SEQ ID NO: 152766 - protein, 8 aa, Mycobacterium tuberculosis
LLSSGADA

SEQ ID NO: 152767 - protein, 8 aa, Mycobacterium tuberculosis
LSSGADAV

SEQ ID NO: 152768 - protein, 8 aa, Mycobacterium tuberculosis
AVVADLAA

SEQ ID NO: 152769 - protein, 8 aa, Mycobacterium tuberculosis
VVADLAAV

SEQ ID NO: 152770 - protein, 8 aa, Mycobacterium tuberculosis
TIPDALQV

SEQ ID NO: 152771 - protein, 8 aa, Mycobacterium tuberculosis
IPDALQVY

SEQ ID NO: 152772 - protein, 8 aa, Mycobacterium tuberculosis
ALQVYSQL

SEQ ID NO: 152773 - protein, 8 aa, Mycobacterium tuberculosis
LQVYSQLK

SEQ ID NO: 152774 - protein, 8 aa, Mycobacterium tuberculosis
QVYSQLKR

SEQ ID NO: 152775 - protein, 8 aa, Mycobacterium tuberculosis
VYSQLKRL

SEQ ID NO: 152776 - protein, 8 aa, Mycobacterium tuberculosis
SQLKRLLT

SEQ ID NO: 152777 - protein, 8 aa, Mycobacterium tuberculosis
KRLLTGRR

SEQ ID NO: 152778 - protein, 8 aa, Mycobacterium tuberculosis
LLTGRRPA

SEQ ID NO: 152779 - protein, 8 aa, Mycobacterium tuberculosis
LTGRRPAV

SEQ ID NO: 152780 - protein, 8 aa, Mycobacterium tuberculosis
RPAVFLDF

SEQ ID NO: 152781 - protein, 8 aa, Mycobacterium tuberculosis
FLDFDGTL

SEQ ID NO: 152782 - protein, 8 aa, Mycobacterium tuberculosis
TLSDIVER

SEQ ID NO: 152783 - protein, 8 aa, Mycobacterium tuberculosis
RPEAATLV

SEQ ID NO: 152784 - protein, 8 aa, Mycobacterium tuberculosis
TLVDGAAE

SEQ ID NO: 152785 - protein, 8 aa, Mycobacterium tuberculosis
LVDGAAEA

SEQ ID NO: 152786 - protein, 8 aa, Mycobacterium tuberculosis
DGAAEALR

SEQ ID NO: 152787 - protein, 8 aa, Mycobacterium tuberculosis
AAEALRAL

SEQ ID NO: 152788 - protein, 8 aa, Mycobacterium tuberculosis
AEALRALA

SEQ ID NO: 152789 - protein, 8 aa, Mycobacterium tuberculosis
EALRALAA

SEQ ID NO: 152790 - protein, 8 aa, Mycobacterium tuberculosis
ALAAQCPV

SEQ ID NO: 152791 - protein, 8 aa, Mycobacterium tuberculosis
AAQCPVAV

SEQ ID NO: 152792 - protein, 8 aa, Mycobacterium tuberculosis
AQCPVAVI

SEQ ID NO: 152793 - protein, 8 aa, Mycobacterium tuberculosis
CPVAVISG

SEQ ID NO: 152794 - protein, 8 aa, Mycobacterium tuberculosis
PVAVISGR

SEQ ID NO: 152795 - protein, 8 aa, Mycobacterium tuberculosis
VISGRDLA

SEQ ID NO: 152796 - protein, 8 aa, Mycobacterium tuberculosis
DLADVRNR

SEQ ID NO: 152797 - protein, 8 aa, Mycobacterium tuberculosis
RVKVDGLW

SEQ ID NO: 152798 - protein, 8 aa, Mycobacterium tuberculosis
KVDGLWLA

SEQ ID NO: 152799 - protein, 8 aa, Mycobacterium tuberculosis
WLAGSHGF

SEQ ID NO: 152800 - protein, 8 aa, Mycobacterium tuberculosis
HQNAAATA

SEQ ID NO: 152801 - protein, 8 aa, Mycobacterium tuberculosis
NAAATAAI

SEQ ID NO: 152802 - protein, 8 aa, Mycobacterium tuberculosis
ATAAIDGL

SEQ ID NO: 152803 - protein, 8 aa, Mycobacterium tuberculosis
AIDGLAEA

SEQ ID NO: 152804 - protein, 8 aa, Mycobacterium tuberculosis
GLAEAAAQ

SEQ ID NO: 152805 - protein, 8 aa, Mycobacterium tuberculosis
AEAAAQLA

SEQ ID NO: 152806 - protein, 8 aa, Mycobacterium tuberculosis
AQLADALR

SEQ ID NO: 152807 - protein, 8 aa, Mycobacterium tuberculosis
ALREIAGA

SEQ ID NO: 152808 - protein, 8 aa, Mycobacterium tuberculosis
REIAGAVV

SEQ ID NO: 152809 - protein, 8 aa, Mycobacterium tuberculosis
GAVVEHKR

SEQ ID NO: 152810 - protein, 8 aa, Mycobacterium tuberculosis
AVVEHKRF

SEQ ID NO: 152811 - protein, 8 aa, Mycobacterium tuberculosis
KRFAVAVH

SEQ ID NO: 152812 - protein, 8 aa, Mycobacterium tuberculosis
RFAVAVHY

SEQ ID NO: 152813 - protein, 8 aa, Mycobacterium tuberculosis
FAVAVHYR

SEQ ID NO: 152814 - protein, 8 aa, Mycobacterium tuberculosis
SVDNLIAA

SEQ ID NO: 152815 - protein, 8 aa, Mycobacterium tuberculosis
NLIAAVRR

SEQ ID NO: 152816 - protein, 8 aa, Mycobacterium tuberculosis
LIAAVRRL

SEQ ID NO: 152817 - protein, 8 aa, Mycobacterium tuberculosis
AVRRLGHA

SEQ ID NO: 152818 - protein, 8 aa, Mycobacterium tuberculosis
RRLGHAAG

SEQ ID NO: 152819 - protein, 8 aa, Mycobacterium tuberculosis
RLGHAAGL

SEQ ID NO: 152820 - protein, 8 aa, Mycobacterium tuberculosis
GLRVTTGR

SEQ ID NO: 152821 - protein, 8 aa, Mycobacterium tuberculosis
RVTTGRKV

SEQ ID NO: 152822 - protein, 8 aa, Mycobacterium tuberculosis
VTTGRKVV

SEQ ID NO: 152823 - protein, 8 aa, Mycobacterium tuberculosis
DIAWDKGK

SEQ ID NO: 152824 - protein, 8 aa, Mycobacterium tuberculosis
EVGPDLRL

SEQ ID NO: 152825 - protein, 8 aa, Mycobacterium tuberculosis
GPDLRLPI

SEQ ID NO: 152826 - protein, 8 aa, Mycobacterium tuberculosis
DLRLPIYI

SEQ ID NO: 152827 - protein, 8 aa, Mycobacterium tuberculosis
LPIYIGDD

SEQ ID NO: 152828 - protein, 8 aa, Mycobacterium tuberculosis
DLTDEDAF

SEQ ID NO: 152829 - protein, 8 aa, Mycobacterium tuberculosis
EDAFDAVR

SEQ ID NO: 152830 - protein, 8 aa, Mycobacterium tuberculosis
DAFDAVRF

SEQ ID NO: 152831 - protein, 8 aa, Mycobacterium tuberculosis
DAVRFTGV

SEQ ID NO: 152832 - protein, 8 aa, Mycobacterium tuberculosis
FTGVGIVV

SEQ ID NO: 152833 - protein, 8 aa, Mycobacterium tuberculosis
TGVGIVVR

SEQ ID NO: 152834 - protein, 8 aa, Mycobacterium tuberculosis
RRSAATFR

SEQ ID NO: 152835 - protein, 8 aa, Mycobacterium tuberculosis
RSAATFRL

SEQ ID NO: 152836 - protein, 8 aa, Mycobacterium tuberculosis
TFRLECPY

SEQ ID NO: 152837 - protein, 8 aa, Mycobacterium tuberculosis
RLECPYTV

SEQ ID NO: 152838 - protein, 8 aa, Mycobacterium tuberculosis
CPYTVCQF

SEQ ID NO: 152839 - protein, 8 aa, Mycobacterium tuberculosis
PYTVCQFL

SEQ ID NO: 152840 - protein, 8 aa, Mycobacterium tuberculosis
YTVCQFLS

SEQ ID NO: 152841 - protein, 8 aa, Mycobacterium tuberculosis
CQFLSQLA

SEQ ID NO: 152842 - protein, 8 aa, Mycobacterium tuberculosis
QHDDPWTL

SEQ ID NO: 152843 - protein, 8 aa, Mycobacterium tuberculosis
HDDPWTLV

SEQ ID NO: 152844 - protein, 8 aa, Mycobacterium tuberculosis
DDPWTLVF

SEQ ID NO: 152845 - protein, 8 aa, Mycobacterium tuberculosis
DPWTLVFH

SEQ ID NO: 152846 - protein, 8 aa, Mycobacterium tuberculosis
WTLVFHGY

SEQ ID NO: 152847 - protein, 8 aa, Mycobacterium tuberculosis
QERLREAL

SEQ ID NO: 152848 - protein, 8 aa, Mycobacterium tuberculosis
RLREALCA

SEQ ID NO: 152849 - protein, 8 aa, Mycobacterium tuberculosis
YLGSRGCA

SEQ ID NO: 152850 - protein, 8 aa, Mycobacterium tuberculosis
SAESEAHY

SEQ ID NO: 152851 - protein, 8 aa, Mycobacterium tuberculosis
EAHYPGTY

SEQ ID NO: 152852 - protein, 8 aa, Mycobacterium tuberculosis
AHYPGTYV

SEQ ID NO: 152853 - protein, 8 aa, Mycobacterium tuberculosis
YPGTYVAG

SEQ ID NO: 152854 - protein, 8 aa, Mycobacterium tuberculosis
GTYVAGVY

SEQ ID NO: 152855 - protein, 8 aa, Mycobacterium tuberculosis
YVAGVYNQ

SEQ ID NO: 152856 - protein, 8 aa, Mycobacterium tuberculosis
QLTDHIEG

SEQ ID NO: 152857 - protein, 8 aa, Mycobacterium tuberculosis
CTVDNESL

SEQ ID NO: 152858 - protein, 8 aa, Mycobacterium tuberculosis
TVDNESLV

SEQ ID NO: 152859 - protein, 8 aa, Mycobacterium tuberculosis
SLVNLPNW

SEQ ID NO: 152860 - protein, 8 aa, Mycobacterium tuberculosis
LVNLPNWL

SEQ ID NO: 152861 - protein, 8 aa, Mycobacterium tuberculosis
NLPNWLSL

SEQ ID NO: 152862 - protein, 8 aa, Mycobacterium tuberculosis
LPNWLSLT

SEQ ID NO: 152863 - protein, 8 aa, Mycobacterium tuberculosis
NWLSLTFR

SEQ ID NO: 152864 - protein, 8 aa, Mycobacterium tuberculosis
WLSLTFRI

SEQ ID NO: 152865 - protein, 8 aa, Mycobacterium tuberculosis
RIDGGAWF

SEQ ID NO: 152866 - protein, 8 aa, Mycobacterium tuberculosis
DGGAWFNV

SEQ ID NO: 152867 - protein, 8 aa, Mycobacterium tuberculosis
FNVDTVEL

SEQ ID NO: 152868 - protein, 8 aa, Mycobacterium tuberculosis
NVDTVELL

SEQ ID NO: 152869 - protein, 8 aa, Mycobacterium tuberculosis
DTVELLSY

SEQ ID NO: 152870 - protein, 8 aa, Mycobacterium tuberculosis
TVELLSYR

SEQ ID NO: 152871 - protein, 8 aa, Mycobacterium tuberculosis
ELLSYRQT

SEQ ID NO: 152872 - protein, 8 aa, Mycobacterium tuberculosis
LLSYRQTF

SEQ ID NO: 152873 - protein, 8 aa, Mycobacterium tuberculosis
SYRQTFDL

SEQ ID NO: 152874 - protein, 8 aa, Mycobacterium tuberculosis
RQTFDLRR

SEQ ID NO: 152875 - protein, 8 aa, Mycobacterium tuberculosis
QTFDLRRA

SEQ ID NO: 152876 - protein, 8 aa, Mycobacterium tuberculosis
FDLRRATL

SEQ ID NO: 152877 - protein, 8 aa, Mycobacterium tuberculosis
RRATLTRS

SEQ ID NO: 152878 - protein, 8 aa, Mycobacterium tuberculosis
RATLTRSL

SEQ ID NO: 152879 - protein, 8 aa, Mycobacterium tuberculosis
ATLTRSLR

SEQ ID NO: 152880 - protein, 8 aa, Mycobacterium tuberculosis
LTRSLRFR

SEQ ID NO: 152881 - protein, 8 aa, Mycobacterium tuberculosis
RFRDAGGR

SEQ ID NO: 152882 - protein, 8 aa, Mycobacterium tuberculosis
VTTMTQER

SEQ ID NO: 152883 - protein, 8 aa, Mycobacterium tuberculosis
TTMTQERF

SEQ ID NO: 152884 - protein, 8 aa, Mycobacterium tuberculosis
TMTQERFA

SEQ ID NO: 152885 - protein, 8 aa, Mycobacterium tuberculosis
ERFASMNR

SEQ ID NO: 152886 - protein, 8 aa, Mycobacterium tuberculosis
SMNRPNLV

SEQ ID NO: 152887 - protein, 8 aa, Mycobacterium tuberculosis
NLVALQTR

SEQ ID NO: 152888 - protein, 8 aa, Mycobacterium tuberculosis
LVALQTRI

SEQ ID NO: 152889 - protein, 8 aa, Mycobacterium tuberculosis
SENWSGTV

SEQ ID NO: 152890 - protein, 8 aa, Mycobacterium tuberculosis
NWSGTVDF

SEQ ID NO: 152891 - protein, 8 aa, Mycobacterium tuberculosis
WSGTVDFR

SEQ ID NO: 152892 - protein, 8 aa, Mycobacterium tuberculosis
GTVDFRSL

SEQ ID NO: 152893 - protein, 8 aa, Mycobacterium tuberculosis
TVDFRSLV

SEQ ID NO: 152894 - protein, 8 aa, Mycobacterium tuberculosis
NTLVDRYR

SEQ ID NO: 152895 - protein, 8 aa, Mycobacterium tuberculosis
TLVDRYRQ

SEQ ID NO: 152896 - protein, 8 aa, Mycobacterium tuberculosis
LVDRYRQL

SEQ ID NO: 152897 - protein, 8 aa, Mycobacterium tuberculosis
RQLSSQHL

SEQ ID NO: 152898 - protein, 8 aa, Mycobacterium tuberculosis
QLSSQHLT

SEQ ID NO: 152899 - protein, 8 aa, Mycobacterium tuberculosis
LTTAEIEV

SEQ ID NO: 152900 - protein, 8 aa, Mycobacterium tuberculosis
TTAEIEVL

SEQ ID NO: 152901 - protein, 8 aa, Mycobacterium tuberculosis
AEIEVLAD

SEQ ID NO: 152902 - protein, 8 aa, Mycobacterium tuberculosis
EVLADSVL

SEQ ID NO: 152903 - protein, 8 aa, Mycobacterium tuberculosis
VLADSVLL

SEQ ID NO: 152904 - protein, 8 aa, Mycobacterium tuberculosis
LADSVLLR

SEQ ID NO: 152905 - protein, 8 aa, Mycobacterium tuberculosis
VLLRTQTS

SEQ ID NO: 152906 - protein, 8 aa, Mycobacterium tuberculosis
LLRTQTSQ

SEQ ID NO: 152907 - protein, 8 aa, Mycobacterium tuberculosis
SQSGIAIA

SEQ ID NO: 152908 - protein, 8 aa, Mycobacterium tuberculosis
SGIAIAVA

SEQ ID NO: 152909 - protein, 8 aa, Mycobacterium tuberculosis
GIAIAVAA

SEQ ID NO: 152910 - protein, 8 aa, Mycobacterium tuberculosis
IAIAVAAR

SEQ ID NO: 152911 - protein, 8 aa, Mycobacterium tuberculosis
AVAARSTL

SEQ ID NO: 152912 - protein, 8 aa, Mycobacterium tuberculosis
VAARSTLW

SEQ ID NO: 152913 - protein, 8 aa, Mycobacterium tuberculosis
AARSTLWR

SEQ ID NO: 152914 - protein, 8 aa, Mycobacterium tuberculosis
TLWRDGQR

SEQ ID NO: 152915 - protein, 8 aa, Mycobacterium tuberculosis
GQRVDAQY

SEQ ID NO: 152916 - protein, 8 aa, Mycobacterium tuberculosis
RVDAQYRV

SEQ ID NO: 152917 - protein, 8 aa, Mycobacterium tuberculosis
DAQYRVAR

SEQ ID NO: 152918 - protein, 8 aa, Mycobacterium tuberculosis
RVARDTNR

SEQ ID NO: 152919 - protein, 8 aa, Mycobacterium tuberculosis
GHDIQVTL

SEQ ID NO: 152920 - protein, 8 aa, Mycobacterium tuberculosis
TLSAGQSV

SEQ ID NO: 152921 - protein, 8 aa, Mycobacterium tuberculosis
GQSVTLEK

SEQ ID NO: 152922 - protein, 8 aa, Mycobacterium tuberculosis
QSVTLEKV

SEQ ID NO: 152923 - protein, 8 aa, Mycobacterium tuberculosis
TLEKVATI

SEQ ID NO: 152924 - protein, 8 aa, Mycobacterium tuberculosis
LEKVATIF

SEQ ID NO: 152925 - protein, 8 aa, Mycobacterium tuberculosis
VATIFTSR

SEQ ID NO: 152926 - protein, 8 aa, Mycobacterium tuberculosis
DAATLTAA

SEQ ID NO: 152927 - protein, 8 aa, Mycobacterium tuberculosis
TLTAAISA

SEQ ID NO: 152928 - protein, 8 aa, Mycobacterium tuberculosis
LTAAISAQ

SEQ ID NO: 152929 - protein, 8 aa, Mycobacterium tuberculosis
TAAISAQR

SEQ ID NO: 152930 - protein, 8 aa, Mycobacterium tuberculosis
AQRCLGEA

SEQ ID NO: 152931 - protein, 8 aa, Mycobacterium tuberculosis
AELCQQHV

SEQ ID NO: 152932 - protein, 8 aa, Mycobacterium tuberculosis
ELCQQHVR

SEQ ID NO: 152933 - protein, 8 aa, Mycobacterium tuberculosis
HVRAWARL

SEQ ID NO: 152934 - protein, 8 aa, Mycobacterium tuberculosis
AWARLWER

SEQ ID NO: 152935 - protein, 8 aa, Mycobacterium tuberculosis
RLWERCAI

SEQ ID NO: 152936 - protein, 8 aa, Mycobacterium tuberculosis
WERCAIDL

SEQ ID NO: 152937 - protein, 8 aa, Mycobacterium tuberculosis
TGNTEELR

SEQ ID NO: 152938 - protein, 8 aa, Mycobacterium tuberculosis
NTEELRLV

SEQ ID NO: 152939 - protein, 8 aa, Mycobacterium tuberculosis
EELRLVRL

SEQ ID NO: 152940 - protein, 8 aa, Mycobacterium tuberculosis
RLVRLHLL

SEQ ID NO: 152941 - protein, 8 aa, Mycobacterium tuberculosis
RLHLLHLL

SEQ ID NO: 152942 - protein, 8 aa, Mycobacterium tuberculosis
HLLHLLQT

SEQ ID NO: 152943 - protein, 8 aa, Mycobacterium tuberculosis
LLHLLQTI

SEQ ID NO: 152944 - protein, 8 aa, Mycobacterium tuberculosis
QTISPHTA

SEQ ID NO: 152945 - protein, 8 aa, Mycobacterium tuberculosis
ELDAGVPA

SEQ ID NO: 152946 - protein, 8 aa, Mycobacterium tuberculosis
GLNGEAYR

SEQ ID NO: 152947 - protein, 8 aa, Mycobacterium tuberculosis
EAYRGHVF

SEQ ID NO: 152948 - protein, 8 aa, Mycobacterium tuberculosis
AYRGHVFW

SEQ ID NO: 152949 - protein, 8 aa, Mycobacterium tuberculosis
HVFWDALF

SEQ ID NO: 152950 - protein, 8 aa, Mycobacterium tuberculosis
VFWDALFV

SEQ ID NO: 152951 - protein, 8 aa, Mycobacterium tuberculosis
FWDALFVA

SEQ ID NO: 152952 - protein, 8 aa, Mycobacterium tuberculosis
DALFVAPV

SEQ ID NO: 152953 - protein, 8 aa, Mycobacterium tuberculosis
ALFVAPVL

SEQ ID NO: 152954 - protein, 8 aa, Mycobacterium tuberculosis
FVAPVLSL

SEQ ID NO: 152955 - protein, 8 aa, Mycobacterium tuberculosis
VAPVLSLR

SEQ ID NO: 152956 - protein, 8 aa, Mycobacterium tuberculosis
APVLSLRM

SEQ ID NO: 152957 - protein, 8 aa, Mycobacterium tuberculosis
VLSLRMPK

SEQ ID NO: 152958 - protein, 8 aa, Mycobacterium tuberculosis
MPKVARSL

SEQ ID NO: 152959 - protein, 8 aa, Mycobacterium tuberculosis
SLLDYRYR

SEQ ID NO: 152960 - protein, 8 aa, Mycobacterium tuberculosis
LLDYRYRR

SEQ ID NO: 152961 - protein, 8 aa, Mycobacterium tuberculosis
YRYRRLPA

SEQ ID NO: 152962 - protein, 8 aa, Mycobacterium tuberculosis
RYRRLPAA

SEQ ID NO: 152963 - protein, 8 aa, Mycobacterium tuberculosis
YRRLPAAR

SEQ ID NO: 152964 - protein, 8 aa, Mycobacterium tuberculosis
RRLPAARR

SEQ ID NO: 152965 - protein, 8 aa, Mycobacterium tuberculosis
RLPAARRA

SEQ ID NO: 152966 - protein, 8 aa, Mycobacterium tuberculosis
LPAARRAA

SEQ ID NO: 152967 - protein, 8 aa, Mycobacterium tuberculosis
AARRAAHR

SEQ ID NO: 152968 - protein, 8 aa, Mycobacterium tuberculosis
RAGHLGAM

SEQ ID NO: 152969 - protein, 8 aa, Mycobacterium tuberculosis
HLGAMYPW

SEQ ID NO: 152970 - protein, 8 aa, Mycobacterium tuberculosis
AMYPWQSG

SEQ ID NO: 152971 - protein, 8 aa, Mycobacterium tuberculosis
YPWQSGSD

SEQ ID NO: 152972 - protein, 8 aa, Mycobacterium tuberculosis
SGSDGSEV

SEQ ID NO: 152973 - protein, 8 aa, Mycobacterium tuberculosis
EVSQQLHL

SEQ ID NO: 152974 - protein, 8 aa, Mycobacterium tuberculosis
QQLHLNPR

SEQ ID NO: 152975 - protein, 8 aa, Mycobacterium tuberculosis
HLNPRSGR

SEQ ID NO: 152976 - protein, 8 aa, Mycobacterium tuberculosis
NPRSGRWT

SEQ ID NO: 152977 - protein, 8 aa, Mycobacterium tuberculosis
WTPDPSDR

SEQ ID NO: 152978 - protein, 8 aa, Mycobacterium tuberculosis
HVGLAVAY

SEQ ID NO: 152979 - protein, 8 aa, Mycobacterium tuberculosis
GLAVAYNA

SEQ ID NO: 152980 - protein, 8 aa, Mycobacterium tuberculosis
LAVAYNAW

SEQ ID NO: 152981 - protein, 8 aa, Mycobacterium tuberculosis
VAYNAWHY

SEQ ID NO: 152982 - protein, 8 aa, Mycobacterium tuberculosis
AYNAWHYY

SEQ ID NO: 152983 - protein, 8 aa, Mycobacterium tuberculosis
NAWHYYQV

SEQ ID NO: 152984 - protein, 8 aa, Mycobacterium tuberculosis
YYQVTGDR

SEQ ID NO: 152985 - protein, 8 aa, Mycobacterium tuberculosis
QVTGDRQY

SEQ ID NO: 152986 - protein, 8 aa, Mycobacterium tuberculosis
VTGDRQYL

SEQ ID NO: 152987 - protein, 8 aa, Mycobacterium tuberculosis
TGDRQYLV

SEQ ID NO: 152988 - protein, 8 aa, Mycobacterium tuberculosis
YLVDCGAE

SEQ ID NO: 152989 - protein, 8 aa, Mycobacterium tuberculosis
LVDCGAEL

SEQ ID NO: 152990 - protein, 8 aa, Mycobacterium tuberculosis
AELLVEIA

SEQ ID NO: 152991 - protein, 8 aa, Mycobacterium tuberculosis
ELLVEIAR

SEQ ID NO: 152992 - protein, 8 aa, Mycobacterium tuberculosis
LLVEIARF

SEQ ID NO: 152993 - protein, 8 aa, Mycobacterium tuberculosis
VEIARFWV

SEQ ID NO: 152994 - protein, 8 aa, Mycobacterium tuberculosis
RFWVGLAK

SEQ ID NO: 152995 - protein, 8 aa, Mycobacterium tuberculosis
LAKLDDSR

SEQ ID NO: 152996 - protein, 8 aa, Mycobacterium tuberculosis
KLDDSRGR

SEQ ID NO: 152997 - protein, 8 aa, Mycobacterium tuberculosis
GRYLIRGV

SEQ ID NO: 152998 - protein, 8 aa, Mycobacterium tuberculosis
RYLIRGVI

SEQ ID NO: 152999 - protein, 8 aa, Mycobacterium tuberculosis
GVIGPDEF

SEQ ID NO: 153000 - protein, 8 aa, Mycobacterium tuberculosis
SGYPGNEY

SEQ ID NO: 153001 - protein, 8 aa, Mycobacterium tuberculosis
DGIDNNAY

SEQ ID NO: 153002 - protein, 8 aa, Mycobacterium tuberculosis
NAYTNVMA

SEQ ID NO: 153003 - protein, 8 aa, Mycobacterium tuberculosis
AYTNVMAV

SEQ ID NO: 153004 - protein, 8 aa, Mycobacterium tuberculosis
YTNVMAVW

SEQ ID NO: 153005 - protein, 8 aa, Mycobacterium tuberculosis
NVMAVWVI

SEQ ID NO: 153006 - protein, 8 aa, Mycobacterium tuberculosis
VMAVWVIL

SEQ ID NO: 153007 - protein, 8 aa, Mycobacterium tuberculosis
MAVWVILR

SEQ ID NO: 153008 - protein, 8 aa, Mycobacterium tuberculosis
AVWVILRA

SEQ ID NO: 153009 - protein, 8 aa, Mycobacterium tuberculosis
VILRAMEA

SEQ ID NO: 153010 - protein, 8 aa, Mycobacterium tuberculosis
ILRAMEAL

SEQ ID NO: 153011 - protein, 8 aa, Mycobacterium tuberculosis
RAMEALDL

SEQ ID NO: 153012 - protein, 8 aa, Mycobacterium tuberculosis
AMEALDLL

SEQ ID NO: 153013 - protein, 8 aa, Mycobacterium tuberculosis
EALDLLPL

SEQ ID NO: 153014 - protein, 8 aa, Mycobacterium tuberculosis
ALDLLPLT

SEQ ID NO: 153015 - protein, 8 aa, Mycobacterium tuberculosis
DLLPLTDR

SEQ ID NO: 153016 - protein, 8 aa, Mycobacterium tuberculosis
PLTDRRHL

SEQ ID NO: 153017 - protein, 8 aa, Mycobacterium tuberculosis
RRHLIEKL

SEQ ID NO: 153018 - protein, 8 aa, Mycobacterium tuberculosis
HLIEKLGL

SEQ ID NO: 153019 - protein, 8 aa, Mycobacterium tuberculosis
TTQERDQW

SEQ ID NO: 153020 - protein, 8 aa, Mycobacterium tuberculosis
DQWDDVSR

SEQ ID NO: 153021 - protein, 8 aa, Mycobacterium tuberculosis
DVSRRMFV

SEQ ID NO: 153022 - protein, 8 aa, Mycobacterium tuberculosis
SRRMFVPF

SEQ ID NO: 153023 - protein, 8 aa, Mycobacterium tuberculosis
RRMFVPFH

SEQ ID NO: 153024 - protein, 8 aa, Mycobacterium tuberculosis
FVPFHDGV

SEQ ID NO: 153025 - protein, 8 aa, Mycobacterium tuberculosis
VPFHDGVI

SEQ ID NO: 153026 - protein, 8 aa, Mycobacterium tuberculosis
VISQFEGY

SEQ ID NO: 153027 - protein, 8 aa, Mycobacterium tuberculosis
SQFEGYSE

SEQ ID NO: 153028 - protein, 8 aa, Mycobacterium tuberculosis
GYSELAEL

SEQ ID NO: 153029 - protein, 8 aa, Mycobacterium tuberculosis
SELAELDW

SEQ ID NO: 153030 - protein, 8 aa, Mycobacterium tuberculosis
AELDWDHY

SEQ ID NO: 153031 - protein, 8 aa, Mycobacterium tuberculosis
ELDWDHYR

SEQ ID NO: 153032 - protein, 8 aa, Mycobacterium tuberculosis
DWDHYRHR

SEQ ID NO: 153033 - protein, 8 aa, Mycobacterium tuberculosis
HRYGNIQR

SEQ ID NO: 153034 - protein, 8 aa, Mycobacterium tuberculosis
RYGNIQRL

SEQ ID NO: 153035 - protein, 8 aa, Mycobacterium tuberculosis
IQRLDRIL

SEQ ID NO: 153036 - protein, 8 aa, Mycobacterium tuberculosis
RLDRILEA

SEQ ID NO: 153037 - protein, 8 aa, Mycobacterium tuberculosis
KQADALML

SEQ ID NO: 153038 - protein, 8 aa, Mycobacterium tuberculosis
QADALMLL

SEQ ID NO: 153039 - protein, 8 aa, Mycobacterium tuberculosis
DALMLLYL

SEQ ID NO: 153040 - protein, 8 aa, Mycobacterium tuberculosis
ALMLLYLL

SEQ ID NO: 153041 - protein, 8 aa, Mycobacterium tuberculosis
MLLYLLSS

SEQ ID NO: 153042 - protein, 8 aa, Mycobacterium tuberculosis
YLLSSDEL

SEQ ID NO: 153043 - protein, 8 aa, Mycobacterium tuberculosis
LLSSDELI

SEQ ID NO: 153044 - protein, 8 aa, Mycobacterium tuberculosis
SSDELIGL

SEQ ID NO: 153045 - protein, 8 aa, Mycobacterium tuberculosis
ELIGLLAR

SEQ ID NO: 153046 - protein, 8 aa, Mycobacterium tuberculosis
LIGLLARL

SEQ ID NO: 153047 - protein, 8 aa, Mycobacterium tuberculosis
GLLARLGY

SEQ ID NO: 153048 - protein, 8 aa, Mycobacterium tuberculosis
LLARLGYR

SEQ ID NO: 153049 - protein, 8 aa, Mycobacterium tuberculosis
YRFAPTQI

SEQ ID NO: 153050 - protein, 8 aa, Mycobacterium tuberculosis
APTQIPGT

SEQ ID NO: 153051 - protein, 8 aa, Mycobacterium tuberculosis
QIPGTVDY

SEQ ID NO: 153052 - protein, 8 aa, Mycobacterium tuberculosis
IPGTVDYY

SEQ ID NO: 153053 - protein, 8 aa, Mycobacterium tuberculosis
GTVDYYLA

SEQ ID NO: 153054 - protein, 8 aa, Mycobacterium tuberculosis
TVDYYLAR

SEQ ID NO: 153055 - protein, 8 aa, Mycobacterium tuberculosis
RTSDGSTL

SEQ ID NO: 153056 - protein, 8 aa, Mycobacterium tuberculosis
DGSTLSAV

SEQ ID NO: 153057 - protein, 8 aa, Mycobacterium tuberculosis
TLSAVVHA

SEQ ID NO: 153058 - protein, 8 aa, Mycobacterium tuberculosis
LSAVVHAW

SEQ ID NO: 153059 - protein, 8 aa, Mycobacterium tuberculosis
SAVVHAWV

SEQ ID NO: 153060 - protein, 8 aa, Mycobacterium tuberculosis
AVVHAWVL

SEQ ID NO: 153061 - protein, 8 aa, Mycobacterium tuberculosis
VVHAWVLA

SEQ ID NO: 153062 - protein, 8 aa, Mycobacterium tuberculosis
HAWVLARA

SEQ ID NO: 153063 - protein, 8 aa, Mycobacterium tuberculosis
WVLARANR

SEQ ID NO: 153064 - protein, 8 aa, Mycobacterium tuberculosis
RANRSNAM

SEQ ID NO: 153065 - protein, 8 aa, Mycobacterium tuberculosis
RSNAMEYF

SEQ ID NO: 153066 - protein, 8 aa, Mycobacterium tuberculosis
SNAMEYFR

SEQ ID NO: 153067 - protein, 8 aa, Mycobacterium tuberculosis
AMEYFRQV

SEQ ID NO: 153068 - protein, 8 aa, Mycobacterium tuberculosis
MEYFRQVL

SEQ ID NO: 153069 - protein, 8 aa, Mycobacterium tuberculosis
EYFRQVLR

SEQ ID NO: 153070 - protein, 8 aa, Mycobacterium tuberculosis
RQVLRSDI

SEQ ID NO: 153071 - protein, 8 aa, Mycobacterium tuberculosis
TTQEGIHL

SEQ ID NO: 153072 - protein, 8 aa, Mycobacterium tuberculosis
TQEGIHLA

SEQ ID NO: 153073 - protein, 8 aa, Mycobacterium tuberculosis
EGIHLAAM

SEQ ID NO: 153074 - protein, 8 aa, Mycobacterium tuberculosis
HLAAMAGS

SEQ ID NO: 153075 - protein, 8 aa, Mycobacterium tuberculosis
LAAMAGSI

SEQ ID NO: 153076 - protein, 8 aa, Mycobacterium tuberculosis
AMAGSIDL

SEQ ID NO: 153077 - protein, 8 aa, Mycobacterium tuberculosis
MAGSIDLL

SEQ ID NO: 153078 - protein, 8 aa, Mycobacterium tuberculosis
GSIDLLQR

SEQ ID NO: 153079 - protein, 8 aa, Mycobacterium tuberculosis
SIDLLQRC

SEQ ID NO: 153080 - protein, 8 aa, Mycobacterium tuberculosis
LQRCYSGL

SEQ ID NO: 153081 - protein, 8 aa, Mycobacterium tuberculosis
RCYSGLEL

SEQ ID NO: 153082 - protein, 8 aa, Mycobacterium tuberculosis
CYSGLELR

SEQ ID NO: 153083 - protein, 8 aa, Mycobacterium tuberculosis
ELRDDRLV

SEQ ID NO: 153084 - protein, 8 aa, Mycobacterium tuberculosis
LRDDRLVL

SEQ ID NO: 153085 - protein, 8 aa, Mycobacterium tuberculosis
RLVLSPQW

SEQ ID NO: 153086 - protein, 8 aa, Mycobacterium tuberculosis
VLSPQWPE

SEQ ID NO: 153087 - protein, 8 aa, Mycobacterium tuberculosis
SPQWPEAL

SEQ ID NO: 153088 - protein, 8 aa, Mycobacterium tuberculosis
WPEALGPL

SEQ ID NO: 153089 - protein, 8 aa, Mycobacterium tuberculosis
EALGPLEF

SEQ ID NO: 153090 - protein, 8 aa, Mycobacterium tuberculosis
GPLEFPFV

SEQ ID NO: 153091 - protein, 8 aa, Mycobacterium tuberculosis
PLEFPFVY

SEQ ID NO: 153092 - protein, 8 aa, Mycobacterium tuberculosis
LEFPFVYR

SEQ ID NO: 153093 - protein, 8 aa, Mycobacterium tuberculosis
EFPFVYRR

SEQ ID NO: 153094 - protein, 8 aa, Mycobacterium tuberculosis
FPFVYRRH

SEQ ID NO: 153095 - protein, 8 aa, Mycobacterium tuberculosis
FVYRRHQL

SEQ ID NO: 153096 - protein, 8 aa, Mycobacterium tuberculosis
YRRHQLSL

SEQ ID NO: 153097 - protein, 8 aa, Mycobacterium tuberculosis
RRHQLSLR

SEQ ID NO: 153098 - protein, 8 aa, Mycobacterium tuberculosis
LSLRISGR

SEQ ID NO: 153099 - protein, 8 aa, Mycobacterium tuberculosis
EPIEVECR

SEQ ID NO: 153100 - protein, 8 aa, Mycobacterium tuberculosis
EVECRGHV

SEQ ID NO: 153101 - protein, 8 aa, Mycobacterium tuberculosis
ECRGHVQR

SEQ ID NO: 153102 - protein, 8 aa, Mycobacterium tuberculosis
RGHVQRLR

SEQ ID NO: 153103 - protein, 8 aa, Mycobacterium tuberculosis
RLRCGHTI

SEQ ID NO: 153104 - protein, 8 aa, Mycobacterium tuberculosis
RCGHTIEV

SEQ ID NO: 153105 - protein, 8 aa, Mycobacterium tuberculosis
TIEVGCSR

SEQ ID NO: 153106 - protein, 9 aa, Mycobacterium tuberculosis
MRCGIVVNV

SEQ ID NO: 153107 - protein, 9 aa, Mycobacterium tuberculosis
NVTGPPPTI

SEQ ID NO: 153108 - protein, 9 aa, Mycobacterium tuberculosis
RRYHDAVIV

SEQ ID NO: 153109 - protein, 9 aa, Mycobacterium tuberculosis
YHDAVIVGL

SEQ ID NO: 153110 - protein, 9 aa, Mycobacterium tuberculosis
AVIVGLDNV

SEQ ID NO: 153111 - protein, 9 aa, Mycobacterium tuberculosis
VIVGLDNVV

SEQ ID NO: 153112 - protein, 9 aa, Mycobacterium tuberculosis
GLDNVVDKA

SEQ ID NO: 153113 - protein, 9 aa, Mycobacterium tuberculosis
NVVDKATRV

SEQ ID NO: 153114 - protein, 9 aa, Mycobacterium tuberculosis
ATRVHAAAW

SEQ ID NO: 153115 - protein, 9 aa, Mycobacterium tuberculosis
RVHAAAWTK

SEQ ID NO: 153116 - protein, 9 aa, Mycobacterium tuberculosis
HAAAWTKFL

SEQ ID NO: 153117 - protein, 9 aa, Mycobacterium tuberculosis
WTKFLDDYL

SEQ ID NO: 153118 - protein, 9 aa, Mycobacterium tuberculosis
KFLDDYLTR

SEQ ID NO: 153119 - protein, 9 aa, Mycobacterium tuberculosis
FLDDYLTRR

SEQ ID NO: 153120 - protein, 9 aa, Mycobacterium tuberculosis
DYLTRRPQR

SEQ ID NO: 153121 - protein, 9 aa, Mycobacterium tuberculosis
YLTRRPQRT

SEQ ID NO: 153122 - protein, 9 aa, Mycobacterium tuberculosis
RTGEDHCPL

SEQ ID NO: 153123 - protein, 9 aa, Mycobacterium tuberculosis
LTHDDYRRF

SEQ ID NO: 153124 - protein, 9 aa, Mycobacterium tuberculosis
THDDYRRFL

SEQ ID NO: 153125 - protein, 9 aa, Mycobacterium tuberculosis
DYRRFLAGK

SEQ ID NO: 153126 - protein, 9 aa, Mycobacterium tuberculosis
FLAGKPDGV

SEQ ID NO: 153127 - protein, 9 aa, Mycobacterium tuberculosis
GVADFLAAR

SEQ ID NO: 153128 - protein, 9 aa, Mycobacterium tuberculosis
DFLAARGIR

SEQ ID NO: 153129 - protein, 9 aa, Mycobacterium tuberculosis
FLAARGIRL

SEQ ID NO: 153130 - protein, 9 aa, Mycobacterium tuberculosis
AARGIRLPP

SEQ ID NO: 153131 - protein, 9 aa, Mycobacterium tuberculosis
RLPPGSPTD

SEQ ID NO: 153132 - protein, 9 aa, Mycobacterium tuberculosis
LPPGSPTDL

SEQ ID NO: 153133 - protein, 9 aa, Mycobacterium tuberculosis
TDLTDDTVY

SEQ ID NO: 153134 - protein, 9 aa, Mycobacterium tuberculosis
DLTDDTVYG

SEQ ID NO: 153135 - protein, 9 aa, Mycobacterium tuberculosis
LTDDTVYGL

SEQ ID NO: 153136 - protein, 9 aa, Mycobacterium tuberculosis
DTVYGLQNL

SEQ ID NO: 153137 - protein, 9 aa, Mycobacterium tuberculosis
TVYGLQNLE

SEQ ID NO: 153138 - protein, 9 aa, Mycobacterium tuberculosis
VYGLQNLER

SEQ ID NO: 153139 - protein, 9 aa, Mycobacterium tuberculosis
LQNLERQTF

SEQ ID NO: 153140 - protein, 9 aa, Mycobacterium tuberculosis
LERQTFLQL

SEQ ID NO: 153141 - protein, 9 aa, Mycobacterium tuberculosis
FLQLLNTGV

SEQ ID NO: 153142 - protein, 9 aa, Mycobacterium tuberculosis
KSIASFARR

SEQ ID NO: 153143 - protein, 9 aa, Mycobacterium tuberculosis
SIASFARRL

SEQ ID NO: 153144 - protein, 9 aa, Mycobacterium tuberculosis
RRLQVAGVR

SEQ ID NO: 153145 - protein, 9 aa, Mycobacterium tuberculosis
RLQVAGVRV

SEQ ID NO: 153146 - protein, 9 aa, Mycobacterium tuberculosis
LQVAGVRVA

SEQ ID NO: 153147 - protein, 9 aa, Mycobacterium tuberculosis
QVAGVRVAA

SEQ ID NO: 153148 - protein, 9 aa, Mycobacterium tuberculosis
RVAAHTSHR

SEQ ID NO: 153149 - protein, 9 aa, Mycobacterium tuberculosis
SHRNYGHTL

SEQ ID NO: 153150 - protein, 9 aa, Mycobacterium tuberculosis
HTLDATGLA

SEQ ID NO: 153151 - protein, 9 aa, Mycobacterium tuberculosis
LDATGLAEV

SEQ ID NO: 153152 - protein, 9 aa, Mycobacterium tuberculosis
DATGLAEVF

SEQ ID NO: 153153 - protein, 9 aa, Mycobacterium tuberculosis
TGLAEVFAV

SEQ ID NO: 153154 - protein, 9 aa, Mycobacterium tuberculosis
GLAEVFAVF

SEQ ID NO: 153155 - protein, 9 aa, Mycobacterium tuberculosis
LAEVFAVFV

SEQ ID NO: 153156 - protein, 9 aa, Mycobacterium tuberculosis
FAVFVDGAV

SEQ ID NO: 153157 - protein, 9 aa, Mycobacterium tuberculosis
VFVDGAVTA

SEQ ID NO: 153158 - protein, 9 aa, Mycobacterium tuberculosis
VTAELGLPA

SEQ ID NO: 153159 - protein, 9 aa, Mycobacterium tuberculosis
GLPAEPNPA

SEQ ID NO: 153160 - protein, 9 aa, Mycobacterium tuberculosis
LPAEPNPAG

SEQ ID NO: 153161 - protein, 9 aa, Mycobacterium tuberculosis
EPNPAGLIE

SEQ ID NO: 153162 - protein, 9 aa, Mycobacterium tuberculosis
NPAGLIETA

SEQ ID NO: 153163 - protein, 9 aa, Mycobacterium tuberculosis
GLIETAKRL

SEQ ID NO: 153164 - protein, 9 aa, Mycobacterium tuberculosis
ETAKRLGAN

SEQ ID NO: 153165 - protein, 9 aa, Mycobacterium tuberculosis
KRLGANPGR

SEQ ID NO: 153166 - protein, 9 aa, Mycobacterium tuberculosis
GANPGRCVV

SEQ ID NO: 153167 - protein, 9 aa, Mycobacterium tuberculosis
VIDSCQTGL

SEQ ID NO: 153168 - protein, 9 aa, Mycobacterium tuberculosis
CQTGLRAGR

SEQ ID NO: 153169 - protein, 9 aa, Mycobacterium tuberculosis
LRAGRNGGF

SEQ ID NO: 153170 - protein, 9 aa, Mycobacterium tuberculosis
AGRNGGFAL

SEQ ID NO: 153171 - protein, 9 aa, Mycobacterium tuberculosis
GRNGGFALV

SEQ ID NO: 153172 - protein, 9 aa, Mycobacterium tuberculosis
GGFALVIAV

SEQ ID NO: 153173 - protein, 9 aa, Mycobacterium tuberculosis
FALVIAVDA

SEQ ID NO: 153174 - protein, 9 aa, Mycobacterium tuberculosis
AHGDAENLL

SEQ ID NO: 153175 - protein, 9 aa, Mycobacterium tuberculosis
AENLLSSGA

SEQ ID NO: 153176 - protein, 9 aa, Mycobacterium tuberculosis
LLSSGADAV

SEQ ID NO: 153177 - protein, 9 aa, Mycobacterium tuberculosis
LSSGADAVV

SEQ ID NO: 153178 - protein, 9 aa, Mycobacterium tuberculosis
DAVVADLAA

SEQ ID NO: 153179 - protein, 9 aa, Mycobacterium tuberculosis
AVVADLAAV

SEQ ID NO: 153180 - protein, 9 aa, Mycobacterium tuberculosis
VADLAAVTV

SEQ ID NO: 153181 - protein, 9 aa, Mycobacterium tuberculosis
DLAAVTVGS

SEQ ID NO: 153182 - protein, 9 aa, Mycobacterium tuberculosis
AISTIPDAL

SEQ ID NO: 153183 - protein, 9 aa, Mycobacterium tuberculosis
STIPDALQV

SEQ ID NO: 153184 - protein, 9 aa, Mycobacterium tuberculosis
TIPDALQVY

SEQ ID NO: 153185 - protein, 9 aa, Mycobacterium tuberculosis
ALQVYSQLK

SEQ ID NO: 153186 - protein, 9 aa, Mycobacterium tuberculosis
LQVYSQLKR

SEQ ID NO: 153187 - protein, 9 aa, Mycobacterium tuberculosis
QVYSQLKRL

SEQ ID NO: 153188 - protein, 9 aa, Mycobacterium tuberculosis
VYSQLKRLL

SEQ ID NO: 153189 - protein, 9 aa, Mycobacterium tuberculosis
QLKRLLTGR

SEQ ID NO: 153190 - protein, 9 aa, Mycobacterium tuberculosis
RLLTGRRPA

SEQ ID NO: 153191 - protein, 9 aa, Mycobacterium tuberculosis
LLTGRRPAV

SEQ ID NO: 153192 - protein, 9 aa, Mycobacterium tuberculosis
LTGRRPAVF

SEQ ID NO: 153193 - protein, 9 aa, Mycobacterium tuberculosis
RRPAVFLDF

SEQ ID NO: 153194 - protein, 9 aa, Mycobacterium tuberculosis
VFLDFDGTL

SEQ ID NO: 153195 - protein, 9 aa, Mycobacterium tuberculosis
FLDFDGTLS

SEQ ID NO: 153196 - protein, 9 aa, Mycobacterium tuberculosis
GTLSDIVER

SEQ ID NO: 153197 - protein, 9 aa, Mycobacterium tuberculosis
TLSDIVERP

SEQ ID NO: 153198 - protein, 9 aa, Mycobacterium tuberculosis
VERPEAATL

SEQ ID NO: 153199 - protein, 9 aa, Mycobacterium tuberculosis
EAATLVDGA

SEQ ID NO: 153200 - protein, 9 aa, Mycobacterium tuberculosis
TLVDGAAEA

SEQ ID NO: 153201 - protein, 9 aa, Mycobacterium tuberculosis
LVDGAAEAL

SEQ ID NO: 153202 - protein, 9 aa, Mycobacterium tuberculosis
GAAEALRAL

SEQ ID NO: 153203 - protein, 9 aa, Mycobacterium tuberculosis
AEALRALAA

SEQ ID NO: 153204 - protein, 9 aa, Mycobacterium tuberculosis
RALAAQCPV

SEQ ID NO: 153205 - protein, 9 aa, Mycobacterium tuberculosis
ALAAQCPVA

SEQ ID NO: 153206 - protein, 9 aa, Mycobacterium tuberculosis
LAAQCPVAV

SEQ ID NO: 153207 - protein, 9 aa, Mycobacterium tuberculosis
CPVAVISGR

SEQ ID NO: 153208 - protein, 9 aa, Mycobacterium tuberculosis
AVISGRDLA

SEQ ID NO: 153209 - protein, 9 aa, Mycobacterium tuberculosis
DLADVRNRV

SEQ ID NO: 153210 - protein, 9 aa, Mycobacterium tuberculosis
VKVDGLWLA

SEQ ID NO: 153211 - protein, 9 aa, Mycobacterium tuberculosis
LWLAGSHGF

SEQ ID NO: 153212 - protein, 9 aa, Mycobacterium tuberculosis
LAGSHGFEL

SEQ ID NO: 153213 - protein, 9 aa, Mycobacterium tuberculosis
AGSHGFELV

SEQ ID NO: 153214 - protein, 9 aa, Mycobacterium tuberculosis
VAPDGSHHQ

SEQ ID NO: 153215 - protein, 9 aa, Mycobacterium tuberculosis
HQNAAATAA

SEQ ID NO: 153216 - protein, 9 aa, Mycobacterium tuberculosis
QNAAATAAI

SEQ ID NO: 153217 - protein, 9 aa, Mycobacterium tuberculosis
AATAAIDGL

SEQ ID NO: 153218 - protein, 9 aa, Mycobacterium tuberculosis
ATAAIDGLA

SEQ ID NO: 153219 - protein, 9 aa, Mycobacterium tuberculosis
AAIDGLAEA

SEQ ID NO: 153220 - protein, 9 aa, Mycobacterium tuberculosis
AIDGLAEAA

SEQ ID NO: 153221 - protein, 9 aa, Mycobacterium tuberculosis
GLAEAAAQL

SEQ ID NO: 153222 - protein, 9 aa, Mycobacterium tuberculosis
AEAAAQLAD

SEQ ID NO: 153223 - protein, 9 aa, Mycobacterium tuberculosis
EAAAQLADA

SEQ ID NO: 153224 - protein, 9 aa, Mycobacterium tuberculosis
AAAQLADAL

SEQ ID NO: 153225 - protein, 9 aa, Mycobacterium tuberculosis
AAQLADALR

SEQ ID NO: 153226 - protein, 9 aa, Mycobacterium tuberculosis
QLADALREI

SEQ ID NO: 153227 - protein, 9 aa, Mycobacterium tuberculosis
ALREIAGAV

SEQ ID NO: 153228 - protein, 9 aa, Mycobacterium tuberculosis
EIAGAVVEH

SEQ ID NO: 153229 - protein, 9 aa, Mycobacterium tuberculosis
IAGAVVEHK

SEQ ID NO: 153230 - protein, 9 aa, Mycobacterium tuberculosis
VVEHKRFAV

SEQ ID NO: 153231 - protein, 9 aa, Mycobacterium tuberculosis
KRFAVAVHY

SEQ ID NO: 153232 - protein, 9 aa, Mycobacterium tuberculosis
RFAVAVHYR

SEQ ID NO: 153233 - protein, 9 aa, Mycobacterium tuberculosis
AVAVHYRNV

SEQ ID NO: 153234 - protein, 9 aa, Mycobacterium tuberculosis
VADDSVDNL

SEQ ID NO: 153235 - protein, 9 aa, Mycobacterium tuberculosis
SVDNLIAAV

SEQ ID NO: 153236 - protein, 9 aa, Mycobacterium tuberculosis
NLIAAVRRL

SEQ ID NO: 153237 - protein, 9 aa, Mycobacterium tuberculosis
AVRRLGHAA

SEQ ID NO: 153238 - protein, 9 aa, Mycobacterium tuberculosis
RRLGHAAGL

SEQ ID NO: 153239 - protein, 9 aa, Mycobacterium tuberculosis
RLGHAAGLR

SEQ ID NO: 153240 - protein, 9 aa, Mycobacterium tuberculosis
GLRVTTGRK

SEQ ID NO: 153241 - protein, 9 aa, Mycobacterium tuberculosis
RVTTGRKVV

SEQ ID NO: 153242 - protein, 9 aa, Mycobacterium tuberculosis
VELRPDIAW

SEQ ID NO: 153243 - protein, 9 aa, Mycobacterium tuberculosis
IAWDKGKAL

SEQ ID NO: 153244 - protein, 9 aa, Mycobacterium tuberculosis
KALDWIGER

SEQ ID NO: 153245 - protein, 9 aa, Mycobacterium tuberculosis
ALDWIGERL

SEQ ID NO: 153246 - protein, 9 aa, Mycobacterium tuberculosis
WIGERLGPA

SEQ ID NO: 153247 - protein, 9 aa, Mycobacterium tuberculosis
GERLGPAEV

SEQ ID NO: 153248 - protein, 9 aa, Mycobacterium tuberculosis
RLGPAEVGP

SEQ ID NO: 153249 - protein, 9 aa, Mycobacterium tuberculosis
GPAEVGPDL

SEQ ID NO: 153250 - protein, 9 aa, Mycobacterium tuberculosis
AEVGPDLRL

SEQ ID NO: 153251 - protein, 9 aa, Mycobacterium tuberculosis
LPIYIGDDL

SEQ ID NO: 153252 - protein, 9 aa, Mycobacterium tuberculosis
FDAVRFTGV

SEQ ID NO: 153253 - protein, 9 aa, Mycobacterium tuberculosis
AVRFTGVGI

SEQ ID NO: 153254 - protein, 9 aa, Mycobacterium tuberculosis
RFTGVGIVV

SEQ ID NO: 153255 - protein, 9 aa, Mycobacterium tuberculosis
FTGVGIVVR

SEQ ID NO: 153256 - protein, 9 aa, Mycobacterium tuberculosis
DRRSAATFR

SEQ ID NO: 153257 - protein, 9 aa, Mycobacterium tuberculosis
RRSAATFRL

SEQ ID NO: 153258 - protein, 9 aa, Mycobacterium tuberculosis
ATFRLECPY

SEQ ID NO: 153259 - protein, 9 aa, Mycobacterium tuberculosis
FRLECPYTV

SEQ ID NO: 153260 - protein, 9 aa, Mycobacterium tuberculosis
ECPYTVCQF

SEQ ID NO: 153261 - protein, 9 aa, Mycobacterium tuberculosis
CPYTVCQFL

SEQ ID NO: 153262 - protein, 9 aa, Mycobacterium tuberculosis
YTVCQFLSQ

SEQ ID NO: 153263 - protein, 9 aa, Mycobacterium tuberculosis
TVCQFLSQL

SEQ ID NO: 153264 - protein, 9 aa, Mycobacterium tuberculosis
FLSQLACDL

SEQ ID NO: 153265 - protein, 9 aa, Mycobacterium tuberculosis
QLACDLQEA

SEQ ID NO: 153266 - protein, 9 aa, Mycobacterium tuberculosis
LACDLQEAV

SEQ ID NO: 153267 - protein, 9 aa, Mycobacterium tuberculosis
EAVQHDDPW

SEQ ID NO: 153268 - protein, 9 aa, Mycobacterium tuberculosis
VQHDDPWTL

SEQ ID NO: 153269 - protein, 9 aa, Mycobacterium tuberculosis
QHDDPWTLV

SEQ ID NO: 153270 - protein, 9 aa, Mycobacterium tuberculosis
HDDPWTLVF

SEQ ID NO: 153271 - protein, 9 aa, Mycobacterium tuberculosis
PWTLVFHGY

SEQ ID NO: 153272 - protein, 9 aa, Mycobacterium tuberculosis
GYDPGQERL

SEQ ID NO: 153273 - protein, 9 aa, Mycobacterium tuberculosis
RLREALCAV

SEQ ID NO: 153274 - protein, 9 aa, Mycobacterium tuberculosis
ALCAVGNGY

SEQ ID NO: 153275 - protein, 9 aa, Mycobacterium tuberculosis
ESAESEAHY

SEQ ID NO: 153276 - protein, 9 aa, Mycobacterium tuberculosis
AESEAHYPG

SEQ ID NO: 153277 - protein, 9 aa, Mycobacterium tuberculosis
SEAHYPGTY

SEQ ID NO: 153278 - protein, 9 aa, Mycobacterium tuberculosis
EAHYPGTYV

SEQ ID NO: 153279 - protein, 9 aa, Mycobacterium tuberculosis
YPGTYVAGV

SEQ ID NO: 153280 - protein, 9 aa, Mycobacterium tuberculosis
YVAGVYNQL

SEQ ID NO: 153281 - protein, 9 aa, Mycobacterium tuberculosis
VYNQLTDHI

SEQ ID NO: 153282 - protein, 9 aa, Mycobacterium tuberculosis
QLTDHIEGC

SEQ ID NO: 153283 - protein, 9 aa, Mycobacterium tuberculosis
CTVDNESLV

SEQ ID NO: 153284 - protein, 9 aa, Mycobacterium tuberculosis
ESLVNLPNW

SEQ ID NO: 153285 - protein, 9 aa, Mycobacterium tuberculosis
SLVNLPNWL

SEQ ID NO: 153286 - protein, 9 aa, Mycobacterium tuberculosis
NLPNWLSLT

SEQ ID NO: 153287 - protein, 9 aa, Mycobacterium tuberculosis
LPNWLSLTF

SEQ ID NO: 153288 - protein, 9 aa, Mycobacterium tuberculosis
NWLSLTFRI

SEQ ID NO: 153289 - protein, 9 aa, Mycobacterium tuberculosis
LTFRIDGGA

SEQ ID NO: 153290 - protein, 9 aa, Mycobacterium tuberculosis
FRIDGGAWF

SEQ ID NO: 153291 - protein, 9 aa, Mycobacterium tuberculosis
RIDGGAWFN

SEQ ID NO: 153292 - protein, 9 aa, Mycobacterium tuberculosis
GAWFNVDTV

SEQ ID NO: 153293 - protein, 9 aa, Mycobacterium tuberculosis
WFNVDTVEL

SEQ ID NO: 153294 - protein, 9 aa, Mycobacterium tuberculosis
FNVDTVELL

SEQ ID NO: 153295 - protein, 9 aa, Mycobacterium tuberculosis
DTVELLSYR

SEQ ID NO: 153296 - protein, 9 aa, Mycobacterium tuberculosis
ELLSYRQTF

SEQ ID NO: 153297 - protein, 9 aa, Mycobacterium tuberculosis
LSYRQTFDL

SEQ ID NO: 153298 - protein, 9 aa, Mycobacterium tuberculosis
SYRQTFDLR

SEQ ID NO: 153299 - protein, 9 aa, Mycobacterium tuberculosis
YRQTFDLRR

SEQ ID NO: 153300 - protein, 9 aa, Mycobacterium tuberculosis
RQTFDLRRA

SEQ ID NO: 153301 - protein, 9 aa, Mycobacterium tuberculosis
DLRRATLTR

SEQ ID NO: 153302 - protein, 9 aa, Mycobacterium tuberculosis
RRATLTRSL

SEQ ID NO: 153303 - protein, 9 aa, Mycobacterium tuberculosis
RATLTRSLR

SEQ ID NO: 153304 - protein, 9 aa, Mycobacterium tuberculosis
ATLTRSLRF

SEQ ID NO: 153305 - protein, 9 aa, Mycobacterium tuberculosis
TLTRSLRFR

SEQ ID NO: 153306 - protein, 9 aa, Mycobacterium tuberculosis
RFRDAGGRV

SEQ ID NO: 153307 - protein, 9 aa, Mycobacterium tuberculosis
RVTTMTQER

SEQ ID NO: 153308 - protein, 9 aa, Mycobacterium tuberculosis
TTMTQERFA

SEQ ID NO: 153309 - protein, 9 aa, Mycobacterium tuberculosis
MTQERFASM

SEQ ID NO: 153310 - protein, 9 aa, Mycobacterium tuberculosis
ASMNRPNLV

SEQ ID NO: 153311 - protein, 9 aa, Mycobacterium tuberculosis
SMNRPNLVA

SEQ ID NO: 153312 - protein, 9 aa, Mycobacterium tuberculosis
RPNLVALQT

SEQ ID NO: 153313 - protein, 9 aa, Mycobacterium tuberculosis
NLVALQTRI

SEQ ID NO: 153314 - protein, 9 aa, Mycobacterium tuberculosis
QTRIESENW

SEQ ID NO: 153315 - protein, 9 aa, Mycobacterium tuberculosis
ESENWSGTV

SEQ ID NO: 153316 - protein, 9 aa, Mycobacterium tuberculosis
NWSGTVDFR

SEQ ID NO: 153317 - protein, 9 aa, Mycobacterium tuberculosis
GTVDFRSLV

SEQ ID NO: 153318 - protein, 9 aa, Mycobacterium tuberculosis
FRSLVDGGV

SEQ ID NO: 153319 - protein, 9 aa, Mycobacterium tuberculosis
SLVDGGVHN

SEQ ID NO: 153320 - protein, 9 aa, Mycobacterium tuberculosis
LVDGGVHNT

SEQ ID NO: 153321 - protein, 9 aa, Mycobacterium tuberculosis
GVHNTLVDR

SEQ ID NO: 153322 - protein, 9 aa, Mycobacterium tuberculosis
HNTLVDRYR

SEQ ID NO: 153323 - protein, 9 aa, Mycobacterium tuberculosis
TLVDRYRQL

SEQ ID NO: 153324 - protein, 9 aa, Mycobacterium tuberculosis
YRQLSSQHL

SEQ ID NO: 153325 - protein, 9 aa, Mycobacterium tuberculosis
RQLSSQHLT

SEQ ID NO: 153326 - protein, 9 aa, Mycobacterium tuberculosis
QLSSQHLTT

SEQ ID NO: 153327 - protein, 9 aa, Mycobacterium tuberculosis
SQHLTTAEI

SEQ ID NO: 153328 - protein, 9 aa, Mycobacterium tuberculosis
HLTTAEIEV

SEQ ID NO: 153329 - protein, 9 aa, Mycobacterium tuberculosis
LTTAEIEVL

SEQ ID NO: 153330 - protein, 9 aa, Mycobacterium tuberculosis
TTAEIEVLA

SEQ ID NO: 153331 - protein, 9 aa, Mycobacterium tuberculosis
AEIEVLADS

SEQ ID NO: 153332 - protein, 9 aa, Mycobacterium tuberculosis
IEVLADSVL

SEQ ID NO: 153333 - protein, 9 aa, Mycobacterium tuberculosis
EVLADSVLL

SEQ ID NO: 153334 - protein, 9 aa, Mycobacterium tuberculosis
VLADSVLLR

SEQ ID NO: 153335 - protein, 9 aa, Mycobacterium tuberculosis
VLLRTQTSQ

SEQ ID NO: 153336 - protein, 9 aa, Mycobacterium tuberculosis
QTSQSGIAI

SEQ ID NO: 153337 - protein, 9 aa, Mycobacterium tuberculosis
SQSGIAIAV

SEQ ID NO: 153338 - protein, 9 aa, Mycobacterium tuberculosis
SGIAIAVAA

SEQ ID NO: 153339 - protein, 9 aa, Mycobacterium tuberculosis
GIAIAVAAR

SEQ ID NO: 153340 - protein, 9 aa, Mycobacterium tuberculosis
IAVAARSTL

SEQ ID NO: 153341 - protein, 9 aa, Mycobacterium tuberculosis
AVAARSTLW

SEQ ID NO: 153342 - protein, 9 aa, Mycobacterium tuberculosis
VAARSTLWR

SEQ ID NO: 153343 - protein, 9 aa, Mycobacterium tuberculosis
STLWRDGQR

SEQ ID NO: 153344 - protein, 9 aa, Mycobacterium tuberculosis
TLWRDGQRV

SEQ ID NO: 153345 - protein, 9 aa, Mycobacterium tuberculosis
GQRVDAQYR

SEQ ID NO: 153346 - protein, 9 aa, Mycobacterium tuberculosis
QRVDAQYRV

SEQ ID NO: 153347 - protein, 9 aa, Mycobacterium tuberculosis
YRVARDTNR

SEQ ID NO: 153348 - protein, 9 aa, Mycobacterium tuberculosis
VTLSAGQSV

SEQ ID NO: 153349 - protein, 9 aa, Mycobacterium tuberculosis
TLSAGQSVT

SEQ ID NO: 153350 - protein, 9 aa, Mycobacterium tuberculosis
AGQSVTLEK

SEQ ID NO: 153351 - protein, 9 aa, Mycobacterium tuberculosis
GQSVTLEKV

SEQ ID NO: 153352 - protein, 9 aa, Mycobacterium tuberculosis
VTLEKVATI

SEQ ID NO: 153353 - protein, 9 aa, Mycobacterium tuberculosis
KVATIFTSR

SEQ ID NO: 153354 - protein, 9 aa, Mycobacterium tuberculosis
TIFTSRDAA

SEQ ID NO: 153355 - protein, 9 aa, Mycobacterium tuberculosis
FTSRDAATL

SEQ ID NO: 153356 - protein, 9 aa, Mycobacterium tuberculosis
DAATLTAAI

SEQ ID NO: 153357 - protein, 9 aa, Mycobacterium tuberculosis
ATLTAAISA

SEQ ID NO: 153358 - protein, 9 aa, Mycobacterium tuberculosis
TLTAAISAQ

SEQ ID NO: 153359 - protein, 9 aa, Mycobacterium tuberculosis
LTAAISAQR

SEQ ID NO: 153360 - protein, 9 aa, Mycobacterium tuberculosis
CLGEAGRYA

SEQ ID NO: 153361 - protein, 9 aa, Mycobacterium tuberculosis
GEAGRYAEL

SEQ ID NO: 153362 - protein, 9 aa, Mycobacterium tuberculosis
ELCQQHVRA

SEQ ID NO: 153363 - protein, 9 aa, Mycobacterium tuberculosis
QQHVRAWAR

SEQ ID NO: 153364 - protein, 9 aa, Mycobacterium tuberculosis
QHVRAWARL

SEQ ID NO: 153365 - protein, 9 aa, Mycobacterium tuberculosis
RAWARLWER

SEQ ID NO: 153366 - protein, 9 aa, Mycobacterium tuberculosis
DLTGNTEEL

SEQ ID NO: 153367 - protein, 9 aa, Mycobacterium tuberculosis
LTGNTEELR

SEQ ID NO: 153368 - protein, 9 aa, Mycobacterium tuberculosis
NTEELRLVR

SEQ ID NO: 153369 - protein, 9 aa, Mycobacterium tuberculosis
ELRLVRLHL

SEQ ID NO: 153370 - protein, 9 aa, Mycobacterium tuberculosis
RLVRLHLLH

SEQ ID NO: 153371 - protein, 9 aa, Mycobacterium tuberculosis
LVRLHLLHL

SEQ ID NO: 153372 - protein, 9 aa, Mycobacterium tuberculosis
RLHLLHLLQ

SEQ ID NO: 153373 - protein, 9 aa, Mycobacterium tuberculosis
HLLHLLQTI

SEQ ID NO: 153374 - protein, 9 aa, Mycobacterium tuberculosis
QTISPHTAE

SEQ ID NO: 153375 - protein, 9 aa, Mycobacterium tuberculosis
TISPHTAEL

SEQ ID NO: 153376 - protein, 9 aa, Mycobacterium tuberculosis
HTAELDAGV

SEQ ID NO: 153377 - protein, 9 aa, Mycobacterium tuberculosis
AELDAGVPA

SEQ ID NO: 153378 - protein, 9 aa, Mycobacterium tuberculosis
ELDAGVPAR

SEQ ID NO: 153379 - protein, 9 aa, Mycobacterium tuberculosis
RGLNGEAYR

SEQ ID NO: 153380 - protein, 9 aa, Mycobacterium tuberculosis
GEAYRGHVF

SEQ ID NO: 153381 - protein, 9 aa, Mycobacterium tuberculosis
EAYRGHVFW

SEQ ID NO: 153382 - protein, 9 aa, Mycobacterium tuberculosis
HVFWDALFV

SEQ ID NO: 153383 - protein, 9 aa, Mycobacterium tuberculosis
VFWDALFVA

SEQ ID NO: 153384 - protein, 9 aa, Mycobacterium tuberculosis
WDALFVAPV

SEQ ID NO: 153385 - protein, 9 aa, Mycobacterium tuberculosis
DALFVAPVL

SEQ ID NO: 153386 - protein, 9 aa, Mycobacterium tuberculosis
FVAPVLSLR

SEQ ID NO: 153387 - protein, 9 aa, Mycobacterium tuberculosis
PVLSLRMPK

SEQ ID NO: 153388 - protein, 9 aa, Mycobacterium tuberculosis
VLSLRMPKV

SEQ ID NO: 153389 - protein, 9 aa, Mycobacterium tuberculosis
SLRMPKVAR

SEQ ID NO: 153390 - protein, 9 aa, Mycobacterium tuberculosis
RMPKVARSL

SEQ ID NO: 153391 - protein, 9 aa, Mycobacterium tuberculosis
MPKVARSLL

SEQ ID NO: 153392 - protein, 9 aa, Mycobacterium tuberculosis
KVARSLLDY

SEQ ID NO: 153393 - protein, 9 aa, Mycobacterium tuberculosis
VARSLLDYR

SEQ ID NO: 153394 - protein, 9 aa, Mycobacterium tuberculosis
RSLLDYRYR

SEQ ID NO: 153395 - protein, 9 aa, Mycobacterium tuberculosis
SLLDYRYRR

SEQ ID NO: 153396 - protein, 9 aa, Mycobacterium tuberculosis
LLDYRYRRL

SEQ ID NO: 153397 - protein, 9 aa, Mycobacterium tuberculosis
DYRYRRLPA

SEQ ID NO: 153398 - protein, 9 aa, Mycobacterium tuberculosis
RYRRLPAAR

SEQ ID NO: 153399 - protein, 9 aa, Mycobacterium tuberculosis
RLPAARRAA

SEQ ID NO: 153400 - protein, 9 aa, Mycobacterium tuberculosis
LPAARRAAH

SEQ ID NO: 153401 - protein, 9 aa, Mycobacterium tuberculosis
RRAAHRAGH

SEQ ID NO: 153402 - protein, 9 aa, Mycobacterium tuberculosis
RAAHRAGHL

SEQ ID NO: 153403 - protein, 9 aa, Mycobacterium tuberculosis
HRAGHLGAM

SEQ ID NO: 153404 - protein, 9 aa, Mycobacterium tuberculosis
RAGHLGAMY

SEQ ID NO: 153405 - protein, 9 aa, Mycobacterium tuberculosis
HLGAMYPWQ

SEQ ID NO: 153406 - protein, 9 aa, Mycobacterium tuberculosis
AMYPWQSGS

SEQ ID NO: 153407 - protein, 9 aa, Mycobacterium tuberculosis
YPWQSGSDG

SEQ ID NO: 153408 - protein, 9 aa, Mycobacterium tuberculosis
SEVSQQLHL

SEQ ID NO: 153409 - protein, 9 aa, Mycobacterium tuberculosis
SQQLHLNPR

SEQ ID NO: 153410 - protein, 9 aa, Mycobacterium tuberculosis
HLNPRSGRW

SEQ ID NO: 153411 - protein, 9 aa, Mycobacterium tuberculosis
WTPDPSDRA

SEQ ID NO: 153412 - protein, 9 aa, Mycobacterium tuberculosis
TPDPSDRAH

SEQ ID NO: 153413 - protein, 9 aa, Mycobacterium tuberculosis
DPSDRAHHV

SEQ ID NO: 153414 - protein, 9 aa, Mycobacterium tuberculosis
RAHHVGLAV

SEQ ID NO: 153415 - protein, 9 aa, Mycobacterium tuberculosis
HHVGLAVAY

SEQ ID NO: 153416 - protein, 9 aa, Mycobacterium tuberculosis
GLAVAYNAW

SEQ ID NO: 153417 - protein, 9 aa, Mycobacterium tuberculosis
AVAYNAWHY

SEQ ID NO: 153418 - protein, 9 aa, Mycobacterium tuberculosis
VAYNAWHYY

SEQ ID NO: 153419 - protein, 9 aa, Mycobacterium tuberculosis
AYNAWHYYQ

SEQ ID NO: 153420 - protein, 9 aa, Mycobacterium tuberculosis
YNAWHYYQV

SEQ ID NO: 153421 - protein, 9 aa, Mycobacterium tuberculosis
NAWHYYQVT

SEQ ID NO: 153422 - protein, 9 aa, Mycobacterium tuberculosis
HYYQVTGDR

SEQ ID NO: 153423 - protein, 9 aa, Mycobacterium tuberculosis
YQVTGDRQY

SEQ ID NO: 153424 - protein, 9 aa, Mycobacterium tuberculosis
QVTGDRQYL

SEQ ID NO: 153425 - protein, 9 aa, Mycobacterium tuberculosis
VTGDRQYLV

SEQ ID NO: 153426 - protein, 9 aa, Mycobacterium tuberculosis
RQYLVDCGA

SEQ ID NO: 153427 - protein, 9 aa, Mycobacterium tuberculosis
YLVDCGAEL

SEQ ID NO: 153428 - protein, 9 aa, Mycobacterium tuberculosis
LVDCGAELL

SEQ ID NO: 153429 - protein, 9 aa, Mycobacterium tuberculosis
CGAELLVEI

SEQ ID NO: 153430 - protein, 9 aa, Mycobacterium tuberculosis
AELLVEIAR

SEQ ID NO: 153431 - protein, 9 aa, Mycobacterium tuberculosis
ELLVEIARF

SEQ ID NO: 153432 - protein, 9 aa, Mycobacterium tuberculosis
LVEIARFWV

SEQ ID NO: 153433 - protein, 9 aa, Mycobacterium tuberculosis
EIARFWVGL

SEQ ID NO: 153434 - protein, 9 aa, Mycobacterium tuberculosis
IARFWVGLA

SEQ ID NO: 153435 - protein, 9 aa, Mycobacterium tuberculosis
ARFWVGLAK

SEQ ID NO: 153436 - protein, 9 aa, Mycobacterium tuberculosis
KLDDSRGRY

SEQ ID NO: 153437 - protein, 9 aa, Mycobacterium tuberculosis
DSRGRYLIR

SEQ ID NO: 153438 - protein, 9 aa, Mycobacterium tuberculosis
GRYLIRGVI

SEQ ID NO: 153439 - protein, 9 aa, Mycobacterium tuberculosis
YLIRGVIGP

SEQ ID NO: 153440 - protein, 9 aa, Mycobacterium tuberculosis
HSGYPGNEY

SEQ ID NO: 153441 - protein, 9 aa, Mycobacterium tuberculosis
YPGNEYDGI

SEQ ID NO: 153442 - protein, 9 aa, Mycobacterium tuberculosis
YDGIDNNAY

SEQ ID NO: 153443 - protein, 9 aa, Mycobacterium tuberculosis
NAYTNVMAV

SEQ ID NO: 153444 - protein, 9 aa, Mycobacterium tuberculosis
AYTNVMAVW

SEQ ID NO: 153445 - protein, 9 aa, Mycobacterium tuberculosis
YTNVMAVWV

SEQ ID NO: 153446 - protein, 9 aa, Mycobacterium tuberculosis
NVMAVWVIL

SEQ ID NO: 153447 - protein, 9 aa, Mycobacterium tuberculosis
VMAVWVILR

SEQ ID NO: 153448 - protein, 9 aa, Mycobacterium tuberculosis
MAVWVILRA

SEQ ID NO: 153449 - protein, 9 aa, Mycobacterium tuberculosis
AVWVILRAM

SEQ ID NO: 153450 - protein, 9 aa, Mycobacterium tuberculosis
WVILRAMEA

SEQ ID NO: 153451 - protein, 9 aa, Mycobacterium tuberculosis
VILRAMEAL

SEQ ID NO: 153452 - protein, 9 aa, Mycobacterium tuberculosis
RAMEALDLL

SEQ ID NO: 153453 - protein, 9 aa, Mycobacterium tuberculosis
MEALDLLPL

SEQ ID NO: 153454 - protein, 9 aa, Mycobacterium tuberculosis
EALDLLPLT

SEQ ID NO: 153455 - protein, 9 aa, Mycobacterium tuberculosis
DLLPLTDRR

SEQ ID NO: 153456 - protein, 9 aa, Mycobacterium tuberculosis
LPLTDRRHL

SEQ ID NO: 153457 - protein, 9 aa, Mycobacterium tuberculosis
PLTDRRHLI

SEQ ID NO: 153458 - protein, 9 aa, Mycobacterium tuberculosis
TDRRHLIEK

SEQ ID NO: 153459 - protein, 9 aa, Mycobacterium tuberculosis
HLIEKLGLT

SEQ ID NO: 153460 - protein, 9 aa, Mycobacterium tuberculosis
KLGLTTQER

SEQ ID NO: 153461 - protein, 9 aa, Mycobacterium tuberculosis
LTTQERDQW

SEQ ID NO: 153462 - protein, 9 aa, Mycobacterium tuberculosis
DQWDDVSRR

SEQ ID NO: 153463 - protein, 9 aa, Mycobacterium tuberculosis
VSRRMFVPF

SEQ ID NO: 153464 - protein, 9 aa, Mycobacterium tuberculosis
MFVPFHDGV

SEQ ID NO: 153465 - protein, 9 aa, Mycobacterium tuberculosis
FVPFHDGVI

SEQ ID NO: 153466 - protein, 9 aa, Mycobacterium tuberculosis
VPFHDGVIS

SEQ ID NO: 153467 - protein, 9 aa, Mycobacterium tuberculosis
FHDGVISQF

SEQ ID NO: 153468 - protein, 9 aa, Mycobacterium tuberculosis
GVISQFEGY

SEQ ID NO: 153469 - protein, 9 aa, Mycobacterium tuberculosis
SQFEGYSEL

SEQ ID NO: 153470 - protein, 9 aa, Mycobacterium tuberculosis
EGYSELAEL

SEQ ID NO: 153471 - protein, 9 aa, Mycobacterium tuberculosis
YSELAELDW

SEQ ID NO: 153472 - protein, 9 aa, Mycobacterium tuberculosis
LAELDWDHY

SEQ ID NO: 153473 - protein, 9 aa, Mycobacterium tuberculosis
AELDWDHYR

SEQ ID NO: 153474 - protein, 9 aa, Mycobacterium tuberculosis
ELDWDHYRH

SEQ ID NO: 153475 - protein, 9 aa, Mycobacterium tuberculosis
HYRHRYGNI

SEQ ID NO: 153476 - protein, 9 aa, Mycobacterium tuberculosis
RHRYGNIQR

SEQ ID NO: 153477 - protein, 9 aa, Mycobacterium tuberculosis
HRYGNIQRL

SEQ ID NO: 153478 - protein, 9 aa, Mycobacterium tuberculosis
RLDRILEAE

SEQ ID NO: 153479 - protein, 9 aa, Mycobacterium tuberculosis
ILEAEGDSV

SEQ ID NO: 153480 - protein, 9 aa, Mycobacterium tuberculosis
AEGDSVNNY

SEQ ID NO: 153481 - protein, 9 aa, Mycobacterium tuberculosis
SVNNYQASK

SEQ ID NO: 153482 - protein, 9 aa, Mycobacterium tuberculosis
YQASKQADA

SEQ ID NO: 153483 - protein, 9 aa, Mycobacterium tuberculosis
QASKQADAL

SEQ ID NO: 153484 - protein, 9 aa, Mycobacterium tuberculosis
KQADALMLL

SEQ ID NO: 153485 - protein, 9 aa, Mycobacterium tuberculosis
QADALMLLY

SEQ ID NO: 153486 - protein, 9 aa, Mycobacterium tuberculosis
DALMLLYLL

SEQ ID NO: 153487 - protein, 9 aa, Mycobacterium tuberculosis
ALMLLYLLS

SEQ ID NO: 153488 - protein, 9 aa, Mycobacterium tuberculosis
LMLLYLLSS

SEQ ID NO: 153489 - protein, 9 aa, Mycobacterium tuberculosis
LYLLSSDEL

SEQ ID NO: 153490 - protein, 9 aa, Mycobacterium tuberculosis
YLLSSDELI

SEQ ID NO: 153491 - protein, 9 aa, Mycobacterium tuberculosis
LSSDELIGL

SEQ ID NO: 153492 - protein, 9 aa, Mycobacterium tuberculosis
SSDELIGLL

SEQ ID NO: 153493 - protein, 9 aa, Mycobacterium tuberculosis
DELIGLLAR

SEQ ID NO: 153494 - protein, 9 aa, Mycobacterium tuberculosis
ELIGLLARL

SEQ ID NO: 153495 - protein, 9 aa, Mycobacterium tuberculosis
GLLARLGYR

SEQ ID NO: 153496 - protein, 9 aa, Mycobacterium tuberculosis
LLARLGYRF

SEQ ID NO: 153497 - protein, 9 aa, Mycobacterium tuberculosis
RLGYRFAPT

SEQ ID NO: 153498 - protein, 9 aa, Mycobacterium tuberculosis
GYRFAPTQI

SEQ ID NO: 153499 - protein, 9 aa, Mycobacterium tuberculosis
APTQIPGTV

SEQ ID NO: 153500 - protein, 9 aa, Mycobacterium tuberculosis
TQIPGTVDY

SEQ ID NO: 153501 - protein, 9 aa, Mycobacterium tuberculosis
QIPGTVDYY

SEQ ID NO: 153502 - protein, 9 aa, Mycobacterium tuberculosis
IPGTVDYYL

SEQ ID NO: 153503 - protein, 9 aa, Mycobacterium tuberculosis
GTVDYYLAR

SEQ ID NO: 153504 - protein, 9 aa, Mycobacterium tuberculosis
YYLARTSDG

SEQ ID NO: 153505 - protein, 9 aa, Mycobacterium tuberculosis
YLARTSDGS

SEQ ID NO: 153506 - protein, 9 aa, Mycobacterium tuberculosis
DGSTLSAVV

SEQ ID NO: 153507 - protein, 9 aa, Mycobacterium tuberculosis
STLSAVVHA

SEQ ID NO: 153508 - protein, 9 aa, Mycobacterium tuberculosis
TLSAVVHAW

SEQ ID NO: 153509 - protein, 9 aa, Mycobacterium tuberculosis
LSAVVHAWV

SEQ ID NO: 153510 - protein, 9 aa, Mycobacterium tuberculosis
SAVVHAWVL

SEQ ID NO: 153511 - protein, 9 aa, Mycobacterium tuberculosis
AVVHAWVLA

SEQ ID NO: 153512 - protein, 9 aa, Mycobacterium tuberculosis
VVHAWVLAR

SEQ ID NO: 153513 - protein, 9 aa, Mycobacterium tuberculosis
AWVLARANR

SEQ ID NO: 153514 - protein, 9 aa, Mycobacterium tuberculosis
RSNAMEYFR

SEQ ID NO: 153515 - protein, 9 aa, Mycobacterium tuberculosis
NAMEYFRQV

SEQ ID NO: 153516 - protein, 9 aa, Mycobacterium tuberculosis
AMEYFRQVL

SEQ ID NO: 153517 - protein, 9 aa, Mycobacterium tuberculosis
MEYFRQVLR

SEQ ID NO: 153518 - protein, 9 aa, Mycobacterium tuberculosis
RQVLRSDIA

SEQ ID NO: 153519 - protein, 9 aa, Mycobacterium tuberculosis
VLRSDIADV

SEQ ID NO: 153520 - protein, 9 aa, Mycobacterium tuberculosis
TTQEGIHLA

SEQ ID NO: 153521 - protein, 9 aa, Mycobacterium tuberculosis
TQEGIHLAA

SEQ ID NO: 153522 - protein, 9 aa, Mycobacterium tuberculosis
HLAAMAGSI

SEQ ID NO: 153523 - protein, 9 aa, Mycobacterium tuberculosis
AAMAGSIDL

SEQ ID NO: 153524 - protein, 9 aa, Mycobacterium tuberculosis
AMAGSIDLL

SEQ ID NO: 153525 - protein, 9 aa, Mycobacterium tuberculosis
SIDLLQRCY

SEQ ID NO: 153526 - protein, 9 aa, Mycobacterium tuberculosis
LLQRCYSGL

SEQ ID NO: 153527 - protein, 9 aa, Mycobacterium tuberculosis
RCYSGLELR

SEQ ID NO: 153528 - protein, 9 aa, Mycobacterium tuberculosis
GLELRDDRL

SEQ ID NO: 153529 - protein, 9 aa, Mycobacterium tuberculosis
ELRDDRLVL

SEQ ID NO: 153530 - protein, 9 aa, Mycobacterium tuberculosis
VLSPQWPEA

SEQ ID NO: 153531 - protein, 9 aa, Mycobacterium tuberculosis
PEALGPLEF

SEQ ID NO: 153532 - protein, 9 aa, Mycobacterium tuberculosis
ALGPLEFPF

SEQ ID NO: 153533 - protein, 9 aa, Mycobacterium tuberculosis
GPLEFPFVY

SEQ ID NO: 153534 - protein, 9 aa, Mycobacterium tuberculosis
PLEFPFVYR

SEQ ID NO: 153535 - protein, 9 aa, Mycobacterium tuberculosis
LEFPFVYRR

SEQ ID NO: 153536 - protein, 9 aa, Mycobacterium tuberculosis
PFVYRRHQL

SEQ ID NO: 153537 - protein, 9 aa, Mycobacterium tuberculosis
VYRRHQLSL

SEQ ID NO: 153538 - protein, 9 aa, Mycobacterium tuberculosis
RRHQLSLRI

SEQ ID NO: 153539 - protein, 9 aa, Mycobacterium tuberculosis
QLSLRISGR

SEQ ID NO: 153540 - protein, 9 aa, Mycobacterium tuberculosis
SLRISGRSA

SEQ ID NO: 153541 - protein, 9 aa, Mycobacterium tuberculosis
RISGRSATL

SEQ ID NO: 153542 - protein, 9 aa, Mycobacterium tuberculosis
SGRSATLTA

SEQ ID NO: 153543 - protein, 9 aa, Mycobacterium tuberculosis
AESGDAEPI

SEQ ID NO: 153544 - protein, 9 aa, Mycobacterium tuberculosis
SGDAEPIEV

SEQ ID NO: 153545 - protein, 9 aa, Mycobacterium tuberculosis
IEVECRGHV

SEQ ID NO: 153546 - protein, 9 aa, Mycobacterium tuberculosis
HTIEVGCSR

SEQ ID NO: 153547 - protein, 10 aa, Mycobacterium tuberculosis
TIDRRYHDAV

SEQ ID NO: 153548 - protein, 10 aa, Mycobacterium tuberculosis
RYHDAVIVGL

SEQ ID NO: 153549 - protein, 10 aa, Mycobacterium tuberculosis
DAVIVGLDNV

SEQ ID NO: 153550 - protein, 10 aa, Mycobacterium tuberculosis
AVIVGLDNVV

SEQ ID NO: 153551 - protein, 10 aa, Mycobacterium tuberculosis
IVGLDNVVDK

SEQ ID NO: 153552 - protein, 10 aa, Mycobacterium tuberculosis
GLDNVVDKAT

SEQ ID NO: 153553 - protein, 10 aa, Mycobacterium tuberculosis
KATRVHAAAW

SEQ ID NO: 153554 - protein, 10 aa, Mycobacterium tuberculosis
RVHAAAWTKF

SEQ ID NO: 153555 - protein, 10 aa, Mycobacterium tuberculosis
AAWTKFLDDY

SEQ ID NO: 153556 - protein, 10 aa, Mycobacterium tuberculosis
TKFLDDYLTR

SEQ ID NO: 153557 - protein, 10 aa, Mycobacterium tuberculosis
KFLDDYLTRR

SEQ ID NO: 153558 - protein, 10 aa, Mycobacterium tuberculosis
FLDDYLTRRP

SEQ ID NO: 153559 - protein, 10 aa, Mycobacterium tuberculosis
DDYLTRRPQR

SEQ ID NO: 153560 - protein, 10 aa, Mycobacterium tuberculosis
LTHDDYRRFL

SEQ ID NO: 153561 - protein, 10 aa, Mycobacterium tuberculosis
FLAGKPDGVA

SEQ ID NO: 153562 - protein, 10 aa, Mycobacterium tuberculosis
DGVADFLAAR

SEQ ID NO: 153563 - protein, 10 aa, Mycobacterium tuberculosis
RLPPGSPTDL

SEQ ID NO: 153564 - protein, 10 aa, Mycobacterium tuberculosis
LPPGSPTDLT

SEQ ID NO: 153565 - protein, 10 aa, Mycobacterium tuberculosis
PTDLTDDTVY

SEQ ID NO: 153566 - protein, 10 aa, Mycobacterium tuberculosis
DLTDDTVYGL

SEQ ID NO: 153567 - protein, 10 aa, Mycobacterium tuberculosis
TVYGLQNLER

SEQ ID NO: 153568 - protein, 10 aa, Mycobacterium tuberculosis
LQNLERQTFL

SEQ ID NO: 153569 - protein, 10 aa, Mycobacterium tuberculosis
NLERQTFLQL

SEQ ID NO: 153570 - protein, 10 aa, Mycobacterium tuberculosis
LERQTFLQLL

SEQ ID NO: 153571 - protein, 10 aa, Mycobacterium tuberculosis
TFLQLLNTGV

SEQ ID NO: 153572 - protein, 10 aa, Mycobacterium tuberculosis
LLNTGVPEGK

SEQ ID NO: 153573 - protein, 10 aa, Mycobacterium tuberculosis
VPEGKSIASF

SEQ ID NO: 153574 - protein, 10 aa, Mycobacterium tuberculosis
EGKSIASFAR

SEQ ID NO: 153575 - protein, 10 aa, Mycobacterium tuberculosis
GKSIASFARR

SEQ ID NO: 153576 - protein, 10 aa, Mycobacterium tuberculosis
KSIASFARRL

SEQ ID NO: 153577 - protein, 10 aa, Mycobacterium tuberculosis
FARRLQVAGV

SEQ ID NO: 153578 - protein, 10 aa, Mycobacterium tuberculosis
RRLQVAGVRV

SEQ ID NO: 153579 - protein, 10 aa, Mycobacterium tuberculosis
RLQVAGVRVA

SEQ ID NO: 153580 - protein, 10 aa, Mycobacterium tuberculosis
LQVAGVRVAA

SEQ ID NO: 153581 - protein, 10 aa, Mycobacterium tuberculosis
VAAHTSHRNY

SEQ ID NO: 153582 - protein, 10 aa, Mycobacterium tuberculosis
TLDATGLAEV

SEQ ID NO: 153583 - protein, 10 aa, Mycobacterium tuberculosis
ATGLAEVFAV

SEQ ID NO: 153584 - protein, 10 aa, Mycobacterium tuberculosis
GLAEVFAVFV

SEQ ID NO: 153585 - protein, 10 aa, Mycobacterium tuberculosis
AEVFAVFVDG

SEQ ID NO: 153586 - protein, 10 aa, Mycobacterium tuberculosis
EVFAVFVDGA

SEQ ID NO: 153587 - protein, 10 aa, Mycobacterium tuberculosis
FAVFVDGAVT

SEQ ID NO: 153588 - protein, 10 aa, Mycobacterium tuberculosis
AVFVDGAVTA

SEQ ID NO: 153589 - protein, 10 aa, Mycobacterium tuberculosis
FVDGAVTAEL

SEQ ID NO: 153590 - protein, 10 aa, Mycobacterium tuberculosis
LPAEPNPAGL

SEQ ID NO: 153591 - protein, 10 aa, Mycobacterium tuberculosis
EPNPAGLIET

SEQ ID NO: 153592 - protein, 10 aa, Mycobacterium tuberculosis
NPAGLIETAK

SEQ ID NO: 153593 - protein, 10 aa, Mycobacterium tuberculosis
RLGANPGRCV

SEQ ID NO: 153594 - protein, 10 aa, Mycobacterium tuberculosis
VVIDSCQTGL

SEQ ID NO: 153595 - protein, 10 aa, Mycobacterium tuberculosis
SCQTGLRAGR

SEQ ID NO: 153596 - protein, 10 aa, Mycobacterium tuberculosis
GLRAGRNGGF

SEQ ID NO: 153597 - protein, 10 aa, Mycobacterium tuberculosis
RAGRNGGFAL

SEQ ID NO: 153598 - protein, 10 aa, Mycobacterium tuberculosis
GRNGGFALVI

SEQ ID NO: 153599 - protein, 10 aa, Mycobacterium tuberculosis
FALVIAVDAH

SEQ ID NO: 153600 - protein, 10 aa, Mycobacterium tuberculosis
AENLLSSGAD

SEQ ID NO: 153601 - protein, 10 aa, Mycobacterium tuberculosis
NLLSSGADAV

SEQ ID NO: 153602 - protein, 10 aa, Mycobacterium tuberculosis
LLSSGADAVV

SEQ ID NO: 153603 - protein, 10 aa, Mycobacterium tuberculosis
DAVVADLAAV

SEQ ID NO: 153604 - protein, 10 aa, Mycobacterium tuberculosis
VVADLAAVTV

SEQ ID NO: 153605 - protein, 10 aa, Mycobacterium tuberculosis
AAISTIPDAL

SEQ ID NO: 153606 - protein, 10 aa, Mycobacterium tuberculosis
STIPDALQVY

SEQ ID NO: 153607 - protein, 10 aa, Mycobacterium tuberculosis
DALQVYSQLK

SEQ ID NO: 153608 - protein, 10 aa, Mycobacterium tuberculosis
ALQVYSQLKR

SEQ ID NO: 153609 - protein, 10 aa, Mycobacterium tuberculosis
LQVYSQLKRL

SEQ ID NO: 153610 - protein, 10 aa, Mycobacterium tuberculosis
QVYSQLKRLL

SEQ ID NO: 153611 - protein, 10 aa, Mycobacterium tuberculosis
SQLKRLLTGR

SEQ ID NO: 153612 - protein, 10 aa, Mycobacterium tuberculosis
QLKRLLTGRR

SEQ ID NO: 153613 - protein, 10 aa, Mycobacterium tuberculosis
KRLLTGRRPA

SEQ ID NO: 153614 - protein, 10 aa, Mycobacterium tuberculosis
RLLTGRRPAV

SEQ ID NO: 153615 - protein, 10 aa, Mycobacterium tuberculosis
LLTGRRPAVF

SEQ ID NO: 153616 - protein, 10 aa, Mycobacterium tuberculosis
LTGRRPAVFL

SEQ ID NO: 153617 - protein, 10 aa, Mycobacterium tuberculosis
AVFLDFDGTL

SEQ ID NO: 153618 - protein, 10 aa, Mycobacterium tuberculosis
FLDFDGTLSD

SEQ ID NO: 153619 - protein, 10 aa, Mycobacterium tuberculosis
DGTLSDIVER

SEQ ID NO: 153620 - protein, 10 aa, Mycobacterium tuberculosis
VERPEAATLV

SEQ ID NO: 153621 - protein, 10 aa, Mycobacterium tuberculosis
EAATLVDGAA

SEQ ID NO: 153622 - protein, 10 aa, Mycobacterium tuberculosis
TLVDGAAEAL

SEQ ID NO: 153623 - protein, 10 aa, Mycobacterium tuberculosis
LVDGAAEALR

SEQ ID NO: 153624 - protein, 10 aa, Mycobacterium tuberculosis
AEALRALAAQ

SEQ ID NO: 153625 - protein, 10 aa, Mycobacterium tuberculosis
LRALAAQCPV

SEQ ID NO: 153626 - protein, 10 aa, Mycobacterium tuberculosis
ALAAQCPVAV

SEQ ID NO: 153627 - protein, 10 aa, Mycobacterium tuberculosis
LAAQCPVAVI

SEQ ID NO: 153628 - protein, 10 aa, Mycobacterium tuberculosis
VISGRDLADV

SEQ ID NO: 153629 - protein, 10 aa, Mycobacterium tuberculosis
DLADVRNRVK

SEQ ID NO: 153630 - protein, 10 aa, Mycobacterium tuberculosis
GLWLAGSHGF

SEQ ID NO: 153631 - protein, 10 aa, Mycobacterium tuberculosis
WLAGSHGFEL

SEQ ID NO: 153632 - protein, 10 aa, Mycobacterium tuberculosis
LAGSHGFELV

SEQ ID NO: 153633 - protein, 10 aa, Mycobacterium tuberculosis
HQNAAATAAI

SEQ ID NO: 153634 - protein, 10 aa, Mycobacterium tuberculosis
AAATAAIDGL

SEQ ID NO: 153635 - protein, 10 aa, Mycobacterium tuberculosis
AAIDGLAEAA

SEQ ID NO: 153636 - protein, 10 aa, Mycobacterium tuberculosis
AIDGLAEAAA

SEQ ID NO: 153637 - protein, 10 aa, Mycobacterium tuberculosis
GLAEAAAQLA

SEQ ID NO: 153638 - protein, 10 aa, Mycobacterium tuberculosis
AEAAAQLADA

SEQ ID NO: 153639 - protein, 10 aa, Mycobacterium tuberculosis
EAAAQLADAL

SEQ ID NO: 153640 - protein, 10 aa, Mycobacterium tuberculosis
AAAQLADALR

SEQ ID NO: 153641 - protein, 10 aa, Mycobacterium tuberculosis
AQLADALREI

SEQ ID NO: 153642 - protein, 10 aa, Mycobacterium tuberculosis
QLADALREIA

SEQ ID NO: 153643 - protein, 10 aa, Mycobacterium tuberculosis
DALREIAGAV

SEQ ID NO: 153644 - protein, 10 aa, Mycobacterium tuberculosis
ALREIAGAVV

SEQ ID NO: 153645 - protein, 10 aa, Mycobacterium tuberculosis
EIAGAVVEHK

SEQ ID NO: 153646 - protein, 10 aa, Mycobacterium tuberculosis
IAGAVVEHKR

SEQ ID NO: 153647 - protein, 10 aa, Mycobacterium tuberculosis
AVVEHKRFAV

SEQ ID NO: 153648 - protein, 10 aa, Mycobacterium tuberculosis
VEHKRFAVAV

SEQ ID NO: 153649 - protein, 10 aa, Mycobacterium tuberculosis
KRFAVAVHYR

SEQ ID NO: 153650 - protein, 10 aa, Mycobacterium tuberculosis
FAVAVHYRNV

SEQ ID NO: 153651 - protein, 10 aa, Mycobacterium tuberculosis
NVADDSVDNL

SEQ ID NO: 153652 - protein, 10 aa, Mycobacterium tuberculosis
DSVDNLIAAV

SEQ ID NO: 153653 - protein, 10 aa, Mycobacterium tuberculosis
SVDNLIAAVR

SEQ ID NO: 153654 - protein, 10 aa, Mycobacterium tuberculosis
RRLGHAAGLR

SEQ ID NO: 153655 - protein, 10 aa, Mycobacterium tuberculosis
RLGHAAGLRV

SEQ ID NO: 153656 - protein, 10 aa, Mycobacterium tuberculosis
AAGLRVTTGR

SEQ ID NO: 153657 - protein, 10 aa, Mycobacterium tuberculosis
AGLRVTTGRK

SEQ ID NO: 153658 - protein, 10 aa, Mycobacterium tuberculosis
GLRVTTGRKV

SEQ ID NO: 153659 - protein, 10 aa, Mycobacterium tuberculosis
TTGRKVVELR

SEQ ID NO: 153660 - protein, 10 aa, Mycobacterium tuberculosis
DIAWDKGKAL

SEQ ID NO: 153661 - protein, 10 aa, Mycobacterium tuberculosis
KALDWIGERL

SEQ ID NO: 153662 - protein, 10 aa, Mycobacterium tuberculosis
EVGPDLRLPI

SEQ ID NO: 153663 - protein, 10 aa, Mycobacterium tuberculosis
GPDLRLPIYI

SEQ ID NO: 153664 - protein, 10 aa, Mycobacterium tuberculosis
RLPIYIGDDL

SEQ ID NO: 153665 - protein, 10 aa, Mycobacterium tuberculosis
LPIYIGDDLT

SEQ ID NO: 153666 - protein, 10 aa, Mycobacterium tuberculosis
DLTDEDAFDA

SEQ ID NO: 153667 - protein, 10 aa, Mycobacterium tuberculosis
LTDEDAFDAV

SEQ ID NO: 153668 - protein, 10 aa, Mycobacterium tuberculosis
AFDAVRFTGV

SEQ ID NO: 153669 - protein, 10 aa, Mycobacterium tuberculosis
DAVRFTGVGI

SEQ ID NO: 153670 - protein, 10 aa, Mycobacterium tuberculosis
AVRFTGVGIV

SEQ ID NO: 153671 - protein, 10 aa, Mycobacterium tuberculosis
RFTGVGIVVR

SEQ ID NO: 153672 - protein, 10 aa, Mycobacterium tuberculosis
LECPYTVCQF

SEQ ID NO: 153673 - protein, 10 aa, Mycobacterium tuberculosis
ECPYTVCQFL

SEQ ID NO: 153674 - protein, 10 aa, Mycobacterium tuberculosis
CPYTVCQFLS

SEQ ID NO: 153675 - protein, 10 aa, Mycobacterium tuberculosis
YTVCQFLSQL

SEQ ID NO: 153676 - protein, 10 aa, Mycobacterium tuberculosis
TVCQFLSQLA

SEQ ID NO: 153677 - protein, 10 aa, Mycobacterium tuberculosis
QFLSQLACDL

SEQ ID NO: 153678 - protein, 10 aa, Mycobacterium tuberculosis
FLSQLACDLQ

SEQ ID NO: 153679 - protein, 10 aa, Mycobacterium tuberculosis
SQLACDLQEA

SEQ ID NO: 153680 - protein, 10 aa, Mycobacterium tuberculosis
QLACDLQEAV

SEQ ID NO: 153681 - protein, 10 aa, Mycobacterium tuberculosis
AVQHDDPWTL

SEQ ID NO: 153682 - protein, 10 aa, Mycobacterium tuberculosis
VQHDDPWTLV

SEQ ID NO: 153683 - protein, 10 aa, Mycobacterium tuberculosis
QHDDPWTLVF

SEQ ID NO: 153684 - protein, 10 aa, Mycobacterium tuberculosis
DPWTLVFHGY

SEQ ID NO: 153685 - protein, 10 aa, Mycobacterium tuberculosis
EALCAVGNGY

SEQ ID NO: 153686 - protein, 10 aa, Mycobacterium tuberculosis
ALCAVGNGYL

SEQ ID NO: 153687 - protein, 10 aa, Mycobacterium tuberculosis
AVGNGYLGSR

SEQ ID NO: 153688 - protein, 10 aa, Mycobacterium tuberculosis
APESAESEAH

SEQ ID NO: 153689 - protein, 10 aa, Mycobacterium tuberculosis
AESEAHYPGT

SEQ ID NO: 153690 - protein, 10 aa, Mycobacterium tuberculosis
ESEAHYPGTY

SEQ ID NO: 153691 - protein, 10 aa, Mycobacterium tuberculosis
SEAHYPGTYV

SEQ ID NO: 153692 - protein, 10 aa, Mycobacterium tuberculosis
EAHYPGTYVA

SEQ ID NO: 153693 - protein, 10 aa, Mycobacterium tuberculosis
HYPGTYVAGV

SEQ ID NO: 153694 - protein, 10 aa, Mycobacterium tuberculosis
YPGTYVAGVY

SEQ ID NO: 153695 - protein, 10 aa, Mycobacterium tuberculosis
TYVAGVYNQL

SEQ ID NO: 153696 - protein, 10 aa, Mycobacterium tuberculosis
YVAGVYNQLT

SEQ ID NO: 153697 - protein, 10 aa, Mycobacterium tuberculosis
GVYNQLTDHI

SEQ ID NO: 153698 - protein, 10 aa, Mycobacterium tuberculosis
QLTDHIEGCT

SEQ ID NO: 153699 - protein, 10 aa, Mycobacterium tuberculosis
LTDHIEGCTV

SEQ ID NO: 153700 - protein, 10 aa, Mycobacterium tuberculosis
EGCTVDNESL

SEQ ID NO: 153701 - protein, 10 aa, Mycobacterium tuberculosis
TVDNESLVNL

SEQ ID NO: 153702 - protein, 10 aa, Mycobacterium tuberculosis
NESLVNLPNW

SEQ ID NO: 153703 - protein, 10 aa, Mycobacterium tuberculosis
ESLVNLPNWL

SEQ ID NO: 153704 - protein, 10 aa, Mycobacterium tuberculosis
SLVNLPNWLS

SEQ ID NO: 153705 - protein, 10 aa, Mycobacterium tuberculosis
LVNLPNWLSL

SEQ ID NO: 153706 - protein, 10 aa, Mycobacterium tuberculosis
NLPNWLSLTF

SEQ ID NO: 153707 - protein, 10 aa, Mycobacterium tuberculosis
LPNWLSLTFR

SEQ ID NO: 153708 - protein, 10 aa, Mycobacterium tuberculosis
SLTFRIDGGA

SEQ ID NO: 153709 - protein, 10 aa, Mycobacterium tuberculosis
LTFRIDGGAW

SEQ ID NO: 153710 - protein, 10 aa, Mycobacterium tuberculosis
TFRIDGGAWF

SEQ ID NO: 153711 - protein, 10 aa, Mycobacterium tuberculosis
RIDGGAWFNV

SEQ ID NO: 153712 - protein, 10 aa, Mycobacterium tuberculosis
AWFNVDTVEL

SEQ ID NO: 153713 - protein, 10 aa, Mycobacterium tuberculosis
NVDTVELLSY

SEQ ID NO: 153714 - protein, 10 aa, Mycobacterium tuberculosis
DTVELLSYRQ

SEQ ID NO: 153715 - protein, 10 aa, Mycobacterium tuberculosis
VELLSYRQTF

SEQ ID NO: 153716 - protein, 10 aa, Mycobacterium tuberculosis
LLSYRQTFDL

SEQ ID NO: 153717 - protein, 10 aa, Mycobacterium tuberculosis
LSYRQTFDLR

SEQ ID NO: 153718 - protein, 10 aa, Mycobacterium tuberculosis
SYRQTFDLRR

SEQ ID NO: 153719 - protein, 10 aa, Mycobacterium tuberculosis
QTFDLRRATL

SEQ ID NO: 153720 - protein, 10 aa, Mycobacterium tuberculosis
RRATLTRSLR

SEQ ID NO: 153721 - protein, 10 aa, Mycobacterium tuberculosis
RATLTRSLRF

SEQ ID NO: 153722 - protein, 10 aa, Mycobacterium tuberculosis
ATLTRSLRFR

SEQ ID NO: 153723 - protein, 10 aa, Mycobacterium tuberculosis
SLRFRDAGGR

SEQ ID NO: 153724 - protein, 10 aa, Mycobacterium tuberculosis
TTMTQERFAS

SEQ ID NO: 153725 - protein, 10 aa, Mycobacterium tuberculosis
TMTQERFASM

SEQ ID NO: 153726 - protein, 10 aa, Mycobacterium tuberculosis
TQERFASMNR

SEQ ID NO: 153727 - protein, 10 aa, Mycobacterium tuberculosis
FASMNRPNLV

SEQ ID NO: 153728 - protein, 10 aa, Mycobacterium tuberculosis
SMNRPNLVAL

SEQ ID NO: 153729 - protein, 10 aa, Mycobacterium tuberculosis
RPNLVALQTR

SEQ ID NO: 153730 - protein, 10 aa, Mycobacterium tuberculosis
IESENWSGTV

SEQ ID NO: 153731 - protein, 10 aa, Mycobacterium tuberculosis
SENWSGTVDF

SEQ ID NO: 153732 - protein, 10 aa, Mycobacterium tuberculosis
ENWSGTVDFR

SEQ ID NO: 153733 - protein, 10 aa, Mycobacterium tuberculosis
SGTVDFRSLV

SEQ ID NO: 153734 - protein, 10 aa, Mycobacterium tuberculosis
SLVDGGVHNT

SEQ ID NO: 153735 - protein, 10 aa, Mycobacterium tuberculosis
LVDGGVHNTL

SEQ ID NO: 153736 - protein, 10 aa, Mycobacterium tuberculosis
GVHNTLVDRY

SEQ ID NO: 153737 - protein, 10 aa, Mycobacterium tuberculosis
VHNTLVDRYR

SEQ ID NO: 153738 - protein, 10 aa, Mycobacterium tuberculosis
TLVDRYRQLS

SEQ ID NO: 153739 - protein, 10 aa, Mycobacterium tuberculosis
RYRQLSSQHL

SEQ ID NO: 153740 - protein, 10 aa, Mycobacterium tuberculosis
RQLSSQHLTT

SEQ ID NO: 153741 - protein, 10 aa, Mycobacterium tuberculosis
QLSSQHLTTA

SEQ ID NO: 153742 - protein, 10 aa, Mycobacterium tuberculosis
HLTTAEIEVL

SEQ ID NO: 153743 - protein, 10 aa, Mycobacterium tuberculosis
AEIEVLADSV

SEQ ID NO: 153744 - protein, 10 aa, Mycobacterium tuberculosis
EIEVLADSVL

SEQ ID NO: 153745 - protein, 10 aa, Mycobacterium tuberculosis
IEVLADSVLL

SEQ ID NO: 153746 - protein, 10 aa, Mycobacterium tuberculosis
EVLADSVLLR

SEQ ID NO: 153747 - protein, 10 aa, Mycobacterium tuberculosis
VLADSVLLRT

SEQ ID NO: 153748 - protein, 10 aa, Mycobacterium tuberculosis
TQTSQSGIAI

SEQ ID NO: 153749 - protein, 10 aa, Mycobacterium tuberculosis
TSQSGIAIAV

SEQ ID NO: 153750 - protein, 10 aa, Mycobacterium tuberculosis
SQSGIAIAVA

SEQ ID NO: 153751 - protein, 10 aa, Mycobacterium tuberculosis
SGIAIAVAAR

SEQ ID NO: 153752 - protein, 10 aa, Mycobacterium tuberculosis
AIAVAARSTL

SEQ ID NO: 153753 - protein, 10 aa, Mycobacterium tuberculosis
IAVAARSTLW

SEQ ID NO: 153754 - protein, 10 aa, Mycobacterium tuberculosis
AVAARSTLWR

SEQ ID NO: 153755 - protein, 10 aa, Mycobacterium tuberculosis
RSTLWRDGQR

SEQ ID NO: 153756 - protein, 10 aa, Mycobacterium tuberculosis
STLWRDGQRV

SEQ ID NO: 153757 - protein, 10 aa, Mycobacterium tuberculosis
GQRVDAQYRV

SEQ ID NO: 153758 - protein, 10 aa, Mycobacterium tuberculosis
RVDAQYRVAR

SEQ ID NO: 153759 - protein, 10 aa, Mycobacterium tuberculosis
QYRVARDTNR

SEQ ID NO: 153760 - protein, 10 aa, Mycobacterium tuberculosis
QVTLSAGQSV

SEQ ID NO: 153761 - protein, 10 aa, Mycobacterium tuberculosis
TLSAGQSVTL

SEQ ID NO: 153762 - protein, 10 aa, Mycobacterium tuberculosis
SAGQSVTLEK

SEQ ID NO: 153763 - protein, 10 aa, Mycobacterium tuberculosis
VTLEKVATIF

SEQ ID NO: 153764 - protein, 10 aa, Mycobacterium tuberculosis
TLEKVATIFT

SEQ ID NO: 153765 - protein, 10 aa, Mycobacterium tuberculosis
EKVATIFTSR

SEQ ID NO: 153766 - protein, 10 aa, Mycobacterium tuberculosis
TSRDAATLTA

SEQ ID NO: 153767 - protein, 10 aa, Mycobacterium tuberculosis
TLTAAISAQR

SEQ ID NO: 153768 - protein, 10 aa, Mycobacterium tuberculosis
AQRCLGEAGR

SEQ ID NO: 153769 - protein, 10 aa, Mycobacterium tuberculosis
RYAELCQQHV

SEQ ID NO: 153770 - protein, 10 aa, Mycobacterium tuberculosis
YAELCQQHVR

SEQ ID NO: 153771 - protein, 10 aa, Mycobacterium tuberculosis
AELCQQHVRA

SEQ ID NO: 153772 - protein, 10 aa, Mycobacterium tuberculosis
CQQHVRAWAR

SEQ ID NO: 153773 - protein, 10 aa, Mycobacterium tuberculosis
QQHVRAWARL

SEQ ID NO: 153774 - protein, 10 aa, Mycobacterium tuberculosis
VRAWARLWER

SEQ ID NO: 153775 - protein, 10 aa, Mycobacterium tuberculosis
WARLWERCAI

SEQ ID NO: 153776 - protein, 10 aa, Mycobacterium tuberculosis
RLWERCAIDL

SEQ ID NO: 153777 - protein, 10 aa, Mycobacterium tuberculosis
DLTGNTEELR

SEQ ID NO: 153778 - protein, 10 aa, Mycobacterium tuberculosis
EELRLVRLHL

SEQ ID NO: 153779 - protein, 10 aa, Mycobacterium tuberculosis
ELRLVRLHLL

SEQ ID NO: 153780 - protein, 10 aa, Mycobacterium tuberculosis
RLVRLHLLHL

SEQ ID NO: 153781 - protein, 10 aa, Mycobacterium tuberculosis
LVRLHLLHLL

SEQ ID NO: 153782 - protein, 10 aa, Mycobacterium tuberculosis
RLHLLHLLQT

SEQ ID NO: 153783 - protein, 10 aa, Mycobacterium tuberculosis
HLLQTISPHT

SEQ ID NO: 153784 - protein, 10 aa, Mycobacterium tuberculosis
LLQTISPHTA

SEQ ID NO: 153785 - protein, 10 aa, Mycobacterium tuberculosis
QTISPHTAEL

SEQ ID NO: 153786 - protein, 10 aa, Mycobacterium tuberculosis
VPARGLNGEA

SEQ ID NO: 153787 - protein, 10 aa, Mycobacterium tuberculosis
GEAYRGHVFW

SEQ ID NO: 153788 - protein, 10 aa, Mycobacterium tuberculosis
YRGHVFWDAL

SEQ ID NO: 153789 - protein, 10 aa, Mycobacterium tuberculosis
HVFWDALFVA

SEQ ID NO: 153790 - protein, 10 aa, Mycobacterium tuberculosis
FWDALFVAPV

SEQ ID NO: 153791 - protein, 10 aa, Mycobacterium tuberculosis
ALFVAPVLSL

SEQ ID NO: 153792 - protein, 10 aa, Mycobacterium tuberculosis
LFVAPVLSLR

SEQ ID NO: 153793 - protein, 10 aa, Mycobacterium tuberculosis
FVAPVLSLRM

SEQ ID NO: 153794 - protein, 10 aa, Mycobacterium tuberculosis
APVLSLRMPK

SEQ ID NO: 153795 - protein, 10 aa, Mycobacterium tuberculosis
PVLSLRMPKV

SEQ ID NO: 153796 - protein, 10 aa, Mycobacterium tuberculosis
VLSLRMPKVA

SEQ ID NO: 153797 - protein, 10 aa, Mycobacterium tuberculosis
LSLRMPKVAR

SEQ ID NO: 153798 - protein, 10 aa, Mycobacterium tuberculosis
LRMPKVARSL

SEQ ID NO: 153799 - protein, 10 aa, Mycobacterium tuberculosis
RMPKVARSLL

SEQ ID NO: 153800 - protein, 10 aa, Mycobacterium tuberculosis
KVARSLLDYR

SEQ ID NO: 153801 - protein, 10 aa, Mycobacterium tuberculosis
ARSLLDYRYR

SEQ ID NO: 153802 - protein, 10 aa, Mycobacterium tuberculosis
RSLLDYRYRR

SEQ ID NO: 153803 - protein, 10 aa, Mycobacterium tuberculosis
SLLDYRYRRL

SEQ ID NO: 153804 - protein, 10 aa, Mycobacterium tuberculosis
YRYRRLPAAR

SEQ ID NO: 153805 - protein, 10 aa, Mycobacterium tuberculosis
RYRRLPAARR

SEQ ID NO: 153806 - protein, 10 aa, Mycobacterium tuberculosis
RRLPAARRAA

SEQ ID NO: 153807 - protein, 10 aa, Mycobacterium tuberculosis
LPAARRAAHR

SEQ ID NO: 153808 - protein, 10 aa, Mycobacterium tuberculosis
RRAAHRAGHL

SEQ ID NO: 153809 - protein, 10 aa, Mycobacterium tuberculosis
HRAGHLGAMY

SEQ ID NO: 153810 - protein, 10 aa, Mycobacterium tuberculosis
HLGAMYPWQS

SEQ ID NO: 153811 - protein, 10 aa, Mycobacterium tuberculosis
AMYPWQSGSD

SEQ ID NO: 153812 - protein, 10 aa, Mycobacterium tuberculosis
YPWQSGSDGS

SEQ ID NO: 153813 - protein, 10 aa, Mycobacterium tuberculosis
WQSGSDGSEV

SEQ ID NO: 153814 - protein, 10 aa, Mycobacterium tuberculosis
VSQQLHLNPR

SEQ ID NO: 153815 - protein, 10 aa, Mycobacterium tuberculosis
QLHLNPRSGR

SEQ ID NO: 153816 - protein, 10 aa, Mycobacterium tuberculosis
HLNPRSGRWT

SEQ ID NO: 153817 - protein, 10 aa, Mycobacterium tuberculosis
NPRSGRWTPD

SEQ ID NO: 153818 - protein, 10 aa, Mycobacterium tuberculosis
VGLAVAYNAW

SEQ ID NO: 153819 - protein, 10 aa, Mycobacterium tuberculosis
LAVAYNAWHY

SEQ ID NO: 153820 - protein, 10 aa, Mycobacterium tuberculosis
AVAYNAWHYY

SEQ ID NO: 153821 - protein, 10 aa, Mycobacterium tuberculosis
AYNAWHYYQV

SEQ ID NO: 153822 - protein, 10 aa, Mycobacterium tuberculosis
YYQVTGDRQY

SEQ ID NO: 153823 - protein, 10 aa, Mycobacterium tuberculosis
YQVTGDRQYL

SEQ ID NO: 153824 - protein, 10 aa, Mycobacterium tuberculosis
QVTGDRQYLV

SEQ ID NO: 153825 - protein, 10 aa, Mycobacterium tuberculosis
QYLVDCGAEL

SEQ ID NO: 153826 - protein, 10 aa, Mycobacterium tuberculosis
YLVDCGAELL

SEQ ID NO: 153827 - protein, 10 aa, Mycobacterium tuberculosis
LVDCGAELLV

SEQ ID NO: 153828 - protein, 10 aa, Mycobacterium tuberculosis
AELLVEIARF

SEQ ID NO: 153829 - protein, 10 aa, Mycobacterium tuberculosis
LLVEIARFWV

SEQ ID NO: 153830 - protein, 10 aa, Mycobacterium tuberculosis
VEIARFWVGL

SEQ ID NO: 153831 - protein, 10 aa, Mycobacterium tuberculosis
EIARFWVGLA

SEQ ID NO: 153832 - protein, 10 aa, Mycobacterium tuberculosis
IARFWVGLAK

SEQ ID NO: 153833 - protein, 10 aa, Mycobacterium tuberculosis
ARFWVGLAKL

SEQ ID NO: 153834 - protein, 10 aa, Mycobacterium tuberculosis
LAKLDDSRGR

SEQ ID NO: 153835 - protein, 10 aa, Mycobacterium tuberculosis
KLDDSRGRYL

SEQ ID NO: 153836 - protein, 10 aa, Mycobacterium tuberculosis
RGRYLIRGVI

SEQ ID NO: 153837 - protein, 10 aa, Mycobacterium tuberculosis
FHSGYPGNEY

SEQ ID NO: 153838 - protein, 10 aa, Mycobacterium tuberculosis
GYPGNEYDGI

SEQ ID NO: 153839 - protein, 10 aa, Mycobacterium tuberculosis
EYDGIDNNAY

SEQ ID NO: 153840 - protein, 10 aa, Mycobacterium tuberculosis
GIDNNAYTNV

SEQ ID NO: 153841 - protein, 10 aa, Mycobacterium tuberculosis
NNAYTNVMAV

SEQ ID NO: 153842 - protein, 10 aa, Mycobacterium tuberculosis
NAYTNVMAVW

SEQ ID NO: 153843 - protein, 10 aa, Mycobacterium tuberculosis
AYTNVMAVWV

SEQ ID NO: 153844 - protein, 10 aa, Mycobacterium tuberculosis
YTNVMAVWVI

SEQ ID NO: 153845 - protein, 10 aa, Mycobacterium tuberculosis
NVMAVWVILR

SEQ ID NO: 153846 - protein, 10 aa, Mycobacterium tuberculosis
VMAVWVILRA

SEQ ID NO: 153847 - protein, 10 aa, Mycobacterium tuberculosis
MAVWVILRAM

SEQ ID NO: 153848 - protein, 10 aa, Mycobacterium tuberculosis
WVILRAMEAL

SEQ ID NO: 153849 - protein, 10 aa, Mycobacterium tuberculosis
ILRAMEALDL

SEQ ID NO: 153850 - protein, 10 aa, Mycobacterium tuberculosis
AMEALDLLPL

SEQ ID NO: 153851 - protein, 10 aa, Mycobacterium tuberculosis
LLPLTDRRHL

SEQ ID NO: 153852 - protein, 10 aa, Mycobacterium tuberculosis
LPLTDRRHLI

SEQ ID NO: 153853 - protein, 10 aa, Mycobacterium tuberculosis
LTDRRHLIEK

SEQ ID NO: 153854 - protein, 10 aa, Mycobacterium tuberculosis
RRHLIEKLGL

SEQ ID NO: 153855 - protein, 10 aa, Mycobacterium tuberculosis
HLIEKLGLTT

SEQ ID NO: 153856 - protein, 10 aa, Mycobacterium tuberculosis
QWDDVSRRMF

SEQ ID NO: 153857 - protein, 10 aa, Mycobacterium tuberculosis
DVSRRMFVPF

SEQ ID NO: 153858 - protein, 10 aa, Mycobacterium tuberculosis
RMFVPFHDGV

SEQ ID NO: 153859 - protein, 10 aa, Mycobacterium tuberculosis
PFHDGVISQF

SEQ ID NO: 153860 - protein, 10 aa, Mycobacterium tuberculosis
SQFEGYSELA

SEQ ID NO: 153861 - protein, 10 aa, Mycobacterium tuberculosis
FEGYSELAEL

SEQ ID NO: 153862 - protein, 10 aa, Mycobacterium tuberculosis
GYSELAELDW

SEQ ID NO: 153863 - protein, 10 aa, Mycobacterium tuberculosis
ELAELDWDHY

SEQ ID NO: 153864 - protein, 10 aa, Mycobacterium tuberculosis
LAELDWDHYR

SEQ ID NO: 153865 - protein, 10 aa, Mycobacterium tuberculosis
ELDWDHYRHR

SEQ ID NO: 153866 - protein, 10 aa, Mycobacterium tuberculosis
RYGNIQRLDR

SEQ ID NO: 153867 - protein, 10 aa, Mycobacterium tuberculosis
RLDRILEAEG

SEQ ID NO: 153868 - protein, 10 aa, Mycobacterium tuberculosis
RILEAEGDSV

SEQ ID NO: 153869 - protein, 10 aa, Mycobacterium tuberculosis
EAEGDSVNNY

SEQ ID NO: 153870 - protein, 10 aa, Mycobacterium tuberculosis
DSVNNYQASK

SEQ ID NO: 153871 - protein, 10 aa, Mycobacterium tuberculosis
YQASKQADAL

SEQ ID NO: 153872 - protein, 10 aa, Mycobacterium tuberculosis
QASKQADALM

SEQ ID NO: 153873 - protein, 10 aa, Mycobacterium tuberculosis
KQADALMLLY

SEQ ID NO: 153874 - protein, 10 aa, Mycobacterium tuberculosis
QADALMLLYL

SEQ ID NO: 153875 - protein, 10 aa, Mycobacterium tuberculosis
ALMLLYLLSS

SEQ ID NO: 153876 - protein, 10 aa, Mycobacterium tuberculosis
LLYLLSSDEL

SEQ ID NO: 153877 - protein, 10 aa, Mycobacterium tuberculosis
LYLLSSDELI

SEQ ID NO: 153878 - protein, 10 aa, Mycobacterium tuberculosis
YLLSSDELIG

SEQ ID NO: 153879 - protein, 10 aa, Mycobacterium tuberculosis
LLSSDELIGL

SEQ ID NO: 153880 - protein, 10 aa, Mycobacterium tuberculosis
LSSDELIGLL

SEQ ID NO: 153881 - protein, 10 aa, Mycobacterium tuberculosis
DELIGLLARL

SEQ ID NO: 153882 - protein, 10 aa, Mycobacterium tuberculosis
IGLLARLGYR

SEQ ID NO: 153883 - protein, 10 aa, Mycobacterium tuberculosis
GLLARLGYRF

SEQ ID NO: 153884 - protein, 10 aa, Mycobacterium tuberculosis
LLARLGYRFA

SEQ ID NO: 153885 - protein, 10 aa, Mycobacterium tuberculosis
FAPTQIPGTV

SEQ ID NO: 153886 - protein, 10 aa, Mycobacterium tuberculosis
TQIPGTVDYY

SEQ ID NO: 153887 - protein, 10 aa, Mycobacterium tuberculosis
QIPGTVDYYL

SEQ ID NO: 153888 - protein, 10 aa, Mycobacterium tuberculosis
IPGTVDYYLA

SEQ ID NO: 153889 - protein, 10 aa, Mycobacterium tuberculosis
YYLARTSDGS

SEQ ID NO: 153890 - protein, 10 aa, Mycobacterium tuberculosis
YLARTSDGST

SEQ ID NO: 153891 - protein, 10 aa, Mycobacterium tuberculosis
LARTSDGSTL

SEQ ID NO: 153892 - protein, 10 aa, Mycobacterium tuberculosis
RTSDGSTLSA

SEQ ID NO: 153893 - protein, 10 aa, Mycobacterium tuberculosis
TSDGSTLSAV

SEQ ID NO: 153894 - protein, 10 aa, Mycobacterium tuberculosis
STLSAVVHAW

SEQ ID NO: 153895 - protein, 10 aa, Mycobacterium tuberculosis
TLSAVVHAWV

SEQ ID NO: 153896 - protein, 10 aa, Mycobacterium tuberculosis
LSAVVHAWVL

SEQ ID NO: 153897 - protein, 10 aa, Mycobacterium tuberculosis
AVVHAWVLAR

SEQ ID NO: 153898 - protein, 10 aa, Mycobacterium tuberculosis
VVHAWVLARA

SEQ ID NO: 153899 - protein, 10 aa, Mycobacterium tuberculosis
HAWVLARANR

SEQ ID NO: 153900 - protein, 10 aa, Mycobacterium tuberculosis
VLARANRSNA

SEQ ID NO: 153901 - protein, 10 aa, Mycobacterium tuberculosis
LARANRSNAM

SEQ ID NO: 153902 - protein, 10 aa, Mycobacterium tuberculosis
RANRSNAMEY

SEQ ID NO: 153903 - protein, 10 aa, Mycobacterium tuberculosis
NRSNAMEYFR

SEQ ID NO: 153904 - protein, 10 aa, Mycobacterium tuberculosis
NAMEYFRQVL

SEQ ID NO: 153905 - protein, 10 aa, Mycobacterium tuberculosis
AMEYFRQVLR

SEQ ID NO: 153906 - protein, 10 aa, Mycobacterium tuberculosis
YFRQVLRSDI

SEQ ID NO: 153907 - protein, 10 aa, Mycobacterium tuberculosis
QVLRSDIADV

SEQ ID NO: 153908 - protein, 10 aa, Mycobacterium tuberculosis
VQGGTTQEGI

SEQ ID NO: 153909 - protein, 10 aa, Mycobacterium tuberculosis
TTQEGIHLAA

SEQ ID NO: 153910 - protein, 10 aa, Mycobacterium tuberculosis
TQEGIHLAAM

SEQ ID NO: 153911 - protein, 10 aa, Mycobacterium tuberculosis
LAAMAGSIDL

SEQ ID NO: 153912 - protein, 10 aa, Mycobacterium tuberculosis
AAMAGSIDLL

SEQ ID NO: 153913 - protein, 10 aa, Mycobacterium tuberculosis
AMAGSIDLLQ

SEQ ID NO: 153914 - protein, 10 aa, Mycobacterium tuberculosis
MAGSIDLLQR

SEQ ID NO: 153915 - protein, 10 aa, Mycobacterium tuberculosis
GSIDLLQRCY

SEQ ID NO: 153916 - protein, 10 aa, Mycobacterium tuberculosis
DLLQRCYSGL

SEQ ID NO: 153917 - protein, 10 aa, Mycobacterium tuberculosis
LQRCYSGLEL

SEQ ID NO: 153918 - protein, 10 aa, Mycobacterium tuberculosis
GLELRDDRLV

SEQ ID NO: 153919 - protein, 10 aa, Mycobacterium tuberculosis
LELRDDRLVL

SEQ ID NO: 153920 - protein, 10 aa, Mycobacterium tuberculosis
LVLSPQWPEA

SEQ ID NO: 153921 - protein, 10 aa, Mycobacterium tuberculosis
VLSPQWPEAL

SEQ ID NO: 153922 - protein, 10 aa, Mycobacterium tuberculosis
WPEALGPLEF

SEQ ID NO: 153923 - protein, 10 aa, Mycobacterium tuberculosis
EALGPLEFPF

SEQ ID NO: 153924 - protein, 10 aa, Mycobacterium tuberculosis
ALGPLEFPFV

SEQ ID NO: 153925 - protein, 10 aa, Mycobacterium tuberculosis
PLEFPFVYRR

SEQ ID NO: 153926 - protein, 10 aa, Mycobacterium tuberculosis
FPFVYRRHQL

SEQ ID NO: 153927 - protein, 10 aa, Mycobacterium tuberculosis
FVYRRHQLSL

SEQ ID NO: 153928 - protein, 10 aa, Mycobacterium tuberculosis
VYRRHQLSLR

SEQ ID NO: 153929 - protein, 10 aa, Mycobacterium tuberculosis
HQLSLRISGR

SEQ ID NO: 153930 - protein, 10 aa, Mycobacterium tuberculosis
LRISGRSATL

SEQ ID NO: 153931 - protein, 10 aa, Mycobacterium tuberculosis
ESGDAEPIEV

SEQ ID NO: 153932 - protein, 10 aa, Mycobacterium tuberculosis
DAEPIEVECR

SEQ ID NO: 153933 - protein, 10 aa, Mycobacterium tuberculosis
EVECRGHVQR

SEQ ID NO: 153934 - protein, 10 aa, Mycobacterium tuberculosis
VECRGHVQRL

SEQ ID NO: 153935 - protein, 10 aa, Mycobacterium tuberculosis
ECRGHVQRLR

SEQ ID NO: 153936 - protein, 10 aa, Mycobacterium tuberculosis
VQRLRCGHTI

SEQ ID NO: 153937 - protein, 10 aa, Mycobacterium tuberculosis
RLRCGHTIEV

SEQ ID NO: 153938 - protein, 11 aa, Mycobacterium tuberculosis
NVTGPPPTIDR

SEQ ID NO: 153939 - protein, 11 aa, Mycobacterium tuberculosis
VTGPPPTIDRR

SEQ ID NO: 153940 - protein, 11 aa, Mycobacterium tuberculosis
PTIDRRYHDAV

SEQ ID NO: 153941 - protein, 11 aa, Mycobacterium tuberculosis
TIDRRYHDAVI

SEQ ID NO: 153942 - protein, 11 aa, Mycobacterium tuberculosis
RRYHDAVIVGL

SEQ ID NO: 153943 - protein, 11 aa, Mycobacterium tuberculosis
HDAVIVGLDNV

SEQ ID NO: 153944 - protein, 11 aa, Mycobacterium tuberculosis
DAVIVGLDNVV

SEQ ID NO: 153945 - protein, 11 aa, Mycobacterium tuberculosis
VIVGLDNVVDK

SEQ ID NO: 153946 - protein, 11 aa, Mycobacterium tuberculosis
VVDKATRVHAA

SEQ ID NO: 153947 - protein, 11 aa, Mycobacterium tuberculosis
ATRVHAAAWTK

SEQ ID NO: 153948 - protein, 11 aa, Mycobacterium tuberculosis
RVHAAAWTKFL

SEQ ID NO: 153949 - protein, 11 aa, Mycobacterium tuberculosis
AAAWTKFLDDY

SEQ ID NO: 153950 - protein, 11 aa, Mycobacterium tuberculosis
AAWTKFLDDYL

SEQ ID NO: 153951 - protein, 11 aa, Mycobacterium tuberculosis
WTKFLDDYLTR

SEQ ID NO: 153952 - protein, 11 aa, Mycobacterium tuberculosis
TKFLDDYLTRR

SEQ ID NO: 153953 - protein, 11 aa, Mycobacterium tuberculosis
FLDDYLTRRPQ

SEQ ID NO: 153954 - protein, 11 aa, Mycobacterium tuberculosis
YLTRRPQRTGE

SEQ ID NO: 153955 - protein, 11 aa, Mycobacterium tuberculosis
CPLTHDDYRRF

SEQ ID NO: 153956 - protein, 11 aa, Mycobacterium tuberculosis
PLTHDDYRRFL

SEQ ID NO: 153957 - protein, 11 aa, Mycobacterium tuberculosis
RRFLAGKPDGV

SEQ ID NO: 153958 - protein, 11 aa, Mycobacterium tuberculosis
FLAGKPDGVAD

SEQ ID NO: 153959 - protein, 11 aa, Mycobacterium tuberculosis
KPDGVADFLAA

SEQ ID NO: 153960 - protein, 11 aa, Mycobacterium tuberculosis
GVADFLAARGI

SEQ ID NO: 153961 - protein, 11 aa, Mycobacterium tuberculosis
RLPPGSPTDLT

SEQ ID NO: 153962 - protein, 11 aa, Mycobacterium tuberculosis
SPTDLTDDTVY

SEQ ID NO: 153963 - protein, 11 aa, Mycobacterium tuberculosis
DLTDDTVYGLQ

SEQ ID NO: 153964 - protein, 11 aa, Mycobacterium tuberculosis
DTVYGLQNLER

SEQ ID NO: 153965 - protein, 11 aa, Mycobacterium tuberculosis
TVYGLQNLERQ

SEQ ID NO: 153966 - protein, 11 aa, Mycobacterium tuberculosis
GLQNLERQTFL

SEQ ID NO: 153967 - protein, 11 aa, Mycobacterium tuberculosis
NLERQTFLQLL

SEQ ID NO: 153968 - protein, 11 aa, Mycobacterium tuberculosis
QTFLQLLNTGV

SEQ ID NO: 153969 - protein, 11 aa, Mycobacterium tuberculosis
QLLNTGVPEGK

SEQ ID NO: 153970 - protein, 11 aa, Mycobacterium tuberculosis
GVPEGKSIASF

SEQ ID NO: 153971 - protein, 11 aa, Mycobacterium tuberculosis
VPEGKSIASFA

SEQ ID NO: 153972 - protein, 11 aa, Mycobacterium tuberculosis
EGKSIASFARR

SEQ ID NO: 153973 - protein, 11 aa, Mycobacterium tuberculosis
SIASFARRLQV

SEQ ID NO: 153974 - protein, 11 aa, Mycobacterium tuberculosis
SFARRLQVAGV

SEQ ID NO: 153975 - protein, 11 aa, Mycobacterium tuberculosis
FARRLQVAGVR

SEQ ID NO: 153976 - protein, 11 aa, Mycobacterium tuberculosis
RRLQVAGVRVA

SEQ ID NO: 153977 - protein, 11 aa, Mycobacterium tuberculosis
RLQVAGVRVAA

SEQ ID NO: 153978 - protein, 11 aa, Mycobacterium tuberculosis
LQVAGVRVAAH

SEQ ID NO: 153979 - protein, 11 aa, Mycobacterium tuberculosis
QVAGVRVAAHT

SEQ ID NO: 153980 - protein, 11 aa, Mycobacterium tuberculosis
GVRVAAHTSHR

SEQ ID NO: 153981 - protein, 11 aa, Mycobacterium tuberculosis
RVAAHTSHRNY

SEQ ID NO: 153982 - protein, 11 aa, Mycobacterium tuberculosis
HTSHRNYGHTL

SEQ ID NO: 153983 - protein, 11 aa, Mycobacterium tuberculosis
NYGHTLDATGL

SEQ ID NO: 153984 - protein, 11 aa, Mycobacterium tuberculosis
HTLDATGLAEV

SEQ ID NO: 153985 - protein, 11 aa, Mycobacterium tuberculosis
TLDATGLAEVF

SEQ ID NO: 153986 - protein, 11 aa, Mycobacterium tuberculosis
DATGLAEVFAV

SEQ ID NO: 153987 - protein, 11 aa, Mycobacterium tuberculosis
TGLAEVFAVFV

SEQ ID NO: 153988 - protein, 11 aa, Mycobacterium tuberculosis
AEVFAVFVDGA

SEQ ID NO: 153989 - protein, 11 aa, Mycobacterium tuberculosis
EVFAVFVDGAV

SEQ ID NO: 153990 - protein, 11 aa, Mycobacterium tuberculosis
FAVFVDGAVTA

SEQ ID NO: 153991 - protein, 11 aa, Mycobacterium tuberculosis
VFVDGAVTAEL

SEQ ID NO: 153992 - protein, 11 aa, Mycobacterium tuberculosis
GLPAEPNPAGL

SEQ ID NO: 153993 - protein, 11 aa, Mycobacterium tuberculosis
LPAEPNPAGLI

SEQ ID NO: 153994 - protein, 11 aa, Mycobacterium tuberculosis
AEPNPAGLIET

SEQ ID NO: 153995 - protein, 11 aa, Mycobacterium tuberculosis
EPNPAGLIETA

SEQ ID NO: 153996 - protein, 11 aa, Mycobacterium tuberculosis
NPAGLIETAKR

SEQ ID NO: 153997 - protein, 11 aa, Mycobacterium tuberculosis
GLIETAKRLGA

SEQ ID NO: 153998 - protein, 11 aa, Mycobacterium tuberculosis
TAKRLGANPGR

SEQ ID NO: 153999 - protein, 11 aa, Mycobacterium tuberculosis
KRLGANPGRCV

SEQ ID NO: 154000 - protein, 11 aa, Mycobacterium tuberculosis
RLGANPGRCVV

SEQ ID NO: 154001 - protein, 11 aa, Mycobacterium tuberculosis
CVVIDSCQTGL

SEQ ID NO: 154002 - protein, 11 aa, Mycobacterium tuberculosis
VVIDSCQTGLR

SEQ ID NO: 154003 - protein, 11 aa, Mycobacterium tuberculosis
VIDSCQTGLRA

SEQ ID NO: 154004 - protein, 11 aa, Mycobacterium tuberculosis
DSCQTGLRAGR

SEQ ID NO: 154005 - protein, 11 aa, Mycobacterium tuberculosis
GLRAGRNGGFA

SEQ ID NO: 154006 - protein, 11 aa, Mycobacterium tuberculosis
LRAGRNGGFAL

SEQ ID NO: 154007 - protein, 11 aa, Mycobacterium tuberculosis
RAGRNGGFALV

SEQ ID NO: 154008 - protein, 11 aa, Mycobacterium tuberculosis
AVDAHGDAENL

SEQ ID NO: 154009 - protein, 11 aa, Mycobacterium tuberculosis
AENLLSSGADA

SEQ ID NO: 154010 - protein, 11 aa, Mycobacterium tuberculosis
NLLSSGADAVV

SEQ ID NO: 154011 - protein, 11 aa, Mycobacterium tuberculosis
LLSSGADAVVA

SEQ ID NO: 154012 - protein, 11 aa, Mycobacterium tuberculosis
SGADAVVADLA

SEQ ID NO: 154013 - protein, 11 aa, Mycobacterium tuberculosis
DAVVADLAAVT

SEQ ID NO: 154014 - protein, 11 aa, Mycobacterium tuberculosis
AVVADLAAVTV

SEQ ID NO: 154015 - protein, 11 aa, Mycobacterium tuberculosis
DAAISTIPDAL

SEQ ID NO: 154016 - protein, 11 aa, Mycobacterium tuberculosis
AISTIPDALQV

SEQ ID NO: 154017 - protein, 11 aa, Mycobacterium tuberculosis
ISTIPDALQVY

SEQ ID NO: 154018 - protein, 11 aa, Mycobacterium tuberculosis
TIPDALQVYSQ

SEQ ID NO: 154019 - protein, 11 aa, Mycobacterium tuberculosis
IPDALQVYSQL

SEQ ID NO: 154020 - protein, 11 aa, Mycobacterium tuberculosis
DALQVYSQLKR

SEQ ID NO: 154021 - protein, 11 aa, Mycobacterium tuberculosis
ALQVYSQLKRL

SEQ ID NO: 154022 - protein, 11 aa, Mycobacterium tuberculosis
LQVYSQLKRLL

SEQ ID NO: 154023 - protein, 11 aa, Mycobacterium tuberculosis
YSQLKRLLTGR

SEQ ID NO: 154024 - protein, 11 aa, Mycobacterium tuberculosis
SQLKRLLTGRR

SEQ ID NO: 154025 - protein, 11 aa, Mycobacterium tuberculosis
KRLLTGRRPAV

SEQ ID NO: 154026 - protein, 11 aa, Mycobacterium tuberculosis
RLLTGRRPAVF

SEQ ID NO: 154027 - protein, 11 aa, Mycobacterium tuberculosis
LLTGRRPAVFL

SEQ ID NO: 154028 - protein, 11 aa, Mycobacterium tuberculosis
FLDFDGTLSDI

SEQ ID NO: 154029 - protein, 11 aa, Mycobacterium tuberculosis
TLSDIVERPEA

SEQ ID NO: 154030 - protein, 11 aa, Mycobacterium tuberculosis
DIVERPEAATL

SEQ ID NO: 154031 - protein, 11 aa, Mycobacterium tuberculosis
IVERPEAATLV

SEQ ID NO: 154032 - protein, 11 aa, Mycobacterium tuberculosis
TLVDGAAEALR

SEQ ID NO: 154033 - protein, 11 aa, Mycobacterium tuberculosis
LVDGAAEALRA

SEQ ID NO: 154034 - protein, 11 aa, Mycobacterium tuberculosis
GAAEALRALAA

SEQ ID NO: 154035 - protein, 11 aa, Mycobacterium tuberculosis
AEALRALAAQC

SEQ ID NO: 154036 - protein, 11 aa, Mycobacterium tuberculosis
ALRALAAQCPV

SEQ ID NO: 154037 - protein, 11 aa, Mycobacterium tuberculosis
RALAAQCPVAV

SEQ ID NO: 154038 - protein, 11 aa, Mycobacterium tuberculosis
ALAAQCPVAVI

SEQ ID NO: 154039 - protein, 11 aa, Mycobacterium tuberculosis
AQCPVAVISGR

SEQ ID NO: 154040 - protein, 11 aa, Mycobacterium tuberculosis
CPVAVISGRDL

SEQ ID NO: 154041 - protein, 11 aa, Mycobacterium tuberculosis
AVISGRDLADV

SEQ ID NO: 154042 - protein, 11 aa, Mycobacterium tuberculosis
VISGRDLADVR

SEQ ID NO: 154043 - protein, 11 aa, Mycobacterium tuberculosis
DLADVRNRVKV

SEQ ID NO: 154044 - protein, 11 aa, Mycobacterium tuberculosis
DVRNRVKVDGL

SEQ ID NO: 154045 - protein, 11 aa, Mycobacterium tuberculosis
LWLAGSHGFEL

SEQ ID NO: 154046 - protein, 11 aa, Mycobacterium tuberculosis
WLAGSHGFELV

SEQ ID NO: 154047 - protein, 11 aa, Mycobacterium tuberculosis
ELVAPDGSHHQ

SEQ ID NO: 154048 - protein, 11 aa, Mycobacterium tuberculosis
VAPDGSHHQNA

SEQ ID NO: 154049 - protein, 11 aa, Mycobacterium tuberculosis
APDGSHHQNAA

SEQ ID NO: 154050 - protein, 11 aa, Mycobacterium tuberculosis
HHQNAAATAAI

SEQ ID NO: 154051 - protein, 11 aa, Mycobacterium tuberculosis
NAAATAAIDGL

SEQ ID NO: 154052 - protein, 11 aa, Mycobacterium tuberculosis
ATAAIDGLAEA

SEQ ID NO: 154053 - protein, 11 aa, Mycobacterium tuberculosis
TAAIDGLAEAA

SEQ ID NO: 154054 - protein, 11 aa, Mycobacterium tuberculosis
AAIDGLAEAAA

SEQ ID NO: 154055 - protein, 11 aa, Mycobacterium tuberculosis
AIDGLAEAAAQ

SEQ ID NO: 154056 - protein, 11 aa, Mycobacterium tuberculosis
AEAAAQLADAL

SEQ ID NO: 154057 - protein, 11 aa, Mycobacterium tuberculosis
EAAAQLADALR

SEQ ID NO: 154058 - protein, 11 aa, Mycobacterium tuberculosis
AQLADALREIA

SEQ ID NO: 154059 - protein, 11 aa, Mycobacterium tuberculosis
DALREIAGAVV

SEQ ID NO: 154060 - protein, 11 aa, Mycobacterium tuberculosis
EIAGAVVEHKR

SEQ ID NO: 154061 - protein, 11 aa, Mycobacterium tuberculosis
IAGAVVEHKRF

SEQ ID NO: 154062 - protein, 11 aa, Mycobacterium tuberculosis
GAVVEHKRFAV

SEQ ID NO: 154063 - protein, 11 aa, Mycobacterium tuberculosis
AVVEHKRFAVA

SEQ ID NO: 154064 - protein, 11 aa, Mycobacterium tuberculosis
VVEHKRFAVAV

SEQ ID NO: 154065 - protein, 11 aa, Mycobacterium tuberculosis
HKRFAVAVHYR

SEQ ID NO: 154066 - protein, 11 aa, Mycobacterium tuberculosis
KRFAVAVHYRN

SEQ ID NO: 154067 - protein, 11 aa, Mycobacterium tuberculosis
FAVAVHYRNVA

SEQ ID NO: 154068 - protein, 11 aa, Mycobacterium tuberculosis
NVADDSVDNLI

SEQ ID NO: 154069 - protein, 11 aa, Mycobacterium tuberculosis
DSVDNLIAAVR

SEQ ID NO: 154070 - protein, 11 aa, Mycobacterium tuberculosis
SVDNLIAAVRR

SEQ ID NO: 154071 - protein, 11 aa, Mycobacterium tuberculosis
LIAAVRRLGHA

SEQ ID NO: 154072 - protein, 11 aa, Mycobacterium tuberculosis
AVRRLGHAAGL

SEQ ID NO: 154073 - protein, 11 aa, Mycobacterium tuberculosis
RRLGHAAGLRV

SEQ ID NO: 154074 - protein, 11 aa, Mycobacterium tuberculosis
HAAGLRVTTGR

SEQ ID NO: 154075 - protein, 11 aa, Mycobacterium tuberculosis
AAGLRVTTGRK

SEQ ID NO: 154076 - protein, 11 aa, Mycobacterium tuberculosis
GLRVTTGRKVV

SEQ ID NO: 154077 - protein, 11 aa, Mycobacterium tuberculosis
RVTTGRKVVEL

SEQ ID NO: 154078 - protein, 11 aa, Mycobacterium tuberculosis
VTTGRKVVELR

SEQ ID NO: 154079 - protein, 11 aa, Mycobacterium tuberculosis
KVVELRPDIAW

SEQ ID NO: 154080 - protein, 11 aa, Mycobacterium tuberculosis
IAWDKGKALDW

SEQ ID NO: 154081 - protein, 11 aa, Mycobacterium tuberculosis
KGKALDWIGER

SEQ ID NO: 154082 - protein, 11 aa, Mycobacterium tuberculosis
ALDWIGERLGP

SEQ ID NO: 154083 - protein, 11 aa, Mycobacterium tuberculosis
WIGERLGPAEV

SEQ ID NO: 154084 - protein, 11 aa, Mycobacterium tuberculosis
RLGPAEVGPDL

SEQ ID NO: 154085 - protein, 11 aa, Mycobacterium tuberculosis
GPAEVGPDLRL

SEQ ID NO: 154086 - protein, 11 aa, Mycobacterium tuberculosis
AEVGPDLRLPI

SEQ ID NO: 154087 - protein, 11 aa, Mycobacterium tuberculosis
EVGPDLRLPIY

SEQ ID NO: 154088 - protein, 11 aa, Mycobacterium tuberculosis
YIGDDLTDEDA

SEQ ID NO: 154089 - protein, 11 aa, Mycobacterium tuberculosis
DLTDEDAFDAV

SEQ ID NO: 154090 - protein, 11 aa, Mycobacterium tuberculosis
LTDEDAFDAVR

SEQ ID NO: 154091 - protein, 11 aa, Mycobacterium tuberculosis
DAFDAVRFTGV

SEQ ID NO: 154092 - protein, 11 aa, Mycobacterium tuberculosis
DAVRFTGVGIV

SEQ ID NO: 154093 - protein, 11 aa, Mycobacterium tuberculosis
AVRFTGVGIVV

SEQ ID NO: 154094 - protein, 11 aa, Mycobacterium tuberculosis
IVVRHNEHGDR

SEQ ID NO: 154095 - protein, 11 aa, Mycobacterium tuberculosis
VVRHNEHGDRR

SEQ ID NO: 154096 - protein, 11 aa, Mycobacterium tuberculosis
SAATFRLECPY

SEQ ID NO: 154097 - protein, 11 aa, Mycobacterium tuberculosis
ATFRLECPYTV

SEQ ID NO: 154098 - protein, 11 aa, Mycobacterium tuberculosis
LECPYTVCQFL

SEQ ID NO: 154099 - protein, 11 aa, Mycobacterium tuberculosis
CPYTVCQFLSQ

SEQ ID NO: 154100 - protein, 11 aa, Mycobacterium tuberculosis
PYTVCQFLSQL

SEQ ID NO: 154101 - protein, 11 aa, Mycobacterium tuberculosis
YTVCQFLSQLA

SEQ ID NO: 154102 - protein, 11 aa, Mycobacterium tuberculosis
SQLACDLQEAV

SEQ ID NO: 154103 - protein, 11 aa, Mycobacterium tuberculosis
EAVQHDDPWTL

SEQ ID NO: 154104 - protein, 11 aa, Mycobacterium tuberculosis
AVQHDDPWTLV

SEQ ID NO: 154105 - protein, 11 aa, Mycobacterium tuberculosis
VQHDDPWTLVF

SEQ ID NO: 154106 - protein, 11 aa, Mycobacterium tuberculosis
VFHGYDPGQER

SEQ ID NO: 154107 - protein, 11 aa, Mycobacterium tuberculosis
FHGYDPGQERL

SEQ ID NO: 154108 - protein, 11 aa, Mycobacterium tuberculosis
DPGQERLREAL

SEQ ID NO: 154109 - protein, 11 aa, Mycobacterium tuberculosis
QERLREALCAV

SEQ ID NO: 154110 - protein, 11 aa, Mycobacterium tuberculosis
REALCAVGNGY

SEQ ID NO: 154111 - protein, 11 aa, Mycobacterium tuberculosis
EALCAVGNGYL

SEQ ID NO: 154112 - protein, 11 aa, Mycobacterium tuberculosis
CAVGNGYLGSR

SEQ ID NO: 154113 - protein, 11 aa, Mycobacterium tuberculosis
YLGSRGCAPES

SEQ ID NO: 154114 - protein, 11 aa, Mycobacterium tuberculosis
APESAESEAHY

SEQ ID NO: 154115 - protein, 11 aa, Mycobacterium tuberculosis
AESEAHYPGTY

SEQ ID NO: 154116 - protein, 11 aa, Mycobacterium tuberculosis
AHYPGTYVAGV

SEQ ID NO: 154117 - protein, 11 aa, Mycobacterium tuberculosis
HYPGTYVAGVY

SEQ ID NO: 154118 - protein, 11 aa, Mycobacterium tuberculosis
GTYVAGVYNQL

SEQ ID NO: 154119 - protein, 11 aa, Mycobacterium tuberculosis
QLTDHIEGCTV

SEQ ID NO: 154120 - protein, 11 aa, Mycobacterium tuberculosis
EGCTVDNESLV

SEQ ID NO: 154121 - protein, 11 aa, Mycobacterium tuberculosis
CTVDNESLVNL

SEQ ID NO: 154122 - protein, 11 aa, Mycobacterium tuberculosis
NESLVNLPNWL

SEQ ID NO: 154123 - protein, 11 aa, Mycobacterium tuberculosis
SLVNLPNWLSL

SEQ ID NO: 154124 - protein, 11 aa, Mycobacterium tuberculosis
VNLPNWLSLTF

SEQ ID NO: 154125 - protein, 11 aa, Mycobacterium tuberculosis
NLPNWLSLTFR

SEQ ID NO: 154126 - protein, 11 aa, Mycobacterium tuberculosis
LPNWLSLTFRI

SEQ ID NO: 154127 - protein, 11 aa, Mycobacterium tuberculosis
LTFRIDGGAWF

SEQ ID NO: 154128 - protein, 11 aa, Mycobacterium tuberculosis
FRIDGGAWFNV

SEQ ID NO: 154129 - protein, 11 aa, Mycobacterium tuberculosis
AWFNVDTVELL

SEQ ID NO: 154130 - protein, 11 aa, Mycobacterium tuberculosis
NVDTVELLSYR

SEQ ID NO: 154131 - protein, 11 aa, Mycobacterium tuberculosis
TVELLSYRQTF

SEQ ID NO: 154132 - protein, 11 aa, Mycobacterium tuberculosis
ELLSYRQTFDL

SEQ ID NO: 154133 - protein, 11 aa, Mycobacterium tuberculosis
LLSYRQTFDLR

SEQ ID NO: 154134 - protein, 11 aa, Mycobacterium tuberculosis
LSYRQTFDLRR

SEQ ID NO: 154135 - protein, 11 aa, Mycobacterium tuberculosis
RQTFDLRRATL

SEQ ID NO: 154136 - protein, 11 aa, Mycobacterium tuberculosis
TFDLRRATLTR

SEQ ID NO: 154137 - protein, 11 aa, Mycobacterium tuberculosis
DLRRATLTRSL

SEQ ID NO: 154138 - protein, 11 aa, Mycobacterium tuberculosis
RRATLTRSLRF

SEQ ID NO: 154139 - protein, 11 aa, Mycobacterium tuberculosis
RATLTRSLRFR

SEQ ID NO: 154140 - protein, 11 aa, Mycobacterium tuberculosis
TLTRSLRFRDA

SEQ ID NO: 154141 - protein, 11 aa, Mycobacterium tuberculosis
RSLRFRDAGGR

SEQ ID NO: 154142 - protein, 11 aa, Mycobacterium tuberculosis
SLRFRDAGGRV

SEQ ID NO: 154143 - protein, 11 aa, Mycobacterium tuberculosis
RFRDAGGRVTT

SEQ ID NO: 154144 - protein, 11 aa, Mycobacterium tuberculosis
FRDAGGRVTTM

SEQ ID NO: 154145 - protein, 11 aa, Mycobacterium tuberculosis
GGRVTTMTQER

SEQ ID NO: 154146 - protein, 11 aa, Mycobacterium tuberculosis
GRVTTMTQERF

SEQ ID NO: 154147 - protein, 11 aa, Mycobacterium tuberculosis
TTMTQERFASM

SEQ ID NO: 154148 - protein, 11 aa, Mycobacterium tuberculosis
MTQERFASMNR

SEQ ID NO: 154149 - protein, 11 aa, Mycobacterium tuberculosis
ASMNRPNLVAL

SEQ ID NO: 154150 - protein, 11 aa, Mycobacterium tuberculosis
SMNRPNLVALQ

SEQ ID NO: 154151 - protein, 11 aa, Mycobacterium tuberculosis
RPNLVALQTRI

SEQ ID NO: 154152 - protein, 11 aa, Mycobacterium tuberculosis
RIESENWSGTV

SEQ ID NO: 154153 - protein, 11 aa, Mycobacterium tuberculosis
SENWSGTVDFR

SEQ ID NO: 154154 - protein, 11 aa, Mycobacterium tuberculosis
WSGTVDFRSLV

SEQ ID NO: 154155 - protein, 11 aa, Mycobacterium tuberculosis
SLVDGGVHNTL

SEQ ID NO: 154156 - protein, 11 aa, Mycobacterium tuberculosis
LVDGGVHNTLV

SEQ ID NO: 154157 - protein, 11 aa, Mycobacterium tuberculosis
GVHNTLVDRYR

SEQ ID NO: 154158 - protein, 11 aa, Mycobacterium tuberculosis
RQLSSQHLTTA

SEQ ID NO: 154159 - protein, 11 aa, Mycobacterium tuberculosis
SQHLTTAEIEV

SEQ ID NO: 154160 - protein, 11 aa, Mycobacterium tuberculosis
QHLTTAEIEVL

SEQ ID NO: 154161 - protein, 11 aa, Mycobacterium tuberculosis
HLTTAEIEVLA

SEQ ID NO: 154162 - protein, 11 aa, Mycobacterium tuberculosis
TTAEIEVLADS

SEQ ID NO: 154163 - protein, 11 aa, Mycobacterium tuberculosis
AEIEVLADSVL

SEQ ID NO: 154164 - protein, 11 aa, Mycobacterium tuberculosis
EIEVLADSVLL

SEQ ID NO: 154165 - protein, 11 aa, Mycobacterium tuberculosis
EVLADSVLLRT

SEQ ID NO: 154166 - protein, 11 aa, Mycobacterium tuberculosis
VLADSVLLRTQ

SEQ ID NO: 154167 - protein, 11 aa, Mycobacterium tuberculosis
VLLRTQTSQSG

SEQ ID NO: 154168 - protein, 11 aa, Mycobacterium tuberculosis
LLRTQTSQSGI

SEQ ID NO: 154169 - protein, 11 aa, Mycobacterium tuberculosis
QTSQSGIAIAV

SEQ ID NO: 154170 - protein, 11 aa, Mycobacterium tuberculosis
SQSGIAIAVAA

SEQ ID NO: 154171 - protein, 11 aa, Mycobacterium tuberculosis
QSGIAIAVAAR

SEQ ID NO: 154172 - protein, 11 aa, Mycobacterium tuberculosis
IAIAVAARSTL

SEQ ID NO: 154173 - protein, 11 aa, Mycobacterium tuberculosis
AIAVAARSTLW

SEQ ID NO: 154174 - protein, 11 aa, Mycobacterium tuberculosis
IAVAARSTLWR

SEQ ID NO: 154175 - protein, 11 aa, Mycobacterium tuberculosis
TLWRDGQRVDA

SEQ ID NO: 154176 - protein, 11 aa, Mycobacterium tuberculosis
WRDGQRVDAQY

SEQ ID NO: 154177 - protein, 11 aa, Mycobacterium tuberculosis
DGQRVDAQYRV

SEQ ID NO: 154178 - protein, 11 aa, Mycobacterium tuberculosis
QRVDAQYRVAR

SEQ ID NO: 154179 - protein, 11 aa, Mycobacterium tuberculosis
AQYRVARDTNR

SEQ ID NO: 154180 - protein, 11 aa, Mycobacterium tuberculosis
DTNRGGHDIQV

SEQ ID NO: 154181 - protein, 11 aa, Mycobacterium tuberculosis
IQVTLSAGQSV

SEQ ID NO: 154182 - protein, 11 aa, Mycobacterium tuberculosis
VTLSAGQSVTL

SEQ ID NO: 154183 - protein, 11 aa, Mycobacterium tuberculosis
LSAGQSVTLEK

SEQ ID NO: 154184 - protein, 11 aa, Mycobacterium tuberculosis
SAGQSVTLEKV

SEQ ID NO: 154185 - protein, 11 aa, Mycobacterium tuberculosis
TIFTSRDAATL

SEQ ID NO: 154186 - protein, 11 aa, Mycobacterium tuberculosis
FTSRDAATLTA

SEQ ID NO: 154187 - protein, 11 aa, Mycobacterium tuberculosis
DAATLTAAISA

SEQ ID NO: 154188 - protein, 11 aa, Mycobacterium tuberculosis
ATLTAAISAQR

SEQ ID NO: 154189 - protein, 11 aa, Mycobacterium tuberculosis
TLTAAISAQRC

SEQ ID NO: 154190 - protein, 11 aa, Mycobacterium tuberculosis
LTAAISAQRCL

SEQ ID NO: 154191 - protein, 11 aa, Mycobacterium tuberculosis
AISAQRCLGEA

SEQ ID NO: 154192 - protein, 11 aa, Mycobacterium tuberculosis
SAQRCLGEAGR

SEQ ID NO: 154193 - protein, 11 aa, Mycobacterium tuberculosis
AQRCLGEAGRY

SEQ ID NO: 154194 - protein, 11 aa, Mycobacterium tuberculosis
CLGEAGRYAEL

SEQ ID NO: 154195 - protein, 11 aa, Mycobacterium tuberculosis
RYAELCQQHVR

SEQ ID NO: 154196 - protein, 11 aa, Mycobacterium tuberculosis
AELCQQHVRAW

SEQ ID NO: 154197 - protein, 11 aa, Mycobacterium tuberculosis
ELCQQHVRAWA

SEQ ID NO: 154198 - protein, 11 aa, Mycobacterium tuberculosis
HVRAWARLWER

SEQ ID NO: 154199 - protein, 11 aa, Mycobacterium tuberculosis
AWARLWERCAI

SEQ ID NO: 154200 - protein, 11 aa, Mycobacterium tuberculosis
RLWERCAIDLT

SEQ ID NO: 154201 - protein, 11 aa, Mycobacterium tuberculosis
AIDLTGNTEEL

SEQ ID NO: 154202 - protein, 11 aa, Mycobacterium tuberculosis
DLTGNTEELRL

SEQ ID NO: 154203 - protein, 11 aa, Mycobacterium tuberculosis
LTGNTEELRLV

SEQ ID NO: 154204 - protein, 11 aa, Mycobacterium tuberculosis
TEELRLVRLHL

SEQ ID NO: 154205 - protein, 11 aa, Mycobacterium tuberculosis
EELRLVRLHLL

SEQ ID NO: 154206 - protein, 11 aa, Mycobacterium tuberculosis
RLVRLHLLHLL

SEQ ID NO: 154207 - protein, 11 aa, Mycobacterium tuberculosis
LVRLHLLHLLQ

SEQ ID NO: 154208 - protein, 11 aa, Mycobacterium tuberculosis
RLHLLHLLQTI

SEQ ID NO: 154209 - protein, 11 aa, Mycobacterium tuberculosis
HLLQTISPHTA

SEQ ID NO: 154210 - protein, 11 aa, Mycobacterium tuberculosis
LQTISPHTAEL

SEQ ID NO: 154211 - protein, 11 aa, Mycobacterium tuberculosis
HTAELDAGVPA

SEQ ID NO: 154212 - protein, 11 aa, Mycobacterium tuberculosis
TAELDAGVPAR

SEQ ID NO: 154213 - protein, 11 aa, Mycobacterium tuberculosis
ELDAGVPARGL

SEQ ID NO: 154214 - protein, 11 aa, Mycobacterium tuberculosis
VPARGLNGEAY

SEQ ID NO: 154215 - protein, 11 aa, Mycobacterium tuberculosis
PARGLNGEAYR

SEQ ID NO: 154216 - protein, 11 aa, Mycobacterium tuberculosis
GLNGEAYRGHV

SEQ ID NO: 154217 - protein, 11 aa, Mycobacterium tuberculosis
EAYRGHVFWDA

SEQ ID NO: 154218 - protein, 11 aa, Mycobacterium tuberculosis
AYRGHVFWDAL

SEQ ID NO: 154219 - protein, 11 aa, Mycobacterium tuberculosis
RGHVFWDALFV

SEQ ID NO: 154220 - protein, 11 aa, Mycobacterium tuberculosis
VFWDALFVAPV

SEQ ID NO: 154221 - protein, 11 aa, Mycobacterium tuberculosis
DALFVAPVLSL

SEQ ID NO: 154222 - protein, 11 aa, Mycobacterium tuberculosis
ALFVAPVLSLR

SEQ ID NO: 154223 - protein, 11 aa, Mycobacterium tuberculosis
VAPVLSLRMPK

SEQ ID NO: 154224 - protein, 11 aa, Mycobacterium tuberculosis
APVLSLRMPKV

SEQ ID NO: 154225 - protein, 11 aa, Mycobacterium tuberculosis
VLSLRMPKVAR

SEQ ID NO: 154226 - protein, 11 aa, Mycobacterium tuberculosis
SLRMPKVARSL

SEQ ID NO: 154227 - protein, 11 aa, Mycobacterium tuberculosis
MPKVARSLLDY

SEQ ID NO: 154228 - protein, 11 aa, Mycobacterium tuberculosis
KVARSLLDYRY

SEQ ID NO: 154229 - protein, 11 aa, Mycobacterium tuberculosis
VARSLLDYRYR

SEQ ID NO: 154230 - protein, 11 aa, Mycobacterium tuberculosis
SLLDYRYRRLP

SEQ ID NO: 154231 - protein, 11 aa, Mycobacterium tuberculosis
LLDYRYRRLPA

SEQ ID NO: 154232 - protein, 11 aa, Mycobacterium tuberculosis
DYRYRRLPAAR

SEQ ID NO: 154233 - protein, 11 aa, Mycobacterium tuberculosis
YRYRRLPAARR

SEQ ID NO: 154234 - protein, 11 aa, Mycobacterium tuberculosis
RYRRLPAARRA

SEQ ID NO: 154235 - protein, 11 aa, Mycobacterium tuberculosis
RRLPAARRAAH

SEQ ID NO: 154236 - protein, 11 aa, Mycobacterium tuberculosis
RLPAARRAAHR

SEQ ID NO: 154237 - protein, 11 aa, Mycobacterium tuberculosis
LPAARRAAHRA

SEQ ID NO: 154238 - protein, 11 aa, Mycobacterium tuberculosis
RAAHRAGHLGA

SEQ ID NO: 154239 - protein, 11 aa, Mycobacterium tuberculosis
AAHRAGHLGAM

SEQ ID NO: 154240 - protein, 11 aa, Mycobacterium tuberculosis
RAGHLGAMYPW

SEQ ID NO: 154241 - protein, 11 aa, Mycobacterium tuberculosis
YPWQSGSDGSE

SEQ ID NO: 154242 - protein, 11 aa, Mycobacterium tuberculosis
EVSQQLHLNPR

SEQ ID NO: 154243 - protein, 11 aa, Mycobacterium tuberculosis
QQLHLNPRSGR

SEQ ID NO: 154244 - protein, 11 aa, Mycobacterium tuberculosis
HLNPRSGRWTP

SEQ ID NO: 154245 - protein, 11 aa, Mycobacterium tuberculosis
RAHHVGLAVAY

SEQ ID NO: 154246 - protein, 11 aa, Mycobacterium tuberculosis
GLAVAYNAWHY

SEQ ID NO: 154247 - protein, 11 aa, Mycobacterium tuberculosis
LAVAYNAWHYY

SEQ ID NO: 154248 - protein, 11 aa, Mycobacterium tuberculosis
VAYNAWHYYQV

SEQ ID NO: 154249 - protein, 11 aa, Mycobacterium tuberculosis
AWHYYQVTGDR

SEQ ID NO: 154250 - protein, 11 aa, Mycobacterium tuberculosis
HYYQVTGDRQY

SEQ ID NO: 154251 - protein, 11 aa, Mycobacterium tuberculosis
YYQVTGDRQYL

SEQ ID NO: 154252 - protein, 11 aa, Mycobacterium tuberculosis
YQVTGDRQYLV

SEQ ID NO: 154253 - protein, 11 aa, Mycobacterium tuberculosis
RQYLVDCGAEL

SEQ ID NO: 154254 - protein, 11 aa, Mycobacterium tuberculosis
QYLVDCGAELL

SEQ ID NO: 154255 - protein, 11 aa, Mycobacterium tuberculosis
YLVDCGAELLV

SEQ ID NO: 154256 - protein, 11 aa, Mycobacterium tuberculosis
AELLVEIARFW

SEQ ID NO: 154257 - protein, 11 aa, Mycobacterium tuberculosis
ELLVEIARFWV

SEQ ID NO: 154258 - protein, 11 aa, Mycobacterium tuberculosis
VEIARFWVGLA

SEQ ID NO: 154259 - protein, 11 aa, Mycobacterium tuberculosis
EIARFWVGLAK

SEQ ID NO: 154260 - protein, 11 aa, Mycobacterium tuberculosis
IARFWVGLAKL

SEQ ID NO: 154261 - protein, 11 aa, Mycobacterium tuberculosis
WVGLAKLDDSR

SEQ ID NO: 154262 - protein, 11 aa, Mycobacterium tuberculosis
KLDDSRGRYLI

SEQ ID NO: 154263 - protein, 11 aa, Mycobacterium tuberculosis
GRYLIRGVIGP

SEQ ID NO: 154264 - protein, 11 aa, Mycobacterium tuberculosis
YLIRGVIGPDE

SEQ ID NO: 154265 - protein, 11 aa, Mycobacterium tuberculosis
VIGPDEFHSGY

SEQ ID NO: 154266 - protein, 11 aa, Mycobacterium tuberculosis
EFHSGYPGNEY

SEQ ID NO: 154267 - protein, 11 aa, Mycobacterium tuberculosis
NEYDGIDNNAY

SEQ ID NO: 154268 - protein, 11 aa, Mycobacterium tuberculosis
DGIDNNAYTNV

SEQ ID NO: 154269 - protein, 11 aa, Mycobacterium tuberculosis
GIDNNAYTNVM

SEQ ID NO: 154270 - protein, 11 aa, Mycobacterium tuberculosis
NAYTNVMAVWV

SEQ ID NO: 154271 - protein, 11 aa, Mycobacterium tuberculosis
AYTNVMAVWVI

SEQ ID NO: 154272 - protein, 11 aa, Mycobacterium tuberculosis
YTNVMAVWVIL

SEQ ID NO: 154273 - protein, 11 aa, Mycobacterium tuberculosis
TNVMAVWVILR

SEQ ID NO: 154274 - protein, 11 aa, Mycobacterium tuberculosis
NVMAVWVILRA

SEQ ID NO: 154275 - protein, 11 aa, Mycobacterium tuberculosis
VMAVWVILRAM

SEQ ID NO: 154276 - protein, 11 aa, Mycobacterium tuberculosis
MAVWVILRAME

SEQ ID NO: 154277 - protein, 11 aa, Mycobacterium tuberculosis
AVWVILRAMEA

SEQ ID NO: 154278 - protein, 11 aa, Mycobacterium tuberculosis
VILRAMEALDL

SEQ ID NO: 154279 - protein, 11 aa, Mycobacterium tuberculosis
ILRAMEALDLL

SEQ ID NO: 154280 - protein, 11 aa, Mycobacterium tuberculosis
RAMEALDLLPL

SEQ ID NO: 154281 - protein, 11 aa, Mycobacterium tuberculosis
EALDLLPLTDR

SEQ ID NO: 154282 - protein, 11 aa, Mycobacterium tuberculosis
DLLPLTDRRHL

SEQ ID NO: 154283 - protein, 11 aa, Mycobacterium tuberculosis
LLPLTDRRHLI

SEQ ID NO: 154284 - protein, 11 aa, Mycobacterium tuberculosis
PLTDRRHLIEK

SEQ ID NO: 154285 - protein, 11 aa, Mycobacterium tuberculosis
HLIEKLGLTTQ

SEQ ID NO: 154286 - protein, 11 aa, Mycobacterium tuberculosis
LGLTTQERDQW

SEQ ID NO: 154287 - protein, 11 aa, Mycobacterium tuberculosis
TTQERDQWDDV

SEQ ID NO: 154288 - protein, 11 aa, Mycobacterium tuberculosis
QWDDVSRRMFV

SEQ ID NO: 154289 - protein, 11 aa, Mycobacterium tuberculosis
DVSRRMFVPFH

SEQ ID NO: 154290 - protein, 11 aa, Mycobacterium tuberculosis
RRMFVPFHDGV

SEQ ID NO: 154291 - protein, 11 aa, Mycobacterium tuberculosis
RMFVPFHDGVI

SEQ ID NO: 154292 - protein, 11 aa, Mycobacterium tuberculosis
VPFHDGVISQF

SEQ ID NO: 154293 - protein, 11 aa, Mycobacterium tuberculosis
VISQFEGYSEL

SEQ ID NO: 154294 - protein, 11 aa, Mycobacterium tuberculosis
SQFEGYSELAE

SEQ ID NO: 154295 - protein, 11 aa, Mycobacterium tuberculosis
SELAELDWDHY

SEQ ID NO: 154296 - protein, 11 aa, Mycobacterium tuberculosis
ELAELDWDHYR

SEQ ID NO: 154297 - protein, 11 aa, Mycobacterium tuberculosis
ELDWDHYRHRY

SEQ ID NO: 154298 - protein, 11 aa, Mycobacterium tuberculosis
HYRHRYGNIQR

SEQ ID NO: 154299 - protein, 11 aa, Mycobacterium tuberculosis
YRHRYGNIQRL

SEQ ID NO: 154300 - protein, 11 aa, Mycobacterium tuberculosis
HRYGNIQRLDR

SEQ ID NO: 154301 - protein, 11 aa, Mycobacterium tuberculosis
RYGNIQRLDRI

SEQ ID NO: 154302 - protein, 11 aa, Mycobacterium tuberculosis
LEAEGDSVNNY

SEQ ID NO: 154303 - protein, 11 aa, Mycobacterium tuberculosis
AEGDSVNNYQA

SEQ ID NO: 154304 - protein, 11 aa, Mycobacterium tuberculosis
SVNNYQASKQA

SEQ ID NO: 154305 - protein, 11 aa, Mycobacterium tuberculosis
NYQASKQADAL

SEQ ID NO: 154306 - protein, 11 aa, Mycobacterium tuberculosis
YQASKQADALM

SEQ ID NO: 154307 - protein, 11 aa, Mycobacterium tuberculosis
KQADALMLLYL

SEQ ID NO: 154308 - protein, 11 aa, Mycobacterium tuberculosis
QADALMLLYLL

SEQ ID NO: 154309 - protein, 11 aa, Mycobacterium tuberculosis
MLLYLLSSDEL

SEQ ID NO: 154310 - protein, 11 aa, Mycobacterium tuberculosis
LLYLLSSDELI

SEQ ID NO: 154311 - protein, 11 aa, Mycobacterium tuberculosis
YLLSSDELIGL

SEQ ID NO: 154312 - protein, 11 aa, Mycobacterium tuberculosis
LLSSDELIGLL

SEQ ID NO: 154313 - protein, 11 aa, Mycobacterium tuberculosis
SSDELIGLLAR

SEQ ID NO: 154314 - protein, 11 aa, Mycobacterium tuberculosis
ELIGLLARLGY

SEQ ID NO: 154315 - protein, 11 aa, Mycobacterium tuberculosis
LIGLLARLGYR

SEQ ID NO: 154316 - protein, 11 aa, Mycobacterium tuberculosis
GLLARLGYRFA

SEQ ID NO: 154317 - protein, 11 aa, Mycobacterium tuberculosis
RLGYRFAPTQI

SEQ ID NO: 154318 - protein, 11 aa, Mycobacterium tuberculosis
RFAPTQIPGTV

SEQ ID NO: 154319 - protein, 11 aa, Mycobacterium tuberculosis
APTQIPGTVDY

SEQ ID NO: 154320 - protein, 11 aa, Mycobacterium tuberculosis
PTQIPGTVDYY

SEQ ID NO: 154321 - protein, 11 aa, Mycobacterium tuberculosis
TQIPGTVDYYL

SEQ ID NO: 154322 - protein, 11 aa, Mycobacterium tuberculosis
QIPGTVDYYLA

SEQ ID NO: 154323 - protein, 11 aa, Mycobacterium tuberculosis
YYLARTSDGST

SEQ ID NO: 154324 - protein, 11 aa, Mycobacterium tuberculosis
YLARTSDGSTL

SEQ ID NO: 154325 - protein, 11 aa, Mycobacterium tuberculosis
RTSDGSTLSAV

SEQ ID NO: 154326 - protein, 11 aa, Mycobacterium tuberculosis
TSDGSTLSAVV

SEQ ID NO: 154327 - protein, 11 aa, Mycobacterium tuberculosis
GSTLSAVVHAW

SEQ ID NO: 154328 - protein, 11 aa, Mycobacterium tuberculosis
STLSAVVHAWV

SEQ ID NO: 154329 - protein, 11 aa, Mycobacterium tuberculosis
TLSAVVHAWVL

SEQ ID NO: 154330 - protein, 11 aa, Mycobacterium tuberculosis
LSAVVHAWVLA

SEQ ID NO: 154331 - protein, 11 aa, Mycobacterium tuberculosis
SAVVHAWVLAR

SEQ ID NO: 154332 - protein, 11 aa, Mycobacterium tuberculosis
AVVHAWVLARA

SEQ ID NO: 154333 - protein, 11 aa, Mycobacterium tuberculosis
WVLARANRSNA

SEQ ID NO: 154334 - protein, 11 aa, Mycobacterium tuberculosis
VLARANRSNAM

SEQ ID NO: 154335 - protein, 11 aa, Mycobacterium tuberculosis
RANRSNAMEYF

SEQ ID NO: 154336 - protein, 11 aa, Mycobacterium tuberculosis
ANRSNAMEYFR

SEQ ID NO: 154337 - protein, 11 aa, Mycobacterium tuberculosis
NAMEYFRQVLR

SEQ ID NO: 154338 - protein, 11 aa, Mycobacterium tuberculosis
EYFRQVLRSDI

SEQ ID NO: 154339 - protein, 11 aa, Mycobacterium tuberculosis
RQVLRSDIADV

SEQ ID NO: 154340 - protein, 11 aa, Mycobacterium tuberculosis
DVQGGTTQEGI

SEQ ID NO: 154341 - protein, 11 aa, Mycobacterium tuberculosis
TTQEGIHLAAM

SEQ ID NO: 154342 - protein, 11 aa, Mycobacterium tuberculosis
GIHLAAMAGSI

SEQ ID NO: 154343 - protein, 11 aa, Mycobacterium tuberculosis
HLAAMAGSIDL

SEQ ID NO: 154344 - protein, 11 aa, Mycobacterium tuberculosis
LAAMAGSIDLL

SEQ ID NO: 154345 - protein, 11 aa, Mycobacterium tuberculosis
AMAGSIDLLQR

SEQ ID NO: 154346 - protein, 11 aa, Mycobacterium tuberculosis
LLQRCYSGLEL

SEQ ID NO: 154347 - protein, 11 aa, Mycobacterium tuberculosis
LQRCYSGLELR

SEQ ID NO: 154348 - protein, 11 aa, Mycobacterium tuberculosis
CYSGLELRDDR

SEQ ID NO: 154349 - protein, 11 aa, Mycobacterium tuberculosis
GLELRDDRLVL

SEQ ID NO: 154350 - protein, 11 aa, Mycobacterium tuberculosis
RLVLSPQWPEA

SEQ ID NO: 154351 - protein, 11 aa, Mycobacterium tuberculosis
LVLSPQWPEAL

SEQ ID NO: 154352 - protein, 11 aa, Mycobacterium tuberculosis
SPQWPEALGPL

SEQ ID NO: 154353 - protein, 11 aa, Mycobacterium tuberculosis
QWPEALGPLEF

SEQ ID NO: 154354 - protein, 11 aa, Mycobacterium tuberculosis
PEALGPLEFPF

SEQ ID NO: 154355 - protein, 11 aa, Mycobacterium tuberculosis
EALGPLEFPFV

SEQ ID NO: 154356 - protein, 11 aa, Mycobacterium tuberculosis
ALGPLEFPFVY

SEQ ID NO: 154357 - protein, 11 aa, Mycobacterium tuberculosis
FPFVYRRHQLS

SEQ ID NO: 154358 - protein, 11 aa, Mycobacterium tuberculosis
FVYRRHQLSLR

SEQ ID NO: 154359 - protein, 11 aa, Mycobacterium tuberculosis
VYRRHQLSLRI

SEQ ID NO: 154360 - protein, 11 aa, Mycobacterium tuberculosis
QLSLRISGRSA

SEQ ID NO: 154361 - protein, 11 aa, Mycobacterium tuberculosis
SLRISGRSATL

SEQ ID NO: 154362 - protein, 11 aa, Mycobacterium tuberculosis
RISGRSATLTA

SEQ ID NO: 154363 - protein, 11 aa, Mycobacterium tuberculosis
LTAESGDAEPI

SEQ ID NO: 154364 - protein, 11 aa, Mycobacterium tuberculosis
AESGDAEPIEV

SEQ ID NO: 154365 - protein, 11 aa, Mycobacterium tuberculosis
EPIEVECRGHV

SEQ ID NO: 154366 - protein, 11 aa, Mycobacterium tuberculosis
EVECRGHVQRL

SEQ ID NO: 154367 - protein, 13 aa, Mycobacterium tuberculosis
MRCGIVVNVTGPP

SEQ ID NO: 154368 - protein, 13 aa, Mycobacterium tuberculosis
RCGIVVNVTGPPP

SEQ ID NO: 154369 - protein, 13 aa, Mycobacterium tuberculosis
CGIVVNVTGPPPT

SEQ ID NO: 154370 - protein, 13 aa, Mycobacterium tuberculosis
GIVVNVTGPPPTI

SEQ ID NO: 154371 - protein, 13 aa, Mycobacterium tuberculosis
IVVNVTGPPPTID

SEQ ID NO: 154372 - protein, 13 aa, Mycobacterium tuberculosis
VVNVTGPPPTIDR

SEQ ID NO: 154373 - protein, 13 aa, Mycobacterium tuberculosis
VNVTGPPPTIDRR

SEQ ID NO: 154374 - protein, 13 aa, Mycobacterium tuberculosis
NVTGPPPTIDRRY

SEQ ID NO: 154375 - protein, 13 aa, Mycobacterium tuberculosis
VTGPPPTIDRRYH

SEQ ID NO: 154376 - protein, 13 aa, Mycobacterium tuberculosis
TGPPPTIDRRYHD

SEQ ID NO: 154377 - protein, 13 aa, Mycobacterium tuberculosis
GPPPTIDRRYHDA

SEQ ID NO: 154378 - protein, 13 aa, Mycobacterium tuberculosis
PPPTIDRRYHDAV

SEQ ID NO: 154379 - protein, 13 aa, Mycobacterium tuberculosis
PPTIDRRYHDAVI

SEQ ID NO: 154380 - protein, 13 aa, Mycobacterium tuberculosis
PTIDRRYHDAVIV

SEQ ID NO: 154381 - protein, 13 aa, Mycobacterium tuberculosis
TIDRRYHDAVIVG

SEQ ID NO: 154382 - protein, 13 aa, Mycobacterium tuberculosis
IDRRYHDAVIVGL

SEQ ID NO: 154383 - protein, 13 aa, Mycobacterium tuberculosis
DRRYHDAVIVGLD

SEQ ID NO: 154384 - protein, 13 aa, Mycobacterium tuberculosis
RRYHDAVIVGLDN

SEQ ID NO: 154385 - protein, 13 aa, Mycobacterium tuberculosis
RYHDAVIVGLDNV

SEQ ID NO: 154386 - protein, 13 aa, Mycobacterium tuberculosis
YHDAVIVGLDNVV

SEQ ID NO: 154387 - protein, 13 aa, Mycobacterium tuberculosis
HDAVIVGLDNVVD

SEQ ID NO: 154388 - protein, 13 aa, Mycobacterium tuberculosis
DAVIVGLDNVVDK

SEQ ID NO: 154389 - protein, 13 aa, Mycobacterium tuberculosis
AVIVGLDNVVDKA

SEQ ID NO: 154390 - protein, 13 aa, Mycobacterium tuberculosis
VIVGLDNVVDKAT

SEQ ID NO: 154391 - protein, 13 aa, Mycobacterium tuberculosis
IVGLDNVVDKATR

SEQ ID NO: 154392 - protein, 13 aa, Mycobacterium tuberculosis
VGLDNVVDKATRV

SEQ ID NO: 154393 - protein, 13 aa, Mycobacterium tuberculosis
GLDNVVDKATRVH

SEQ ID NO: 154394 - protein, 13 aa, Mycobacterium tuberculosis
LDNVVDKATRVHA

SEQ ID NO: 154395 - protein, 13 aa, Mycobacterium tuberculosis
DNVVDKATRVHAA

SEQ ID NO: 154396 - protein, 13 aa, Mycobacterium tuberculosis
NVVDKATRVHAAA

SEQ ID NO: 154397 - protein, 13 aa, Mycobacterium tuberculosis
VVDKATRVHAAAW

SEQ ID NO: 154398 - protein, 13 aa, Mycobacterium tuberculosis
VDKATRVHAAAWT

SEQ ID NO: 154399 - protein, 13 aa, Mycobacterium tuberculosis
DKATRVHAAAWTK

SEQ ID NO: 154400 - protein, 13 aa, Mycobacterium tuberculosis
KATRVHAAAWTKF

SEQ ID NO: 154401 - protein, 13 aa, Mycobacterium tuberculosis
ATRVHAAAWTKFL

SEQ ID NO: 154402 - protein, 13 aa, Mycobacterium tuberculosis
TRVHAAAWTKFLD

SEQ ID NO: 154403 - protein, 13 aa, Mycobacterium tuberculosis
RVHAAAWTKFLDD

SEQ ID NO: 154404 - protein, 13 aa, Mycobacterium tuberculosis
VHAAAWTKFLDDY

SEQ ID NO: 154405 - protein, 13 aa, Mycobacterium tuberculosis
HAAAWTKFLDDYL

SEQ ID NO: 154406 - protein, 13 aa, Mycobacterium tuberculosis
AAAWTKFLDDYLT

SEQ ID NO: 154407 - protein, 13 aa, Mycobacterium tuberculosis
AAWTKFLDDYLTR

SEQ ID NO: 154408 - protein, 13 aa, Mycobacterium tuberculosis
AWTKFLDDYLTRR

SEQ ID NO: 154409 - protein, 13 aa, Mycobacterium tuberculosis
WTKFLDDYLTRRP

SEQ ID NO: 154410 - protein, 13 aa, Mycobacterium tuberculosis
TKFLDDYLTRRPQ

SEQ ID NO: 154411 - protein, 13 aa, Mycobacterium tuberculosis
KFLDDYLTRRPQR

SEQ ID NO: 154412 - protein, 13 aa, Mycobacterium tuberculosis
FLDDYLTRRPQRT

SEQ ID NO: 154413 - protein, 13 aa, Mycobacterium tuberculosis
LDDYLTRRPQRTG

SEQ ID NO: 154414 - protein, 13 aa, Mycobacterium tuberculosis
DDYLTRRPQRTGE

SEQ ID NO: 154415 - protein, 13 aa, Mycobacterium tuberculosis
DYLTRRPQRTGED

SEQ ID NO: 154416 - protein, 13 aa, Mycobacterium tuberculosis
YLTRRPQRTGEDH

SEQ ID NO: 154417 - protein, 13 aa, Mycobacterium tuberculosis
LTRRPQRTGEDHC

SEQ ID NO: 154418 - protein, 13 aa, Mycobacterium tuberculosis
TRRPQRTGEDHCP

SEQ ID NO: 154419 - protein, 13 aa, Mycobacterium tuberculosis
RRPQRTGEDHCPL

SEQ ID NO: 154420 - protein, 13 aa, Mycobacterium tuberculosis
RPQRTGEDHCPLT

SEQ ID NO: 154421 - protein, 13 aa, Mycobacterium tuberculosis
PQRTGEDHCPLTH

SEQ ID NO: 154422 - protein, 13 aa, Mycobacterium tuberculosis
QRTGEDHCPLTHD

SEQ ID NO: 154423 - protein, 13 aa, Mycobacterium tuberculosis
RTGEDHCPLTHDD

SEQ ID NO: 154424 - protein, 13 aa, Mycobacterium tuberculosis
TGEDHCPLTHDDY

SEQ ID NO: 154425 - protein, 13 aa, Mycobacterium tuberculosis
GEDHCPLTHDDYR

SEQ ID NO: 154426 - protein, 13 aa, Mycobacterium tuberculosis
EDHCPLTHDDYRR

SEQ ID NO: 154427 - protein, 13 aa, Mycobacterium tuberculosis
DHCPLTHDDYRRF

SEQ ID NO: 154428 - protein, 13 aa, Mycobacterium tuberculosis
HCPLTHDDYRRFL

SEQ ID NO: 154429 - protein, 13 aa, Mycobacterium tuberculosis
CPLTHDDYRRFLA

SEQ ID NO: 154430 - protein, 13 aa, Mycobacterium tuberculosis
PLTHDDYRRFLAG

SEQ ID NO: 154431 - protein, 13 aa, Mycobacterium tuberculosis
LTHDDYRRFLAGK

SEQ ID NO: 154432 - protein, 13 aa, Mycobacterium tuberculosis
THDDYRRFLAGKP

SEQ ID NO: 154433 - protein, 13 aa, Mycobacterium tuberculosis
HDDYRRFLAGKPD

SEQ ID NO: 154434 - protein, 13 aa, Mycobacterium tuberculosis
DDYRRFLAGKPDG

SEQ ID NO: 154435 - protein, 13 aa, Mycobacterium tuberculosis
DYRRFLAGKPDGV

SEQ ID NO: 154436 - protein, 13 aa, Mycobacterium tuberculosis
YRRFLAGKPDGVA

SEQ ID NO: 154437 - protein, 13 aa, Mycobacterium tuberculosis
RRFLAGKPDGVAD

SEQ ID NO: 154438 - protein, 13 aa, Mycobacterium tuberculosis
RFLAGKPDGVADF

SEQ ID NO: 154439 - protein, 13 aa, Mycobacterium tuberculosis
FLAGKPDGVADFL

SEQ ID NO: 154440 - protein, 13 aa, Mycobacterium tuberculosis
LAGKPDGVADFLA

SEQ ID NO: 154441 - protein, 13 aa, Mycobacterium tuberculosis
AGKPDGVADFLAA

SEQ ID NO: 154442 - protein, 13 aa, Mycobacterium tuberculosis
GKPDGVADFLAAR

SEQ ID NO: 154443 - protein, 13 aa, Mycobacterium tuberculosis
KPDGVADFLAARG

SEQ ID NO: 154444 - protein, 13 aa, Mycobacterium tuberculosis
PDGVADFLAARGI

SEQ ID NO: 154445 - protein, 13 aa, Mycobacterium tuberculosis
DGVADFLAARGIR

SEQ ID NO: 154446 - protein, 13 aa, Mycobacterium tuberculosis
GVADFLAARGIRL

SEQ ID NO: 154447 - protein, 13 aa, Mycobacterium tuberculosis
VADFLAARGIRLP

SEQ ID NO: 154448 - protein, 13 aa, Mycobacterium tuberculosis
ADFLAARGIRLPP

SEQ ID NO: 154449 - protein, 13 aa, Mycobacterium tuberculosis
DFLAARGIRLPPG

SEQ ID NO: 154450 - protein, 13 aa, Mycobacterium tuberculosis
FLAARGIRLPPGS

SEQ ID NO: 154451 - protein, 13 aa, Mycobacterium tuberculosis
LAARGIRLPPGSP

SEQ ID NO: 154452 - protein, 13 aa, Mycobacterium tuberculosis
AARGIRLPPGSPT

SEQ ID NO: 154453 - protein, 13 aa, Mycobacterium tuberculosis
ARGIRLPPGSPTD

SEQ ID NO: 154454 - protein, 13 aa, Mycobacterium tuberculosis
RGIRLPPGSPTDL

SEQ ID NO: 154455 - protein, 13 aa, Mycobacterium tuberculosis
GIRLPPGSPTDLT

SEQ ID NO: 154456 - protein, 13 aa, Mycobacterium tuberculosis
IRLPPGSPTDLTD

SEQ ID NO: 154457 - protein, 13 aa, Mycobacterium tuberculosis
RLPPGSPTDLTDD

SEQ ID NO: 154458 - protein, 13 aa, Mycobacterium tuberculosis
LPPGSPTDLTDDT

SEQ ID NO: 154459 - protein, 13 aa, Mycobacterium tuberculosis
PPGSPTDLTDDTV

SEQ ID NO: 154460 - protein, 13 aa, Mycobacterium tuberculosis
PGSPTDLTDDTVY

SEQ ID NO: 154461 - protein, 13 aa, Mycobacterium tuberculosis
GSPTDLTDDTVYG

SEQ ID NO: 154462 - protein, 13 aa, Mycobacterium tuberculosis
SPTDLTDDTVYGL

SEQ ID NO: 154463 - protein, 13 aa, Mycobacterium tuberculosis
PTDLTDDTVYGLQ

SEQ ID NO: 154464 - protein, 13 aa, Mycobacterium tuberculosis
TDLTDDTVYGLQN

SEQ ID NO: 154465 - protein, 13 aa, Mycobacterium tuberculosis
DLTDDTVYGLQNL

SEQ ID NO: 154466 - protein, 13 aa, Mycobacterium tuberculosis
LTDDTVYGLQNLE

SEQ ID NO: 154467 - protein, 13 aa, Mycobacterium tuberculosis
TDDTVYGLQNLER

SEQ ID NO: 154468 - protein, 13 aa, Mycobacterium tuberculosis
DDTVYGLQNLERQ

SEQ ID NO: 154469 - protein, 13 aa, Mycobacterium tuberculosis
DTVYGLQNLERQT

SEQ ID NO: 154470 - protein, 13 aa, Mycobacterium tuberculosis
TVYGLQNLERQTF

SEQ ID NO: 154471 - protein, 13 aa, Mycobacterium tuberculosis
VYGLQNLERQTFL

SEQ ID NO: 154472 - protein, 13 aa, Mycobacterium tuberculosis
YGLQNLERQTFLQ

SEQ ID NO: 154473 - protein, 13 aa, Mycobacterium tuberculosis
GLQNLERQTFLQL

SEQ ID NO: 154474 - protein, 13 aa, Mycobacterium tuberculosis
LQNLERQTFLQLL

SEQ ID NO: 154475 - protein, 13 aa, Mycobacterium tuberculosis
QNLERQTFLQLLN

SEQ ID NO: 154476 - protein, 13 aa, Mycobacterium tuberculosis
NLERQTFLQLLNT

SEQ ID NO: 154477 - protein, 13 aa, Mycobacterium tuberculosis
LERQTFLQLLNTG

SEQ ID NO: 154478 - protein, 13 aa, Mycobacterium tuberculosis
ERQTFLQLLNTGV

SEQ ID NO: 154479 - protein, 13 aa, Mycobacterium tuberculosis
RQTFLQLLNTGVP

SEQ ID NO: 154480 - protein, 13 aa, Mycobacterium tuberculosis
QTFLQLLNTGVPE

SEQ ID NO: 154481 - protein, 13 aa, Mycobacterium tuberculosis
TFLQLLNTGVPEG

SEQ ID NO: 154482 - protein, 13 aa, Mycobacterium tuberculosis
FLQLLNTGVPEGK

SEQ ID NO: 154483 - protein, 13 aa, Mycobacterium tuberculosis
LQLLNTGVPEGKS

SEQ ID NO: 154484 - protein, 13 aa, Mycobacterium tuberculosis
QLLNTGVPEGKSI

SEQ ID NO: 154485 - protein, 13 aa, Mycobacterium tuberculosis
LLNTGVPEGKSIA

SEQ ID NO: 154486 - protein, 13 aa, Mycobacterium tuberculosis
LNTGVPEGKSIAS

SEQ ID NO: 154487 - protein, 13 aa, Mycobacterium tuberculosis
NTGVPEGKSIASF

SEQ ID NO: 154488 - protein, 13 aa, Mycobacterium tuberculosis
TGVPEGKSIASFA

SEQ ID NO: 154489 - protein, 13 aa, Mycobacterium tuberculosis
GVPEGKSIASFAR

SEQ ID NO: 154490 - protein, 13 aa, Mycobacterium tuberculosis
VPEGKSIASFARR

SEQ ID NO: 154491 - protein, 13 aa, Mycobacterium tuberculosis
PEGKSIASFARRL

SEQ ID NO: 154492 - protein, 13 aa, Mycobacterium tuberculosis
EGKSIASFARRLQ

SEQ ID NO: 154493 - protein, 13 aa, Mycobacterium tuberculosis
GKSIASFARRLQV

SEQ ID NO: 154494 - protein, 13 aa, Mycobacterium tuberculosis
KSIASFARRLQVA

SEQ ID NO: 154495 - protein, 13 aa, Mycobacterium tuberculosis
SIASFARRLQVAG

SEQ ID NO: 154496 - protein, 13 aa, Mycobacterium tuberculosis
IASFARRLQVAGV

SEQ ID NO: 154497 - protein, 13 aa, Mycobacterium tuberculosis
ASFARRLQVAGVR

SEQ ID NO: 154498 - protein, 13 aa, Mycobacterium tuberculosis
SFARRLQVAGVRV

SEQ ID NO: 154499 - protein, 13 aa, Mycobacterium tuberculosis
FARRLQVAGVRVA

SEQ ID NO: 154500 - protein, 13 aa, Mycobacterium tuberculosis
ARRLQVAGVRVAA

SEQ ID NO: 154501 - protein, 13 aa, Mycobacterium tuberculosis
RRLQVAGVRVAAH

SEQ ID NO: 154502 - protein, 13 aa, Mycobacterium tuberculosis
RLQVAGVRVAAHT

SEQ ID NO: 154503 - protein, 13 aa, Mycobacterium tuberculosis
LQVAGVRVAAHTS

SEQ ID NO: 154504 - protein, 13 aa, Mycobacterium tuberculosis
QVAGVRVAAHTSH

SEQ ID NO: 154505 - protein, 13 aa, Mycobacterium tuberculosis
VAGVRVAAHTSHR

SEQ ID NO: 154506 - protein, 13 aa, Mycobacterium tuberculosis
AGVRVAAHTSHRN

SEQ ID NO: 154507 - protein, 13 aa, Mycobacterium tuberculosis
GVRVAAHTSHRNY

SEQ ID NO: 154508 - protein, 13 aa, Mycobacterium tuberculosis
VRVAAHTSHRNYG

SEQ ID NO: 154509 - protein, 13 aa, Mycobacterium tuberculosis
RVAAHTSHRNYGH

SEQ ID NO: 154510 - protein, 13 aa, Mycobacterium tuberculosis
VAAHTSHRNYGHT

SEQ ID NO: 154511 - protein, 13 aa, Mycobacterium tuberculosis
AAHTSHRNYGHTL

SEQ ID NO: 154512 - protein, 13 aa, Mycobacterium tuberculosis
AHTSHRNYGHTLD

SEQ ID NO: 154513 - protein, 13 aa, Mycobacterium tuberculosis
HTSHRNYGHTLDA

SEQ ID NO: 154514 - protein, 13 aa, Mycobacterium tuberculosis
TSHRNYGHTLDAT

SEQ ID NO: 154515 - protein, 13 aa, Mycobacterium tuberculosis
SHRNYGHTLDATG

SEQ ID NO: 154516 - protein, 13 aa, Mycobacterium tuberculosis
HRNYGHTLDATGL

SEQ ID NO: 154517 - protein, 13 aa, Mycobacterium tuberculosis
RNYGHTLDATGLA

SEQ ID NO: 154518 - protein, 13 aa, Mycobacterium tuberculosis
NYGHTLDATGLAE

SEQ ID NO: 154519 - protein, 13 aa, Mycobacterium tuberculosis
YGHTLDATGLAEV

SEQ ID NO: 154520 - protein, 13 aa, Mycobacterium tuberculosis
GHTLDATGLAEVF

SEQ ID NO: 154521 - protein, 13 aa, Mycobacterium tuberculosis
HTLDATGLAEVFA

SEQ ID NO: 154522 - protein, 13 aa, Mycobacterium tuberculosis
TLDATGLAEVFAV

SEQ ID NO: 154523 - protein, 13 aa, Mycobacterium tuberculosis
LDATGLAEVFAVF

SEQ ID NO: 154524 - protein, 13 aa, Mycobacterium tuberculosis
DATGLAEVFAVFV

SEQ ID NO: 154525 - protein, 13 aa, Mycobacterium tuberculosis
ATGLAEVFAVFVD

SEQ ID NO: 154526 - protein, 13 aa, Mycobacterium tuberculosis
TGLAEVFAVFVDG

SEQ ID NO: 154527 - protein, 13 aa, Mycobacterium tuberculosis
GLAEVFAVFVDGA

SEQ ID NO: 154528 - protein, 13 aa, Mycobacterium tuberculosis
LAEVFAVFVDGAV

SEQ ID NO: 154529 - protein, 13 aa, Mycobacterium tuberculosis
AEVFAVFVDGAVT

SEQ ID NO: 154530 - protein, 13 aa, Mycobacterium tuberculosis
EVFAVFVDGAVTA

SEQ ID NO: 154531 - protein, 13 aa, Mycobacterium tuberculosis
VFAVFVDGAVTAE

SEQ ID NO: 154532 - protein, 13 aa, Mycobacterium tuberculosis
FAVFVDGAVTAEL

SEQ ID NO: 154533 - protein, 13 aa, Mycobacterium tuberculosis
AVFVDGAVTAELG

SEQ ID NO: 154534 - protein, 13 aa, Mycobacterium tuberculosis
VFVDGAVTAELGL

SEQ ID NO: 154535 - protein, 13 aa, Mycobacterium tuberculosis
FVDGAVTAELGLP

SEQ ID NO: 154536 - protein, 13 aa, Mycobacterium tuberculosis
VDGAVTAELGLPA

SEQ ID NO: 154537 - protein, 13 aa, Mycobacterium tuberculosis
DGAVTAELGLPAE

SEQ ID NO: 154538 - protein, 13 aa, Mycobacterium tuberculosis
GAVTAELGLPAEP

SEQ ID NO: 154539 - protein, 13 aa, Mycobacterium tuberculosis
AVTAELGLPAEPN

SEQ ID NO: 154540 - protein, 13 aa, Mycobacterium tuberculosis
VTAELGLPAEPNP

SEQ ID NO: 154541 - protein, 13 aa, Mycobacterium tuberculosis
TAELGLPAEPNPA

SEQ ID NO: 154542 - protein, 13 aa, Mycobacterium tuberculosis
AELGLPAEPNPAG

SEQ ID NO: 154543 - protein, 13 aa, Mycobacterium tuberculosis
ELGLPAEPNPAGL

SEQ ID NO: 154544 - protein, 13 aa, Mycobacterium tuberculosis
LGLPAEPNPAGLI

SEQ ID NO: 154545 - protein, 13 aa, Mycobacterium tuberculosis
GLPAEPNPAGLIE

SEQ ID NO: 154546 - protein, 13 aa, Mycobacterium tuberculosis
LPAEPNPAGLIET

SEQ ID NO: 154547 - protein, 13 aa, Mycobacterium tuberculosis
PAEPNPAGLIETA

SEQ ID NO: 154548 - protein, 13 aa, Mycobacterium tuberculosis
AEPNPAGLIETAK

SEQ ID NO: 154549 - protein, 13 aa, Mycobacterium tuberculosis
EPNPAGLIETAKR

SEQ ID NO: 154550 - protein, 13 aa, Mycobacterium tuberculosis
PNPAGLIETAKRL

SEQ ID NO: 154551 - protein, 13 aa, Mycobacterium tuberculosis
NPAGLIETAKRLG

SEQ ID NO: 154552 - protein, 13 aa, Mycobacterium tuberculosis
PAGLIETAKRLGA

SEQ ID NO: 154553 - protein, 13 aa, Mycobacterium tuberculosis
AGLIETAKRLGAN

SEQ ID NO: 154554 - protein, 13 aa, Mycobacterium tuberculosis
GLIETAKRLGANP

SEQ ID NO: 154555 - protein, 13 aa, Mycobacterium tuberculosis
LIETAKRLGANPG

SEQ ID NO: 154556 - protein, 13 aa, Mycobacterium tuberculosis
IETAKRLGANPGR

SEQ ID NO: 154557 - protein, 13 aa, Mycobacterium tuberculosis
ETAKRLGANPGRC

SEQ ID NO: 154558 - protein, 13 aa, Mycobacterium tuberculosis
TAKRLGANPGRCV

SEQ ID NO: 154559 - protein, 13 aa, Mycobacterium tuberculosis
AKRLGANPGRCVV

SEQ ID NO: 154560 - protein, 13 aa, Mycobacterium tuberculosis
KRLGANPGRCVVI

SEQ ID NO: 154561 - protein, 13 aa, Mycobacterium tuberculosis
RLGANPGRCVVID

SEQ ID NO: 154562 - protein, 13 aa, Mycobacterium tuberculosis
LGANPGRCVVIDS

SEQ ID NO: 154563 - protein, 13 aa, Mycobacterium tuberculosis
GANPGRCVVIDSC

SEQ ID NO: 154564 - protein, 13 aa, Mycobacterium tuberculosis
ANPGRCVVIDSCQ

SEQ ID NO: 154565 - protein, 13 aa, Mycobacterium tuberculosis
NPGRCVVIDSCQT

SEQ ID NO: 154566 - protein, 13 aa, Mycobacterium tuberculosis
PGRCVVIDSCQTG

SEQ ID NO: 154567 - protein, 13 aa, Mycobacterium tuberculosis
GRCVVIDSCQTGL

SEQ ID NO: 154568 - protein, 13 aa, Mycobacterium tuberculosis
RCVVIDSCQTGLR

SEQ ID NO: 154569 - protein, 13 aa, Mycobacterium tuberculosis
CVVIDSCQTGLRA

SEQ ID NO: 154570 - protein, 13 aa, Mycobacterium tuberculosis
VVIDSCQTGLRAG

SEQ ID NO: 154571 - protein, 13 aa, Mycobacterium tuberculosis
VIDSCQTGLRAGR

SEQ ID NO: 154572 - protein, 13 aa, Mycobacterium tuberculosis
IDSCQTGLRAGRN

SEQ ID NO: 154573 - protein, 13 aa, Mycobacterium tuberculosis
DSCQTGLRAGRNG

SEQ ID NO: 154574 - protein, 13 aa, Mycobacterium tuberculosis
SCQTGLRAGRNGG

SEQ ID NO: 154575 - protein, 13 aa, Mycobacterium tuberculosis
CQTGLRAGRNGGF

SEQ ID NO: 154576 - protein, 13 aa, Mycobacterium tuberculosis
QTGLRAGRNGGFA

SEQ ID NO: 154577 - protein, 13 aa, Mycobacterium tuberculosis
TGLRAGRNGGFAL

SEQ ID NO: 154578 - protein, 13 aa, Mycobacterium tuberculosis
GLRAGRNGGFALV

SEQ ID NO: 154579 - protein, 13 aa, Mycobacterium tuberculosis
LRAGRNGGFALVI

SEQ ID NO: 154580 - protein, 13 aa, Mycobacterium tuberculosis
RAGRNGGFALVIA

SEQ ID NO: 154581 - protein, 13 aa, Mycobacterium tuberculosis
AGRNGGFALVIAV

SEQ ID NO: 154582 - protein, 13 aa, Mycobacterium tuberculosis
GRNGGFALVIAVD

SEQ ID NO: 154583 - protein, 13 aa, Mycobacterium tuberculosis
RNGGFALVIAVDA

SEQ ID NO: 154584 - protein, 13 aa, Mycobacterium tuberculosis
NGGFALVIAVDAH

SEQ ID NO: 154585 - protein, 13 aa, Mycobacterium tuberculosis
GGFALVIAVDAHG

SEQ ID NO: 154586 - protein, 13 aa, Mycobacterium tuberculosis
GFALVIAVDAHGD

SEQ ID NO: 154587 - protein, 13 aa, Mycobacterium tuberculosis
FALVIAVDAHGDA

SEQ ID NO: 154588 - protein, 13 aa, Mycobacterium tuberculosis
ALVIAVDAHGDAE

SEQ ID NO: 154589 - protein, 13 aa, Mycobacterium tuberculosis
LVIAVDAHGDAEN

SEQ ID NO: 154590 - protein, 13 aa, Mycobacterium tuberculosis
VIAVDAHGDAENL

SEQ ID NO: 154591 - protein, 13 aa, Mycobacterium tuberculosis
IAVDAHGDAENLL

SEQ ID NO: 154592 - protein, 13 aa, Mycobacterium tuberculosis
AVDAHGDAENLLS

SEQ ID NO: 154593 - protein, 13 aa, Mycobacterium tuberculosis
VDAHGDAENLLSS

SEQ ID NO: 154594 - protein, 13 aa, Mycobacterium tuberculosis
DAHGDAENLLSSG

SEQ ID NO: 154595 - protein, 13 aa, Mycobacterium tuberculosis
AHGDAENLLSSGA

SEQ ID NO: 154596 - protein, 13 aa, Mycobacterium tuberculosis
HGDAENLLSSGAD

SEQ ID NO: 154597 - protein, 13 aa, Mycobacterium tuberculosis
GDAENLLSSGADA

SEQ ID NO: 154598 - protein, 13 aa, Mycobacterium tuberculosis
DAENLLSSGADAV

SEQ ID NO: 154599 - protein, 13 aa, Mycobacterium tuberculosis
AENLLSSGADAVV

SEQ ID NO: 154600 - protein, 13 aa, Mycobacterium tuberculosis
ENLLSSGADAVVA

SEQ ID NO: 154601 - protein, 13 aa, Mycobacterium tuberculosis
NLLSSGADAVVAD

SEQ ID NO: 154602 - protein, 13 aa, Mycobacterium tuberculosis
LLSSGADAVVADL

SEQ ID NO: 154603 - protein, 13 aa, Mycobacterium tuberculosis
LSSGADAVVADLA

SEQ ID NO: 154604 - protein, 13 aa, Mycobacterium tuberculosis
SSGADAVVADLAA

SEQ ID NO: 154605 - protein, 13 aa, Mycobacterium tuberculosis
SGADAVVADLAAV

SEQ ID NO: 154606 - protein, 13 aa, Mycobacterium tuberculosis
GADAVVADLAAVT

SEQ ID NO: 154607 - protein, 13 aa, Mycobacterium tuberculosis
ADAVVADLAAVTV

SEQ ID NO: 154608 - protein, 13 aa, Mycobacterium tuberculosis
DAVVADLAAVTVG

SEQ ID NO: 154609 - protein, 13 aa, Mycobacterium tuberculosis
AVVADLAAVTVGS

SEQ ID NO: 154610 - protein, 13 aa, Mycobacterium tuberculosis
VVADLAAVTVGSG

SEQ ID NO: 154611 - protein, 13 aa, Mycobacterium tuberculosis
VADLAAVTVGSGD

SEQ ID NO: 154612 - protein, 13 aa, Mycobacterium tuberculosis
ADLAAVTVGSGDA

SEQ ID NO: 154613 - protein, 13 aa, Mycobacterium tuberculosis
DLAAVTVGSGDAA

SEQ ID NO: 154614 - protein, 13 aa, Mycobacterium tuberculosis
LAAVTVGSGDAAI

SEQ ID NO: 154615 - protein, 13 aa, Mycobacterium tuberculosis
AAVTVGSGDAAIS

SEQ ID NO: 154616 - protein, 13 aa, Mycobacterium tuberculosis
AVTVGSGDAAIST

SEQ ID NO: 154617 - protein, 13 aa, Mycobacterium tuberculosis
VTVGSGDAAISTI

SEQ ID NO: 154618 - protein, 13 aa, Mycobacterium tuberculosis
TVGSGDAAISTIP

SEQ ID NO: 154619 - protein, 13 aa, Mycobacterium tuberculosis
VGSGDAAISTIPD

SEQ ID NO: 154620 - protein, 13 aa, Mycobacterium tuberculosis
GSGDAAISTIPDA

SEQ ID NO: 154621 - protein, 13 aa, Mycobacterium tuberculosis
SGDAAISTIPDAL

SEQ ID NO: 154622 - protein, 13 aa, Mycobacterium tuberculosis
GDAAISTIPDALQ

SEQ ID NO: 154623 - protein, 13 aa, Mycobacterium tuberculosis
DAAISTIPDALQV

SEQ ID NO: 154624 - protein, 13 aa, Mycobacterium tuberculosis
AAISTIPDALQVY

SEQ ID NO: 154625 - protein, 13 aa, Mycobacterium tuberculosis
AISTIPDALQVYS

SEQ ID NO: 154626 - protein, 13 aa, Mycobacterium tuberculosis
ISTIPDALQVYSQ

SEQ ID NO: 154627 - protein, 13 aa, Mycobacterium tuberculosis
STIPDALQVYSQL

SEQ ID NO: 154628 - protein, 13 aa, Mycobacterium tuberculosis
TIPDALQVYSQLK

SEQ ID NO: 154629 - protein, 13 aa, Mycobacterium tuberculosis
IPDALQVYSQLKR

SEQ ID NO: 154630 - protein, 13 aa, Mycobacterium tuberculosis
PDALQVYSQLKRL

SEQ ID NO: 154631 - protein, 13 aa, Mycobacterium tuberculosis
DALQVYSQLKRLL

SEQ ID NO: 154632 - protein, 13 aa, Mycobacterium tuberculosis
ALQVYSQLKRLLT

SEQ ID NO: 154633 - protein, 13 aa, Mycobacterium tuberculosis
LQVYSQLKRLLTG

SEQ ID NO: 154634 - protein, 13 aa, Mycobacterium tuberculosis
QVYSQLKRLLTGR

SEQ ID NO: 154635 - protein, 13 aa, Mycobacterium tuberculosis
VYSQLKRLLTGRR

SEQ ID NO: 154636 - protein, 13 aa, Mycobacterium tuberculosis
YSQLKRLLTGRRP

SEQ ID NO: 154637 - protein, 13 aa, Mycobacterium tuberculosis
SQLKRLLTGRRPA

SEQ ID NO: 154638 - protein, 13 aa, Mycobacterium tuberculosis
QLKRLLTGRRPAV

SEQ ID NO: 154639 - protein, 13 aa, Mycobacterium tuberculosis
LKRLLTGRRPAVF

SEQ ID NO: 154640 - protein, 13 aa, Mycobacterium tuberculosis
KRLLTGRRPAVFL

SEQ ID NO: 154641 - protein, 13 aa, Mycobacterium tuberculosis
RLLTGRRPAVFLD

SEQ ID NO: 154642 - protein, 13 aa, Mycobacterium tuberculosis
LLTGRRPAVFLDF

SEQ ID NO: 154643 - protein, 13 aa, Mycobacterium tuberculosis
LTGRRPAVFLDFD

SEQ ID NO: 154644 - protein, 13 aa, Mycobacterium tuberculosis
TGRRPAVFLDFDG

SEQ ID NO: 154645 - protein, 13 aa, Mycobacterium tuberculosis
GRRPAVFLDFDGT

SEQ ID NO: 154646 - protein, 13 aa, Mycobacterium tuberculosis
RRPAVFLDFDGTL

SEQ ID NO: 154647 - protein, 13 aa, Mycobacterium tuberculosis
RPAVFLDFDGTLS

SEQ ID NO: 154648 - protein, 13 aa, Mycobacterium tuberculosis
PAVFLDFDGTLSD

SEQ ID NO: 154649 - protein, 13 aa, Mycobacterium tuberculosis
AVFLDFDGTLSDI

SEQ ID NO: 154650 - protein, 13 aa, Mycobacterium tuberculosis
VFLDFDGTLSDIV

SEQ ID NO: 154651 - protein, 13 aa, Mycobacterium tuberculosis
FLDFDGTLSDIVE

SEQ ID NO: 154652 - protein, 13 aa, Mycobacterium tuberculosis
LDFDGTLSDIVER

SEQ ID NO: 154653 - protein, 13 aa, Mycobacterium tuberculosis
DFDGTLSDIVERP

SEQ ID NO: 154654 - protein, 13 aa, Mycobacterium tuberculosis
FDGTLSDIVERPE

SEQ ID NO: 154655 - protein, 13 aa, Mycobacterium tuberculosis
DGTLSDIVERPEA

SEQ ID NO: 154656 - protein, 13 aa, Mycobacterium tuberculosis
GTLSDIVERPEAA

SEQ ID NO: 154657 - protein, 13 aa, Mycobacterium tuberculosis
TLSDIVERPEAAT

SEQ ID NO: 154658 - protein, 13 aa, Mycobacterium tuberculosis
LSDIVERPEAATL

SEQ ID NO: 154659 - protein, 13 aa, Mycobacterium tuberculosis
SDIVERPEAATLV

SEQ ID NO: 154660 - protein, 13 aa, Mycobacterium tuberculosis
DIVERPEAATLVD

SEQ ID NO: 154661 - protein, 13 aa, Mycobacterium tuberculosis
IVERPEAATLVDG

SEQ ID NO: 154662 - protein, 13 aa, Mycobacterium tuberculosis
VERPEAATLVDGA

SEQ ID NO: 154663 - protein, 13 aa, Mycobacterium tuberculosis
ERPEAATLVDGAA

SEQ ID NO: 154664 - protein, 13 aa, Mycobacterium tuberculosis
RPEAATLVDGAAE

SEQ ID NO: 154665 - protein, 13 aa, Mycobacterium tuberculosis
PEAATLVDGAAEA

SEQ ID NO: 154666 - protein, 13 aa, Mycobacterium tuberculosis
EAATLVDGAAEAL

SEQ ID NO: 154667 - protein, 13 aa, Mycobacterium tuberculosis
AATLVDGAAEALR

SEQ ID NO: 154668 - protein, 13 aa, Mycobacterium tuberculosis
ATLVDGAAEALRA

SEQ ID NO: 154669 - protein, 13 aa, Mycobacterium tuberculosis
TLVDGAAEALRAL

SEQ ID NO: 154670 - protein, 13 aa, Mycobacterium tuberculosis
LVDGAAEALRALA

SEQ ID NO: 154671 - protein, 13 aa, Mycobacterium tuberculosis
VDGAAEALRALAA

SEQ ID NO: 154672 - protein, 13 aa, Mycobacterium tuberculosis
DGAAEALRALAAQ

SEQ ID NO: 154673 - protein, 13 aa, Mycobacterium tuberculosis
GAAEALRALAAQC

SEQ ID NO: 154674 - protein, 13 aa, Mycobacterium tuberculosis
AAEALRALAAQCP

SEQ ID NO: 154675 - protein, 13 aa, Mycobacterium tuberculosis
AEALRALAAQCPV

SEQ ID NO: 154676 - protein, 13 aa, Mycobacterium tuberculosis
EALRALAAQCPVA

SEQ ID NO: 154677 - protein, 13 aa, Mycobacterium tuberculosis
ALRALAAQCPVAV

SEQ ID NO: 154678 - protein, 13 aa, Mycobacterium tuberculosis
LRALAAQCPVAVI

SEQ ID NO: 154679 - protein, 13 aa, Mycobacterium tuberculosis
RALAAQCPVAVIS

SEQ ID NO: 154680 - protein, 13 aa, Mycobacterium tuberculosis
ALAAQCPVAVISG

SEQ ID NO: 154681 - protein, 13 aa, Mycobacterium tuberculosis
LAAQCPVAVISGR

SEQ ID NO: 154682 - protein, 13 aa, Mycobacterium tuberculosis
AAQCPVAVISGRD

SEQ ID NO: 154683 - protein, 13 aa, Mycobacterium tuberculosis
AQCPVAVISGRDL

SEQ ID NO: 154684 - protein, 13 aa, Mycobacterium tuberculosis
QCPVAVISGRDLA

SEQ ID NO: 154685 - protein, 13 aa, Mycobacterium tuberculosis
CPVAVISGRDLAD

SEQ ID NO: 154686 - protein, 13 aa, Mycobacterium tuberculosis
PVAVISGRDLADV

SEQ ID NO: 154687 - protein, 13 aa, Mycobacterium tuberculosis
VAVISGRDLADVR

SEQ ID NO: 154688 - protein, 13 aa, Mycobacterium tuberculosis
AVISGRDLADVRN

SEQ ID NO: 154689 - protein, 13 aa, Mycobacterium tuberculosis
VISGRDLADVRNR

SEQ ID NO: 154690 - protein, 13 aa, Mycobacterium tuberculosis
ISGRDLADVRNRV

SEQ ID NO: 154691 - protein, 13 aa, Mycobacterium tuberculosis
SGRDLADVRNRVK

SEQ ID NO: 154692 - protein, 13 aa, Mycobacterium tuberculosis
GRDLADVRNRVKV

SEQ ID NO: 154693 - protein, 13 aa, Mycobacterium tuberculosis
RDLADVRNRVKVD

SEQ ID NO: 154694 - protein, 13 aa, Mycobacterium tuberculosis
DLADVRNRVKVDG

SEQ ID NO: 154695 - protein, 13 aa, Mycobacterium tuberculosis
LADVRNRVKVDGL

SEQ ID NO: 154696 - protein, 13 aa, Mycobacterium tuberculosis
ADVRNRVKVDGLW

SEQ ID NO: 154697 - protein, 13 aa, Mycobacterium tuberculosis
DVRNRVKVDGLWL

SEQ ID NO: 154698 - protein, 13 aa, Mycobacterium tuberculosis
VRNRVKVDGLWLA

SEQ ID NO: 154699 - protein, 13 aa, Mycobacterium tuberculosis
RNRVKVDGLWLAG

SEQ ID NO: 154700 - protein, 13 aa, Mycobacterium tuberculosis
NRVKVDGLWLAGS

SEQ ID NO: 154701 - protein, 13 aa, Mycobacterium tuberculosis
RVKVDGLWLAGSH

SEQ ID NO: 154702 - protein, 13 aa, Mycobacterium tuberculosis
VKVDGLWLAGSHG

SEQ ID NO: 154703 - protein, 13 aa, Mycobacterium tuberculosis
KVDGLWLAGSHGF

SEQ ID NO: 154704 - protein, 13 aa, Mycobacterium tuberculosis
VDGLWLAGSHGFE

SEQ ID NO: 154705 - protein, 13 aa, Mycobacterium tuberculosis
DGLWLAGSHGFEL

SEQ ID NO: 154706 - protein, 13 aa, Mycobacterium tuberculosis
GLWLAGSHGFELV

SEQ ID NO: 154707 - protein, 13 aa, Mycobacterium tuberculosis
LWLAGSHGFELVA

SEQ ID NO: 154708 - protein, 13 aa, Mycobacterium tuberculosis
WLAGSHGFELVAP

SEQ ID NO: 154709 - protein, 13 aa, Mycobacterium tuberculosis
LAGSHGFELVAPD

SEQ ID NO: 154710 - protein, 13 aa, Mycobacterium tuberculosis
AGSHGFELVAPDG

SEQ ID NO: 154711 - protein, 13 aa, Mycobacterium tuberculosis
GSHGFELVAPDGS

SEQ ID NO: 154712 - protein, 13 aa, Mycobacterium tuberculosis
SHGFELVAPDGSH

SEQ ID NO: 154713 - protein, 13 aa, Mycobacterium tuberculosis
HGFELVAPDGSHH

SEQ ID NO: 154714 - protein, 13 aa, Mycobacterium tuberculosis
GFELVAPDGSHHQ

SEQ ID NO: 154715 - protein, 13 aa, Mycobacterium tuberculosis
FELVAPDGSHHQN

SEQ ID NO: 154716 - protein, 13 aa, Mycobacterium tuberculosis
ELVAPDGSHHQNA

SEQ ID NO: 154717 - protein, 13 aa, Mycobacterium tuberculosis
LVAPDGSHHQNAA

SEQ ID NO: 154718 - protein, 13 aa, Mycobacterium tuberculosis
VAPDGSHHQNAAA

SEQ ID NO: 154719 - protein, 13 aa, Mycobacterium tuberculosis
APDGSHHQNAAAT

SEQ ID NO: 154720 - protein, 13 aa, Mycobacterium tuberculosis
PDGSHHQNAAATA

SEQ ID NO: 154721 - protein, 13 aa, Mycobacterium tuberculosis
DGSHHQNAAATAA

SEQ ID NO: 154722 - protein, 13 aa, Mycobacterium tuberculosis
GSHHQNAAATAAI

SEQ ID NO: 154723 - protein, 13 aa, Mycobacterium tuberculosis
SHHQNAAATAAID

SEQ ID NO: 154724 - protein, 13 aa, Mycobacterium tuberculosis
HHQNAAATAAIDG

SEQ ID NO: 154725 - protein, 13 aa, Mycobacterium tuberculosis
HQNAAATAAIDGL

SEQ ID NO: 154726 - protein, 13 aa, Mycobacterium tuberculosis
QNAAATAAIDGLA

SEQ ID NO: 154727 - protein, 13 aa, Mycobacterium tuberculosis
NAAATAAIDGLAE

SEQ ID NO: 154728 - protein, 13 aa, Mycobacterium tuberculosis
AAATAAIDGLAEA

SEQ ID NO: 154729 - protein, 13 aa, Mycobacterium tuberculosis
AATAAIDGLAEAA

SEQ ID NO: 154730 - protein, 13 aa, Mycobacterium tuberculosis
ATAAIDGLAEAAA

SEQ ID NO: 154731 - protein, 13 aa, Mycobacterium tuberculosis
TAAIDGLAEAAAQ

SEQ ID NO: 154732 - protein, 13 aa, Mycobacterium tuberculosis
AAIDGLAEAAAQL

SEQ ID NO: 154733 - protein, 13 aa, Mycobacterium tuberculosis
AIDGLAEAAAQLA

SEQ ID NO: 154734 - protein, 13 aa, Mycobacterium tuberculosis
IDGLAEAAAQLAD

SEQ ID NO: 154735 - protein, 13 aa, Mycobacterium tuberculosis
DGLAEAAAQLADA

SEQ ID NO: 154736 - protein, 13 aa, Mycobacterium tuberculosis
GLAEAAAQLADAL

SEQ ID NO: 154737 - protein, 13 aa, Mycobacterium tuberculosis
LAEAAAQLADALR

SEQ ID NO: 154738 - protein, 13 aa, Mycobacterium tuberculosis
AEAAAQLADALRE

SEQ ID NO: 154739 - protein, 13 aa, Mycobacterium tuberculosis
EAAAQLADALREI

SEQ ID NO: 154740 - protein, 13 aa, Mycobacterium tuberculosis
AAAQLADALREIA

SEQ ID NO: 154741 - protein, 13 aa, Mycobacterium tuberculosis
AAQLADALREIAG

SEQ ID NO: 154742 - protein, 13 aa, Mycobacterium tuberculosis
AQLADALREIAGA

SEQ ID NO: 154743 - protein, 13 aa, Mycobacterium tuberculosis
QLADALREIAGAV

SEQ ID NO: 154744 - protein, 13 aa, Mycobacterium tuberculosis
LADALREIAGAVV

SEQ ID NO: 154745 - protein, 13 aa, Mycobacterium tuberculosis
ADALREIAGAVVE

SEQ ID NO: 154746 - protein, 13 aa, Mycobacterium tuberculosis
DALREIAGAVVEH

SEQ ID NO: 154747 - protein, 13 aa, Mycobacterium tuberculosis
ALREIAGAVVEHK

SEQ ID NO: 154748 - protein, 13 aa, Mycobacterium tuberculosis
LREIAGAVVEHKR

SEQ ID NO: 154749 - protein, 13 aa, Mycobacterium tuberculosis
REIAGAVVEHKRF

SEQ ID NO: 154750 - protein, 13 aa, Mycobacterium tuberculosis
EIAGAVVEHKRFA

SEQ ID NO: 154751 - protein, 13 aa, Mycobacterium tuberculosis
IAGAVVEHKRFAV

SEQ ID NO: 154752 - protein, 13 aa, Mycobacterium tuberculosis
AGAVVEHKRFAVA

SEQ ID NO: 154753 - protein, 13 aa, Mycobacterium tuberculosis
GAVVEHKRFAVAV

SEQ ID NO: 154754 - protein, 13 aa, Mycobacterium tuberculosis
AVVEHKRFAVAVH

SEQ ID NO: 154755 - protein, 13 aa, Mycobacterium tuberculosis
VVEHKRFAVAVHY

SEQ ID NO: 154756 - protein, 13 aa, Mycobacterium tuberculosis
VEHKRFAVAVHYR

SEQ ID NO: 154757 - protein, 13 aa, Mycobacterium tuberculosis
EHKRFAVAVHYRN

SEQ ID NO: 154758 - protein, 13 aa, Mycobacterium tuberculosis
HKRFAVAVHYRNV

SEQ ID NO: 154759 - protein, 13 aa, Mycobacterium tuberculosis
KRFAVAVHYRNVA

SEQ ID NO: 154760 - protein, 13 aa, Mycobacterium tuberculosis
RFAVAVHYRNVAD

SEQ ID NO: 154761 - protein, 13 aa, Mycobacterium tuberculosis
FAVAVHYRNVADD

SEQ ID NO: 154762 - protein, 13 aa, Mycobacterium tuberculosis
AVAVHYRNVADDS

SEQ ID NO: 154763 - protein, 13 aa, Mycobacterium tuberculosis
VAVHYRNVADDSV

SEQ ID NO: 154764 - protein, 13 aa, Mycobacterium tuberculosis
AVHYRNVADDSVD

SEQ ID NO: 154765 - protein, 13 aa, Mycobacterium tuberculosis
VHYRNVADDSVDN

SEQ ID NO: 154766 - protein, 13 aa, Mycobacterium tuberculosis
HYRNVADDSVDNL

SEQ ID NO: 154767 - protein, 13 aa, Mycobacterium tuberculosis
YRNVADDSVDNLI

SEQ ID NO: 154768 - protein, 13 aa, Mycobacterium tuberculosis
RNVADDSVDNLIA

SEQ ID NO: 154769 - protein, 13 aa, Mycobacterium tuberculosis
NVADDSVDNLIAA

SEQ ID NO: 154770 - protein, 13 aa, Mycobacterium tuberculosis
VADDSVDNLIAAV

SEQ ID NO: 154771 - protein, 13 aa, Mycobacterium tuberculosis
ADDSVDNLIAAVR

SEQ ID NO: 154772 - protein, 13 aa, Mycobacterium tuberculosis
DDSVDNLIAAVRR

SEQ ID NO: 154773 - protein, 13 aa, Mycobacterium tuberculosis
DSVDNLIAAVRRL

SEQ ID NO: 154774 - protein, 13 aa, Mycobacterium tuberculosis
SVDNLIAAVRRLG

SEQ ID NO: 154775 - protein, 13 aa, Mycobacterium tuberculosis
VDNLIAAVRRLGH

SEQ ID NO: 154776 - protein, 13 aa, Mycobacterium tuberculosis
DNLIAAVRRLGHA

SEQ ID NO: 154777 - protein, 13 aa, Mycobacterium tuberculosis
NLIAAVRRLGHAA

SEQ ID NO: 154778 - protein, 13 aa, Mycobacterium tuberculosis
LIAAVRRLGHAAG

SEQ ID NO: 154779 - protein, 13 aa, Mycobacterium tuberculosis
IAAVRRLGHAAGL

SEQ ID NO: 154780 - protein, 13 aa, Mycobacterium tuberculosis
AAVRRLGHAAGLR

SEQ ID NO: 154781 - protein, 13 aa, Mycobacterium tuberculosis
AVRRLGHAAGLRV

SEQ ID NO: 154782 - protein, 13 aa, Mycobacterium tuberculosis
VRRLGHAAGLRVT

SEQ ID NO: 154783 - protein, 13 aa, Mycobacterium tuberculosis
RRLGHAAGLRVTT

SEQ ID NO: 154784 - protein, 13 aa, Mycobacterium tuberculosis
RLGHAAGLRVTTG

SEQ ID NO: 154785 - protein, 13 aa, Mycobacterium tuberculosis
LGHAAGLRVTTGR

SEQ ID NO: 154786 - protein, 13 aa, Mycobacterium tuberculosis
GHAAGLRVTTGRK

SEQ ID NO: 154787 - protein, 13 aa, Mycobacterium tuberculosis
HAAGLRVTTGRKV

SEQ ID NO: 154788 - protein, 13 aa, Mycobacterium tuberculosis
AAGLRVTTGRKVV

SEQ ID NO: 154789 - protein, 13 aa, Mycobacterium tuberculosis
AGLRVTTGRKVVE

SEQ ID NO: 154790 - protein, 13 aa, Mycobacterium tuberculosis
GLRVTTGRKVVEL

SEQ ID NO: 154791 - protein, 13 aa, Mycobacterium tuberculosis
LRVTTGRKVVELR

SEQ ID NO: 154792 - protein, 13 aa, Mycobacterium tuberculosis
RVTTGRKVVELRP

SEQ ID NO: 154793 - protein, 13 aa, Mycobacterium tuberculosis
VTTGRKVVELRPD

SEQ ID NO: 154794 - protein, 13 aa, Mycobacterium tuberculosis
TTGRKVVELRPDI

SEQ ID NO: 154795 - protein, 13 aa, Mycobacterium tuberculosis
TGRKVVELRPDIA

SEQ ID NO: 154796 - protein, 13 aa, Mycobacterium tuberculosis
GRKVVELRPDIAW

SEQ ID NO: 154797 - protein, 13 aa, Mycobacterium tuberculosis
RKVVELRPDIAWD

SEQ ID NO: 154798 - protein, 13 aa, Mycobacterium tuberculosis
KVVELRPDIAWDK

SEQ ID NO: 154799 - protein, 13 aa, Mycobacterium tuberculosis
VVELRPDIAWDKG

SEQ ID NO: 154800 - protein, 13 aa, Mycobacterium tuberculosis
VELRPDIAWDKGK

SEQ ID NO: 154801 - protein, 13 aa, Mycobacterium tuberculosis
ELRPDIAWDKGKA

SEQ ID NO: 154802 - protein, 13 aa, Mycobacterium tuberculosis
LRPDIAWDKGKAL

SEQ ID NO: 154803 - protein, 13 aa, Mycobacterium tuberculosis
RPDIAWDKGKALD

SEQ ID NO: 154804 - protein, 13 aa, Mycobacterium tuberculosis
PDIAWDKGKALDW

SEQ ID NO: 154805 - protein, 13 aa, Mycobacterium tuberculosis
DIAWDKGKALDWI

SEQ ID NO: 154806 - protein, 13 aa, Mycobacterium tuberculosis
IAWDKGKALDWIG

SEQ ID NO: 154807 - protein, 13 aa, Mycobacterium tuberculosis
AWDKGKALDWIGE

SEQ ID NO: 154808 - protein, 13 aa, Mycobacterium tuberculosis
WDKGKALDWIGER

SEQ ID NO: 154809 - protein, 13 aa, Mycobacterium tuberculosis
DKGKALDWIGERL

SEQ ID NO: 154810 - protein, 13 aa, Mycobacterium tuberculosis
KGKALDWIGERLG

SEQ ID NO: 154811 - protein, 13 aa, Mycobacterium tuberculosis
GKALDWIGERLGP

SEQ ID NO: 154812 - protein, 13 aa, Mycobacterium tuberculosis
KALDWIGERLGPA

SEQ ID NO: 154813 - protein, 13 aa, Mycobacterium tuberculosis
ALDWIGERLGPAE

SEQ ID NO: 154814 - protein, 13 aa, Mycobacterium tuberculosis
LDWIGERLGPAEV

SEQ ID NO: 154815 - protein, 13 aa, Mycobacterium tuberculosis
DWIGERLGPAEVG

SEQ ID NO: 154816 - protein, 13 aa, Mycobacterium tuberculosis
WIGERLGPAEVGP

SEQ ID NO: 154817 - protein, 13 aa, Mycobacterium tuberculosis
IGERLGPAEVGPD

SEQ ID NO: 154818 - protein, 13 aa, Mycobacterium tuberculosis
GERLGPAEVGPDL

SEQ ID NO: 154819 - protein, 13 aa, Mycobacterium tuberculosis
ERLGPAEVGPDLR

SEQ ID NO: 154820 - protein, 13 aa, Mycobacterium tuberculosis
RLGPAEVGPDLRL

SEQ ID NO: 154821 - protein, 13 aa, Mycobacterium tuberculosis
LGPAEVGPDLRLP

SEQ ID NO: 154822 - protein, 13 aa, Mycobacterium tuberculosis
GPAEVGPDLRLPI

SEQ ID NO: 154823 - protein, 13 aa, Mycobacterium tuberculosis
PAEVGPDLRLPIY

SEQ ID NO: 154824 - protein, 13 aa, Mycobacterium tuberculosis
AEVGPDLRLPIYI

SEQ ID NO: 154825 - protein, 13 aa, Mycobacterium tuberculosis
EVGPDLRLPIYIG

SEQ ID NO: 154826 - protein, 13 aa, Mycobacterium tuberculosis
VGPDLRLPIYIGD

SEQ ID NO: 154827 - protein, 13 aa, Mycobacterium tuberculosis
GPDLRLPIYIGDD

SEQ ID NO: 154828 - protein, 13 aa, Mycobacterium tuberculosis
PDLRLPIYIGDDL

SEQ ID NO: 154829 - protein, 13 aa, Mycobacterium tuberculosis
DLRLPIYIGDDLT

SEQ ID NO: 154830 - protein, 13 aa, Mycobacterium tuberculosis
LRLPIYIGDDLTD

SEQ ID NO: 154831 - protein, 13 aa, Mycobacterium tuberculosis
RLPIYIGDDLTDE

SEQ ID NO: 154832 - protein, 13 aa, Mycobacterium tuberculosis
LPIYIGDDLTDED

SEQ ID NO: 154833 - protein, 13 aa, Mycobacterium tuberculosis
PIYIGDDLTDEDA

SEQ ID NO: 154834 - protein, 13 aa, Mycobacterium tuberculosis
IYIGDDLTDEDAF

SEQ ID NO: 154835 - protein, 13 aa, Mycobacterium tuberculosis
YIGDDLTDEDAFD

SEQ ID NO: 154836 - protein, 13 aa, Mycobacterium tuberculosis
IGDDLTDEDAFDA

SEQ ID NO: 154837 - protein, 13 aa, Mycobacterium tuberculosis
GDDLTDEDAFDAV

SEQ ID NO: 154838 - protein, 13 aa, Mycobacterium tuberculosis
DDLTDEDAFDAVR

SEQ ID NO: 154839 - protein, 13 aa, Mycobacterium tuberculosis
DLTDEDAFDAVRF

SEQ ID NO: 154840 - protein, 13 aa, Mycobacterium tuberculosis
LTDEDAFDAVRFT

SEQ ID NO: 154841 - protein, 13 aa, Mycobacterium tuberculosis
TDEDAFDAVRFTG

SEQ ID NO: 154842 - protein, 13 aa, Mycobacterium tuberculosis
DEDAFDAVRFTGV

SEQ ID NO: 154843 - protein, 13 aa, Mycobacterium tuberculosis
EDAFDAVRFTGVG

SEQ ID NO: 154844 - protein, 13 aa, Mycobacterium tuberculosis
DAFDAVRFTGVGI

SEQ ID NO: 154845 - protein, 13 aa, Mycobacterium tuberculosis
AFDAVRFTGVGIV

SEQ ID NO: 154846 - protein, 13 aa, Mycobacterium tuberculosis
FDAVRFTGVGIVV

SEQ ID NO: 154847 - protein, 13 aa, Mycobacterium tuberculosis
DAVRFTGVGIVVR

SEQ ID NO: 154848 - protein, 13 aa, Mycobacterium tuberculosis
AVRFTGVGIVVRH

SEQ ID NO: 154849 - protein, 13 aa, Mycobacterium tuberculosis
VRFTGVGIVVRHN

SEQ ID NO: 154850 - protein, 13 aa, Mycobacterium tuberculosis
RFTGVGIVVRHNE

SEQ ID NO: 154851 - protein, 13 aa, Mycobacterium tuberculosis
FTGVGIVVRHNEH

SEQ ID NO: 154852 - protein, 13 aa, Mycobacterium tuberculosis
TGVGIVVRHNEHG

SEQ ID NO: 154853 - protein, 13 aa, Mycobacterium tuberculosis
GVGIVVRHNEHGD

SEQ ID NO: 154854 - protein, 13 aa, Mycobacterium tuberculosis
VGIVVRHNEHGDR

SEQ ID NO: 154855 - protein, 13 aa, Mycobacterium tuberculosis
GIVVRHNEHGDRR

SEQ ID NO: 154856 - protein, 13 aa, Mycobacterium tuberculosis
IVVRHNEHGDRRS

SEQ ID NO: 154857 - protein, 13 aa, Mycobacterium tuberculosis
VVRHNEHGDRRSA

SEQ ID NO: 154858 - protein, 13 aa, Mycobacterium tuberculosis
VRHNEHGDRRSAA

SEQ ID NO: 154859 - protein, 13 aa, Mycobacterium tuberculosis
RHNEHGDRRSAAT

SEQ ID NO: 154860 - protein, 13 aa, Mycobacterium tuberculosis
HNEHGDRRSAATF

SEQ ID NO: 154861 - protein, 13 aa, Mycobacterium tuberculosis
NEHGDRRSAATFR

SEQ ID NO: 154862 - protein, 13 aa, Mycobacterium tuberculosis
EHGDRRSAATFRL

SEQ ID NO: 154863 - protein, 13 aa, Mycobacterium tuberculosis
HGDRRSAATFRLE

SEQ ID NO: 154864 - protein, 13 aa, Mycobacterium tuberculosis
GDRRSAATFRLEC

SEQ ID NO: 154865 - protein, 13 aa, Mycobacterium tuberculosis
DRRSAATFRLECP

SEQ ID NO: 154866 - protein, 13 aa, Mycobacterium tuberculosis
RRSAATFRLECPY

SEQ ID NO: 154867 - protein, 13 aa, Mycobacterium tuberculosis
RSAATFRLECPYT

SEQ ID NO: 154868 - protein, 13 aa, Mycobacterium tuberculosis
SAATFRLECPYTV

SEQ ID NO: 154869 - protein, 13 aa, Mycobacterium tuberculosis
AATFRLECPYTVC

SEQ ID NO: 154870 - protein, 13 aa, Mycobacterium tuberculosis
ATFRLECPYTVCQ

SEQ ID NO: 154871 - protein, 13 aa, Mycobacterium tuberculosis
TFRLECPYTVCQF

SEQ ID NO: 154872 - protein, 13 aa, Mycobacterium tuberculosis
FRLECPYTVCQFL

SEQ ID NO: 154873 - protein, 13 aa, Mycobacterium tuberculosis
RLECPYTVCQFLS

SEQ ID NO: 154874 - protein, 13 aa, Mycobacterium tuberculosis
LECPYTVCQFLSQ

SEQ ID NO: 154875 - protein, 13 aa, Mycobacterium tuberculosis
ECPYTVCQFLSQL

SEQ ID NO: 154876 - protein, 13 aa, Mycobacterium tuberculosis
CPYTVCQFLSQLA

SEQ ID NO: 154877 - protein, 13 aa, Mycobacterium tuberculosis
PYTVCQFLSQLAC

SEQ ID NO: 154878 - protein, 13 aa, Mycobacterium tuberculosis
YTVCQFLSQLACD

SEQ ID NO: 154879 - protein, 13 aa, Mycobacterium tuberculosis
TVCQFLSQLACDL

SEQ ID NO: 154880 - protein, 13 aa, Mycobacterium tuberculosis
VCQFLSQLACDLQ

SEQ ID NO: 154881 - protein, 13 aa, Mycobacterium tuberculosis
CQFLSQLACDLQE

SEQ ID NO: 154882 - protein, 13 aa, Mycobacterium tuberculosis
QFLSQLACDLQEA

SEQ ID NO: 154883 - protein, 13 aa, Mycobacterium tuberculosis
FLSQLACDLQEAV

SEQ ID NO: 154884 - protein, 13 aa, Mycobacterium tuberculosis
LSQLACDLQEAVQ

SEQ ID NO: 154885 - protein, 13 aa, Mycobacterium tuberculosis
SQLACDLQEAVQH

SEQ ID NO: 154886 - protein, 13 aa, Mycobacterium tuberculosis
QLACDLQEAVQHD

SEQ ID NO: 154887 - protein, 13 aa, Mycobacterium tuberculosis
LACDLQEAVQHDD

SEQ ID NO: 154888 - protein, 13 aa, Mycobacterium tuberculosis
ACDLQEAVQHDDP

SEQ ID NO: 154889 - protein, 13 aa, Mycobacterium tuberculosis
CDLQEAVQHDDPW

SEQ ID NO: 154890 - protein, 13 aa, Mycobacterium tuberculosis
DLQEAVQHDDPWT

SEQ ID NO: 154891 - protein, 13 aa, Mycobacterium tuberculosis
LQEAVQHDDPWTL

SEQ ID NO: 154892 - protein, 13 aa, Mycobacterium tuberculosis
QEAVQHDDPWTLV

SEQ ID NO: 154893 - protein, 13 aa, Mycobacterium tuberculosis
EAVQHDDPWTLVF

SEQ ID NO: 154894 - protein, 13 aa, Mycobacterium tuberculosis
AVQHDDPWTLVFH

SEQ ID NO: 154895 - protein, 13 aa, Mycobacterium tuberculosis
VQHDDPWTLVFHG

SEQ ID NO: 154896 - protein, 13 aa, Mycobacterium tuberculosis
QHDDPWTLVFHGY

SEQ ID NO: 154897 - protein, 13 aa, Mycobacterium tuberculosis
HDDPWTLVFHGYD

SEQ ID NO: 154898 - protein, 13 aa, Mycobacterium tuberculosis
DDPWTLVFHGYDP

SEQ ID NO: 154899 - protein, 13 aa, Mycobacterium tuberculosis
DPWTLVFHGYDPG

SEQ ID NO: 154900 - protein, 13 aa, Mycobacterium tuberculosis
PWTLVFHGYDPGQ

SEQ ID NO: 154901 - protein, 13 aa, Mycobacterium tuberculosis
WTLVFHGYDPGQE

SEQ ID NO: 154902 - protein, 13 aa, Mycobacterium tuberculosis
TLVFHGYDPGQER

SEQ ID NO: 154903 - protein, 13 aa, Mycobacterium tuberculosis
LVFHGYDPGQERL

SEQ ID NO: 154904 - protein, 13 aa, Mycobacterium tuberculosis
VFHGYDPGQERLR

SEQ ID NO: 154905 - protein, 13 aa, Mycobacterium tuberculosis
FHGYDPGQERLRE

SEQ ID NO: 154906 - protein, 13 aa, Mycobacterium tuberculosis
HGYDPGQERLREA

SEQ ID NO: 154907 - protein, 13 aa, Mycobacterium tuberculosis
GYDPGQERLREAL

SEQ ID NO: 154908 - protein, 13 aa, Mycobacterium tuberculosis
YDPGQERLREALC

SEQ ID NO: 154909 - protein, 13 aa, Mycobacterium tuberculosis
DPGQERLREALCA

SEQ ID NO: 154910 - protein, 13 aa, Mycobacterium tuberculosis
PGQERLREALCAV

SEQ ID NO: 154911 - protein, 13 aa, Mycobacterium tuberculosis
GQERLREALCAVG

SEQ ID NO: 154912 - protein, 13 aa, Mycobacterium tuberculosis
QERLREALCAVGN

SEQ ID NO: 154913 - protein, 13 aa, Mycobacterium tuberculosis
ERLREALCAVGNG

SEQ ID NO: 154914 - protein, 13 aa, Mycobacterium tuberculosis
RLREALCAVGNGY

SEQ ID NO: 154915 - protein, 13 aa, Mycobacterium tuberculosis
LREALCAVGNGYL

SEQ ID NO: 154916 - protein, 13 aa, Mycobacterium tuberculosis
REALCAVGNGYLG

SEQ ID NO: 154917 - protein, 13 aa, Mycobacterium tuberculosis
EALCAVGNGYLGS

SEQ ID NO: 154918 - protein, 13 aa, Mycobacterium tuberculosis
ALCAVGNGYLGSR

SEQ ID NO: 154919 - protein, 13 aa, Mycobacterium tuberculosis
LCAVGNGYLGSRG

SEQ ID NO: 154920 - protein, 13 aa, Mycobacterium tuberculosis
CAVGNGYLGSRGC

SEQ ID NO: 154921 - protein, 13 aa, Mycobacterium tuberculosis
AVGNGYLGSRGCA

SEQ ID NO: 154922 - protein, 13 aa, Mycobacterium tuberculosis
VGNGYLGSRGCAP

SEQ ID NO: 154923 - protein, 13 aa, Mycobacterium tuberculosis
GNGYLGSRGCAPE

SEQ ID NO: 154924 - protein, 13 aa, Mycobacterium tuberculosis
NGYLGSRGCAPES

SEQ ID NO: 154925 - protein, 13 aa, Mycobacterium tuberculosis
GYLGSRGCAPESA

SEQ ID NO: 154926 - protein, 13 aa, Mycobacterium tuberculosis
YLGSRGCAPESAE

SEQ ID NO: 154927 - protein, 13 aa, Mycobacterium tuberculosis
LGSRGCAPESAES

SEQ ID NO: 154928 - protein, 13 aa, Mycobacterium tuberculosis
GSRGCAPESAESE

SEQ ID NO: 154929 - protein, 13 aa, Mycobacterium tuberculosis
SRGCAPESAESEA

SEQ ID NO: 154930 - protein, 13 aa, Mycobacterium tuberculosis
RGCAPESAESEAH

SEQ ID NO: 154931 - protein, 13 aa, Mycobacterium tuberculosis
GCAPESAESEAHY

SEQ ID NO: 154932 - protein, 13 aa, Mycobacterium tuberculosis
CAPESAESEAHYP

SEQ ID NO: 154933 - protein, 13 aa, Mycobacterium tuberculosis
APESAESEAHYPG

SEQ ID NO: 154934 - protein, 13 aa, Mycobacterium tuberculosis
PESAESEAHYPGT

SEQ ID NO: 154935 - protein, 13 aa, Mycobacterium tuberculosis
ESAESEAHYPGTY

SEQ ID NO: 154936 - protein, 13 aa, Mycobacterium tuberculosis
SAESEAHYPGTYV

SEQ ID NO: 154937 - protein, 13 aa, Mycobacterium tuberculosis
AESEAHYPGTYVA

SEQ ID NO: 154938 - protein, 13 aa, Mycobacterium tuberculosis
ESEAHYPGTYVAG

SEQ ID NO: 154939 - protein, 13 aa, Mycobacterium tuberculosis
SEAHYPGTYVAGV

SEQ ID NO: 154940 - protein, 13 aa, Mycobacterium tuberculosis
EAHYPGTYVAGVY

SEQ ID NO: 154941 - protein, 13 aa, Mycobacterium tuberculosis
AHYPGTYVAGVYN

SEQ ID NO: 154942 - protein, 13 aa, Mycobacterium tuberculosis
HYPGTYVAGVYNQ

SEQ ID NO: 154943 - protein, 13 aa, Mycobacterium tuberculosis
YPGTYVAGVYNQL

SEQ ID NO: 154944 - protein, 13 aa, Mycobacterium tuberculosis
PGTYVAGVYNQLT

SEQ ID NO: 154945 - protein, 13 aa, Mycobacterium tuberculosis
GTYVAGVYNQLTD

SEQ ID NO: 154946 - protein, 13 aa, Mycobacterium tuberculosis
TYVAGVYNQLTDH

SEQ ID NO: 154947 - protein, 13 aa, Mycobacterium tuberculosis
YVAGVYNQLTDHI

SEQ ID NO: 154948 - protein, 13 aa, Mycobacterium tuberculosis
VAGVYNQLTDHIE

SEQ ID NO: 154949 - protein, 13 aa, Mycobacterium tuberculosis
AGVYNQLTDHIEG

SEQ ID NO: 154950 - protein, 13 aa, Mycobacterium tuberculosis
GVYNQLTDHIEGC

SEQ ID NO: 154951 - protein, 13 aa, Mycobacterium tuberculosis
VYNQLTDHIEGCT

SEQ ID NO: 154952 - protein, 13 aa, Mycobacterium tuberculosis
YNQLTDHIEGCTV

SEQ ID NO: 154953 - protein, 13 aa, Mycobacterium tuberculosis
NQLTDHIEGCTVD

SEQ ID NO: 154954 - protein, 13 aa, Mycobacterium tuberculosis
QLTDHIEGCTVDN

SEQ ID NO: 154955 - protein, 13 aa, Mycobacterium tuberculosis
LTDHIEGCTVDNE

SEQ ID NO: 154956 - protein, 13 aa, Mycobacterium tuberculosis
TDHIEGCTVDNES

SEQ ID NO: 154957 - protein, 13 aa, Mycobacterium tuberculosis
DHIEGCTVDNESL

SEQ ID NO: 154958 - protein, 13 aa, Mycobacterium tuberculosis
HIEGCTVDNESLV

SEQ ID NO: 154959 - protein, 13 aa, Mycobacterium tuberculosis
IEGCTVDNESLVN

SEQ ID NO: 154960 - protein, 13 aa, Mycobacterium tuberculosis
EGCTVDNESLVNL

SEQ ID NO: 154961 - protein, 13 aa, Mycobacterium tuberculosis
GCTVDNESLVNLP

SEQ ID NO: 154962 - protein, 13 aa, Mycobacterium tuberculosis
CTVDNESLVNLPN

SEQ ID NO: 154963 - protein, 13 aa, Mycobacterium tuberculosis
TVDNESLVNLPNW

SEQ ID NO: 154964 - protein, 13 aa, Mycobacterium tuberculosis
VDNESLVNLPNWL

SEQ ID NO: 154965 - protein, 13 aa, Mycobacterium tuberculosis
DNESLVNLPNWLS

SEQ ID NO: 154966 - protein, 13 aa, Mycobacterium tuberculosis
NESLVNLPNWLSL

SEQ ID NO: 154967 - protein, 13 aa, Mycobacterium tuberculosis
ESLVNLPNWLSLT

SEQ ID NO: 154968 - protein, 13 aa, Mycobacterium tuberculosis
SLVNLPNWLSLTF

SEQ ID NO: 154969 - protein, 13 aa, Mycobacterium tuberculosis
LVNLPNWLSLTFR

SEQ ID NO: 154970 - protein, 13 aa, Mycobacterium tuberculosis
VNLPNWLSLTFRI

SEQ ID NO: 154971 - protein, 13 aa, Mycobacterium tuberculosis
NLPNWLSLTFRID

SEQ ID NO: 154972 - protein, 13 aa, Mycobacterium tuberculosis
LPNWLSLTFRIDG

SEQ ID NO: 154973 - protein, 13 aa, Mycobacterium tuberculosis
PNWLSLTFRIDGG

SEQ ID NO: 154974 - protein, 13 aa, Mycobacterium tuberculosis
NWLSLTFRIDGGA

SEQ ID NO: 154975 - protein, 13 aa, Mycobacterium tuberculosis
WLSLTFRIDGGAW

SEQ ID NO: 154976 - protein, 13 aa, Mycobacterium tuberculosis
LSLTFRIDGGAWF

SEQ ID NO: 154977 - protein, 13 aa, Mycobacterium tuberculosis
SLTFRIDGGAWFN

SEQ ID NO: 154978 - protein, 13 aa, Mycobacterium tuberculosis
LTFRIDGGAWFNV

SEQ ID NO: 154979 - protein, 13 aa, Mycobacterium tuberculosis
TFRIDGGAWFNVD

SEQ ID NO: 154980 - protein, 13 aa, Mycobacterium tuberculosis
FRIDGGAWFNVDT

SEQ ID NO: 154981 - protein, 13 aa, Mycobacterium tuberculosis
RIDGGAWFNVDTV

SEQ ID NO: 154982 - protein, 13 aa, Mycobacterium tuberculosis
IDGGAWFNVDTVE

SEQ ID NO: 154983 - protein, 13 aa, Mycobacterium tuberculosis
DGGAWFNVDTVEL

SEQ ID NO: 154984 - protein, 13 aa, Mycobacterium tuberculosis
GGAWFNVDTVELL

SEQ ID NO: 154985 - protein, 13 aa, Mycobacterium tuberculosis
GAWFNVDTVELLS

SEQ ID NO: 154986 - protein, 13 aa, Mycobacterium tuberculosis
AWFNVDTVELLSY

SEQ ID NO: 154987 - protein, 13 aa, Mycobacterium tuberculosis
WFNVDTVELLSYR

SEQ ID NO: 154988 - protein, 13 aa, Mycobacterium tuberculosis
FNVDTVELLSYRQ

SEQ ID NO: 154989 - protein, 13 aa, Mycobacterium tuberculosis
NVDTVELLSYRQT

SEQ ID NO: 154990 - protein, 13 aa, Mycobacterium tuberculosis
VDTVELLSYRQTF

SEQ ID NO: 154991 - protein, 13 aa, Mycobacterium tuberculosis
DTVELLSYRQTFD

SEQ ID NO: 154992 - protein, 13 aa, Mycobacterium tuberculosis
TVELLSYRQTFDL

SEQ ID NO: 154993 - protein, 13 aa, Mycobacterium tuberculosis
VELLSYRQTFDLR

SEQ ID NO: 154994 - protein, 13 aa, Mycobacterium tuberculosis
ELLSYRQTFDLRR

SEQ ID NO: 154995 - protein, 13 aa, Mycobacterium tuberculosis
LLSYRQTFDLRRA

SEQ ID NO: 154996 - protein, 13 aa, Mycobacterium tuberculosis
LSYRQTFDLRRAT

SEQ ID NO: 154997 - protein, 13 aa, Mycobacterium tuberculosis
SYRQTFDLRRATL

SEQ ID NO: 154998 - protein, 13 aa, Mycobacterium tuberculosis
YRQTFDLRRATLT

SEQ ID NO: 154999 - protein, 13 aa, Mycobacterium tuberculosis
RQTFDLRRATLTR

SEQ ID NO: 155000 - protein, 13 aa, Mycobacterium tuberculosis
QTFDLRRATLTRS

SEQ ID NO: 155001 - protein, 13 aa, Mycobacterium tuberculosis
TFDLRRATLTRSL

SEQ ID NO: 155002 - protein, 13 aa, Mycobacterium tuberculosis
FDLRRATLTRSLR

SEQ ID NO: 155003 - protein, 13 aa, Mycobacterium tuberculosis
DLRRATLTRSLRF

SEQ ID NO: 155004 - protein, 13 aa, Mycobacterium tuberculosis
LRRATLTRSLRFR

SEQ ID NO: 155005 - protein, 13 aa, Mycobacterium tuberculosis
RRATLTRSLRFRD

SEQ ID NO: 155006 - protein, 13 aa, Mycobacterium tuberculosis
RATLTRSLRFRDA

SEQ ID NO: 155007 - protein, 13 aa, Mycobacterium tuberculosis
ATLTRSLRFRDAG

SEQ ID NO: 155008 - protein, 13 aa, Mycobacterium tuberculosis
TLTRSLRFRDAGG

SEQ ID NO: 155009 - protein, 13 aa, Mycobacterium tuberculosis
LTRSLRFRDAGGR

SEQ ID NO: 155010 - protein, 13 aa, Mycobacterium tuberculosis
TRSLRFRDAGGRV

SEQ ID NO: 155011 - protein, 13 aa, Mycobacterium tuberculosis
RSLRFRDAGGRVT

SEQ ID NO: 155012 - protein, 13 aa, Mycobacterium tuberculosis
SLRFRDAGGRVTT

SEQ ID NO: 155013 - protein, 13 aa, Mycobacterium tuberculosis
LRFRDAGGRVTTM

SEQ ID NO: 155014 - protein, 13 aa, Mycobacterium tuberculosis
RFRDAGGRVTTMT

SEQ ID NO: 155015 - protein, 13 aa, Mycobacterium tuberculosis
FRDAGGRVTTMTQ

SEQ ID NO: 155016 - protein, 13 aa, Mycobacterium tuberculosis
RDAGGRVTTMTQE

SEQ ID NO: 155017 - protein, 13 aa, Mycobacterium tuberculosis
DAGGRVTTMTQER

SEQ ID NO: 155018 - protein, 13 aa, Mycobacterium tuberculosis
AGGRVTTMTQERF

SEQ ID NO: 155019 - protein, 13 aa, Mycobacterium tuberculosis
GGRVTTMTQERFA

SEQ ID NO: 155020 - protein, 13 aa, Mycobacterium tuberculosis
GRVTTMTQERFAS

SEQ ID NO: 155021 - protein, 13 aa, Mycobacterium tuberculosis
RVTTMTQERFASM

SEQ ID NO: 155022 - protein, 13 aa, Mycobacterium tuberculosis
VTTMTQERFASMN

SEQ ID NO: 155023 - protein, 13 aa, Mycobacterium tuberculosis
TTMTQERFASMNR

SEQ ID NO: 155024 - protein, 13 aa, Mycobacterium tuberculosis
TMTQERFASMNRP

SEQ ID NO: 155025 - protein, 13 aa, Mycobacterium tuberculosis
MTQERFASMNRPN

SEQ ID NO: 155026 - protein, 13 aa, Mycobacterium tuberculosis
TQERFASMNRPNL

SEQ ID NO: 155027 - protein, 13 aa, Mycobacterium tuberculosis
QERFASMNRPNLV

SEQ ID NO: 155028 - protein, 13 aa, Mycobacterium tuberculosis
ERFASMNRPNLVA

SEQ ID NO: 155029 - protein, 13 aa, Mycobacterium tuberculosis
RFASMNRPNLVAL

SEQ ID NO: 155030 - protein, 13 aa, Mycobacterium tuberculosis
FASMNRPNLVALQ

SEQ ID NO: 155031 - protein, 13 aa, Mycobacterium tuberculosis
ASMNRPNLVALQT

SEQ ID NO: 155032 - protein, 13 aa, Mycobacterium tuberculosis
SMNRPNLVALQTR

SEQ ID NO: 155033 - protein, 13 aa, Mycobacterium tuberculosis
MNRPNLVALQTRI

SEQ ID NO: 155034 - protein, 13 aa, Mycobacterium tuberculosis
NRPNLVALQTRIE

SEQ ID NO: 155035 - protein, 13 aa, Mycobacterium tuberculosis
RPNLVALQTRIES

SEQ ID NO: 155036 - protein, 13 aa, Mycobacterium tuberculosis
PNLVALQTRIESE

SEQ ID NO: 155037 - protein, 13 aa, Mycobacterium tuberculosis
NLVALQTRIESEN

SEQ ID NO: 155038 - protein, 13 aa, Mycobacterium tuberculosis
LVALQTRIESENW

SEQ ID NO: 155039 - protein, 13 aa, Mycobacterium tuberculosis
VALQTRIESENWS

SEQ ID NO: 155040 - protein, 13 aa, Mycobacterium tuberculosis
ALQTRIESENWSG

SEQ ID NO: 155041 - protein, 13 aa, Mycobacterium tuberculosis
LQTRIESENWSGT

SEQ ID NO: 155042 - protein, 13 aa, Mycobacterium tuberculosis
QTRIESENWSGTV

SEQ ID NO: 155043 - protein, 13 aa, Mycobacterium tuberculosis
TRIESENWSGTVD

SEQ ID NO: 155044 - protein, 13 aa, Mycobacterium tuberculosis
RIESENWSGTVDF

SEQ ID NO: 155045 - protein, 13 aa, Mycobacterium tuberculosis
IESENWSGTVDFR

SEQ ID NO: 155046 - protein, 13 aa, Mycobacterium tuberculosis
ESENWSGTVDFRS

SEQ ID NO: 155047 - protein, 13 aa, Mycobacterium tuberculosis
SENWSGTVDFRSL

SEQ ID NO: 155048 - protein, 13 aa, Mycobacterium tuberculosis
ENWSGTVDFRSLV

SEQ ID NO: 155049 - protein, 13 aa, Mycobacterium tuberculosis
NWSGTVDFRSLVD

SEQ ID NO: 155050 - protein, 13 aa, Mycobacterium tuberculosis
WSGTVDFRSLVDG

SEQ ID NO: 155051 - protein, 13 aa, Mycobacterium tuberculosis
SGTVDFRSLVDGG

SEQ ID NO: 155052 - protein, 13 aa, Mycobacterium tuberculosis
GTVDFRSLVDGGV

SEQ ID NO: 155053 - protein, 13 aa, Mycobacterium tuberculosis
TVDFRSLVDGGVH

SEQ ID NO: 155054 - protein, 13 aa, Mycobacterium tuberculosis
VDFRSLVDGGVHN

SEQ ID NO: 155055 - protein, 13 aa, Mycobacterium tuberculosis
DFRSLVDGGVHNT

SEQ ID NO: 155056 - protein, 13 aa, Mycobacterium tuberculosis
FRSLVDGGVHNTL

SEQ ID NO: 155057 - protein, 13 aa, Mycobacterium tuberculosis
RSLVDGGVHNTLV

SEQ ID NO: 155058 - protein, 13 aa, Mycobacterium tuberculosis
SLVDGGVHNTLVD

SEQ ID NO: 155059 - protein, 13 aa, Mycobacterium tuberculosis
LVDGGVHNTLVDR

SEQ ID NO: 155060 - protein, 13 aa, Mycobacterium tuberculosis
VDGGVHNTLVDRY

SEQ ID NO: 155061 - protein, 13 aa, Mycobacterium tuberculosis
DGGVHNTLVDRYR

SEQ ID NO: 155062 - protein, 13 aa, Mycobacterium tuberculosis
GGVHNTLVDRYRQ

SEQ ID NO: 155063 - protein, 13 aa, Mycobacterium tuberculosis
GVHNTLVDRYRQL

SEQ ID NO: 155064 - protein, 13 aa, Mycobacterium tuberculosis
VHNTLVDRYRQLS

SEQ ID NO: 155065 - protein, 13 aa, Mycobacterium tuberculosis
HNTLVDRYRQLSS

SEQ ID NO: 155066 - protein, 13 aa, Mycobacterium tuberculosis
NTLVDRYRQLSSQ

SEQ ID NO: 155067 - protein, 13 aa, Mycobacterium tuberculosis
TLVDRYRQLSSQH

SEQ ID NO: 155068 - protein, 13 aa, Mycobacterium tuberculosis
LVDRYRQLSSQHL

SEQ ID NO: 155069 - protein, 13 aa, Mycobacterium tuberculosis
VDRYRQLSSQHLT

SEQ ID NO: 155070 - protein, 13 aa, Mycobacterium tuberculosis
DRYRQLSSQHLTT

SEQ ID NO: 155071 - protein, 13 aa, Mycobacterium tuberculosis
RYRQLSSQHLTTA

SEQ ID NO: 155072 - protein, 13 aa, Mycobacterium tuberculosis
YRQLSSQHLTTAE

SEQ ID NO: 155073 - protein, 13 aa, Mycobacterium tuberculosis
RQLSSQHLTTAEI

SEQ ID NO: 155074 - protein, 13 aa, Mycobacterium tuberculosis
QLSSQHLTTAEIE

SEQ ID NO: 155075 - protein, 13 aa, Mycobacterium tuberculosis
LSSQHLTTAEIEV

SEQ ID NO: 155076 - protein, 13 aa, Mycobacterium tuberculosis
SSQHLTTAEIEVL

SEQ ID NO: 155077 - protein, 13 aa, Mycobacterium tuberculosis
SQHLTTAEIEVLA

SEQ ID NO: 155078 - protein, 13 aa, Mycobacterium tuberculosis
QHLTTAEIEVLAD

SEQ ID NO: 155079 - protein, 13 aa, Mycobacterium tuberculosis
HLTTAEIEVLADS

SEQ ID NO: 155080 - protein, 13 aa, Mycobacterium tuberculosis
LTTAEIEVLADSV

SEQ ID NO: 155081 - protein, 13 aa, Mycobacterium tuberculosis
TTAEIEVLADSVL

SEQ ID NO: 155082 - protein, 13 aa, Mycobacterium tuberculosis
TAEIEVLADSVLL

SEQ ID NO: 155083 - protein, 13 aa, Mycobacterium tuberculosis
AEIEVLADSVLLR

SEQ ID NO: 155084 - protein, 13 aa, Mycobacterium tuberculosis
EIEVLADSVLLRT

SEQ ID NO: 155085 - protein, 13 aa, Mycobacterium tuberculosis
IEVLADSVLLRTQ

SEQ ID NO: 155086 - protein, 13 aa, Mycobacterium tuberculosis
EVLADSVLLRTQT

SEQ ID NO: 155087 - protein, 13 aa, Mycobacterium tuberculosis
VLADSVLLRTQTS

SEQ ID NO: 155088 - protein, 13 aa, Mycobacterium tuberculosis
LADSVLLRTQTSQ

SEQ ID NO: 155089 - protein, 13 aa, Mycobacterium tuberculosis
ADSVLLRTQTSQS

SEQ ID NO: 155090 - protein, 13 aa, Mycobacterium tuberculosis
DSVLLRTQTSQSG

SEQ ID NO: 155091 - protein, 13 aa, Mycobacterium tuberculosis
SVLLRTQTSQSGI

SEQ ID NO: 155092 - protein, 13 aa, Mycobacterium tuberculosis
VLLRTQTSQSGIA

SEQ ID NO: 155093 - protein, 13 aa, Mycobacterium tuberculosis
LLRTQTSQSGIAI

SEQ ID NO: 155094 - protein, 13 aa, Mycobacterium tuberculosis
LRTQTSQSGIAIA

SEQ ID NO: 155095 - protein, 13 aa, Mycobacterium tuberculosis
RTQTSQSGIAIAV

SEQ ID NO: 155096 - protein, 13 aa, Mycobacterium tuberculosis
TQTSQSGIAIAVA

SEQ ID NO: 155097 - protein, 13 aa, Mycobacterium tuberculosis
QTSQSGIAIAVAA

SEQ ID NO: 155098 - protein, 13 aa, Mycobacterium tuberculosis
TSQSGIAIAVAAR

SEQ ID NO: 155099 - protein, 13 aa, Mycobacterium tuberculosis
SQSGIAIAVAARS

SEQ ID NO: 155100 - protein, 13 aa, Mycobacterium tuberculosis
QSGIAIAVAARST

SEQ ID NO: 155101 - protein, 13 aa, Mycobacterium tuberculosis
SGIAIAVAARSTL

SEQ ID NO: 155102 - protein, 13 aa, Mycobacterium tuberculosis
GIAIAVAARSTLW

SEQ ID NO: 155103 - protein, 13 aa, Mycobacterium tuberculosis
IAIAVAARSTLWR

SEQ ID NO: 155104 - protein, 13 aa, Mycobacterium tuberculosis
AIAVAARSTLWRD

SEQ ID NO: 155105 - protein, 13 aa, Mycobacterium tuberculosis
IAVAARSTLWRDG

SEQ ID NO: 155106 - protein, 13 aa, Mycobacterium tuberculosis
AVAARSTLWRDGQ

SEQ ID NO: 155107 - protein, 13 aa, Mycobacterium tuberculosis
VAARSTLWRDGQR

SEQ ID NO: 155108 - protein, 13 aa, Mycobacterium tuberculosis
AARSTLWRDGQRV

SEQ ID NO: 155109 - protein, 13 aa, Mycobacterium tuberculosis
ARSTLWRDGQRVD

SEQ ID NO: 155110 - protein, 13 aa, Mycobacterium tuberculosis
RSTLWRDGQRVDA

SEQ ID NO: 155111 - protein, 13 aa, Mycobacterium tuberculosis
STLWRDGQRVDAQ

SEQ ID NO: 155112 - protein, 13 aa, Mycobacterium tuberculosis
TLWRDGQRVDAQY

SEQ ID NO: 155113 - protein, 13 aa, Mycobacterium tuberculosis
LWRDGQRVDAQYR

SEQ ID NO: 155114 - protein, 13 aa, Mycobacterium tuberculosis
WRDGQRVDAQYRV

SEQ ID NO: 155115 - protein, 13 aa, Mycobacterium tuberculosis
RDGQRVDAQYRVA

SEQ ID NO: 155116 - protein, 13 aa, Mycobacterium tuberculosis
DGQRVDAQYRVAR

SEQ ID NO: 155117 - protein, 13 aa, Mycobacterium tuberculosis
GQRVDAQYRVARD

SEQ ID NO: 155118 - protein, 13 aa, Mycobacterium tuberculosis
QRVDAQYRVARDT

SEQ ID NO: 155119 - protein, 13 aa, Mycobacterium tuberculosis
RVDAQYRVARDTN

SEQ ID NO: 155120 - protein, 13 aa, Mycobacterium tuberculosis
VDAQYRVARDTNR

SEQ ID NO: 155121 - protein, 13 aa, Mycobacterium tuberculosis
DAQYRVARDTNRG

SEQ ID NO: 155122 - protein, 13 aa, Mycobacterium tuberculosis
AQYRVARDTNRGG

SEQ ID NO: 155123 - protein, 13 aa, Mycobacterium tuberculosis
QYRVARDTNRGGH

SEQ ID NO: 155124 - protein, 13 aa, Mycobacterium tuberculosis
YRVARDTNRGGHD

SEQ ID NO: 155125 - protein, 13 aa, Mycobacterium tuberculosis
RVARDTNRGGHDI

SEQ ID NO: 155126 - protein, 13 aa, Mycobacterium tuberculosis
VARDTNRGGHDIQ

SEQ ID NO: 155127 - protein, 13 aa, Mycobacterium tuberculosis
ARDTNRGGHDIQV

SEQ ID NO: 155128 - protein, 13 aa, Mycobacterium tuberculosis
RDTNRGGHDIQVT

SEQ ID NO: 155129 - protein, 13 aa, Mycobacterium tuberculosis
DTNRGGHDIQVTL

SEQ ID NO: 155130 - protein, 13 aa, Mycobacterium tuberculosis
TNRGGHDIQVTLS

SEQ ID NO: 155131 - protein, 13 aa, Mycobacterium tuberculosis
NRGGHDIQVTLSA

SEQ ID NO: 155132 - protein, 13 aa, Mycobacterium tuberculosis
RGGHDIQVTLSAG

SEQ ID NO: 155133 - protein, 13 aa, Mycobacterium tuberculosis
GGHDIQVTLSAGQ

SEQ ID NO: 155134 - protein, 13 aa, Mycobacterium tuberculosis
GHDIQVTLSAGQS

SEQ ID NO: 155135 - protein, 13 aa, Mycobacterium tuberculosis
HDIQVTLSAGQSV

SEQ ID NO: 155136 - protein, 13 aa, Mycobacterium tuberculosis
DIQVTLSAGQSVT

SEQ ID NO: 155137 - protein, 13 aa, Mycobacterium tuberculosis
IQVTLSAGQSVTL

SEQ ID NO: 155138 - protein, 13 aa, Mycobacterium tuberculosis
QVTLSAGQSVTLE

SEQ ID NO: 155139 - protein, 13 aa, Mycobacterium tuberculosis
VTLSAGQSVTLEK

SEQ ID NO: 155140 - protein, 13 aa, Mycobacterium tuberculosis
TLSAGQSVTLEKV

SEQ ID NO: 155141 - protein, 13 aa, Mycobacterium tuberculosis
LSAGQSVTLEKVA

SEQ ID NO: 155142 - protein, 13 aa, Mycobacterium tuberculosis
SAGQSVTLEKVAT

SEQ ID NO: 155143 - protein, 13 aa, Mycobacterium tuberculosis
AGQSVTLEKVATI

SEQ ID NO: 155144 - protein, 13 aa, Mycobacterium tuberculosis
GQSVTLEKVATIF

SEQ ID NO: 155145 - protein, 13 aa, Mycobacterium tuberculosis
QSVTLEKVATIFT

SEQ ID NO: 155146 - protein, 13 aa, Mycobacterium tuberculosis
SVTLEKVATIFTS

SEQ ID NO: 155147 - protein, 13 aa, Mycobacterium tuberculosis
VTLEKVATIFTSR

SEQ ID NO: 155148 - protein, 13 aa, Mycobacterium tuberculosis
TLEKVATIFTSRD

SEQ ID NO: 155149 - protein, 13 aa, Mycobacterium tuberculosis
LEKVATIFTSRDA

SEQ ID NO: 155150 - protein, 13 aa, Mycobacterium tuberculosis
EKVATIFTSRDAA

SEQ ID NO: 155151 - protein, 13 aa, Mycobacterium tuberculosis
KVATIFTSRDAAT

SEQ ID NO: 155152 - protein, 13 aa, Mycobacterium tuberculosis
VATIFTSRDAATL

SEQ ID NO: 155153 - protein, 13 aa, Mycobacterium tuberculosis
ATIFTSRDAATLT

SEQ ID NO: 155154 - protein, 13 aa, Mycobacterium tuberculosis
TIFTSRDAATLTA

SEQ ID NO: 155155 - protein, 13 aa, Mycobacterium tuberculosis
IFTSRDAATLTAA

SEQ ID NO: 155156 - protein, 13 aa, Mycobacterium tuberculosis
FTSRDAATLTAAI

SEQ ID NO: 155157 - protein, 13 aa, Mycobacterium tuberculosis
TSRDAATLTAAIS

SEQ ID NO: 155158 - protein, 13 aa, Mycobacterium tuberculosis
SRDAATLTAAISA

SEQ ID NO: 155159 - protein, 13 aa, Mycobacterium tuberculosis
RDAATLTAAISAQ

SEQ ID NO: 155160 - protein, 13 aa, Mycobacterium tuberculosis
DAATLTAAISAQR

SEQ ID NO: 155161 - protein, 13 aa, Mycobacterium tuberculosis
AATLTAAISAQRC

SEQ ID NO: 155162 - protein, 13 aa, Mycobacterium tuberculosis
ATLTAAISAQRCL

SEQ ID NO: 155163 - protein, 13 aa, Mycobacterium tuberculosis
TLTAAISAQRCLG

SEQ ID NO: 155164 - protein, 13 aa, Mycobacterium tuberculosis
LTAAISAQRCLGE

SEQ ID NO: 155165 - protein, 13 aa, Mycobacterium tuberculosis
TAAISAQRCLGEA

SEQ ID NO: 155166 - protein, 13 aa, Mycobacterium tuberculosis
AAISAQRCLGEAG

SEQ ID NO: 155167 - protein, 13 aa, Mycobacterium tuberculosis
AISAQRCLGEAGR

SEQ ID NO: 155168 - protein, 13 aa, Mycobacterium tuberculosis
ISAQRCLGEAGRY

SEQ ID NO: 155169 - protein, 13 aa, Mycobacterium tuberculosis
SAQRCLGEAGRYA

SEQ ID NO: 155170 - protein, 13 aa, Mycobacterium tuberculosis
AQRCLGEAGRYAE

SEQ ID NO: 155171 - protein, 13 aa, Mycobacterium tuberculosis
QRCLGEAGRYAEL

SEQ ID NO: 155172 - protein, 13 aa, Mycobacterium tuberculosis
RCLGEAGRYAELC

SEQ ID NO: 155173 - protein, 13 aa, Mycobacterium tuberculosis
CLGEAGRYAELCQ

SEQ ID NO: 155174 - protein, 13 aa, Mycobacterium tuberculosis
LGEAGRYAELCQQ

SEQ ID NO: 155175 - protein, 13 aa, Mycobacterium tuberculosis
GEAGRYAELCQQH

SEQ ID NO: 155176 - protein, 13 aa, Mycobacterium tuberculosis
EAGRYAELCQQHV

SEQ ID NO: 155177 - protein, 13 aa, Mycobacterium tuberculosis
AGRYAELCQQHVR

SEQ ID NO: 155178 - protein, 13 aa, Mycobacterium tuberculosis
GRYAELCQQHVRA

SEQ ID NO: 155179 - protein, 13 aa, Mycobacterium tuberculosis
RYAELCQQHVRAW

SEQ ID NO: 155180 - protein, 13 aa, Mycobacterium tuberculosis
YAELCQQHVRAWA

SEQ ID NO: 155181 - protein, 13 aa, Mycobacterium tuberculosis
AELCQQHVRAWAR

SEQ ID NO: 155182 - protein, 13 aa, Mycobacterium tuberculosis
ELCQQHVRAWARL

SEQ ID NO: 155183 - protein, 13 aa, Mycobacterium tuberculosis
LCQQHVRAWARLW

SEQ ID NO: 155184 - protein, 13 aa, Mycobacterium tuberculosis
CQQHVRAWARLWE

SEQ ID NO: 155185 - protein, 13 aa, Mycobacterium tuberculosis
QQHVRAWARLWER

SEQ ID NO: 155186 - protein, 13 aa, Mycobacterium tuberculosis
QHVRAWARLWERC

SEQ ID NO: 155187 - protein, 13 aa, Mycobacterium tuberculosis
HVRAWARLWERCA

SEQ ID NO: 155188 - protein, 13 aa, Mycobacterium tuberculosis
VRAWARLWERCAI

SEQ ID NO: 155189 - protein, 13 aa, Mycobacterium tuberculosis
RAWARLWERCAID

SEQ ID NO: 155190 - protein, 13 aa, Mycobacterium tuberculosis
AWARLWERCAIDL

SEQ ID NO: 155191 - protein, 13 aa, Mycobacterium tuberculosis
WARLWERCAIDLT

SEQ ID NO: 155192 - protein, 13 aa, Mycobacterium tuberculosis
ARLWERCAIDLTG

SEQ ID NO: 155193 - protein, 13 aa, Mycobacterium tuberculosis
RLWERCAIDLTGN

SEQ ID NO: 155194 - protein, 13 aa, Mycobacterium tuberculosis
LWERCAIDLTGNT

SEQ ID NO: 155195 - protein, 13 aa, Mycobacterium tuberculosis
WERCAIDLTGNTE

SEQ ID NO: 155196 - protein, 13 aa, Mycobacterium tuberculosis
ERCAIDLTGNTEE

SEQ ID NO: 155197 - protein, 13 aa, Mycobacterium tuberculosis
RCAIDLTGNTEEL

SEQ ID NO: 155198 - protein, 13 aa, Mycobacterium tuberculosis
CAIDLTGNTEELR

SEQ ID NO: 155199 - protein, 13 aa, Mycobacterium tuberculosis
AIDLTGNTEELRL

SEQ ID NO: 155200 - protein, 13 aa, Mycobacterium tuberculosis
IDLTGNTEELRLV

SEQ ID NO: 155201 - protein, 13 aa, Mycobacterium tuberculosis
DLTGNTEELRLVR

SEQ ID NO: 155202 - protein, 13 aa, Mycobacterium tuberculosis
LTGNTEELRLVRL

SEQ ID NO: 155203 - protein, 13 aa, Mycobacterium tuberculosis
TGNTEELRLVRLH

SEQ ID NO: 155204 - protein, 13 aa, Mycobacterium tuberculosis
GNTEELRLVRLHL

SEQ ID NO: 155205 - protein, 13 aa, Mycobacterium tuberculosis
NTEELRLVRLHLL

SEQ ID NO: 155206 - protein, 13 aa, Mycobacterium tuberculosis
TEELRLVRLHLLH

SEQ ID NO: 155207 - protein, 13 aa, Mycobacterium tuberculosis
EELRLVRLHLLHL

SEQ ID NO: 155208 - protein, 13 aa, Mycobacterium tuberculosis
ELRLVRLHLLHLL

SEQ ID NO: 155209 - protein, 13 aa, Mycobacterium tuberculosis
LRLVRLHLLHLLQ

SEQ ID NO: 155210 - protein, 13 aa, Mycobacterium tuberculosis
RLVRLHLLHLLQT

SEQ ID NO: 155211 - protein, 13 aa, Mycobacterium tuberculosis
LVRLHLLHLLQTI

SEQ ID NO: 155212 - protein, 13 aa, Mycobacterium tuberculosis
VRLHLLHLLQTIS

SEQ ID NO: 155213 - protein, 13 aa, Mycobacterium tuberculosis
RLHLLHLLQTISP

SEQ ID NO: 155214 - protein, 13 aa, Mycobacterium tuberculosis
LHLLHLLQTISPH

SEQ ID NO: 155215 - protein, 13 aa, Mycobacterium tuberculosis
HLLHLLQTISPHT

SEQ ID NO: 155216 - protein, 13 aa, Mycobacterium tuberculosis
LLHLLQTISPHTA

SEQ ID NO: 155217 - protein, 13 aa, Mycobacterium tuberculosis
LHLLQTISPHTAE

SEQ ID NO: 155218 - protein, 13 aa, Mycobacterium tuberculosis
HLLQTISPHTAEL

SEQ ID NO: 155219 - protein, 13 aa, Mycobacterium tuberculosis
LLQTISPHTAELD

SEQ ID NO: 155220 - protein, 13 aa, Mycobacterium tuberculosis
LQTISPHTAELDA

SEQ ID NO: 155221 - protein, 13 aa, Mycobacterium tuberculosis
QTISPHTAELDAG

SEQ ID NO: 155222 - protein, 13 aa, Mycobacterium tuberculosis
TISPHTAELDAGV

SEQ ID NO: 155223 - protein, 13 aa, Mycobacterium tuberculosis
ISPHTAELDAGVP

SEQ ID NO: 155224 - protein, 13 aa, Mycobacterium tuberculosis
SPHTAELDAGVPA

SEQ ID NO: 155225 - protein, 13 aa, Mycobacterium tuberculosis
PHTAELDAGVPAR

SEQ ID NO: 155226 - protein, 13 aa, Mycobacterium tuberculosis
HTAELDAGVPARG

SEQ ID NO: 155227 - protein, 13 aa, Mycobacterium tuberculosis
TAELDAGVPARGL

SEQ ID NO: 155228 - protein, 13 aa, Mycobacterium tuberculosis
AELDAGVPARGLN

SEQ ID NO: 155229 - protein, 13 aa, Mycobacterium tuberculosis
ELDAGVPARGLNG

SEQ ID NO: 155230 - protein, 13 aa, Mycobacterium tuberculosis
LDAGVPARGLNGE

SEQ ID NO: 155231 - protein, 13 aa, Mycobacterium tuberculosis
DAGVPARGLNGEA

SEQ ID NO: 155232 - protein, 13 aa, Mycobacterium tuberculosis
AGVPARGLNGEAY

SEQ ID NO: 155233 - protein, 13 aa, Mycobacterium tuberculosis
GVPARGLNGEAYR

SEQ ID NO: 155234 - protein, 13 aa, Mycobacterium tuberculosis
VPARGLNGEAYRG

SEQ ID NO: 155235 - protein, 13 aa, Mycobacterium tuberculosis
PARGLNGEAYRGH

SEQ ID NO: 155236 - protein, 13 aa, Mycobacterium tuberculosis
ARGLNGEAYRGHV

SEQ ID NO: 155237 - protein, 13 aa, Mycobacterium tuberculosis
RGLNGEAYRGHVF

SEQ ID NO: 155238 - protein, 13 aa, Mycobacterium tuberculosis
GLNGEAYRGHVFW

SEQ ID NO: 155239 - protein, 13 aa, Mycobacterium tuberculosis
LNGEAYRGHVFWD

SEQ ID NO: 155240 - protein, 13 aa, Mycobacterium tuberculosis
NGEAYRGHVFWDA

SEQ ID NO: 155241 - protein, 13 aa, Mycobacterium tuberculosis
GEAYRGHVFWDAL

SEQ ID NO: 155242 - protein, 13 aa, Mycobacterium tuberculosis
EAYRGHVFWDALF

SEQ ID NO: 155243 - protein, 13 aa, Mycobacterium tuberculosis
AYRGHVFWDALFV

SEQ ID NO: 155244 - protein, 13 aa, Mycobacterium tuberculosis
YRGHVFWDALFVA

SEQ ID NO: 155245 - protein, 13 aa, Mycobacterium tuberculosis
RGHVFWDALFVAP

SEQ ID NO: 155246 - protein, 13 aa, Mycobacterium tuberculosis
GHVFWDALFVAPV

SEQ ID NO: 155247 - protein, 13 aa, Mycobacterium tuberculosis
HVFWDALFVAPVL

SEQ ID NO: 155248 - protein, 13 aa, Mycobacterium tuberculosis
VFWDALFVAPVLS

SEQ ID NO: 155249 - protein, 13 aa, Mycobacterium tuberculosis
FWDALFVAPVLSL

SEQ ID NO: 155250 - protein, 13 aa, Mycobacterium tuberculosis
WDALFVAPVLSLR

SEQ ID NO: 155251 - protein, 13 aa, Mycobacterium tuberculosis
DALFVAPVLSLRM

SEQ ID NO: 155252 - protein, 13 aa, Mycobacterium tuberculosis
ALFVAPVLSLRMP

SEQ ID NO: 155253 - protein, 13 aa, Mycobacterium tuberculosis
LFVAPVLSLRMPK

SEQ ID NO: 155254 - protein, 13 aa, Mycobacterium tuberculosis
FVAPVLSLRMPKV

SEQ ID NO: 155255 - protein, 13 aa, Mycobacterium tuberculosis
VAPVLSLRMPKVA

SEQ ID NO: 155256 - protein, 13 aa, Mycobacterium tuberculosis
APVLSLRMPKVAR

SEQ ID NO: 155257 - protein, 13 aa, Mycobacterium tuberculosis
PVLSLRMPKVARS

SEQ ID NO: 155258 - protein, 13 aa, Mycobacterium tuberculosis
VLSLRMPKVARSL

SEQ ID NO: 155259 - protein, 13 aa, Mycobacterium tuberculosis
LSLRMPKVARSLL

SEQ ID NO: 155260 - protein, 13 aa, Mycobacterium tuberculosis
SLRMPKVARSLLD

SEQ ID NO: 155261 - protein, 13 aa, Mycobacterium tuberculosis
LRMPKVARSLLDY

SEQ ID NO: 155262 - protein, 13 aa, Mycobacterium tuberculosis
RMPKVARSLLDYR

SEQ ID NO: 155263 - protein, 13 aa, Mycobacterium tuberculosis
MPKVARSLLDYRY

SEQ ID NO: 155264 - protein, 13 aa, Mycobacterium tuberculosis
PKVARSLLDYRYR

SEQ ID NO: 155265 - protein, 13 aa, Mycobacterium tuberculosis
KVARSLLDYRYRR

SEQ ID NO: 155266 - protein, 13 aa, Mycobacterium tuberculosis
VARSLLDYRYRRL

SEQ ID NO: 155267 - protein, 13 aa, Mycobacterium tuberculosis
ARSLLDYRYRRLP

SEQ ID NO: 155268 - protein, 13 aa, Mycobacterium tuberculosis
RSLLDYRYRRLPA

SEQ ID NO: 155269 - protein, 13 aa, Mycobacterium tuberculosis
SLLDYRYRRLPAA

SEQ ID NO: 155270 - protein, 13 aa, Mycobacterium tuberculosis
LLDYRYRRLPAAR

SEQ ID NO: 155271 - protein, 13 aa, Mycobacterium tuberculosis
LDYRYRRLPAARR

SEQ ID NO: 155272 - protein, 13 aa, Mycobacterium tuberculosis
DYRYRRLPAARRA

SEQ ID NO: 155273 - protein, 13 aa, Mycobacterium tuberculosis
YRYRRLPAARRAA

SEQ ID NO: 155274 - protein, 13 aa, Mycobacterium tuberculosis
RYRRLPAARRAAH

SEQ ID NO: 155275 - protein, 13 aa, Mycobacterium tuberculosis
YRRLPAARRAAHR

SEQ ID NO: 155276 - protein, 13 aa, Mycobacterium tuberculosis
RRLPAARRAAHRA

SEQ ID NO: 155277 - protein, 13 aa, Mycobacterium tuberculosis
RLPAARRAAHRAG

SEQ ID NO: 155278 - protein, 13 aa, Mycobacterium tuberculosis
LPAARRAAHRAGH

SEQ ID NO: 155279 - protein, 13 aa, Mycobacterium tuberculosis
PAARRAAHRAGHL

SEQ ID NO: 155280 - protein, 13 aa, Mycobacterium tuberculosis
AARRAAHRAGHLG

SEQ ID NO: 155281 - protein, 13 aa, Mycobacterium tuberculosis
ARRAAHRAGHLGA

SEQ ID NO: 155282 - protein, 13 aa, Mycobacterium tuberculosis
RRAAHRAGHLGAM

SEQ ID NO: 155283 - protein, 13 aa, Mycobacterium tuberculosis
RAAHRAGHLGAMY

SEQ ID NO: 155284 - protein, 13 aa, Mycobacterium tuberculosis
AAHRAGHLGAMYP

SEQ ID NO: 155285 - protein, 13 aa, Mycobacterium tuberculosis
AHRAGHLGAMYPW

SEQ ID NO: 155286 - protein, 13 aa, Mycobacterium tuberculosis
HRAGHLGAMYPWQ

SEQ ID NO: 155287 - protein, 13 aa, Mycobacterium tuberculosis
RAGHLGAMYPWQS

SEQ ID NO: 155288 - protein, 13 aa, Mycobacterium tuberculosis
AGHLGAMYPWQSG

SEQ ID NO: 155289 - protein, 13 aa, Mycobacterium tuberculosis
GHLGAMYPWQSGS

SEQ ID NO: 155290 - protein, 13 aa, Mycobacterium tuberculosis
HLGAMYPWQSGSD

SEQ ID NO: 155291 - protein, 13 aa, Mycobacterium tuberculosis
LGAMYPWQSGSDG

SEQ ID NO: 155292 - protein, 13 aa, Mycobacterium tuberculosis
GAMYPWQSGSDGS

SEQ ID NO: 155293 - protein, 13 aa, Mycobacterium tuberculosis
AMYPWQSGSDGSE

SEQ ID NO: 155294 - protein, 13 aa, Mycobacterium tuberculosis
MYPWQSGSDGSEV

SEQ ID NO: 155295 - protein, 13 aa, Mycobacterium tuberculosis
YPWQSGSDGSEVS

SEQ ID NO: 155296 - protein, 13 aa, Mycobacterium tuberculosis
PWQSGSDGSEVSQ

SEQ ID NO: 155297 - protein, 13 aa, Mycobacterium tuberculosis
WQSGSDGSEVSQQ

SEQ ID NO: 155298 - protein, 13 aa, Mycobacterium tuberculosis
QSGSDGSEVSQQL

SEQ ID NO: 155299 - protein, 13 aa, Mycobacterium tuberculosis
SGSDGSEVSQQLH

SEQ ID NO: 155300 - protein, 13 aa, Mycobacterium tuberculosis
GSDGSEVSQQLHL

SEQ ID NO: 155301 - protein, 13 aa, Mycobacterium tuberculosis
SDGSEVSQQLHLN

SEQ ID NO: 155302 - protein, 13 aa, Mycobacterium tuberculosis
DGSEVSQQLHLNP

SEQ ID NO: 155303 - protein, 13 aa, Mycobacterium tuberculosis
GSEVSQQLHLNPR

SEQ ID NO: 155304 - protein, 13 aa, Mycobacterium tuberculosis
SEVSQQLHLNPRS

SEQ ID NO: 155305 - protein, 13 aa, Mycobacterium tuberculosis
EVSQQLHLNPRSG

SEQ ID NO: 155306 - protein, 13 aa, Mycobacterium tuberculosis
VSQQLHLNPRSGR

SEQ ID NO: 155307 - protein, 13 aa, Mycobacterium tuberculosis
SQQLHLNPRSGRW

SEQ ID NO: 155308 - protein, 13 aa, Mycobacterium tuberculosis
QQLHLNPRSGRWT

SEQ ID NO: 155309 - protein, 13 aa, Mycobacterium tuberculosis
QLHLNPRSGRWTP

SEQ ID NO: 155310 - protein, 13 aa, Mycobacterium tuberculosis
LHLNPRSGRWTPD

SEQ ID NO: 155311 - protein, 13 aa, Mycobacterium tuberculosis
HLNPRSGRWTPDP

SEQ ID NO: 155312 - protein, 13 aa, Mycobacterium tuberculosis
LNPRSGRWTPDPS

SEQ ID NO: 155313 - protein, 13 aa, Mycobacterium tuberculosis
NPRSGRWTPDPSD

SEQ ID NO: 155314 - protein, 13 aa, Mycobacterium tuberculosis
PRSGRWTPDPSDR

SEQ ID NO: 155315 - protein, 13 aa, Mycobacterium tuberculosis
RSGRWTPDPSDRA

SEQ ID NO: 155316 - protein, 13 aa, Mycobacterium tuberculosis
SGRWTPDPSDRAH

SEQ ID NO: 155317 - protein, 13 aa, Mycobacterium tuberculosis
GRWTPDPSDRAHH

SEQ ID NO: 155318 - protein, 13 aa, Mycobacterium tuberculosis
RWTPDPSDRAHHV

SEQ ID NO: 155319 - protein, 13 aa, Mycobacterium tuberculosis
WTPDPSDRAHHVG

SEQ ID NO: 155320 - protein, 13 aa, Mycobacterium tuberculosis
TPDPSDRAHHVGL

SEQ ID NO: 155321 - protein, 13 aa, Mycobacterium tuberculosis
PDPSDRAHHVGLA

SEQ ID NO: 155322 - protein, 13 aa, Mycobacterium tuberculosis
DPSDRAHHVGLAV

SEQ ID NO: 155323 - protein, 13 aa, Mycobacterium tuberculosis
PSDRAHHVGLAVA

SEQ ID NO: 155324 - protein, 13 aa, Mycobacterium tuberculosis
SDRAHHVGLAVAY

SEQ ID NO: 155325 - protein, 13 aa, Mycobacterium tuberculosis
DRAHHVGLAVAYN

SEQ ID NO: 155326 - protein, 13 aa, Mycobacterium tuberculosis
RAHHVGLAVAYNA

SEQ ID NO: 155327 - protein, 13 aa, Mycobacterium tuberculosis
AHHVGLAVAYNAW

SEQ ID NO: 155328 - protein, 13 aa, Mycobacterium tuberculosis
HHVGLAVAYNAWH

SEQ ID NO: 155329 - protein, 13 aa, Mycobacterium tuberculosis
HVGLAVAYNAWHY

SEQ ID NO: 155330 - protein, 13 aa, Mycobacterium tuberculosis
VGLAVAYNAWHYY

SEQ ID NO: 155331 - protein, 13 aa, Mycobacterium tuberculosis
GLAVAYNAWHYYQ

SEQ ID NO: 155332 - protein, 13 aa, Mycobacterium tuberculosis
LAVAYNAWHYYQV

SEQ ID NO: 155333 - protein, 13 aa, Mycobacterium tuberculosis
AVAYNAWHYYQVT

SEQ ID NO: 155334 - protein, 13 aa, Mycobacterium tuberculosis
VAYNAWHYYQVTG

SEQ ID NO: 155335 - protein, 13 aa, Mycobacterium tuberculosis
AYNAWHYYQVTGD

SEQ ID NO: 155336 - protein, 13 aa, Mycobacterium tuberculosis
YNAWHYYQVTGDR

SEQ ID NO: 155337 - protein, 13 aa, Mycobacterium tuberculosis
NAWHYYQVTGDRQ

SEQ ID NO: 155338 - protein, 13 aa, Mycobacterium tuberculosis
AWHYYQVTGDRQY

SEQ ID NO: 155339 - protein, 13 aa, Mycobacterium tuberculosis
WHYYQVTGDRQYL

SEQ ID NO: 155340 - protein, 13 aa, Mycobacterium tuberculosis
HYYQVTGDRQYLV

SEQ ID NO: 155341 - protein, 13 aa, Mycobacterium tuberculosis
YYQVTGDRQYLVD

SEQ ID NO: 155342 - protein, 13 aa, Mycobacterium tuberculosis
YQVTGDRQYLVDC

SEQ ID NO: 155343 - protein, 13 aa, Mycobacterium tuberculosis
QVTGDRQYLVDCG

SEQ ID NO: 155344 - protein, 13 aa, Mycobacterium tuberculosis
VTGDRQYLVDCGA

SEQ ID NO: 155345 - protein, 13 aa, Mycobacterium tuberculosis
TGDRQYLVDCGAE

SEQ ID NO: 155346 - protein, 13 aa, Mycobacterium tuberculosis
GDRQYLVDCGAEL

SEQ ID NO: 155347 - protein, 13 aa, Mycobacterium tuberculosis
DRQYLVDCGAELL

SEQ ID NO: 155348 - protein, 13 aa, Mycobacterium tuberculosis
RQYLVDCGAELLV

SEQ ID NO: 155349 - protein, 13 aa, Mycobacterium tuberculosis
QYLVDCGAELLVE

SEQ ID NO: 155350 - protein, 13 aa, Mycobacterium tuberculosis
YLVDCGAELLVEI

SEQ ID NO: 155351 - protein, 13 aa, Mycobacterium tuberculosis
LVDCGAELLVEIA

SEQ ID NO: 155352 - protein, 13 aa, Mycobacterium tuberculosis
VDCGAELLVEIAR

SEQ ID NO: 155353 - protein, 13 aa, Mycobacterium tuberculosis
DCGAELLVEIARF

SEQ ID NO: 155354 - protein, 13 aa, Mycobacterium tuberculosis
CGAELLVEIARFW

SEQ ID NO: 155355 - protein, 13 aa, Mycobacterium tuberculosis
GAELLVEIARFWV

SEQ ID NO: 155356 - protein, 13 aa, Mycobacterium tuberculosis
AELLVEIARFWVG

SEQ ID NO: 155357 - protein, 13 aa, Mycobacterium tuberculosis
ELLVEIARFWVGL

SEQ ID NO: 155358 - protein, 13 aa, Mycobacterium tuberculosis
LLVEIARFWVGLA

SEQ ID NO: 155359 - protein, 13 aa, Mycobacterium tuberculosis
LVEIARFWVGLAK

SEQ ID NO: 155360 - protein, 13 aa, Mycobacterium tuberculosis
VEIARFWVGLAKL

SEQ ID NO: 155361 - protein, 13 aa, Mycobacterium tuberculosis
EIARFWVGLAKLD

SEQ ID NO: 155362 - protein, 13 aa, Mycobacterium tuberculosis
IARFWVGLAKLDD

SEQ ID NO: 155363 - protein, 13 aa, Mycobacterium tuberculosis
ARFWVGLAKLDDS

SEQ ID NO: 155364 - protein, 13 aa, Mycobacterium tuberculosis
RFWVGLAKLDDSR

SEQ ID NO: 155365 - protein, 13 aa, Mycobacterium tuberculosis
FWVGLAKLDDSRG

SEQ ID NO: 155366 - protein, 13 aa, Mycobacterium tuberculosis
WVGLAKLDDSRGR

SEQ ID NO: 155367 - protein, 13 aa, Mycobacterium tuberculosis
VGLAKLDDSRGRY

SEQ ID NO: 155368 - protein, 13 aa, Mycobacterium tuberculosis
GLAKLDDSRGRYL

SEQ ID NO: 155369 - protein, 13 aa, Mycobacterium tuberculosis
LAKLDDSRGRYLI

SEQ ID NO: 155370 - protein, 13 aa, Mycobacterium tuberculosis
AKLDDSRGRYLIR

SEQ ID NO: 155371 - protein, 13 aa, Mycobacterium tuberculosis
KLDDSRGRYLIRG

SEQ ID NO: 155372 - protein, 13 aa, Mycobacterium tuberculosis
LDDSRGRYLIRGV

SEQ ID NO: 155373 - protein, 13 aa, Mycobacterium tuberculosis
DDSRGRYLIRGVI

SEQ ID NO: 155374 - protein, 13 aa, Mycobacterium tuberculosis
DSRGRYLIRGVIG

SEQ ID NO: 155375 - protein, 13 aa, Mycobacterium tuberculosis
SRGRYLIRGVIGP

SEQ ID NO: 155376 - protein, 13 aa, Mycobacterium tuberculosis
RGRYLIRGVIGPD

SEQ ID NO: 155377 - protein, 13 aa, Mycobacterium tuberculosis
GRYLIRGVIGPDE

SEQ ID NO: 155378 - protein, 13 aa, Mycobacterium tuberculosis
RYLIRGVIGPDEF

SEQ ID NO: 155379 - protein, 13 aa, Mycobacterium tuberculosis
YLIRGVIGPDEFH

SEQ ID NO: 155380 - protein, 13 aa, Mycobacterium tuberculosis
LIRGVIGPDEFHS

SEQ ID NO: 155381 - protein, 13 aa, Mycobacterium tuberculosis
IRGVIGPDEFHSG

SEQ ID NO: 155382 - protein, 13 aa, Mycobacterium tuberculosis
RGVIGPDEFHSGY

SEQ ID NO: 155383 - protein, 13 aa, Mycobacterium tuberculosis
GVIGPDEFHSGYP

SEQ ID NO: 155384 - protein, 13 aa, Mycobacterium tuberculosis
VIGPDEFHSGYPG

SEQ ID NO: 155385 - protein, 13 aa, Mycobacterium tuberculosis
IGPDEFHSGYPGN

SEQ ID NO: 155386 - protein, 13 aa, Mycobacterium tuberculosis
GPDEFHSGYPGNE

SEQ ID NO: 155387 - protein, 13 aa, Mycobacterium tuberculosis
PDEFHSGYPGNEY

SEQ ID NO: 155388 - protein, 13 aa, Mycobacterium tuberculosis
DEFHSGYPGNEYD

SEQ ID NO: 155389 - protein, 13 aa, Mycobacterium tuberculosis
EFHSGYPGNEYDG

SEQ ID NO: 155390 - protein, 13 aa, Mycobacterium tuberculosis
FHSGYPGNEYDGI

SEQ ID NO: 155391 - protein, 13 aa, Mycobacterium tuberculosis
HSGYPGNEYDGID

SEQ ID NO: 155392 - protein, 13 aa, Mycobacterium tuberculosis
SGYPGNEYDGIDN

SEQ ID NO: 155393 - protein, 13 aa, Mycobacterium tuberculosis
GYPGNEYDGIDNN

SEQ ID NO: 155394 - protein, 13 aa, Mycobacterium tuberculosis
YPGNEYDGIDNNA

SEQ ID NO: 155395 - protein, 13 aa, Mycobacterium tuberculosis
PGNEYDGIDNNAY

SEQ ID NO: 155396 - protein, 13 aa, Mycobacterium tuberculosis
GNEYDGIDNNAYT

SEQ ID NO: 155397 - protein, 13 aa, Mycobacterium tuberculosis
NEYDGIDNNAYTN

SEQ ID NO: 155398 - protein, 13 aa, Mycobacterium tuberculosis
EYDGIDNNAYTNV

SEQ ID NO: 155399 - protein, 13 aa, Mycobacterium tuberculosis
YDGIDNNAYTNVM

SEQ ID NO: 155400 - protein, 13 aa, Mycobacterium tuberculosis
DGIDNNAYTNVMA

SEQ ID NO: 155401 - protein, 13 aa, Mycobacterium tuberculosis
GIDNNAYTNVMAV

SEQ ID NO: 155402 - protein, 13 aa, Mycobacterium tuberculosis
IDNNAYTNVMAVW

SEQ ID NO: 155403 - protein, 13 aa, Mycobacterium tuberculosis
DNNAYTNVMAVWV

SEQ ID NO: 155404 - protein, 13 aa, Mycobacterium tuberculosis
NNAYTNVMAVWVI

SEQ ID NO: 155405 - protein, 13 aa, Mycobacterium tuberculosis
NAYTNVMAVWVIL

SEQ ID NO: 155406 - protein, 13 aa, Mycobacterium tuberculosis
AYTNVMAVWVILR

SEQ ID NO: 155407 - protein, 13 aa, Mycobacterium tuberculosis
YTNVMAVWVILRA

SEQ ID NO: 155408 - protein, 13 aa, Mycobacterium tuberculosis
TNVMAVWVILRAM

SEQ ID NO: 155409 - protein, 13 aa, Mycobacterium tuberculosis
NVMAVWVILRAME

SEQ ID NO: 155410 - protein, 13 aa, Mycobacterium tuberculosis
VMAVWVILRAMEA

SEQ ID NO: 155411 - protein, 13 aa, Mycobacterium tuberculosis
MAVWVILRAMEAL

SEQ ID NO: 155412 - protein, 13 aa, Mycobacterium tuberculosis
AVWVILRAMEALD

SEQ ID NO: 155413 - protein, 13 aa, Mycobacterium tuberculosis
VWVILRAMEALDL

SEQ ID NO: 155414 - protein, 13 aa, Mycobacterium tuberculosis
WVILRAMEALDLL

SEQ ID NO: 155415 - protein, 13 aa, Mycobacterium tuberculosis
VILRAMEALDLLP

SEQ ID NO: 155416 - protein, 13 aa, Mycobacterium tuberculosis
ILRAMEALDLLPL

SEQ ID NO: 155417 - protein, 13 aa, Mycobacterium tuberculosis
LRAMEALDLLPLT

SEQ ID NO: 155418 - protein, 13 aa, Mycobacterium tuberculosis
RAMEALDLLPLTD

SEQ ID NO: 155419 - protein, 13 aa, Mycobacterium tuberculosis
AMEALDLLPLTDR

SEQ ID NO: 155420 - protein, 13 aa, Mycobacterium tuberculosis
MEALDLLPLTDRR

SEQ ID NO: 155421 - protein, 13 aa, Mycobacterium tuberculosis
EALDLLPLTDRRH

SEQ ID NO: 155422 - protein, 13 aa, Mycobacterium tuberculosis
ALDLLPLTDRRHL

SEQ ID NO: 155423 - protein, 13 aa, Mycobacterium tuberculosis
LDLLPLTDRRHLI

SEQ ID NO: 155424 - protein, 13 aa, Mycobacterium tuberculosis
DLLPLTDRRHLIE

SEQ ID NO: 155425 - protein, 13 aa, Mycobacterium tuberculosis
LLPLTDRRHLIEK

SEQ ID NO: 155426 - protein, 13 aa, Mycobacterium tuberculosis
LPLTDRRHLIEKL

SEQ ID NO: 155427 - protein, 13 aa, Mycobacterium tuberculosis
PLTDRRHLIEKLG

SEQ ID NO: 155428 - protein, 13 aa, Mycobacterium tuberculosis
LTDRRHLIEKLGL

SEQ ID NO: 155429 - protein, 13 aa, Mycobacterium tuberculosis
TDRRHLIEKLGLT

SEQ ID NO: 155430 - protein, 13 aa, Mycobacterium tuberculosis
DRRHLIEKLGLTT

SEQ ID NO: 155431 - protein, 13 aa, Mycobacterium tuberculosis
RRHLIEKLGLTTQ

SEQ ID NO: 155432 - protein, 13 aa, Mycobacterium tuberculosis
RHLIEKLGLTTQE

SEQ ID NO: 155433 - protein, 13 aa, Mycobacterium tuberculosis
HLIEKLGLTTQER

SEQ ID NO: 155434 - protein, 13 aa, Mycobacterium tuberculosis
LIEKLGLTTQERD

SEQ ID NO: 155435 - protein, 13 aa, Mycobacterium tuberculosis
IEKLGLTTQERDQ

SEQ ID NO: 155436 - protein, 13 aa, Mycobacterium tuberculosis
EKLGLTTQERDQW

SEQ ID NO: 155437 - protein, 13 aa, Mycobacterium tuberculosis
KLGLTTQERDQWD

SEQ ID NO: 155438 - protein, 13 aa, Mycobacterium tuberculosis
LGLTTQERDQWDD

SEQ ID NO: 155439 - protein, 13 aa, Mycobacterium tuberculosis
GLTTQERDQWDDV

SEQ ID NO: 155440 - protein, 13 aa, Mycobacterium tuberculosis
LTTQERDQWDDVS

SEQ ID NO: 155441 - protein, 13 aa, Mycobacterium tuberculosis
TTQERDQWDDVSR

SEQ ID NO: 155442 - protein, 13 aa, Mycobacterium tuberculosis
TQERDQWDDVSRR

SEQ ID NO: 155443 - protein, 13 aa, Mycobacterium tuberculosis
QERDQWDDVSRRM

SEQ ID NO: 155444 - protein, 13 aa, Mycobacterium tuberculosis
ERDQWDDVSRRMF

SEQ ID NO: 155445 - protein, 13 aa, Mycobacterium tuberculosis
RDQWDDVSRRMFV

SEQ ID NO: 155446 - protein, 13 aa, Mycobacterium tuberculosis
DQWDDVSRRMFVP

SEQ ID NO: 155447 - protein, 13 aa, Mycobacterium tuberculosis
QWDDVSRRMFVPF

SEQ ID NO: 155448 - protein, 13 aa, Mycobacterium tuberculosis
WDDVSRRMFVPFH

SEQ ID NO: 155449 - protein, 13 aa, Mycobacterium tuberculosis
DDVSRRMFVPFHD

SEQ ID NO: 155450 - protein, 13 aa, Mycobacterium tuberculosis
DVSRRMFVPFHDG

SEQ ID NO: 155451 - protein, 13 aa, Mycobacterium tuberculosis
VSRRMFVPFHDGV

SEQ ID NO: 155452 - protein, 13 aa, Mycobacterium tuberculosis
SRRMFVPFHDGVI

SEQ ID NO: 155453 - protein, 13 aa, Mycobacterium tuberculosis
RRMFVPFHDGVIS

SEQ ID NO: 155454 - protein, 13 aa, Mycobacterium tuberculosis
RMFVPFHDGVISQ

SEQ ID NO: 155455 - protein, 13 aa, Mycobacterium tuberculosis
MFVPFHDGVISQF

SEQ ID NO: 155456 - protein, 13 aa, Mycobacterium tuberculosis
FVPFHDGVISQFE

SEQ ID NO: 155457 - protein, 13 aa, Mycobacterium tuberculosis
VPFHDGVISQFEG

SEQ ID NO: 155458 - protein, 13 aa, Mycobacterium tuberculosis
PFHDGVISQFEGY

SEQ ID NO: 155459 - protein, 13 aa, Mycobacterium tuberculosis
FHDGVISQFEGYS

SEQ ID NO: 155460 - protein, 13 aa, Mycobacterium tuberculosis
HDGVISQFEGYSE

SEQ ID NO: 155461 - protein, 13 aa, Mycobacterium tuberculosis
DGVISQFEGYSEL

SEQ ID NO: 155462 - protein, 13 aa, Mycobacterium tuberculosis
GVISQFEGYSELA

SEQ ID NO: 155463 - protein, 13 aa, Mycobacterium tuberculosis
VISQFEGYSELAE

SEQ ID NO: 155464 - protein, 13 aa, Mycobacterium tuberculosis
ISQFEGYSELAEL

SEQ ID NO: 155465 - protein, 13 aa, Mycobacterium tuberculosis
SQFEGYSELAELD

SEQ ID NO: 155466 - protein, 13 aa, Mycobacterium tuberculosis
QFEGYSELAELDW

SEQ ID NO: 155467 - protein, 13 aa, Mycobacterium tuberculosis
FEGYSELAELDWD

SEQ ID NO: 155468 - protein, 13 aa, Mycobacterium tuberculosis
EGYSELAELDWDH

SEQ ID NO: 155469 - protein, 13 aa, Mycobacterium tuberculosis
GYSELAELDWDHY

SEQ ID NO: 155470 - protein, 13 aa, Mycobacterium tuberculosis
YSELAELDWDHYR

SEQ ID NO: 155471 - protein, 13 aa, Mycobacterium tuberculosis
SELAELDWDHYRH

SEQ ID NO: 155472 - protein, 13 aa, Mycobacterium tuberculosis
ELAELDWDHYRHR

SEQ ID NO: 155473 - protein, 13 aa, Mycobacterium tuberculosis
LAELDWDHYRHRY

SEQ ID NO: 155474 - protein, 13 aa, Mycobacterium tuberculosis
AELDWDHYRHRYG

SEQ ID NO: 155475 - protein, 13 aa, Mycobacterium tuberculosis
ELDWDHYRHRYGN

SEQ ID NO: 155476 - protein, 13 aa, Mycobacterium tuberculosis
LDWDHYRHRYGNI

SEQ ID NO: 155477 - protein, 13 aa, Mycobacterium tuberculosis
DWDHYRHRYGNIQ

SEQ ID NO: 155478 - protein, 13 aa, Mycobacterium tuberculosis
WDHYRHRYGNIQR

SEQ ID NO: 155479 - protein, 13 aa, Mycobacterium tuberculosis
DHYRHRYGNIQRL

SEQ ID NO: 155480 - protein, 13 aa, Mycobacterium tuberculosis
HYRHRYGNIQRLD

SEQ ID NO: 155481 - protein, 13 aa, Mycobacterium tuberculosis
YRHRYGNIQRLDR

SEQ ID NO: 155482 - protein, 13 aa, Mycobacterium tuberculosis
RHRYGNIQRLDRI

SEQ ID NO: 155483 - protein, 13 aa, Mycobacterium tuberculosis
HRYGNIQRLDRIL

SEQ ID NO: 155484 - protein, 13 aa, Mycobacterium tuberculosis
RYGNIQRLDRILE

SEQ ID NO: 155485 - protein, 13 aa, Mycobacterium tuberculosis
YGNIQRLDRILEA

SEQ ID NO: 155486 - protein, 13 aa, Mycobacterium tuberculosis
GNIQRLDRILEAE

SEQ ID NO: 155487 - protein, 13 aa, Mycobacterium tuberculosis
NIQRLDRILEAEG

SEQ ID NO: 155488 - protein, 13 aa, Mycobacterium tuberculosis
IQRLDRILEAEGD

SEQ ID NO: 155489 - protein, 13 aa, Mycobacterium tuberculosis
QRLDRILEAEGDS

SEQ ID NO: 155490 - protein, 13 aa, Mycobacterium tuberculosis
RLDRILEAEGDSV

SEQ ID NO: 155491 - protein, 13 aa, Mycobacterium tuberculosis
LDRILEAEGDSVN

SEQ ID NO: 155492 - protein, 13 aa, Mycobacterium tuberculosis
DRILEAEGDSVNN

SEQ ID NO: 155493 - protein, 13 aa, Mycobacterium tuberculosis
RILEAEGDSVNNY

SEQ ID NO: 155494 - protein, 13 aa, Mycobacterium tuberculosis
ILEAEGDSVNNYQ

SEQ ID NO: 155495 - protein, 13 aa, Mycobacterium tuberculosis
LEAEGDSVNNYQA

SEQ ID NO: 155496 - protein, 13 aa, Mycobacterium tuberculosis
EAEGDSVNNYQAS

SEQ ID NO: 155497 - protein, 13 aa, Mycobacterium tuberculosis
AEGDSVNNYQASK

SEQ ID NO: 155498 - protein, 13 aa, Mycobacterium tuberculosis
EGDSVNNYQASKQ

SEQ ID NO: 155499 - protein, 13 aa, Mycobacterium tuberculosis
GDSVNNYQASKQA

SEQ ID NO: 155500 - protein, 13 aa, Mycobacterium tuberculosis
DSVNNYQASKQAD

SEQ ID NO: 155501 - protein, 13 aa, Mycobacterium tuberculosis
SVNNYQASKQADA

SEQ ID NO: 155502 - protein, 13 aa, Mycobacterium tuberculosis
VNNYQASKQADAL

SEQ ID NO: 155503 - protein, 13 aa, Mycobacterium tuberculosis
NNYQASKQADALM

SEQ ID NO: 155504 - protein, 13 aa, Mycobacterium tuberculosis
NYQASKQADALML

SEQ ID NO: 155505 - protein, 13 aa, Mycobacterium tuberculosis
YQASKQADALMLL

SEQ ID NO: 155506 - protein, 13 aa, Mycobacterium tuberculosis
QASKQADALMLLY

SEQ ID NO: 155507 - protein, 13 aa, Mycobacterium tuberculosis
ASKQADALMLLYL

SEQ ID NO: 155508 - protein, 13 aa, Mycobacterium tuberculosis
SKQADALMLLYLL

SEQ ID NO: 155509 - protein, 13 aa, Mycobacterium tuberculosis
KQADALMLLYLLS

SEQ ID NO: 155510 - protein, 13 aa, Mycobacterium tuberculosis
QADALMLLYLLSS

SEQ ID NO: 155511 - protein, 13 aa, Mycobacterium tuberculosis
ADALMLLYLLSSD

SEQ ID NO: 155512 - protein, 13 aa, Mycobacterium tuberculosis
DALMLLYLLSSDE

SEQ ID NO: 155513 - protein, 13 aa, Mycobacterium tuberculosis
ALMLLYLLSSDEL

SEQ ID NO: 155514 - protein, 13 aa, Mycobacterium tuberculosis
LMLLYLLSSDELI

SEQ ID NO: 155515 - protein, 13 aa, Mycobacterium tuberculosis
MLLYLLSSDELIG

SEQ ID NO: 155516 - protein, 13 aa, Mycobacterium tuberculosis
LLYLLSSDELIGL

SEQ ID NO: 155517 - protein, 13 aa, Mycobacterium tuberculosis
LYLLSSDELIGLL

SEQ ID NO: 155518 - protein, 13 aa, Mycobacterium tuberculosis
YLLSSDELIGLLA

SEQ ID NO: 155519 - protein, 13 aa, Mycobacterium tuberculosis
LLSSDELIGLLAR

SEQ ID NO: 155520 - protein, 13 aa, Mycobacterium tuberculosis
LSSDELIGLLARL

SEQ ID NO: 155521 - protein, 13 aa, Mycobacterium tuberculosis
SSDELIGLLARLG

SEQ ID NO: 155522 - protein, 13 aa, Mycobacterium tuberculosis
SDELIGLLARLGY

SEQ ID NO: 155523 - protein, 13 aa, Mycobacterium tuberculosis
DELIGLLARLGYR

SEQ ID NO: 155524 - protein, 13 aa, Mycobacterium tuberculosis
ELIGLLARLGYRF

SEQ ID NO: 155525 - protein, 13 aa, Mycobacterium tuberculosis
LIGLLARLGYRFA

SEQ ID NO: 155526 - protein, 13 aa, Mycobacterium tuberculosis
IGLLARLGYRFAP

SEQ ID NO: 155527 - protein, 13 aa, Mycobacterium tuberculosis
GLLARLGYRFAPT

SEQ ID NO: 155528 - protein, 13 aa, Mycobacterium tuberculosis
LLARLGYRFAPTQ

SEQ ID NO: 155529 - protein, 13 aa, Mycobacterium tuberculosis
LARLGYRFAPTQI

SEQ ID NO: 155530 - protein, 13 aa, Mycobacterium tuberculosis
ARLGYRFAPTQIP

SEQ ID NO: 155531 - protein, 13 aa, Mycobacterium tuberculosis
RLGYRFAPTQIPG

SEQ ID NO: 155532 - protein, 13 aa, Mycobacterium tuberculosis
LGYRFAPTQIPGT

SEQ ID NO: 155533 - protein, 13 aa, Mycobacterium tuberculosis
GYRFAPTQIPGTV

SEQ ID NO: 155534 - protein, 13 aa, Mycobacterium tuberculosis
YRFAPTQIPGTVD

SEQ ID NO: 155535 - protein, 13 aa, Mycobacterium tuberculosis
RFAPTQIPGTVDY

SEQ ID NO: 155536 - protein, 13 aa, Mycobacterium tuberculosis
FAPTQIPGTVDYY

SEQ ID NO: 155537 - protein, 13 aa, Mycobacterium tuberculosis
APTQIPGTVDYYL

SEQ ID NO: 155538 - protein, 13 aa, Mycobacterium tuberculosis
PTQIPGTVDYYLA

SEQ ID NO: 155539 - protein, 13 aa, Mycobacterium tuberculosis
TQIPGTVDYYLAR

SEQ ID NO: 155540 - protein, 13 aa, Mycobacterium tuberculosis
QIPGTVDYYLART

SEQ ID NO: 155541 - protein, 13 aa, Mycobacterium tuberculosis
IPGTVDYYLARTS

SEQ ID NO: 155542 - protein, 13 aa, Mycobacterium tuberculosis
PGTVDYYLARTSD

SEQ ID NO: 155543 - protein, 13 aa, Mycobacterium tuberculosis
GTVDYYLARTSDG

SEQ ID NO: 155544 - protein, 13 aa, Mycobacterium tuberculosis
TVDYYLARTSDGS

SEQ ID NO: 155545 - protein, 13 aa, Mycobacterium tuberculosis
VDYYLARTSDGST

SEQ ID NO: 155546 - protein, 13 aa, Mycobacterium tuberculosis
DYYLARTSDGSTL

SEQ ID NO: 155547 - protein, 13 aa, Mycobacterium tuberculosis
YYLARTSDGSTLS

SEQ ID NO: 155548 - protein, 13 aa, Mycobacterium tuberculosis
YLARTSDGSTLSA

SEQ ID NO: 155549 - protein, 13 aa, Mycobacterium tuberculosis
LARTSDGSTLSAV

SEQ ID NO: 155550 - protein, 13 aa, Mycobacterium tuberculosis
ARTSDGSTLSAVV

SEQ ID NO: 155551 - protein, 13 aa, Mycobacterium tuberculosis
RTSDGSTLSAVVH

SEQ ID NO: 155552 - protein, 13 aa, Mycobacterium tuberculosis
TSDGSTLSAVVHA

SEQ ID NO: 155553 - protein, 13 aa, Mycobacterium tuberculosis
SDGSTLSAVVHAW

SEQ ID NO: 155554 - protein, 13 aa, Mycobacterium tuberculosis
DGSTLSAVVHAWV

SEQ ID NO: 155555 - protein, 13 aa, Mycobacterium tuberculosis
GSTLSAVVHAWVL

SEQ ID NO: 155556 - protein, 13 aa, Mycobacterium tuberculosis
STLSAVVHAWVLA

SEQ ID NO: 155557 - protein, 13 aa, Mycobacterium tuberculosis
TLSAVVHAWVLAR

SEQ ID NO: 155558 - protein, 13 aa, Mycobacterium tuberculosis
LSAVVHAWVLARA

SEQ ID NO: 155559 - protein, 13 aa, Mycobacterium tuberculosis
SAVVHAWVLARAN

SEQ ID NO: 155560 - protein, 13 aa, Mycobacterium tuberculosis
AVVHAWVLARANR

SEQ ID NO: 155561 - protein, 13 aa, Mycobacterium tuberculosis
VVHAWVLARANRS

SEQ ID NO: 155562 - protein, 13 aa, Mycobacterium tuberculosis
VHAWVLARANRSN

SEQ ID NO: 155563 - protein, 13 aa, Mycobacterium tuberculosis
HAWVLARANRSNA

SEQ ID NO: 155564 - protein, 13 aa, Mycobacterium tuberculosis
AWVLARANRSNAM

SEQ ID NO: 155565 - protein, 13 aa, Mycobacterium tuberculosis
WVLARANRSNAME

SEQ ID NO: 155566 - protein, 13 aa, Mycobacterium tuberculosis
VLARANRSNAMEY

SEQ ID NO: 155567 - protein, 13 aa, Mycobacterium tuberculosis
LARANRSNAMEYF

SEQ ID NO: 155568 - protein, 13 aa, Mycobacterium tuberculosis
ARANRSNAMEYFR

SEQ ID NO: 155569 - protein, 13 aa, Mycobacterium tuberculosis
RANRSNAMEYFRQ

SEQ ID NO: 155570 - protein, 13 aa, Mycobacterium tuberculosis
ANRSNAMEYFRQV

SEQ ID NO: 155571 - protein, 13 aa, Mycobacterium tuberculosis
NRSNAMEYFRQVL

SEQ ID NO: 155572 - protein, 13 aa, Mycobacterium tuberculosis
RSNAMEYFRQVLR

SEQ ID NO: 155573 - protein, 13 aa, Mycobacterium tuberculosis
SNAMEYFRQVLRS

SEQ ID NO: 155574 - protein, 13 aa, Mycobacterium tuberculosis
NAMEYFRQVLRSD

SEQ ID NO: 155575 - protein, 13 aa, Mycobacterium tuberculosis
AMEYFRQVLRSDI

SEQ ID NO: 155576 - protein, 13 aa, Mycobacterium tuberculosis
MEYFRQVLRSDIA

SEQ ID NO: 155577 - protein, 13 aa, Mycobacterium tuberculosis
EYFRQVLRSDIAD

SEQ ID NO: 155578 - protein, 13 aa, Mycobacterium tuberculosis
YFRQVLRSDIADV

SEQ ID NO: 155579 - protein, 13 aa, Mycobacterium tuberculosis
FRQVLRSDIADVQ

SEQ ID NO: 155580 - protein, 13 aa, Mycobacterium tuberculosis
RQVLRSDIADVQG

SEQ ID NO: 155581 - protein, 13 aa, Mycobacterium tuberculosis
QVLRSDIADVQGG

SEQ ID NO: 155582 - protein, 13 aa, Mycobacterium tuberculosis
VLRSDIADVQGGT

SEQ ID NO: 155583 - protein, 13 aa, Mycobacterium tuberculosis
LRSDIADVQGGTT

SEQ ID NO: 155584 - protein, 13 aa, Mycobacterium tuberculosis
RSDIADVQGGTTQ

SEQ ID NO: 155585 - protein, 13 aa, Mycobacterium tuberculosis
SDIADVQGGTTQE

SEQ ID NO: 155586 - protein, 13 aa, Mycobacterium tuberculosis
DIADVQGGTTQEG

SEQ ID NO: 155587 - protein, 13 aa, Mycobacterium tuberculosis
IADVQGGTTQEGI

SEQ ID NO: 155588 - protein, 13 aa, Mycobacterium tuberculosis
ADVQGGTTQEGIH

SEQ ID NO: 155589 - protein, 13 aa, Mycobacterium tuberculosis
DVQGGTTQEGIHL

SEQ ID NO: 155590 - protein, 13 aa, Mycobacterium tuberculosis
VQGGTTQEGIHLA

SEQ ID NO: 155591 - protein, 13 aa, Mycobacterium tuberculosis
QGGTTQEGIHLAA

SEQ ID NO: 155592 - protein, 13 aa, Mycobacterium tuberculosis
GGTTQEGIHLAAM

SEQ ID NO: 155593 - protein, 13 aa, Mycobacterium tuberculosis
GTTQEGIHLAAMA

SEQ ID NO: 155594 - protein, 13 aa, Mycobacterium tuberculosis
TTQEGIHLAAMAG

SEQ ID NO: 155595 - protein, 13 aa, Mycobacterium tuberculosis
TQEGIHLAAMAGS

SEQ ID NO: 155596 - protein, 13 aa, Mycobacterium tuberculosis
QEGIHLAAMAGSI

SEQ ID NO: 155597 - protein, 13 aa, Mycobacterium tuberculosis
EGIHLAAMAGSID

SEQ ID NO: 155598 - protein, 13 aa, Mycobacterium tuberculosis
GIHLAAMAGSIDL

SEQ ID NO: 155599 - protein, 13 aa, Mycobacterium tuberculosis
IHLAAMAGSIDLL

SEQ ID NO: 155600 - protein, 13 aa, Mycobacterium tuberculosis
HLAAMAGSIDLLQ

SEQ ID NO: 155601 - protein, 13 aa, Mycobacterium tuberculosis
LAAMAGSIDLLQR

SEQ ID NO: 155602 - protein, 13 aa, Mycobacterium tuberculosis
AAMAGSIDLLQRC

SEQ ID NO: 155603 - protein, 13 aa, Mycobacterium tuberculosis
AMAGSIDLLQRCY

SEQ ID NO: 155604 - protein, 13 aa, Mycobacterium tuberculosis
MAGSIDLLQRCYS

SEQ ID NO: 155605 - protein, 13 aa, Mycobacterium tuberculosis
AGSIDLLQRCYSG

SEQ ID NO: 155606 - protein, 13 aa, Mycobacterium tuberculosis
GSIDLLQRCYSGL

SEQ ID NO: 155607 - protein, 13 aa, Mycobacterium tuberculosis
SIDLLQRCYSGLE

SEQ ID NO: 155608 - protein, 13 aa, Mycobacterium tuberculosis
IDLLQRCYSGLEL

SEQ ID NO: 155609 - protein, 13 aa, Mycobacterium tuberculosis
DLLQRCYSGLELR

SEQ ID NO: 155610 - protein, 13 aa, Mycobacterium tuberculosis
LLQRCYSGLELRD

SEQ ID NO: 155611 - protein, 13 aa, Mycobacterium tuberculosis
LQRCYSGLELRDD

SEQ ID NO: 155612 - protein, 13 aa, Mycobacterium tuberculosis
QRCYSGLELRDDR

SEQ ID NO: 155613 - protein, 13 aa, Mycobacterium tuberculosis
RCYSGLELRDDRL

SEQ ID NO: 155614 - protein, 13 aa, Mycobacterium tuberculosis
CYSGLELRDDRLV

SEQ ID NO: 155615 - protein, 13 aa, Mycobacterium tuberculosis
YSGLELRDDRLVL

SEQ ID NO: 155616 - protein, 13 aa, Mycobacterium tuberculosis
SGLELRDDRLVLS

SEQ ID NO: 155617 - protein, 13 aa, Mycobacterium tuberculosis
GLELRDDRLVLSP

SEQ ID NO: 155618 - protein, 13 aa, Mycobacterium tuberculosis
LELRDDRLVLSPQ

SEQ ID NO: 155619 - protein, 13 aa, Mycobacterium tuberculosis
ELRDDRLVLSPQW

SEQ ID NO: 155620 - protein, 13 aa, Mycobacterium tuberculosis
LRDDRLVLSPQWP

SEQ ID NO: 155621 - protein, 13 aa, Mycobacterium tuberculosis
RDDRLVLSPQWPE

SEQ ID NO: 155622 - protein, 13 aa, Mycobacterium tuberculosis
DDRLVLSPQWPEA

SEQ ID NO: 155623 - protein, 13 aa, Mycobacterium tuberculosis
DRLVLSPQWPEAL

SEQ ID NO: 155624 - protein, 13 aa, Mycobacterium tuberculosis
RLVLSPQWPEALG

SEQ ID NO: 155625 - protein, 13 aa, Mycobacterium tuberculosis
LVLSPQWPEALGP

SEQ ID NO: 155626 - protein, 13 aa, Mycobacterium tuberculosis
VLSPQWPEALGPL

SEQ ID NO: 155627 - protein, 13 aa, Mycobacterium tuberculosis
LSPQWPEALGPLE

SEQ ID NO: 155628 - protein, 13 aa, Mycobacterium tuberculosis
SPQWPEALGPLEF

SEQ ID NO: 155629 - protein, 13 aa, Mycobacterium tuberculosis
PQWPEALGPLEFP

SEQ ID NO: 155630 - protein, 13 aa, Mycobacterium tuberculosis
QWPEALGPLEFPF

SEQ ID NO: 155631 - protein, 13 aa, Mycobacterium tuberculosis
WPEALGPLEFPFV

SEQ ID NO: 155632 - protein, 13 aa, Mycobacterium tuberculosis
PEALGPLEFPFVY

SEQ ID NO: 155633 - protein, 13 aa, Mycobacterium tuberculosis
EALGPLEFPFVYR

SEQ ID NO: 155634 - protein, 13 aa, Mycobacterium tuberculosis
ALGPLEFPFVYRR

SEQ ID NO: 155635 - protein, 13 aa, Mycobacterium tuberculosis
LGPLEFPFVYRRH

SEQ ID NO: 155636 - protein, 13 aa, Mycobacterium tuberculosis
GPLEFPFVYRRHQ

SEQ ID NO: 155637 - protein, 13 aa, Mycobacterium tuberculosis
PLEFPFVYRRHQL

SEQ ID NO: 155638 - protein, 13 aa, Mycobacterium tuberculosis
LEFPFVYRRHQLS

SEQ ID NO: 155639 - protein, 13 aa, Mycobacterium tuberculosis
EFPFVYRRHQLSL

SEQ ID NO: 155640 - protein, 13 aa, Mycobacterium tuberculosis
FPFVYRRHQLSLR

SEQ ID NO: 155641 - protein, 13 aa, Mycobacterium tuberculosis
PFVYRRHQLSLRI

SEQ ID NO: 155642 - protein, 13 aa, Mycobacterium tuberculosis
FVYRRHQLSLRIS

SEQ ID NO: 155643 - protein, 13 aa, Mycobacterium tuberculosis
VYRRHQLSLRISG

SEQ ID NO: 155644 - protein, 13 aa, Mycobacterium tuberculosis
YRRHQLSLRISGR

SEQ ID NO: 155645 - protein, 13 aa, Mycobacterium tuberculosis
RRHQLSLRISGRS

SEQ ID NO: 155646 - protein, 13 aa, Mycobacterium tuberculosis
RHQLSLRISGRSA

SEQ ID NO: 155647 - protein, 13 aa, Mycobacterium tuberculosis
HQLSLRISGRSAT

SEQ ID NO: 155648 - protein, 13 aa, Mycobacterium tuberculosis
QLSLRISGRSATL

SEQ ID NO: 155649 - protein, 13 aa, Mycobacterium tuberculosis
LSLRISGRSATLT

SEQ ID NO: 155650 - protein, 13 aa, Mycobacterium tuberculosis
SLRISGRSATLTA

SEQ ID NO: 155651 - protein, 13 aa, Mycobacterium tuberculosis
LRISGRSATLTAE

SEQ ID NO: 155652 - protein, 13 aa, Mycobacterium tuberculosis
RISGRSATLTAES

SEQ ID NO: 155653 - protein, 13 aa, Mycobacterium tuberculosis
ISGRSATLTAESG

SEQ ID NO: 155654 - protein, 13 aa, Mycobacterium tuberculosis
SGRSATLTAESGD

SEQ ID NO: 155655 - protein, 13 aa, Mycobacterium tuberculosis
GRSATLTAESGDA

SEQ ID NO: 155656 - protein, 13 aa, Mycobacterium tuberculosis
RSATLTAESGDAE

SEQ ID NO: 155657 - protein, 13 aa, Mycobacterium tuberculosis
SATLTAESGDAEP

SEQ ID NO: 155658 - protein, 13 aa, Mycobacterium tuberculosis
ATLTAESGDAEPI

SEQ ID NO: 155659 - protein, 13 aa, Mycobacterium tuberculosis
TLTAESGDAEPIE

SEQ ID NO: 155660 - protein, 13 aa, Mycobacterium tuberculosis
LTAESGDAEPIEV

SEQ ID NO: 155661 - protein, 13 aa, Mycobacterium tuberculosis
TAESGDAEPIEVE

SEQ ID NO: 155662 - protein, 13 aa, Mycobacterium tuberculosis
AESGDAEPIEVEC

SEQ ID NO: 155663 - protein, 13 aa, Mycobacterium tuberculosis
ESGDAEPIEVECR

SEQ ID NO: 155664 - protein, 13 aa, Mycobacterium tuberculosis
SGDAEPIEVECRG

SEQ ID NO: 155665 - protein, 13 aa, Mycobacterium tuberculosis
GDAEPIEVECRGH

SEQ ID NO: 155666 - protein, 13 aa, Mycobacterium tuberculosis
DAEPIEVECRGHV

SEQ ID NO: 155667 - protein, 13 aa, Mycobacterium tuberculosis
AEPIEVECRGHVQ

SEQ ID NO: 155668 - protein, 13 aa, Mycobacterium tuberculosis
EPIEVECRGHVQR

SEQ ID NO: 155669 - protein, 13 aa, Mycobacterium tuberculosis
PIEVECRGHVQRL

SEQ ID NO: 155670 - protein, 13 aa, Mycobacterium tuberculosis
IEVECRGHVQRLR

SEQ ID NO: 155671 - protein, 13 aa, Mycobacterium tuberculosis
EVECRGHVQRLRC

SEQ ID NO: 155672 - protein, 13 aa, Mycobacterium tuberculosis
VECRGHVQRLRCG

SEQ ID NO: 155673 - protein, 13 aa, Mycobacterium tuberculosis
ECRGHVQRLRCGH

SEQ ID NO: 155674 - protein, 13 aa, Mycobacterium tuberculosis
CRGHVQRLRCGHT

SEQ ID NO: 155675 - protein, 13 aa, Mycobacterium tuberculosis
RGHVQRLRCGHTI

SEQ ID NO: 155676 - protein, 13 aa, Mycobacterium tuberculosis
GHVQRLRCGHTIE

SEQ ID NO: 155677 - protein, 13 aa, Mycobacterium tuberculosis
HVQRLRCGHTIEV

SEQ ID NO: 155678 - protein, 13 aa, Mycobacterium tuberculosis
VQRLRCGHTIEVG

SEQ ID NO: 155679 - protein, 13 aa, Mycobacterium tuberculosis
QRLRCGHTIEVGC

SEQ ID NO: 155680 - protein, 13 aa, Mycobacterium tuberculosis
RLRCGHTIEVGCS

SEQ ID NO: 155681 - protein, 13 aa, Mycobacterium tuberculosis
LRCGHTIEVGCSR

SEQ ID NO: 155682 - protein, 14 aa, Mycobacterium tuberculosis
MRCGIVVNVTGPPP

SEQ ID NO: 155683 - protein, 14 aa, Mycobacterium tuberculosis
RCGIVVNVTGPPPT

SEQ ID NO: 155684 - protein, 14 aa, Mycobacterium tuberculosis
CGIVVNVTGPPPTI

SEQ ID NO: 155685 - protein, 14 aa, Mycobacterium tuberculosis
GIVVNVTGPPPTID

SEQ ID NO: 155686 - protein, 14 aa, Mycobacterium tuberculosis
IVVNVTGPPPTIDR

SEQ ID NO: 155687 - protein, 14 aa, Mycobacterium tuberculosis
VVNVTGPPPTIDRR

SEQ ID NO: 155688 - protein, 14 aa, Mycobacterium tuberculosis
VNVTGPPPTIDRRY

SEQ ID NO: 155689 - protein, 14 aa, Mycobacterium tuberculosis
NVTGPPPTIDRRYH

SEQ ID NO: 155690 - protein, 14 aa, Mycobacterium tuberculosis
VTGPPPTIDRRYHD

SEQ ID NO: 155691 - protein, 14 aa, Mycobacterium tuberculosis
TGPPPTIDRRYHDA

SEQ ID NO: 155692 - protein, 14 aa, Mycobacterium tuberculosis
GPPPTIDRRYHDAV

SEQ ID NO: 155693 - protein, 14 aa, Mycobacterium tuberculosis
PPPTIDRRYHDAVI

SEQ ID NO: 155694 - protein, 14 aa, Mycobacterium tuberculosis
PPTIDRRYHDAVIV

SEQ ID NO: 155695 - protein, 14 aa, Mycobacterium tuberculosis
PTIDRRYHDAVIVG

SEQ ID NO: 155696 - protein, 14 aa, Mycobacterium tuberculosis
TIDRRYHDAVIVGL

SEQ ID NO: 155697 - protein, 14 aa, Mycobacterium tuberculosis
IDRRYHDAVIVGLD

SEQ ID NO: 155698 - protein, 14 aa, Mycobacterium tuberculosis
DRRYHDAVIVGLDN

SEQ ID NO: 155699 - protein, 14 aa, Mycobacterium tuberculosis
RRYHDAVIVGLDNV

SEQ ID NO: 155700 - protein, 14 aa, Mycobacterium tuberculosis
RYHDAVIVGLDNVV

SEQ ID NO: 155701 - protein, 14 aa, Mycobacterium tuberculosis
YHDAVIVGLDNVVD

SEQ ID NO: 155702 - protein, 14 aa, Mycobacterium tuberculosis
HDAVIVGLDNVVDK

SEQ ID NO: 155703 - protein, 14 aa, Mycobacterium tuberculosis
DAVIVGLDNVVDKA

SEQ ID NO: 155704 - protein, 14 aa, Mycobacterium tuberculosis
AVIVGLDNVVDKAT

SEQ ID NO: 155705 - protein, 14 aa, Mycobacterium tuberculosis
VIVGLDNVVDKATR

SEQ ID NO: 155706 - protein, 14 aa, Mycobacterium tuberculosis
IVGLDNVVDKATRV

SEQ ID NO: 155707 - protein, 14 aa, Mycobacterium tuberculosis
VGLDNVVDKATRVH

SEQ ID NO: 155708 - protein, 14 aa, Mycobacterium tuberculosis
GLDNVVDKATRVHA

SEQ ID NO: 155709 - protein, 14 aa, Mycobacterium tuberculosis
LDNVVDKATRVHAA

SEQ ID NO: 155710 - protein, 14 aa, Mycobacterium tuberculosis
DNVVDKATRVHAAA

SEQ ID NO: 155711 - protein, 14 aa, Mycobacterium tuberculosis
NVVDKATRVHAAAW

SEQ ID NO: 155712 - protein, 14 aa, Mycobacterium tuberculosis
VVDKATRVHAAAWT

SEQ ID NO: 155713 - protein, 14 aa, Mycobacterium tuberculosis
VDKATRVHAAAWTK

SEQ ID NO: 155714 - protein, 14 aa, Mycobacterium tuberculosis
DKATRVHAAAWTKF

SEQ ID NO: 155715 - protein, 14 aa, Mycobacterium tuberculosis
KATRVHAAAWTKFL

SEQ ID NO: 155716 - protein, 14 aa, Mycobacterium tuberculosis
ATRVHAAAWTKFLD

SEQ ID NO: 155717 - protein, 14 aa, Mycobacterium tuberculosis
TRVHAAAWTKFLDD

SEQ ID NO: 155718 - protein, 14 aa, Mycobacterium tuberculosis
RVHAAAWTKFLDDY

SEQ ID NO: 155719 - protein, 14 aa, Mycobacterium tuberculosis
VHAAAWTKFLDDYL

SEQ ID NO: 155720 - protein, 14 aa, Mycobacterium tuberculosis
HAAAWTKFLDDYLT

SEQ ID NO: 155721 - protein, 14 aa, Mycobacterium tuberculosis
AAAWTKFLDDYLTR

SEQ ID NO: 155722 - protein, 14 aa, Mycobacterium tuberculosis
AAWTKFLDDYLTRR

SEQ ID NO: 155723 - protein, 14 aa, Mycobacterium tuberculosis
AWTKFLDDYLTRRP

SEQ ID NO: 155724 - protein, 14 aa, Mycobacterium tuberculosis
WTKFLDDYLTRRPQ

SEQ ID NO: 155725 - protein, 14 aa, Mycobacterium tuberculosis
TKFLDDYLTRRPQR

SEQ ID NO: 155726 - protein, 14 aa, Mycobacterium tuberculosis
KFLDDYLTRRPQRT

SEQ ID NO: 155727 - protein, 14 aa, Mycobacterium tuberculosis
FLDDYLTRRPQRTG

SEQ ID NO: 155728 - protein, 14 aa, Mycobacterium tuberculosis
LDDYLTRRPQRTGE

SEQ ID NO: 155729 - protein, 14 aa, Mycobacterium tuberculosis
DDYLTRRPQRTGED

SEQ ID NO: 155730 - protein, 14 aa, Mycobacterium tuberculosis
DYLTRRPQRTGEDH

SEQ ID NO: 155731 - protein, 14 aa, Mycobacterium tuberculosis
YLTRRPQRTGEDHC

SEQ ID NO: 155732 - protein, 14 aa, Mycobacterium tuberculosis
LTRRPQRTGEDHCP

SEQ ID NO: 155733 - protein, 14 aa, Mycobacterium tuberculosis
TRRPQRTGEDHCPL

SEQ ID NO: 155734 - protein, 14 aa, Mycobacterium tuberculosis
RRPQRTGEDHCPLT

SEQ ID NO: 155735 - protein, 14 aa, Mycobacterium tuberculosis
RPQRTGEDHCPLTH

SEQ ID NO: 155736 - protein, 14 aa, Mycobacterium tuberculosis
PQRTGEDHCPLTHD

SEQ ID NO: 155737 - protein, 14 aa, Mycobacterium tuberculosis
QRTGEDHCPLTHDD

SEQ ID NO: 155738 - protein, 14 aa, Mycobacterium tuberculosis
RTGEDHCPLTHDDY

SEQ ID NO: 155739 - protein, 14 aa, Mycobacterium tuberculosis
TGEDHCPLTHDDYR

SEQ ID NO: 155740 - protein, 14 aa, Mycobacterium tuberculosis
GEDHCPLTHDDYRR

SEQ ID NO: 155741 - protein, 14 aa, Mycobacterium tuberculosis
EDHCPLTHDDYRRF

SEQ ID NO: 155742 - protein, 14 aa, Mycobacterium tuberculosis
DHCPLTHDDYRRFL

SEQ ID NO: 155743 - protein, 14 aa, Mycobacterium tuberculosis
HCPLTHDDYRRFLA

SEQ ID NO: 155744 - protein, 14 aa, Mycobacterium tuberculosis
CPLTHDDYRRFLAG

SEQ ID NO: 155745 - protein, 14 aa, Mycobacterium tuberculosis
PLTHDDYRRFLAGK

SEQ ID NO: 155746 - protein, 14 aa, Mycobacterium tuberculosis
LTHDDYRRFLAGKP

SEQ ID NO: 155747 - protein, 14 aa, Mycobacterium tuberculosis
THDDYRRFLAGKPD

SEQ ID NO: 155748 - protein, 14 aa, Mycobacterium tuberculosis
HDDYRRFLAGKPDG

SEQ ID NO: 155749 - protein, 14 aa, Mycobacterium tuberculosis
DDYRRFLAGKPDGV

SEQ ID NO: 155750 - protein, 14 aa, Mycobacterium tuberculosis
DYRRFLAGKPDGVA

SEQ ID NO: 155751 - protein, 14 aa, Mycobacterium tuberculosis
YRRFLAGKPDGVAD

SEQ ID NO: 155752 - protein, 14 aa, Mycobacterium tuberculosis
RRFLAGKPDGVADF

SEQ ID NO: 155753 - protein, 14 aa, Mycobacterium tuberculosis
RFLAGKPDGVADFL

SEQ ID NO: 155754 - protein, 14 aa, Mycobacterium tuberculosis
FLAGKPDGVADFLA

SEQ ID NO: 155755 - protein, 14 aa, Mycobacterium tuberculosis
LAGKPDGVADFLAA

SEQ ID NO: 155756 - protein, 14 aa, Mycobacterium tuberculosis
AGKPDGVADFLAAR

SEQ ID NO: 155757 - protein, 14 aa, Mycobacterium tuberculosis
GKPDGVADFLAARG

SEQ ID NO: 155758 - protein, 14 aa, Mycobacterium tuberculosis
KPDGVADFLAARGI

SEQ ID NO: 155759 - protein, 14 aa, Mycobacterium tuberculosis
PDGVADFLAARGIR

SEQ ID NO: 155760 - protein, 14 aa, Mycobacterium tuberculosis
DGVADFLAARGIRL

SEQ ID NO: 155761 - protein, 14 aa, Mycobacterium tuberculosis
GVADFLAARGIRLP

SEQ ID NO: 155762 - protein, 14 aa, Mycobacterium tuberculosis
VADFLAARGIRLPP

SEQ ID NO: 155763 - protein, 14 aa, Mycobacterium tuberculosis
ADFLAARGIRLPPG

SEQ ID NO: 155764 - protein, 14 aa, Mycobacterium tuberculosis
DFLAARGIRLPPGS

SEQ ID NO: 155765 - protein, 14 aa, Mycobacterium tuberculosis
FLAARGIRLPPGSP

SEQ ID NO: 155766 - protein, 14 aa, Mycobacterium tuberculosis
LAARGIRLPPGSPT

SEQ ID NO: 155767 - protein, 14 aa, Mycobacterium tuberculosis
AARGIRLPPGSPTD

SEQ ID NO: 155768 - protein, 14 aa, Mycobacterium tuberculosis
ARGIRLPPGSPTDL

SEQ ID NO: 155769 - protein, 14 aa, Mycobacterium tuberculosis
RGIRLPPGSPTDLT

SEQ ID NO: 155770 - protein, 14 aa, Mycobacterium tuberculosis
GIRLPPGSPTDLTD

SEQ ID NO: 155771 - protein, 14 aa, Mycobacterium tuberculosis
IRLPPGSPTDLTDD

SEQ ID NO: 155772 - protein, 14 aa, Mycobacterium tuberculosis
RLPPGSPTDLTDDT

SEQ ID NO: 155773 - protein, 14 aa, Mycobacterium tuberculosis
LPPGSPTDLTDDTV

SEQ ID NO: 155774 - protein, 14 aa, Mycobacterium tuberculosis
PPGSPTDLTDDTVY

SEQ ID NO: 155775 - protein, 14 aa, Mycobacterium tuberculosis
PGSPTDLTDDTVYG

SEQ ID NO: 155776 - protein, 14 aa, Mycobacterium tuberculosis
GSPTDLTDDTVYGL

SEQ ID NO: 155777 - protein, 14 aa, Mycobacterium tuberculosis
SPTDLTDDTVYGLQ

SEQ ID NO: 155778 - protein, 14 aa, Mycobacterium tuberculosis
PTDLTDDTVYGLQN

SEQ ID NO: 155779 - protein, 14 aa, Mycobacterium tuberculosis
TDLTDDTVYGLQNL

SEQ ID NO: 155780 - protein, 14 aa, Mycobacterium tuberculosis
DLTDDTVYGLQNLE

SEQ ID NO: 155781 - protein, 14 aa, Mycobacterium tuberculosis
LTDDTVYGLQNLER

SEQ ID NO: 155782 - protein, 14 aa, Mycobacterium tuberculosis
TDDTVYGLQNLERQ

SEQ ID NO: 155783 - protein, 14 aa, Mycobacterium tuberculosis
DDTVYGLQNLERQT

SEQ ID NO: 155784 - protein, 14 aa, Mycobacterium tuberculosis
DTVYGLQNLERQTF

SEQ ID NO: 155785 - protein, 14 aa, Mycobacterium tuberculosis
TVYGLQNLERQTFL

SEQ ID NO: 155786 - protein, 14 aa, Mycobacterium tuberculosis
VYGLQNLERQTFLQ

SEQ ID NO: 155787 - protein, 14 aa, Mycobacterium tuberculosis
YGLQNLERQTFLQL

SEQ ID NO: 155788 - protein, 14 aa, Mycobacterium tuberculosis
GLQNLERQTFLQLL

SEQ ID NO: 155789 - protein, 14 aa, Mycobacterium tuberculosis
LQNLERQTFLQLLN

SEQ ID NO: 155790 - protein, 14 aa, Mycobacterium tuberculosis
QNLERQTFLQLLNT

SEQ ID NO: 155791 - protein, 14 aa, Mycobacterium tuberculosis
NLERQTFLQLLNTG

SEQ ID NO: 155792 - protein, 14 aa, Mycobacterium tuberculosis
LERQTFLQLLNTGV

SEQ ID NO: 155793 - protein, 14 aa, Mycobacterium tuberculosis
ERQTFLQLLNTGVP

SEQ ID NO: 155794 - protein, 14 aa, Mycobacterium tuberculosis
RQTFLQLLNTGVPE

SEQ ID NO: 155795 - protein, 14 aa, Mycobacterium tuberculosis
QTFLQLLNTGVPEG

SEQ ID NO: 155796 - protein, 14 aa, Mycobacterium tuberculosis
TFLQLLNTGVPEGK

SEQ ID NO: 155797 - protein, 14 aa, Mycobacterium tuberculosis
FLQLLNTGVPEGKS

SEQ ID NO: 155798 - protein, 14 aa, Mycobacterium tuberculosis
LQLLNTGVPEGKSI

SEQ ID NO: 155799 - protein, 14 aa, Mycobacterium tuberculosis
QLLNTGVPEGKSIA

SEQ ID NO: 155800 - protein, 14 aa, Mycobacterium tuberculosis
LLNTGVPEGKSIAS

SEQ ID NO: 155801 - protein, 14 aa, Mycobacterium tuberculosis
LNTGVPEGKSIASF

SEQ ID NO: 155802 - protein, 14 aa, Mycobacterium tuberculosis
NTGVPEGKSIASFA

SEQ ID NO: 155803 - protein, 14 aa, Mycobacterium tuberculosis
TGVPEGKSIASFAR

SEQ ID NO: 155804 - protein, 14 aa, Mycobacterium tuberculosis
GVPEGKSIASFARR

SEQ ID NO: 155805 - protein, 14 aa, Mycobacterium tuberculosis
VPEGKSIASFARRL

SEQ ID NO: 155806 - protein, 14 aa, Mycobacterium tuberculosis
PEGKSIASFARRLQ

SEQ ID NO: 155807 - protein, 14 aa, Mycobacterium tuberculosis
EGKSIASFARRLQV

SEQ ID NO: 155808 - protein, 14 aa, Mycobacterium tuberculosis
GKSIASFARRLQVA

SEQ ID NO: 155809 - protein, 14 aa, Mycobacterium tuberculosis
KSIASFARRLQVAG

SEQ ID NO: 155810 - protein, 14 aa, Mycobacterium tuberculosis
SIASFARRLQVAGV

SEQ ID NO: 155811 - protein, 14 aa, Mycobacterium tuberculosis
IASFARRLQVAGVR

SEQ ID NO: 155812 - protein, 14 aa, Mycobacterium tuberculosis
ASFARRLQVAGVRV

SEQ ID NO: 155813 - protein, 14 aa, Mycobacterium tuberculosis
SFARRLQVAGVRVA

SEQ ID NO: 155814 - protein, 14 aa, Mycobacterium tuberculosis
FARRLQVAGVRVAA

SEQ ID NO: 155815 - protein, 14 aa, Mycobacterium tuberculosis
ARRLQVAGVRVAAH

SEQ ID NO: 155816 - protein, 14 aa, Mycobacterium tuberculosis
RRLQVAGVRVAAHT

SEQ ID NO: 155817 - protein, 14 aa, Mycobacterium tuberculosis
RLQVAGVRVAAHTS

SEQ ID NO: 155818 - protein, 14 aa, Mycobacterium tuberculosis
LQVAGVRVAAHTSH

SEQ ID NO: 155819 - protein, 14 aa, Mycobacterium tuberculosis
QVAGVRVAAHTSHR

SEQ ID NO: 155820 - protein, 14 aa, Mycobacterium tuberculosis
VAGVRVAAHTSHRN

SEQ ID NO: 155821 - protein, 14 aa, Mycobacterium tuberculosis
AGVRVAAHTSHRNY

SEQ ID NO: 155822 - protein, 14 aa, Mycobacterium tuberculosis
GVRVAAHTSHRNYG

SEQ ID NO: 155823 - protein, 14 aa, Mycobacterium tuberculosis
VRVAAHTSHRNYGH

SEQ ID NO: 155824 - protein, 14 aa, Mycobacterium tuberculosis
RVAAHTSHRNYGHT

SEQ ID NO: 155825 - protein, 14 aa, Mycobacterium tuberculosis
VAAHTSHRNYGHTL

SEQ ID NO: 155826 - protein, 14 aa, Mycobacterium tuberculosis
AAHTSHRNYGHTLD

SEQ ID NO: 155827 - protein, 14 aa, Mycobacterium tuberculosis
AHTSHRNYGHTLDA

SEQ ID NO: 155828 - protein, 14 aa, Mycobacterium tuberculosis
HTSHRNYGHTLDAT

SEQ ID NO: 155829 - protein, 14 aa, Mycobacterium tuberculosis
TSHRNYGHTLDATG

SEQ ID NO: 155830 - protein, 14 aa, Mycobacterium tuberculosis
SHRNYGHTLDATGL

SEQ ID NO: 155831 - protein, 14 aa, Mycobacterium tuberculosis
HRNYGHTLDATGLA

SEQ ID NO: 155832 - protein, 14 aa, Mycobacterium tuberculosis
RNYGHTLDATGLAE

SEQ ID NO: 155833 - protein, 14 aa, Mycobacterium tuberculosis
NYGHTLDATGLAEV

SEQ ID NO: 155834 - protein, 14 aa, Mycobacterium tuberculosis
YGHTLDATGLAEVF

SEQ ID NO: 155835 - protein, 14 aa, Mycobacterium tuberculosis
GHTLDATGLAEVFA

SEQ ID NO: 155836 - protein, 14 aa, Mycobacterium tuberculosis
HTLDATGLAEVFAV

SEQ ID NO: 155837 - protein, 14 aa, Mycobacterium tuberculosis
TLDATGLAEVFAVF

SEQ ID NO: 155838 - protein, 14 aa, Mycobacterium tuberculosis
LDATGLAEVFAVFV

SEQ ID NO: 155839 - protein, 14 aa, Mycobacterium tuberculosis
DATGLAEVFAVFVD

SEQ ID NO: 155840 - protein, 14 aa, Mycobacterium tuberculosis
ATGLAEVFAVFVDG

SEQ ID NO: 155841 - protein, 14 aa, Mycobacterium tuberculosis
TGLAEVFAVFVDGA

SEQ ID NO: 155842 - protein, 14 aa, Mycobacterium tuberculosis
GLAEVFAVFVDGAV

SEQ ID NO: 155843 - protein, 14 aa, Mycobacterium tuberculosis
LAEVFAVFVDGAVT

SEQ ID NO: 155844 - protein, 14 aa, Mycobacterium tuberculosis
AEVFAVFVDGAVTA

SEQ ID NO: 155845 - protein, 14 aa, Mycobacterium tuberculosis
EVFAVFVDGAVTAE

SEQ ID NO: 155846 - protein, 14 aa, Mycobacterium tuberculosis
VFAVFVDGAVTAEL

SEQ ID NO: 155847 - protein, 14 aa, Mycobacterium tuberculosis
FAVFVDGAVTAELG

SEQ ID NO: 155848 - protein, 14 aa, Mycobacterium tuberculosis
AVFVDGAVTAELGL

SEQ ID NO: 155849 - protein, 14 aa, Mycobacterium tuberculosis
VFVDGAVTAELGLP

SEQ ID NO: 155850 - protein, 14 aa, Mycobacterium tuberculosis
FVDGAVTAELGLPA

SEQ ID NO: 155851 - protein, 14 aa, Mycobacterium tuberculosis
VDGAVTAELGLPAE

SEQ ID NO: 155852 - protein, 14 aa, Mycobacterium tuberculosis
DGAVTAELGLPAEP

SEQ ID NO: 155853 - protein, 14 aa, Mycobacterium tuberculosis
GAVTAELGLPAEPN

SEQ ID NO: 155854 - protein, 14 aa, Mycobacterium tuberculosis
AVTAELGLPAEPNP

SEQ ID NO: 155855 - protein, 14 aa, Mycobacterium tuberculosis
VTAELGLPAEPNPA

SEQ ID NO: 155856 - protein, 14 aa, Mycobacterium tuberculosis
TAELGLPAEPNPAG

SEQ ID NO: 155857 - protein, 14 aa, Mycobacterium tuberculosis
AELGLPAEPNPAGL

SEQ ID NO: 155858 - protein, 14 aa, Mycobacterium tuberculosis
ELGLPAEPNPAGLI

SEQ ID NO: 155859 - protein, 14 aa, Mycobacterium tuberculosis
LGLPAEPNPAGLIE

SEQ ID NO: 155860 - protein, 14 aa, Mycobacterium tuberculosis
GLPAEPNPAGLIET

SEQ ID NO: 155861 - protein, 14 aa, Mycobacterium tuberculosis
LPAEPNPAGLIETA

SEQ ID NO: 155862 - protein, 14 aa, Mycobacterium tuberculosis
PAEPNPAGLIETAK

SEQ ID NO: 155863 - protein, 14 aa, Mycobacterium tuberculosis
AEPNPAGLIETAKR

SEQ ID NO: 155864 - protein, 14 aa, Mycobacterium tuberculosis
EPNPAGLIETAKRL

SEQ ID NO: 155865 - protein, 14 aa, Mycobacterium tuberculosis
PNPAGLIETAKRLG

SEQ ID NO: 155866 - protein, 14 aa, Mycobacterium tuberculosis
NPAGLIETAKRLGA

SEQ ID NO: 155867 - protein, 14 aa, Mycobacterium tuberculosis
PAGLIETAKRLGAN

SEQ ID NO: 155868 - protein, 14 aa, Mycobacterium tuberculosis
AGLIETAKRLGANP

SEQ ID NO: 155869 - protein, 14 aa, Mycobacterium tuberculosis
GLIETAKRLGANPG

SEQ ID NO: 155870 - protein, 14 aa, Mycobacterium tuberculosis
LIETAKRLGANPGR

SEQ ID NO: 155871 - protein, 14 aa, Mycobacterium tuberculosis
IETAKRLGANPGRC

SEQ ID NO: 155872 - protein, 14 aa, Mycobacterium tuberculosis
ETAKRLGANPGRCV

SEQ ID NO: 155873 - protein, 14 aa, Mycobacterium tuberculosis
TAKRLGANPGRCVV

SEQ ID NO: 155874 - protein, 14 aa, Mycobacterium tuberculosis
AKRLGANPGRCVVI

SEQ ID NO: 155875 - protein, 14 aa, Mycobacterium tuberculosis
KRLGANPGRCVVID

SEQ ID NO: 155876 - protein, 14 aa, Mycobacterium tuberculosis
RLGANPGRCVVIDS

SEQ ID NO: 155877 - protein, 14 aa, Mycobacterium tuberculosis
LGANPGRCVVIDSC

SEQ ID NO: 155878 - protein, 14 aa, Mycobacterium tuberculosis
GANPGRCVVIDSCQ

SEQ ID NO: 155879 - protein, 14 aa, Mycobacterium tuberculosis
ANPGRCVVIDSCQT

SEQ ID NO: 155880 - protein, 14 aa, Mycobacterium tuberculosis
NPGRCVVIDSCQTG

SEQ ID NO: 155881 - protein, 14 aa, Mycobacterium tuberculosis
PGRCVVIDSCQTGL

SEQ ID NO: 155882 - protein, 14 aa, Mycobacterium tuberculosis
GRCVVIDSCQTGLR

SEQ ID NO: 155883 - protein, 14 aa, Mycobacterium tuberculosis
RCVVIDSCQTGLRA

SEQ ID NO: 155884 - protein, 14 aa, Mycobacterium tuberculosis
CVVIDSCQTGLRAG

SEQ ID NO: 155885 - protein, 14 aa, Mycobacterium tuberculosis
VVIDSCQTGLRAGR

SEQ ID NO: 155886 - protein, 14 aa, Mycobacterium tuberculosis
VIDSCQTGLRAGRN

SEQ ID NO: 155887 - protein, 14 aa, Mycobacterium tuberculosis
IDSCQTGLRAGRNG

SEQ ID NO: 155888 - protein, 14 aa, Mycobacterium tuberculosis
DSCQTGLRAGRNGG

SEQ ID NO: 155889 - protein, 14 aa, Mycobacterium tuberculosis
SCQTGLRAGRNGGF

SEQ ID NO: 155890 - protein, 14 aa, Mycobacterium tuberculosis
CQTGLRAGRNGGFA

SEQ ID NO: 155891 - protein, 14 aa, Mycobacterium tuberculosis
QTGLRAGRNGGFAL

SEQ ID NO: 155892 - protein, 14 aa, Mycobacterium tuberculosis
TGLRAGRNGGFALV

SEQ ID NO: 155893 - protein, 14 aa, Mycobacterium tuberculosis
GLRAGRNGGFALVI

SEQ ID NO: 155894 - protein, 14 aa, Mycobacterium tuberculosis
LRAGRNGGFALVIA

SEQ ID NO: 155895 - protein, 14 aa, Mycobacterium tuberculosis
RAGRNGGFALVIAV

SEQ ID NO: 155896 - protein, 14 aa, Mycobacterium tuberculosis
AGRNGGFALVIAVD

SEQ ID NO: 155897 - protein, 14 aa, Mycobacterium tuberculosis
GRNGGFALVIAVDA

SEQ ID NO: 155898 - protein, 14 aa, Mycobacterium tuberculosis
RNGGFALVIAVDAH

SEQ ID NO: 155899 - protein, 14 aa, Mycobacterium tuberculosis
NGGFALVIAVDAHG

SEQ ID NO: 155900 - protein, 14 aa, Mycobacterium tuberculosis
GGFALVIAVDAHGD

SEQ ID NO: 155901 - protein, 14 aa, Mycobacterium tuberculosis
GFALVIAVDAHGDA

SEQ ID NO: 155902 - protein, 14 aa, Mycobacterium tuberculosis
FALVIAVDAHGDAE

SEQ ID NO: 155903 - protein, 14 aa, Mycobacterium tuberculosis
ALVIAVDAHGDAEN

SEQ ID NO: 155904 - protein, 14 aa, Mycobacterium tuberculosis
LVIAVDAHGDAENL

SEQ ID NO: 155905 - protein, 14 aa, Mycobacterium tuberculosis
VIAVDAHGDAENLL

SEQ ID NO: 155906 - protein, 14 aa, Mycobacterium tuberculosis
IAVDAHGDAENLLS

SEQ ID NO: 155907 - protein, 14 aa, Mycobacterium tuberculosis
AVDAHGDAENLLSS

SEQ ID NO: 155908 - protein, 14 aa, Mycobacterium tuberculosis
VDAHGDAENLLSSG

SEQ ID NO: 155909 - protein, 14 aa, Mycobacterium tuberculosis
DAHGDAENLLSSGA

SEQ ID NO: 155910 - protein, 14 aa, Mycobacterium tuberculosis
AHGDAENLLSSGAD

SEQ ID NO: 155911 - protein, 14 aa, Mycobacterium tuberculosis
HGDAENLLSSGADA

SEQ ID NO: 155912 - protein, 14 aa, Mycobacterium tuberculosis
GDAENLLSSGADAV

SEQ ID NO: 155913 - protein, 14 aa, Mycobacterium tuberculosis
DAENLLSSGADAVV

SEQ ID NO: 155914 - protein, 14 aa, Mycobacterium tuberculosis
AENLLSSGADAVVA

SEQ ID NO: 155915 - protein, 14 aa, Mycobacterium tuberculosis
ENLLSSGADAVVAD

SEQ ID NO: 155916 - protein, 14 aa, Mycobacterium tuberculosis
NLLSSGADAVVADL

SEQ ID NO: 155917 - protein, 14 aa, Mycobacterium tuberculosis
LLSSGADAVVADLA

SEQ ID NO: 155918 - protein, 14 aa, Mycobacterium tuberculosis
LSSGADAVVADLAA

SEQ ID NO: 155919 - protein, 14 aa, Mycobacterium tuberculosis
SSGADAVVADLAAV

SEQ ID NO: 155920 - protein, 14 aa, Mycobacterium tuberculosis
SGADAVVADLAAVT

SEQ ID NO: 155921 - protein, 14 aa, Mycobacterium tuberculosis
GADAVVADLAAVTV

SEQ ID NO: 155922 - protein, 14 aa, Mycobacterium tuberculosis
ADAVVADLAAVTVG

SEQ ID NO: 155923 - protein, 14 aa, Mycobacterium tuberculosis
DAVVADLAAVTVGS

SEQ ID NO: 155924 - protein, 14 aa, Mycobacterium tuberculosis
AVVADLAAVTVGSG

SEQ ID NO: 155925 - protein, 14 aa, Mycobacterium tuberculosis
VVADLAAVTVGSGD

SEQ ID NO: 155926 - protein, 14 aa, Mycobacterium tuberculosis
VADLAAVTVGSGDA

SEQ ID NO: 155927 - protein, 14 aa, Mycobacterium tuberculosis
ADLAAVTVGSGDAA

SEQ ID NO: 155928 - protein, 14 aa, Mycobacterium tuberculosis
DLAAVTVGSGDAAI

SEQ ID NO: 155929 - protein, 14 aa, Mycobacterium tuberculosis
LAAVTVGSGDAAIS

SEQ ID NO: 155930 - protein, 14 aa, Mycobacterium tuberculosis
AAVTVGSGDAAIST

SEQ ID NO: 155931 - protein, 14 aa, Mycobacterium tuberculosis
AVTVGSGDAAISTI

SEQ ID NO: 155932 - protein, 14 aa, Mycobacterium tuberculosis
VTVGSGDAAISTIP

SEQ ID NO: 155933 - protein, 14 aa, Mycobacterium tuberculosis
TVGSGDAAISTIPD

SEQ ID NO: 155934 - protein, 14 aa, Mycobacterium tuberculosis
VGSGDAAISTIPDA

SEQ ID NO: 155935 - protein, 14 aa, Mycobacterium tuberculosis
GSGDAAISTIPDAL

SEQ ID NO: 155936 - protein, 14 aa, Mycobacterium tuberculosis
SGDAAISTIPDALQ

SEQ ID NO: 155937 - protein, 14 aa, Mycobacterium tuberculosis
GDAAISTIPDALQV

SEQ ID NO: 155938 - protein, 14 aa, Mycobacterium tuberculosis
DAAISTIPDALQVY

SEQ ID NO: 155939 - protein, 14 aa, Mycobacterium tuberculosis
AAISTIPDALQVYS

SEQ ID NO: 155940 - protein, 14 aa, Mycobacterium tuberculosis
AISTIPDALQVYSQ

SEQ ID NO: 155941 - protein, 14 aa, Mycobacterium tuberculosis
ISTIPDALQVYSQL

SEQ ID NO: 155942 - protein, 14 aa, Mycobacterium tuberculosis
STIPDALQVYSQLK

SEQ ID NO: 155943 - protein, 14 aa, Mycobacterium tuberculosis
TIPDALQVYSQLKR

SEQ ID NO: 155944 - protein, 14 aa, Mycobacterium tuberculosis
IPDALQVYSQLKRL

SEQ ID NO: 155945 - protein, 14 aa, Mycobacterium tuberculosis
PDALQVYSQLKRLL

SEQ ID NO: 155946 - protein, 14 aa, Mycobacterium tuberculosis
DALQVYSQLKRLLT

SEQ ID NO: 155947 - protein, 14 aa, Mycobacterium tuberculosis
ALQVYSQLKRLLTG

SEQ ID NO: 155948 - protein, 14 aa, Mycobacterium tuberculosis
LQVYSQLKRLLTGR

SEQ ID NO: 155949 - protein, 14 aa, Mycobacterium tuberculosis
QVYSQLKRLLTGRR

SEQ ID NO: 155950 - protein, 14 aa, Mycobacterium tuberculosis
VYSQLKRLLTGRRP

SEQ ID NO: 155951 - protein, 14 aa, Mycobacterium tuberculosis
YSQLKRLLTGRRPA

SEQ ID NO: 155952 - protein, 14 aa, Mycobacterium tuberculosis
SQLKRLLTGRRPAV

SEQ ID NO: 155953 - protein, 14 aa, Mycobacterium tuberculosis
QLKRLLTGRRPAVF

SEQ ID NO: 155954 - protein, 14 aa, Mycobacterium tuberculosis
LKRLLTGRRPAVFL

SEQ ID NO: 155955 - protein, 14 aa, Mycobacterium tuberculosis
KRLLTGRRPAVFLD

SEQ ID NO: 155956 - protein, 14 aa, Mycobacterium tuberculosis
RLLTGRRPAVFLDF

SEQ ID NO: 155957 - protein, 14 aa, Mycobacterium tuberculosis
LLTGRRPAVFLDFD

SEQ ID NO: 155958 - protein, 14 aa, Mycobacterium tuberculosis
LTGRRPAVFLDFDG

SEQ ID NO: 155959 - protein, 14 aa, Mycobacterium tuberculosis
TGRRPAVFLDFDGT

SEQ ID NO: 155960 - protein, 14 aa, Mycobacterium tuberculosis
GRRPAVFLDFDGTL

SEQ ID NO: 155961 - protein, 14 aa, Mycobacterium tuberculosis
RRPAVFLDFDGTLS

SEQ ID NO: 155962 - protein, 14 aa, Mycobacterium tuberculosis
RPAVFLDFDGTLSD

SEQ ID NO: 155963 - protein, 14 aa, Mycobacterium tuberculosis
PAVFLDFDGTLSDI

SEQ ID NO: 155964 - protein, 14 aa, Mycobacterium tuberculosis
AVFLDFDGTLSDIV

SEQ ID NO: 155965 - protein, 14 aa, Mycobacterium tuberculosis
VFLDFDGTLSDIVE

SEQ ID NO: 155966 - protein, 14 aa, Mycobacterium tuberculosis
FLDFDGTLSDIVER

SEQ ID NO: 155967 - protein, 14 aa, Mycobacterium tuberculosis
LDFDGTLSDIVERP

SEQ ID NO: 155968 - protein, 14 aa, Mycobacterium tuberculosis
DFDGTLSDIVERPE

SEQ ID NO: 155969 - protein, 14 aa, Mycobacterium tuberculosis
FDGTLSDIVERPEA

SEQ ID NO: 155970 - protein, 14 aa, Mycobacterium tuberculosis
DGTLSDIVERPEAA

SEQ ID NO: 155971 - protein, 14 aa, Mycobacterium tuberculosis
GTLSDIVERPEAAT

SEQ ID NO: 155972 - protein, 14 aa, Mycobacterium tuberculosis
TLSDIVERPEAATL

SEQ ID NO: 155973 - protein, 14 aa, Mycobacterium tuberculosis
LSDIVERPEAATLV

SEQ ID NO: 155974 - protein, 14 aa, Mycobacterium tuberculosis
SDIVERPEAATLVD

SEQ ID NO: 155975 - protein, 14 aa, Mycobacterium tuberculosis
DIVERPEAATLVDG

SEQ ID NO: 155976 - protein, 14 aa, Mycobacterium tuberculosis
IVERPEAATLVDGA

SEQ ID NO: 155977 - protein, 14 aa, Mycobacterium tuberculosis
VERPEAATLVDGAA

SEQ ID NO: 155978 - protein, 14 aa, Mycobacterium tuberculosis
ERPEAATLVDGAAE

SEQ ID NO: 155979 - protein, 14 aa, Mycobacterium tuberculosis
RPEAATLVDGAAEA

SEQ ID NO: 155980 - protein, 14 aa, Mycobacterium tuberculosis
PEAATLVDGAAEAL

SEQ ID NO: 155981 - protein, 14 aa, Mycobacterium tuberculosis
EAATLVDGAAEALR

SEQ ID NO: 155982 - protein, 14 aa, Mycobacterium tuberculosis
AATLVDGAAEALRA

SEQ ID NO: 155983 - protein, 14 aa, Mycobacterium tuberculosis
ATLVDGAAEALRAL

SEQ ID NO: 155984 - protein, 14 aa, Mycobacterium tuberculosis
TLVDGAAEALRALA

SEQ ID NO: 155985 - protein, 14 aa, Mycobacterium tuberculosis
LVDGAAEALRALAA

SEQ ID NO: 155986 - protein, 14 aa, Mycobacterium tuberculosis
VDGAAEALRALAAQ

SEQ ID NO: 155987 - protein, 14 aa, Mycobacterium tuberculosis
DGAAEALRALAAQC

SEQ ID NO: 155988 - protein, 14 aa, Mycobacterium tuberculosis
GAAEALRALAAQCP

SEQ ID NO: 155989 - protein, 14 aa, Mycobacterium tuberculosis
AAEALRALAAQCPV

SEQ ID NO: 155990 - protein, 14 aa, Mycobacterium tuberculosis
AEALRALAAQCPVA

SEQ ID NO: 155991 - protein, 14 aa, Mycobacterium tuberculosis
EALRALAAQCPVAV

SEQ ID NO: 155992 - protein, 14 aa, Mycobacterium tuberculosis
ALRALAAQCPVAVI

SEQ ID NO: 155993 - protein, 14 aa, Mycobacterium tuberculosis
LRALAAQCPVAVIS

SEQ ID NO: 155994 - protein, 14 aa, Mycobacterium tuberculosis
RALAAQCPVAVISG

SEQ ID NO: 155995 - protein, 14 aa, Mycobacterium tuberculosis
ALAAQCPVAVISGR

SEQ ID NO: 155996 - protein, 14 aa, Mycobacterium tuberculosis
LAAQCPVAVISGRD

SEQ ID NO: 155997 - protein, 14 aa, Mycobacterium tuberculosis
AAQCPVAVISGRDL

SEQ ID NO: 155998 - protein, 14 aa, Mycobacterium tuberculosis
AQCPVAVISGRDLA

SEQ ID NO: 155999 - protein, 14 aa, Mycobacterium tuberculosis
QCPVAVISGRDLAD

SEQ ID NO: 156000 - protein, 14 aa, Mycobacterium tuberculosis
CPVAVISGRDLADV

SEQ ID NO: 156001 - protein, 14 aa, Mycobacterium tuberculosis
PVAVISGRDLADVR

SEQ ID NO: 156002 - protein, 14 aa, Mycobacterium tuberculosis
VAVISGRDLADVRN

SEQ ID NO: 156003 - protein, 14 aa, Mycobacterium tuberculosis
AVISGRDLADVRNR

SEQ ID NO: 156004 - protein, 14 aa, Mycobacterium tuberculosis
VISGRDLADVRNRV

SEQ ID NO: 156005 - protein, 14 aa, Mycobacterium tuberculosis
ISGRDLADVRNRVK

SEQ ID NO: 156006 - protein, 14 aa, Mycobacterium tuberculosis
SGRDLADVRNRVKV

SEQ ID NO: 156007 - protein, 14 aa, Mycobacterium tuberculosis
GRDLADVRNRVKVD

SEQ ID NO: 156008 - protein, 14 aa, Mycobacterium tuberculosis
RDLADVRNRVKVDG

SEQ ID NO: 156009 - protein, 14 aa, Mycobacterium tuberculosis
DLADVRNRVKVDGL

SEQ ID NO: 156010 - protein, 14 aa, Mycobacterium tuberculosis
LADVRNRVKVDGLW

SEQ ID NO: 156011 - protein, 14 aa, Mycobacterium tuberculosis
ADVRNRVKVDGLWL

SEQ ID NO: 156012 - protein, 14 aa, Mycobacterium tuberculosis
DVRNRVKVDGLWLA

SEQ ID NO: 156013 - protein, 14 aa, Mycobacterium tuberculosis
VRNRVKVDGLWLAG

SEQ ID NO: 156014 - protein, 14 aa, Mycobacterium tuberculosis
RNRVKVDGLWLAGS

SEQ ID NO: 156015 - protein, 14 aa, Mycobacterium tuberculosis
NRVKVDGLWLAGSH

SEQ ID NO: 156016 - protein, 14 aa, Mycobacterium tuberculosis
RVKVDGLWLAGSHG

SEQ ID NO: 156017 - protein, 14 aa, Mycobacterium tuberculosis
VKVDGLWLAGSHGF

SEQ ID NO: 156018 - protein, 14 aa, Mycobacterium tuberculosis
KVDGLWLAGSHGFE

SEQ ID NO: 156019 - protein, 14 aa, Mycobacterium tuberculosis
VDGLWLAGSHGFEL

SEQ ID NO: 156020 - protein, 14 aa, Mycobacterium tuberculosis
DGLWLAGSHGFELV

SEQ ID NO: 156021 - protein, 14 aa, Mycobacterium tuberculosis
GLWLAGSHGFELVA

SEQ ID NO: 156022 - protein, 14 aa, Mycobacterium tuberculosis
LWLAGSHGFELVAP

SEQ ID NO: 156023 - protein, 14 aa, Mycobacterium tuberculosis
WLAGSHGFELVAPD

SEQ ID NO: 156024 - protein, 14 aa, Mycobacterium tuberculosis
LAGSHGFELVAPDG

SEQ ID NO: 156025 - protein, 14 aa, Mycobacterium tuberculosis
AGSHGFELVAPDGS

SEQ ID NO: 156026 - protein, 14 aa, Mycobacterium tuberculosis
GSHGFELVAPDGSH

SEQ ID NO: 156027 - protein, 14 aa, Mycobacterium tuberculosis
SHGFELVAPDGSHH

SEQ ID NO: 156028 - protein, 14 aa, Mycobacterium tuberculosis
HGFELVAPDGSHHQ

SEQ ID NO: 156029 - protein, 14 aa, Mycobacterium tuberculosis
GFELVAPDGSHHQN

SEQ ID NO: 156030 - protein, 14 aa, Mycobacterium tuberculosis
FELVAPDGSHHQNA

SEQ ID NO: 156031 - protein, 14 aa, Mycobacterium tuberculosis
ELVAPDGSHHQNAA

SEQ ID NO: 156032 - protein, 14 aa, Mycobacterium tuberculosis
LVAPDGSHHQNAAA

SEQ ID NO: 156033 - protein, 14 aa, Mycobacterium tuberculosis
VAPDGSHHQNAAAT

SEQ ID NO: 156034 - protein, 14 aa, Mycobacterium tuberculosis
APDGSHHQNAAATA

SEQ ID NO: 156035 - protein, 14 aa, Mycobacterium tuberculosis
PDGSHHQNAAATAA

SEQ ID NO: 156036 - protein, 14 aa, Mycobacterium tuberculosis
DGSHHQNAAATAAI

SEQ ID NO: 156037 - protein, 14 aa, Mycobacterium tuberculosis
GSHHQNAAATAAID

SEQ ID NO: 156038 - protein, 14 aa, Mycobacterium tuberculosis
SHHQNAAATAAIDG

SEQ ID NO: 156039 - protein, 14 aa, Mycobacterium tuberculosis
HHQNAAATAAIDGL

SEQ ID NO: 156040 - protein, 14 aa, Mycobacterium tuberculosis
HQNAAATAAIDGLA

SEQ ID NO: 156041 - protein, 14 aa, Mycobacterium tuberculosis
QNAAATAAIDGLAE

SEQ ID NO: 156042 - protein, 14 aa, Mycobacterium tuberculosis
NAAATAAIDGLAEA

SEQ ID NO: 156043 - protein, 14 aa, Mycobacterium tuberculosis
AAATAAIDGLAEAA

SEQ ID NO: 156044 - protein, 14 aa, Mycobacterium tuberculosis
AATAAIDGLAEAAA

SEQ ID NO: 156045 - protein, 14 aa, Mycobacterium tuberculosis
ATAAIDGLAEAAAQ

SEQ ID NO: 156046 - protein, 14 aa, Mycobacterium tuberculosis
TAAIDGLAEAAAQL

SEQ ID NO: 156047 - protein, 14 aa, Mycobacterium tuberculosis
AAIDGLAEAAAQLA

SEQ ID NO: 156048 - protein, 14 aa, Mycobacterium tuberculosis
AIDGLAEAAAQLAD

SEQ ID NO: 156049 - protein, 14 aa, Mycobacterium tuberculosis
IDGLAEAAAQLADA

SEQ ID NO: 156050 - protein, 14 aa, Mycobacterium tuberculosis
DGLAEAAAQLADAL

SEQ ID NO: 156051 - protein, 14 aa, Mycobacterium tuberculosis
GLAEAAAQLADALR

SEQ ID NO: 156052 - protein, 14 aa, Mycobacterium tuberculosis
LAEAAAQLADALRE

SEQ ID NO: 156053 - protein, 14 aa, Mycobacterium tuberculosis
AEAAAQLADALREI

SEQ ID NO: 156054 - protein, 14 aa, Mycobacterium tuberculosis
EAAAQLADALREIA

SEQ ID NO: 156055 - protein, 14 aa, Mycobacterium tuberculosis
AAAQLADALREIAG

SEQ ID NO: 156056 - protein, 14 aa, Mycobacterium tuberculosis
AAQLADALREIAGA

SEQ ID NO: 156057 - protein, 14 aa, Mycobacterium tuberculosis
AQLADALREIAGAV

SEQ ID NO: 156058 - protein, 14 aa, Mycobacterium tuberculosis
QLADALREIAGAVV

SEQ ID NO: 156059 - protein, 14 aa, Mycobacterium tuberculosis
LADALREIAGAVVE

SEQ ID NO: 156060 - protein, 14 aa, Mycobacterium tuberculosis
ADALREIAGAVVEH

SEQ ID NO: 156061 - protein, 14 aa, Mycobacterium tuberculosis
DALREIAGAVVEHK

SEQ ID NO: 156062 - protein, 14 aa, Mycobacterium tuberculosis
ALREIAGAVVEHKR

SEQ ID NO: 156063 - protein, 14 aa, Mycobacterium tuberculosis
LREIAGAVVEHKRF

SEQ ID NO: 156064 - protein, 14 aa, Mycobacterium tuberculosis
REIAGAVVEHKRFA

SEQ ID NO: 156065 - protein, 14 aa, Mycobacterium tuberculosis
EIAGAVVEHKRFAV

SEQ ID NO: 156066 - protein, 14 aa, Mycobacterium tuberculosis
IAGAVVEHKRFAVA

SEQ ID NO: 156067 - protein, 14 aa, Mycobacterium tuberculosis
AGAVVEHKRFAVAV

SEQ ID NO: 156068 - protein, 14 aa, Mycobacterium tuberculosis
GAVVEHKRFAVAVH

SEQ ID NO: 156069 - protein, 14 aa, Mycobacterium tuberculosis
AVVEHKRFAVAVHY

SEQ ID NO: 156070 - protein, 14 aa, Mycobacterium tuberculosis
VVEHKRFAVAVHYR

SEQ ID NO: 156071 - protein, 14 aa, Mycobacterium tuberculosis
VEHKRFAVAVHYRN

SEQ ID NO: 156072 - protein, 14 aa, Mycobacterium tuberculosis
EHKRFAVAVHYRNV

SEQ ID NO: 156073 - protein, 14 aa, Mycobacterium tuberculosis
HKRFAVAVHYRNVA

SEQ ID NO: 156074 - protein, 14 aa, Mycobacterium tuberculosis
KRFAVAVHYRNVAD

SEQ ID NO: 156075 - protein, 14 aa, Mycobacterium tuberculosis
RFAVAVHYRNVADD

SEQ ID NO: 156076 - protein, 14 aa, Mycobacterium tuberculosis
FAVAVHYRNVADDS

SEQ ID NO: 156077 - protein, 14 aa, Mycobacterium tuberculosis
AVAVHYRNVADDSV

SEQ ID NO: 156078 - protein, 14 aa, Mycobacterium tuberculosis
VAVHYRNVADDSVD

SEQ ID NO: 156079 - protein, 14 aa, Mycobacterium tuberculosis
AVHYRNVADDSVDN

SEQ ID NO: 156080 - protein, 14 aa, Mycobacterium tuberculosis
VHYRNVADDSVDNL

SEQ ID NO: 156081 - protein, 14 aa, Mycobacterium tuberculosis
HYRNVADDSVDNLI

SEQ ID NO: 156082 - protein, 14 aa, Mycobacterium tuberculosis
YRNVADDSVDNLIA

SEQ ID NO: 156083 - protein, 14 aa, Mycobacterium tuberculosis
RNVADDSVDNLIAA

SEQ ID NO: 156084 - protein, 14 aa, Mycobacterium tuberculosis
NVADDSVDNLIAAV

SEQ ID NO: 156085 - protein, 14 aa, Mycobacterium tuberculosis
VADDSVDNLIAAVR

SEQ ID NO: 156086 - protein, 14 aa, Mycobacterium tuberculosis
ADDSVDNLIAAVRR

SEQ ID NO: 156087 - protein, 14 aa, Mycobacterium tuberculosis
DDSVDNLIAAVRRL

SEQ ID NO: 156088 - protein, 14 aa, Mycobacterium tuberculosis
DSVDNLIAAVRRLG

SEQ ID NO: 156089 - protein, 14 aa, Mycobacterium tuberculosis
SVDNLIAAVRRLGH

SEQ ID NO: 156090 - protein, 14 aa, Mycobacterium tuberculosis
VDNLIAAVRRLGHA

SEQ ID NO: 156091 - protein, 14 aa, Mycobacterium tuberculosis
DNLIAAVRRLGHAA

SEQ ID NO: 156092 - protein, 14 aa, Mycobacterium tuberculosis
NLIAAVRRLGHAAG

SEQ ID NO: 156093 - protein, 14 aa, Mycobacterium tuberculosis
LIAAVRRLGHAAGL

SEQ ID NO: 156094 - protein, 14 aa, Mycobacterium tuberculosis
IAAVRRLGHAAGLR

SEQ ID NO: 156095 - protein, 14 aa, Mycobacterium tuberculosis
AAVRRLGHAAGLRV

SEQ ID NO: 156096 - protein, 14 aa, Mycobacterium tuberculosis
AVRRLGHAAGLRVT

SEQ ID NO: 156097 - protein, 14 aa, Mycobacterium tuberculosis
VRRLGHAAGLRVTT

SEQ ID NO: 156098 - protein, 14 aa, Mycobacterium tuberculosis
RRLGHAAGLRVTTG

SEQ ID NO: 156099 - protein, 14 aa, Mycobacterium tuberculosis
RLGHAAGLRVTTGR

SEQ ID NO: 156100 - protein, 14 aa, Mycobacterium tuberculosis
LGHAAGLRVTTGRK

SEQ ID NO: 156101 - protein, 14 aa, Mycobacterium tuberculosis
GHAAGLRVTTGRKV

SEQ ID NO: 156102 - protein, 14 aa, Mycobacterium tuberculosis
HAAGLRVTTGRKVV

SEQ ID NO: 156103 - protein, 14 aa, Mycobacterium tuberculosis
AAGLRVTTGRKVVE

SEQ ID NO: 156104 - protein, 14 aa, Mycobacterium tuberculosis
AGLRVTTGRKVVEL

SEQ ID NO: 156105 - protein, 14 aa, Mycobacterium tuberculosis
GLRVTTGRKVVELR

SEQ ID NO: 156106 - protein, 14 aa, Mycobacterium tuberculosis
LRVTTGRKVVELRP

SEQ ID NO: 156107 - protein, 14 aa, Mycobacterium tuberculosis
RVTTGRKVVELRPD

SEQ ID NO: 156108 - protein, 14 aa, Mycobacterium tuberculosis
VTTGRKVVELRPDI

SEQ ID NO: 156109 - protein, 14 aa, Mycobacterium tuberculosis
TTGRKVVELRPDIA

SEQ ID NO: 156110 - protein, 14 aa, Mycobacterium tuberculosis
TGRKVVELRPDIAW

SEQ ID NO: 156111 - protein, 14 aa, Mycobacterium tuberculosis
GRKVVELRPDIAWD

SEQ ID NO: 156112 - protein, 14 aa, Mycobacterium tuberculosis
RKVVELRPDIAWDK

SEQ ID NO: 156113 - protein, 14 aa, Mycobacterium tuberculosis
KVVELRPDIAWDKG

SEQ ID NO: 156114 - protein, 14 aa, Mycobacterium tuberculosis
VVELRPDIAWDKGK

SEQ ID NO: 156115 - protein, 14 aa, Mycobacterium tuberculosis
VELRPDIAWDKGKA

SEQ ID NO: 156116 - protein, 14 aa, Mycobacterium tuberculosis
ELRPDIAWDKGKAL

SEQ ID NO: 156117 - protein, 14 aa, Mycobacterium tuberculosis
LRPDIAWDKGKALD

SEQ ID NO: 156118 - protein, 14 aa, Mycobacterium tuberculosis
RPDIAWDKGKALDW

SEQ ID NO: 156119 - protein, 14 aa, Mycobacterium tuberculosis
PDIAWDKGKALDWI

SEQ ID NO: 156120 - protein, 14 aa, Mycobacterium tuberculosis
DIAWDKGKALDWIG

SEQ ID NO: 156121 - protein, 14 aa, Mycobacterium tuberculosis
IAWDKGKALDWIGE

SEQ ID NO: 156122 - protein, 14 aa, Mycobacterium tuberculosis
AWDKGKALDWIGER

SEQ ID NO: 156123 - protein, 14 aa, Mycobacterium tuberculosis
WDKGKALDWIGERL

SEQ ID NO: 156124 - protein, 14 aa, Mycobacterium tuberculosis
DKGKALDWIGERLG

SEQ ID NO: 156125 - protein, 14 aa, Mycobacterium tuberculosis
KGKALDWIGERLGP

SEQ ID NO: 156126 - protein, 14 aa, Mycobacterium tuberculosis
GKALDWIGERLGPA

SEQ ID NO: 156127 - protein, 14 aa, Mycobacterium tuberculosis
KALDWIGERLGPAE

SEQ ID NO: 156128 - protein, 14 aa, Mycobacterium tuberculosis
ALDWIGERLGPAEV

SEQ ID NO: 156129 - protein, 14 aa, Mycobacterium tuberculosis
LDWIGERLGPAEVG

SEQ ID NO: 156130 - protein, 14 aa, Mycobacterium tuberculosis
DWIGERLGPAEVGP

SEQ ID NO: 156131 - protein, 14 aa, Mycobacterium tuberculosis
WIGERLGPAEVGPD

SEQ ID NO: 156132 - protein, 14 aa, Mycobacterium tuberculosis
IGERLGPAEVGPDL

SEQ ID NO: 156133 - protein, 14 aa, Mycobacterium tuberculosis
GERLGPAEVGPDLR

SEQ ID NO: 156134 - protein, 14 aa, Mycobacterium tuberculosis
ERLGPAEVGPDLRL

SEQ ID NO: 156135 - protein, 14 aa, Mycobacterium tuberculosis
RLGPAEVGPDLRLP

SEQ ID NO: 156136 - protein, 14 aa, Mycobacterium tuberculosis
LGPAEVGPDLRLPI

SEQ ID NO: 156137 - protein, 14 aa, Mycobacterium tuberculosis
GPAEVGPDLRLPIY

SEQ ID NO: 156138 - protein, 14 aa, Mycobacterium tuberculosis
PAEVGPDLRLPIYI

SEQ ID NO: 156139 - protein, 14 aa, Mycobacterium tuberculosis
AEVGPDLRLPIYIG

SEQ ID NO: 156140 - protein, 14 aa, Mycobacterium tuberculosis
EVGPDLRLPIYIGD

SEQ ID NO: 156141 - protein, 14 aa, Mycobacterium tuberculosis
VGPDLRLPIYIGDD

SEQ ID NO: 156142 - protein, 14 aa, Mycobacterium tuberculosis
GPDLRLPIYIGDDL

SEQ ID NO: 156143 - protein, 14 aa, Mycobacterium tuberculosis
PDLRLPIYIGDDLT

SEQ ID NO: 156144 - protein, 14 aa, Mycobacterium tuberculosis
DLRLPIYIGDDLTD

SEQ ID NO: 156145 - protein, 14 aa, Mycobacterium tuberculosis
LRLPIYIGDDLTDE

SEQ ID NO: 156146 - protein, 14 aa, Mycobacterium tuberculosis
RLPIYIGDDLTDED

SEQ ID NO: 156147 - protein, 14 aa, Mycobacterium tuberculosis
LPIYIGDDLTDEDA

SEQ ID NO: 156148 - protein, 14 aa, Mycobacterium tuberculosis
PIYIGDDLTDEDAF

SEQ ID NO: 156149 - protein, 14 aa, Mycobacterium tuberculosis
IYIGDDLTDEDAFD

SEQ ID NO: 156150 - protein, 14 aa, Mycobacterium tuberculosis
YIGDDLTDEDAFDA

SEQ ID NO: 156151 - protein, 14 aa, Mycobacterium tuberculosis
IGDDLTDEDAFDAV

SEQ ID NO: 156152 - protein, 14 aa, Mycobacterium tuberculosis
GDDLTDEDAFDAVR

SEQ ID NO: 156153 - protein, 14 aa, Mycobacterium tuberculosis
DDLTDEDAFDAVRF

SEQ ID NO: 156154 - protein, 14 aa, Mycobacterium tuberculosis
DLTDEDAFDAVRFT

SEQ ID NO: 156155 - protein, 14 aa, Mycobacterium tuberculosis
LTDEDAFDAVRFTG

SEQ ID NO: 156156 - protein, 14 aa, Mycobacterium tuberculosis
TDEDAFDAVRFTGV

SEQ ID NO: 156157 - protein, 14 aa, Mycobacterium tuberculosis
DEDAFDAVRFTGVG

SEQ ID NO: 156158 - protein, 14 aa, Mycobacterium tuberculosis
EDAFDAVRFTGVGI

SEQ ID NO: 156159 - protein, 14 aa, Mycobacterium tuberculosis
DAFDAVRFTGVGIV

SEQ ID NO: 156160 - protein, 14 aa, Mycobacterium tuberculosis
AFDAVRFTGVGIVV

SEQ ID NO: 156161 - protein, 14 aa, Mycobacterium tuberculosis
FDAVRFTGVGIVVR

SEQ ID NO: 156162 - protein, 14 aa, Mycobacterium tuberculosis
DAVRFTGVGIVVRH

SEQ ID NO: 156163 - protein, 14 aa, Mycobacterium tuberculosis
AVRFTGVGIVVRHN

SEQ ID NO: 156164 - protein, 14 aa, Mycobacterium tuberculosis
VRFTGVGIVVRHNE

SEQ ID NO: 156165 - protein, 14 aa, Mycobacterium tuberculosis
RFTGVGIVVRHNEH

SEQ ID NO: 156166 - protein, 14 aa, Mycobacterium tuberculosis
FTGVGIVVRHNEHG

SEQ ID NO: 156167 - protein, 14 aa, Mycobacterium tuberculosis
TGVGIVVRHNEHGD

SEQ ID NO: 156168 - protein, 14 aa, Mycobacterium tuberculosis
GVGIVVRHNEHGDR

SEQ ID NO: 156169 - protein, 14 aa, Mycobacterium tuberculosis
VGIVVRHNEHGDRR

SEQ ID NO: 156170 - protein, 14 aa, Mycobacterium tuberculosis
GIVVRHNEHGDRRS

SEQ ID NO: 156171 - protein, 14 aa, Mycobacterium tuberculosis
IVVRHNEHGDRRSA

SEQ ID NO: 156172 - protein, 14 aa, Mycobacterium tuberculosis
VVRHNEHGDRRSAA

SEQ ID NO: 156173 - protein, 14 aa, Mycobacterium tuberculosis
VRHNEHGDRRSAAT

SEQ ID NO: 156174 - protein, 14 aa, Mycobacterium tuberculosis
RHNEHGDRRSAATF

SEQ ID NO: 156175 - protein, 14 aa, Mycobacterium tuberculosis
HNEHGDRRSAATFR

SEQ ID NO: 156176 - protein, 14 aa, Mycobacterium tuberculosis
NEHGDRRSAATFRL

SEQ ID NO: 156177 - protein, 14 aa, Mycobacterium tuberculosis
EHGDRRSAATFRLE

SEQ ID NO: 156178 - protein, 14 aa, Mycobacterium tuberculosis
HGDRRSAATFRLEC

SEQ ID NO: 156179 - protein, 14 aa, Mycobacterium tuberculosis
GDRRSAATFRLECP

SEQ ID NO: 156180 - protein, 14 aa, Mycobacterium tuberculosis
DRRSAATFRLECPY

SEQ ID NO: 156181 - protein, 14 aa, Mycobacterium tuberculosis
RRSAATFRLECPYT

SEQ ID NO: 156182 - protein, 14 aa, Mycobacterium tuberculosis
RSAATFRLECPYTV

SEQ ID NO: 156183 - protein, 14 aa, Mycobacterium tuberculosis
SAATFRLECPYTVC

SEQ ID NO: 156184 - protein, 14 aa, Mycobacterium tuberculosis
AATFRLECPYTVCQ

SEQ ID NO: 156185 - protein, 14 aa, Mycobacterium tuberculosis
ATFRLECPYTVCQF

SEQ ID NO: 156186 - protein, 14 aa, Mycobacterium tuberculosis
TFRLECPYTVCQFL

SEQ ID NO: 156187 - protein, 14 aa, Mycobacterium tuberculosis
FRLECPYTVCQFLS

SEQ ID NO: 156188 - protein, 14 aa, Mycobacterium tuberculosis
RLECPYTVCQFLSQ

SEQ ID NO: 156189 - protein, 14 aa, Mycobacterium tuberculosis
LECPYTVCQFLSQL

SEQ ID NO: 156190 - protein, 14 aa, Mycobacterium tuberculosis
ECPYTVCQFLSQLA

SEQ ID NO: 156191 - protein, 14 aa, Mycobacterium tuberculosis
CPYTVCQFLSQLAC

SEQ ID NO: 156192 - protein, 14 aa, Mycobacterium tuberculosis
PYTVCQFLSQLACD

SEQ ID NO: 156193 - protein, 14 aa, Mycobacterium tuberculosis
YTVCQFLSQLACDL

SEQ ID NO: 156194 - protein, 14 aa, Mycobacterium tuberculosis
TVCQFLSQLACDLQ

SEQ ID NO: 156195 - protein, 14 aa, Mycobacterium tuberculosis
VCQFLSQLACDLQE

SEQ ID NO: 156196 - protein, 14 aa, Mycobacterium tuberculosis
CQFLSQLACDLQEA

SEQ ID NO: 156197 - protein, 14 aa, Mycobacterium tuberculosis
QFLSQLACDLQEAV

SEQ ID NO: 156198 - protein, 14 aa, Mycobacterium tuberculosis
FLSQLACDLQEAVQ

SEQ ID NO: 156199 - protein, 14 aa, Mycobacterium tuberculosis
LSQLACDLQEAVQH

SEQ ID NO: 156200 - protein, 14 aa, Mycobacterium tuberculosis
SQLACDLQEAVQHD

SEQ ID NO: 156201 - protein, 14 aa, Mycobacterium tuberculosis
QLACDLQEAVQHDD

SEQ ID NO: 156202 - protein, 14 aa, Mycobacterium tuberculosis
LACDLQEAVQHDDP

SEQ ID NO: 156203 - protein, 14 aa, Mycobacterium tuberculosis
ACDLQEAVQHDDPW

SEQ ID NO: 156204 - protein, 14 aa, Mycobacterium tuberculosis
CDLQEAVQHDDPWT

SEQ ID NO: 156205 - protein, 14 aa, Mycobacterium tuberculosis
DLQEAVQHDDPWTL

SEQ ID NO: 156206 - protein, 14 aa, Mycobacterium tuberculosis
LQEAVQHDDPWTLV

SEQ ID NO: 156207 - protein, 14 aa, Mycobacterium tuberculosis
QEAVQHDDPWTLVF

SEQ ID NO: 156208 - protein, 14 aa, Mycobacterium tuberculosis
EAVQHDDPWTLVFH

SEQ ID NO: 156209 - protein, 14 aa, Mycobacterium tuberculosis
AVQHDDPWTLVFHG

SEQ ID NO: 156210 - protein, 14 aa, Mycobacterium tuberculosis
VQHDDPWTLVFHGY

SEQ ID NO: 156211 - protein, 14 aa, Mycobacterium tuberculosis
QHDDPWTLVFHGYD

SEQ ID NO: 156212 - protein, 14 aa, Mycobacterium tuberculosis
HDDPWTLVFHGYDP

SEQ ID NO: 156213 - protein, 14 aa, Mycobacterium tuberculosis
DDPWTLVFHGYDPG

SEQ ID NO: 156214 - protein, 14 aa, Mycobacterium tuberculosis
DPWTLVFHGYDPGQ

SEQ ID NO: 156215 - protein, 14 aa, Mycobacterium tuberculosis
PWTLVFHGYDPGQE

SEQ ID NO: 156216 - protein, 14 aa, Mycobacterium tuberculosis
WTLVFHGYDPGQER

SEQ ID NO: 156217 - protein, 14 aa, Mycobacterium tuberculosis
TLVFHGYDPGQERL

SEQ ID NO: 156218 - protein, 14 aa, Mycobacterium tuberculosis
LVFHGYDPGQERLR

SEQ ID NO: 156219 - protein, 14 aa, Mycobacterium tuberculosis
VFHGYDPGQERLRE

SEQ ID NO: 156220 - protein, 14 aa, Mycobacterium tuberculosis
FHGYDPGQERLREA

SEQ ID NO: 156221 - protein, 14 aa, Mycobacterium tuberculosis
HGYDPGQERLREAL

SEQ ID NO: 156222 - protein, 14 aa, Mycobacterium tuberculosis
GYDPGQERLREALC

SEQ ID NO: 156223 - protein, 14 aa, Mycobacterium tuberculosis
YDPGQERLREALCA

SEQ ID NO: 156224 - protein, 14 aa, Mycobacterium tuberculosis
DPGQERLREALCAV

SEQ ID NO: 156225 - protein, 14 aa, Mycobacterium tuberculosis
PGQERLREALCAVG

SEQ ID NO: 156226 - protein, 14 aa, Mycobacterium tuberculosis
GQERLREALCAVGN

SEQ ID NO: 156227 - protein, 14 aa, Mycobacterium tuberculosis
QERLREALCAVGNG

SEQ ID NO: 156228 - protein, 14 aa, Mycobacterium tuberculosis
ERLREALCAVGNGY

SEQ ID NO: 156229 - protein, 14 aa, Mycobacterium tuberculosis
RLREALCAVGNGYL

SEQ ID NO: 156230 - protein, 14 aa, Mycobacterium tuberculosis
LREALCAVGNGYLG

SEQ ID NO: 156231 - protein, 14 aa, Mycobacterium tuberculosis
REALCAVGNGYLGS

SEQ ID NO: 156232 - protein, 14 aa, Mycobacterium tuberculosis
EALCAVGNGYLGSR

SEQ ID NO: 156233 - protein, 14 aa, Mycobacterium tuberculosis
ALCAVGNGYLGSRG

SEQ ID NO: 156234 - protein, 14 aa, Mycobacterium tuberculosis
LCAVGNGYLGSRGC

SEQ ID NO: 156235 - protein, 14 aa, Mycobacterium tuberculosis
CAVGNGYLGSRGCA

SEQ ID NO: 156236 - protein, 14 aa, Mycobacterium tuberculosis
AVGNGYLGSRGCAP

SEQ ID NO: 156237 - protein, 14 aa, Mycobacterium tuberculosis
VGNGYLGSRGCAPE

SEQ ID NO: 156238 - protein, 14 aa, Mycobacterium tuberculosis
GNGYLGSRGCAPES

SEQ ID NO: 156239 - protein, 14 aa, Mycobacterium tuberculosis
NGYLGSRGCAPESA

SEQ ID NO: 156240 - protein, 14 aa, Mycobacterium tuberculosis
GYLGSRGCAPESAE

SEQ ID NO: 156241 - protein, 14 aa, Mycobacterium tuberculosis
YLGSRGCAPESAES

SEQ ID NO: 156242 - protein, 14 aa, Mycobacterium tuberculosis
LGSRGCAPESAESE

SEQ ID NO: 156243 - protein, 14 aa, Mycobacterium tuberculosis
GSRGCAPESAESEA

SEQ ID NO: 156244 - protein, 14 aa, Mycobacterium tuberculosis
SRGCAPESAESEAH

SEQ ID NO: 156245 - protein, 14 aa, Mycobacterium tuberculosis
RGCAPESAESEAHY

SEQ ID NO: 156246 - protein, 14 aa, Mycobacterium tuberculosis
GCAPESAESEAHYP

SEQ ID NO: 156247 - protein, 14 aa, Mycobacterium tuberculosis
CAPESAESEAHYPG

SEQ ID NO: 156248 - protein, 14 aa, Mycobacterium tuberculosis
APESAESEAHYPGT

SEQ ID NO: 156249 - protein, 14 aa, Mycobacterium tuberculosis
PESAESEAHYPGTY

SEQ ID NO: 156250 - protein, 14 aa, Mycobacterium tuberculosis
ESAESEAHYPGTYV

SEQ ID NO: 156251 - protein, 14 aa, Mycobacterium tuberculosis
SAESEAHYPGTYVA

SEQ ID NO: 156252 - protein, 14 aa, Mycobacterium tuberculosis
AESEAHYPGTYVAG

SEQ ID NO: 156253 - protein, 14 aa, Mycobacterium tuberculosis
ESEAHYPGTYVAGV

SEQ ID NO: 156254 - protein, 14 aa, Mycobacterium tuberculosis
SEAHYPGTYVAGVY

SEQ ID NO: 156255 - protein, 14 aa, Mycobacterium tuberculosis
EAHYPGTYVAGVYN

SEQ ID NO: 156256 - protein, 14 aa, Mycobacterium tuberculosis
AHYPGTYVAGVYNQ

SEQ ID NO: 156257 - protein, 14 aa, Mycobacterium tuberculosis
HYPGTYVAGVYNQL

SEQ ID NO: 156258 - protein, 14 aa, Mycobacterium tuberculosis
YPGTYVAGVYNQLT

SEQ ID NO: 156259 - protein, 14 aa, Mycobacterium tuberculosis
PGTYVAGVYNQLTD

SEQ ID NO: 156260 - protein, 14 aa, Mycobacterium tuberculosis
GTYVAGVYNQLTDH

SEQ ID NO: 156261 - protein, 14 aa, Mycobacterium tuberculosis
TYVAGVYNQLTDHI

SEQ ID NO: 156262 - protein, 14 aa, Mycobacterium tuberculosis
YVAGVYNQLTDHIE

SEQ ID NO: 156263 - protein, 14 aa, Mycobacterium tuberculosis
VAGVYNQLTDHIEG

SEQ ID NO: 156264 - protein, 14 aa, Mycobacterium tuberculosis
AGVYNQLTDHIEGC

SEQ ID NO: 156265 - protein, 14 aa, Mycobacterium tuberculosis
GVYNQLTDHIEGCT

SEQ ID NO: 156266 - protein, 14 aa, Mycobacterium tuberculosis
VYNQLTDHIEGCTV

SEQ ID NO: 156267 - protein, 14 aa, Mycobacterium tuberculosis
YNQLTDHIEGCTVD

SEQ ID NO: 156268 - protein, 14 aa, Mycobacterium tuberculosis
NQLTDHIEGCTVDN

SEQ ID NO: 156269 - protein, 14 aa, Mycobacterium tuberculosis
QLTDHIEGCTVDNE

SEQ ID NO: 156270 - protein, 14 aa, Mycobacterium tuberculosis
LTDHIEGCTVDNES

SEQ ID NO: 156271 - protein, 14 aa, Mycobacterium tuberculosis
TDHIEGCTVDNESL

SEQ ID NO: 156272 - protein, 14 aa, Mycobacterium tuberculosis
DHIEGCTVDNESLV

SEQ ID NO: 156273 - protein, 14 aa, Mycobacterium tuberculosis
HIEGCTVDNESLVN

SEQ ID NO: 156274 - protein, 14 aa, Mycobacterium tuberculosis
IEGCTVDNESLVNL

SEQ ID NO: 156275 - protein, 14 aa, Mycobacterium tuberculosis
EGCTVDNESLVNLP

SEQ ID NO: 156276 - protein, 14 aa, Mycobacterium tuberculosis
GCTVDNESLVNLPN

SEQ ID NO: 156277 - protein, 14 aa, Mycobacterium tuberculosis
CTVDNESLVNLPNW

SEQ ID NO: 156278 - protein, 14 aa, Mycobacterium tuberculosis
TVDNESLVNLPNWL

SEQ ID NO: 156279 - protein, 14 aa, Mycobacterium tuberculosis
VDNESLVNLPNWLS

SEQ ID NO: 156280 - protein, 14 aa, Mycobacterium tuberculosis
DNESLVNLPNWLSL

SEQ ID NO: 156281 - protein, 14 aa, Mycobacterium tuberculosis
NESLVNLPNWLSLT

SEQ ID NO: 156282 - protein, 14 aa, Mycobacterium tuberculosis
ESLVNLPNWLSLTF

SEQ ID NO: 156283 - protein, 14 aa, Mycobacterium tuberculosis
SLVNLPNWLSLTFR

SEQ ID NO: 156284 - protein, 14 aa, Mycobacterium tuberculosis
LVNLPNWLSLTFRI

SEQ ID NO: 156285 - protein, 14 aa, Mycobacterium tuberculosis
VNLPNWLSLTFRID

SEQ ID NO: 156286 - protein, 14 aa, Mycobacterium tuberculosis
NLPNWLSLTFRIDG

SEQ ID NO: 156287 - protein, 14 aa, Mycobacterium tuberculosis
LPNWLSLTFRIDGG

SEQ ID NO: 156288 - protein, 14 aa, Mycobacterium tuberculosis
PNWLSLTFRIDGGA

SEQ ID NO: 156289 - protein, 14 aa, Mycobacterium tuberculosis
NWLSLTFRIDGGAW

SEQ ID NO: 156290 - protein, 14 aa, Mycobacterium tuberculosis
WLSLTFRIDGGAWF

SEQ ID NO: 156291 - protein, 14 aa, Mycobacterium tuberculosis
LSLTFRIDGGAWFN

SEQ ID NO: 156292 - protein, 14 aa, Mycobacterium tuberculosis
SLTFRIDGGAWFNV

SEQ ID NO: 156293 - protein, 14 aa, Mycobacterium tuberculosis
LTFRIDGGAWFNVD

SEQ ID NO: 156294 - protein, 14 aa, Mycobacterium tuberculosis
TFRIDGGAWFNVDT

SEQ ID NO: 156295 - protein, 14 aa, Mycobacterium tuberculosis
FRIDGGAWFNVDTV

SEQ ID NO: 156296 - protein, 14 aa, Mycobacterium tuberculosis
RIDGGAWFNVDTVE

SEQ ID NO: 156297 - protein, 14 aa, Mycobacterium tuberculosis
IDGGAWFNVDTVEL

SEQ ID NO: 156298 - protein, 14 aa, Mycobacterium tuberculosis
DGGAWFNVDTVELL

SEQ ID NO: 156299 - protein, 14 aa, Mycobacterium tuberculosis
GGAWFNVDTVELLS

SEQ ID NO: 156300 - protein, 14 aa, Mycobacterium tuberculosis
GAWFNVDTVELLSY

SEQ ID NO: 156301 - protein, 14 aa, Mycobacterium tuberculosis
AWFNVDTVELLSYR

SEQ ID NO: 156302 - protein, 14 aa, Mycobacterium tuberculosis
WFNVDTVELLSYRQ

SEQ ID NO: 156303 - protein, 14 aa, Mycobacterium tuberculosis
FNVDTVELLSYRQT

SEQ ID NO: 156304 - protein, 14 aa, Mycobacterium tuberculosis
NVDTVELLSYRQTF

SEQ ID NO: 156305 - protein, 14 aa, Mycobacterium tuberculosis
VDTVELLSYRQTFD

SEQ ID NO: 156306 - protein, 14 aa, Mycobacterium tuberculosis
DTVELLSYRQTFDL

SEQ ID NO: 156307 - protein, 14 aa, Mycobacterium tuberculosis
TVELLSYRQTFDLR

SEQ ID NO: 156308 - protein, 14 aa, Mycobacterium tuberculosis
VELLSYRQTFDLRR

SEQ ID NO: 156309 - protein, 14 aa, Mycobacterium tuberculosis
ELLSYRQTFDLRRA

SEQ ID NO: 156310 - protein, 14 aa, Mycobacterium tuberculosis
LLSYRQTFDLRRAT

SEQ ID NO: 156311 - protein, 14 aa, Mycobacterium tuberculosis
LSYRQTFDLRRATL

SEQ ID NO: 156312 - protein, 14 aa, Mycobacterium tuberculosis
SYRQTFDLRRATLT

SEQ ID NO: 156313 - protein, 14 aa, Mycobacterium tuberculosis
YRQTFDLRRATLTR

SEQ ID NO: 156314 - protein, 14 aa, Mycobacterium tuberculosis
RQTFDLRRATLTRS

SEQ ID NO: 156315 - protein, 14 aa, Mycobacterium tuberculosis
QTFDLRRATLTRSL

SEQ ID NO: 156316 - protein, 14 aa, Mycobacterium tuberculosis
TFDLRRATLTRSLR

SEQ ID NO: 156317 - protein, 14 aa, Mycobacterium tuberculosis
FDLRRATLTRSLRF

SEQ ID NO: 156318 - protein, 14 aa, Mycobacterium tuberculosis
DLRRATLTRSLRFR

SEQ ID NO: 156319 - protein, 14 aa, Mycobacterium tuberculosis
LRRATLTRSLRFRD

SEQ ID NO: 156320 - protein, 14 aa, Mycobacterium tuberculosis
RRATLTRSLRFRDA

SEQ ID NO: 156321 - protein, 14 aa, Mycobacterium tuberculosis
RATLTRSLRFRDAG

SEQ ID NO: 156322 - protein, 14 aa, Mycobacterium tuberculosis
ATLTRSLRFRDAGG

SEQ ID NO: 156323 - protein, 14 aa, Mycobacterium tuberculosis
TLTRSLRFRDAGGR

SEQ ID NO: 156324 - protein, 14 aa, Mycobacterium tuberculosis
LTRSLRFRDAGGRV

SEQ ID NO: 156325 - protein, 14 aa, Mycobacterium tuberculosis
TRSLRFRDAGGRVT

SEQ ID NO: 156326 - protein, 14 aa, Mycobacterium tuberculosis
RSLRFRDAGGRVTT

SEQ ID NO: 156327 - protein, 14 aa, Mycobacterium tuberculosis
SLRFRDAGGRVTTM

SEQ ID NO: 156328 - protein, 14 aa, Mycobacterium tuberculosis
LRFRDAGGRVTTMT

SEQ ID NO: 156329 - protein, 14 aa, Mycobacterium tuberculosis
RFRDAGGRVTTMTQ

SEQ ID NO: 156330 - protein, 14 aa, Mycobacterium tuberculosis
FRDAGGRVTTMTQE

SEQ ID NO: 156331 - protein, 14 aa, Mycobacterium tuberculosis
RDAGGRVTTMTQER

SEQ ID NO: 156332 - protein, 14 aa, Mycobacterium tuberculosis
DAGGRVTTMTQERF

SEQ ID NO: 156333 - protein, 14 aa, Mycobacterium tuberculosis
AGGRVTTMTQERFA

SEQ ID NO: 156334 - protein, 14 aa, Mycobacterium tuberculosis
GGRVTTMTQERFAS

SEQ ID NO: 156335 - protein, 14 aa, Mycobacterium tuberculosis
GRVTTMTQERFASM

SEQ ID NO: 156336 - protein, 14 aa, Mycobacterium tuberculosis
RVTTMTQERFASMN

SEQ ID NO: 156337 - protein, 14 aa, Mycobacterium tuberculosis
VTTMTQERFASMNR

SEQ ID NO: 156338 - protein, 14 aa, Mycobacterium tuberculosis
TTMTQERFASMNRP

SEQ ID NO: 156339 - protein, 14 aa, Mycobacterium tuberculosis
TMTQERFASMNRPN

SEQ ID NO: 156340 - protein, 14 aa, Mycobacterium tuberculosis
MTQERFASMNRPNL

SEQ ID NO: 156341 - protein, 14 aa, Mycobacterium tuberculosis
TQERFASMNRPNLV

SEQ ID NO: 156342 - protein, 14 aa, Mycobacterium tuberculosis
QERFASMNRPNLVA

SEQ ID NO: 156343 - protein, 14 aa, Mycobacterium tuberculosis
ERFASMNRPNLVAL

SEQ ID NO: 156344 - protein, 14 aa, Mycobacterium tuberculosis
RFASMNRPNLVALQ

SEQ ID NO: 156345 - protein, 14 aa, Mycobacterium tuberculosis
FASMNRPNLVALQT

SEQ ID NO: 156346 - protein, 14 aa, Mycobacterium tuberculosis
ASMNRPNLVALQTR

SEQ ID NO: 156347 - protein, 14 aa, Mycobacterium tuberculosis
SMNRPNLVALQTRI

SEQ ID NO: 156348 - protein, 14 aa, Mycobacterium tuberculosis
MNRPNLVALQTRIE

SEQ ID NO: 156349 - protein, 14 aa, Mycobacterium tuberculosis
NRPNLVALQTRIES

SEQ ID NO: 156350 - protein, 14 aa, Mycobacterium tuberculosis
RPNLVALQTRIESE

SEQ ID NO: 156351 - protein, 14 aa, Mycobacterium tuberculosis
PNLVALQTRIESEN

SEQ ID NO: 156352 - protein, 14 aa, Mycobacterium tuberculosis
NLVALQTRIESENW

SEQ ID NO: 156353 - protein, 14 aa, Mycobacterium tuberculosis
LVALQTRIESENWS

SEQ ID NO: 156354 - protein, 14 aa, Mycobacterium tuberculosis
VALQTRIESENWSG

SEQ ID NO: 156355 - protein, 14 aa, Mycobacterium tuberculosis
ALQTRIESENWSGT

SEQ ID NO: 156356 - protein, 14 aa, Mycobacterium tuberculosis
LQTRIESENWSGTV

SEQ ID NO: 156357 - protein, 14 aa, Mycobacterium tuberculosis
QTRIESENWSGTVD

SEQ ID NO: 156358 - protein, 14 aa, Mycobacterium tuberculosis
TRIESENWSGTVDF

SEQ ID NO: 156359 - protein, 14 aa, Mycobacterium tuberculosis
RIESENWSGTVDFR

SEQ ID NO: 156360 - protein, 14 aa, Mycobacterium tuberculosis
IESENWSGTVDFRS

SEQ ID NO: 156361 - protein, 14 aa, Mycobacterium tuberculosis
ESENWSGTVDFRSL

SEQ ID NO: 156362 - protein, 14 aa, Mycobacterium tuberculosis
SENWSGTVDFRSLV

SEQ ID NO: 156363 - protein, 14 aa, Mycobacterium tuberculosis
ENWSGTVDFRSLVD

SEQ ID NO: 156364 - protein, 14 aa, Mycobacterium tuberculosis
NWSGTVDFRSLVDG

SEQ ID NO: 156365 - protein, 14 aa, Mycobacterium tuberculosis
WSGTVDFRSLVDGG

SEQ ID NO: 156366 - protein, 14 aa, Mycobacterium tuberculosis
SGTVDFRSLVDGGV

SEQ ID NO: 156367 - protein, 14 aa, Mycobacterium tuberculosis
GTVDFRSLVDGGVH

SEQ ID NO: 156368 - protein, 14 aa, Mycobacterium tuberculosis
TVDFRSLVDGGVHN

SEQ ID NO: 156369 - protein, 14 aa, Mycobacterium tuberculosis
VDFRSLVDGGVHNT

SEQ ID NO: 156370 - protein, 14 aa, Mycobacterium tuberculosis
DFRSLVDGGVHNTL

SEQ ID NO: 156371 - protein, 14 aa, Mycobacterium tuberculosis
FRSLVDGGVHNTLV

SEQ ID NO: 156372 - protein, 14 aa, Mycobacterium tuberculosis
RSLVDGGVHNTLVD

SEQ ID NO: 156373 - protein, 14 aa, Mycobacterium tuberculosis
SLVDGGVHNTLVDR

SEQ ID NO: 156374 - protein, 14 aa, Mycobacterium tuberculosis
LVDGGVHNTLVDRY

SEQ ID NO: 156375 - protein, 14 aa, Mycobacterium tuberculosis
VDGGVHNTLVDRYR

SEQ ID NO: 156376 - protein, 14 aa, Mycobacterium tuberculosis
DGGVHNTLVDRYRQ

SEQ ID NO: 156377 - protein, 14 aa, Mycobacterium tuberculosis
GGVHNTLVDRYRQL

SEQ ID NO: 156378 - protein, 14 aa, Mycobacterium tuberculosis
GVHNTLVDRYRQLS

SEQ ID NO: 156379 - protein, 14 aa, Mycobacterium tuberculosis
VHNTLVDRYRQLSS

SEQ ID NO: 156380 - protein, 14 aa, Mycobacterium tuberculosis
HNTLVDRYRQLSSQ

SEQ ID NO: 156381 - protein, 14 aa, Mycobacterium tuberculosis
NTLVDRYRQLSSQH

SEQ ID NO: 156382 - protein, 14 aa, Mycobacterium tuberculosis
TLVDRYRQLSSQHL

SEQ ID NO: 156383 - protein, 14 aa, Mycobacterium tuberculosis
LVDRYRQLSSQHLT

SEQ ID NO: 156384 - protein, 14 aa, Mycobacterium tuberculosis
VDRYRQLSSQHLTT

SEQ ID NO: 156385 - protein, 14 aa, Mycobacterium tuberculosis
DRYRQLSSQHLTTA

SEQ ID NO: 156386 - protein, 14 aa, Mycobacterium tuberculosis
RYRQLSSQHLTTAE

SEQ ID NO: 156387 - protein, 14 aa, Mycobacterium tuberculosis
YRQLSSQHLTTAEI

SEQ ID NO: 156388 - protein, 14 aa, Mycobacterium tuberculosis
RQLSSQHLTTAEIE

SEQ ID NO: 156389 - protein, 14 aa, Mycobacterium tuberculosis
QLSSQHLTTAEIEV

SEQ ID NO: 156390 - protein, 14 aa, Mycobacterium tuberculosis
LSSQHLTTAEIEVL

SEQ ID NO: 156391 - protein, 14 aa, Mycobacterium tuberculosis
SSQHLTTAEIEVLA

SEQ ID NO: 156392 - protein, 14 aa, Mycobacterium tuberculosis
SQHLTTAEIEVLAD

SEQ ID NO: 156393 - protein, 14 aa, Mycobacterium tuberculosis
QHLTTAEIEVLADS

SEQ ID NO: 156394 - protein, 14 aa, Mycobacterium tuberculosis
HLTTAEIEVLADSV

SEQ ID NO: 156395 - protein, 14 aa, Mycobacterium tuberculosis
LTTAEIEVLADSVL

SEQ ID NO: 156396 - protein, 14 aa, Mycobacterium tuberculosis
TTAEIEVLADSVLL

SEQ ID NO: 156397 - protein, 14 aa, Mycobacterium tuberculosis
TAEIEVLADSVLLR

SEQ ID NO: 156398 - protein, 14 aa, Mycobacterium tuberculosis
AEIEVLADSVLLRT

SEQ ID NO: 156399 - protein, 14 aa, Mycobacterium tuberculosis
EIEVLADSVLLRTQ

SEQ ID NO: 156400 - protein, 14 aa, Mycobacterium tuberculosis
IEVLADSVLLRTQT

SEQ ID NO: 156401 - protein, 14 aa, Mycobacterium tuberculosis
EVLADSVLLRTQTS

SEQ ID NO: 156402 - protein, 14 aa, Mycobacterium tuberculosis
VLADSVLLRTQTSQ

SEQ ID NO: 156403 - protein, 14 aa, Mycobacterium tuberculosis
LADSVLLRTQTSQS

SEQ ID NO: 156404 - protein, 14 aa, Mycobacterium tuberculosis
ADSVLLRTQTSQSG

SEQ ID NO: 156405 - protein, 14 aa, Mycobacterium tuberculosis
DSVLLRTQTSQSGI

SEQ ID NO: 156406 - protein, 14 aa, Mycobacterium tuberculosis
SVLLRTQTSQSGIA

SEQ ID NO: 156407 - protein, 14 aa, Mycobacterium tuberculosis
VLLRTQTSQSGIAI

SEQ ID NO: 156408 - protein, 14 aa, Mycobacterium tuberculosis
LLRTQTSQSGIAIA

SEQ ID NO: 156409 - protein, 14 aa, Mycobacterium tuberculosis
LRTQTSQSGIAIAV

SEQ ID NO: 156410 - protein, 14 aa, Mycobacterium tuberculosis
RTQTSQSGIAIAVA

SEQ ID NO: 156411 - protein, 14 aa, Mycobacterium tuberculosis
TQTSQSGIAIAVAA

SEQ ID NO: 156412 - protein, 14 aa, Mycobacterium tuberculosis
QTSQSGIAIAVAAR

SEQ ID NO: 156413 - protein, 14 aa, Mycobacterium tuberculosis
TSQSGIAIAVAARS

SEQ ID NO: 156414 - protein, 14 aa, Mycobacterium tuberculosis
SQSGIAIAVAARST

SEQ ID NO: 156415 - protein, 14 aa, Mycobacterium tuberculosis
QSGIAIAVAARSTL

SEQ ID NO: 156416 - protein, 14 aa, Mycobacterium tuberculosis
SGIAIAVAARSTLW

SEQ ID NO: 156417 - protein, 14 aa, Mycobacterium tuberculosis
GIAIAVAARSTLWR

SEQ ID NO: 156418 - protein, 14 aa, Mycobacterium tuberculosis
IAIAVAARSTLWRD

SEQ ID NO: 156419 - protein, 14 aa, Mycobacterium tuberculosis
AIAVAARSTLWRDG

SEQ ID NO: 156420 - protein, 14 aa, Mycobacterium tuberculosis
IAVAARSTLWRDGQ

SEQ ID NO: 156421 - protein, 14 aa, Mycobacterium tuberculosis
AVAARSTLWRDGQR

SEQ ID NO: 156422 - protein, 14 aa, Mycobacterium tuberculosis
VAARSTLWRDGQRV

SEQ ID NO: 156423 - protein, 14 aa, Mycobacterium tuberculosis
AARSTLWRDGQRVD

SEQ ID NO: 156424 - protein, 14 aa, Mycobacterium tuberculosis
ARSTLWRDGQRVDA

SEQ ID NO: 156425 - protein, 14 aa, Mycobacterium tuberculosis
RSTLWRDGQRVDAQ

SEQ ID NO: 156426 - protein, 14 aa, Mycobacterium tuberculosis
STLWRDGQRVDAQY

SEQ ID NO: 156427 - protein, 14 aa, Mycobacterium tuberculosis
TLWRDGQRVDAQYR

SEQ ID NO: 156428 - protein, 14 aa, Mycobacterium tuberculosis
LWRDGQRVDAQYRV

SEQ ID NO: 156429 - protein, 14 aa, Mycobacterium tuberculosis
WRDGQRVDAQYRVA

SEQ ID NO: 156430 - protein, 14 aa, Mycobacterium tuberculosis
RDGQRVDAQYRVAR

SEQ ID NO: 156431 - protein, 14 aa, Mycobacterium tuberculosis
DGQRVDAQYRVARD

SEQ ID NO: 156432 - protein, 14 aa, Mycobacterium tuberculosis
GQRVDAQYRVARDT

SEQ ID NO: 156433 - protein, 14 aa, Mycobacterium tuberculosis
QRVDAQYRVARDTN

SEQ ID NO: 156434 - protein, 14 aa, Mycobacterium tuberculosis
RVDAQYRVARDTNR

SEQ ID NO: 156435 - protein, 14 aa, Mycobacterium tuberculosis
VDAQYRVARDTNRG

SEQ ID NO: 156436 - protein, 14 aa, Mycobacterium tuberculosis
DAQYRVARDTNRGG

SEQ ID NO: 156437 - protein, 14 aa, Mycobacterium tuberculosis
AQYRVARDTNRGGH

SEQ ID NO: 156438 - protein, 14 aa, Mycobacterium tuberculosis
QYRVARDTNRGGHD

SEQ ID NO: 156439 - protein, 14 aa, Mycobacterium tuberculosis
YRVARDTNRGGHDI

SEQ ID NO: 156440 - protein, 14 aa, Mycobacterium tuberculosis
RVARDTNRGGHDIQ

SEQ ID NO: 156441 - protein, 14 aa, Mycobacterium tuberculosis
VARDTNRGGHDIQV

SEQ ID NO: 156442 - protein, 14 aa, Mycobacterium tuberculosis
ARDTNRGGHDIQVT

SEQ ID NO: 156443 - protein, 14 aa, Mycobacterium tuberculosis
RDTNRGGHDIQVTL

SEQ ID NO: 156444 - protein, 14 aa, Mycobacterium tuberculosis
DTNRGGHDIQVTLS

SEQ ID NO: 156445 - protein, 14 aa, Mycobacterium tuberculosis
TNRGGHDIQVTLSA

SEQ ID NO: 156446 - protein, 14 aa, Mycobacterium tuberculosis
NRGGHDIQVTLSAG

SEQ ID NO: 156447 - protein, 14 aa, Mycobacterium tuberculosis
RGGHDIQVTLSAGQ

SEQ ID NO: 156448 - protein, 14 aa, Mycobacterium tuberculosis
GGHDIQVTLSAGQS

SEQ ID NO: 156449 - protein, 14 aa, Mycobacterium tuberculosis
GHDIQVTLSAGQSV

SEQ ID NO: 156450 - protein, 14 aa, Mycobacterium tuberculosis
HDIQVTLSAGQSVT

SEQ ID NO: 156451 - protein, 14 aa, Mycobacterium tuberculosis
DIQVTLSAGQSVTL

SEQ ID NO: 156452 - protein, 14 aa, Mycobacterium tuberculosis
IQVTLSAGQSVTLE

SEQ ID NO: 156453 - protein, 14 aa, Mycobacterium tuberculosis
QVTLSAGQSVTLEK

SEQ ID NO: 156454 - protein, 14 aa, Mycobacterium tuberculosis
VTLSAGQSVTLEKV

SEQ ID NO: 156455 - protein, 14 aa, Mycobacterium tuberculosis
TLSAGQSVTLEKVA

SEQ ID NO: 156456 - protein, 14 aa, Mycobacterium tuberculosis
LSAGQSVTLEKVAT

SEQ ID NO: 156457 - protein, 14 aa, Mycobacterium tuberculosis
SAGQSVTLEKVATI

SEQ ID NO: 156458 - protein, 14 aa, Mycobacterium tuberculosis
AGQSVTLEKVATIF

SEQ ID NO: 156459 - protein, 14 aa, Mycobacterium tuberculosis
GQSVTLEKVATIFT

SEQ ID NO: 156460 - protein, 14 aa, Mycobacterium tuberculosis
QSVTLEKVATIFTS

SEQ ID NO: 156461 - protein, 14 aa, Mycobacterium tuberculosis
SVTLEKVATIFTSR

SEQ ID NO: 156462 - protein, 14 aa, Mycobacterium tuberculosis
VTLEKVATIFTSRD

SEQ ID NO: 156463 - protein, 14 aa, Mycobacterium tuberculosis
TLEKVATIFTSRDA

SEQ ID NO: 156464 - protein, 14 aa, Mycobacterium tuberculosis
LEKVATIFTSRDAA

SEQ ID NO: 156465 - protein, 14 aa, Mycobacterium tuberculosis
EKVATIFTSRDAAT

SEQ ID NO: 156466 - protein, 14 aa, Mycobacterium tuberculosis
KVATIFTSRDAATL

SEQ ID NO: 156467 - protein, 14 aa, Mycobacterium tuberculosis
VATIFTSRDAATLT

SEQ ID NO: 156468 - protein, 14 aa, Mycobacterium tuberculosis
ATIFTSRDAATLTA

SEQ ID NO: 156469 - protein, 14 aa, Mycobacterium tuberculosis
TIFTSRDAATLTAA

SEQ ID NO: 156470 - protein, 14 aa, Mycobacterium tuberculosis
IFTSRDAATLTAAI

SEQ ID NO: 156471 - protein, 14 aa, Mycobacterium tuberculosis
FTSRDAATLTAAIS

SEQ ID NO: 156472 - protein, 14 aa, Mycobacterium tuberculosis
TSRDAATLTAAISA

SEQ ID NO: 156473 - protein, 14 aa, Mycobacterium tuberculosis
SRDAATLTAAISAQ

SEQ ID NO: 156474 - protein, 14 aa, Mycobacterium tuberculosis
RDAATLTAAISAQR

SEQ ID NO: 156475 - protein, 14 aa, Mycobacterium tuberculosis
DAATLTAAISAQRC

SEQ ID NO: 156476 - protein, 14 aa, Mycobacterium tuberculosis
AATLTAAISAQRCL

SEQ ID NO: 156477 - protein, 14 aa, Mycobacterium tuberculosis
ATLTAAISAQRCLG

SEQ ID NO: 156478 - protein, 14 aa, Mycobacterium tuberculosis
TLTAAISAQRCLGE

SEQ ID NO: 156479 - protein, 14 aa, Mycobacterium tuberculosis
LTAAISAQRCLGEA

SEQ ID NO: 156480 - protein, 14 aa, Mycobacterium tuberculosis
TAAISAQRCLGEAG

SEQ ID NO: 156481 - protein, 14 aa, Mycobacterium tuberculosis
AAISAQRCLGEAGR

SEQ ID NO: 156482 - protein, 14 aa, Mycobacterium tuberculosis
AISAQRCLGEAGRY

SEQ ID NO: 156483 - protein, 14 aa, Mycobacterium tuberculosis
ISAQRCLGEAGRYA

SEQ ID NO: 156484 - protein, 14 aa, Mycobacterium tuberculosis
SAQRCLGEAGRYAE

SEQ ID NO: 156485 - protein, 14 aa, Mycobacterium tuberculosis
AQRCLGEAGRYAEL

SEQ ID NO: 156486 - protein, 14 aa, Mycobacterium tuberculosis
QRCLGEAGRYAELC

SEQ ID NO: 156487 - protein, 14 aa, Mycobacterium tuberculosis
RCLGEAGRYAELCQ

SEQ ID NO: 156488 - protein, 14 aa, Mycobacterium tuberculosis
CLGEAGRYAELCQQ

SEQ ID NO: 156489 - protein, 14 aa, Mycobacterium tuberculosis
LGEAGRYAELCQQH

SEQ ID NO: 156490 - protein, 14 aa, Mycobacterium tuberculosis
GEAGRYAELCQQHV

SEQ ID NO: 156491 - protein, 14 aa, Mycobacterium tuberculosis
EAGRYAELCQQHVR

SEQ ID NO: 156492 - protein, 14 aa, Mycobacterium tuberculosis
AGRYAELCQQHVRA

SEQ ID NO: 156493 - protein, 14 aa, Mycobacterium tuberculosis
GRYAELCQQHVRAW

SEQ ID NO: 156494 - protein, 14 aa, Mycobacterium tuberculosis
RYAELCQQHVRAWA

SEQ ID NO: 156495 - protein, 14 aa, Mycobacterium tuberculosis
YAELCQQHVRAWAR

SEQ ID NO: 156496 - protein, 14 aa, Mycobacterium tuberculosis
AELCQQHVRAWARL

SEQ ID NO: 156497 - protein, 14 aa, Mycobacterium tuberculosis
ELCQQHVRAWARLW

SEQ ID NO: 156498 - protein, 14 aa, Mycobacterium tuberculosis
LCQQHVRAWARLWE

SEQ ID NO: 156499 - protein, 14 aa, Mycobacterium tuberculosis
CQQHVRAWARLWER

SEQ ID NO: 156500 - protein, 14 aa, Mycobacterium tuberculosis
QQHVRAWARLWERC

SEQ ID NO: 156501 - protein, 14 aa, Mycobacterium tuberculosis
QHVRAWARLWERCA

SEQ ID NO: 156502 - protein, 14 aa, Mycobacterium tuberculosis
HVRAWARLWERCAI

SEQ ID NO: 156503 - protein, 14 aa, Mycobacterium tuberculosis
VRAWARLWERCAID

SEQ ID NO: 156504 - protein, 14 aa, Mycobacterium tuberculosis
RAWARLWERCAIDL

SEQ ID NO: 156505 - protein, 14 aa, Mycobacterium tuberculosis
AWARLWERCAIDLT

SEQ ID NO: 156506 - protein, 14 aa, Mycobacterium tuberculosis
WARLWERCAIDLTG

SEQ ID NO: 156507 - protein, 14 aa, Mycobacterium tuberculosis
ARLWERCAIDLTGN

SEQ ID NO: 156508 - protein, 14 aa, Mycobacterium tuberculosis
RLWERCAIDLTGNT

SEQ ID NO: 156509 - protein, 14 aa, Mycobacterium tuberculosis
LWERCAIDLTGNTE

SEQ ID NO: 156510 - protein, 14 aa, Mycobacterium tuberculosis
WERCAIDLTGNTEE

SEQ ID NO: 156511 - protein, 14 aa, Mycobacterium tuberculosis
ERCAIDLTGNTEEL

SEQ ID NO: 156512 - protein, 14 aa, Mycobacterium tuberculosis
RCAIDLTGNTEELR

SEQ ID NO: 156513 - protein, 14 aa, Mycobacterium tuberculosis
CAIDLTGNTEELRL

SEQ ID NO: 156514 - protein, 14 aa, Mycobacterium tuberculosis
AIDLTGNTEELRLV

SEQ ID NO: 156515 - protein, 14 aa, Mycobacterium tuberculosis
IDLTGNTEELRLVR

SEQ ID NO: 156516 - protein, 14 aa, Mycobacterium tuberculosis
DLTGNTEELRLVRL

SEQ ID NO: 156517 - protein, 14 aa, Mycobacterium tuberculosis
LTGNTEELRLVRLH

SEQ ID NO: 156518 - protein, 14 aa, Mycobacterium tuberculosis
TGNTEELRLVRLHL

SEQ ID NO: 156519 - protein, 14 aa, Mycobacterium tuberculosis
GNTEELRLVRLHLL

SEQ ID NO: 156520 - protein, 14 aa, Mycobacterium tuberculosis
NTEELRLVRLHLLH

SEQ ID NO: 156521 - protein, 14 aa, Mycobacterium tuberculosis
TEELRLVRLHLLHL

SEQ ID NO: 156522 - protein, 14 aa, Mycobacterium tuberculosis
EELRLVRLHLLHLL

SEQ ID NO: 156523 - protein, 14 aa, Mycobacterium tuberculosis
ELRLVRLHLLHLLQ

SEQ ID NO: 156524 - protein, 14 aa, Mycobacterium tuberculosis
LRLVRLHLLHLLQT

SEQ ID NO: 156525 - protein, 14 aa, Mycobacterium tuberculosis
RLVRLHLLHLLQTI

SEQ ID NO: 156526 - protein, 14 aa, Mycobacterium tuberculosis
LVRLHLLHLLQTIS

SEQ ID NO: 156527 - protein, 14 aa, Mycobacterium tuberculosis
VRLHLLHLLQTISP

SEQ ID NO: 156528 - protein, 14 aa, Mycobacterium tuberculosis
RLHLLHLLQTISPH

SEQ ID NO: 156529 - protein, 14 aa, Mycobacterium tuberculosis
LHLLHLLQTISPHT

SEQ ID NO: 156530 - protein, 14 aa, Mycobacterium tuberculosis
HLLHLLQTISPHTA

SEQ ID NO: 156531 - protein, 14 aa, Mycobacterium tuberculosis
LLHLLQTISPHTAE

SEQ ID NO: 156532 - protein, 14 aa, Mycobacterium tuberculosis
LHLLQTISPHTAEL

SEQ ID NO: 156533 - protein, 14 aa, Mycobacterium tuberculosis
HLLQTISPHTAELD

SEQ ID NO: 156534 - protein, 14 aa, Mycobacterium tuberculosis
LLQTISPHTAELDA

SEQ ID NO: 156535 - protein, 14 aa, Mycobacterium tuberculosis
LQTISPHTAELDAG

SEQ ID NO: 156536 - protein, 14 aa, Mycobacterium tuberculosis
QTISPHTAELDAGV

SEQ ID NO: 156537 - protein, 14 aa, Mycobacterium tuberculosis
TISPHTAELDAGVP

SEQ ID NO: 156538 - protein, 14 aa, Mycobacterium tuberculosis
ISPHTAELDAGVPA

SEQ ID NO: 156539 - protein, 14 aa, Mycobacterium tuberculosis
SPHTAELDAGVPAR

SEQ ID NO: 156540 - protein, 14 aa, Mycobacterium tuberculosis
PHTAELDAGVPARG

SEQ ID NO: 156541 - protein, 14 aa, Mycobacterium tuberculosis
HTAELDAGVPARGL

SEQ ID NO: 156542 - protein, 14 aa, Mycobacterium tuberculosis
TAELDAGVPARGLN

SEQ ID NO: 156543 - protein, 14 aa, Mycobacterium tuberculosis
AELDAGVPARGLNG

SEQ ID NO: 156544 - protein, 14 aa, Mycobacterium tuberculosis
ELDAGVPARGLNGE

SEQ ID NO: 156545 - protein, 14 aa, Mycobacterium tuberculosis
LDAGVPARGLNGEA

SEQ ID NO: 156546 - protein, 14 aa, Mycobacterium tuberculosis
DAGVPARGLNGEAY

SEQ ID NO: 156547 - protein, 14 aa, Mycobacterium tuberculosis
AGVPARGLNGEAYR

SEQ ID NO: 156548 - protein, 14 aa, Mycobacterium tuberculosis
GVPARGLNGEAYRG

SEQ ID NO: 156549 - protein, 14 aa, Mycobacterium tuberculosis
VPARGLNGEAYRGH

SEQ ID NO: 156550 - protein, 14 aa, Mycobacterium tuberculosis
PARGLNGEAYRGHV

SEQ ID NO: 156551 - protein, 14 aa, Mycobacterium tuberculosis
ARGLNGEAYRGHVF

SEQ ID NO: 156552 - protein, 14 aa, Mycobacterium tuberculosis
RGLNGEAYRGHVFW

SEQ ID NO: 156553 - protein, 14 aa, Mycobacterium tuberculosis
GLNGEAYRGHVFWD

SEQ ID NO: 156554 - protein, 14 aa, Mycobacterium tuberculosis
LNGEAYRGHVFWDA

SEQ ID NO: 156555 - protein, 14 aa, Mycobacterium tuberculosis
NGEAYRGHVFWDAL

SEQ ID NO: 156556 - protein, 14 aa, Mycobacterium tuberculosis
GEAYRGHVFWDALF

SEQ ID NO: 156557 - protein, 14 aa, Mycobacterium tuberculosis
EAYRGHVFWDALFV

SEQ ID NO: 156558 - protein, 14 aa, Mycobacterium tuberculosis
AYRGHVFWDALFVA

SEQ ID NO: 156559 - protein, 14 aa, Mycobacterium tuberculosis
YRGHVFWDALFVAP

SEQ ID NO: 156560 - protein, 14 aa, Mycobacterium tuberculosis
RGHVFWDALFVAPV

SEQ ID NO: 156561 - protein, 14 aa, Mycobacterium tuberculosis
GHVFWDALFVAPVL

SEQ ID NO: 156562 - protein, 14 aa, Mycobacterium tuberculosis
HVFWDALFVAPVLS

SEQ ID NO: 156563 - protein, 14 aa, Mycobacterium tuberculosis
VFWDALFVAPVLSL

SEQ ID NO: 156564 - protein, 14 aa, Mycobacterium tuberculosis
FWDALFVAPVLSLR

SEQ ID NO: 156565 - protein, 14 aa, Mycobacterium tuberculosis
WDALFVAPVLSLRM

SEQ ID NO: 156566 - protein, 14 aa, Mycobacterium tuberculosis
DALFVAPVLSLRMP

SEQ ID NO: 156567 - protein, 14 aa, Mycobacterium tuberculosis
ALFVAPVLSLRMPK

SEQ ID NO: 156568 - protein, 14 aa, Mycobacterium tuberculosis
LFVAPVLSLRMPKV

SEQ ID NO: 156569 - protein, 14 aa, Mycobacterium tuberculosis
FVAPVLSLRMPKVA

SEQ ID NO: 156570 - protein, 14 aa, Mycobacterium tuberculosis
VAPVLSLRMPKVAR

SEQ ID NO: 156571 - protein, 14 aa, Mycobacterium tuberculosis
APVLSLRMPKVARS

SEQ ID NO: 156572 - protein, 14 aa, Mycobacterium tuberculosis
PVLSLRMPKVARSL

SEQ ID NO: 156573 - protein, 14 aa, Mycobacterium tuberculosis
VLSLRMPKVARSLL

SEQ ID NO: 156574 - protein, 14 aa, Mycobacterium tuberculosis
LSLRMPKVARSLLD

SEQ ID NO: 156575 - protein, 14 aa, Mycobacterium tuberculosis
SLRMPKVARSLLDY

SEQ ID NO: 156576 - protein, 14 aa, Mycobacterium tuberculosis
LRMPKVARSLLDYR

SEQ ID NO: 156577 - protein, 14 aa, Mycobacterium tuberculosis
RMPKVARSLLDYRY

SEQ ID NO: 156578 - protein, 14 aa, Mycobacterium tuberculosis
MPKVARSLLDYRYR

SEQ ID NO: 156579 - protein, 14 aa, Mycobacterium tuberculosis
PKVARSLLDYRYRR

SEQ ID NO: 156580 - protein, 14 aa, Mycobacterium tuberculosis
KVARSLLDYRYRRL

SEQ ID NO: 156581 - protein, 14 aa, Mycobacterium tuberculosis
VARSLLDYRYRRLP

SEQ ID NO: 156582 - protein, 14 aa, Mycobacterium tuberculosis
ARSLLDYRYRRLPA

SEQ ID NO: 156583 - protein, 14 aa, Mycobacterium tuberculosis
RSLLDYRYRRLPAA

SEQ ID NO: 156584 - protein, 14 aa, Mycobacterium tuberculosis
SLLDYRYRRLPAAR

SEQ ID NO: 156585 - protein, 14 aa, Mycobacterium tuberculosis
LLDYRYRRLPAARR

SEQ ID NO: 156586 - protein, 14 aa, Mycobacterium tuberculosis
LDYRYRRLPAARRA

SEQ ID NO: 156587 - protein, 14 aa, Mycobacterium tuberculosis
DYRYRRLPAARRAA

SEQ ID NO: 156588 - protein, 14 aa, Mycobacterium tuberculosis
YRYRRLPAARRAAH

SEQ ID NO: 156589 - protein, 14 aa, Mycobacterium tuberculosis
RYRRLPAARRAAHR

SEQ ID NO: 156590 - protein, 14 aa, Mycobacterium tuberculosis
YRRLPAARRAAHRA

SEQ ID NO: 156591 - protein, 14 aa, Mycobacterium tuberculosis
RRLPAARRAAHRAG

SEQ ID NO: 156592 - protein, 14 aa, Mycobacterium tuberculosis
RLPAARRAAHRAGH

SEQ ID NO: 156593 - protein, 14 aa, Mycobacterium tuberculosis
LPAARRAAHRAGHL

SEQ ID NO: 156594 - protein, 14 aa, Mycobacterium tuberculosis
PAARRAAHRAGHLG

SEQ ID NO: 156595 - protein, 14 aa, Mycobacterium tuberculosis
AARRAAHRAGHLGA

SEQ ID NO: 156596 - protein, 14 aa, Mycobacterium tuberculosis
ARRAAHRAGHLGAM

SEQ ID NO: 156597 - protein, 14 aa, Mycobacterium tuberculosis
RRAAHRAGHLGAMY

SEQ ID NO: 156598 - protein, 14 aa, Mycobacterium tuberculosis
RAAHRAGHLGAMYP

SEQ ID NO: 156599 - protein, 14 aa, Mycobacterium tuberculosis
AAHRAGHLGAMYPW

SEQ ID NO: 156600 - protein, 14 aa, Mycobacterium tuberculosis
AHRAGHLGAMYPWQ

SEQ ID NO: 156601 - protein, 14 aa, Mycobacterium tuberculosis
HRAGHLGAMYPWQS

SEQ ID NO: 156602 - protein, 14 aa, Mycobacterium tuberculosis
RAGHLGAMYPWQSG

SEQ ID NO: 156603 - protein, 14 aa, Mycobacterium tuberculosis
AGHLGAMYPWQSGS

SEQ ID NO: 156604 - protein, 14 aa, Mycobacterium tuberculosis
GHLGAMYPWQSGSD

SEQ ID NO: 156605 - protein, 14 aa, Mycobacterium tuberculosis
HLGAMYPWQSGSDG

SEQ ID NO: 156606 - protein, 14 aa, Mycobacterium tuberculosis
LGAMYPWQSGSDGS

SEQ ID NO: 156607 - protein, 14 aa, Mycobacterium tuberculosis
GAMYPWQSGSDGSE

SEQ ID NO: 156608 - protein, 14 aa, Mycobacterium tuberculosis
AMYPWQSGSDGSEV

SEQ ID NO: 156609 - protein, 14 aa, Mycobacterium tuberculosis
MYPWQSGSDGSEVS

SEQ ID NO: 156610 - protein, 14 aa, Mycobacterium tuberculosis
YPWQSGSDGSEVSQ

SEQ ID NO: 156611 - protein, 14 aa, Mycobacterium tuberculosis
PWQSGSDGSEVSQQ

SEQ ID NO: 156612 - protein, 14 aa, Mycobacterium tuberculosis
WQSGSDGSEVSQQL

SEQ ID NO: 156613 - protein, 14 aa, Mycobacterium tuberculosis
QSGSDGSEVSQQLH

SEQ ID NO: 156614 - protein, 14 aa, Mycobacterium tuberculosis
SGSDGSEVSQQLHL

SEQ ID NO: 156615 - protein, 14 aa, Mycobacterium tuberculosis
GSDGSEVSQQLHLN

SEQ ID NO: 156616 - protein, 14 aa, Mycobacterium tuberculosis
SDGSEVSQQLHLNP

SEQ ID NO: 156617 - protein, 14 aa, Mycobacterium tuberculosis
DGSEVSQQLHLNPR

SEQ ID NO: 156618 - protein, 14 aa, Mycobacterium tuberculosis
GSEVSQQLHLNPRS

SEQ ID NO: 156619 - protein, 14 aa, Mycobacterium tuberculosis
SEVSQQLHLNPRSG

SEQ ID NO: 156620 - protein, 14 aa, Mycobacterium tuberculosis
EVSQQLHLNPRSGR

SEQ ID NO: 156621 - protein, 14 aa, Mycobacterium tuberculosis
VSQQLHLNPRSGRW

SEQ ID NO: 156622 - protein, 14 aa, Mycobacterium tuberculosis
SQQLHLNPRSGRWT

SEQ ID NO: 156623 - protein, 14 aa, Mycobacterium tuberculosis
QQLHLNPRSGRWTP

SEQ ID NO: 156624 - protein, 14 aa, Mycobacterium tuberculosis
QLHLNPRSGRWTPD

SEQ ID NO: 156625 - protein, 14 aa, Mycobacterium tuberculosis
LHLNPRSGRWTPDP

SEQ ID NO: 156626 - protein, 14 aa, Mycobacterium tuberculosis
HLNPRSGRWTPDPS

SEQ ID NO: 156627 - protein, 14 aa, Mycobacterium tuberculosis
LNPRSGRWTPDPSD

SEQ ID NO: 156628 - protein, 14 aa, Mycobacterium tuberculosis
NPRSGRWTPDPSDR

SEQ ID NO: 156629 - protein, 14 aa, Mycobacterium tuberculosis
PRSGRWTPDPSDRA

SEQ ID NO: 156630 - protein, 14 aa, Mycobacterium tuberculosis
RSGRWTPDPSDRAH

SEQ ID NO: 156631 - protein, 14 aa, Mycobacterium tuberculosis
SGRWTPDPSDRAHH

SEQ ID NO: 156632 - protein, 14 aa, Mycobacterium tuberculosis
GRWTPDPSDRAHHV

SEQ ID NO: 156633 - protein, 14 aa, Mycobacterium tuberculosis
RWTPDPSDRAHHVG

SEQ ID NO: 156634 - protein, 14 aa, Mycobacterium tuberculosis
WTPDPSDRAHHVGL

SEQ ID NO: 156635 - protein, 14 aa, Mycobacterium tuberculosis
TPDPSDRAHHVGLA

SEQ ID NO: 156636 - protein, 14 aa, Mycobacterium tuberculosis
PDPSDRAHHVGLAV

SEQ ID NO: 156637 - protein, 14 aa, Mycobacterium tuberculosis
DPSDRAHHVGLAVA

SEQ ID NO: 156638 - protein, 14 aa, Mycobacterium tuberculosis
PSDRAHHVGLAVAY

SEQ ID NO: 156639 - protein, 14 aa, Mycobacterium tuberculosis
SDRAHHVGLAVAYN

SEQ ID NO: 156640 - protein, 14 aa, Mycobacterium tuberculosis
DRAHHVGLAVAYNA

SEQ ID NO: 156641 - protein, 14 aa, Mycobacterium tuberculosis
RAHHVGLAVAYNAW

SEQ ID NO: 156642 - protein, 14 aa, Mycobacterium tuberculosis
AHHVGLAVAYNAWH

SEQ ID NO: 156643 - protein, 14 aa, Mycobacterium tuberculosis
HHVGLAVAYNAWHY

SEQ ID NO: 156644 - protein, 14 aa, Mycobacterium tuberculosis
HVGLAVAYNAWHYY

SEQ ID NO: 156645 - protein, 14 aa, Mycobacterium tuberculosis
VGLAVAYNAWHYYQ

SEQ ID NO: 156646 - protein, 14 aa, Mycobacterium tuberculosis
GLAVAYNAWHYYQV

SEQ ID NO: 156647 - protein, 14 aa, Mycobacterium tuberculosis
LAVAYNAWHYYQVT

SEQ ID NO: 156648 - protein, 14 aa, Mycobacterium tuberculosis
AVAYNAWHYYQVTG

SEQ ID NO: 156649 - protein, 14 aa, Mycobacterium tuberculosis
VAYNAWHYYQVTGD

SEQ ID NO: 156650 - protein, 14 aa, Mycobacterium tuberculosis
AYNAWHYYQVTGDR

SEQ ID NO: 156651 - protein, 14 aa, Mycobacterium tuberculosis
YNAWHYYQVTGDRQ

SEQ ID NO: 156652 - protein, 14 aa, Mycobacterium tuberculosis
NAWHYYQVTGDRQY

SEQ ID NO: 156653 - protein, 14 aa, Mycobacterium tuberculosis
AWHYYQVTGDRQYL

SEQ ID NO: 156654 - protein, 14 aa, Mycobacterium tuberculosis
WHYYQVTGDRQYLV

SEQ ID NO: 156655 - protein, 14 aa, Mycobacterium tuberculosis
HYYQVTGDRQYLVD

SEQ ID NO: 156656 - protein, 14 aa, Mycobacterium tuberculosis
YYQVTGDRQYLVDC

SEQ ID NO: 156657 - protein, 14 aa, Mycobacterium tuberculosis
YQVTGDRQYLVDCG

SEQ ID NO: 156658 - protein, 14 aa, Mycobacterium tuberculosis
QVTGDRQYLVDCGA

SEQ ID NO: 156659 - protein, 14 aa, Mycobacterium tuberculosis
VTGDRQYLVDCGAE

SEQ ID NO: 156660 - protein, 14 aa, Mycobacterium tuberculosis
TGDRQYLVDCGAEL

SEQ ID NO: 156661 - protein, 14 aa, Mycobacterium tuberculosis
GDRQYLVDCGAELL

SEQ ID NO: 156662 - protein, 14 aa, Mycobacterium tuberculosis
DRQYLVDCGAELLV

SEQ ID NO: 156663 - protein, 14 aa, Mycobacterium tuberculosis
RQYLVDCGAELLVE

SEQ ID NO: 156664 - protein, 14 aa, Mycobacterium tuberculosis
QYLVDCGAELLVEI

SEQ ID NO: 156665 - protein, 14 aa, Mycobacterium tuberculosis
YLVDCGAELLVEIA

SEQ ID NO: 156666 - protein, 14 aa, Mycobacterium tuberculosis
LVDCGAELLVEIAR

SEQ ID NO: 156667 - protein, 14 aa, Mycobacterium tuberculosis
VDCGAELLVEIARF

SEQ ID NO: 156668 - protein, 14 aa, Mycobacterium tuberculosis
DCGAELLVEIARFW

SEQ ID NO: 156669 - protein, 14 aa, Mycobacterium tuberculosis
CGAELLVEIARFWV

SEQ ID NO: 156670 - protein, 14 aa, Mycobacterium tuberculosis
GAELLVEIARFWVG

SEQ ID NO: 156671 - protein, 14 aa, Mycobacterium tuberculosis
AELLVEIARFWVGL

SEQ ID NO: 156672 - protein, 14 aa, Mycobacterium tuberculosis
ELLVEIARFWVGLA

SEQ ID NO: 156673 - protein, 14 aa, Mycobacterium tuberculosis
LLVEIARFWVGLAK

SEQ ID NO: 156674 - protein, 14 aa, Mycobacterium tuberculosis
LVEIARFWVGLAKL

SEQ ID NO: 156675 - protein, 14 aa, Mycobacterium tuberculosis
VEIARFWVGLAKLD

SEQ ID NO: 156676 - protein, 14 aa, Mycobacterium tuberculosis
EIARFWVGLAKLDD

SEQ ID NO: 156677 - protein, 14 aa, Mycobacterium tuberculosis
IARFWVGLAKLDDS

SEQ ID NO: 156678 - protein, 14 aa, Mycobacterium tuberculosis
ARFWVGLAKLDDSR

SEQ ID NO: 156679 - protein, 14 aa, Mycobacterium tuberculosis
RFWVGLAKLDDSRG

SEQ ID NO: 156680 - protein, 14 aa, Mycobacterium tuberculosis
FWVGLAKLDDSRGR

SEQ ID NO: 156681 - protein, 14 aa, Mycobacterium tuberculosis
WVGLAKLDDSRGRY

SEQ ID NO: 156682 - protein, 14 aa, Mycobacterium tuberculosis
VGLAKLDDSRGRYL

SEQ ID NO: 156683 - protein, 14 aa, Mycobacterium tuberculosis
GLAKLDDSRGRYLI

SEQ ID NO: 156684 - protein, 14 aa, Mycobacterium tuberculosis
LAKLDDSRGRYLIR

SEQ ID NO: 156685 - protein, 14 aa, Mycobacterium tuberculosis
AKLDDSRGRYLIRG

SEQ ID NO: 156686 - protein, 14 aa, Mycobacterium tuberculosis
KLDDSRGRYLIRGV

SEQ ID NO: 156687 - protein, 14 aa, Mycobacterium tuberculosis
LDDSRGRYLIRGVI

SEQ ID NO: 156688 - protein, 14 aa, Mycobacterium tuberculosis
DDSRGRYLIRGVIG

SEQ ID NO: 156689 - protein, 14 aa, Mycobacterium tuberculosis
DSRGRYLIRGVIGP

SEQ ID NO: 156690 - protein, 14 aa, Mycobacterium tuberculosis
SRGRYLIRGVIGPD

SEQ ID NO: 156691 - protein, 14 aa, Mycobacterium tuberculosis
RGRYLIRGVIGPDE

SEQ ID NO: 156692 - protein, 14 aa, Mycobacterium tuberculosis
GRYLIRGVIGPDEF

SEQ ID NO: 156693 - protein, 14 aa, Mycobacterium tuberculosis
RYLIRGVIGPDEFH

SEQ ID NO: 156694 - protein, 14 aa, Mycobacterium tuberculosis
YLIRGVIGPDEFHS

SEQ ID NO: 156695 - protein, 14 aa, Mycobacterium tuberculosis
LIRGVIGPDEFHSG

SEQ ID NO: 156696 - protein, 14 aa, Mycobacterium tuberculosis
IRGVIGPDEFHSGY

SEQ ID NO: 156697 - protein, 14 aa, Mycobacterium tuberculosis
RGVIGPDEFHSGYP

SEQ ID NO: 156698 - protein, 14 aa, Mycobacterium tuberculosis
GVIGPDEFHSGYPG

SEQ ID NO: 156699 - protein, 14 aa, Mycobacterium tuberculosis
VIGPDEFHSGYPGN

SEQ ID NO: 156700 - protein, 14 aa, Mycobacterium tuberculosis
IGPDEFHSGYPGNE

SEQ ID NO: 156701 - protein, 14 aa, Mycobacterium tuberculosis
GPDEFHSGYPGNEY

SEQ ID NO: 156702 - protein, 14 aa, Mycobacterium tuberculosis
PDEFHSGYPGNEYD

SEQ ID NO: 156703 - protein, 14 aa, Mycobacterium tuberculosis
DEFHSGYPGNEYDG

SEQ ID NO: 156704 - protein, 14 aa, Mycobacterium tuberculosis
EFHSGYPGNEYDGI

SEQ ID NO: 156705 - protein, 14 aa, Mycobacterium tuberculosis
FHSGYPGNEYDGID

SEQ ID NO: 156706 - protein, 14 aa, Mycobacterium tuberculosis
HSGYPGNEYDGIDN

SEQ ID NO: 156707 - protein, 14 aa, Mycobacterium tuberculosis
SGYPGNEYDGIDNN

SEQ ID NO: 156708 - protein, 14 aa, Mycobacterium tuberculosis
GYPGNEYDGIDNNA

SEQ ID NO: 156709 - protein, 14 aa, Mycobacterium tuberculosis
YPGNEYDGIDNNAY

SEQ ID NO: 156710 - protein, 14 aa, Mycobacterium tuberculosis
PGNEYDGIDNNAYT

SEQ ID NO: 156711 - protein, 14 aa, Mycobacterium tuberculosis
GNEYDGIDNNAYTN

SEQ ID NO: 156712 - protein, 14 aa, Mycobacterium tuberculosis
NEYDGIDNNAYTNV

SEQ ID NO: 156713 - protein, 14 aa, Mycobacterium tuberculosis
EYDGIDNNAYTNVM

SEQ ID NO: 156714 - protein, 14 aa, Mycobacterium tuberculosis
YDGIDNNAYTNVMA

SEQ ID NO: 156715 - protein, 14 aa, Mycobacterium tuberculosis
DGIDNNAYTNVMAV

SEQ ID NO: 156716 - protein, 14 aa, Mycobacterium tuberculosis
GIDNNAYTNVMAVW

SEQ ID NO: 156717 - protein, 14 aa, Mycobacterium tuberculosis
IDNNAYTNVMAVWV

SEQ ID NO: 156718 - protein, 14 aa, Mycobacterium tuberculosis
DNNAYTNVMAVWVI

SEQ ID NO: 156719 - protein, 14 aa, Mycobacterium tuberculosis
NNAYTNVMAVWVIL

SEQ ID NO: 156720 - protein, 14 aa, Mycobacterium tuberculosis
NAYTNVMAVWVILR

SEQ ID NO: 156721 - protein, 14 aa, Mycobacterium tuberculosis
AYTNVMAVWVILRA

SEQ ID NO: 156722 - protein, 14 aa, Mycobacterium tuberculosis
YTNVMAVWVILRAM

SEQ ID NO: 156723 - protein, 14 aa, Mycobacterium tuberculosis
TNVMAVWVILRAME

SEQ ID NO: 156724 - protein, 14 aa, Mycobacterium tuberculosis
NVMAVWVILRAMEA

SEQ ID NO: 156725 - protein, 14 aa, Mycobacterium tuberculosis
VMAVWVILRAMEAL

SEQ ID NO: 156726 - protein, 14 aa, Mycobacterium tuberculosis
MAVWVILRAMEALD

SEQ ID NO: 156727 - protein, 14 aa, Mycobacterium tuberculosis
AVWVILRAMEALDL

SEQ ID NO: 156728 - protein, 14 aa, Mycobacterium tuberculosis
VWVILRAMEALDLL

SEQ ID NO: 156729 - protein, 14 aa, Mycobacterium tuberculosis
WVILRAMEALDLLP

SEQ ID NO: 156730 - protein, 14 aa, Mycobacterium tuberculosis
VILRAMEALDLLPL

SEQ ID NO: 156731 - protein, 14 aa, Mycobacterium tuberculosis
ILRAMEALDLLPLT

SEQ ID NO: 156732 - protein, 14 aa, Mycobacterium tuberculosis
LRAMEALDLLPLTD

SEQ ID NO: 156733 - protein, 14 aa, Mycobacterium tuberculosis
RAMEALDLLPLTDR

SEQ ID NO: 156734 - protein, 14 aa, Mycobacterium tuberculosis
AMEALDLLPLTDRR

SEQ ID NO: 156735 - protein, 14 aa, Mycobacterium tuberculosis
MEALDLLPLTDRRH

SEQ ID NO: 156736 - protein, 14 aa, Mycobacterium tuberculosis
EALDLLPLTDRRHL

SEQ ID NO: 156737 - protein, 14 aa, Mycobacterium tuberculosis
ALDLLPLTDRRHLI

SEQ ID NO: 156738 - protein, 14 aa, Mycobacterium tuberculosis
LDLLPLTDRRHLIE

SEQ ID NO: 156739 - protein, 14 aa, Mycobacterium tuberculosis
DLLPLTDRRHLIEK

SEQ ID NO: 156740 - protein, 14 aa, Mycobacterium tuberculosis
LLPLTDRRHLIEKL

SEQ ID NO: 156741 - protein, 14 aa, Mycobacterium tuberculosis
LPLTDRRHLIEKLG

SEQ ID NO: 156742 - protein, 14 aa, Mycobacterium tuberculosis
PLTDRRHLIEKLGL

SEQ ID NO: 156743 - protein, 14 aa, Mycobacterium tuberculosis
LTDRRHLIEKLGLT

SEQ ID NO: 156744 - protein, 14 aa, Mycobacterium tuberculosis
TDRRHLIEKLGLTT

SEQ ID NO: 156745 - protein, 14 aa, Mycobacterium tuberculosis
DRRHLIEKLGLTTQ

SEQ ID NO: 156746 - protein, 14 aa, Mycobacterium tuberculosis
RRHLIEKLGLTTQE

SEQ ID NO: 156747 - protein, 14 aa, Mycobacterium tuberculosis
RHLIEKLGLTTQER

SEQ ID NO: 156748 - protein, 14 aa, Mycobacterium tuberculosis
HLIEKLGLTTQERD

SEQ ID NO: 156749 - protein, 14 aa, Mycobacterium tuberculosis
LIEKLGLTTQERDQ

SEQ ID NO: 156750 - protein, 14 aa, Mycobacterium tuberculosis
IEKLGLTTQERDQW

SEQ ID NO: 156751 - protein, 14 aa, Mycobacterium tuberculosis
EKLGLTTQERDQWD

SEQ ID NO: 156752 - protein, 14 aa, Mycobacterium tuberculosis
KLGLTTQERDQWDD

SEQ ID NO: 156753 - protein, 14 aa, Mycobacterium tuberculosis
LGLTTQERDQWDDV

SEQ ID NO: 156754 - protein, 14 aa, Mycobacterium tuberculosis
GLTTQERDQWDDVS

SEQ ID NO: 156755 - protein, 14 aa, Mycobacterium tuberculosis
LTTQERDQWDDVSR

SEQ ID NO: 156756 - protein, 14 aa, Mycobacterium tuberculosis
TTQERDQWDDVSRR

SEQ ID NO: 156757 - protein, 14 aa, Mycobacterium tuberculosis
TQERDQWDDVSRRM

SEQ ID NO: 156758 - protein, 14 aa, Mycobacterium tuberculosis
QERDQWDDVSRRMF

SEQ ID NO: 156759 - protein, 14 aa, Mycobacterium tuberculosis
ERDQWDDVSRRMFV

SEQ ID NO: 156760 - protein, 14 aa, Mycobacterium tuberculosis
RDQWDDVSRRMFVP

SEQ ID NO: 156761 - protein, 14 aa, Mycobacterium tuberculosis
DQWDDVSRRMFVPF

SEQ ID NO: 156762 - protein, 14 aa, Mycobacterium tuberculosis
QWDDVSRRMFVPFH

SEQ ID NO: 156763 - protein, 14 aa, Mycobacterium tuberculosis
WDDVSRRMFVPFHD

SEQ ID NO: 156764 - protein, 14 aa, Mycobacterium tuberculosis
DDVSRRMFVPFHDG

SEQ ID NO: 156765 - protein, 14 aa, Mycobacterium tuberculosis
DVSRRMFVPFHDGV

SEQ ID NO: 156766 - protein, 14 aa, Mycobacterium tuberculosis
VSRRMFVPFHDGVI

SEQ ID NO: 156767 - protein, 14 aa, Mycobacterium tuberculosis
SRRMFVPFHDGVIS

SEQ ID NO: 156768 - protein, 14 aa, Mycobacterium tuberculosis
RRMFVPFHDGVISQ

SEQ ID NO: 156769 - protein, 14 aa, Mycobacterium tuberculosis
RMFVPFHDGVISQF

SEQ ID NO: 156770 - protein, 14 aa, Mycobacterium tuberculosis
MFVPFHDGVISQFE

SEQ ID NO: 156771 - protein, 14 aa, Mycobacterium tuberculosis
FVPFHDGVISQFEG

SEQ ID NO: 156772 - protein, 14 aa, Mycobacterium tuberculosis
VPFHDGVISQFEGY

SEQ ID NO: 156773 - protein, 14 aa, Mycobacterium tuberculosis
PFHDGVISQFEGYS

SEQ ID NO: 156774 - protein, 14 aa, Mycobacterium tuberculosis
FHDGVISQFEGYSE

SEQ ID NO: 156775 - protein, 14 aa, Mycobacterium tuberculosis
HDGVISQFEGYSEL

SEQ ID NO: 156776 - protein, 14 aa, Mycobacterium tuberculosis
DGVISQFEGYSELA

SEQ ID NO: 156777 - protein, 14 aa, Mycobacterium tuberculosis
GVISQFEGYSELAE

SEQ ID NO: 156778 - protein, 14 aa, Mycobacterium tuberculosis
VISQFEGYSELAEL

SEQ ID NO: 156779 - protein, 14 aa, Mycobacterium tuberculosis
ISQFEGYSELAELD

SEQ ID NO: 156780 - protein, 14 aa, Mycobacterium tuberculosis
SQFEGYSELAELDW

SEQ ID NO: 156781 - protein, 14 aa, Mycobacterium tuberculosis
QFEGYSELAELDWD

SEQ ID NO: 156782 - protein, 14 aa, Mycobacterium tuberculosis
FEGYSELAELDWDH

SEQ ID NO: 156783 - protein, 14 aa, Mycobacterium tuberculosis
EGYSELAELDWDHY

SEQ ID NO: 156784 - protein, 14 aa, Mycobacterium tuberculosis
GYSELAELDWDHYR

SEQ ID NO: 156785 - protein, 14 aa, Mycobacterium tuberculosis
YSELAELDWDHYRH

SEQ ID NO: 156786 - protein, 14 aa, Mycobacterium tuberculosis
SELAELDWDHYRHR

SEQ ID NO: 156787 - protein, 14 aa, Mycobacterium tuberculosis
ELAELDWDHYRHRY

SEQ ID NO: 156788 - protein, 14 aa, Mycobacterium tuberculosis
LAELDWDHYRHRYG

SEQ ID NO: 156789 - protein, 14 aa, Mycobacterium tuberculosis
AELDWDHYRHRYGN

SEQ ID NO: 156790 - protein, 14 aa, Mycobacterium tuberculosis
ELDWDHYRHRYGNI

SEQ ID NO: 156791 - protein, 14 aa, Mycobacterium tuberculosis
LDWDHYRHRYGNIQ

SEQ ID NO: 156792 - protein, 14 aa, Mycobacterium tuberculosis
DWDHYRHRYGNIQR

SEQ ID NO: 156793 - protein, 14 aa, Mycobacterium tuberculosis
WDHYRHRYGNIQRL

SEQ ID NO: 156794 - protein, 14 aa, Mycobacterium tuberculosis
DHYRHRYGNIQRLD

SEQ ID NO: 156795 - protein, 14 aa, Mycobacterium tuberculosis
HYRHRYGNIQRLDR

SEQ ID NO: 156796 - protein, 14 aa, Mycobacterium tuberculosis
YRHRYGNIQRLDRI

SEQ ID NO: 156797 - protein, 14 aa, Mycobacterium tuberculosis
RHRYGNIQRLDRIL

SEQ ID NO: 156798 - protein, 14 aa, Mycobacterium tuberculosis
HRYGNIQRLDRILE

SEQ ID NO: 156799 - protein, 14 aa, Mycobacterium tuberculosis
RYGNIQRLDRILEA

SEQ ID NO: 156800 - protein, 14 aa, Mycobacterium tuberculosis
YGNIQRLDRILEAE

SEQ ID NO: 156801 - protein, 14 aa, Mycobacterium tuberculosis
GNIQRLDRILEAEG

SEQ ID NO: 156802 - protein, 14 aa, Mycobacterium tuberculosis
NIQRLDRILEAEGD

SEQ ID NO: 156803 - protein, 14 aa, Mycobacterium tuberculosis
IQRLDRILEAEGDS

SEQ ID NO: 156804 - protein, 14 aa, Mycobacterium tuberculosis
QRLDRILEAEGDSV

SEQ ID NO: 156805 - protein, 14 aa, Mycobacterium tuberculosis
RLDRILEAEGDSVN

SEQ ID NO: 156806 - protein, 14 aa, Mycobacterium tuberculosis
LDRILEAEGDSVNN

SEQ ID NO: 156807 - protein, 14 aa, Mycobacterium tuberculosis
DRILEAEGDSVNNY

SEQ ID NO: 156808 - protein, 14 aa, Mycobacterium tuberculosis
RILEAEGDSVNNYQ

SEQ ID NO: 156809 - protein, 14 aa, Mycobacterium tuberculosis
ILEAEGDSVNNYQA

SEQ ID NO: 156810 - protein, 14 aa, Mycobacterium tuberculosis
LEAEGDSVNNYQAS

SEQ ID NO: 156811 - protein, 14 aa, Mycobacterium tuberculosis
EAEGDSVNNYQASK

SEQ ID NO: 156812 - protein, 14 aa, Mycobacterium tuberculosis
AEGDSVNNYQASKQ

SEQ ID NO: 156813 - protein, 14 aa, Mycobacterium tuberculosis
EGDSVNNYQASKQA

SEQ ID NO: 156814 - protein, 14 aa, Mycobacterium tuberculosis
GDSVNNYQASKQAD

SEQ ID NO: 156815 - protein, 14 aa, Mycobacterium tuberculosis
DSVNNYQASKQADA

SEQ ID NO: 156816 - protein, 14 aa, Mycobacterium tuberculosis
SVNNYQASKQADAL

SEQ ID NO: 156817 - protein, 14 aa, Mycobacterium tuberculosis
VNNYQASKQADALM

SEQ ID NO: 156818 - protein, 14 aa, Mycobacterium tuberculosis
NNYQASKQADALML

SEQ ID NO: 156819 - protein, 14 aa, Mycobacterium tuberculosis
NYQASKQADALMLL

SEQ ID NO: 156820 - protein, 14 aa, Mycobacterium tuberculosis
YQASKQADALMLLY

SEQ ID NO: 156821 - protein, 14 aa, Mycobacterium tuberculosis
QASKQADALMLLYL

SEQ ID NO: 156822 - protein, 14 aa, Mycobacterium tuberculosis
ASKQADALMLLYLL

SEQ ID NO: 156823 - protein, 14 aa, Mycobacterium tuberculosis
SKQADALMLLYLLS

SEQ ID NO: 156824 - protein, 14 aa, Mycobacterium tuberculosis
KQADALMLLYLLSS

SEQ ID NO: 156825 - protein, 14 aa, Mycobacterium tuberculosis
QADALMLLYLLSSD

SEQ ID NO: 156826 - protein, 14 aa, Mycobacterium tuberculosis
ADALMLLYLLSSDE

SEQ ID NO: 156827 - protein, 14 aa, Mycobacterium tuberculosis
DALMLLYLLSSDEL

SEQ ID NO: 156828 - protein, 14 aa, Mycobacterium tuberculosis
ALMLLYLLSSDELI

SEQ ID NO: 156829 - protein, 14 aa, Mycobacterium tuberculosis
LMLLYLLSSDELIG

SEQ ID NO: 156830 - protein, 14 aa, Mycobacterium tuberculosis
MLLYLLSSDELIGL

SEQ ID NO: 156831 - protein, 14 aa, Mycobacterium tuberculosis
LLYLLSSDELIGLL

SEQ ID NO: 156832 - protein, 14 aa, Mycobacterium tuberculosis
LYLLSSDELIGLLA

SEQ ID NO: 156833 - protein, 14 aa, Mycobacterium tuberculosis
YLLSSDELIGLLAR

SEQ ID NO: 156834 - protein, 14 aa, Mycobacterium tuberculosis
LLSSDELIGLLARL

SEQ ID NO: 156835 - protein, 14 aa, Mycobacterium tuberculosis
LSSDELIGLLARLG

SEQ ID NO: 156836 - protein, 14 aa, Mycobacterium tuberculosis
SSDELIGLLARLGY

SEQ ID NO: 156837 - protein, 14 aa, Mycobacterium tuberculosis
SDELIGLLARLGYR

SEQ ID NO: 156838 - protein, 14 aa, Mycobacterium tuberculosis
DELIGLLARLGYRF

SEQ ID NO: 156839 - protein, 14 aa, Mycobacterium tuberculosis
ELIGLLARLGYRFA

SEQ ID NO: 156840 - protein, 14 aa, Mycobacterium tuberculosis
LIGLLARLGYRFAP

SEQ ID NO: 156841 - protein, 14 aa, Mycobacterium tuberculosis
IGLLARLGYRFAPT

SEQ ID NO: 156842 - protein, 14 aa, Mycobacterium tuberculosis
GLLARLGYRFAPTQ

SEQ ID NO: 156843 - protein, 14 aa, Mycobacterium tuberculosis
LLARLGYRFAPTQI

SEQ ID NO: 156844 - protein, 14 aa, Mycobacterium tuberculosis
LARLGYRFAPTQIP

SEQ ID NO: 156845 - protein, 14 aa, Mycobacterium tuberculosis
ARLGYRFAPTQIPG

SEQ ID NO: 156846 - protein, 14 aa, Mycobacterium tuberculosis
RLGYRFAPTQIPGT

SEQ ID NO: 156847 - protein, 14 aa, Mycobacterium tuberculosis
LGYRFAPTQIPGTV

SEQ ID NO: 156848 - protein, 14 aa, Mycobacterium tuberculosis
GYRFAPTQIPGTVD

SEQ ID NO: 156849 - protein, 14 aa, Mycobacterium tuberculosis
YRFAPTQIPGTVDY

SEQ ID NO: 156850 - protein, 14 aa, Mycobacterium tuberculosis
RFAPTQIPGTVDYY

SEQ ID NO: 156851 - protein, 14 aa, Mycobacterium tuberculosis
FAPTQIPGTVDYYL

SEQ ID NO: 156852 - protein, 14 aa, Mycobacterium tuberculosis
APTQIPGTVDYYLA

SEQ ID NO: 156853 - protein, 14 aa, Mycobacterium tuberculosis
PTQIPGTVDYYLAR

SEQ ID NO: 156854 - protein, 14 aa, Mycobacterium tuberculosis
TQIPGTVDYYLART

SEQ ID NO: 156855 - protein, 14 aa, Mycobacterium tuberculosis
QIPGTVDYYLARTS

SEQ ID NO: 156856 - protein, 14 aa, Mycobacterium tuberculosis
IPGTVDYYLARTSD

SEQ ID NO: 156857 - protein, 14 aa, Mycobacterium tuberculosis
PGTVDYYLARTSDG

SEQ ID NO: 156858 - protein, 14 aa, Mycobacterium tuberculosis
GTVDYYLARTSDGS

SEQ ID NO: 156859 - protein, 14 aa, Mycobacterium tuberculosis
TVDYYLARTSDGST

SEQ ID NO: 156860 - protein, 14 aa, Mycobacterium tuberculosis
VDYYLARTSDGSTL

SEQ ID NO: 156861 - protein, 14 aa, Mycobacterium tuberculosis
DYYLARTSDGSTLS

SEQ ID NO: 156862 - protein, 14 aa, Mycobacterium tuberculosis
YYLARTSDGSTLSA

SEQ ID NO: 156863 - protein, 14 aa, Mycobacterium tuberculosis
YLARTSDGSTLSAV

SEQ ID NO: 156864 - protein, 14 aa, Mycobacterium tuberculosis
LARTSDGSTLSAVV

SEQ ID NO: 156865 - protein, 14 aa, Mycobacterium tuberculosis
ARTSDGSTLSAVVH

SEQ ID NO: 156866 - protein, 14 aa, Mycobacterium tuberculosis
RTSDGSTLSAVVHA

SEQ ID NO: 156867 - protein, 14 aa, Mycobacterium tuberculosis
TSDGSTLSAVVHAW

SEQ ID NO: 156868 - protein, 14 aa, Mycobacterium tuberculosis
SDGSTLSAVVHAWV

SEQ ID NO: 156869 - protein, 14 aa, Mycobacterium tuberculosis
DGSTLSAVVHAWVL

SEQ ID NO: 156870 - protein, 14 aa, Mycobacterium tuberculosis
GSTLSAVVHAWVLA

SEQ ID NO: 156871 - protein, 14 aa, Mycobacterium tuberculosis
STLSAVVHAWVLAR

SEQ ID NO: 156872 - protein, 14 aa, Mycobacterium tuberculosis
TLSAVVHAWVLARA

SEQ ID NO: 156873 - protein, 14 aa, Mycobacterium tuberculosis
LSAVVHAWVLARAN

SEQ ID NO: 156874 - protein, 14 aa, Mycobacterium tuberculosis
SAVVHAWVLARANR

SEQ ID NO: 156875 - protein, 14 aa, Mycobacterium tuberculosis
AVVHAWVLARANRS

SEQ ID NO: 156876 - protein, 14 aa, Mycobacterium tuberculosis
VVHAWVLARANRSN

SEQ ID NO: 156877 - protein, 14 aa, Mycobacterium tuberculosis
VHAWVLARANRSNA

SEQ ID NO: 156878 - protein, 14 aa, Mycobacterium tuberculosis
HAWVLARANRSNAM

SEQ ID NO: 156879 - protein, 14 aa, Mycobacterium tuberculosis
AWVLARANRSNAME

SEQ ID NO: 156880 - protein, 14 aa, Mycobacterium tuberculosis
WVLARANRSNAMEY

SEQ ID NO: 156881 - protein, 14 aa, Mycobacterium tuberculosis
VLARANRSNAMEYF

SEQ ID NO: 156882 - protein, 14 aa, Mycobacterium tuberculosis
LARANRSNAMEYFR

SEQ ID NO: 156883 - protein, 14 aa, Mycobacterium tuberculosis
ARANRSNAMEYFRQ

SEQ ID NO: 156884 - protein, 14 aa, Mycobacterium tuberculosis
RANRSNAMEYFRQV

SEQ ID NO: 156885 - protein, 14 aa, Mycobacterium tuberculosis
ANRSNAMEYFRQVL

SEQ ID NO: 156886 - protein, 14 aa, Mycobacterium tuberculosis
NRSNAMEYFRQVLR

SEQ ID NO: 156887 - protein, 14 aa, Mycobacterium tuberculosis
RSNAMEYFRQVLRS

SEQ ID NO: 156888 - protein, 14 aa, Mycobacterium tuberculosis
SNAMEYFRQVLRSD

SEQ ID NO: 156889 - protein, 14 aa, Mycobacterium tuberculosis
NAMEYFRQVLRSDI

SEQ ID NO: 156890 - protein, 14 aa, Mycobacterium tuberculosis
AMEYFRQVLRSDIA

SEQ ID NO: 156891 - protein, 14 aa, Mycobacterium tuberculosis
MEYFRQVLRSDIAD

SEQ ID NO: 156892 - protein, 14 aa, Mycobacterium tuberculosis
EYFRQVLRSDIADV

SEQ ID NO: 156893 - protein, 14 aa, Mycobacterium tuberculosis
YFRQVLRSDIADVQ

SEQ ID NO: 156894 - protein, 14 aa, Mycobacterium tuberculosis
FRQVLRSDIADVQG

SEQ ID NO: 156895 - protein, 14 aa, Mycobacterium tuberculosis
RQVLRSDIADVQGG

SEQ ID NO: 156896 - protein, 14 aa, Mycobacterium tuberculosis
QVLRSDIADVQGGT

SEQ ID NO: 156897 - protein, 14 aa, Mycobacterium tuberculosis
VLRSDIADVQGGTT

SEQ ID NO: 156898 - protein, 14 aa, Mycobacterium tuberculosis
LRSDIADVQGGTTQ

SEQ ID NO: 156899 - protein, 14 aa, Mycobacterium tuberculosis
RSDIADVQGGTTQE

SEQ ID NO: 156900 - protein, 14 aa, Mycobacterium tuberculosis
SDIADVQGGTTQEG

SEQ ID NO: 156901 - protein, 14 aa, Mycobacterium tuberculosis
DIADVQGGTTQEGI

SEQ ID NO: 156902 - protein, 14 aa, Mycobacterium tuberculosis
IADVQGGTTQEGIH

SEQ ID NO: 156903 - protein, 14 aa, Mycobacterium tuberculosis
ADVQGGTTQEGIHL

SEQ ID NO: 156904 - protein, 14 aa, Mycobacterium tuberculosis
DVQGGTTQEGIHLA

SEQ ID NO: 156905 - protein, 14 aa, Mycobacterium tuberculosis
VQGGTTQEGIHLAA

SEQ ID NO: 156906 - protein, 14 aa, Mycobacterium tuberculosis
QGGTTQEGIHLAAM

SEQ ID NO: 156907 - protein, 14 aa, Mycobacterium tuberculosis
GGTTQEGIHLAAMA

SEQ ID NO: 156908 - protein, 14 aa, Mycobacterium tuberculosis
GTTQEGIHLAAMAG

SEQ ID NO: 156909 - protein, 14 aa, Mycobacterium tuberculosis
TTQEGIHLAAMAGS

SEQ ID NO: 156910 - protein, 14 aa, Mycobacterium tuberculosis
TQEGIHLAAMAGSI

SEQ ID NO: 156911 - protein, 14 aa, Mycobacterium tuberculosis
QEGIHLAAMAGSID

SEQ ID NO: 156912 - protein, 14 aa, Mycobacterium tuberculosis
EGIHLAAMAGSIDL

SEQ ID NO: 156913 - protein, 14 aa, Mycobacterium tuberculosis
GIHLAAMAGSIDLL

SEQ ID NO: 156914 - protein, 14 aa, Mycobacterium tuberculosis
IHLAAMAGSIDLLQ

SEQ ID NO: 156915 - protein, 14 aa, Mycobacterium tuberculosis
HLAAMAGSIDLLQR

SEQ ID NO: 156916 - protein, 14 aa, Mycobacterium tuberculosis
LAAMAGSIDLLQRC

SEQ ID NO: 156917 - protein, 14 aa, Mycobacterium tuberculosis
AAMAGSIDLLQRCY

SEQ ID NO: 156918 - protein, 14 aa, Mycobacterium tuberculosis
AMAGSIDLLQRCYS

SEQ ID NO: 156919 - protein, 14 aa, Mycobacterium tuberculosis
MAGSIDLLQRCYSG

SEQ ID NO: 156920 - protein, 14 aa, Mycobacterium tuberculosis
AGSIDLLQRCYSGL

SEQ ID NO: 156921 - protein, 14 aa, Mycobacterium tuberculosis
GSIDLLQRCYSGLE

SEQ ID NO: 156922 - protein, 14 aa, Mycobacterium tuberculosis
SIDLLQRCYSGLEL

SEQ ID NO: 156923 - protein, 14 aa, Mycobacterium tuberculosis
IDLLQRCYSGLELR

SEQ ID NO: 156924 - protein, 14 aa, Mycobacterium tuberculosis
DLLQRCYSGLELRD

SEQ ID NO: 156925 - protein, 14 aa, Mycobacterium tuberculosis
LLQRCYSGLELRDD

SEQ ID NO: 156926 - protein, 14 aa, Mycobacterium tuberculosis
LQRCYSGLELRDDR

SEQ ID NO: 156927 - protein, 14 aa, Mycobacterium tuberculosis
QRCYSGLELRDDRL

SEQ ID NO: 156928 - protein, 14 aa, Mycobacterium tuberculosis
RCYSGLELRDDRLV

SEQ ID NO: 156929 - protein, 14 aa, Mycobacterium tuberculosis
CYSGLELRDDRLVL

SEQ ID NO: 156930 - protein, 14 aa, Mycobacterium tuberculosis
YSGLELRDDRLVLS

SEQ ID NO: 156931 - protein, 14 aa, Mycobacterium tuberculosis
SGLELRDDRLVLSP

SEQ ID NO: 156932 - protein, 14 aa, Mycobacterium tuberculosis
GLELRDDRLVLSPQ

SEQ ID NO: 156933 - protein, 14 aa, Mycobacterium tuberculosis
LELRDDRLVLSPQW

SEQ ID NO: 156934 - protein, 14 aa, Mycobacterium tuberculosis
ELRDDRLVLSPQWP

SEQ ID NO: 156935 - protein, 14 aa, Mycobacterium tuberculosis
LRDDRLVLSPQWPE

SEQ ID NO: 156936 - protein, 14 aa, Mycobacterium tuberculosis
RDDRLVLSPQWPEA

SEQ ID NO: 156937 - protein, 14 aa, Mycobacterium tuberculosis
DDRLVLSPQWPEAL

SEQ ID NO: 156938 - protein, 14 aa, Mycobacterium tuberculosis
DRLVLSPQWPEALG

SEQ ID NO: 156939 - protein, 14 aa, Mycobacterium tuberculosis
RLVLSPQWPEALGP

SEQ ID NO: 156940 - protein, 14 aa, Mycobacterium tuberculosis
LVLSPQWPEALGPL

SEQ ID NO: 156941 - protein, 14 aa, Mycobacterium tuberculosis
VLSPQWPEALGPLE

SEQ ID NO: 156942 - protein, 14 aa, Mycobacterium tuberculosis
LSPQWPEALGPLEF

SEQ ID NO: 156943 - protein, 14 aa, Mycobacterium tuberculosis
SPQWPEALGPLEFP

SEQ ID NO: 156944 - protein, 14 aa, Mycobacterium tuberculosis
PQWPEALGPLEFPF

SEQ ID NO: 156945 - protein, 14 aa, Mycobacterium tuberculosis
QWPEALGPLEFPFV

SEQ ID NO: 156946 - protein, 14 aa, Mycobacterium tuberculosis
WPEALGPLEFPFVY

SEQ ID NO: 156947 - protein, 14 aa, Mycobacterium tuberculosis
PEALGPLEFPFVYR

SEQ ID NO: 156948 - protein, 14 aa, Mycobacterium tuberculosis
EALGPLEFPFVYRR

SEQ ID NO: 156949 - protein, 14 aa, Mycobacterium tuberculosis
ALGPLEFPFVYRRH

SEQ ID NO: 156950 - protein, 14 aa, Mycobacterium tuberculosis
LGPLEFPFVYRRHQ

SEQ ID NO: 156951 - protein, 14 aa, Mycobacterium tuberculosis
GPLEFPFVYRRHQL

SEQ ID NO: 156952 - protein, 14 aa, Mycobacterium tuberculosis
PLEFPFVYRRHQLS

SEQ ID NO: 156953 - protein, 14 aa, Mycobacterium tuberculosis
LEFPFVYRRHQLSL

SEQ ID NO: 156954 - protein, 14 aa, Mycobacterium tuberculosis
EFPFVYRRHQLSLR

SEQ ID NO: 156955 - protein, 14 aa, Mycobacterium tuberculosis
FPFVYRRHQLSLRI

SEQ ID NO: 156956 - protein, 14 aa, Mycobacterium tuberculosis
PFVYRRHQLSLRIS

SEQ ID NO: 156957 - protein, 14 aa, Mycobacterium tuberculosis
FVYRRHQLSLRISG

SEQ ID NO: 156958 - protein, 14 aa, Mycobacterium tuberculosis
VYRRHQLSLRISGR

SEQ ID NO: 156959 - protein, 14 aa, Mycobacterium tuberculosis
YRRHQLSLRISGRS

SEQ ID NO: 156960 - protein, 14 aa, Mycobacterium tuberculosis
RRHQLSLRISGRSA

SEQ ID NO: 156961 - protein, 14 aa, Mycobacterium tuberculosis
RHQLSLRISGRSAT

SEQ ID NO: 156962 - protein, 14 aa, Mycobacterium tuberculosis
HQLSLRISGRSATL

SEQ ID NO: 156963 - protein, 14 aa, Mycobacterium tuberculosis
QLSLRISGRSATLT

SEQ ID NO: 156964 - protein, 14 aa, Mycobacterium tuberculosis
LSLRISGRSATLTA

SEQ ID NO: 156965 - protein, 14 aa, Mycobacterium tuberculosis
SLRISGRSATLTAE

SEQ ID NO: 156966 - protein, 14 aa, Mycobacterium tuberculosis
LRISGRSATLTAES

SEQ ID NO: 156967 - protein, 14 aa, Mycobacterium tuberculosis
RISGRSATLTAESG

SEQ ID NO: 156968 - protein, 14 aa, Mycobacterium tuberculosis
ISGRSATLTAESGD

SEQ ID NO: 156969 - protein, 14 aa, Mycobacterium tuberculosis
SGRSATLTAESGDA

SEQ ID NO: 156970 - protein, 14 aa, Mycobacterium tuberculosis
GRSATLTAESGDAE

SEQ ID NO: 156971 - protein, 14 aa, Mycobacterium tuberculosis
RSATLTAESGDAEP

SEQ ID NO: 156972 - protein, 14 aa, Mycobacterium tuberculosis
SATLTAESGDAEPI

SEQ ID NO: 156973 - protein, 14 aa, Mycobacterium tuberculosis
ATLTAESGDAEPIE

SEQ ID NO: 156974 - protein, 14 aa, Mycobacterium tuberculosis
TLTAESGDAEPIEV

SEQ ID NO: 156975 - protein, 14 aa, Mycobacterium tuberculosis
LTAESGDAEPIEVE

SEQ ID NO: 156976 - protein, 14 aa, Mycobacterium tuberculosis
TAESGDAEPIEVEC

SEQ ID NO: 156977 - protein, 14 aa, Mycobacterium tuberculosis
AESGDAEPIEVECR

SEQ ID NO: 156978 - protein, 14 aa, Mycobacterium tuberculosis
ESGDAEPIEVECRG

SEQ ID NO: 156979 - protein, 14 aa, Mycobacterium tuberculosis
SGDAEPIEVECRGH

SEQ ID NO: 156980 - protein, 14 aa, Mycobacterium tuberculosis
GDAEPIEVECRGHV

SEQ ID NO: 156981 - protein, 14 aa, Mycobacterium tuberculosis
DAEPIEVECRGHVQ

SEQ ID NO: 156982 - protein, 14 aa, Mycobacterium tuberculosis
AEPIEVECRGHVQR

SEQ ID NO: 156983 - protein, 14 aa, Mycobacterium tuberculosis
EPIEVECRGHVQRL

SEQ ID NO: 156984 - protein, 14 aa, Mycobacterium tuberculosis
PIEVECRGHVQRLR

SEQ ID NO: 156985 - protein, 14 aa, Mycobacterium tuberculosis
IEVECRGHVQRLRC

SEQ ID NO: 156986 - protein, 14 aa, Mycobacterium tuberculosis
EVECRGHVQRLRCG

SEQ ID NO: 156987 - protein, 14 aa, Mycobacterium tuberculosis
VECRGHVQRLRCGH

SEQ ID NO: 156988 - protein, 14 aa, Mycobacterium tuberculosis
ECRGHVQRLRCGHT

SEQ ID NO: 156989 - protein, 14 aa, Mycobacterium tuberculosis
CRGHVQRLRCGHTI

SEQ ID NO: 156990 - protein, 14 aa, Mycobacterium tuberculosis
RGHVQRLRCGHTIE

SEQ ID NO: 156991 - protein, 14 aa, Mycobacterium tuberculosis
GHVQRLRCGHTIEV

SEQ ID NO: 156992 - protein, 14 aa, Mycobacterium tuberculosis
HVQRLRCGHTIEVG

SEQ ID NO: 156993 - protein, 14 aa, Mycobacterium tuberculosis
VQRLRCGHTIEVGC

SEQ ID NO: 156994 - protein, 14 aa, Mycobacterium tuberculosis
QRLRCGHTIEVGCS

SEQ ID NO: 156995 - protein, 14 aa, Mycobacterium tuberculosis
RLRCGHTIEVGCSR

SEQ ID NO: 156996 - protein, 15 aa, Mycobacterium tuberculosis
MRCGIVVNVTGPPPT

SEQ ID NO: 156997 - protein, 15 aa, Mycobacterium tuberculosis
RCGIVVNVTGPPPTI

SEQ ID NO: 156998 - protein, 15 aa, Mycobacterium tuberculosis
CGIVVNVTGPPPTID

SEQ ID NO: 156999 - protein, 15 aa, Mycobacterium tuberculosis
GIVVNVTGPPPTIDR

SEQ ID NO: 157000 - protein, 15 aa, Mycobacterium tuberculosis
IVVNVTGPPPTIDRR

SEQ ID NO: 157001 - protein, 15 aa, Mycobacterium tuberculosis
VVNVTGPPPTIDRRY

SEQ ID NO: 157002 - protein, 15 aa, Mycobacterium tuberculosis
VNVTGPPPTIDRRYH

SEQ ID NO: 157003 - protein, 15 aa, Mycobacterium tuberculosis
NVTGPPPTIDRRYHD

SEQ ID NO: 157004 - protein, 15 aa, Mycobacterium tuberculosis
VTGPPPTIDRRYHDA

SEQ ID NO: 157005 - protein, 15 aa, Mycobacterium tuberculosis
TGPPPTIDRRYHDAV

SEQ ID NO: 157006 - protein, 15 aa, Mycobacterium tuberculosis
GPPPTIDRRYHDAVI

SEQ ID NO: 157007 - protein, 15 aa, Mycobacterium tuberculosis
PPPTIDRRYHDAVIV

SEQ ID NO: 157008 - protein, 15 aa, Mycobacterium tuberculosis
PPTIDRRYHDAVIVG

SEQ ID NO: 157009 - protein, 15 aa, Mycobacterium tuberculosis
PTIDRRYHDAVIVGL

SEQ ID NO: 157010 - protein, 15 aa, Mycobacterium tuberculosis
TIDRRYHDAVIVGLD

SEQ ID NO: 157011 - protein, 15 aa, Mycobacterium tuberculosis
IDRRYHDAVIVGLDN

SEQ ID NO: 157012 - protein, 15 aa, Mycobacterium tuberculosis
DRRYHDAVIVGLDNV

SEQ ID NO: 157013 - protein, 15 aa, Mycobacterium tuberculosis
RRYHDAVIVGLDNVV

SEQ ID NO: 157014 - protein, 15 aa, Mycobacterium tuberculosis
RYHDAVIVGLDNVVD

SEQ ID NO: 157015 - protein, 15 aa, Mycobacterium tuberculosis
YHDAVIVGLDNVVDK

SEQ ID NO: 157016 - protein, 15 aa, Mycobacterium tuberculosis
HDAVIVGLDNVVDKA

SEQ ID NO: 157017 - protein, 15 aa, Mycobacterium tuberculosis
DAVIVGLDNVVDKAT

SEQ ID NO: 157018 - protein, 15 aa, Mycobacterium tuberculosis
AVIVGLDNVVDKATR

SEQ ID NO: 157019 - protein, 15 aa, Mycobacterium tuberculosis
VIVGLDNVVDKATRV

SEQ ID NO: 157020 - protein, 15 aa, Mycobacterium tuberculosis
IVGLDNVVDKATRVH

SEQ ID NO: 157021 - protein, 15 aa, Mycobacterium tuberculosis
VGLDNVVDKATRVHA

SEQ ID NO: 157022 - protein, 15 aa, Mycobacterium tuberculosis
GLDNVVDKATRVHAA

SEQ ID NO: 157023 - protein, 15 aa, Mycobacterium tuberculosis
LDNVVDKATRVHAAA

SEQ ID NO: 157024 - protein, 15 aa, Mycobacterium tuberculosis
DNVVDKATRVHAAAW

SEQ ID NO: 157025 - protein, 15 aa, Mycobacterium tuberculosis
NVVDKATRVHAAAWT

SEQ ID NO: 157026 - protein, 15 aa, Mycobacterium tuberculosis
VVDKATRVHAAAWTK

SEQ ID NO: 157027 - protein, 15 aa, Mycobacterium tuberculosis
VDKATRVHAAAWTKF

SEQ ID NO: 157028 - protein, 15 aa, Mycobacterium tuberculosis
DKATRVHAAAWTKFL

SEQ ID NO: 157029 - protein, 15 aa, Mycobacterium tuberculosis
KATRVHAAAWTKFLD

SEQ ID NO: 157030 - protein, 15 aa, Mycobacterium tuberculosis
ATRVHAAAWTKFLDD

SEQ ID NO: 157031 - protein, 15 aa, Mycobacterium tuberculosis
TRVHAAAWTKFLDDY

SEQ ID NO: 157032 - protein, 15 aa, Mycobacterium tuberculosis
RVHAAAWTKFLDDYL

SEQ ID NO: 157033 - protein, 15 aa, Mycobacterium tuberculosis
VHAAAWTKFLDDYLT

SEQ ID NO: 157034 - protein, 15 aa, Mycobacterium tuberculosis
HAAAWTKFLDDYLTR

SEQ ID NO: 157035 - protein, 15 aa, Mycobacterium tuberculosis
AAAWTKFLDDYLTRR

SEQ ID NO: 157036 - protein, 15 aa, Mycobacterium tuberculosis
AAWTKFLDDYLTRRP

SEQ ID NO: 157037 - protein, 15 aa, Mycobacterium tuberculosis
AWTKFLDDYLTRRPQ

SEQ ID NO: 157038 - protein, 15 aa, Mycobacterium tuberculosis
WTKFLDDYLTRRPQR

SEQ ID NO: 157039 - protein, 15 aa, Mycobacterium tuberculosis
TKFLDDYLTRRPQRT

SEQ ID NO: 157040 - protein, 15 aa, Mycobacterium tuberculosis
KFLDDYLTRRPQRTG

SEQ ID NO: 157041 - protein, 15 aa, Mycobacterium tuberculosis
FLDDYLTRRPQRTGE

SEQ ID NO: 157042 - protein, 15 aa, Mycobacterium tuberculosis
LDDYLTRRPQRTGED

SEQ ID NO: 157043 - protein, 15 aa, Mycobacterium tuberculosis
DDYLTRRPQRTGEDH

SEQ ID NO: 157044 - protein, 15 aa, Mycobacterium tuberculosis
DYLTRRPQRTGEDHC

SEQ ID NO: 157045 - protein, 15 aa, Mycobacterium tuberculosis
YLTRRPQRTGEDHCP

SEQ ID NO: 157046 - protein, 15 aa, Mycobacterium tuberculosis
LTRRPQRTGEDHCPL

SEQ ID NO: 157047 - protein, 15 aa, Mycobacterium tuberculosis
TRRPQRTGEDHCPLT

SEQ ID NO: 157048 - protein, 15 aa, Mycobacterium tuberculosis
RRPQRTGEDHCPLTH

SEQ ID NO: 157049 - protein, 15 aa, Mycobacterium tuberculosis
RPQRTGEDHCPLTHD

SEQ ID NO: 157050 - protein, 15 aa, Mycobacterium tuberculosis
PQRTGEDHCPLTHDD

SEQ ID NO: 157051 - protein, 15 aa, Mycobacterium tuberculosis
QRTGEDHCPLTHDDY

SEQ ID NO: 157052 - protein, 15 aa, Mycobacterium tuberculosis
RTGEDHCPLTHDDYR

SEQ ID NO: 157053 - protein, 15 aa, Mycobacterium tuberculosis
TGEDHCPLTHDDYRR

SEQ ID NO: 157054 - protein, 15 aa, Mycobacterium tuberculosis
GEDHCPLTHDDYRRF

SEQ ID NO: 157055 - protein, 15 aa, Mycobacterium tuberculosis
EDHCPLTHDDYRRFL

SEQ ID NO: 157056 - protein, 15 aa, Mycobacterium tuberculosis
DHCPLTHDDYRRFLA

SEQ ID NO: 157057 - protein, 15 aa, Mycobacterium tuberculosis
HCPLTHDDYRRFLAG

SEQ ID NO: 157058 - protein, 15 aa, Mycobacterium tuberculosis
CPLTHDDYRRFLAGK

SEQ ID NO: 157059 - protein, 15 aa, Mycobacterium tuberculosis
PLTHDDYRRFLAGKP

SEQ ID NO: 157060 - protein, 15 aa, Mycobacterium tuberculosis
LTHDDYRRFLAGKPD

SEQ ID NO: 157061 - protein, 15 aa, Mycobacterium tuberculosis
THDDYRRFLAGKPDG

SEQ ID NO: 157062 - protein, 15 aa, Mycobacterium tuberculosis
HDDYRRFLAGKPDGV

SEQ ID NO: 157063 - protein, 15 aa, Mycobacterium tuberculosis
DDYRRFLAGKPDGVA

SEQ ID NO: 157064 - protein, 15 aa, Mycobacterium tuberculosis
DYRRFLAGKPDGVAD

SEQ ID NO: 157065 - protein, 15 aa, Mycobacterium tuberculosis
YRRFLAGKPDGVADF

SEQ ID NO: 157066 - protein, 15 aa, Mycobacterium tuberculosis
RRFLAGKPDGVADFL

SEQ ID NO: 157067 - protein, 15 aa, Mycobacterium tuberculosis
RFLAGKPDGVADFLA

SEQ ID NO: 157068 - protein, 15 aa, Mycobacterium tuberculosis
FLAGKPDGVADFLAA

SEQ ID NO: 157069 - protein, 15 aa, Mycobacterium tuberculosis
LAGKPDGVADFLAAR

SEQ ID NO: 157070 - protein, 15 aa, Mycobacterium tuberculosis
AGKPDGVADFLAARG

SEQ ID NO: 157071 - protein, 15 aa, Mycobacterium tuberculosis
GKPDGVADFLAARGI

SEQ ID NO: 157072 - protein, 15 aa, Mycobacterium tuberculosis
KPDGVADFLAARGIR

SEQ ID NO: 157073 - protein, 15 aa, Mycobacterium tuberculosis
PDGVADFLAARGIRL

SEQ ID NO: 157074 - protein, 15 aa, Mycobacterium tuberculosis
DGVADFLAARGIRLP

SEQ ID NO: 157075 - protein, 15 aa, Mycobacterium tuberculosis
GVADFLAARGIRLPP

SEQ ID NO: 157076 - protein, 15 aa, Mycobacterium tuberculosis
VADFLAARGIRLPPG

SEQ ID NO: 157077 - protein, 15 aa, Mycobacterium tuberculosis
ADFLAARGIRLPPGS

SEQ ID NO: 157078 - protein, 15 aa, Mycobacterium tuberculosis
DFLAARGIRLPPGSP

SEQ ID NO: 157079 - protein, 15 aa, Mycobacterium tuberculosis
FLAARGIRLPPGSPT

SEQ ID NO: 157080 - protein, 15 aa, Mycobacterium tuberculosis
LAARGIRLPPGSPTD

SEQ ID NO: 157081 - protein, 15 aa, Mycobacterium tuberculosis
AARGIRLPPGSPTDL

SEQ ID NO: 157082 - protein, 15 aa, Mycobacterium tuberculosis
ARGIRLPPGSPTDLT

SEQ ID NO: 157083 - protein, 15 aa, Mycobacterium tuberculosis
RGIRLPPGSPTDLTD

SEQ ID NO: 157084 - protein, 15 aa, Mycobacterium tuberculosis
GIRLPPGSPTDLTDD

SEQ ID NO: 157085 - protein, 15 aa, Mycobacterium tuberculosis
IRLPPGSPTDLTDDT

SEQ ID NO: 157086 - protein, 15 aa, Mycobacterium tuberculosis
RLPPGSPTDLTDDTV

SEQ ID NO: 157087 - protein, 15 aa, Mycobacterium tuberculosis
LPPGSPTDLTDDTVY

SEQ ID NO: 157088 - protein, 15 aa, Mycobacterium tuberculosis
PPGSPTDLTDDTVYG

SEQ ID NO: 157089 - protein, 15 aa, Mycobacterium tuberculosis
PGSPTDLTDDTVYGL

SEQ ID NO: 157090 - protein, 15 aa, Mycobacterium tuberculosis
GSPTDLTDDTVYGLQ

SEQ ID NO: 157091 - protein, 15 aa, Mycobacterium tuberculosis
SPTDLTDDTVYGLQN

SEQ ID NO: 157092 - protein, 15 aa, Mycobacterium tuberculosis
PTDLTDDTVYGLQNL

SEQ ID NO: 157093 - protein, 15 aa, Mycobacterium tuberculosis
TDLTDDTVYGLQNLE

SEQ ID NO: 157094 - protein, 15 aa, Mycobacterium tuberculosis
DLTDDTVYGLQNLER

SEQ ID NO: 157095 - protein, 15 aa, Mycobacterium tuberculosis
LTDDTVYGLQNLERQ

SEQ ID NO: 157096 - protein, 15 aa, Mycobacterium tuberculosis
TDDTVYGLQNLERQT

SEQ ID NO: 157097 - protein, 15 aa, Mycobacterium tuberculosis
DDTVYGLQNLERQTF

SEQ ID NO: 157098 - protein, 15 aa, Mycobacterium tuberculosis
DTVYGLQNLERQTFL

SEQ ID NO: 157099 - protein, 15 aa, Mycobacterium tuberculosis
TVYGLQNLERQTFLQ

SEQ ID NO: 157100 - protein, 15 aa, Mycobacterium tuberculosis
VYGLQNLERQTFLQL

SEQ ID NO: 157101 - protein, 15 aa, Mycobacterium tuberculosis
YGLQNLERQTFLQLL

SEQ ID NO: 157102 - protein, 15 aa, Mycobacterium tuberculosis
GLQNLERQTFLQLLN

SEQ ID NO: 157103 - protein, 15 aa, Mycobacterium tuberculosis
LQNLERQTFLQLLNT

SEQ ID NO: 157104 - protein, 15 aa, Mycobacterium tuberculosis
QNLERQTFLQLLNTG

SEQ ID NO: 157105 - protein, 15 aa, Mycobacterium tuberculosis
NLERQTFLQLLNTGV

SEQ ID NO: 157106 - protein, 15 aa, Mycobacterium tuberculosis
LERQTFLQLLNTGVP

SEQ ID NO: 157107 - protein, 15 aa, Mycobacterium tuberculosis
ERQTFLQLLNTGVPE

SEQ ID NO: 157108 - protein, 15 aa, Mycobacterium tuberculosis
RQTFLQLLNTGVPEG

SEQ ID NO: 157109 - protein, 15 aa, Mycobacterium tuberculosis
QTFLQLLNTGVPEGK

SEQ ID NO: 157110 - protein, 15 aa, Mycobacterium tuberculosis
TFLQLLNTGVPEGKS

SEQ ID NO: 157111 - protein, 15 aa, Mycobacterium tuberculosis
FLQLLNTGVPEGKSI

SEQ ID NO: 157112 - protein, 15 aa, Mycobacterium tuberculosis
LQLLNTGVPEGKSIA

SEQ ID NO: 157113 - protein, 15 aa, Mycobacterium tuberculosis
QLLNTGVPEGKSIAS

SEQ ID NO: 157114 - protein, 15 aa, Mycobacterium tuberculosis
LLNTGVPEGKSIASF

SEQ ID NO: 157115 - protein, 15 aa, Mycobacterium tuberculosis
LNTGVPEGKSIASFA

SEQ ID NO: 157116 - protein, 15 aa, Mycobacterium tuberculosis
NTGVPEGKSIASFAR

SEQ ID NO: 157117 - protein, 15 aa, Mycobacterium tuberculosis
TGVPEGKSIASFARR

SEQ ID NO: 157118 - protein, 15 aa, Mycobacterium tuberculosis
GVPEGKSIASFARRL

SEQ ID NO: 157119 - protein, 15 aa, Mycobacterium tuberculosis
VPEGKSIASFARRLQ

SEQ ID NO: 157120 - protein, 15 aa, Mycobacterium tuberculosis
PEGKSIASFARRLQV

SEQ ID NO: 157121 - protein, 15 aa, Mycobacterium tuberculosis
EGKSIASFARRLQVA

SEQ ID NO: 157122 - protein, 15 aa, Mycobacterium tuberculosis
GKSIASFARRLQVAG

SEQ ID NO: 157123 - protein, 15 aa, Mycobacterium tuberculosis
KSIASFARRLQVAGV

SEQ ID NO: 157124 - protein, 15 aa, Mycobacterium tuberculosis
SIASFARRLQVAGVR

SEQ ID NO: 157125 - protein, 15 aa, Mycobacterium tuberculosis
IASFARRLQVAGVRV

SEQ ID NO: 157126 - protein, 15 aa, Mycobacterium tuberculosis
ASFARRLQVAGVRVA

SEQ ID NO: 157127 - protein, 15 aa, Mycobacterium tuberculosis
SFARRLQVAGVRVAA

SEQ ID NO: 157128 - protein, 15 aa, Mycobacterium tuberculosis
FARRLQVAGVRVAAH

SEQ ID NO: 157129 - protein, 15 aa, Mycobacterium tuberculosis
ARRLQVAGVRVAAHT

SEQ ID NO: 157130 - protein, 15 aa, Mycobacterium tuberculosis
RRLQVAGVRVAAHTS

SEQ ID NO: 157131 - protein, 15 aa, Mycobacterium tuberculosis
RLQVAGVRVAAHTSH

SEQ ID NO: 157132 - protein, 15 aa, Mycobacterium tuberculosis
LQVAGVRVAAHTSHR

SEQ ID NO: 157133 - protein, 15 aa, Mycobacterium tuberculosis
QVAGVRVAAHTSHRN

SEQ ID NO: 157134 - protein, 15 aa, Mycobacterium tuberculosis
VAGVRVAAHTSHRNY

SEQ ID NO: 157135 - protein, 15 aa, Mycobacterium tuberculosis
AGVRVAAHTSHRNYG

SEQ ID NO: 157136 - protein, 15 aa, Mycobacterium tuberculosis
GVRVAAHTSHRNYGH

SEQ ID NO: 157137 - protein, 15 aa, Mycobacterium tuberculosis
VRVAAHTSHRNYGHT

SEQ ID NO: 157138 - protein, 15 aa, Mycobacterium tuberculosis
RVAAHTSHRNYGHTL

SEQ ID NO: 157139 - protein, 15 aa, Mycobacterium tuberculosis
VAAHTSHRNYGHTLD

SEQ ID NO: 157140 - protein, 15 aa, Mycobacterium tuberculosis
AAHTSHRNYGHTLDA

SEQ ID NO: 157141 - protein, 15 aa, Mycobacterium tuberculosis
AHTSHRNYGHTLDAT

SEQ ID NO: 157142 - protein, 15 aa, Mycobacterium tuberculosis
HTSHRNYGHTLDATG

SEQ ID NO: 157143 - protein, 15 aa, Mycobacterium tuberculosis
TSHRNYGHTLDATGL

SEQ ID NO: 157144 - protein, 15 aa, Mycobacterium tuberculosis
SHRNYGHTLDATGLA

SEQ ID NO: 157145 - protein, 15 aa, Mycobacterium tuberculosis
HRNYGHTLDATGLAE

SEQ ID NO: 157146 - protein, 15 aa, Mycobacterium tuberculosis
RNYGHTLDATGLAEV

SEQ ID NO: 157147 - protein, 15 aa, Mycobacterium tuberculosis
NYGHTLDATGLAEVF

SEQ ID NO: 157148 - protein, 15 aa, Mycobacterium tuberculosis
YGHTLDATGLAEVFA

SEQ ID NO: 157149 - protein, 15 aa, Mycobacterium tuberculosis
GHTLDATGLAEVFAV

SEQ ID NO: 157150 - protein, 15 aa, Mycobacterium tuberculosis
HTLDATGLAEVFAVF

SEQ ID NO: 157151 - protein, 15 aa, Mycobacterium tuberculosis
TLDATGLAEVFAVFV

SEQ ID NO: 157152 - protein, 15 aa, Mycobacterium tuberculosis
LDATGLAEVFAVFVD

SEQ ID NO: 157153 - protein, 15 aa, Mycobacterium tuberculosis
DATGLAEVFAVFVDG

SEQ ID NO: 157154 - protein, 15 aa, Mycobacterium tuberculosis
ATGLAEVFAVFVDGA

SEQ ID NO: 157155 - protein, 15 aa, Mycobacterium tuberculosis
TGLAEVFAVFVDGAV

SEQ ID NO: 157156 - protein, 15 aa, Mycobacterium tuberculosis
GLAEVFAVFVDGAVT

SEQ ID NO: 157157 - protein, 15 aa, Mycobacterium tuberculosis
LAEVFAVFVDGAVTA

SEQ ID NO: 157158 - protein, 15 aa, Mycobacterium tuberculosis
AEVFAVFVDGAVTAE

SEQ ID NO: 157159 - protein, 15 aa, Mycobacterium tuberculosis
EVFAVFVDGAVTAEL

SEQ ID NO: 157160 - protein, 15 aa, Mycobacterium tuberculosis
VFAVFVDGAVTAELG

SEQ ID NO: 157161 - protein, 15 aa, Mycobacterium tuberculosis
FAVFVDGAVTAELGL

SEQ ID NO: 157162 - protein, 15 aa, Mycobacterium tuberculosis
AVFVDGAVTAELGLP

SEQ ID NO: 157163 - protein, 15 aa, Mycobacterium tuberculosis
VFVDGAVTAELGLPA

SEQ ID NO: 157164 - protein, 15 aa, Mycobacterium tuberculosis
FVDGAVTAELGLPAE

SEQ ID NO: 157165 - protein, 15 aa, Mycobacterium tuberculosis
VDGAVTAELGLPAEP

SEQ ID NO: 157166 - protein, 15 aa, Mycobacterium tuberculosis
DGAVTAELGLPAEPN

SEQ ID NO: 157167 - protein, 15 aa, Mycobacterium tuberculosis
GAVTAELGLPAEPNP

SEQ ID NO: 157168 - protein, 15 aa, Mycobacterium tuberculosis
AVTAELGLPAEPNPA

SEQ ID NO: 157169 - protein, 15 aa, Mycobacterium tuberculosis
VTAELGLPAEPNPAG

SEQ ID NO: 157170 - protein, 15 aa, Mycobacterium tuberculosis
TAELGLPAEPNPAGL

SEQ ID NO: 157171 - protein, 15 aa, Mycobacterium tuberculosis
AELGLPAEPNPAGLI

SEQ ID NO: 157172 - protein, 15 aa, Mycobacterium tuberculosis
ELGLPAEPNPAGLIE

SEQ ID NO: 157173 - protein, 15 aa, Mycobacterium tuberculosis
LGLPAEPNPAGLIET

SEQ ID NO: 157174 - protein, 15 aa, Mycobacterium tuberculosis
GLPAEPNPAGLIETA

SEQ ID NO: 157175 - protein, 15 aa, Mycobacterium tuberculosis
LPAEPNPAGLIETAK

SEQ ID NO: 157176 - protein, 15 aa, Mycobacterium tuberculosis
PAEPNPAGLIETAKR

SEQ ID NO: 157177 - protein, 15 aa, Mycobacterium tuberculosis
AEPNPAGLIETAKRL

SEQ ID NO: 157178 - protein, 15 aa, Mycobacterium tuberculosis
EPNPAGLIETAKRLG

SEQ ID NO: 157179 - protein, 15 aa, Mycobacterium tuberculosis
PNPAGLIETAKRLGA

SEQ ID NO: 157180 - protein, 15 aa, Mycobacterium tuberculosis
NPAGLIETAKRLGAN

SEQ ID NO: 157181 - protein, 15 aa, Mycobacterium tuberculosis
PAGLIETAKRLGANP

SEQ ID NO: 157182 - protein, 15 aa, Mycobacterium tuberculosis
AGLIETAKRLGANPG

SEQ ID NO: 157183 - protein, 15 aa, Mycobacterium tuberculosis
GLIETAKRLGANPGR

SEQ ID NO: 157184 - protein, 15 aa, Mycobacterium tuberculosis
LIETAKRLGANPGRC

SEQ ID NO: 157185 - protein, 15 aa, Mycobacterium tuberculosis
IETAKRLGANPGRCV

SEQ ID NO: 157186 - protein, 15 aa, Mycobacterium tuberculosis
ETAKRLGANPGRCVV

SEQ ID NO: 157187 - protein, 15 aa, Mycobacterium tuberculosis
TAKRLGANPGRCVVI

SEQ ID NO: 157188 - protein, 15 aa, Mycobacterium tuberculosis
AKRLGANPGRCVVID

SEQ ID NO: 157189 - protein, 15 aa, Mycobacterium tuberculosis
KRLGANPGRCVVIDS

SEQ ID NO: 157190 - protein, 15 aa, Mycobacterium tuberculosis
RLGANPGRCVVIDSC

SEQ ID NO: 157191 - protein, 15 aa, Mycobacterium tuberculosis
LGANPGRCVVIDSCQ

SEQ ID NO: 157192 - protein, 15 aa, Mycobacterium tuberculosis
GANPGRCVVIDSCQT

SEQ ID NO: 157193 - protein, 15 aa, Mycobacterium tuberculosis
ANPGRCVVIDSCQTG

SEQ ID NO: 157194 - protein, 15 aa, Mycobacterium tuberculosis
NPGRCVVIDSCQTGL

SEQ ID NO: 157195 - protein, 15 aa, Mycobacterium tuberculosis
PGRCVVIDSCQTGLR

SEQ ID NO: 157196 - protein, 15 aa, Mycobacterium tuberculosis
GRCVVIDSCQTGLRA

SEQ ID NO: 157197 - protein, 15 aa, Mycobacterium tuberculosis
RCVVIDSCQTGLRAG

SEQ ID NO: 157198 - protein, 15 aa, Mycobacterium tuberculosis
CVVIDSCQTGLRAGR

SEQ ID NO: 157199 - protein, 15 aa, Mycobacterium tuberculosis
VVIDSCQTGLRAGRN

SEQ ID NO: 157200 - protein, 15 aa, Mycobacterium tuberculosis
VIDSCQTGLRAGRNG

SEQ ID NO: 157201 - protein, 15 aa, Mycobacterium tuberculosis
IDSCQTGLRAGRNGG

SEQ ID NO: 157202 - protein, 15 aa, Mycobacterium tuberculosis
DSCQTGLRAGRNGGF

SEQ ID NO: 157203 - protein, 15 aa, Mycobacterium tuberculosis
SCQTGLRAGRNGGFA

SEQ ID NO: 157204 - protein, 15 aa, Mycobacterium tuberculosis
CQTGLRAGRNGGFAL

SEQ ID NO: 157205 - protein, 15 aa, Mycobacterium tuberculosis
QTGLRAGRNGGFALV

SEQ ID NO: 157206 - protein, 15 aa, Mycobacterium tuberculosis
TGLRAGRNGGFALVI

SEQ ID NO: 157207 - protein, 15 aa, Mycobacterium tuberculosis
GLRAGRNGGFALVIA

SEQ ID NO: 157208 - protein, 15 aa, Mycobacterium tuberculosis
LRAGRNGGFALVIAV

SEQ ID NO: 157209 - protein, 15 aa, Mycobacterium tuberculosis
RAGRNGGFALVIAVD

SEQ ID NO: 157210 - protein, 15 aa, Mycobacterium tuberculosis
AGRNGGFALVIAVDA

SEQ ID NO: 157211 - protein, 15 aa, Mycobacterium tuberculosis
GRNGGFALVIAVDAH

SEQ ID NO: 157212 - protein, 15 aa, Mycobacterium tuberculosis
RNGGFALVIAVDAHG

SEQ ID NO: 157213 - protein, 15 aa, Mycobacterium tuberculosis
NGGFALVIAVDAHGD

SEQ ID NO: 157214 - protein, 15 aa, Mycobacterium tuberculosis
GGFALVIAVDAHGDA

SEQ ID NO: 157215 - protein, 15 aa, Mycobacterium tuberculosis
GFALVIAVDAHGDAE

SEQ ID NO: 157216 - protein, 15 aa, Mycobacterium tuberculosis
FALVIAVDAHGDAEN

SEQ ID NO: 157217 - protein, 15 aa, Mycobacterium tuberculosis
ALVIAVDAHGDAENL

SEQ ID NO: 157218 - protein, 15 aa, Mycobacterium tuberculosis
LVIAVDAHGDAENLL

SEQ ID NO: 157219 - protein, 15 aa, Mycobacterium tuberculosis
VIAVDAHGDAENLLS

SEQ ID NO: 157220 - protein, 15 aa, Mycobacterium tuberculosis
IAVDAHGDAENLLSS

SEQ ID NO: 157221 - protein, 15 aa, Mycobacterium tuberculosis
AVDAHGDAENLLSSG

SEQ ID NO: 157222 - protein, 15 aa, Mycobacterium tuberculosis
VDAHGDAENLLSSGA

SEQ ID NO: 157223 - protein, 15 aa, Mycobacterium tuberculosis
DAHGDAENLLSSGAD

SEQ ID NO: 157224 - protein, 15 aa, Mycobacterium tuberculosis
AHGDAENLLSSGADA

SEQ ID NO: 157225 - protein, 15 aa, Mycobacterium tuberculosis
HGDAENLLSSGADAV

SEQ ID NO: 157226 - protein, 15 aa, Mycobacterium tuberculosis
GDAENLLSSGADAVV

SEQ ID NO: 157227 - protein, 15 aa, Mycobacterium tuberculosis
DAENLLSSGADAVVA

SEQ ID NO: 157228 - protein, 15 aa, Mycobacterium tuberculosis
AENLLSSGADAVVAD

SEQ ID NO: 157229 - protein, 15 aa, Mycobacterium tuberculosis
ENLLSSGADAVVADL

SEQ ID NO: 157230 - protein, 15 aa, Mycobacterium tuberculosis
NLLSSGADAVVADLA

SEQ ID NO: 157231 - protein, 15 aa, Mycobacterium tuberculosis
LLSSGADAVVADLAA

SEQ ID NO: 157232 - protein, 15 aa, Mycobacterium tuberculosis
LSSGADAVVADLAAV

SEQ ID NO: 157233 - protein, 15 aa, Mycobacterium tuberculosis
SSGADAVVADLAAVT

SEQ ID NO: 157234 - protein, 15 aa, Mycobacterium tuberculosis
SGADAVVADLAAVTV

SEQ ID NO: 157235 - protein, 15 aa, Mycobacterium tuberculosis
GADAVVADLAAVTVG

SEQ ID NO: 157236 - protein, 15 aa, Mycobacterium tuberculosis
ADAVVADLAAVTVGS

SEQ ID NO: 157237 - protein, 15 aa, Mycobacterium tuberculosis
DAVVADLAAVTVGSG

SEQ ID NO: 157238 - protein, 15 aa, Mycobacterium tuberculosis
AVVADLAAVTVGSGD

SEQ ID NO: 157239 - protein, 15 aa, Mycobacterium tuberculosis
VVADLAAVTVGSGDA

SEQ ID NO: 157240 - protein, 15 aa, Mycobacterium tuberculosis
VADLAAVTVGSGDAA

SEQ ID NO: 157241 - protein, 15 aa, Mycobacterium tuberculosis
ADLAAVTVGSGDAAI

SEQ ID NO: 157242 - protein, 15 aa, Mycobacterium tuberculosis
DLAAVTVGSGDAAIS

SEQ ID NO: 157243 - protein, 15 aa, Mycobacterium tuberculosis
LAAVTVGSGDAAIST

SEQ ID NO: 157244 - protein, 15 aa, Mycobacterium tuberculosis
AAVTVGSGDAAISTI

SEQ ID NO: 157245 - protein, 15 aa, Mycobacterium tuberculosis
AVTVGSGDAAISTIP

SEQ ID NO: 157246 - protein, 15 aa, Mycobacterium tuberculosis
VTVGSGDAAISTIPD

SEQ ID NO: 157247 - protein, 15 aa, Mycobacterium tuberculosis
TVGSGDAAISTIPDA

SEQ ID NO: 157248 - protein, 15 aa, Mycobacterium tuberculosis
VGSGDAAISTIPDAL

SEQ ID NO: 157249 - protein, 15 aa, Mycobacterium tuberculosis
GSGDAAISTIPDALQ

SEQ ID NO: 157250 - protein, 15 aa, Mycobacterium tuberculosis
SGDAAISTIPDALQV

SEQ ID NO: 157251 - protein, 15 aa, Mycobacterium tuberculosis
GDAAISTIPDALQVY

SEQ ID NO: 157252 - protein, 15 aa, Mycobacterium tuberculosis
DAAISTIPDALQVYS

SEQ ID NO: 157253 - protein, 15 aa, Mycobacterium tuberculosis
AAISTIPDALQVYSQ

SEQ ID NO: 157254 - protein, 15 aa, Mycobacterium tuberculosis
AISTIPDALQVYSQL

SEQ ID NO: 157255 - protein, 15 aa, Mycobacterium tuberculosis
ISTIPDALQVYSQLK

SEQ ID NO: 157256 - protein, 15 aa, Mycobacterium tuberculosis
STIPDALQVYSQLKR

SEQ ID NO: 157257 - protein, 15 aa, Mycobacterium tuberculosis
TIPDALQVYSQLKRL

SEQ ID NO: 157258 - protein, 15 aa, Mycobacterium tuberculosis
IPDALQVYSQLKRLL

SEQ ID NO: 157259 - protein, 15 aa, Mycobacterium tuberculosis
PDALQVYSQLKRLLT

SEQ ID NO: 157260 - protein, 15 aa, Mycobacterium tuberculosis
DALQVYSQLKRLLTG

SEQ ID NO: 157261 - protein, 15 aa, Mycobacterium tuberculosis
ALQVYSQLKRLLTGR

SEQ ID NO: 157262 - protein, 15 aa, Mycobacterium tuberculosis
LQVYSQLKRLLTGRR

SEQ ID NO: 157263 - protein, 15 aa, Mycobacterium tuberculosis
QVYSQLKRLLTGRRP

SEQ ID NO: 157264 - protein, 15 aa, Mycobacterium tuberculosis
VYSQLKRLLTGRRPA

SEQ ID NO: 157265 - protein, 15 aa, Mycobacterium tuberculosis
YSQLKRLLTGRRPAV

SEQ ID NO: 157266 - protein, 15 aa, Mycobacterium tuberculosis
SQLKRLLTGRRPAVF

SEQ ID NO: 157267 - protein, 15 aa, Mycobacterium tuberculosis
QLKRLLTGRRPAVFL

SEQ ID NO: 157268 - protein, 15 aa, Mycobacterium tuberculosis
LKRLLTGRRPAVFLD

SEQ ID NO: 157269 - protein, 15 aa, Mycobacterium tuberculosis
KRLLTGRRPAVFLDF

SEQ ID NO: 157270 - protein, 15 aa, Mycobacterium tuberculosis
RLLTGRRPAVFLDFD

SEQ ID NO: 157271 - protein, 15 aa, Mycobacterium tuberculosis
LLTGRRPAVFLDFDG

SEQ ID NO: 157272 - protein, 15 aa, Mycobacterium tuberculosis
LTGRRPAVFLDFDGT

SEQ ID NO: 157273 - protein, 15 aa, Mycobacterium tuberculosis
TGRRPAVFLDFDGTL

SEQ ID NO: 157274 - protein, 15 aa, Mycobacterium tuberculosis
GRRPAVFLDFDGTLS

SEQ ID NO: 157275 - protein, 15 aa, Mycobacterium tuberculosis
RRPAVFLDFDGTLSD

SEQ ID NO: 157276 - protein, 15 aa, Mycobacterium tuberculosis
RPAVFLDFDGTLSDI

SEQ ID NO: 157277 - protein, 15 aa, Mycobacterium tuberculosis
PAVFLDFDGTLSDIV

SEQ ID NO: 157278 - protein, 15 aa, Mycobacterium tuberculosis
AVFLDFDGTLSDIVE

SEQ ID NO: 157279 - protein, 15 aa, Mycobacterium tuberculosis
VFLDFDGTLSDIVER

SEQ ID NO: 157280 - protein, 15 aa, Mycobacterium tuberculosis
FLDFDGTLSDIVERP

SEQ ID NO: 157281 - protein, 15 aa, Mycobacterium tuberculosis
LDFDGTLSDIVERPE

SEQ ID NO: 157282 - protein, 15 aa, Mycobacterium tuberculosis
DFDGTLSDIVERPEA

SEQ ID NO: 157283 - protein, 15 aa, Mycobacterium tuberculosis
FDGTLSDIVERPEAA

SEQ ID NO: 157284 - protein, 15 aa, Mycobacterium tuberculosis
DGTLSDIVERPEAAT

SEQ ID NO: 157285 - protein, 15 aa, Mycobacterium tuberculosis
GTLSDIVERPEAATL

SEQ ID NO: 157286 - protein, 15 aa, Mycobacterium tuberculosis
TLSDIVERPEAATLV

SEQ ID NO: 157287 - protein, 15 aa, Mycobacterium tuberculosis
LSDIVERPEAATLVD

SEQ ID NO: 157288 - protein, 15 aa, Mycobacterium tuberculosis
SDIVERPEAATLVDG

SEQ ID NO: 157289 - protein, 15 aa, Mycobacterium tuberculosis
DIVERPEAATLVDGA

SEQ ID NO: 157290 - protein, 15 aa, Mycobacterium tuberculosis
IVERPEAATLVDGAA

SEQ ID NO: 157291 - protein, 15 aa, Mycobacterium tuberculosis
VERPEAATLVDGAAE

SEQ ID NO: 157292 - protein, 15 aa, Mycobacterium tuberculosis
ERPEAATLVDGAAEA

SEQ ID NO: 157293 - protein, 15 aa, Mycobacterium tuberculosis
RPEAATLVDGAAEAL

SEQ ID NO: 157294 - protein, 15 aa, Mycobacterium tuberculosis
PEAATLVDGAAEALR

SEQ ID NO: 157295 - protein, 15 aa, Mycobacterium tuberculosis
EAATLVDGAAEALRA

SEQ ID NO: 157296 - protein, 15 aa, Mycobacterium tuberculosis
AATLVDGAAEALRAL

SEQ ID NO: 157297 - protein, 15 aa, Mycobacterium tuberculosis
ATLVDGAAEALRALA

SEQ ID NO: 157298 - protein, 15 aa, Mycobacterium tuberculosis
TLVDGAAEALRALAA

SEQ ID NO: 157299 - protein, 15 aa, Mycobacterium tuberculosis
LVDGAAEALRALAAQ

SEQ ID NO: 157300 - protein, 15 aa, Mycobacterium tuberculosis
VDGAAEALRALAAQC

SEQ ID NO: 157301 - protein, 15 aa, Mycobacterium tuberculosis
DGAAEALRALAAQCP

SEQ ID NO: 157302 - protein, 15 aa, Mycobacterium tuberculosis
GAAEALRALAAQCPV

SEQ ID NO: 157303 - protein, 15 aa, Mycobacterium tuberculosis
AAEALRALAAQCPVA

SEQ ID NO: 157304 - protein, 15 aa, Mycobacterium tuberculosis
AEALRALAAQCPVAV

SEQ ID NO: 157305 - protein, 15 aa, Mycobacterium tuberculosis
EALRALAAQCPVAVI

SEQ ID NO: 157306 - protein, 15 aa, Mycobacterium tuberculosis
ALRALAAQCPVAVIS

SEQ ID NO: 157307 - protein, 15 aa, Mycobacterium tuberculosis
LRALAAQCPVAVISG

SEQ ID NO: 157308 - protein, 15 aa, Mycobacterium tuberculosis
RALAAQCPVAVISGR

SEQ ID NO: 157309 - protein, 15 aa, Mycobacterium tuberculosis
ALAAQCPVAVISGRD

SEQ ID NO: 157310 - protein, 15 aa, Mycobacterium tuberculosis
LAAQCPVAVISGRDL

SEQ ID NO: 157311 - protein, 15 aa, Mycobacterium tuberculosis
AAQCPVAVISGRDLA

SEQ ID NO: 157312 - protein, 15 aa, Mycobacterium tuberculosis
AQCPVAVISGRDLAD

SEQ ID NO: 157313 - protein, 15 aa, Mycobacterium tuberculosis
QCPVAVISGRDLADV

SEQ ID NO: 157314 - protein, 15 aa, Mycobacterium tuberculosis
CPVAVISGRDLADVR

SEQ ID NO: 157315 - protein, 15 aa, Mycobacterium tuberculosis
PVAVISGRDLADVRN

SEQ ID NO: 157316 - protein, 15 aa, Mycobacterium tuberculosis
VAVISGRDLADVRNR

SEQ ID NO: 157317 - protein, 15 aa, Mycobacterium tuberculosis
AVISGRDLADVRNRV

SEQ ID NO: 157318 - protein, 15 aa, Mycobacterium tuberculosis
VISGRDLADVRNRVK

SEQ ID NO: 157319 - protein, 15 aa, Mycobacterium tuberculosis
ISGRDLADVRNRVKV

SEQ ID NO: 157320 - protein, 15 aa, Mycobacterium tuberculosis
SGRDLADVRNRVKVD

SEQ ID NO: 157321 - protein, 15 aa, Mycobacterium tuberculosis
GRDLADVRNRVKVDG

SEQ ID NO: 157322 - protein, 15 aa, Mycobacterium tuberculosis
RDLADVRNRVKVDGL

SEQ ID NO: 157323 - protein, 15 aa, Mycobacterium tuberculosis
DLADVRNRVKVDGLW

SEQ ID NO: 157324 - protein, 15 aa, Mycobacterium tuberculosis
LADVRNRVKVDGLWL

SEQ ID NO: 157325 - protein, 15 aa, Mycobacterium tuberculosis
ADVRNRVKVDGLWLA

SEQ ID NO: 157326 - protein, 15 aa, Mycobacterium tuberculosis
DVRNRVKVDGLWLAG

SEQ ID NO: 157327 - protein, 15 aa, Mycobacterium tuberculosis
VRNRVKVDGLWLAGS

SEQ ID NO: 157328 - protein, 15 aa, Mycobacterium tuberculosis
RNRVKVDGLWLAGSH

SEQ ID NO: 157329 - protein, 15 aa, Mycobacterium tuberculosis
NRVKVDGLWLAGSHG

SEQ ID NO: 157330 - protein, 15 aa, Mycobacterium tuberculosis
RVKVDGLWLAGSHGF

SEQ ID NO: 157331 - protein, 15 aa, Mycobacterium tuberculosis
VKVDGLWLAGSHGFE

SEQ ID NO: 157332 - protein, 15 aa, Mycobacterium tuberculosis
KVDGLWLAGSHGFEL

SEQ ID NO: 157333 - protein, 15 aa, Mycobacterium tuberculosis
VDGLWLAGSHGFELV

SEQ ID NO: 157334 - protein, 15 aa, Mycobacterium tuberculosis
DGLWLAGSHGFELVA

SEQ ID NO: 157335 - protein, 15 aa, Mycobacterium tuberculosis
GLWLAGSHGFELVAP

SEQ ID NO: 157336 - protein, 15 aa, Mycobacterium tuberculosis
LWLAGSHGFELVAPD

SEQ ID NO: 157337 - protein, 15 aa, Mycobacterium tuberculosis
WLAGSHGFELVAPDG

SEQ ID NO: 157338 - protein, 15 aa, Mycobacterium tuberculosis
LAGSHGFELVAPDGS

SEQ ID NO: 157339 - protein, 15 aa, Mycobacterium tuberculosis
AGSHGFELVAPDGSH

SEQ ID NO: 157340 - protein, 15 aa, Mycobacterium tuberculosis
GSHGFELVAPDGSHH

SEQ ID NO: 157341 - protein, 15 aa, Mycobacterium tuberculosis
SHGFELVAPDGSHHQ

SEQ ID NO: 157342 - protein, 15 aa, Mycobacterium tuberculosis
HGFELVAPDGSHHQN

SEQ ID NO: 157343 - protein, 15 aa, Mycobacterium tuberculosis
GFELVAPDGSHHQNA

SEQ ID NO: 157344 - protein, 15 aa, Mycobacterium tuberculosis
FELVAPDGSHHQNAA

SEQ ID NO: 157345 - protein, 15 aa, Mycobacterium tuberculosis
ELVAPDGSHHQNAAA

SEQ ID NO: 157346 - protein, 15 aa, Mycobacterium tuberculosis
LVAPDGSHHQNAAAT

SEQ ID NO: 157347 - protein, 15 aa, Mycobacterium tuberculosis
VAPDGSHHQNAAATA

SEQ ID NO: 157348 - protein, 15 aa, Mycobacterium tuberculosis
APDGSHHQNAAATAA

SEQ ID NO: 157349 - protein, 15 aa, Mycobacterium tuberculosis
PDGSHHQNAAATAAI

SEQ ID NO: 157350 - protein, 15 aa, Mycobacterium tuberculosis
DGSHHQNAAATAAID

SEQ ID NO: 157351 - protein, 15 aa, Mycobacterium tuberculosis
GSHHQNAAATAAIDG

SEQ ID NO: 157352 - protein, 15 aa, Mycobacterium tuberculosis
SHHQNAAATAAIDGL

SEQ ID NO: 157353 - protein, 15 aa, Mycobacterium tuberculosis
HHQNAAATAAIDGLA

SEQ ID NO: 157354 - protein, 15 aa, Mycobacterium tuberculosis
HQNAAATAAIDGLAE

SEQ ID NO: 157355 - protein, 15 aa, Mycobacterium tuberculosis
QNAAATAAIDGLAEA

SEQ ID NO: 157356 - protein, 15 aa, Mycobacterium tuberculosis
NAAATAAIDGLAEAA

SEQ ID NO: 157357 - protein, 15 aa, Mycobacterium tuberculosis
AAATAAIDGLAEAAA

SEQ ID NO: 157358 - protein, 15 aa, Mycobacterium tuberculosis
AATAAIDGLAEAAAQ

SEQ ID NO: 157359 - protein, 15 aa, Mycobacterium tuberculosis
ATAAIDGLAEAAAQL

SEQ ID NO: 157360 - protein, 15 aa, Mycobacterium tuberculosis
TAAIDGLAEAAAQLA

SEQ ID NO: 157361 - protein, 15 aa, Mycobacterium tuberculosis
AAIDGLAEAAAQLAD

SEQ ID NO: 157362 - protein, 15 aa, Mycobacterium tuberculosis
AIDGLAEAAAQLADA

SEQ ID NO: 157363 - protein, 15 aa, Mycobacterium tuberculosis
IDGLAEAAAQLADAL

SEQ ID NO: 157364 - protein, 15 aa, Mycobacterium tuberculosis
DGLAEAAAQLADALR

SEQ ID NO: 157365 - protein, 15 aa, Mycobacterium tuberculosis
GLAEAAAQLADALRE

SEQ ID NO: 157366 - protein, 15 aa, Mycobacterium tuberculosis
LAEAAAQLADALREI

SEQ ID NO: 157367 - protein, 15 aa, Mycobacterium tuberculosis
AEAAAQLADALREIA

SEQ ID NO: 157368 - protein, 15 aa, Mycobacterium tuberculosis
EAAAQLADALREIAG

SEQ ID NO: 157369 - protein, 15 aa, Mycobacterium tuberculosis
AAAQLADALREIAGA

SEQ ID NO: 157370 - protein, 15 aa, Mycobacterium tuberculosis
AAQLADALREIAGAV

SEQ ID NO: 157371 - protein, 15 aa, Mycobacterium tuberculosis
AQLADALREIAGAVV

SEQ ID NO: 157372 - protein, 15 aa, Mycobacterium tuberculosis
QLADALREIAGAVVE

SEQ ID NO: 157373 - protein, 15 aa, Mycobacterium tuberculosis
LADALREIAGAVVEH

SEQ ID NO: 157374 - protein, 15 aa, Mycobacterium tuberculosis
ADALREIAGAVVEHK

SEQ ID NO: 157375 - protein, 15 aa, Mycobacterium tuberculosis
DALREIAGAVVEHKR

SEQ ID NO: 157376 - protein, 15 aa, Mycobacterium tuberculosis
ALREIAGAVVEHKRF

SEQ ID NO: 157377 - protein, 15 aa, Mycobacterium tuberculosis
LREIAGAVVEHKRFA

SEQ ID NO: 157378 - protein, 15 aa, Mycobacterium tuberculosis
REIAGAVVEHKRFAV

SEQ ID NO: 157379 - protein, 15 aa, Mycobacterium tuberculosis
EIAGAVVEHKRFAVA

SEQ ID NO: 157380 - protein, 15 aa, Mycobacterium tuberculosis
IAGAVVEHKRFAVAV

SEQ ID NO: 157381 - protein, 15 aa, Mycobacterium tuberculosis
AGAVVEHKRFAVAVH

SEQ ID NO: 157382 - protein, 15 aa, Mycobacterium tuberculosis
GAVVEHKRFAVAVHY

SEQ ID NO: 157383 - protein, 15 aa, Mycobacterium tuberculosis
AVVEHKRFAVAVHYR

SEQ ID NO: 157384 - protein, 15 aa, Mycobacterium tuberculosis
VVEHKRFAVAVHYRN

SEQ ID NO: 157385 - protein, 15 aa, Mycobacterium tuberculosis
VEHKRFAVAVHYRNV

SEQ ID NO: 157386 - protein, 15 aa, Mycobacterium tuberculosis
EHKRFAVAVHYRNVA

SEQ ID NO: 157387 - protein, 15 aa, Mycobacterium tuberculosis
HKRFAVAVHYRNVAD

SEQ ID NO: 157388 - protein, 15 aa, Mycobacterium tuberculosis
KRFAVAVHYRNVADD

SEQ ID NO: 157389 - protein, 15 aa, Mycobacterium tuberculosis
RFAVAVHYRNVADDS

SEQ ID NO: 157390 - protein, 15 aa, Mycobacterium tuberculosis
FAVAVHYRNVADDSV

SEQ ID NO: 157391 - protein, 15 aa, Mycobacterium tuberculosis
AVAVHYRNVADDSVD

SEQ ID NO: 157392 - protein, 15 aa, Mycobacterium tuberculosis
VAVHYRNVADDSVDN

SEQ ID NO: 157393 - protein, 15 aa, Mycobacterium tuberculosis
AVHYRNVADDSVDNL

SEQ ID NO: 157394 - protein, 15 aa, Mycobacterium tuberculosis
VHYRNVADDSVDNLI

SEQ ID NO: 157395 - protein, 15 aa, Mycobacterium tuberculosis
HYRNVADDSVDNLIA

SEQ ID NO: 157396 - protein, 15 aa, Mycobacterium tuberculosis
YRNVADDSVDNLIAA

SEQ ID NO: 157397 - protein, 15 aa, Mycobacterium tuberculosis
RNVADDSVDNLIAAV

SEQ ID NO: 157398 - protein, 15 aa, Mycobacterium tuberculosis
NVADDSVDNLIAAVR

SEQ ID NO: 157399 - protein, 15 aa, Mycobacterium tuberculosis
VADDSVDNLIAAVRR

SEQ ID NO: 157400 - protein, 15 aa, Mycobacterium tuberculosis
ADDSVDNLIAAVRRL

SEQ ID NO: 157401 - protein, 15 aa, Mycobacterium tuberculosis
DDSVDNLIAAVRRLG

SEQ ID NO: 157402 - protein, 15 aa, Mycobacterium tuberculosis
DSVDNLIAAVRRLGH

SEQ ID NO: 157403 - protein, 15 aa, Mycobacterium tuberculosis
SVDNLIAAVRRLGHA

SEQ ID NO: 157404 - protein, 15 aa, Mycobacterium tuberculosis
VDNLIAAVRRLGHAA

SEQ ID NO: 157405 - protein, 15 aa, Mycobacterium tuberculosis
DNLIAAVRRLGHAAG

SEQ ID NO: 157406 - protein, 15 aa, Mycobacterium tuberculosis
NLIAAVRRLGHAAGL

SEQ ID NO: 157407 - protein, 15 aa, Mycobacterium tuberculosis
LIAAVRRLGHAAGLR

SEQ ID NO: 157408 - protein, 15 aa, Mycobacterium tuberculosis
IAAVRRLGHAAGLRV

SEQ ID NO: 157409 - protein, 15 aa, Mycobacterium tuberculosis
AAVRRLGHAAGLRVT

SEQ ID NO: 157410 - protein, 15 aa, Mycobacterium tuberculosis
AVRRLGHAAGLRVTT

SEQ ID NO: 157411 - protein, 15 aa, Mycobacterium tuberculosis
VRRLGHAAGLRVTTG

SEQ ID NO: 157412 - protein, 15 aa, Mycobacterium tuberculosis
RRLGHAAGLRVTTGR

SEQ ID NO: 157413 - protein, 15 aa, Mycobacterium tuberculosis
RLGHAAGLRVTTGRK

SEQ ID NO: 157414 - protein, 15 aa, Mycobacterium tuberculosis
LGHAAGLRVTTGRKV

SEQ ID NO: 157415 - protein, 15 aa, Mycobacterium tuberculosis
GHAAGLRVTTGRKVV

SEQ ID NO: 157416 - protein, 15 aa, Mycobacterium tuberculosis
HAAGLRVTTGRKVVE

SEQ ID NO: 157417 - protein, 15 aa, Mycobacterium tuberculosis
AAGLRVTTGRKVVEL

SEQ ID NO: 157418 - protein, 15 aa, Mycobacterium tuberculosis
AGLRVTTGRKVVELR

SEQ ID NO: 157419 - protein, 15 aa, Mycobacterium tuberculosis
GLRVTTGRKVVELRP

SEQ ID NO: 157420 - protein, 15 aa, Mycobacterium tuberculosis
LRVTTGRKVVELRPD

SEQ ID NO: 157421 - protein, 15 aa, Mycobacterium tuberculosis
RVTTGRKVVELRPDI

SEQ ID NO: 157422 - protein, 15 aa, Mycobacterium tuberculosis
VTTGRKVVELRPDIA

SEQ ID NO: 157423 - protein, 15 aa, Mycobacterium tuberculosis
TTGRKVVELRPDIAW

SEQ ID NO: 157424 - protein, 15 aa, Mycobacterium tuberculosis
TGRKVVELRPDIAWD

SEQ ID NO: 157425 - protein, 15 aa, Mycobacterium tuberculosis
GRKVVELRPDIAWDK

SEQ ID NO: 157426 - protein, 15 aa, Mycobacterium tuberculosis
RKVVELRPDIAWDKG

SEQ ID NO: 157427 - protein, 15 aa, Mycobacterium tuberculosis
KVVELRPDIAWDKGK

SEQ ID NO: 157428 - protein, 15 aa, Mycobacterium tuberculosis
VVELRPDIAWDKGKA

SEQ ID NO: 157429 - protein, 15 aa, Mycobacterium tuberculosis
VELRPDIAWDKGKAL

SEQ ID NO: 157430 - protein, 15 aa, Mycobacterium tuberculosis
ELRPDIAWDKGKALD

SEQ ID NO: 157431 - protein, 15 aa, Mycobacterium tuberculosis
LRPDIAWDKGKALDW

SEQ ID NO: 157432 - protein, 15 aa, Mycobacterium tuberculosis
RPDIAWDKGKALDWI

SEQ ID NO: 157433 - protein, 15 aa, Mycobacterium tuberculosis
PDIAWDKGKALDWIG

SEQ ID NO: 157434 - protein, 15 aa, Mycobacterium tuberculosis
DIAWDKGKALDWIGE

SEQ ID NO: 157435 - protein, 15 aa, Mycobacterium tuberculosis
IAWDKGKALDWIGER

SEQ ID NO: 157436 - protein, 15 aa, Mycobacterium tuberculosis
AWDKGKALDWIGERL

SEQ ID NO: 157437 - protein, 15 aa, Mycobacterium tuberculosis
WDKGKALDWIGERLG

SEQ ID NO: 157438 - protein, 15 aa, Mycobacterium tuberculosis
DKGKALDWIGERLGP

SEQ ID NO: 157439 - protein, 15 aa, Mycobacterium tuberculosis
KGKALDWIGERLGPA

SEQ ID NO: 157440 - protein, 15 aa, Mycobacterium tuberculosis
GKALDWIGERLGPAE

SEQ ID NO: 157441 - protein, 15 aa, Mycobacterium tuberculosis
KALDWIGERLGPAEV

SEQ ID NO: 157442 - protein, 15 aa, Mycobacterium tuberculosis
ALDWIGERLGPAEVG

SEQ ID NO: 157443 - protein, 15 aa, Mycobacterium tuberculosis
LDWIGERLGPAEVGP

SEQ ID NO: 157444 - protein, 15 aa, Mycobacterium tuberculosis
DWIGERLGPAEVGPD

SEQ ID NO: 157445 - protein, 15 aa, Mycobacterium tuberculosis
WIGERLGPAEVGPDL

SEQ ID NO: 157446 - protein, 15 aa, Mycobacterium tuberculosis
IGERLGPAEVGPDLR

SEQ ID NO: 157447 - protein, 15 aa, Mycobacterium tuberculosis
GERLGPAEVGPDLRL

SEQ ID NO: 157448 - protein, 15 aa, Mycobacterium tuberculosis
ERLGPAEVGPDLRLP

SEQ ID NO: 157449 - protein, 15 aa, Mycobacterium tuberculosis
RLGPAEVGPDLRLPI

SEQ ID NO: 157450 - protein, 15 aa, Mycobacterium tuberculosis
LGPAEVGPDLRLPIY

SEQ ID NO: 157451 - protein, 15 aa, Mycobacterium tuberculosis
GPAEVGPDLRLPIYI

SEQ ID NO: 157452 - protein, 15 aa, Mycobacterium tuberculosis
PAEVGPDLRLPIYIG

SEQ ID NO: 157453 - protein, 15 aa, Mycobacterium tuberculosis
AEVGPDLRLPIYIGD

SEQ ID NO: 157454 - protein, 15 aa, Mycobacterium tuberculosis
EVGPDLRLPIYIGDD

SEQ ID NO: 157455 - protein, 15 aa, Mycobacterium tuberculosis
VGPDLRLPIYIGDDL

SEQ ID NO: 157456 - protein, 15 aa, Mycobacterium tuberculosis
GPDLRLPIYIGDDLT

SEQ ID NO: 157457 - protein, 15 aa, Mycobacterium tuberculosis
PDLRLPIYIGDDLTD

SEQ ID NO: 157458 - protein, 15 aa, Mycobacterium tuberculosis
DLRLPIYIGDDLTDE

SEQ ID NO: 157459 - protein, 15 aa, Mycobacterium tuberculosis
LRLPIYIGDDLTDED

SEQ ID NO: 157460 - protein, 15 aa, Mycobacterium tuberculosis
RLPIYIGDDLTDEDA

SEQ ID NO: 157461 - protein, 15 aa, Mycobacterium tuberculosis
LPIYIGDDLTDEDAF

SEQ ID NO: 157462 - protein, 15 aa, Mycobacterium tuberculosis
PIYIGDDLTDEDAFD

SEQ ID NO: 157463 - protein, 15 aa, Mycobacterium tuberculosis
IYIGDDLTDEDAFDA

SEQ ID NO: 157464 - protein, 15 aa, Mycobacterium tuberculosis
YIGDDLTDEDAFDAV

SEQ ID NO: 157465 - protein, 15 aa, Mycobacterium tuberculosis
IGDDLTDEDAFDAVR

SEQ ID NO: 157466 - protein, 15 aa, Mycobacterium tuberculosis
GDDLTDEDAFDAVRF

SEQ ID NO: 157467 - protein, 15 aa, Mycobacterium tuberculosis
DDLTDEDAFDAVRFT

SEQ ID NO: 157468 - protein, 15 aa, Mycobacterium tuberculosis
DLTDEDAFDAVRFTG

SEQ ID NO: 157469 - protein, 15 aa, Mycobacterium tuberculosis
LTDEDAFDAVRFTGV

SEQ ID NO: 157470 - protein, 15 aa, Mycobacterium tuberculosis
TDEDAFDAVRFTGVG

SEQ ID NO: 157471 - protein, 15 aa, Mycobacterium tuberculosis
DEDAFDAVRFTGVGI

SEQ ID NO: 157472 - protein, 15 aa, Mycobacterium tuberculosis
EDAFDAVRFTGVGIV

SEQ ID NO: 157473 - protein, 15 aa, Mycobacterium tuberculosis
DAFDAVRFTGVGIVV

SEQ ID NO: 157474 - protein, 15 aa, Mycobacterium tuberculosis
AFDAVRFTGVGIVVR

SEQ ID NO: 157475 - protein, 15 aa, Mycobacterium tuberculosis
FDAVRFTGVGIVVRH

SEQ ID NO: 157476 - protein, 15 aa, Mycobacterium tuberculosis
DAVRFTGVGIVVRHN

SEQ ID NO: 157477 - protein, 15 aa, Mycobacterium tuberculosis
AVRFTGVGIVVRHNE

SEQ ID NO: 157478 - protein, 15 aa, Mycobacterium tuberculosis
VRFTGVGIVVRHNEH

SEQ ID NO: 157479 - protein, 15 aa, Mycobacterium tuberculosis
RFTGVGIVVRHNEHG

SEQ ID NO: 157480 - protein, 15 aa, Mycobacterium tuberculosis
FTGVGIVVRHNEHGD

SEQ ID NO: 157481 - protein, 15 aa, Mycobacterium tuberculosis
TGVGIVVRHNEHGDR

SEQ ID NO: 157482 - protein, 15 aa, Mycobacterium tuberculosis
GVGIVVRHNEHGDRR

SEQ ID NO: 157483 - protein, 15 aa, Mycobacterium tuberculosis
VGIVVRHNEHGDRRS

SEQ ID NO: 157484 - protein, 15 aa, Mycobacterium tuberculosis
GIVVRHNEHGDRRSA

SEQ ID NO: 157485 - protein, 15 aa, Mycobacterium tuberculosis
IVVRHNEHGDRRSAA

SEQ ID NO: 157486 - protein, 15 aa, Mycobacterium tuberculosis
VVRHNEHGDRRSAAT

SEQ ID NO: 157487 - protein, 15 aa, Mycobacterium tuberculosis
VRHNEHGDRRSAATF

SEQ ID NO: 157488 - protein, 15 aa, Mycobacterium tuberculosis
RHNEHGDRRSAATFR

SEQ ID NO: 157489 - protein, 15 aa, Mycobacterium tuberculosis
HNEHGDRRSAATFRL

SEQ ID NO: 157490 - protein, 15 aa, Mycobacterium tuberculosis
NEHGDRRSAATFRLE

SEQ ID NO: 157491 - protein, 15 aa, Mycobacterium tuberculosis
EHGDRRSAATFRLEC

SEQ ID NO: 157492 - protein, 15 aa, Mycobacterium tuberculosis
HGDRRSAATFRLECP

SEQ ID NO: 157493 - protein, 15 aa, Mycobacterium tuberculosis
GDRRSAATFRLECPY

SEQ ID NO: 157494 - protein, 15 aa, Mycobacterium tuberculosis
DRRSAATFRLECPYT

SEQ ID NO: 157495 - protein, 15 aa, Mycobacterium tuberculosis
RRSAATFRLECPYTV

SEQ ID NO: 157496 - protein, 15 aa, Mycobacterium tuberculosis
RSAATFRLECPYTVC

SEQ ID NO: 157497 - protein, 15 aa, Mycobacterium tuberculosis
SAATFRLECPYTVCQ

SEQ ID NO: 157498 - protein, 15 aa, Mycobacterium tuberculosis
AATFRLECPYTVCQF

SEQ ID NO: 157499 - protein, 15 aa, Mycobacterium tuberculosis
ATFRLECPYTVCQFL

SEQ ID NO: 157500 - protein, 15 aa, Mycobacterium tuberculosis
TFRLECPYTVCQFLS

SEQ ID NO: 157501 - protein, 15 aa, Mycobacterium tuberculosis
FRLECPYTVCQFLSQ

SEQ ID NO: 157502 - protein, 15 aa, Mycobacterium tuberculosis
RLECPYTVCQFLSQL

SEQ ID NO: 157503 - protein, 15 aa, Mycobacterium tuberculosis
LECPYTVCQFLSQLA

SEQ ID NO: 157504 - protein, 15 aa, Mycobacterium tuberculosis
ECPYTVCQFLSQLAC

SEQ ID NO: 157505 - protein, 15 aa, Mycobacterium tuberculosis
CPYTVCQFLSQLACD

SEQ ID NO: 157506 - protein, 15 aa, Mycobacterium tuberculosis
PYTVCQFLSQLACDL

SEQ ID NO: 157507 - protein, 15 aa, Mycobacterium tuberculosis
YTVCQFLSQLACDLQ

SEQ ID NO: 157508 - protein, 15 aa, Mycobacterium tuberculosis
TVCQFLSQLACDLQE

SEQ ID NO: 157509 - protein, 15 aa, Mycobacterium tuberculosis
VCQFLSQLACDLQEA

SEQ ID NO: 157510 - protein, 15 aa, Mycobacterium tuberculosis
CQFLSQLACDLQEAV

SEQ ID NO: 157511 - protein, 15 aa, Mycobacterium tuberculosis
QFLSQLACDLQEAVQ

SEQ ID NO: 157512 - protein, 15 aa, Mycobacterium tuberculosis
FLSQLACDLQEAVQH

SEQ ID NO: 157513 - protein, 15 aa, Mycobacterium tuberculosis
LSQLACDLQEAVQHD

SEQ ID NO: 157514 - protein, 15 aa, Mycobacterium tuberculosis
SQLACDLQEAVQHDD

SEQ ID NO: 157515 - protein, 15 aa, Mycobacterium tuberculosis
QLACDLQEAVQHDDP

SEQ ID NO: 157516 - protein, 15 aa, Mycobacterium tuberculosis
LACDLQEAVQHDDPW

SEQ ID NO: 157517 - protein, 15 aa, Mycobacterium tuberculosis
ACDLQEAVQHDDPWT

SEQ ID NO: 157518 - protein, 15 aa, Mycobacterium tuberculosis
CDLQEAVQHDDPWTL

SEQ ID NO: 157519 - protein, 15 aa, Mycobacterium tuberculosis
DLQEAVQHDDPWTLV

SEQ ID NO: 157520 - protein, 15 aa, Mycobacterium tuberculosis
LQEAVQHDDPWTLVF

SEQ ID NO: 157521 - protein, 15 aa, Mycobacterium tuberculosis
QEAVQHDDPWTLVFH

SEQ ID NO: 157522 - protein, 15 aa, Mycobacterium tuberculosis
EAVQHDDPWTLVFHG

SEQ ID NO: 157523 - protein, 15 aa, Mycobacterium tuberculosis
AVQHDDPWTLVFHGY

SEQ ID NO: 157524 - protein, 15 aa, Mycobacterium tuberculosis
VQHDDPWTLVFHGYD

SEQ ID NO: 157525 - protein, 15 aa, Mycobacterium tuberculosis
QHDDPWTLVFHGYDP

SEQ ID NO: 157526 - protein, 15 aa, Mycobacterium tuberculosis
HDDPWTLVFHGYDPG

SEQ ID NO: 157527 - protein, 15 aa, Mycobacterium tuberculosis
DDPWTLVFHGYDPGQ

SEQ ID NO: 157528 - protein, 15 aa, Mycobacterium tuberculosis
DPWTLVFHGYDPGQE

SEQ ID NO: 157529 - protein, 15 aa, Mycobacterium tuberculosis
PWTLVFHGYDPGQER

SEQ ID NO: 157530 - protein, 15 aa, Mycobacterium tuberculosis
WTLVFHGYDPGQERL

SEQ ID NO: 157531 - protein, 15 aa, Mycobacterium tuberculosis
TLVFHGYDPGQERLR

SEQ ID NO: 157532 - protein, 15 aa, Mycobacterium tuberculosis
LVFHGYDPGQERLRE

SEQ ID NO: 157533 - protein, 15 aa, Mycobacterium tuberculosis
VFHGYDPGQERLREA

SEQ ID NO: 157534 - protein, 15 aa, Mycobacterium tuberculosis
FHGYDPGQERLREAL

SEQ ID NO: 157535 - protein, 15 aa, Mycobacterium tuberculosis
HGYDPGQERLREALC

SEQ ID NO: 157536 - protein, 15 aa, Mycobacterium tuberculosis
GYDPGQERLREALCA

SEQ ID NO: 157537 - protein, 15 aa, Mycobacterium tuberculosis
YDPGQERLREALCAV

SEQ ID NO: 157538 - protein, 15 aa, Mycobacterium tuberculosis
DPGQERLREALCAVG

SEQ ID NO: 157539 - protein, 15 aa, Mycobacterium tuberculosis
PGQERLREALCAVGN

SEQ ID NO: 157540 - protein, 15 aa, Mycobacterium tuberculosis
GQERLREALCAVGNG

SEQ ID NO: 157541 - protein, 15 aa, Mycobacterium tuberculosis
QERLREALCAVGNGY

SEQ ID NO: 157542 - protein, 15 aa, Mycobacterium tuberculosis
ERLREALCAVGNGYL

SEQ ID NO: 157543 - protein, 15 aa, Mycobacterium tuberculosis
RLREALCAVGNGYLG

SEQ ID NO: 157544 - protein, 15 aa, Mycobacterium tuberculosis
LREALCAVGNGYLGS

SEQ ID NO: 157545 - protein, 15 aa, Mycobacterium tuberculosis
REALCAVGNGYLGSR

SEQ ID NO: 157546 - protein, 15 aa, Mycobacterium tuberculosis
EALCAVGNGYLGSRG

SEQ ID NO: 157547 - protein, 15 aa, Mycobacterium tuberculosis
ALCAVGNGYLGSRGC

SEQ ID NO: 157548 - protein, 15 aa, Mycobacterium tuberculosis
LCAVGNGYLGSRGCA

SEQ ID NO: 157549 - protein, 15 aa, Mycobacterium tuberculosis
CAVGNGYLGSRGCAP

SEQ ID NO: 157550 - protein, 15 aa, Mycobacterium tuberculosis
AVGNGYLGSRGCAPE

SEQ ID NO: 157551 - protein, 15 aa, Mycobacterium tuberculosis
VGNGYLGSRGCAPES

SEQ ID NO: 157552 - protein, 15 aa, Mycobacterium tuberculosis
GNGYLGSRGCAPESA

SEQ ID NO: 157553 - protein, 15 aa, Mycobacterium tuberculosis
NGYLGSRGCAPESAE

SEQ ID NO: 157554 - protein, 15 aa, Mycobacterium tuberculosis
GYLGSRGCAPESAES

SEQ ID NO: 157555 - protein, 15 aa, Mycobacterium tuberculosis
YLGSRGCAPESAESE

SEQ ID NO: 157556 - protein, 15 aa, Mycobacterium tuberculosis
LGSRGCAPESAESEA

SEQ ID NO: 157557 - protein, 15 aa, Mycobacterium tuberculosis
GSRGCAPESAESEAH

SEQ ID NO: 157558 - protein, 15 aa, Mycobacterium tuberculosis
SRGCAPESAESEAHY

SEQ ID NO: 157559 - protein, 15 aa, Mycobacterium tuberculosis
RGCAPESAESEAHYP

SEQ ID NO: 157560 - protein, 15 aa, Mycobacterium tuberculosis
GCAPESAESEAHYPG

SEQ ID NO: 157561 - protein, 15 aa, Mycobacterium tuberculosis
CAPESAESEAHYPGT

SEQ ID NO: 157562 - protein, 15 aa, Mycobacterium tuberculosis
APESAESEAHYPGTY

SEQ ID NO: 157563 - protein, 15 aa, Mycobacterium tuberculosis
PESAESEAHYPGTYV

SEQ ID NO: 157564 - protein, 15 aa, Mycobacterium tuberculosis
ESAESEAHYPGTYVA

SEQ ID NO: 157565 - protein, 15 aa, Mycobacterium tuberculosis
SAESEAHYPGTYVAG

SEQ ID NO: 157566 - protein, 15 aa, Mycobacterium tuberculosis
AESEAHYPGTYVAGV

SEQ ID NO: 157567 - protein, 15 aa, Mycobacterium tuberculosis
ESEAHYPGTYVAGVY

SEQ ID NO: 157568 - protein, 15 aa, Mycobacterium tuberculosis
SEAHYPGTYVAGVYN

SEQ ID NO: 157569 - protein, 15 aa, Mycobacterium tuberculosis
EAHYPGTYVAGVYNQ

SEQ ID NO: 157570 - protein, 15 aa, Mycobacterium tuberculosis
AHYPGTYVAGVYNQL

SEQ ID NO: 157571 - protein, 15 aa, Mycobacterium tuberculosis
HYPGTYVAGVYNQLT

SEQ ID NO: 157572 - protein, 15 aa, Mycobacterium tuberculosis
YPGTYVAGVYNQLTD

SEQ ID NO: 157573 - protein, 15 aa, Mycobacterium tuberculosis
PGTYVAGVYNQLTDH

SEQ ID NO: 157574 - protein, 15 aa, Mycobacterium tuberculosis
GTYVAGVYNQLTDHI

SEQ ID NO: 157575 - protein, 15 aa, Mycobacterium tuberculosis
TYVAGVYNQLTDHIE

SEQ ID NO: 157576 - protein, 15 aa, Mycobacterium tuberculosis
YVAGVYNQLTDHIEG

SEQ ID NO: 157577 - protein, 15 aa, Mycobacterium tuberculosis
VAGVYNQLTDHIEGC

SEQ ID NO: 157578 - protein, 15 aa, Mycobacterium tuberculosis
AGVYNQLTDHIEGCT

SEQ ID NO: 157579 - protein, 15 aa, Mycobacterium tuberculosis
GVYNQLTDHIEGCTV

SEQ ID NO: 157580 - protein, 15 aa, Mycobacterium tuberculosis
VYNQLTDHIEGCTVD

SEQ ID NO: 157581 - protein, 15 aa, Mycobacterium tuberculosis
YNQLTDHIEGCTVDN

SEQ ID NO: 157582 - protein, 15 aa, Mycobacterium tuberculosis
NQLTDHIEGCTVDNE

SEQ ID NO: 157583 - protein, 15 aa, Mycobacterium tuberculosis
QLTDHIEGCTVDNES

SEQ ID NO: 157584 - protein, 15 aa, Mycobacterium tuberculosis
LTDHIEGCTVDNESL

SEQ ID NO: 157585 - protein, 15 aa, Mycobacterium tuberculosis
TDHIEGCTVDNESLV

SEQ ID NO: 157586 - protein, 15 aa, Mycobacterium tuberculosis
DHIEGCTVDNESLVN

SEQ ID NO: 157587 - protein, 15 aa, Mycobacterium tuberculosis
HIEGCTVDNESLVNL

SEQ ID NO: 157588 - protein, 15 aa, Mycobacterium tuberculosis
IEGCTVDNESLVNLP

SEQ ID NO: 157589 - protein, 15 aa, Mycobacterium tuberculosis
EGCTVDNESLVNLPN

SEQ ID NO: 157590 - protein, 15 aa, Mycobacterium tuberculosis
GCTVDNESLVNLPNW

SEQ ID NO: 157591 - protein, 15 aa, Mycobacterium tuberculosis
CTVDNESLVNLPNWL

SEQ ID NO: 157592 - protein, 15 aa, Mycobacterium tuberculosis
TVDNESLVNLPNWLS

SEQ ID NO: 157593 - protein, 15 aa, Mycobacterium tuberculosis
VDNESLVNLPNWLSL

SEQ ID NO: 157594 - protein, 15 aa, Mycobacterium tuberculosis
DNESLVNLPNWLSLT

SEQ ID NO: 157595 - protein, 15 aa, Mycobacterium tuberculosis
NESLVNLPNWLSLTF

SEQ ID NO: 157596 - protein, 15 aa, Mycobacterium tuberculosis
ESLVNLPNWLSLTFR

SEQ ID NO: 157597 - protein, 15 aa, Mycobacterium tuberculosis
SLVNLPNWLSLTFRI

SEQ ID NO: 157598 - protein, 15 aa, Mycobacterium tuberculosis
LVNLPNWLSLTFRID

SEQ ID NO: 157599 - protein, 15 aa, Mycobacterium tuberculosis
VNLPNWLSLTFRIDG

SEQ ID NO: 157600 - protein, 15 aa, Mycobacterium tuberculosis
NLPNWLSLTFRIDGG

SEQ ID NO: 157601 - protein, 15 aa, Mycobacterium tuberculosis
LPNWLSLTFRIDGGA

SEQ ID NO: 157602 - protein, 15 aa, Mycobacterium tuberculosis
PNWLSLTFRIDGGAW

SEQ ID NO: 157603 - protein, 15 aa, Mycobacterium tuberculosis
NWLSLTFRIDGGAWF

SEQ ID NO: 157604 - protein, 15 aa, Mycobacterium tuberculosis
WLSLTFRIDGGAWFN

SEQ ID NO: 157605 - protein, 15 aa, Mycobacterium tuberculosis
LSLTFRIDGGAWFNV

SEQ ID NO: 157606 - protein, 15 aa, Mycobacterium tuberculosis
SLTFRIDGGAWFNVD

SEQ ID NO: 157607 - protein, 15 aa, Mycobacterium tuberculosis
LTFRIDGGAWFNVDT

SEQ ID NO: 157608 - protein, 15 aa, Mycobacterium tuberculosis
TFRIDGGAWFNVDTV

SEQ ID NO: 157609 - protein, 15 aa, Mycobacterium tuberculosis
FRIDGGAWFNVDTVE

SEQ ID NO: 157610 - protein, 15 aa, Mycobacterium tuberculosis
RIDGGAWFNVDTVEL

SEQ ID NO: 157611 - protein, 15 aa, Mycobacterium tuberculosis
IDGGAWFNVDTVELL

SEQ ID NO: 157612 - protein, 15 aa, Mycobacterium tuberculosis
DGGAWFNVDTVELLS

SEQ ID NO: 157613 - protein, 15 aa, Mycobacterium tuberculosis
GGAWFNVDTVELLSY

SEQ ID NO: 157614 - protein, 15 aa, Mycobacterium tuberculosis
GAWFNVDTVELLSYR

SEQ ID NO: 157615 - protein, 15 aa, Mycobacterium tuberculosis
AWFNVDTVELLSYRQ

SEQ ID NO: 157616 - protein, 15 aa, Mycobacterium tuberculosis
WFNVDTVELLSYRQT

SEQ ID NO: 157617 - protein, 15 aa, Mycobacterium tuberculosis
FNVDTVELLSYRQTF

SEQ ID NO: 157618 - protein, 15 aa, Mycobacterium tuberculosis
NVDTVELLSYRQTFD

SEQ ID NO: 157619 - protein, 15 aa, Mycobacterium tuberculosis
VDTVELLSYRQTFDL

SEQ ID NO: 157620 - protein, 15 aa, Mycobacterium tuberculosis
DTVELLSYRQTFDLR

SEQ ID NO: 157621 - protein, 15 aa, Mycobacterium tuberculosis
TVELLSYRQTFDLRR

SEQ ID NO: 157622 - protein, 15 aa, Mycobacterium tuberculosis
VELLSYRQTFDLRRA

SEQ ID NO: 157623 - protein, 15 aa, Mycobacterium tuberculosis
ELLSYRQTFDLRRAT

SEQ ID NO: 157624 - protein, 15 aa, Mycobacterium tuberculosis
LLSYRQTFDLRRATL

SEQ ID NO: 157625 - protein, 15 aa, Mycobacterium tuberculosis
LSYRQTFDLRRATLT

SEQ ID NO: 157626 - protein, 15 aa, Mycobacterium tuberculosis
SYRQTFDLRRATLTR

SEQ ID NO: 157627 - protein, 15 aa, Mycobacterium tuberculosis
YRQTFDLRRATLTRS

SEQ ID NO: 157628 - protein, 15 aa, Mycobacterium tuberculosis
RQTFDLRRATLTRSL

SEQ ID NO: 157629 - protein, 15 aa, Mycobacterium tuberculosis
QTFDLRRATLTRSLR

SEQ ID NO: 157630 - protein, 15 aa, Mycobacterium tuberculosis
TFDLRRATLTRSLRF

SEQ ID NO: 157631 - protein, 15 aa, Mycobacterium tuberculosis
FDLRRATLTRSLRFR

SEQ ID NO: 157632 - protein, 15 aa, Mycobacterium tuberculosis
DLRRATLTRSLRFRD

SEQ ID NO: 157633 - protein, 15 aa, Mycobacterium tuberculosis
LRRATLTRSLRFRDA

SEQ ID NO: 157634 - protein, 15 aa, Mycobacterium tuberculosis
RRATLTRSLRFRDAG

SEQ ID NO: 157635 - protein, 15 aa, Mycobacterium tuberculosis
RATLTRSLRFRDAGG

SEQ ID NO: 157636 - protein, 15 aa, Mycobacterium tuberculosis
ATLTRSLRFRDAGGR

SEQ ID NO: 157637 - protein, 15 aa, Mycobacterium tuberculosis
TLTRSLRFRDAGGRV

SEQ ID NO: 157638 - protein, 15 aa, Mycobacterium tuberculosis
LTRSLRFRDAGGRVT

SEQ ID NO: 157639 - protein, 15 aa, Mycobacterium tuberculosis
TRSLRFRDAGGRVTT

SEQ ID NO: 157640 - protein, 15 aa, Mycobacterium tuberculosis
RSLRFRDAGGRVTTM

SEQ ID NO: 157641 - protein, 15 aa, Mycobacterium tuberculosis
SLRFRDAGGRVTTMT

SEQ ID NO: 157642 - protein, 15 aa, Mycobacterium tuberculosis
LRFRDAGGRVTTMTQ

SEQ ID NO: 157643 - protein, 15 aa, Mycobacterium tuberculosis
RFRDAGGRVTTMTQE

SEQ ID NO: 157644 - protein, 15 aa, Mycobacterium tuberculosis
FRDAGGRVTTMTQER

SEQ ID NO: 157645 - protein, 15 aa, Mycobacterium tuberculosis
RDAGGRVTTMTQERF

SEQ ID NO: 157646 - protein, 15 aa, Mycobacterium tuberculosis
DAGGRVTTMTQERFA

SEQ ID NO: 157647 - protein, 15 aa, Mycobacterium tuberculosis
AGGRVTTMTQERFAS

SEQ ID NO: 157648 - protein, 15 aa, Mycobacterium tuberculosis
GGRVTTMTQERFASM

SEQ ID NO: 157649 - protein, 15 aa, Mycobacterium tuberculosis
GRVTTMTQERFASMN

SEQ ID NO: 157650 - protein, 15 aa, Mycobacterium tuberculosis
RVTTMTQERFASMNR

SEQ ID NO: 157651 - protein, 15 aa, Mycobacterium tuberculosis
VTTMTQERFASMNRP

SEQ ID NO: 157652 - protein, 15 aa, Mycobacterium tuberculosis
TTMTQERFASMNRPN

SEQ ID NO: 157653 - protein, 15 aa, Mycobacterium tuberculosis
TMTQERFASMNRPNL

SEQ ID NO: 157654 - protein, 15 aa, Mycobacterium tuberculosis
MTQERFASMNRPNLV

SEQ ID NO: 157655 - protein, 15 aa, Mycobacterium tuberculosis
TQERFASMNRPNLVA

SEQ ID NO: 157656 - protein, 15 aa, Mycobacterium tuberculosis
QERFASMNRPNLVAL

SEQ ID NO: 157657 - protein, 15 aa, Mycobacterium tuberculosis
ERFASMNRPNLVALQ

SEQ ID NO: 157658 - protein, 15 aa, Mycobacterium tuberculosis
RFASMNRPNLVALQT

SEQ ID NO: 157659 - protein, 15 aa, Mycobacterium tuberculosis
FASMNRPNLVALQTR

SEQ ID NO: 157660 - protein, 15 aa, Mycobacterium tuberculosis
ASMNRPNLVALQTRI

SEQ ID NO: 157661 - protein, 15 aa, Mycobacterium tuberculosis
SMNRPNLVALQTRIE

SEQ ID NO: 157662 - protein, 15 aa, Mycobacterium tuberculosis
MNRPNLVALQTRIES

SEQ ID NO: 157663 - protein, 15 aa, Mycobacterium tuberculosis
NRPNLVALQTRIESE

SEQ ID NO: 157664 - protein, 15 aa, Mycobacterium tuberculosis
RPNLVALQTRIESEN

SEQ ID NO: 157665 - protein, 15 aa, Mycobacterium tuberculosis
PNLVALQTRIESENW

SEQ ID NO: 157666 - protein, 15 aa, Mycobacterium tuberculosis
NLVALQTRIESENWS

SEQ ID NO: 157667 - protein, 15 aa, Mycobacterium tuberculosis
LVALQTRIESENWSG

SEQ ID NO: 157668 - protein, 15 aa, Mycobacterium tuberculosis
VALQTRIESENWSGT

SEQ ID NO: 157669 - protein, 15 aa, Mycobacterium tuberculosis
ALQTRIESENWSGTV

SEQ ID NO: 157670 - protein, 15 aa, Mycobacterium tuberculosis
LQTRIESENWSGTVD

SEQ ID NO: 157671 - protein, 15 aa, Mycobacterium tuberculosis
QTRIESENWSGTVDF

SEQ ID NO: 157672 - protein, 15 aa, Mycobacterium tuberculosis
TRIESENWSGTVDFR

SEQ ID NO: 157673 - protein, 15 aa, Mycobacterium tuberculosis
RIESENWSGTVDFRS

SEQ ID NO: 157674 - protein, 15 aa, Mycobacterium tuberculosis
IESENWSGTVDFRSL

SEQ ID NO: 157675 - protein, 15 aa, Mycobacterium tuberculosis
ESENWSGTVDFRSLV

SEQ ID NO: 157676 - protein, 15 aa, Mycobacterium tuberculosis
SENWSGTVDFRSLVD

SEQ ID NO: 157677 - protein, 15 aa, Mycobacterium tuberculosis
ENWSGTVDFRSLVDG

SEQ ID NO: 157678 - protein, 15 aa, Mycobacterium tuberculosis
NWSGTVDFRSLVDGG

SEQ ID NO: 157679 - protein, 15 aa, Mycobacterium tuberculosis
WSGTVDFRSLVDGGV

SEQ ID NO: 157680 - protein, 15 aa, Mycobacterium tuberculosis
SGTVDFRSLVDGGVH

SEQ ID NO: 157681 - protein, 15 aa, Mycobacterium tuberculosis
GTVDFRSLVDGGVHN

SEQ ID NO: 157682 - protein, 15 aa, Mycobacterium tuberculosis
TVDFRSLVDGGVHNT

SEQ ID NO: 157683 - protein, 15 aa, Mycobacterium tuberculosis
VDFRSLVDGGVHNTL

SEQ ID NO: 157684 - protein, 15 aa, Mycobacterium tuberculosis
DFRSLVDGGVHNTLV

SEQ ID NO: 157685 - protein, 15 aa, Mycobacterium tuberculosis
FRSLVDGGVHNTLVD

SEQ ID NO: 157686 - protein, 15 aa, Mycobacterium tuberculosis
RSLVDGGVHNTLVDR

SEQ ID NO: 157687 - protein, 15 aa, Mycobacterium tuberculosis
SLVDGGVHNTLVDRY

SEQ ID NO: 157688 - protein, 15 aa, Mycobacterium tuberculosis
LVDGGVHNTLVDRYR

SEQ ID NO: 157689 - protein, 15 aa, Mycobacterium tuberculosis
VDGGVHNTLVDRYRQ

SEQ ID NO: 157690 - protein, 15 aa, Mycobacterium tuberculosis
DGGVHNTLVDRYRQL

SEQ ID NO: 157691 - protein, 15 aa, Mycobacterium tuberculosis
GGVHNTLVDRYRQLS

SEQ ID NO: 157692 - protein, 15 aa, Mycobacterium tuberculosis
GVHNTLVDRYRQLSS

SEQ ID NO: 157693 - protein, 15 aa, Mycobacterium tuberculosis
VHNTLVDRYRQLSSQ

SEQ ID NO: 157694 - protein, 15 aa, Mycobacterium tuberculosis
HNTLVDRYRQLSSQH

SEQ ID NO: 157695 - protein, 15 aa, Mycobacterium tuberculosis
NTLVDRYRQLSSQHL

SEQ ID NO: 157696 - protein, 15 aa, Mycobacterium tuberculosis
TLVDRYRQLSSQHLT

SEQ ID NO: 157697 - protein, 15 aa, Mycobacterium tuberculosis
LVDRYRQLSSQHLTT

SEQ ID NO: 157698 - protein, 15 aa, Mycobacterium tuberculosis
VDRYRQLSSQHLTTA

SEQ ID NO: 157699 - protein, 15 aa, Mycobacterium tuberculosis
DRYRQLSSQHLTTAE

SEQ ID NO: 157700 - protein, 15 aa, Mycobacterium tuberculosis
RYRQLSSQHLTTAEI

SEQ ID NO: 157701 - protein, 15 aa, Mycobacterium tuberculosis
YRQLSSQHLTTAEIE

SEQ ID NO: 157702 - protein, 15 aa, Mycobacterium tuberculosis
RQLSSQHLTTAEIEV

SEQ ID NO: 157703 - protein, 15 aa, Mycobacterium tuberculosis
QLSSQHLTTAEIEVL

SEQ ID NO: 157704 - protein, 15 aa, Mycobacterium tuberculosis
LSSQHLTTAEIEVLA

SEQ ID NO: 157705 - protein, 15 aa, Mycobacterium tuberculosis
SSQHLTTAEIEVLAD

SEQ ID NO: 157706 - protein, 15 aa, Mycobacterium tuberculosis
SQHLTTAEIEVLADS

SEQ ID NO: 157707 - protein, 15 aa, Mycobacterium tuberculosis
QHLTTAEIEVLADSV

SEQ ID NO: 157708 - protein, 15 aa, Mycobacterium tuberculosis
HLTTAEIEVLADSVL

SEQ ID NO: 157709 - protein, 15 aa, Mycobacterium tuberculosis
LTTAEIEVLADSVLL

SEQ ID NO: 157710 - protein, 15 aa, Mycobacterium tuberculosis
TTAEIEVLADSVLLR

SEQ ID NO: 157711 - protein, 15 aa, Mycobacterium tuberculosis
TAEIEVLADSVLLRT

SEQ ID NO: 157712 - protein, 15 aa, Mycobacterium tuberculosis
AEIEVLADSVLLRTQ

SEQ ID NO: 157713 - protein, 15 aa, Mycobacterium tuberculosis
EIEVLADSVLLRTQT

SEQ ID NO: 157714 - protein, 15 aa, Mycobacterium tuberculosis
IEVLADSVLLRTQTS

SEQ ID NO: 157715 - protein, 15 aa, Mycobacterium tuberculosis
EVLADSVLLRTQTSQ

SEQ ID NO: 157716 - protein, 15 aa, Mycobacterium tuberculosis
VLADSVLLRTQTSQS

SEQ ID NO: 157717 - protein, 15 aa, Mycobacterium tuberculosis
LADSVLLRTQTSQSG

SEQ ID NO: 157718 - protein, 15 aa, Mycobacterium tuberculosis
ADSVLLRTQTSQSGI

SEQ ID NO: 157719 - protein, 15 aa, Mycobacterium tuberculosis
DSVLLRTQTSQSGIA

SEQ ID NO: 157720 - protein, 15 aa, Mycobacterium tuberculosis
SVLLRTQTSQSGIAI

SEQ ID NO: 157721 - protein, 15 aa, Mycobacterium tuberculosis
VLLRTQTSQSGIAIA

SEQ ID NO: 157722 - protein, 15 aa, Mycobacterium tuberculosis
LLRTQTSQSGIAIAV

SEQ ID NO: 157723 - protein, 15 aa, Mycobacterium tuberculosis
LRTQTSQSGIAIAVA

SEQ ID NO: 157724 - protein, 15 aa, Mycobacterium tuberculosis
RTQTSQSGIAIAVAA

SEQ ID NO: 157725 - protein, 15 aa, Mycobacterium tuberculosis
TQTSQSGIAIAVAAR

SEQ ID NO: 157726 - protein, 15 aa, Mycobacterium tuberculosis
QTSQSGIAIAVAARS

SEQ ID NO: 157727 - protein, 15 aa, Mycobacterium tuberculosis
TSQSGIAIAVAARST

SEQ ID NO: 157728 - protein, 15 aa, Mycobacterium tuberculosis
SQSGIAIAVAARSTL

SEQ ID NO: 157729 - protein, 15 aa, Mycobacterium tuberculosis
QSGIAIAVAARSTLW

SEQ ID NO: 157730 - protein, 15 aa, Mycobacterium tuberculosis
SGIAIAVAARSTLWR

SEQ ID NO: 157731 - protein, 15 aa, Mycobacterium tuberculosis
GIAIAVAARSTLWRD

SEQ ID NO: 157732 - protein, 15 aa, Mycobacterium tuberculosis
IAIAVAARSTLWRDG

SEQ ID NO: 157733 - protein, 15 aa, Mycobacterium tuberculosis
AIAVAARSTLWRDGQ

SEQ ID NO: 157734 - protein, 15 aa, Mycobacterium tuberculosis
IAVAARSTLWRDGQR

SEQ ID NO: 157735 - protein, 15 aa, Mycobacterium tuberculosis
AVAARSTLWRDGQRV

SEQ ID NO: 157736 - protein, 15 aa, Mycobacterium tuberculosis
VAARSTLWRDGQRVD

SEQ ID NO: 157737 - protein, 15 aa, Mycobacterium tuberculosis
AARSTLWRDGQRVDA

SEQ ID NO: 157738 - protein, 15 aa, Mycobacterium tuberculosis
ARSTLWRDGQRVDAQ

SEQ ID NO: 157739 - protein, 15 aa, Mycobacterium tuberculosis
RSTLWRDGQRVDAQY

SEQ ID NO: 157740 - protein, 15 aa, Mycobacterium tuberculosis
STLWRDGQRVDAQYR

SEQ ID NO: 157741 - protein, 15 aa, Mycobacterium tuberculosis
TLWRDGQRVDAQYRV

SEQ ID NO: 157742 - protein, 15 aa, Mycobacterium tuberculosis
LWRDGQRVDAQYRVA

SEQ ID NO: 157743 - protein, 15 aa, Mycobacterium tuberculosis
WRDGQRVDAQYRVAR

SEQ ID NO: 157744 - protein, 15 aa, Mycobacterium tuberculosis
RDGQRVDAQYRVARD

SEQ ID NO: 157745 - protein, 15 aa, Mycobacterium tuberculosis
DGQRVDAQYRVARDT

SEQ ID NO: 157746 - protein, 15 aa, Mycobacterium tuberculosis
GQRVDAQYRVARDTN

SEQ ID NO: 157747 - protein, 15 aa, Mycobacterium tuberculosis
QRVDAQYRVARDTNR

SEQ ID NO: 157748 - protein, 15 aa, Mycobacterium tuberculosis
RVDAQYRVARDTNRG

SEQ ID NO: 157749 - protein, 15 aa, Mycobacterium tuberculosis
VDAQYRVARDTNRGG

SEQ ID NO: 157750 - protein, 15 aa, Mycobacterium tuberculosis
DAQYRVARDTNRGGH

SEQ ID NO: 157751 - protein, 15 aa, Mycobacterium tuberculosis
AQYRVARDTNRGGHD

SEQ ID NO: 157752 - protein, 15 aa, Mycobacterium tuberculosis
QYRVARDTNRGGHDI

SEQ ID NO: 157753 - protein, 15 aa, Mycobacterium tuberculosis
YRVARDTNRGGHDIQ

SEQ ID NO: 157754 - protein, 15 aa, Mycobacterium tuberculosis
RVARDTNRGGHDIQV

SEQ ID NO: 157755 - protein, 15 aa, Mycobacterium tuberculosis
VARDTNRGGHDIQVT

SEQ ID NO: 157756 - protein, 15 aa, Mycobacterium tuberculosis
ARDTNRGGHDIQVTL

SEQ ID NO: 157757 - protein, 15 aa, Mycobacterium tuberculosis
RDTNRGGHDIQVTLS

SEQ ID NO: 157758 - protein, 15 aa, Mycobacterium tuberculosis
DTNRGGHDIQVTLSA

SEQ ID NO: 157759 - protein, 15 aa, Mycobacterium tuberculosis
TNRGGHDIQVTLSAG

SEQ ID NO: 157760 - protein, 15 aa, Mycobacterium tuberculosis
NRGGHDIQVTLSAGQ

SEQ ID NO: 157761 - protein, 15 aa, Mycobacterium tuberculosis
RGGHDIQVTLSAGQS

SEQ ID NO: 157762 - protein, 15 aa, Mycobacterium tuberculosis
GGHDIQVTLSAGQSV

SEQ ID NO: 157763 - protein, 15 aa, Mycobacterium tuberculosis
GHDIQVTLSAGQSVT

SEQ ID NO: 157764 - protein, 15 aa, Mycobacterium tuberculosis
HDIQVTLSAGQSVTL

SEQ ID NO: 157765 - protein, 15 aa, Mycobacterium tuberculosis
DIQVTLSAGQSVTLE

SEQ ID NO: 157766 - protein, 15 aa, Mycobacterium tuberculosis
IQVTLSAGQSVTLEK

SEQ ID NO: 157767 - protein, 15 aa, Mycobacterium tuberculosis
QVTLSAGQSVTLEKV

SEQ ID NO: 157768 - protein, 15 aa, Mycobacterium tuberculosis
VTLSAGQSVTLEKVA

SEQ ID NO: 157769 - protein, 15 aa, Mycobacterium tuberculosis
TLSAGQSVTLEKVAT

SEQ ID NO: 157770 - protein, 15 aa, Mycobacterium tuberculosis
LSAGQSVTLEKVATI

SEQ ID NO: 157771 - protein, 15 aa, Mycobacterium tuberculosis
SAGQSVTLEKVATIF

SEQ ID NO: 157772 - protein, 15 aa, Mycobacterium tuberculosis
AGQSVTLEKVATIFT

SEQ ID NO: 157773 - protein, 15 aa, Mycobacterium tuberculosis
GQSVTLEKVATIFTS

SEQ ID NO: 157774 - protein, 15 aa, Mycobacterium tuberculosis
QSVTLEKVATIFTSR

SEQ ID NO: 157775 - protein, 15 aa, Mycobacterium tuberculosis
SVTLEKVATIFTSRD

SEQ ID NO: 157776 - protein, 15 aa, Mycobacterium tuberculosis
VTLEKVATIFTSRDA

SEQ ID NO: 157777 - protein, 15 aa, Mycobacterium tuberculosis
TLEKVATIFTSRDAA

SEQ ID NO: 157778 - protein, 15 aa, Mycobacterium tuberculosis
LEKVATIFTSRDAAT

SEQ ID NO: 157779 - protein, 15 aa, Mycobacterium tuberculosis
EKVATIFTSRDAATL

SEQ ID NO: 157780 - protein, 15 aa, Mycobacterium tuberculosis
KVATIFTSRDAATLT

SEQ ID NO: 157781 - protein, 15 aa, Mycobacterium tuberculosis
VATIFTSRDAATLTA

SEQ ID NO: 157782 - protein, 15 aa, Mycobacterium tuberculosis
ATIFTSRDAATLTAA

SEQ ID NO: 157783 - protein, 15 aa, Mycobacterium tuberculosis
TIFTSRDAATLTAAI

SEQ ID NO: 157784 - protein, 15 aa, Mycobacterium tuberculosis
IFTSRDAATLTAAIS

SEQ ID NO: 157785 - protein, 15 aa, Mycobacterium tuberculosis
FTSRDAATLTAAISA

SEQ ID NO: 157786 - protein, 15 aa, Mycobacterium tuberculosis
TSRDAATLTAAISAQ

SEQ ID NO: 157787 - protein, 15 aa, Mycobacterium tuberculosis
SRDAATLTAAISAQR

SEQ ID NO: 157788 - protein, 15 aa, Mycobacterium tuberculosis
RDAATLTAAISAQRC

SEQ ID NO: 157789 - protein, 15 aa, Mycobacterium tuberculosis
DAATLTAAISAQRCL

SEQ ID NO: 157790 - protein, 15 aa, Mycobacterium tuberculosis
AATLTAAISAQRCLG

SEQ ID NO: 157791 - protein, 15 aa, Mycobacterium tuberculosis
ATLTAAISAQRCLGE

SEQ ID NO: 157792 - protein, 15 aa, Mycobacterium tuberculosis
TLTAAISAQRCLGEA

SEQ ID NO: 157793 - protein, 15 aa, Mycobacterium tuberculosis
LTAAISAQRCLGEAG

SEQ ID NO: 157794 - protein, 15 aa, Mycobacterium tuberculosis
TAAISAQRCLGEAGR

SEQ ID NO: 157795 - protein, 15 aa, Mycobacterium tuberculosis
AAISAQRCLGEAGRY

SEQ ID NO: 157796 - protein, 15 aa, Mycobacterium tuberculosis
AISAQRCLGEAGRYA

SEQ ID NO: 157797 - protein, 15 aa, Mycobacterium tuberculosis
ISAQRCLGEAGRYAE

SEQ ID NO: 157798 - protein, 15 aa, Mycobacterium tuberculosis
SAQRCLGEAGRYAEL

SEQ ID NO: 157799 - protein, 15 aa, Mycobacterium tuberculosis
AQRCLGEAGRYAELC

SEQ ID NO: 157800 - protein, 15 aa, Mycobacterium tuberculosis
QRCLGEAGRYAELCQ

SEQ ID NO: 157801 - protein, 15 aa, Mycobacterium tuberculosis
RCLGEAGRYAELCQQ

SEQ ID NO: 157802 - protein, 15 aa, Mycobacterium tuberculosis
CLGEAGRYAELCQQH

SEQ ID NO: 157803 - protein, 15 aa, Mycobacterium tuberculosis
LGEAGRYAELCQQHV

SEQ ID NO: 157804 - protein, 15 aa, Mycobacterium tuberculosis
GEAGRYAELCQQHVR

SEQ ID NO: 157805 - protein, 15 aa, Mycobacterium tuberculosis
EAGRYAELCQQHVRA

SEQ ID NO: 157806 - protein, 15 aa, Mycobacterium tuberculosis
AGRYAELCQQHVRAW

SEQ ID NO: 157807 - protein, 15 aa, Mycobacterium tuberculosis
GRYAELCQQHVRAWA

SEQ ID NO: 157808 - protein, 15 aa, Mycobacterium tuberculosis
RYAELCQQHVRAWAR

SEQ ID NO: 157809 - protein, 15 aa, Mycobacterium tuberculosis
YAELCQQHVRAWARL

SEQ ID NO: 157810 - protein, 15 aa, Mycobacterium tuberculosis
AELCQQHVRAWARLW

SEQ ID NO: 157811 - protein, 15 aa, Mycobacterium tuberculosis
ELCQQHVRAWARLWE

SEQ ID NO: 157812 - protein, 15 aa, Mycobacterium tuberculosis
LCQQHVRAWARLWER

SEQ ID NO: 157813 - protein, 15 aa, Mycobacterium tuberculosis
CQQHVRAWARLWERC

SEQ ID NO: 157814 - protein, 15 aa, Mycobacterium tuberculosis
QQHVRAWARLWERCA

SEQ ID NO: 157815 - protein, 15 aa, Mycobacterium tuberculosis
QHVRAWARLWERCAI

SEQ ID NO: 157816 - protein, 15 aa, Mycobacterium tuberculosis
HVRAWARLWERCAID

SEQ ID NO: 157817 - protein, 15 aa, Mycobacterium tuberculosis
VRAWARLWERCAIDL

SEQ ID NO: 157818 - protein, 15 aa, Mycobacterium tuberculosis
RAWARLWERCAIDLT

SEQ ID NO: 157819 - protein, 15 aa, Mycobacterium tuberculosis
AWARLWERCAIDLTG

SEQ ID NO: 157820 - protein, 15 aa, Mycobacterium tuberculosis
WARLWERCAIDLTGN

SEQ ID NO: 157821 - protein, 15 aa, Mycobacterium tuberculosis
ARLWERCAIDLTGNT

SEQ ID NO: 157822 - protein, 15 aa, Mycobacterium tuberculosis
RLWERCAIDLTGNTE

SEQ ID NO: 157823 - protein, 15 aa, Mycobacterium tuberculosis
LWERCAIDLTGNTEE

SEQ ID NO: 157824 - protein, 15 aa, Mycobacterium tuberculosis
WERCAIDLTGNTEEL

SEQ ID NO: 157825 - protein, 15 aa, Mycobacterium tuberculosis
ERCAIDLTGNTEELR

SEQ ID NO: 157826 - protein, 15 aa, Mycobacterium tuberculosis
RCAIDLTGNTEELRL

SEQ ID NO: 157827 - protein, 15 aa, Mycobacterium tuberculosis
CAIDLTGNTEELRLV

SEQ ID NO: 157828 - protein, 15 aa, Mycobacterium tuberculosis
AIDLTGNTEELRLVR

SEQ ID NO: 157829 - protein, 15 aa, Mycobacterium tuberculosis
IDLTGNTEELRLVRL

SEQ ID NO: 157830 - protein, 15 aa, Mycobacterium tuberculosis
DLTGNTEELRLVRLH

SEQ ID NO: 157831 - protein, 15 aa, Mycobacterium tuberculosis
LTGNTEELRLVRLHL

SEQ ID NO: 157832 - protein, 15 aa, Mycobacterium tuberculosis
TGNTEELRLVRLHLL

SEQ ID NO: 157833 - protein, 15 aa, Mycobacterium tuberculosis
GNTEELRLVRLHLLH

SEQ ID NO: 157834 - protein, 15 aa, Mycobacterium tuberculosis
NTEELRLVRLHLLHL

SEQ ID NO: 157835 - protein, 15 aa, Mycobacterium tuberculosis
TEELRLVRLHLLHLL

SEQ ID NO: 157836 - protein, 15 aa, Mycobacterium tuberculosis
EELRLVRLHLLHLLQ

SEQ ID NO: 157837 - protein, 15 aa, Mycobacterium tuberculosis
ELRLVRLHLLHLLQT

SEQ ID NO: 157838 - protein, 15 aa, Mycobacterium tuberculosis
LRLVRLHLLHLLQTI

SEQ ID NO: 157839 - protein, 15 aa, Mycobacterium tuberculosis
RLVRLHLLHLLQTIS

SEQ ID NO: 157840 - protein, 15 aa, Mycobacterium tuberculosis
LVRLHLLHLLQTISP

SEQ ID NO: 157841 - protein, 15 aa, Mycobacterium tuberculosis
VRLHLLHLLQTISPH

SEQ ID NO: 157842 - protein, 15 aa, Mycobacterium tuberculosis
RLHLLHLLQTISPHT

SEQ ID NO: 157843 - protein, 15 aa, Mycobacterium tuberculosis
LHLLHLLQTISPHTA

SEQ ID NO: 157844 - protein, 15 aa, Mycobacterium tuberculosis
HLLHLLQTISPHTAE

SEQ ID NO: 157845 - protein, 15 aa, Mycobacterium tuberculosis
LLHLLQTISPHTAEL

SEQ ID NO: 157846 - protein, 15 aa, Mycobacterium tuberculosis
LHLLQTISPHTAELD

SEQ ID NO: 157847 - protein, 15 aa, Mycobacterium tuberculosis
HLLQTISPHTAELDA

SEQ ID NO: 157848 - protein, 15 aa, Mycobacterium tuberculosis
LLQTISPHTAELDAG

SEQ ID NO: 157849 - protein, 15 aa, Mycobacterium tuberculosis
LQTISPHTAELDAGV

SEQ ID NO: 157850 - protein, 15 aa, Mycobacterium tuberculosis
QTISPHTAELDAGVP

SEQ ID NO: 157851 - protein, 15 aa, Mycobacterium tuberculosis
TISPHTAELDAGVPA

SEQ ID NO: 157852 - protein, 15 aa, Mycobacterium tuberculosis
ISPHTAELDAGVPAR

SEQ ID NO: 157853 - protein, 15 aa, Mycobacterium tuberculosis
SPHTAELDAGVPARG

SEQ ID NO: 157854 - protein, 15 aa, Mycobacterium tuberculosis
PHTAELDAGVPARGL

SEQ ID NO: 157855 - protein, 15 aa, Mycobacterium tuberculosis
HTAELDAGVPARGLN

SEQ ID NO: 157856 - protein, 15 aa, Mycobacterium tuberculosis
TAELDAGVPARGLNG

SEQ ID NO: 157857 - protein, 15 aa, Mycobacterium tuberculosis
AELDAGVPARGLNGE

SEQ ID NO: 157858 - protein, 15 aa, Mycobacterium tuberculosis
ELDAGVPARGLNGEA

SEQ ID NO: 157859 - protein, 15 aa, Mycobacterium tuberculosis
LDAGVPARGLNGEAY

SEQ ID NO: 157860 - protein, 15 aa, Mycobacterium tuberculosis
DAGVPARGLNGEAYR

SEQ ID NO: 157861 - protein, 15 aa, Mycobacterium tuberculosis
AGVPARGLNGEAYRG

SEQ ID NO: 157862 - protein, 15 aa, Mycobacterium tuberculosis
GVPARGLNGEAYRGH

SEQ ID NO: 157863 - protein, 15 aa, Mycobacterium tuberculosis
VPARGLNGEAYRGHV

SEQ ID NO: 157864 - protein, 15 aa, Mycobacterium tuberculosis
PARGLNGEAYRGHVF

SEQ ID NO: 157865 - protein, 15 aa, Mycobacterium tuberculosis
ARGLNGEAYRGHVFW

SEQ ID NO: 157866 - protein, 15 aa, Mycobacterium tuberculosis
RGLNGEAYRGHVFWD

SEQ ID NO: 157867 - protein, 15 aa, Mycobacterium tuberculosis
GLNGEAYRGHVFWDA

SEQ ID NO: 157868 - protein, 15 aa, Mycobacterium tuberculosis
LNGEAYRGHVFWDAL

SEQ ID NO: 157869 - protein, 15 aa, Mycobacterium tuberculosis
NGEAYRGHVFWDALF

SEQ ID NO: 157870 - protein, 15 aa, Mycobacterium tuberculosis
GEAYRGHVFWDALFV

SEQ ID NO: 157871 - protein, 15 aa, Mycobacterium tuberculosis
EAYRGHVFWDALFVA

SEQ ID NO: 157872 - protein, 15 aa, Mycobacterium tuberculosis
AYRGHVFWDALFVAP

SEQ ID NO: 157873 - protein, 15 aa, Mycobacterium tuberculosis
YRGHVFWDALFVAPV

SEQ ID NO: 157874 - protein, 15 aa, Mycobacterium tuberculosis
RGHVFWDALFVAPVL

SEQ ID NO: 157875 - protein, 15 aa, Mycobacterium tuberculosis
GHVFWDALFVAPVLS

SEQ ID NO: 157876 - protein, 15 aa, Mycobacterium tuberculosis
HVFWDALFVAPVLSL

SEQ ID NO: 157877 - protein, 15 aa, Mycobacterium tuberculosis
VFWDALFVAPVLSLR

SEQ ID NO: 157878 - protein, 15 aa, Mycobacterium tuberculosis
FWDALFVAPVLSLRM

SEQ ID NO: 157879 - protein, 15 aa, Mycobacterium tuberculosis
WDALFVAPVLSLRMP

SEQ ID NO: 157880 - protein, 15 aa, Mycobacterium tuberculosis
DALFVAPVLSLRMPK

SEQ ID NO: 157881 - protein, 15 aa, Mycobacterium tuberculosis
ALFVAPVLSLRMPKV

SEQ ID NO: 157882 - protein, 15 aa, Mycobacterium tuberculosis
LFVAPVLSLRMPKVA

SEQ ID NO: 157883 - protein, 15 aa, Mycobacterium tuberculosis
FVAPVLSLRMPKVAR

SEQ ID NO: 157884 - protein, 15 aa, Mycobacterium tuberculosis
VAPVLSLRMPKVARS

SEQ ID NO: 157885 - protein, 15 aa, Mycobacterium tuberculosis
APVLSLRMPKVARSL

SEQ ID NO: 157886 - protein, 15 aa, Mycobacterium tuberculosis
PVLSLRMPKVARSLL

SEQ ID NO: 157887 - protein, 15 aa, Mycobacterium tuberculosis
VLSLRMPKVARSLLD

SEQ ID NO: 157888 - protein, 15 aa, Mycobacterium tuberculosis
LSLRMPKVARSLLDY

SEQ ID NO: 157889 - protein, 15 aa, Mycobacterium tuberculosis
SLRMPKVARSLLDYR

SEQ ID NO: 157890 - protein, 15 aa, Mycobacterium tuberculosis
LRMPKVARSLLDYRY

SEQ ID NO: 157891 - protein, 15 aa, Mycobacterium tuberculosis
RMPKVARSLLDYRYR

SEQ ID NO: 157892 - protein, 15 aa, Mycobacterium tuberculosis
MPKVARSLLDYRYRR

SEQ ID NO: 157893 - protein, 15 aa, Mycobacterium tuberculosis
PKVARSLLDYRYRRL

SEQ ID NO: 157894 - protein, 15 aa, Mycobacterium tuberculosis
KVARSLLDYRYRRLP

SEQ ID NO: 157895 - protein, 15 aa, Mycobacterium tuberculosis
VARSLLDYRYRRLPA

SEQ ID NO: 157896 - protein, 15 aa, Mycobacterium tuberculosis
ARSLLDYRYRRLPAA

SEQ ID NO: 157897 - protein, 15 aa, Mycobacterium tuberculosis
RSLLDYRYRRLPAAR

SEQ ID NO: 157898 - protein, 15 aa, Mycobacterium tuberculosis
SLLDYRYRRLPAARR

SEQ ID NO: 157899 - protein, 15 aa, Mycobacterium tuberculosis
LLDYRYRRLPAARRA

SEQ ID NO: 157900 - protein, 15 aa, Mycobacterium tuberculosis
LDYRYRRLPAARRAA

SEQ ID NO: 157901 - protein, 15 aa, Mycobacterium tuberculosis
DYRYRRLPAARRAAH

SEQ ID NO: 157902 - protein, 15 aa, Mycobacterium tuberculosis
YRYRRLPAARRAAHR

SEQ ID NO: 157903 - protein, 15 aa, Mycobacterium tuberculosis
RYRRLPAARRAAHRA

SEQ ID NO: 157904 - protein, 15 aa, Mycobacterium tuberculosis
YRRLPAARRAAHRAG

SEQ ID NO: 157905 - protein, 15 aa, Mycobacterium tuberculosis
RRLPAARRAAHRAGH

SEQ ID NO: 157906 - protein, 15 aa, Mycobacterium tuberculosis
RLPAARRAAHRAGHL

SEQ ID NO: 157907 - protein, 15 aa, Mycobacterium tuberculosis
LPAARRAAHRAGHLG

SEQ ID NO: 157908 - protein, 15 aa, Mycobacterium tuberculosis
PAARRAAHRAGHLGA

SEQ ID NO: 157909 - protein, 15 aa, Mycobacterium tuberculosis
AARRAAHRAGHLGAM

SEQ ID NO: 157910 - protein, 15 aa, Mycobacterium tuberculosis
ARRAAHRAGHLGAMY

SEQ ID NO: 157911 - protein, 15 aa, Mycobacterium tuberculosis
RRAAHRAGHLGAMYP

SEQ ID NO: 157912 - protein, 15 aa, Mycobacterium tuberculosis
RAAHRAGHLGAMYPW

SEQ ID NO: 157913 - protein, 15 aa, Mycobacterium tuberculosis
AAHRAGHLGAMYPWQ

SEQ ID NO: 157914 - protein, 15 aa, Mycobacterium tuberculosis
AHRAGHLGAMYPWQS

SEQ ID NO: 157915 - protein, 15 aa, Mycobacterium tuberculosis
HRAGHLGAMYPWQSG

SEQ ID NO: 157916 - protein, 15 aa, Mycobacterium tuberculosis
RAGHLGAMYPWQSGS

SEQ ID NO: 157917 - protein, 15 aa, Mycobacterium tuberculosis
AGHLGAMYPWQSGSD

SEQ ID NO: 157918 - protein, 15 aa, Mycobacterium tuberculosis
GHLGAMYPWQSGSDG

SEQ ID NO: 157919 - protein, 15 aa, Mycobacterium tuberculosis
HLGAMYPWQSGSDGS

SEQ ID NO: 157920 - protein, 15 aa, Mycobacterium tuberculosis
LGAMYPWQSGSDGSE

SEQ ID NO: 157921 - protein, 15 aa, Mycobacterium tuberculosis
GAMYPWQSGSDGSEV

SEQ ID NO: 157922 - protein, 15 aa, Mycobacterium tuberculosis
AMYPWQSGSDGSEVS

SEQ ID NO: 157923 - protein, 15 aa, Mycobacterium tuberculosis
MYPWQSGSDGSEVSQ

SEQ ID NO: 157924 - protein, 15 aa, Mycobacterium tuberculosis
YPWQSGSDGSEVSQQ

SEQ ID NO: 157925 - protein, 15 aa, Mycobacterium tuberculosis
PWQSGSDGSEVSQQL

SEQ ID NO: 157926 - protein, 15 aa, Mycobacterium tuberculosis
WQSGSDGSEVSQQLH

SEQ ID NO: 157927 - protein, 15 aa, Mycobacterium tuberculosis
QSGSDGSEVSQQLHL

SEQ ID NO: 157928 - protein, 15 aa, Mycobacterium tuberculosis
SGSDGSEVSQQLHLN

SEQ ID NO: 157929 - protein, 15 aa, Mycobacterium tuberculosis
GSDGSEVSQQLHLNP

SEQ ID NO: 157930 - protein, 15 aa, Mycobacterium tuberculosis
SDGSEVSQQLHLNPR

SEQ ID NO: 157931 - protein, 15 aa, Mycobacterium tuberculosis
DGSEVSQQLHLNPRS

SEQ ID NO: 157932 - protein, 15 aa, Mycobacterium tuberculosis
GSEVSQQLHLNPRSG

SEQ ID NO: 157933 - protein, 15 aa, Mycobacterium tuberculosis
SEVSQQLHLNPRSGR

SEQ ID NO: 157934 - protein, 15 aa, Mycobacterium tuberculosis
EVSQQLHLNPRSGRW

SEQ ID NO: 157935 - protein, 15 aa, Mycobacterium tuberculosis
VSQQLHLNPRSGRWT

SEQ ID NO: 157936 - protein, 15 aa, Mycobacterium tuberculosis
SQQLHLNPRSGRWTP

SEQ ID NO: 157937 - protein, 15 aa, Mycobacterium tuberculosis
QQLHLNPRSGRWTPD

SEQ ID NO: 157938 - protein, 15 aa, Mycobacterium tuberculosis
QLHLNPRSGRWTPDP

SEQ ID NO: 157939 - protein, 15 aa, Mycobacterium tuberculosis
LHLNPRSGRWTPDPS

SEQ ID NO: 157940 - protein, 15 aa, Mycobacterium tuberculosis
HLNPRSGRWTPDPSD

SEQ ID NO: 157941 - protein, 15 aa, Mycobacterium tuberculosis
LNPRSGRWTPDPSDR

SEQ ID NO: 157942 - protein, 15 aa, Mycobacterium tuberculosis
NPRSGRWTPDPSDRA

SEQ ID NO: 157943 - protein, 15 aa, Mycobacterium tuberculosis
PRSGRWTPDPSDRAH

SEQ ID NO: 157944 - protein, 15 aa, Mycobacterium tuberculosis
RSGRWTPDPSDRAHH

SEQ ID NO: 157945 - protein, 15 aa, Mycobacterium tuberculosis
SGRWTPDPSDRAHHV

SEQ ID NO: 157946 - protein, 15 aa, Mycobacterium tuberculosis
GRWTPDPSDRAHHVG

SEQ ID NO: 157947 - protein, 15 aa, Mycobacterium tuberculosis
RWTPDPSDRAHHVGL

SEQ ID NO: 157948 - protein, 15 aa, Mycobacterium tuberculosis
WTPDPSDRAHHVGLA

SEQ ID NO: 157949 - protein, 15 aa, Mycobacterium tuberculosis
TPDPSDRAHHVGLAV

SEQ ID NO: 157950 - protein, 15 aa, Mycobacterium tuberculosis
PDPSDRAHHVGLAVA

SEQ ID NO: 157951 - protein, 15 aa, Mycobacterium tuberculosis
DPSDRAHHVGLAVAY

SEQ ID NO: 157952 - protein, 15 aa, Mycobacterium tuberculosis
PSDRAHHVGLAVAYN

SEQ ID NO: 157953 - protein, 15 aa, Mycobacterium tuberculosis
SDRAHHVGLAVAYNA

SEQ ID NO: 157954 - protein, 15 aa, Mycobacterium tuberculosis
DRAHHVGLAVAYNAW

SEQ ID NO: 157955 - protein, 15 aa, Mycobacterium tuberculosis
RAHHVGLAVAYNAWH

SEQ ID NO: 157956 - protein, 15 aa, Mycobacterium tuberculosis
AHHVGLAVAYNAWHY

SEQ ID NO: 157957 - protein, 15 aa, Mycobacterium tuberculosis
HHVGLAVAYNAWHYY

SEQ ID NO: 157958 - protein, 15 aa, Mycobacterium tuberculosis
HVGLAVAYNAWHYYQ

SEQ ID NO: 157959 - protein, 15 aa, Mycobacterium tuberculosis
VGLAVAYNAWHYYQV

SEQ ID NO: 157960 - protein, 15 aa, Mycobacterium tuberculosis
GLAVAYNAWHYYQVT

SEQ ID NO: 157961 - protein, 15 aa, Mycobacterium tuberculosis
LAVAYNAWHYYQVTG

SEQ ID NO: 157962 - protein, 15 aa, Mycobacterium tuberculosis
AVAYNAWHYYQVTGD

SEQ ID NO: 157963 - protein, 15 aa, Mycobacterium tuberculosis
VAYNAWHYYQVTGDR

SEQ ID NO: 157964 - protein, 15 aa, Mycobacterium tuberculosis
AYNAWHYYQVTGDRQ

SEQ ID NO: 157965 - protein, 15 aa, Mycobacterium tuberculosis
YNAWHYYQVTGDRQY

SEQ ID NO: 157966 - protein, 15 aa, Mycobacterium tuberculosis
NAWHYYQVTGDRQYL

SEQ ID NO: 157967 - protein, 15 aa, Mycobacterium tuberculosis
AWHYYQVTGDRQYLV

SEQ ID NO: 157968 - protein, 15 aa, Mycobacterium tuberculosis
WHYYQVTGDRQYLVD

SEQ ID NO: 157969 - protein, 15 aa, Mycobacterium tuberculosis
HYYQVTGDRQYLVDC

SEQ ID NO: 157970 - protein, 15 aa, Mycobacterium tuberculosis
YYQVTGDRQYLVDCG

SEQ ID NO: 157971 - protein, 15 aa, Mycobacterium tuberculosis
YQVTGDRQYLVDCGA

SEQ ID NO: 157972 - protein, 15 aa, Mycobacterium tuberculosis
QVTGDRQYLVDCGAE

SEQ ID NO: 157973 - protein, 15 aa, Mycobacterium tuberculosis
VTGDRQYLVDCGAEL

SEQ ID NO: 157974 - protein, 15 aa, Mycobacterium tuberculosis
TGDRQYLVDCGAELL

SEQ ID NO: 157975 - protein, 15 aa, Mycobacterium tuberculosis
GDRQYLVDCGAELLV

SEQ ID NO: 157976 - protein, 15 aa, Mycobacterium tuberculosis
DRQYLVDCGAELLVE

SEQ ID NO: 157977 - protein, 15 aa, Mycobacterium tuberculosis
RQYLVDCGAELLVEI

SEQ ID NO: 157978 - protein, 15 aa, Mycobacterium tuberculosis
QYLVDCGAELLVEIA

SEQ ID NO: 157979 - protein, 15 aa, Mycobacterium tuberculosis
YLVDCGAELLVEIAR

SEQ ID NO: 157980 - protein, 15 aa, Mycobacterium tuberculosis
LVDCGAELLVEIARF

SEQ ID NO: 157981 - protein, 15 aa, Mycobacterium tuberculosis
VDCGAELLVEIARFW

SEQ ID NO: 157982 - protein, 15 aa, Mycobacterium tuberculosis
DCGAELLVEIARFWV

SEQ ID NO: 157983 - protein, 15 aa, Mycobacterium tuberculosis
CGAELLVEIARFWVG

SEQ ID NO: 157984 - protein, 15 aa, Mycobacterium tuberculosis
GAELLVEIARFWVGL

SEQ ID NO: 157985 - protein, 15 aa, Mycobacterium tuberculosis
AELLVEIARFWVGLA

SEQ ID NO: 157986 - protein, 15 aa, Mycobacterium tuberculosis
ELLVEIARFWVGLAK

SEQ ID NO: 157987 - protein, 15 aa, Mycobacterium tuberculosis
LLVEIARFWVGLAKL

SEQ ID NO: 157988 - protein, 15 aa, Mycobacterium tuberculosis
LVEIARFWVGLAKLD

SEQ ID NO: 157989 - protein, 15 aa, Mycobacterium tuberculosis
VEIARFWVGLAKLDD

SEQ ID NO: 157990 - protein, 15 aa, Mycobacterium tuberculosis
EIARFWVGLAKLDDS

SEQ ID NO: 157991 - protein, 15 aa, Mycobacterium tuberculosis
IARFWVGLAKLDDSR

SEQ ID NO: 157992 - protein, 15 aa, Mycobacterium tuberculosis
ARFWVGLAKLDDSRG

SEQ ID NO: 157993 - protein, 15 aa, Mycobacterium tuberculosis
RFWVGLAKLDDSRGR

SEQ ID NO: 157994 - protein, 15 aa, Mycobacterium tuberculosis
FWVGLAKLDDSRGRY

SEQ ID NO: 157995 - protein, 15 aa, Mycobacterium tuberculosis
WVGLAKLDDSRGRYL

SEQ ID NO: 157996 - protein, 15 aa, Mycobacterium tuberculosis
VGLAKLDDSRGRYLI

SEQ ID NO: 157997 - protein, 15 aa, Mycobacterium tuberculosis
GLAKLDDSRGRYLIR

SEQ ID NO: 157998 - protein, 15 aa, Mycobacterium tuberculosis
LAKLDDSRGRYLIRG

SEQ ID NO: 157999 - protein, 15 aa, Mycobacterium tuberculosis
AKLDDSRGRYLIRGV

SEQ ID NO: 158000 - protein, 15 aa, Mycobacterium tuberculosis
KLDDSRGRYLIRGVI

SEQ ID NO: 158001 - protein, 15 aa, Mycobacterium tuberculosis
LDDSRGRYLIRGVIG

SEQ ID NO: 158002 - protein, 15 aa, Mycobacterium tuberculosis
DDSRGRYLIRGVIGP

SEQ ID NO: 158003 - protein, 15 aa, Mycobacterium tuberculosis
DSRGRYLIRGVIGPD

SEQ ID NO: 158004 - protein, 15 aa, Mycobacterium tuberculosis
SRGRYLIRGVIGPDE

SEQ ID NO: 158005 - protein, 15 aa, Mycobacterium tuberculosis
RGRYLIRGVIGPDEF

SEQ ID NO: 158006 - protein, 15 aa, Mycobacterium tuberculosis
GRYLIRGVIGPDEFH

SEQ ID NO: 158007 - protein, 15 aa, Mycobacterium tuberculosis
RYLIRGVIGPDEFHS

SEQ ID NO: 158008 - protein, 15 aa, Mycobacterium tuberculosis
YLIRGVIGPDEFHSG

SEQ ID NO: 158009 - protein, 15 aa, Mycobacterium tuberculosis
LIRGVIGPDEFHSGY

SEQ ID NO: 158010 - protein, 15 aa, Mycobacterium tuberculosis
IRGVIGPDEFHSGYP

SEQ ID NO: 158011 - protein, 15 aa, Mycobacterium tuberculosis
RGVIGPDEFHSGYPG

SEQ ID NO: 158012 - protein, 15 aa, Mycobacterium tuberculosis
GVIGPDEFHSGYPGN

SEQ ID NO: 158013 - protein, 15 aa, Mycobacterium tuberculosis
VIGPDEFHSGYPGNE

SEQ ID NO: 158014 - protein, 15 aa, Mycobacterium tuberculosis
IGPDEFHSGYPGNEY

SEQ ID NO: 158015 - protein, 15 aa, Mycobacterium tuberculosis
GPDEFHSGYPGNEYD

SEQ ID NO: 158016 - protein, 15 aa, Mycobacterium tuberculosis
PDEFHSGYPGNEYDG

SEQ ID NO: 158017 - protein, 15 aa, Mycobacterium tuberculosis
DEFHSGYPGNEYDGI

SEQ ID NO: 158018 - protein, 15 aa, Mycobacterium tuberculosis
EFHSGYPGNEYDGID

SEQ ID NO: 158019 - protein, 15 aa, Mycobacterium tuberculosis
FHSGYPGNEYDGIDN

SEQ ID NO: 158020 - protein, 15 aa, Mycobacterium tuberculosis
HSGYPGNEYDGIDNN

SEQ ID NO: 158021 - protein, 15 aa, Mycobacterium tuberculosis
SGYPGNEYDGIDNNA

SEQ ID NO: 158022 - protein, 15 aa, Mycobacterium tuberculosis
GYPGNEYDGIDNNAY

SEQ ID NO: 158023 - protein, 15 aa, Mycobacterium tuberculosis
YPGNEYDGIDNNAYT

SEQ ID NO: 158024 - protein, 15 aa, Mycobacterium tuberculosis
PGNEYDGIDNNAYTN

SEQ ID NO: 158025 - protein, 15 aa, Mycobacterium tuberculosis
GNEYDGIDNNAYTNV

SEQ ID NO: 158026 - protein, 15 aa, Mycobacterium tuberculosis
NEYDGIDNNAYTNVM

SEQ ID NO: 158027 - protein, 15 aa, Mycobacterium tuberculosis
EYDGIDNNAYTNVMA

SEQ ID NO: 158028 - protein, 15 aa, Mycobacterium tuberculosis
YDGIDNNAYTNVMAV

SEQ ID NO: 158029 - protein, 15 aa, Mycobacterium tuberculosis
DGIDNNAYTNVMAVW

SEQ ID NO: 158030 - protein, 15 aa, Mycobacterium tuberculosis
GIDNNAYTNVMAVWV

SEQ ID NO: 158031 - protein, 15 aa, Mycobacterium tuberculosis
IDNNAYTNVMAVWVI

SEQ ID NO: 158032 - protein, 15 aa, Mycobacterium tuberculosis
DNNAYTNVMAVWVIL

SEQ ID NO: 158033 - protein, 15 aa, Mycobacterium tuberculosis
NNAYTNVMAVWVILR

SEQ ID NO: 158034 - protein, 15 aa, Mycobacterium tuberculosis
NAYTNVMAVWVILRA

SEQ ID NO: 158035 - protein, 15 aa, Mycobacterium tuberculosis
AYTNVMAVWVILRAM

SEQ ID NO: 158036 - protein, 15 aa, Mycobacterium tuberculosis
YTNVMAVWVILRAME

SEQ ID NO: 158037 - protein, 15 aa, Mycobacterium tuberculosis
TNVMAVWVILRAMEA

SEQ ID NO: 158038 - protein, 15 aa, Mycobacterium tuberculosis
NVMAVWVILRAMEAL

SEQ ID NO: 158039 - protein, 15 aa, Mycobacterium tuberculosis
VMAVWVILRAMEALD

SEQ ID NO: 158040 - protein, 15 aa, Mycobacterium tuberculosis
MAVWVILRAMEALDL

SEQ ID NO: 158041 - protein, 15 aa, Mycobacterium tuberculosis
AVWVILRAMEALDLL

SEQ ID NO: 158042 - protein, 15 aa, Mycobacterium tuberculosis
VWVILRAMEALDLLP

SEQ ID NO: 158043 - protein, 15 aa, Mycobacterium tuberculosis
WVILRAMEALDLLPL

SEQ ID NO: 158044 - protein, 15 aa, Mycobacterium tuberculosis
VILRAMEALDLLPLT

SEQ ID NO: 158045 - protein, 15 aa, Mycobacterium tuberculosis
ILRAMEALDLLPLTD

SEQ ID NO: 158046 - protein, 15 aa, Mycobacterium tuberculosis
LRAMEALDLLPLTDR

SEQ ID NO: 158047 - protein, 15 aa, Mycobacterium tuberculosis
RAMEALDLLPLTDRR

SEQ ID NO: 158048 - protein, 15 aa, Mycobacterium tuberculosis
AMEALDLLPLTDRRH

SEQ ID NO: 158049 - protein, 15 aa, Mycobacterium tuberculosis
MEALDLLPLTDRRHL

SEQ ID NO: 158050 - protein, 15 aa, Mycobacterium tuberculosis
EALDLLPLTDRRHLI

SEQ ID NO: 158051 - protein, 15 aa, Mycobacterium tuberculosis
ALDLLPLTDRRHLIE

SEQ ID NO: 158052 - protein, 15 aa, Mycobacterium tuberculosis
LDLLPLTDRRHLIEK

SEQ ID NO: 158053 - protein, 15 aa, Mycobacterium tuberculosis
DLLPLTDRRHLIEKL

SEQ ID NO: 158054 - protein, 15 aa, Mycobacterium tuberculosis
LLPLTDRRHLIEKLG

SEQ ID NO: 158055 - protein, 15 aa, Mycobacterium tuberculosis
LPLTDRRHLIEKLGL

SEQ ID NO: 158056 - protein, 15 aa, Mycobacterium tuberculosis
PLTDRRHLIEKLGLT

SEQ ID NO: 158057 - protein, 15 aa, Mycobacterium tuberculosis
LTDRRHLIEKLGLTT

SEQ ID NO: 158058 - protein, 15 aa, Mycobacterium tuberculosis
TDRRHLIEKLGLTTQ

SEQ ID NO: 158059 - protein, 15 aa, Mycobacterium tuberculosis
DRRHLIEKLGLTTQE

SEQ ID NO: 158060 - protein, 15 aa, Mycobacterium tuberculosis
RRHLIEKLGLTTQER

SEQ ID NO: 158061 - protein, 15 aa, Mycobacterium tuberculosis
RHLIEKLGLTTQERD

SEQ ID NO: 158062 - protein, 15 aa, Mycobacterium tuberculosis
HLIEKLGLTTQERDQ

SEQ ID NO: 158063 - protein, 15 aa, Mycobacterium tuberculosis
LIEKLGLTTQERDQW

SEQ ID NO: 158064 - protein, 15 aa, Mycobacterium tuberculosis
IEKLGLTTQERDQWD

SEQ ID NO: 158065 - protein, 15 aa, Mycobacterium tuberculosis
EKLGLTTQERDQWDD

SEQ ID NO: 158066 - protein, 15 aa, Mycobacterium tuberculosis
KLGLTTQERDQWDDV

SEQ ID NO: 158067 - protein, 15 aa, Mycobacterium tuberculosis
LGLTTQERDQWDDVS

SEQ ID NO: 158068 - protein, 15 aa, Mycobacterium tuberculosis
GLTTQERDQWDDVSR

SEQ ID NO: 158069 - protein, 15 aa, Mycobacterium tuberculosis
LTTQERDQWDDVSRR

SEQ ID NO: 158070 - protein, 15 aa, Mycobacterium tuberculosis
TTQERDQWDDVSRRM

SEQ ID NO: 158071 - protein, 15 aa, Mycobacterium tuberculosis
TQERDQWDDVSRRMF

SEQ ID NO: 158072 - protein, 15 aa, Mycobacterium tuberculosis
QERDQWDDVSRRMFV

SEQ ID NO: 158073 - protein, 15 aa, Mycobacterium tuberculosis
ERDQWDDVSRRMFVP

SEQ ID NO: 158074 - protein, 15 aa, Mycobacterium tuberculosis
RDQWDDVSRRMFVPF

SEQ ID NO: 158075 - protein, 15 aa, Mycobacterium tuberculosis
DQWDDVSRRMFVPFH

SEQ ID NO: 158076 - protein, 15 aa, Mycobacterium tuberculosis
QWDDVSRRMFVPFHD

SEQ ID NO: 158077 - protein, 15 aa, Mycobacterium tuberculosis
WDDVSRRMFVPFHDG

SEQ ID NO: 158078 - protein, 15 aa, Mycobacterium tuberculosis
DDVSRRMFVPFHDGV

SEQ ID NO: 158079 - protein, 15 aa, Mycobacterium tuberculosis
DVSRRMFVPFHDGVI

SEQ ID NO: 158080 - protein, 15 aa, Mycobacterium tuberculosis
VSRRMFVPFHDGVIS

SEQ ID NO: 158081 - protein, 15 aa, Mycobacterium tuberculosis
SRRMFVPFHDGVISQ

SEQ ID NO: 158082 - protein, 15 aa, Mycobacterium tuberculosis
RRMFVPFHDGVISQF

SEQ ID NO: 158083 - protein, 15 aa, Mycobacterium tuberculosis
RMFVPFHDGVISQFE

SEQ ID NO: 158084 - protein, 15 aa, Mycobacterium tuberculosis
MFVPFHDGVISQFEG

SEQ ID NO: 158085 - protein, 15 aa, Mycobacterium tuberculosis
FVPFHDGVISQFEGY

SEQ ID NO: 158086 - protein, 15 aa, Mycobacterium tuberculosis
VPFHDGVISQFEGYS

SEQ ID NO: 158087 - protein, 15 aa, Mycobacterium tuberculosis
PFHDGVISQFEGYSE

SEQ ID NO: 158088 - protein, 15 aa, Mycobacterium tuberculosis
FHDGVISQFEGYSEL

SEQ ID NO: 158089 - protein, 15 aa, Mycobacterium tuberculosis
HDGVISQFEGYSELA

SEQ ID NO: 158090 - protein, 15 aa, Mycobacterium tuberculosis
DGVISQFEGYSELAE

SEQ ID NO: 158091 - protein, 15 aa, Mycobacterium tuberculosis
GVISQFEGYSELAEL

SEQ ID NO: 158092 - protein, 15 aa, Mycobacterium tuberculosis
VISQFEGYSELAELD

SEQ ID NO: 158093 - protein, 15 aa, Mycobacterium tuberculosis
ISQFEGYSELAELDW

SEQ ID NO: 158094 - protein, 15 aa, Mycobacterium tuberculosis
SQFEGYSELAELDWD

SEQ ID NO: 158095 - protein, 15 aa, Mycobacterium tuberculosis
QFEGYSELAELDWDH

SEQ ID NO: 158096 - protein, 15 aa, Mycobacterium tuberculosis
FEGYSELAELDWDHY

SEQ ID NO: 158097 - protein, 15 aa, Mycobacterium tuberculosis
EGYSELAELDWDHYR

SEQ ID NO: 158098 - protein, 15 aa, Mycobacterium tuberculosis
GYSELAELDWDHYRH

SEQ ID NO: 158099 - protein, 15 aa, Mycobacterium tuberculosis
YSELAELDWDHYRHR

SEQ ID NO: 158100 - protein, 15 aa, Mycobacterium tuberculosis
SELAELDWDHYRHRY

SEQ ID NO: 158101 - protein, 15 aa, Mycobacterium tuberculosis
ELAELDWDHYRHRYG

SEQ ID NO: 158102 - protein, 15 aa, Mycobacterium tuberculosis
LAELDWDHYRHRYGN

SEQ ID NO: 158103 - protein, 15 aa, Mycobacterium tuberculosis
AELDWDHYRHRYGNI

SEQ ID NO: 158104 - protein, 15 aa, Mycobacterium tuberculosis
ELDWDHYRHRYGNIQ

SEQ ID NO: 158105 - protein, 15 aa, Mycobacterium tuberculosis
LDWDHYRHRYGNIQR

SEQ ID NO: 158106 - protein, 15 aa, Mycobacterium tuberculosis
DWDHYRHRYGNIQRL

SEQ ID NO: 158107 - protein, 15 aa, Mycobacterium tuberculosis
WDHYRHRYGNIQRLD

SEQ ID NO: 158108 - protein, 15 aa, Mycobacterium tuberculosis
DHYRHRYGNIQRLDR

SEQ ID NO: 158109 - protein, 15 aa, Mycobacterium tuberculosis
HYRHRYGNIQRLDRI

SEQ ID NO: 158110 - protein, 15 aa, Mycobacterium tuberculosis
YRHRYGNIQRLDRIL

SEQ ID NO: 158111 - protein, 15 aa, Mycobacterium tuberculosis
RHRYGNIQRLDRILE

SEQ ID NO: 158112 - protein, 15 aa, Mycobacterium tuberculosis
HRYGNIQRLDRILEA

SEQ ID NO: 158113 - protein, 15 aa, Mycobacterium tuberculosis
RYGNIQRLDRILEAE

SEQ ID NO: 158114 - protein, 15 aa, Mycobacterium tuberculosis
YGNIQRLDRILEAEG

SEQ ID NO: 158115 - protein, 15 aa, Mycobacterium tuberculosis
GNIQRLDRILEAEGD

SEQ ID NO: 158116 - protein, 15 aa, Mycobacterium tuberculosis
NIQRLDRILEAEGDS

SEQ ID NO: 158117 - protein, 15 aa, Mycobacterium tuberculosis
IQRLDRILEAEGDSV

SEQ ID NO: 158118 - protein, 15 aa, Mycobacterium tuberculosis
QRLDRILEAEGDSVN

SEQ ID NO: 158119 - protein, 15 aa, Mycobacterium tuberculosis
RLDRILEAEGDSVNN

SEQ ID NO: 158120 - protein, 15 aa, Mycobacterium tuberculosis
LDRILEAEGDSVNNY

SEQ ID NO: 158121 - protein, 15 aa, Mycobacterium tuberculosis
DRILEAEGDSVNNYQ

SEQ ID NO: 158122 - protein, 15 aa, Mycobacterium tuberculosis
RILEAEGDSVNNYQA

SEQ ID NO: 158123 - protein, 15 aa, Mycobacterium tuberculosis
ILEAEGDSVNNYQAS

SEQ ID NO: 158124 - protein, 15 aa, Mycobacterium tuberculosis
LEAEGDSVNNYQASK

SEQ ID NO: 158125 - protein, 15 aa, Mycobacterium tuberculosis
EAEGDSVNNYQASKQ

SEQ ID NO: 158126 - protein, 15 aa, Mycobacterium tuberculosis
AEGDSVNNYQASKQA

SEQ ID NO: 158127 - protein, 15 aa, Mycobacterium tuberculosis
EGDSVNNYQASKQAD

SEQ ID NO: 158128 - protein, 15 aa, Mycobacterium tuberculosis
GDSVNNYQASKQADA

SEQ ID NO: 158129 - protein, 15 aa, Mycobacterium tuberculosis
DSVNNYQASKQADAL

SEQ ID NO: 158130 - protein, 15 aa, Mycobacterium tuberculosis
SVNNYQASKQADALM

SEQ ID NO: 158131 - protein, 15 aa, Mycobacterium tuberculosis
VNNYQASKQADALML

SEQ ID NO: 158132 - protein, 15 aa, Mycobacterium tuberculosis
NNYQASKQADALMLL

SEQ ID NO: 158133 - protein, 15 aa, Mycobacterium tuberculosis
NYQASKQADALMLLY

SEQ ID NO: 158134 - protein, 15 aa, Mycobacterium tuberculosis
YQASKQADALMLLYL

SEQ ID NO: 158135 - protein, 15 aa, Mycobacterium tuberculosis
QASKQADALMLLYLL

SEQ ID NO: 158136 - protein, 15 aa, Mycobacterium tuberculosis
ASKQADALMLLYLLS

SEQ ID NO: 158137 - protein, 15 aa, Mycobacterium tuberculosis
SKQADALMLLYLLSS

SEQ ID NO: 158138 - protein, 15 aa, Mycobacterium tuberculosis
KQADALMLLYLLSSD

SEQ ID NO: 158139 - protein, 15 aa, Mycobacterium tuberculosis
QADALMLLYLLSSDE

SEQ ID NO: 158140 - protein, 15 aa, Mycobacterium tuberculosis
ADALMLLYLLSSDEL

SEQ ID NO: 158141 - protein, 15 aa, Mycobacterium tuberculosis
DALMLLYLLSSDELI

SEQ ID NO: 158142 - protein, 15 aa, Mycobacterium tuberculosis
ALMLLYLLSSDELIG

SEQ ID NO: 158143 - protein, 15 aa, Mycobacterium tuberculosis
LMLLYLLSSDELIGL

SEQ ID NO: 158144 - protein, 15 aa, Mycobacterium tuberculosis
MLLYLLSSDELIGLL

SEQ ID NO: 158145 - protein, 15 aa, Mycobacterium tuberculosis
LLYLLSSDELIGLLA

SEQ ID NO: 158146 - protein, 15 aa, Mycobacterium tuberculosis
LYLLSSDELIGLLAR

SEQ ID NO: 158147 - protein, 15 aa, Mycobacterium tuberculosis
YLLSSDELIGLLARL

SEQ ID NO: 158148 - protein, 15 aa, Mycobacterium tuberculosis
LLSSDELIGLLARLG

SEQ ID NO: 158149 - protein, 15 aa, Mycobacterium tuberculosis
LSSDELIGLLARLGY

SEQ ID NO: 158150 - protein, 15 aa, Mycobacterium tuberculosis
SSDELIGLLARLGYR

SEQ ID NO: 158151 - protein, 15 aa, Mycobacterium tuberculosis
SDELIGLLARLGYRF

SEQ ID NO: 158152 - protein, 15 aa, Mycobacterium tuberculosis
DELIGLLARLGYRFA

SEQ ID NO: 158153 - protein, 15 aa, Mycobacterium tuberculosis
ELIGLLARLGYRFAP

SEQ ID NO: 158154 - protein, 15 aa, Mycobacterium tuberculosis
LIGLLARLGYRFAPT

SEQ ID NO: 158155 - protein, 15 aa, Mycobacterium tuberculosis
IGLLARLGYRFAPTQ

SEQ ID NO: 158156 - protein, 15 aa, Mycobacterium tuberculosis
GLLARLGYRFAPTQI

SEQ ID NO: 158157 - protein, 15 aa, Mycobacterium tuberculosis
LLARLGYRFAPTQIP

SEQ ID NO: 158158 - protein, 15 aa, Mycobacterium tuberculosis
LARLGYRFAPTQIPG

SEQ ID NO: 158159 - protein, 15 aa, Mycobacterium tuberculosis
ARLGYRFAPTQIPGT

SEQ ID NO: 158160 - protein, 15 aa, Mycobacterium tuberculosis
RLGYRFAPTQIPGTV

SEQ ID NO: 158161 - protein, 15 aa, Mycobacterium tuberculosis
LGYRFAPTQIPGTVD

SEQ ID NO: 158162 - protein, 15 aa, Mycobacterium tuberculosis
GYRFAPTQIPGTVDY

SEQ ID NO: 158163 - protein, 15 aa, Mycobacterium tuberculosis
YRFAPTQIPGTVDYY

SEQ ID NO: 158164 - protein, 15 aa, Mycobacterium tuberculosis
RFAPTQIPGTVDYYL

SEQ ID NO: 158165 - protein, 15 aa, Mycobacterium tuberculosis
FAPTQIPGTVDYYLA

SEQ ID NO: 158166 - protein, 15 aa, Mycobacterium tuberculosis
APTQIPGTVDYYLAR

SEQ ID NO: 158167 - protein, 15 aa, Mycobacterium tuberculosis
PTQIPGTVDYYLART

SEQ ID NO: 158168 - protein, 15 aa, Mycobacterium tuberculosis
TQIPGTVDYYLARTS

SEQ ID NO: 158169 - protein, 15 aa, Mycobacterium tuberculosis
QIPGTVDYYLARTSD

SEQ ID NO: 158170 - protein, 15 aa, Mycobacterium tuberculosis
IPGTVDYYLARTSDG

SEQ ID NO: 158171 - protein, 15 aa, Mycobacterium tuberculosis
PGTVDYYLARTSDGS

SEQ ID NO: 158172 - protein, 15 aa, Mycobacterium tuberculosis
GTVDYYLARTSDGST

SEQ ID NO: 158173 - protein, 15 aa, Mycobacterium tuberculosis
TVDYYLARTSDGSTL

SEQ ID NO: 158174 - protein, 15 aa, Mycobacterium tuberculosis
VDYYLARTSDGSTLS

SEQ ID NO: 158175 - protein, 15 aa, Mycobacterium tuberculosis
DYYLARTSDGSTLSA

SEQ ID NO: 158176 - protein, 15 aa, Mycobacterium tuberculosis
YYLARTSDGSTLSAV

SEQ ID NO: 158177 - protein, 15 aa, Mycobacterium tuberculosis
YLARTSDGSTLSAVV

SEQ ID NO: 158178 - protein, 15 aa, Mycobacterium tuberculosis
LARTSDGSTLSAVVH

SEQ ID NO: 158179 - protein, 15 aa, Mycobacterium tuberculosis
ARTSDGSTLSAVVHA

SEQ ID NO: 158180 - protein, 15 aa, Mycobacterium tuberculosis
RTSDGSTLSAVVHAW

SEQ ID NO: 158181 - protein, 15 aa, Mycobacterium tuberculosis
TSDGSTLSAVVHAWV

SEQ ID NO: 158182 - protein, 15 aa, Mycobacterium tuberculosis
SDGSTLSAVVHAWVL

SEQ ID NO: 158183 - protein, 15 aa, Mycobacterium tuberculosis
DGSTLSAVVHAWVLA

SEQ ID NO: 158184 - protein, 15 aa, Mycobacterium tuberculosis
GSTLSAVVHAWVLAR

SEQ ID NO: 158185 - protein, 15 aa, Mycobacterium tuberculosis
STLSAVVHAWVLARA

SEQ ID NO: 158186 - protein, 15 aa, Mycobacterium tuberculosis
TLSAVVHAWVLARAN

SEQ ID NO: 158187 - protein, 15 aa, Mycobacterium tuberculosis
LSAVVHAWVLARANR

SEQ ID NO: 158188 - protein, 15 aa, Mycobacterium tuberculosis
SAVVHAWVLARANRS

SEQ ID NO: 158189 - protein, 15 aa, Mycobacterium tuberculosis
AVVHAWVLARANRSN

SEQ ID NO: 158190 - protein, 15 aa, Mycobacterium tuberculosis
VVHAWVLARANRSNA

SEQ ID NO: 158191 - protein, 15 aa, Mycobacterium tuberculosis
VHAWVLARANRSNAM

SEQ ID NO: 158192 - protein, 15 aa, Mycobacterium tuberculosis
HAWVLARANRSNAME

SEQ ID NO: 158193 - protein, 15 aa, Mycobacterium tuberculosis
AWVLARANRSNAMEY

SEQ ID NO: 158194 - protein, 15 aa, Mycobacterium tuberculosis
WVLARANRSNAMEYF

SEQ ID NO: 158195 - protein, 15 aa, Mycobacterium tuberculosis
VLARANRSNAMEYFR

SEQ ID NO: 158196 - protein, 15 aa, Mycobacterium tuberculosis
LARANRSNAMEYFRQ

SEQ ID NO: 158197 - protein, 15 aa, Mycobacterium tuberculosis
ARANRSNAMEYFRQV

SEQ ID NO: 158198 - protein, 15 aa, Mycobacterium tuberculosis
RANRSNAMEYFRQVL

SEQ ID NO: 158199 - protein, 15 aa, Mycobacterium tuberculosis
ANRSNAMEYFRQVLR

SEQ ID NO: 158200 - protein, 15 aa, Mycobacterium tuberculosis
NRSNAMEYFRQVLRS

SEQ ID NO: 158201 - protein, 15 aa, Mycobacterium tuberculosis
RSNAMEYFRQVLRSD

SEQ ID NO: 158202 - protein, 15 aa, Mycobacterium tuberculosis
SNAMEYFRQVLRSDI

SEQ ID NO: 158203 - protein, 15 aa, Mycobacterium tuberculosis
NAMEYFRQVLRSDIA

SEQ ID NO: 158204 - protein, 15 aa, Mycobacterium tuberculosis
AMEYFRQVLRSDIAD

SEQ ID NO: 158205 - protein, 15 aa, Mycobacterium tuberculosis
MEYFRQVLRSDIADV

SEQ ID NO: 158206 - protein, 15 aa, Mycobacterium tuberculosis
EYFRQVLRSDIADVQ

SEQ ID NO: 158207 - protein, 15 aa, Mycobacterium tuberculosis
YFRQVLRSDIADVQG

SEQ ID NO: 158208 - protein, 15 aa, Mycobacterium tuberculosis
FRQVLRSDIADVQGG

SEQ ID NO: 158209 - protein, 15 aa, Mycobacterium tuberculosis
RQVLRSDIADVQGGT

SEQ ID NO: 158210 - protein, 15 aa, Mycobacterium tuberculosis
QVLRSDIADVQGGTT

SEQ ID NO: 158211 - protein, 15 aa, Mycobacterium tuberculosis
VLRSDIADVQGGTTQ

SEQ ID NO: 158212 - protein, 15 aa, Mycobacterium tuberculosis
LRSDIADVQGGTTQE

SEQ ID NO: 158213 - protein, 15 aa, Mycobacterium tuberculosis
RSDIADVQGGTTQEG

SEQ ID NO: 158214 - protein, 15 aa, Mycobacterium tuberculosis
SDIADVQGGTTQEGI

SEQ ID NO: 158215 - protein, 15 aa, Mycobacterium tuberculosis
DIADVQGGTTQEGIH

SEQ ID NO: 158216 - protein, 15 aa, Mycobacterium tuberculosis
IADVQGGTTQEGIHL

SEQ ID NO: 158217 - protein, 15 aa, Mycobacterium tuberculosis
ADVQGGTTQEGIHLA

SEQ ID NO: 158218 - protein, 15 aa, Mycobacterium tuberculosis
DVQGGTTQEGIHLAA

SEQ ID NO: 158219 - protein, 15 aa, Mycobacterium tuberculosis
VQGGTTQEGIHLAAM

SEQ ID NO: 158220 - protein, 15 aa, Mycobacterium tuberculosis
QGGTTQEGIHLAAMA

SEQ ID NO: 158221 - protein, 15 aa, Mycobacterium tuberculosis
GGTTQEGIHLAAMAG

SEQ ID NO: 158222 - protein, 15 aa, Mycobacterium tuberculosis
GTTQEGIHLAAMAGS

SEQ ID NO: 158223 - protein, 15 aa, Mycobacterium tuberculosis
TTQEGIHLAAMAGSI

SEQ ID NO: 158224 - protein, 15 aa, Mycobacterium tuberculosis
TQEGIHLAAMAGSID

SEQ ID NO: 158225 - protein, 15 aa, Mycobacterium tuberculosis
QEGIHLAAMAGSIDL

SEQ ID NO: 158226 - protein, 15 aa, Mycobacterium tuberculosis
EGIHLAAMAGSIDLL

SEQ ID NO: 158227 - protein, 15 aa, Mycobacterium tuberculosis
GIHLAAMAGSIDLLQ

SEQ ID NO: 158228 - protein, 15 aa, Mycobacterium tuberculosis
IHLAAMAGSIDLLQR

SEQ ID NO: 158229 - protein, 15 aa, Mycobacterium tuberculosis
HLAAMAGSIDLLQRC

SEQ ID NO: 158230 - protein, 15 aa, Mycobacterium tuberculosis
LAAMAGSIDLLQRCY

SEQ ID NO: 158231 - protein, 15 aa, Mycobacterium tuberculosis
AAMAGSIDLLQRCYS

SEQ ID NO: 158232 - protein, 15 aa, Mycobacterium tuberculosis
AMAGSIDLLQRCYSG

SEQ ID NO: 158233 - protein, 15 aa, Mycobacterium tuberculosis
MAGSIDLLQRCYSGL

SEQ ID NO: 158234 - protein, 15 aa, Mycobacterium tuberculosis
AGSIDLLQRCYSGLE

SEQ ID NO: 158235 - protein, 15 aa, Mycobacterium tuberculosis
GSIDLLQRCYSGLEL

SEQ ID NO: 158236 - protein, 15 aa, Mycobacterium tuberculosis
SIDLLQRCYSGLELR

SEQ ID NO: 158237 - protein, 15 aa, Mycobacterium tuberculosis
IDLLQRCYSGLELRD

SEQ ID NO: 158238 - protein, 15 aa, Mycobacterium tuberculosis
DLLQRCYSGLELRDD

SEQ ID NO: 158239 - protein, 15 aa, Mycobacterium tuberculosis
LLQRCYSGLELRDDR

SEQ ID NO: 158240 - protein, 15 aa, Mycobacterium tuberculosis
LQRCYSGLELRDDRL

SEQ ID NO: 158241 - protein, 15 aa, Mycobacterium tuberculosis
QRCYSGLELRDDRLV

SEQ ID NO: 158242 - protein, 15 aa, Mycobacterium tuberculosis
RCYSGLELRDDRLVL

SEQ ID NO: 158243 - protein, 15 aa, Mycobacterium tuberculosis
CYSGLELRDDRLVLS

SEQ ID NO: 158244 - protein, 15 aa, Mycobacterium tuberculosis
YSGLELRDDRLVLSP

SEQ ID NO: 158245 - protein, 15 aa, Mycobacterium tuberculosis
SGLELRDDRLVLSPQ

SEQ ID NO: 158246 - protein, 15 aa, Mycobacterium tuberculosis
GLELRDDRLVLSPQW

SEQ ID NO: 158247 - protein, 15 aa, Mycobacterium tuberculosis
LELRDDRLVLSPQWP

SEQ ID NO: 158248 - protein, 15 aa, Mycobacterium tuberculosis
ELRDDRLVLSPQWPE

SEQ ID NO: 158249 - protein, 15 aa, Mycobacterium tuberculosis
LRDDRLVLSPQWPEA

SEQ ID NO: 158250 - protein, 15 aa, Mycobacterium tuberculosis
RDDRLVLSPQWPEAL

SEQ ID NO: 158251 - protein, 15 aa, Mycobacterium tuberculosis
DDRLVLSPQWPEALG

SEQ ID NO: 158252 - protein, 15 aa, Mycobacterium tuberculosis
DRLVLSPQWPEALGP

SEQ ID NO: 158253 - protein, 15 aa, Mycobacterium tuberculosis
RLVLSPQWPEALGPL

SEQ ID NO: 158254 - protein, 15 aa, Mycobacterium tuberculosis
LVLSPQWPEALGPLE

SEQ ID NO: 158255 - protein, 15 aa, Mycobacterium tuberculosis
VLSPQWPEALGPLEF

SEQ ID NO: 158256 - protein, 15 aa, Mycobacterium tuberculosis
LSPQWPEALGPLEFP

SEQ ID NO: 158257 - protein, 15 aa, Mycobacterium tuberculosis
SPQWPEALGPLEFPF

SEQ ID NO: 158258 - protein, 15 aa, Mycobacterium tuberculosis
PQWPEALGPLEFPFV

SEQ ID NO: 158259 - protein, 15 aa, Mycobacterium tuberculosis
QWPEALGPLEFPFVY

SEQ ID NO: 158260 - protein, 15 aa, Mycobacterium tuberculosis
WPEALGPLEFPFVYR

SEQ ID NO: 158261 - protein, 15 aa, Mycobacterium tuberculosis
PEALGPLEFPFVYRR

SEQ ID NO: 158262 - protein, 15 aa, Mycobacterium tuberculosis
EALGPLEFPFVYRRH

SEQ ID NO: 158263 - protein, 15 aa, Mycobacterium tuberculosis
ALGPLEFPFVYRRHQ

SEQ ID NO: 158264 - protein, 15 aa, Mycobacterium tuberculosis
LGPLEFPFVYRRHQL

SEQ ID NO: 158265 - protein, 15 aa, Mycobacterium tuberculosis
GPLEFPFVYRRHQLS

SEQ ID NO: 158266 - protein, 15 aa, Mycobacterium tuberculosis
PLEFPFVYRRHQLSL

SEQ ID NO: 158267 - protein, 15 aa, Mycobacterium tuberculosis
LEFPFVYRRHQLSLR

SEQ ID NO: 158268 - protein, 15 aa, Mycobacterium tuberculosis
EFPFVYRRHQLSLRI

SEQ ID NO: 158269 - protein, 15 aa, Mycobacterium tuberculosis
FPFVYRRHQLSLRIS

SEQ ID NO: 158270 - protein, 15 aa, Mycobacterium tuberculosis
PFVYRRHQLSLRISG

SEQ ID NO: 158271 - protein, 15 aa, Mycobacterium tuberculosis
FVYRRHQLSLRISGR

SEQ ID NO: 158272 - protein, 15 aa, Mycobacterium tuberculosis
VYRRHQLSLRISGRS

SEQ ID NO: 158273 - protein, 15 aa, Mycobacterium tuberculosis
YRRHQLSLRISGRSA

SEQ ID NO: 158274 - protein, 15 aa, Mycobacterium tuberculosis
RRHQLSLRISGRSAT

SEQ ID NO: 158275 - protein, 15 aa, Mycobacterium tuberculosis
RHQLSLRISGRSATL

SEQ ID NO: 158276 - protein, 15 aa, Mycobacterium tuberculosis
HQLSLRISGRSATLT

SEQ ID NO: 158277 - protein, 15 aa, Mycobacterium tuberculosis
QLSLRISGRSATLTA

SEQ ID NO: 158278 - protein, 15 aa, Mycobacterium tuberculosis
LSLRISGRSATLTAE

SEQ ID NO: 158279 - protein, 15 aa, Mycobacterium tuberculosis
SLRISGRSATLTAES

SEQ ID NO: 158280 - protein, 15 aa, Mycobacterium tuberculosis
LRISGRSATLTAESG

SEQ ID NO: 158281 - protein, 15 aa, Mycobacterium tuberculosis
RISGRSATLTAESGD

SEQ ID NO: 158282 - protein, 15 aa, Mycobacterium tuberculosis
ISGRSATLTAESGDA

SEQ ID NO: 158283 - protein, 15 aa, Mycobacterium tuberculosis
SGRSATLTAESGDAE

SEQ ID NO: 158284 - protein, 15 aa, Mycobacterium tuberculosis
GRSATLTAESGDAEP

SEQ ID NO: 158285 - protein, 15 aa, Mycobacterium tuberculosis
RSATLTAESGDAEPI

SEQ ID NO: 158286 - protein, 15 aa, Mycobacterium tuberculosis
SATLTAESGDAEPIE

SEQ ID NO: 158287 - protein, 15 aa, Mycobacterium tuberculosis
ATLTAESGDAEPIEV

SEQ ID NO: 158288 - protein, 15 aa, Mycobacterium tuberculosis
TLTAESGDAEPIEVE

SEQ ID NO: 158289 - protein, 15 aa, Mycobacterium tuberculosis
LTAESGDAEPIEVEC

SEQ ID NO: 158290 - protein, 15 aa, Mycobacterium tuberculosis
TAESGDAEPIEVECR

SEQ ID NO: 158291 - protein, 15 aa, Mycobacterium tuberculosis
AESGDAEPIEVECRG

SEQ ID NO: 158292 - protein, 15 aa, Mycobacterium tuberculosis
ESGDAEPIEVECRGH

SEQ ID NO: 158293 - protein, 15 aa, Mycobacterium tuberculosis
SGDAEPIEVECRGHV

SEQ ID NO: 158294 - protein, 15 aa, Mycobacterium tuberculosis
GDAEPIEVECRGHVQ

SEQ ID NO: 158295 - protein, 15 aa, Mycobacterium tuberculosis
DAEPIEVECRGHVQR

SEQ ID NO: 158296 - protein, 15 aa, Mycobacterium tuberculosis
AEPIEVECRGHVQRL

SEQ ID NO: 158297 - protein, 15 aa, Mycobacterium tuberculosis
EPIEVECRGHVQRLR

SEQ ID NO: 158298 - protein, 15 aa, Mycobacterium tuberculosis
PIEVECRGHVQRLRC

SEQ ID NO: 158299 - protein, 15 aa, Mycobacterium tuberculosis
IEVECRGHVQRLRCG

SEQ ID NO: 158300 - protein, 15 aa, Mycobacterium tuberculosis
EVECRGHVQRLRCGH

SEQ ID NO: 158301 - protein, 15 aa, Mycobacterium tuberculosis
VECRGHVQRLRCGHT

SEQ ID NO: 158302 - protein, 15 aa, Mycobacterium tuberculosis
ECRGHVQRLRCGHTI

SEQ ID NO: 158303 - protein, 15 aa, Mycobacterium tuberculosis
CRGHVQRLRCGHTIE

SEQ ID NO: 158304 - protein, 15 aa, Mycobacterium tuberculosis
RGHVQRLRCGHTIEV

SEQ ID NO: 158305 - protein, 15 aa, Mycobacterium tuberculosis
GHVQRLRCGHTIEVG

SEQ ID NO: 158306 - protein, 15 aa, Mycobacterium tuberculosis
HVQRLRCGHTIEVGC

SEQ ID NO: 158307 - protein, 15 aa, Mycobacterium tuberculosis
VQRLRCGHTIEVGCS

SEQ ID NO: 158308 - protein, 15 aa, Mycobacterium tuberculosis
QRLRCGHTIEVGCSR

SEQ ID NO: 158309 - protein, 16 aa, Mycobacterium tuberculosis
MRCGIVVNVTGPPPTI

SEQ ID NO: 158310 - protein, 16 aa, Mycobacterium tuberculosis
RCGIVVNVTGPPPTID

SEQ ID NO: 158311 - protein, 16 aa, Mycobacterium tuberculosis
CGIVVNVTGPPPTIDR

SEQ ID NO: 158312 - protein, 16 aa, Mycobacterium tuberculosis
GIVVNVTGPPPTIDRR

SEQ ID NO: 158313 - protein, 16 aa, Mycobacterium tuberculosis
IVVNVTGPPPTIDRRY

SEQ ID NO: 158314 - protein, 16 aa, Mycobacterium tuberculosis
VVNVTGPPPTIDRRYH

SEQ ID NO: 158315 - protein, 16 aa, Mycobacterium tuberculosis
VNVTGPPPTIDRRYHD

SEQ ID NO: 158316 - protein, 16 aa, Mycobacterium tuberculosis
NVTGPPPTIDRRYHDA

SEQ ID NO: 158317 - protein, 16 aa, Mycobacterium tuberculosis
VTGPPPTIDRRYHDAV

SEQ ID NO: 158318 - protein, 16 aa, Mycobacterium tuberculosis
TGPPPTIDRRYHDAVI

SEQ ID NO: 158319 - protein, 16 aa, Mycobacterium tuberculosis
GPPPTIDRRYHDAVIV

SEQ ID NO: 158320 - protein, 16 aa, Mycobacterium tuberculosis
PPPTIDRRYHDAVIVG

SEQ ID NO: 158321 - protein, 16 aa, Mycobacterium tuberculosis
PPTIDRRYHDAVIVGL

SEQ ID NO: 158322 - protein, 16 aa, Mycobacterium tuberculosis
PTIDRRYHDAVIVGLD

SEQ ID NO: 158323 - protein, 16 aa, Mycobacterium tuberculosis
TIDRRYHDAVIVGLDN

SEQ ID NO: 158324 - protein, 16 aa, Mycobacterium tuberculosis
IDRRYHDAVIVGLDNV

SEQ ID NO: 158325 - protein, 16 aa, Mycobacterium tuberculosis
DRRYHDAVIVGLDNVV

SEQ ID NO: 158326 - protein, 16 aa, Mycobacterium tuberculosis
RRYHDAVIVGLDNVVD

SEQ ID NO: 158327 - protein, 16 aa, Mycobacterium tuberculosis
RYHDAVIVGLDNVVDK

SEQ ID NO: 158328 - protein, 16 aa, Mycobacterium tuberculosis
YHDAVIVGLDNVVDKA

SEQ ID NO: 158329 - protein, 16 aa, Mycobacterium tuberculosis
HDAVIVGLDNVVDKAT

SEQ ID NO: 158330 - protein, 16 aa, Mycobacterium tuberculosis
DAVIVGLDNVVDKATR

SEQ ID NO: 158331 - protein, 16 aa, Mycobacterium tuberculosis
AVIVGLDNVVDKATRV

SEQ ID NO: 158332 - protein, 16 aa, Mycobacterium tuberculosis
VIVGLDNVVDKATRVH

SEQ ID NO: 158333 - protein, 16 aa, Mycobacterium tuberculosis
IVGLDNVVDKATRVHA

SEQ ID NO: 158334 - protein, 16 aa, Mycobacterium tuberculosis
VGLDNVVDKATRVHAA

SEQ ID NO: 158335 - protein, 16 aa, Mycobacterium tuberculosis
GLDNVVDKATRVHAAA

SEQ ID NO: 158336 - protein, 16 aa, Mycobacterium tuberculosis
LDNVVDKATRVHAAAW

SEQ ID NO: 158337 - protein, 16 aa, Mycobacterium tuberculosis
DNVVDKATRVHAAAWT

SEQ ID NO: 158338 - protein, 16 aa, Mycobacterium tuberculosis
NVVDKATRVHAAAWTK

SEQ ID NO: 158339 - protein, 16 aa, Mycobacterium tuberculosis
VVDKATRVHAAAWTKF

SEQ ID NO: 158340 - protein, 16 aa, Mycobacterium tuberculosis
VDKATRVHAAAWTKFL

SEQ ID NO: 158341 - protein, 16 aa, Mycobacterium tuberculosis
DKATRVHAAAWTKFLD

SEQ ID NO: 158342 - protein, 16 aa, Mycobacterium tuberculosis
KATRVHAAAWTKFLDD

SEQ ID NO: 158343 - protein, 16 aa, Mycobacterium tuberculosis
ATRVHAAAWTKFLDDY

SEQ ID NO: 158344 - protein, 16 aa, Mycobacterium tuberculosis
TRVHAAAWTKFLDDYL

SEQ ID NO: 158345 - protein, 16 aa, Mycobacterium tuberculosis
RVHAAAWTKFLDDYLT

SEQ ID NO: 158346 - protein, 16 aa, Mycobacterium tuberculosis
VHAAAWTKFLDDYLTR

SEQ ID NO: 158347 - protein, 16 aa, Mycobacterium tuberculosis
HAAAWTKFLDDYLTRR

SEQ ID NO: 158348 - protein, 16 aa, Mycobacterium tuberculosis
AAAWTKFLDDYLTRRP

SEQ ID NO: 158349 - protein, 16 aa, Mycobacterium tuberculosis
AAWTKFLDDYLTRRPQ

SEQ ID NO: 158350 - protein, 16 aa, Mycobacterium tuberculosis
AWTKFLDDYLTRRPQR

SEQ ID NO: 158351 - protein, 16 aa, Mycobacterium tuberculosis
WTKFLDDYLTRRPQRT

SEQ ID NO: 158352 - protein, 16 aa, Mycobacterium tuberculosis
TKFLDDYLTRRPQRTG

SEQ ID NO: 158353 - protein, 16 aa, Mycobacterium tuberculosis
KFLDDYLTRRPQRTGE

SEQ ID NO: 158354 - protein, 16 aa, Mycobacterium tuberculosis
FLDDYLTRRPQRTGED

SEQ ID NO: 158355 - protein, 16 aa, Mycobacterium tuberculosis
LDDYLTRRPQRTGEDH

SEQ ID NO: 158356 - protein, 16 aa, Mycobacterium tuberculosis
DDYLTRRPQRTGEDHC

SEQ ID NO: 158357 - protein, 16 aa, Mycobacterium tuberculosis
DYLTRRPQRTGEDHCP

SEQ ID NO: 158358 - protein, 16 aa, Mycobacterium tuberculosis
YLTRRPQRTGEDHCPL

SEQ ID NO: 158359 - protein, 16 aa, Mycobacterium tuberculosis
LTRRPQRTGEDHCPLT

SEQ ID NO: 158360 - protein, 16 aa, Mycobacterium tuberculosis
TRRPQRTGEDHCPLTH

SEQ ID NO: 158361 - protein, 16 aa, Mycobacterium tuberculosis
RRPQRTGEDHCPLTHD

SEQ ID NO: 158362 - protein, 16 aa, Mycobacterium tuberculosis
RPQRTGEDHCPLTHDD

SEQ ID NO: 158363 - protein, 16 aa, Mycobacterium tuberculosis
PQRTGEDHCPLTHDDY

SEQ ID NO: 158364 - protein, 16 aa, Mycobacterium tuberculosis
QRTGEDHCPLTHDDYR

SEQ ID NO: 158365 - protein, 16 aa, Mycobacterium tuberculosis
RTGEDHCPLTHDDYRR

SEQ ID NO: 158366 - protein, 16 aa, Mycobacterium tuberculosis
TGEDHCPLTHDDYRRF

SEQ ID NO: 158367 - protein, 16 aa, Mycobacterium tuberculosis
GEDHCPLTHDDYRRFL

SEQ ID NO: 158368 - protein, 16 aa, Mycobacterium tuberculosis
EDHCPLTHDDYRRFLA

SEQ ID NO: 158369 - protein, 16 aa, Mycobacterium tuberculosis
DHCPLTHDDYRRFLAG

SEQ ID NO: 158370 - protein, 16 aa, Mycobacterium tuberculosis
HCPLTHDDYRRFLAGK

SEQ ID NO: 158371 - protein, 16 aa, Mycobacterium tuberculosis
CPLTHDDYRRFLAGKP

SEQ ID NO: 158372 - protein, 16 aa, Mycobacterium tuberculosis
PLTHDDYRRFLAGKPD

SEQ ID NO: 158373 - protein, 16 aa, Mycobacterium tuberculosis
LTHDDYRRFLAGKPDG

SEQ ID NO: 158374 - protein, 16 aa, Mycobacterium tuberculosis
THDDYRRFLAGKPDGV

SEQ ID NO: 158375 - protein, 16 aa, Mycobacterium tuberculosis
HDDYRRFLAGKPDGVA

SEQ ID NO: 158376 - protein, 16 aa, Mycobacterium tuberculosis
DDYRRFLAGKPDGVAD

SEQ ID NO: 158377 - protein, 16 aa, Mycobacterium tuberculosis
DYRRFLAGKPDGVADF

SEQ ID NO: 158378 - protein, 16 aa, Mycobacterium tuberculosis
YRRFLAGKPDGVADFL

SEQ ID NO: 158379 - protein, 16 aa, Mycobacterium tuberculosis
RRFLAGKPDGVADFLA

SEQ ID NO: 158380 - protein, 16 aa, Mycobacterium tuberculosis
RFLAGKPDGVADFLAA

SEQ ID NO: 158381 - protein, 16 aa, Mycobacterium tuberculosis
FLAGKPDGVADFLAAR

SEQ ID NO: 158382 - protein, 16 aa, Mycobacterium tuberculosis
LAGKPDGVADFLAARG

SEQ ID NO: 158383 - protein, 16 aa, Mycobacterium tuberculosis
AGKPDGVADFLAARGI

SEQ ID NO: 158384 - protein, 16 aa, Mycobacterium tuberculosis
GKPDGVADFLAARGIR

SEQ ID NO: 158385 - protein, 16 aa, Mycobacterium tuberculosis
KPDGVADFLAARGIRL

SEQ ID NO: 158386 - protein, 16 aa, Mycobacterium tuberculosis
PDGVADFLAARGIRLP

SEQ ID NO: 158387 - protein, 16 aa, Mycobacterium tuberculosis
DGVADFLAARGIRLPP

SEQ ID NO: 158388 - protein, 16 aa, Mycobacterium tuberculosis
GVADFLAARGIRLPPG

SEQ ID NO: 158389 - protein, 16 aa, Mycobacterium tuberculosis
VADFLAARGIRLPPGS

SEQ ID NO: 158390 - protein, 16 aa, Mycobacterium tuberculosis
ADFLAARGIRLPPGSP

SEQ ID NO: 158391 - protein, 16 aa, Mycobacterium tuberculosis
DFLAARGIRLPPGSPT

SEQ ID NO: 158392 - protein, 16 aa, Mycobacterium tuberculosis
FLAARGIRLPPGSPTD

SEQ ID NO: 158393 - protein, 16 aa, Mycobacterium tuberculosis
LAARGIRLPPGSPTDL

SEQ ID NO: 158394 - protein, 16 aa, Mycobacterium tuberculosis
AARGIRLPPGSPTDLT

SEQ ID NO: 158395 - protein, 16 aa, Mycobacterium tuberculosis
ARGIRLPPGSPTDLTD

SEQ ID NO: 158396 - protein, 16 aa, Mycobacterium tuberculosis
RGIRLPPGSPTDLTDD

SEQ ID NO: 158397 - protein, 16 aa, Mycobacterium tuberculosis
GIRLPPGSPTDLTDDT

SEQ ID NO: 158398 - protein, 16 aa, Mycobacterium tuberculosis
IRLPPGSPTDLTDDTV

SEQ ID NO: 158399 - protein, 16 aa, Mycobacterium tuberculosis
RLPPGSPTDLTDDTVY

SEQ ID NO: 158400 - protein, 16 aa, Mycobacterium tuberculosis
LPPGSPTDLTDDTVYG

SEQ ID NO: 158401 - protein, 16 aa, Mycobacterium tuberculosis
PPGSPTDLTDDTVYGL

SEQ ID NO: 158402 - protein, 16 aa, Mycobacterium tuberculosis
PGSPTDLTDDTVYGLQ

SEQ ID NO: 158403 - protein, 16 aa, Mycobacterium tuberculosis
GSPTDLTDDTVYGLQN

SEQ ID NO: 158404 - protein, 16 aa, Mycobacterium tuberculosis
SPTDLTDDTVYGLQNL

SEQ ID NO: 158405 - protein, 16 aa, Mycobacterium tuberculosis
PTDLTDDTVYGLQNLE

SEQ ID NO: 158406 - protein, 16 aa, Mycobacterium tuberculosis
TDLTDDTVYGLQNLER

SEQ ID NO: 158407 - protein, 16 aa, Mycobacterium tuberculosis
DLTDDTVYGLQNLERQ

SEQ ID NO: 158408 - protein, 16 aa, Mycobacterium tuberculosis
LTDDTVYGLQNLERQT

SEQ ID NO: 158409 - protein, 16 aa, Mycobacterium tuberculosis
TDDTVYGLQNLERQTF

SEQ ID NO: 158410 - protein, 16 aa, Mycobacterium tuberculosis
DDTVYGLQNLERQTFL

SEQ ID NO: 158411 - protein, 16 aa, Mycobacterium tuberculosis
DTVYGLQNLERQTFLQ

SEQ ID NO: 158412 - protein, 16 aa, Mycobacterium tuberculosis
TVYGLQNLERQTFLQL

SEQ ID NO: 158413 - protein, 16 aa, Mycobacterium tuberculosis
VYGLQNLERQTFLQLL

SEQ ID NO: 158414 - protein, 16 aa, Mycobacterium tuberculosis
YGLQNLERQTFLQLLN

SEQ ID NO: 158415 - protein, 16 aa, Mycobacterium tuberculosis
GLQNLERQTFLQLLNT

SEQ ID NO: 158416 - protein, 16 aa, Mycobacterium tuberculosis
LQNLERQTFLQLLNTG

SEQ ID NO: 158417 - protein, 16 aa, Mycobacterium tuberculosis
QNLERQTFLQLLNTGV

SEQ ID NO: 158418 - protein, 16 aa, Mycobacterium tuberculosis
NLERQTFLQLLNTGVP

SEQ ID NO: 158419 - protein, 16 aa, Mycobacterium tuberculosis
LERQTFLQLLNTGVPE

SEQ ID NO: 158420 - protein, 16 aa, Mycobacterium tuberculosis
ERQTFLQLLNTGVPEG

SEQ ID NO: 158421 - protein, 16 aa, Mycobacterium tuberculosis
RQTFLQLLNTGVPEGK

SEQ ID NO: 158422 - protein, 16 aa, Mycobacterium tuberculosis
QTFLQLLNTGVPEGKS

SEQ ID NO: 158423 - protein, 16 aa, Mycobacterium tuberculosis
TFLQLLNTGVPEGKSI

SEQ ID NO: 158424 - protein, 16 aa, Mycobacterium tuberculosis
FLQLLNTGVPEGKSIA

SEQ ID NO: 158425 - protein, 16 aa, Mycobacterium tuberculosis
LQLLNTGVPEGKSIAS

SEQ ID NO: 158426 - protein, 16 aa, Mycobacterium tuberculosis
QLLNTGVPEGKSIASF

SEQ ID NO: 158427 - protein, 16 aa, Mycobacterium tuberculosis
LLNTGVPEGKSIASFA

SEQ ID NO: 158428 - protein, 16 aa, Mycobacterium tuberculosis
LNTGVPEGKSIASFAR

SEQ ID NO: 158429 - protein, 16 aa, Mycobacterium tuberculosis
NTGVPEGKSIASFARR

SEQ ID NO: 158430 - protein, 16 aa, Mycobacterium tuberculosis
TGVPEGKSIASFARRL

SEQ ID NO: 158431 - protein, 16 aa, Mycobacterium tuberculosis
GVPEGKSIASFARRLQ

SEQ ID NO: 158432 - protein, 16 aa, Mycobacterium tuberculosis
VPEGKSIASFARRLQV

SEQ ID NO: 158433 - protein, 16 aa, Mycobacterium tuberculosis
PEGKSIASFARRLQVA

SEQ ID NO: 158434 - protein, 16 aa, Mycobacterium tuberculosis
EGKSIASFARRLQVAG

SEQ ID NO: 158435 - protein, 16 aa, Mycobacterium tuberculosis
GKSIASFARRLQVAGV

SEQ ID NO: 158436 - protein, 16 aa, Mycobacterium tuberculosis
KSIASFARRLQVAGVR

SEQ ID NO: 158437 - protein, 16 aa, Mycobacterium tuberculosis
SIASFARRLQVAGVRV

SEQ ID NO: 158438 - protein, 16 aa, Mycobacterium tuberculosis
IASFARRLQVAGVRVA

SEQ ID NO: 158439 - protein, 16 aa, Mycobacterium tuberculosis
ASFARRLQVAGVRVAA

SEQ ID NO: 158440 - protein, 16 aa, Mycobacterium tuberculosis
SFARRLQVAGVRVAAH

SEQ ID NO: 158441 - protein, 16 aa, Mycobacterium tuberculosis
FARRLQVAGVRVAAHT

SEQ ID NO: 158442 - protein, 16 aa, Mycobacterium tuberculosis
ARRLQVAGVRVAAHTS

SEQ ID NO: 158443 - protein, 16 aa, Mycobacterium tuberculosis
RRLQVAGVRVAAHTSH

SEQ ID NO: 158444 - protein, 16 aa, Mycobacterium tuberculosis
RLQVAGVRVAAHTSHR

SEQ ID NO: 158445 - protein, 16 aa, Mycobacterium tuberculosis
LQVAGVRVAAHTSHRN

SEQ ID NO: 158446 - protein, 16 aa, Mycobacterium tuberculosis
QVAGVRVAAHTSHRNY

SEQ ID NO: 158447 - protein, 16 aa, Mycobacterium tuberculosis
VAGVRVAAHTSHRNYG

SEQ ID NO: 158448 - protein, 16 aa, Mycobacterium tuberculosis
AGVRVAAHTSHRNYGH

SEQ ID NO: 158449 - protein, 16 aa, Mycobacterium tuberculosis
GVRVAAHTSHRNYGHT

SEQ ID NO: 158450 - protein, 16 aa, Mycobacterium tuberculosis
VRVAAHTSHRNYGHTL

SEQ ID NO: 158451 - protein, 16 aa, Mycobacterium tuberculosis
RVAAHTSHRNYGHTLD

SEQ ID NO: 158452 - protein, 16 aa, Mycobacterium tuberculosis
VAAHTSHRNYGHTLDA

SEQ ID NO: 158453 - protein, 16 aa, Mycobacterium tuberculosis
AAHTSHRNYGHTLDAT

SEQ ID NO: 158454 - protein, 16 aa, Mycobacterium tuberculosis
AHTSHRNYGHTLDATG

SEQ ID NO: 158455 - protein, 16 aa, Mycobacterium tuberculosis
HTSHRNYGHTLDATGL

SEQ ID NO: 158456 - protein, 16 aa, Mycobacterium tuberculosis
TSHRNYGHTLDATGLA

SEQ ID NO: 158457 - protein, 16 aa, Mycobacterium tuberculosis
SHRNYGHTLDATGLAE

SEQ ID NO: 158458 - protein, 16 aa, Mycobacterium tuberculosis
HRNYGHTLDATGLAEV

SEQ ID NO: 158459 - protein, 16 aa, Mycobacterium tuberculosis
RNYGHTLDATGLAEVF

SEQ ID NO: 158460 - protein, 16 aa, Mycobacterium tuberculosis
NYGHTLDATGLAEVFA

SEQ ID NO: 158461 - protein, 16 aa, Mycobacterium tuberculosis
YGHTLDATGLAEVFAV

SEQ ID NO: 158462 - protein, 16 aa, Mycobacterium tuberculosis
GHTLDATGLAEVFAVF

SEQ ID NO: 158463 - protein, 16 aa, Mycobacterium tuberculosis
HTLDATGLAEVFAVFV

SEQ ID NO: 158464 - protein, 16 aa, Mycobacterium tuberculosis
TLDATGLAEVFAVFVD

SEQ ID NO: 158465 - protein, 16 aa, Mycobacterium tuberculosis
LDATGLAEVFAVFVDG

SEQ ID NO: 158466 - protein, 16 aa, Mycobacterium tuberculosis
DATGLAEVFAVFVDGA

SEQ ID NO: 158467 - protein, 16 aa, Mycobacterium tuberculosis
ATGLAEVFAVFVDGAV

SEQ ID NO: 158468 - protein, 16 aa, Mycobacterium tuberculosis
TGLAEVFAVFVDGAVT

SEQ ID NO: 158469 - protein, 16 aa, Mycobacterium tuberculosis
GLAEVFAVFVDGAVTA

SEQ ID NO: 158470 - protein, 16 aa, Mycobacterium tuberculosis
LAEVFAVFVDGAVTAE

SEQ ID NO: 158471 - protein, 16 aa, Mycobacterium tuberculosis
AEVFAVFVDGAVTAEL

SEQ ID NO: 158472 - protein, 16 aa, Mycobacterium tuberculosis
EVFAVFVDGAVTAELG

SEQ ID NO: 158473 - protein, 16 aa, Mycobacterium tuberculosis
VFAVFVDGAVTAELGL

SEQ ID NO: 158474 - protein, 16 aa, Mycobacterium tuberculosis
FAVFVDGAVTAELGLP

SEQ ID NO: 158475 - protein, 16 aa, Mycobacterium tuberculosis
AVFVDGAVTAELGLPA

SEQ ID NO: 158476 - protein, 16 aa, Mycobacterium tuberculosis
VFVDGAVTAELGLPAE

SEQ ID NO: 158477 - protein, 16 aa, Mycobacterium tuberculosis
FVDGAVTAELGLPAEP

SEQ ID NO: 158478 - protein, 16 aa, Mycobacterium tuberculosis
VDGAVTAELGLPAEPN

SEQ ID NO: 158479 - protein, 16 aa, Mycobacterium tuberculosis
DGAVTAELGLPAEPNP

SEQ ID NO: 158480 - protein, 16 aa, Mycobacterium tuberculosis
GAVTAELGLPAEPNPA

SEQ ID NO: 158481 - protein, 16 aa, Mycobacterium tuberculosis
AVTAELGLPAEPNPAG

SEQ ID NO: 158482 - protein, 16 aa, Mycobacterium tuberculosis
VTAELGLPAEPNPAGL

SEQ ID NO: 158483 - protein, 16 aa, Mycobacterium tuberculosis
TAELGLPAEPNPAGLI

SEQ ID NO: 158484 - protein, 16 aa, Mycobacterium tuberculosis
AELGLPAEPNPAGLIE

SEQ ID NO: 158485 - protein, 16 aa, Mycobacterium tuberculosis
ELGLPAEPNPAGLIET

SEQ ID NO: 158486 - protein, 16 aa, Mycobacterium tuberculosis
LGLPAEPNPAGLIETA

SEQ ID NO: 158487 - protein, 16 aa, Mycobacterium tuberculosis
GLPAEPNPAGLIETAK

SEQ ID NO: 158488 - protein, 16 aa, Mycobacterium tuberculosis
LPAEPNPAGLIETAKR

SEQ ID NO: 158489 - protein, 16 aa, Mycobacterium tuberculosis
PAEPNPAGLIETAKRL

SEQ ID NO: 158490 - protein, 16 aa, Mycobacterium tuberculosis
AEPNPAGLIETAKRLG

SEQ ID NO: 158491 - protein, 16 aa, Mycobacterium tuberculosis
EPNPAGLIETAKRLGA

SEQ ID NO: 158492 - protein, 16 aa, Mycobacterium tuberculosis
PNPAGLIETAKRLGAN

SEQ ID NO: 158493 - protein, 16 aa, Mycobacterium tuberculosis
NPAGLIETAKRLGANP

SEQ ID NO: 158494 - protein, 16 aa, Mycobacterium tuberculosis
PAGLIETAKRLGANPG

SEQ ID NO: 158495 - protein, 16 aa, Mycobacterium tuberculosis
AGLIETAKRLGANPGR

SEQ ID NO: 158496 - protein, 16 aa, Mycobacterium tuberculosis
GLIETAKRLGANPGRC

SEQ ID NO: 158497 - protein, 16 aa, Mycobacterium tuberculosis
LIETAKRLGANPGRCV

SEQ ID NO: 158498 - protein, 16 aa, Mycobacterium tuberculosis
IETAKRLGANPGRCVV

SEQ ID NO: 158499 - protein, 16 aa, Mycobacterium tuberculosis
ETAKRLGANPGRCVVI

SEQ ID NO: 158500 - protein, 16 aa, Mycobacterium tuberculosis
TAKRLGANPGRCVVID

SEQ ID NO: 158501 - protein, 16 aa, Mycobacterium tuberculosis
AKRLGANPGRCVVIDS

SEQ ID NO: 158502 - protein, 16 aa, Mycobacterium tuberculosis
KRLGANPGRCVVIDSC

SEQ ID NO: 158503 - protein, 16 aa, Mycobacterium tuberculosis
RLGANPGRCVVIDSCQ

SEQ ID NO: 158504 - protein, 16 aa, Mycobacterium tuberculosis
LGANPGRCVVIDSCQT

SEQ ID NO: 158505 - protein, 16 aa, Mycobacterium tuberculosis
GANPGRCVVIDSCQTG

SEQ ID NO: 158506 - protein, 16 aa, Mycobacterium tuberculosis
ANPGRCVVIDSCQTGL

SEQ ID NO: 158507 - protein, 16 aa, Mycobacterium tuberculosis
NPGRCVVIDSCQTGLR

SEQ ID NO: 158508 - protein, 16 aa, Mycobacterium tuberculosis
PGRCVVIDSCQTGLRA

SEQ ID NO: 158509 - protein, 16 aa, Mycobacterium tuberculosis
GRCVVIDSCQTGLRAG

SEQ ID NO: 158510 - protein, 16 aa, Mycobacterium tuberculosis
RCVVIDSCQTGLRAGR

SEQ ID NO: 158511 - protein, 16 aa, Mycobacterium tuberculosis
CVVIDSCQTGLRAGRN

SEQ ID NO: 158512 - protein, 16 aa, Mycobacterium tuberculosis
VVIDSCQTGLRAGRNG

SEQ ID NO: 158513 - protein, 16 aa, Mycobacterium tuberculosis
VIDSCQTGLRAGRNGG

SEQ ID NO: 158514 - protein, 16 aa, Mycobacterium tuberculosis
IDSCQTGLRAGRNGGF

SEQ ID NO: 158515 - protein, 16 aa, Mycobacterium tuberculosis
DSCQTGLRAGRNGGFA

SEQ ID NO: 158516 - protein, 16 aa, Mycobacterium tuberculosis
SCQTGLRAGRNGGFAL

SEQ ID NO: 158517 - protein, 16 aa, Mycobacterium tuberculosis
CQTGLRAGRNGGFALV

SEQ ID NO: 158518 - protein, 16 aa, Mycobacterium tuberculosis
QTGLRAGRNGGFALVI

SEQ ID NO: 158519 - protein, 16 aa, Mycobacterium tuberculosis
TGLRAGRNGGFALVIA

SEQ ID NO: 158520 - protein, 16 aa, Mycobacterium tuberculosis
GLRAGRNGGFALVIAV

SEQ ID NO: 158521 - protein, 16 aa, Mycobacterium tuberculosis
LRAGRNGGFALVIAVD

SEQ ID NO: 158522 - protein, 16 aa, Mycobacterium tuberculosis
RAGRNGGFALVIAVDA

SEQ ID NO: 158523 - protein, 16 aa, Mycobacterium tuberculosis
AGRNGGFALVIAVDAH

SEQ ID NO: 158524 - protein, 16 aa, Mycobacterium tuberculosis
GRNGGFALVIAVDAHG

SEQ ID NO: 158525 - protein, 16 aa, Mycobacterium tuberculosis
RNGGFALVIAVDAHGD

SEQ ID NO: 158526 - protein, 16 aa, Mycobacterium tuberculosis
NGGFALVIAVDAHGDA

SEQ ID NO: 158527 - protein, 16 aa, Mycobacterium tuberculosis
GGFALVIAVDAHGDAE

SEQ ID NO: 158528 - protein, 16 aa, Mycobacterium tuberculosis
GFALVIAVDAHGDAEN

SEQ ID NO: 158529 - protein, 16 aa, Mycobacterium tuberculosis
FALVIAVDAHGDAENL

SEQ ID NO: 158530 - protein, 16 aa, Mycobacterium tuberculosis
ALVIAVDAHGDAENLL

SEQ ID NO: 158531 - protein, 16 aa, Mycobacterium tuberculosis
LVIAVDAHGDAENLLS

SEQ ID NO: 158532 - protein, 16 aa, Mycobacterium tuberculosis
VIAVDAHGDAENLLSS

SEQ ID NO: 158533 - protein, 16 aa, Mycobacterium tuberculosis
IAVDAHGDAENLLSSG

SEQ ID NO: 158534 - protein, 16 aa, Mycobacterium tuberculosis
AVDAHGDAENLLSSGA

SEQ ID NO: 158535 - protein, 16 aa, Mycobacterium tuberculosis
VDAHGDAENLLSSGAD

SEQ ID NO: 158536 - protein, 16 aa, Mycobacterium tuberculosis
DAHGDAENLLSSGADA

SEQ ID NO: 158537 - protein, 16 aa, Mycobacterium tuberculosis
AHGDAENLLSSGADAV

SEQ ID NO: 158538 - protein, 16 aa, Mycobacterium tuberculosis
HGDAENLLSSGADAVV

SEQ ID NO: 158539 - protein, 16 aa, Mycobacterium tuberculosis
GDAENLLSSGADAVVA

SEQ ID NO: 158540 - protein, 16 aa, Mycobacterium tuberculosis
DAENLLSSGADAVVAD

SEQ ID NO: 158541 - protein, 16 aa, Mycobacterium tuberculosis
AENLLSSGADAVVADL

SEQ ID NO: 158542 - protein, 16 aa, Mycobacterium tuberculosis
ENLLSSGADAVVADLA

SEQ ID NO: 158543 - protein, 16 aa, Mycobacterium tuberculosis
NLLSSGADAVVADLAA

SEQ ID NO: 158544 - protein, 16 aa, Mycobacterium tuberculosis
LLSSGADAVVADLAAV

SEQ ID NO: 158545 - protein, 16 aa, Mycobacterium tuberculosis
LSSGADAVVADLAAVT

SEQ ID NO: 158546 - protein, 16 aa, Mycobacterium tuberculosis
SSGADAVVADLAAVTV

SEQ ID NO: 158547 - protein, 16 aa, Mycobacterium tuberculosis
SGADAVVADLAAVTVG

SEQ ID NO: 158548 - protein, 16 aa, Mycobacterium tuberculosis
GADAVVADLAAVTVGS

SEQ ID NO: 158549 - protein, 16 aa, Mycobacterium tuberculosis
ADAVVADLAAVTVGSG

SEQ ID NO: 158550 - protein, 16 aa, Mycobacterium tuberculosis
DAVVADLAAVTVGSGD

SEQ ID NO: 158551 - protein, 16 aa, Mycobacterium tuberculosis
AVVADLAAVTVGSGDA

SEQ ID NO: 158552 - protein, 16 aa, Mycobacterium tuberculosis
VVADLAAVTVGSGDAA

SEQ ID NO: 158553 - protein, 16 aa, Mycobacterium tuberculosis
VADLAAVTVGSGDAAI

SEQ ID NO: 158554 - protein, 16 aa, Mycobacterium tuberculosis
ADLAAVTVGSGDAAIS

SEQ ID NO: 158555 - protein, 16 aa, Mycobacterium tuberculosis
DLAAVTVGSGDAAIST

SEQ ID NO: 158556 - protein, 16 aa, Mycobacterium tuberculosis
LAAVTVGSGDAAISTI

SEQ ID NO: 158557 - protein, 16 aa, Mycobacterium tuberculosis
AAVTVGSGDAAISTIP

SEQ ID NO: 158558 - protein, 16 aa, Mycobacterium tuberculosis
AVTVGSGDAAISTIPD

SEQ ID NO: 158559 - protein, 16 aa, Mycobacterium tuberculosis
VTVGSGDAAISTIPDA

SEQ ID NO: 158560 - protein, 16 aa, Mycobacterium tuberculosis
TVGSGDAAISTIPDAL

SEQ ID NO: 158561 - protein, 16 aa, Mycobacterium tuberculosis
VGSGDAAISTIPDALQ

SEQ ID NO: 158562 - protein, 16 aa, Mycobacterium tuberculosis
GSGDAAISTIPDALQV

SEQ ID NO: 158563 - protein, 16 aa, Mycobacterium tuberculosis
SGDAAISTIPDALQVY

SEQ ID NO: 158564 - protein, 16 aa, Mycobacterium tuberculosis
GDAAISTIPDALQVYS

SEQ ID NO: 158565 - protein, 16 aa, Mycobacterium tuberculosis
DAAISTIPDALQVYSQ

SEQ ID NO: 158566 - protein, 16 aa, Mycobacterium tuberculosis
AAISTIPDALQVYSQL

SEQ ID NO: 158567 - protein, 16 aa, Mycobacterium tuberculosis
AISTIPDALQVYSQLK

SEQ ID NO: 158568 - protein, 16 aa, Mycobacterium tuberculosis
ISTIPDALQVYSQLKR

SEQ ID NO: 158569 - protein, 16 aa, Mycobacterium tuberculosis
STIPDALQVYSQLKRL

SEQ ID NO: 158570 - protein, 16 aa, Mycobacterium tuberculosis
TIPDALQVYSQLKRLL

SEQ ID NO: 158571 - protein, 16 aa, Mycobacterium tuberculosis
IPDALQVYSQLKRLLT

SEQ ID NO: 158572 - protein, 16 aa, Mycobacterium tuberculosis
PDALQVYSQLKRLLTG

SEQ ID NO: 158573 - protein, 16 aa, Mycobacterium tuberculosis
DALQVYSQLKRLLTGR

SEQ ID NO: 158574 - protein, 16 aa, Mycobacterium tuberculosis
ALQVYSQLKRLLTGRR

SEQ ID NO: 158575 - protein, 16 aa, Mycobacterium tuberculosis
LQVYSQLKRLLTGRRP

SEQ ID NO: 158576 - protein, 16 aa, Mycobacterium tuberculosis
QVYSQLKRLLTGRRPA

SEQ ID NO: 158577 - protein, 16 aa, Mycobacterium tuberculosis
VYSQLKRLLTGRRPAV

SEQ ID NO: 158578 - protein, 16 aa, Mycobacterium tuberculosis
YSQLKRLLTGRRPAVF

SEQ ID NO: 158579 - protein, 16 aa, Mycobacterium tuberculosis
SQLKRLLTGRRPAVFL

SEQ ID NO: 158580 - protein, 16 aa, Mycobacterium tuberculosis
QLKRLLTGRRPAVFLD

SEQ ID NO: 158581 - protein, 16 aa, Mycobacterium tuberculosis
LKRLLTGRRPAVFLDF

SEQ ID NO: 158582 - protein, 16 aa, Mycobacterium tuberculosis
KRLLTGRRPAVFLDFD

SEQ ID NO: 158583 - protein, 16 aa, Mycobacterium tuberculosis
RLLTGRRPAVFLDFDG

SEQ ID NO: 158584 - protein, 16 aa, Mycobacterium tuberculosis
LLTGRRPAVFLDFDGT

SEQ ID NO: 158585 - protein, 16 aa, Mycobacterium tuberculosis
LTGRRPAVFLDFDGTL

SEQ ID NO: 158586 - protein, 16 aa, Mycobacterium tuberculosis
TGRRPAVFLDFDGTLS

SEQ ID NO: 158587 - protein, 16 aa, Mycobacterium tuberculosis
GRRPAVFLDFDGTLSD

SEQ ID NO: 158588 - protein, 16 aa, Mycobacterium tuberculosis
RRPAVFLDFDGTLSDI

SEQ ID NO: 158589 - protein, 16 aa, Mycobacterium tuberculosis
RPAVFLDFDGTLSDIV

SEQ ID NO: 158590 - protein, 16 aa, Mycobacterium tuberculosis
PAVFLDFDGTLSDIVE

SEQ ID NO: 158591 - protein, 16 aa, Mycobacterium tuberculosis
AVFLDFDGTLSDIVER

SEQ ID NO: 158592 - protein, 16 aa, Mycobacterium tuberculosis
VFLDFDGTLSDIVERP

SEQ ID NO: 158593 - protein, 16 aa, Mycobacterium tuberculosis
FLDFDGTLSDIVERPE

SEQ ID NO: 158594 - protein, 16 aa, Mycobacterium tuberculosis
LDFDGTLSDIVERPEA

SEQ ID NO: 158595 - protein, 16 aa, Mycobacterium tuberculosis
DFDGTLSDIVERPEAA

SEQ ID NO: 158596 - protein, 16 aa, Mycobacterium tuberculosis
FDGTLSDIVERPEAAT

SEQ ID NO: 158597 - protein, 16 aa, Mycobacterium tuberculosis
DGTLSDIVERPEAATL

SEQ ID NO: 158598 - protein, 16 aa, Mycobacterium tuberculosis
GTLSDIVERPEAATLV

SEQ ID NO: 158599 - protein, 16 aa, Mycobacterium tuberculosis
TLSDIVERPEAATLVD

SEQ ID NO: 158600 - protein, 16 aa, Mycobacterium tuberculosis
LSDIVERPEAATLVDG

SEQ ID NO: 158601 - protein, 16 aa, Mycobacterium tuberculosis
SDIVERPEAATLVDGA

SEQ ID NO: 158602 - protein, 16 aa, Mycobacterium tuberculosis
DIVERPEAATLVDGAA

SEQ ID NO: 158603 - protein, 16 aa, Mycobacterium tuberculosis
IVERPEAATLVDGAAE

SEQ ID NO: 158604 - protein, 16 aa, Mycobacterium tuberculosis
VERPEAATLVDGAAEA

SEQ ID NO: 158605 - protein, 16 aa, Mycobacterium tuberculosis
ERPEAATLVDGAAEAL

SEQ ID NO: 158606 - protein, 16 aa, Mycobacterium tuberculosis
RPEAATLVDGAAEALR

SEQ ID NO: 158607 - protein, 16 aa, Mycobacterium tuberculosis
PEAATLVDGAAEALRA

SEQ ID NO: 158608 - protein, 16 aa, Mycobacterium tuberculosis
EAATLVDGAAEALRAL

SEQ ID NO: 158609 - protein, 16 aa, Mycobacterium tuberculosis
AATLVDGAAEALRALA

SEQ ID NO: 158610 - protein, 16 aa, Mycobacterium tuberculosis
ATLVDGAAEALRALAA

SEQ ID NO: 158611 - protein, 16 aa, Mycobacterium tuberculosis
TLVDGAAEALRALAAQ

SEQ ID NO: 158612 - protein, 16 aa, Mycobacterium tuberculosis
LVDGAAEALRALAAQC

SEQ ID NO: 158613 - protein, 16 aa, Mycobacterium tuberculosis
VDGAAEALRALAAQCP

SEQ ID NO: 158614 - protein, 16 aa, Mycobacterium tuberculosis
DGAAEALRALAAQCPV

SEQ ID NO: 158615 - protein, 16 aa, Mycobacterium tuberculosis
GAAEALRALAAQCPVA

SEQ ID NO: 158616 - protein, 16 aa, Mycobacterium tuberculosis
AAEALRALAAQCPVAV

SEQ ID NO: 158617 - protein, 16 aa, Mycobacterium tuberculosis
AEALRALAAQCPVAVI

SEQ ID NO: 158618 - protein, 16 aa, Mycobacterium tuberculosis
EALRALAAQCPVAVIS

SEQ ID NO: 158619 - protein, 16 aa, Mycobacterium tuberculosis
ALRALAAQCPVAVISG

SEQ ID NO: 158620 - protein, 16 aa, Mycobacterium tuberculosis
LRALAAQCPVAVISGR

SEQ ID NO: 158621 - protein, 16 aa, Mycobacterium tuberculosis
RALAAQCPVAVISGRD

SEQ ID NO: 158622 - protein, 16 aa, Mycobacterium tuberculosis
ALAAQCPVAVISGRDL

SEQ ID NO: 158623 - protein, 16 aa, Mycobacterium tuberculosis
LAAQCPVAVISGRDLA

SEQ ID NO: 158624 - protein, 16 aa, Mycobacterium tuberculosis
AAQCPVAVISGRDLAD

SEQ ID NO: 158625 - protein, 16 aa, Mycobacterium tuberculosis
AQCPVAVISGRDLADV

SEQ ID NO: 158626 - protein, 16 aa, Mycobacterium tuberculosis
QCPVAVISGRDLADVR

SEQ ID NO: 158627 - protein, 16 aa, Mycobacterium tuberculosis
CPVAVISGRDLADVRN

SEQ ID NO: 158628 - protein, 16 aa, Mycobacterium tuberculosis
PVAVISGRDLADVRNR

SEQ ID NO: 158629 - protein, 16 aa, Mycobacterium tuberculosis
VAVISGRDLADVRNRV

SEQ ID NO: 158630 - protein, 16 aa, Mycobacterium tuberculosis
AVISGRDLADVRNRVK

SEQ ID NO: 158631 - protein, 16 aa, Mycobacterium tuberculosis
VISGRDLADVRNRVKV

SEQ ID NO: 158632 - protein, 16 aa, Mycobacterium tuberculosis
ISGRDLADVRNRVKVD

SEQ ID NO: 158633 - protein, 16 aa, Mycobacterium tuberculosis
SGRDLADVRNRVKVDG

SEQ ID NO: 158634 - protein, 16 aa, Mycobacterium tuberculosis
GRDLADVRNRVKVDGL

SEQ ID NO: 158635 - protein, 16 aa, Mycobacterium tuberculosis
RDLADVRNRVKVDGLW

SEQ ID NO: 158636 - protein, 16 aa, Mycobacterium tuberculosis
DLADVRNRVKVDGLWL

SEQ ID NO: 158637 - protein, 16 aa, Mycobacterium tuberculosis
LADVRNRVKVDGLWLA

SEQ ID NO: 158638 - protein, 16 aa, Mycobacterium tuberculosis
ADVRNRVKVDGLWLAG

SEQ ID NO: 158639 - protein, 16 aa, Mycobacterium tuberculosis
DVRNRVKVDGLWLAGS

SEQ ID NO: 158640 - protein, 16 aa, Mycobacterium tuberculosis
VRNRVKVDGLWLAGSH

SEQ ID NO: 158641 - protein, 16 aa, Mycobacterium tuberculosis
RNRVKVDGLWLAGSHG

SEQ ID NO: 158642 - protein, 16 aa, Mycobacterium tuberculosis
NRVKVDGLWLAGSHGF

SEQ ID NO: 158643 - protein, 16 aa, Mycobacterium tuberculosis
RVKVDGLWLAGSHGFE

SEQ ID NO: 158644 - protein, 16 aa, Mycobacterium tuberculosis
VKVDGLWLAGSHGFEL

SEQ ID NO: 158645 - protein, 16 aa, Mycobacterium tuberculosis
KVDGLWLAGSHGFELV

SEQ ID NO: 158646 - protein, 16 aa, Mycobacterium tuberculosis
VDGLWLAGSHGFELVA

SEQ ID NO: 158647 - protein, 16 aa, Mycobacterium tuberculosis
DGLWLAGSHGFELVAP

SEQ ID NO: 158648 - protein, 16 aa, Mycobacterium tuberculosis
GLWLAGSHGFELVAPD

SEQ ID NO: 158649 - protein, 16 aa, Mycobacterium tuberculosis
LWLAGSHGFELVAPDG

SEQ ID NO: 158650 - protein, 16 aa, Mycobacterium tuberculosis
WLAGSHGFELVAPDGS

SEQ ID NO: 158651 - protein, 16 aa, Mycobacterium tuberculosis
LAGSHGFELVAPDGSH

SEQ ID NO: 158652 - protein, 16 aa, Mycobacterium tuberculosis
AGSHGFELVAPDGSHH

SEQ ID NO: 158653 - protein, 16 aa, Mycobacterium tuberculosis
GSHGFELVAPDGSHHQ

SEQ ID NO: 158654 - protein, 16 aa, Mycobacterium tuberculosis
SHGFELVAPDGSHHQN

SEQ ID NO: 158655 - protein, 16 aa, Mycobacterium tuberculosis
HGFELVAPDGSHHQNA

SEQ ID NO: 158656 - protein, 16 aa, Mycobacterium tuberculosis
GFELVAPDGSHHQNAA

SEQ ID NO: 158657 - protein, 16 aa, Mycobacterium tuberculosis
FELVAPDGSHHQNAAA

SEQ ID NO: 158658 - protein, 16 aa, Mycobacterium tuberculosis
ELVAPDGSHHQNAAAT

SEQ ID NO: 158659 - protein, 16 aa, Mycobacterium tuberculosis
LVAPDGSHHQNAAATA

SEQ ID NO: 158660 - protein, 16 aa, Mycobacterium tuberculosis
VAPDGSHHQNAAATAA

SEQ ID NO: 158661 - protein, 16 aa, Mycobacterium tuberculosis
APDGSHHQNAAATAAI

SEQ ID NO: 158662 - protein, 16 aa, Mycobacterium tuberculosis
PDGSHHQNAAATAAID

SEQ ID NO: 158663 - protein, 16 aa, Mycobacterium tuberculosis
DGSHHQNAAATAAIDG

SEQ ID NO: 158664 - protein, 16 aa, Mycobacterium tuberculosis
GSHHQNAAATAAIDGL

SEQ ID NO: 158665 - protein, 16 aa, Mycobacterium tuberculosis
SHHQNAAATAAIDGLA

SEQ ID NO: 158666 - protein, 16 aa, Mycobacterium tuberculosis
HHQNAAATAAIDGLAE

SEQ ID NO: 158667 - protein, 16 aa, Mycobacterium tuberculosis
HQNAAATAAIDGLAEA

SEQ ID NO: 158668 - protein, 16 aa, Mycobacterium tuberculosis
QNAAATAAIDGLAEAA

SEQ ID NO: 158669 - protein, 16 aa, Mycobacterium tuberculosis
NAAATAAIDGLAEAAA

SEQ ID NO: 158670 - protein, 16 aa, Mycobacterium tuberculosis
AAATAAIDGLAEAAAQ

SEQ ID NO: 158671 - protein, 16 aa, Mycobacterium tuberculosis
AATAAIDGLAEAAAQL

SEQ ID NO: 158672 - protein, 16 aa, Mycobacterium tuberculosis
ATAAIDGLAEAAAQLA

SEQ ID NO: 158673 - protein, 16 aa, Mycobacterium tuberculosis
TAAIDGLAEAAAQLAD

SEQ ID NO: 158674 - protein, 16 aa, Mycobacterium tuberculosis
AAIDGLAEAAAQLADA

SEQ ID NO: 158675 - protein, 16 aa, Mycobacterium tuberculosis
AIDGLAEAAAQLADAL

SEQ ID NO: 158676 - protein, 16 aa, Mycobacterium tuberculosis
IDGLAEAAAQLADALR

SEQ ID NO: 158677 - protein, 16 aa, Mycobacterium tuberculosis
DGLAEAAAQLADALRE

SEQ ID NO: 158678 - protein, 16 aa, Mycobacterium tuberculosis
GLAEAAAQLADALREI

SEQ ID NO: 158679 - protein, 16 aa, Mycobacterium tuberculosis
LAEAAAQLADALREIA

SEQ ID NO: 158680 - protein, 16 aa, Mycobacterium tuberculosis
AEAAAQLADALREIAG

SEQ ID NO: 158681 - protein, 16 aa, Mycobacterium tuberculosis
EAAAQLADALREIAGA

SEQ ID NO: 158682 - protein, 16 aa, Mycobacterium tuberculosis
AAAQLADALREIAGAV

SEQ ID NO: 158683 - protein, 16 aa, Mycobacterium tuberculosis
AAQLADALREIAGAVV

SEQ ID NO: 158684 - protein, 16 aa, Mycobacterium tuberculosis
AQLADALREIAGAVVE

SEQ ID NO: 158685 - protein, 16 aa, Mycobacterium tuberculosis
QLADALREIAGAVVEH

SEQ ID NO: 158686 - protein, 16 aa, Mycobacterium tuberculosis
LADALREIAGAVVEHK

SEQ ID NO: 158687 - protein, 16 aa, Mycobacterium tuberculosis
ADALREIAGAVVEHKR

SEQ ID NO: 158688 - protein, 16 aa, Mycobacterium tuberculosis
DALREIAGAVVEHKRF

SEQ ID NO: 158689 - protein, 16 aa, Mycobacterium tuberculosis
ALREIAGAVVEHKRFA

SEQ ID NO: 158690 - protein, 16 aa, Mycobacterium tuberculosis
LREIAGAVVEHKRFAV

SEQ ID NO: 158691 - protein, 16 aa, Mycobacterium tuberculosis
REIAGAVVEHKRFAVA

SEQ ID NO: 158692 - protein, 16 aa, Mycobacterium tuberculosis
EIAGAVVEHKRFAVAV

SEQ ID NO: 158693 - protein, 16 aa, Mycobacterium tuberculosis
IAGAVVEHKRFAVAVH

SEQ ID NO: 158694 - protein, 16 aa, Mycobacterium tuberculosis
AGAVVEHKRFAVAVHY

SEQ ID NO: 158695 - protein, 16 aa, Mycobacterium tuberculosis
GAVVEHKRFAVAVHYR

SEQ ID NO: 158696 - protein, 16 aa, Mycobacterium tuberculosis
AVVEHKRFAVAVHYRN

SEQ ID NO: 158697 - protein, 16 aa, Mycobacterium tuberculosis
VVEHKRFAVAVHYRNV

SEQ ID NO: 158698 - protein, 16 aa, Mycobacterium tuberculosis
VEHKRFAVAVHYRNVA

SEQ ID NO: 158699 - protein, 16 aa, Mycobacterium tuberculosis
EHKRFAVAVHYRNVAD

SEQ ID NO: 158700 - protein, 16 aa, Mycobacterium tuberculosis
HKRFAVAVHYRNVADD

SEQ ID NO: 158701 - protein, 16 aa, Mycobacterium tuberculosis
KRFAVAVHYRNVADDS

SEQ ID NO: 158702 - protein, 16 aa, Mycobacterium tuberculosis
RFAVAVHYRNVADDSV

SEQ ID NO: 158703 - protein, 16 aa, Mycobacterium tuberculosis
FAVAVHYRNVADDSVD

SEQ ID NO: 158704 - protein, 16 aa, Mycobacterium tuberculosis
AVAVHYRNVADDSVDN

SEQ ID NO: 158705 - protein, 16 aa, Mycobacterium tuberculosis
VAVHYRNVADDSVDNL

SEQ ID NO: 158706 - protein, 16 aa, Mycobacterium tuberculosis
AVHYRNVADDSVDNLI

SEQ ID NO: 158707 - protein, 16 aa, Mycobacterium tuberculosis
VHYRNVADDSVDNLIA

SEQ ID NO: 158708 - protein, 16 aa, Mycobacterium tuberculosis
HYRNVADDSVDNLIAA

SEQ ID NO: 158709 - protein, 16 aa, Mycobacterium tuberculosis
YRNVADDSVDNLIAAV

SEQ ID NO: 158710 - protein, 16 aa, Mycobacterium tuberculosis
RNVADDSVDNLIAAVR

SEQ ID NO: 158711 - protein, 16 aa, Mycobacterium tuberculosis
NVADDSVDNLIAAVRR

SEQ ID NO: 158712 - protein, 16 aa, Mycobacterium tuberculosis
VADDSVDNLIAAVRRL

SEQ ID NO: 158713 - protein, 16 aa, Mycobacterium tuberculosis
ADDSVDNLIAAVRRLG

SEQ ID NO: 158714 - protein, 16 aa, Mycobacterium tuberculosis
DDSVDNLIAAVRRLGH

SEQ ID NO: 158715 - protein, 16 aa, Mycobacterium tuberculosis
DSVDNLIAAVRRLGHA

SEQ ID NO: 158716 - protein, 16 aa, Mycobacterium tuberculosis
SVDNLIAAVRRLGHAA

SEQ ID NO: 158717 - protein, 16 aa, Mycobacterium tuberculosis
VDNLIAAVRRLGHAAG

SEQ ID NO: 158718 - protein, 16 aa, Mycobacterium tuberculosis
DNLIAAVRRLGHAAGL

SEQ ID NO: 158719 - protein, 16 aa, Mycobacterium tuberculosis
NLIAAVRRLGHAAGLR

SEQ ID NO: 158720 - protein, 16 aa, Mycobacterium tuberculosis
LIAAVRRLGHAAGLRV

SEQ ID NO: 158721 - protein, 16 aa, Mycobacterium tuberculosis
IAAVRRLGHAAGLRVT

SEQ ID NO: 158722 - protein, 16 aa, Mycobacterium tuberculosis
AAVRRLGHAAGLRVTT

SEQ ID NO: 158723 - protein, 16 aa, Mycobacterium tuberculosis
AVRRLGHAAGLRVTTG

SEQ ID NO: 158724 - protein, 16 aa, Mycobacterium tuberculosis
VRRLGHAAGLRVTTGR

SEQ ID NO: 158725 - protein, 16 aa, Mycobacterium tuberculosis
RRLGHAAGLRVTTGRK

SEQ ID NO: 158726 - protein, 16 aa, Mycobacterium tuberculosis
RLGHAAGLRVTTGRKV

SEQ ID NO: 158727 - protein, 16 aa, Mycobacterium tuberculosis
LGHAAGLRVTTGRKVV

SEQ ID NO: 158728 - protein, 16 aa, Mycobacterium tuberculosis
GHAAGLRVTTGRKVVE

SEQ ID NO: 158729 - protein, 16 aa, Mycobacterium tuberculosis
HAAGLRVTTGRKVVEL

SEQ ID NO: 158730 - protein, 16 aa, Mycobacterium tuberculosis
AAGLRVTTGRKVVELR

SEQ ID NO: 158731 - protein, 16 aa, Mycobacterium tuberculosis
AGLRVTTGRKVVELRP

SEQ ID NO: 158732 - protein, 16 aa, Mycobacterium tuberculosis
GLRVTTGRKVVELRPD

SEQ ID NO: 158733 - protein, 16 aa, Mycobacterium tuberculosis
LRVTTGRKVVELRPDI

SEQ ID NO: 158734 - protein, 16 aa, Mycobacterium tuberculosis
RVTTGRKVVELRPDIA

SEQ ID NO: 158735 - protein, 16 aa, Mycobacterium tuberculosis
VTTGRKVVELRPDIAW

SEQ ID NO: 158736 - protein, 16 aa, Mycobacterium tuberculosis
TTGRKVVELRPDIAWD

SEQ ID NO: 158737 - protein, 16 aa, Mycobacterium tuberculosis
TGRKVVELRPDIAWDK

SEQ ID NO: 158738 - protein, 16 aa, Mycobacterium tuberculosis
GRKVVELRPDIAWDKG

SEQ ID NO: 158739 - protein, 16 aa, Mycobacterium tuberculosis
RKVVELRPDIAWDKGK

SEQ ID NO: 158740 - protein, 16 aa, Mycobacterium tuberculosis
KVVELRPDIAWDKGKA

SEQ ID NO: 158741 - protein, 16 aa, Mycobacterium tuberculosis
VVELRPDIAWDKGKAL

SEQ ID NO: 158742 - protein, 16 aa, Mycobacterium tuberculosis
VELRPDIAWDKGKALD

SEQ ID NO: 158743 - protein, 16 aa, Mycobacterium tuberculosis
ELRPDIAWDKGKALDW

SEQ ID NO: 158744 - protein, 16 aa, Mycobacterium tuberculosis
LRPDIAWDKGKALDWI

SEQ ID NO: 158745 - protein, 16 aa, Mycobacterium tuberculosis
RPDIAWDKGKALDWIG

SEQ ID NO: 158746 - protein, 16 aa, Mycobacterium tuberculosis
PDIAWDKGKALDWIGE

SEQ ID NO: 158747 - protein, 16 aa, Mycobacterium tuberculosis
DIAWDKGKALDWIGER

SEQ ID NO: 158748 - protein, 16 aa, Mycobacterium tuberculosis
IAWDKGKALDWIGERL

SEQ ID NO: 158749 - protein, 16 aa, Mycobacterium tuberculosis
AWDKGKALDWIGERLG

SEQ ID NO: 158750 - protein, 16 aa, Mycobacterium tuberculosis
WDKGKALDWIGERLGP

SEQ ID NO: 158751 - protein, 16 aa, Mycobacterium tuberculosis
DKGKALDWIGERLGPA

SEQ ID NO: 158752 - protein, 16 aa, Mycobacterium tuberculosis
KGKALDWIGERLGPAE

SEQ ID NO: 158753 - protein, 16 aa, Mycobacterium tuberculosis
GKALDWIGERLGPAEV

SEQ ID NO: 158754 - protein, 16 aa, Mycobacterium tuberculosis
KALDWIGERLGPAEVG

SEQ ID NO: 158755 - protein, 16 aa, Mycobacterium tuberculosis
ALDWIGERLGPAEVGP

SEQ ID NO: 158756 - protein, 16 aa, Mycobacterium tuberculosis
LDWIGERLGPAEVGPD

SEQ ID NO: 158757 - protein, 16 aa, Mycobacterium tuberculosis
DWIGERLGPAEVGPDL

SEQ ID NO: 158758 - protein, 16 aa, Mycobacterium tuberculosis
WIGERLGPAEVGPDLR

SEQ ID NO: 158759 - protein, 16 aa, Mycobacterium tuberculosis
IGERLGPAEVGPDLRL

SEQ ID NO: 158760 - protein, 16 aa, Mycobacterium tuberculosis
GERLGPAEVGPDLRLP

SEQ ID NO: 158761 - protein, 16 aa, Mycobacterium tuberculosis
ERLGPAEVGPDLRLPI

SEQ ID NO: 158762 - protein, 16 aa, Mycobacterium tuberculosis
RLGPAEVGPDLRLPIY

SEQ ID NO: 158763 - protein, 16 aa, Mycobacterium tuberculosis
LGPAEVGPDLRLPIYI

SEQ ID NO: 158764 - protein, 16 aa, Mycobacterium tuberculosis
GPAEVGPDLRLPIYIG

SEQ ID NO: 158765 - protein, 16 aa, Mycobacterium tuberculosis
PAEVGPDLRLPIYIGD

SEQ ID NO: 158766 - protein, 16 aa, Mycobacterium tuberculosis
AEVGPDLRLPIYIGDD

SEQ ID NO: 158767 - protein, 16 aa, Mycobacterium tuberculosis
EVGPDLRLPIYIGDDL

SEQ ID NO: 158768 - protein, 16 aa, Mycobacterium tuberculosis
VGPDLRLPIYIGDDLT

SEQ ID NO: 158769 - protein, 16 aa, Mycobacterium tuberculosis
GPDLRLPIYIGDDLTD

SEQ ID NO: 158770 - protein, 16 aa, Mycobacterium tuberculosis
PDLRLPIYIGDDLTDE

SEQ ID NO: 158771 - protein, 16 aa, Mycobacterium tuberculosis
DLRLPIYIGDDLTDED

SEQ ID NO: 158772 - protein, 16 aa, Mycobacterium tuberculosis
LRLPIYIGDDLTDEDA

SEQ ID NO: 158773 - protein, 16 aa, Mycobacterium tuberculosis
RLPIYIGDDLTDEDAF

SEQ ID NO: 158774 - protein, 16 aa, Mycobacterium tuberculosis
LPIYIGDDLTDEDAFD

SEQ ID NO: 158775 - protein, 16 aa, Mycobacterium tuberculosis
PIYIGDDLTDEDAFDA

SEQ ID NO: 158776 - protein, 16 aa, Mycobacterium tuberculosis
IYIGDDLTDEDAFDAV

SEQ ID NO: 158777 - protein, 16 aa, Mycobacterium tuberculosis
YIGDDLTDEDAFDAVR

SEQ ID NO: 158778 - protein, 16 aa, Mycobacterium tuberculosis
IGDDLTDEDAFDAVRF

SEQ ID NO: 158779 - protein, 16 aa, Mycobacterium tuberculosis
GDDLTDEDAFDAVRFT

SEQ ID NO: 158780 - protein, 16 aa, Mycobacterium tuberculosis
DDLTDEDAFDAVRFTG

SEQ ID NO: 158781 - protein, 16 aa, Mycobacterium tuberculosis
DLTDEDAFDAVRFTGV

SEQ ID NO: 158782 - protein, 16 aa, Mycobacterium tuberculosis
LTDEDAFDAVRFTGVG

SEQ ID NO: 158783 - protein, 16 aa, Mycobacterium tuberculosis
TDEDAFDAVRFTGVGI

SEQ ID NO: 158784 - protein, 16 aa, Mycobacterium tuberculosis
DEDAFDAVRFTGVGIV

SEQ ID NO: 158785 - protein, 16 aa, Mycobacterium tuberculosis
EDAFDAVRFTGVGIVV

SEQ ID NO: 158786 - protein, 16 aa, Mycobacterium tuberculosis
DAFDAVRFTGVGIVVR

SEQ ID NO: 158787 - protein, 16 aa, Mycobacterium tuberculosis
AFDAVRFTGVGIVVRH

SEQ ID NO: 158788 - protein, 16 aa, Mycobacterium tuberculosis
FDAVRFTGVGIVVRHN

SEQ ID NO: 158789 - protein, 16 aa, Mycobacterium tuberculosis
DAVRFTGVGIVVRHNE

SEQ ID NO: 158790 - protein, 16 aa, Mycobacterium tuberculosis
AVRFTGVGIVVRHNEH

SEQ ID NO: 158791 - protein, 16 aa, Mycobacterium tuberculosis
VRFTGVGIVVRHNEHG

SEQ ID NO: 158792 - protein, 16 aa, Mycobacterium tuberculosis
RFTGVGIVVRHNEHGD

SEQ ID NO: 158793 - protein, 16 aa, Mycobacterium tuberculosis
FTGVGIVVRHNEHGDR

SEQ ID NO: 158794 - protein, 16 aa, Mycobacterium tuberculosis
TGVGIVVRHNEHGDRR

SEQ ID NO: 158795 - protein, 16 aa, Mycobacterium tuberculosis
GVGIVVRHNEHGDRRS

SEQ ID NO: 158796 - protein, 16 aa, Mycobacterium tuberculosis
VGIVVRHNEHGDRRSA

SEQ ID NO: 158797 - protein, 16 aa, Mycobacterium tuberculosis
GIVVRHNEHGDRRSAA

SEQ ID NO: 158798 - protein, 16 aa, Mycobacterium tuberculosis
IVVRHNEHGDRRSAAT

SEQ ID NO: 158799 - protein, 16 aa, Mycobacterium tuberculosis
VVRHNEHGDRRSAATF

SEQ ID NO: 158800 - protein, 16 aa, Mycobacterium tuberculosis
VRHNEHGDRRSAATFR

SEQ ID NO: 158801 - protein, 16 aa, Mycobacterium tuberculosis
RHNEHGDRRSAATFRL

SEQ ID NO: 158802 - protein, 16 aa, Mycobacterium tuberculosis
HNEHGDRRSAATFRLE

SEQ ID NO: 158803 - protein, 16 aa, Mycobacterium tuberculosis
NEHGDRRSAATFRLEC

SEQ ID NO: 158804 - protein, 16 aa, Mycobacterium tuberculosis
EHGDRRSAATFRLECP

SEQ ID NO: 158805 - protein, 16 aa, Mycobacterium tuberculosis
HGDRRSAATFRLECPY

SEQ ID NO: 158806 - protein, 16 aa, Mycobacterium tuberculosis
GDRRSAATFRLECPYT

SEQ ID NO: 158807 - protein, 16 aa, Mycobacterium tuberculosis
DRRSAATFRLECPYTV

SEQ ID NO: 158808 - protein, 16 aa, Mycobacterium tuberculosis
RRSAATFRLECPYTVC

SEQ ID NO: 158809 - protein, 16 aa, Mycobacterium tuberculosis
RSAATFRLECPYTVCQ

SEQ ID NO: 158810 - protein, 16 aa, Mycobacterium tuberculosis
SAATFRLECPYTVCQF

SEQ ID NO: 158811 - protein, 16 aa, Mycobacterium tuberculosis
AATFRLECPYTVCQFL

SEQ ID NO: 158812 - protein, 16 aa, Mycobacterium tuberculosis
ATFRLECPYTVCQFLS

SEQ ID NO: 158813 - protein, 16 aa, Mycobacterium tuberculosis
TFRLECPYTVCQFLSQ

SEQ ID NO: 158814 - protein, 16 aa, Mycobacterium tuberculosis
FRLECPYTVCQFLSQL

SEQ ID NO: 158815 - protein, 16 aa, Mycobacterium tuberculosis
RLECPYTVCQFLSQLA

SEQ ID NO: 158816 - protein, 16 aa, Mycobacterium tuberculosis
LECPYTVCQFLSQLAC

SEQ ID NO: 158817 - protein, 16 aa, Mycobacterium tuberculosis
ECPYTVCQFLSQLACD

SEQ ID NO: 158818 - protein, 16 aa, Mycobacterium tuberculosis
CPYTVCQFLSQLACDL

SEQ ID NO: 158819 - protein, 16 aa, Mycobacterium tuberculosis
PYTVCQFLSQLACDLQ

SEQ ID NO: 158820 - protein, 16 aa, Mycobacterium tuberculosis
YTVCQFLSQLACDLQE

SEQ ID NO: 158821 - protein, 16 aa, Mycobacterium tuberculosis
TVCQFLSQLACDLQEA

SEQ ID NO: 158822 - protein, 16 aa, Mycobacterium tuberculosis
VCQFLSQLACDLQEAV

SEQ ID NO: 158823 - protein, 16 aa, Mycobacterium tuberculosis
CQFLSQLACDLQEAVQ

SEQ ID NO: 158824 - protein, 16 aa, Mycobacterium tuberculosis
QFLSQLACDLQEAVQH

SEQ ID NO: 158825 - protein, 16 aa, Mycobacterium tuberculosis
FLSQLACDLQEAVQHD

SEQ ID NO: 158826 - protein, 16 aa, Mycobacterium tuberculosis
LSQLACDLQEAVQHDD

SEQ ID NO: 158827 - protein, 16 aa, Mycobacterium tuberculosis
SQLACDLQEAVQHDDP

SEQ ID NO: 158828 - protein, 16 aa, Mycobacterium tuberculosis
QLACDLQEAVQHDDPW

SEQ ID NO: 158829 - protein, 16 aa, Mycobacterium tuberculosis
LACDLQEAVQHDDPWT

SEQ ID NO: 158830 - protein, 16 aa, Mycobacterium tuberculosis
ACDLQEAVQHDDPWTL

SEQ ID NO: 158831 - protein, 16 aa, Mycobacterium tuberculosis
CDLQEAVQHDDPWTLV

SEQ ID NO: 158832 - protein, 16 aa, Mycobacterium tuberculosis
DLQEAVQHDDPWTLVF

SEQ ID NO: 158833 - protein, 16 aa, Mycobacterium tuberculosis
LQEAVQHDDPWTLVFH

SEQ ID NO: 158834 - protein, 16 aa, Mycobacterium tuberculosis
QEAVQHDDPWTLVFHG

SEQ ID NO: 158835 - protein, 16 aa, Mycobacterium tuberculosis
EAVQHDDPWTLVFHGY

SEQ ID NO: 158836 - protein, 16 aa, Mycobacterium tuberculosis
AVQHDDPWTLVFHGYD

SEQ ID NO: 158837 - protein, 16 aa, Mycobacterium tuberculosis
VQHDDPWTLVFHGYDP

SEQ ID NO: 158838 - protein, 16 aa, Mycobacterium tuberculosis
QHDDPWTLVFHGYDPG

SEQ ID NO: 158839 - protein, 16 aa, Mycobacterium tuberculosis
HDDPWTLVFHGYDPGQ

SEQ ID NO: 158840 - protein, 16 aa, Mycobacterium tuberculosis
DDPWTLVFHGYDPGQE

SEQ ID NO: 158841 - protein, 16 aa, Mycobacterium tuberculosis
DPWTLVFHGYDPGQER

SEQ ID NO: 158842 - protein, 16 aa, Mycobacterium tuberculosis
PWTLVFHGYDPGQERL

SEQ ID NO: 158843 - protein, 16 aa, Mycobacterium tuberculosis
WTLVFHGYDPGQERLR

SEQ ID NO: 158844 - protein, 16 aa, Mycobacterium tuberculosis
TLVFHGYDPGQERLRE

SEQ ID NO: 158845 - protein, 16 aa, Mycobacterium tuberculosis
LVFHGYDPGQERLREA

SEQ ID NO: 158846 - protein, 16 aa, Mycobacterium tuberculosis
VFHGYDPGQERLREAL

SEQ ID NO: 158847 - protein, 16 aa, Mycobacterium tuberculosis
FHGYDPGQERLREALC

SEQ ID NO: 158848 - protein, 16 aa, Mycobacterium tuberculosis
HGYDPGQERLREALCA

SEQ ID NO: 158849 - protein, 16 aa, Mycobacterium tuberculosis
GYDPGQERLREALCAV

SEQ ID NO: 158850 - protein, 16 aa, Mycobacterium tuberculosis
YDPGQERLREALCAVG

SEQ ID NO: 158851 - protein, 16 aa, Mycobacterium tuberculosis
DPGQERLREALCAVGN

SEQ ID NO: 158852 - protein, 16 aa, Mycobacterium tuberculosis
PGQERLREALCAVGNG

SEQ ID NO: 158853 - protein, 16 aa, Mycobacterium tuberculosis
GQERLREALCAVGNGY

SEQ ID NO: 158854 - protein, 16 aa, Mycobacterium tuberculosis
QERLREALCAVGNGYL

SEQ ID NO: 158855 - protein, 16 aa, Mycobacterium tuberculosis
ERLREALCAVGNGYLG

SEQ ID NO: 158856 - protein, 16 aa, Mycobacterium tuberculosis
RLREALCAVGNGYLGS

SEQ ID NO: 158857 - protein, 16 aa, Mycobacterium tuberculosis
LREALCAVGNGYLGSR

SEQ ID NO: 158858 - protein, 16 aa, Mycobacterium tuberculosis
REALCAVGNGYLGSRG

SEQ ID NO: 158859 - protein, 16 aa, Mycobacterium tuberculosis
EALCAVGNGYLGSRGC

SEQ ID NO: 158860 - protein, 16 aa, Mycobacterium tuberculosis
ALCAVGNGYLGSRGCA

SEQ ID NO: 158861 - protein, 16 aa, Mycobacterium tuberculosis
LCAVGNGYLGSRGCAP

SEQ ID NO: 158862 - protein, 16 aa, Mycobacterium tuberculosis
CAVGNGYLGSRGCAPE

SEQ ID NO: 158863 - protein, 16 aa, Mycobacterium tuberculosis
AVGNGYLGSRGCAPES

SEQ ID NO: 158864 - protein, 16 aa, Mycobacterium tuberculosis
VGNGYLGSRGCAPESA

SEQ ID NO: 158865 - protein, 16 aa, Mycobacterium tuberculosis
GNGYLGSRGCAPESAE

SEQ ID NO: 158866 - protein, 16 aa, Mycobacterium tuberculosis
NGYLGSRGCAPESAES

SEQ ID NO: 158867 - protein, 16 aa, Mycobacterium tuberculosis
GYLGSRGCAPESAESE

SEQ ID NO: 158868 - protein, 16 aa, Mycobacterium tuberculosis
YLGSRGCAPESAESEA

SEQ ID NO: 158869 - protein, 16 aa, Mycobacterium tuberculosis
LGSRGCAPESAESEAH

SEQ ID NO: 158870 - protein, 16 aa, Mycobacterium tuberculosis
GSRGCAPESAESEAHY

SEQ ID NO: 158871 - protein, 16 aa, Mycobacterium tuberculosis
SRGCAPESAESEAHYP

SEQ ID NO: 158872 - protein, 16 aa, Mycobacterium tuberculosis
RGCAPESAESEAHYPG

SEQ ID NO: 158873 - protein, 16 aa, Mycobacterium tuberculosis
GCAPESAESEAHYPGT

SEQ ID NO: 158874 - protein, 16 aa, Mycobacterium tuberculosis
CAPESAESEAHYPGTY

SEQ ID NO: 158875 - protein, 16 aa, Mycobacterium tuberculosis
APESAESEAHYPGTYV

SEQ ID NO: 158876 - protein, 16 aa, Mycobacterium tuberculosis
PESAESEAHYPGTYVA

SEQ ID NO: 158877 - protein, 16 aa, Mycobacterium tuberculosis
ESAESEAHYPGTYVAG

SEQ ID NO: 158878 - protein, 16 aa, Mycobacterium tuberculosis
SAESEAHYPGTYVAGV

SEQ ID NO: 158879 - protein, 16 aa, Mycobacterium tuberculosis
AESEAHYPGTYVAGVY

SEQ ID NO: 158880 - protein, 16 aa, Mycobacterium tuberculosis
ESEAHYPGTYVAGVYN

SEQ ID NO: 158881 - protein, 16 aa, Mycobacterium tuberculosis
SEAHYPGTYVAGVYNQ

SEQ ID NO: 158882 - protein, 16 aa, Mycobacterium tuberculosis
EAHYPGTYVAGVYNQL

SEQ ID NO: 158883 - protein, 16 aa, Mycobacterium tuberculosis
AHYPGTYVAGVYNQLT

SEQ ID NO: 158884 - protein, 16 aa, Mycobacterium tuberculosis
HYPGTYVAGVYNQLTD

SEQ ID NO: 158885 - protein, 16 aa, Mycobacterium tuberculosis
YPGTYVAGVYNQLTDH

SEQ ID NO: 158886 - protein, 16 aa, Mycobacterium tuberculosis
PGTYVAGVYNQLTDHI

SEQ ID NO: 158887 - protein, 16 aa, Mycobacterium tuberculosis
GTYVAGVYNQLTDHIE

SEQ ID NO: 158888 - protein, 16 aa, Mycobacterium tuberculosis
TYVAGVYNQLTDHIEG

SEQ ID NO: 158889 - protein, 16 aa, Mycobacterium tuberculosis
YVAGVYNQLTDHIEGC

SEQ ID NO: 158890 - protein, 16 aa, Mycobacterium tuberculosis
VAGVYNQLTDHIEGCT

SEQ ID NO: 158891 - protein, 16 aa, Mycobacterium tuberculosis
AGVYNQLTDHIEGCTV

SEQ ID NO: 158892 - protein, 16 aa, Mycobacterium tuberculosis
GVYNQLTDHIEGCTVD

SEQ ID NO: 158893 - protein, 16 aa, Mycobacterium tuberculosis
VYNQLTDHIEGCTVDN

SEQ ID NO: 158894 - protein, 16 aa, Mycobacterium tuberculosis
YNQLTDHIEGCTVDNE

SEQ ID NO: 158895 - protein, 16 aa, Mycobacterium tuberculosis
NQLTDHIEGCTVDNES

SEQ ID NO: 158896 - protein, 16 aa, Mycobacterium tuberculosis
QLTDHIEGCTVDNESL

SEQ ID NO: 158897 - protein, 16 aa, Mycobacterium tuberculosis
LTDHIEGCTVDNESLV

SEQ ID NO: 158898 - protein, 16 aa, Mycobacterium tuberculosis
TDHIEGCTVDNESLVN

SEQ ID NO: 158899 - protein, 16 aa, Mycobacterium tuberculosis
DHIEGCTVDNESLVNL

SEQ ID NO: 158900 - protein, 16 aa, Mycobacterium tuberculosis
HIEGCTVDNESLVNLP

SEQ ID NO: 158901 - protein, 16 aa, Mycobacterium tuberculosis
IEGCTVDNESLVNLPN

SEQ ID NO: 158902 - protein, 16 aa, Mycobacterium tuberculosis
EGCTVDNESLVNLPNW

SEQ ID NO: 158903 - protein, 16 aa, Mycobacterium tuberculosis
GCTVDNESLVNLPNWL

SEQ ID NO: 158904 - protein, 16 aa, Mycobacterium tuberculosis
CTVDNESLVNLPNWLS

SEQ ID NO: 158905 - protein, 16 aa, Mycobacterium tuberculosis
TVDNESLVNLPNWLSL

SEQ ID NO: 158906 - protein, 16 aa, Mycobacterium tuberculosis
VDNESLVNLPNWLSLT

SEQ ID NO: 158907 - protein, 16 aa, Mycobacterium tuberculosis
DNESLVNLPNWLSLTF

SEQ ID NO: 158908 - protein, 16 aa, Mycobacterium tuberculosis
NESLVNLPNWLSLTFR

SEQ ID NO: 158909 - protein, 16 aa, Mycobacterium tuberculosis
ESLVNLPNWLSLTFRI

SEQ ID NO: 158910 - protein, 16 aa, Mycobacterium tuberculosis
SLVNLPNWLSLTFRID

SEQ ID NO: 158911 - protein, 16 aa, Mycobacterium tuberculosis
LVNLPNWLSLTFRIDG

SEQ ID NO: 158912 - protein, 16 aa, Mycobacterium tuberculosis
VNLPNWLSLTFRIDGG

SEQ ID NO: 158913 - protein, 16 aa, Mycobacterium tuberculosis
NLPNWLSLTFRIDGGA

SEQ ID NO: 158914 - protein, 16 aa, Mycobacterium tuberculosis
LPNWLSLTFRIDGGAW

SEQ ID NO: 158915 - protein, 16 aa, Mycobacterium tuberculosis
PNWLSLTFRIDGGAWF

SEQ ID NO: 158916 - protein, 16 aa, Mycobacterium tuberculosis
NWLSLTFRIDGGAWFN

SEQ ID NO: 158917 - protein, 16 aa, Mycobacterium tuberculosis
WLSLTFRIDGGAWFNV

SEQ ID NO: 158918 - protein, 16 aa, Mycobacterium tuberculosis
LSLTFRIDGGAWFNVD

SEQ ID NO: 158919 - protein, 16 aa, Mycobacterium tuberculosis
SLTFRIDGGAWFNVDT

SEQ ID NO: 158920 - protein, 16 aa, Mycobacterium tuberculosis
LTFRIDGGAWFNVDTV

SEQ ID NO: 158921 - protein, 16 aa, Mycobacterium tuberculosis
TFRIDGGAWFNVDTVE

SEQ ID NO: 158922 - protein, 16 aa, Mycobacterium tuberculosis
FRIDGGAWFNVDTVEL

SEQ ID NO: 158923 - protein, 16 aa, Mycobacterium tuberculosis
RIDGGAWFNVDTVELL

SEQ ID NO: 158924 - protein, 16 aa, Mycobacterium tuberculosis
IDGGAWFNVDTVELLS

SEQ ID NO: 158925 - protein, 16 aa, Mycobacterium tuberculosis
DGGAWFNVDTVELLSY

SEQ ID NO: 158926 - protein, 16 aa, Mycobacterium tuberculosis
GGAWFNVDTVELLSYR

SEQ ID NO: 158927 - protein, 16 aa, Mycobacterium tuberculosis
GAWFNVDTVELLSYRQ

SEQ ID NO: 158928 - protein, 16 aa, Mycobacterium tuberculosis
AWFNVDTVELLSYRQT

SEQ ID NO: 158929 - protein, 16 aa, Mycobacterium tuberculosis
WFNVDTVELLSYRQTF

SEQ ID NO: 158930 - protein, 16 aa, Mycobacterium tuberculosis
FNVDTVELLSYRQTFD

SEQ ID NO: 158931 - protein, 16 aa, Mycobacterium tuberculosis
NVDTVELLSYRQTFDL

SEQ ID NO: 158932 - protein, 16 aa, Mycobacterium tuberculosis
VDTVELLSYRQTFDLR

SEQ ID NO: 158933 - protein, 16 aa, Mycobacterium tuberculosis
DTVELLSYRQTFDLRR

SEQ ID NO: 158934 - protein, 16 aa, Mycobacterium tuberculosis
TVELLSYRQTFDLRRA

SEQ ID NO: 158935 - protein, 16 aa, Mycobacterium tuberculosis
VELLSYRQTFDLRRAT

SEQ ID NO: 158936 - protein, 16 aa, Mycobacterium tuberculosis
ELLSYRQTFDLRRATL

SEQ ID NO: 158937 - protein, 16 aa, Mycobacterium tuberculosis
LLSYRQTFDLRRATLT

SEQ ID NO: 158938 - protein, 16 aa, Mycobacterium tuberculosis
LSYRQTFDLRRATLTR

SEQ ID NO: 158939 - protein, 16 aa, Mycobacterium tuberculosis
SYRQTFDLRRATLTRS

SEQ ID NO: 158940 - protein, 16 aa, Mycobacterium tuberculosis
YRQTFDLRRATLTRSL

SEQ ID NO: 158941 - protein, 16 aa, Mycobacterium tuberculosis
RQTFDLRRATLTRSLR

SEQ ID NO: 158942 - protein, 16 aa, Mycobacterium tuberculosis
QTFDLRRATLTRSLRF

SEQ ID NO: 158943 - protein, 16 aa, Mycobacterium tuberculosis
TFDLRRATLTRSLRFR

SEQ ID NO: 158944 - protein, 16 aa, Mycobacterium tuberculosis
FDLRRATLTRSLRFRD

SEQ ID NO: 158945 - protein, 16 aa, Mycobacterium tuberculosis
DLRRATLTRSLRFRDA

SEQ ID NO: 158946 - protein, 16 aa, Mycobacterium tuberculosis
LRRATLTRSLRFRDAG

SEQ ID NO: 158947 - protein, 16 aa, Mycobacterium tuberculosis
RRATLTRSLRFRDAGG

SEQ ID NO: 158948 - protein, 16 aa, Mycobacterium tuberculosis
RATLTRSLRFRDAGGR

SEQ ID NO: 158949 - protein, 16 aa, Mycobacterium tuberculosis
ATLTRSLRFRDAGGRV

SEQ ID NO: 158950 - protein, 16 aa, Mycobacterium tuberculosis
TLTRSLRFRDAGGRVT

SEQ ID NO: 158951 - protein, 16 aa, Mycobacterium tuberculosis
LTRSLRFRDAGGRVTT

SEQ ID NO: 158952 - protein, 16 aa, Mycobacterium tuberculosis
TRSLRFRDAGGRVTTM

SEQ ID NO: 158953 - protein, 16 aa, Mycobacterium tuberculosis
RSLRFRDAGGRVTTMT

SEQ ID NO: 158954 - protein, 16 aa, Mycobacterium tuberculosis
SLRFRDAGGRVTTMTQ

SEQ ID NO: 158955 - protein, 16 aa, Mycobacterium tuberculosis
LRFRDAGGRVTTMTQE

SEQ ID NO: 158956 - protein, 16 aa, Mycobacterium tuberculosis
RFRDAGGRVTTMTQER

SEQ ID NO: 158957 - protein, 16 aa, Mycobacterium tuberculosis
FRDAGGRVTTMTQERF

SEQ ID NO: 158958 - protein, 16 aa, Mycobacterium tuberculosis
RDAGGRVTTMTQERFA

SEQ ID NO: 158959 - protein, 16 aa, Mycobacterium tuberculosis
DAGGRVTTMTQERFAS

SEQ ID NO: 158960 - protein, 16 aa, Mycobacterium tuberculosis
AGGRVTTMTQERFASM

SEQ ID NO: 158961 - protein, 16 aa, Mycobacterium tuberculosis
GGRVTTMTQERFASMN

SEQ ID NO: 158962 - protein, 16 aa, Mycobacterium tuberculosis
GRVTTMTQERFASMNR

SEQ ID NO: 158963 - protein, 16 aa, Mycobacterium tuberculosis
RVTTMTQERFASMNRP

SEQ ID NO: 158964 - protein, 16 aa, Mycobacterium tuberculosis
VTTMTQERFASMNRPN

SEQ ID NO: 158965 - protein, 16 aa, Mycobacterium tuberculosis
TTMTQERFASMNRPNL

SEQ ID NO: 158966 - protein, 16 aa, Mycobacterium tuberculosis
TMTQERFASMNRPNLV

SEQ ID NO: 158967 - protein, 16 aa, Mycobacterium tuberculosis
MTQERFASMNRPNLVA

SEQ ID NO: 158968 - protein, 16 aa, Mycobacterium tuberculosis
TQERFASMNRPNLVAL

SEQ ID NO: 158969 - protein, 16 aa, Mycobacterium tuberculosis
QERFASMNRPNLVALQ

SEQ ID NO: 158970 - protein, 16 aa, Mycobacterium tuberculosis
ERFASMNRPNLVALQT

SEQ ID NO: 158971 - protein, 16 aa, Mycobacterium tuberculosis
RFASMNRPNLVALQTR

SEQ ID NO: 158972 - protein, 16 aa, Mycobacterium tuberculosis
FASMNRPNLVALQTRI

SEQ ID NO: 158973 - protein, 16 aa, Mycobacterium tuberculosis
ASMNRPNLVALQTRIE

SEQ ID NO: 158974 - protein, 16 aa, Mycobacterium tuberculosis
SMNRPNLVALQTRIES

SEQ ID NO: 158975 - protein, 16 aa, Mycobacterium tuberculosis
MNRPNLVALQTRIESE

SEQ ID NO: 158976 - protein, 16 aa, Mycobacterium tuberculosis
NRPNLVALQTRIESEN

SEQ ID NO: 158977 - protein, 16 aa, Mycobacterium tuberculosis
RPNLVALQTRIESENW

SEQ ID NO: 158978 - protein, 16 aa, Mycobacterium tuberculosis
PNLVALQTRIESENWS

SEQ ID NO: 158979 - protein, 16 aa, Mycobacterium tuberculosis
NLVALQTRIESENWSG

SEQ ID NO: 158980 - protein, 16 aa, Mycobacterium tuberculosis
LVALQTRIESENWSGT

SEQ ID NO: 158981 - protein, 16 aa, Mycobacterium tuberculosis
VALQTRIESENWSGTV

SEQ ID NO: 158982 - protein, 16 aa, Mycobacterium tuberculosis
ALQTRIESENWSGTVD

SEQ ID NO: 158983 - protein, 16 aa, Mycobacterium tuberculosis
LQTRIESENWSGTVDF

SEQ ID NO: 158984 - protein, 16 aa, Mycobacterium tuberculosis
QTRIESENWSGTVDFR

SEQ ID NO: 158985 - protein, 16 aa, Mycobacterium tuberculosis
TRIESENWSGTVDFRS

SEQ ID NO: 158986 - protein, 16 aa, Mycobacterium tuberculosis
RIESENWSGTVDFRSL

SEQ ID NO: 158987 - protein, 16 aa, Mycobacterium tuberculosis
IESENWSGTVDFRSLV

SEQ ID NO: 158988 - protein, 16 aa, Mycobacterium tuberculosis
ESENWSGTVDFRSLVD

SEQ ID NO: 158989 - protein, 16 aa, Mycobacterium tuberculosis
SENWSGTVDFRSLVDG

SEQ ID NO: 158990 - protein, 16 aa, Mycobacterium tuberculosis
ENWSGTVDFRSLVDGG

SEQ ID NO: 158991 - protein, 16 aa, Mycobacterium tuberculosis
NWSGTVDFRSLVDGGV

SEQ ID NO: 158992 - protein, 16 aa, Mycobacterium tuberculosis
WSGTVDFRSLVDGGVH

SEQ ID NO: 158993 - protein, 16 aa, Mycobacterium tuberculosis
SGTVDFRSLVDGGVHN

SEQ ID NO: 158994 - protein, 16 aa, Mycobacterium tuberculosis
GTVDFRSLVDGGVHNT

SEQ ID NO: 158995 - protein, 16 aa, Mycobacterium tuberculosis
TVDFRSLVDGGVHNTL

SEQ ID NO: 158996 - protein, 16 aa, Mycobacterium tuberculosis
VDFRSLVDGGVHNTLV

SEQ ID NO: 158997 - protein, 16 aa, Mycobacterium tuberculosis
DFRSLVDGGVHNTLVD

SEQ ID NO: 158998 - protein, 16 aa, Mycobacterium tuberculosis
FRSLVDGGVHNTLVDR

SEQ ID NO: 158999 - protein, 16 aa, Mycobacterium tuberculosis
RSLVDGGVHNTLVDRY

SEQ ID NO: 159000 - protein, 16 aa, Mycobacterium tuberculosis
SLVDGGVHNTLVDRYR

SEQ ID NO: 159001 - protein, 16 aa, Mycobacterium tuberculosis
LVDGGVHNTLVDRYRQ

SEQ ID NO: 159002 - protein, 16 aa, Mycobacterium tuberculosis
VDGGVHNTLVDRYRQL

SEQ ID NO: 159003 - protein, 16 aa, Mycobacterium tuberculosis
DGGVHNTLVDRYRQLS

SEQ ID NO: 159004 - protein, 16 aa, Mycobacterium tuberculosis
GGVHNTLVDRYRQLSS

SEQ ID NO: 159005 - protein, 16 aa, Mycobacterium tuberculosis
GVHNTLVDRYRQLSSQ

SEQ ID NO: 159006 - protein, 16 aa, Mycobacterium tuberculosis
VHNTLVDRYRQLSSQH

SEQ ID NO: 159007 - protein, 16 aa, Mycobacterium tuberculosis
HNTLVDRYRQLSSQHL

SEQ ID NO: 159008 - protein, 16 aa, Mycobacterium tuberculosis
NTLVDRYRQLSSQHLT

SEQ ID NO: 159009 - protein, 16 aa, Mycobacterium tuberculosis
TLVDRYRQLSSQHLTT

SEQ ID NO: 159010 - protein, 16 aa, Mycobacterium tuberculosis
LVDRYRQLSSQHLTTA

SEQ ID NO: 159011 - protein, 16 aa, Mycobacterium tuberculosis
VDRYRQLSSQHLTTAE

SEQ ID NO: 159012 - protein, 16 aa, Mycobacterium tuberculosis
DRYRQLSSQHLTTAEI

SEQ ID NO: 159013 - protein, 16 aa, Mycobacterium tuberculosis
RYRQLSSQHLTTAEIE

SEQ ID NO: 159014 - protein, 16 aa, Mycobacterium tuberculosis
YRQLSSQHLTTAEIEV

SEQ ID NO: 159015 - protein, 16 aa, Mycobacterium tuberculosis
RQLSSQHLTTAEIEVL

SEQ ID NO: 159016 - protein, 16 aa, Mycobacterium tuberculosis
QLSSQHLTTAEIEVLA

SEQ ID NO: 159017 - protein, 16 aa, Mycobacterium tuberculosis
LSSQHLTTAEIEVLAD

SEQ ID NO: 159018 - protein, 16 aa, Mycobacterium tuberculosis
SSQHLTTAEIEVLADS

SEQ ID NO: 159019 - protein, 16 aa, Mycobacterium tuberculosis
SQHLTTAEIEVLADSV

SEQ ID NO: 159020 - protein, 16 aa, Mycobacterium tuberculosis
QHLTTAEIEVLADSVL

SEQ ID NO: 159021 - protein, 16 aa, Mycobacterium tuberculosis
HLTTAEIEVLADSVLL

SEQ ID NO: 159022 - protein, 16 aa, Mycobacterium tuberculosis
LTTAEIEVLADSVLLR

SEQ ID NO: 159023 - protein, 16 aa, Mycobacterium tuberculosis
TTAEIEVLADSVLLRT

SEQ ID NO: 159024 - protein, 16 aa, Mycobacterium tuberculosis
TAEIEVLADSVLLRTQ

SEQ ID NO: 159025 - protein, 16 aa, Mycobacterium tuberculosis
AEIEVLADSVLLRTQT

SEQ ID NO: 159026 - protein, 16 aa, Mycobacterium tuberculosis
EIEVLADSVLLRTQTS

SEQ ID NO: 159027 - protein, 16 aa, Mycobacterium tuberculosis
IEVLADSVLLRTQTSQ

SEQ ID NO: 159028 - protein, 16 aa, Mycobacterium tuberculosis
EVLADSVLLRTQTSQS

SEQ ID NO: 159029 - protein, 16 aa, Mycobacterium tuberculosis
VLADSVLLRTQTSQSG

SEQ ID NO: 159030 - protein, 16 aa, Mycobacterium tuberculosis
LADSVLLRTQTSQSGI

SEQ ID NO: 159031 - protein, 16 aa, Mycobacterium tuberculosis
ADSVLLRTQTSQSGIA

SEQ ID NO: 159032 - protein, 16 aa, Mycobacterium tuberculosis
DSVLLRTQTSQSGIAI

SEQ ID NO: 159033 - protein, 16 aa, Mycobacterium tuberculosis
SVLLRTQTSQSGIAIA

SEQ ID NO: 159034 - protein, 16 aa, Mycobacterium tuberculosis
VLLRTQTSQSGIAIAV

SEQ ID NO: 159035 - protein, 16 aa, Mycobacterium tuberculosis
LLRTQTSQSGIAIAVA

SEQ ID NO: 159036 - protein, 16 aa, Mycobacterium tuberculosis
LRTQTSQSGIAIAVAA

SEQ ID NO: 159037 - protein, 16 aa, Mycobacterium tuberculosis
RTQTSQSGIAIAVAAR

SEQ ID NO: 159038 - protein, 16 aa, Mycobacterium tuberculosis
TQTSQSGIAIAVAARS

SEQ ID NO: 159039 - protein, 16 aa, Mycobacterium tuberculosis
QTSQSGIAIAVAARST

SEQ ID NO: 159040 - protein, 16 aa, Mycobacterium tuberculosis
TSQSGIAIAVAARSTL

SEQ ID NO: 159041 - protein, 16 aa, Mycobacterium tuberculosis
SQSGIAIAVAARSTLW

SEQ ID NO: 159042 - protein, 16 aa, Mycobacterium tuberculosis
QSGIAIAVAARSTLWR

SEQ ID NO: 159043 - protein, 16 aa, Mycobacterium tuberculosis
SGIAIAVAARSTLWRD

SEQ ID NO: 159044 - protein, 16 aa, Mycobacterium tuberculosis
GIAIAVAARSTLWRDG

SEQ ID NO: 159045 - protein, 16 aa, Mycobacterium tuberculosis
IAIAVAARSTLWRDGQ

SEQ ID NO: 159046 - protein, 16 aa, Mycobacterium tuberculosis
AIAVAARSTLWRDGQR

SEQ ID NO: 159047 - protein, 16 aa, Mycobacterium tuberculosis
IAVAARSTLWRDGQRV

SEQ ID NO: 159048 - protein, 16 aa, Mycobacterium tuberculosis
AVAARSTLWRDGQRVD

SEQ ID NO: 159049 - protein, 16 aa, Mycobacterium tuberculosis
VAARSTLWRDGQRVDA

SEQ ID NO: 159050 - protein, 16 aa, Mycobacterium tuberculosis
AARSTLWRDGQRVDAQ

SEQ ID NO: 159051 - protein, 16 aa, Mycobacterium tuberculosis
ARSTLWRDGQRVDAQY

SEQ ID NO: 159052 - protein, 16 aa, Mycobacterium tuberculosis
RSTLWRDGQRVDAQYR

SEQ ID NO: 159053 - protein, 16 aa, Mycobacterium tuberculosis
STLWRDGQRVDAQYRV

SEQ ID NO: 159054 - protein, 16 aa, Mycobacterium tuberculosis
TLWRDGQRVDAQYRVA

SEQ ID NO: 159055 - protein, 16 aa, Mycobacterium tuberculosis
LWRDGQRVDAQYRVAR

SEQ ID NO: 159056 - protein, 16 aa, Mycobacterium tuberculosis
WRDGQRVDAQYRVARD

SEQ ID NO: 159057 - protein, 16 aa, Mycobacterium tuberculosis
RDGQRVDAQYRVARDT

SEQ ID NO: 159058 - protein, 16 aa, Mycobacterium tuberculosis
DGQRVDAQYRVARDTN

SEQ ID NO: 159059 - protein, 16 aa, Mycobacterium tuberculosis
GQRVDAQYRVARDTNR

SEQ ID NO: 159060 - protein, 16 aa, Mycobacterium tuberculosis
QRVDAQYRVARDTNRG

SEQ ID NO: 159061 - protein, 16 aa, Mycobacterium tuberculosis
RVDAQYRVARDTNRGG

SEQ ID NO: 159062 - protein, 16 aa, Mycobacterium tuberculosis
VDAQYRVARDTNRGGH

SEQ ID NO: 159063 - protein, 16 aa, Mycobacterium tuberculosis
DAQYRVARDTNRGGHD

SEQ ID NO: 159064 - protein, 16 aa, Mycobacterium tuberculosis
AQYRVARDTNRGGHDI

SEQ ID NO: 159065 - protein, 16 aa, Mycobacterium tuberculosis
QYRVARDTNRGGHDIQ

SEQ ID NO: 159066 - protein, 16 aa, Mycobacterium tuberculosis
YRVARDTNRGGHDIQV

SEQ ID NO: 159067 - protein, 16 aa, Mycobacterium tuberculosis
RVARDTNRGGHDIQVT

SEQ ID NO: 159068 - protein, 16 aa, Mycobacterium tuberculosis
VARDTNRGGHDIQVTL

SEQ ID NO: 159069 - protein, 16 aa, Mycobacterium tuberculosis
ARDTNRGGHDIQVTLS

SEQ ID NO: 159070 - protein, 16 aa, Mycobacterium tuberculosis
RDTNRGGHDIQVTLSA

SEQ ID NO: 159071 - protein, 16 aa, Mycobacterium tuberculosis
DTNRGGHDIQVTLSAG

SEQ ID NO: 159072 - protein, 16 aa, Mycobacterium tuberculosis
TNRGGHDIQVTLSAGQ

SEQ ID NO: 159073 - protein, 16 aa, Mycobacterium tuberculosis
NRGGHDIQVTLSAGQS

SEQ ID NO: 159074 - protein, 16 aa, Mycobacterium tuberculosis
RGGHDIQVTLSAGQSV

SEQ ID NO: 159075 - protein, 16 aa, Mycobacterium tuberculosis
GGHDIQVTLSAGQSVT

SEQ ID NO: 159076 - protein, 16 aa, Mycobacterium tuberculosis
GHDIQVTLSAGQSVTL

SEQ ID NO: 159077 - protein, 16 aa, Mycobacterium tuberculosis
HDIQVTLSAGQSVTLE

SEQ ID NO: 159078 - protein, 16 aa, Mycobacterium tuberculosis
DIQVTLSAGQSVTLEK

SEQ ID NO: 159079 - protein, 16 aa, Mycobacterium tuberculosis
IQVTLSAGQSVTLEKV

SEQ ID NO: 159080 - protein, 16 aa, Mycobacterium tuberculosis
QVTLSAGQSVTLEKVA

SEQ ID NO: 159081 - protein, 16 aa, Mycobacterium tuberculosis
VTLSAGQSVTLEKVAT

SEQ ID NO: 159082 - protein, 16 aa, Mycobacterium tuberculosis
TLSAGQSVTLEKVATI

SEQ ID NO: 159083 - protein, 16 aa, Mycobacterium tuberculosis
LSAGQSVTLEKVATIF

SEQ ID NO: 159084 - protein, 16 aa, Mycobacterium tuberculosis
SAGQSVTLEKVATIFT

SEQ ID NO: 159085 - protein, 16 aa, Mycobacterium tuberculosis
AGQSVTLEKVATIFTS

SEQ ID NO: 159086 - protein, 16 aa, Mycobacterium tuberculosis
GQSVTLEKVATIFTSR

SEQ ID NO: 159087 - protein, 16 aa, Mycobacterium tuberculosis
QSVTLEKVATIFTSRD

SEQ ID NO: 159088 - protein, 16 aa, Mycobacterium tuberculosis
SVTLEKVATIFTSRDA

SEQ ID NO: 159089 - protein, 16 aa, Mycobacterium tuberculosis
VTLEKVATIFTSRDAA

SEQ ID NO: 159090 - protein, 16 aa, Mycobacterium tuberculosis
TLEKVATIFTSRDAAT

SEQ ID NO: 159091 - protein, 16 aa, Mycobacterium tuberculosis
LEKVATIFTSRDAATL

SEQ ID NO: 159092 - protein, 16 aa, Mycobacterium tuberculosis
EKVATIFTSRDAATLT

SEQ ID NO: 159093 - protein, 16 aa, Mycobacterium tuberculosis
KVATIFTSRDAATLTA

SEQ ID NO: 159094 - protein, 16 aa, Mycobacterium tuberculosis
VATIFTSRDAATLTAA

SEQ ID NO: 159095 - protein, 16 aa, Mycobacterium tuberculosis
ATIFTSRDAATLTAAI

SEQ ID NO: 159096 - protein, 16 aa, Mycobacterium tuberculosis
TIFTSRDAATLTAAIS

SEQ ID NO: 159097 - protein, 16 aa, Mycobacterium tuberculosis
IFTSRDAATLTAAISA

SEQ ID NO: 159098 - protein, 16 aa, Mycobacterium tuberculosis
FTSRDAATLTAAISAQ

SEQ ID NO: 159099 - protein, 16 aa, Mycobacterium tuberculosis
TSRDAATLTAAISAQR

SEQ ID NO: 159100 - protein, 16 aa, Mycobacterium tuberculosis
SRDAATLTAAISAQRC

SEQ ID NO: 159101 - protein, 16 aa, Mycobacterium tuberculosis
RDAATLTAAISAQRCL

SEQ ID NO: 159102 - protein, 16 aa, Mycobacterium tuberculosis
DAATLTAAISAQRCLG

SEQ ID NO: 159103 - protein, 16 aa, Mycobacterium tuberculosis
AATLTAAISAQRCLGE

SEQ ID NO: 159104 - protein, 16 aa, Mycobacterium tuberculosis
ATLTAAISAQRCLGEA

SEQ ID NO: 159105 - protein, 16 aa, Mycobacterium tuberculosis
TLTAAISAQRCLGEAG

SEQ ID NO: 159106 - protein, 16 aa, Mycobacterium tuberculosis
LTAAISAQRCLGEAGR

SEQ ID NO: 159107 - protein, 16 aa, Mycobacterium tuberculosis
TAAISAQRCLGEAGRY

SEQ ID NO: 159108 - protein, 16 aa, Mycobacterium tuberculosis
AAISAQRCLGEAGRYA

SEQ ID NO: 159109 - protein, 16 aa, Mycobacterium tuberculosis
AISAQRCLGEAGRYAE

SEQ ID NO: 159110 - protein, 16 aa, Mycobacterium tuberculosis
ISAQRCLGEAGRYAEL

SEQ ID NO: 159111 - protein, 16 aa, Mycobacterium tuberculosis
SAQRCLGEAGRYAELC

SEQ ID NO: 159112 - protein, 16 aa, Mycobacterium tuberculosis
AQRCLGEAGRYAELCQ

SEQ ID NO: 159113 - protein, 16 aa, Mycobacterium tuberculosis
QRCLGEAGRYAELCQQ

SEQ ID NO: 159114 - protein, 16 aa, Mycobacterium tuberculosis
RCLGEAGRYAELCQQH

SEQ ID NO: 159115 - protein, 16 aa, Mycobacterium tuberculosis
CLGEAGRYAELCQQHV

SEQ ID NO: 159116 - protein, 16 aa, Mycobacterium tuberculosis
LGEAGRYAELCQQHVR

SEQ ID NO: 159117 - protein, 16 aa, Mycobacterium tuberculosis
GEAGRYAELCQQHVRA

SEQ ID NO: 159118 - protein, 16 aa, Mycobacterium tuberculosis
EAGRYAELCQQHVRAW

SEQ ID NO: 159119 - protein, 16 aa, Mycobacterium tuberculosis
AGRYAELCQQHVRAWA

SEQ ID NO: 159120 - protein, 16 aa, Mycobacterium tuberculosis
GRYAELCQQHVRAWAR

SEQ ID NO: 159121 - protein, 16 aa, Mycobacterium tuberculosis
RYAELCQQHVRAWARL

SEQ ID NO: 159122 - protein, 16 aa, Mycobacterium tuberculosis
YAELCQQHVRAWARLW

SEQ ID NO: 159123 - protein, 16 aa, Mycobacterium tuberculosis
AELCQQHVRAWARLWE

SEQ ID NO: 159124 - protein, 16 aa, Mycobacterium tuberculosis
ELCQQHVRAWARLWER

SEQ ID NO: 159125 - protein, 16 aa, Mycobacterium tuberculosis
LCQQHVRAWARLWERC

SEQ ID NO: 159126 - protein, 16 aa, Mycobacterium tuberculosis
CQQHVRAWARLWERCA

SEQ ID NO: 159127 - protein, 16 aa, Mycobacterium tuberculosis
QQHVRAWARLWERCAI

SEQ ID NO: 159128 - protein, 16 aa, Mycobacterium tuberculosis
QHVRAWARLWERCAID

SEQ ID NO: 159129 - protein, 16 aa, Mycobacterium tuberculosis
HVRAWARLWERCAIDL

SEQ ID NO: 159130 - protein, 16 aa, Mycobacterium tuberculosis
VRAWARLWERCAIDLT

SEQ ID NO: 159131 - protein, 16 aa, Mycobacterium tuberculosis
RAWARLWERCAIDLTG

SEQ ID NO: 159132 - protein, 16 aa, Mycobacterium tuberculosis
AWARLWERCAIDLTGN

SEQ ID NO: 159133 - protein, 16 aa, Mycobacterium tuberculosis
WARLWERCAIDLTGNT

SEQ ID NO: 159134 - protein, 16 aa, Mycobacterium tuberculosis
ARLWERCAIDLTGNTE

SEQ ID NO: 159135 - protein, 16 aa, Mycobacterium tuberculosis
RLWERCAIDLTGNTEE

SEQ ID NO: 159136 - protein, 16 aa, Mycobacterium tuberculosis
LWERCAIDLTGNTEEL

SEQ ID NO: 159137 - protein, 16 aa, Mycobacterium tuberculosis
WERCAIDLTGNTEELR

SEQ ID NO: 159138 - protein, 16 aa, Mycobacterium tuberculosis
ERCAIDLTGNTEELRL

SEQ ID NO: 159139 - protein, 16 aa, Mycobacterium tuberculosis
RCAIDLTGNTEELRLV

SEQ ID NO: 159140 - protein, 16 aa, Mycobacterium tuberculosis
CAIDLTGNTEELRLVR

SEQ ID NO: 159141 - protein, 16 aa, Mycobacterium tuberculosis
AIDLTGNTEELRLVRL

SEQ ID NO: 159142 - protein, 16 aa, Mycobacterium tuberculosis
IDLTGNTEELRLVRLH

SEQ ID NO: 159143 - protein, 16 aa, Mycobacterium tuberculosis
DLTGNTEELRLVRLHL

SEQ ID NO: 159144 - protein, 16 aa, Mycobacterium tuberculosis
LTGNTEELRLVRLHLL

SEQ ID NO: 159145 - protein, 16 aa, Mycobacterium tuberculosis
TGNTEELRLVRLHLLH

SEQ ID NO: 159146 - protein, 16 aa, Mycobacterium tuberculosis
GNTEELRLVRLHLLHL

SEQ ID NO: 159147 - protein, 16 aa, Mycobacterium tuberculosis
NTEELRLVRLHLLHLL

SEQ ID NO: 159148 - protein, 16 aa, Mycobacterium tuberculosis
TEELRLVRLHLLHLLQ

SEQ ID NO: 159149 - protein, 16 aa, Mycobacterium tuberculosis
EELRLVRLHLLHLLQT

SEQ ID NO: 159150 - protein, 16 aa, Mycobacterium tuberculosis
ELRLVRLHLLHLLQTI

SEQ ID NO: 159151 - protein, 16 aa, Mycobacterium tuberculosis
LRLVRLHLLHLLQTIS

SEQ ID NO: 159152 - protein, 16 aa, Mycobacterium tuberculosis
RLVRLHLLHLLQTISP

SEQ ID NO: 159153 - protein, 16 aa, Mycobacterium tuberculosis
LVRLHLLHLLQTISPH

SEQ ID NO: 159154 - protein, 16 aa, Mycobacterium tuberculosis
VRLHLLHLLQTISPHT

SEQ ID NO: 159155 - protein, 16 aa, Mycobacterium tuberculosis
RLHLLHLLQTISPHTA

SEQ ID NO: 159156 - protein, 16 aa, Mycobacterium tuberculosis
LHLLHLLQTISPHTAE

SEQ ID NO: 159157 - protein, 16 aa, Mycobacterium tuberculosis
HLLHLLQTISPHTAEL

SEQ ID NO: 159158 - protein, 16 aa, Mycobacterium tuberculosis
LLHLLQTISPHTAELD

SEQ ID NO: 159159 - protein, 16 aa, Mycobacterium tuberculosis
LHLLQTISPHTAELDA

SEQ ID NO: 159160 - protein, 16 aa, Mycobacterium tuberculosis
HLLQTISPHTAELDAG

SEQ ID NO: 159161 - protein, 16 aa, Mycobacterium tuberculosis
LLQTISPHTAELDAGV

SEQ ID NO: 159162 - protein, 16 aa, Mycobacterium tuberculosis
LQTISPHTAELDAGVP

SEQ ID NO: 159163 - protein, 16 aa, Mycobacterium tuberculosis
QTISPHTAELDAGVPA

SEQ ID NO: 159164 - protein, 16 aa, Mycobacterium tuberculosis
TISPHTAELDAGVPAR

SEQ ID NO: 159165 - protein, 16 aa, Mycobacterium tuberculosis
ISPHTAELDAGVPARG

SEQ ID NO: 159166 - protein, 16 aa, Mycobacterium tuberculosis
SPHTAELDAGVPARGL

SEQ ID NO: 159167 - protein, 16 aa, Mycobacterium tuberculosis
PHTAELDAGVPARGLN

SEQ ID NO: 159168 - protein, 16 aa, Mycobacterium tuberculosis
HTAELDAGVPARGLNG

SEQ ID NO: 159169 - protein, 16 aa, Mycobacterium tuberculosis
TAELDAGVPARGLNGE

SEQ ID NO: 159170 - protein, 16 aa, Mycobacterium tuberculosis
AELDAGVPARGLNGEA

SEQ ID NO: 159171 - protein, 16 aa, Mycobacterium tuberculosis
ELDAGVPARGLNGEAY

SEQ ID NO: 159172 - protein, 16 aa, Mycobacterium tuberculosis
LDAGVPARGLNGEAYR

SEQ ID NO: 159173 - protein, 16 aa, Mycobacterium tuberculosis
DAGVPARGLNGEAYRG

SEQ ID NO: 159174 - protein, 16 aa, Mycobacterium tuberculosis
AGVPARGLNGEAYRGH

SEQ ID NO: 159175 - protein, 16 aa, Mycobacterium tuberculosis
GVPARGLNGEAYRGHV

SEQ ID NO: 159176 - protein, 16 aa, Mycobacterium tuberculosis
VPARGLNGEAYRGHVF

SEQ ID NO: 159177 - protein, 16 aa, Mycobacterium tuberculosis
PARGLNGEAYRGHVFW

SEQ ID NO: 159178 - protein, 16 aa, Mycobacterium tuberculosis
ARGLNGEAYRGHVFWD

SEQ ID NO: 159179 - protein, 16 aa, Mycobacterium tuberculosis
RGLNGEAYRGHVFWDA

SEQ ID NO: 159180 - protein, 16 aa, Mycobacterium tuberculosis
GLNGEAYRGHVFWDAL

SEQ ID NO: 159181 - protein, 16 aa, Mycobacterium tuberculosis
LNGEAYRGHVFWDALF

SEQ ID NO: 159182 - protein, 16 aa, Mycobacterium tuberculosis
NGEAYRGHVFWDALFV

SEQ ID NO: 159183 - protein, 16 aa, Mycobacterium tuberculosis
GEAYRGHVFWDALFVA

SEQ ID NO: 159184 - protein, 16 aa, Mycobacterium tuberculosis
EAYRGHVFWDALFVAP

SEQ ID NO: 159185 - protein, 16 aa, Mycobacterium tuberculosis
AYRGHVFWDALFVAPV

SEQ ID NO: 159186 - protein, 16 aa, Mycobacterium tuberculosis
YRGHVFWDALFVAPVL

SEQ ID NO: 159187 - protein, 16 aa, Mycobacterium tuberculosis
RGHVFWDALFVAPVLS

SEQ ID NO: 159188 - protein, 16 aa, Mycobacterium tuberculosis
GHVFWDALFVAPVLSL

SEQ ID NO: 159189 - protein, 16 aa, Mycobacterium tuberculosis
HVFWDALFVAPVLSLR

SEQ ID NO: 159190 - protein, 16 aa, Mycobacterium tuberculosis
VFWDALFVAPVLSLRM

SEQ ID NO: 159191 - protein, 16 aa, Mycobacterium tuberculosis
FWDALFVAPVLSLRMP

SEQ ID NO: 159192 - protein, 16 aa, Mycobacterium tuberculosis
WDALFVAPVLSLRMPK

SEQ ID NO: 159193 - protein, 16 aa, Mycobacterium tuberculosis
DALFVAPVLSLRMPKV

SEQ ID NO: 159194 - protein, 16 aa, Mycobacterium tuberculosis
ALFVAPVLSLRMPKVA

SEQ ID NO: 159195 - protein, 16 aa, Mycobacterium tuberculosis
LFVAPVLSLRMPKVAR

SEQ ID NO: 159196 - protein, 16 aa, Mycobacterium tuberculosis
FVAPVLSLRMPKVARS

SEQ ID NO: 159197 - protein, 16 aa, Mycobacterium tuberculosis
VAPVLSLRMPKVARSL

SEQ ID NO: 159198 - protein, 16 aa, Mycobacterium tuberculosis
APVLSLRMPKVARSLL

SEQ ID NO: 159199 - protein, 16 aa, Mycobacterium tuberculosis
PVLSLRMPKVARSLLD

SEQ ID NO: 159200 - protein, 16 aa, Mycobacterium tuberculosis
VLSLRMPKVARSLLDY

SEQ ID NO: 159201 - protein, 16 aa, Mycobacterium tuberculosis
LSLRMPKVARSLLDYR

SEQ ID NO: 159202 - protein, 16 aa, Mycobacterium tuberculosis
SLRMPKVARSLLDYRY

SEQ ID NO: 159203 - protein, 16 aa, Mycobacterium tuberculosis
LRMPKVARSLLDYRYR

SEQ ID NO: 159204 - protein, 16 aa, Mycobacterium tuberculosis
RMPKVARSLLDYRYRR

SEQ ID NO: 159205 - protein, 16 aa, Mycobacterium tuberculosis
MPKVARSLLDYRYRRL

SEQ ID NO: 159206 - protein, 16 aa, Mycobacterium tuberculosis
PKVARSLLDYRYRRLP

SEQ ID NO: 159207 - protein, 16 aa, Mycobacterium tuberculosis
KVARSLLDYRYRRLPA

SEQ ID NO: 159208 - protein, 16 aa, Mycobacterium tuberculosis
VARSLLDYRYRRLPAA

SEQ ID NO: 159209 - protein, 16 aa, Mycobacterium tuberculosis
ARSLLDYRYRRLPAAR

SEQ ID NO: 159210 - protein, 16 aa, Mycobacterium tuberculosis
RSLLDYRYRRLPAARR

SEQ ID NO: 159211 - protein, 16 aa, Mycobacterium tuberculosis
SLLDYRYRRLPAARRA

SEQ ID NO: 159212 - protein, 16 aa, Mycobacterium tuberculosis
LLDYRYRRLPAARRAA

SEQ ID NO: 159213 - protein, 16 aa, Mycobacterium tuberculosis
LDYRYRRLPAARRAAH

SEQ ID NO: 159214 - protein, 16 aa, Mycobacterium tuberculosis
DYRYRRLPAARRAAHR

SEQ ID NO: 159215 - protein, 16 aa, Mycobacterium tuberculosis
YRYRRLPAARRAAHRA

SEQ ID NO: 159216 - protein, 16 aa, Mycobacterium tuberculosis
RYRRLPAARRAAHRAG

SEQ ID NO: 159217 - protein, 16 aa, Mycobacterium tuberculosis
YRRLPAARRAAHRAGH

SEQ ID NO: 159218 - protein, 16 aa, Mycobacterium tuberculosis
RRLPAARRAAHRAGHL

SEQ ID NO: 159219 - protein, 16 aa, Mycobacterium tuberculosis
RLPAARRAAHRAGHLG

SEQ ID NO: 159220 - protein, 16 aa, Mycobacterium tuberculosis
LPAARRAAHRAGHLGA

SEQ ID NO: 159221 - protein, 16 aa, Mycobacterium tuberculosis
PAARRAAHRAGHLGAM

SEQ ID NO: 159222 - protein, 16 aa, Mycobacterium tuberculosis
AARRAAHRAGHLGAMY

SEQ ID NO: 159223 - protein, 16 aa, Mycobacterium tuberculosis
ARRAAHRAGHLGAMYP

SEQ ID NO: 159224 - protein, 16 aa, Mycobacterium tuberculosis
RRAAHRAGHLGAMYPW

SEQ ID NO: 159225 - protein, 16 aa, Mycobacterium tuberculosis
RAAHRAGHLGAMYPWQ

SEQ ID NO: 159226 - protein, 16 aa, Mycobacterium tuberculosis
AAHRAGHLGAMYPWQS

SEQ ID NO: 159227 - protein, 16 aa, Mycobacterium tuberculosis
AHRAGHLGAMYPWQSG

SEQ ID NO: 159228 - protein, 16 aa, Mycobacterium tuberculosis
HRAGHLGAMYPWQSGS

SEQ ID NO: 159229 - protein, 16 aa, Mycobacterium tuberculosis
RAGHLGAMYPWQSGSD

SEQ ID NO: 159230 - protein, 16 aa, Mycobacterium tuberculosis
AGHLGAMYPWQSGSDG

SEQ ID NO: 159231 - protein, 16 aa, Mycobacterium tuberculosis
GHLGAMYPWQSGSDGS

SEQ ID NO: 159232 - protein, 16 aa, Mycobacterium tuberculosis
HLGAMYPWQSGSDGSE

SEQ ID NO: 159233 - protein, 16 aa, Mycobacterium tuberculosis
LGAMYPWQSGSDGSEV

SEQ ID NO: 159234 - protein, 16 aa, Mycobacterium tuberculosis
GAMYPWQSGSDGSEVS

SEQ ID NO: 159235 - protein, 16 aa, Mycobacterium tuberculosis
AMYPWQSGSDGSEVSQ

SEQ ID NO: 159236 - protein, 16 aa, Mycobacterium tuberculosis
MYPWQSGSDGSEVSQQ

SEQ ID NO: 159237 - protein, 16 aa, Mycobacterium tuberculosis
YPWQSGSDGSEVSQQL

SEQ ID NO: 159238 - protein, 16 aa, Mycobacterium tuberculosis
PWQSGSDGSEVSQQLH

SEQ ID NO: 159239 - protein, 16 aa, Mycobacterium tuberculosis
WQSGSDGSEVSQQLHL

SEQ ID NO: 159240 - protein, 16 aa, Mycobacterium tuberculosis
QSGSDGSEVSQQLHLN

SEQ ID NO: 159241 - protein, 16 aa, Mycobacterium tuberculosis
SGSDGSEVSQQLHLNP

SEQ ID NO: 159242 - protein, 16 aa, Mycobacterium tuberculosis
GSDGSEVSQQLHLNPR

SEQ ID NO: 159243 - protein, 16 aa, Mycobacterium tuberculosis
SDGSEVSQQLHLNPRS

SEQ ID NO: 159244 - protein, 16 aa, Mycobacterium tuberculosis
DGSEVSQQLHLNPRSG

SEQ ID NO: 159245 - protein, 16 aa, Mycobacterium tuberculosis
GSEVSQQLHLNPRSGR

SEQ ID NO: 159246 - protein, 16 aa, Mycobacterium tuberculosis
SEVSQQLHLNPRSGRW

SEQ ID NO: 159247 - protein, 16 aa, Mycobacterium tuberculosis
EVSQQLHLNPRSGRWT

SEQ ID NO: 159248 - protein, 16 aa, Mycobacterium tuberculosis
VSQQLHLNPRSGRWTP

SEQ ID NO: 159249 - protein, 16 aa, Mycobacterium tuberculosis
SQQLHLNPRSGRWTPD

SEQ ID NO: 159250 - protein, 16 aa, Mycobacterium tuberculosis
QQLHLNPRSGRWTPDP

SEQ ID NO: 159251 - protein, 16 aa, Mycobacterium tuberculosis
QLHLNPRSGRWTPDPS

SEQ ID NO: 159252 - protein, 16 aa, Mycobacterium tuberculosis
LHLNPRSGRWTPDPSD

SEQ ID NO: 159253 - protein, 16 aa, Mycobacterium tuberculosis
HLNPRSGRWTPDPSDR

SEQ ID NO: 159254 - protein, 16 aa, Mycobacterium tuberculosis
LNPRSGRWTPDPSDRA

SEQ ID NO: 159255 - protein, 16 aa, Mycobacterium tuberculosis
NPRSGRWTPDPSDRAH

SEQ ID NO: 159256 - protein, 16 aa, Mycobacterium tuberculosis
PRSGRWTPDPSDRAHH

SEQ ID NO: 159257 - protein, 16 aa, Mycobacterium tuberculosis
RSGRWTPDPSDRAHHV

SEQ ID NO: 159258 - protein, 16 aa, Mycobacterium tuberculosis
SGRWTPDPSDRAHHVG

SEQ ID NO: 159259 - protein, 16 aa, Mycobacterium tuberculosis
GRWTPDPSDRAHHVGL

SEQ ID NO: 159260 - protein, 16 aa, Mycobacterium tuberculosis
RWTPDPSDRAHHVGLA

SEQ ID NO: 159261 - protein, 16 aa, Mycobacterium tuberculosis
WTPDPSDRAHHVGLAV

SEQ ID NO: 159262 - protein, 16 aa, Mycobacterium tuberculosis
TPDPSDRAHHVGLAVA

SEQ ID NO: 159263 - protein, 16 aa, Mycobacterium tuberculosis
PDPSDRAHHVGLAVAY

SEQ ID NO: 159264 - protein, 16 aa, Mycobacterium tuberculosis
DPSDRAHHVGLAVAYN

SEQ ID NO: 159265 - protein, 16 aa, Mycobacterium tuberculosis
PSDRAHHVGLAVAYNA

SEQ ID NO: 159266 - protein, 16 aa, Mycobacterium tuberculosis
SDRAHHVGLAVAYNAW

SEQ ID NO: 159267 - protein, 16 aa, Mycobacterium tuberculosis
DRAHHVGLAVAYNAWH

SEQ ID NO: 159268 - protein, 16 aa, Mycobacterium tuberculosis
RAHHVGLAVAYNAWHY

SEQ ID NO: 159269 - protein, 16 aa, Mycobacterium tuberculosis
AHHVGLAVAYNAWHYY

SEQ ID NO: 159270 - protein, 16 aa, Mycobacterium tuberculosis
HHVGLAVAYNAWHYYQ

SEQ ID NO: 159271 - protein, 16 aa, Mycobacterium tuberculosis
HVGLAVAYNAWHYYQV

SEQ ID NO: 159272 - protein, 16 aa, Mycobacterium tuberculosis
VGLAVAYNAWHYYQVT

SEQ ID NO: 159273 - protein, 16 aa, Mycobacterium tuberculosis
GLAVAYNAWHYYQVTG

SEQ ID NO: 159274 - protein, 16 aa, Mycobacterium tuberculosis
LAVAYNAWHYYQVTGD

SEQ ID NO: 159275 - protein, 16 aa, Mycobacterium tuberculosis
AVAYNAWHYYQVTGDR

SEQ ID NO: 159276 - protein, 16 aa, Mycobacterium tuberculosis
VAYNAWHYYQVTGDRQ

SEQ ID NO: 159277 - protein, 16 aa, Mycobacterium tuberculosis
AYNAWHYYQVTGDRQY

SEQ ID NO: 159278 - protein, 16 aa, Mycobacterium tuberculosis
YNAWHYYQVTGDRQYL

SEQ ID NO: 159279 - protein, 16 aa, Mycobacterium tuberculosis
NAWHYYQVTGDRQYLV

SEQ ID NO: 159280 - protein, 16 aa, Mycobacterium tuberculosis
AWHYYQVTGDRQYLVD

SEQ ID NO: 159281 - protein, 16 aa, Mycobacterium tuberculosis
WHYYQVTGDRQYLVDC

SEQ ID NO: 159282 - protein, 16 aa, Mycobacterium tuberculosis
HYYQVTGDRQYLVDCG

SEQ ID NO: 159283 - protein, 16 aa, Mycobacterium tuberculosis
YYQVTGDRQYLVDCGA

SEQ ID NO: 159284 - protein, 16 aa, Mycobacterium tuberculosis
YQVTGDRQYLVDCGAE

SEQ ID NO: 159285 - protein, 16 aa, Mycobacterium tuberculosis
QVTGDRQYLVDCGAEL

SEQ ID NO: 159286 - protein, 16 aa, Mycobacterium tuberculosis
VTGDRQYLVDCGAELL

SEQ ID NO: 159287 - protein, 16 aa, Mycobacterium tuberculosis
TGDRQYLVDCGAELLV

SEQ ID NO: 159288 - protein, 16 aa, Mycobacterium tuberculosis
GDRQYLVDCGAELLVE

SEQ ID NO: 159289 - protein, 16 aa, Mycobacterium tuberculosis
DRQYLVDCGAELLVEI

SEQ ID NO: 159290 - protein, 16 aa, Mycobacterium tuberculosis
RQYLVDCGAELLVEIA

SEQ ID NO: 159291 - protein, 16 aa, Mycobacterium tuberculosis
QYLVDCGAELLVEIAR

SEQ ID NO: 159292 - protein, 16 aa, Mycobacterium tuberculosis
YLVDCGAELLVEIARF

SEQ ID NO: 159293 - protein, 16 aa, Mycobacterium tuberculosis
LVDCGAELLVEIARFW

SEQ ID NO: 159294 - protein, 16 aa, Mycobacterium tuberculosis
VDCGAELLVEIARFWV

SEQ ID NO: 159295 - protein, 16 aa, Mycobacterium tuberculosis
DCGAELLVEIARFWVG

SEQ ID NO: 159296 - protein, 16 aa, Mycobacterium tuberculosis
CGAELLVEIARFWVGL

SEQ ID NO: 159297 - protein, 16 aa, Mycobacterium tuberculosis
GAELLVEIARFWVGLA

SEQ ID NO: 159298 - protein, 16 aa, Mycobacterium tuberculosis
AELLVEIARFWVGLAK

SEQ ID NO: 159299 - protein, 16 aa, Mycobacterium tuberculosis
ELLVEIARFWVGLAKL

SEQ ID NO: 159300 - protein, 16 aa, Mycobacterium tuberculosis
LLVEIARFWVGLAKLD

SEQ ID NO: 159301 - protein, 16 aa, Mycobacterium tuberculosis
LVEIARFWVGLAKLDD

SEQ ID NO: 159302 - protein, 16 aa, Mycobacterium tuberculosis
VEIARFWVGLAKLDDS

SEQ ID NO: 159303 - protein, 16 aa, Mycobacterium tuberculosis
EIARFWVGLAKLDDSR

SEQ ID NO: 159304 - protein, 16 aa, Mycobacterium tuberculosis
IARFWVGLAKLDDSRG

SEQ ID NO: 159305 - protein, 16 aa, Mycobacterium tuberculosis
ARFWVGLAKLDDSRGR

SEQ ID NO: 159306 - protein, 16 aa, Mycobacterium tuberculosis
RFWVGLAKLDDSRGRY

SEQ ID NO: 159307 - protein, 16 aa, Mycobacterium tuberculosis
FWVGLAKLDDSRGRYL

SEQ ID NO: 159308 - protein, 16 aa, Mycobacterium tuberculosis
WVGLAKLDDSRGRYLI

SEQ ID NO: 159309 - protein, 16 aa, Mycobacterium tuberculosis
VGLAKLDDSRGRYLIR

SEQ ID NO: 159310 - protein, 16 aa, Mycobacterium tuberculosis
GLAKLDDSRGRYLIRG

SEQ ID NO: 159311 - protein, 16 aa, Mycobacterium tuberculosis
LAKLDDSRGRYLIRGV

SEQ ID NO: 159312 - protein, 16 aa, Mycobacterium tuberculosis
AKLDDSRGRYLIRGVI

SEQ ID NO: 159313 - protein, 16 aa, Mycobacterium tuberculosis
KLDDSRGRYLIRGVIG

SEQ ID NO: 159314 - protein, 16 aa, Mycobacterium tuberculosis
LDDSRGRYLIRGVIGP

SEQ ID NO: 159315 - protein, 16 aa, Mycobacterium tuberculosis
DDSRGRYLIRGVIGPD

SEQ ID NO: 159316 - protein, 16 aa, Mycobacterium tuberculosis
DSRGRYLIRGVIGPDE

SEQ ID NO: 159317 - protein, 16 aa, Mycobacterium tuberculosis
SRGRYLIRGVIGPDEF

SEQ ID NO: 159318 - protein, 16 aa, Mycobacterium tuberculosis
RGRYLIRGVIGPDEFH

SEQ ID NO: 159319 - protein, 16 aa, Mycobacterium tuberculosis
GRYLIRGVIGPDEFHS

SEQ ID NO: 159320 - protein, 16 aa, Mycobacterium tuberculosis
RYLIRGVIGPDEFHSG

SEQ ID NO: 159321 - protein, 16 aa, Mycobacterium tuberculosis
YLIRGVIGPDEFHSGY

SEQ ID NO: 159322 - protein, 16 aa, Mycobacterium tuberculosis
LIRGVIGPDEFHSGYP

SEQ ID NO: 159323 - protein, 16 aa, Mycobacterium tuberculosis
IRGVIGPDEFHSGYPG

SEQ ID NO: 159324 - protein, 16 aa, Mycobacterium tuberculosis
RGVIGPDEFHSGYPGN

SEQ ID NO: 159325 - protein, 16 aa, Mycobacterium tuberculosis
GVIGPDEFHSGYPGNE

SEQ ID NO: 159326 - protein, 16 aa, Mycobacterium tuberculosis
VIGPDEFHSGYPGNEY

SEQ ID NO: 159327 - protein, 16 aa, Mycobacterium tuberculosis
IGPDEFHSGYPGNEYD

SEQ ID NO: 159328 - protein, 16 aa, Mycobacterium tuberculosis
GPDEFHSGYPGNEYDG

SEQ ID NO: 159329 - protein, 16 aa, Mycobacterium tuberculosis
PDEFHSGYPGNEYDGI

SEQ ID NO: 159330 - protein, 16 aa, Mycobacterium tuberculosis
DEFHSGYPGNEYDGID

SEQ ID NO: 159331 - protein, 16 aa, Mycobacterium tuberculosis
EFHSGYPGNEYDGIDN

SEQ ID NO: 159332 - protein, 16 aa, Mycobacterium tuberculosis
FHSGYPGNEYDGIDNN

SEQ ID NO: 159333 - protein, 16 aa, Mycobacterium tuberculosis
HSGYPGNEYDGIDNNA

SEQ ID NO: 159334 - protein, 16 aa, Mycobacterium tuberculosis
SGYPGNEYDGIDNNAY

SEQ ID NO: 159335 - protein, 16 aa, Mycobacterium tuberculosis
GYPGNEYDGIDNNAYT

SEQ ID NO: 159336 - protein, 16 aa, Mycobacterium tuberculosis
YPGNEYDGIDNNAYTN

SEQ ID NO: 159337 - protein, 16 aa, Mycobacterium tuberculosis
PGNEYDGIDNNAYTNV

SEQ ID NO: 159338 - protein, 16 aa, Mycobacterium tuberculosis
GNEYDGIDNNAYTNVM

SEQ ID NO: 159339 - protein, 16 aa, Mycobacterium tuberculosis
NEYDGIDNNAYTNVMA

SEQ ID NO: 159340 - protein, 16 aa, Mycobacterium tuberculosis
EYDGIDNNAYTNVMAV

SEQ ID NO: 159341 - protein, 16 aa, Mycobacterium tuberculosis
YDGIDNNAYTNVMAVW

SEQ ID NO: 159342 - protein, 16 aa, Mycobacterium tuberculosis
DGIDNNAYTNVMAVWV

SEQ ID NO: 159343 - protein, 16 aa, Mycobacterium tuberculosis
GIDNNAYTNVMAVWVI

SEQ ID NO: 159344 - protein, 16 aa, Mycobacterium tuberculosis
IDNNAYTNVMAVWVIL

SEQ ID NO: 159345 - protein, 16 aa, Mycobacterium tuberculosis
DNNAYTNVMAVWVILR

SEQ ID NO: 159346 - protein, 16 aa, Mycobacterium tuberculosis
NNAYTNVMAVWVILRA

SEQ ID NO: 159347 - protein, 16 aa, Mycobacterium tuberculosis
NAYTNVMAVWVILRAM

SEQ ID NO: 159348 - protein, 16 aa, Mycobacterium tuberculosis
AYTNVMAVWVILRAME

SEQ ID NO: 159349 - protein, 16 aa, Mycobacterium tuberculosis
YTNVMAVWVILRAMEA

SEQ ID NO: 159350 - protein, 16 aa, Mycobacterium tuberculosis
TNVMAVWVILRAMEAL

SEQ ID NO: 159351 - protein, 16 aa, Mycobacterium tuberculosis
NVMAVWVILRAMEALD

SEQ ID NO: 159352 - protein, 16 aa, Mycobacterium tuberculosis
VMAVWVILRAMEALDL

SEQ ID NO: 159353 - protein, 16 aa, Mycobacterium tuberculosis
MAVWVILRAMEALDLL

SEQ ID NO: 159354 - protein, 16 aa, Mycobacterium tuberculosis
AVWVILRAMEALDLLP

SEQ ID NO: 159355 - protein, 16 aa, Mycobacterium tuberculosis
VWVILRAMEALDLLPL

SEQ ID NO: 159356 - protein, 16 aa, Mycobacterium tuberculosis
WVILRAMEALDLLPLT

SEQ ID NO: 159357 - protein, 16 aa, Mycobacterium tuberculosis
VILRAMEALDLLPLTD

SEQ ID NO: 159358 - protein, 16 aa, Mycobacterium tuberculosis
ILRAMEALDLLPLTDR

SEQ ID NO: 159359 - protein, 16 aa, Mycobacterium tuberculosis
LRAMEALDLLPLTDRR

SEQ ID NO: 159360 - protein, 16 aa, Mycobacterium tuberculosis
RAMEALDLLPLTDRRH

SEQ ID NO: 159361 - protein, 16 aa, Mycobacterium tuberculosis
AMEALDLLPLTDRRHL

SEQ ID NO: 159362 - protein, 16 aa, Mycobacterium tuberculosis
MEALDLLPLTDRRHLI

SEQ ID NO: 159363 - protein, 16 aa, Mycobacterium tuberculosis
EALDLLPLTDRRHLIE

SEQ ID NO: 159364 - protein, 16 aa, Mycobacterium tuberculosis
ALDLLPLTDRRHLIEK

SEQ ID NO: 159365 - protein, 16 aa, Mycobacterium tuberculosis
LDLLPLTDRRHLIEKL

SEQ ID NO: 159366 - protein, 16 aa, Mycobacterium tuberculosis
DLLPLTDRRHLIEKLG

SEQ ID NO: 159367 - protein, 16 aa, Mycobacterium tuberculosis
LLPLTDRRHLIEKLGL

SEQ ID NO: 159368 - protein, 16 aa, Mycobacterium tuberculosis
LPLTDRRHLIEKLGLT

SEQ ID NO: 159369 - protein, 16 aa, Mycobacterium tuberculosis
PLTDRRHLIEKLGLTT

SEQ ID NO: 159370 - protein, 16 aa, Mycobacterium tuberculosis
LTDRRHLIEKLGLTTQ

SEQ ID NO: 159371 - protein, 16 aa, Mycobacterium tuberculosis
TDRRHLIEKLGLTTQE

SEQ ID NO: 159372 - protein, 16 aa, Mycobacterium tuberculosis
DRRHLIEKLGLTTQER

SEQ ID NO: 159373 - protein, 16 aa, Mycobacterium tuberculosis
RRHLIEKLGLTTQERD

SEQ ID NO: 159374 - protein, 16 aa, Mycobacterium tuberculosis
RHLIEKLGLTTQERDQ

SEQ ID NO: 159375 - protein, 16 aa, Mycobacterium tuberculosis
HLIEKLGLTTQERDQW

SEQ ID NO: 159376 - protein, 16 aa, Mycobacterium tuberculosis
LIEKLGLTTQERDQWD

SEQ ID NO: 159377 - protein, 16 aa, Mycobacterium tuberculosis
IEKLGLTTQERDQWDD

SEQ ID NO: 159378 - protein, 16 aa, Mycobacterium tuberculosis
EKLGLTTQERDQWDDV

SEQ ID NO: 159379 - protein, 16 aa, Mycobacterium tuberculosis
KLGLTTQERDQWDDVS

SEQ ID NO: 159380 - protein, 16 aa, Mycobacterium tuberculosis
LGLTTQERDQWDDVSR

SEQ ID NO: 159381 - protein, 16 aa, Mycobacterium tuberculosis
GLTTQERDQWDDVSRR

SEQ ID NO: 159382 - protein, 16 aa, Mycobacterium tuberculosis
LTTQERDQWDDVSRRM

SEQ ID NO: 159383 - protein, 16 aa, Mycobacterium tuberculosis
TTQERDQWDDVSRRMF

SEQ ID NO: 159384 - protein, 16 aa, Mycobacterium tuberculosis
TQERDQWDDVSRRMFV

SEQ ID NO: 159385 - protein, 16 aa, Mycobacterium tuberculosis
QERDQWDDVSRRMFVP

SEQ ID NO: 159386 - protein, 16 aa, Mycobacterium tuberculosis
ERDQWDDVSRRMFVPF

SEQ ID NO: 159387 - protein, 16 aa, Mycobacterium tuberculosis
RDQWDDVSRRMFVPFH

SEQ ID NO: 159388 - protein, 16 aa, Mycobacterium tuberculosis
DQWDDVSRRMFVPFHD

SEQ ID NO: 159389 - protein, 16 aa, Mycobacterium tuberculosis
QWDDVSRRMFVPFHDG

SEQ ID NO: 159390 - protein, 16 aa, Mycobacterium tuberculosis
WDDVSRRMFVPFHDGV

SEQ ID NO: 159391 - protein, 16 aa, Mycobacterium tuberculosis
DDVSRRMFVPFHDGVI

SEQ ID NO: 159392 - protein, 16 aa, Mycobacterium tuberculosis
DVSRRMFVPFHDGVIS

SEQ ID NO: 159393 - protein, 16 aa, Mycobacterium tuberculosis
VSRRMFVPFHDGVISQ

SEQ ID NO: 159394 - protein, 16 aa, Mycobacterium tuberculosis
SRRMFVPFHDGVISQF

SEQ ID NO: 159395 - protein, 16 aa, Mycobacterium tuberculosis
RRMFVPFHDGVISQFE

SEQ ID NO: 159396 - protein, 16 aa, Mycobacterium tuberculosis
RMFVPFHDGVISQFEG

SEQ ID NO: 159397 - protein, 16 aa, Mycobacterium tuberculosis
MFVPFHDGVISQFEGY

SEQ ID NO: 159398 - protein, 16 aa, Mycobacterium tuberculosis
FVPFHDGVISQFEGYS

SEQ ID NO: 159399 - protein, 16 aa, Mycobacterium tuberculosis
VPFHDGVISQFEGYSE

SEQ ID NO: 159400 - protein, 16 aa, Mycobacterium tuberculosis
PFHDGVISQFEGYSEL

SEQ ID NO: 159401 - protein, 16 aa, Mycobacterium tuberculosis
FHDGVISQFEGYSELA

SEQ ID NO: 159402 - protein, 16 aa, Mycobacterium tuberculosis
HDGVISQFEGYSELAE

SEQ ID NO: 159403 - protein, 16 aa, Mycobacterium tuberculosis
DGVISQFEGYSELAEL

SEQ ID NO: 159404 - protein, 16 aa, Mycobacterium tuberculosis
GVISQFEGYSELAELD

SEQ ID NO: 159405 - protein, 16 aa, Mycobacterium tuberculosis
VISQFEGYSELAELDW

SEQ ID NO: 159406 - protein, 16 aa, Mycobacterium tuberculosis
ISQFEGYSELAELDWD

SEQ ID NO: 159407 - protein, 16 aa, Mycobacterium tuberculosis
SQFEGYSELAELDWDH

SEQ ID NO: 159408 - protein, 16 aa, Mycobacterium tuberculosis
QFEGYSELAELDWDHY

SEQ ID NO: 159409 - protein, 16 aa, Mycobacterium tuberculosis
FEGYSELAELDWDHYR

SEQ ID NO: 159410 - protein, 16 aa, Mycobacterium tuberculosis
EGYSELAELDWDHYRH

SEQ ID NO: 159411 - protein, 16 aa, Mycobacterium tuberculosis
GYSELAELDWDHYRHR

SEQ ID NO: 159412 - protein, 16 aa, Mycobacterium tuberculosis
YSELAELDWDHYRHRY

SEQ ID NO: 159413 - protein, 16 aa, Mycobacterium tuberculosis
SELAELDWDHYRHRYG

SEQ ID NO: 159414 - protein, 16 aa, Mycobacterium tuberculosis
ELAELDWDHYRHRYGN

SEQ ID NO: 159415 - protein, 16 aa, Mycobacterium tuberculosis
LAELDWDHYRHRYGNI

SEQ ID NO: 159416 - protein, 16 aa, Mycobacterium tuberculosis
AELDWDHYRHRYGNIQ

SEQ ID NO: 159417 - protein, 16 aa, Mycobacterium tuberculosis
ELDWDHYRHRYGNIQR

SEQ ID NO: 159418 - protein, 16 aa, Mycobacterium tuberculosis
LDWDHYRHRYGNIQRL

SEQ ID NO: 159419 - protein, 16 aa, Mycobacterium tuberculosis
DWDHYRHRYGNIQRLD

SEQ ID NO: 159420 - protein, 16 aa, Mycobacterium tuberculosis
WDHYRHRYGNIQRLDR

SEQ ID NO: 159421 - protein, 16 aa, Mycobacterium tuberculosis
DHYRHRYGNIQRLDRI

SEQ ID NO: 159422 - protein, 16 aa, Mycobacterium tuberculosis
HYRHRYGNIQRLDRIL

SEQ ID NO: 159423 - protein, 16 aa, Mycobacterium tuberculosis
YRHRYGNIQRLDRILE

SEQ ID NO: 159424 - protein, 16 aa, Mycobacterium tuberculosis
RHRYGNIQRLDRILEA

SEQ ID NO: 159425 - protein, 16 aa, Mycobacterium tuberculosis
HRYGNIQRLDRILEAE

SEQ ID NO: 159426 - protein, 16 aa, Mycobacterium tuberculosis
RYGNIQRLDRILEAEG

SEQ ID NO: 159427 - protein, 16 aa, Mycobacterium tuberculosis
YGNIQRLDRILEAEGD

SEQ ID NO: 159428 - protein, 16 aa, Mycobacterium tuberculosis
GNIQRLDRILEAEGDS

SEQ ID NO: 159429 - protein, 16 aa, Mycobacterium tuberculosis
NIQRLDRILEAEGDSV

SEQ ID NO: 159430 - protein, 16 aa, Mycobacterium tuberculosis
IQRLDRILEAEGDSVN

SEQ ID NO: 159431 - protein, 16 aa, Mycobacterium tuberculosis
QRLDRILEAEGDSVNN

SEQ ID NO: 159432 - protein, 16 aa, Mycobacterium tuberculosis
RLDRILEAEGDSVNNY

SEQ ID NO: 159433 - protein, 16 aa, Mycobacterium tuberculosis
LDRILEAEGDSVNNYQ

SEQ ID NO: 159434 - protein, 16 aa, Mycobacterium tuberculosis
DRILEAEGDSVNNYQA

SEQ ID NO: 159435 - protein, 16 aa, Mycobacterium tuberculosis
RILEAEGDSVNNYQAS

SEQ ID NO: 159436 - protein, 16 aa, Mycobacterium tuberculosis
ILEAEGDSVNNYQASK

SEQ ID NO: 159437 - protein, 16 aa, Mycobacterium tuberculosis
LEAEGDSVNNYQASKQ

SEQ ID NO: 159438 - protein, 16 aa, Mycobacterium tuberculosis
EAEGDSVNNYQASKQA

SEQ ID NO: 159439 - protein, 16 aa, Mycobacterium tuberculosis
AEGDSVNNYQASKQAD

SEQ ID NO: 159440 - protein, 16 aa, Mycobacterium tuberculosis
EGDSVNNYQASKQADA

SEQ ID NO: 159441 - protein, 16 aa, Mycobacterium tuberculosis
GDSVNNYQASKQADAL

SEQ ID NO: 159442 - protein, 16 aa, Mycobacterium tuberculosis
DSVNNYQASKQADALM

SEQ ID NO: 159443 - protein, 16 aa, Mycobacterium tuberculosis
SVNNYQASKQADALML

SEQ ID NO: 159444 - protein, 16 aa, Mycobacterium tuberculosis
VNNYQASKQADALMLL

SEQ ID NO: 159445 - protein, 16 aa, Mycobacterium tuberculosis
NNYQASKQADALMLLY

SEQ ID NO: 159446 - protein, 16 aa, Mycobacterium tuberculosis
NYQASKQADALMLLYL

SEQ ID NO: 159447 - protein, 16 aa, Mycobacterium tuberculosis
YQASKQADALMLLYLL

SEQ ID NO: 159448 - protein, 16 aa, Mycobacterium tuberculosis
QASKQADALMLLYLLS

SEQ ID NO: 159449 - protein, 16 aa, Mycobacterium tuberculosis
ASKQADALMLLYLLSS

SEQ ID NO: 159450 - protein, 16 aa, Mycobacterium tuberculosis
SKQADALMLLYLLSSD

SEQ ID NO: 159451 - protein, 16 aa, Mycobacterium tuberculosis
KQADALMLLYLLSSDE

SEQ ID NO: 159452 - protein, 16 aa, Mycobacterium tuberculosis
QADALMLLYLLSSDEL

SEQ ID NO: 159453 - protein, 16 aa, Mycobacterium tuberculosis
ADALMLLYLLSSDELI

SEQ ID NO: 159454 - protein, 16 aa, Mycobacterium tuberculosis
DALMLLYLLSSDELIG

SEQ ID NO: 159455 - protein, 16 aa, Mycobacterium tuberculosis
ALMLLYLLSSDELIGL

SEQ ID NO: 159456 - protein, 16 aa, Mycobacterium tuberculosis
LMLLYLLSSDELIGLL

SEQ ID NO: 159457 - protein, 16 aa, Mycobacterium tuberculosis
MLLYLLSSDELIGLLA

SEQ ID NO: 159458 - protein, 16 aa, Mycobacterium tuberculosis
LLYLLSSDELIGLLAR

SEQ ID NO: 159459 - protein, 16 aa, Mycobacterium tuberculosis
LYLLSSDELIGLLARL

SEQ ID NO: 159460 - protein, 16 aa, Mycobacterium tuberculosis
YLLSSDELIGLLARLG

SEQ ID NO: 159461 - protein, 16 aa, Mycobacterium tuberculosis
LLSSDELIGLLARLGY

SEQ ID NO: 159462 - protein, 16 aa, Mycobacterium tuberculosis
LSSDELIGLLARLGYR

SEQ ID NO: 159463 - protein, 16 aa, Mycobacterium tuberculosis
SSDELIGLLARLGYRF

SEQ ID NO: 159464 - protein, 16 aa, Mycobacterium tuberculosis
SDELIGLLARLGYRFA

SEQ ID NO: 159465 - protein, 16 aa, Mycobacterium tuberculosis
DELIGLLARLGYRFAP

SEQ ID NO: 159466 - protein, 16 aa, Mycobacterium tuberculosis
ELIGLLARLGYRFAPT

SEQ ID NO: 159467 - protein, 16 aa, Mycobacterium tuberculosis
LIGLLARLGYRFAPTQ

SEQ ID NO: 159468 - protein, 16 aa, Mycobacterium tuberculosis
IGLLARLGYRFAPTQI

SEQ ID NO: 159469 - protein, 16 aa, Mycobacterium tuberculosis
GLLARLGYRFAPTQIP

SEQ ID NO: 159470 - protein, 16 aa, Mycobacterium tuberculosis
LLARLGYRFAPTQIPG

SEQ ID NO: 159471 - protein, 16 aa, Mycobacterium tuberculosis
LARLGYRFAPTQIPGT

SEQ ID NO: 159472 - protein, 16 aa, Mycobacterium tuberculosis
ARLGYRFAPTQIPGTV

SEQ ID NO: 159473 - protein, 16 aa, Mycobacterium tuberculosis
RLGYRFAPTQIPGTVD

SEQ ID NO: 159474 - protein, 16 aa, Mycobacterium tuberculosis
LGYRFAPTQIPGTVDY

SEQ ID NO: 159475 - protein, 16 aa, Mycobacterium tuberculosis
GYRFAPTQIPGTVDYY

SEQ ID NO: 159476 - protein, 16 aa, Mycobacterium tuberculosis
YRFAPTQIPGTVDYYL

SEQ ID NO: 159477 - protein, 16 aa, Mycobacterium tuberculosis
RFAPTQIPGTVDYYLA

SEQ ID NO: 159478 - protein, 16 aa, Mycobacterium tuberculosis
FAPTQIPGTVDYYLAR

SEQ ID NO: 159479 - protein, 16 aa, Mycobacterium tuberculosis
APTQIPGTVDYYLART

SEQ ID NO: 159480 - protein, 16 aa, Mycobacterium tuberculosis
PTQIPGTVDYYLARTS

SEQ ID NO: 159481 - protein, 16 aa, Mycobacterium tuberculosis
TQIPGTVDYYLARTSD

SEQ ID NO: 159482 - protein, 16 aa, Mycobacterium tuberculosis
QIPGTVDYYLARTSDG

SEQ ID NO: 159483 - protein, 16 aa, Mycobacterium tuberculosis
IPGTVDYYLARTSDGS

SEQ ID NO: 159484 - protein, 16 aa, Mycobacterium tuberculosis
PGTVDYYLARTSDGST

SEQ ID NO: 159485 - protein, 16 aa, Mycobacterium tuberculosis
GTVDYYLARTSDGSTL

SEQ ID NO: 159486 - protein, 16 aa, Mycobacterium tuberculosis
TVDYYLARTSDGSTLS

SEQ ID NO: 159487 - protein, 16 aa, Mycobacterium tuberculosis
VDYYLARTSDGSTLSA

SEQ ID NO: 159488 - protein, 16 aa, Mycobacterium tuberculosis
DYYLARTSDGSTLSAV

SEQ ID NO: 159489 - protein, 16 aa, Mycobacterium tuberculosis
YYLARTSDGSTLSAVV

SEQ ID NO: 159490 - protein, 16 aa, Mycobacterium tuberculosis
YLARTSDGSTLSAVVH

SEQ ID NO: 159491 - protein, 16 aa, Mycobacterium tuberculosis
LARTSDGSTLSAVVHA

SEQ ID NO: 159492 - protein, 16 aa, Mycobacterium tuberculosis
ARTSDGSTLSAVVHAW

SEQ ID NO: 159493 - protein, 16 aa, Mycobacterium tuberculosis
RTSDGSTLSAVVHAWV

SEQ ID NO: 159494 - protein, 16 aa, Mycobacterium tuberculosis
TSDGSTLSAVVHAWVL

SEQ ID NO: 159495 - protein, 16 aa, Mycobacterium tuberculosis
SDGSTLSAVVHAWVLA

SEQ ID NO: 159496 - protein, 16 aa, Mycobacterium tuberculosis
DGSTLSAVVHAWVLAR

SEQ ID NO: 159497 - protein, 16 aa, Mycobacterium tuberculosis
GSTLSAVVHAWVLARA

SEQ ID NO: 159498 - protein, 16 aa, Mycobacterium tuberculosis
STLSAVVHAWVLARAN

SEQ ID NO: 159499 - protein, 16 aa, Mycobacterium tuberculosis
TLSAVVHAWVLARANR

SEQ ID NO: 159500 - protein, 16 aa, Mycobacterium tuberculosis
LSAVVHAWVLARANRS

SEQ ID NO: 159501 - protein, 16 aa, Mycobacterium tuberculosis
SAVVHAWVLARANRSN

SEQ ID NO: 159502 - protein, 16 aa, Mycobacterium tuberculosis
AVVHAWVLARANRSNA

SEQ ID NO: 159503 - protein, 16 aa, Mycobacterium tuberculosis
VVHAWVLARANRSNAM

SEQ ID NO: 159504 - protein, 16 aa, Mycobacterium tuberculosis
VHAWVLARANRSNAME

SEQ ID NO: 159505 - protein, 16 aa, Mycobacterium tuberculosis
HAWVLARANRSNAMEY

SEQ ID NO: 159506 - protein, 16 aa, Mycobacterium tuberculosis
AWVLARANRSNAMEYF

SEQ ID NO: 159507 - protein, 16 aa, Mycobacterium tuberculosis
WVLARANRSNAMEYFR

SEQ ID NO: 159508 - protein, 16 aa, Mycobacterium tuberculosis
VLARANRSNAMEYFRQ

SEQ ID NO: 159509 - protein, 16 aa, Mycobacterium tuberculosis
LARANRSNAMEYFRQV

SEQ ID NO: 159510 - protein, 16 aa, Mycobacterium tuberculosis
ARANRSNAMEYFRQVL

SEQ ID NO: 159511 - protein, 16 aa, Mycobacterium tuberculosis
RANRSNAMEYFRQVLR

SEQ ID NO: 159512 - protein, 16 aa, Mycobacterium tuberculosis
ANRSNAMEYFRQVLRS

SEQ ID NO: 159513 - protein, 16 aa, Mycobacterium tuberculosis
NRSNAMEYFRQVLRSD

SEQ ID NO: 159514 - protein, 16 aa, Mycobacterium tuberculosis
RSNAMEYFRQVLRSDI

SEQ ID NO: 159515 - protein, 16 aa, Mycobacterium tuberculosis
SNAMEYFRQVLRSDIA

SEQ ID NO: 159516 - protein, 16 aa, Mycobacterium tuberculosis
NAMEYFRQVLRSDIAD

SEQ ID NO: 159517 - protein, 16 aa, Mycobacterium tuberculosis
AMEYFRQVLRSDIADV

SEQ ID NO: 159518 - protein, 16 aa, Mycobacterium tuberculosis
MEYFRQVLRSDIADVQ

SEQ ID NO: 159519 - protein, 16 aa, Mycobacterium tuberculosis
EYFRQVLRSDIADVQG

SEQ ID NO: 159520 - protein, 16 aa, Mycobacterium tuberculosis
YFRQVLRSDIADVQGG

SEQ ID NO: 159521 - protein, 16 aa, Mycobacterium tuberculosis
FRQVLRSDIADVQGGT

SEQ ID NO: 159522 - protein, 16 aa, Mycobacterium tuberculosis
RQVLRSDIADVQGGTT

SEQ ID NO: 159523 - protein, 16 aa, Mycobacterium tuberculosis
QVLRSDIADVQGGTTQ

SEQ ID NO: 159524 - protein, 16 aa, Mycobacterium tuberculosis
VLRSDIADVQGGTTQE

SEQ ID NO: 159525 - protein, 16 aa, Mycobacterium tuberculosis
LRSDIADVQGGTTQEG

SEQ ID NO: 159526 - protein, 16 aa, Mycobacterium tuberculosis
RSDIADVQGGTTQEGI

SEQ ID NO: 159527 - protein, 16 aa, Mycobacterium tuberculosis
SDIADVQGGTTQEGIH

SEQ ID NO: 159528 - protein, 16 aa, Mycobacterium tuberculosis
DIADVQGGTTQEGIHL

SEQ ID NO: 159529 - protein, 16 aa, Mycobacterium tuberculosis
IADVQGGTTQEGIHLA

SEQ ID NO: 159530 - protein, 16 aa, Mycobacterium tuberculosis
ADVQGGTTQEGIHLAA

SEQ ID NO: 159531 - protein, 16 aa, Mycobacterium tuberculosis
DVQGGTTQEGIHLAAM

SEQ ID NO: 159532 - protein, 16 aa, Mycobacterium tuberculosis
VQGGTTQEGIHLAAMA

SEQ ID NO: 159533 - protein, 16 aa, Mycobacterium tuberculosis
QGGTTQEGIHLAAMAG

SEQ ID NO: 159534 - protein, 16 aa, Mycobacterium tuberculosis
GGTTQEGIHLAAMAGS

SEQ ID NO: 159535 - protein, 16 aa, Mycobacterium tuberculosis
GTTQEGIHLAAMAGSI

SEQ ID NO: 159536 - protein, 16 aa, Mycobacterium tuberculosis
TTQEGIHLAAMAGSID

SEQ ID NO: 159537 - protein, 16 aa, Mycobacterium tuberculosis
TQEGIHLAAMAGSIDL

SEQ ID NO: 159538 - protein, 16 aa, Mycobacterium tuberculosis
QEGIHLAAMAGSIDLL

SEQ ID NO: 159539 - protein, 16 aa, Mycobacterium tuberculosis
EGIHLAAMAGSIDLLQ

SEQ ID NO: 159540 - protein, 16 aa, Mycobacterium tuberculosis
GIHLAAMAGSIDLLQR

SEQ ID NO: 159541 - protein, 16 aa, Mycobacterium tuberculosis
IHLAAMAGSIDLLQRC

SEQ ID NO: 159542 - protein, 16 aa, Mycobacterium tuberculosis
HLAAMAGSIDLLQRCY

SEQ ID NO: 159543 - protein, 16 aa, Mycobacterium tuberculosis
LAAMAGSIDLLQRCYS

SEQ ID NO: 159544 - protein, 16 aa, Mycobacterium tuberculosis
AAMAGSIDLLQRCYSG

SEQ ID NO: 159545 - protein, 16 aa, Mycobacterium tuberculosis
AMAGSIDLLQRCYSGL

SEQ ID NO: 159546 - protein, 16 aa, Mycobacterium tuberculosis
MAGSIDLLQRCYSGLE

SEQ ID NO: 159547 - protein, 16 aa, Mycobacterium tuberculosis
AGSIDLLQRCYSGLEL

SEQ ID NO: 159548 - protein, 16 aa, Mycobacterium tuberculosis
GSIDLLQRCYSGLELR

SEQ ID NO: 159549 - protein, 16 aa, Mycobacterium tuberculosis
SIDLLQRCYSGLELRD

SEQ ID NO: 159550 - protein, 16 aa, Mycobacterium tuberculosis
IDLLQRCYSGLELRDD

SEQ ID NO: 159551 - protein, 16 aa, Mycobacterium tuberculosis
DLLQRCYSGLELRDDR

SEQ ID NO: 159552 - protein, 16 aa, Mycobacterium tuberculosis
LLQRCYSGLELRDDRL

SEQ ID NO: 159553 - protein, 16 aa, Mycobacterium tuberculosis
LQRCYSGLELRDDRLV

SEQ ID NO: 159554 - protein, 16 aa, Mycobacterium tuberculosis
QRCYSGLELRDDRLVL

SEQ ID NO: 159555 - protein, 16 aa, Mycobacterium tuberculosis
RCYSGLELRDDRLVLS

SEQ ID NO: 159556 - protein, 16 aa, Mycobacterium tuberculosis
CYSGLELRDDRLVLSP

SEQ ID NO: 159557 - protein, 16 aa, Mycobacterium tuberculosis
YSGLELRDDRLVLSPQ

SEQ ID NO: 159558 - protein, 16 aa, Mycobacterium tuberculosis
SGLELRDDRLVLSPQW

SEQ ID NO: 159559 - protein, 16 aa, Mycobacterium tuberculosis
GLELRDDRLVLSPQWP

SEQ ID NO: 159560 - protein, 16 aa, Mycobacterium tuberculosis
LELRDDRLVLSPQWPE

SEQ ID NO: 159561 - protein, 16 aa, Mycobacterium tuberculosis
ELRDDRLVLSPQWPEA

SEQ ID NO: 159562 - protein, 16 aa, Mycobacterium tuberculosis
LRDDRLVLSPQWPEAL

SEQ ID NO: 159563 - protein, 16 aa, Mycobacterium tuberculosis
RDDRLVLSPQWPEALG

SEQ ID NO: 159564 - protein, 16 aa, Mycobacterium tuberculosis
DDRLVLSPQWPEALGP

SEQ ID NO: 159565 - protein, 16 aa, Mycobacterium tuberculosis
DRLVLSPQWPEALGPL

SEQ ID NO: 159566 - protein, 16 aa, Mycobacterium tuberculosis
RLVLSPQWPEALGPLE

SEQ ID NO: 159567 - protein, 16 aa, Mycobacterium tuberculosis
LVLSPQWPEALGPLEF

SEQ ID NO: 159568 - protein, 16 aa, Mycobacterium tuberculosis
VLSPQWPEALGPLEFP

SEQ ID NO: 159569 - protein, 16 aa, Mycobacterium tuberculosis
LSPQWPEALGPLEFPF

SEQ ID NO: 159570 - protein, 16 aa, Mycobacterium tuberculosis
SPQWPEALGPLEFPFV

SEQ ID NO: 159571 - protein, 16 aa, Mycobacterium tuberculosis
PQWPEALGPLEFPFVY

SEQ ID NO: 159572 - protein, 16 aa, Mycobacterium tuberculosis
QWPEALGPLEFPFVYR

SEQ ID NO: 159573 - protein, 16 aa, Mycobacterium tuberculosis
WPEALGPLEFPFVYRR

SEQ ID NO: 159574 - protein, 16 aa, Mycobacterium tuberculosis
PEALGPLEFPFVYRRH

SEQ ID NO: 159575 - protein, 16 aa, Mycobacterium tuberculosis
EALGPLEFPFVYRRHQ

SEQ ID NO: 159576 - protein, 16 aa, Mycobacterium tuberculosis
ALGPLEFPFVYRRHQL

SEQ ID NO: 159577 - protein, 16 aa, Mycobacterium tuberculosis
LGPLEFPFVYRRHQLS

SEQ ID NO: 159578 - protein, 16 aa, Mycobacterium tuberculosis
GPLEFPFVYRRHQLSL

SEQ ID NO: 159579 - protein, 16 aa, Mycobacterium tuberculosis
PLEFPFVYRRHQLSLR

SEQ ID NO: 159580 - protein, 16 aa, Mycobacterium tuberculosis
LEFPFVYRRHQLSLRI

SEQ ID NO: 159581 - protein, 16 aa, Mycobacterium tuberculosis
EFPFVYRRHQLSLRIS

SEQ ID NO: 159582 - protein, 16 aa, Mycobacterium tuberculosis
FPFVYRRHQLSLRISG

SEQ ID NO: 159583 - protein, 16 aa, Mycobacterium tuberculosis
PFVYRRHQLSLRISGR

SEQ ID NO: 159584 - protein, 16 aa, Mycobacterium tuberculosis
FVYRRHQLSLRISGRS

SEQ ID NO: 159585 - protein, 16 aa, Mycobacterium tuberculosis
VYRRHQLSLRISGRSA

SEQ ID NO: 159586 - protein, 16 aa, Mycobacterium tuberculosis
YRRHQLSLRISGRSAT

SEQ ID NO: 159587 - protein, 16 aa, Mycobacterium tuberculosis
RRHQLSLRISGRSATL

SEQ ID NO: 159588 - protein, 16 aa, Mycobacterium tuberculosis
RHQLSLRISGRSATLT

SEQ ID NO: 159589 - protein, 16 aa, Mycobacterium tuberculosis
HQLSLRISGRSATLTA

SEQ ID NO: 159590 - protein, 16 aa, Mycobacterium tuberculosis
QLSLRISGRSATLTAE

SEQ ID NO: 159591 - protein, 16 aa, Mycobacterium tuberculosis
LSLRISGRSATLTAES

SEQ ID NO: 159592 - protein, 16 aa, Mycobacterium tuberculosis
SLRISGRSATLTAESG

SEQ ID NO: 159593 - protein, 16 aa, Mycobacterium tuberculosis
LRISGRSATLTAESGD

SEQ ID NO: 159594 - protein, 16 aa, Mycobacterium tuberculosis
RISGRSATLTAESGDA

SEQ ID NO: 159595 - protein, 16 aa, Mycobacterium tuberculosis
ISGRSATLTAESGDAE

SEQ ID NO: 159596 - protein, 16 aa, Mycobacterium tuberculosis
SGRSATLTAESGDAEP

SEQ ID NO: 159597 - protein, 16 aa, Mycobacterium tuberculosis
GRSATLTAESGDAEPI

SEQ ID NO: 159598 - protein, 16 aa, Mycobacterium tuberculosis
RSATLTAESGDAEPIE

SEQ ID NO: 159599 - protein, 16 aa, Mycobacterium tuberculosis
SATLTAESGDAEPIEV

SEQ ID NO: 159600 - protein, 16 aa, Mycobacterium tuberculosis
ATLTAESGDAEPIEVE

SEQ ID NO: 159601 - protein, 16 aa, Mycobacterium tuberculosis
TLTAESGDAEPIEVEC

SEQ ID NO: 159602 - protein, 16 aa, Mycobacterium tuberculosis
LTAESGDAEPIEVECR

SEQ ID NO: 159603 - protein, 16 aa, Mycobacterium tuberculosis
TAESGDAEPIEVECRG

SEQ ID NO: 159604 - protein, 16 aa, Mycobacterium tuberculosis
AESGDAEPIEVECRGH

SEQ ID NO: 159605 - protein, 16 aa, Mycobacterium tuberculosis
ESGDAEPIEVECRGHV

SEQ ID NO: 159606 - protein, 16 aa, Mycobacterium tuberculosis
SGDAEPIEVECRGHVQ

SEQ ID NO: 159607 - protein, 16 aa, Mycobacterium tuberculosis
GDAEPIEVECRGHVQR

SEQ ID NO: 159608 - protein, 16 aa, Mycobacterium tuberculosis
DAEPIEVECRGHVQRL

SEQ ID NO: 159609 - protein, 16 aa, Mycobacterium tuberculosis
AEPIEVECRGHVQRLR

SEQ ID NO: 159610 - protein, 16 aa, Mycobacterium tuberculosis
EPIEVECRGHVQRLRC

SEQ ID NO: 159611 - protein, 16 aa, Mycobacterium tuberculosis
PIEVECRGHVQRLRCG

SEQ ID NO: 159612 - protein, 16 aa, Mycobacterium tuberculosis
IEVECRGHVQRLRCGH

SEQ ID NO: 159613 - protein, 16 aa, Mycobacterium tuberculosis
EVECRGHVQRLRCGHT

SEQ ID NO: 159614 - protein, 16 aa, Mycobacterium tuberculosis
VECRGHVQRLRCGHTI

SEQ ID NO: 159615 - protein, 16 aa, Mycobacterium tuberculosis
ECRGHVQRLRCGHTIE

SEQ ID NO: 159616 - protein, 16 aa, Mycobacterium tuberculosis
CRGHVQRLRCGHTIEV

SEQ ID NO: 159617 - protein, 16 aa, Mycobacterium tuberculosis
RGHVQRLRCGHTIEVG

SEQ ID NO: 159618 - protein, 16 aa, Mycobacterium tuberculosis
GHVQRLRCGHTIEVGC

SEQ ID NO: 159619 - protein, 16 aa, Mycobacterium tuberculosis
HVQRLRCGHTIEVGCS

SEQ ID NO: 159620 - protein, 16 aa, Mycobacterium tuberculosis
VQRLRCGHTIEVGCSR

SEQ ID NO: 159621 - protein, 339 aa, Mycobacterium tuberculosis
MTEPAAWDEGKPRIITLTMNPALDITTSVDVVRPTEKMRCGAPRYDPGGGGINVARIVHVLGGCSTALFPAGGSTGSLLMALLGDAGVPFRVIPIAASTRESFTVNESRTAKQYRFVLPGPSLTVAEQEQCLDELRGAAASAAFVVASGSLPPGVAADYYQRVADICRRSSTPLILDTSGGGLQHISSGVFLLKASVRELRECVGSELLTEPEQLAAAHELIDRGRAEVVVVSLGSQGALLATRHASHRFSSIPMTAVSGVGAGDAMVAAITVGLSRGWSLIKSVRLGNAAGAAMLLTPGTAACNRDDVERFFELAAEPTEVGQDQYVWHPIVNPEASP

SEQ ID NO: 159622 - protein, 8 aa, Mycobacterium tuberculosis
KPRIITLT

SEQ ID NO: 159623 - protein, 8 aa, Mycobacterium tuberculosis
ITLTMNPA

SEQ ID NO: 159624 - protein, 8 aa, Mycobacterium tuberculosis
TLTMNPAL

SEQ ID NO: 159625 - protein, 8 aa, Mycobacterium tuberculosis
TMNPALDI

SEQ ID NO: 159626 - protein, 8 aa, Mycobacterium tuberculosis
NPALDITT

SEQ ID NO: 159627 - protein, 8 aa, Mycobacterium tuberculosis
ALDITTSV

SEQ ID NO: 159628 - protein, 8 aa, Mycobacterium tuberculosis
ITTSVDVV

SEQ ID NO: 159629 - protein, 8 aa, Mycobacterium tuberculosis
TTSVDVVR

SEQ ID NO: 159630 - protein, 8 aa, Mycobacterium tuberculosis
DVVRPTEK

SEQ ID NO: 159631 - protein, 8 aa, Mycobacterium tuberculosis
RPTEKMRC

SEQ ID NO: 159632 - protein, 8 aa, Mycobacterium tuberculosis
KMRCGAPR

SEQ ID NO: 159633 - protein, 8 aa, Mycobacterium tuberculosis
GINVARIV

SEQ ID NO: 159634 - protein, 8 aa, Mycobacterium tuberculosis
NVARIVHV

SEQ ID NO: 159635 - protein, 8 aa, Mycobacterium tuberculosis
VARIVHVL

SEQ ID NO: 159636 - protein, 8 aa, Mycobacterium tuberculosis
VLGGCSTA

SEQ ID NO: 159637 - protein, 8 aa, Mycobacterium tuberculosis
CSTALFPA

SEQ ID NO: 159638 - protein, 8 aa, Mycobacterium tuberculosis
FPAGGSTG

SEQ ID NO: 159639 - protein, 8 aa, Mycobacterium tuberculosis
TGSLLMAL

SEQ ID NO: 159640 - protein, 8 aa, Mycobacterium tuberculosis
LMALLGDA

SEQ ID NO: 159641 - protein, 8 aa, Mycobacterium tuberculosis
ALLGDAGV

SEQ ID NO: 159642 - protein, 8 aa, Mycobacterium tuberculosis
DAGVPFRV

SEQ ID NO: 159643 - protein, 8 aa, Mycobacterium tuberculosis
VPFRVIPI

SEQ ID NO: 159644 - protein, 8 aa, Mycobacterium tuberculosis
IPIAASTR

SEQ ID NO: 159645 - protein, 8 aa, Mycobacterium tuberculosis
STRESFTV

SEQ ID NO: 159646 - protein, 8 aa, Mycobacterium tuberculosis
ESFTVNES

SEQ ID NO: 159647 - protein, 8 aa, Mycobacterium tuberculosis
SFTVNESR

SEQ ID NO: 159648 - protein, 8 aa, Mycobacterium tuberculosis
RTAKQYRF

SEQ ID NO: 159649 - protein, 8 aa, Mycobacterium tuberculosis
TAKQYRFV

SEQ ID NO: 159650 - protein, 8 aa, Mycobacterium tuberculosis
FVLPGPSL

SEQ ID NO: 159651 - protein, 8 aa, Mycobacterium tuberculosis
VLPGPSLT

SEQ ID NO: 159652 - protein, 8 aa, Mycobacterium tuberculosis
LPGPSLTV

SEQ ID NO: 159653 - protein, 8 aa, Mycobacterium tuberculosis
AEQEQCLD

SEQ ID NO: 159654 - protein, 8 aa, Mycobacterium tuberculosis
QEQCLDEL

SEQ ID NO: 159655 - protein, 8 aa, Mycobacterium tuberculosis
EQCLDELR

SEQ ID NO: 159656 - protein, 8 aa, Mycobacterium tuberculosis
CLDELRGA

SEQ ID NO: 159657 - protein, 8 aa, Mycobacterium tuberculosis
GAAASAAF

SEQ ID NO: 159658 - protein, 8 aa, Mycobacterium tuberculosis
AAASAAFV

SEQ ID NO: 159659 - protein, 8 aa, Mycobacterium tuberculosis
AASAAFVV

SEQ ID NO: 159660 - protein, 8 aa, Mycobacterium tuberculosis
FVVASGSL

SEQ ID NO: 159661 - protein, 8 aa, Mycobacterium tuberculosis
SLPPGVAA

SEQ ID NO: 159662 - protein, 8 aa, Mycobacterium tuberculosis
LPPGVAAD

SEQ ID NO: 159663 - protein, 8 aa, Mycobacterium tuberculosis
VAADYYQR

SEQ ID NO: 159664 - protein, 8 aa, Mycobacterium tuberculosis
AADYYQRV

SEQ ID NO: 159665 - protein, 8 aa, Mycobacterium tuberculosis
YYQRVADI

SEQ ID NO: 159666 - protein, 8 aa, Mycobacterium tuberculosis
RVADICRR

SEQ ID NO: 159667 - protein, 8 aa, Mycobacterium tuberculosis
RSSTPLIL

SEQ ID NO: 159668 - protein, 8 aa, Mycobacterium tuberculosis
LQHISSGV

SEQ ID NO: 159669 - protein, 8 aa, Mycobacterium tuberculosis
HISSGVFL

SEQ ID NO: 159670 - protein, 8 aa, Mycobacterium tuberculosis
ISSGVFLL

SEQ ID NO: 159671 - protein, 8 aa, Mycobacterium tuberculosis
SSGVFLLK

SEQ ID NO: 159672 - protein, 8 aa, Mycobacterium tuberculosis
FLLKASVR

SEQ ID NO: 159673 - protein, 8 aa, Mycobacterium tuberculosis
KASVRELR

SEQ ID NO: 159674 - protein, 8 aa, Mycobacterium tuberculosis
RECVGSEL

SEQ ID NO: 159675 - protein, 8 aa, Mycobacterium tuberculosis
ECVGSELL

SEQ ID NO: 159676 - protein, 8 aa, Mycobacterium tuberculosis
LLTEPEQL

SEQ ID NO: 159677 - protein, 8 aa, Mycobacterium tuberculosis
EPEQLAAA

SEQ ID NO: 159678 - protein, 8 aa, Mycobacterium tuberculosis
QLAAAHEL

SEQ ID NO: 159679 - protein, 8 aa, Mycobacterium tuberculosis
LAAAHELI

SEQ ID NO: 159680 - protein, 8 aa, Mycobacterium tuberculosis
ELIDRGRA

SEQ ID NO: 159681 - protein, 8 aa, Mycobacterium tuberculosis
AEVVVVSL

SEQ ID NO: 159682 - protein, 8 aa, Mycobacterium tuberculosis
SLGSQGAL

SEQ ID NO: 159683 - protein, 8 aa, Mycobacterium tuberculosis
SQGALLAT

SEQ ID NO: 159684 - protein, 8 aa, Mycobacterium tuberculosis
ALLATRHA

SEQ ID NO: 159685 - protein, 8 aa, Mycobacterium tuberculosis
ATRHASHR

SEQ ID NO: 159686 - protein, 8 aa, Mycobacterium tuberculosis
HRFSSIPM

SEQ ID NO: 159687 - protein, 8 aa, Mycobacterium tuberculosis
FSSIPMTA

SEQ ID NO: 159688 - protein, 8 aa, Mycobacterium tuberculosis
SSIPMTAV

SEQ ID NO: 159689 - protein, 8 aa, Mycobacterium tuberculosis
IPMTAVSG

SEQ ID NO: 159690 - protein, 8 aa, Mycobacterium tuberculosis
PMTAVSGV

SEQ ID NO: 159691 - protein, 8 aa, Mycobacterium tuberculosis
AMVAAITV

SEQ ID NO: 159692 - protein, 8 aa, Mycobacterium tuberculosis
MVAAITVG

SEQ ID NO: 159693 - protein, 8 aa, Mycobacterium tuberculosis
VAAITVGL

SEQ ID NO: 159694 - protein, 8 aa, Mycobacterium tuberculosis
AITVGLSR

SEQ ID NO: 159695 - protein, 8 aa, Mycobacterium tuberculosis
GLSRGWSL

SEQ ID NO: 159696 - protein, 8 aa, Mycobacterium tuberculosis
WSLIKSVR

SEQ ID NO: 159697 - protein, 8 aa, Mycobacterium tuberculosis
SLIKSVRL

SEQ ID NO: 159698 - protein, 8 aa, Mycobacterium tuberculosis
RLGNAAGA

SEQ ID NO: 159699 - protein, 8 aa, Mycobacterium tuberculosis
NAAGAAML

SEQ ID NO: 159700 - protein, 8 aa, Mycobacterium tuberculosis
MLLTPGTA

SEQ ID NO: 159701 - protein, 8 aa, Mycobacterium tuberculosis
LLTPGTAA

SEQ ID NO: 159702 - protein, 8 aa, Mycobacterium tuberculosis
DVERFFEL

SEQ ID NO: 159703 - protein, 8 aa, Mycobacterium tuberculosis
LAAEPTEV

SEQ ID NO: 159704 - protein, 8 aa, Mycobacterium tuberculosis
TEVGQDQY

SEQ ID NO: 159705 - protein, 8 aa, Mycobacterium tuberculosis
EVGQDQYV

SEQ ID NO: 159706 - protein, 8 aa, Mycobacterium tuberculosis
DQYVWHPI

SEQ ID NO: 159707 - protein, 8 aa, Mycobacterium tuberculosis
QYVWHPIV

SEQ ID NO: 159708 - protein, 8 aa, Mycobacterium tuberculosis
HPIVNPEA

SEQ ID NO: 159709 - protein, 9 aa, Mycobacterium tuberculosis
EPAAWDEGK

SEQ ID NO: 159710 - protein, 9 aa, Mycobacterium tuberculosis
KPRIITLTM

SEQ ID NO: 159711 - protein, 9 aa, Mycobacterium tuberculosis
IITLTMNPA

SEQ ID NO: 159712 - protein, 9 aa, Mycobacterium tuberculosis
ITLTMNPAL

SEQ ID NO: 159713 - protein, 9 aa, Mycobacterium tuberculosis
LTMNPALDI

SEQ ID NO: 159714 - protein, 9 aa, Mycobacterium tuberculosis
TMNPALDIT

SEQ ID NO: 159715 - protein, 9 aa, Mycobacterium tuberculosis
NPALDITTS

SEQ ID NO: 159716 - protein, 9 aa, Mycobacterium tuberculosis
PALDITTSV

SEQ ID NO: 159717 - protein, 9 aa, Mycobacterium tuberculosis
ITTSVDVVR

SEQ ID NO: 159718 - protein, 9 aa, Mycobacterium tuberculosis
DVVRPTEKM

SEQ ID NO: 159719 - protein, 9 aa, Mycobacterium tuberculosis
KMRCGAPRY

SEQ ID NO: 159720 - protein, 9 aa, Mycobacterium tuberculosis
APRYDPGGG

SEQ ID NO: 159721 - protein, 9 aa, Mycobacterium tuberculosis
RYDPGGGGI

SEQ ID NO: 159722 - protein, 9 aa, Mycobacterium tuberculosis
DPGGGGINV

SEQ ID NO: 159723 - protein, 9 aa, Mycobacterium tuberculosis
NVARIVHVL

SEQ ID NO: 159724 - protein, 9 aa, Mycobacterium tuberculosis
HVLGGCSTA

SEQ ID NO: 159725 - protein, 9 aa, Mycobacterium tuberculosis
VLGGCSTAL

SEQ ID NO: 159726 - protein, 9 aa, Mycobacterium tuberculosis
ALFPAGGST

SEQ ID NO: 159727 - protein, 9 aa, Mycobacterium tuberculosis
FPAGGSTGS

SEQ ID NO: 159728 - protein, 9 aa, Mycobacterium tuberculosis
STGSLLMAL

SEQ ID NO: 159729 - protein, 9 aa, Mycobacterium tuberculosis
TGSLLMALL

SEQ ID NO: 159730 - protein, 9 aa, Mycobacterium tuberculosis
LLMALLGDA

SEQ ID NO: 159731 - protein, 9 aa, Mycobacterium tuberculosis
MALLGDAGV

SEQ ID NO: 159732 - protein, 9 aa, Mycobacterium tuberculosis
LLGDAGVPF

SEQ ID NO: 159733 - protein, 9 aa, Mycobacterium tuberculosis
GVPFRVIPI

SEQ ID NO: 159734 - protein, 9 aa, Mycobacterium tuberculosis
VPFRVIPIA

SEQ ID NO: 159735 - protein, 9 aa, Mycobacterium tuberculosis
RVIPIAAST

SEQ ID NO: 159736 - protein, 9 aa, Mycobacterium tuberculosis
VIPIAASTR

SEQ ID NO: 159737 - protein, 9 aa, Mycobacterium tuberculosis
IAASTRESF

SEQ ID NO: 159738 - protein, 9 aa, Mycobacterium tuberculosis
ESFTVNESR

SEQ ID NO: 159739 - protein, 9 aa, Mycobacterium tuberculosis
FTVNESRTA

SEQ ID NO: 159740 - protein, 9 aa, Mycobacterium tuberculosis
TVNESRTAK

SEQ ID NO: 159741 - protein, 9 aa, Mycobacterium tuberculosis
NESRTAKQY

SEQ ID NO: 159742 - protein, 9 aa, Mycobacterium tuberculosis
ESRTAKQYR

SEQ ID NO: 159743 - protein, 9 aa, Mycobacterium tuberculosis
SRTAKQYRF

SEQ ID NO: 159744 - protein, 9 aa, Mycobacterium tuberculosis
RTAKQYRFV

SEQ ID NO: 159745 - protein, 9 aa, Mycobacterium tuberculosis
FVLPGPSLT

SEQ ID NO: 159746 - protein, 9 aa, Mycobacterium tuberculosis
VLPGPSLTV

SEQ ID NO: 159747 - protein, 9 aa, Mycobacterium tuberculosis
LPGPSLTVA

SEQ ID NO: 159748 - protein, 9 aa, Mycobacterium tuberculosis
SLTVAEQEQ

SEQ ID NO: 159749 - protein, 9 aa, Mycobacterium tuberculosis
TVAEQEQCL

SEQ ID NO: 159750 - protein, 9 aa, Mycobacterium tuberculosis
AEQEQCLDE

SEQ ID NO: 159751 - protein, 9 aa, Mycobacterium tuberculosis
CLDELRGAA

SEQ ID NO: 159752 - protein, 9 aa, Mycobacterium tuberculosis
ELRGAAASA

SEQ ID NO: 159753 - protein, 9 aa, Mycobacterium tuberculosis
RGAAASAAF

SEQ ID NO: 159754 - protein, 9 aa, Mycobacterium tuberculosis
GAAASAAFV

SEQ ID NO: 159755 - protein, 9 aa, Mycobacterium tuberculosis
AAASAAFVV

SEQ ID NO: 159756 - protein, 9 aa, Mycobacterium tuberculosis
AASAAFVVA

SEQ ID NO: 159757 - protein, 9 aa, Mycobacterium tuberculosis
SLPPGVAAD

SEQ ID NO: 159758 - protein, 9 aa, Mycobacterium tuberculosis
LPPGVAADY

SEQ ID NO: 159759 - protein, 9 aa, Mycobacterium tuberculosis
PPGVAADYY

SEQ ID NO: 159760 - protein, 9 aa, Mycobacterium tuberculosis
GVAADYYQR

SEQ ID NO: 159761 - protein, 9 aa, Mycobacterium tuberculosis
VAADYYQRV

SEQ ID NO: 159762 - protein, 9 aa, Mycobacterium tuberculosis
DYYQRVADI

SEQ ID NO: 159763 - protein, 9 aa, Mycobacterium tuberculosis
YYQRVADIC

SEQ ID NO: 159764 - protein, 9 aa, Mycobacterium tuberculosis
YQRVADICR

SEQ ID NO: 159765 - protein, 9 aa, Mycobacterium tuberculosis
ICRRSSTPL

SEQ ID NO: 159766 - protein, 9 aa, Mycobacterium tuberculosis
RRSSTPLIL

SEQ ID NO: 159767 - protein, 9 aa, Mycobacterium tuberculosis
ILDTSGGGL

SEQ ID NO: 159768 - protein, 9 aa, Mycobacterium tuberculosis
GLQHISSGV

SEQ ID NO: 159769 - protein, 9 aa, Mycobacterium tuberculosis
LQHISSGVF

SEQ ID NO: 159770 - protein, 9 aa, Mycobacterium tuberculosis
HISSGVFLL

SEQ ID NO: 159771 - protein, 9 aa, Mycobacterium tuberculosis
ISSGVFLLK

SEQ ID NO: 159772 - protein, 9 aa, Mycobacterium tuberculosis
GVFLLKASV

SEQ ID NO: 159773 - protein, 9 aa, Mycobacterium tuberculosis
VFLLKASVR

SEQ ID NO: 159774 - protein, 9 aa, Mycobacterium tuberculosis
FLLKASVRE

SEQ ID NO: 159775 - protein, 9 aa, Mycobacterium tuberculosis
LLKASVREL

SEQ ID NO: 159776 - protein, 9 aa, Mycobacterium tuberculosis
LKASVRELR

SEQ ID NO: 159777 - protein, 9 aa, Mycobacterium tuberculosis
SVRELRECV

SEQ ID NO: 159778 - protein, 9 aa, Mycobacterium tuberculosis
RECVGSELL

SEQ ID NO: 159779 - protein, 9 aa, Mycobacterium tuberculosis
ELLTEPEQL

SEQ ID NO: 159780 - protein, 9 aa, Mycobacterium tuberculosis
LLTEPEQLA

SEQ ID NO: 159781 - protein, 9 aa, Mycobacterium tuberculosis
EPEQLAAAH

SEQ ID NO: 159782 - protein, 9 aa, Mycobacterium tuberculosis
EQLAAAHEL

SEQ ID NO: 159783 - protein, 9 aa, Mycobacterium tuberculosis
QLAAAHELI

SEQ ID NO: 159784 - protein, 9 aa, Mycobacterium tuberculosis
LIDRGRAEV

SEQ ID NO: 159785 - protein, 9 aa, Mycobacterium tuberculosis
RAEVVVVSL

SEQ ID NO: 159786 - protein, 9 aa, Mycobacterium tuberculosis
VVSLGSQGA

SEQ ID NO: 159787 - protein, 9 aa, Mycobacterium tuberculosis
SLGSQGALL

SEQ ID NO: 159788 - protein, 9 aa, Mycobacterium tuberculosis
SQGALLATR

SEQ ID NO: 159789 - protein, 9 aa, Mycobacterium tuberculosis
ALLATRHAS

SEQ ID NO: 159790 - protein, 9 aa, Mycobacterium tuberculosis
LATRHASHR

SEQ ID NO: 159791 - protein, 9 aa, Mycobacterium tuberculosis
ATRHASHRF

SEQ ID NO: 159792 - protein, 9 aa, Mycobacterium tuberculosis
HASHRFSSI

SEQ ID NO: 159793 - protein, 9 aa, Mycobacterium tuberculosis
SHRFSSIPM

SEQ ID NO: 159794 - protein, 9 aa, Mycobacterium tuberculosis
FSSIPMTAV

SEQ ID NO: 159795 - protein, 9 aa, Mycobacterium tuberculosis
IPMTAVSGV

SEQ ID NO: 159796 - protein, 9 aa, Mycobacterium tuberculosis
MTAVSGVGA

SEQ ID NO: 159797 - protein, 9 aa, Mycobacterium tuberculosis
SGVGAGDAM

SEQ ID NO: 159798 - protein, 9 aa, Mycobacterium tuberculosis
GVGAGDAMV

SEQ ID NO: 159799 - protein, 9 aa, Mycobacterium tuberculosis
GAGDAMVAA

SEQ ID NO: 159800 - protein, 9 aa, Mycobacterium tuberculosis
DAMVAAITV

SEQ ID NO: 159801 - protein, 9 aa, Mycobacterium tuberculosis
MVAAITVGL

SEQ ID NO: 159802 - protein, 9 aa, Mycobacterium tuberculosis
AAITVGLSR

SEQ ID NO: 159803 - protein, 9 aa, Mycobacterium tuberculosis
ITVGLSRGW

SEQ ID NO: 159804 - protein, 9 aa, Mycobacterium tuberculosis
GLSRGWSLI

SEQ ID NO: 159805 - protein, 9 aa, Mycobacterium tuberculosis
LSRGWSLIK

SEQ ID NO: 159806 - protein, 9 aa, Mycobacterium tuberculosis
RGWSLIKSV

SEQ ID NO: 159807 - protein, 9 aa, Mycobacterium tuberculosis
GWSLIKSVR

SEQ ID NO: 159808 - protein, 9 aa, Mycobacterium tuberculosis
RLGNAAGAA

SEQ ID NO: 159809 - protein, 9 aa, Mycobacterium tuberculosis
LGNAAGAAM

SEQ ID NO: 159810 - protein, 9 aa, Mycobacterium tuberculosis
NAAGAAMLL

SEQ ID NO: 159811 - protein, 9 aa, Mycobacterium tuberculosis
AMLLTPGTA

SEQ ID NO: 159812 - protein, 9 aa, Mycobacterium tuberculosis
MLLTPGTAA

SEQ ID NO: 159813 - protein, 9 aa, Mycobacterium tuberculosis
LLTPGTAAC

SEQ ID NO: 159814 - protein, 9 aa, Mycobacterium tuberculosis
TPGTAACNR

SEQ ID NO: 159815 - protein, 9 aa, Mycobacterium tuberculosis
TAACNRDDV

SEQ ID NO: 159816 - protein, 9 aa, Mycobacterium tuberculosis
DVERFFELA

SEQ ID NO: 159817 - protein, 9 aa, Mycobacterium tuberculosis
ELAAEPTEV

SEQ ID NO: 159818 - protein, 9 aa, Mycobacterium tuberculosis
PTEVGQDQY

SEQ ID NO: 159819 - protein, 9 aa, Mycobacterium tuberculosis
TEVGQDQYV

SEQ ID NO: 159820 - protein, 9 aa, Mycobacterium tuberculosis
GQDQYVWHP

SEQ ID NO: 159821 - protein, 9 aa, Mycobacterium tuberculosis
DQYVWHPIV

SEQ ID NO: 159822 - protein, 9 aa, Mycobacterium tuberculosis
HPIVNPEAS

SEQ ID NO: 159823 - protein, 10 aa, Mycobacterium tuberculosis
AAWDEGKPRI

SEQ ID NO: 159824 - protein, 10 aa, Mycobacterium tuberculosis
DEGKPRIITL

SEQ ID NO: 159825 - protein, 10 aa, Mycobacterium tuberculosis
KPRIITLTMN

SEQ ID NO: 159826 - protein, 10 aa, Mycobacterium tuberculosis
RIITLTMNPA

SEQ ID NO: 159827 - protein, 10 aa, Mycobacterium tuberculosis
TLTMNPALDI

SEQ ID NO: 159828 - protein, 10 aa, Mycobacterium tuberculosis
TMNPALDITT

SEQ ID NO: 159829 - protein, 10 aa, Mycobacterium tuberculosis
NPALDITTSV

SEQ ID NO: 159830 - protein, 10 aa, Mycobacterium tuberculosis
ALDITTSVDV

SEQ ID NO: 159831 - protein, 10 aa, Mycobacterium tuberculosis
DITTSVDVVR

SEQ ID NO: 159832 - protein, 10 aa, Mycobacterium tuberculosis
SVDVVRPTEK

SEQ ID NO: 159833 - protein, 10 aa, Mycobacterium tuberculosis
DVVRPTEKMR

SEQ ID NO: 159834 - protein, 10 aa, Mycobacterium tuberculosis
RPTEKMRCGA

SEQ ID NO: 159835 - protein, 10 aa, Mycobacterium tuberculosis
TEKMRCGAPR

SEQ ID NO: 159836 - protein, 10 aa, Mycobacterium tuberculosis
APRYDPGGGG

SEQ ID NO: 159837 - protein, 10 aa, Mycobacterium tuberculosis
GINVARIVHV

SEQ ID NO: 159838 - protein, 10 aa, Mycobacterium tuberculosis
HVLGGCSTAL

SEQ ID NO: 159839 - protein, 10 aa, Mycobacterium tuberculosis
VLGGCSTALF

SEQ ID NO: 159840 - protein, 10 aa, Mycobacterium tuberculosis
STALFPAGGS

SEQ ID NO: 159841 - protein, 10 aa, Mycobacterium tuberculosis
FPAGGSTGSL

SEQ ID NO: 159842 - protein, 10 aa, Mycobacterium tuberculosis
STGSLLMALL

SEQ ID NO: 159843 - protein, 10 aa, Mycobacterium tuberculosis
SLLMALLGDA

SEQ ID NO: 159844 - protein, 10 aa, Mycobacterium tuberculosis
LLMALLGDAG

SEQ ID NO: 159845 - protein, 10 aa, Mycobacterium tuberculosis
LMALLGDAGV

SEQ ID NO: 159846 - protein, 10 aa, Mycobacterium tuberculosis
ALLGDAGVPF

SEQ ID NO: 159847 - protein, 10 aa, Mycobacterium tuberculosis
LLGDAGVPFR

SEQ ID NO: 159848 - protein, 10 aa, Mycobacterium tuberculosis
LGDAGVPFRV

SEQ ID NO: 159849 - protein, 10 aa, Mycobacterium tuberculosis
VPFRVIPIAA

SEQ ID NO: 159850 - protein, 10 aa, Mycobacterium tuberculosis
RVIPIAASTR

SEQ ID NO: 159851 - protein, 10 aa, Mycobacterium tuberculosis
AASTRESFTV

SEQ ID NO: 159852 - protein, 10 aa, Mycobacterium tuberculosis
RESFTVNESR

SEQ ID NO: 159853 - protein, 10 aa, Mycobacterium tuberculosis
ESFTVNESRT

SEQ ID NO: 159854 - protein, 10 aa, Mycobacterium tuberculosis
FTVNESRTAK

SEQ ID NO: 159855 - protein, 10 aa, Mycobacterium tuberculosis
RTAKQYRFVL

SEQ ID NO: 159856 - protein, 10 aa, Mycobacterium tuberculosis
KQYRFVLPGP

SEQ ID NO: 159857 - protein, 10 aa, Mycobacterium tuberculosis
YRFVLPGPSL

SEQ ID NO: 159858 - protein, 10 aa, Mycobacterium tuberculosis
FVLPGPSLTV

SEQ ID NO: 159859 - protein, 10 aa, Mycobacterium tuberculosis
VLPGPSLTVA

SEQ ID NO: 159860 - protein, 10 aa, Mycobacterium tuberculosis
SLTVAEQEQC

SEQ ID NO: 159861 - protein, 10 aa, Mycobacterium tuberculosis
AEQEQCLDEL

SEQ ID NO: 159862 - protein, 10 aa, Mycobacterium tuberculosis
EQEQCLDELR

SEQ ID NO: 159863 - protein, 10 aa, Mycobacterium tuberculosis
CLDELRGAAA

SEQ ID NO: 159864 - protein, 10 aa, Mycobacterium tuberculosis
ELRGAAASAA

SEQ ID NO: 159865 - protein, 10 aa, Mycobacterium tuberculosis
RGAAASAAFV

SEQ ID NO: 159866 - protein, 10 aa, Mycobacterium tuberculosis
GAAASAAFVV

SEQ ID NO: 159867 - protein, 10 aa, Mycobacterium tuberculosis
AAASAAFVVA

SEQ ID NO: 159868 - protein, 10 aa, Mycobacterium tuberculosis
SAAFVVASGS

SEQ ID NO: 159869 - protein, 10 aa, Mycobacterium tuberculosis
VASGSLPPGV

SEQ ID NO: 159870 - protein, 10 aa, Mycobacterium tuberculosis
SLPPGVAADY

SEQ ID NO: 159871 - protein, 10 aa, Mycobacterium tuberculosis
LPPGVAADYY

SEQ ID NO: 159872 - protein, 10 aa, Mycobacterium tuberculosis
GVAADYYQRV

SEQ ID NO: 159873 - protein, 10 aa, Mycobacterium tuberculosis
YYQRVADICR

SEQ ID NO: 159874 - protein, 10 aa, Mycobacterium tuberculosis
YQRVADICRR

SEQ ID NO: 159875 - protein, 10 aa, Mycobacterium tuberculosis
DICRRSSTPL

SEQ ID NO: 159876 - protein, 10 aa, Mycobacterium tuberculosis
ICRRSSTPLI

SEQ ID NO: 159877 - protein, 10 aa, Mycobacterium tuberculosis
LILDTSGGGL

SEQ ID NO: 159878 - protein, 10 aa, Mycobacterium tuberculosis
ILDTSGGGLQ

SEQ ID NO: 159879 - protein, 10 aa, Mycobacterium tuberculosis
DTSGGGLQHI

SEQ ID NO: 159880 - protein, 10 aa, Mycobacterium tuberculosis
GLQHISSGVF

SEQ ID NO: 159881 - protein, 10 aa, Mycobacterium tuberculosis
LQHISSGVFL

SEQ ID NO: 159882 - protein, 10 aa, Mycobacterium tuberculosis
HISSGVFLLK

SEQ ID NO: 159883 - protein, 10 aa, Mycobacterium tuberculosis
SGVFLLKASV

SEQ ID NO: 159884 - protein, 10 aa, Mycobacterium tuberculosis
GVFLLKASVR

SEQ ID NO: 159885 - protein, 10 aa, Mycobacterium tuberculosis
FLLKASVREL

SEQ ID NO: 159886 - protein, 10 aa, Mycobacterium tuberculosis
LLKASVRELR

SEQ ID NO: 159887 - protein, 10 aa, Mycobacterium tuberculosis
ELRECVGSEL

SEQ ID NO: 159888 - protein, 10 aa, Mycobacterium tuberculosis
SELLTEPEQL

SEQ ID NO: 159889 - protein, 10 aa, Mycobacterium tuberculosis
ELLTEPEQLA

SEQ ID NO: 159890 - protein, 10 aa, Mycobacterium tuberculosis
LLTEPEQLAA

SEQ ID NO: 159891 - protein, 10 aa, Mycobacterium tuberculosis
PEQLAAAHEL

SEQ ID NO: 159892 - protein, 10 aa, Mycobacterium tuberculosis
EQLAAAHELI

SEQ ID NO: 159893 - protein, 10 aa, Mycobacterium tuberculosis
LAAAHELIDR

SEQ ID NO: 159894 - protein, 10 aa, Mycobacterium tuberculosis
AAHELIDRGR

SEQ ID NO: 159895 - protein, 10 aa, Mycobacterium tuberculosis
ELIDRGRAEV

SEQ ID NO: 159896 - protein, 10 aa, Mycobacterium tuberculosis
LIDRGRAEVV

SEQ ID NO: 159897 - protein, 10 aa, Mycobacterium tuberculosis
GRAEVVVVSL

SEQ ID NO: 159898 - protein, 10 aa, Mycobacterium tuberculosis
AEVVVVSLGS

SEQ ID NO: 159899 - protein, 10 aa, Mycobacterium tuberculosis
VVSLGSQGAL

SEQ ID NO: 159900 - protein, 10 aa, Mycobacterium tuberculosis
SLGSQGALLA

SEQ ID NO: 159901 - protein, 10 aa, Mycobacterium tuberculosis
GSQGALLATR

SEQ ID NO: 159902 - protein, 10 aa, Mycobacterium tuberculosis
LLATRHASHR

SEQ ID NO: 159903 - protein, 10 aa, Mycobacterium tuberculosis
LATRHASHRF

SEQ ID NO: 159904 - protein, 10 aa, Mycobacterium tuberculosis
ATRHASHRFS

SEQ ID NO: 159905 - protein, 10 aa, Mycobacterium tuberculosis
ASHRFSSIPM

SEQ ID NO: 159906 - protein, 10 aa, Mycobacterium tuberculosis
SIPMTAVSGV

SEQ ID NO: 159907 - protein, 10 aa, Mycobacterium tuberculosis
SGVGAGDAMV

SEQ ID NO: 159908 - protein, 10 aa, Mycobacterium tuberculosis
GAGDAMVAAI

SEQ ID NO: 159909 - protein, 10 aa, Mycobacterium tuberculosis
AMVAAITVGL

SEQ ID NO: 159910 - protein, 10 aa, Mycobacterium tuberculosis
MVAAITVGLS

SEQ ID NO: 159911 - protein, 10 aa, Mycobacterium tuberculosis
VAAITVGLSR

SEQ ID NO: 159912 - protein, 10 aa, Mycobacterium tuberculosis
GLSRGWSLIK

SEQ ID NO: 159913 - protein, 10 aa, Mycobacterium tuberculosis
RGWSLIKSVR

SEQ ID NO: 159914 - protein, 10 aa, Mycobacterium tuberculosis
LIKSVRLGNA

SEQ ID NO: 159915 - protein, 10 aa, Mycobacterium tuberculosis
RLGNAAGAAM

SEQ ID NO: 159916 - protein, 10 aa, Mycobacterium tuberculosis
GNAAGAAMLL

SEQ ID NO: 159917 - protein, 10 aa, Mycobacterium tuberculosis
AMLLTPGTAA

SEQ ID NO: 159918 - protein, 10 aa, Mycobacterium tuberculosis
MLLTPGTAAC

SEQ ID NO: 159919 - protein, 10 aa, Mycobacterium tuberculosis
LLTPGTAACN

SEQ ID NO: 159920 - protein, 10 aa, Mycobacterium tuberculosis
LTPGTAACNR

SEQ ID NO: 159921 - protein, 10 aa, Mycobacterium tuberculosis
AACNRDDVER

SEQ ID NO: 159922 - protein, 10 aa, Mycobacterium tuberculosis
FELAAEPTEV

SEQ ID NO: 159923 - protein, 10 aa, Mycobacterium tuberculosis
EPTEVGQDQY

SEQ ID NO: 159924 - protein, 10 aa, Mycobacterium tuberculosis
TEVGQDQYVW

SEQ ID NO: 159925 - protein, 10 aa, Mycobacterium tuberculosis
GQDQYVWHPI

SEQ ID NO: 159926 - protein, 11 aa, Mycobacterium tuberculosis
MTEPAAWDEGK

SEQ ID NO: 159927 - protein, 11 aa, Mycobacterium tuberculosis
EPAAWDEGKPR

SEQ ID NO: 159928 - protein, 11 aa, Mycobacterium tuberculosis
EGKPRIITLTM

SEQ ID NO: 159929 - protein, 11 aa, Mycobacterium tuberculosis
RIITLTMNPAL

SEQ ID NO: 159930 - protein, 11 aa, Mycobacterium tuberculosis
TMNPALDITTS

SEQ ID NO: 159931 - protein, 11 aa, Mycobacterium tuberculosis
MNPALDITTSV

SEQ ID NO: 159932 - protein, 11 aa, Mycobacterium tuberculosis
PALDITTSVDV

SEQ ID NO: 159933 - protein, 11 aa, Mycobacterium tuberculosis
ALDITTSVDVV

SEQ ID NO: 159934 - protein, 11 aa, Mycobacterium tuberculosis
TSVDVVRPTEK

SEQ ID NO: 159935 - protein, 11 aa, Mycobacterium tuberculosis
RPTEKMRCGAP

SEQ ID NO: 159936 - protein, 11 aa, Mycobacterium tuberculosis
PTEKMRCGAPR

SEQ ID NO: 159937 - protein, 11 aa, Mycobacterium tuberculosis
KMRCGAPRYDP

SEQ ID NO: 159938 - protein, 11 aa, Mycobacterium tuberculosis
APRYDPGGGGI

SEQ ID NO: 159939 - protein, 11 aa, Mycobacterium tuberculosis
RYDPGGGGINV

SEQ ID NO: 159940 - protein, 11 aa, Mycobacterium tuberculosis
DPGGGGINVAR

SEQ ID NO: 159941 - protein, 11 aa, Mycobacterium tuberculosis
GINVARIVHVL

SEQ ID NO: 159942 - protein, 11 aa, Mycobacterium tuberculosis
RIVHVLGGCST

SEQ ID NO: 159943 - protein, 11 aa, Mycobacterium tuberculosis
VHVLGGCSTAL

SEQ ID NO: 159944 - protein, 11 aa, Mycobacterium tuberculosis
HVLGGCSTALF

SEQ ID NO: 159945 - protein, 11 aa, Mycobacterium tuberculosis
STALFPAGGST

SEQ ID NO: 159946 - protein, 11 aa, Mycobacterium tuberculosis
ALFPAGGSTGS

SEQ ID NO: 159947 - protein, 11 aa, Mycobacterium tuberculosis
LFPAGGSTGSL

SEQ ID NO: 159948 - protein, 11 aa, Mycobacterium tuberculosis
FPAGGSTGSLL

SEQ ID NO: 159949 - protein, 11 aa, Mycobacterium tuberculosis
LLMALLGDAGV

SEQ ID NO: 159950 - protein, 11 aa, Mycobacterium tuberculosis
MALLGDAGVPF

SEQ ID NO: 159951 - protein, 11 aa, Mycobacterium tuberculosis
ALLGDAGVPFR

SEQ ID NO: 159952 - protein, 11 aa, Mycobacterium tuberculosis
LLGDAGVPFRV

SEQ ID NO: 159953 - protein, 11 aa, Mycobacterium tuberculosis
VPFRVIPIAAS

SEQ ID NO: 159954 - protein, 11 aa, Mycobacterium tuberculosis
IPIAASTRESF

SEQ ID NO: 159955 - protein, 11 aa, Mycobacterium tuberculosis
IAASTRESFTV

SEQ ID NO: 159956 - protein, 11 aa, Mycobacterium tuberculosis
ESFTVNESRTA

SEQ ID NO: 159957 - protein, 11 aa, Mycobacterium tuberculosis
TVNESRTAKQY

SEQ ID NO: 159958 - protein, 11 aa, Mycobacterium tuberculosis
VNESRTAKQYR

SEQ ID NO: 159959 - protein, 11 aa, Mycobacterium tuberculosis
SRTAKQYRFVL

SEQ ID NO: 159960 - protein, 11 aa, Mycobacterium tuberculosis
QYRFVLPGPSL

SEQ ID NO: 159961 - protein, 11 aa, Mycobacterium tuberculosis
FVLPGPSLTVA

SEQ ID NO: 159962 - protein, 11 aa, Mycobacterium tuberculosis
VLPGPSLTVAE

SEQ ID NO: 159963 - protein, 11 aa, Mycobacterium tuberculosis
SLTVAEQEQCL

SEQ ID NO: 159964 - protein, 11 aa, Mycobacterium tuberculosis
CLDELRGAAAS

SEQ ID NO: 159965 - protein, 11 aa, Mycobacterium tuberculosis
ELRGAAASAAF

SEQ ID NO: 159966 - protein, 11 aa, Mycobacterium tuberculosis
RGAAASAAFVV

SEQ ID NO: 159967 - protein, 11 aa, Mycobacterium tuberculosis
SAAFVVASGSL

SEQ ID NO: 159968 - protein, 11 aa, Mycobacterium tuberculosis
VVASGSLPPGV

SEQ ID NO: 159969 - protein, 11 aa, Mycobacterium tuberculosis
SLPPGVAADYY

SEQ ID NO: 159970 - protein, 11 aa, Mycobacterium tuberculosis
DYYQRVADICR

SEQ ID NO: 159971 - protein, 11 aa, Mycobacterium tuberculosis
YYQRVADICRR

SEQ ID NO: 159972 - protein, 11 aa, Mycobacterium tuberculosis
RVADICRRSST

SEQ ID NO: 159973 - protein, 11 aa, Mycobacterium tuberculosis
ICRRSSTPLIL

SEQ ID NO: 159974 - protein, 11 aa, Mycobacterium tuberculosis
GLQHISSGVFL

SEQ ID NO: 159975 - protein, 11 aa, Mycobacterium tuberculosis
LQHISSGVFLL

SEQ ID NO: 159976 - protein, 11 aa, Mycobacterium tuberculosis
HISSGVFLLKA

SEQ ID NO: 159977 - protein, 11 aa, Mycobacterium tuberculosis
VFLLKASVREL

SEQ ID NO: 159978 - protein, 11 aa, Mycobacterium tuberculosis
FLLKASVRELR

SEQ ID NO: 159979 - protein, 11 aa, Mycobacterium tuberculosis
RELRECVGSEL

SEQ ID NO: 159980 - protein, 11 aa, Mycobacterium tuberculosis
ELRECVGSELL

SEQ ID NO: 159981 - protein, 11 aa, Mycobacterium tuberculosis
ELLTEPEQLAA

SEQ ID NO: 159982 - protein, 11 aa, Mycobacterium tuberculosis
LLTEPEQLAAA

SEQ ID NO: 159983 - protein, 11 aa, Mycobacterium tuberculosis
EPEQLAAAHEL

SEQ ID NO: 159984 - protein, 11 aa, Mycobacterium tuberculosis
QLAAAHELIDR

SEQ ID NO: 159985 - protein, 11 aa, Mycobacterium tuberculosis
ELIDRGRAEVV

SEQ ID NO: 159986 - protein, 11 aa, Mycobacterium tuberculosis
LIDRGRAEVVV

SEQ ID NO: 159987 - protein, 11 aa, Mycobacterium tuberculosis
RGRAEVVVVSL

SEQ ID NO: 159988 - protein, 11 aa, Mycobacterium tuberculosis
VVVVSLGSQGA

SEQ ID NO: 159989 - protein, 11 aa, Mycobacterium tuberculosis
VVVSLGSQGAL

SEQ ID NO: 159990 - protein, 11 aa, Mycobacterium tuberculosis
VVSLGSQGALL

SEQ ID NO: 159991 - protein, 11 aa, Mycobacterium tuberculosis
SLGSQGALLAT

SEQ ID NO: 159992 - protein, 11 aa, Mycobacterium tuberculosis
SQGALLATRHA

SEQ ID NO: 159993 - protein, 11 aa, Mycobacterium tuberculosis
ALLATRHASHR

SEQ ID NO: 159994 - protein, 11 aa, Mycobacterium tuberculosis
LLATRHASHRF

SEQ ID NO: 159995 - protein, 11 aa, Mycobacterium tuberculosis
ATRHASHRFSS

SEQ ID NO: 159996 - protein, 11 aa, Mycobacterium tuberculosis
HASHRFSSIPM

SEQ ID NO: 159997 - protein, 11 aa, Mycobacterium tuberculosis
HRFSSIPMTAV

SEQ ID NO: 159998 - protein, 11 aa, Mycobacterium tuberculosis
SSIPMTAVSGV

SEQ ID NO: 159999 - protein, 11 aa, Mycobacterium tuberculosis
IPMTAVSGVGA

SEQ ID NO: 160000 - protein, 11 aa, Mycobacterium tuberculosis
AVSGVGAGDAM

SEQ ID NO: 160001 - protein, 11 aa, Mycobacterium tuberculosis
AGDAMVAAITV

SEQ ID NO: 160002 - protein, 11 aa, Mycobacterium tuberculosis
DAMVAAITVGL

SEQ ID NO: 160003 - protein, 11 aa, Mycobacterium tuberculosis
AMVAAITVGLS

SEQ ID NO: 160004 - protein, 11 aa, Mycobacterium tuberculosis
MVAAITVGLSR

SEQ ID NO: 160005 - protein, 11 aa, Mycobacterium tuberculosis
AAITVGLSRGW

SEQ ID NO: 160006 - protein, 11 aa, Mycobacterium tuberculosis
ITVGLSRGWSL

SEQ ID NO: 160007 - protein, 11 aa, Mycobacterium tuberculosis
SLIKSVRLGNA

SEQ ID NO: 160008 - protein, 11 aa, Mycobacterium tuberculosis
LIKSVRLGNAA

SEQ ID NO: 160009 - protein, 11 aa, Mycobacterium tuberculosis
SVRLGNAAGAA

SEQ ID NO: 160010 - protein, 11 aa, Mycobacterium tuberculosis
VRLGNAAGAAM

SEQ ID NO: 160011 - protein, 11 aa, Mycobacterium tuberculosis
RLGNAAGAAML

SEQ ID NO: 160012 - protein, 11 aa, Mycobacterium tuberculosis
GAAMLLTPGTA

SEQ ID NO: 160013 - protein, 11 aa, Mycobacterium tuberculosis
AAMLLTPGTAA

SEQ ID NO: 160014 - protein, 11 aa, Mycobacterium tuberculosis
AMLLTPGTAAC

SEQ ID NO: 160015 - protein, 11 aa, Mycobacterium tuberculosis
LLTPGTAACNR

SEQ ID NO: 160016 - protein, 11 aa, Mycobacterium tuberculosis
TAACNRDDVER

SEQ ID NO: 160017 - protein, 11 aa, Mycobacterium tuberculosis
NRDDVERFFEL

SEQ ID NO: 160018 - protein, 11 aa, Mycobacterium tuberculosis
AEPTEVGQDQY

SEQ ID NO: 160019 - protein, 11 aa, Mycobacterium tuberculosis
EPTEVGQDQYV

SEQ ID NO: 160020 - protein, 11 aa, Mycobacterium tuberculosis
PTEVGQDQYVW

SEQ ID NO: 160021 - protein, 11 aa, Mycobacterium tuberculosis
GQDQYVWHPIV

SEQ ID NO: 160022 - protein, 11 aa, Mycobacterium tuberculosis
YVWHPIVNPEA

SEQ ID NO: 160023 - protein, 13 aa, Mycobacterium tuberculosis
MTEPAAWDEGKPR

SEQ ID NO: 160024 - protein, 13 aa, Mycobacterium tuberculosis
TEPAAWDEGKPRI

SEQ ID NO: 160025 - protein, 13 aa, Mycobacterium tuberculosis
EPAAWDEGKPRII

SEQ ID NO: 160026 - protein, 13 aa, Mycobacterium tuberculosis
PAAWDEGKPRIIT

SEQ ID NO: 160027 - protein, 13 aa, Mycobacterium tuberculosis
AAWDEGKPRIITL

SEQ ID NO: 160028 - protein, 13 aa, Mycobacterium tuberculosis
AWDEGKPRIITLT

SEQ ID NO: 160029 - protein, 13 aa, Mycobacterium tuberculosis
WDEGKPRIITLTM

SEQ ID NO: 160030 - protein, 13 aa, Mycobacterium tuberculosis
DEGKPRIITLTMN

SEQ ID NO: 160031 - protein, 13 aa, Mycobacterium tuberculosis
EGKPRIITLTMNP

SEQ ID NO: 160032 - protein, 13 aa, Mycobacterium tuberculosis
GKPRIITLTMNPA

SEQ ID NO: 160033 - protein, 13 aa, Mycobacterium tuberculosis
KPRIITLTMNPAL

SEQ ID NO: 160034 - protein, 13 aa, Mycobacterium tuberculosis
PRIITLTMNPALD

SEQ ID NO: 160035 - protein, 13 aa, Mycobacterium tuberculosis
RIITLTMNPALDI

SEQ ID NO: 160036 - protein, 13 aa, Mycobacterium tuberculosis
IITLTMNPALDIT

SEQ ID NO: 160037 - protein, 13 aa, Mycobacterium tuberculosis
ITLTMNPALDITT

SEQ ID NO: 160038 - protein, 13 aa, Mycobacterium tuberculosis
TLTMNPALDITTS

SEQ ID NO: 160039 - protein, 13 aa, Mycobacterium tuberculosis
LTMNPALDITTSV

SEQ ID NO: 160040 - protein, 13 aa, Mycobacterium tuberculosis
TMNPALDITTSVD

SEQ ID NO: 160041 - protein, 13 aa, Mycobacterium tuberculosis
MNPALDITTSVDV

SEQ ID NO: 160042 - protein, 13 aa, Mycobacterium tuberculosis
NPALDITTSVDVV

SEQ ID NO: 160043 - protein, 13 aa, Mycobacterium tuberculosis
PALDITTSVDVVR

SEQ ID NO: 160044 - protein, 13 aa, Mycobacterium tuberculosis
ALDITTSVDVVRP

SEQ ID NO: 160045 - protein, 13 aa, Mycobacterium tuberculosis
LDITTSVDVVRPT

SEQ ID NO: 160046 - protein, 13 aa, Mycobacterium tuberculosis
DITTSVDVVRPTE

SEQ ID NO: 160047 - protein, 13 aa, Mycobacterium tuberculosis
ITTSVDVVRPTEK

SEQ ID NO: 160048 - protein, 13 aa, Mycobacterium tuberculosis
TTSVDVVRPTEKM

SEQ ID NO: 160049 - protein, 13 aa, Mycobacterium tuberculosis
TSVDVVRPTEKMR

SEQ ID NO: 160050 - protein, 13 aa, Mycobacterium tuberculosis
SVDVVRPTEKMRC

SEQ ID NO: 160051 - protein, 13 aa, Mycobacterium tuberculosis
VDVVRPTEKMRCG

SEQ ID NO: 160052 - protein, 13 aa, Mycobacterium tuberculosis
DVVRPTEKMRCGA

SEQ ID NO: 160053 - protein, 13 aa, Mycobacterium tuberculosis
VVRPTEKMRCGAP

SEQ ID NO: 160054 - protein, 13 aa, Mycobacterium tuberculosis
VRPTEKMRCGAPR

SEQ ID NO: 160055 - protein, 13 aa, Mycobacterium tuberculosis
RPTEKMRCGAPRY

SEQ ID NO: 160056 - protein, 13 aa, Mycobacterium tuberculosis
PTEKMRCGAPRYD

SEQ ID NO: 160057 - protein, 13 aa, Mycobacterium tuberculosis
TEKMRCGAPRYDP

SEQ ID NO: 160058 - protein, 13 aa, Mycobacterium tuberculosis
EKMRCGAPRYDPG

SEQ ID NO: 160059 - protein, 13 aa, Mycobacterium tuberculosis
KMRCGAPRYDPGG

SEQ ID NO: 160060 - protein, 13 aa, Mycobacterium tuberculosis
MRCGAPRYDPGGG

SEQ ID NO: 160061 - protein, 13 aa, Mycobacterium tuberculosis
RCGAPRYDPGGGG

SEQ ID NO: 160062 - protein, 13 aa, Mycobacterium tuberculosis
CGAPRYDPGGGGI

SEQ ID NO: 160063 - protein, 13 aa, Mycobacterium tuberculosis
GAPRYDPGGGGIN

SEQ ID NO: 160064 - protein, 13 aa, Mycobacterium tuberculosis
APRYDPGGGGINV

SEQ ID NO: 160065 - protein, 13 aa, Mycobacterium tuberculosis
PRYDPGGGGINVA

SEQ ID NO: 160066 - protein, 13 aa, Mycobacterium tuberculosis
RYDPGGGGINVAR

SEQ ID NO: 160067 - protein, 13 aa, Mycobacterium tuberculosis
YDPGGGGINVARI

SEQ ID NO: 160068 - protein, 13 aa, Mycobacterium tuberculosis
DPGGGGINVARIV

SEQ ID NO: 160069 - protein, 13 aa, Mycobacterium tuberculosis
PGGGGINVARIVH

SEQ ID NO: 160070 - protein, 13 aa, Mycobacterium tuberculosis
GGGGINVARIVHV

SEQ ID NO: 160071 - protein, 13 aa, Mycobacterium tuberculosis
GGGINVARIVHVL

SEQ ID NO: 160072 - protein, 13 aa, Mycobacterium tuberculosis
GGINVARIVHVLG

SEQ ID NO: 160073 - protein, 13 aa, Mycobacterium tuberculosis
GINVARIVHVLGG

SEQ ID NO: 160074 - protein, 13 aa, Mycobacterium tuberculosis
INVARIVHVLGGC

SEQ ID NO: 160075 - protein, 13 aa, Mycobacterium tuberculosis
NVARIVHVLGGCS

SEQ ID NO: 160076 - protein, 13 aa, Mycobacterium tuberculosis
VARIVHVLGGCST

SEQ ID NO: 160077 - protein, 13 aa, Mycobacterium tuberculosis
ARIVHVLGGCSTA

SEQ ID NO: 160078 - protein, 13 aa, Mycobacterium tuberculosis
RIVHVLGGCSTAL

SEQ ID NO: 160079 - protein, 13 aa, Mycobacterium tuberculosis
IVHVLGGCSTALF

SEQ ID NO: 160080 - protein, 13 aa, Mycobacterium tuberculosis
VHVLGGCSTALFP

SEQ ID NO: 160081 - protein, 13 aa, Mycobacterium tuberculosis
HVLGGCSTALFPA

SEQ ID NO: 160082 - protein, 13 aa, Mycobacterium tuberculosis
VLGGCSTALFPAG

SEQ ID NO: 160083 - protein, 13 aa, Mycobacterium tuberculosis
LGGCSTALFPAGG

SEQ ID NO: 160084 - protein, 13 aa, Mycobacterium tuberculosis
GGCSTALFPAGGS

SEQ ID NO: 160085 - protein, 13 aa, Mycobacterium tuberculosis
GCSTALFPAGGST

SEQ ID NO: 160086 - protein, 13 aa, Mycobacterium tuberculosis
CSTALFPAGGSTG

SEQ ID NO: 160087 - protein, 13 aa, Mycobacterium tuberculosis
STALFPAGGSTGS

SEQ ID NO: 160088 - protein, 13 aa, Mycobacterium tuberculosis
TALFPAGGSTGSL

SEQ ID NO: 160089 - protein, 13 aa, Mycobacterium tuberculosis
ALFPAGGSTGSLL

SEQ ID NO: 160090 - protein, 13 aa, Mycobacterium tuberculosis
LFPAGGSTGSLLM

SEQ ID NO: 160091 - protein, 13 aa, Mycobacterium tuberculosis
FPAGGSTGSLLMA

SEQ ID NO: 160092 - protein, 13 aa, Mycobacterium tuberculosis
PAGGSTGSLLMAL

SEQ ID NO: 160093 - protein, 13 aa, Mycobacterium tuberculosis
AGGSTGSLLMALL

SEQ ID NO: 160094 - protein, 13 aa, Mycobacterium tuberculosis
GGSTGSLLMALLG

SEQ ID NO: 160095 - protein, 13 aa, Mycobacterium tuberculosis
GSTGSLLMALLGD

SEQ ID NO: 160096 - protein, 13 aa, Mycobacterium tuberculosis
STGSLLMALLGDA

SEQ ID NO: 160097 - protein, 13 aa, Mycobacterium tuberculosis
TGSLLMALLGDAG

SEQ ID NO: 160098 - protein, 13 aa, Mycobacterium tuberculosis
GSLLMALLGDAGV

SEQ ID NO: 160099 - protein, 13 aa, Mycobacterium tuberculosis
SLLMALLGDAGVP

SEQ ID NO: 160100 - protein, 13 aa, Mycobacterium tuberculosis
LLMALLGDAGVPF

SEQ ID NO: 160101 - protein, 13 aa, Mycobacterium tuberculosis
LMALLGDAGVPFR

SEQ ID NO: 160102 - protein, 13 aa, Mycobacterium tuberculosis
MALLGDAGVPFRV

SEQ ID NO: 160103 - protein, 13 aa, Mycobacterium tuberculosis
ALLGDAGVPFRVI

SEQ ID NO: 160104 - protein, 13 aa, Mycobacterium tuberculosis
LLGDAGVPFRVIP

SEQ ID NO: 160105 - protein, 13 aa, Mycobacterium tuberculosis
LGDAGVPFRVIPI

SEQ ID NO: 160106 - protein, 13 aa, Mycobacterium tuberculosis
GDAGVPFRVIPIA

SEQ ID NO: 160107 - protein, 13 aa, Mycobacterium tuberculosis
DAGVPFRVIPIAA

SEQ ID NO: 160108 - protein, 13 aa, Mycobacterium tuberculosis
AGVPFRVIPIAAS

SEQ ID NO: 160109 - protein, 13 aa, Mycobacterium tuberculosis
GVPFRVIPIAAST

SEQ ID NO: 160110 - protein, 13 aa, Mycobacterium tuberculosis
VPFRVIPIAASTR

SEQ ID NO: 160111 - protein, 13 aa, Mycobacterium tuberculosis
PFRVIPIAASTRE

SEQ ID NO: 160112 - protein, 13 aa, Mycobacterium tuberculosis
FRVIPIAASTRES

SEQ ID NO: 160113 - protein, 13 aa, Mycobacterium tuberculosis
RVIPIAASTRESF

SEQ ID NO: 160114 - protein, 13 aa, Mycobacterium tuberculosis
VIPIAASTRESFT

SEQ ID NO: 160115 - protein, 13 aa, Mycobacterium tuberculosis
IPIAASTRESFTV

SEQ ID NO: 160116 - protein, 13 aa, Mycobacterium tuberculosis
PIAASTRESFTVN

SEQ ID NO: 160117 - protein, 13 aa, Mycobacterium tuberculosis
IAASTRESFTVNE

SEQ ID NO: 160118 - protein, 13 aa, Mycobacterium tuberculosis
AASTRESFTVNES

SEQ ID NO: 160119 - protein, 13 aa, Mycobacterium tuberculosis
ASTRESFTVNESR

SEQ ID NO: 160120 - protein, 13 aa, Mycobacterium tuberculosis
STRESFTVNESRT

SEQ ID NO: 160121 - protein, 13 aa, Mycobacterium tuberculosis
TRESFTVNESRTA

SEQ ID NO: 160122 - protein, 13 aa, Mycobacterium tuberculosis
RESFTVNESRTAK

SEQ ID NO: 160123 - protein, 13 aa, Mycobacterium tuberculosis
ESFTVNESRTAKQ

SEQ ID NO: 160124 - protein, 13 aa, Mycobacterium tuberculosis
SFTVNESRTAKQY

SEQ ID NO: 160125 - protein, 13 aa, Mycobacterium tuberculosis
FTVNESRTAKQYR

SEQ ID NO: 160126 - protein, 13 aa, Mycobacterium tuberculosis
TVNESRTAKQYRF

SEQ ID NO: 160127 - protein, 13 aa, Mycobacterium tuberculosis
VNESRTAKQYRFV

SEQ ID NO: 160128 - protein, 13 aa, Mycobacterium tuberculosis
NESRTAKQYRFVL

SEQ ID NO: 160129 - protein, 13 aa, Mycobacterium tuberculosis
ESRTAKQYRFVLP

SEQ ID NO: 160130 - protein, 13 aa, Mycobacterium tuberculosis
SRTAKQYRFVLPG

SEQ ID NO: 160131 - protein, 13 aa, Mycobacterium tuberculosis
RTAKQYRFVLPGP

SEQ ID NO: 160132 - protein, 13 aa, Mycobacterium tuberculosis
TAKQYRFVLPGPS

SEQ ID NO: 160133 - protein, 13 aa, Mycobacterium tuberculosis
AKQYRFVLPGPSL

SEQ ID NO: 160134 - protein, 13 aa, Mycobacterium tuberculosis
KQYRFVLPGPSLT

SEQ ID NO: 160135 - protein, 13 aa, Mycobacterium tuberculosis
QYRFVLPGPSLTV

SEQ ID NO: 160136 - protein, 13 aa, Mycobacterium tuberculosis
YRFVLPGPSLTVA

SEQ ID NO: 160137 - protein, 13 aa, Mycobacterium tuberculosis
RFVLPGPSLTVAE

SEQ ID NO: 160138 - protein, 13 aa, Mycobacterium tuberculosis
FVLPGPSLTVAEQ

SEQ ID NO: 160139 - protein, 13 aa, Mycobacterium tuberculosis
VLPGPSLTVAEQE

SEQ ID NO: 160140 - protein, 13 aa, Mycobacterium tuberculosis
LPGPSLTVAEQEQ

SEQ ID NO: 160141 - protein, 13 aa, Mycobacterium tuberculosis
PGPSLTVAEQEQC

SEQ ID NO: 160142 - protein, 13 aa, Mycobacterium tuberculosis
GPSLTVAEQEQCL

SEQ ID NO: 160143 - protein, 13 aa, Mycobacterium tuberculosis
PSLTVAEQEQCLD

SEQ ID NO: 160144 - protein, 13 aa, Mycobacterium tuberculosis
SLTVAEQEQCLDE

SEQ ID NO: 160145 - protein, 13 aa, Mycobacterium tuberculosis
LTVAEQEQCLDEL

SEQ ID NO: 160146 - protein, 13 aa, Mycobacterium tuberculosis
TVAEQEQCLDELR

SEQ ID NO: 160147 - protein, 13 aa, Mycobacterium tuberculosis
VAEQEQCLDELRG

SEQ ID NO: 160148 - protein, 13 aa, Mycobacterium tuberculosis
AEQEQCLDELRGA

SEQ ID NO: 160149 - protein, 13 aa, Mycobacterium tuberculosis
EQEQCLDELRGAA

SEQ ID NO: 160150 - protein, 13 aa, Mycobacterium tuberculosis
QEQCLDELRGAAA

SEQ ID NO: 160151 - protein, 13 aa, Mycobacterium tuberculosis
EQCLDELRGAAAS

SEQ ID NO: 160152 - protein, 13 aa, Mycobacterium tuberculosis
QCLDELRGAAASA

SEQ ID NO: 160153 - protein, 13 aa, Mycobacterium tuberculosis
CLDELRGAAASAA

SEQ ID NO: 160154 - protein, 13 aa, Mycobacterium tuberculosis
LDELRGAAASAAF

SEQ ID NO: 160155 - protein, 13 aa, Mycobacterium tuberculosis
DELRGAAASAAFV

SEQ ID NO: 160156 - protein, 13 aa, Mycobacterium tuberculosis
ELRGAAASAAFVV

SEQ ID NO: 160157 - protein, 13 aa, Mycobacterium tuberculosis
LRGAAASAAFVVA

SEQ ID NO: 160158 - protein, 13 aa, Mycobacterium tuberculosis
RGAAASAAFVVAS

SEQ ID NO: 160159 - protein, 13 aa, Mycobacterium tuberculosis
GAAASAAFVVASG

SEQ ID NO: 160160 - protein, 13 aa, Mycobacterium tuberculosis
AAASAAFVVASGS

SEQ ID NO: 160161 - protein, 13 aa, Mycobacterium tuberculosis
AASAAFVVASGSL

SEQ ID NO: 160162 - protein, 13 aa, Mycobacterium tuberculosis
ASAAFVVASGSLP

SEQ ID NO: 160163 - protein, 13 aa, Mycobacterium tuberculosis
SAAFVVASGSLPP

SEQ ID NO: 160164 - protein, 13 aa, Mycobacterium tuberculosis
AAFVVASGSLPPG

SEQ ID NO: 160165 - protein, 13 aa, Mycobacterium tuberculosis
AFVVASGSLPPGV

SEQ ID NO: 160166 - protein, 13 aa, Mycobacterium tuberculosis
FVVASGSLPPGVA

SEQ ID NO: 160167 - protein, 13 aa, Mycobacterium tuberculosis
VVASGSLPPGVAA

SEQ ID NO: 160168 - protein, 13 aa, Mycobacterium tuberculosis
VASGSLPPGVAAD

SEQ ID NO: 160169 - protein, 13 aa, Mycobacterium tuberculosis
ASGSLPPGVAADY

SEQ ID NO: 160170 - protein, 13 aa, Mycobacterium tuberculosis
SGSLPPGVAADYY

SEQ ID NO: 160171 - protein, 13 aa, Mycobacterium tuberculosis
GSLPPGVAADYYQ

SEQ ID NO: 160172 - protein, 13 aa, Mycobacterium tuberculosis
SLPPGVAADYYQR

SEQ ID NO: 160173 - protein, 13 aa, Mycobacterium tuberculosis
LPPGVAADYYQRV

SEQ ID NO: 160174 - protein, 13 aa, Mycobacterium tuberculosis
PPGVAADYYQRVA

SEQ ID NO: 160175 - protein, 13 aa, Mycobacterium tuberculosis
PGVAADYYQRVAD

SEQ ID NO: 160176 - protein, 13 aa, Mycobacterium tuberculosis
GVAADYYQRVADI

SEQ ID NO: 160177 - protein, 13 aa, Mycobacterium tuberculosis
VAADYYQRVADIC

SEQ ID NO: 160178 - protein, 13 aa, Mycobacterium tuberculosis
AADYYQRVADICR

SEQ ID NO: 160179 - protein, 13 aa, Mycobacterium tuberculosis
ADYYQRVADICRR

SEQ ID NO: 160180 - protein, 13 aa, Mycobacterium tuberculosis
DYYQRVADICRRS

SEQ ID NO: 160181 - protein, 13 aa, Mycobacterium tuberculosis
YYQRVADICRRSS

SEQ ID NO: 160182 - protein, 13 aa, Mycobacterium tuberculosis
YQRVADICRRSST

SEQ ID NO: 160183 - protein, 13 aa, Mycobacterium tuberculosis
QRVADICRRSSTP

SEQ ID NO: 160184 - protein, 13 aa, Mycobacterium tuberculosis
RVADICRRSSTPL

SEQ ID NO: 160185 - protein, 13 aa, Mycobacterium tuberculosis
VADICRRSSTPLI

SEQ ID NO: 160186 - protein, 13 aa, Mycobacterium tuberculosis
ADICRRSSTPLIL

SEQ ID NO: 160187 - protein, 13 aa, Mycobacterium tuberculosis
DICRRSSTPLILD

SEQ ID NO: 160188 - protein, 13 aa, Mycobacterium tuberculosis
ICRRSSTPLILDT

SEQ ID NO: 160189 - protein, 13 aa, Mycobacterium tuberculosis
CRRSSTPLILDTS

SEQ ID NO: 160190 - protein, 13 aa, Mycobacterium tuberculosis
RRSSTPLILDTSG

SEQ ID NO: 160191 - protein, 13 aa, Mycobacterium tuberculosis
RSSTPLILDTSGG

SEQ ID NO: 160192 - protein, 13 aa, Mycobacterium tuberculosis
SSTPLILDTSGGG

SEQ ID NO: 160193 - protein, 13 aa, Mycobacterium tuberculosis
STPLILDTSGGGL

SEQ ID NO: 160194 - protein, 13 aa, Mycobacterium tuberculosis
TPLILDTSGGGLQ

SEQ ID NO: 160195 - protein, 13 aa, Mycobacterium tuberculosis
PLILDTSGGGLQH

SEQ ID NO: 160196 - protein, 13 aa, Mycobacterium tuberculosis
LILDTSGGGLQHI

SEQ ID NO: 160197 - protein, 13 aa, Mycobacterium tuberculosis
ILDTSGGGLQHIS

SEQ ID NO: 160198 - protein, 13 aa, Mycobacterium tuberculosis
LDTSGGGLQHISS

SEQ ID NO: 160199 - protein, 13 aa, Mycobacterium tuberculosis
DTSGGGLQHISSG

SEQ ID NO: 160200 - protein, 13 aa, Mycobacterium tuberculosis
TSGGGLQHISSGV

SEQ ID NO: 160201 - protein, 13 aa, Mycobacterium tuberculosis
SGGGLQHISSGVF

SEQ ID NO: 160202 - protein, 13 aa, Mycobacterium tuberculosis
GGGLQHISSGVFL

SEQ ID NO: 160203 - protein, 13 aa, Mycobacterium tuberculosis
GGLQHISSGVFLL

SEQ ID NO: 160204 - protein, 13 aa, Mycobacterium tuberculosis
GLQHISSGVFLLK

SEQ ID NO: 160205 - protein, 13 aa, Mycobacterium tuberculosis
LQHISSGVFLLKA

SEQ ID NO: 160206 - protein, 13 aa, Mycobacterium tuberculosis
QHISSGVFLLKAS

SEQ ID NO: 160207 - protein, 13 aa, Mycobacterium tuberculosis
HISSGVFLLKASV

SEQ ID NO: 160208 - protein, 13 aa, Mycobacterium tuberculosis
ISSGVFLLKASVR

SEQ ID NO: 160209 - protein, 13 aa, Mycobacterium tuberculosis
SSGVFLLKASVRE

SEQ ID NO: 160210 - protein, 13 aa, Mycobacterium tuberculosis
SGVFLLKASVREL

SEQ ID NO: 160211 - protein, 13 aa, Mycobacterium tuberculosis
GVFLLKASVRELR

SEQ ID NO: 160212 - protein, 13 aa, Mycobacterium tuberculosis
VFLLKASVRELRE

SEQ ID NO: 160213 - protein, 13 aa, Mycobacterium tuberculosis
FLLKASVRELREC

SEQ ID NO: 160214 - protein, 13 aa, Mycobacterium tuberculosis
LLKASVRELRECV

SEQ ID NO: 160215 - protein, 13 aa, Mycobacterium tuberculosis
LKASVRELRECVG

SEQ ID NO: 160216 - protein, 13 aa, Mycobacterium tuberculosis
KASVRELRECVGS

SEQ ID NO: 160217 - protein, 13 aa, Mycobacterium tuberculosis
ASVRELRECVGSE

SEQ ID NO: 160218 - protein, 13 aa, Mycobacterium tuberculosis
SVRELRECVGSEL

SEQ ID NO: 160219 - protein, 13 aa, Mycobacterium tuberculosis
VRELRECVGSELL

SEQ ID NO: 160220 - protein, 13 aa, Mycobacterium tuberculosis
RELRECVGSELLT

SEQ ID NO: 160221 - protein, 13 aa, Mycobacterium tuberculosis
ELRECVGSELLTE

SEQ ID NO: 160222 - protein, 13 aa, Mycobacterium tuberculosis
LRECVGSELLTEP

SEQ ID NO: 160223 - protein, 13 aa, Mycobacterium tuberculosis
RECVGSELLTEPE

SEQ ID NO: 160224 - protein, 13 aa, Mycobacterium tuberculosis
ECVGSELLTEPEQ

SEQ ID NO: 160225 - protein, 13 aa, Mycobacterium tuberculosis
CVGSELLTEPEQL

SEQ ID NO: 160226 - protein, 13 aa, Mycobacterium tuberculosis
VGSELLTEPEQLA

SEQ ID NO: 160227 - protein, 13 aa, Mycobacterium tuberculosis
GSELLTEPEQLAA

SEQ ID NO: 160228 - protein, 13 aa, Mycobacterium tuberculosis
SELLTEPEQLAAA

SEQ ID NO: 160229 - protein, 13 aa, Mycobacterium tuberculosis
ELLTEPEQLAAAH

SEQ ID NO: 160230 - protein, 13 aa, Mycobacterium tuberculosis
LLTEPEQLAAAHE

SEQ ID NO: 160231 - protein, 13 aa, Mycobacterium tuberculosis
LTEPEQLAAAHEL

SEQ ID NO: 160232 - protein, 13 aa, Mycobacterium tuberculosis
TEPEQLAAAHELI

SEQ ID NO: 160233 - protein, 13 aa, Mycobacterium tuberculosis
EPEQLAAAHELID

SEQ ID NO: 160234 - protein, 13 aa, Mycobacterium tuberculosis
PEQLAAAHELIDR

SEQ ID NO: 160235 - protein, 13 aa, Mycobacterium tuberculosis
EQLAAAHELIDRG

SEQ ID NO: 160236 - protein, 13 aa, Mycobacterium tuberculosis
QLAAAHELIDRGR

SEQ ID NO: 160237 - protein, 13 aa, Mycobacterium tuberculosis
LAAAHELIDRGRA

SEQ ID NO: 160238 - protein, 13 aa, Mycobacterium tuberculosis
AAAHELIDRGRAE

SEQ ID NO: 160239 - protein, 13 aa, Mycobacterium tuberculosis
AAHELIDRGRAEV

SEQ ID NO: 160240 - protein, 13 aa, Mycobacterium tuberculosis
AHELIDRGRAEVV

SEQ ID NO: 160241 - protein, 13 aa, Mycobacterium tuberculosis
HELIDRGRAEVVV

SEQ ID NO: 160242 - protein, 13 aa, Mycobacterium tuberculosis
ELIDRGRAEVVVV

SEQ ID NO: 160243 - protein, 13 aa, Mycobacterium tuberculosis
LIDRGRAEVVVVS

SEQ ID NO: 160244 - protein, 13 aa, Mycobacterium tuberculosis
IDRGRAEVVVVSL

SEQ ID NO: 160245 - protein, 13 aa, Mycobacterium tuberculosis
DRGRAEVVVVSLG

SEQ ID NO: 160246 - protein, 13 aa, Mycobacterium tuberculosis
RGRAEVVVVSLGS

SEQ ID NO: 160247 - protein, 13 aa, Mycobacterium tuberculosis
GRAEVVVVSLGSQ

SEQ ID NO: 160248 - protein, 13 aa, Mycobacterium tuberculosis
RAEVVVVSLGSQG

SEQ ID NO: 160249 - protein, 13 aa, Mycobacterium tuberculosis
AEVVVVSLGSQGA

SEQ ID NO: 160250 - protein, 13 aa, Mycobacterium tuberculosis
EVVVVSLGSQGAL

SEQ ID NO: 160251 - protein, 13 aa, Mycobacterium tuberculosis
VVVVSLGSQGALL

SEQ ID NO: 160252 - protein, 13 aa, Mycobacterium tuberculosis
VVVSLGSQGALLA

SEQ ID NO: 160253 - protein, 13 aa, Mycobacterium tuberculosis
VVSLGSQGALLAT

SEQ ID NO: 160254 - protein, 13 aa, Mycobacterium tuberculosis
VSLGSQGALLATR

SEQ ID NO: 160255 - protein, 13 aa, Mycobacterium tuberculosis
SLGSQGALLATRH

SEQ ID NO: 160256 - protein, 13 aa, Mycobacterium tuberculosis
LGSQGALLATRHA

SEQ ID NO: 160257 - protein, 13 aa, Mycobacterium tuberculosis
GSQGALLATRHAS

SEQ ID NO: 160258 - protein, 13 aa, Mycobacterium tuberculosis
SQGALLATRHASH

SEQ ID NO: 160259 - protein, 13 aa, Mycobacterium tuberculosis
QGALLATRHASHR

SEQ ID NO: 160260 - protein, 13 aa, Mycobacterium tuberculosis
GALLATRHASHRF

SEQ ID NO: 160261 - protein, 13 aa, Mycobacterium tuberculosis
ALLATRHASHRFS

SEQ ID NO: 160262 - protein, 13 aa, Mycobacterium tuberculosis
LLATRHASHRFSS

SEQ ID NO: 160263 - protein, 13 aa, Mycobacterium tuberculosis
LATRHASHRFSSI

SEQ ID NO: 160264 - protein, 13 aa, Mycobacterium tuberculosis
ATRHASHRFSSIP

SEQ ID NO: 160265 - protein, 13 aa, Mycobacterium tuberculosis
TRHASHRFSSIPM

SEQ ID NO: 160266 - protein, 13 aa, Mycobacterium tuberculosis
RHASHRFSSIPMT

SEQ ID NO: 160267 - protein, 13 aa, Mycobacterium tuberculosis
HASHRFSSIPMTA

SEQ ID NO: 160268 - protein, 13 aa, Mycobacterium tuberculosis
ASHRFSSIPMTAV

SEQ ID NO: 160269 - protein, 13 aa, Mycobacterium tuberculosis
SHRFSSIPMTAVS

SEQ ID NO: 160270 - protein, 13 aa, Mycobacterium tuberculosis
HRFSSIPMTAVSG

SEQ ID NO: 160271 - protein, 13 aa, Mycobacterium tuberculosis
RFSSIPMTAVSGV

SEQ ID NO: 160272 - protein, 13 aa, Mycobacterium tuberculosis
FSSIPMTAVSGVG

SEQ ID NO: 160273 - protein, 13 aa, Mycobacterium tuberculosis
SSIPMTAVSGVGA

SEQ ID NO: 160274 - protein, 13 aa, Mycobacterium tuberculosis
SIPMTAVSGVGAG

SEQ ID NO: 160275 - protein, 13 aa, Mycobacterium tuberculosis
IPMTAVSGVGAGD

SEQ ID NO: 160276 - protein, 13 aa, Mycobacterium tuberculosis
PMTAVSGVGAGDA

SEQ ID NO: 160277 - protein, 13 aa, Mycobacterium tuberculosis
MTAVSGVGAGDAM

SEQ ID NO: 160278 - protein, 13 aa, Mycobacterium tuberculosis
TAVSGVGAGDAMV

SEQ ID NO: 160279 - protein, 13 aa, Mycobacterium tuberculosis
AVSGVGAGDAMVA

SEQ ID NO: 160280 - protein, 13 aa, Mycobacterium tuberculosis
VSGVGAGDAMVAA

SEQ ID NO: 160281 - protein, 13 aa, Mycobacterium tuberculosis
SGVGAGDAMVAAI

SEQ ID NO: 160282 - protein, 13 aa, Mycobacterium tuberculosis
GVGAGDAMVAAIT

SEQ ID NO: 160283 - protein, 13 aa, Mycobacterium tuberculosis
VGAGDAMVAAITV

SEQ ID NO: 160284 - protein, 13 aa, Mycobacterium tuberculosis
GAGDAMVAAITVG

SEQ ID NO: 160285 - protein, 13 aa, Mycobacterium tuberculosis
AGDAMVAAITVGL

SEQ ID NO: 160286 - protein, 13 aa, Mycobacterium tuberculosis
GDAMVAAITVGLS

SEQ ID NO: 160287 - protein, 13 aa, Mycobacterium tuberculosis
DAMVAAITVGLSR

SEQ ID NO: 160288 - protein, 13 aa, Mycobacterium tuberculosis
AMVAAITVGLSRG

SEQ ID NO: 160289 - protein, 13 aa, Mycobacterium tuberculosis
MVAAITVGLSRGW

SEQ ID NO: 160290 - protein, 13 aa, Mycobacterium tuberculosis
VAAITVGLSRGWS

SEQ ID NO: 160291 - protein, 13 aa, Mycobacterium tuberculosis
AAITVGLSRGWSL

SEQ ID NO: 160292 - protein, 13 aa, Mycobacterium tuberculosis
AITVGLSRGWSLI

SEQ ID NO: 160293 - protein, 13 aa, Mycobacterium tuberculosis
ITVGLSRGWSLIK

SEQ ID NO: 160294 - protein, 13 aa, Mycobacterium tuberculosis
TVGLSRGWSLIKS

SEQ ID NO: 160295 - protein, 13 aa, Mycobacterium tuberculosis
VGLSRGWSLIKSV

SEQ ID NO: 160296 - protein, 13 aa, Mycobacterium tuberculosis
GLSRGWSLIKSVR

SEQ ID NO: 160297 - protein, 13 aa, Mycobacterium tuberculosis
LSRGWSLIKSVRL

SEQ ID NO: 160298 - protein, 13 aa, Mycobacterium tuberculosis
SRGWSLIKSVRLG

SEQ ID NO: 160299 - protein, 13 aa, Mycobacterium tuberculosis
RGWSLIKSVRLGN

SEQ ID NO: 160300 - protein, 13 aa, Mycobacterium tuberculosis
GWSLIKSVRLGNA

SEQ ID NO: 160301 - protein, 13 aa, Mycobacterium tuberculosis
WSLIKSVRLGNAA

SEQ ID NO: 160302 - protein, 13 aa, Mycobacterium tuberculosis
SLIKSVRLGNAAG

SEQ ID NO: 160303 - protein, 13 aa, Mycobacterium tuberculosis
LIKSVRLGNAAGA

SEQ ID NO: 160304 - protein, 13 aa, Mycobacterium tuberculosis
IKSVRLGNAAGAA

SEQ ID NO: 160305 - protein, 13 aa, Mycobacterium tuberculosis
KSVRLGNAAGAAM

SEQ ID NO: 160306 - protein, 13 aa, Mycobacterium tuberculosis
SVRLGNAAGAAML

SEQ ID NO: 160307 - protein, 13 aa, Mycobacterium tuberculosis
VRLGNAAGAAMLL

SEQ ID NO: 160308 - protein, 13 aa, Mycobacterium tuberculosis
RLGNAAGAAMLLT

SEQ ID NO: 160309 - protein, 13 aa, Mycobacterium tuberculosis
LGNAAGAAMLLTP

SEQ ID NO: 160310 - protein, 13 aa, Mycobacterium tuberculosis
GNAAGAAMLLTPG

SEQ ID NO: 160311 - protein, 13 aa, Mycobacterium tuberculosis
NAAGAAMLLTPGT

SEQ ID NO: 160312 - protein, 13 aa, Mycobacterium tuberculosis
AAGAAMLLTPGTA

SEQ ID NO: 160313 - protein, 13 aa, Mycobacterium tuberculosis
AGAAMLLTPGTAA

SEQ ID NO: 160314 - protein, 13 aa, Mycobacterium tuberculosis
GAAMLLTPGTAAC

SEQ ID NO: 160315 - protein, 13 aa, Mycobacterium tuberculosis
AAMLLTPGTAACN

SEQ ID NO: 160316 - protein, 13 aa, Mycobacterium tuberculosis
AMLLTPGTAACNR

SEQ ID NO: 160317 - protein, 13 aa, Mycobacterium tuberculosis
MLLTPGTAACNRD

SEQ ID NO: 160318 - protein, 13 aa, Mycobacterium tuberculosis
LLTPGTAACNRDD

SEQ ID NO: 160319 - protein, 13 aa, Mycobacterium tuberculosis
LTPGTAACNRDDV

SEQ ID NO: 160320 - protein, 13 aa, Mycobacterium tuberculosis
TPGTAACNRDDVE

SEQ ID NO: 160321 - protein, 13 aa, Mycobacterium tuberculosis
PGTAACNRDDVER

SEQ ID NO: 160322 - protein, 13 aa, Mycobacterium tuberculosis
GTAACNRDDVERF

SEQ ID NO: 160323 - protein, 13 aa, Mycobacterium tuberculosis
TAACNRDDVERFF

SEQ ID NO: 160324 - protein, 13 aa, Mycobacterium tuberculosis
AACNRDDVERFFE

SEQ ID NO: 160325 - protein, 13 aa, Mycobacterium tuberculosis
ACNRDDVERFFEL

SEQ ID NO: 160326 - protein, 13 aa, Mycobacterium tuberculosis
CNRDDVERFFELA

SEQ ID NO: 160327 - protein, 13 aa, Mycobacterium tuberculosis
NRDDVERFFELAA

SEQ ID NO: 160328 - protein, 13 aa, Mycobacterium tuberculosis
RDDVERFFELAAE

SEQ ID NO: 160329 - protein, 13 aa, Mycobacterium tuberculosis
DDVERFFELAAEP

SEQ ID NO: 160330 - protein, 13 aa, Mycobacterium tuberculosis
DVERFFELAAEPT

SEQ ID NO: 160331 - protein, 13 aa, Mycobacterium tuberculosis
VERFFELAAEPTE

SEQ ID NO: 160332 - protein, 13 aa, Mycobacterium tuberculosis
ERFFELAAEPTEV

SEQ ID NO: 160333 - protein, 13 aa, Mycobacterium tuberculosis
RFFELAAEPTEVG

SEQ ID NO: 160334 - protein, 13 aa, Mycobacterium tuberculosis
FFELAAEPTEVGQ

SEQ ID NO: 160335 - protein, 13 aa, Mycobacterium tuberculosis
FELAAEPTEVGQD

SEQ ID NO: 160336 - protein, 13 aa, Mycobacterium tuberculosis
ELAAEPTEVGQDQ

SEQ ID NO: 160337 - protein, 13 aa, Mycobacterium tuberculosis
LAAEPTEVGQDQY

SEQ ID NO: 160338 - protein, 13 aa, Mycobacterium tuberculosis
AAEPTEVGQDQYV

SEQ ID NO: 160339 - protein, 13 aa, Mycobacterium tuberculosis
AEPTEVGQDQYVW

SEQ ID NO: 160340 - protein, 13 aa, Mycobacterium tuberculosis
EPTEVGQDQYVWH

SEQ ID NO: 160341 - protein, 13 aa, Mycobacterium tuberculosis
PTEVGQDQYVWHP

SEQ ID NO: 160342 - protein, 13 aa, Mycobacterium tuberculosis
TEVGQDQYVWHPI

SEQ ID NO: 160343 - protein, 13 aa, Mycobacterium tuberculosis
EVGQDQYVWHPIV

SEQ ID NO: 160344 - protein, 13 aa, Mycobacterium tuberculosis
VGQDQYVWHPIVN

SEQ ID NO: 160345 - protein, 13 aa, Mycobacterium tuberculosis
GQDQYVWHPIVNP

SEQ ID NO: 160346 - protein, 13 aa, Mycobacterium tuberculosis
QDQYVWHPIVNPE

SEQ ID NO: 160347 - protein, 13 aa, Mycobacterium tuberculosis
DQYVWHPIVNPEA

SEQ ID NO: 160348 - protein, 13 aa, Mycobacterium tuberculosis
QYVWHPIVNPEAS

SEQ ID NO: 160349 - protein, 13 aa, Mycobacterium tuberculosis
YVWHPIVNPEASP

SEQ ID NO: 160350 - protein, 14 aa, Mycobacterium tuberculosis
MTEPAAWDEGKPRI

SEQ ID NO: 160351 - protein, 14 aa, Mycobacterium tuberculosis
TEPAAWDEGKPRII

SEQ ID NO: 160352 - protein, 14 aa, Mycobacterium tuberculosis
EPAAWDEGKPRIIT

SEQ ID NO: 160353 - protein, 14 aa, Mycobacterium tuberculosis
PAAWDEGKPRIITL

SEQ ID NO: 160354 - protein, 14 aa, Mycobacterium tuberculosis
AAWDEGKPRIITLT

SEQ ID NO: 160355 - protein, 14 aa, Mycobacterium tuberculosis
AWDEGKPRIITLTM

SEQ ID NO: 160356 - protein, 14 aa, Mycobacterium tuberculosis
WDEGKPRIITLTMN

SEQ ID NO: 160357 - protein, 14 aa, Mycobacterium tuberculosis
DEGKPRIITLTMNP

SEQ ID NO: 160358 - protein, 14 aa, Mycobacterium tuberculosis
EGKPRIITLTMNPA

SEQ ID NO: 160359 - protein, 14 aa, Mycobacterium tuberculosis
GKPRIITLTMNPAL

SEQ ID NO: 160360 - protein, 14 aa, Mycobacterium tuberculosis
KPRIITLTMNPALD

SEQ ID NO: 160361 - protein, 14 aa, Mycobacterium tuberculosis
PRIITLTMNPALDI

SEQ ID NO: 160362 - protein, 14 aa, Mycobacterium tuberculosis
RIITLTMNPALDIT

SEQ ID NO: 160363 - protein, 14 aa, Mycobacterium tuberculosis
IITLTMNPALDITT

SEQ ID NO: 160364 - protein, 14 aa, Mycobacterium tuberculosis
ITLTMNPALDITTS

SEQ ID NO: 160365 - protein, 14 aa, Mycobacterium tuberculosis
TLTMNPALDITTSV

SEQ ID NO: 160366 - protein, 14 aa, Mycobacterium tuberculosis
LTMNPALDITTSVD

SEQ ID NO: 160367 - protein, 14 aa, Mycobacterium tuberculosis
TMNPALDITTSVDV

SEQ ID NO: 160368 - protein, 14 aa, Mycobacterium tuberculosis
MNPALDITTSVDVV

SEQ ID NO: 160369 - protein, 14 aa, Mycobacterium tuberculosis
NPALDITTSVDVVR

SEQ ID NO: 160370 - protein, 14 aa, Mycobacterium tuberculosis
PALDITTSVDVVRP

SEQ ID NO: 160371 - protein, 14 aa, Mycobacterium tuberculosis
ALDITTSVDVVRPT

SEQ ID NO: 160372 - protein, 14 aa, Mycobacterium tuberculosis
LDITTSVDVVRPTE

SEQ ID NO: 160373 - protein, 14 aa, Mycobacterium tuberculosis
DITTSVDVVRPTEK

SEQ ID NO: 160374 - protein, 14 aa, Mycobacterium tuberculosis
ITTSVDVVRPTEKM

SEQ ID NO: 160375 - protein, 14 aa, Mycobacterium tuberculosis
TTSVDVVRPTEKMR

SEQ ID NO: 160376 - protein, 14 aa, Mycobacterium tuberculosis
TSVDVVRPTEKMRC

SEQ ID NO: 160377 - protein, 14 aa, Mycobacterium tuberculosis
SVDVVRPTEKMRCG

SEQ ID NO: 160378 - protein, 14 aa, Mycobacterium tuberculosis
VDVVRPTEKMRCGA

SEQ ID NO: 160379 - protein, 14 aa, Mycobacterium tuberculosis
DVVRPTEKMRCGAP

SEQ ID NO: 160380 - protein, 14 aa, Mycobacterium tuberculosis
VVRPTEKMRCGAPR

SEQ ID NO: 160381 - protein, 14 aa, Mycobacterium tuberculosis
VRPTEKMRCGAPRY

SEQ ID NO: 160382 - protein, 14 aa, Mycobacterium tuberculosis
RPTEKMRCGAPRYD

SEQ ID NO: 160383 - protein, 14 aa, Mycobacterium tuberculosis
PTEKMRCGAPRYDP

SEQ ID NO: 160384 - protein, 14 aa, Mycobacterium tuberculosis
TEKMRCGAPRYDPG

SEQ ID NO: 160385 - protein, 14 aa, Mycobacterium tuberculosis
EKMRCGAPRYDPGG

SEQ ID NO: 160386 - protein, 14 aa, Mycobacterium tuberculosis
KMRCGAPRYDPGGG

SEQ ID NO: 160387 - protein, 14 aa, Mycobacterium tuberculosis
MRCGAPRYDPGGGG

SEQ ID NO: 160388 - protein, 14 aa, Mycobacterium tuberculosis
RCGAPRYDPGGGGI

SEQ ID NO: 160389 - protein, 14 aa, Mycobacterium tuberculosis
CGAPRYDPGGGGIN

SEQ ID NO: 160390 - protein, 14 aa, Mycobacterium tuberculosis
GAPRYDPGGGGINV

SEQ ID NO: 160391 - protein, 14 aa, Mycobacterium tuberculosis
APRYDPGGGGINVA

SEQ ID NO: 160392 - protein, 14 aa, Mycobacterium tuberculosis
PRYDPGGGGINVAR

SEQ ID NO: 160393 - protein, 14 aa, Mycobacterium tuberculosis
RYDPGGGGINVARI

SEQ ID NO: 160394 - protein, 14 aa, Mycobacterium tuberculosis
YDPGGGGINVARIV

SEQ ID NO: 160395 - protein, 14 aa, Mycobacterium tuberculosis
DPGGGGINVARIVH

SEQ ID NO: 160396 - protein, 14 aa, Mycobacterium tuberculosis
PGGGGINVARIVHV

SEQ ID NO: 160397 - protein, 14 aa, Mycobacterium tuberculosis
GGGGINVARIVHVL

SEQ ID NO: 160398 - protein, 14 aa, Mycobacterium tuberculosis
GGGINVARIVHVLG

SEQ ID NO: 160399 - protein, 14 aa, Mycobacterium tuberculosis
GGINVARIVHVLGG

SEQ ID NO: 160400 - protein, 14 aa, Mycobacterium tuberculosis
GINVARIVHVLGGC

SEQ ID NO: 160401 - protein, 14 aa, Mycobacterium tuberculosis
INVARIVHVLGGCS

SEQ ID NO: 160402 - protein, 14 aa, Mycobacterium tuberculosis
NVARIVHVLGGCST

SEQ ID NO: 160403 - protein, 14 aa, Mycobacterium tuberculosis
VARIVHVLGGCSTA

SEQ ID NO: 160404 - protein, 14 aa, Mycobacterium tuberculosis
ARIVHVLGGCSTAL

SEQ ID NO: 160405 - protein, 14 aa, Mycobacterium tuberculosis
RIVHVLGGCSTALF

SEQ ID NO: 160406 - protein, 14 aa, Mycobacterium tuberculosis
IVHVLGGCSTALFP

SEQ ID NO: 160407 - protein, 14 aa, Mycobacterium tuberculosis
VHVLGGCSTALFPA

SEQ ID NO: 160408 - protein, 14 aa, Mycobacterium tuberculosis
HVLGGCSTALFPAG

SEQ ID NO: 160409 - protein, 14 aa, Mycobacterium tuberculosis
VLGGCSTALFPAGG

SEQ ID NO: 160410 - protein, 14 aa, Mycobacterium tuberculosis
LGGCSTALFPAGGS

SEQ ID NO: 160411 - protein, 14 aa, Mycobacterium tuberculosis
GGCSTALFPAGGST

SEQ ID NO: 160412 - protein, 14 aa, Mycobacterium tuberculosis
GCSTALFPAGGSTG

SEQ ID NO: 160413 - protein, 14 aa, Mycobacterium tuberculosis
CSTALFPAGGSTGS

SEQ ID NO: 160414 - protein, 14 aa, Mycobacterium tuberculosis
STALFPAGGSTGSL

SEQ ID NO: 160415 - protein, 14 aa, Mycobacterium tuberculosis
TALFPAGGSTGSLL

SEQ ID NO: 160416 - protein, 14 aa, Mycobacterium tuberculosis
ALFPAGGSTGSLLM

SEQ ID NO: 160417 - protein, 14 aa, Mycobacterium tuberculosis
LFPAGGSTGSLLMA

SEQ ID NO: 160418 - protein, 14 aa, Mycobacterium tuberculosis
FPAGGSTGSLLMAL

SEQ ID NO: 160419 - protein, 14 aa, Mycobacterium tuberculosis
PAGGSTGSLLMALL

SEQ ID NO: 160420 - protein, 14 aa, Mycobacterium tuberculosis
AGGSTGSLLMALLG

SEQ ID NO: 160421 - protein, 14 aa, Mycobacterium tuberculosis
GGSTGSLLMALLGD

SEQ ID NO: 160422 - protein, 14 aa, Mycobacterium tuberculosis
GSTGSLLMALLGDA

SEQ ID NO: 160423 - protein, 14 aa, Mycobacterium tuberculosis
STGSLLMALLGDAG

SEQ ID NO: 160424 - protein, 14 aa, Mycobacterium tuberculosis
TGSLLMALLGDAGV

SEQ ID NO: 160425 - protein, 14 aa, Mycobacterium tuberculosis
GSLLMALLGDAGVP

SEQ ID NO: 160426 - protein, 14 aa, Mycobacterium tuberculosis
SLLMALLGDAGVPF

SEQ ID NO: 160427 - protein, 14 aa, Mycobacterium tuberculosis
LLMALLGDAGVPFR

SEQ ID NO: 160428 - protein, 14 aa, Mycobacterium tuberculosis
LMALLGDAGVPFRV

SEQ ID NO: 160429 - protein, 14 aa, Mycobacterium tuberculosis
MALLGDAGVPFRVI

SEQ ID NO: 160430 - protein, 14 aa, Mycobacterium tuberculosis
ALLGDAGVPFRVIP

SEQ ID NO: 160431 - protein, 14 aa, Mycobacterium tuberculosis
LLGDAGVPFRVIPI

SEQ ID NO: 160432 - protein, 14 aa, Mycobacterium tuberculosis
LGDAGVPFRVIPIA

SEQ ID NO: 160433 - protein, 14 aa, Mycobacterium tuberculosis
GDAGVPFRVIPIAA

SEQ ID NO: 160434 - protein, 14 aa, Mycobacterium tuberculosis
DAGVPFRVIPIAAS

SEQ ID NO: 160435 - protein, 14 aa, Mycobacterium tuberculosis
AGVPFRVIPIAAST

SEQ ID NO: 160436 - protein, 14 aa, Mycobacterium tuberculosis
GVPFRVIPIAASTR

SEQ ID NO: 160437 - protein, 14 aa, Mycobacterium tuberculosis
VPFRVIPIAASTRE

SEQ ID NO: 160438 - protein, 14 aa, Mycobacterium tuberculosis
PFRVIPIAASTRES

SEQ ID NO: 160439 - protein, 14 aa, Mycobacterium tuberculosis
FRVIPIAASTRESF

SEQ ID NO: 160440 - protein, 14 aa, Mycobacterium tuberculosis
RVIPIAASTRESFT

SEQ ID NO: 160441 - protein, 14 aa, Mycobacterium tuberculosis
VIPIAASTRESFTV

SEQ ID NO: 160442 - protein, 14 aa, Mycobacterium tuberculosis
IPIAASTRESFTVN

SEQ ID NO: 160443 - protein, 14 aa, Mycobacterium tuberculosis
PIAASTRESFTVNE

SEQ ID NO: 160444 - protein, 14 aa, Mycobacterium tuberculosis
IAASTRESFTVNES

SEQ ID NO: 160445 - protein, 14 aa, Mycobacterium tuberculosis
AASTRESFTVNESR

SEQ ID NO: 160446 - protein, 14 aa, Mycobacterium tuberculosis
ASTRESFTVNESRT

SEQ ID NO: 160447 - protein, 14 aa, Mycobacterium tuberculosis
STRESFTVNESRTA

SEQ ID NO: 160448 - protein, 14 aa, Mycobacterium tuberculosis
TRESFTVNESRTAK

SEQ ID NO: 160449 - protein, 14 aa, Mycobacterium tuberculosis
RESFTVNESRTAKQ

SEQ ID NO: 160450 - protein, 14 aa, Mycobacterium tuberculosis
ESFTVNESRTAKQY

SEQ ID NO: 160451 - protein, 14 aa, Mycobacterium tuberculosis
SFTVNESRTAKQYR

SEQ ID NO: 160452 - protein, 14 aa, Mycobacterium tuberculosis
FTVNESRTAKQYRF

SEQ ID NO: 160453 - protein, 14 aa, Mycobacterium tuberculosis
TVNESRTAKQYRFV

SEQ ID NO: 160454 - protein, 14 aa, Mycobacterium tuberculosis
VNESRTAKQYRFVL

SEQ ID NO: 160455 - protein, 14 aa, Mycobacterium tuberculosis
NESRTAKQYRFVLP

SEQ ID NO: 160456 - protein, 14 aa, Mycobacterium tuberculosis
ESRTAKQYRFVLPG

SEQ ID NO: 160457 - protein, 14 aa, Mycobacterium tuberculosis
SRTAKQYRFVLPGP

SEQ ID NO: 160458 - protein, 14 aa, Mycobacterium tuberculosis
RTAKQYRFVLPGPS

SEQ ID NO: 160459 - protein, 14 aa, Mycobacterium tuberculosis
TAKQYRFVLPGPSL

SEQ ID NO: 160460 - protein, 14 aa, Mycobacterium tuberculosis
AKQYRFVLPGPSLT

SEQ ID NO: 160461 - protein, 14 aa, Mycobacterium tuberculosis
KQYRFVLPGPSLTV

SEQ ID NO: 160462 - protein, 14 aa, Mycobacterium tuberculosis
QYRFVLPGPSLTVA

SEQ ID NO: 160463 - protein, 14 aa, Mycobacterium tuberculosis
YRFVLPGPSLTVAE

SEQ ID NO: 160464 - protein, 14 aa, Mycobacterium tuberculosis
RFVLPGPSLTVAEQ

SEQ ID NO: 160465 - protein, 14 aa, Mycobacterium tuberculosis
FVLPGPSLTVAEQE

SEQ ID NO: 160466 - protein, 14 aa, Mycobacterium tuberculosis
VLPGPSLTVAEQEQ

SEQ ID NO: 160467 - protein, 14 aa, Mycobacterium tuberculosis
LPGPSLTVAEQEQC

SEQ ID NO: 160468 - protein, 14 aa, Mycobacterium tuberculosis
PGPSLTVAEQEQCL

SEQ ID NO: 160469 - protein, 14 aa, Mycobacterium tuberculosis
GPSLTVAEQEQCLD

SEQ ID NO: 160470 - protein, 14 aa, Mycobacterium tuberculosis
PSLTVAEQEQCLDE

SEQ ID NO: 160471 - protein, 14 aa, Mycobacterium tuberculosis
SLTVAEQEQCLDEL

SEQ ID NO: 160472 - protein, 14 aa, Mycobacterium tuberculosis
LTVAEQEQCLDELR

SEQ ID NO: 160473 - protein, 14 aa, Mycobacterium tuberculosis
TVAEQEQCLDELRG

SEQ ID NO: 160474 - protein, 14 aa, Mycobacterium tuberculosis
VAEQEQCLDELRGA

SEQ ID NO: 160475 - protein, 14 aa, Mycobacterium tuberculosis
AEQEQCLDELRGAA

SEQ ID NO: 160476 - protein, 14 aa, Mycobacterium tuberculosis
EQEQCLDELRGAAA

SEQ ID NO: 160477 - protein, 14 aa, Mycobacterium tuberculosis
QEQCLDELRGAAAS

SEQ ID NO: 160478 - protein, 14 aa, Mycobacterium tuberculosis
EQCLDELRGAAASA

SEQ ID NO: 160479 - protein, 14 aa, Mycobacterium tuberculosis
QCLDELRGAAASAA

SEQ ID NO: 160480 - protein, 14 aa, Mycobacterium tuberculosis
CLDELRGAAASAAF

SEQ ID NO: 160481 - protein, 14 aa, Mycobacterium tuberculosis
LDELRGAAASAAFV

SEQ ID NO: 160482 - protein, 14 aa, Mycobacterium tuberculosis
DELRGAAASAAFVV

SEQ ID NO: 160483 - protein, 14 aa, Mycobacterium tuberculosis
ELRGAAASAAFVVA

SEQ ID NO: 160484 - protein, 14 aa, Mycobacterium tuberculosis
LRGAAASAAFVVAS

SEQ ID NO: 160485 - protein, 14 aa, Mycobacterium tuberculosis
RGAAASAAFVVASG

SEQ ID NO: 160486 - protein, 14 aa, Mycobacterium tuberculosis
GAAASAAFVVASGS

SEQ ID NO: 160487 - protein, 14 aa, Mycobacterium tuberculosis
AAASAAFVVASGSL

SEQ ID NO: 160488 - protein, 14 aa, Mycobacterium tuberculosis
AASAAFVVASGSLP

SEQ ID NO: 160489 - protein, 14 aa, Mycobacterium tuberculosis
ASAAFVVASGSLPP

SEQ ID NO: 160490 - protein, 14 aa, Mycobacterium tuberculosis
SAAFVVASGSLPPG

SEQ ID NO: 160491 - protein, 14 aa, Mycobacterium tuberculosis
AAFVVASGSLPPGV

SEQ ID NO: 160492 - protein, 14 aa, Mycobacterium tuberculosis
AFVVASGSLPPGVA

SEQ ID NO: 160493 - protein, 14 aa, Mycobacterium tuberculosis
FVVASGSLPPGVAA

SEQ ID NO: 160494 - protein, 14 aa, Mycobacterium tuberculosis
VVASGSLPPGVAAD

SEQ ID NO: 160495 - protein, 14 aa, Mycobacterium tuberculosis
VASGSLPPGVAADY

SEQ ID NO: 160496 - protein, 14 aa, Mycobacterium tuberculosis
ASGSLPPGVAADYY

SEQ ID NO: 160497 - protein, 14 aa, Mycobacterium tuberculosis
SGSLPPGVAADYYQ

SEQ ID NO: 160498 - protein, 14 aa, Mycobacterium tuberculosis
GSLPPGVAADYYQR

SEQ ID NO: 160499 - protein, 14 aa, Mycobacterium tuberculosis
SLPPGVAADYYQRV

SEQ ID NO: 160500 - protein, 14 aa, Mycobacterium tuberculosis
LPPGVAADYYQRVA

SEQ ID NO: 160501 - protein, 14 aa, Mycobacterium tuberculosis
PPGVAADYYQRVAD

SEQ ID NO: 160502 - protein, 14 aa, Mycobacterium tuberculosis
PGVAADYYQRVADI

SEQ ID NO: 160503 - protein, 14 aa, Mycobacterium tuberculosis
GVAADYYQRVADIC

SEQ ID NO: 160504 - protein, 14 aa, Mycobacterium tuberculosis
VAADYYQRVADICR

SEQ ID NO: 160505 - protein, 14 aa, Mycobacterium tuberculosis
AADYYQRVADICRR

SEQ ID NO: 160506 - protein, 14 aa, Mycobacterium tuberculosis
ADYYQRVADICRRS

SEQ ID NO: 160507 - protein, 14 aa, Mycobacterium tuberculosis
DYYQRVADICRRSS

SEQ ID NO: 160508 - protein, 14 aa, Mycobacterium tuberculosis
YYQRVADICRRSST

SEQ ID NO: 160509 - protein, 14 aa, Mycobacterium tuberculosis
YQRVADICRRSSTP

SEQ ID NO: 160510 - protein, 14 aa, Mycobacterium tuberculosis
QRVADICRRSSTPL

SEQ ID NO: 160511 - protein, 14 aa, Mycobacterium tuberculosis
RVADICRRSSTPLI

SEQ ID NO: 160512 - protein, 14 aa, Mycobacterium tuberculosis
VADICRRSSTPLIL

SEQ ID NO: 160513 - protein, 14 aa, Mycobacterium tuberculosis
ADICRRSSTPLILD

SEQ ID NO: 160514 - protein, 14 aa, Mycobacterium tuberculosis
DICRRSSTPLILDT

SEQ ID NO: 160515 - protein, 14 aa, Mycobacterium tuberculosis
ICRRSSTPLILDTS

SEQ ID NO: 160516 - protein, 14 aa, Mycobacterium tuberculosis
CRRSSTPLILDTSG

SEQ ID NO: 160517 - protein, 14 aa, Mycobacterium tuberculosis
RRSSTPLILDTSGG

SEQ ID NO: 160518 - protein, 14 aa, Mycobacterium tuberculosis
RSSTPLILDTSGGG

SEQ ID NO: 160519 - protein, 14 aa, Mycobacterium tuberculosis
SSTPLILDTSGGGL

SEQ ID NO: 160520 - protein, 14 aa, Mycobacterium tuberculosis
STPLILDTSGGGLQ

SEQ ID NO: 160521 - protein, 14 aa, Mycobacterium tuberculosis
TPLILDTSGGGLQH

SEQ ID NO: 160522 - protein, 14 aa, Mycobacterium tuberculosis
PLILDTSGGGLQHI

SEQ ID NO: 160523 - protein, 14 aa, Mycobacterium tuberculosis
LILDTSGGGLQHIS

SEQ ID NO: 160524 - protein, 14 aa, Mycobacterium tuberculosis
ILDTSGGGLQHISS

SEQ ID NO: 160525 - protein, 14 aa, Mycobacterium tuberculosis
LDTSGGGLQHISSG

SEQ ID NO: 160526 - protein, 14 aa, Mycobacterium tuberculosis
DTSGGGLQHISSGV

SEQ ID NO: 160527 - protein, 14 aa, Mycobacterium tuberculosis
TSGGGLQHISSGVF

SEQ ID NO: 160528 - protein, 14 aa, Mycobacterium tuberculosis
SGGGLQHISSGVFL

SEQ ID NO: 160529 - protein, 14 aa, Mycobacterium tuberculosis
GGGLQHISSGVFLL

SEQ ID NO: 160530 - protein, 14 aa, Mycobacterium tuberculosis
GGLQHISSGVFLLK

SEQ ID NO: 160531 - protein, 14 aa, Mycobacterium tuberculosis
GLQHISSGVFLLKA

SEQ ID NO: 160532 - protein, 14 aa, Mycobacterium tuberculosis
LQHISSGVFLLKAS

SEQ ID NO: 160533 - protein, 14 aa, Mycobacterium tuberculosis
QHISSGVFLLKASV

SEQ ID NO: 160534 - protein, 14 aa, Mycobacterium tuberculosis
HISSGVFLLKASVR

SEQ ID NO: 160535 - protein, 14 aa, Mycobacterium tuberculosis
ISSGVFLLKASVRE

SEQ ID NO: 160536 - protein, 14 aa, Mycobacterium tuberculosis
SSGVFLLKASVREL

SEQ ID NO: 160537 - protein, 14 aa, Mycobacterium tuberculosis
SGVFLLKASVRELR

SEQ ID NO: 160538 - protein, 14 aa, Mycobacterium tuberculosis
GVFLLKASVRELRE

SEQ ID NO: 160539 - protein, 14 aa, Mycobacterium tuberculosis
VFLLKASVRELREC

SEQ ID NO: 160540 - protein, 14 aa, Mycobacterium tuberculosis
FLLKASVRELRECV

SEQ ID NO: 160541 - protein, 14 aa, Mycobacterium tuberculosis
LLKASVRELRECVG

SEQ ID NO: 160542 - protein, 14 aa, Mycobacterium tuberculosis
LKASVRELRECVGS

SEQ ID NO: 160543 - protein, 14 aa, Mycobacterium tuberculosis
KASVRELRECVGSE

SEQ ID NO: 160544 - protein, 14 aa, Mycobacterium tuberculosis
ASVRELRECVGSEL

SEQ ID NO: 160545 - protein, 14 aa, Mycobacterium tuberculosis
SVRELRECVGSELL

SEQ ID NO: 160546 - protein, 14 aa, Mycobacterium tuberculosis
VRELRECVGSELLT

SEQ ID NO: 160547 - protein, 14 aa, Mycobacterium tuberculosis
RELRECVGSELLTE

SEQ ID NO: 160548 - protein, 14 aa, Mycobacterium tuberculosis
ELRECVGSELLTEP

SEQ ID NO: 160549 - protein, 14 aa, Mycobacterium tuberculosis
LRECVGSELLTEPE

SEQ ID NO: 160550 - protein, 14 aa, Mycobacterium tuberculosis
RECVGSELLTEPEQ

SEQ ID NO: 160551 - protein, 14 aa, Mycobacterium tuberculosis
ECVGSELLTEPEQL

SEQ ID NO: 160552 - protein, 14 aa, Mycobacterium tuberculosis
CVGSELLTEPEQLA

SEQ ID NO: 160553 - protein, 14 aa, Mycobacterium tuberculosis
VGSELLTEPEQLAA

SEQ ID NO: 160554 - protein, 14 aa, Mycobacterium tuberculosis
GSELLTEPEQLAAA

SEQ ID NO: 160555 - protein, 14 aa, Mycobacterium tuberculosis
SELLTEPEQLAAAH

SEQ ID NO: 160556 - protein, 14 aa, Mycobacterium tuberculosis
ELLTEPEQLAAAHE

SEQ ID NO: 160557 - protein, 14 aa, Mycobacterium tuberculosis
LLTEPEQLAAAHEL

SEQ ID NO: 160558 - protein, 14 aa, Mycobacterium tuberculosis
LTEPEQLAAAHELI
